United States Patent 11,369,692 (MATERIALS AND METHODS FOR TREATMENT OF DUCHENNE MUSCULAR DYSTROPHY) - sequence listing, part 19

SEQ ID NO: 618282 - DNA, 20 bp, Artificial Sequence
  chemically synthesized
ataataaagctagctcatgt

SEQ ID NO: 618283 - DNA, 20 bp, Artificial Sequence
  chemically synthesized
tgagctagctttattataaa

SEQ ID NO: 618284 - DNA, 20 bp, Artificial Sequence
  chemically synthesized
ttataaaataggtttgtgtg

SEQ ID NO: 618285 - DNA, 20 bp, Artificial Sequence
  chemically synthesized
gcctaccctactttaaatgt

SEQ ID NO: 618286 - DNA, 20 bp, Artificial Sequence
  chemically synthesized
aagtagggtaggctaagcta

SEQ ID NO: 618287 - DNA, 20 bp, Artificial Sequence
  chemically synthesized
atacctaaccttcgaaacaa

SEQ ID NO: 618288 - DNA, 20 bp, Artificial Sequence
  chemically synthesized
tgtgatattttcaacttatg

SEQ ID NO: 618289 - DNA, 20 bp, Artificial Sequence
  chemically synthesized
ttttttagttgattctttct

SEQ ID NO: 618290 - DNA, 20 bp, Artificial Sequence
  chemically synthesized
cattgtttaggaagtttttt

SEQ ID NO: 618291 - DNA, 20 bp, Artificial Sequence
  chemically synthesized
caaaatgcaaccattgttta

SEQ ID NO: 618292 - DNA, 20 bp, Artificial Sequence
  chemically synthesized
tagtaaccccaaaatgcaac

SEQ ID NO: 618293 - DNA, 20 bp, Artificial Sequence
  chemically synthesized
ggggttactaaacattcaaa

SEQ ID NO: 618294 - DNA, 20 bp, Artificial Sequence
  chemically synthesized
agaggatttaatctaccttt

SEQ ID NO: 618295 - DNA, 20 bp, Artificial Sequence
  chemically synthesized
ttaaatgctcgcttactcac

SEQ ID NO: 618296 - DNA, 20 bp, Artificial Sequence
  chemically synthesized
aataacaggtggtattaaat

SEQ ID NO: 618297 - DNA, 20 bp, Artificial Sequence
  chemically synthesized
tcactgtctccaacccccct

SEQ ID NO: 618298 - DNA, 20 bp, Artificial Sequence
  chemically synthesized
tctcataggacttatcaatt

SEQ ID NO: 618299 - DNA, 20 bp, Artificial Sequence
  chemically synthesized
ataataggtatggaaatatc

SEQ ID NO: 618300 - DNA, 20 bp, Artificial Sequence
  chemically synthesized
tagagtccattttcttgggt

SEQ ID NO: 618301 - DNA, 20 bp, Artificial Sequence
  chemically synthesized
atgagtaaaatgtgaattta

SEQ ID NO: 618302 - DNA, 20 bp, Artificial Sequence
  chemically synthesized
tcatcttgaatacttgtatc

SEQ ID NO: 618303 - DNA, 20 bp, Artificial Sequence
  chemically synthesized
ccatatacatataattttca

SEQ ID NO: 618304 - DNA, 20 bp, Artificial Sequence
  chemically synthesized
aatagtgaggattgggaact

SEQ ID NO: 618305 - DNA, 20 bp, Artificial Sequence
  chemically synthesized
aatcctcgtttcagaaatag

SEQ ID NO: 618306 - DNA, 20 bp, Artificial Sequence
  chemically synthesized
aatcctcactatttctgaaa

SEQ ID NO: 618307 - DNA, 20 bp, Artificial Sequence
  chemically synthesized
tttctgaaacgaggatttcc

SEQ ID NO: 618308 - DNA, 20 bp, Artificial Sequence
  chemically synthesized
tacaggaaacttacggaaat

SEQ ID NO: 618309 - DNA, 20 bp, Artificial Sequence
  chemically synthesized
tcactgtacgtcatctgctc

SEQ ID NO: 618310 - DNA, 20 bp, Artificial Sequence
  chemically synthesized
tcctgtgcccctggcttcct

SEQ ID NO: 618311 - DNA, 20 bp, Artificial Sequence
  chemically synthesized
tggctcctgtgcccctggct

SEQ ID NO: 618312 - DNA, 20 bp, Artificial Sequence
  chemically synthesized
tctaaaatggctcctgtgcc

SEQ ID NO: 618313 - DNA, 20 bp, Artificial Sequence
  chemically synthesized
agcagagctattgtgccatg

SEQ ID NO: 618314 - DNA, 20 bp, Artificial Sequence
  chemically synthesized
ttccatggcacaatagctct

SEQ ID NO: 618315 - DNA, 20 bp, Artificial Sequence
  chemically synthesized
atataactattgtgcaatgt

SEQ ID NO: 618316 - DNA, 20 bp, Artificial Sequence
  chemically synthesized
atataaatgtgttagctata

SEQ ID NO: 618317 - DNA, 20 bp, Artificial Sequence
  chemically synthesized
tgttacctccttcactgaaa

SEQ ID NO: 618318 - DNA, 20 bp, Artificial Sequence
  chemically synthesized
tctatatttaaaatgagctt

SEQ ID NO: 618319 - DNA, 20 bp, Artificial Sequence
  chemically synthesized
aaacatattctatatttaaa

SEQ ID NO: 618320 - DNA, 20 bp, Artificial Sequence
  chemically synthesized
aagctcattttaaatataga

SEQ ID NO: 618321 - DNA, 20 bp, Artificial Sequence
  chemically synthesized
gtgtgcgcgcacgcgcgtgt

SEQ ID NO: 618322 - DNA, 20 bp, Artificial Sequence
  chemically synthesized
tagtaacacatgaataaatg

SEQ ID NO: 618323 - DNA, 20 bp, Artificial Sequence
  chemically synthesized
atgaataaatgctctgtttt

SEQ ID NO: 618324 - DNA, 20 bp, Artificial Sequence
  chemically synthesized
ttgttcatttctttattgat

SEQ ID NO: 618325 - DNA, 20 bp, Artificial Sequence
  chemically synthesized
tggatacttgttcatttctt

SEQ ID NO: 618326 - DNA, 20 bp, Artificial Sequence
  chemically synthesized
tcagaactaaagtttttgaa

SEQ ID NO: 618327 - DNA, 20 bp, Artificial Sequence
  chemically synthesized
tgaatctagattttcagaac

SEQ ID NO: 618328 - DNA, 20 bp, Artificial Sequence
  chemically synthesized
aaaaactttagttctgaaaa

SEQ ID NO: 618329 - DNA, 20 bp, Artificial Sequence
  chemically synthesized
ctgaaaatctagattcatgt

SEQ ID NO: 618330 - DNA, 20 bp, Artificial Sequence
  chemically synthesized
atatcaatccttaacatgaa

SEQ ID NO: 618331 - DNA, 20 bp, Artificial Sequence
  chemically synthesized
aggctattgggatatgggag

SEQ ID NO: 618332 - DNA, 20 bp, Artificial Sequence
  chemically synthesized
acagtggaaatttgcaatca

SEQ ID NO: 618333 - DNA, 20 bp, Artificial Sequence
  chemically synthesized
attaaacctctctttaatct

SEQ ID NO: 618334 - DNA, 20 bp, Artificial Sequence
  chemically synthesized
tgcaatcagtcagattaaag

SEQ ID NO: 618335 - DNA, 20 bp, Artificial Sequence
  chemically synthesized
tcagattaaagagaggttta

SEQ ID NO: 618336 - DNA, 20 bp, Artificial Sequence
  chemically synthesized
tcacaacttcatccctttcc

SEQ ID NO: 618337 - DNA, 20 bp, Artificial Sequence
  chemically synthesized
ccaacatcctactcccttta

SEQ ID NO: 618338 - DNA, 20 bp, Artificial Sequence
  chemically synthesized
aaggttttgctgatgatgct

SEQ ID NO: 618339 - DNA, 20 bp, Artificial Sequence
  chemically synthesized
ccctgccttgcttgaacacg

SEQ ID NO: 618340 - DNA, 20 bp, Artificial Sequence
  chemically synthesized
agcttgtccacaatgccctg

SEQ ID NO: 618341 - DNA, 20 bp, Artificial Sequence
  chemically synthesized
gtaaacatgactacataaag

SEQ ID NO: 618342 - DNA, 20 bp, Artificial Sequence
  chemically synthesized
acaagctgtcctttatgtag

SEQ ID NO: 618343 - DNA, 20 bp, Artificial Sequence
  chemically synthesized
gtgcattttggtcatagctg

SEQ ID NO: 618344 - DNA, 20 bp, Artificial Sequence
  chemically synthesized
gtccagaatactgtaagtgt

SEQ ID NO: 618345 - DNA, 20 bp, Artificial Sequence
  chemically synthesized
tagaagaatgcaaaatgtta

SEQ ID NO: 618346 - DNA, 20 bp, Artificial Sequence
  chemically synthesized
ggagattgaatttctcacca

SEQ ID NO: 618347 - DNA, 20 bp, Artificial Sequence
  chemically synthesized
gggttactagttgctgcagg

SEQ ID NO: 618348 - DNA, 20 bp, Artificial Sequence
  chemically synthesized
aatgtagagaaacaaggaaa

SEQ ID NO: 618349 - DNA, 20 bp, Artificial Sequence
  chemically synthesized
gtttgtaataagccatattt

SEQ ID NO: 618350 - DNA, 20 bp, Artificial Sequence
  chemically synthesized
catgaattttgattctataa

SEQ ID NO: 618351 - DNA, 20 bp, Artificial Sequence
  chemically synthesized
gctattgaaatgcacatgaa

SEQ ID NO: 618352 - DNA, 20 bp, Artificial Sequence
  chemically synthesized
aaattatggagttaggaaca

SEQ ID NO: 618353 - DNA, 20 bp, Artificial Sequence
  chemically synthesized
gaatagaagtaaataagaag

SEQ ID NO: 618354 - DNA, 20 bp, Artificial Sequence
  chemically synthesized
atgacaaaaatgggaatatt

SEQ ID NO: 618355 - DNA, 20 bp, Artificial Sequence
  chemically synthesized
aatgggaatattttgtgttt

SEQ ID NO: 618356 - DNA, 20 bp, Artificial Sequence
  chemically synthesized
atttataatgcccttttatt

SEQ ID NO: 618357 - DNA, 20 bp, Artificial Sequence
  chemically synthesized
aataaattaaagtatggata

SEQ ID NO: 618358 - DNA, 20 bp, Artificial Sequence
  chemically synthesized
gtagagagtagtgtgaagaa

SEQ ID NO: 618359 - DNA, 20 bp, Artificial Sequence
  chemically synthesized
gcacgttattttttgataaa

SEQ ID NO: 618360 - DNA, 20 bp, Artificial Sequence
  chemically synthesized
atcactacactgacttccac

SEQ ID NO: 618361 - DNA, 20 bp, Artificial Sequence
  chemically synthesized
aaccattgtggaagtcagtg

SEQ ID NO: 618362 - DNA, 20 bp, Artificial Sequence
  chemically synthesized
attgctaggttgaatggtag

SEQ ID NO: 618363 - DNA, 20 bp, Artificial Sequence
  chemically synthesized
ctctgggtacatgcccagta

SEQ ID NO: 618364 - DNA, 20 bp, Artificial Sequence
  chemically synthesized
tgtatgcgtgtcttataata

SEQ ID NO: 618365 - DNA, 20 bp, Artificial Sequence
  chemically synthesized
ctatcattgacgggcatttg

SEQ ID NO: 618366 - DNA, 20 bp, Artificial Sequence
  chemically synthesized
ataagtgagaacatgcagta

SEQ ID NO: 618367 - DNA, 20 bp, Artificial Sequence
  chemically synthesized
tagaggggaacaacacacac

SEQ ID NO: 618368 - DNA, 20 bp, Artificial Sequence
  chemically synthesized
tgtgtcacgggggttggttg

SEQ ID NO: 618369 - DNA, 20 bp, Artificial Sequence
  chemically synthesized
gtacaaccaacccccgtgac

SEQ ID NO: 618370 - DNA, 20 bp, Artificial Sequence
  chemically synthesized
ttaagttcaggggtacatgt

SEQ ID NO: 618371 - DNA, 20 bp, Artificial Sequence
  chemically synthesized
aaaggctaccttactgactc

SEQ ID NO: 618372 - DNA, 20 bp, Artificial Sequence
  chemically synthesized
tagtgttaatttaccctaca

SEQ ID NO: 618373 - DNA, 20 bp, Artificial Sequence
  chemically synthesized
attgatatgacatacttctt

SEQ ID NO: 618374 - DNA, 20 bp, Artificial Sequence
  chemically synthesized
attgcccaaagagggtgagt

SEQ ID NO: 618375 - DNA, 20 bp, Artificial Sequence
  chemically synthesized
ctaatgcaggcctccacaac

SEQ ID NO: 618376 - DNA, 20 bp, Artificial Sequence
  chemically synthesized
tgtttaagggcgctggctct

SEQ ID NO: 618377 - DNA, 20 bp, Artificial Sequence
  chemically synthesized
ggcttttgttaccgtccagc

SEQ ID NO: 618378 - DNA, 20 bp, Artificial Sequence
  chemically synthesized
gacggtaacaaaagcccacc

SEQ ID NO: 618379 - DNA, 20 bp, Artificial Sequence
  chemically synthesized
aggcctgggcaaaactcttg

SEQ ID NO: 618380 - DNA, 20 bp, Artificial Sequence
  chemically synthesized
agaattccttcattatcttg

SEQ ID NO: 618381 - DNA, 20 bp, Artificial Sequence
  chemically synthesized
caggacccttttagaattaa

SEQ ID NO: 618382 - DNA, 20 bp, Artificial Sequence
  chemically synthesized
gagtttcttcagacccccaa

SEQ ID NO: 618383 - DNA, 20 bp, Artificial Sequence
  chemically synthesized
aacttgtttgtggagtcctg

SEQ ID NO: 618384 - DNA, 20 bp, Artificial Sequence
  chemically synthesized
aactccccaggactccacaa

SEQ ID NO: 618385 - DNA, 20 bp, Artificial Sequence
  chemically synthesized
ttccttcagatgcccagtaa

SEQ ID NO: 618386 - DNA, 20 bp, Artificial Sequence
  chemically synthesized
tgaaggaactcccccaaact

SEQ ID NO: 618387 - DNA, 20 bp, Artificial Sequence
  chemically synthesized
tcttatctccggctaaatca

SEQ ID NO: 618388 - DNA, 20 bp, Artificial Sequence
  chemically synthesized
ctaaatgggtccaggtgctg

SEQ ID NO: 618389 - DNA, 20 bp, Artificial Sequence
  chemically synthesized
tcttctgatctgtaactaag

SEQ ID NO: 618390 - DNA, 20 bp, Artificial Sequence
  chemically synthesized
gtgtatccatctaaagacat

SEQ ID NO: 618391 - DNA, 20 bp, Artificial Sequence
  chemically synthesized
ctcaaaactataaagttttc

SEQ ID NO: 618392 - DNA, 20 bp, Artificial Sequence
  chemically synthesized
atataagctctggaaaactt

SEQ ID NO: 618393 - DNA, 20 bp, Artificial Sequence
  chemically synthesized
cccagaccaactcaaaacta

SEQ ID NO: 618394 - DNA, 20 bp, Artificial Sequence
  chemically synthesized
gcagatgaacgggaaaagga

SEQ ID NO: 618395 - DNA, 20 bp, Artificial Sequence
  chemically synthesized
caagaataagcagcccaatc

SEQ ID NO: 618396 - DNA, 20 bp, Artificial Sequence
  chemically synthesized
ctggaccaaactgaggattg

SEQ ID NO: 618397 - DNA, 20 bp, Artificial Sequence
  chemically synthesized
atagtgttcctggaccaaac

SEQ ID NO: 618398 - DNA, 20 bp, Artificial Sequence
  chemically synthesized
tccaggaacactatcatatc

SEQ ID NO: 618399 - DNA, 20 bp, Artificial Sequence
  chemically synthesized
aaatgaagtagaaatgcata

SEQ ID NO: 618400 - DNA, 20 bp, Artificial Sequence
  chemically synthesized
atttttttccaacatagtat

SEQ ID NO: 618401 - DNA, 20 bp, Artificial Sequence
  chemically synthesized
atttccatactcactcttct

SEQ ID NO: 618402 - DNA, 20 bp, Artificial Sequence
  chemically synthesized
aagagtgagtatggaaataa

SEQ ID NO: 618403 - DNA, 20 bp, Artificial Sequence
  chemically synthesized
tatctcccaatgagtgatat

SEQ ID NO: 618404 - DNA, 20 bp, Artificial Sequence
  chemically synthesized
catcatatcactcattggga

SEQ ID NO: 618405 - DNA, 20 bp, Artificial Sequence
  chemically synthesized
tcataaaatgtgcttgatgt

SEQ ID NO: 618406 - DNA, 20 bp, Artificial Sequence
  chemically synthesized
attttgtcataaaatgtgct

SEQ ID NO: 618407 - DNA, 20 bp, Artificial Sequence
  chemically synthesized
aaaaataattttgtcataaa

SEQ ID NO: 618408 - DNA, 20 bp, Artificial Sequence
  chemically synthesized
tatgacaaaattatttttgg

SEQ ID NO: 618409 - DNA, 20 bp, Artificial Sequence
  chemically synthesized
gccggcttaataaagggaag

SEQ ID NO: 618410 - DNA, 20 bp, Artificial Sequence
  chemically synthesized
taaaaatcttgctcatccat

SEQ ID NO: 618411 - DNA, 20 bp, Artificial Sequence
  chemically synthesized
tattaagccggcatggatga

SEQ ID NO: 618412 - DNA, 20 bp, Artificial Sequence
  chemically synthesized
tcgtgtatactctatgacaa

SEQ ID NO: 618413 - DNA, 20 bp, Artificial Sequence
  chemically synthesized
tatttgtcatagagtataca

SEQ ID NO: 618414 - DNA, 20 bp, Artificial Sequence
  chemically synthesized
gagtatacacgaggcttttt

SEQ ID NO: 618415 - DNA, 20 bp, Artificial Sequence
  chemically synthesized
ctgaattaatcttatctaga

SEQ ID NO: 618416 - DNA, 20 bp, Artificial Sequence
  chemically synthesized
aaacacaaaaccatttctag

SEQ ID NO: 618417 - DNA, 20 bp, Artificial Sequence
  chemically synthesized
aatcttatctagaaatggtt

SEQ ID NO: 618418 - DNA, 20 bp, Artificial Sequence
  chemically synthesized
ttccaaaaaattctactaga

SEQ ID NO: 618419 - DNA, 20 bp, Artificial Sequence
  chemically synthesized
taaaataagtcttctattaa

SEQ ID NO: 618420 - DNA, 20 bp, Artificial Sequence
  chemically synthesized
agacttattttaaaaagaga

SEQ ID NO: 618421 - DNA, 20 bp, Artificial Sequence
  chemically synthesized
accaggaaagtggaaaatca

SEQ ID NO: 618422 - DNA, 20 bp, Artificial Sequence
  chemically synthesized
tgtgtctttgcagtaaatct

SEQ ID NO: 618423 - DNA, 20 bp, Artificial Sequence
  chemically synthesized
agatttactgcaaagacaca

SEQ ID NO: 618424 - DNA, 20 bp, Artificial Sequence
  chemically synthesized
gggatatttaaaggaaataa

SEQ ID NO: 618425 - DNA, 20 bp, Artificial Sequence
  chemically synthesized
tttcctttaaatatcccttc

SEQ ID NO: 618426 - DNA, 20 bp, Artificial Sequence
  chemically synthesized
gactataaaaatgaatatga

SEQ ID NO: 618427 - DNA, 20 bp, Artificial Sequence
  chemically synthesized
tcttcaacacaatttttcca

SEQ ID NO: 618428 - DNA, 20 bp, Artificial Sequence
  chemically synthesized
atttttccacccagtttttc

SEQ ID NO: 618429 - DNA, 20 bp, Artificial Sequence
  chemically synthesized
tcttctgtttctacagttag

SEQ ID NO: 618430 - DNA, 20 bp, Artificial Sequence
  chemically synthesized
ttctacagttagcatagatt

SEQ ID NO: 618431 - DNA, 20 bp, Artificial Sequence
  chemically synthesized
tagtgtactagtaataaaca

SEQ ID NO: 618432 - DNA, 20 bp, Artificial Sequence
  chemically synthesized
gtatatcttctatataatct

SEQ ID NO: 618433 - DNA, 20 bp, Artificial Sequence
  chemically synthesized
cctttgatgggctcacattt

SEQ ID NO: 618434 - DNA, 20 bp, Artificial Sequence
  chemically synthesized
gagctttcttcataaaggtt

SEQ ID NO: 618435 - DNA, 20 bp, Artificial Sequence
  chemically synthesized
ggttaccagattccctctag

SEQ ID NO: 618436 - DNA, 20 bp, Artificial Sequence
  chemically synthesized
tggaacctacacagttattt

SEQ ID NO: 618437 - DNA, 20 bp, Artificial Sequence
  chemically synthesized
tgtgtaggttccatgagttc

SEQ ID NO: 618438 - DNA, 20 bp, Artificial Sequence
  chemically synthesized
aattctagccctgtaggata

SEQ ID NO: 618439 - DNA, 20 bp, Artificial Sequence
  chemically synthesized
aaatgatatatatatcacaa

SEQ ID NO: 618440 - DNA, 20 bp, Artificial Sequence
  chemically synthesized
tatcacaattatgtttatct

SEQ ID NO: 618441 - DNA, 20 bp, Artificial Sequence
  chemically synthesized
tttatcttttggtttcacca

SEQ ID NO: 618442 - DNA, 20 bp, Artificial Sequence
  chemically synthesized
aagtggcttaaactgaatca

SEQ ID NO: 618443 - DNA, 20 bp, Artificial Sequence
  chemically synthesized
atttagaggaagctagttga

SEQ ID NO: 618444 - DNA, 20 bp, Artificial Sequence
  chemically synthesized
atgggaatttagaggaagct

SEQ ID NO: 618445 - DNA, 20 bp, Artificial Sequence
  chemically synthesized
aaaagaatgcagtcacttag

SEQ ID NO: 618446 - DNA, 20 bp, Artificial Sequence
  chemically synthesized
aaaagaataagaaaagagga

SEQ ID NO: 618447 - DNA, 20 bp, Artificial Sequence
  chemically synthesized
tatatacattttacctttaa

SEQ ID NO: 618448 - DNA, 20 bp, Artificial Sequence
  chemically synthesized
taggtgtcaggaatagaaat

SEQ ID NO: 618449 - DNA, 20 bp, Artificial Sequence
  chemically synthesized
ttctattcctgacacctagg

SEQ ID NO: 618450 - DNA, 20 bp, Artificial Sequence
  chemically synthesized
ttcacatatatgagcacatt

SEQ ID NO: 618451 - DNA, 20 bp, Artificial Sequence
  chemically synthesized
gctcatatatgtgaatattt

SEQ ID NO: 618452 - DNA, 20 bp, Artificial Sequence
  chemically synthesized
ctaacaatatataaatagag

SEQ ID NO: 618453 - DNA, 20 bp, Artificial Sequence
  chemically synthesized
aatagaggatggattggata

SEQ ID NO: 618454 - DNA, 20 bp, Artificial Sequence
  chemically synthesized
aggatggattggatatcaag

SEQ ID NO: 618455 - DNA, 20 bp, Artificial Sequence
  chemically synthesized
tcacctgttaatatagaaat

SEQ ID NO: 618456 - DNA, 20 bp, Artificial Sequence
  chemically synthesized
atgaggatacacagtacttg

SEQ ID NO: 618457 - DNA, 20 bp, Artificial Sequence
  chemically synthesized
aaaattactctagttcaatt

SEQ ID NO: 618458 - DNA, 20 bp, Artificial Sequence
  chemically synthesized
ttcagaaaatttcttcacaa

SEQ ID NO: 618459 - DNA, 20 bp, Artificial Sequence
  chemically synthesized
ttcacaattctgatttgtct

SEQ ID NO: 618460 - DNA, 20 bp, Artificial Sequence
  chemically synthesized
caattctgatttgtctgtat

SEQ ID NO: 618461 - DNA, 20 bp, Artificial Sequence
  chemically synthesized
tgtttgaaaatatgtctctt

SEQ ID NO: 618462 - DNA, 20 bp, Artificial Sequence
  chemically synthesized
tactggcatcattgacattt

SEQ ID NO: 618463 - DNA, 20 bp, Artificial Sequence
  chemically synthesized
atatttataagatggttata

SEQ ID NO: 618464 - DNA, 20 bp, Artificial Sequence
  chemically synthesized
gaataactttcctaaatatc

SEQ ID NO: 618465 - DNA, 20 bp, Artificial Sequence
  chemically synthesized
ttcacttagctaaaaaaagt

SEQ ID NO: 618466 - DNA, 20 bp, Artificial Sequence
  chemically synthesized
aaaaaagttgaggatttaaa

SEQ ID NO: 618467 - DNA, 20 bp, Artificial Sequence
  chemically synthesized
ttaaaaaacgtttttaaaat

SEQ ID NO: 618468 - DNA, 20 bp, Artificial Sequence
  chemically synthesized
aacagaaacatgtattttaa

SEQ ID NO: 618469 - DNA, 20 bp, Artificial Sequence
  chemically synthesized
aacgtttttaaaatacatgt

SEQ ID NO: 618470 - DNA, 20 bp, Artificial Sequence
  chemically synthesized
aagaatagacgatattctaa

SEQ ID NO: 618471 - DNA, 20 bp, Artificial Sequence
  chemically synthesized
tcatagaaaagggagaactt

SEQ ID NO: 618472 - DNA, 20 bp, Artificial Sequence
  chemically synthesized
cttttgagattggatctcct

SEQ ID NO: 618473 - DNA, 20 bp, Artificial Sequence
  chemically synthesized
tgagattggatctcctagtg

SEQ ID NO: 618474 - DNA, 20 bp, Artificial Sequence
  chemically synthesized
atgaattactccctctatgg

SEQ ID NO: 618475 - DNA, 20 bp, Artificial Sequence
  chemically synthesized
gggagtaattcatagctatt

SEQ ID NO: 618476 - DNA, 20 bp, Artificial Sequence
  chemically synthesized
ggatattttgtttcttattg

SEQ ID NO: 618477 - DNA, 20 bp, Artificial Sequence
  chemically synthesized
catagttttgatagtggata

SEQ ID NO: 618478 - DNA, 20 bp, Artificial Sequence
  chemically synthesized
acccaaggctttaagagtgg

SEQ ID NO: 618479 - DNA, 20 bp, Artificial Sequence
  chemically synthesized
actatgccactcttaaagcc

SEQ ID NO: 618480 - DNA, 20 bp, Artificial Sequence
  chemically synthesized
taaaatatggcccttaaacc

SEQ ID NO: 618481 - DNA, 20 bp, Artificial Sequence
  chemically synthesized
gggtttaagggccatatttt

SEQ ID NO: 618482 - DNA, 20 bp, Artificial Sequence
  chemically synthesized
ttagctttatttttccatta

SEQ ID NO: 618483 - DNA, 20 bp, Artificial Sequence
  chemically synthesized
tgtttgtatatgtatatatt

SEQ ID NO: 618484 - DNA, 20 bp, Artificial Sequence
  chemically synthesized
tgaatgtttgtatatgtata

SEQ ID NO: 618485 - DNA, 20 bp, Artificial Sequence
  chemically synthesized
ttttcttatgtttccatcat

SEQ ID NO: 618486 - DNA, 20 bp, Artificial Sequence
  chemically synthesized
tgtttggtgagtcggttttc

SEQ ID NO: 618487 - DNA, 20 bp, Artificial Sequence
  chemically synthesized
atcaatcaaatgtttggtga

SEQ ID NO: 618488 - DNA, 20 bp, Artificial Sequence
  chemically synthesized
agaaaaccgactcaccaaac

SEQ ID NO: 618489 - DNA, 20 bp, Artificial Sequence
  chemically synthesized
aaccgactcaccaaacattt

SEQ ID NO: 618490 - DNA, 20 bp, Artificial Sequence
  chemically synthesized
tcgatttgggtaaatcaatc

SEQ ID NO: 618491 - DNA, 20 bp, Artificial Sequence
  chemically synthesized
acttgcattttaattattat

SEQ ID NO: 618492 - DNA, 20 bp, Artificial Sequence
  chemically synthesized
atggaggtttattgggatgt

SEQ ID NO: 618493 - DNA, 20 bp, Artificial Sequence
  chemically synthesized
gtattaggaatgcaatatat

SEQ ID NO: 618494 - DNA, 20 bp, Artificial Sequence
  chemically synthesized
ccatatattgcattcctaat

SEQ ID NO: 618495 - DNA, 20 bp, Artificial Sequence
  chemically synthesized
ttaatcaatagcgtgactct

SEQ ID NO: 618496 - DNA, 20 bp, Artificial Sequence
  chemically synthesized
ataatcatctagagtcacgc

SEQ ID NO: 618497 - DNA, 20 bp, Artificial Sequence
  chemically synthesized
aattaagtaaatattaagag

SEQ ID NO: 618498 - DNA, 20 bp, Artificial Sequence
  chemically synthesized
taagttcatcttgtttttgt

SEQ ID NO: 618499 - DNA, 20 bp, Artificial Sequence
  chemically synthesized
gattaaagacaataagttca

SEQ ID NO: 618500 - DNA, 20 bp, Artificial Sequence
  chemically synthesized
tatagtttagagcatatttc

SEQ ID NO: 618501 - DNA, 20 bp, Artificial Sequence
  chemically synthesized
ctttgggtgtattcagccac

SEQ ID NO: 618502 - DNA, 20 bp, Artificial Sequence
  chemically synthesized
gaatacacccaaagcaatta

SEQ ID NO: 618503 - DNA, 20 bp, Artificial Sequence
  chemically synthesized
aagttcaagaaaagcaatat

SEQ ID NO: 618504 - DNA, 20 bp, Artificial Sequence
  chemically synthesized
acatattctagctacttgat

SEQ ID NO: 618505 - DNA, 20 bp, Artificial Sequence
  chemically synthesized
tctttaatgacatgagtcct

SEQ ID NO: 618506 - DNA, 20 bp, Artificial Sequence
  chemically synthesized
ctttgattcttcttgacaat

SEQ ID NO: 618507 - DNA, 20 bp, Artificial Sequence
  chemically synthesized
taattatataaaatgtatat

SEQ ID NO: 618508 - DNA, 20 bp, Artificial Sequence
  chemically synthesized
tgtatctttgccatatcttc

SEQ ID NO: 618509 - DNA, 20 bp, Artificial Sequence
  chemically synthesized
ataagagtgaacataatatt

SEQ ID NO: 618510 - DNA, 20 bp, Artificial Sequence
  chemically synthesized
tgacactatgagagaaataa

SEQ ID NO: 618511 - DNA, 20 bp, Artificial Sequence
  chemically synthesized
tgtacctgtgtatcttaaaa

SEQ ID NO: 618512 - DNA, 20 bp, Artificial Sequence
  chemically synthesized
gcacaattttctaaggtaag

SEQ ID NO: 618513 - DNA, 20 bp, Artificial Sequence
  chemically synthesized
tgtgcatttacccattttgt

SEQ ID NO: 618514 - DNA, 20 bp, Artificial Sequence
  chemically synthesized
aaaatatgaattatatttaa

SEQ ID NO: 618515 - DNA, 20 bp, Artificial Sequence
  chemically synthesized
aactttccattatgatgtgt

SEQ ID NO: 618516 - DNA, 20 bp, Artificial Sequence
  chemically synthesized
tggaattaaacatgagtgat

SEQ ID NO: 618517 - DNA, 20 bp, Artificial Sequence
  chemically synthesized
atgccccaaaccagcatcac

SEQ ID NO: 618518 - DNA, 20 bp, Artificial Sequence
  chemically synthesized
tggctcacgcctgtgatccc

SEQ ID NO: 618519 - DNA, 20 bp, Artificial Sequence
  chemically synthesized
aggacggatcacttgaggcc

SEQ ID NO: 618520 - DNA, 20 bp, Artificial Sequence
  chemically synthesized
ttttgtattttcagtagaga

SEQ ID NO: 618521 - DNA, 20 bp, Artificial Sequence
  chemically synthesized
tgcctcagcctcccaagtag

SEQ ID NO: 618522 - DNA, 20 bp, Artificial Sequence
  chemically synthesized
aacctccacctcctggattc

SEQ ID NO: 618523 - DNA, 20 bp, Artificial Sequence
  chemically synthesized
gctcactgcaacctccacct

SEQ ID NO: 618524 - DNA, 20 bp, Artificial Sequence
  chemically synthesized
gcgacagagcaagatcccgc

SEQ ID NO: 618525 - DNA, 20 bp, Artificial Sequence
  chemically synthesized
actatgggtttggtcatatt

SEQ ID NO: 618526 - DNA, 20 bp, Artificial Sequence
  chemically synthesized
catacagtatttgaacgact

SEQ ID NO: 618527 - DNA, 20 bp, Artificial Sequence
  chemically synthesized
cccatagtcgttcaaatact

SEQ ID NO: 618528 - DNA, 20 bp, Artificial Sequence
  chemically synthesized
tttcggagtaaatgacagct

SEQ ID NO: 618529 - DNA, 20 bp, Artificial Sequence
  chemically synthesized
ggcatggggaaaggctccga

SEQ ID NO: 618530 - DNA, 20 bp, Artificial Sequence
  chemically synthesized
ccatccacccaaccatggag

SEQ ID NO: 618531 - DNA, 20 bp, Artificial Sequence
  chemically synthesized
gggcctgatctcactatgga

SEQ ID NO: 618532 - DNA, 20 bp, Artificial Sequence
  chemically synthesized
ggtttcctgatgagcaggag

SEQ ID NO: 618533 - DNA, 20 bp, Artificial Sequence
  chemically synthesized
caggagcatggtttagttat

SEQ ID NO: 618534 - DNA, 20 bp, Artificial Sequence
  chemically synthesized
aatacatctgacaaatacgt

SEQ ID NO: 618535 - DNA, 20 bp, Artificial Sequence
  chemically synthesized
acgtgcatgctttaaggaag

SEQ ID NO: 618536 - DNA, 20 bp, Artificial Sequence
  chemically synthesized
tactcaaagaaaaaagtccc

SEQ ID NO: 618537 - DNA, 20 bp, Artificial Sequence
  chemically synthesized
agtccccaaagatttatact

SEQ ID NO: 618538 - DNA, 20 bp, Artificial Sequence
  chemically synthesized
agggagaaaaattattaaaa

SEQ ID NO: 618539 - DNA, 20 bp, Artificial Sequence
  chemically synthesized
tagaagcatgaattcagtga

SEQ ID NO: 618540 - DNA, 20 bp, Artificial Sequence
  chemically synthesized
aaaaaacagcttcactgaat

SEQ ID NO: 618541 - DNA, 20 bp, Artificial Sequence
  chemically synthesized
catttgacttaatactaatt

SEQ ID NO: 618542 - DNA, 20 bp, Artificial Sequence
  chemically synthesized
acattttaatatatcaagat

SEQ ID NO: 618543 - DNA, 20 bp, Artificial Sequence
  chemically synthesized
tcatcaatcttgatatatta

SEQ ID NO: 618544 - DNA, 20 bp, Artificial Sequence
  chemically synthesized
gagaaaaacattttaatata

SEQ ID NO: 618545 - DNA, 20 bp, Artificial Sequence
  chemically synthesized
caataattaaaaaaatagtc

SEQ ID NO: 618546 - DNA, 20 bp, Artificial Sequence
  chemically synthesized
catttactgaacattaacta

SEQ ID NO: 618547 - DNA, 20 bp, Artificial Sequence
  chemically synthesized
taaattttatattttatcta

SEQ ID NO: 618548 - DNA, 20 bp, Artificial Sequence
  chemically synthesized
tgaaaaatatatgagagcaa

SEQ ID NO: 618549 - DNA, 20 bp, Artificial Sequence
  chemically synthesized
atttttcagtagtaaatctc

SEQ ID NO: 618550 - DNA, 20 bp, Artificial Sequence
  chemically synthesized
tatgtttttaagagaagcaa

SEQ ID NO: 618551 - DNA, 20 bp, Artificial Sequence
  chemically synthesized
tgttatgcgaaagtgattcc

SEQ ID NO: 618552 - DNA, 20 bp, Artificial Sequence
  chemically synthesized
tgcatatatttgttatgcga

SEQ ID NO: 618553 - DNA, 20 bp, Artificial Sequence
  chemically synthesized
tatatgcatgcaccaaaaat

SEQ ID NO: 618554 - DNA, 20 bp, Artificial Sequence
  chemically synthesized
aatctacttatagattagta

SEQ ID NO: 618555 - DNA, 20 bp, Artificial Sequence
  chemically synthesized
aatcacaatactaatctata

SEQ ID NO: 618556 - DNA, 20 bp, Artificial Sequence
  chemically synthesized
attgactaaaggaatctact

SEQ ID NO: 618557 - DNA, 20 bp, Artificial Sequence
  chemically synthesized
taaaatttctcacctaagat

SEQ ID NO: 618558 - DNA, 20 bp, Artificial Sequence
  chemically synthesized
tatttaattatgttattcac

SEQ ID NO: 618559 - DNA, 20 bp, Artificial Sequence
  chemically synthesized
ttgatattgaacatacatat

SEQ ID NO: 618560 - DNA, 20 bp, Artificial Sequence
  chemically synthesized
gaaatacttccatattgtag

SEQ ID NO: 618561 - DNA, 20 bp, Artificial Sequence
  chemically synthesized
aataaataaaaacagatagt

SEQ ID NO: 618562 - DNA, 20 bp, Artificial Sequence
  chemically synthesized
taggtttgaaaactattact

SEQ ID NO: 618563 - DNA, 20 bp, Artificial Sequence
  chemically synthesized
aagatttgaaggaggctaga

SEQ ID NO: 618564 - DNA, 20 bp, Artificial Sequence
  chemically synthesized
tagtattaattttatgaaag

SEQ ID NO: 618565 - DNA, 20 bp, Artificial Sequence
  chemically synthesized
tcctccataaagtctatgaa

SEQ ID NO: 618566 - DNA, 20 bp, Artificial Sequence
  chemically synthesized
atcttcatagactttatgga

SEQ ID NO: 618567 - DNA, 20 bp, Artificial Sequence
  chemically synthesized
tttcaactgactcatttact

SEQ ID NO: 618568 - DNA, 20 bp, Artificial Sequence
  chemically synthesized
tgtttcaaagacatctgaat

SEQ ID NO: 618569 - DNA, 20 bp, Artificial Sequence
  chemically synthesized
cttttggcagagggttttgg

SEQ ID NO: 618570 - DNA, 20 bp, Artificial Sequence
  chemically synthesized
ctcatattgagcttttggca

SEQ ID NO: 618571 - DNA, 20 bp, Artificial Sequence
  chemically synthesized
tcacttcaaaagacctcata

SEQ ID NO: 618572 - DNA, 20 bp, Artificial Sequence
  chemically synthesized
gctcaatatgaggtcttttg

SEQ ID NO: 618573 - DNA, 20 bp, Artificial Sequence
  chemically synthesized
cttttgaagtgatttaatct

SEQ ID NO: 618574 - DNA, 20 bp, Artificial Sequence
  chemically synthesized
gtatttttcacttaaaagcc

SEQ ID NO: 618575 - DNA, 20 bp, Artificial Sequence
  chemically synthesized
caaggttttcgtgctgcctt

SEQ ID NO: 618576 - DNA, 20 bp, Artificial Sequence
  chemically synthesized
taacactttgcacataatgt

SEQ ID NO: 618577 - DNA, 20 bp, Artificial Sequence
  chemically synthesized
ctgtgtaaataacactaaat

SEQ ID NO: 618578 - DNA, 20 bp, Artificial Sequence
  chemically synthesized
tgagagaggacaactagcaa

SEQ ID NO: 618579 - DNA, 20 bp, Artificial Sequence
  chemically synthesized
ttcttagtgccttactattc

SEQ ID NO: 618580 - DNA, 20 bp, Artificial Sequence
  chemically synthesized
tagtgccttactattcataa

SEQ ID NO: 618581 - DNA, 20 bp, Artificial Sequence
  chemically synthesized
gtataaagtagtaaattaca

SEQ ID NO: 618582 - DNA, 20 bp, Artificial Sequence
  chemically synthesized
tagctttattccttctcagc

SEQ ID NO: 618583 - DNA, 20 bp, Artificial Sequence
  chemically synthesized
acttaatagctttattcctt

SEQ ID NO: 618584 - DNA, 20 bp, Artificial Sequence
  chemically synthesized
caagttcatttctgtcactt

SEQ ID NO: 618585 - DNA, 20 bp, Artificial Sequence
  chemically synthesized
agtgacagaaatgaacttga

SEQ ID NO: 618586 - DNA, 20 bp, Artificial Sequence
  chemically synthesized
agattttctgaatcaaagtc

SEQ ID NO: 618587 - DNA, 20 bp, Artificial Sequence
  chemically synthesized
tcaatgtgaaaagccatgga

SEQ ID NO: 618588 - DNA, 20 bp, Artificial Sequence
  chemically synthesized
aatatgttcaccttttgtga

SEQ ID NO: 618589 - DNA, 20 bp, Artificial Sequence
  chemically synthesized
atgcaaaacaaccatgaaat

SEQ ID NO: 618590 - DNA, 20 bp, Artificial Sequence
  chemically synthesized
aatagaagctctgatttcat

SEQ ID NO: 618591 - DNA, 20 bp, Artificial Sequence
  chemically synthesized
tgagttgttcaaaatagaag

SEQ ID NO: 618592 - DNA, 20 bp, Artificial Sequence
  chemically synthesized
gttgttaatacttcaaataa

SEQ ID NO: 618593 - DNA, 20 bp, Artificial Sequence
  chemically synthesized
tgattgatttttggatgtta

SEQ ID NO: 618594 - DNA, 20 bp, Artificial Sequence
  chemically synthesized
agtgtggacacaaaaatttt

SEQ ID NO: 618595 - DNA, 20 bp, Artificial Sequence
  chemically synthesized
taaaagtgtggacacaaaaa

SEQ ID NO: 618596 - DNA, 20 bp, Artificial Sequence
  chemically synthesized
aaaaggaaagagcagcttat

SEQ ID NO: 618597 - DNA, 20 bp, Artificial Sequence
  chemically synthesized
tcatataagctgctctttcc

SEQ ID NO: 618598 - DNA, 20 bp, Artificial Sequence
  chemically synthesized
aatagcaaacaaaaggaaag

SEQ ID NO: 618599 - DNA, 20 bp, Artificial Sequence
  chemically synthesized
tgagtgcatgagcatgttta

SEQ ID NO: 618600 - DNA, 20 bp, Artificial Sequence
  chemically synthesized
aaaaagaagtgagtgcatga

SEQ ID NO: 618601 - DNA, 20 bp, Artificial Sequence
  chemically synthesized
tgctcatgcactcacttctt

SEQ ID NO: 618602 - DNA, 20 bp, Artificial Sequence
  chemically synthesized
agatatttagcaaaagtcat

SEQ ID NO: 618603 - DNA, 20 bp, Artificial Sequence
  chemically synthesized
gccgcaggtatgtcattcat

SEQ ID NO: 618604 - DNA, 20 bp, Artificial Sequence
  chemically synthesized
tatgtcattcataggagttt

SEQ ID NO: 618605 - DNA, 20 bp, Artificial Sequence
  chemically synthesized
gctttagtcttttacggtat

SEQ ID NO: 618606 - DNA, 20 bp, Artificial Sequence
  chemically synthesized
agtcttttacggtattgctg

SEQ ID NO: 618607 - DNA, 20 bp, Artificial Sequence
  chemically synthesized
tttagatgtaaggagatcct

SEQ ID NO: 618608 - DNA, 20 bp, Artificial Sequence
  chemically synthesized
gatgtaaggagatccttgat

SEQ ID NO: 618609 - DNA, 20 bp, Artificial Sequence
  chemically synthesized
gtttgctttaatcataatta

SEQ ID NO: 618610 - DNA, 20 bp, Artificial Sequence
  chemically synthesized
ttcattagtaatcaaattaa

SEQ ID NO: 618611 - DNA, 20 bp, Artificial Sequence
  chemically synthesized
ttgattactaatgaagtaga

SEQ ID NO: 618612 - DNA, 20 bp, Artificial Sequence
  chemically synthesized
gttcctatttttgtcaaaat

SEQ ID NO: 618613 - DNA, 20 bp, Artificial Sequence
  chemically synthesized
caaatggagcccatgacttg

SEQ ID NO: 618614 - DNA, 20 bp, Artificial Sequence
  chemically synthesized
catttcaagtcatgggctcc

SEQ ID NO: 618615 - DNA, 20 bp, Artificial Sequence
  chemically synthesized
tctacacatacatatttgca

SEQ ID NO: 618616 - DNA, 20 bp, Artificial Sequence
  chemically synthesized
aacttggattttatggttat

SEQ ID NO: 618617 - DNA, 20 bp, Artificial Sequence
  chemically synthesized
agcttaattttgatcgttaa

SEQ ID NO: 618618 - DNA, 20 bp, Artificial Sequence
  chemically synthesized
ccattcactgactaaaagtg

SEQ ID NO: 618619 - DNA, 20 bp, Artificial Sequence
  chemically synthesized
atttttattgctatttgtca

SEQ ID NO: 618620 - DNA, 20 bp, Artificial Sequence
  chemically synthesized
ctttaggttaactaagggta

SEQ ID NO: 618621 - DNA, 20 bp, Artificial Sequence
  chemically synthesized
tatgtgtgatgtgtatgtat

SEQ ID NO: 618622 - DNA, 20 bp, Artificial Sequence
  chemically synthesized
acatcatgttaacgtatcaa

SEQ ID NO: 618623 - DNA, 20 bp, Artificial Sequence
  chemically synthesized
ttgttgctgattgcacatta

SEQ ID NO: 618624 - DNA, 20 bp, Artificial Sequence
  chemically synthesized
tcttttctcatttgctttgt

SEQ ID NO: 618625 - DNA, 20 bp, Artificial Sequence
  chemically synthesized
tatcactttattcttttctc

SEQ ID NO: 618626 - DNA, 20 bp, Artificial Sequence
  chemically synthesized
tgagaaaagaataaagtgat

SEQ ID NO: 618627 - DNA, 20 bp, Artificial Sequence
  chemically synthesized
gtgatagctgttttattaca

SEQ ID NO: 618628 - DNA, 20 bp, Artificial Sequence
  chemically synthesized
attacaaaatgattatatgc

SEQ ID NO: 618629 - DNA, 20 bp, Artificial Sequence
  chemically synthesized
aggaaatgaaatagaatatg

SEQ ID NO: 618630 - DNA, 20 bp, Artificial Sequence
  chemically synthesized
atattctatttcatttcctt

SEQ ID NO: 618631 - DNA, 20 bp, Artificial Sequence
  chemically synthesized
tctatttcatttcctttagg

SEQ ID NO: 618632 - DNA, 20 bp, Artificial Sequence
  chemically synthesized
ttcctttagggtttgtttat

SEQ ID NO: 618633 - DNA, 20 bp, Artificial Sequence
  chemically synthesized
tctcttattaatatgcacat

SEQ ID NO: 618634 - DNA, 20 bp, Artificial Sequence
  chemically synthesized
tttcaagtaaattttcctaa

SEQ ID NO: 618635 - DNA, 20 bp, Artificial Sequence
  chemically synthesized
acttcttgacatctccaggg

SEQ ID NO: 618636 - DNA, 20 bp, Artificial Sequence
  chemically synthesized
cataaattgcaaaaactgac

SEQ ID NO: 618637 - DNA, 20 bp, Artificial Sequence
  chemically synthesized
gagaataaaataaaacgttg

SEQ ID NO: 618638 - DNA, 20 bp, Artificial Sequence
  chemically synthesized
acggggaaatcccatataaa

SEQ ID NO: 618639 - DNA, 20 bp, Artificial Sequence
  chemically synthesized
tgttagaaagctaattttat

SEQ ID NO: 618640 - DNA, 20 bp, Artificial Sequence
  chemically synthesized
ataactttattagaaggggt

SEQ ID NO: 618641 - DNA, 20 bp, Artificial Sequence
  chemically synthesized
tatgtggcctttcatatttt

SEQ ID NO: 618642 - DNA, 20 bp, Artificial Sequence
  chemically synthesized
gatatattaaattgcaatat

SEQ ID NO: 618643 - DNA, 20 bp, Artificial Sequence
  chemically synthesized
ttccacagatttaatgttcc

SEQ ID NO: 618644 - DNA, 20 bp, Artificial Sequence
  chemically synthesized
gggaacattaaatctgtgga

SEQ ID NO: 618645 - DNA, 20 bp, Artificial Sequence
  chemically synthesized
aagccactggaagccagttc

SEQ ID NO: 618646 - DNA, 20 bp, Artificial Sequence
  chemically synthesized
aatctgtggaactggcttcc

SEQ ID NO: 618647 - DNA, 20 bp, Artificial Sequence
  chemically synthesized
catttcacagttaaagacgc

SEQ ID NO: 618648 - DNA, 20 bp, Artificial Sequence
  chemically synthesized
ttataaaataaatatttaca

SEQ ID NO: 618649 - DNA, 20 bp, Artificial Sequence
  chemically synthesized
actagttactgaaaatataa

SEQ ID NO: 618650 - DNA, 20 bp, Artificial Sequence
  chemically synthesized
aagagctctcccagactgaa

SEQ ID NO: 618651 - DNA, 20 bp, Artificial Sequence
  chemically synthesized
tatatatttttgtttatgca

SEQ ID NO: 618652 - DNA, 20 bp, Artificial Sequence
  chemically synthesized
cgctttaaatttatatatat

SEQ ID NO: 618653 - DNA, 20 bp, Artificial Sequence
  chemically synthesized
cctttctccatgctcctata

SEQ ID NO: 618654 - DNA, 20 bp, Artificial Sequence
  chemically synthesized
ttgtccttactgtctgctca

SEQ ID NO: 618655 - DNA, 20 bp, Artificial Sequence
  chemically synthesized
ataatgaatgagcgtgtact

SEQ ID NO: 618656 - DNA, 20 bp, Artificial Sequence
  chemically synthesized
cacgctcattcattatgcaa

SEQ ID NO: 618657 - DNA, 20 bp, Artificial Sequence
  chemically synthesized
tttttaaatgctttcactta

SEQ ID NO: 618658 - DNA, 20 bp, Artificial Sequence
  chemically synthesized
ttttttttcccccagttttt

SEQ ID NO: 618659 - DNA, 20 bp, Artificial Sequence
  chemically synthesized
ttttctgtttttttttttcc

SEQ ID NO: 618660 - DNA, 20 bp, Artificial Sequence
  chemically synthesized
tagtgtttatagaactgttt

SEQ ID NO: 618661 - DNA, 20 bp, Artificial Sequence
  chemically synthesized
ataattgttagtgtttatag

SEQ ID NO: 618662 - DNA, 20 bp, Artificial Sequence
  chemically synthesized
tgtgtaatgggaataattgt

SEQ ID NO: 618663 - DNA, 20 bp, Artificial Sequence
  chemically synthesized
ttcttgtacagattatggtt

SEQ ID NO: 618664 - DNA, 20 bp, Artificial Sequence
  chemically synthesized
aaaaaaattttattttcttg

SEQ ID NO: 618665 - DNA, 20 bp, Artificial Sequence
  chemically synthesized
tgaggaggcagaggtgagag

SEQ ID NO: 618666 - DNA, 20 bp, Artificial Sequence
  chemically synthesized
cagaaggattgatggagtcc

SEQ ID NO: 618667 - DNA, 20 bp, Artificial Sequence
  chemically synthesized
cactttgggaggctgagaca

SEQ ID NO: 618668 - DNA, 20 bp, Artificial Sequence
  chemically synthesized
ccaaggaaatatcatttaaa

SEQ ID NO: 618669 - DNA, 20 bp, Artificial Sequence
  chemically synthesized
aagggaatattaaagttgat

SEQ ID NO: 618670 - DNA, 20 bp, Artificial Sequence
  chemically synthesized
ccattgcatttcttcactac

SEQ ID NO: 618671 - DNA, 20 bp, Artificial Sequence
  chemically synthesized
tacaggcgtgagccactgcg

SEQ ID NO: 618672 - DNA, 20 bp, Artificial Sequence
  chemically synthesized
cacctcggcctcccaaagtg

SEQ ID NO: 618673 - DNA, 20 bp, Artificial Sequence
  chemically synthesized
ttttgtatttttagtagaga

SEQ ID NO: 618674 - DNA, 20 bp, Artificial Sequence
  chemically synthesized
gcaattaagttcagtctatt

SEQ ID NO: 618675 - DNA, 20 bp, Artificial Sequence
  chemically synthesized
ccatatttttcatttttttc

SEQ ID NO: 618676 - DNA, 20 bp, Artificial Sequence
  chemically synthesized
gagaaaaaaatgaaaaatat

SEQ ID NO: 618677 - DNA, 20 bp, Artificial Sequence
  chemically synthesized
aaatatcacataaccttatc

SEQ ID NO: 618678 - DNA, 20 bp, Artificial Sequence
  chemically synthesized
actttctaaatatgtcctaa

SEQ ID NO: 618679 - DNA, 20 bp, Artificial Sequence
  chemically synthesized
aatttaggacatatttagaa

SEQ ID NO: 618680 - DNA, 20 bp, Artificial Sequence
  chemically synthesized
gcaatggaaaatggtatgaa

SEQ ID NO: 618681 - DNA, 20 bp, Artificial Sequence
  chemically synthesized
tattaaatctgagtaatagt

SEQ ID NO: 618682 - DNA, 20 bp, Artificial Sequence
  chemically synthesized
cccataatcaaagactatta

SEQ ID NO: 618683 - DNA, 20 bp, Artificial Sequence
  chemically synthesized
ctgagtaatagtctttgatt

SEQ ID NO: 618684 - DNA, 20 bp, Artificial Sequence
  chemically synthesized
cgcctgaggtgacgttagtg

SEQ ID NO: 618685 - DNA, 20 bp, Artificial Sequence
  chemically synthesized
agcttttctgttcttcgtgc

SEQ ID NO: 618686 - DNA, 20 bp, Artificial Sequence
  chemically synthesized
aaagaaatatctttgacatg

SEQ ID NO: 618687 - DNA, 20 bp, Artificial Sequence
  chemically synthesized
aagatatttctttatttccc

SEQ ID NO: 618688 - DNA, 20 bp, Artificial Sequence
  chemically synthesized
aacacattctatgctaagtg

SEQ ID NO: 618689 - DNA, 20 bp, Artificial Sequence
  chemically synthesized
tacatagtagtgctcaataa

SEQ ID NO: 618690 - DNA, 20 bp, Artificial Sequence
  chemically synthesized
ggtgttttaagttaacgaag

SEQ ID NO: 618691 - DNA, 20 bp, Artificial Sequence
  chemically synthesized
ggaggcattattctgcctac

SEQ ID NO: 618692 - DNA, 20 bp, Artificial Sequence
  chemically synthesized
cataatttattcacagatgt

SEQ ID NO: 618693 - DNA, 20 bp, Artificial Sequence
  chemically synthesized
taattagctaacttttgata

SEQ ID NO: 618694 - DNA, 20 bp, Artificial Sequence
  chemically synthesized
acttttgatagggagattat

SEQ ID NO: 618695 - DNA, 20 bp, Artificial Sequence
  chemically synthesized
atcccagattatctgagtgg

SEQ ID NO: 618696 - DNA, 20 bp, Artificial Sequence
  chemically synthesized
ttccccccttttaaggaccc

SEQ ID NO: 618697 - DNA, 20 bp, Artificial Sequence
  chemically synthesized
ctcggaccaagtccttctca

SEQ ID NO: 618698 - DNA, 20 bp, Artificial Sequence
  chemically synthesized
gaaggacttggtccgaggtg

SEQ ID NO: 618699 - DNA, 20 bp, Artificial Sequence
  chemically synthesized
gaaaatggaaaaggcaagga

SEQ ID NO: 618700 - DNA, 20 bp, Artificial Sequence
  chemically synthesized
agtacacagcccttctggca

SEQ ID NO: 618701 - DNA, 20 bp, Artificial Sequence
  chemically synthesized
atgatttgagtccagtaagt

SEQ ID NO: 618702 - DNA, 20 bp, Artificial Sequence
  chemically synthesized
ttgagtccagtaagttccag

SEQ ID NO: 618703 - DNA, 20 bp, Artificial Sequence
  chemically synthesized
tataaaattaccacaaattt

SEQ ID NO: 618704 - DNA, 20 bp, Artificial Sequence
  chemically synthesized
ttaaatatgaaatgtaattt

SEQ ID NO: 618705 - DNA, 20 bp, Artificial Sequence
  chemically synthesized
agagacactgcctttctcac

SEQ ID NO: 618706 - DNA, 20 bp, Artificial Sequence
  chemically synthesized
actgtgagaaaggcagtgtc

SEQ ID NO: 618707 - DNA, 20 bp, Artificial Sequence
  chemically synthesized
gtgtctctagcttttttcct

SEQ ID NO: 618708 - DNA, 20 bp, Artificial Sequence
  chemically synthesized
tcaacatacccttttgttgt

SEQ ID NO: 618709 - DNA, 20 bp, Artificial Sequence
  chemically synthesized
atatatgattgtcacatgac

SEQ ID NO: 618710 - DNA, 20 bp, Artificial Sequence
  chemically synthesized
ttcaaggtagtttccttaat

SEQ ID NO: 618711 - DNA, 20 bp, Artificial Sequence
  chemically synthesized
ggaagctctggatttttcaa

SEQ ID NO: 618712 - DNA, 20 bp, Artificial Sequence
  chemically synthesized
ggaaactaccttgaaaaatc

SEQ ID NO: 618713 - DNA, 20 bp, Artificial Sequence
  chemically synthesized
tgtcacttcatcaaggaagc

SEQ ID NO: 618714 - DNA, 20 bp, Artificial Sequence
  chemically synthesized
ttgatgaagtgacatctcag

SEQ ID NO: 618715 - DNA, 20 bp, Artificial Sequence
  chemically synthesized
cctgacactttcacctgctc

SEQ ID NO: 618716 - DNA, 20 bp, Artificial Sequence
  chemically synthesized
tttccctacttaaaattctg

SEQ ID NO: 618717 - DNA, 20 bp, Artificial Sequence
  chemically synthesized
tgctatttccctacttaaaa

SEQ ID NO: 618718 - DNA, 20 bp, Artificial Sequence
  chemically synthesized
taagtagggaaatagcaatg

SEQ ID NO: 618719 - DNA, 20 bp, Artificial Sequence
  chemically synthesized
agggaaatagcaatgtcagg

SEQ ID NO: 618720 - DNA, 20 bp, Artificial Sequence
  chemically synthesized
agctcatgtgtcttcttatt

SEQ ID NO: 618721 - DNA, 20 bp, Artificial Sequence
  chemically synthesized
tgtaaataagaagacacatg

SEQ ID NO: 618722 - DNA, 20 bp, Artificial Sequence
  chemically synthesized
caagtcatgcttacttctca

SEQ ID NO: 618723 - DNA, 20 bp, Artificial Sequence
  chemically synthesized
ctgccattcattaatgcaag

SEQ ID NO: 618724 - DNA, 20 bp, Artificial Sequence
  chemically synthesized
aaggagtaggtgcattcaag

SEQ ID NO: 618725 - DNA, 20 bp, Artificial Sequence
  chemically synthesized
atcagggaatttagctttat

SEQ ID NO: 618726 - DNA, 20 bp, Artificial Sequence
  chemically synthesized
gtagtttctccatcagggaa

SEQ ID NO: 618727 - DNA, 20 bp, Artificial Sequence
  chemically synthesized
atatatgattgtaacagaac

SEQ ID NO: 618728 - DNA, 20 bp, Artificial Sequence
  chemically synthesized
ttcaagttagttctcttaat

SEQ ID NO: 618729 - DNA, 20 bp, Artificial Sequence
  chemically synthesized
gagaactaacttgaaaaatc

SEQ ID NO: 618730 - DNA, 20 bp, Artificial Sequence
  chemically synthesized
tgtaacctcatcagagaagc

SEQ ID NO: 618731 - DNA, 20 bp, Artificial Sequence
  chemically synthesized
cttctctgatgaggttacag

SEQ ID NO: 618732 - DNA, 20 bp, Artificial Sequence
  chemically synthesized
gtgtactcctctaaacatat

SEQ ID NO: 618733 - DNA, 20 bp, Artificial Sequence
  chemically synthesized
gccaacaggcctaatcgata

SEQ ID NO: 618734 - DNA, 20 bp, Artificial Sequence
  chemically synthesized
gcagacctggtagatgtata

SEQ ID NO: 618735 - DNA, 20 bp, Artificial Sequence
  chemically synthesized
atgatttatttatggagaaa

SEQ ID NO: 618736 - DNA, 20 bp, Artificial Sequence
  chemically synthesized
aatttctccataaataaatc

SEQ ID NO: 618737 - DNA, 20 bp, Artificial Sequence
  chemically synthesized
cataaataaatcatatgctt

SEQ ID NO: 618738 - DNA, 20 bp, Artificial Sequence
  chemically synthesized
aaggactaaagcaagaaagc

SEQ ID NO: 618739 - DNA, 20 bp, Artificial Sequence
  chemically synthesized
ttaagatctaggtcgaatgt

SEQ ID NO: 618740 - DNA, 20 bp, Artificial Sequence
  chemically synthesized
aagttatgccagggagataa

SEQ ID NO: 618741 - DNA, 20 bp, Artificial Sequence
  chemically synthesized
acatatgtatatatcagaag

SEQ ID NO: 618742 - DNA, 20 bp, Artificial Sequence
  chemically synthesized
ctacacatatgtatatatca

SEQ ID NO: 618743 - DNA, 20 bp, Artificial Sequence
  chemically synthesized
cttctgatatatacatatgt

SEQ ID NO: 618744 - DNA, 20 bp, Artificial Sequence
  chemically synthesized
tgtgtgcattataatttata

SEQ ID NO: 618745 - DNA, 20 bp, Artificial Sequence
  chemically synthesized
aagtgatttcaaatatctca

SEQ ID NO: 618746 - DNA, 20 bp, Artificial Sequence
  chemically synthesized
tacacacacacaaacagaaa

SEQ ID NO: 618747 - DNA, 20 bp, Artificial Sequence
  chemically synthesized
tggaagacaacaaactaatt

SEQ ID NO: 618748 - DNA, 20 bp, Artificial Sequence
  chemically synthesized
tcacatttaggaggtaatga

SEQ ID NO: 618749 - DNA, 20 bp, Artificial Sequence
  chemically synthesized
cctatttctgcttcagtata

SEQ ID NO: 618750 - DNA, 20 bp, Artificial Sequence
  chemically synthesized
aacccttactaagtacctat

SEQ ID NO: 618751 - DNA, 20 bp, Artificial Sequence
  chemically synthesized
agcagaaataggtacttagt

SEQ ID NO: 618752 - DNA, 20 bp, Artificial Sequence
  chemically synthesized
aattacagtattgattagtc

SEQ ID NO: 618753 - DNA, 20 bp, Artificial Sequence
  chemically synthesized
gatctgagatttaattacag

SEQ ID NO: 618754 - DNA, 20 bp, Artificial Sequence
  chemically synthesized
tggtctaggacttagtagat

SEQ ID NO: 618755 - DNA, 20 bp, Artificial Sequence
  chemically synthesized
agatctactaagtcctagac

SEQ ID NO: 618756 - DNA, 20 bp, Artificial Sequence
  chemically synthesized
agaaggtctataattaacag

SEQ ID NO: 618757 - DNA, 20 bp, Artificial Sequence
  chemically synthesized
ttggggagaagtcattgaaa

SEQ ID NO: 618758 - DNA, 20 bp, Artificial Sequence
  chemically synthesized
cacctagagaaataaaggca

SEQ ID NO: 618759 - DNA, 20 bp, Artificial Sequence
  chemically synthesized
aattcacctagagaaataaa

SEQ ID NO: 618760 - DNA, 20 bp, Artificial Sequence
  chemically synthesized
tacttcatctttcatgactg

SEQ ID NO: 618761 - DNA, 20 bp, Artificial Sequence
  chemically synthesized
tgacctacctgagaaagaag

SEQ ID NO: 618762 - DNA, 20 bp, Artificial Sequence
  chemically synthesized
acttctttctcaggtaggtc

SEQ ID NO: 618763 - DNA, 20 bp, Artificial Sequence
  chemically synthesized
gggagttgttggactcagaa

SEQ ID NO: 618764 - DNA, 20 bp, Artificial Sequence
  chemically synthesized
gagctgacatggctttccaa

SEQ ID NO: 618765 - DNA, 20 bp, Artificial Sequence
  chemically synthesized
ttttattcaatatgagctga

SEQ ID NO: 618766 - DNA, 20 bp, Artificial Sequence
  chemically synthesized
ttgctaatggagcataaatt

SEQ ID NO: 618767 - DNA, 20 bp, Artificial Sequence
  chemically synthesized
atttttatgaatatacaact

SEQ ID NO: 618768 - DNA, 20 bp, Artificial Sequence
  chemically synthesized
atatttctacaatacttgtg

SEQ ID NO: 618769 - DNA, 20 bp, Artificial Sequence
  chemically synthesized
ttatgtcctacttcatgcaa

SEQ ID NO: 618770 - DNA, 20 bp, Artificial Sequence
  chemically synthesized
tgaagtaggacataatgaca

SEQ ID NO: 618771 - DNA, 20 bp, Artificial Sequence
  chemically synthesized
ttggaaaaacagtgccatct

SEQ ID NO: 618772 - DNA, 20 bp, Artificial Sequence
  chemically synthesized
ttgcacaatctaccagatgg

SEQ ID NO: 618773 - DNA, 20 bp, Artificial Sequence
  chemically synthesized
attttaagaggataagaatt

SEQ ID NO: 618774 - DNA, 20 bp, Artificial Sequence
  chemically synthesized
caaataacctgagttccaac

SEQ ID NO: 618775 - DNA, 20 bp, Artificial Sequence
  chemically synthesized
ctctgtgtctcattgcctct

SEQ ID NO: 618776 - DNA, 20 bp, Artificial Sequence
  chemically synthesized
atatttggaagtaaagattt

SEQ ID NO: 618777 - DNA, 20 bp, Artificial Sequence
  chemically synthesized
agttgtaatatatttggaag

SEQ ID NO: 618778 - DNA, 20 bp, Artificial Sequence
  chemically synthesized
gacattatttcataaaatag

SEQ ID NO: 618779 - DNA, 20 bp, Artificial Sequence
  chemically synthesized
ggcagccatgttaataatta

SEQ ID NO: 618780 - DNA, 20 bp, Artificial Sequence
  chemically synthesized
tatgcaaaaaattcaagtct

SEQ ID NO: 618781 - DNA, 20 bp, Artificial Sequence
  chemically synthesized
tatgtgaatatcatttcata

SEQ ID NO: 618782 - DNA, 20 bp, Artificial Sequence
  chemically synthesized
ctcatgctcaaaagaatgaa

SEQ ID NO: 618783 - DNA, 20 bp, Artificial Sequence
  chemically synthesized
gtggtgcattataatttata

SEQ ID NO: 618784 - DNA, 20 bp, Artificial Sequence
  chemically synthesized
aagtgatttcaaatatctca

SEQ ID NO: 618785 - DNA, 20 bp, Artificial Sequence
  chemically synthesized
acaagtctacacccacatac

SEQ ID NO: 618786 - DNA, 20 bp, Artificial Sequence
  chemically synthesized
aattagtatgcagacttgaa

SEQ ID NO: 618787 - DNA, 20 bp, Artificial Sequence
  chemically synthesized
cactggagaccttgacctta

SEQ ID NO: 618788 - DNA, 20 bp, Artificial Sequence
  chemically synthesized
agcagaactgctaactagat

SEQ ID NO: 618789 - DNA, 20 bp, Artificial Sequence
  chemically synthesized
gcctactcaatattactttt

SEQ ID NO: 618790 - DNA, 20 bp, Artificial Sequence
  chemically synthesized
atttggctgtttgctttcct

SEQ ID NO: 618791 - DNA, 20 bp, Artificial Sequence
  chemically synthesized
tgtgtcgtgcacatttggct

SEQ ID NO: 618792 - DNA, 20 bp, Artificial Sequence
  chemically synthesized
gttgtgtgtcgtgcacattt

SEQ ID NO: 618793 - DNA, 20 bp, Artificial Sequence
  chemically synthesized
tctaaagcatctcattaaca

SEQ ID NO: 618794 - DNA, 20 bp, Artificial Sequence
  chemically synthesized
ttccaaacatactgttaatg

SEQ ID NO: 618795 - DNA, 20 bp, Artificial Sequence
  chemically synthesized
ggccctgtgtttgaccattt

SEQ ID NO: 618796 - DNA, 20 bp, Artificial Sequence
  chemically synthesized
acaaatggtcaaacacaggg

SEQ ID NO: 618797 - DNA, 20 bp, Artificial Sequence
  chemically synthesized
atccccttataatccaggcc

SEQ ID NO: 618798 - DNA, 20 bp, Artificial Sequence
  chemically synthesized
gtaagttgagtaaatacatc

SEQ ID NO: 618799 - DNA, 20 bp, Artificial Sequence
  chemically synthesized
gttcacctataactatagtg

SEQ ID NO: 618800 - DNA, 20 bp, Artificial Sequence
  chemically synthesized
tgaacggattctgtggatgc

SEQ ID NO: 618801 - DNA, 20 bp, Artificial Sequence
  chemically synthesized
caccacaagcatccacatct

SEQ ID NO: 618802 - DNA, 20 bp, Artificial Sequence
  chemically synthesized
acaaagaaacagagagatgt

SEQ ID NO: 618803 - DNA, 20 bp, Artificial Sequence
  chemically synthesized
atctctctgtttctttgtgt

SEQ ID NO: 618804 - DNA, 20 bp, Artificial Sequence
  chemically synthesized
ttctttgtgttaaggctttc

SEQ ID NO: 618805 - DNA, 20 bp, Artificial Sequence
  chemically synthesized
taaggctttcttcagtttag

SEQ ID NO: 618806 - DNA, 20 bp, Artificial Sequence
  chemically synthesized
acttctggactgccctgcaa

SEQ ID NO: 618807 - DNA, 20 bp, Artificial Sequence
  chemically synthesized
gcagggcagtccagaagtga

SEQ ID NO: 618808 - DNA, 20 bp, Artificial Sequence
  chemically synthesized
ttaatacatagacttctgtc

SEQ ID NO: 618809 - DNA, 20 bp, Artificial Sequence
  chemically synthesized
ggcatgcttagcaattgttc

SEQ ID NO: 618810 - DNA, 20 bp, Artificial Sequence
  chemically synthesized
caattgaggagccctacagg

SEQ ID NO: 618811 - DNA, 20 bp, Artificial Sequence
  chemically synthesized
acgatgctcctatgggccat

SEQ ID NO: 618812 - DNA, 20 bp, Artificial Sequence
  chemically synthesized
tggaatttgggcccacattt

SEQ ID NO: 618813 - DNA, 20 bp, Artificial Sequence
  chemically synthesized
cacctgggcctcccaaagtg

SEQ ID NO: 618814 - DNA, 20 bp, Artificial Sequence
  chemically synthesized
ctttttatttttagtagaga

SEQ ID NO: 618815 - DNA, 20 bp, Artificial Sequence
  chemically synthesized
ccccgtctctactaaaaata

SEQ ID NO: 618816 - DNA, 20 bp, Artificial Sequence
  chemically synthesized
tgcgtcagcctcccaagtag

SEQ ID NO: 618817 - DNA, 20 bp, Artificial Sequence
  chemically synthesized
aacctcagcctcccaggttc

SEQ ID NO: 618818 - DNA, 20 bp, Artificial Sequence
  chemically synthesized
tttgttttgtttgtttgttt

SEQ ID NO: 618819 - DNA, 20 bp, Artificial Sequence
  chemically synthesized
tttctttgttttgtttgttt

SEQ ID NO: 618820 - DNA, 20 bp, Artificial Sequence
  chemically synthesized
tttctttctttgttttgttt

SEQ ID NO: 618821 - DNA, 20 bp, Artificial Sequence
  chemically synthesized
gtcttttctttctttgtttt

SEQ ID NO: 618822 - DNA, 20 bp, Artificial Sequence
  chemically synthesized
atgagtcttttctttctttg

SEQ ID NO: 618823 - DNA, 20 bp, Artificial Sequence
  chemically synthesized
ggcttatgagtcttttcttt

SEQ ID NO: 618824 - DNA, 20 bp, Artificial Sequence
  chemically synthesized
actcataagccacaccaaac

SEQ ID NO: 618825 - DNA, 20 bp, Artificial Sequence
  chemically synthesized
actggaaatcttgggtttgg

SEQ ID NO: 618826 - DNA, 20 bp, Artificial Sequence
  chemically synthesized
ctcttttcagactggaaatc

SEQ ID NO: 618827 - DNA, 20 bp, Artificial Sequence
  chemically synthesized
tgaagctaagagttttttta

SEQ ID NO: 618828 - DNA, 20 bp, Artificial Sequence
  chemically synthesized
ataatcgtggtaaaaaaact

SEQ ID NO: 618829 - DNA, 20 bp, Artificial Sequence
  chemically synthesized
tacctcatcaaagtgaagct

SEQ ID NO: 618830 - DNA, 20 bp, Artificial Sequence
  chemically synthesized
tctttgcttaagactacttt

SEQ ID NO: 618831 - DNA, 20 bp, Artificial Sequence
  chemically synthesized
gcacttactttgtactaagt

SEQ ID NO: 618832 - DNA, 20 bp, Artificial Sequence
  chemically synthesized
tagaacttcttgaacaagtt

SEQ ID NO: 618833 - DNA, 20 bp, Artificial Sequence
  chemically synthesized
gtagtttacattatttgctc

SEQ ID NO: 618834 - DNA, 20 bp, Artificial Sequence
  chemically synthesized
acttgccatggttcaccatg

SEQ ID NO: 618835 - DNA, 20 bp, Artificial Sequence
  chemically synthesized
gagtgtgtcaattctgagct

SEQ ID NO: 618836 - DNA, 20 bp, Artificial Sequence
  chemically synthesized
ctaggggcttaagaatcata

SEQ ID NO: 618837 - DNA, 20 bp, Artificial Sequence
  chemically synthesized
ccaagaaaagtgaaaacact

SEQ ID NO: 618838 - DNA, 20 bp, Artificial Sequence
  chemically synthesized
ctgacatgtgaataagaaat

SEQ ID NO: 618839 - DNA, 20 bp, Artificial Sequence
  chemically synthesized
atgtttgttcttataagtca

SEQ ID NO: 618840 - DNA, 20 bp, Artificial Sequence
  chemically synthesized
gttcttataagtcattgaga

SEQ ID NO: 618841 - DNA, 20 bp, Artificial Sequence
  chemically synthesized
tataagtcattgagatttgg

SEQ ID NO: 618842 - DNA, 20 bp, Artificial Sequence
  chemically synthesized
actatttacctgctatatta

SEQ ID NO: 618843 - DNA, 20 bp, Artificial Sequence
  chemically synthesized
aatttaaaataagctgaaga

SEQ ID NO: 618844 - DNA, 20 bp, Artificial Sequence
  chemically synthesized
acttcatttaaaacccattc

SEQ ID NO: 618845 - DNA, 20 bp, Artificial Sequence
  chemically synthesized
tgggttttaaatgaagtatt

SEQ ID NO: 618846 - DNA, 20 bp, Artificial Sequence
  chemically synthesized
ttctgaaagggcaatttttg

SEQ ID NO: 618847 - DNA, 20 bp, Artificial Sequence
  chemically synthesized
tggtatggtaaggagaaaga

SEQ ID NO: 618848 - DNA, 20 bp, Artificial Sequence
  chemically synthesized
tgagaacaacctgcttgttt

SEQ ID NO: 618849 - DNA, 20 bp, Artificial Sequence
  chemically synthesized
gccatgtatgagaacaacct

SEQ ID NO: 618850 - DNA, 20 bp, Artificial Sequence
  chemically synthesized
cttggccatgtatgagaaca

SEQ ID NO: 618851 - DNA, 20 bp, Artificial Sequence
  chemically synthesized
tccacttaaattgttttcta

SEQ ID NO: 618852 - DNA, 20 bp, Artificial Sequence
  chemically synthesized
taaaacttattttccactta

SEQ ID NO: 618853 - DNA, 20 bp, Artificial Sequence
  chemically synthesized
gaaaacaatttaagtggaaa

SEQ ID NO: 618854 - DNA, 20 bp, Artificial Sequence
  chemically synthesized
cgaaactttatttctgtttt

SEQ ID NO: 618855 - DNA, 20 bp, Artificial Sequence
  chemically synthesized
gaaagcacttaaaacagaaa

SEQ ID NO: 618856 - DNA, 20 bp, Artificial Sequence
  chemically synthesized
tgattactccgaaactttat

SEQ ID NO: 618857 - DNA, 20 bp, Artificial Sequence
  chemically synthesized
gtatttggtgaacagggagt

SEQ ID NO: 618858 - DNA, 20 bp, Artificial Sequence
  chemically synthesized
caaatacggaagtcttaagc

SEQ ID NO: 618859 - DNA, 20 bp, Artificial Sequence
  chemically synthesized
tggcttgatctttcataaac

SEQ ID NO: 618860 - DNA, 20 bp, Artificial Sequence
  chemically synthesized
cttcattcctatttataatt

SEQ ID NO: 618861 - DNA, 20 bp, Artificial Sequence
  chemically synthesized
taaataggaatgaaggccaa

SEQ ID NO: 618862 - DNA, 20 bp, Artificial Sequence
  chemically synthesized
gtttcccgtcagtgctgaaa

SEQ ID NO: 618863 - DNA, 20 bp, Artificial Sequence
  chemically synthesized
taatgttcttttactgactg

SEQ ID NO: 618864 - DNA, 20 bp, Artificial Sequence
  chemically synthesized
ttagagtcagtcttttagaa

SEQ ID NO: 618865 - DNA, 20 bp, Artificial Sequence
  chemically synthesized
tctcctcttttgattagctc

SEQ ID NO: 618866 - DNA, 20 bp, Artificial Sequence
  chemically synthesized
gggagctaatcaaaagagga

SEQ ID NO: 618867 - DNA, 20 bp, Artificial Sequence
  chemically synthesized
actctcaaaactgtctcctc

SEQ ID NO: 618868 - DNA, 20 bp, Artificial Sequence
  chemically synthesized
gataatctattagcattggc

SEQ ID NO: 618869 - DNA, 20 bp, Artificial Sequence
  chemically synthesized
gttaatcaggtgccaatgct

SEQ ID NO: 618870 - DNA, 20 bp, Artificial Sequence
  chemically synthesized
agtcacacaatcaattttta

SEQ ID NO: 618871 - DNA, 20 bp, Artificial Sequence
  chemically synthesized
agcaactcaagctgaataaa

SEQ ID NO: 618872 - DNA, 20 bp, Artificial Sequence
  chemically synthesized
actgatgacaagtggttaac

SEQ ID NO: 618873 - DNA, 20 bp, Artificial Sequence
  chemically synthesized
gtggttaacgactgcttctt

SEQ ID NO: 618874 - DNA, 20 bp, Artificial Sequence
  chemically synthesized
aatgaaagacttctcttttc

SEQ ID NO: 618875 - DNA, 20 bp, Artificial Sequence
  chemically synthesized
tttctcaggtttattatgcc

SEQ ID NO: 618876 - DNA, 20 bp, Artificial Sequence
  chemically synthesized
tcagtgtacattgccaatag

SEQ ID NO: 618877 - DNA, 20 bp, Artificial Sequence
  chemically synthesized
atagatgagttttgtctata

SEQ ID NO: 618878 - DNA, 20 bp, Artificial Sequence
  chemically synthesized
aacctacactcacatctatt

SEQ ID NO: 618879 - DNA, 20 bp, Artificial Sequence
  chemically synthesized
cacctcggcctcccaaagtg

SEQ ID NO: 618880 - DNA, 20 bp, Artificial Sequence
  chemically synthesized
ttagtagagacggggtttca

SEQ ID NO: 618881 - DNA, 20 bp, Artificial Sequence
  chemically synthesized
ttttgtatttttagtagaga

SEQ ID NO: 618882 - DNA, 20 bp, Artificial Sequence
  chemically synthesized
ggtgcccgccaccacgcccg

SEQ ID NO: 618883 - DNA, 20 bp, Artificial Sequence
  chemically synthesized
gaatggctgaacccgggagg

SEQ ID NO: 618884 - DNA, 20 bp, Artificial Sequence
  chemically synthesized
gcaaacaataaggctagtat

SEQ ID NO: 618885 - DNA, 20 bp, Artificial Sequence
  chemically synthesized
aaaagctctcatactagcct

SEQ ID NO: 618886 - DNA, 20 bp, Artificial Sequence
  chemically synthesized
ggaaaatataacagaattac

SEQ ID NO: 618887 - DNA, 20 bp, Artificial Sequence
  chemically synthesized
tttagacattgtagaaaaaa

SEQ ID NO: 618888 - DNA, 20 bp, Artificial Sequence
  chemically synthesized
ttttattatataaaacaaac

SEQ ID NO: 618889 - DNA, 20 bp, Artificial Sequence
  chemically synthesized
ttaaaacctcaaaatctatt

SEQ ID NO: 618890 - DNA, 20 bp, Artificial Sequence
  chemically synthesized
ataaaacaaacaatagattt

SEQ ID NO: 618891 - DNA, 20 bp, Artificial Sequence
  chemically synthesized
tcccttaaaacctcaaaatc

SEQ ID NO: 618892 - DNA, 20 bp, Artificial Sequence
  chemically synthesized
tttgaggttttaagggaatt

SEQ ID NO: 618893 - DNA, 20 bp, Artificial Sequence
  chemically synthesized
tcgaaaaacagcattttaag

SEQ ID NO: 618894 - DNA, 20 bp, Artificial Sequence
  chemically synthesized
aaataaaactatacttaaaa

SEQ ID NO: 618895 - DNA, 20 bp, Artificial Sequence
  chemically synthesized
gtaatgactagaatttaaaa

SEQ ID NO: 618896 - DNA, 20 bp, Artificial Sequence
  chemically synthesized
agactttaagtcaaatggca

SEQ ID NO: 618897 - DNA, 20 bp, Artificial Sequence
  chemically synthesized
tttcctctatagccaattta

SEQ ID NO: 618898 - DNA, 20 bp, Artificial Sequence
  chemically synthesized
acatattgttatatacatac

SEQ ID NO: 618899 - DNA, 20 bp, Artificial Sequence
  chemically synthesized
ctttatatgttatatatgta

SEQ ID NO: 618900 - DNA, 20 bp, Artificial Sequence
  chemically synthesized
aattgtagcacactgaaaac

SEQ ID NO: 618901 - DNA, 20 bp, Artificial Sequence
  chemically synthesized
agcacactgaaaacattagt

SEQ ID NO: 618902 - DNA, 20 bp, Artificial Sequence
  chemically synthesized
aatgttctctaatcaaaaac

SEQ ID NO: 618903 - DNA, 20 bp, Artificial Sequence
  chemically synthesized
tttttgattagagaacatta

SEQ ID NO: 618904 - DNA, 20 bp, Artificial Sequence
  chemically synthesized
agtagaatctccagaatttc

SEQ ID NO: 618905 - DNA, 20 bp, Artificial Sequence
  chemically synthesized
tttacaaactttggaaattc

SEQ ID NO: 618906 - DNA, 20 bp, Artificial Sequence
  chemically synthesized
gacattcgaattttctaatt

SEQ ID NO: 618907 - DNA, 20 bp, Artificial Sequence
  chemically synthesized
ggaaagccattccctttata

SEQ ID NO: 618908 - DNA, 20 bp, Artificial Sequence
  chemically synthesized
actaaacgaattataaaggg

SEQ ID NO: 618909 - DNA, 20 bp, Artificial Sequence
  chemically synthesized
ttcctgaattacagtaatat

SEQ ID NO: 618910 - DNA, 20 bp, Artificial Sequence
  chemically synthesized
aattacagtaatatggtagt

SEQ ID NO: 618911 - DNA, 20 bp, Artificial Sequence
  chemically synthesized
gctacttattaacagtgtgc

SEQ ID NO: 618912 - DNA, 20 bp, Artificial Sequence
  chemically synthesized
aataatgataataatatcgg

SEQ ID NO: 618913 - DNA, 20 bp, Artificial Sequence
  chemically synthesized
aatatcggtgtagctttgtc

SEQ ID NO: 618914 - DNA, 20 bp, Artificial Sequence
  chemically synthesized
ctctaacactaacttgctct

SEQ ID NO: 618915 - DNA, 20 bp, Artificial Sequence
  chemically synthesized
aaattgtattccacataatt

SEQ ID NO: 618916 - DNA, 20 bp, Artificial Sequence
  chemically synthesized
gaaattatcttttccaaatt

SEQ ID NO: 618917 - DNA, 20 bp, Artificial Sequence
  chemically synthesized
gccagttctaaaactctatc

SEQ ID NO: 618918 - DNA, 20 bp, Artificial Sequence
  chemically synthesized
tagaataaagaagcagatga

SEQ ID NO: 618919 - DNA, 20 bp, Artificial Sequence
  chemically synthesized
ctatcatctgcttctttatt

SEQ ID NO: 618920 - DNA, 20 bp, Artificial Sequence
  chemically synthesized
tctgcttctttattctaggt

SEQ ID NO: 618921 - DNA, 20 bp, Artificial Sequence
  chemically synthesized
cttctttattctaggttttt

SEQ ID NO: 618922 - DNA, 20 bp, Artificial Sequence
  chemically synthesized
ttctaggtttttgtttgttt

SEQ ID NO: 618923 - DNA, 20 bp, Artificial Sequence
  chemically synthesized
gtttatttgtttctgcagga

SEQ ID NO: 618924 - DNA, 20 bp, Artificial Sequence
  chemically synthesized
tatgctctggaatcatacgg

SEQ ID NO: 618925 - DNA, 20 bp, Artificial Sequence
  chemically synthesized
ctggactttaaatccaggcc

SEQ ID NO: 618926 - DNA, 20 bp, Artificial Sequence
  chemically synthesized
catacggcctggatttaaag

SEQ ID NO: 618927 - DNA, 20 bp, Artificial Sequence
  chemically synthesized
ctggatttaaagtccagttt

SEQ ID NO: 618928 - DNA, 20 bp, Artificial Sequence
  chemically synthesized
ccagttttgccgcttactgg

SEQ ID NO: 618929 - DNA, 20 bp, Artificial Sequence
  chemically synthesized
tttacataacttttctttcc

SEQ ID NO: 618930 - DNA, 20 bp, Artificial Sequence
  chemically synthesized
tttctatgccatataaagat

SEQ ID NO: 618931 - DNA, 20 bp, Artificial Sequence
  chemically synthesized
tttcaggataggaataacaa

SEQ ID NO: 618932 - DNA, 20 bp, Artificial Sequence
  chemically synthesized
ttattcctatcctgaaatct

SEQ ID NO: 618933 - DNA, 20 bp, Artificial Sequence
  chemically synthesized
ccatagtcgtattgaaagcc

SEQ ID NO: 618934 - DNA, 20 bp, Artificial Sequence
  chemically synthesized
aaaattttgcccacaatttt

SEQ ID NO: 618935 - DNA, 20 bp, Artificial Sequence
  chemically synthesized
tatgagagtccacagtcatc

SEQ ID NO: 618936 - DNA, 20 bp, Artificial Sequence
  chemically synthesized
agcagattctaaaagggctc

SEQ ID NO: 618937 - DNA, 20 bp, Artificial Sequence
  chemically synthesized
ctcttatggatattaatgat

SEQ ID NO: 618938 - DNA, 20 bp, Artificial Sequence
  chemically synthesized
agtggcattaacagcaatag

SEQ ID NO: 618939 - DNA, 20 bp, Artificial Sequence
  chemically synthesized
gtttttattatttttcttta

SEQ ID NO: 618940 - DNA, 20 bp, Artificial Sequence
  chemically synthesized
tctttactttgctttttttt

SEQ ID NO: 618941 - DNA, 20 bp, Artificial Sequence
  chemically synthesized
ccctaggccagataaggagc

SEQ ID NO: 618942 - DNA, 20 bp, Artificial Sequence
  chemically synthesized
tctggcctagggaataaata

SEQ ID NO: 618943 - DNA, 20 bp, Artificial Sequence
  chemically synthesized
agatattactcttcagccac

SEQ ID NO: 618944 - DNA, 20 bp, Artificial Sequence
  chemically synthesized
ggcactatttttttgttgtt

SEQ ID NO: 618945 - DNA, 20 bp, Artificial Sequence
  chemically synthesized
tttttgttgttgttagtttc

SEQ ID NO: 618946 - DNA, 20 bp, Artificial Sequence
  chemically synthesized
tgtgcttccatatacacaga

SEQ ID NO: 618947 - DNA, 20 bp, Artificial Sequence
  chemically synthesized
aatacagtaattggaactca

SEQ ID NO: 618948 - DNA, 20 bp, Artificial Sequence
  chemically synthesized
agtaattggaactcagaaag

SEQ ID NO: 618949 - DNA, 20 bp, Artificial Sequence
  chemically synthesized
gaaagatttgtttgctacct

SEQ ID NO: 618950 - DNA, 20 bp, Artificial Sequence
  chemically synthesized
aatgtgcattaaaaatatgt

SEQ ID NO: 618951 - DNA, 20 bp, Artificial Sequence
  chemically synthesized
aaccactcaaatgtggaatt

SEQ ID NO: 618952 - DNA, 20 bp, Artificial Sequence
  chemically synthesized
gatttgtttcttgtatggca

SEQ ID NO: 618953 - DNA, 20 bp, Artificial Sequence
  chemically synthesized
tatctatgcagaaaggagtg

SEQ ID NO: 618954 - DNA, 20 bp, Artificial Sequence
  chemically synthesized
cactgtatctatgcagaaag

SEQ ID NO: 618955 - DNA, 20 bp, Artificial Sequence
  chemically synthesized
ctgcatagatacagtgaatt

SEQ ID NO: 618956 - DNA, 20 bp, Artificial Sequence
  chemically synthesized
tcataccacgctttgaaaat

SEQ ID NO: 618957 - DNA, 20 bp, Artificial Sequence
  chemically synthesized
tattctcagacactttcata

SEQ ID NO: 618958 - DNA, 20 bp, Artificial Sequence
  chemically synthesized
tatttctactgatctctgct

SEQ ID NO: 618959 - DNA, 20 bp, Artificial Sequence
  chemically synthesized
aaccgctaaaagaggaacat

SEQ ID NO: 618960 - DNA, 20 bp, Artificial Sequence
  chemically synthesized
cacacacatcttttctcttt

SEQ ID NO: 618961 - DNA, 20 bp, Artificial Sequence
  chemically synthesized
actaaatttagacaagtatt

SEQ ID NO: 618962 - DNA, 20 bp, Artificial Sequence
  chemically synthesized
agatgtttctttatcttgaa

SEQ ID NO: 618963 - DNA, 20 bp, Artificial Sequence
  chemically synthesized
tcaagataaagaaacatctt

SEQ ID NO: 618964 - DNA, 20 bp, Artificial Sequence
  chemically synthesized
agactacttttaatctctga

SEQ ID NO: 618965 - DNA, 20 bp, Artificial Sequence
  chemically synthesized
agagattaaaagtagtcttt

SEQ ID NO: 618966 - DNA, 20 bp, Artificial Sequence
  chemically synthesized
tgaggagtcaaactaaaacc

SEQ ID NO: 618967 - DNA, 20 bp, Artificial Sequence
  chemically synthesized
actaattacaatctattggt

SEQ ID NO: 618968 - DNA, 20 bp, Artificial Sequence
  chemically synthesized
catcatactaattacaatct

SEQ ID NO: 618969 - DNA, 20 bp, Artificial Sequence
  chemically synthesized
ccaatagattgtaattagta

SEQ ID NO: 618970 - DNA, 20 bp, Artificial Sequence
  chemically synthesized
gacagatgcattatttaccc

SEQ ID NO: 618971 - DNA, 20 bp, Artificial Sequence
  chemically synthesized
aattaatttataaattaaat

SEQ ID NO: 618972 - DNA, 20 bp, Artificial Sequence
  chemically synthesized
cttttaatactcactttttc

SEQ ID NO: 618973 - DNA, 20 bp, Artificial Sequence
  chemically synthesized
ctagagaaaaagtgagtatt

SEQ ID NO: 618974 - DNA, 20 bp, Artificial Sequence
  chemically synthesized
aaaagtgagtattaaaagct

SEQ ID NO: 618975 - DNA, 20 bp, Artificial Sequence
  chemically synthesized
gtattaaaagctttaggatt

SEQ ID NO: 618976 - DNA, 20 bp, Artificial Sequence
  chemically synthesized
atatatcaaactttaaatcc

SEQ ID NO: 618977 - DNA, 20 bp, Artificial Sequence
  chemically synthesized
tactttcttcatttaaaata

SEQ ID NO: 618978 - DNA, 20 bp, Artificial Sequence
  chemically synthesized
aatgcttctagatatttaaa

SEQ ID NO: 618979 - DNA, 20 bp, Artificial Sequence
  chemically synthesized
ttttatgggaacaaagaaga

SEQ ID NO: 618980 - DNA, 20 bp, Artificial Sequence
  chemically synthesized
tgttcccataaaaattaccg

SEQ ID NO: 618981 - DNA, 20 bp, Artificial Sequence
  chemically synthesized
taataatcccacatttgggt

SEQ ID NO: 618982 - DNA, 20 bp, Artificial Sequence
  chemically synthesized
gataaagcctccacccaaat

SEQ ID NO: 618983 - DNA, 20 bp, Artificial Sequence
  chemically synthesized
aaaagagtctcaaaaattat

SEQ ID NO: 618984 - DNA, 20 bp, Artificial Sequence
  chemically synthesized
ttaggtgaaaaatcatctcc

SEQ ID NO: 618985 - DNA, 20 bp, Artificial Sequence
  chemically synthesized
atatgtaccaaaacttacgg

SEQ ID NO: 618986 - DNA, 20 bp, Artificial Sequence
  chemically synthesized
tcatccattacaggtaggaa

SEQ ID NO: 618987 - DNA, 20 bp, Artificial Sequence
  chemically synthesized
atatatacacacacatgcat

SEQ ID NO: 618988 - DNA, 20 bp, Artificial Sequence
  chemically synthesized
agttgaaggattcagggaga

SEQ ID NO: 618989 - DNA, 20 bp, Artificial Sequence
  chemically synthesized
tatatttatatctcgcagtt

SEQ ID NO: 618990 - DNA, 20 bp, Artificial Sequence
  chemically synthesized
gctgttcctcatgtagcaga

SEQ ID NO: 618991 - DNA, 20 bp, Artificial Sequence
  chemically synthesized
aactatcttttttattgcag

SEQ ID NO: 618992 - DNA, 20 bp, Artificial Sequence
  chemically synthesized
ctctaaactatcttttttat

SEQ ID NO: 618993 - DNA, 20 bp, Artificial Sequence
  chemically synthesized
agccaatctgcaataaaaaa

SEQ ID NO: 618994 - DNA, 20 bp, Artificial Sequence
  chemically synthesized
agatgtgacagagagtcctg

SEQ ID NO: 618995 - DNA, 20 bp, Artificial Sequence
  chemically synthesized
tgacagagagtcctggaagg

SEQ ID NO: 618996 - DNA, 20 bp, Artificial Sequence
  chemically synthesized
tacgtttattctaaggatta

SEQ ID NO: 618997 - DNA, 20 bp, Artificial Sequence
  chemically synthesized
tccaaaggatacgtttattc

SEQ ID NO: 618998 - DNA, 20 bp, Artificial Sequence
  chemically synthesized
tgtggaatttattccaaagg

SEQ ID NO: 618999 - DNA, 20 bp, Artificial Sequence
  chemically synthesized
taattaatactcaagtaata

SEQ ID NO: 619000 - DNA, 20 bp, Artificial Sequence
  chemically synthesized
tactcaagtaataagtagtt

SEQ ID NO: 619001 - DNA, 20 bp, Artificial Sequence
  chemically synthesized
gttaagagactttttctccc

SEQ ID NO: 619002 - DNA, 20 bp, Artificial Sequence
  chemically synthesized
agggttttttttttttcctg

SEQ ID NO: 619003 - DNA, 20 bp, Artificial Sequence
  chemically synthesized
ttaagtactagaaatgacat

SEQ ID NO: 619004 - DNA, 20 bp, Artificial Sequence
  chemically synthesized
tatctgccataaacacatga

SEQ ID NO: 619005 - DNA, 20 bp, Artificial Sequence
  chemically synthesized
gaacaaaccaaaacagcttc

SEQ ID NO: 619006 - DNA, 20 bp, Artificial Sequence
  chemically synthesized
ccataaacacatgaagctgt

SEQ ID NO: 619007 - DNA, 20 bp, Artificial Sequence
  chemically synthesized
agggtaactgaacaaaccaa

SEQ ID NO: 619008 - DNA, 20 bp, Artificial Sequence
  chemically synthesized
aacccagagacaattccaat

SEQ ID NO: 619009 - DNA, 20 bp, Artificial Sequence
  chemically synthesized
gattccttggtcacccctat

SEQ ID NO: 619010 - DNA, 20 bp, Artificial Sequence
  chemically synthesized
caaggaatccaaccagaact

SEQ ID NO: 619011 - DNA, 20 bp, Artificial Sequence
  chemically synthesized
aaactaaacagaaagttctg

SEQ ID NO: 619012 - DNA, 20 bp, Artificial Sequence
  chemically synthesized
aatccaaccagaactttctg

SEQ ID NO: 619013 - DNA, 20 bp, Artificial Sequence
  chemically synthesized
acttacaagtttttcagtgc

SEQ ID NO: 619014 - DNA, 20 bp, Artificial Sequence
  chemically synthesized
agcactgaaaaacttgtaag

SEQ ID NO: 619015 - DNA, 20 bp, Artificial Sequence
  chemically synthesized
caagaaactaaacaagactt

SEQ ID NO: 619016 - DNA, 20 bp, Artificial Sequence
  chemically synthesized
tgaaaaacttgtaagtcttg

SEQ ID NO: 619017 - DNA, 20 bp, Artificial Sequence
  chemically synthesized
tcttgctgaaatttaaataa

SEQ ID NO: 619018 - DNA, 20 bp, Artificial Sequence
  chemically synthesized
aaatattcattttattcttt

SEQ ID NO: 619019 - DNA, 20 bp, Artificial Sequence
  chemically synthesized
tagctatgctccctctcatg

SEQ ID NO: 619020 - DNA, 20 bp, Artificial Sequence
  chemically synthesized
aggaatagctatgctccctc

SEQ ID NO: 619021 - DNA, 20 bp, Artificial Sequence
  chemically synthesized
ttggtatactacaataggaa

SEQ ID NO: 619022 - DNA, 20 bp, Artificial Sequence
  chemically synthesized
ggaagtatgatttcctttta

SEQ ID NO: 619023 - DNA, 20 bp, Artificial Sequence
  chemically synthesized
gtatgatttccttttaatat

SEQ ID NO: 619024 - DNA, 20 bp, Artificial Sequence
  chemically synthesized
gttactaattgcagaaacca

SEQ ID NO: 619025 - DNA, 20 bp, Artificial Sequence
  chemically synthesized
tattgatgatgttaaatcaa

SEQ ID NO: 619026 - DNA, 20 bp, Artificial Sequence
  chemically synthesized
atgtaatgatattgttcaca

SEQ ID NO: 619027 - DNA, 20 bp, Artificial Sequence
  chemically synthesized
ctttaactttgctagacacc

SEQ ID NO: 619028 - DNA, 20 bp, Artificial Sequence
  chemically synthesized
atgtatcttaatattttatt

SEQ ID NO: 619029 - DNA, 20 bp, Artificial Sequence
  chemically synthesized
atttcatatttcaatatccc

SEQ ID NO: 619030 - DNA, 20 bp, Artificial Sequence
  chemically synthesized
atataaatacatgcatgaaa

SEQ ID NO: 619031 - DNA, 20 bp, Artificial Sequence
  chemically synthesized
atgatgcatatgagattatt

SEQ ID NO: 619032 - DNA, 20 bp, Artificial Sequence
  chemically synthesized
atctccttataatgatgcat

SEQ ID NO: 619033 - DNA, 20 bp, Artificial Sequence
  chemically synthesized
gcatcattataaggagatga

SEQ ID NO: 619034 - DNA, 20 bp, Artificial Sequence
  chemically synthesized
gagatgaaagggattaagaa

SEQ ID NO: 619035 - DNA, 20 bp, Artificial Sequence
  chemically synthesized
tttgcatctaatatgaatgg

SEQ ID NO: 619036 - DNA, 20 bp, Artificial Sequence
  chemically synthesized
ggcatttgcttattttatta

SEQ ID NO: 619037 - DNA, 20 bp, Artificial Sequence
  chemically synthesized
caataataaaataagcaaat

SEQ ID NO: 619038 - DNA, 20 bp, Artificial Sequence
  chemically synthesized
aggagaaaataaaagcaggc

SEQ ID NO: 619039 - DNA, 20 bp, Artificial Sequence
  chemically synthesized
cttttattttctcctaatta

SEQ ID NO: 619040 - DNA, 20 bp, Artificial Sequence
  chemically synthesized
aaacaactaacattaagtgc

SEQ ID NO: 619041 - DNA, 20 bp, Artificial Sequence
  chemically synthesized
aatcctttgcacttaatgtt

SEQ ID NO: 619042 - DNA, 20 bp, Artificial Sequence
  chemically synthesized
tcccagctcaactttgggat

SEQ ID NO: 619043 - DNA, 20 bp, Artificial Sequence
  chemically synthesized
agtttgaacacatcgaggca

SEQ ID NO: 619044 - DNA, 20 bp, Artificial Sequence
  chemically synthesized
ccttcaaaaatgctctcaca

SEQ ID NO: 619045 - DNA, 20 bp, Artificial Sequence
  chemically synthesized
agatatgtgaattttgactg

SEQ ID NO: 619046 - DNA, 20 bp, Artificial Sequence
  chemically synthesized
ccagccaaaaggttcatttc

SEQ ID NO: 619047 - DNA, 20 bp, Artificial Sequence
  chemically synthesized
ccacctcagctcctagagtg

SEQ ID NO: 619048 - DNA, 20 bp, Artificial Sequence
  chemically synthesized
ggtctcgaactcctgacctc

SEQ ID NO: 619049 - DNA, 20 bp, Artificial Sequence
  chemically synthesized
cttgaggtcaggagttcgag

SEQ ID NO: 619050 - DNA, 20 bp, Artificial Sequence
  chemically synthesized
tttgtgttttttagtagaga

SEQ ID NO: 619051 - DNA, 20 bp, Artificial Sequence
  chemically synthesized
ccaccatgcccggctaattt

SEQ ID NO: 619052 - DNA, 20 bp, Artificial Sequence
  chemically synthesized
tgcctgagacttgcgagtag

SEQ ID NO: 619053 - DNA, 20 bp, Artificial Sequence
  chemically synthesized
aacttctgcctcctgggttc

SEQ ID NO: 619054 - DNA, 20 bp, Artificial Sequence
  chemically synthesized
ctccagcctgggtgacagag

SEQ ID NO: 619055 - DNA, 20 bp, Artificial Sequence
  chemically synthesized
aaatagtcttcggagaaatg

SEQ ID NO: 619056 - DNA, 20 bp, Artificial Sequence
  chemically synthesized
tttcatttctccgaagacta

SEQ ID NO: 619057 - DNA, 20 bp, Artificial Sequence
  chemically synthesized
gattgacacccgtagcctat

SEQ ID NO: 619058 - DNA, 20 bp, Artificial Sequence
  chemically synthesized
ttttccgttgttggagatat

SEQ ID NO: 619059 - DNA, 20 bp, Artificial Sequence
  chemically synthesized
tagaatactcacacttttat

SEQ ID NO: 619060 - DNA, 20 bp, Artificial Sequence
  chemically synthesized
tgagatacaaaattttggag

SEQ ID NO: 619061 - DNA, 20 bp, Artificial Sequence
  chemically synthesized
aaaattttggagccctgctt

SEQ ID NO: 619062 - DNA, 20 bp, Artificial Sequence
  chemically synthesized
taaggagtgtggtattgact

SEQ ID NO: 619063 - DNA, 20 bp, Artificial Sequence
  chemically synthesized
ctggcctttttgttttgttt

SEQ ID NO: 619064 - DNA, 20 bp, Artificial Sequence
  chemically synthesized
tgtcctggcctttttgtttt

SEQ ID NO: 619065 - DNA, 20 bp, Artificial Sequence
  chemically synthesized
ctgctgtcctggcctttttg

SEQ ID NO: 619066 - DNA, 20 bp, Artificial Sequence
  chemically synthesized
agaacctgctgtcctggcct

SEQ ID NO: 619067 - DNA, 20 bp, Artificial Sequence
  chemically synthesized
ttttggacagtgtgccaaat

SEQ ID NO: 619068 - DNA, 20 bp, Artificial Sequence
  chemically synthesized
cctaatttgtgatgttgaaa

SEQ ID NO: 619069 - DNA, 20 bp, Artificial Sequence
  chemically synthesized
ctcagtttcaacatcacaaa

SEQ ID NO: 619070 - DNA, 20 bp, Artificial Sequence
  chemically synthesized
atcacaaattaggtttcaca

SEQ ID NO: 619071 - DNA, 20 bp, Artificial Sequence
  chemically synthesized
aaatggattctgaatataca

SEQ ID NO: 619072 - DNA, 20 bp, Artificial Sequence
  chemically synthesized
gaaaacacttcattgtattt

SEQ ID NO: 619073 - DNA, 20 bp, Artificial Sequence
  chemically synthesized
aaaagctctgaaatacaatg

SEQ ID NO: 619074 - DNA, 20 bp, Artificial Sequence
  chemically synthesized
aaatacaatgaagtgttttc

SEQ ID NO: 619075 - DNA, 20 bp, Artificial Sequence
  chemically synthesized
ttttcatgacttttcccatt

SEQ ID NO: 619076 - DNA, 20 bp, Artificial Sequence
  chemically synthesized
taataaaaataagtattatt

SEQ ID NO: 619077 - DNA, 20 bp, Artificial Sequence
  chemically synthesized
atctaaagtaagggtaactg

SEQ ID NO: 619078 - DNA, 20 bp, Artificial Sequence
  chemically synthesized
atcccaagagggtaaaatac

SEQ ID NO: 619079 - DNA, 20 bp, Artificial Sequence
  chemically synthesized
ccatcataatcaagttcctc

SEQ ID NO: 619080 - DNA, 20 bp, Artificial Sequence
  chemically synthesized
acatcctaagcagaagagga

SEQ ID NO: 619081 - DNA, 20 bp, Artificial Sequence
  chemically synthesized
taatacgtttttatagatca

SEQ ID NO: 619082 - DNA, 20 bp, Artificial Sequence
  chemically synthesized
tataaatggctcaaaaaata

SEQ ID NO: 619083 - DNA, 20 bp, Artificial Sequence
  chemically synthesized
tgtatccagtctctccttgg

SEQ ID NO: 619084 - DNA, 20 bp, Artificial Sequence
  chemically synthesized
aaggagagactggatacatg

SEQ ID NO: 619085 - DNA, 20 bp, Artificial Sequence
  chemically synthesized
cttttttgcaagttcccaat

SEQ ID NO: 619086 - DNA, 20 bp, Artificial Sequence
  chemically synthesized
catgtttgtgtgtcactgag

SEQ ID NO: 619087 - DNA, 20 bp, Artificial Sequence
  chemically synthesized
tctggaaaatgggtttgact

SEQ ID NO: 619088 - DNA, 20 bp, Artificial Sequence
  chemically synthesized
agaagaggagggtctggaaa

SEQ ID NO: 619089 - DNA, 20 bp, Artificial Sequence
  chemically synthesized
accctcctcttctaaaaggc

SEQ ID NO: 619090 - DNA, 20 bp, Artificial Sequence
  chemically synthesized
gtagagtttagtatctttcc

SEQ ID NO: 619091 - DNA, 20 bp, Artificial Sequence
  chemically synthesized
caggcgggtcccatgggtgg

SEQ ID NO: 619092 - DNA, 20 bp, Artificial Sequence
  chemically synthesized
gggtatcttgaccctctctc

SEQ ID NO: 619093 - DNA, 20 bp, Artificial Sequence
  chemically synthesized
agtatgataacctctttggc

SEQ ID NO: 619094 - DNA, 20 bp, Artificial Sequence
  chemically synthesized
cccctagtggtaacagatca

SEQ ID NO: 619095 - DNA, 20 bp, Artificial Sequence
  chemically synthesized
ctaggggagagacaggcata

SEQ ID NO: 619096 - DNA, 20 bp, Artificial Sequence
  chemically synthesized
ttctatcttcttgttccatc

SEQ ID NO: 619097 - DNA, 20 bp, Artificial Sequence
  chemically synthesized
taatagtgtctgcggtccta

SEQ ID NO: 619098 - DNA, 20 bp, Artificial Sequence
  chemically synthesized
actgatgggctgctgctatc

SEQ ID NO: 619099 - DNA, 20 bp, Artificial Sequence
  chemically synthesized
gtcagtggtgttagtattga

SEQ ID NO: 619100 - DNA, 20 bp, Artificial Sequence
  chemically synthesized
tttctgtcatactgctagta

SEQ ID NO: 619101 - DNA, 20 bp, Artificial Sequence
  chemically synthesized
aaaaaaagctatacctattt

SEQ ID NO: 619102 - DNA, 20 bp, Artificial Sequence
  chemically synthesized
tgtttaatcttggaaatagg

SEQ ID NO: 619103 - DNA, 20 bp, Artificial Sequence
  chemically synthesized
aaaaatagagaatgaggtaa

SEQ ID NO: 619104 - DNA, 20 bp, Artificial Sequence
  chemically synthesized
ttgataatgggtgtattttg

SEQ ID NO: 619105 - DNA, 20 bp, Artificial Sequence
  chemically synthesized
acttcttgataatgggtgta

SEQ ID NO: 619106 - DNA, 20 bp, Artificial Sequence
  chemically synthesized
tctcttagtctggttatgtt

SEQ ID NO: 619107 - DNA, 20 bp, Artificial Sequence
  chemically synthesized
accagactaagagataacct

SEQ ID NO: 619108 - DNA, 20 bp, Artificial Sequence
  chemically synthesized
ctctgactgataagataagg

SEQ ID NO: 619109 - DNA, 20 bp, Artificial Sequence
  chemically synthesized
catctgtttgtgaaagtttt

SEQ ID NO: 619110 - DNA, 20 bp, Artificial Sequence
  chemically synthesized
gaaacatcccatctgtttgt

SEQ ID NO: 619111 - DNA, 20 bp, Artificial Sequence
  chemically synthesized
aaaactttcacaaacagatg

SEQ ID NO: 619112 - DNA, 20 bp, Artificial Sequence
  chemically synthesized
tcactgtgctgaaacatccc

SEQ ID NO: 619113 - DNA, 20 bp, Artificial Sequence
  chemically synthesized
gcaattccattgcatcattt

SEQ ID NO: 619114 - DNA, 20 bp, Artificial Sequence
  chemically synthesized
cattaacattttgagttgat

SEQ ID NO: 619115 - DNA, 20 bp, Artificial Sequence
  chemically synthesized
attgctacattaacattttg

SEQ ID NO: 619116 - DNA, 20 bp, Artificial Sequence
  chemically synthesized
acagatgttaatattggaaa

SEQ ID NO: 619117 - DNA, 20 bp, Artificial Sequence
  chemically synthesized
atagtgtcataccttccatc

SEQ ID NO: 619118 - DNA, 20 bp, Artificial Sequence
  chemically synthesized
tgatggaaggtatgacacta

SEQ ID NO: 619119 - DNA, 20 bp, Artificial Sequence
  chemically synthesized
gcaggctgcgcggccactta

SEQ ID NO: 619120 - DNA, 20 bp, Artificial Sequence
  chemically synthesized
cgcgcagaggcggtagctat

SEQ ID NO: 619121 - DNA, 20 bp, Artificial Sequence
  chemically synthesized
gcgtcgccctccacggttac

SEQ ID NO: 619122 - DNA, 20 bp, Artificial Sequence
  chemically synthesized
acatcactttttatttgacc

SEQ ID NO: 619123 - DNA, 20 bp, Artificial Sequence
  chemically synthesized
agaggcaaaacaacaagaag

SEQ ID NO: 619124 - DNA, 20 bp, Artificial Sequence
  chemically synthesized
ttttttcaatcttttcttct

SEQ ID NO: 619125 - DNA, 20 bp, Artificial Sequence
  chemically synthesized
gggattcttgtaggatctct

SEQ ID NO: 619126 - DNA, 20 bp, Artificial Sequence
  chemically synthesized
tggcaatctgggatcatcat

SEQ ID NO: 619127 - DNA, 20 bp, Artificial Sequence
  chemically synthesized
caagaatcccggatgatgat

SEQ ID NO: 619128 - DNA, 20 bp, Artificial Sequence
  chemically synthesized
atctgttgaagatccaaata

SEQ ID NO: 619129 - DNA, 20 bp, Artificial Sequence
  chemically synthesized
aaacgtgcttctttatattc

SEQ ID NO: 619130 - DNA, 20 bp, Artificial Sequence
  chemically synthesized
aagctgaggaatataaagaa

SEQ ID NO: 619131 - DNA, 20 bp, Artificial Sequence
  chemically synthesized
tataaagaagcacgtttagt

SEQ ID NO: 619132 - DNA, 20 bp, Artificial Sequence
  chemically synthesized
ttcactgaatccagtactaa

SEQ ID NO: 619133 - DNA, 20 bp, Artificial Sequence
  chemically synthesized
caccccatacgagaaaagtt

SEQ ID NO: 619134 - DNA, 20 bp, Artificial Sequence
  chemically synthesized
caaaaaccaccccatacgag

SEQ ID NO: 619135 - DNA, 20 bp, Artificial Sequence
  chemically synthesized
ctgaaacttttctcgtatgg

SEQ ID NO: 619136 - DNA, 20 bp, Artificial Sequence
  chemically synthesized
aatggattgtaaaatggacc

SEQ ID NO: 619137 - DNA, 20 bp, Artificial Sequence
  chemically synthesized
acaccgcagtggtcaaaaat

SEQ ID NO: 619138 - DNA, 20 bp, Artificial Sequence
  chemically synthesized
tgtgttcaagtagtatgaga

SEQ ID NO: 619139 - DNA, 20 bp, Artificial Sequence
  chemically synthesized
ttcaagtagtatgagaatgt

SEQ ID NO: 619140 - DNA, 20 bp, Artificial Sequence
  chemically synthesized
aaaaaaatccatacgtgatg

SEQ ID NO: 619141 - DNA, 20 bp, Artificial Sequence
  chemically synthesized
aatataaaccacacatcacg

SEQ ID NO: 619142 - DNA, 20 bp, Artificial Sequence
  chemically synthesized
agaaaatgctacttatgtgc

SEQ ID NO: 619143 - DNA, 20 bp, Artificial Sequence
  chemically synthesized
gaaaattgatcatttggagc

SEQ ID NO: 619144 - DNA, 20 bp, Artificial Sequence
  chemically synthesized
tggcagcccacctcatggct

SEQ ID NO: 619145 - DNA, 20 bp, Artificial Sequence
  chemically synthesized
gtgggctgccaggtaaattg

SEQ ID NO: 619146 - DNA, 20 bp, Artificial Sequence
  chemically synthesized
attcccttctcaacagccta

SEQ ID NO: 619147 - DNA, 20 bp, Artificial Sequence
  chemically synthesized
cttgaaatgatatattaata

SEQ ID NO: 619148 - DNA, 20 bp, Artificial Sequence
  chemically synthesized
ctttctattaatatatcatt

SEQ ID NO: 619149 - DNA, 20 bp, Artificial Sequence
  chemically synthesized
atgcaacacaaaagacgagc

SEQ ID NO: 619150 - DNA, 20 bp, Artificial Sequence
  chemically synthesized
gccttttgtagaggggcatc

SEQ ID NO: 619151 - DNA, 20 bp, Artificial Sequence
  chemically synthesized
tagaataggaaaagaacaac

SEQ ID NO: 619152 - DNA, 20 bp, Artificial Sequence
  chemically synthesized
tcttttcctattctatcatt

SEQ ID NO: 619153 - DNA, 20 bp, Artificial Sequence
  chemically synthesized
acattcacgtttgtgttgag

SEQ ID NO: 619154 - DNA, 20 bp, Artificial Sequence
  chemically synthesized
caatgacattcacgtttgtg

SEQ ID NO: 619155 - DNA, 20 bp, Artificial Sequence
  chemically synthesized
tttttagctttcaatgacat

SEQ ID NO: 619156 - DNA, 20 bp, Artificial Sequence
  chemically synthesized
tcattaactttgtttacttt

SEQ ID NO: 619157 - DNA, 20 bp, Artificial Sequence
  chemically synthesized
cttacgggtgtgatcattaa

SEQ ID NO: 619158 - DNA, 20 bp, Artificial Sequence
  chemically synthesized
atgatcacacccgtaagtgc

SEQ ID NO: 619159 - DNA, 20 bp, Artificial Sequence
  chemically synthesized
tgaactcagaggagaaagtt

SEQ ID NO: 619160 - DNA, 20 bp, Artificial Sequence
  chemically synthesized
cccaaaagtaagtgaagggt

SEQ ID NO: 619161 - DNA, 20 bp, Artificial Sequence
  chemically synthesized
agcctgttgctctaattatt

SEQ ID NO: 619162 - DNA, 20 bp, Artificial Sequence
  chemically synthesized
atttgaggttttttatgtgt

SEQ ID NO: 619163 - DNA, 20 bp, Artificial Sequence
  chemically synthesized
ttatgtgttgttgttttagc

SEQ ID NO: 619164 - DNA, 20 bp, Artificial Sequence
  chemically synthesized
gttgttgttttagctgttgt

SEQ ID NO: 619165 - DNA, 20 bp, Artificial Sequence
  chemically synthesized
tattcatgctatgagttatc

SEQ ID NO: 619166 - DNA, 20 bp, Artificial Sequence
  chemically synthesized
gagttgggatggtgcaagga

SEQ ID NO: 619167 - DNA, 20 bp, Artificial Sequence
  chemically synthesized
tcttaatctccatccaagtt

SEQ ID NO: 619168 - DNA, 20 bp, Artificial Sequence
  chemically synthesized
tctgaaacacacaacttgga

SEQ ID NO: 619169 - DNA, 20 bp, Artificial Sequence
  chemically synthesized
tctaaatattaatacaattg

SEQ ID NO: 619170 - DNA, 20 bp, Artificial Sequence
  chemically synthesized
aaaagaatatatttgcattt

SEQ ID NO: 619171 - DNA, 20 bp, Artificial Sequence
  chemically synthesized
aaatatattcttttttaatt

SEQ ID NO: 619172 - DNA, 20 bp, Artificial Sequence
  chemically synthesized
atagattgtgcagaagaata

SEQ ID NO: 619173 - DNA, 20 bp, Artificial Sequence
  chemically synthesized
ttaatgattctaataggagc

SEQ ID NO: 619174 - DNA, 20 bp, Artificial Sequence
  chemically synthesized
tactgctgctgaatgtactt

SEQ ID NO: 619175 - DNA, 20 bp, Artificial Sequence
  chemically synthesized
gtcatgttcacattttccct

SEQ ID NO: 619176 - DNA, 20 bp, Artificial Sequence
  chemically synthesized
taataaaataatatgaacaa

SEQ ID NO: 619177 - DNA, 20 bp, Artificial Sequence
  chemically synthesized
tgaacaaaaaggcttttttt

SEQ ID NO: 619178 - DNA, 20 bp, Artificial Sequence
  chemically synthesized
ttttaagaaatagatcaggt

SEQ ID NO: 619179 - DNA, 20 bp, Artificial Sequence
  chemically synthesized
ctatttcttaaaatcctcac

SEQ ID NO: 619180 - DNA, 20 bp, Artificial Sequence
  chemically synthesized
atggttcagtgaaaccttcg

SEQ ID NO: 619181 - DNA, 20 bp, Artificial Sequence
  chemically synthesized
gaaggtttcactgaaccatt

SEQ ID NO: 619182 - DNA, 20 bp, Artificial Sequence
  chemically synthesized
aaaagattggttcatgttta

SEQ ID NO: 619183 - DNA, 20 bp, Artificial Sequence
  chemically synthesized
gtcattctaaaaagattggt

SEQ ID NO: 619184 - DNA, 20 bp, Artificial Sequence
  chemically synthesized
gcacttcagtagtcattcta

SEQ ID NO: 619185 - DNA, 20 bp, Artificial Sequence
  chemically synthesized
tataaacctgacaagtacct

SEQ ID NO: 619186 - DNA, 20 bp, Artificial Sequence
  chemically synthesized
aagaaacaaacaggtacttg

SEQ ID NO: 619187 - DNA, 20 bp, Artificial Sequence
  chemically synthesized
cccttataaacctgacaagt

SEQ ID NO: 619188 - DNA, 20 bp, Artificial Sequence
  chemically synthesized
atgcttgcatgcatatgtgt

SEQ ID NO: 619189 - DNA, 20 bp, Artificial Sequence
  chemically synthesized
tgttctgcttgtgcatgcgt

SEQ ID NO: 619190 - DNA, 20 bp, Artificial Sequence
  chemically synthesized
ctatagcttctaaatttgtg

SEQ ID NO: 619191 - DNA, 20 bp, Artificial Sequence
  chemically synthesized
tgttttctatttattttctc

SEQ ID NO: 619192 - DNA, 20 bp, Artificial Sequence
  chemically synthesized
agaaaataaatagaaaacaa

SEQ ID NO: 619193 - DNA, 20 bp, Artificial Sequence
  chemically synthesized
gtttggttttgtcaaaactt

SEQ ID NO: 619194 - DNA, 20 bp, Artificial Sequence
  chemically synthesized
taatctaaaagtaaagacag

SEQ ID NO: 619195 - DNA, 20 bp, Artificial Sequence
  chemically synthesized
aaaaccaaactgtctttact

SEQ ID NO: 619196 - DNA, 20 bp, Artificial Sequence
  chemically synthesized
ttttataatctaaaagtaaa

SEQ ID NO: 619197 - DNA, 20 bp, Artificial Sequence
  chemically synthesized
taataataaaaaaaagagtt

SEQ ID NO: 619198 - DNA, 20 bp, Artificial Sequence
  chemically synthesized
agtataataataaaaaaaag

SEQ ID NO: 619199 - DNA, 20 bp, Artificial Sequence
  chemically synthesized
cttttttttattattatact

SEQ ID NO: 619200 - DNA, 20 bp, Artificial Sequence
  chemically synthesized
agggtacatgtgcacaacgt

SEQ ID NO: 619201 - DNA, 20 bp, Artificial Sequence
  chemically synthesized
agctcctttcgttttgcaga

SEQ ID NO: 619202 - DNA, 20 bp, Artificial Sequence
  chemically synthesized
atctaaatctgcaaaacgaa

SEQ ID NO: 619203 - DNA, 20 bp, Artificial Sequence
  chemically synthesized
agtggaagctcctttcgttt

SEQ ID NO: 619204 - DNA, 20 bp, Artificial Sequence
  chemically synthesized
tctggcctagtggaagctcc

SEQ ID NO: 619205 - DNA, 20 bp, Artificial Sequence
  chemically synthesized
ccatgaaagtgttccattct

SEQ ID NO: 619206 - DNA, 20 bp, Artificial Sequence
  chemically synthesized
acgcccatgaaagtgttcca

SEQ ID NO: 619207 - DNA, 20 bp, Artificial Sequence
  chemically synthesized
atgggcgttcctacagacca

SEQ ID NO: 619208 - DNA, 20 bp, Artificial Sequence
  chemically synthesized
cagcccatttaatttcatat

SEQ ID NO: 619209 - DNA, 20 bp, Artificial Sequence
  chemically synthesized
ccatttaatttcatatttat

SEQ ID NO: 619210 - DNA, 20 bp, Artificial Sequence
  chemically synthesized
tgcctcggcttcccaaagta

SEQ ID NO: 619211 - DNA, 20 bp, Artificial Sequence
  chemically synthesized
acctcaagtgatccacctgc

SEQ ID NO: 619212 - DNA, 20 bp, Artificial Sequence
  chemically synthesized
ttttgtatttttagtagaga

SEQ ID NO: 619213 - DNA, 20 bp, Artificial Sequence
  chemically synthesized
cctgtaatcccagctactag

SEQ ID NO: 619214 - DNA, 20 bp, Artificial Sequence
  chemically synthesized
tgcctaagcctccctagtag

SEQ ID NO: 619215 - DNA, 20 bp, Artificial Sequence
  chemically synthesized
aacctcctcctcccgggttc

SEQ ID NO: 619216 - DNA, 20 bp, Artificial Sequence
  chemically synthesized
tatgaattgtcccattccct

SEQ ID NO: 619217 - DNA, 20 bp, Artificial Sequence
  chemically synthesized
agttaactagaactgctggg

SEQ ID NO: 619218 - DNA, 20 bp, Artificial Sequence
  chemically synthesized
tcacagttaactagaactgc

SEQ ID NO: 619219 - DNA, 20 bp, Artificial Sequence
  chemically synthesized
aactgaaccagtaagatgca

SEQ ID NO: 619220 - DNA, 20 bp, Artificial Sequence
  chemically synthesized
acttcggaaataatttatgt

SEQ ID NO: 619221 - DNA, 20 bp, Artificial Sequence
  chemically synthesized
aaataagagcaattccaagg

SEQ ID NO: 619222 - DNA, 20 bp, Artificial Sequence
  chemically synthesized
agatgcaagagaatgctcag

SEQ ID NO: 619223 - DNA, 20 bp, Artificial Sequence
  chemically synthesized
aatacggctcttcagctctg

SEQ ID NO: 619224 - DNA, 20 bp, Artificial Sequence
  chemically synthesized
tctgaatacggctcttcagc

SEQ ID NO: 619225 - DNA, 20 bp, Artificial Sequence
  chemically synthesized
agataaatttattctgcgtt

SEQ ID NO: 619226 - DNA, 20 bp, Artificial Sequence
  chemically synthesized
agaaggaattcatttttcac

SEQ ID NO: 619227 - DNA, 20 bp, Artificial Sequence
  chemically synthesized
ggcatatttttatacaacta

SEQ ID NO: 619228 - DNA, 20 bp, Artificial Sequence
  chemically synthesized
atgcatataaagcagaccca

SEQ ID NO: 619229 - DNA, 20 bp, Artificial Sequence
  chemically synthesized
tttaccccaaatcctcttgg

SEQ ID NO: 619230 - DNA, 20 bp, Artificial Sequence
  chemically synthesized
cagccttttactaactatcc

SEQ ID NO: 619231 - DNA, 20 bp, Artificial Sequence
  chemically synthesized
gtttgttctcagcctagttg

SEQ ID NO: 619232 - DNA, 20 bp, Artificial Sequence
  chemically synthesized
taaatgggaaataaaatgcc

SEQ ID NO: 619233 - DNA, 20 bp, Artificial Sequence
  chemically synthesized
taggcattttatttcccatt

SEQ ID NO: 619234 - DNA, 20 bp, Artificial Sequence
  chemically synthesized
cagattgtaaacctgaggca

SEQ ID NO: 619235 - DNA, 20 bp, Artificial Sequence
  chemically synthesized
aggcaactaatcctattgcc

SEQ ID NO: 619236 - DNA, 20 bp, Artificial Sequence
  chemically synthesized
ggtggtggaggcctataata

SEQ ID NO: 619237 - DNA, 20 bp, Artificial Sequence
  chemically synthesized
cacacacacacaagtatttc

SEQ ID NO: 619238 - DNA, 20 bp, Artificial Sequence
  chemically synthesized
tgcaagtaaggtaagttagg

SEQ ID NO: 619239 - DNA, 20 bp, Artificial Sequence
  chemically synthesized
ctgtttcctcactgccttag

SEQ ID NO: 619240 - DNA, 20 bp, Artificial Sequence
  chemically synthesized
tcttgaattacaaaatcaac

SEQ ID NO: 619241 - DNA, 20 bp, Artificial Sequence
  chemically synthesized
cctctgtcagtgaaatcaag

SEQ ID NO: 619242 - DNA, 20 bp, Artificial Sequence
  chemically synthesized
tgatttcactgacagaggtc

SEQ ID NO: 619243 - DNA, 20 bp, Artificial Sequence
  chemically synthesized
ctgcttttagtgtaagtgaa

SEQ ID NO: 619244 - DNA, 20 bp, Artificial Sequence
  chemically synthesized
tttaaacaggattcttctat

SEQ ID NO: 619245 - DNA, 20 bp, Artificial Sequence
  chemically synthesized
cataaacagatatagaagaa

SEQ ID NO: 619246 - DNA, 20 bp, Artificial Sequence
  chemically synthesized
gatatagaagaatcctgttt

SEQ ID NO: 619247 - DNA, 20 bp, Artificial Sequence
  chemically synthesized
gagcaggtaaaaacttttaa

SEQ ID NO: 619248 - DNA, 20 bp, Artificial Sequence
  chemically synthesized
ggaccctccccacaccccca

SEQ ID NO: 619249 - DNA, 20 bp, Artificial Sequence
  chemically synthesized
cagagcaaagggactgggca

SEQ ID NO: 619250 - DNA, 20 bp, Artificial Sequence
  chemically synthesized
acaggggtctgagcatctca

SEQ ID NO: 619251 - DNA, 20 bp, Artificial Sequence
  chemically synthesized
ctcaagcaccgacacatgtt

SEQ ID NO: 619252 - DNA, 20 bp, Artificial Sequence
  chemically synthesized
gataagcagctaacatgtgt

SEQ ID NO: 619253 - DNA, 20 bp, Artificial Sequence
  chemically synthesized
taccacacccttgaaagact

SEQ ID NO: 619254 - DNA, 20 bp, Artificial Sequence
  chemically synthesized
caggatttggggtgtctgtg

SEQ ID NO: 619255 - DNA, 20 bp, Artificial Sequence
  chemically synthesized
ttgaactgcctattctgcct

SEQ ID NO: 619256 - DNA, 20 bp, Artificial Sequence
  chemically synthesized
ttcatggcatcagggccaac

SEQ ID NO: 619257 - DNA, 20 bp, Artificial Sequence
  chemically synthesized
ggaataacacaggagtatta

SEQ ID NO: 619258 - DNA, 20 bp, Artificial Sequence
  chemically synthesized
ttaggactctagcctccact

SEQ ID NO: 619259 - DNA, 20 bp, Artificial Sequence
  chemically synthesized
tgaaaagtcactgaatttta

SEQ ID NO: 619260 - DNA, 20 bp, Artificial Sequence
  chemically synthesized
ttggttcctcttttaattta

SEQ ID NO: 619261 - DNA, 20 bp, Artificial Sequence
  chemically synthesized
tagtgcaaaggtgtagggcc

SEQ ID NO: 619262 - DNA, 20 bp, Artificial Sequence
  chemically synthesized
aatgtgctccccaaaataat

SEQ ID NO: 619263 - DNA, 20 bp, Artificial Sequence
  chemically synthesized
acaaaatactatagtccata

SEQ ID NO: 619264 - DNA, 20 bp, Artificial Sequence
  chemically synthesized
tgatagtattaatagttgtt

SEQ ID NO: 619265 - DNA, 20 bp, Artificial Sequence
  chemically synthesized
acatgtagaaataagaaaac

SEQ ID NO: 619266 - DNA, 20 bp, Artificial Sequence
  chemically synthesized
agagtccaaccactctaagc

SEQ ID NO: 619267 - DNA, 20 bp, Artificial Sequence
  chemically synthesized
tagagtggttggactctatc

SEQ ID NO: 619268 - DNA, 20 bp, Artificial Sequence
  chemically synthesized
ctgggggctcaaaattgttc

SEQ ID NO: 619269 - DNA, 20 bp, Artificial Sequence
  chemically synthesized
ctcctgattgtaaatatcaa

SEQ ID NO: 619270 - DNA, 20 bp, Artificial Sequence
  chemically synthesized
tatatggacaagtataggaa

SEQ ID NO: 619271 - DNA, 20 bp, Artificial Sequence
  chemically synthesized
ctatttggtgctcaataact

SEQ ID NO: 619272 - DNA, 20 bp, Artificial Sequence
  chemically synthesized
cttccgggcactaaataaat

SEQ ID NO: 619273 - DNA, 20 bp, Artificial Sequence
  chemically synthesized
tattaaaattccctcctcaa

SEQ ID NO: 619274 - DNA, 20 bp, Artificial Sequence
  chemically synthesized
catctacaaattgctagaca

SEQ ID NO: 619275 - DNA, 20 bp, Artificial Sequence
  chemically synthesized
ctgagatttttatgcacttt

SEQ ID NO: 619276 - DNA, 20 bp, Artificial Sequence
  chemically synthesized
atatgtaatgtggattaaca

SEQ ID NO: 619277 - DNA, 20 bp, Artificial Sequence
  chemically synthesized
ctccatttcctcatatgtaa

SEQ ID NO: 619278 - DNA, 20 bp, Artificial Sequence
  chemically synthesized
atgaggaaatggagagagaa

SEQ ID NO: 619279 - DNA, 20 bp, Artificial Sequence
  chemically synthesized
ggccatagtccatataattt

SEQ ID NO: 619280 - DNA, 20 bp, Artificial Sequence
  chemically synthesized
gaagtatgttcatgtgttta

SEQ ID NO: 619281 - DNA, 20 bp, Artificial Sequence
  chemically synthesized
tgtgaaaatgaagtatgttc

SEQ ID NO: 619282 - DNA, 20 bp, Artificial Sequence
  chemically synthesized
cctattgtatggataggaaa

SEQ ID NO: 619283 - DNA, 20 bp, Artificial Sequence
  chemically synthesized
agttacttaacctcgctaag

SEQ ID NO: 619284 - DNA, 20 bp, Artificial Sequence
  chemically synthesized
tgggcagttacttaacctcg

SEQ ID NO: 619285 - DNA, 20 bp, Artificial Sequence
  chemically synthesized
agatgagcacaaattgaaac

SEQ ID NO: 619286 - DNA, 20 bp, Artificial Sequence
  chemically synthesized
aataatggagttagagaagc

SEQ ID NO: 619287 - DNA, 20 bp, Artificial Sequence
  chemically synthesized
tcctttgtcagcaacacgat

SEQ ID NO: 619288 - DNA, 20 bp, Artificial Sequence
  chemically synthesized
agatagtattattatgtggc

SEQ ID NO: 619289 - DNA, 20 bp, Artificial Sequence
  chemically synthesized
aagggaacattactgatgta

SEQ ID NO: 619290 - DNA, 20 bp, Artificial Sequence
  chemically synthesized
ttttattttcataaataaaa

SEQ ID NO: 619291 - DNA, 20 bp, Artificial Sequence
  chemically synthesized
atgaaaataaaaatgaatat

SEQ ID NO: 619292 - DNA, 20 bp, Artificial Sequence
  chemically synthesized
gattgtattttcattcttcc

SEQ ID NO: 619293 - DNA, 20 bp, Artificial Sequence
  chemically synthesized
gtcaaagagaagggaggcac

SEQ ID NO: 619294 - DNA, 20 bp, Artificial Sequence
  chemically synthesized
ttgccatatttaaatgtgtg

SEQ ID NO: 619295 - DNA, 20 bp, Artificial Sequence
  chemically synthesized
gtccatcatttgcagggctg

SEQ ID NO: 619296 - DNA, 20 bp, Artificial Sequence
  chemically synthesized
tgcaaatgatggactataaa

SEQ ID NO: 619297 - DNA, 20 bp, Artificial Sequence
  chemically synthesized
ataaaatttgtttgtactac

SEQ ID NO: 619298 - DNA, 20 bp, Artificial Sequence
  chemically synthesized
tactggcgatttttttttaa

SEQ ID NO: 619299 - DNA, 20 bp, Artificial Sequence
  chemically synthesized
aaatatgaaagtaggtgtgc

SEQ ID NO: 619300 - DNA, 20 bp, Artificial Sequence
  chemically synthesized
agataaagatctgttttaat

SEQ ID NO: 619301 - DNA, 20 bp, Artificial Sequence
  chemically synthesized
agattttttaaaagataaag

SEQ ID NO: 619302 - DNA, 20 bp, Artificial Sequence
  chemically synthesized
tcatttgtttccttttggaa

SEQ ID NO: 619303 - DNA, 20 bp, Artificial Sequence
  chemically synthesized
taataagacaaaaataattc

SEQ ID NO: 619304 - DNA, 20 bp, Artificial Sequence
  chemically synthesized
tttttgtcttattattacca

SEQ ID NO: 619305 - DNA, 20 bp, Artificial Sequence
  chemically synthesized
gaatgataatgatttcaggt

SEQ ID NO: 619306 - DNA, 20 bp, Artificial Sequence
  chemically synthesized
tgttttaaagatttgaatga

SEQ ID NO: 619307 - DNA, 20 bp, Artificial Sequence
  chemically synthesized
aacatttaagtgccttgttt

SEQ ID NO: 619308 - DNA, 20 bp, Artificial Sequence
  chemically synthesized
atctttaaaacaaggcactt

SEQ ID NO: 619309 - DNA, 20 bp, Artificial Sequence
  chemically synthesized
aaagattaaacatttaagtg

SEQ ID NO: 619310 - DNA, 20 bp, Artificial Sequence
  chemically synthesized
tgcattggctaagtttttaa

SEQ ID NO: 619311 - DNA, 20 bp, Artificial Sequence
  chemically synthesized
ggaaagcagttttgcattgg

SEQ ID NO: 619312 - DNA, 20 bp, Artificial Sequence
  chemically synthesized
taaaaacttagccaatgcaa

SEQ ID NO: 619313 - DNA, 20 bp, Artificial Sequence
  chemically synthesized
ctgagggcgttttggaggaa

SEQ ID NO: 619314 - DNA, 20 bp, Artificial Sequence
  chemically synthesized
ggagaagcaggtaattctga

SEQ ID NO: 619315 - DNA, 20 bp, Artificial Sequence
  chemically synthesized
tccaaaacgccctcagaatt

SEQ ID NO: 619316 - DNA, 20 bp, Artificial Sequence
  chemically synthesized
aatgaaattcacagagaatt

SEQ ID NO: 619317 - DNA, 20 bp, Artificial Sequence
  chemically synthesized
ggcattttgatgaagcgatg

SEQ ID NO: 619318 - DNA, 20 bp, Artificial Sequence
  chemically synthesized
tttgatgaagcgatgtaggg

SEQ ID NO: 619319 - DNA, 20 bp, Artificial Sequence
  chemically synthesized
ctatttaaaactaatcccta

SEQ ID NO: 619320 - DNA, 20 bp, Artificial Sequence
  chemically synthesized
gattagttttaaatagggat

SEQ ID NO: 619321 - DNA, 20 bp, Artificial Sequence
  chemically synthesized
caaatcacttttggaagaaa

SEQ ID NO: 619322 - DNA, 20 bp, Artificial Sequence
  chemically synthesized
gtaaacttactttcttccaa

SEQ ID NO: 619323 - DNA, 20 bp, Artificial Sequence
  chemically synthesized
tcttagcttccattgatctt

SEQ ID NO: 619324 - DNA, 20 bp, Artificial Sequence
  chemically synthesized
caatggaagctaagaattag

SEQ ID NO: 619325 - DNA, 20 bp, Artificial Sequence
  chemically synthesized
ttgtataagcatttctaatt

SEQ ID NO: 619326 - DNA, 20 bp, Artificial Sequence
  chemically synthesized
gcatatatacagttaggttt

SEQ ID NO: 619327 - DNA, 20 bp, Artificial Sequence
  chemically synthesized
tattatatgcatatatacag

SEQ ID NO: 619328 - DNA, 20 bp, Artificial Sequence
  chemically synthesized
ttgaattattctaaagaatt

SEQ ID NO: 619329 - DNA, 20 bp, Artificial Sequence
  chemically synthesized
tataattatggatacagaca

SEQ ID NO: 619330 - DNA, 20 bp, Artificial Sequence
  chemically synthesized
agacacatagattcacattg

SEQ ID NO: 619331 - DNA, 20 bp, Artificial Sequence
  chemically synthesized
gattcacattgtaatgttta

SEQ ID NO: 619332 - DNA, 20 bp, Artificial Sequence
  chemically synthesized
ttgtaatgtttattcagatt

SEQ ID NO: 619333 - DNA, 20 bp, Artificial Sequence
  chemically synthesized
attcagattttgtgtttatt

SEQ ID NO: 619334 - DNA, 20 bp, Artificial Sequence
  chemically synthesized
ctgttgacaccaaatgcagt

SEQ ID NO: 619335 - DNA, 20 bp, Artificial Sequence
  chemically synthesized
atgcaactgttgacaccaaa

SEQ ID NO: 619336 - DNA, 20 bp, Artificial Sequence
  chemically synthesized
gactacgtaaggctctatgg

SEQ ID NO: 619337 - DNA, 20 bp, Artificial Sequence
  chemically synthesized
ctgtgctataaatttgtgac

SEQ ID NO: 619338 - DNA, 20 bp, Artificial Sequence
  chemically synthesized
cagcagacctttacactgaa

SEQ ID NO: 619339 - DNA, 20 bp, Artificial Sequence
  chemically synthesized
cgcctcggcctcccaaagtg

SEQ ID NO: 619340 - DNA, 20 bp, Artificial Sequence
  chemically synthesized
ttcttgtatttttagtagag

SEQ ID NO: 619341 - DNA, 20 bp, Artificial Sequence
  chemically synthesized
cgggaggctgagggcaggag

SEQ ID NO: 619342 - DNA, 20 bp, Artificial Sequence
  chemically synthesized
aacctccacctcccgggttc

SEQ ID NO: 619343 - DNA, 20 bp, Artificial Sequence
  chemically synthesized
taccagttctcattcatttt

SEQ ID NO: 619344 - DNA, 20 bp, Artificial Sequence
  chemically synthesized
gtggtaattactttccctgc

SEQ ID NO: 619345 - DNA, 20 bp, Artificial Sequence
  chemically synthesized
ttcttgcggtgccccctttc

SEQ ID NO: 619346 - DNA, 20 bp, Artificial Sequence
  chemically synthesized
caccgcaagaaaagtattgc

SEQ ID NO: 619347 - DNA, 20 bp, Artificial Sequence
  chemically synthesized
taggatgtgatatctggcag

SEQ ID NO: 619348 - DNA, 20 bp, Artificial Sequence
  chemically synthesized
gcagtggtgattccaatcat

SEQ ID NO: 619349 - DNA, 20 bp, Artificial Sequence
  chemically synthesized
tgagatacagttttaatccc

SEQ ID NO: 619350 - DNA, 20 bp, Artificial Sequence
  chemically synthesized
agaaagagcacaagttgaga

SEQ ID NO: 619351 - DNA, 20 bp, Artificial Sequence
  chemically synthesized
atctcaacttgtgctctttc

SEQ ID NO: 619352 - DNA, 20 bp, Artificial Sequence
  chemically synthesized
tgagtccatatagatatcat

SEQ ID NO: 619353 - DNA, 20 bp, Artificial Sequence
  chemically synthesized
catttggcagacttgacaca

SEQ ID NO: 619354 - DNA, 20 bp, Artificial Sequence
  chemically synthesized
gtagacaatgcctacatatt

SEQ ID NO: 619355 - DNA, 20 bp, Artificial Sequence
  chemically synthesized
agagtcctttctacagttcc

SEQ ID NO: 619356 - DNA, 20 bp, Artificial Sequence
  chemically synthesized
cctttctacagttcccaagg

SEQ ID NO: 619357 - DNA, 20 bp, Artificial Sequence
  chemically synthesized
cccaaggatttgtttggttg

SEQ ID NO: 619358 - DNA, 20 bp, Artificial Sequence
  chemically synthesized
gtttggagctccattttcag

SEQ ID NO: 619359 - DNA, 20 bp, Artificial Sequence
  chemically synthesized
aaaatggagctccaaactta

SEQ ID NO: 619360 - DNA, 20 bp, Artificial Sequence
  chemically synthesized
attccaggatgaaaatcgtg

SEQ ID NO: 619361 - DNA, 20 bp, Artificial Sequence
  chemically synthesized
attttcatcctggaatgtat

SEQ ID NO: 619362 - DNA, 20 bp, Artificial Sequence
  chemically synthesized
actttttacctgaaatttat

SEQ ID NO: 619363 - DNA, 20 bp, Artificial Sequence
  chemically synthesized
agactgtatatttccccagt

SEQ ID NO: 619364 - DNA, 20 bp, Artificial Sequence
  chemically synthesized
acctacagtattaatggcag

SEQ ID NO: 619365 - DNA, 20 bp, Artificial Sequence
  chemically synthesized
cagtattaatggcagaaatg

SEQ ID NO: 619366 - DNA, 20 bp, Artificial Sequence
  chemically synthesized
taatattgtctctcttttcc

SEQ ID NO: 619367 - DNA, 20 bp, Artificial Sequence
  chemically synthesized
cacctatctctcatttttta

SEQ ID NO: 619368 - DNA, 20 bp, Artificial Sequence
  chemically synthesized
aaaaatgagagataggtggg

SEQ ID NO: 619369 - DNA, 20 bp, Artificial Sequence
  chemically synthesized
aaaaaaaaaggcagtctatg

SEQ ID NO: 619370 - DNA, 20 bp, Artificial Sequence
  chemically synthesized
agggaggtggcctaatttag

SEQ ID NO: 619371 - DNA, 20 bp, Artificial Sequence
  chemically synthesized
ttggtactattccatagtgg

SEQ ID NO: 619372 - DNA, 20 bp, Artificial Sequence
  chemically synthesized
atagattatgagtgggtaat

SEQ ID NO: 619373 - DNA, 20 bp, Artificial Sequence
  chemically synthesized
tatatattaattttcaaaaa

SEQ ID NO: 619374 - DNA, 20 bp, Artificial Sequence
  chemically synthesized
atccaagttcatgttgaccc

SEQ ID NO: 619375 - DNA, 20 bp, Artificial Sequence
  chemically synthesized
taaagaaaaaatgagaagtg

SEQ ID NO: 619376 - DNA, 20 bp, Artificial Sequence
  chemically synthesized
ttggttaaagaaaaaatgag

SEQ ID NO: 619377 - DNA, 20 bp, Artificial Sequence
  chemically synthesized
agaaaagaccacttttaaat

SEQ ID NO: 619378 - DNA, 20 bp, Artificial Sequence
  chemically synthesized
atttactttttcttacatga

SEQ ID NO: 619379 - DNA, 20 bp, Artificial Sequence
  chemically synthesized
ctttttcttacatgaattgg

SEQ ID NO: 619380 - DNA, 20 bp, Artificial Sequence
  chemically synthesized
ttttctacagttttttttgg

SEQ ID NO: 619381 - DNA, 20 bp, Artificial Sequence
  chemically synthesized
aataaatattcactcttttc

SEQ ID NO: 619382 - DNA, 20 bp, Artificial Sequence
  chemically synthesized
gagtgaatatttattctatt

SEQ ID NO: 619383 - DNA, 20 bp, Artificial Sequence
  chemically synthesized
tttattctattggatgtttg

SEQ ID NO: 619384 - DNA, 20 bp, Artificial Sequence
  chemically synthesized
attgaggccaactttgatca

SEQ ID NO: 619385 - DNA, 20 bp, Artificial Sequence
  chemically synthesized
ataataagttctctatgctg

SEQ ID NO: 619386 - DNA, 20 bp, Artificial Sequence
  chemically synthesized
agcccaccctcaccactacc

SEQ ID NO: 619387 - DNA, 20 bp, Artificial Sequence
  chemically synthesized
tagtggtgagggtgggctag

SEQ ID NO: 619388 - DNA, 20 bp, Artificial Sequence
  chemically synthesized
ggtgggctagaaatgattaa

SEQ ID NO: 619389 - DNA, 20 bp, Artificial Sequence
  chemically synthesized
gcttctttttttaaaaaaaa

SEQ ID NO: 619390 - DNA, 20 bp, Artificial Sequence
  chemically synthesized
tgcattttttccagcggtat

SEQ ID NO: 619391 - DNA, 20 bp, Artificial Sequence
  chemically synthesized
gaaatattctgaacgtgtgt

SEQ ID NO: 619392 - DNA, 20 bp, Artificial Sequence
  chemically synthesized
tgtacttgattttccttcat

SEQ ID NO: 619393 - DNA, 20 bp, Artificial Sequence
  chemically synthesized
ctctgctcaaagaggctaga

SEQ ID NO: 619394 - DNA, 20 bp, Artificial Sequence
  chemically synthesized
tgatctctgctcaaagaggc

SEQ ID NO: 619395 - DNA, 20 bp, Artificial Sequence
  chemically synthesized
caagggcaacagcagagcct

SEQ ID NO: 619396 - DNA, 20 bp, Artificial Sequence
  chemically synthesized
caacctctagccttcaaggg

SEQ ID NO: 619397 - DNA, 20 bp, Artificial Sequence
  chemically synthesized
ggctgaagtgccttgtgatg

SEQ ID NO: 619398 - DNA, 20 bp, Artificial Sequence
  chemically synthesized
cttcagcccatagcccatga

SEQ ID NO: 619399 - DNA, 20 bp, Artificial Sequence
  chemically synthesized
agcccatagcccatgacaaa

SEQ ID NO: 619400 - DNA, 20 bp, Artificial Sequence
  chemically synthesized
ttaacacttttccattctaa

SEQ ID NO: 619401 - DNA, 20 bp, Artificial Sequence
  chemically synthesized
tatagctgtgtcttgttttt

SEQ ID NO: 619402 - DNA, 20 bp, Artificial Sequence
  chemically synthesized
cctctttccttatagctgtg

SEQ ID NO: 619403 - DNA, 20 bp, Artificial Sequence
  chemically synthesized
gtgttcataacaagataaaa

SEQ ID NO: 619404 - DNA, 20 bp, Artificial Sequence
  chemically synthesized
tcataattttcttcttgctc

SEQ ID NO: 619405 - DNA, 20 bp, Artificial Sequence
  chemically synthesized
ttgcttttggcttttggatt

SEQ ID NO: 619406 - DNA, 20 bp, Artificial Sequence
  chemically synthesized
caagtttattgcttttggct

SEQ ID NO: 619407 - DNA, 20 bp, Artificial Sequence
  chemically synthesized
atttaaacaagtttattgct

SEQ ID NO: 619408 - DNA, 20 bp, Artificial Sequence
  chemically synthesized
ccaaaagccaaaagcaataa

SEQ ID NO: 619409 - DNA, 20 bp, Artificial Sequence
  chemically synthesized
cttcagtatttaaacaagtt

SEQ ID NO: 619410 - DNA, 20 bp, Artificial Sequence
  chemically synthesized
atgtgaacttcagtatttaa

SEQ ID NO: 619411 - DNA, 20 bp, Artificial Sequence
  chemically synthesized
tactgaagttcacatggtgc

SEQ ID NO: 619412 - DNA, 20 bp, Artificial Sequence
  chemically synthesized
cattatgggtgtaaagtgta

SEQ ID NO: 619413 - DNA, 20 bp, Artificial Sequence
  chemically synthesized
ttaaatatttaactgctcac

SEQ ID NO: 619414 - DNA, 20 bp, Artificial Sequence
  chemically synthesized
tgctaaaaaagtgtgtgtta

SEQ ID NO: 619415 - DNA, 20 bp, Artificial Sequence
  chemically synthesized
actccagcctgggcgataga

SEQ ID NO: 619416 - DNA, 20 bp, Artificial Sequence
  chemically synthesized
ctatcgcccaggctggagtg

SEQ ID NO: 619417 - DNA, 20 bp, Artificial Sequence
  chemically synthesized
gaggaggaggttgcagtgag

SEQ ID NO: 619418 - DNA, 20 bp, Artificial Sequence
  chemically synthesized
aacctcctcctcctgggtcc

SEQ ID NO: 619419 - DNA, 20 bp, Artificial Sequence
  chemically synthesized
ttaggaggctgaggcagaag

SEQ ID NO: 619420 - DNA, 20 bp, Artificial Sequence
  chemically synthesized
tgcctcagcctcctaagtag

SEQ ID NO: 619421 - DNA, 20 bp, Artificial Sequence
  chemically synthesized
tgttgtatttttagtagaga

SEQ ID NO: 619422 - DNA, 20 bp, Artificial Sequence
  chemically synthesized
ccagtggatcacttgaagac

SEQ ID NO: 619423 - DNA, 20 bp, Artificial Sequence
  chemically synthesized
ggcctctaactcccgaagtg

SEQ ID NO: 619424 - DNA, 20 bp, Artificial Sequence
  chemically synthesized
tttttagaccacaggtaaat

SEQ ID NO: 619425 - DNA, 20 bp, Artificial Sequence
  chemically synthesized
aggtaaatgttagttttact

SEQ ID NO: 619426 - DNA, 20 bp, Artificial Sequence
  chemically synthesized
cgatctcaactcactgcaac

SEQ ID NO: 619427 - DNA, 20 bp, Artificial Sequence
  chemically synthesized
ttgggaggctgaggcaggag

SEQ ID NO: 619428 - DNA, 20 bp, Artificial Sequence
  chemically synthesized
ttttgtatttttagtagaga

SEQ ID NO: 619429 - DNA, 20 bp, Artificial Sequence
  chemically synthesized
cgcctcggcctcccaaagtg

SEQ ID NO: 619430 - DNA, 20 bp, Artificial Sequence
  chemically synthesized
cattatagtcacatagatac

SEQ ID NO: 619431 - DNA, 20 bp, Artificial Sequence
  chemically synthesized
aatatacatttcagaaaagt

SEQ ID NO: 619432 - DNA, 20 bp, Artificial Sequence
  chemically synthesized
tattaagatttatttcctct

SEQ ID NO: 619433 - DNA, 20 bp, Artificial Sequence
  chemically synthesized
gaggaaataaatcttaatag

SEQ ID NO: 619434 - DNA, 20 bp, Artificial Sequence
  chemically synthesized
tgctgtaaaaatcatttcta

SEQ ID NO: 619435 - DNA, 20 bp, Artificial Sequence
  chemically synthesized
agcatttcgaacacaagaat

SEQ ID NO: 619436 - DNA, 20 bp, Artificial Sequence
  chemically synthesized
ctttaaagctataagtaaac

SEQ ID NO: 619437 - DNA, 20 bp, Artificial Sequence
  chemically synthesized
tttggaaacattggtttact

SEQ ID NO: 619438 - DNA, 20 bp, Artificial Sequence
  chemically synthesized
taagtaaaccaatgtttcca

SEQ ID NO: 619439 - DNA, 20 bp, Artificial Sequence
  chemically synthesized
agaaaaaacagtttggaaac

SEQ ID NO: 619440 - DNA, 20 bp, Artificial Sequence
  chemically synthesized
ggaaattttgctctagaaaa

SEQ ID NO: 619441 - DNA, 20 bp, Artificial Sequence
  chemically synthesized
aaccaaaataatcttgaaat

SEQ ID NO: 619442 - DNA, 20 bp, Artificial Sequence
  chemically synthesized
gctttgtttaatctaaaatt

SEQ ID NO: 619443 - DNA, 20 bp, Artificial Sequence
  chemically synthesized
ttttagattaaacaaagcaa

SEQ ID NO: 619444 - DNA, 20 bp, Artificial Sequence
  chemically synthesized
aggtgatttaatctgttttg

SEQ ID NO: 619445 - DNA, 20 bp, Artificial Sequence
  chemically synthesized
cttggaggtgatttaatctg

SEQ ID NO: 619446 - DNA, 20 bp, Artificial Sequence
  chemically synthesized
agaaacttggaggtgattta

SEQ ID NO: 619447 - DNA, 20 bp, Artificial Sequence
  chemically synthesized
caaaacagattaaatcacct

SEQ ID NO: 619448 - DNA, 20 bp, Artificial Sequence
  chemically synthesized
gaagattctgagaaacttgg

SEQ ID NO: 619449 - DNA, 20 bp, Artificial Sequence
  chemically synthesized
attaacagccatttgtatgt

SEQ ID NO: 619450 - DNA, 20 bp, Artificial Sequence
  chemically synthesized
atatctcaaaaaggaataaa

SEQ ID NO: 619451 - DNA, 20 bp, Artificial Sequence
  chemically synthesized
ttctcgtatatatttggaaa

SEQ ID NO: 619452 - DNA, 20 bp, Artificial Sequence
  chemically synthesized
ttagctattgatgccaagct

SEQ ID NO: 619453 - DNA, 20 bp, Artificial Sequence
  chemically synthesized
tttaaactatatgagaaaca

SEQ ID NO: 619454 - DNA, 20 bp, Artificial Sequence
  chemically synthesized
gccaagctcagtgtttctca

SEQ ID NO: 619455 - DNA, 20 bp, Artificial Sequence
  chemically synthesized
ggaacagcaaatttacttcc

SEQ ID NO: 619456 - DNA, 20 bp, Artificial Sequence
  chemically synthesized
aatgtttccatattatcagg

SEQ ID NO: 619457 - DNA, 20 bp, Artificial Sequence
  chemically synthesized
ttgttattagttagttgaat

SEQ ID NO: 619458 - DNA, 20 bp, Artificial Sequence
  chemically synthesized
tgaatcagttttaatttgtt

SEQ ID NO: 619459 - DNA, 20 bp, Artificial Sequence
  chemically synthesized
caaaacaggcaacaaattaa

SEQ ID NO: 619460 - DNA, 20 bp, Artificial Sequence
  chemically synthesized
tcccttgaattcccctttga

SEQ ID NO: 619461 - DNA, 20 bp, Artificial Sequence
  chemically synthesized
agaaagaaaaagaagctaga

SEQ ID NO: 619462 - DNA, 20 bp, Artificial Sequence
  chemically synthesized
ttctaacttagcaatcttgt

SEQ ID NO: 619463 - DNA, 20 bp, Artificial Sequence
  chemically synthesized
gattgctaagttagaaacaa

SEQ ID NO: 619464 - DNA, 20 bp, Artificial Sequence
  chemically synthesized
cactttttgatgttaatctg

SEQ ID NO: 619465 - DNA, 20 bp, Artificial Sequence
  chemically synthesized
tattgcactttttgatgtta

SEQ ID NO: 619466 - DNA, 20 bp, Artificial Sequence
  chemically synthesized
gtatttactattgattaggg

SEQ ID NO: 619467 - DNA, 20 bp, Artificial Sequence
  chemically synthesized
ctatagtatttactattgat

SEQ ID NO: 619468 - DNA, 20 bp, Artificial Sequence
  chemically synthesized
agtcaccctatagtatttac

SEQ ID NO: 619469 - DNA, 20 bp, Artificial Sequence
  chemically synthesized
tttaaataactaagagtata

SEQ ID NO: 619470 - DNA, 20 bp, Artificial Sequence
  chemically synthesized
aataactaagagtataactg

SEQ ID NO: 619471 - DNA, 20 bp, Artificial Sequence
  chemically synthesized
ttgtttgtaacacaaaggat

SEQ ID NO: 619472 - DNA, 20 bp, Artificial Sequence
  chemically synthesized
tgtctgtatcaaaatatctc

SEQ ID NO: 619473 - DNA, 20 bp, Artificial Sequence
  chemically synthesized
gtctaaaagatctaccgaca

SEQ ID NO: 619474 - DNA, 20 bp, Artificial Sequence
  chemically synthesized
cttgttcttttgccttattt

SEQ ID NO: 619475 - DNA, 20 bp, Artificial Sequence
  chemically synthesized
tttgccttatttccaagttt

SEQ ID NO: 619476 - DNA, 20 bp, Artificial Sequence
  chemically synthesized
tttccaagttttagagttta

SEQ ID NO: 619477 - DNA, 20 bp, Artificial Sequence
  chemically synthesized
aatgagtaattatgacacat

SEQ ID NO: 619478 - DNA, 20 bp, Artificial Sequence
  chemically synthesized
gataaatgcccatacttttt

SEQ ID NO: 619479 - DNA, 20 bp, Artificial Sequence
  chemically synthesized
catgtcattatccctcatta

SEQ ID NO: 619480 - DNA, 20 bp, Artificial Sequence
  chemically synthesized
catcaaaccactttgcaatt

SEQ ID NO: 619481 - DNA, 20 bp, Artificial Sequence
  chemically synthesized
atgtaaacaggaaattgcaa

SEQ ID NO: 619482 - DNA, 20 bp, Artificial Sequence
  chemically synthesized
ccgcgcccggcccacagtaa

SEQ ID NO: 619483 - DNA, 20 bp, Artificial Sequence
  chemically synthesized
cgcctcagcctcccaaagtt

SEQ ID NO: 619484 - DNA, 20 bp, Artificial Sequence
  chemically synthesized
ttgtatttttttagtagaga

SEQ ID NO: 619485 - DNA, 20 bp, Artificial Sequence
  chemically synthesized
tcgggaggctgagacagaag

SEQ ID NO: 619486 - DNA, 20 bp, Artificial Sequence
  chemically synthesized
aacctccgcctcccgagttc

SEQ ID NO: 619487 - DNA, 20 bp, Artificial Sequence
  chemically synthesized
cagtaactatttttttttct

SEQ ID NO: 619488 - DNA, 20 bp, Artificial Sequence
  chemically synthesized
caactttttacccagctaac

SEQ ID NO: 619489 - DNA, 20 bp, Artificial Sequence
  chemically synthesized
catgtcatacaagtcactat

SEQ ID NO: 619490 - DNA, 20 bp, Artificial Sequence
  chemically synthesized
ctagaatagtgacttgtatg

SEQ ID NO: 619491 - DNA, 20 bp, Artificial Sequence
  chemically synthesized
agtgcagaggccaattaatg

SEQ ID NO: 619492 - DNA, 20 bp, Artificial Sequence
  chemically synthesized
tggtagagcatcttatagaa

SEQ ID NO: 619493 - DNA, 20 bp, Artificial Sequence
  chemically synthesized
ctttcccaattgttatcaaa

SEQ ID NO: 619494 - DNA, 20 bp, Artificial Sequence
  chemically synthesized
tttttgataacaattgggaa

SEQ ID NO: 619495 - DNA, 20 bp, Artificial Sequence
  chemically synthesized
caattgggaaagtggatttg

SEQ ID NO: 619496 - DNA, 20 bp, Artificial Sequence
  chemically synthesized
cctgagtgattacaatagcc

SEQ ID NO: 619497 - DNA, 20 bp, Artificial Sequence
  chemically synthesized
tttataccaccttttcacct

SEQ ID NO: 619498 - DNA, 20 bp, Artificial Sequence
  chemically synthesized
tctgtttccatggctgttac

SEQ ID NO: 619499 - DNA, 20 bp, Artificial Sequence
  chemically synthesized
acaattaactgatgtgatca

SEQ ID NO: 619500 - DNA, 20 bp, Artificial Sequence
  chemically synthesized
aaatattagttgattggatt

SEQ ID NO: 619501 - DNA, 20 bp, Artificial Sequence
  chemically synthesized
cacgtttgaaatattagttg

SEQ ID NO: 619502 - DNA, 20 bp, Artificial Sequence
  chemically synthesized
ttttgcacgtttgaaatatt

SEQ ID NO: 619503 - DNA, 20 bp, Artificial Sequence
  chemically synthesized
taatatttcaaacgtgcaaa

SEQ ID NO: 619504 - DNA, 20 bp, Artificial Sequence
  chemically synthesized
acccctgccaaacatatttt

SEQ ID NO: 619505 - DNA, 20 bp, Artificial Sequence
  chemically synthesized
acgtgcaaaatatgtttggc

SEQ ID NO: 619506 - DNA, 20 bp, Artificial Sequence
  chemically synthesized
gtttggcaggggtttattac

SEQ ID NO: 619507 - DNA, 20 bp, Artificial Sequence
  chemically synthesized
atatgcctatatatatattc

SEQ ID NO: 619508 - DNA, 20 bp, Artificial Sequence
  chemically synthesized
attttgcaaatcatttaaca

SEQ ID NO: 619509 - DNA, 20 bp, Artificial Sequence
  chemically synthesized
ttaaatgaaaactaattgtt

SEQ ID NO: 619510 - DNA, 20 bp, Artificial Sequence
  chemically synthesized
acaattagttttcatttaaa

SEQ ID NO: 619511 - DNA, 20 bp, Artificial Sequence
  chemically synthesized
cattcaagaataaatttgtc

SEQ ID NO: 619512 - DNA, 20 bp, Artificial Sequence
  chemically synthesized
ttttcatggtcctcgatgct

SEQ ID NO: 619513 - DNA, 20 bp, Artificial Sequence
  chemically synthesized
agcatcgaggaccatgaaaa

SEQ ID NO: 619514 - DNA, 20 bp, Artificial Sequence
  chemically synthesized
aataactagttgacttaatt

SEQ ID NO: 619515 - DNA, 20 bp, Artificial Sequence
  chemically synthesized
tttattttgaagaaaccgca

SEQ ID NO: 619516 - DNA, 20 bp, Artificial Sequence
  chemically synthesized
cttccccctagaaaaccttc

SEQ ID NO: 619517 - DNA, 20 bp, Artificial Sequence
  chemically synthesized
ggggaagatgacacaatcga

SEQ ID NO: 619518 - DNA, 20 bp, Artificial Sequence
  chemically synthesized
cagaatgttttaaaaagcat

SEQ ID NO: 619519 - DNA, 20 bp, Artificial Sequence
  chemically synthesized
cagttttccacatgcagcca

SEQ ID NO: 619520 - DNA, 20 bp, Artificial Sequence
  chemically synthesized
aatttcccccacccctgtga

SEQ ID NO: 619521 - DNA, 20 bp, Artificial Sequence
  chemically synthesized
atgttcaatttcccccaccc

SEQ ID NO: 619522 - DNA, 20 bp, Artificial Sequence
  chemically synthesized
aggggtgggggaaattgaac

SEQ ID NO: 619523 - DNA, 20 bp, Artificial Sequence
  chemically synthesized
gcatcagccatcatgttttg

SEQ ID NO: 619524 - DNA, 20 bp, Artificial Sequence
  chemically synthesized
cattaccttggcatcagcca

SEQ ID NO: 619525 - DNA, 20 bp, Artificial Sequence
  chemically synthesized
gaatgatacccccaaacctg

SEQ ID NO: 619526 - DNA, 20 bp, Artificial Sequence
  chemically synthesized
gacatcatgtgccaaacttc

SEQ ID NO: 619527 - DNA, 20 bp, Artificial Sequence
  chemically synthesized
tgagctagagaaggaggaag

SEQ ID NO: 619528 - DNA, 20 bp, Artificial Sequence
  chemically synthesized
ggaggaagaattgcttagaa

SEQ ID NO: 619529 - DNA, 20 bp, Artificial Sequence
  chemically synthesized
gcagtttttgatctcatata

SEQ ID NO: 619530 - DNA, 20 bp, Artificial Sequence
  chemically synthesized
gataggtctctagctcaaaa

SEQ ID NO: 619531 - DNA, 20 bp, Artificial Sequence
  chemically synthesized
aacaactcttaaccatgacc

SEQ ID NO: 619532 - DNA, 20 bp, Artificial Sequence
  chemically synthesized
tggttaagagttgttattgc

SEQ ID NO: 619533 - DNA, 20 bp, Artificial Sequence
  chemically synthesized
tgatgagatcaagaaaaata

SEQ ID NO: 619534 - DNA, 20 bp, Artificial Sequence
  chemically synthesized
aaaaatatgttgattgagca

SEQ ID NO: 619535 - DNA, 20 bp, Artificial Sequence
  chemically synthesized
agattgaagctcaacgttaa

SEQ ID NO: 619536 - DNA, 20 bp, Artificial Sequence
  chemically synthesized
atcgtaaatctcttttaacg

SEQ ID NO: 619537 - DNA, 20 bp, Artificial Sequence
  chemically synthesized
cttctaagatattccactat

SEQ ID NO: 619538 - DNA, 20 bp, Artificial Sequence
  chemically synthesized
tatcttagaagccagggaag

SEQ ID NO: 619539 - DNA, 20 bp, Artificial Sequence
  chemically synthesized
tattggaaaaactcttcttc

SEQ ID NO: 619540 - DNA, 20 bp, Artificial Sequence
  chemically synthesized
ctcatcttaccactctgtag

SEQ ID NO: 619541 - DNA, 20 bp, Artificial Sequence
  chemically synthesized
cttccacatccttcaactga

SEQ ID NO: 619542 - DNA, 20 bp, Artificial Sequence
  chemically synthesized
agttgaaggatgtggaagca

SEQ ID NO: 619543 - DNA, 20 bp, Artificial Sequence
  chemically synthesized
tgtggaagcagccggattat

SEQ ID NO: 619544 - DNA, 20 bp, Artificial Sequence
  chemically synthesized
acctcaaacaccaataatcc

SEQ ID NO: 619545 - DNA, 20 bp, Artificial Sequence
  chemically synthesized
atgagcatagaaattgttaa

SEQ ID NO: 619546 - DNA, 20 bp, Artificial Sequence
  chemically synthesized
catagaaattgttaaagaag

SEQ ID NO: 619547 - DNA, 20 bp, Artificial Sequence
  chemically synthesized
gtggaaaataacaagtcggt

SEQ ID NO: 619548 - DNA, 20 bp, Artificial Sequence
  chemically synthesized
aacaaataggacattctgct

SEQ ID NO: 619549 - DNA, 20 bp, Artificial Sequence
  chemically synthesized
cttgcgttcaggcatttgtg

SEQ ID NO: 619550 - DNA, 20 bp, Artificial Sequence
  chemically synthesized
gaacgcaagaaaaaaaatta

SEQ ID NO: 619551 - DNA, 20 bp, Artificial Sequence
  chemically synthesized
cccaattgattgccaaaata

SEQ ID NO: 619552 - DNA, 20 bp, Artificial Sequence
  chemically synthesized
agaaaatatctcatttcccc

SEQ ID NO: 619553 - DNA, 20 bp, Artificial Sequence
  chemically synthesized
tggaggagtggctgaaagca

SEQ ID NO: 619554 - DNA, 20 bp, Artificial Sequence
  chemically synthesized
atttgtcagactataaaaca

SEQ ID NO: 619555 - DNA, 20 bp, Artificial Sequence
  chemically synthesized
tactgagcctctttcaaagc

SEQ ID NO: 619556 - DNA, 20 bp, Artificial Sequence
  chemically synthesized
ttgtttacaaatgagaaaac

SEQ ID NO: 619557 - DNA, 20 bp, Artificial Sequence
  chemically synthesized
taaaagagctattgttactg

SEQ ID NO: 619558 - DNA, 20 bp, Artificial Sequence
  chemically synthesized
ttctataaaagagctattgt

SEQ ID NO: 619559 - DNA, 20 bp, Artificial Sequence
  chemically synthesized
attactttatttattcttct

SEQ ID NO: 619560 - DNA, 20 bp, Artificial Sequence
  chemically synthesized
ggtattataagaagttcttc

SEQ ID NO: 619561 - DNA, 20 bp, Artificial Sequence
  chemically synthesized
ctaaagctgtggttctcaaa

SEQ ID NO: 619562 - DNA, 20 bp, Artificial Sequence
  chemically synthesized
ctgaaacatactttgagaac

SEQ ID NO: 619563 - DNA, 20 bp, Artificial Sequence
  chemically synthesized
aaatgctaatatttacattc

SEQ ID NO: 619564 - DNA, 20 bp, Artificial Sequence
  chemically synthesized
catggtcctcatcaaagtcc

SEQ ID NO: 619565 - DNA, 20 bp, Artificial Sequence
  chemically synthesized
tttttcttttcttttcgaga

SEQ ID NO: 619566 - DNA, 20 bp, Artificial Sequence
  chemically synthesized
aaccactgtctccagggttc

SEQ ID NO: 619567 - DNA, 20 bp, Artificial Sequence
  chemically synthesized
ttgggaggctgaggcaggag

SEQ ID NO: 619568 - DNA, 20 bp, Artificial Sequence
  chemically synthesized
ttttgtatttttagtagaga

SEQ ID NO: 619569 - DNA, 20 bp, Artificial Sequence
  chemically synthesized
ttagtagagacggggtttta

SEQ ID NO: 619570 - DNA, 20 bp, Artificial Sequence
  chemically synthesized
tgcctcagcctcccaaagtg

SEQ ID NO: 619571 - DNA, 20 bp, Artificial Sequence
  chemically synthesized
gccaccgcgccccggccccc

SEQ ID NO: 619572 - DNA, 20 bp, Artificial Sequence
  chemically synthesized
agagtctctgaatactgtag

SEQ ID NO: 619573 - DNA, 20 bp, Artificial Sequence
  chemically synthesized
cagagactcttttctgccat

SEQ ID NO: 619574 - DNA, 20 bp, Artificial Sequence
  chemically synthesized
tttgatctagttaacactta

SEQ ID NO: 619575 - DNA, 20 bp, Artificial Sequence
  chemically synthesized
taacgaatctctttatcatt

SEQ ID NO: 619576 - DNA, 20 bp, Artificial Sequence
  chemically synthesized
gatataagctagaaatgata

SEQ ID NO: 619577 - DNA, 20 bp, Artificial Sequence
  chemically synthesized
catggagtctgtgacagaca

SEQ ID NO: 619578 - DNA, 20 bp, Artificial Sequence
  chemically synthesized
atgtgggtattattatactg

SEQ ID NO: 619579 - DNA, 20 bp, Artificial Sequence
  chemically synthesized
atgagccccgtgggccatga

SEQ ID NO: 619580 - DNA, 20 bp, Artificial Sequence
  chemically synthesized
ttttatgagccccgtgggcc

SEQ ID NO: 619581 - DNA, 20 bp, Artificial Sequence
  chemically synthesized
gtacatattgatcaaattag

SEQ ID NO: 619582 - DNA, 20 bp, Artificial Sequence
  chemically synthesized
catatatacataatataagc

SEQ ID NO: 619583 - DNA, 20 bp, Artificial Sequence
  chemically synthesized
ttgttctatctgaataaagc

SEQ ID NO: 619584 - DNA, 20 bp, Artificial Sequence
  chemically synthesized
aaatgccagataatattgtt

SEQ ID NO: 619585 - DNA, 20 bp, Artificial Sequence
  chemically synthesized
ttatgtgttttaaaatgata

SEQ ID NO: 619586 - DNA, 20 bp, Artificial Sequence
  chemically synthesized
aaaaaaaagtgagccatttt

SEQ ID NO: 619587 - DNA, 20 bp, Artificial Sequence
  chemically synthesized
ttttcttcagtgcctgtcca

SEQ ID NO: 619588 - DNA, 20 bp, Artificial Sequence
  chemically synthesized
gtccatcttgtttagaaaag

SEQ ID NO: 619589 - DNA, 20 bp, Artificial Sequence
  chemically synthesized
ttccattgcctatcagtgga

SEQ ID NO: 619590 - DNA, 20 bp, Artificial Sequence
  chemically synthesized
tccactgataggcaatggaa

SEQ ID NO: 619591 - DNA, 20 bp, Artificial Sequence
  chemically synthesized
ttagatacttgtgtatccga

SEQ ID NO: 619592 - DNA, 20 bp, Artificial Sequence
  chemically synthesized
gatactgtttaaaagactgg

SEQ ID NO: 619593 - DNA, 20 bp, Artificial Sequence
  chemically synthesized
taactaatctttttttttgt

SEQ ID NO: 619594 - DNA, 20 bp, Artificial Sequence
  chemically synthesized
agcccaagctcctacaaaaa

SEQ ID NO: 619595 - DNA, 20 bp, Artificial Sequence
  chemically synthesized
ttaataaaatgtgtgttcta

SEQ ID NO: 619596 - DNA, 20 bp, Artificial Sequence
  chemically synthesized
tgtgcagaatttttatttca

SEQ ID NO: 619597 - DNA, 20 bp, Artificial Sequence
  chemically synthesized
cagaactctttttccttgat

SEQ ID NO: 619598 - DNA, 20 bp, Artificial Sequence
  chemically synthesized
ataatgattcaggtcagcag

SEQ ID NO: 619599 - DNA, 20 bp, Artificial Sequence
  chemically synthesized
gaactggccaaagttatcta

SEQ ID NO: 619600 - DNA, 20 bp, Artificial Sequence
  chemically synthesized
actgtgtgattccatctata

SEQ ID NO: 619601 - DNA, 20 bp, Artificial Sequence
  chemically synthesized
ctagaagatgaacatttact

SEQ ID NO: 619602 - DNA, 20 bp, Artificial Sequence
  chemically synthesized
tgttcatcttctagtcaaca

SEQ ID NO: 619603 - DNA, 20 bp, Artificial Sequence
  chemically synthesized
cgttcatattcttccaagta

SEQ ID NO: 619604 - DNA, 20 bp, Artificial Sequence
  chemically synthesized
attccacggatatacccaat

SEQ ID NO: 619605 - DNA, 20 bp, Artificial Sequence
  chemically synthesized
ggatatacccaatttttgtt

SEQ ID NO: 619606 - DNA, 20 bp, Artificial Sequence
  chemically synthesized
atacccaatttttgtttttt

SEQ ID NO: 619607 - DNA, 20 bp, Artificial Sequence
  chemically synthesized
atttttgttttttgtttgtt

SEQ ID NO: 619608 - DNA, 20 bp, Artificial Sequence
  chemically synthesized
gttttttgtttgttttttgt

SEQ ID NO: 619609 - DNA, 20 bp, Artificial Sequence
  chemically synthesized
aacctctgcctcctgggttc

SEQ ID NO: 619610 - DNA, 20 bp, Artificial Sequence
  chemically synthesized
tcaggaggctaaggcaggag

SEQ ID NO: 619611 - DNA, 20 bp, Artificial Sequence
  chemically synthesized
tgccttagcctcctgagtag

SEQ ID NO: 619612 - DNA, 20 bp, Artificial Sequence
  chemically synthesized
ttttgtatttttagtagaga

SEQ ID NO: 619613 - DNA, 20 bp, Artificial Sequence
  chemically synthesized
ctcctgggcctcccaaagtg

SEQ ID NO: 619614 - DNA, 20 bp, Artificial Sequence
  chemically synthesized
gaagttgaggctgcagggag

SEQ ID NO: 619615 - DNA, 20 bp, Artificial Sequence
  chemically synthesized
tccagaggctgagatgagag

SEQ ID NO: 619616 - DNA, 20 bp, Artificial Sequence
  chemically synthesized
atgccaccatgtcaggctaa

SEQ ID NO: 619617 - DNA, 20 bp, Artificial Sequence
  chemically synthesized
ttttagactatcctgggcaa

SEQ ID NO: 619618 - DNA, 20 bp, Artificial Sequence
  chemically synthesized
gcccaggatagtctaaaact

SEQ ID NO: 619619 - DNA, 20 bp, Artificial Sequence
  chemically synthesized
tgggagggtcacttgaagcc

SEQ ID NO: 619620 - DNA, 20 bp, Artificial Sequence
  chemically synthesized
cactttggcctcccaaagtg

SEQ ID NO: 619621 - DNA, 20 bp, Artificial Sequence
  chemically synthesized
gctcataaggaaggcataaa

SEQ ID NO: 619622 - DNA, 20 bp, Artificial Sequence
  chemically synthesized
agctggagctctcaaatatt

SEQ ID NO: 619623 - DNA, 20 bp, Artificial Sequence
  chemically synthesized
atataggggtattcaaaatt

SEQ ID NO: 619624 - DNA, 20 bp, Artificial Sequence
  chemically synthesized
atgaagttaggcacctattc

SEQ ID NO: 619625 - DNA, 20 bp, Artificial Sequence
  chemically synthesized
ttgtctttttattgatatgt

SEQ ID NO: 619626 - DNA, 20 bp, Artificial Sequence
  chemically synthesized
gtttattatatattatggat

SEQ ID NO: 619627 - DNA, 20 bp, Artificial Sequence
  chemically synthesized
aaaatattcacaagacgtat

SEQ ID NO: 619628 - DNA, 20 bp, Artificial Sequence
  chemically synthesized
gtattataatagatagaatt

SEQ ID NO: 619629 - DNA, 20 bp, Artificial Sequence
  chemically synthesized
tttaatgaagctcaatttat

SEQ ID NO: 619630 - DNA, 20 bp, Artificial Sequence
  chemically synthesized
caaagtcaaacactgataaa

SEQ ID NO: 619631 - DNA, 20 bp, Artificial Sequence
  chemically synthesized
tcagtgtttgactttgtact

SEQ ID NO: 619632 - DNA, 20 bp, Artificial Sequence
  chemically synthesized
ttcggtcctaattatgaaat

SEQ ID NO: 619633 - DNA, 20 bp, Artificial Sequence
  chemically synthesized
cgagtgagatacaggctaag

SEQ ID NO: 619634 - DNA, 20 bp, Artificial Sequence
  chemically synthesized
tgcttagcctgtatctcact

SEQ ID NO: 619635 - DNA, 20 bp, Artificial Sequence
  chemically synthesized
tagattattttacttatgac

SEQ ID NO: 619636 - DNA, 20 bp, Artificial Sequence
  chemically synthesized
cacagccatattctccttga

SEQ ID NO: 619637 - DNA, 20 bp, Artificial Sequence
  chemically synthesized
cgagacatagtctctgccaa

SEQ ID NO: 619638 - DNA, 20 bp, Artificial Sequence
  chemically synthesized
caactcccaaagatatataa

SEQ ID NO: 619639 - DNA, 20 bp, Artificial Sequence
  chemically synthesized
ttggactcctcagccctagc

SEQ ID NO: 619640 - DNA, 20 bp, Artificial Sequence
  chemically synthesized
gttccctgacatcttctatt

SEQ ID NO: 619641 - DNA, 20 bp, Artificial Sequence
  chemically synthesized
ctcaaaagtactgcaaggta

SEQ ID NO: 619642 - DNA, 20 bp, Artificial Sequence
  chemically synthesized
ctcgagcttcagaacagggt

SEQ ID NO: 619643 - DNA, 20 bp, Artificial Sequence
  chemically synthesized
ccctgttctgaagctcgagc

SEQ ID NO: 619644 - DNA, 20 bp, Artificial Sequence
  chemically synthesized
ggaaaataataagctagggc

SEQ ID NO: 619645 - DNA, 20 bp, Artificial Sequence
  chemically synthesized
agaagtatttgtaggaaatt

SEQ ID NO: 619646 - DNA, 20 bp, Artificial Sequence
  chemically synthesized
atttcctacaaatacttctt

SEQ ID NO: 619647 - DNA, 20 bp, Artificial Sequence
  chemically synthesized
aaatatgaaatgaagggtac

SEQ ID NO: 619648 - DNA, 20 bp, Artificial Sequence
  chemically synthesized
tttcttttgaaaatttaata

SEQ ID NO: 619649 - DNA, 20 bp, Artificial Sequence
  chemically synthesized
aaatgcaaatatctgttcta

SEQ ID NO: 619650 - DNA, 20 bp, Artificial Sequence
  chemically synthesized
tttctgccagtgatacccag

SEQ ID NO: 619651 - DNA, 20 bp, Artificial Sequence
  chemically synthesized
gccagtgatacccagccaag

SEQ ID NO: 619652 - DNA, 20 bp, Artificial Sequence
  chemically synthesized
tataaggatcgcacattacc

SEQ ID NO: 619653 - DNA, 20 bp, Artificial Sequence
  chemically synthesized
acttgctgaatcacggtaag

SEQ ID NO: 619654 - DNA, 20 bp, Artificial Sequence
  chemically synthesized
cttgaataaagcctgcctta

SEQ ID NO: 619655 - DNA, 20 bp, Artificial Sequence
  chemically synthesized
tagggtcttgcagtagggga

SEQ ID NO: 619656 - DNA, 20 bp, Artificial Sequence
  chemically synthesized
gcaggagtctcccttaccca

SEQ ID NO: 619657 - DNA, 20 bp, Artificial Sequence
  chemically synthesized
agaaaacactcatccttggt

SEQ ID NO: 619658 - DNA, 20 bp, Artificial Sequence
  chemically synthesized
gataatcaaataccaaggat

SEQ ID NO: 619659 - DNA, 20 bp, Artificial Sequence
  chemically synthesized
atttagttttagcaggccag

SEQ ID NO: 619660 - DNA, 20 bp, Artificial Sequence
  chemically synthesized
ctgtgcacattctcctaaaa

SEQ ID NO: 619661 - DNA, 20 bp, Artificial Sequence
  chemically synthesized
tttgctcggccaaaatttat

SEQ ID NO: 619662 - DNA, 20 bp, Artificial Sequence
  chemically synthesized
attaactatgttagtactga

SEQ ID NO: 619663 - DNA, 20 bp, Artificial Sequence
  chemically synthesized
aaatgaattactggggtact

SEQ ID NO: 619664 - DNA, 20 bp, Artificial Sequence
  chemically synthesized
ccagtaattcatttatgaaa

SEQ ID NO: 619665 - DNA, 20 bp, Artificial Sequence
  chemically synthesized
tgcctctgcctcctaaagtg

SEQ ID NO: 619666 - DNA, 20 bp, Artificial Sequence
  chemically synthesized
tttgtatttttagtagagaa

SEQ ID NO: 619667 - DNA, 20 bp, Artificial Sequence
  chemically synthesized
tgcttcagcctcccggttag

SEQ ID NO: 619668 - DNA, 20 bp, Artificial Sequence
  chemically synthesized
ccgggaggctgaagcaggag

SEQ ID NO: 619669 - DNA, 20 bp, Artificial Sequence
  chemically synthesized
ctcccaggttcaagcgattc

SEQ ID NO: 619670 - DNA, 20 bp, Artificial Sequence
  chemically synthesized
aacctctgcctcccaggttc

SEQ ID NO: 619671 - DNA, 20 bp, Artificial Sequence
  chemically synthesized
ttttttttttttttttgaaa

SEQ ID NO: 619672 - DNA, 20 bp, Artificial Sequence
  chemically synthesized
gatacataactttcaaagag

SEQ ID NO: 619673 - DNA, 20 bp, Artificial Sequence
  chemically synthesized
caagtgatacataactttca

SEQ ID NO: 619674 - DNA, 20 bp, Artificial Sequence
  chemically synthesized
ctgaacctacgtcacaaagg

SEQ ID NO: 619675 - DNA, 20 bp, Artificial Sequence
  chemically synthesized
ttgtttaacttagtttaacc

SEQ ID NO: 619676 - DNA, 20 bp, Artificial Sequence
  chemically synthesized
tagttaaaaaaattgtttaa

SEQ ID NO: 619677 - DNA, 20 bp, Artificial Sequence
  chemically synthesized
aaatgttttgtagttaaaaa

SEQ ID NO: 619678 - DNA, 20 bp, Artificial Sequence
  chemically synthesized
cgagtcacaactcaaccctg

SEQ ID NO: 619679 - DNA, 20 bp, Artificial Sequence
  chemically synthesized
gaaattatcacattttaaca

SEQ ID NO: 619680 - DNA, 20 bp, Artificial Sequence
  chemically synthesized
gaataacgtaacaagagcaa

SEQ ID NO: 619681 - DNA, 20 bp, Artificial Sequence
  chemically synthesized
atttgaaattggatatatct

SEQ ID NO: 619682 - DNA, 20 bp, Artificial Sequence
  chemically synthesized
tttatacacagatcatagta

SEQ ID NO: 619683 - DNA, 20 bp, Artificial Sequence
  chemically synthesized
agctcatcactttgaatgtt

SEQ ID NO: 619684 - DNA, 20 bp, Artificial Sequence
  chemically synthesized
atcttttaacattcaaagtg

SEQ ID NO: 619685 - DNA, 20 bp, Artificial Sequence
  chemically synthesized
aagtgatgagctttggagaa

SEQ ID NO: 619686 - DNA, 20 bp, Artificial Sequence
  chemically synthesized
aggagttacacctgcagtat

SEQ ID NO: 619687 - DNA, 20 bp, Artificial Sequence
  chemically synthesized
ccccgatgccttaatctggg

SEQ ID NO: 619688 - DNA, 20 bp, Artificial Sequence
  chemically synthesized
taaccactgcaaaaacaaca

SEQ ID NO: 619689 - DNA, 20 bp, Artificial Sequence
  chemically synthesized
aggaggaaggagaggaggtg

SEQ ID NO: 619690 - DNA, 20 bp, Artificial Sequence
  chemically synthesized
caagattcagacactgcaga

SEQ ID NO: 619691 - DNA, 20 bp, Artificial Sequence
  chemically synthesized
aaaccgcatcatggaattat

SEQ ID NO: 619692 - DNA, 20 bp, Artificial Sequence
  chemically synthesized
aagcagaaataattccatga

SEQ ID NO: 619693 - DNA, 20 bp, Artificial Sequence
  chemically synthesized
attccatgatgcggttttgt

SEQ ID NO: 619694 - DNA, 20 bp, Artificial Sequence
  chemically synthesized
gacaaagttgtgtcagccac

SEQ ID NO: 619695 - DNA, 20 bp, Artificial Sequence
  chemically synthesized
gcaaatgcacaccccattct

SEQ ID NO: 619696 - DNA, 20 bp, Artificial Sequence
  chemically synthesized
aacctgtagctgaattctgc

SEQ ID NO: 619697 - DNA, 20 bp, Artificial Sequence
  chemically synthesized
atctaaggcagaattcagct

SEQ ID NO: 619698 - DNA, 20 bp, Artificial Sequence
  chemically synthesized
tttaaaatgtcagggaaaaa

SEQ ID NO: 619699 - DNA, 20 bp, Artificial Sequence
  chemically synthesized
ttttccctgacattttaaat

SEQ ID NO: 619700 - DNA, 20 bp, Artificial Sequence
  chemically synthesized
aagtttccctattcactttg

SEQ ID NO: 619701 - DNA, 20 bp, Artificial Sequence
  chemically synthesized
ttgttacatatcagtattaa

SEQ ID NO: 619702 - DNA, 20 bp, Artificial Sequence
  chemically synthesized
atgtctcttctccataaaga

SEQ ID NO: 619703 - DNA, 20 bp, Artificial Sequence
  chemically synthesized
agtattgtgagaagataatt

SEQ ID NO: 619704 - DNA, 20 bp, Artificial Sequence
  chemically synthesized
ttgtgagaagataattaaaa

SEQ ID NO: 619705 - DNA, 20 bp, Artificial Sequence
  chemically synthesized
ctttccttcttctcagcaga

SEQ ID NO: 619706 - DNA, 20 bp, Artificial Sequence
  chemically synthesized
ttaatttgcccttatgaaag

SEQ ID NO: 619707 - DNA, 20 bp, Artificial Sequence
  chemically synthesized
caggaactctgaatttggga

SEQ ID NO: 619708 - DNA, 20 bp, Artificial Sequence
  chemically synthesized
atgaataatcatctttggca

SEQ ID NO: 619709 - DNA, 20 bp, Artificial Sequence
  chemically synthesized
catttgaatcctattgccaa

SEQ ID NO: 619710 - DNA, 20 bp, Artificial Sequence
  chemically synthesized
aatagaggttggatcaagaa

SEQ ID NO: 619711 - DNA, 20 bp, Artificial Sequence
  chemically synthesized
ttgcataactggacaacaat

SEQ ID NO: 619712 - DNA, 20 bp, Artificial Sequence
  chemically synthesized
ttgtttcttcctggaattca

SEQ ID NO: 619713 - DNA, 20 bp, Artificial Sequence
  chemically synthesized
caaggagtttattctacaat

SEQ ID NO: 619714 - DNA, 20 bp, Artificial Sequence
  chemically synthesized
tcgggaggctgaggcaggag

SEQ ID NO: 619715 - DNA, 20 bp, Artificial Sequence
  chemically synthesized
ggcgtgcgccactacgcctg

SEQ ID NO: 619716 - DNA, 20 bp, Artificial Sequence
  chemically synthesized
ttttgtatttttagtagaga

SEQ ID NO: 619717 - DNA, 20 bp, Artificial Sequence
  chemically synthesized
acttctttccccacatgaca

SEQ ID NO: 619718 - DNA, 20 bp, Artificial Sequence
  chemically synthesized
gttttttataatactaaata

SEQ ID NO: 619719 - DNA, 20 bp, Artificial Sequence
  chemically synthesized
tgcaagtatgtttggtgcat

SEQ ID NO: 619720 - DNA, 20 bp, Artificial Sequence
  chemically synthesized
atgtttattgatgattgcaa

SEQ ID NO: 619721 - DNA, 20 bp, Artificial Sequence
  chemically synthesized
gagatatgtcatatgtttat

SEQ ID NO: 619722 - DNA, 20 bp, Artificial Sequence
  chemically synthesized
cttgttagtagagatatgtc

SEQ ID NO: 619723 - DNA, 20 bp, Artificial Sequence
  chemically synthesized
atgacatatctctactaaca

SEQ ID NO: 619724 - DNA, 20 bp, Artificial Sequence
  chemically synthesized
aattgatgccataatttcca

SEQ ID NO: 619725 - DNA, 20 bp, Artificial Sequence
  chemically synthesized
accatctgtgccacacagac

SEQ ID NO: 619726 - DNA, 20 bp, Artificial Sequence
  chemically synthesized
tataactttctgtttcaaat

SEQ ID NO: 619727 - DNA, 20 bp, Artificial Sequence
  chemically synthesized
tcttatgctcatatataact

SEQ ID NO: 619728 - DNA, 20 bp, Artificial Sequence
  chemically synthesized
atagaatatatactgttata

SEQ ID NO: 619729 - DNA, 20 bp, Artificial Sequence
  chemically synthesized
ataggtttaacaataagtga

SEQ ID NO: 619730 - DNA, 20 bp, Artificial Sequence
  chemically synthesized
ttttattaatgtatatgtat

SEQ ID NO: 619731 - DNA, 20 bp, Artificial Sequence
  chemically synthesized
aatattgacctacaaataat

SEQ ID NO: 619732 - DNA, 20 bp, Artificial Sequence
  chemically synthesized
gtgctactagttttattata

SEQ ID NO: 619733 - DNA, 20 bp, Artificial Sequence
  chemically synthesized
atcttgtctgtttctgtgct

SEQ ID NO: 619734 - DNA, 20 bp, Artificial Sequence
  chemically synthesized
aactagtagcacagaaacag

SEQ ID NO: 619735 - DNA, 20 bp, Artificial Sequence
  chemically synthesized
ctggtaaccaaagtaatctt

SEQ ID NO: 619736 - DNA, 20 bp, Artificial Sequence
  chemically synthesized
ccctcagtacttaacatttt

SEQ ID NO: 619737 - DNA, 20 bp, Artificial Sequence
  chemically synthesized
aagacttactctgacggtgt

SEQ ID NO: 619738 - DNA, 20 bp, Artificial Sequence
  chemically synthesized
gagaaccacttctggaattc

SEQ ID NO: 619739 - DNA, 20 bp, Artificial Sequence
  chemically synthesized
gagagggttctttgtaatgc

SEQ ID NO: 619740 - DNA, 20 bp, Artificial Sequence
  chemically synthesized
cagttggtctggggtggggt

SEQ ID NO: 619741 - DNA, 20 bp, Artificial Sequence
  chemically synthesized
cccaagccccggcatagaga

SEQ ID NO: 619742 - DNA, 20 bp, Artificial Sequence
  chemically synthesized
ctgaatcactatctctatgc

SEQ ID NO: 619743 - DNA, 20 bp, Artificial Sequence
  chemically synthesized
gagagtacatgaagttgaaa

SEQ ID NO: 619744 - DNA, 20 bp, Artificial Sequence
  chemically synthesized
ttcctaagtccacttagaaa

SEQ ID NO: 619745 - DNA, 20 bp, Artificial Sequence
  chemically synthesized
gaaaaaattaaaaatgtaaa

SEQ ID NO: 619746 - DNA, 20 bp, Artificial Sequence
  chemically synthesized
agagcattgaaaatagacat

SEQ ID NO: 619747 - DNA, 20 bp, Artificial Sequence
  chemically synthesized
aaatagacataattgattgc

SEQ ID NO: 619748 - DNA, 20 bp, Artificial Sequence
  chemically synthesized
cactactgtgccctatcaaa

SEQ ID NO: 619749 - DNA, 20 bp, Artificial Sequence
  chemically synthesized
ctcattttgatagggcacag

SEQ ID NO: 619750 - DNA, 20 bp, Artificial Sequence
  chemically synthesized
acaatgttacatgaaaaatg

SEQ ID NO: 619751 - DNA, 20 bp, Artificial Sequence
  chemically synthesized
tttttcatgtaacattgtct

SEQ ID NO: 619752 - DNA, 20 bp, Artificial Sequence
  chemically synthesized
aaagttgccgcaataataga

SEQ ID NO: 619753 - DNA, 20 bp, Artificial Sequence
  chemically synthesized
ttcattatgtgatagtcttc

SEQ ID NO: 619754 - DNA, 20 bp, Artificial Sequence
  chemically synthesized
tagagaaagaagtaacaatt

SEQ ID NO: 619755 - DNA, 20 bp, Artificial Sequence
  chemically synthesized
tctttctctatctcactctc

SEQ ID NO: 619756 - DNA, 20 bp, Artificial Sequence
  chemically synthesized
atatcactatataatagtta

SEQ ID NO: 619757 - DNA, 20 bp, Artificial Sequence
  chemically synthesized
ttcaattaaaattgttaagc

SEQ ID NO: 619758 - DNA, 20 bp, Artificial Sequence
  chemically synthesized
attcggtggtgtcaacaatc

SEQ ID NO: 619759 - DNA, 20 bp, Artificial Sequence
  chemically synthesized
ttgttgacaccaccgaatat

SEQ ID NO: 619760 - DNA, 20 bp, Artificial Sequence
  chemically synthesized
ttaagtgcaattctgtttac

SEQ ID NO: 619761 - DNA, 20 bp, Artificial Sequence
  chemically synthesized
tgaatatcatttaagtgcaa

SEQ ID NO: 619762 - DNA, 20 bp, Artificial Sequence
  chemically synthesized
cacctcagcctcccaaagtg

SEQ ID NO: 619763 - DNA, 20 bp, Artificial Sequence
  chemically synthesized
ttttgtgtttttagtagaga

SEQ ID NO: 619764 - DNA, 20 bp, Artificial Sequence
  chemically synthesized
ccaccatgcccggctaattt

SEQ ID NO: 619765 - DNA, 20 bp, Artificial Sequence
  chemically synthesized
ttgggagactgaggtgggag

SEQ ID NO: 619766 - DNA, 20 bp, Artificial Sequence
  chemically synthesized
agcttctgagaagtagagac

SEQ ID NO: 619767 - DNA, 20 bp, Artificial Sequence
  chemically synthesized
cacaaacctgtatcatccaa

SEQ ID NO: 619768 - DNA, 20 bp, Artificial Sequence
  chemically synthesized
cagaagctctgttggatgat

SEQ ID NO: 619769 - DNA, 20 bp, Artificial Sequence
  chemically synthesized
agtagaggaggcataaactt

SEQ ID NO: 619770 - DNA, 20 bp, Artificial Sequence
  chemically synthesized
ggaggcataaacttgctcga

SEQ ID NO: 619771 - DNA, 20 bp, Artificial Sequence
  chemically synthesized
caaccaccaaacctaatcga

SEQ ID NO: 619772 - DNA, 20 bp, Artificial Sequence
  chemically synthesized
ctcgattaggtttggtggtt

SEQ ID NO: 619773 - DNA, 20 bp, Artificial Sequence
  chemically synthesized
aaagagatgatgaggcaaat

SEQ ID NO: 619774 - DNA, 20 bp, Artificial Sequence
  chemically synthesized
tggaatttttatatccacta

SEQ ID NO: 619775 - DNA, 20 bp, Artificial Sequence
  chemically synthesized
tttatggtcatatttggcca

SEQ ID NO: 619776 - DNA, 20 bp, Artificial Sequence
  chemically synthesized
ccaaatatgaccataaatat

SEQ ID NO: 619777 - DNA, 20 bp, Artificial Sequence
  chemically synthesized
ttacaatacctagaaatttc

SEQ ID NO: 619778 - DNA, 20 bp, Artificial Sequence
  chemically synthesized
tagagttcttcactttcaaa

SEQ ID NO: 619779 - DNA, 20 bp, Artificial Sequence
  chemically synthesized
ttaatgagatagaaacaatt

SEQ ID NO: 619780 - DNA, 20 bp, Artificial Sequence
  chemically synthesized
tgagatagaaacaattatca

SEQ ID NO: 619781 - DNA, 20 bp, Artificial Sequence
  chemically synthesized
ccttaatgaatcaaactgat

SEQ ID NO: 619782 - DNA, 20 bp, Artificial Sequence
  chemically synthesized
aatgtcctttttatctacta

SEQ ID NO: 619783 - DNA, 20 bp, Artificial Sequence
  chemically synthesized
tacatttcataatttcatcc

SEQ ID NO: 619784 - DNA, 20 bp, Artificial Sequence
  chemically synthesized
tacatgctgcctactggcac

SEQ ID NO: 619785 - DNA, 20 bp, Artificial Sequence
  chemically synthesized
gattataagccggtctcaca

SEQ ID NO: 619786 - DNA, 20 bp, Artificial Sequence
  chemically synthesized
aatgaaaagccaattgtgag

SEQ ID NO: 619787 - DNA, 20 bp, Artificial Sequence
  chemically synthesized
ttatataaagaacacccatt

SEQ ID NO: 619788 - DNA, 20 bp, Artificial Sequence
  chemically synthesized
aagaagtaaagttatgaaca

SEQ ID NO: 619789 - DNA, 20 bp, Artificial Sequence
  chemically synthesized
aaccaaagaaaatataactg

SEQ ID NO: 619790 - DNA, 20 bp, Artificial Sequence
  chemically synthesized
aattccttagaattacaact

SEQ ID NO: 619791 - DNA, 20 bp, Artificial Sequence
  chemically synthesized
tgtgtttagacaataaaacc

SEQ ID NO: 619792 - DNA, 20 bp, Artificial Sequence
  chemically synthesized
ttgatatttgaggcaaatcc

SEQ ID NO: 619793 - DNA, 20 bp, Artificial Sequence
  chemically synthesized
tatagcattgcccatttgca

SEQ ID NO: 619794 - DNA, 20 bp, Artificial Sequence
  chemically synthesized
ttcacttagaggagagtgag

SEQ ID NO: 619795 - DNA, 20 bp, Artificial Sequence
  chemically synthesized
tctcctctaagtgaatgcta

SEQ ID NO: 619796 - DNA, 20 bp, Artificial Sequence
  chemically synthesized
catgaattgacacaactaaa

SEQ ID NO: 619797 - DNA, 20 bp, Artificial Sequence
  chemically synthesized
ttataagaacatacatagcc

SEQ ID NO: 619798 - DNA, 20 bp, Artificial Sequence
  chemically synthesized
ccctctgtaacttgttttaa

SEQ ID NO: 619799 - DNA, 20 bp, Artificial Sequence
  chemically synthesized
cttccgtttaaccctctgta

SEQ ID NO: 619800 - DNA, 20 bp, Artificial Sequence
  chemically synthesized
acttagctacctacttttgc

SEQ ID NO: 619801 - DNA, 20 bp, Artificial Sequence
  chemically synthesized
cctaatacttagctacctac

SEQ ID NO: 619802 - DNA, 20 bp, Artificial Sequence
  chemically synthesized
actgcacctggccttattac

SEQ ID NO: 619803 - DNA, 20 bp, Artificial Sequence
  chemically synthesized
cgcctcggcctcccaaagtg

SEQ ID NO: 619804 - DNA, 20 bp, Artificial Sequence
  chemically synthesized
ggtttcatcacattggccag

SEQ ID NO: 619805 - DNA, 20 bp, Artificial Sequence
  chemically synthesized
aatttttattttagtagaga

SEQ ID NO: 619806 - DNA, 20 bp, Artificial Sequence
  chemically synthesized
tgcctcaccctcctgagtag

SEQ ID NO: 619807 - DNA, 20 bp, Artificial Sequence
  chemically synthesized
tcaggagggtgaggcatgag

SEQ ID NO: 619808 - DNA, 20 bp, Artificial Sequence
  chemically synthesized
aacctctgcctcccaggttc

SEQ ID NO: 619809 - DNA, 20 bp, Artificial Sequence
  chemically synthesized
ttttttttttgacagagtct

SEQ ID NO: 619810 - DNA, 20 bp, Artificial Sequence
  chemically synthesized
tcctaagattagtctattac

SEQ ID NO: 619811 - DNA, 20 bp, Artificial Sequence
  chemically synthesized
attctactccagccagcttc

SEQ ID NO: 619812 - DNA, 20 bp, Artificial Sequence
  chemically synthesized
ctctatgccattctactcca

SEQ ID NO: 619813 - DNA, 20 bp, Artificial Sequence
  chemically synthesized
tatcctctataggcctttta

SEQ ID NO: 619814 - DNA, 20 bp, Artificial Sequence
  chemically synthesized
gcagaactttaggcagaatt

SEQ ID NO: 619815 - DNA, 20 bp, Artificial Sequence
  chemically synthesized
taattctgcctaaagttctg

SEQ ID NO: 619816 - DNA, 20 bp, Artificial Sequence
  chemically synthesized
caaaaaatatgcattcttat

SEQ ID NO: 619817 - DNA, 20 bp, Artificial Sequence
  chemically synthesized
tgcatattttttgccttgcc

SEQ ID NO: 619818 - DNA, 20 bp, Artificial Sequence
  chemically synthesized
ttgccttgcctttagttttt

SEQ ID NO: 619819 - DNA, 20 bp, Artificial Sequence
  chemically synthesized
ggttttcatgatattaacac

SEQ ID NO: 619820 - DNA, 20 bp, Artificial Sequence
  chemically synthesized
caccaacgattatgtcagag

SEQ ID NO: 619821 - DNA, 20 bp, Artificial Sequence
  chemically synthesized
acgattatgtcagagttatg

SEQ ID NO: 619822 - DNA, 20 bp, Artificial Sequence
  chemically synthesized
cattctttagggggcctatg

SEQ ID NO: 619823 - DNA, 20 bp, Artificial Sequence
  chemically synthesized
catttcattctttagggggc

SEQ ID NO: 619824 - DNA, 20 bp, Artificial Sequence
  chemically synthesized
tggttgtatcaggcaggagt

SEQ ID NO: 619825 - DNA, 20 bp, Artificial Sequence
  chemically synthesized
cctgcctgatacaaccagaa

SEQ ID NO: 619826 - DNA, 20 bp, Artificial Sequence
  chemically synthesized
aggatgacaaaggtccttat

SEQ ID NO: 619827 - DNA, 20 bp, Artificial Sequence
  chemically synthesized
tacatgttctctctctactg

SEQ ID NO: 619828 - DNA, 20 bp, Artificial Sequence
  chemically synthesized
aacaggaattgcttatttaa

SEQ ID NO: 619829 - DNA, 20 bp, Artificial Sequence
  chemically synthesized
gcagacacttactgaacagg

SEQ ID NO: 619830 - DNA, 20 bp, Artificial Sequence
  chemically synthesized
ctgttcagtaagtgtctgca

SEQ ID NO: 619831 - DNA, 20 bp, Artificial Sequence
  chemically synthesized
cattgttattaatacttcaa

SEQ ID NO: 619832 - DNA, 20 bp, Artificial Sequence
  chemically synthesized
gcgactgcagacacaaagag

SEQ ID NO: 619833 - DNA, 20 bp, Artificial Sequence
  chemically synthesized
acaaagagtgtggattctcc

SEQ ID NO: 619834 - DNA, 20 bp, Artificial Sequence
  chemically synthesized
tagtaatcatttatttctat

SEQ ID NO: 619835 - DNA, 20 bp, Artificial Sequence
  chemically synthesized
ataaaagccttaatagaaat

SEQ ID NO: 619836 - DNA, 20 bp, Artificial Sequence
  chemically synthesized
gaaagaagataaccttgtta

SEQ ID NO: 619837 - DNA, 20 bp, Artificial Sequence
  chemically synthesized
tccaattacaataatcaaag

SEQ ID NO: 619838 - DNA, 20 bp, Artificial Sequence
  chemically synthesized
atattctaagaaaatcacct

SEQ ID NO: 619839 - DNA, 20 bp, Artificial Sequence
  chemically synthesized
aatgaaacaaatgaatgaaa

SEQ ID NO: 619840 - DNA, 20 bp, Artificial Sequence
  chemically synthesized
aaggaaacacattttcattc

SEQ ID NO: 619841 - DNA, 20 bp, Artificial Sequence
  chemically synthesized
tttcattcatttttttagtg

SEQ ID NO: 619842 - DNA, 20 bp, Artificial Sequence
  chemically synthesized
cgccttggcctcccaaagtg

SEQ ID NO: 619843 - DNA, 20 bp, Artificial Sequence
  chemically synthesized
tttttgtatttttagtagag

SEQ ID NO: 619844 - DNA, 20 bp, Artificial Sequence
  chemically synthesized
tgcctcagcttcccaagtag

SEQ ID NO: 619845 - DNA, 20 bp, Artificial Sequence
  chemically synthesized
ttgggaagctgaggcaagag

SEQ ID NO: 619846 - DNA, 20 bp, Artificial Sequence
  chemically synthesized
ggttcaagcgattctcttgc

SEQ ID NO: 619847 - DNA, 20 bp, Artificial Sequence
  chemically synthesized
aacctccacctctcgggttc

SEQ ID NO: 619848 - DNA, 20 bp, Artificial Sequence
  chemically synthesized
tagtgagatgaactgttaat

SEQ ID NO: 619849 - DNA, 20 bp, Artificial Sequence
  chemically synthesized
gttaatggttgattccataa

SEQ ID NO: 619850 - DNA, 20 bp, Artificial Sequence
  chemically synthesized
tgttggcactattgttgtta

SEQ ID NO: 619851 - DNA, 20 bp, Artificial Sequence
  chemically synthesized
ctgctagtgctgaaaatttc

SEQ ID NO: 619852 - DNA, 20 bp, Artificial Sequence
  chemically synthesized
aggtctttgttattcccatt

SEQ ID NO: 619853 - DNA, 20 bp, Artificial Sequence
  chemically synthesized
ataacaaagaccttttagag

SEQ ID NO: 619854 - DNA, 20 bp, Artificial Sequence
  chemically synthesized
cagaagaatatcatttagaa

SEQ ID NO: 619855 - DNA, 20 bp, Artificial Sequence
  chemically synthesized
cctagaatgcttattaaaaa

SEQ ID NO: 619856 - DNA, 20 bp, Artificial Sequence
  chemically synthesized
gcatttttaataagcattct

SEQ ID NO: 619857 - DNA, 20 bp, Artificial Sequence
  chemically synthesized
gaatacagcagaatccccta

SEQ ID NO: 619858 - DNA, 20 bp, Artificial Sequence
  chemically synthesized
taggggattctgctgtattc

SEQ ID NO: 619859 - DNA, 20 bp, Artificial Sequence
  chemically synthesized
gagtttgggaaggactgcct

SEQ ID NO: 619860 - DNA, 20 bp, Artificial Sequence
  chemically synthesized
agtagattgtaaggccaagg

SEQ ID NO: 619861 - DNA, 20 bp, Artificial Sequence
  chemically synthesized
acttagaaaaatatttcagc

SEQ ID NO: 619862 - DNA, 20 bp, Artificial Sequence
  chemically synthesized
tacagttattacctatataa

SEQ ID NO: 619863 - DNA, 20 bp, Artificial Sequence
  chemically synthesized
aatttaagagtgaaatgaaa

SEQ ID NO: 619864 - DNA, 20 bp, Artificial Sequence
  chemically synthesized
tttgctaccatatccagtga

SEQ ID NO: 619865 - DNA, 20 bp, Artificial Sequence
  chemically synthesized
ataagcacatatctacgcac

SEQ ID NO: 619866 - DNA, 20 bp, Artificial Sequence
  chemically synthesized
caaaacaacagtgcgtagat

SEQ ID NO: 619867 - DNA, 20 bp, Artificial Sequence
  chemically synthesized
aacagtgcgtagatatgtgc

SEQ ID NO: 619868 - DNA, 20 bp, Artificial Sequence
  chemically synthesized
cgtgtgagttctatctatgt

SEQ ID NO: 619869 - DNA, 20 bp, Artificial Sequence
  chemically synthesized
catacagtgagagaaagaga

SEQ ID NO: 619870 - DNA, 20 bp, Artificial Sequence
  chemically synthesized
gtttataatcttccaacatt

SEQ ID NO: 619871 - DNA, 20 bp, Artificial Sequence
  chemically synthesized
tgacataagccaaaaatgtt

SEQ ID NO: 619872 - DNA, 20 bp, Artificial Sequence
  chemically synthesized
ttcctctttggcatcacaaa

SEQ ID NO: 619873 - DNA, 20 bp, Artificial Sequence
  chemically synthesized
agcagagaaaataactcaaa

SEQ ID NO: 619874 - DNA, 20 bp, Artificial Sequence
  chemically synthesized
tttacttaggtatgggaggt

SEQ ID NO: 619875 - DNA, 20 bp, Artificial Sequence
  chemically synthesized
aagattatttgtggcatcat

SEQ ID NO: 619876 - DNA, 20 bp, Artificial Sequence
  chemically synthesized
gtactttgcacaaccttgcc

SEQ ID NO: 619877 - DNA, 20 bp, Artificial Sequence
  chemically synthesized
caaagtaccatcttgatcag

SEQ ID NO: 619878 - DNA, 20 bp, Artificial Sequence
  chemically synthesized
tgtaatccatccttaaggga

SEQ ID NO: 619879 - DNA, 20 bp, Artificial Sequence
  chemically synthesized
gtgaagctttttcccttaag

SEQ ID NO: 619880 - DNA, 20 bp, Artificial Sequence
  chemically synthesized
tacctattactttaaaccag

SEQ ID NO: 619881 - DNA, 20 bp, Artificial Sequence
  chemically synthesized
attaagtacaataaaacgtt

SEQ ID NO: 619882 - DNA, 20 bp, Artificial Sequence
  chemically synthesized
tcttaggctatctaggtaat

SEQ ID NO: 619883 - DNA, 20 bp, Artificial Sequence
  chemically synthesized
tctaggtaatctctgtttat

SEQ ID NO: 619884 - DNA, 20 bp, Artificial Sequence
  chemically synthesized
actttgtaaacacctataaa

SEQ ID NO: 619885 - DNA, 20 bp, Artificial Sequence
  chemically synthesized
caattagcaccaacgttttt

SEQ ID NO: 619886 - DNA, 20 bp, Artificial Sequence
  chemically synthesized
ctaataaaaacgttggtgct

SEQ ID NO: 619887 - DNA, 20 bp, Artificial Sequence
  chemically synthesized
atgtgtaaagcaattagcac

SEQ ID NO: 619888 - DNA, 20 bp, Artificial Sequence
  chemically synthesized
ttggtgctaattgctttaca

SEQ ID NO: 619889 - DNA, 20 bp, Artificial Sequence
  chemically synthesized
actactcaactgcaaaaatg

SEQ ID NO: 619890 - DNA, 20 bp, Artificial Sequence
  chemically synthesized
agcaactactcaactgcaaa

SEQ ID NO: 619891 - DNA, 20 bp, Artificial Sequence
  chemically synthesized
actattggccaatctatttc

SEQ ID NO: 619892 - DNA, 20 bp, Artificial Sequence
  chemically synthesized
gaaaaacaagaagctataga

SEQ ID NO: 619893 - DNA, 20 bp, Artificial Sequence
  chemically synthesized
gccaatctatttctatagct

SEQ ID NO: 619894 - DNA, 20 bp, Artificial Sequence
  chemically synthesized
gtatttttttaagatagaaa

SEQ ID NO: 619895 - DNA, 20 bp, Artificial Sequence
  chemically synthesized
caagttaggcctaagaagga

SEQ ID NO: 619896 - DNA, 20 bp, Artificial Sequence
  chemically synthesized
tgatttcccaaggatgttca

SEQ ID NO: 619897 - DNA, 20 bp, Artificial Sequence
  chemically synthesized
agaattcatatacacagaaa

SEQ ID NO: 619898 - DNA, 20 bp, Artificial Sequence
  chemically synthesized
atacacagaaaacatgcttt

SEQ ID NO: 619899 - DNA, 20 bp, Artificial Sequence
  chemically synthesized
gaactcaggaaacaagaaaa

SEQ ID NO: 619900 - DNA, 20 bp, Artificial Sequence
  chemically synthesized
ttgctcattatagaattatg

SEQ ID NO: 619901 - DNA, 20 bp, Artificial Sequence
  chemically synthesized
tataattgctcattatagaa

SEQ ID NO: 619902 - DNA, 20 bp, Artificial Sequence
  chemically synthesized
aattgaagaacaacagcatt

SEQ ID NO: 619903 - DNA, 20 bp, Artificial Sequence
  chemically synthesized
tttttctgctaagaaatgga

SEQ ID NO: 619904 - DNA, 20 bp, Artificial Sequence
  chemically synthesized
taccttggaatacattgcct

SEQ ID NO: 619905 - DNA, 20 bp, Artificial Sequence
  chemically synthesized
caaggtagctcacagaataa

SEQ ID NO: 619906 - DNA, 20 bp, Artificial Sequence
  chemically synthesized
aaaaatctaattctattaaa

SEQ ID NO: 619907 - DNA, 20 bp, Artificial Sequence
  chemically synthesized
aataatcaggatttaataga

SEQ ID NO: 619908 - DNA, 20 bp, Artificial Sequence
  chemically synthesized
ttttttaccatcatttgaga

SEQ ID NO: 619909 - DNA, 20 bp, Artificial Sequence
  chemically synthesized
ccaggaattttagtgttttt

SEQ ID NO: 619910 - DNA, 20 bp, Artificial Sequence
  chemically synthesized
tgtaagggatccaggaattt

SEQ ID NO: 619911 - DNA, 20 bp, Artificial Sequence
  chemically synthesized
agtagagaaggacttttatg

SEQ ID NO: 619912 - DNA, 20 bp, Artificial Sequence
  chemically synthesized
ttctctactatagtatctct

SEQ ID NO: 619913 - DNA, 20 bp, Artificial Sequence
  chemically synthesized
cctttcagcttgagcagagt

SEQ ID NO: 619914 - DNA, 20 bp, Artificial Sequence
  chemically synthesized
tctatccgatttgtttacct

SEQ ID NO: 619915 - DNA, 20 bp, Artificial Sequence
  chemically synthesized
tcaaatgatgcttctatccg

SEQ ID NO: 619916 - DNA, 20 bp, Artificial Sequence
  chemically synthesized
tgagctcaaatgatgcttct

SEQ ID NO: 619917 - DNA, 20 bp, Artificial Sequence
  chemically synthesized
tgatatggcttgagctcaaa

SEQ ID NO: 619918 - DNA, 20 bp, Artificial Sequence
  chemically synthesized
taaatccacaagattgttga

SEQ ID NO: 619919 - DNA, 20 bp, Artificial Sequence
  chemically synthesized
tcaagccatatcaacaatct

SEQ ID NO: 619920 - DNA, 20 bp, Artificial Sequence
  chemically synthesized
tttcctggcaatgtaaatcc

SEQ ID NO: 619921 - DNA, 20 bp, Artificial Sequence
  chemically synthesized
tatcccggcataattttgaa

SEQ ID NO: 619922 - DNA, 20 bp, Artificial Sequence
  chemically synthesized
cccatctttttgatattata

SEQ ID NO: 619923 - DNA, 20 bp, Artificial Sequence
  chemically synthesized
gttgctggaaaaagcctgct

SEQ ID NO: 619924 - DNA, 20 bp, Artificial Sequence
  chemically synthesized
tctttctaggcaatctgcta

SEQ ID NO: 619925 - DNA, 20 bp, Artificial Sequence
  chemically synthesized
atgagattttaacatattag

SEQ ID NO: 619926 - DNA, 20 bp, Artificial Sequence
  chemically synthesized
tcatttatttcaatgtttag

SEQ ID NO: 619927 - DNA, 20 bp, Artificial Sequence
  chemically synthesized
tctcatctaaacattgaaat

SEQ ID NO: 619928 - DNA, 20 bp, Artificial Sequence
  chemically synthesized
aagtgaataatcatttattt

SEQ ID NO: 619929 - DNA, 20 bp, Artificial Sequence
  chemically synthesized
ttcacttacagagtaaacag

SEQ ID NO: 619930 - DNA, 20 bp, Artificial Sequence
  chemically synthesized
aaaaaaatacacttaaacat

SEQ ID NO: 619931 - DNA, 20 bp, Artificial Sequence
  chemically synthesized
tacgtagtcacatgtatata

SEQ ID NO: 619932 - DNA, 20 bp, Artificial Sequence
  chemically synthesized
cctaggaattgtaccataac

SEQ ID NO: 619933 - DNA, 20 bp, Artificial Sequence
  chemically synthesized
ttatggtacaattcctaggt

SEQ ID NO: 619934 - DNA, 20 bp, Artificial Sequence
  chemically synthesized
aaatactacaggaactacca

SEQ ID NO: 619935 - DNA, 20 bp, Artificial Sequence
  chemically synthesized
taaatacatttatttaataa

SEQ ID NO: 619936 - DNA, 20 bp, Artificial Sequence
  chemically synthesized
ctcaaatccaggaagaagga

SEQ ID NO: 619937 - DNA, 20 bp, Artificial Sequence
  chemically synthesized
aaaaaatctagttccttctt

SEQ ID NO: 619938 - DNA, 20 bp, Artificial Sequence
  chemically synthesized
catatctatatcaatattga

SEQ ID NO: 619939 - DNA, 20 bp, Artificial Sequence
  chemically synthesized
tcattctcccgcttgaaaaa

SEQ ID NO: 619940 - DNA, 20 bp, Artificial Sequence
  chemically synthesized
gaataattgtgttttcattc

SEQ ID NO: 619941 - DNA, 20 bp, Artificial Sequence
  chemically synthesized
tattcgccatcttagaataa

SEQ ID NO: 619942 - DNA, 20 bp, Artificial Sequence
  chemically synthesized
gggcccttttttctagatag

SEQ ID NO: 619943 - DNA, 20 bp, Artificial Sequence
  chemically synthesized
taagggggcccttttttcta

SEQ ID NO: 619944 - DNA, 20 bp, Artificial Sequence
  chemically synthesized
gaccagtgaatgaggaaaca

SEQ ID NO: 619945 - DNA, 20 bp, Artificial Sequence
  chemically synthesized
caaaagacttgatttaatca

SEQ ID NO: 619946 - DNA, 20 bp, Artificial Sequence
  chemically synthesized
taatgctgtgctttcaaaag

SEQ ID NO: 619947 - DNA, 20 bp, Artificial Sequence
  chemically synthesized
caatatgtctcacaataatg

SEQ ID NO: 619948 - DNA, 20 bp, Artificial Sequence
  chemically synthesized
tatacttgaagttagaatac

SEQ ID NO: 619949 - DNA, 20 bp, Artificial Sequence
  chemically synthesized
agttactcaacctctttgtg

SEQ ID NO: 619950 - DNA, 20 bp, Artificial Sequence
  chemically synthesized
cacctcggcctcccaaagtg

SEQ ID NO: 619951 - DNA, 20 bp, Artificial Sequence
  chemically synthesized
ggtttcaccatgttggccag

SEQ ID NO: 619952 - DNA, 20 bp, Artificial Sequence
  chemically synthesized
acggggtttcaccatgttgg

SEQ ID NO: 619953 - DNA, 20 bp, Artificial Sequence
  chemically synthesized
gcctggccaacatggtgaaa

SEQ ID NO: 619954 - DNA, 20 bp, Artificial Sequence
  chemically synthesized
ttttgtatttttagtggaaa

SEQ ID NO: 619955 - DNA, 20 bp, Artificial Sequence
  chemically synthesized
ggcaacagagtgagactctg

SEQ ID NO: 619956 - DNA, 20 bp, Artificial Sequence
  chemically synthesized
tacaaatatccagggctaat

SEQ ID NO: 619957 - DNA, 20 bp, Artificial Sequence
  chemically synthesized
tatccagggctaattggaga

SEQ ID NO: 619958 - DNA, 20 bp, Artificial Sequence
  chemically synthesized
tacaacttacaagagttcag

SEQ ID NO: 619959 - DNA, 20 bp, Artificial Sequence
  chemically synthesized
agaagctcacacaacaatga

SEQ ID NO: 619960 - DNA, 20 bp, Artificial Sequence
  chemically synthesized
tgaagcccaatcattgttgt

SEQ ID NO: 619961 - DNA, 20 bp, Artificial Sequence
  chemically synthesized
atatgaagaagctcacacaa

SEQ ID NO: 619962 - DNA, 20 bp, Artificial Sequence
  chemically synthesized
atattatcttatttcaatta

SEQ ID NO: 619963 - DNA, 20 bp, Artificial Sequence
  chemically synthesized
tcttagactctaattatata

SEQ ID NO: 619964 - DNA, 20 bp, Artificial Sequence
  chemically synthesized
ttgccagtctgaatagttaa

SEQ ID NO: 619965 - DNA, 20 bp, Artificial Sequence
  chemically synthesized
atctttacgaaaaatgtaaa

SEQ ID NO: 619966 - DNA, 20 bp, Artificial Sequence
  chemically synthesized
agcatcttttacatttttcg

SEQ ID NO: 619967 - DNA, 20 bp, Artificial Sequence
  chemically synthesized
tttcgtaaagattctaagtg

SEQ ID NO: 619968 - DNA, 20 bp, Artificial Sequence
  chemically synthesized
tatatctttcaaaaatagct

SEQ ID NO: 619969 - DNA, 20 bp, Artificial Sequence
  chemically synthesized
atctgtgattgtgacagtgc

SEQ ID NO: 619970 - DNA, 20 bp, Artificial Sequence
  chemically synthesized
agcaaaggcactgtcacaat

SEQ ID NO: 619971 - DNA, 20 bp, Artificial Sequence
  chemically synthesized
taaatggcactaaatagaat

SEQ ID NO: 619972 - DNA, 20 bp, Artificial Sequence
  chemically synthesized
tgaacacattttcaagtcta

SEQ ID NO: 619973 - DNA, 20 bp, Artificial Sequence
  chemically synthesized
tagacttgaaaatgtgttca

SEQ ID NO: 619974 - DNA, 20 bp, Artificial Sequence
  chemically synthesized
tgccattcaatgttccattt

SEQ ID NO: 619975 - DNA, 20 bp, Artificial Sequence
  chemically synthesized
gccaccgcgctgggcctgtg

SEQ ID NO: 619976 - DNA, 20 bp, Artificial Sequence
  chemically synthesized
tgccttggcctcccaaagtg

SEQ ID NO: 619977 - DNA, 20 bp, Artificial Sequence
  chemically synthesized
caggcggatcacctgaggtc

SEQ ID NO: 619978 - DNA, 20 bp, Artificial Sequence
  chemically synthesized
ttttgtatttttagtagaga

SEQ ID NO: 619979 - DNA, 20 bp, Artificial Sequence
  chemically synthesized
tacctcagcctcccgagtag

SEQ ID NO: 619980 - DNA, 20 bp, Artificial Sequence
  chemically synthesized
aacctccatctcccaggttc

SEQ ID NO: 619981 - DNA, 20 bp, Artificial Sequence
  chemically synthesized
cctgggcgataagagtgaaa

SEQ ID NO: 619982 - DNA, 20 bp, Artificial Sequence
  chemically synthesized
tttgtttttggtttttgaaa

SEQ ID NO: 619983 - DNA, 20 bp, Artificial Sequence
  chemically synthesized
tttttttgtcgttgtttgtt

SEQ ID NO: 619984 - DNA, 20 bp, Artificial Sequence
  chemically synthesized
gcccagatttttttgtcgtt

SEQ ID NO: 619985 - DNA, 20 bp, Artificial Sequence
  chemically synthesized
ctgtgcccagatttttttgt

SEQ ID NO: 619986 - DNA, 20 bp, Artificial Sequence
  chemically synthesized
tccttgtgtaattatctgtg

SEQ ID NO: 619987 - DNA, 20 bp, Artificial Sequence
  chemically synthesized
tctgggcacagataattaca

SEQ ID NO: 619988 - DNA, 20 bp, Artificial Sequence
  chemically synthesized
gtgattcagaagttatttag

SEQ ID NO: 619989 - DNA, 20 bp, Artificial Sequence
  chemically synthesized
caaatcaatggtgcatttac

SEQ ID NO: 619990 - DNA, 20 bp, Artificial Sequence
  chemically synthesized
tgaatcacctgtaaatgcac

SEQ ID NO: 619991 - DNA, 20 bp, Artificial Sequence
  chemically synthesized
accttttaacttattccaca

SEQ ID NO: 619992 - DNA, 20 bp, Artificial Sequence
  chemically synthesized
agcagctcggtgagcatttc

SEQ ID NO: 619993 - DNA, 20 bp, Artificial Sequence
  chemically synthesized
gaatttgaccaagttctcat

SEQ ID NO: 619994 - DNA, 20 bp, Artificial Sequence
  chemically synthesized
taccagcttttatgttacac

SEQ ID NO: 619995 - DNA, 20 bp, Artificial Sequence
  chemically synthesized
acacagctgtttattaccat

SEQ ID NO: 619996 - DNA, 20 bp, Artificial Sequence
  chemically synthesized
gcatgatggaaattatgctg

SEQ ID NO: 619997 - DNA, 20 bp, Artificial Sequence
  chemically synthesized
ttctacttattatttggacc

SEQ ID NO: 619998 - DNA, 20 bp, Artificial Sequence
  chemically synthesized
ttgtatacagataattaaat

SEQ ID NO: 619999 - DNA, 20 bp, Artificial Sequence
  chemically synthesized
atttctttttaatgttattt

SEQ ID NO: 620000 - DNA, 20 bp, Artificial Sequence
  chemically synthesized
taaatctctgacagtaaagt

SEQ ID NO: 620001 - DNA, 20 bp, Artificial Sequence
  chemically synthesized
ataatctttcactttactgt

SEQ ID NO: 620002 - DNA, 20 bp, Artificial Sequence
  chemically synthesized
atatctactgaataaaaaag

SEQ ID NO: 620003 - DNA, 20 bp, Artificial Sequence
  chemically synthesized
tatcctcagtataccaattg

SEQ ID NO: 620004 - DNA, 20 bp, Artificial Sequence
  chemically synthesized
attgttcagttttggtgcaa

SEQ ID NO: 620005 - DNA, 20 bp, Artificial Sequence
  chemically synthesized
agtaagaaaccctgagaggg

SEQ ID NO: 620006 - DNA, 20 bp, Artificial Sequence
  chemically synthesized
acaattaaacatgtccctct

SEQ ID NO: 620007 - DNA, 20 bp, Artificial Sequence
  chemically synthesized
aagtatgtatttatgtgctt

SEQ ID NO: 620008 - DNA, 20 bp, Artificial Sequence
  chemically synthesized
ataatagtaagtatgtattt

SEQ ID NO: 620009 - DNA, 20 bp, Artificial Sequence
  chemically synthesized
ctatatatcacaaagcacta

SEQ ID NO: 620010 - DNA, 20 bp, Artificial Sequence
  chemically synthesized
aaaatgtattttaagcctct

SEQ ID NO: 620011 - DNA, 20 bp, Artificial Sequence
  chemically synthesized
ttggcagttgggcctgatca

SEQ ID NO: 620012 - DNA, 20 bp, Artificial Sequence
  chemically synthesized
ttgatcaggcccaactgcca

SEQ ID NO: 620013 - DNA, 20 bp, Artificial Sequence
  chemically synthesized
aactgccaataagtttgaag

SEQ ID NO: 620014 - DNA, 20 bp, Artificial Sequence
  chemically synthesized
tttgaagacaggattcaaac

SEQ ID NO: 620015 - DNA, 20 bp, Artificial Sequence
  chemically synthesized
tgagatttggagaggcaaac

SEQ ID NO: 620016 - DNA, 20 bp, Artificial Sequence
  chemically synthesized
ctcatggcttggtatagttc

SEQ ID NO: 620017 - DNA, 20 bp, Artificial Sequence
  chemically synthesized
tagctgtttaatatgtaact

SEQ ID NO: 620018 - DNA, 20 bp, Artificial Sequence
  chemically synthesized
ccaccacgcccacctgcctt

SEQ ID NO: 620019 - DNA, 20 bp, Artificial Sequence
  chemically synthesized
cacctcagcctcccaaagtg

SEQ ID NO: 620020 - DNA, 20 bp, Artificial Sequence
  chemically synthesized
ttttgtgtttttagtagaga

SEQ ID NO: 620021 - DNA, 20 bp, Artificial Sequence
  chemically synthesized
caccaagcccggctaatttt

SEQ ID NO: 620022 - DNA, 20 bp, Artificial Sequence
  chemically synthesized
ctaaaaacacaaaaaattag

SEQ ID NO: 620023 - DNA, 20 bp, Artificial Sequence
  chemically synthesized
tgcctcagcctctcgagtag

SEQ ID NO: 620024 - DNA, 20 bp, Artificial Sequence
  chemically synthesized
aacctccgcctgccaggttc

SEQ ID NO: 620025 - DNA, 20 bp, Artificial Sequence
  chemically synthesized
atttatttatttatttgaga

SEQ ID NO: 620026 - DNA, 20 bp, Artificial Sequence
  chemically synthesized
taatattgactgttagcctt

SEQ ID NO: 620027 - DNA, 20 bp, Artificial Sequence
  chemically synthesized
attaaaaattataaacacta

SEQ ID NO: 620028 - DNA, 20 bp, Artificial Sequence
  chemically synthesized
aataagttagagaaacactt

SEQ ID NO: 620029 - DNA, 20 bp, Artificial Sequence
  chemically synthesized
tccttctcaggccgtattta

SEQ ID NO: 620030 - DNA, 20 bp, Artificial Sequence
  chemically synthesized
ggagtccttctcaggccgta

SEQ ID NO: 620031 - DNA, 20 bp, Artificial Sequence
  chemically synthesized
caacctatctcaataggtag

SEQ ID NO: 620032 - DNA, 20 bp, Artificial Sequence
  chemically synthesized
tcacaggcccatactcctaa

SEQ ID NO: 620033 - DNA, 20 bp, Artificial Sequence
  chemically synthesized
ggctgggattggccaagact

SEQ ID NO: 620034 - DNA, 20 bp, Artificial Sequence
  chemically synthesized
aactggctgaagaatggcgg

SEQ ID NO: 620035 - DNA, 20 bp, Artificial Sequence
  chemically synthesized
ttcttcagccagttatacac

SEQ ID NO: 620036 - DNA, 20 bp, Artificial Sequence
  chemically synthesized
cgctgtttgccttatttgaa

SEQ ID NO: 620037 - DNA, 20 bp, Artificial Sequence
  chemically synthesized
cagctggattggttacagct

SEQ ID NO: 620038 - DNA, 20 bp, Artificial Sequence
  chemically synthesized
cagcgagctgtaaccaatcc

SEQ ID NO: 620039 - DNA, 20 bp, Artificial Sequence
  chemically synthesized
ggaagtgagatgcagaaaca

SEQ ID NO: 620040 - DNA, 20 bp, Artificial Sequence
  chemically synthesized
cagctgtttctgcatctcac

SEQ ID NO: 620041 - DNA, 20 bp, Artificial Sequence
  chemically synthesized
caggcagccctcagaattac

SEQ ID NO: 620042 - DNA, 20 bp, Artificial Sequence
  chemically synthesized
ctgctgtaattctgagggct

SEQ ID NO: 620043 - DNA, 20 bp, Artificial Sequence
  chemically synthesized
aaggagtttaattgagcaat

SEQ ID NO: 620044 - DNA, 20 bp, Artificial Sequence
  chemically synthesized
ttgagccaaattaaagttaa

SEQ ID NO: 620045 - DNA, 20 bp, Artificial Sequence
  chemically synthesized
tcctttaactttaatttggc

SEQ ID NO: 620046 - DNA, 20 bp, Artificial Sequence
  chemically synthesized
ttaaaaatagcatttaactc

SEQ ID NO: 620047 - DNA, 20 bp, Artificial Sequence
  chemically synthesized
tcctttgattcagtggttgc

SEQ ID NO: 620048 - DNA, 20 bp, Artificial Sequence
  chemically synthesized
gatcatgaaagttctgccct

SEQ ID NO: 620049 - DNA, 20 bp, Artificial Sequence
  chemically synthesized
ccctaatggattaatgagtt

SEQ ID NO: 620050 - DNA, 20 bp, Artificial Sequence
  chemically synthesized
attatcatgggaatggcact

SEQ ID NO: 620051 - DNA, 20 bp, Artificial Sequence
  chemically synthesized
taaaggcaagagaggagttg

SEQ ID NO: 620052 - DNA, 20 bp, Artificial Sequence
  chemically synthesized
taagcccaggaataattaag

SEQ ID NO: 620053 - DNA, 20 bp, Artificial Sequence
  chemically synthesized
caagctgctcttaattattc

SEQ ID NO: 620054 - DNA, 20 bp, Artificial Sequence
  chemically synthesized
aactataaatgtctcccaaa

SEQ ID NO: 620055 - DNA, 20 bp, Artificial Sequence
  chemically synthesized
agctaactttgggagacatt

SEQ ID NO: 620056 - DNA, 20 bp, Artificial Sequence
  chemically synthesized
agcccttccccaaaactcaa

SEQ ID NO: 620057 - DNA, 20 bp, Artificial Sequence
  chemically synthesized
cattagctctacaaacgcgg

SEQ ID NO: 620058 - DNA, 20 bp, Artificial Sequence
  chemically synthesized
atgtctacaccgcagcagaa

SEQ ID NO: 620059 - DNA, 20 bp, Artificial Sequence
  chemically synthesized
ttctgctgcggtgtagacat

SEQ ID NO: 620060 - DNA, 20 bp, Artificial Sequence
  chemically synthesized
caacatcactattgtagaac

SEQ ID NO: 620061 - DNA, 20 bp, Artificial Sequence
  chemically synthesized
gaggacccttgcccacagtc

SEQ ID NO: 620062 - DNA, 20 bp, Artificial Sequence
  chemically synthesized
aggtgcttgctgctgactgg

SEQ ID NO: 620063 - DNA, 20 bp, Artificial Sequence
  chemically synthesized
tcagcagcaagcacctattg

SEQ ID NO: 620064 - DNA, 20 bp, Artificial Sequence
  chemically synthesized
catgtggaaagctacgcaat

SEQ ID NO: 620065 - DNA, 20 bp, Artificial Sequence
  chemically synthesized
ctgaggctagggttttcaag

SEQ ID NO: 620066 - DNA, 20 bp, Artificial Sequence
  chemically synthesized
ctcctcaagaagtctgaggc

SEQ ID NO: 620067 - DNA, 20 bp, Artificial Sequence
  chemically synthesized
agcctcagacttcttgagga

SEQ ID NO: 620068 - DNA, 20 bp, Artificial Sequence
  chemically synthesized
gtaatagtaaaactctgatc

SEQ ID NO: 620069 - DNA, 20 bp, Artificial Sequence
  chemically synthesized
ccaccagctaagcagaagat

SEQ ID NO: 620070 - DNA, 20 bp, Artificial Sequence
  chemically synthesized
aagacaagggaattgcaatg

SEQ ID NO: 620071 - DNA, 20 bp, Artificial Sequence
  chemically synthesized
ctttcctgctgcccaggtag

SEQ ID NO: 620072 - DNA, 20 bp, Artificial Sequence
  chemically synthesized
ttcctttttgaaataagtaa

SEQ ID NO: 620073 - DNA, 20 bp, Artificial Sequence
  chemically synthesized
aagtaacctagtttcaggta

SEQ ID NO: 620074 - DNA, 20 bp, Artificial Sequence
  chemically synthesized
ataccgtattgggatatctt

SEQ ID NO: 620075 - DNA, 20 bp, Artificial Sequence
  chemically synthesized
tatcttagatgttttggcat

SEQ ID NO: 620076 - DNA, 20 bp, Artificial Sequence
  chemically synthesized
ctgaatgcattttcgtaaga

SEQ ID NO: 620077 - DNA, 20 bp, Artificial Sequence
  chemically synthesized
ttcagttataattttgcaat

SEQ ID NO: 620078 - DNA, 20 bp, Artificial Sequence
  chemically synthesized
aggaatgagcaaggacagcc

SEQ ID NO: 620079 - DNA, 20 bp, Artificial Sequence
  chemically synthesized
taagttcctcccaaagttat

SEQ ID NO: 620080 - DNA, 20 bp, Artificial Sequence
  chemically synthesized
tgaaataactttgggaggaa

SEQ ID NO: 620081 - DNA, 20 bp, Artificial Sequence
  chemically synthesized
actttgggaggaacttagtt

SEQ ID NO: 620082 - DNA, 20 bp, Artificial Sequence
  chemically synthesized
gaggaacttagtttatagct

SEQ ID NO: 620083 - DNA, 20 bp, Artificial Sequence
  chemically synthesized
tggggaagggttgtcattgc

SEQ ID NO: 620084 - DNA, 20 bp, Artificial Sequence
  chemically synthesized
agtccccaggcaagaaggag

SEQ ID NO: 620085 - DNA, 20 bp, Artificial Sequence
  chemically synthesized
gtaggactaacaaaatagcc

SEQ ID NO: 620086 - DNA, 20 bp, Artificial Sequence
  chemically synthesized
atagccaaaagattagaaat

SEQ ID NO: 620087 - DNA, 20 bp, Artificial Sequence
  chemically synthesized
tgcagctagagactacaaga

SEQ ID NO: 620088 - DNA, 20 bp, Artificial Sequence
  chemically synthesized
accattgtaaagcctaagat

SEQ ID NO: 620089 - DNA, 20 bp, Artificial Sequence
  chemically synthesized
aaacgtctcaagcactgatc

SEQ ID NO: 620090 - DNA, 20 bp, Artificial Sequence
  chemically synthesized
aagcctaagatcagtgcttg

SEQ ID NO: 620091 - DNA, 20 bp, Artificial Sequence
  chemically synthesized
ggggtcataggatgagatga

SEQ ID NO: 620092 - DNA, 20 bp, Artificial Sequence
  chemically synthesized
caggaactgactcagggcaa

SEQ ID NO: 620093 - DNA, 20 bp, Artificial Sequence
  chemically synthesized
ggcaagacagctttgactcc

SEQ ID NO: 620094 - DNA, 20 bp, Artificial Sequence
  chemically synthesized
gagcagccagtggtcagaag

SEQ ID NO: 620095 - DNA, 20 bp, Artificial Sequence
  chemically synthesized
ctccctgagcatttggggac

SEQ ID NO: 620096 - DNA, 20 bp, Artificial Sequence
  chemically synthesized
ggtccccaaatgctcaggga

SEQ ID NO: 620097 - DNA, 20 bp, Artificial Sequence
  chemically synthesized
gagcaggctgtatgggagac

SEQ ID NO: 620098 - DNA, 20 bp, Artificial Sequence
  chemically synthesized
cttgcccactctctagacag

SEQ ID NO: 620099 - DNA, 20 bp, Artificial Sequence
  chemically synthesized
acactcgatcaccctaaagt

SEQ ID NO: 620100 - DNA, 20 bp, Artificial Sequence
  chemically synthesized
ctggtgtgcctgggggctaa

SEQ ID NO: 620101 - DNA, 20 bp, Artificial Sequence
  chemically synthesized
taaagtcccatatcccacaa

SEQ ID NO: 620102 - DNA, 20 bp, Artificial Sequence
  chemically synthesized
tttttgtttttcaggaattt

SEQ ID NO: 620103 - DNA, 20 bp, Artificial Sequence
  chemically synthesized
cttgttttatttttgtttgt

SEQ ID NO: 620104 - DNA, 20 bp, Artificial Sequence
  chemically synthesized
acttttcttgttttattttt

SEQ ID NO: 620105 - DNA, 20 bp, Artificial Sequence
  chemically synthesized
accaacttttcttgttttat

SEQ ID NO: 620106 - DNA, 20 bp, Artificial Sequence
  chemically synthesized
attttagggtaaccaacttt

SEQ ID NO: 620107 - DNA, 20 bp, Artificial Sequence
  chemically synthesized
aagttggttaccctaaaatg

SEQ ID NO: 620108 - DNA, 20 bp, Artificial Sequence
  chemically synthesized
aaatactatttactagaagc

SEQ ID NO: 620109 - DNA, 20 bp, Artificial Sequence
  chemically synthesized
taatatacataaccaaaagc

SEQ ID NO: 620110 - DNA, 20 bp, Artificial Sequence
  chemically synthesized
atagggcaaagcaagaaaat

SEQ ID NO: 620111 - DNA, 20 bp, Artificial Sequence
  chemically synthesized
acctagtaaagctttcattt

SEQ ID NO: 620112 - DNA, 20 bp, Artificial Sequence
  chemically synthesized
cggtcacagttttgacctag

SEQ ID NO: 620113 - DNA, 20 bp, Artificial Sequence
  chemically synthesized
agttgaacctcttgggcggt

SEQ ID NO: 620114 - DNA, 20 bp, Artificial Sequence
  chemically synthesized
ctcgcctgctgcctggacag

SEQ ID NO: 620115 - DNA, 20 bp, Artificial Sequence
  chemically synthesized
gagccagctgtgcgggagac

SEQ ID NO: 620116 - DNA, 20 bp, Artificial Sequence
  chemically synthesized
gctccccgaatgcttgggga

SEQ ID NO: 620117 - DNA, 20 bp, Artificial Sequence
  chemically synthesized
ctccccaagcattcggggag

SEQ ID NO: 620118 - DNA, 20 bp, Artificial Sequence
  chemically synthesized
ccttaaaaactctgctcccc

SEQ ID NO: 620119 - DNA, 20 bp, Artificial Sequence
  chemically synthesized
ccagtcagcactcctggctc

SEQ ID NO: 620120 - DNA, 20 bp, Artificial Sequence
  chemically synthesized
aagaagacagctccgactcc

SEQ ID NO: 620121 - DNA, 20 bp, Artificial Sequence
  chemically synthesized
gaggccacaagatcagatga

SEQ ID NO: 620122 - DNA, 20 bp, Artificial Sequence
  chemically synthesized
caccaaactgctcctaagat

SEQ ID NO: 620123 - DNA, 20 bp, Artificial Sequence
  chemically synthesized
tctcaagcactgatcttagg

SEQ ID NO: 620124 - DNA, 20 bp, Artificial Sequence
  chemically synthesized
gagtcatgcagctggaggca

SEQ ID NO: 620125 - DNA, 20 bp, Artificial Sequence
  chemically synthesized
tcagccacagtgttagaaat

SEQ ID NO: 620126 - DNA, 20 bp, Artificial Sequence
  chemically synthesized
aattccttcttgcctgggac

SEQ ID NO: 620127 - DNA, 20 bp, Artificial Sequence
  chemically synthesized
taccatctttaaactgtaaa

SEQ ID NO: 620128 - DNA, 20 bp, Artificial Sequence
  chemically synthesized
actttgggagaaacttagtt

SEQ ID NO: 620129 - DNA, 20 bp, Artificial Sequence
  chemically synthesized
tgaactaactttgggagaaa

SEQ ID NO: 620130 - DNA, 20 bp, Artificial Sequence
  chemically synthesized
tatgcccaggaatgaacgaa

SEQ ID NO: 620131 - DNA, 20 bp, Artificial Sequence
  chemically synthesized
atctaacttaactgactcca

SEQ ID NO: 620132 - DNA, 20 bp, Artificial Sequence
  chemically synthesized
agcaagatggagtcagttaa

SEQ ID NO: 620133 - DNA, 20 bp, Artificial Sequence
  chemically synthesized
agatggagtcagttaagtta

SEQ ID NO: 620134 - DNA, 20 bp, Artificial Sequence
  chemically synthesized
ctcagacctaattttgcaaa

SEQ ID NO: 620135 - DNA, 20 bp, Artificial Sequence
  chemically synthesized
ggtggtttcaatcccttcct

SEQ ID NO: 620136 - DNA, 20 bp, Artificial Sequence
  chemically synthesized
agtgttagaaaacccaaagg

SEQ ID NO: 620137 - DNA, 20 bp, Artificial Sequence
  chemically synthesized
gggaaaaggccgtcgatcgc

SEQ ID NO: 620138 - DNA, 20 bp, Artificial Sequence
  chemically synthesized
ctccaaggtgagaagagtgg

SEQ ID NO: 620139 - DNA, 20 bp, Artificial Sequence
  chemically synthesized
gaagagtggaactgctttgc

SEQ ID NO: 620140 - DNA, 20 bp, Artificial Sequence
  chemically synthesized
aactgctttgcaactgtttg

SEQ ID NO: 620141 - DNA, 20 bp, Artificial Sequence
  chemically synthesized
gtggattcatgcaggcctaa

SEQ ID NO: 620142 - DNA, 20 bp, Artificial Sequence
  chemically synthesized
tgcaggcctaattgggcttc

SEQ ID NO: 620143 - DNA, 20 bp, Artificial Sequence
  chemically synthesized
aaaactatagatgagagtaa

SEQ ID NO: 620144 - DNA, 20 bp, Artificial Sequence
  chemically synthesized
gaaacattattactctcatc

SEQ ID NO: 620145 - DNA, 20 bp, Artificial Sequence
  chemically synthesized
tctcatctatagttttacta

SEQ ID NO: 620146 - DNA, 20 bp, Artificial Sequence
  chemically synthesized
ccaaactaatgatttcaaat

SEQ ID NO: 620147 - DNA, 20 bp, Artificial Sequence
  chemically synthesized
aaaagcaaacatttgaaatc

SEQ ID NO: 620148 - DNA, 20 bp, Artificial Sequence
  chemically synthesized
gttcccaaactaatgatttc

SEQ ID NO: 620149 - DNA, 20 bp, Artificial Sequence
  chemically synthesized
tgggttagaagttcccaaac

SEQ ID NO: 620150 - DNA, 20 bp, Artificial Sequence
  chemically synthesized
tcagtttagactaaattcta

SEQ ID NO: 620151 - DNA, 20 bp, Artificial Sequence
  chemically synthesized
gctattcttgaggttaattc

SEQ ID NO: 620152 - DNA, 20 bp, Artificial Sequence
  chemically synthesized
aattaacctcaagaatagct

SEQ ID NO: 620153 - DNA, 20 bp, Artificial Sequence
  chemically synthesized
aagaatagctaatagtttac

SEQ ID NO: 620154 - DNA, 20 bp, Artificial Sequence
  chemically synthesized
ggggactgaacagagaaata

SEQ ID NO: 620155 - DNA, 20 bp, Artificial Sequence
  chemically synthesized
agcaaatcatttctatcatg

SEQ ID NO: 620156 - DNA, 20 bp, Artificial Sequence
  chemically synthesized
ttaaaaacaaatcatgatag

SEQ ID NO: 620157 - DNA, 20 bp, Artificial Sequence
  chemically synthesized
ttataagcaaatcatttcta

SEQ ID NO: 620158 - DNA, 20 bp, Artificial Sequence
  chemically synthesized
aacaaatcatgatagaaatg

SEQ ID NO: 620159 - DNA, 20 bp, Artificial Sequence
  chemically synthesized
ttttagtcttactgtacttg

SEQ ID NO: 620160 - DNA, 20 bp, Artificial Sequence
  chemically synthesized
caagaataattatttttcac

SEQ ID NO: 620161 - DNA, 20 bp, Artificial Sequence
  chemically synthesized
ttttcacttaggctttttaa

SEQ ID NO: 620162 - DNA, 20 bp, Artificial Sequence
  chemically synthesized
cggctttcaaaaagtcttat

SEQ ID NO: 620163 - DNA, 20 bp, Artificial Sequence
  chemically synthesized
tttgaaagccgagcccagcc

SEQ ID NO: 620164 - DNA, 20 bp, Artificial Sequence
  chemically synthesized
ggtacaaacccatggctggg

SEQ ID NO: 620165 - DNA, 20 bp, Artificial Sequence
  chemically synthesized
ctgtgtggacaaggtatgag

SEQ ID NO: 620166 - DNA, 20 bp, Artificial Sequence
  chemically synthesized
gtatgaggccagattcccca

SEQ ID NO: 620167 - DNA, 20 bp, Artificial Sequence
  chemically synthesized
taaatggctctataagtcaa

SEQ ID NO: 620168 - DNA, 20 bp, Artificial Sequence
  chemically synthesized
ccaaggctttgactggaatg

SEQ ID NO: 620169 - DNA, 20 bp, Artificial Sequence
  chemically synthesized
ggagaaattggtcattttac

SEQ ID NO: 620170 - DNA, 20 bp, Artificial Sequence
  chemically synthesized
ggtgtcctgttacaaaagaa

SEQ ID NO: 620171 - DNA, 20 bp, Artificial Sequence
  chemically synthesized
attgcatacgtgcaataaga

SEQ ID NO: 620172 - DNA, 20 bp, Artificial Sequence
  chemically synthesized
ataaattgagaatactcaca

SEQ ID NO: 620173 - DNA, 20 bp, Artificial Sequence
  chemically synthesized
gagcaaatttgtttctctct

SEQ ID NO: 620174 - DNA, 20 bp, Artificial Sequence
  chemically synthesized
agtgacaaattttggagcaa

SEQ ID NO: 620175 - DNA, 20 bp, Artificial Sequence
  chemically synthesized
ttatgttgactctgaaaaca

SEQ ID NO: 620176 - DNA, 20 bp, Artificial Sequence
  chemically synthesized
tctgaaaacaaaaggattag

SEQ ID NO: 620177 - DNA, 20 bp, Artificial Sequence
  chemically synthesized
gtgttaaacattgctaatcc

SEQ ID NO: 620178 - DNA, 20 bp, Artificial Sequence
  chemically synthesized
ggattagcaatgtttaacac

SEQ ID NO: 620179 - DNA, 20 bp, Artificial Sequence
  chemically synthesized
cacatcagtttgccacattt

SEQ ID NO: 620180 - DNA, 20 bp, Artificial Sequence
  chemically synthesized
acctgcactcagagtattat

SEQ ID NO: 620181 - DNA, 20 bp, Artificial Sequence
  chemically synthesized
tgctttggtccttttcaaaa

SEQ ID NO: 620182 - DNA, 20 bp, Artificial Sequence
  chemically synthesized
tgtcatccacagacatttta

SEQ ID NO: 620183 - DNA, 20 bp, Artificial Sequence
  chemically synthesized
aaccaaaattcctagtcaat

SEQ ID NO: 620184 - DNA, 20 bp, Artificial Sequence
  chemically synthesized
gggaaacttctataattctg

SEQ ID NO: 620185 - DNA, 20 bp, Artificial Sequence
  chemically synthesized
tgaaatcatatcagaattat

SEQ ID NO: 620186 - DNA, 20 bp, Artificial Sequence
  chemically synthesized
aaatagaagagtgaatggtg

SEQ ID NO: 620187 - DNA, 20 bp, Artificial Sequence
  chemically synthesized
ctttcaaatagaagagtgaa

SEQ ID NO: 620188 - DNA, 20 bp, Artificial Sequence
  chemically synthesized
caccattcactcttctattt

SEQ ID NO: 620189 - DNA, 20 bp, Artificial Sequence
  chemically synthesized
aggtttctgattaataactc

SEQ ID NO: 620190 - DNA, 20 bp, Artificial Sequence
  chemically synthesized
aggtggtcttaaatgcaggt

SEQ ID NO: 620191 - DNA, 20 bp, Artificial Sequence
  chemically synthesized
tgtaacaggtggtcttaaat

SEQ ID NO: 620192 - DNA, 20 bp, Artificial Sequence
  chemically synthesized
gaaactctgtctcaaaaaaa

SEQ ID NO: 620193 - DNA, 20 bp, Artificial Sequence
  chemically synthesized
aaaaccatttttttttgaga

SEQ ID NO: 620194 - DNA, 20 bp, Artificial Sequence
  chemically synthesized
aacctccgcctcctaggttc

SEQ ID NO: 620195 - DNA, 20 bp, Artificial Sequence
  chemically synthesized
tcgggagaccgaggcaggag

SEQ ID NO: 620196 - DNA, 20 bp, Artificial Sequence
  chemically synthesized
tgcctcggtctcccgagtag

SEQ ID NO: 620197 - DNA, 20 bp, Artificial Sequence
  chemically synthesized
ccgagtagctgggattacag

SEQ ID NO: 620198 - DNA, 20 bp, Artificial Sequence
  chemically synthesized
ttttgtatttttagtagaga

SEQ ID NO: 620199 - DNA, 20 bp, Artificial Sequence
  chemically synthesized
cacctcggcctcctaacgtg

SEQ ID NO: 620200 - DNA, 20 bp, Artificial Sequence
  chemically synthesized
tcatttttgtcctcttaaaa

SEQ ID NO: 620201 - DNA, 20 bp, Artificial Sequence
  chemically synthesized
ctttaactctggctactcta

SEQ ID NO: 620202 - DNA, 20 bp, Artificial Sequence
  chemically synthesized
acagaggtaacaaatttcct

SEQ ID NO: 620203 - DNA, 20 bp, Artificial Sequence
  chemically synthesized
ctaagtcatattagaattat

SEQ ID NO: 620204 - DNA, 20 bp, Artificial Sequence
  chemically synthesized
atatatgattgacatatgtt

SEQ ID NO: 620205 - DNA, 20 bp, Artificial Sequence
  chemically synthesized
ggggctatatttgtgtaaat

SEQ ID NO: 620206 - DNA, 20 bp, Artificial Sequence
  chemically synthesized
ttgtcaaatatgaaatggtg

SEQ ID NO: 620207 - DNA, 20 bp, Artificial Sequence
  chemically synthesized
aaacattgtcaaatatgaaa

SEQ ID NO: 620208 - DNA, 20 bp, Artificial Sequence
  chemically synthesized
aaacaccatttcatatttga

SEQ ID NO: 620209 - DNA, 20 bp, Artificial Sequence
  chemically synthesized
catatttgacaatgtttcct

SEQ ID NO: 620210 - DNA, 20 bp, Artificial Sequence
  chemically synthesized
ctttagaggacctaatatct

SEQ ID NO: 620211 - DNA, 20 bp, Artificial Sequence
  chemically synthesized
agaaagagacataatttata

SEQ ID NO: 620212 - DNA, 20 bp, Artificial Sequence
  chemically synthesized
taatttataatttgattttg

SEQ ID NO: 620213 - DNA, 20 bp, Artificial Sequence
  chemically synthesized
tggaaagtttgccaaatatc

SEQ ID NO: 620214 - DNA, 20 bp, Artificial Sequence
  chemically synthesized
ggattctattttgtgatatc

SEQ ID NO: 620215 - DNA, 20 bp, Artificial Sequence
  chemically synthesized
aatgaatgacttatggtgac

SEQ ID NO: 620216 - DNA, 20 bp, Artificial Sequence
  chemically synthesized
ttcttttaagattttggagt

SEQ ID NO: 620217 - DNA, 20 bp, Artificial Sequence
  chemically synthesized
tcagaataaaggtttttctt

SEQ ID NO: 620218 - DNA, 20 bp, Artificial Sequence
  chemically synthesized
taagtctcctctgtcagaat

SEQ ID NO: 620219 - DNA, 20 bp, Artificial Sequence
  chemically synthesized
ctttattctgacagaggaga

SEQ ID NO: 620220 - DNA, 20 bp, Artificial Sequence
  chemically synthesized
ctcatgctgtctttattggg

SEQ ID NO: 620221 - DNA, 20 bp, Artificial Sequence
  chemically synthesized
gttaaaagataatgaaaggg

SEQ ID NO: 620222 - DNA, 20 bp, Artificial Sequence
  chemically synthesized
gtaacgttaaaagataatga

SEQ ID NO: 620223 - DNA, 20 bp, Artificial Sequence
  chemically synthesized
aatttggttttctcttttga

SEQ ID NO: 620224 - DNA, 20 bp, Artificial Sequence
  chemically synthesized
gcactaatgcgaacatgaaa

SEQ ID NO: 620225 - DNA, 20 bp, Artificial Sequence
  chemically synthesized
agtgcatctttaatgctaaa

SEQ ID NO: 620226 - DNA, 20 bp, Artificial Sequence
  chemically synthesized
acataaaattttatttaaaa

SEQ ID NO: 620227 - DNA, 20 bp, Artificial Sequence
  chemically synthesized
aataaaattttatgtatcta

SEQ ID NO: 620228 - DNA, 20 bp, Artificial Sequence
  chemically synthesized
tatgtatctatccagtttta

SEQ ID NO: 620229 - DNA, 20 bp, Artificial Sequence
  chemically synthesized
acattctcataaacttttta

SEQ ID NO: 620230 - DNA, 20 bp, Artificial Sequence
  chemically synthesized
gaaaattataaagcgttcta

SEQ ID NO: 620231 - DNA, 20 bp, Artificial Sequence
  chemically synthesized
gtcttcttagaaaattgatc

SEQ ID NO: 620232 - DNA, 20 bp, Artificial Sequence
  chemically synthesized
ctgttatttggacacatggg

SEQ ID NO: 620233 - DNA, 20 bp, Artificial Sequence
  chemically synthesized
ctaagatttgaaaaaggtta

SEQ ID NO: 620234 - DNA, 20 bp, Artificial Sequence
  chemically synthesized
cctttttcaaatcttagcca

SEQ ID NO: 620235 - DNA, 20 bp, Artificial Sequence
  chemically synthesized
tgtgggtataaacaagttgg

SEQ ID NO: 620236 - DNA, 20 bp, Artificial Sequence
  chemically synthesized
ccctgtataaacccttttca

SEQ ID NO: 620237 - DNA, 20 bp, Artificial Sequence
  chemically synthesized
gagggtttaagcaaagtgaa

SEQ ID NO: 620238 - DNA, 20 bp, Artificial Sequence
  chemically synthesized
cttttcactttgcttaaacc

SEQ ID NO: 620239 - DNA, 20 bp, Artificial Sequence
  chemically synthesized
aagagtaacggaacgaaact

SEQ ID NO: 620240 - DNA, 20 bp, Artificial Sequence
  chemically synthesized
cagtttcgttccgttactct

SEQ ID NO: 620241 - DNA, 20 bp, Artificial Sequence
  chemically synthesized
aatgtaattttgtctagttc

SEQ ID NO: 620242 - DNA, 20 bp, Artificial Sequence
  chemically synthesized
aagataataaggcataggaa

SEQ ID NO: 620243 - DNA, 20 bp, Artificial Sequence
  chemically synthesized
acatacaaggtgtgtaggga

SEQ ID NO: 620244 - DNA, 20 bp, Artificial Sequence
  chemically synthesized
cctacacaccttgtatgtaa

SEQ ID NO: 620245 - DNA, 20 bp, Artificial Sequence
  chemically synthesized
gaaatcgaggttactggaga

SEQ ID NO: 620246 - DNA, 20 bp, Artificial Sequence
  chemically synthesized
taaaactgtttctccagtaa

SEQ ID NO: 620247 - DNA, 20 bp, Artificial Sequence
  chemically synthesized
acaatgttaactcttagcaa

SEQ ID NO: 620248 - DNA, 20 bp, Artificial Sequence
  chemically synthesized
taattaaaatagctttttta

SEQ ID NO: 620249 - DNA, 20 bp, Artificial Sequence
  chemically synthesized
catccctagcatataattaa

SEQ ID NO: 620250 - DNA, 20 bp, Artificial Sequence
  chemically synthesized
caattttccaaagtcaagga

SEQ ID NO: 620251 - DNA, 20 bp, Artificial Sequence
  chemically synthesized
tgctaaattctttaaggtca

SEQ ID NO: 620252 - DNA, 20 bp, Artificial Sequence
  chemically synthesized
ggtctaaattaaggtcagct

SEQ ID NO: 620253 - DNA, 20 bp, Artificial Sequence
  chemically synthesized
tttggcaataaagacaattt

SEQ ID NO: 620254 - DNA, 20 bp, Artificial Sequence
  chemically synthesized
ttaaaattgtctttattgcc

SEQ ID NO: 620255 - DNA, 20 bp, Artificial Sequence
  chemically synthesized
tcatgtgaacaaaaagtcat

SEQ ID NO: 620256 - DNA, 20 bp, Artificial Sequence
  chemically synthesized
gattaattggcttggaaaat

SEQ ID NO: 620257 - DNA, 20 bp, Artificial Sequence
  chemically synthesized
ttataaaagagctctgatta

SEQ ID NO: 620258 - DNA, 20 bp, Artificial Sequence
  chemically synthesized
gtgtgatgtttataaaagag

SEQ ID NO: 620259 - DNA, 20 bp, Artificial Sequence
  chemically synthesized
tgtgtgtgtgtgtgtgtgtg

SEQ ID NO: 620260 - DNA, 20 bp, Artificial Sequence
  chemically synthesized
aatcttctgtctgtatttac

SEQ ID NO: 620261 - DNA, 20 bp, Artificial Sequence
  chemically synthesized
aaacacatgtaaatacagac

SEQ ID NO: 620262 - DNA, 20 bp, Artificial Sequence
  chemically synthesized
actgataagactttttattt

SEQ ID NO: 620263 - DNA, 20 bp, Artificial Sequence
  chemically synthesized
ttttatttgccagtttctta

SEQ ID NO: 620264 - DNA, 20 bp, Artificial Sequence
  chemically synthesized
gccagtttcttaatcagatt

SEQ ID NO: 620265 - DNA, 20 bp, Artificial Sequence
  chemically synthesized
gctccaccctgaagccagta

SEQ ID NO: 620266 - DNA, 20 bp, Artificial Sequence
  chemically synthesized
gccaggaaagtatgcatttc

SEQ ID NO: 620267 - DNA, 20 bp, Artificial Sequence
  chemically synthesized
agttctgtctttgccttcag

SEQ ID NO: 620268 - DNA, 20 bp, Artificial Sequence
  chemically synthesized
tactacgggagaagacagta

SEQ ID NO: 620269 - DNA, 20 bp, Artificial Sequence
  chemically synthesized
ccctacatttcttttcttat

SEQ ID NO: 620270 - DNA, 20 bp, Artificial Sequence
  chemically synthesized
aacctccgcctcctgggttc

SEQ ID NO: 620271 - DNA, 20 bp, Artificial Sequence
  chemically synthesized
tgccttagcctctcaagtag

SEQ ID NO: 620272 - DNA, 20 bp, Artificial Sequence
  chemically synthesized
ttttgtatttttcttagaga

SEQ ID NO: 620273 - DNA, 20 bp, Artificial Sequence
  chemically synthesized
agggcggatcacttgaggtc

SEQ ID NO: 620274 - DNA, 20 bp, Artificial Sequence
  chemically synthesized
tcccaaagtgcagcctccca

SEQ ID NO: 620275 - DNA, 20 bp, Artificial Sequence
  chemically synthesized
aagtgcagcctcccaaagtg

SEQ ID NO: 620276 - DNA, 20 bp, Artificial Sequence
  chemically synthesized
gtatggccgggtgccgtggc

SEQ ID NO: 620277 - DNA, 20 bp, Artificial Sequence
  chemically synthesized
gacgggctgattacaaaatg

SEQ ID NO: 620278 - DNA, 20 bp, Artificial Sequence
  chemically synthesized
tcagactcccatgaaggacg

SEQ ID NO: 620279 - DNA, 20 bp, Artificial Sequence
  chemically synthesized
atctcccagtggagggtgag

SEQ ID NO: 620280 - DNA, 20 bp, Artificial Sequence
  chemically synthesized
tatcttccgggtgaccaaaa

SEQ ID NO: 620281 - DNA, 20 bp, Artificial Sequence
  chemically synthesized
gcacacttggatccagagaa

SEQ ID NO: 620282 - DNA, 20 bp, Artificial Sequence
  chemically synthesized
gaaattacttcacattatga

SEQ ID NO: 620283 - DNA, 20 bp, Artificial Sequence
  chemically synthesized
cattgtgttatctgatggtt

SEQ ID NO: 620284 - DNA, 20 bp, Artificial Sequence
  chemically synthesized
tgtttttcattgtgttatct

SEQ ID NO: 620285 - DNA, 20 bp, Artificial Sequence
  chemically synthesized
aatgaaaaacagagcagagt

SEQ ID NO: 620286 - DNA, 20 bp, Artificial Sequence
  chemically synthesized
tctcaaaatcaaagactctg

SEQ ID NO: 620287 - DNA, 20 bp, Artificial Sequence
  chemically synthesized
tttgattttgagagggatcc

SEQ ID NO: 620288 - DNA, 20 bp, Artificial Sequence
  chemically synthesized
atccatctgtttttaattcc

SEQ ID NO: 620289 - DNA, 20 bp, Artificial Sequence
  chemically synthesized
tcctggggtttcatgtggaa

SEQ ID NO: 620290 - DNA, 20 bp, Artificial Sequence
  chemically synthesized
ttttagggaaaaaaaaaaaa

SEQ ID NO: 620291 - DNA, 20 bp, Artificial Sequence
  chemically synthesized
aacagaggaggcaccacaga

SEQ ID NO: 620292 - DNA, 20 bp, Artificial Sequence
  chemically synthesized
aacgggttctgtggtgcctc

SEQ ID NO: 620293 - DNA, 20 bp, Artificial Sequence
  chemically synthesized
ttggaacttgtttttttgga

SEQ ID NO: 620294 - DNA, 20 bp, Artificial Sequence
  chemically synthesized
tatgtttttctcttcttgga

SEQ ID NO: 620295 - DNA, 20 bp, Artificial Sequence
  chemically synthesized
tagatatatttaaaaggcct

SEQ ID NO: 620296 - DNA, 20 bp, Artificial Sequence
  chemically synthesized
aaaggccttttaaatatatc

SEQ ID NO: 620297 - DNA, 20 bp, Artificial Sequence
  chemically synthesized
gccttttaaatatatctata

SEQ ID NO: 620298 - DNA, 20 bp, Artificial Sequence
  chemically synthesized
aaagagcactatggttaaaa

SEQ ID NO: 620299 - DNA, 20 bp, Artificial Sequence
  chemically synthesized
catgccaagtggacaatatt

SEQ ID NO: 620300 - DNA, 20 bp, Artificial Sequence
  chemically synthesized
ctatgtctttgcagcaccta

SEQ ID NO: 620301 - DNA, 20 bp, Artificial Sequence
  chemically synthesized
ggtgctgcaaagacatagta

SEQ ID NO: 620302 - DNA, 20 bp, Artificial Sequence
  chemically synthesized
atagtaagaagtttcttttt

SEQ ID NO: 620303 - DNA, 20 bp, Artificial Sequence
  chemically synthesized
cctttctctggactaccttg

SEQ ID NO: 620304 - DNA, 20 bp, Artificial Sequence
  chemically synthesized
tgccatttattaagtttctt

SEQ ID NO: 620305 - DNA, 20 bp, Artificial Sequence
  chemically synthesized
ttgtgtagctttgccattta

SEQ ID NO: 620306 - DNA, 20 bp, Artificial Sequence
  chemically synthesized
cctttctgatttgttatttg

SEQ ID NO: 620307 - DNA, 20 bp, Artificial Sequence
  chemically synthesized
tggcttctggaatgattcct

SEQ ID NO: 620308 - DNA, 20 bp, Artificial Sequence
  chemically synthesized
ggttcaattgttggcttctg

SEQ ID NO: 620309 - DNA, 20 bp, Artificial Sequence
  chemically synthesized
gtggtggcctgggttcaatt

SEQ ID NO: 620310 - DNA, 20 bp, Artificial Sequence
  chemically synthesized
gctgtatatagctcagtagc

SEQ ID NO: 620311 - DNA, 20 bp, Artificial Sequence
  chemically synthesized
atacagcgttgagaaatttc

SEQ ID NO: 620312 - DNA, 20 bp, Artificial Sequence
  chemically synthesized
cccagaaggagcctagagaa

SEQ ID NO: 620313 - DNA, 20 bp, Artificial Sequence
  chemically synthesized
ggagcctagagaagccagtt

SEQ ID NO: 620314 - DNA, 20 bp, Artificial Sequence
  chemically synthesized
aaaagccttgcaagcctgaa

SEQ ID NO: 620315 - DNA, 20 bp, Artificial Sequence
  chemically synthesized
agaagccagtttcaggcttg

SEQ ID NO: 620316 - DNA, 20 bp, Artificial Sequence
  chemically synthesized
ggttcatgtcatagttactc

SEQ ID NO: 620317 - DNA, 20 bp, Artificial Sequence
  chemically synthesized
accatgtggggatactttct

SEQ ID NO: 620318 - DNA, 20 bp, Artificial Sequence
  chemically synthesized
ctgtcttgttttgtgtcctt

SEQ ID NO: 620319 - DNA, 20 bp, Artificial Sequence
  chemically synthesized
tactctatgaaatttctctg

SEQ ID NO: 620320 - DNA, 20 bp, Artificial Sequence
  chemically synthesized
acagagaaatttcatagagt

SEQ ID NO: 620321 - DNA, 20 bp, Artificial Sequence
  chemically synthesized
ttggtttcagggacctgtag

SEQ ID NO: 620322 - DNA, 20 bp, Artificial Sequence
  chemically synthesized
cccataagtctgcttttcaa

SEQ ID NO: 620323 - DNA, 20 bp, Artificial Sequence
  chemically synthesized
gtgggttaggacacccataa

SEQ ID NO: 620324 - DNA, 20 bp, Artificial Sequence
  chemically synthesized
actaatcttagcacatctga

SEQ ID NO: 620325 - DNA, 20 bp, Artificial Sequence
  chemically synthesized
cacaaactacatcagatgtg

SEQ ID NO: 620326 - DNA, 20 bp, Artificial Sequence
  chemically synthesized
aagggtttggttaatagaaa

SEQ ID NO: 620327 - DNA, 20 bp, Artificial Sequence
  chemically synthesized
aaactatttgtctcctctgc

SEQ ID NO: 620328 - DNA, 20 bp, Artificial Sequence
  chemically synthesized
aaacccttgcagaggagaca

SEQ ID NO: 620329 - DNA, 20 bp, Artificial Sequence
  chemically synthesized
gggtaagaaattcttatcag

SEQ ID NO: 620330 - DNA, 20 bp, Artificial Sequence
  chemically synthesized
ttacccttattgctgggatg

SEQ ID NO: 620331 - DNA, 20 bp, Artificial Sequence
  chemically synthesized
gtttctgggttccctttctc

SEQ ID NO: 620332 - DNA, 20 bp, Artificial Sequence
  chemically synthesized
aacggagtggcgtcttacga

SEQ ID NO: 620333 - DNA, 20 bp, Artificial Sequence
  chemically synthesized
gagtggcgtcttacgaccct

SEQ ID NO: 620334 - DNA, 20 bp, Artificial Sequence
  chemically synthesized
gcttgcttgtgctatagctg

SEQ ID NO: 620335 - DNA, 20 bp, Artificial Sequence
  chemically synthesized
agggtgattttatcttgtaa

SEQ ID NO: 620336 - DNA, 20 bp, Artificial Sequence
  chemically synthesized
tggttccataaaatggtaaa

SEQ ID NO: 620337 - DNA, 20 bp, Artificial Sequence
  chemically synthesized
accattttatggaaccataa

SEQ ID NO: 620338 - DNA, 20 bp, Artificial Sequence
  chemically synthesized
agaatcttgcaaattaagaa

SEQ ID NO: 620339 - DNA, 20 bp, Artificial Sequence
  chemically synthesized
ataaacaagattcttaattt

SEQ ID NO: 620340 - DNA, 20 bp, Artificial Sequence
  chemically synthesized
tgcggaaagaggtgactaat

SEQ ID NO: 620341 - DNA, 20 bp, Artificial Sequence
  chemically synthesized
agggaccaagatgaaaaatt

SEQ ID NO: 620342 - DNA, 20 bp, Artificial Sequence
  chemically synthesized
tctgtccctcttgtctttgc

SEQ ID NO: 620343 - DNA, 20 bp, Artificial Sequence
  chemically synthesized
cttggacttcttggttaggg

SEQ ID NO: 620344 - DNA, 20 bp, Artificial Sequence
  chemically synthesized
tctcatacagaaaataggag

SEQ ID NO: 620345 - DNA, 20 bp, Artificial Sequence
  chemically synthesized
ttcaatcaggaagattttga

SEQ ID NO: 620346 - DNA, 20 bp, Artificial Sequence
  chemically synthesized
gagaaacctcctcaaaatct

SEQ ID NO: 620347 - DNA, 20 bp, Artificial Sequence
  chemically synthesized
gggagacttctcttcaatca

SEQ ID NO: 620348 - DNA, 20 bp, Artificial Sequence
  chemically synthesized
ttctaactagtaggaagact

SEQ ID NO: 620349 - DNA, 20 bp, Artificial Sequence
  chemically synthesized
gtatcctaggtgctgccaat

SEQ ID NO: 620350 - DNA, 20 bp, Artificial Sequence
  chemically synthesized
tgtagctccgttttggggtg

SEQ ID NO: 620351 - DNA, 20 bp, Artificial Sequence
  chemically synthesized
ggtggggtgtctatctgtag

SEQ ID NO: 620352 - DNA, 20 bp, Artificial Sequence
  chemically synthesized
tgcccctgtggctacctgcc

SEQ ID NO: 620353 - DNA, 20 bp, Artificial Sequence
  chemically synthesized
ttacaaatttgggggctcac

SEQ ID NO: 620354 - DNA, 20 bp, Artificial Sequence
  chemically synthesized
gagctggctgtgtgggacac

SEQ ID NO: 620355 - DNA, 20 bp, Artificial Sequence
  chemically synthesized
aatgcctggggagaccgatt

SEQ ID NO: 620356 - DNA, 20 bp, Artificial Sequence
  chemically synthesized
gttccccgaatgcctgggga

SEQ ID NO: 620357 - DNA, 20 bp, Artificial Sequence
  chemically synthesized
ctccccaggcattcggggaa

SEQ ID NO: 620358 - DNA, 20 bp, Artificial Sequence
  chemically synthesized
ccagtcagcactcctggctc

SEQ ID NO: 620359 - DNA, 20 bp, Artificial Sequence
  chemically synthesized
aagaagacagctccaactcc

SEQ ID NO: 620360 - DNA, 20 bp, Artificial Sequence
  chemically synthesized
gaggccacaagatcagatga

SEQ ID NO: 620361 - DNA, 20 bp, Artificial Sequence
  chemically synthesized
caccaaactgctcctaagat

SEQ ID NO: 620362 - DNA, 20 bp, Artificial Sequence
  chemically synthesized
tctcaagcactgatcttagg

SEQ ID NO: 620363 - DNA, 20 bp, Artificial Sequence
  chemically synthesized
gagtcatgcagctggaggca

SEQ ID NO: 620364 - DNA, 20 bp, Artificial Sequence
  chemically synthesized
tcagccacagtattagaaat

SEQ ID NO: 620365 - DNA, 20 bp, Artificial Sequence
  chemically synthesized
gcagaccttcttgcctgggg

SEQ ID NO: 620366 - DNA, 20 bp, Artificial Sequence
  chemically synthesized
tctagtccccaggcaagaag

SEQ ID NO: 620367 - DNA, 20 bp, Artificial Sequence
  chemically synthesized
gctttgggaaagggctgtta

SEQ ID NO: 620368 - DNA, 20 bp, Artificial Sequence
  chemically synthesized
tgggaaagggctgttatgat

SEQ ID NO: 620369 - DNA, 20 bp, Artificial Sequence
  chemically synthesized
acctccactaatttatagtt

SEQ ID NO: 620370 - DNA, 20 bp, Artificial Sequence
  chemically synthesized
gcttctaacctccactaatt

SEQ ID NO: 620371 - DNA, 20 bp, Artificial Sequence
  chemically synthesized
atctaacttaactgactcca

SEQ ID NO: 620372 - DNA, 20 bp, Artificial Sequence
  chemically synthesized
ctcagtcctaattttgcagt

SEQ ID NO: 620373 - DNA, 20 bp, Artificial Sequence
  chemically synthesized
tttatggtaaaataaagtat

SEQ ID NO: 620374 - DNA, 20 bp, Artificial Sequence
  chemically synthesized
ctttattttaccataaacaa

SEQ ID NO: 620375 - DNA, 20 bp, Artificial Sequence
  chemically synthesized
gaattcattactaaaagctc

SEQ ID NO: 620376 - DNA, 20 bp, Artificial Sequence
  chemically synthesized
aattgttatcagttgtacaa

SEQ ID NO: 620377 - DNA, 20 bp, Artificial Sequence
  chemically synthesized
gctcaaatgttggaggaaag

SEQ ID NO: 620378 - DNA, 20 bp, Artificial Sequence
  chemically synthesized
gaaagggaagctttatggta

SEQ ID NO: 620379 - DNA, 20 bp, Artificial Sequence
  chemically synthesized
tttaatgaaacataatacca

SEQ ID NO: 620380 - DNA, 20 bp, Artificial Sequence
  chemically synthesized
ttatgtttcattaaactaag

SEQ ID NO: 620381 - DNA, 20 bp, Artificial Sequence
  chemically synthesized
gtacaattctgaaagcctat

SEQ ID NO: 620382 - DNA, 20 bp, Artificial Sequence
  chemically synthesized
agtaatacatataggtttaa

SEQ ID NO: 620383 - DNA, 20 bp, Artificial Sequence
  chemically synthesized
ttaaatcatcagtaatacat

SEQ ID NO: 620384 - DNA, 20 bp, Artificial Sequence
  chemically synthesized
tttaaacctatatgtattac

SEQ ID NO: 620385 - DNA, 20 bp, Artificial Sequence
  chemically synthesized
gtgagtgtatcagggaaata

SEQ ID NO: 620386 - DNA, 20 bp, Artificial Sequence
  chemically synthesized
gacaacttacgaagttgttg

SEQ ID NO: 620387 - DNA, 20 bp, Artificial Sequence
  chemically synthesized
gacttacttatatattaaat

SEQ ID NO: 620388 - DNA, 20 bp, Artificial Sequence
  chemically synthesized
ccatacttgttcctagtaaa

SEQ ID NO: 620389 - DNA, 20 bp, Artificial Sequence
  chemically synthesized
tatagagaacagtggctgaa

SEQ ID NO: 620390 - DNA, 20 bp, Artificial Sequence
  chemically synthesized
attttatagagaacagtggc

SEQ ID NO: 620391 - DNA, 20 bp, Artificial Sequence
  chemically synthesized
ggcacgcaatattaaaacaa

SEQ ID NO: 620392 - DNA, 20 bp, Artificial Sequence
  chemically synthesized
caatattaaaacaactcagt

SEQ ID NO: 620393 - DNA, 20 bp, Artificial Sequence
  chemically synthesized
gattaatgaaacataaactg

SEQ ID NO: 620394 - DNA, 20 bp, Artificial Sequence
  chemically synthesized
aaaatgaggttgttttgaat

SEQ ID NO: 620395 - DNA, 20 bp, Artificial Sequence
  chemically synthesized
attatggatttacaaaatga

SEQ ID NO: 620396 - DNA, 20 bp, Artificial Sequence
  chemically synthesized
ctgtagccaagtttgcatat

SEQ ID NO: 620397 - DNA, 20 bp, Artificial Sequence
  chemically synthesized
tctgattggacagtctgtag

SEQ ID NO: 620398 - DNA, 20 bp, Artificial Sequence
  chemically synthesized
acttggctacagactgtcca

SEQ ID NO: 620399 - DNA, 20 bp, Artificial Sequence
  chemically synthesized
tgacttgaaaggagaataaa

SEQ ID NO: 620400 - DNA, 20 bp, Artificial Sequence
  chemically synthesized
agattttattctcctttcaa

SEQ ID NO: 620401 - DNA, 20 bp, Artificial Sequence
  chemically synthesized
gcatagaaacaaccataaaa

SEQ ID NO: 620402 - DNA, 20 bp, Artificial Sequence
  chemically synthesized
tttgcaaaactgggttttat

SEQ ID NO: 620403 - DNA, 20 bp, Artificial Sequence
  chemically synthesized
ctaacttaatatttgcaaaa

SEQ ID NO: 620404 - DNA, 20 bp, Artificial Sequence
  chemically synthesized
ccatagtgtaatgctatgcc

SEQ ID NO: 620405 - DNA, 20 bp, Artificial Sequence
  chemically synthesized
actaataactttttttcttt

SEQ ID NO: 620406 - DNA, 20 bp, Artificial Sequence
  chemically synthesized
tcagatgtgtataatataac

SEQ ID NO: 620407 - DNA, 20 bp, Artificial Sequence
  chemically synthesized
aactgccagctctactcaat

SEQ ID NO: 620408 - DNA, 20 bp, Artificial Sequence
  chemically synthesized
agctatgtcattgattacat

SEQ ID NO: 620409 - DNA, 20 bp, Artificial Sequence
  chemically synthesized
tttatcaagttcagctatgt

SEQ ID NO: 620410 - DNA, 20 bp, Artificial Sequence
  chemically synthesized
atattttccttatgtaaatg

SEQ ID NO: 620411 - DNA, 20 bp, Artificial Sequence
  chemically synthesized
catttacataaggaaaatat

SEQ ID NO: 620412 - DNA, 20 bp, Artificial Sequence
  chemically synthesized
ggaaaatatccctgattatc

SEQ ID NO: 620413 - DNA, 20 bp, Artificial Sequence
  chemically synthesized
attcagacagactatcattc

SEQ ID NO: 620414 - DNA, 20 bp, Artificial Sequence
  chemically synthesized
attatctgattttcatggga

SEQ ID NO: 620415 - DNA, 20 bp, Artificial Sequence
  chemically synthesized
actttaaaaaattctaaatt

SEQ ID NO: 620416 - DNA, 20 bp, Artificial Sequence
  chemically synthesized
agcaaatgttctaccttata

SEQ ID NO: 620417 - DNA, 20 bp, Artificial Sequence
  chemically synthesized
taaggtagaacatttgctaa

SEQ ID NO: 620418 - DNA, 20 bp, Artificial Sequence
  chemically synthesized
gaacatatgttattaacagg

SEQ ID NO: 620419 - DNA, 20 bp, Artificial Sequence
  chemically synthesized
catagttatataatggggtt

SEQ ID NO: 620420 - DNA, 20 bp, Artificial Sequence
  chemically synthesized
ttatagtatgaaatgtggta

SEQ ID NO: 620421 - DNA, 20 bp, Artificial Sequence
  chemically synthesized
attcatgaatgagtaattaa

SEQ ID NO: 620422 - DNA, 20 bp, Artificial Sequence
  chemically synthesized
ctttctaaagtgtttaatat

SEQ ID NO: 620423 - DNA, 20 bp, Artificial Sequence
  chemically synthesized
atattgggtcagtctttcta

SEQ ID NO: 620424 - DNA, 20 bp, Artificial Sequence
  chemically synthesized
ccaatattaaaatccaagct

SEQ ID NO: 620425 - DNA, 20 bp, Artificial Sequence
  chemically synthesized
tacactttaaaatctaacag

SEQ ID NO: 620426 - DNA, 20 bp, Artificial Sequence
  chemically synthesized
taacatacactttaaaatct

SEQ ID NO: 620427 - DNA, 20 bp, Artificial Sequence
  chemically synthesized
atatatacactaagagatat

SEQ ID NO: 620428 - DNA, 20 bp, Artificial Sequence
  chemically synthesized
gtgtatatatacacacaaat

SEQ ID NO: 620429 - DNA, 20 bp, Artificial Sequence
  chemically synthesized
acaaatatctgttttcatat

SEQ ID NO: 620430 - DNA, 20 bp, Artificial Sequence
  chemically synthesized
gatagagggagataaaggaa

SEQ ID NO: 620431 - DNA, 20 bp, Artificial Sequence
  chemically synthesized
agggagataaaggaaggggg

SEQ ID NO: 620432 - DNA, 20 bp, Artificial Sequence
  chemically synthesized
attagacttttccacaaatg

SEQ ID NO: 620433 - DNA, 20 bp, Artificial Sequence
  chemically synthesized
tgtttgttgccaggaaacac

SEQ ID NO: 620434 - DNA, 20 bp, Artificial Sequence
  chemically synthesized
agcagtgagtttagaagcac

SEQ ID NO: 620435 - DNA, 20 bp, Artificial Sequence
  chemically synthesized
aacacaggtgcttctaaact

SEQ ID NO: 620436 - DNA, 20 bp, Artificial Sequence
  chemically synthesized
attttgcatggcctaaagca

SEQ ID NO: 620437 - DNA, 20 bp, Artificial Sequence
  chemically synthesized
ctcttgagctttcctgactg

SEQ ID NO: 620438 - DNA, 20 bp, Artificial Sequence
  chemically synthesized
cttgtcagtcaggaaagctc

SEQ ID NO: 620439 - DNA, 20 bp, Artificial Sequence
  chemically synthesized
tggctttggatgctaatctc

SEQ ID NO: 620440 - DNA, 20 bp, Artificial Sequence
  chemically synthesized
tcaagagattagcatccaaa

SEQ ID NO: 620441 - DNA, 20 bp, Artificial Sequence
  chemically synthesized
ttaaccagccccagaagtaa

SEQ ID NO: 620442 - DNA, 20 bp, Artificial Sequence
  chemically synthesized
gtttacttctggggctggtt

SEQ ID NO: 620443 - DNA, 20 bp, Artificial Sequence
  chemically synthesized
ggggctggttaaaagctttc

SEQ ID NO: 620444 - DNA, 20 bp, Artificial Sequence
  chemically synthesized
caattacacaggaatcctct

SEQ ID NO: 620445 - DNA, 20 bp, Artificial Sequence
  chemically synthesized
aatcaaatgttagttgctat

SEQ ID NO: 620446 - DNA, 20 bp, Artificial Sequence
  chemically synthesized
aaacatcaatagcaactaac

SEQ ID NO: 620447 - DNA, 20 bp, Artificial Sequence
  chemically synthesized
ttccaaggtgttaataattt

SEQ ID NO: 620448 - DNA, 20 bp, Artificial Sequence
  chemically synthesized
ataaaattattaacaccttg

SEQ ID NO: 620449 - DNA, 20 bp, Artificial Sequence
  chemically synthesized
gaactaaatgctagatattt

SEQ ID NO: 620450 - DNA, 20 bp, Artificial Sequence
  chemically synthesized
cttaaaatacatatttgtgt

SEQ ID NO: 620451 - DNA, 20 bp, Artificial Sequence
  chemically synthesized
tttgtgttgatgattctggc

SEQ ID NO: 620452 - DNA, 20 bp, Artificial Sequence
  chemically synthesized
ggttatattgccctcttccc

SEQ ID NO: 620453 - DNA, 20 bp, Artificial Sequence
  chemically synthesized
ttccccaaggatttctcaag

SEQ ID NO: 620454 - DNA, 20 bp, Artificial Sequence
  chemically synthesized
ggatttctcaagaaatgttt

SEQ ID NO: 620455 - DNA, 20 bp, Artificial Sequence
  chemically synthesized
tttgatttgtatgatacatt

SEQ ID NO: 620456 - DNA, 20 bp, Artificial Sequence
  chemically synthesized
caatactgtgttcattatgc

SEQ ID NO: 620457 - DNA, 20 bp, Artificial Sequence
  chemically synthesized
gctttaaaattagaaactgt

SEQ ID NO: 620458 - DNA, 20 bp, Artificial Sequence
  chemically synthesized
aaaaacaagattcaaacccc

SEQ ID NO: 620459 - DNA, 20 bp, Artificial Sequence
  chemically synthesized
agaaactgtgggggtttgaa

SEQ ID NO: 620460 - DNA, 20 bp, Artificial Sequence
  chemically synthesized
acagctatcacatggcaaaa

SEQ ID NO: 620461 - DNA, 20 bp, Artificial Sequence
  chemically synthesized
aataatttctatgaagaaag

SEQ ID NO: 620462 - DNA, 20 bp, Artificial Sequence
  chemically synthesized
tgtattttaatatcctcatt

SEQ ID NO: 620463 - DNA, 20 bp, Artificial Sequence
  chemically synthesized
tgatgtagctaccctcacct

SEQ ID NO: 620464 - DNA, 20 bp, Artificial Sequence
  chemically synthesized
ttctttatattcactagtcc

SEQ ID NO: 620465 - DNA, 20 bp, Artificial Sequence
  chemically synthesized
ttcagtttgggggagctaag

SEQ ID NO: 620466 - DNA, 20 bp, Artificial Sequence
  chemically synthesized
atgcattcagtttgggggag

SEQ ID NO: 620467 - DNA, 20 bp, Artificial Sequence
  chemically synthesized
gcaaagcagagaatgatgca

SEQ ID NO: 620468 - DNA, 20 bp, Artificial Sequence
  chemically synthesized
cccaaactgaatgcatcatt

SEQ ID NO: 620469 - DNA, 20 bp, Artificial Sequence
  chemically synthesized
tcattctctgctttgcggcc

SEQ ID NO: 620470 - DNA, 20 bp, Artificial Sequence
  chemically synthesized
aatatattttattttatttt

SEQ ID NO: 620471 - DNA, 20 bp, Artificial Sequence
  chemically synthesized
gaggtaaaggttgcagtgag

SEQ ID NO: 620472 - DNA, 20 bp, Artificial Sequence
  chemically synthesized
cactgcaacctttacctccc

SEQ ID NO: 620473 - DNA, 20 bp, Artificial Sequence
  chemically synthesized
tctggaggctgagacaggag

SEQ ID NO: 620474 - DNA, 20 bp, Artificial Sequence
  chemically synthesized
tgtctcagcctccagactag

SEQ ID NO: 620475 - DNA, 20 bp, Artificial Sequence
  chemically synthesized
tttgaagtcaggagttcgac

SEQ ID NO: 620476 - DNA, 20 bp, Artificial Sequence
  chemically synthesized
cacaggtgtgagccactgca

SEQ ID NO: 620477 - DNA, 20 bp, Artificial Sequence
  chemically synthesized
taccaattgcaaggtgcttc

SEQ ID NO: 620478 - DNA, 20 bp, Artificial Sequence
  chemically synthesized
gttgaattctaccaattgca

SEQ ID NO: 620479 - DNA, 20 bp, Artificial Sequence
  chemically synthesized
tccatagctctctaatgcac

SEQ ID NO: 620480 - DNA, 20 bp, Artificial Sequence
  chemically synthesized
tcgtatgtgcattagagagc

SEQ ID NO: 620481 - DNA, 20 bp, Artificial Sequence
  chemically synthesized
cagcctcccgagtagctctt

SEQ ID NO: 620482 - DNA, 20 bp, Artificial Sequence
  chemically synthesized
aatggtgtaaacccgggagg

SEQ ID NO: 620483 - DNA, 20 bp, Artificial Sequence
  chemically synthesized
ctcactgcaagctccgcctc

SEQ ID NO: 620484 - DNA, 20 bp, Artificial Sequence
  chemically synthesized
ctcattaaagttattttatt

SEQ ID NO: 620485 - DNA, 20 bp, Artificial Sequence
  chemically synthesized
ataataaaataactttaatg

SEQ ID NO: 620486 - DNA, 20 bp, Artificial Sequence
  chemically synthesized
taatgagtggcttggaaatt

SEQ ID NO: 620487 - DNA, 20 bp, Artificial Sequence
  chemically synthesized
gtttaattttcaaagaaata

SEQ ID NO: 620488 - DNA, 20 bp, Artificial Sequence
  chemically synthesized
atctctcagttattttacta

SEQ ID NO: 620489 - DNA, 20 bp, Artificial Sequence
  chemically synthesized
agcctcctcatggcgccaat

SEQ ID NO: 620490 - DNA, 20 bp, Artificial Sequence
  chemically synthesized
ctcactgcaacctctgcctc

SEQ ID NO: 620491 - DNA, 20 bp, Artificial Sequence
  chemically synthesized
ttgggaggctgaggcaggag

SEQ ID NO: 620492 - DNA, 20 bp, Artificial Sequence
  chemically synthesized
ttttctatttttagtagaga

SEQ ID NO: 620493 - DNA, 20 bp, Artificial Sequence
  chemically synthesized
agcctcggcctcccaaagtg

SEQ ID NO: 620494 - DNA, 20 bp, Artificial Sequence
  chemically synthesized
cgtgagccaccgtgcggccc

SEQ ID NO: 620495 - DNA, 20 bp, Artificial Sequence
  chemically synthesized
cctgttgcttctccattctt

SEQ ID NO: 620496 - DNA, 20 bp, Artificial Sequence
  chemically synthesized
ctccattcttaactgattgc

SEQ ID NO: 620497 - DNA, 20 bp, Artificial Sequence
  chemically synthesized
ataggcgtgagacacaattc

SEQ ID NO: 620498 - DNA, 20 bp, Artificial Sequence
  chemically synthesized
cacttcagtcccccaggtag

SEQ ID NO: 620499 - DNA, 20 bp, Artificial Sequence
  chemically synthesized
tatactgacgtttattatca

SEQ ID NO: 620500 - DNA, 20 bp, Artificial Sequence
  chemically synthesized
acattgtatctcctttatac

SEQ ID NO: 620501 - DNA, 20 bp, Artificial Sequence
  chemically synthesized
tacttttagcaaggctgatt

SEQ ID NO: 620502 - DNA, 20 bp, Artificial Sequence
  chemically synthesized
ggttcttttacttttagcaa

SEQ ID NO: 620503 - DNA, 20 bp, Artificial Sequence
  chemically synthesized
tttgtaatatgcttaggtca

SEQ ID NO: 620504 - DNA, 20 bp, Artificial Sequence
  chemically synthesized
cattaatttcaatttttgta

SEQ ID NO: 620505 - DNA, 20 bp, Artificial Sequence
  chemically synthesized
tacattttgcctctacaaaa

SEQ ID NO: 620506 - DNA, 20 bp, Artificial Sequence
  chemically synthesized
tctacttcatttttctcccg

SEQ ID NO: 620507 - DNA, 20 bp, Artificial Sequence
  chemically synthesized
aagtagagcaaaggacttac

SEQ ID NO: 620508 - DNA, 20 bp, Artificial Sequence
  chemically synthesized
aaatttgcagtaactctgtc

SEQ ID NO: 620509 - DNA, 20 bp, Artificial Sequence
  chemically synthesized
tgtcagggaacttcatagtt

SEQ ID NO: 620510 - DNA, 20 bp, Artificial Sequence
  chemically synthesized
ctcacatgattgagtatctt

SEQ ID NO: 620511 - DNA, 20 bp, Artificial Sequence
  chemically synthesized
tacacagtaactttgtgctc

SEQ ID NO: 620512 - DNA, 20 bp, Artificial Sequence
  chemically synthesized
tggttaaagtttacatctat

SEQ ID NO: 620513 - DNA, 20 bp, Artificial Sequence
  chemically synthesized
gctatcacttacttcgtggt

SEQ ID NO: 620514 - DNA, 20 bp, Artificial Sequence
  chemically synthesized
cacgaagtaagtgatagcta

SEQ ID NO: 620515 - DNA, 20 bp, Artificial Sequence
  chemically synthesized
atagctacaaagcttgtaaa

SEQ ID NO: 620516 - DNA, 20 bp, Artificial Sequence
  chemically synthesized
tcctttaataaacatatttt

SEQ ID NO: 620517 - DNA, 20 bp, Artificial Sequence
  chemically synthesized
aaaatatgtttattaaagga

SEQ ID NO: 620518 - DNA, 20 bp, Artificial Sequence
  chemically synthesized
ttttcagtcaatctagagga

SEQ ID NO: 620519 - DNA, 20 bp, Artificial Sequence
  chemically synthesized
gtatctccgaagccatttcc

SEQ ID NO: 620520 - DNA, 20 bp, Artificial Sequence
  chemically synthesized
tggcttcggagatacatgga

SEQ ID NO: 620521 - DNA, 20 bp, Artificial Sequence
  chemically synthesized
ttcggagatacatggaattt

SEQ ID NO: 620522 - DNA, 20 bp, Artificial Sequence
  chemically synthesized
actaaattattataagtcca

SEQ ID NO: 620523 - DNA, 20 bp, Artificial Sequence
  chemically synthesized
ggtatatatacgtggcttat

SEQ ID NO: 620524 - DNA, 20 bp, Artificial Sequence
  chemically synthesized
atgtaattttggtatatata

SEQ ID NO: 620525 - DNA, 20 bp, Artificial Sequence
  chemically synthesized
cagctacaaatatagtctat

SEQ ID NO: 620526 - DNA, 20 bp, Artificial Sequence
  chemically synthesized
tgcaagtgacccagtatata

SEQ ID NO: 620527 - DNA, 20 bp, Artificial Sequence
  chemically synthesized
ttatatactgggtcacttgc

SEQ ID NO: 620528 - DNA, 20 bp, Artificial Sequence
  chemically synthesized
actataaataaaacacaaaa

SEQ ID NO: 620529 - DNA, 20 bp, Artificial Sequence
  chemically synthesized
cagaaaagacaaactctctt

SEQ ID NO: 620530 - DNA, 20 bp, Artificial Sequence
  chemically synthesized
caaaagagagtttgtctttt

SEQ ID NO: 620531 - DNA, 20 bp, Artificial Sequence
  chemically synthesized
tagacatatgcttgtctaat

SEQ ID NO: 620532 - DNA, 20 bp, Artificial Sequence
  chemically synthesized
cttgatatatataattagac

SEQ ID NO: 620533 - DNA, 20 bp, Artificial Sequence
  chemically synthesized
cttgatatatataatatgac

SEQ ID NO: 620534 - DNA, 20 bp, Artificial Sequence
  chemically synthesized
agctacctacagtatatgta

SEQ ID NO: 620535 - DNA, 20 bp, Artificial Sequence
  chemically synthesized
aacatcatacatatactgta

SEQ ID NO: 620536 - DNA, 20 bp, Artificial Sequence
  chemically synthesized
taggtagctttttgtggtca

SEQ ID NO: 620537 - DNA, 20 bp, Artificial Sequence
  chemically synthesized
gtacataaaaataataatag

SEQ ID NO: 620538 - DNA, 20 bp, Artificial Sequence
  chemically synthesized
acaggataattttaagtaaa

SEQ ID NO: 620539 - DNA, 20 bp, Artificial Sequence
  chemically synthesized
atgaacattgactgaaagat

SEQ ID NO: 620540 - DNA, 20 bp, Artificial Sequence
  chemically synthesized
ataatatatgaacattgact

SEQ ID NO: 620541 - DNA, 20 bp, Artificial Sequence
  chemically synthesized
tacctcagacaaattactta

SEQ ID NO: 620542 - DNA, 20 bp, Artificial Sequence
  chemically synthesized
cctttacattttggcttgag

SEQ ID NO: 620543 - DNA, 20 bp, Artificial Sequence
  chemically synthesized
aaaaacataggcctttacat

SEQ ID NO: 620544 - DNA, 20 bp, Artificial Sequence
  chemically synthesized
tcaagccaaaatgtaaaggc

SEQ ID NO: 620545 - DNA, 20 bp, Artificial Sequence
  chemically synthesized
aaatgtaaaggcctatgttt

SEQ ID NO: 620546 - DNA, 20 bp, Artificial Sequence
  chemically synthesized
gactgagagttgggaaaaag

SEQ ID NO: 620547 - DNA, 20 bp, Artificial Sequence
  chemically synthesized
caaactcatatgcttagtgt

SEQ ID NO: 620548 - DNA, 20 bp, Artificial Sequence
  chemically synthesized
aaatctcaaacactaagcat

SEQ ID NO: 620549 - DNA, 20 bp, Artificial Sequence
  chemically synthesized
cgctcacaaactcatatgct

SEQ ID NO: 620550 - DNA, 20 bp, Artificial Sequence
  chemically synthesized
aaaccttcgctcacaaactc

SEQ ID NO: 620551 - DNA, 20 bp, Artificial Sequence
  chemically synthesized
aagcatatgagtttgtgagc

SEQ ID NO: 620552 - DNA, 20 bp, Artificial Sequence
  chemically synthesized
tataaattttaaatttagtt

SEQ ID NO: 620553 - DNA, 20 bp, Artificial Sequence
  chemically synthesized
tttaaactataaattttaaa

SEQ ID NO: 620554 - DNA, 20 bp, Artificial Sequence
  chemically synthesized
cataaactaaatttaaaatt

SEQ ID NO: 620555 - DNA, 20 bp, Artificial Sequence
  chemically synthesized
tttactagaattttgaaata

SEQ ID NO: 620556 - DNA, 20 bp, Artificial Sequence
  chemically synthesized
aaaagtaaatagaagtgtgt

SEQ ID NO: 620557 - DNA, 20 bp, Artificial Sequence
  chemically synthesized
accagcttttggttaagtat

SEQ ID NO: 620558 - DNA, 20 bp, Artificial Sequence
  chemically synthesized
gcagggatacttaaccaaaa

SEQ ID NO: 620559 - DNA, 20 bp, Artificial Sequence
  chemically synthesized
taaccaaaagctggtttagg

SEQ ID NO: 620560 - DNA, 20 bp, Artificial Sequence
  chemically synthesized
cattcataatccattcctaa

SEQ ID NO: 620561 - DNA, 20 bp, Artificial Sequence
  chemically synthesized
tggtttaggaatggattatg

SEQ ID NO: 620562 - DNA, 20 bp, Artificial Sequence
  chemically synthesized
tggattatgaatggcttatg

SEQ ID NO: 620563 - DNA, 20 bp, Artificial Sequence
  chemically synthesized
attgcaggagcatttgaact

SEQ ID NO: 620564 - DNA, 20 bp, Artificial Sequence
  chemically synthesized
tgtatttttctgaggagtcc

SEQ ID NO: 620565 - DNA, 20 bp, Artificial Sequence
  chemically synthesized
aagaccttaattgcttttta

SEQ ID NO: 620566 - DNA, 20 bp, Artificial Sequence
  chemically synthesized
atagaggttataaagacctt

SEQ ID NO: 620567 - DNA, 20 bp, Artificial Sequence
  chemically synthesized
acctctatacatagaaagtt

SEQ ID NO: 620568 - DNA, 20 bp, Artificial Sequence
  chemically synthesized
ctggacaaataatgtcttgt

SEQ ID NO: 620569 - DNA, 20 bp, Artificial Sequence
  chemically synthesized
tgtcttgtaaaagtttagtt

SEQ ID NO: 620570 - DNA, 20 bp, Artificial Sequence
  chemically synthesized
acatcatctcctacttcact

SEQ ID NO: 620571 - DNA, 20 bp, Artificial Sequence
  chemically synthesized
aagtgaagaatagtcatgaa

SEQ ID NO: 620572 - DNA, 20 bp, Artificial Sequence
  chemically synthesized
ttcttcaaaataagcataat

SEQ ID NO: 620573 - DNA, 20 bp, Artificial Sequence
  chemically synthesized
acatgtagctgaagcaaaga

SEQ ID NO: 620574 - DNA, 20 bp, Artificial Sequence
  chemically synthesized
agaaacacatgtagctgaag

SEQ ID NO: 620575 - DNA, 20 bp, Artificial Sequence
  chemically synthesized
ataatctttgcttcagctac

SEQ ID NO: 620576 - DNA, 20 bp, Artificial Sequence
  chemically synthesized
cttcagctacatgtgtttct

SEQ ID NO: 620577 - DNA, 20 bp, Artificial Sequence
  chemically synthesized
tttctaatgctcttccacat

SEQ ID NO: 620578 - DNA, 20 bp, Artificial Sequence
  chemically synthesized
cgtaagagtatttatttaat

SEQ ID NO: 620579 - DNA, 20 bp, Artificial Sequence
  chemically synthesized
cataattcttgactacttac

SEQ ID NO: 620580 - DNA, 20 bp, Artificial Sequence
  chemically synthesized
cttacatatgcttgtctaat

SEQ ID NO: 620581 - DNA, 20 bp, Artificial Sequence
  chemically synthesized
caaaagagagtttgtctttt

SEQ ID NO: 620582 - DNA, 20 bp, Artificial Sequence
  chemically synthesized
cagaaaagacaaactctctt

SEQ ID NO: 620583 - DNA, 20 bp, Artificial Sequence
  chemically synthesized
actataaataaaacacaaaa

SEQ ID NO: 620584 - DNA, 20 bp, Artificial Sequence
  chemically synthesized
ttatatactgggtcacttgc

SEQ ID NO: 620585 - DNA, 20 bp, Artificial Sequence
  chemically synthesized
tgcaagtgacccagtatata

SEQ ID NO: 620586 - DNA, 20 bp, Artificial Sequence
  chemically synthesized
ttaaggcataatctctagaa

SEQ ID NO: 620587 - DNA, 20 bp, Artificial Sequence
  chemically synthesized
acttttaaaaaacatttttc

SEQ ID NO: 620588 - DNA, 20 bp, Artificial Sequence
  chemically synthesized
agaaaaatgttttttaaaag

SEQ ID NO: 620589 - DNA, 20 bp, Artificial Sequence
  chemically synthesized
tatgtatcaataacagaaat

SEQ ID NO: 620590 - DNA, 20 bp, Artificial Sequence
  chemically synthesized
tgtgtgctttactattttct

SEQ ID NO: 620591 - DNA, 20 bp, Artificial Sequence
  chemically synthesized
taatttcaggatatttggta

SEQ ID NO: 620592 - DNA, 20 bp, Artificial Sequence
  chemically synthesized
agtgtatatagaccaattta

SEQ ID NO: 620593 - DNA, 20 bp, Artificial Sequence
  chemically synthesized
attttataattggtcttatt

SEQ ID NO: 620594 - DNA, 20 bp, Artificial Sequence
  chemically synthesized
tggtcttattttccgttttc

SEQ ID NO: 620595 - DNA, 20 bp, Artificial Sequence
  chemically synthesized
tgttggctaagaagataaat

SEQ ID NO: 620596 - DNA, 20 bp, Artificial Sequence
  chemically synthesized
aaagcaaaagaggtcagttg

SEQ ID NO: 620597 - DNA, 20 bp, Artificial Sequence
  chemically synthesized
taatccaagcaactgacctc

SEQ ID NO: 620598 - DNA, 20 bp, Artificial Sequence
  chemically synthesized
taatcaaagcaaaagaggtc

SEQ ID NO: 620599 - DNA, 20 bp, Artificial Sequence
  chemically synthesized
caagcaactgacctcttttg

SEQ ID NO: 620600 - DNA, 20 bp, Artificial Sequence
  chemically synthesized
atgaatgtgatcaagacacc

SEQ ID NO: 620601 - DNA, 20 bp, Artificial Sequence
  chemically synthesized
acaattcttcaatagcatac

SEQ ID NO: 620602 - DNA, 20 bp, Artificial Sequence
  chemically synthesized
taagatagatatccgaactc

SEQ ID NO: 620603 - DNA, 20 bp, Artificial Sequence
  chemically synthesized
agctttcatttcttgaatga

SEQ ID NO: 620604 - DNA, 20 bp, Artificial Sequence
  chemically synthesized
aacctccacctcctgggttc

SEQ ID NO: 620605 - DNA, 20 bp, Artificial Sequence
  chemically synthesized
ttgggaggctgaggctggag

SEQ ID NO: 620606 - DNA, 20 bp, Artificial Sequence
  chemically synthesized
agcctcagcctcccaagtag

SEQ ID NO: 620607 - DNA, 20 bp, Artificial Sequence
  chemically synthesized
ttttgtatttaaagcagaga

SEQ ID NO: 620608 - DNA, 20 bp, Artificial Sequence
  chemically synthesized
ccaacatagtgaaacttcat

SEQ ID NO: 620609 - DNA, 20 bp, Artificial Sequence
  chemically synthesized
cgcctcggcctcccaaagtg

SEQ ID NO: 620610 - DNA, 20 bp, Artificial Sequence
  chemically synthesized
tttctgttccttcccacaat

SEQ ID NO: 620611 - DNA, 20 bp, Artificial Sequence
  chemically synthesized
aagcctattctgttggagta

SEQ ID NO: 620612 - DNA, 20 bp, Artificial Sequence
  chemically synthesized
aagctctttactccaacaga

SEQ ID NO: 620613 - DNA, 20 bp, Artificial Sequence
  chemically synthesized
gtacgtcttccccattgaca

SEQ ID NO: 620614 - DNA, 20 bp, Artificial Sequence
  chemically synthesized
aagtttcacaaggataggaa

SEQ ID NO: 620615 - DNA, 20 bp, Artificial Sequence
  chemically synthesized
acaaggataggaaacatgtt

SEQ ID NO: 620616 - DNA, 20 bp, Artificial Sequence
  chemically synthesized
taacaagacaaaaactgaaa

SEQ ID NO: 620617 - DNA, 20 bp, Artificial Sequence
  chemically synthesized
gttttcagtttttgtcttgt

SEQ ID NO: 620618 - DNA, 20 bp, Artificial Sequence
  chemically synthesized
cagtttttgtcttgttactg

SEQ ID NO: 620619 - DNA, 20 bp, Artificial Sequence
  chemically synthesized
agcaactagcaccttttatg

SEQ ID NO: 620620 - DNA, 20 bp, Artificial Sequence
  chemically synthesized
atgtatgcagatttaaggcc

SEQ ID NO: 620621 - DNA, 20 bp, Artificial Sequence
  chemically synthesized
tgactagagccaaatatgta

SEQ ID NO: 620622 - DNA, 20 bp, Artificial Sequence
  chemically synthesized
tttttgcttactgtctttca

SEQ ID NO: 620623 - DNA, 20 bp, Artificial Sequence
  chemically synthesized
gattgtactaatttgtcagt

SEQ ID NO: 620624 - DNA, 20 bp, Artificial Sequence
  chemically synthesized
ttccaagattgtactaattt

SEQ ID NO: 620625 - DNA, 20 bp, Artificial Sequence
  chemically synthesized
ccttttataatacatgaatt

SEQ ID NO: 620626 - DNA, 20 bp, Artificial Sequence
  chemically synthesized
catgtattataaaaggctgg

SEQ ID NO: 620627 - DNA, 20 bp, Artificial Sequence
  chemically synthesized
tattataaaaggctggttca

SEQ ID NO: 620628 - DNA, 20 bp, Artificial Sequence
  chemically synthesized
gattgttttactcaattgta

SEQ ID NO: 620629 - DNA, 20 bp, Artificial Sequence
  chemically synthesized
ttttactcaattgtaacatg

SEQ ID NO: 620630 - DNA, 20 bp, Artificial Sequence
  chemically synthesized
gataattttttcctgtttta

SEQ ID NO: 620631 - DNA, 20 bp, Artificial Sequence
  chemically synthesized
tttggttctagataattttt

SEQ ID NO: 620632 - DNA, 20 bp, Artificial Sequence
  chemically synthesized
ttccatagccaacatgcaat

SEQ ID NO: 620633 - DNA, 20 bp, Artificial Sequence
  chemically synthesized
actcatcaagattatggcct

SEQ ID NO: 620634 - DNA, 20 bp, Artificial Sequence
  chemically synthesized
tcaactaggccataatcttg

SEQ ID NO: 620635 - DNA, 20 bp, Artificial Sequence
  chemically synthesized
ggccataatcttgatgagtt

SEQ ID NO: 620636 - DNA, 20 bp, Artificial Sequence
  chemically synthesized
taatcaaatctgaaaactca

SEQ ID NO: 620637 - DNA, 20 bp, Artificial Sequence
  chemically synthesized
taatcttgatgagttttcag

SEQ ID NO: 620638 - DNA, 20 bp, Artificial Sequence
  chemically synthesized
tgtaaaatatattgaagttt

SEQ ID NO: 620639 - DNA, 20 bp, Artificial Sequence
  chemically synthesized
aaatctattgtaaaatatat

SEQ ID NO: 620640 - DNA, 20 bp, Artificial Sequence
  chemically synthesized
gaaacttcaatatattttac

SEQ ID NO: 620641 - DNA, 20 bp, Artificial Sequence
  chemically synthesized
acaatagattttaaatacta

SEQ ID NO: 620642 - DNA, 20 bp, Artificial Sequence
  chemically synthesized
taatgcaacataaatttgcc

SEQ ID NO: 620643 - DNA, 20 bp, Artificial Sequence
  chemically synthesized
cgcaccttaaaagaaatgtt

SEQ ID NO: 620644 - DNA, 20 bp, Artificial Sequence
  chemically synthesized
attctacttgtatcatgatg

SEQ ID NO: 620645 - DNA, 20 bp, Artificial Sequence
  chemically synthesized
gtgacataactattgaaaat

SEQ ID NO: 620646 - DNA, 20 bp, Artificial Sequence
  chemically synthesized
tctgcagtacaatcttcaca

SEQ ID NO: 620647 - DNA, 20 bp, Artificial Sequence
  chemically synthesized
attacaattaaatctgaatg

SEQ ID NO: 620648 - DNA, 20 bp, Artificial Sequence
  chemically synthesized
cttctatgagcaaaagttgg

SEQ ID NO: 620649 - DNA, 20 bp, Artificial Sequence
  chemically synthesized
ttagccaacttttgctcata

SEQ ID NO: 620650 - DNA, 20 bp, Artificial Sequence
  chemically synthesized
gaaggattaatcatatgact

SEQ ID NO: 620651 - DNA, 20 bp, Artificial Sequence
  chemically synthesized
ttgtgtgtaaacaaaaagtc

SEQ ID NO: 620652 - DNA, 20 bp, Artificial Sequence
  chemically synthesized
gaatgataactgctttctac

SEQ ID NO: 620653 - DNA, 20 bp, Artificial Sequence
  chemically synthesized
gaagaaatgaatagaatgat

SEQ ID NO: 620654 - DNA, 20 bp, Artificial Sequence
  chemically synthesized
tcttttgagaaagacaaggc

SEQ ID NO: 620655 - DNA, 20 bp, Artificial Sequence
  chemically synthesized
gtttctctggctcttttttc

SEQ ID NO: 620656 - DNA, 20 bp, Artificial Sequence
  chemically synthesized
cctaatttagatccctcttt

SEQ ID NO: 620657 - DNA, 20 bp, Artificial Sequence
  chemically synthesized
tgccatggactcccaaagtg

SEQ ID NO: 620658 - DNA, 20 bp, Artificial Sequence
  chemically synthesized
ttttgtatttttaggagaga

SEQ ID NO: 620659 - DNA, 20 bp, Artificial Sequence
  chemically synthesized
ctcctcagcctcccgagtag

SEQ ID NO: 620660 - DNA, 20 bp, Artificial Sequence
  chemically synthesized
tcgggaggctgaggagggag

SEQ ID NO: 620661 - DNA, 20 bp, Artificial Sequence
  chemically synthesized
aacttccacctcccaggttc

SEQ ID NO: 620662 - DNA, 20 bp, Artificial Sequence
  chemically synthesized
gaggtggaagttgcagtgag

SEQ ID NO: 620663 - DNA, 20 bp, Artificial Sequence
  chemically synthesized
gggcattttgaggtaagtaa

SEQ ID NO: 620664 - DNA, 20 bp, Artificial Sequence
  chemically synthesized
attttaggttaaaggggtag

SEQ ID NO: 620665 - DNA, 20 bp, Artificial Sequence
  chemically synthesized
ttatgattttttcctttcaa

SEQ ID NO: 620666 - DNA, 20 bp, Artificial Sequence
  chemically synthesized
aagagtaataaaaaattaga

SEQ ID NO: 620667 - DNA, 20 bp, Artificial Sequence
  chemically synthesized
gtaataaagagtaataaaaa

SEQ ID NO: 620668 - DNA, 20 bp, Artificial Sequence
  chemically synthesized
ctctttattacaaaaacaaa

SEQ ID NO: 620669 - DNA, 20 bp, Artificial Sequence
  chemically synthesized
ttattgatctttaaaaccaa

SEQ ID NO: 620670 - DNA, 20 bp, Artificial Sequence
  chemically synthesized
atactactttgtattaaaaa

SEQ ID NO: 620671 - DNA, 20 bp, Artificial Sequence
  chemically synthesized
tgtaattaccttttgctatt

SEQ ID NO: 620672 - DNA, 20 bp, Artificial Sequence
  chemically synthesized
atatttgtatgcacacagag

SEQ ID NO: 620673 - DNA, 20 bp, Artificial Sequence
  chemically synthesized
tcatatgtgtgttgtacaca

SEQ ID NO: 620674 - DNA, 20 bp, Artificial Sequence
  chemically synthesized
tgtgtacaacacacatatga

SEQ ID NO: 620675 - DNA, 20 bp, Artificial Sequence
  chemically synthesized
caatttagcaagtcatttgc

SEQ ID NO: 620676 - DNA, 20 bp, Artificial Sequence
  chemically synthesized
tatttgcaatttagcaagtc

SEQ ID NO: 620677 - DNA, 20 bp, Artificial Sequence
  chemically synthesized
atagatatatttgctcatgc

SEQ ID NO: 620678 - DNA, 20 bp, Artificial Sequence
  chemically synthesized
ataccacccgtgtgagtgtt

SEQ ID NO: 620679 - DNA, 20 bp, Artificial Sequence
  chemically synthesized
acttataccacccgtgtgag

SEQ ID NO: 620680 - DNA, 20 bp, Artificial Sequence
  chemically synthesized
cataacaagggacataaaaa

SEQ ID NO: 620681 - DNA, 20 bp, Artificial Sequence
  chemically synthesized
aaaccataacaagggacata

SEQ ID NO: 620682 - DNA, 20 bp, Artificial Sequence
  chemically synthesized
aatctttttatgtcccttgt

SEQ ID NO: 620683 - DNA, 20 bp, Artificial Sequence
  chemically synthesized
cttaggttcccttgaaattg

SEQ ID NO: 620684 - DNA, 20 bp, Artificial Sequence
  chemically synthesized
aatattagtcattgctcatg

SEQ ID NO: 620685 - DNA, 20 bp, Artificial Sequence
  chemically synthesized
caggaagttcactaatttac

SEQ ID NO: 620686 - DNA, 20 bp, Artificial Sequence
  chemically synthesized
gcacttcattgcagttccac

SEQ ID NO: 620687 - DNA, 20 bp, Artificial Sequence
  chemically synthesized
acagaaaagagaattaaaaa

SEQ ID NO: 620688 - DNA, 20 bp, Artificial Sequence
  chemically synthesized
agtgtacaaactcatgtatc

SEQ ID NO: 620689 - DNA, 20 bp, Artificial Sequence
  chemically synthesized
gcccccaaagctactgatac

SEQ ID NO: 620690 - DNA, 20 bp, Artificial Sequence
  chemically synthesized
tgaggcaaatttaaaatatg

SEQ ID NO: 620691 - DNA, 20 bp, Artificial Sequence
  chemically synthesized
ttttaaatttgcctcatttc

SEQ ID NO: 620692 - DNA, 20 bp, Artificial Sequence
  chemically synthesized
gtcttcttatattcaaagga

SEQ ID NO: 620693 - DNA, 20 bp, Artificial Sequence
  chemically synthesized
acagtatcaacttctgcatt

SEQ ID NO: 620694 - DNA, 20 bp, Artificial Sequence
  chemically synthesized
acaatttgtatgcattttga

SEQ ID NO: 620695 - DNA, 20 bp, Artificial Sequence
  chemically synthesized
atgttagataaataaattga

SEQ ID NO: 620696 - DNA, 20 bp, Artificial Sequence
  chemically synthesized
aaatatgttagataaataaa

SEQ ID NO: 620697 - DNA, 20 bp, Artificial Sequence
  chemically synthesized
aaaatagcttacaggtttat

SEQ ID NO: 620698 - DNA, 20 bp, Artificial Sequence
  chemically synthesized
tgatgttgttaaaatagctt

SEQ ID NO: 620699 - DNA, 20 bp, Artificial Sequence
  chemically synthesized
catacatttgatgttgttaa

SEQ ID NO: 620700 - DNA, 20 bp, Artificial Sequence
  chemically synthesized
aaaattctggaagaagtagt

SEQ ID NO: 620701 - DNA, 20 bp, Artificial Sequence
  chemically synthesized
aaaaaaaattctggaagaag

SEQ ID NO: 620702 - DNA, 20 bp, Artificial Sequence
  chemically synthesized
ttttgtatttttagtagaga

SEQ ID NO: 620703 - DNA, 20 bp, Artificial Sequence
  chemically synthesized
caccttggcctcccaaagtg

SEQ ID NO: 620704 - DNA, 20 bp, Artificial Sequence
  chemically synthesized
ttgggagatgtaaaataaag

SEQ ID NO: 620705 - DNA, 20 bp, Artificial Sequence
  chemically synthesized
gattaaaatatgcattcaca

SEQ ID NO: 620706 - DNA, 20 bp, Artificial Sequence
  chemically synthesized
taaaatctccagagccagag

SEQ ID NO: 620707 - DNA, 20 bp, Artificial Sequence
  chemically synthesized
tttaatctttactctggctc

SEQ ID NO: 620708 - DNA, 20 bp, Artificial Sequence
  chemically synthesized
tagaggtaggtaaactaaag

SEQ ID NO: 620709 - DNA, 20 bp, Artificial Sequence
  chemically synthesized
acattatttagaaacacaac

SEQ ID NO: 620710 - DNA, 20 bp, Artificial Sequence
  chemically synthesized
actaaagttgtgtttctaaa

SEQ ID NO: 620711 - DNA, 20 bp, Artificial Sequence
  chemically synthesized
atttttaaatctataagtta

SEQ ID NO: 620712 - DNA, 20 bp, Artificial Sequence
  chemically synthesized
ctctctgaaacattttaact

SEQ ID NO: 620713 - DNA, 20 bp, Artificial Sequence
  chemically synthesized
tgtttcagagagataatgcg

SEQ ID NO: 620714 - DNA, 20 bp, Artificial Sequence
  chemically synthesized
aagtcgtctccaaaatatag

SEQ ID NO: 620715 - DNA, 20 bp, Artificial Sequence
  chemically synthesized
ttttttttatttttttgaga

SEQ ID NO: 620716 - DNA, 20 bp, Artificial Sequence
  chemically synthesized
gctcactgcaacctctgcct

SEQ ID NO: 620717 - DNA, 20 bp, Artificial Sequence
  chemically synthesized
caacctctgcctcccagatt

SEQ ID NO: 620718 - DNA, 20 bp, Artificial Sequence
  chemically synthesized
tgcctcagcctcccaagtag

SEQ ID NO: 620719 - DNA, 20 bp, Artificial Sequence
  chemically synthesized
gattagccaggtgtggtggt

SEQ ID NO: 620720 - DNA, 20 bp, Artificial Sequence
  chemically synthesized
atgcaccaccacacctggct

SEQ ID NO: 620721 - DNA, 20 bp, Artificial Sequence
  chemically synthesized
cccatctctactaaaaatac

SEQ ID NO: 620722 - DNA, 20 bp, Artificial Sequence
  chemically synthesized
gtttgtatttttagtagaga

SEQ ID NO: 620723 - DNA, 20 bp, Artificial Sequence
  chemically synthesized
ggtctcgaactcctggcctc

SEQ ID NO: 620724 - DNA, 20 bp, Artificial Sequence
  chemically synthesized
ttgggaggctgaggcgagta

SEQ ID NO: 620725 - DNA, 20 bp, Artificial Sequence
  chemically synthesized
cgcctcagcctcccaaagtg

SEQ ID NO: 620726 - DNA, 20 bp, Artificial Sequence
  chemically synthesized
atatttctttaggtcaaagg

SEQ ID NO: 620727 - DNA, 20 bp, Artificial Sequence
  chemically synthesized
tcttgcagtttgtgtggtta

SEQ ID NO: 620728 - DNA, 20 bp, Artificial Sequence
  chemically synthesized
agaagggaaatatttgttct

SEQ ID NO: 620729 - DNA, 20 bp, Artificial Sequence
  chemically synthesized
gtatctgggaatatcaaaca

SEQ ID NO: 620730 - DNA, 20 bp, Artificial Sequence
  chemically synthesized
tataatttgcttatgaatca

SEQ ID NO: 620731 - DNA, 20 bp, Artificial Sequence
  chemically synthesized
tgaatattctggacattata

SEQ ID NO: 620732 - DNA, 20 bp, Artificial Sequence
  chemically synthesized
gaatattcaaattttcaata

SEQ ID NO: 620733 - DNA, 20 bp, Artificial Sequence
  chemically synthesized
tcaaattttcaatatcaagt

SEQ ID NO: 620734 - DNA, 20 bp, Artificial Sequence
  chemically synthesized
aactcgataatttcttataa

SEQ ID NO: 620735 - DNA, 20 bp, Artificial Sequence
  chemically synthesized
atcaaaattataagaaatta

SEQ ID NO: 620736 - DNA, 20 bp, Artificial Sequence
  chemically synthesized
ctcattctctcaactgttaa

SEQ ID NO: 620737 - DNA, 20 bp, Artificial Sequence
  chemically synthesized
atctgaataaaacacataaa

SEQ ID NO: 620738 - DNA, 20 bp, Artificial Sequence
  chemically synthesized
aagtctaagaatcatagttt

SEQ ID NO: 620739 - DNA, 20 bp, Artificial Sequence
  chemically synthesized
ggtgataaaagtctaagaat

SEQ ID NO: 620740 - DNA, 20 bp, Artificial Sequence
  chemically synthesized
tgctttaaggaaagttttta

SEQ ID NO: 620741 - DNA, 20 bp, Artificial Sequence
  chemically synthesized
gcttgtgttattgctttaag

SEQ ID NO: 620742 - DNA, 20 bp, Artificial Sequence
  chemically synthesized
accatctagaatgcttgtgt

SEQ ID NO: 620743 - DNA, 20 bp, Artificial Sequence
  chemically synthesized
cttctatgtggaaccatcta

SEQ ID NO: 620744 - DNA, 20 bp, Artificial Sequence
  chemically synthesized
ctttctttcttgtatttttt

SEQ ID NO: 620745 - DNA, 20 bp, Artificial Sequence
  chemically synthesized
taaatcagggattggttata

SEQ ID NO: 620746 - DNA, 20 bp, Artificial Sequence
  chemically synthesized
gaaagctctatataaccaat

SEQ ID NO: 620747 - DNA, 20 bp, Artificial Sequence
  chemically synthesized
attgtttcacaattttaaat

SEQ ID NO: 620748 - DNA, 20 bp, Artificial Sequence
  chemically synthesized
atgggactggacctatttga

SEQ ID NO: 620749 - DNA, 20 bp, Artificial Sequence
  chemically synthesized
tgaaatgggactggacctat

SEQ ID NO: 620750 - DNA, 20 bp, Artificial Sequence
  chemically synthesized
catttcattaccaaacatct

SEQ ID NO: 620751 - DNA, 20 bp, Artificial Sequence
  chemically synthesized
aacccagagcataaacttgt

SEQ ID NO: 620752 - DNA, 20 bp, Artificial Sequence
  chemically synthesized
aacatctacaagtttatgct

SEQ ID NO: 620753 - DNA, 20 bp, Artificial Sequence
  chemically synthesized
ttggggtggtaattagttat

SEQ ID NO: 620754 - DNA, 20 bp, Artificial Sequence
  chemically synthesized
aaaagagtctcatgtataaa

SEQ ID NO: 620755 - DNA, 20 bp, Artificial Sequence
  chemically synthesized
ttgggaggctgaggcaggag

SEQ ID NO: 620756 - DNA, 20 bp, Artificial Sequence
  chemically synthesized
tgcctcagcctcccaagcag

SEQ ID NO: 620757 - DNA, 20 bp, Artificial Sequence
  chemically synthesized
tggccagtgcctgtaatctc

SEQ ID NO: 620758 - DNA, 20 bp, Artificial Sequence
  chemically synthesized
ttttgtatttttagtagaga

SEQ ID NO: 620759 - DNA, 20 bp, Artificial Sequence
  chemically synthesized
gggatgaattacctgaggtc

SEQ ID NO: 620760 - DNA, 20 bp, Artificial Sequence
  chemically synthesized
cccctcagcctcccaaagtg

SEQ ID NO: 620761 - DNA, 20 bp, Artificial Sequence
  chemically synthesized
ttatttactctggtctgcta

SEQ ID NO: 620762 - DNA, 20 bp, Artificial Sequence
  chemically synthesized
atatattctgtcctatctgg

SEQ ID NO: 620763 - DNA, 20 bp, Artificial Sequence
  chemically synthesized
atatgtatttgttctgttca

SEQ ID NO: 620764 - DNA, 20 bp, Artificial Sequence
  chemically synthesized
ttctgttcagaaagattcat

SEQ ID NO: 620765 - DNA, 20 bp, Artificial Sequence
  chemically synthesized
agctattataggtgttgagg

SEQ ID NO: 620766 - DNA, 20 bp, Artificial Sequence
  chemically synthesized
taaaaagctattataggtgt

SEQ ID NO: 620767 - DNA, 20 bp, Artificial Sequence
  chemically synthesized
aacgaagcctcaacacctat

SEQ ID NO: 620768 - DNA, 20 bp, Artificial Sequence
  chemically synthesized
ctttttaaatatcacaaaac

SEQ ID NO: 620769 - DNA, 20 bp, Artificial Sequence
  chemically synthesized
gtattctttgatagataagc

SEQ ID NO: 620770 - DNA, 20 bp, Artificial Sequence
  chemically synthesized
gttgctaactttctttgaat

SEQ ID NO: 620771 - DNA, 20 bp, Artificial Sequence
  chemically synthesized
tttctcatggtgtaaaccaa

SEQ ID NO: 620772 - DNA, 20 bp, Artificial Sequence
  chemically synthesized
agcagacccattcaagcaga

SEQ ID NO: 620773 - DNA, 20 bp, Artificial Sequence
  chemically synthesized
gatgtggtataaaaattgtg

SEQ ID NO: 620774 - DNA, 20 bp, Artificial Sequence
  chemically synthesized
gtgctacttaagagaagggc

SEQ ID NO: 620775 - DNA, 20 bp, Artificial Sequence
  chemically synthesized
agtgccgtgctacttaagag

SEQ ID NO: 620776 - DNA, 20 bp, Artificial Sequence
  chemically synthesized
gcactaaagacttataactt

SEQ ID NO: 620777 - DNA, 20 bp, Artificial Sequence
  chemically synthesized
ttccctgtgttatatgtaaa

SEQ ID NO: 620778 - DNA, 20 bp, Artificial Sequence
  chemically synthesized
gcattctgtttctaaataaa

SEQ ID NO: 620779 - DNA, 20 bp, Artificial Sequence
  chemically synthesized
acaatgtttatttagaaaca

SEQ ID NO: 620780 - DNA, 20 bp, Artificial Sequence
  chemically synthesized
gcagcaccagggaacaagca

SEQ ID NO: 620781 - DNA, 20 bp, Artificial Sequence
  chemically synthesized
gagttaaatttatgttcgag

SEQ ID NO: 620782 - DNA, 20 bp, Artificial Sequence
  chemically synthesized
gcagaaagggtacactcgcc

SEQ ID NO: 620783 - DNA, 20 bp, Artificial Sequence
  chemically synthesized
acagggtcatttataacctg

SEQ ID NO: 620784 - DNA, 20 bp, Artificial Sequence
  chemically synthesized
atgtttactctactgctgtg

SEQ ID NO: 620785 - DNA, 20 bp, Artificial Sequence
  chemically synthesized
gaccacacattctgtatttg

SEQ ID NO: 620786 - DNA, 20 bp, Artificial Sequence
  chemically synthesized
aacaaaggaaggaggaagta

SEQ ID NO: 620787 - DNA, 20 bp, Artificial Sequence
  chemically synthesized
tgttcctcttccttatttga

SEQ ID NO: 620788 - DNA, 20 bp, Artificial Sequence
  chemically synthesized
ggaacaggctatgacctaat

SEQ ID NO: 620789 - DNA, 20 bp, Artificial Sequence
  chemically synthesized
tagcctaaatatttgccctg

SEQ ID NO: 620790 - DNA, 20 bp, Artificial Sequence
  chemically synthesized
ggaactaagaacataaagta

SEQ ID NO: 620791 - DNA, 20 bp, Artificial Sequence
  chemically synthesized
tatttaagaatgttagcaca

SEQ ID NO: 620792 - DNA, 20 bp, Artificial Sequence
  chemically synthesized
agcacaggtcgtttaataaa

SEQ ID NO: 620793 - DNA, 20 bp, Artificial Sequence
  chemically synthesized
attcccatttagatgggtag

SEQ ID NO: 620794 - DNA, 20 bp, Artificial Sequence
  chemically synthesized
ctcttgcaggtgtaaaaagt

SEQ ID NO: 620795 - DNA, 20 bp, Artificial Sequence
  chemically synthesized
ccacctgcatcacagtattc

SEQ ID NO: 620796 - DNA, 20 bp, Artificial Sequence
  chemically synthesized
accctacccacaactttgaa

SEQ ID NO: 620797 - DNA, 20 bp, Artificial Sequence
  chemically synthesized
tattgtttcttattgcctct

SEQ ID NO: 620798 - DNA, 20 bp, Artificial Sequence
  chemically synthesized
tttacccattttagcatgcc

SEQ ID NO: 620799 - DNA, 20 bp, Artificial Sequence
  chemically synthesized
cccattttagcatgccgtgt

SEQ ID NO: 620800 - DNA, 20 bp, Artificial Sequence
  chemically synthesized
gcagacatatcatcatctct

SEQ ID NO: 620801 - DNA, 20 bp, Artificial Sequence
  chemically synthesized
atgatatgtctgctattaat

SEQ ID NO: 620802 - DNA, 20 bp, Artificial Sequence
  chemically synthesized
aaatgagaactattctagag

SEQ ID NO: 620803 - DNA, 20 bp, Artificial Sequence
  chemically synthesized
agaatagttctcatttcatg

SEQ ID NO: 620804 - DNA, 20 bp, Artificial Sequence
  chemically synthesized
atcttgcccattaaaggcaa

SEQ ID NO: 620805 - DNA, 20 bp, Artificial Sequence
  chemically synthesized
tgcccattaaaggcaaaaca

SEQ ID NO: 620806 - DNA, 20 bp, Artificial Sequence
  chemically synthesized
gaagaaataattaaaaaaca

SEQ ID NO: 620807 - DNA, 20 bp, Artificial Sequence
  chemically synthesized
cgtgtactgtaagcattctt

SEQ ID NO: 620808 - DNA, 20 bp, Artificial Sequence
  chemically synthesized
tggctgtaaaaaacagtaaa

SEQ ID NO: 620809 - DNA, 20 bp, Artificial Sequence
  chemically synthesized
ttacagccaagaaaaatcga

SEQ ID NO: 620810 - DNA, 20 bp, Artificial Sequence
  chemically synthesized
atcaataggtgtgtaaacta

SEQ ID NO: 620811 - DNA, 20 bp, Artificial Sequence
  chemically synthesized
atcgacatagtttacacacc

SEQ ID NO: 620812 - DNA, 20 bp, Artificial Sequence
  chemically synthesized
tagagaacaaaaaaaaccca

SEQ ID NO: 620813 - DNA, 20 bp, Artificial Sequence
  chemically synthesized
actcttgtccattaatctgt

SEQ ID NO: 620814 - DNA, 20 bp, Artificial Sequence
  chemically synthesized
attaacactcttgtccatta

SEQ ID NO: 620815 - DNA, 20 bp, Artificial Sequence
  chemically synthesized
cgttagagctattatgtaat

SEQ ID NO: 620816 - DNA, 20 bp, Artificial Sequence
  chemically synthesized
ccttgagtcaacaatgcctt

SEQ ID NO: 620817 - DNA, 20 bp, Artificial Sequence
  chemically synthesized
ctggcccaatccaaacagat

SEQ ID NO: 620818 - DNA, 20 bp, Artificial Sequence
  chemically synthesized
tcattttaaaccagcatctg

SEQ ID NO: 620819 - DNA, 20 bp, Artificial Sequence
  chemically synthesized
tccagtcattttaaaccagc

SEQ ID NO: 620820 - DNA, 20 bp, Artificial Sequence
  chemically synthesized
tgctccataatattctgtca

SEQ ID NO: 620821 - DNA, 20 bp, Artificial Sequence
  chemically synthesized
atattatggagcaatgtaag

SEQ ID NO: 620822 - DNA, 20 bp, Artificial Sequence
  chemically synthesized
tggagcaatgtaagtaatga

SEQ ID NO: 620823 - DNA, 20 bp, Artificial Sequence
  chemically synthesized
actttattaaggaaaaaata

SEQ ID NO: 620824 - DNA, 20 bp, Artificial Sequence
  chemically synthesized
gctaaaacatcctttctcta

SEQ ID NO: 620825 - DNA, 20 bp, Artificial Sequence
  chemically synthesized
aaataaactgtttagagaaa

SEQ ID NO: 620826 - DNA, 20 bp, Artificial Sequence
  chemically synthesized
gaaaggatgttttagctgtg

SEQ ID NO: 620827 - DNA, 20 bp, Artificial Sequence
  chemically synthesized
ttagctgtgggtggctttcc

SEQ ID NO: 620828 - DNA, 20 bp, Artificial Sequence
  chemically synthesized
tgagccaccgtgcccggctt

SEQ ID NO: 620829 - DNA, 20 bp, Artificial Sequence
  chemically synthesized
tacaagcgtgagccaccgtg

SEQ ID NO: 620830 - DNA, 20 bp, Artificial Sequence
  chemically synthesized
atgaagccgggcacggtggc

SEQ ID NO: 620831 - DNA, 20 bp, Artificial Sequence
  chemically synthesized
tgcctctgcctcccaaagtg

SEQ ID NO: 620832 - DNA, 20 bp, Artificial Sequence
  chemically synthesized
ttttatattagtagtacaga

SEQ ID NO: 620833 - DNA, 20 bp, Artificial Sequence
  chemically synthesized
tcgggaagctgaggcaggag

SEQ ID NO: 620834 - DNA, 20 bp, Artificial Sequence
  chemically synthesized
ggttcaagcgattctcctgc

SEQ ID NO: 620835 - DNA, 20 bp, Artificial Sequence
  chemically synthesized
aatctccgcctcctgggttc

SEQ ID NO: 620836 - DNA, 20 bp, Artificial Sequence
  chemically synthesized
aatcgcttgaacccaggagg

SEQ ID NO: 620837 - DNA, 20 bp, Artificial Sequence
  chemically synthesized
gaggcggagattgcagtgag

SEQ ID NO: 620838 - DNA, 20 bp, Artificial Sequence
  chemically synthesized
ttgttttttgttttttgaga

SEQ ID NO: 620839 - DNA, 20 bp, Artificial Sequence
  chemically synthesized
catggttttcattttttgtt

SEQ ID NO: 620840 - DNA, 20 bp, Artificial Sequence
  chemically synthesized
tattactcatggttttcatt

SEQ ID NO: 620841 - DNA, 20 bp, Artificial Sequence
  chemically synthesized
attgattttcatttattact

SEQ ID NO: 620842 - DNA, 20 bp, Artificial Sequence
  chemically synthesized
ccattaatacactctgagtt

SEQ ID NO: 620843 - DNA, 20 bp, Artificial Sequence
  chemically synthesized
gagatattctatccaaattc

SEQ ID NO: 620844 - DNA, 20 bp, Artificial Sequence
  chemically synthesized
aacatgaaaaaattggtagg

SEQ ID NO: 620845 - DNA, 20 bp, Artificial Sequence
  chemically synthesized
taggcatttcctaggagctg

SEQ ID NO: 620846 - DNA, 20 bp, Artificial Sequence
  chemically synthesized
tcatcagctcctaggaaatg

SEQ ID NO: 620847 - DNA, 20 bp, Artificial Sequence
  chemically synthesized
ccatcctatccataggttat

SEQ ID NO: 620848 - DNA, 20 bp, Artificial Sequence
  chemically synthesized
tatatctctctttctcttcc

SEQ ID NO: 620849 - DNA, 20 bp, Artificial Sequence
  chemically synthesized
agatactttgttggcaatcg

SEQ ID NO: 620850 - DNA, 20 bp, Artificial Sequence
  chemically synthesized
tgttggcaatcgcagcgttt

SEQ ID NO: 620851 - DNA, 20 bp, Artificial Sequence
  chemically synthesized
accaaataaacaaataaacg

SEQ ID NO: 620852 - DNA, 20 bp, Artificial Sequence
  chemically synthesized
tcgcagcgtttatttgttta

SEQ ID NO: 620853 - DNA, 20 bp, Artificial Sequence
  chemically synthesized
acaatacaagtgcctcttta

SEQ ID NO: 620854 - DNA, 20 bp, Artificial Sequence
  chemically synthesized
tcctactaaagctaggaaaa

SEQ ID NO: 620855 - DNA, 20 bp, Artificial Sequence
  chemically synthesized
tgatccaaaaactgtatttt

SEQ ID NO: 620856 - DNA, 20 bp, Artificial Sequence
  chemically synthesized
ggatcagatctaaatttaag

SEQ ID NO: 620857 - DNA, 20 bp, Artificial Sequence
  chemically synthesized
gagatttttcagtaatttac

SEQ ID NO: 620858 - DNA, 20 bp, Artificial Sequence
  chemically synthesized
aatatagataatagggttca

SEQ ID NO: 620859 - DNA, 20 bp, Artificial Sequence
  chemically synthesized
agccaccgcacctggcctga

SEQ ID NO: 620860 - DNA, 20 bp, Artificial Sequence
  chemically synthesized
tgcctcggcctcccaaagtg

SEQ ID NO: 620861 - DNA, 20 bp, Artificial Sequence
  chemically synthesized
tctgtattttttagtagaga

SEQ ID NO: 620862 - DNA, 20 bp, Artificial Sequence
  chemically synthesized
ttgggaagctaaggcaggag

SEQ ID NO: 620863 - DNA, 20 bp, Artificial Sequence
  chemically synthesized
ggttcaagcgattctcctgc

SEQ ID NO: 620864 - DNA, 20 bp, Artificial Sequence
  chemically synthesized
aacctccgcctccctggttc

SEQ ID NO: 620865 - DNA, 20 bp, Artificial Sequence
  chemically synthesized
aagaaagaaaaactacttca

SEQ ID NO: 620866 - DNA, 20 bp, Artificial Sequence
  chemically synthesized
tcttcccaaaagccatttga

SEQ ID NO: 620867 - DNA, 20 bp, Artificial Sequence
  chemically synthesized
cctgatagtgcataattaat

SEQ ID NO: 620868 - DNA, 20 bp, Artificial Sequence
  chemically synthesized
aaattatattcacaaggtag

SEQ ID NO: 620869 - DNA, 20 bp, Artificial Sequence
  chemically synthesized
acttgtttccctctatatca

SEQ ID NO: 620870 - DNA, 20 bp, Artificial Sequence
  chemically synthesized
gtttccctctatatcagtaa

SEQ ID NO: 620871 - DNA, 20 bp, Artificial Sequence
  chemically synthesized
ttgagccagtttaaaaataa

SEQ ID NO: 620872 - DNA, 20 bp, Artificial Sequence
  chemically synthesized
aatatcttcaattgccttga

SEQ ID NO: 620873 - DNA, 20 bp, Artificial Sequence
  chemically synthesized
cctttgataaaactttcaaa

SEQ ID NO: 620874 - DNA, 20 bp, Artificial Sequence
  chemically synthesized
aaacattgaaaaccttcttt

SEQ ID NO: 620875 - DNA, 20 bp, Artificial Sequence
  chemically synthesized
aaactttcaaagaaggtttt

SEQ ID NO: 620876 - DNA, 20 bp, Artificial Sequence
  chemically synthesized
aggttttcaatgtttattcc

SEQ ID NO: 620877 - DNA, 20 bp, Artificial Sequence
  chemically synthesized
ttgacgttataagttcaaat

SEQ ID NO: 620878 - DNA, 20 bp, Artificial Sequence
  chemically synthesized
tcttagaaaagtttaggaag

SEQ ID NO: 620879 - DNA, 20 bp, Artificial Sequence
  chemically synthesized
tactgtcttagaaaagttta

SEQ ID NO: 620880 - DNA, 20 bp, Artificial Sequence
  chemically synthesized
tggttattttactgtcttag

SEQ ID NO: 620881 - DNA, 20 bp, Artificial Sequence
  chemically synthesized
ctcacggacttcatagactg

SEQ ID NO: 620882 - DNA, 20 bp, Artificial Sequence
  chemically synthesized
actgtcacgttttatttatt

SEQ ID NO: 620883 - DNA, 20 bp, Artificial Sequence
  chemically synthesized
cgttttatttatttcaggtt

SEQ ID NO: 620884 - DNA, 20 bp, Artificial Sequence
  chemically synthesized
tttccaaaattatacttaaa

SEQ ID NO: 620885 - DNA, 20 bp, Artificial Sequence
  chemically synthesized
tggggtaatatctcctcttt

SEQ ID NO: 620886 - DNA, 20 bp, Artificial Sequence
  chemically synthesized
aggagatattaccccagaag

SEQ ID NO: 620887 - DNA, 20 bp, Artificial Sequence
  chemically synthesized
taccccagaaggctggtttt

SEQ ID NO: 620888 - DNA, 20 bp, Artificial Sequence
  chemically synthesized
tgctcagtgaactgtaacac

SEQ ID NO: 620889 - DNA, 20 bp, Artificial Sequence
  chemically synthesized
cagttcactgagcataatgt

SEQ ID NO: 620890 - DNA, 20 bp, Artificial Sequence
  chemically synthesized
tcaaataacttcttagaaat

SEQ ID NO: 620891 - DNA, 20 bp, Artificial Sequence
  chemically synthesized
agacagtgttacatttaatg

SEQ ID NO: 620892 - DNA, 20 bp, Artificial Sequence
  chemically synthesized
ttatttattctcccacttta

SEQ ID NO: 620893 - DNA, 20 bp, Artificial Sequence
  chemically synthesized
taataatgatgtatttctct

SEQ ID NO: 620894 - DNA, 20 bp, Artificial Sequence
  chemically synthesized
atgtatttctctgaatgctt

SEQ ID NO: 620895 - DNA, 20 bp, Artificial Sequence
  chemically synthesized
cagagtccattcagtcttat

SEQ ID NO: 620896 - DNA, 20 bp, Artificial Sequence
  chemically synthesized
gatgtaaaatgtagaatgcc

SEQ ID NO: 620897 - DNA, 20 bp, Artificial Sequence
  chemically synthesized
aaagcgttcacttaacaact

SEQ ID NO: 620898 - DNA, 20 bp, Artificial Sequence
  chemically synthesized
caagcatttagttgttaagt

SEQ ID NO: 620899 - DNA, 20 bp, Artificial Sequence
  chemically synthesized
attggcaagaaaaacttact

SEQ ID NO: 620900 - DNA, 20 bp, Artificial Sequence
  chemically synthesized
ctgaaccaattaaacatcaa

SEQ ID NO: 620901 - DNA, 20 bp, Artificial Sequence
  chemically synthesized
ttccataccacttgccattt

SEQ ID NO: 620902 - DNA, 20 bp, Artificial Sequence
  chemically synthesized
aatcatactttaattcgctt

SEQ ID NO: 620903 - DNA, 20 bp, Artificial Sequence
  chemically synthesized
aagcatataagcgaattaaa

SEQ ID NO: 620904 - DNA, 20 bp, Artificial Sequence
  chemically synthesized
agaaaatgaatcatacttta

SEQ ID NO: 620905 - DNA, 20 bp, Artificial Sequence
  chemically synthesized
ctgtgtccattccaatagaa

SEQ ID NO: 620906 - DNA, 20 bp, Artificial Sequence
  chemically synthesized
caggaatgagcctatctggt

SEQ ID NO: 620907 - DNA, 20 bp, Artificial Sequence
  chemically synthesized
atgtcttaccaattaatatt

SEQ ID NO: 620908 - DNA, 20 bp, Artificial Sequence
  chemically synthesized
tgaaagaaattaacttaatg

SEQ ID NO: 620909 - DNA, 20 bp, Artificial Sequence
  chemically synthesized
tttggttctagagtactttg

SEQ ID NO: 620910 - DNA, 20 bp, Artificial Sequence
  chemically synthesized
ggtcacaggggatatgatgg

SEQ ID NO: 620911 - DNA, 20 bp, Artificial Sequence
  chemically synthesized
atgcaggtcacaggggatat

SEQ ID NO: 620912 - DNA, 20 bp, Artificial Sequence
  chemically synthesized
acaggccattttcacttctt

SEQ ID NO: 620913 - DNA, 20 bp, Artificial Sequence
  chemically synthesized
ggtcacaaggtgctcagtgg

SEQ ID NO: 620914 - DNA, 20 bp, Artificial Sequence
  chemically synthesized
gtaattttcctttacctacc

SEQ ID NO: 620915 - DNA, 20 bp, Artificial Sequence
  chemically synthesized
gataggggtggggccgtttt

SEQ ID NO: 620916 - DNA, 20 bp, Artificial Sequence
  chemically synthesized
gggaagggagataggggtgg

SEQ ID NO: 620917 - DNA, 20 bp, Artificial Sequence
  chemically synthesized
gactcagcccgcctgcaccc

SEQ ID NO: 620918 - DNA, 20 bp, Artificial Sequence
  chemically synthesized
cgcctgcacccaggtgatta

SEQ ID NO: 620919 - DNA, 20 bp, Artificial Sequence
  chemically synthesized
aacaggctttgtgtgagcaa

SEQ ID NO: 620920 - DNA, 20 bp, Artificial Sequence
  chemically synthesized
agctttattgctcacacaaa

SEQ ID NO: 620921 - DNA, 20 bp, Artificial Sequence
  chemically synthesized
ccgtgtgaagagaccaccaa

SEQ ID NO: 620922 - DNA, 20 bp, Artificial Sequence
  chemically synthesized
aaaatgcaagacataagtaa

SEQ ID NO: 620923 - DNA, 20 bp, Artificial Sequence
  chemically synthesized
tttagtgattccatacattt

SEQ ID NO: 620924 - DNA, 20 bp, Artificial Sequence
  chemically synthesized
cccattttctataatttttt

SEQ ID NO: 620925 - DNA, 20 bp, Artificial Sequence
  chemically synthesized
ttatcattatttttatttgg

SEQ ID NO: 620926 - DNA, 20 bp, Artificial Sequence
  chemically synthesized
agatttatcattatttttat

SEQ ID NO: 620927 - DNA, 20 bp, Artificial Sequence
  chemically synthesized
aagaaataatgatttattat

SEQ ID NO: 620928 - DNA, 20 bp, Artificial Sequence
  chemically synthesized
gaaaaatatatttaaagaaa

SEQ ID NO: 620929 - DNA, 20 bp, Artificial Sequence
  chemically synthesized
tagtgttcccctgaggactt

SEQ ID NO: 620930 - DNA, 20 bp, Artificial Sequence
  chemically synthesized
taatttaaaagtagaatatc

SEQ ID NO: 620931 - DNA, 20 bp, Artificial Sequence
  chemically synthesized
ttattgaatcataattacac

SEQ ID NO: 620932 - DNA, 20 bp, Artificial Sequence
  chemically synthesized
tatgtaaatcaatagtgtaa

SEQ ID NO: 620933 - DNA, 20 bp, Artificial Sequence
  chemically synthesized
ttcacaggtaaactttctcc

SEQ ID NO: 620934 - DNA, 20 bp, Artificial Sequence
  chemically synthesized
aatatgacaaaactctagga

SEQ ID NO: 620935 - DNA, 20 bp, Artificial Sequence
  chemically synthesized
ctaaatgagttagcccactt

SEQ ID NO: 620936 - DNA, 20 bp, Artificial Sequence
  chemically synthesized
atgagttagcccacttaaat

SEQ ID NO: 620937 - DNA, 20 bp, Artificial Sequence
  chemically synthesized
agcacagaaaaatatgttaa

SEQ ID NO: 620938 - DNA, 20 bp, Artificial Sequence
  chemically synthesized
cgttttaaaataataatgta

SEQ ID NO: 620939 - DNA, 20 bp, Artificial Sequence
  chemically synthesized
tagcttgggctcagaggcct

SEQ ID NO: 620940 - DNA, 20 bp, Artificial Sequence
  chemically synthesized
gatcacaggggatatgatgg

SEQ ID NO: 620941 - DNA, 20 bp, Artificial Sequence
  chemically synthesized
gtgcagatcacaggggatat

SEQ ID NO: 620942 - DNA, 20 bp, Artificial Sequence
  chemically synthesized
ctgtgatctgcacgtacaca

SEQ ID NO: 620943 - DNA, 20 bp, Artificial Sequence
  chemically synthesized
ggtcacaaggtactcagtgg

SEQ ID NO: 620944 - DNA, 20 bp, Artificial Sequence
  chemically synthesized
gataggggtggggccgtttt

SEQ ID NO: 620945 - DNA, 20 bp, Artificial Sequence
  chemically synthesized
gcgaagggagataggggtgg

SEQ ID NO: 620946 - DNA, 20 bp, Artificial Sequence
  chemically synthesized
acctgcacccaggtgaaata

SEQ ID NO: 620947 - DNA, 20 bp, Artificial Sequence
  chemically synthesized
aggctttgtgtgagccataa

SEQ ID NO: 620948 - DNA, 20 bp, Artificial Sequence
  chemically synthesized
agctttatggctcacacaaa

SEQ ID NO: 620949 - DNA, 20 bp, Artificial Sequence
  chemically synthesized
ccgtgtgaagagaccaccaa

SEQ ID NO: 620950 - DNA, 20 bp, Artificial Sequence
  chemically synthesized
tgtttgaattaagaatggtt

SEQ ID NO: 620951 - DNA, 20 bp, Artificial Sequence
  chemically synthesized
cacttttcttacttgggcgt

SEQ ID NO: 620952 - DNA, 20 bp, Artificial Sequence
  chemically synthesized
ttcagtttgtgaactaataa

SEQ ID NO: 620953 - DNA, 20 bp, Artificial Sequence
  chemically synthesized
ttttaggttattactgatat

SEQ ID NO: 620954 - DNA, 20 bp, Artificial Sequence
  chemically synthesized
atatcagtaataacctaaaa

SEQ ID NO: 620955 - DNA, 20 bp, Artificial Sequence
  chemically synthesized
agtagattctaatgcctaat

SEQ ID NO: 620956 - DNA, 20 bp, Artificial Sequence
  chemically synthesized
attcacttttgagtttgaaa

SEQ ID NO: 620957 - DNA, 20 bp, Artificial Sequence
  chemically synthesized
aattacaaggagattcactt

SEQ ID NO: 620958 - DNA, 20 bp, Artificial Sequence
  chemically synthesized
atttagctctgataattaca

SEQ ID NO: 620959 - DNA, 20 bp, Artificial Sequence
  chemically synthesized
taaatatatgtaaacaaagt

SEQ ID NO: 620960 - DNA, 20 bp, Artificial Sequence
  chemically synthesized
cactttaactaaatcagtta

SEQ ID NO: 620961 - DNA, 20 bp, Artificial Sequence
  chemically synthesized
caaagtaactgatttagtta

SEQ ID NO: 620962 - DNA, 20 bp, Artificial Sequence
  chemically synthesized
taactgggggagaatgggaa

SEQ ID NO: 620963 - DNA, 20 bp, Artificial Sequence
  chemically synthesized
tggctaaaaattattatctt

SEQ ID NO: 620964 - DNA, 20 bp, Artificial Sequence
  chemically synthesized
ccaatggtctatgtaggaat

SEQ ID NO: 620965 - DNA, 20 bp, Artificial Sequence
  chemically synthesized
tttaagtatttggcttcact

SEQ ID NO: 620966 - DNA, 20 bp, Artificial Sequence
  chemically synthesized
aggtaaattggttttaagta

SEQ ID NO: 620967 - DNA, 20 bp, Artificial Sequence
  chemically synthesized
gtatgctttgttgaaggtaa

SEQ ID NO: 620968 - DNA, 20 bp, Artificial Sequence
  chemically synthesized
tttgcccaatttatgttttt

SEQ ID NO: 620969 - DNA, 20 bp, Artificial Sequence
  chemically synthesized
taggctgtcctttgcccaat

SEQ ID NO: 620970 - DNA, 20 bp, Artificial Sequence
  chemically synthesized
tatatggtaggagataggga

SEQ ID NO: 620971 - DNA, 20 bp, Artificial Sequence
  chemically synthesized
atatacaaaaattagctcaa

SEQ ID NO: 620972 - DNA, 20 bp, Artificial Sequence
  chemically synthesized
aggttttctttgaggagttt

SEQ ID NO: 620973 - DNA, 20 bp, Artificial Sequence
  chemically synthesized
tttttcctaggttttctttg

SEQ ID NO: 620974 - DNA, 20 bp, Artificial Sequence
  chemically synthesized
aatgtccaggagagtttttc

SEQ ID NO: 620975 - DNA, 20 bp, Artificial Sequence
  chemically synthesized
ttacctaggccaatgtccag

SEQ ID NO: 620976 - DNA, 20 bp, Artificial Sequence
  chemically synthesized
tttatttttatttttgttgc

SEQ ID NO: 620977 - DNA, 20 bp, Artificial Sequence
  chemically synthesized
ttttagtttacttagatccc

SEQ ID NO: 620978 - DNA, 20 bp, Artificial Sequence
  chemically synthesized
aatgggatctaagtaaacta

SEQ ID NO: 620979 - DNA, 20 bp, Artificial Sequence
  chemically synthesized
cttttgctgtgcagaagctt

SEQ ID NO: 620980 - DNA, 20 bp, Artificial Sequence
  chemically synthesized
ggttatttcttttgctgtgc

SEQ ID NO: 620981 - DNA, 20 bp, Artificial Sequence
  chemically synthesized
ttttttccattctgtcggtt

SEQ ID NO: 620982 - DNA, 20 bp, Artificial Sequence
  chemically synthesized
caaatatttttttccattct

SEQ ID NO: 620983 - DNA, 20 bp, Artificial Sequence
  chemically synthesized
gatattggtcagttgtcaga

SEQ ID NO: 620984 - DNA, 20 bp, Artificial Sequence
  chemically synthesized
agattgttttcttcttgctg

SEQ ID NO: 620985 - DNA, 20 bp, Artificial Sequence
  chemically synthesized
taaagagattgttttcttct

SEQ ID NO: 620986 - DNA, 20 bp, Artificial Sequence
  chemically synthesized
agaagaaaacaatctcttta

SEQ ID NO: 620987 - DNA, 20 bp, Artificial Sequence
  chemically synthesized
gtttccaagctttttaaaga

SEQ ID NO: 620988 - DNA, 20 bp, Artificial Sequence
  chemically synthesized
tgtcgtttccaagcttttta

SEQ ID NO: 620989 - DNA, 20 bp, Artificial Sequence
  chemically synthesized
aatgtatattcttgtcgttt

SEQ ID NO: 620990 - DNA, 20 bp, Artificial Sequence
  chemically synthesized
ttttgagaaatgtatattct

SEQ ID NO: 620991 - DNA, 20 bp, Artificial Sequence
  chemically synthesized
ggttttaatttgcattcccc

SEQ ID NO: 620992 - DNA, 20 bp, Artificial Sequence
  chemically synthesized
aagataaggaagtatctcat

SEQ ID NO: 620993 - DNA, 20 bp, Artificial Sequence
  chemically synthesized
atcttgtccatgccaacgtt

SEQ ID NO: 620994 - DNA, 20 bp, Artificial Sequence
  chemically synthesized
tctttttatcttgtccatgc

SEQ ID NO: 620995 - DNA, 20 bp, Artificial Sequence
  chemically synthesized
tacctctctggaaaacagta

SEQ ID NO: 620996 - DNA, 20 bp, Artificial Sequence
  chemically synthesized
agttctttgagaaatctcca

SEQ ID NO: 620997 - DNA, 20 bp, Artificial Sequence
  chemically synthesized
agatatgcagtattaggatt

SEQ ID NO: 620998 - DNA, 20 bp, Artificial Sequence
  chemically synthesized
attttggtagatatgcagta

SEQ ID NO: 620999 - DNA, 20 bp, Artificial Sequence
  chemically synthesized
tgaaaaaggcacctgcatac

SEQ ID NO: 621000 - DNA, 20 bp, Artificial Sequence
  chemically synthesized
ctaaggtggattctatatct

SEQ ID NO: 621001 - DNA, 20 bp, Artificial Sequence
  chemically synthesized
attttctttatccactctaa

SEQ ID NO: 621002 - DNA, 20 bp, Artificial Sequence
  chemically synthesized
tgctgcagaagacgttattt

SEQ ID NO: 621003 - DNA, 20 bp, Artificial Sequence
  chemically synthesized
tataagtgagaacacacagt

SEQ ID NO: 621004 - DNA, 20 bp, Artificial Sequence
  chemically synthesized
agtgtacgttgtacccaata

SEQ ID NO: 621005 - DNA, 20 bp, Artificial Sequence
  chemically synthesized
gaattgtataatggtgaagt

SEQ ID NO: 621006 - DNA, 20 bp, Artificial Sequence
  chemically synthesized
gctttagggtttcaagtggt

SEQ ID NO: 621007 - DNA, 20 bp, Artificial Sequence
  chemically synthesized
tcaatagctttagggtttca

SEQ ID NO: 621008 - DNA, 20 bp, Artificial Sequence
  chemically synthesized
ttgttgtacttcaatagctt

SEQ ID NO: 621009 - DNA, 20 bp, Artificial Sequence
  chemically synthesized
tttttattttgttgtacttc

SEQ ID NO: 621010 - DNA, 20 bp, Artificial Sequence
  chemically synthesized
aaatgtatattccaataaga

SEQ ID NO: 621011 - DNA, 20 bp, Artificial Sequence
  chemically synthesized
aatgtttatgttttggcttt

SEQ ID NO: 621012 - DNA, 20 bp, Artificial Sequence
  chemically synthesized
agccctgtgaatgtttatgt

SEQ ID NO: 621013 - DNA, 20 bp, Artificial Sequence
  chemically synthesized
agccaaaacataaacattca

SEQ ID NO: 621014 - DNA, 20 bp, Artificial Sequence
  chemically synthesized
ccaggaagccctgtgaatgt

SEQ ID NO: 621015 - DNA, 20 bp, Artificial Sequence
  chemically synthesized
agatcaccaggaagccctgt

SEQ ID NO: 621016 - DNA, 20 bp, Artificial Sequence
  chemically synthesized
cctcctcattatttgcctca

SEQ ID NO: 621017 - DNA, 20 bp, Artificial Sequence
  chemically synthesized
gaacacatccactgtcttca

SEQ ID NO: 621018 - DNA, 20 bp, Artificial Sequence
  chemically synthesized
atcacatttgatgttgtaag

SEQ ID NO: 621019 - DNA, 20 bp, Artificial Sequence
  chemically synthesized
agcttcccttacaacatcaa

SEQ ID NO: 621020 - DNA, 20 bp, Artificial Sequence
  chemically synthesized
tttcccctattcacttccaa

SEQ ID NO: 621021 - DNA, 20 bp, Artificial Sequence
  chemically synthesized
ccatgaaattgagggccaaa

SEQ ID NO: 621022 - DNA, 20 bp, Artificial Sequence
  chemically synthesized
gggccaaacacagatttcca

SEQ ID NO: 621023 - DNA, 20 bp, Artificial Sequence
  chemically synthesized
acagcaagctttttggaaat

SEQ ID NO: 621024 - DNA, 20 bp, Artificial Sequence
  chemically synthesized
acacagatttccaaaaagct

SEQ ID NO: 621025 - DNA, 20 bp, Artificial Sequence
  chemically synthesized
acataaccatatcgaaaaca

SEQ ID NO: 621026 - DNA, 20 bp, Artificial Sequence
  chemically synthesized
cccacatcctgtcatgctag

SEQ ID NO: 621027 - DNA, 20 bp, Artificial Sequence
  chemically synthesized
tttacagaagcaagtggctg

SEQ ID NO: 621028 - DNA, 20 bp, Artificial Sequence
  chemically synthesized
taccacaaaaccttacagcc

SEQ ID NO: 621029 - DNA, 20 bp, Artificial Sequence
  chemically synthesized
tttatacgtattgagttaat

SEQ ID NO: 621030 - DNA, 20 bp, Artificial Sequence
  chemically synthesized
aactcaatacgtataaaaga

SEQ ID NO: 621031 - DNA, 20 bp, Artificial Sequence
  chemically synthesized
aaaagagaaagctttcgaaa

SEQ ID NO: 621032 - DNA, 20 bp, Artificial Sequence
  chemically synthesized
ccggccttaaacttcttttc

SEQ ID NO: 621033 - DNA, 20 bp, Artificial Sequence
  chemically synthesized
cacctctgcctccgaaagtg

SEQ ID NO: 621034 - DNA, 20 bp, Artificial Sequence
  chemically synthesized
ttttgtatttttagtagaga

SEQ ID NO: 621035 - DNA, 20 bp, Artificial Sequence
  chemically synthesized
tgcctcagcctcccgagtag

SEQ ID NO: 621036 - DNA, 20 bp, Artificial Sequence
  chemically synthesized
aacctccgcctcctgagtta

SEQ ID NO: 621037 - DNA, 20 bp, Artificial Sequence
  chemically synthesized
tgttggggggggggggggga

SEQ ID NO: 621038 - DNA, 20 bp, Artificial Sequence
  chemically synthesized
actttgttttttgttgttgt

SEQ ID NO: 621039 - DNA, 20 bp, Artificial Sequence
  chemically synthesized
acagcaacaacaacaaaaaa

SEQ ID NO: 621040 - DNA, 20 bp, Artificial Sequence
  chemically synthesized
tggcatgtattatacacaaa

SEQ ID NO: 621041 - DNA, 20 bp, Artificial Sequence
  chemically synthesized
ctgtcaagatatatttctaa

SEQ ID NO: 621042 - DNA, 20 bp, Artificial Sequence
  chemically synthesized
tgctactgccttcctaataa

SEQ ID NO: 621043 - DNA, 20 bp, Artificial Sequence
  chemically synthesized
aatttctaaatttaaaaaaa

SEQ ID NO: 621044 - DNA, 20 bp, Artificial Sequence
  chemically synthesized
taagtattagttctgttggt

SEQ ID NO: 621045 - DNA, 20 bp, Artificial Sequence
  chemically synthesized
cttaagtataatttccatgg

SEQ ID NO: 621046 - DNA, 20 bp, Artificial Sequence
  chemically synthesized
ctataaattcatagtcaata

SEQ ID NO: 621047 - DNA, 20 bp, Artificial Sequence
  chemically synthesized
attgactatgaatttataga

SEQ ID NO: 621048 - DNA, 20 bp, Artificial Sequence
  chemically synthesized
catttctattataaatgcaa

SEQ ID NO: 621049 - DNA, 20 bp, Artificial Sequence
  chemically synthesized
ttctcatttctattataaat

SEQ ID NO: 621050 - DNA, 20 bp, Artificial Sequence
  chemically synthesized
cttcaacatattacacattc

SEQ ID NO: 621051 - DNA, 20 bp, Artificial Sequence
  chemically synthesized
gtggaggacagtcaagttcc

SEQ ID NO: 621052 - DNA, 20 bp, Artificial Sequence
  chemically synthesized
tatttagttcaggttataat

SEQ ID NO: 621053 - DNA, 20 bp, Artificial Sequence
  chemically synthesized
aataaagtaccatttctact

SEQ ID NO: 621054 - DNA, 20 bp, Artificial Sequence
  chemically synthesized
tagattatgacttttaaaaa

SEQ ID NO: 621055 - DNA, 20 bp, Artificial Sequence
  chemically synthesized
aaatatgaataaaaaggaca

SEQ ID NO: 621056 - DNA, 20 bp, Artificial Sequence
  chemically synthesized
atgaataaaaaggacaagct

SEQ ID NO: 621057 - DNA, 20 bp, Artificial Sequence
  chemically synthesized
ttttgcctcttaatgaatca

SEQ ID NO: 621058 - DNA, 20 bp, Artificial Sequence
  chemically synthesized
tagatattgtatcaacaata

SEQ ID NO: 621059 - DNA, 20 bp, Artificial Sequence
  chemically synthesized
tgttttactaacaataaaac

SEQ ID NO: 621060 - DNA, 20 bp, Artificial Sequence
  chemically synthesized
ttattttagttaatggaaac

SEQ ID NO: 621061 - DNA, 20 bp, Artificial Sequence
  chemically synthesized
aaaacctaataaaattaaaa

SEQ ID NO: 621062 - DNA, 20 bp, Artificial Sequence
  chemically synthesized
taatccctattttaatttta

SEQ ID NO: 621063 - DNA, 20 bp, Artificial Sequence
  chemically synthesized
gtattagcttagctcagcat

SEQ ID NO: 621064 - DNA, 20 bp, Artificial Sequence
  chemically synthesized
ttttgtattagcttagctca

SEQ ID NO: 621065 - DNA, 20 bp, Artificial Sequence
  chemically synthesized
cagaaaatgtattattttgt

SEQ ID NO: 621066 - DNA, 20 bp, Artificial Sequence
  chemically synthesized
aataatacattttctgttgc

SEQ ID NO: 621067 - DNA, 20 bp, Artificial Sequence
  chemically synthesized
ttctgttgctgttgtttgtc

SEQ ID NO: 621068 - DNA, 20 bp, Artificial Sequence
  chemically synthesized
gctcactgtaacctctgcct

SEQ ID NO: 621069 - DNA, 20 bp, Artificial Sequence
  chemically synthesized
aacctctgcctctcggtttc

SEQ ID NO: 621070 - DNA, 20 bp, Artificial Sequence
  chemically synthesized
gcctcagcacccccgagtag

SEQ ID NO: 621071 - DNA, 20 bp, Artificial Sequence
  chemically synthesized
ttttgtatttttagtacaga

SEQ ID NO: 621072 - DNA, 20 bp, Artificial Sequence
  chemically synthesized
cggtccgatcacctgagatc

SEQ ID NO: 621073 - DNA, 20 bp, Artificial Sequence
  chemically synthesized
cgcctcagcctgccaaagtg

SEQ ID NO: 621074 - DNA, 20 bp, Artificial Sequence
  chemically synthesized
cccagaataacacatttaag

SEQ ID NO: 621075 - DNA, 20 bp, Artificial Sequence
  chemically synthesized
ctcctgggcctcacaaaggg

SEQ ID NO: 621076 - DNA, 20 bp, Artificial Sequence
  chemically synthesized
ccctttgtgaggcccaggag

SEQ ID NO: 621077 - DNA, 20 bp, Artificial Sequence
  chemically synthesized
agggcggattacctgaggtc

SEQ ID NO: 621078 - DNA, 20 bp, Artificial Sequence
  chemically synthesized
ttttgtatttgtagtagaga

SEQ ID NO: 621079 - DNA, 20 bp, Artificial Sequence
  chemically synthesized
tcatgaggctgaggcaggag

SEQ ID NO: 621080 - DNA, 20 bp, Artificial Sequence
  chemically synthesized
cctgggcaacaagagtgaaa

SEQ ID NO: 621081 - DNA, 20 bp, Artificial Sequence
  chemically synthesized
ttttttttttttttccgaaa

SEQ ID NO: 621082 - DNA, 20 bp, Artificial Sequence
  chemically synthesized
aaaaaaagaagaagagagag

SEQ ID NO: 621083 - DNA, 20 bp, Artificial Sequence
  chemically synthesized
agttttaaaattgaacagac

SEQ ID NO: 621084 - DNA, 20 bp, Artificial Sequence
  chemically synthesized
tataatttttatttaagatt

SEQ ID NO: 621085 - DNA, 20 bp, Artificial Sequence
  chemically synthesized
attctaaatataatttttat

SEQ ID NO: 621086 - DNA, 20 bp, Artificial Sequence
  chemically synthesized
aatttgtactatcagctata

SEQ ID NO: 621087 - DNA, 20 bp, Artificial Sequence
  chemically synthesized
tgtactatcagctatagatg

SEQ ID NO: 621088 - DNA, 20 bp, Artificial Sequence
  chemically synthesized
tttttaatatatactcatgc

SEQ ID NO: 621089 - DNA, 20 bp, Artificial Sequence
  chemically synthesized
ttgttttgaaaattagagat

SEQ ID NO: 621090 - DNA, 20 bp, Artificial Sequence
  chemically synthesized
ttgaaaattagagataactg

SEQ ID NO: 621091 - DNA, 20 bp, Artificial Sequence
  chemically synthesized
ataactgtttagctttaaca

SEQ ID NO: 621092 - DNA, 20 bp, Artificial Sequence
  chemically synthesized
tagtgtccattcaggtccct

SEQ ID NO: 621093 - DNA, 20 bp, Artificial Sequence
  chemically synthesized
ccattcaggtccctgctggt

SEQ ID NO: 621094 - DNA, 20 bp, Artificial Sequence
  chemically synthesized
tttaagaccgttattattgg

SEQ ID NO: 621095 - DNA, 20 bp, Artificial Sequence
  chemically synthesized
gccaataataacggtcttaa

SEQ ID NO: 621096 - DNA, 20 bp, Artificial Sequence
  chemically synthesized
actgttctagattaagacaa

SEQ ID NO: 621097 - DNA, 20 bp, Artificial Sequence
  chemically synthesized
gcaaaattgtcttaatctag

SEQ ID NO: 621098 - DNA, 20 bp, Artificial Sequence
  chemically synthesized
agatagtgttttcaaactgt

SEQ ID NO: 621099 - DNA, 20 bp, Artificial Sequence
  chemically synthesized
aatacactaatagactaaga

SEQ ID NO: 621100 - DNA, 20 bp, Artificial Sequence
  chemically synthesized
ctattagtgtattttttcag

SEQ ID NO: 621101 - DNA, 20 bp, Artificial Sequence
  chemically synthesized
tagtgtattttttcagtccg

SEQ ID NO: 621102 - DNA, 20 bp, Artificial Sequence
  chemically synthesized
ttttcagtccggtttgtttc

SEQ ID NO: 621103 - DNA, 20 bp, Artificial Sequence
  chemically synthesized
cttctgcttctttaaatcat

SEQ ID NO: 621104 - DNA, 20 bp, Artificial Sequence
  chemically synthesized
aagttcatccagaaaaacaa

SEQ ID NO: 621105 - DNA, 20 bp, Artificial Sequence
  chemically synthesized
gagaaatgtcaatgtgaatt

SEQ ID NO: 621106 - DNA, 20 bp, Artificial Sequence
  chemically synthesized
ctttctaaatgtgtgcttta

SEQ ID NO: 621107 - DNA, 20 bp, Artificial Sequence
  chemically synthesized
tgtacttaggctttctaaat

SEQ ID NO: 621108 - DNA, 20 bp, Artificial Sequence
  chemically synthesized
ggaagctttagatgctgtac

SEQ ID NO: 621109 - DNA, 20 bp, Artificial Sequence
  chemically synthesized
gaaagcctaagtacagcatc

SEQ ID NO: 621110 - DNA, 20 bp, Artificial Sequence
  chemically synthesized
tattcagttataatggtcaa

SEQ ID NO: 621111 - DNA, 20 bp, Artificial Sequence
  chemically synthesized
cagttacatggttcagtctc

SEQ ID NO: 621112 - DNA, 20 bp, Artificial Sequence
  chemically synthesized
ttttcacctccccacttcgt

SEQ ID NO: 621113 - DNA, 20 bp, Artificial Sequence
  chemically synthesized
acgacgaagtggggaggtga

SEQ ID NO: 621114 - DNA, 20 bp, Artificial Sequence
  chemically synthesized
gtggggaggtgaaaaagatt

SEQ ID NO: 621115 - DNA, 20 bp, Artificial Sequence
  chemically synthesized
tttttccccttacaggtaga

SEQ ID NO: 621116 - DNA, 20 bp, Artificial Sequence
  chemically synthesized
ggtagatgttgtttgaaata

SEQ ID NO: 621117 - DNA, 20 bp, Artificial Sequence
  chemically synthesized
tgagatttaaaacgctaatg

SEQ ID NO: 621118 - DNA, 20 bp, Artificial Sequence
  chemically synthesized
aagagatcaaagctctgcat

SEQ ID NO: 621119 - DNA, 20 bp, Artificial Sequence
  chemically synthesized
cagagctttgatctcttctt

SEQ ID NO: 621120 - DNA, 20 bp, Artificial Sequence
  chemically synthesized
gttaaaataaaaagccagag

SEQ ID NO: 621121 - DNA, 20 bp, Artificial Sequence
  chemically synthesized
ttagtgagtagaaactattc

SEQ ID NO: 621122 - DNA, 20 bp, Artificial Sequence
  chemically synthesized
agagaatagtttctactcac

SEQ ID NO: 621123 - DNA, 20 bp, Artificial Sequence
  chemically synthesized
actcactaatgattaataaa

SEQ ID NO: 621124 - DNA, 20 bp, Artificial Sequence
  chemically synthesized
gtgcaagattgcatttgcca

SEQ ID NO: 621125 - DNA, 20 bp, Artificial Sequence
  chemically synthesized
ctgttttcatttgtcaatgt

SEQ ID NO: 621126 - DNA, 20 bp, Artificial Sequence
  chemically synthesized
aaccattgttgggcatccta

SEQ ID NO: 621127 - DNA, 20 bp, Artificial Sequence
  chemically synthesized
aacagaataggatgcccaac

SEQ ID NO: 621128 - DNA, 20 bp, Artificial Sequence
  chemically synthesized
aacaatggtttaaaaaaaaa

SEQ ID NO: 621129 - DNA, 20 bp, Artificial Sequence
  chemically synthesized
tttaaaaaaaaaaaaggttt

SEQ ID NO: 621130 - DNA, 20 bp, Artificial Sequence
  chemically synthesized
aaaaaaaaaaaggttttttt

SEQ ID NO: 621131 - DNA, 20 bp, Artificial Sequence
  chemically synthesized
aaaggtttttttgtttgttt

SEQ ID NO: 621132 - DNA, 20 bp, Artificial Sequence
  chemically synthesized
gtttttttgtttgtttcttt

SEQ ID NO: 621133 - DNA, 20 bp, Artificial Sequence
  chemically synthesized
caaagtcgaagtcacccggt

SEQ ID NO: 621134 - DNA, 20 bp, Artificial Sequence
  chemically synthesized
accactagagaaacaatcac

SEQ ID NO: 621135 - DNA, 20 bp, Artificial Sequence
  chemically synthesized
tttggccttgaagcacacgt

SEQ ID NO: 621136 - DNA, 20 bp, Artificial Sequence
  chemically synthesized
ttgatttggccttgaagcac

SEQ ID NO: 621137 - DNA, 20 bp, Artificial Sequence
  chemically synthesized
caaaggactgaagaggaaat

SEQ ID NO: 621138 - DNA, 20 bp, Artificial Sequence
  chemically synthesized
ccatggtacagaaaaataac

SEQ ID NO: 621139 - DNA, 20 bp, Artificial Sequence
  chemically synthesized
aacagtctgggaagtgttcc

SEQ ID NO: 621140 - DNA, 20 bp, Artificial Sequence
  chemically synthesized
agcatatggaacacttccca

SEQ ID NO: 621141 - DNA, 20 bp, Artificial Sequence
  chemically synthesized
tcctttgttttttatatgct

SEQ ID NO: 621142 - DNA, 20 bp, Artificial Sequence
  chemically synthesized
attaatttcctttgtttttt

SEQ ID NO: 621143 - DNA, 20 bp, Artificial Sequence
  chemically synthesized
attgcaatataattaatttc

SEQ ID NO: 621144 - DNA, 20 bp, Artificial Sequence
  chemically synthesized
cttttaatttgtattaatta

SEQ ID NO: 621145 - DNA, 20 bp, Artificial Sequence
  chemically synthesized
taattaatacaaattaaaag

SEQ ID NO: 621146 - DNA, 20 bp, Artificial Sequence
  chemically synthesized
aaccactggtatatattaac

SEQ ID NO: 621147 - DNA, 20 bp, Artificial Sequence
  chemically synthesized
tttcaagatatccaaaacaa

SEQ ID NO: 621148 - DNA, 20 bp, Artificial Sequence
  chemically synthesized
atatttttatatcaaatcct

SEQ ID NO: 621149 - DNA, 20 bp, Artificial Sequence
  chemically synthesized
atattgctaataccgttctg

SEQ ID NO: 621150 - DNA, 20 bp, Artificial Sequence
  chemically synthesized
tcctatcatggttcatggac

SEQ ID NO: 621151 - DNA, 20 bp, Artificial Sequence
  chemically synthesized
aggacactgtattttgactg

SEQ ID NO: 621152 - DNA, 20 bp, Artificial Sequence
  chemically synthesized
tgactgtatggcttcaaggg

SEQ ID NO: 621153 - DNA, 20 bp, Artificial Sequence
  chemically synthesized
ttcggccaccattcaatagg

SEQ ID NO: 621154 - DNA, 20 bp, Artificial Sequence
  chemically synthesized
cacaattcggccaccattca

SEQ ID NO: 621155 - DNA, 20 bp, Artificial Sequence
  chemically synthesized
tataataaatattttaatta

SEQ ID NO: 621156 - DNA, 20 bp, Artificial Sequence
  chemically synthesized
tcatacccattgacaagttt

SEQ ID NO: 621157 - DNA, 20 bp, Artificial Sequence
  chemically synthesized
gccacgtatcatacccattg

SEQ ID NO: 621158 - DNA, 20 bp, Artificial Sequence
  chemically synthesized
acgtggcactgtgtatattc

SEQ ID NO: 621159 - DNA, 20 bp, Artificial Sequence
  chemically synthesized
atattcttttgcttatacac

SEQ ID NO: 621160 - DNA, 20 bp, Artificial Sequence
  chemically synthesized
attgctgagtgcttagttgc

SEQ ID NO: 621161 - DNA, 20 bp, Artificial Sequence
  chemically synthesized
agaaaaatatgacaattgct

SEQ ID NO: 621162 - DNA, 20 bp, Artificial Sequence
  chemically synthesized
atactcaacatcatttccca

SEQ ID NO: 621163 - DNA, 20 bp, Artificial Sequence
  chemically synthesized
tgctgagtttctgtagaggt

SEQ ID NO: 621164 - DNA, 20 bp, Artificial Sequence
  chemically synthesized
agggactgctgagtttctgt

SEQ ID NO: 621165 - DNA, 20 bp, Artificial Sequence
  chemically synthesized
aggatgtgttgtagggactg

SEQ ID NO: 621166 - DNA, 20 bp, Artificial Sequence
  chemically synthesized
gaaataaccgtggattgaga

SEQ ID NO: 621167 - DNA, 20 bp, Artificial Sequence
  chemically synthesized
tagtataacaaagaaataac

SEQ ID NO: 621168 - DNA, 20 bp, Artificial Sequence
  chemically synthesized
tgataggagacgtccaaatg

SEQ ID NO: 621169 - DNA, 20 bp, Artificial Sequence
  chemically synthesized
gattattggtttatatgaca

SEQ ID NO: 621170 - DNA, 20 bp, Artificial Sequence
  chemically synthesized
atgtcatataaaccaataat

SEQ ID NO: 621171 - DNA, 20 bp, Artificial Sequence
  chemically synthesized
gaaaaattcaatcacagatt

SEQ ID NO: 621172 - DNA, 20 bp, Artificial Sequence
  chemically synthesized
tgaaagctgaaaaattcaat

SEQ ID NO: 621173 - DNA, 20 bp, Artificial Sequence
  chemically synthesized
aataatctgtgattgaattt

SEQ ID NO: 621174 - DNA, 20 bp, Artificial Sequence
  chemically synthesized
tgattgaatttttcagcttt

SEQ ID NO: 621175 - DNA, 20 bp, Artificial Sequence
  chemically synthesized
gtcgttttgtttattctcta

SEQ ID NO: 621176 - DNA, 20 bp, Artificial Sequence
  chemically synthesized
aagagaaattatgtttgtcg

SEQ ID NO: 621177 - DNA, 20 bp, Artificial Sequence
  chemically synthesized
acattaagagaaattatgtt

SEQ ID NO: 621178 - DNA, 20 bp, Artificial Sequence
  chemically synthesized
cacacgcacattaagagaaa

SEQ ID NO: 621179 - DNA, 20 bp, Artificial Sequence
  chemically synthesized
taatttctcttaatgtgcgt

SEQ ID NO: 621180 - DNA, 20 bp, Artificial Sequence
  chemically synthesized
tgtgtttttcttttttgaga

SEQ ID NO: 621181 - DNA, 20 bp, Artificial Sequence
  chemically synthesized
gtttcattcttgttgcccag

SEQ ID NO: 621182 - DNA, 20 bp, Artificial Sequence
  chemically synthesized
aacctctgcctctggggttc

SEQ ID NO: 621183 - DNA, 20 bp, Artificial Sequence
  chemically synthesized
tgactcagcctcccaagtaa

SEQ ID NO: 621184 - DNA, 20 bp, Artificial Sequence
  chemically synthesized
aggtgcctgccaccacgccc

SEQ ID NO: 621185 - DNA, 20 bp, Artificial Sequence
  chemically synthesized
tttctatttttagtagagac

SEQ ID NO: 621186 - DNA, 20 bp, Artificial Sequence
  chemically synthesized
ggtctcaaactcctgacctc

SEQ ID NO: 621187 - DNA, 20 bp, Artificial Sequence
  chemically synthesized
caggtgaatcacttgaggtc

SEQ ID NO: 621188 - DNA, 20 bp, Artificial Sequence
  chemically synthesized
tgcctcggcctcccaaagtg

SEQ ID NO: 621189 - DNA, 20 bp, Artificial Sequence
  chemically synthesized
gggattacaggcgtgagcca

SEQ ID NO: 621190 - DNA, 20 bp, Artificial Sequence
  chemically synthesized
tacaggcgtgagccagcatg

SEQ ID NO: 621191 - DNA, 20 bp, Artificial Sequence
  chemically synthesized
gagccagcatgcttggctta

SEQ ID NO: 621192 - DNA, 20 bp, Artificial Sequence
  chemically synthesized
ttgagatttttatttcatgt

SEQ ID NO: 621193 - DNA, 20 bp, Artificial Sequence
  chemically synthesized
ctacatgaaataaaaatctc

SEQ ID NO: 621194 - DNA, 20 bp, Artificial Sequence
  chemically synthesized
tgtatccatttggcaaacaa

SEQ ID NO: 621195 - DNA, 20 bp, Artificial Sequence
  chemically synthesized
acagtagtctgcctcttatc

SEQ ID NO: 621196 - DNA, 20 bp, Artificial Sequence
  chemically synthesized
atatatacattaggaaccat

SEQ ID NO: 621197 - DNA, 20 bp, Artificial Sequence
  chemically synthesized
ttatatacatacacatataa

SEQ ID NO: 621198 - DNA, 20 bp, Artificial Sequence
  chemically synthesized
taccaaaccttatgtatata

SEQ ID NO: 621199 - DNA, 20 bp, Artificial Sequence
  chemically synthesized
taagaaacataatatataca

SEQ ID NO: 621200 - DNA, 20 bp, Artificial Sequence
  chemically synthesized
acataaggtttggtattatc

SEQ ID NO: 621201 - DNA, 20 bp, Artificial Sequence
  chemically synthesized
cacgtatccctacagataag

SEQ ID NO: 621202 - DNA, 20 bp, Artificial Sequence
  chemically synthesized
ttagaaataatttttgaata

SEQ ID NO: 621203 - DNA, 20 bp, Artificial Sequence
  chemically synthesized
aaagagagtctataacgcta

SEQ ID NO: 621204 - DNA, 20 bp, Artificial Sequence
  chemically synthesized
cattaaagacattaatagtt

SEQ ID NO: 621205 - DNA, 20 bp, Artificial Sequence
  chemically synthesized
tgtgtcagcctcccaaagtg

SEQ ID NO: 621206 - DNA, 20 bp, Artificial Sequence
  chemically synthesized
aacctctgcctcccaggttc

SEQ ID NO: 621207 - DNA, 20 bp, Artificial Sequence
  chemically synthesized
ccaagactgcgccattgcac

SEQ ID NO: 621208 - DNA, 20 bp, Artificial Sequence
  chemically synthesized
ctcaaaaaaaaaaaaaaaag

SEQ ID NO: 621209 - DNA, 20 bp, Artificial Sequence
  chemically synthesized
gaggcagaggtcgcagtgag

SEQ ID NO: 621210 - DNA, 20 bp, Artificial Sequence
  chemically synthesized
gacctctgcctcccaagttc

SEQ ID NO: 621211 - DNA, 20 bp, Artificial Sequence
  chemically synthesized
ctttgtatttttagtagaga

SEQ ID NO: 621212 - DNA, 20 bp, Artificial Sequence
  chemically synthesized
cgtgcggatcacctgaggtc

SEQ ID NO: 621213 - DNA, 20 bp, Artificial Sequence
  chemically synthesized
cgcctcagccgcccaaagtg

SEQ ID NO: 621214 - DNA, 20 bp, Artificial Sequence
  chemically synthesized
acaaagtaattggggaaaaa

SEQ ID NO: 621215 - DNA, 20 bp, Artificial Sequence
  chemically synthesized
atttcaaacgaataagaaac

SEQ ID NO: 621216 - DNA, 20 bp, Artificial Sequence
  chemically synthesized
aaacaaatctaatgtttctt

SEQ ID NO: 621217 - DNA, 20 bp, Artificial Sequence
  chemically synthesized
aaacgaataagaaacattag

SEQ ID NO: 621218 - DNA, 20 bp, Artificial Sequence
  chemically synthesized
gagccagaaggaaacaaatc

SEQ ID NO: 621219 - DNA, 20 bp, Artificial Sequence
  chemically synthesized
tttgcctcatattttggaat

SEQ ID NO: 621220 - DNA, 20 bp, Artificial Sequence
  chemically synthesized
tttgggggggggggcaagaa

SEQ ID NO: 621221 - DNA, 20 bp, Artificial Sequence
  chemically synthesized
tctgtgttacaacagttgct

SEQ ID NO: 621222 - DNA, 20 bp, Artificial Sequence
  chemically synthesized
atcatgcttcatcttttata

SEQ ID NO: 621223 - DNA, 20 bp, Artificial Sequence
  chemically synthesized
attcattaaccaaaataata

SEQ ID NO: 621224 - DNA, 20 bp, Artificial Sequence
  chemically synthesized
tttaattccaaatgttacag

SEQ ID NO: 621225 - DNA, 20 bp, Artificial Sequence
  chemically synthesized
gtacatattgcattttaaca

SEQ ID NO: 621226 - DNA, 20 bp, Artificial Sequence
  chemically synthesized
catgagaatttacttttctc

SEQ ID NO: 621227 - DNA, 20 bp, Artificial Sequence
  chemically synthesized
gtaaattctcatgtaatatt

SEQ ID NO: 621228 - DNA, 20 bp, Artificial Sequence
  chemically synthesized
catctacccgtggaagtgtc

SEQ ID NO: 621229 - DNA, 20 bp, Artificial Sequence
  chemically synthesized
accattttgaggggtaagtt

SEQ ID NO: 621230 - DNA, 20 bp, Artificial Sequence
  chemically synthesized
actcttaaccattttgaggg

SEQ ID NO: 621231 - DNA, 20 bp, Artificial Sequence
  chemically synthesized
agaaatattgaaaatataat

SEQ ID NO: 621232 - DNA, 20 bp, Artificial Sequence
  chemically synthesized
tattcgaattacacaataat

SEQ ID NO: 621233 - DNA, 20 bp, Artificial Sequence
  chemically synthesized
actccagcctgggcaaaaaa

SEQ ID NO: 621234 - DNA, 20 bp, Artificial Sequence
  chemically synthesized
ctggagtgcagtggcatgtt

SEQ ID NO: 621235 - DNA, 20 bp, Artificial Sequence
  chemically synthesized
agcctccacctcccgggttc

SEQ ID NO: 621236 - DNA, 20 bp, Artificial Sequence
  chemically synthesized
tcgggaggctgagacaggag

SEQ ID NO: 621237 - DNA, 20 bp, Artificial Sequence
  chemically synthesized
tgtctcagcctcccgagtag

SEQ ID NO: 621238 - DNA, 20 bp, Artificial Sequence
  chemically synthesized
ttttgtatttttagtagaga

SEQ ID NO: 621239 - DNA, 20 bp, Artificial Sequence
  chemically synthesized
tacaaaatgtggatttacta

SEQ ID NO: 621240 - DNA, 20 bp, Artificial Sequence
  chemically synthesized
ctataaatggaaatacaaaa

SEQ ID NO: 621241 - DNA, 20 bp, Artificial Sequence
  chemically synthesized
agataaaactttcttataca

SEQ ID NO: 621242 - DNA, 20 bp, Artificial Sequence
  chemically synthesized
ttaaaaagcttactgtataa

SEQ ID NO: 621243 - DNA, 20 bp, Artificial Sequence
  chemically synthesized
tgatttggtctcacatttta

SEQ ID NO: 621244 - DNA, 20 bp, Artificial Sequence
  chemically synthesized
tttttcattacgctcttgtt

SEQ ID NO: 621245 - DNA, 20 bp, Artificial Sequence
  chemically synthesized
atcgtttttcattacgctct

SEQ ID NO: 621246 - DNA, 20 bp, Artificial Sequence
  chemically synthesized
tattttagttgttttccttc

SEQ ID NO: 621247 - DNA, 20 bp, Artificial Sequence
  chemically synthesized
agctaggaggttcttatttt

SEQ ID NO: 621248 - DNA, 20 bp, Artificial Sequence
  chemically synthesized
ctaaaataagaacctcctag

SEQ ID NO: 621249 - DNA, 20 bp, Artificial Sequence
  chemically synthesized
ctatgaaaaaatattattat

SEQ ID NO: 621250 - DNA, 20 bp, Artificial Sequence
  chemically synthesized
attttttcatagatagtaac

SEQ ID NO: 621251 - DNA, 20 bp, Artificial Sequence
  chemically synthesized
ctttactctgaaagtagaat

SEQ ID NO: 621252 - DNA, 20 bp, Artificial Sequence
  chemically synthesized
cacaggcactattaatgaag

SEQ ID NO: 621253 - DNA, 20 bp, Artificial Sequence
  chemically synthesized
ctgtgcttcattaatagtgc

SEQ ID NO: 621254 - DNA, 20 bp, Artificial Sequence
  chemically synthesized
agaagtatagcctcagtgtt

SEQ ID NO: 621255 - DNA, 20 bp, Artificial Sequence
  chemically synthesized
agaactttatgatttgggct

SEQ ID NO: 621256 - DNA, 20 bp, Artificial Sequence
  chemically synthesized
agagcatctttaggagaact

SEQ ID NO: 621257 - DNA, 20 bp, Artificial Sequence
  chemically synthesized
taaacattaacaattttcct

SEQ ID NO: 621258 - DNA, 20 bp, Artificial Sequence
  chemically synthesized
caaacacttaggaaaattgt

SEQ ID NO: 621259 - DNA, 20 bp, Artificial Sequence
  chemically synthesized
ttctgaatatttaaatgaga

SEQ ID NO: 621260 - DNA, 20 bp, Artificial Sequence
  chemically synthesized
tgctgaggttgtgctttact

SEQ ID NO: 621261 - DNA, 20 bp, Artificial Sequence
  chemically synthesized
attcattatgaatgctgagg

SEQ ID NO: 621262 - DNA, 20 bp, Artificial Sequence
  chemically synthesized
aagaacaagccttttctcat

SEQ ID NO: 621263 - DNA, 20 bp, Artificial Sequence
  chemically synthesized
ggtagtaaacatgaatgaga

SEQ ID NO: 621264 - DNA, 20 bp, Artificial Sequence
  chemically synthesized
gattaagtagtttattcaac

SEQ ID NO: 621265 - DNA, 20 bp, Artificial Sequence
  chemically synthesized
ggttatgtttgtaaggatta

SEQ ID NO: 621266 - DNA, 20 bp, Artificial Sequence
  chemically synthesized
aaataatctggttatgtttg

SEQ ID NO: 621267 - DNA, 20 bp, Artificial Sequence
  chemically synthesized
acttaatccttacaaacata

SEQ ID NO: 621268 - DNA, 20 bp, Artificial Sequence
  chemically synthesized
tgttgctgaaaataatctgg

SEQ ID NO: 621269 - DNA, 20 bp, Artificial Sequence
  chemically synthesized
aggaccagctgttatcacta

SEQ ID NO: 621270 - DNA, 20 bp, Artificial Sequence
  chemically synthesized
gttaagtgacaaaaagctaa

SEQ ID NO: 621271 - DNA, 20 bp, Artificial Sequence
  chemically synthesized
ttgactgcatcacaatccat

SEQ ID NO: 621272 - DNA, 20 bp, Artificial Sequence
  chemically synthesized
gcagtcaaagccacgaatga

SEQ ID NO: 621273 - DNA, 20 bp, Artificial Sequence
  chemically synthesized
tggtagaaaactgtgtcatt

SEQ ID NO: 621274 - DNA, 20 bp, Artificial Sequence
  chemically synthesized
ggagatccccccattacact

SEQ ID NO: 621275 - DNA, 20 bp, Artificial Sequence
  chemically synthesized
cctccccctaccataatgcc

SEQ ID NO: 621276 - DNA, 20 bp, Artificial Sequence
  chemically synthesized
atatatttatcatatttatc

SEQ ID NO: 621277 - DNA, 20 bp, Artificial Sequence
  chemically synthesized
aatggcgtgaacccaggagg

SEQ ID NO: 621278 - DNA, 20 bp, Artificial Sequence
  chemically synthesized
ttttgtatttttagtagata

SEQ ID NO: 621279 - DNA, 20 bp, Artificial Sequence
  chemically synthesized
tccgccggcctcccaaagtg

SEQ ID NO: 621280 - DNA, 20 bp, Artificial Sequence
  chemically synthesized
cactgcgcccggccaaaaga

SEQ ID NO: 621281 - DNA, 20 bp, Artificial Sequence
  chemically synthesized
aagtaatactgtgttcatag

SEQ ID NO: 621282 - DNA, 20 bp, Artificial Sequence
  chemically synthesized
aaaacattgagcatcaaata

SEQ ID NO: 621283 - DNA, 20 bp, Artificial Sequence
  chemically synthesized
aaaacatattatttgatgct

SEQ ID NO: 621284 - DNA, 20 bp, Artificial Sequence
  chemically synthesized
gatgctcaatgttttataaa

SEQ ID NO: 621285 - DNA, 20 bp, Artificial Sequence
  chemically synthesized
ccagctctgcatttttgaat

SEQ ID NO: 621286 - DNA, 20 bp, Artificial Sequence
  chemically synthesized
gtcctcggcctcccaaagtg

SEQ ID NO: 621287 - DNA, 20 bp, Artificial Sequence
  chemically synthesized
tttttgtatttttagtagag

SEQ ID NO: 621288 - DNA, 20 bp, Artificial Sequence
  chemically synthesized
tgcctcagcctcccgaatag

SEQ ID NO: 621289 - DNA, 20 bp, Artificial Sequence
  chemically synthesized
tcgggaggctgaggcagaaa

SEQ ID NO: 621290 - DNA, 20 bp, Artificial Sequence
  chemically synthesized
aacctctgcctcctgggttc

SEQ ID NO: 621291 - DNA, 20 bp, Artificial Sequence
  chemically synthesized
ttgttttggtttttttgaga

SEQ ID NO: 621292 - DNA, 20 bp, Artificial Sequence
  chemically synthesized
ctgtggttttttgtcgttgt

SEQ ID NO: 621293 - DNA, 20 bp, Artificial Sequence
  chemically synthesized
ccagccctgtggttttttgt

SEQ ID NO: 621294 - DNA, 20 bp, Artificial Sequence
  chemically synthesized
ccactgtgcccggccagccc

SEQ ID NO: 621295 - DNA, 20 bp, Artificial Sequence
  chemically synthesized
tgcctcagcttcccaaagtg

SEQ ID NO: 621296 - DNA, 20 bp, Artificial Sequence
  chemically synthesized
agctcaggtgacccacctgc

SEQ ID NO: 621297 - DNA, 20 bp, Artificial Sequence
  chemically synthesized
caggtgggtcacctgagctc

SEQ ID NO: 621298 - DNA, 20 bp, Artificial Sequence
  chemically synthesized
tttcgtactttttgtagaga

SEQ ID NO: 621299 - DNA, 20 bp, Artificial Sequence
  chemically synthesized
agatttcctgagagcacgtg

SEQ ID NO: 621300 - DNA, 20 bp, Artificial Sequence
  chemically synthesized
ccataactttttaacttttt

SEQ ID NO: 621301 - DNA, 20 bp, Artificial Sequence
  chemically synthesized
aattatttcctgtggattaa

SEQ ID NO: 621302 - DNA, 20 bp, Artificial Sequence
  chemically synthesized
attgcttgctaattatttcc

SEQ ID NO: 621303 - DNA, 20 bp, Artificial Sequence
  chemically synthesized
ttctacccagttatcgacat

SEQ ID NO: 621304 - DNA, 20 bp, Artificial Sequence
  chemically synthesized
caaaagttcatagaaaaaag

SEQ ID NO: 621305 - DNA, 20 bp, Artificial Sequence
  chemically synthesized
gttaccacaacactttctct

SEQ ID NO: 621306 - DNA, 20 bp, Artificial Sequence
  chemically synthesized
aattgaatttttgaagatgg

SEQ ID NO: 621307 - DNA, 20 bp, Artificial Sequence
  chemically synthesized
aaccaaaagtcgatggagga

SEQ ID NO: 621308 - DNA, 20 bp, Artificial Sequence
  chemically synthesized
catttattcttgcttttcta

SEQ ID NO: 621309 - DNA, 20 bp, Artificial Sequence
  chemically synthesized
atacaggccagctcatttat

SEQ ID NO: 621310 - DNA, 20 bp, Artificial Sequence
  chemically synthesized
tatgctggctatacactttt

SEQ ID NO: 621311 - DNA, 20 bp, Artificial Sequence
  chemically synthesized
ccttaaaagtgtatagccag

SEQ ID NO: 621312 - DNA, 20 bp, Artificial Sequence
  chemically synthesized
atagccagcatagttttctg

SEQ ID NO: 621313 - DNA, 20 bp, Artificial Sequence
  chemically synthesized
cttaaatctagtagagtatc

SEQ ID NO: 621314 - DNA, 20 bp, Artificial Sequence
  chemically synthesized
ctcaaatcagaagatactct

SEQ ID NO: 621315 - DNA, 20 bp, Artificial Sequence
  chemically synthesized
ccgaaagttccaaggctttc

SEQ ID NO: 621316 - DNA, 20 bp, Artificial Sequence
  chemically synthesized
gactatgtagccgaaagttc

SEQ ID NO: 621317 - DNA, 20 bp, Artificial Sequence
  chemically synthesized
gtgaaattgagctataatag

SEQ ID NO: 621318 - DNA, 20 bp, Artificial Sequence
  chemically synthesized
tatacaattttgccaattaa

SEQ ID NO: 621319 - DNA, 20 bp, Artificial Sequence
  chemically synthesized
aatgagttactttttgaaaa

SEQ ID NO: 621320 - DNA, 20 bp, Artificial Sequence
  chemically synthesized
cactgttccactttgctttg

SEQ ID NO: 621321 - DNA, 20 bp, Artificial Sequence
  chemically synthesized
tactggctaccactgttcca

SEQ ID NO: 621322 - DNA, 20 bp, Artificial Sequence
  chemically synthesized
agcttactcatcttataact

SEQ ID NO: 621323 - DNA, 20 bp, Artificial Sequence
  chemically synthesized
catgctgtacattagatccc

SEQ ID NO: 621324 - DNA, 20 bp, Artificial Sequence
  chemically synthesized
ggtgaaggatatattaatta

SEQ ID NO: 621325 - DNA, 20 bp, Artificial Sequence
  chemically synthesized
tttgatacatatacattctg

SEQ ID NO: 621326 - DNA, 20 bp, Artificial Sequence
  chemically synthesized
tatattcaaggtgtacaata

SEQ ID NO: 621327 - DNA, 20 bp, Artificial Sequence
  chemically synthesized
attgaggtataattgacaaa

SEQ ID NO: 621328 - DNA, 20 bp, Artificial Sequence
  chemically synthesized
aaatatgaggtaccttttcc

SEQ ID NO: 621329 - DNA, 20 bp, Artificial Sequence
  chemically synthesized
tcagttttcatatctaaaaa

SEQ ID NO: 621330 - DNA, 20 bp, Artificial Sequence
  chemically synthesized
atatgaaaactgaggcccat

SEQ ID NO: 621331 - DNA, 20 bp, Artificial Sequence
  chemically synthesized
atcattaatcctcaatgggc

SEQ ID NO: 621332 - DNA, 20 bp, Artificial Sequence
  chemically synthesized
aactgaggcccattgaggat

SEQ ID NO: 621333 - DNA, 20 bp, Artificial Sequence
  chemically synthesized
tgtaactttactgcttaccc

SEQ ID NO: 621334 - DNA, 20 bp, Artificial Sequence
  chemically synthesized
catgagaggagttgtaactt

SEQ ID NO: 621335 - DNA, 20 bp, Artificial Sequence
  chemically synthesized
gttacaactcctctcatgtg

SEQ ID NO: 621336 - DNA, 20 bp, Artificial Sequence
  chemically synthesized
aggaaattacagacgttagg

SEQ ID NO: 621337 - DNA, 20 bp, Artificial Sequence
  chemically synthesized
cctagaaatgtttttatgat

SEQ ID NO: 621338 - DNA, 20 bp, Artificial Sequence
  chemically synthesized
tatggtaccagatttcctag

SEQ ID NO: 621339 - DNA, 20 bp, Artificial Sequence
  chemically synthesized
atagttgattagcgtatggt

SEQ ID NO: 621340 - DNA, 20 bp, Artificial Sequence
  chemically synthesized
aaaatggattttctttccat

SEQ ID NO: 621341 - DNA, 20 bp, Artificial Sequence
  chemically synthesized
agttgagatactcctttaaa

SEQ ID NO: 621342 - DNA, 20 bp, Artificial Sequence
  chemically synthesized
acctatttcattgtttctgc

SEQ ID NO: 621343 - DNA, 20 bp, Artificial Sequence
  chemically synthesized
tggtgaacctatttcattgt

SEQ ID NO: 621344 - DNA, 20 bp, Artificial Sequence
  chemically synthesized
ctctaatggtgaacctattt

SEQ ID NO: 621345 - DNA, 20 bp, Artificial Sequence
  chemically synthesized
gtcctaaggggaaaaagcat

SEQ ID NO: 621346 - DNA, 20 bp, Artificial Sequence
  chemically synthesized
ctttactagtgtggaatcag

SEQ ID NO: 621347 - DNA, 20 bp, Artificial Sequence
  chemically synthesized
aggatgtaaattagatagct

SEQ ID NO: 621348 - DNA, 20 bp, Artificial Sequence
  chemically synthesized
caagtataggatgtaaatta

SEQ ID NO: 621349 - DNA, 20 bp, Artificial Sequence
  chemically synthesized
aatggcgtgaacccgggagg

SEQ ID NO: 621350 - DNA, 20 bp, Artificial Sequence
  chemically synthesized
ttttgtatttttagtggaga

SEQ ID NO: 621351 - DNA, 20 bp, Artificial Sequence
  chemically synthesized
cgcctcggcctcccaaagtg

SEQ ID NO: 621352 - DNA, 20 bp, Artificial Sequence
  chemically synthesized
ccaccgcgcccggccaagac

SEQ ID NO: 621353 - DNA, 20 bp, Artificial Sequence
  chemically synthesized
agcttatgttgccactgcag

SEQ ID NO: 621354 - DNA, 20 bp, Artificial Sequence
  chemically synthesized
atcctgcctgcagtggcaac

SEQ ID NO: 621355 - DNA, 20 bp, Artificial Sequence
  chemically synthesized
tgcctgcagtggcaacataa

SEQ ID NO: 621356 - DNA, 20 bp, Artificial Sequence
  chemically synthesized
atccagtgcttaagagtaaa

SEQ ID NO: 621357 - DNA, 20 bp, Artificial Sequence
  chemically synthesized
gtaagacagtttgtcctatc

SEQ ID NO: 621358 - DNA, 20 bp, Artificial Sequence
  chemically synthesized
cttttcctaggactgagtaa

SEQ ID NO: 621359 - DNA, 20 bp, Artificial Sequence
  chemically synthesized
tttaaatcttttgttcagat

SEQ ID NO: 621360 - DNA, 20 bp, Artificial Sequence
  chemically synthesized
aaagaaacgttcatctgaac

SEQ ID NO: 621361 - DNA, 20 bp, Artificial Sequence
  chemically synthesized
attcattttcaaaatgtatt

SEQ ID NO: 621362 - DNA, 20 bp, Artificial Sequence
  chemically synthesized
tgaaatacattttgaaaatg

SEQ ID NO: 621363 - DNA, 20 bp, Artificial Sequence
  chemically synthesized
atcaggttatcacatgccaa

SEQ ID NO: 621364 - DNA, 20 bp, Artificial Sequence
  chemically synthesized
aattagcctagctatctcag

SEQ ID NO: 621365 - DNA, 20 bp, Artificial Sequence
  chemically synthesized
agacaaggacaaatagacaa

SEQ ID NO: 621366 - DNA, 20 bp, Artificial Sequence
  chemically synthesized
gtagcatcttgctgtggata

SEQ ID NO: 621367 - DNA, 20 bp, Artificial Sequence
  chemically synthesized
tgactttttggcctttctca

SEQ ID NO: 621368 - DNA, 20 bp, Artificial Sequence
  chemically synthesized
atgcttcttcaccactgtgg

SEQ ID NO: 621369 - DNA, 20 bp, Artificial Sequence
  chemically synthesized
ataatgagcagtttagtagg

SEQ ID NO: 621370 - DNA, 20 bp, Artificial Sequence
  chemically synthesized
tgccaattttaaagataatg

SEQ ID NO: 621371 - DNA, 20 bp, Artificial Sequence
  chemically synthesized
ctgaagtgatcagtcagagt

SEQ ID NO: 621372 - DNA, 20 bp, Artificial Sequence
  chemically synthesized
atatgtcatatatgtcatat

SEQ ID NO: 621373 - DNA, 20 bp, Artificial Sequence
  chemically synthesized
tttgctaaggcatcagatga

SEQ ID NO: 621374 - DNA, 20 bp, Artificial Sequence
  chemically synthesized
gttcagttgatggtggataa

SEQ ID NO: 621375 - DNA, 20 bp, Artificial Sequence
  chemically synthesized
ccatgctgttactctttccc

SEQ ID NO: 621376 - DNA, 20 bp, Artificial Sequence
  chemically synthesized
catattgtcagtcacgcagt

SEQ ID NO: 621377 - DNA, 20 bp, Artificial Sequence
  chemically synthesized
gagcagtaacgaattttaat

SEQ ID NO: 621378 - DNA, 20 bp, Artificial Sequence
  chemically synthesized
ataaaccaggttgtgtcaat

SEQ ID NO: 621379 - DNA, 20 bp, Artificial Sequence
  chemically synthesized
ttaatcagagattgacacaa

SEQ ID NO: 621380 - DNA, 20 bp, Artificial Sequence
  chemically synthesized
agagattgacacaacctggt

SEQ ID NO: 621381 - DNA, 20 bp, Artificial Sequence
  chemically synthesized
tactctacatggcctaaagg

SEQ ID NO: 621382 - DNA, 20 bp, Artificial Sequence
  chemically synthesized
ccccaactcatctttgccac

SEQ ID NO: 621383 - DNA, 20 bp, Artificial Sequence
  chemically synthesized
acaagtggcaaagatgagtt

SEQ ID NO: 621384 - DNA, 20 bp, Artificial Sequence
  chemically synthesized
ggacatatatcatccatata

SEQ ID NO: 621385 - DNA, 20 bp, Artificial Sequence
  chemically synthesized
accagtcttctaacccttcc

SEQ ID NO: 621386 - DNA, 20 bp, Artificial Sequence
  chemically synthesized
tattgatttgcaggttcact

SEQ ID NO: 621387 - DNA, 20 bp, Artificial Sequence
  chemically synthesized
actcacacgggatgacttca

SEQ ID NO: 621388 - DNA, 20 bp, Artificial Sequence
  chemically synthesized
acagagtgaagtcatcccgt

SEQ ID NO: 621389 - DNA, 20 bp, Artificial Sequence
  chemically synthesized
taacatcttaagtgcctttg

SEQ ID NO: 621390 - DNA, 20 bp, Artificial Sequence
  chemically synthesized
tcttaagtgcctttgccctg

SEQ ID NO: 621391 - DNA, 20 bp, Artificial Sequence
  chemically synthesized
ggttagcgagaaattgtttc

SEQ ID NO: 621392 - DNA, 20 bp, Artificial Sequence
  chemically synthesized
aacacagaaggttagcgaga

SEQ ID NO: 621393 - DNA, 20 bp, Artificial Sequence
  chemically synthesized
tcgctaaccttctgtgttac

SEQ ID NO: 621394 - DNA, 20 bp, Artificial Sequence
  chemically synthesized
tccccagacagacactgagg

SEQ ID NO: 621395 - DNA, 20 bp, Artificial Sequence
  chemically synthesized
aaggatttgaggtgcaggta

SEQ ID NO: 621396 - DNA, 20 bp, Artificial Sequence
  chemically synthesized
aggtacacagtttatctggc

SEQ ID NO: 621397 - DNA, 20 bp, Artificial Sequence
  chemically synthesized
caagtgagaggaaagagaaa

SEQ ID NO: 621398 - DNA, 20 bp, Artificial Sequence
  chemically synthesized
taatgtgctcattgacacac

SEQ ID NO: 621399 - DNA, 20 bp, Artificial Sequence
  chemically synthesized
gcatgttcctcacagcttct

SEQ ID NO: 621400 - DNA, 20 bp, Artificial Sequence
  chemically synthesized
taattctgaggcatgttcct

SEQ ID NO: 621401 - DNA, 20 bp, Artificial Sequence
  chemically synthesized
caccagaagatgagatggct

SEQ ID NO: 621402 - DNA, 20 bp, Artificial Sequence
  chemically synthesized
tccatcccctcgtagttaaa

SEQ ID NO: 621403 - DNA, 20 bp, Artificial Sequence
  chemically synthesized
ttaacacaacccctcatatt

SEQ ID NO: 621404 - DNA, 20 bp, Artificial Sequence
  chemically synthesized
ccctcatatttctggcttac

SEQ ID NO: 621405 - DNA, 20 bp, Artificial Sequence
  chemically synthesized
cacccgagttccatgcagta

SEQ ID NO: 621406 - DNA, 20 bp, Artificial Sequence
  chemically synthesized
atcttcttatcccttcagga

SEQ ID NO: 621407 - DNA, 20 bp, Artificial Sequence
  chemically synthesized
gccactgtgcctggcctaaa

SEQ ID NO: 621408 - DNA, 20 bp, Artificial Sequence
  chemically synthesized
tgcctcggcctcccaaagtg

SEQ ID NO: 621409 - DNA, 20 bp, Artificial Sequence
  chemically synthesized
ttttgtatttttagtagaga

SEQ ID NO: 621410 - DNA, 20 bp, Artificial Sequence
  chemically synthesized
tgcctcagcctcccgagtag

SEQ ID NO: 621411 - DNA, 20 bp, Artificial Sequence
  chemically synthesized
tcgggaggctgaggcaggag

SEQ ID NO: 621412 - DNA, 20 bp, Artificial Sequence
  chemically synthesized
aacctccgcctccctgtttc

SEQ ID NO: 621413 - DNA, 20 bp, Artificial Sequence
  chemically synthesized
gctcactgcaacctccgcct

SEQ ID NO: 621414 - DNA, 20 bp, Artificial Sequence
  chemically synthesized
tcacataatagggttggact

SEQ ID NO: 621415 - DNA, 20 bp, Artificial Sequence
  chemically synthesized
tctagtccaaccctattatg

SEQ ID NO: 621416 - DNA, 20 bp, Artificial Sequence
  chemically synthesized
tcgatagaataatgtgaatg

SEQ ID NO: 621417 - DNA, 20 bp, Artificial Sequence
  chemically synthesized
aaaaatcgatagaataatgt

SEQ ID NO: 621418 - DNA, 20 bp, Artificial Sequence
  chemically synthesized
acaaagcattcacattattc

SEQ ID NO: 621419 - DNA, 20 bp, Artificial Sequence
  chemically synthesized
acatttaagtgggcccagaa

SEQ ID NO: 621420 - DNA, 20 bp, Artificial Sequence
  chemically synthesized
ttctgggcccacttaaatgt

SEQ ID NO: 621421 - DNA, 20 bp, Artificial Sequence
  chemically synthesized
tccatattttatgttggtta

SEQ ID NO: 621422 - DNA, 20 bp, Artificial Sequence
  chemically synthesized
tgtggtgtcaagatattaaa

SEQ ID NO: 621423 - DNA, 20 bp, Artificial Sequence
  chemically synthesized
ttgccatttatcaatatgta

SEQ ID NO: 621424 - DNA, 20 bp, Artificial Sequence
  chemically synthesized
caacagacgctggcacagat

SEQ ID NO: 621425 - DNA, 20 bp, Artificial Sequence
  chemically synthesized
aaaaattcaacagacgctgg

SEQ ID NO: 621426 - DNA, 20 bp, Artificial Sequence
  chemically synthesized
atcacttgaacctgggaggc

SEQ ID NO: 621427 - DNA, 20 bp, Artificial Sequence
  chemically synthesized
aacctccgcctcccaggttc

SEQ ID NO: 621428 - DNA, 20 bp, Artificial Sequence
  chemically synthesized
ttttgtatttttggtagaga

SEQ ID NO: 621429 - DNA, 20 bp, Artificial Sequence
  chemically synthesized
cattttgagaggccaaggtg

SEQ ID NO: 621430 - DNA, 20 bp, Artificial Sequence
  chemically synthesized
caccttggcctctcaaaatg

SEQ ID NO: 621431 - DNA, 20 bp, Artificial Sequence
  chemically synthesized
gcagagcattttggaacgta

SEQ ID NO: 621432 - DNA, 20 bp, Artificial Sequence
  chemically synthesized
ccatacgtagcacatgcaaa

SEQ ID NO: 621433 - DNA, 20 bp, Artificial Sequence
  chemically synthesized
gggagaagtacattttttgt

SEQ ID NO: 621434 - DNA, 20 bp, Artificial Sequence
  chemically synthesized
tacattttttgtagttgttt

SEQ ID NO: 621435 - DNA, 20 bp, Artificial Sequence
  chemically synthesized
gccctagaaacctccaaggt

SEQ ID NO: 621436 - DNA, 20 bp, Artificial Sequence
  chemically synthesized
aatttctaaacacttacctt

SEQ ID NO: 621437 - DNA, 20 bp, Artificial Sequence
  chemically synthesized
ccaaggtaagtgtttagaaa

SEQ ID NO: 621438 - DNA, 20 bp, Artificial Sequence
  chemically synthesized
ataatgtttacaaaagtact

SEQ ID NO: 621439 - DNA, 20 bp, Artificial Sequence
  chemically synthesized
gtttatgcttatgcttcaga

SEQ ID NO: 621440 - DNA, 20 bp, Artificial Sequence
  chemically synthesized
ctgttcaaatttgtttatgc

SEQ ID NO: 621441 - DNA, 20 bp, Artificial Sequence
  chemically synthesized
agcctgctgttcaaatttgt

SEQ ID NO: 621442 - DNA, 20 bp, Artificial Sequence
  chemically synthesized
tgagctagcctgctgttcaa

SEQ ID NO: 621443 - DNA, 20 bp, Artificial Sequence
  chemically synthesized
cagcaggctagctcacacag

SEQ ID NO: 621444 - DNA, 20 bp, Artificial Sequence
  chemically synthesized
cacatgtggtatactttatt

SEQ ID NO: 621445 - DNA, 20 bp, Artificial Sequence
  chemically synthesized
gtggtatactttatttttag

SEQ ID NO: 621446 - DNA, 20 bp, Artificial Sequence
  chemically synthesized
tatttttagtttggtttcat

SEQ ID NO: 621447 - DNA, 20 bp, Artificial Sequence
  chemically synthesized
gtttcatttatgattaataa

SEQ ID NO: 621448 - DNA, 20 bp, Artificial Sequence
  chemically synthesized
attaataattatgattccaa

SEQ ID NO: 621449 - DNA, 20 bp, Artificial Sequence
  chemically synthesized
aggcatgaaccaccatggcc

SEQ ID NO: 621450 - DNA, 20 bp, Artificial Sequence
  chemically synthesized
catctcggcctcccaaagtg

SEQ ID NO: 621451 - DNA, 20 bp, Artificial Sequence
  chemically synthesized
ttttatatttttaggagaga

SEQ ID NO: 621452 - DNA, 20 bp, Artificial Sequence
  chemically synthesized
tgcctgagcctcctcagtaa

SEQ ID NO: 621453 - DNA, 20 bp, Artificial Sequence
  chemically synthesized
tgaggaggctcaggcaggag

SEQ ID NO: 621454 - DNA, 20 bp, Artificial Sequence
  chemically synthesized
gaggtggaggttgcagggag

SEQ ID NO: 621455 - DNA, 20 bp, Artificial Sequence
  chemically synthesized
tgttttttgtttgtttgttt

SEQ ID NO: 621456 - DNA, 20 bp, Artificial Sequence
  chemically synthesized
tttttgttttttgtttgttt

SEQ ID NO: 621457 - DNA, 20 bp, Artificial Sequence
  chemically synthesized
ttgttttttgttttttgttt

SEQ ID NO: 621458 - DNA, 20 bp, Artificial Sequence
  chemically synthesized
atttttgttttttgtttttt

SEQ ID NO: 621459 - DNA, 20 bp, Artificial Sequence
  chemically synthesized
tttgatttttgttttttgtt

SEQ ID NO: 621460 - DNA, 20 bp, Artificial Sequence
  chemically synthesized
caccacctttgatttttgtt

SEQ ID NO: 621461 - DNA, 20 bp, Artificial Sequence
  chemically synthesized
attatttcaccacctttgat

SEQ ID NO: 621462 - DNA, 20 bp, Artificial Sequence
  chemically synthesized
caacaaaattatttcaccac

SEQ ID NO: 621463 - DNA, 20 bp, Artificial Sequence
  chemically synthesized
attttagtcaaagaacctaa

SEQ ID NO: 621464 - DNA, 20 bp, Artificial Sequence
  chemically synthesized
aagaacctaatgcagcttag

SEQ ID NO: 621465 - DNA, 20 bp, Artificial Sequence
  chemically synthesized
tttccaataaaaatgagcat

SEQ ID NO: 621466 - DNA, 20 bp, Artificial Sequence
  chemically synthesized
ttttattggaaagtaatttt

SEQ ID NO: 621467 - DNA, 20 bp, Artificial Sequence
  chemically synthesized
tatttttttgaaagttaaga

SEQ ID NO: 621468 - DNA, 20 bp, Artificial Sequence
  chemically synthesized
ataatgtattttcaaataac

SEQ ID NO: 621469 - DNA, 20 bp, Artificial Sequence
  chemically synthesized
aaaagaactttcccacaggt

SEQ ID NO: 621470 - DNA, 20 bp, Artificial Sequence
  chemically synthesized
cccacaggttcatgtttaat

SEQ ID NO: 621471 - DNA, 20 bp, Artificial Sequence
  chemically synthesized
ctctatattcaagactcaaa

SEQ ID NO: 621472 - DNA, 20 bp, Artificial Sequence
  chemically synthesized
ccaaagcagaaaaagttgta

SEQ ID NO: 621473 - DNA, 20 bp, Artificial Sequence
  chemically synthesized
gtgaagcgaagtacaacttt

SEQ ID NO: 621474 - DNA, 20 bp, Artificial Sequence
  chemically synthesized
tctgctttggacaaatttag

SEQ ID NO: 621475 - DNA, 20 bp, Artificial Sequence
  chemically synthesized
aggtttagagggaggtcccc

SEQ ID NO: 621476 - DNA, 20 bp, Artificial Sequence
  chemically synthesized
tggaaggtttagagggaggt

SEQ ID NO: 621477 - DNA, 20 bp, Artificial Sequence
  chemically synthesized
gagggagagaaagagaagtg

SEQ ID NO: 621478 - DNA, 20 bp, Artificial Sequence
  chemically synthesized
ccctctctcaactgtgttcc

SEQ ID NO: 621479 - DNA, 20 bp, Artificial Sequence
  chemically synthesized
ctttctctaaaacacagagg

SEQ ID NO: 621480 - DNA, 20 bp, Artificial Sequence
  chemically synthesized
agccagtcaaaactcagcct

SEQ ID NO: 621481 - DNA, 20 bp, Artificial Sequence
  chemically synthesized
ttttgactggctggaaaaac

SEQ ID NO: 621482 - DNA, 20 bp, Artificial Sequence
  chemically synthesized
aggaagaacatgaaataaac

SEQ ID NO: 621483 - DNA, 20 bp, Artificial Sequence
  chemically synthesized
tatttcatgttcttcctttc

SEQ ID NO: 621484 - DNA, 20 bp, Artificial Sequence
  chemically synthesized
aaaagataggaactgcataa

SEQ ID NO: 621485 - DNA, 20 bp, Artificial Sequence
  chemically synthesized
aatgggaccactgcggtata

SEQ ID NO: 621486 - DNA, 20 bp, Artificial Sequence
  chemically synthesized
gcatataccgcagtggtccc

SEQ ID NO: 621487 - DNA, 20 bp, Artificial Sequence
  chemically synthesized
tggtcccatttgattataac

SEQ ID NO: 621488 - DNA, 20 bp, Artificial Sequence
  chemically synthesized
ctgtaccttctaatggttag

SEQ ID NO: 621489 - DNA, 20 bp, Artificial Sequence
  chemically synthesized
tcagtacagtcacatgctgt

SEQ ID NO: 621490 - DNA, 20 bp, Artificial Sequence
  chemically synthesized
ggttgtatggtatatcctat

SEQ ID NO: 621491 - DNA, 20 bp, Artificial Sequence
  chemically synthesized
caacgatgaaattaccttag

SEQ ID NO: 621492 - DNA, 20 bp, Artificial Sequence
  chemically synthesized
cataactgtatatatcctgt

SEQ ID NO: 621493 - DNA, 20 bp, Artificial Sequence
  chemically synthesized
gtttgtgtgtcactgaagag

SEQ ID NO: 621494 - DNA, 20 bp, Artificial Sequence
  chemically synthesized
atttgtttaccttttcagtt

SEQ ID NO: 621495 - DNA, 20 bp, Artificial Sequence
  chemically synthesized
tacaataatttgtttacctt

SEQ ID NO: 621496 - DNA, 20 bp, Artificial Sequence
  chemically synthesized
gagactttcaggatacaata

SEQ ID NO: 621497 - DNA, 20 bp, Artificial Sequence
  chemically synthesized
ttgtatcctgaaagtctcaa

SEQ ID NO: 621498 - DNA, 20 bp, Artificial Sequence
  chemically synthesized
tgagtttttgttctactttc

SEQ ID NO: 621499 - DNA, 20 bp, Artificial Sequence
  chemically synthesized
actccagcctgggcgacaga

SEQ ID NO: 621500 - DNA, 20 bp, Artificial Sequence
  chemically synthesized
tcgggaggctgaggcaggag

SEQ ID NO: 621501 - DNA, 20 bp, Artificial Sequence
  chemically synthesized
tgcctcagcctcccgagtag

SEQ ID NO: 621502 - DNA, 20 bp, Artificial Sequence
  chemically synthesized
ttttgtatttttaggagaga

SEQ ID NO: 621503 - DNA, 20 bp, Artificial Sequence
  chemically synthesized
tgtacagatcacttgaggtc

SEQ ID NO: 621504 - DNA, 20 bp, Artificial Sequence
  chemically synthesized
cacctcagcctcccaaattg

SEQ ID NO: 621505 - DNA, 20 bp, Artificial Sequence
  chemically synthesized
agccaccacgcccggttcaa

SEQ ID NO: 621506 - DNA, 20 bp, Artificial Sequence
  chemically synthesized
caaaaggcattctggttttc

SEQ ID NO: 621507 - DNA, 20 bp, Artificial Sequence
  chemically synthesized
agaacaaaaggcattctggt

SEQ ID NO: 621508 - DNA, 20 bp, Artificial Sequence
  chemically synthesized
aatgtgagaacaaaaggcat

SEQ ID NO: 621509 - DNA, 20 bp, Artificial Sequence
  chemically synthesized
gacattttattctgatagct

SEQ ID NO: 621510 - DNA, 20 bp, Artificial Sequence
  chemically synthesized
ttatttcaatttttactgct

SEQ ID NO: 621511 - DNA, 20 bp, Artificial Sequence
  chemically synthesized
ccttttatttcaatttttac

SEQ ID NO: 621512 - DNA, 20 bp, Artificial Sequence
  chemically synthesized
cacctcggcctcccaaagtg

SEQ ID NO: 621513 - DNA, 20 bp, Artificial Sequence
  chemically synthesized
cttgaggacaggagttagag

SEQ ID NO: 621514 - DNA, 20 bp, Artificial Sequence
  chemically synthesized
ttttgtatttttattagaga

SEQ ID NO: 621515 - DNA, 20 bp, Artificial Sequence
  chemically synthesized
aattagctgggcgtagtggc

SEQ ID NO: 621516 - DNA, 20 bp, Artificial Sequence
  chemically synthesized
ttgggaggctgaggcagaag

SEQ ID NO: 621517 - DNA, 20 bp, Artificial Sequence
  chemically synthesized
cttgtttctaactcctgacc

SEQ ID NO: 621518 - DNA, 20 bp, Artificial Sequence
  chemically synthesized
ggtttcaccatgttggccag

SEQ ID NO: 621519 - DNA, 20 bp, Artificial Sequence
  chemically synthesized
ccgaggtttcaccatgttgg

SEQ ID NO: 621520 - DNA, 20 bp, Artificial Sequence
  chemically synthesized
gtttgtatttttagtagagc

SEQ ID NO: 621521 - DNA, 20 bp, Artificial Sequence
  chemically synthesized
cgcctgccaccacgcccagc

SEQ ID NO: 621522 - DNA, 20 bp, Artificial Sequence
  chemically synthesized
aacctccgcccttcaggttc

SEQ ID NO: 621523 - DNA, 20 bp, Artificial Sequence
  chemically synthesized
gacagggtatttttatttct

SEQ ID NO: 621524 - DNA, 20 bp, Artificial Sequence
  chemically synthesized
cttccttggcaaaattgtct

SEQ ID NO: 621525 - DNA, 20 bp, Artificial Sequence
  chemically synthesized
ttgaatccttagtagttaat

SEQ ID NO: 621526 - DNA, 20 bp, Artificial Sequence
  chemically synthesized
tccaagcaggtattaactac

SEQ ID NO: 621527 - DNA, 20 bp, Artificial Sequence
  chemically synthesized
ggagacctagtacgtacagc

SEQ ID NO: 621528 - DNA, 20 bp, Artificial Sequence
  chemically synthesized
gtacagccttagtttctttt

SEQ ID NO: 621529 - DNA, 20 bp, Artificial Sequence
  chemically synthesized
tgctctaaaattccgttaag

SEQ ID NO: 621530 - DNA, 20 bp, Artificial Sequence
  chemically synthesized
tgcctctgcctcccaaagtg

SEQ ID NO: 621531 - DNA, 20 bp, Artificial Sequence
  chemically synthesized
ttttgtatttttaggagaga

SEQ ID NO: 621532 - DNA, 20 bp, Artificial Sequence
  chemically synthesized
gtctctcctaaaaatacaaa

SEQ ID NO: 621533 - DNA, 20 bp, Artificial Sequence
  chemically synthesized
tgcctcagcctcccgagtag

SEQ ID NO: 621534 - DNA, 20 bp, Artificial Sequence
  chemically synthesized
tcgggaggctgaggcaggag

SEQ ID NO: 621535 - DNA, 20 bp, Artificial Sequence
  chemically synthesized
gcccaggctggagtgcaatg

SEQ ID NO: 621536 - DNA, 20 bp, Artificial Sequence
  chemically synthesized
aaaaaaaaaaaaaaaaaaaa

SEQ ID NO: 621537 - DNA, 20 bp, Artificial Sequence
  chemically synthesized
taagatttatgacattaatt

SEQ ID NO: 621538 - DNA, 20 bp, Artificial Sequence
  chemically synthesized
actgataattattaacatag

SEQ ID NO: 621539 - DNA, 20 bp, Artificial Sequence
  chemically synthesized
tatctatgttaataattatc

SEQ ID NO: 621540 - DNA, 20 bp, Artificial Sequence
  chemically synthesized
ccagtttttcccttttgttt

SEQ ID NO: 621541 - DNA, 20 bp, Artificial Sequence
  chemically synthesized
ctcacttgccagtttttccc

SEQ ID NO: 621542 - DNA, 20 bp, Artificial Sequence
  chemically synthesized
tatttcagcctggctcactt

SEQ ID NO: 621543 - DNA, 20 bp, Artificial Sequence
  chemically synthesized
aaataattcaatataatatt

SEQ ID NO: 621544 - DNA, 20 bp, Artificial Sequence
  chemically synthesized
aaagattagaaatatggtac

SEQ ID NO: 621545 - DNA, 20 bp, Artificial Sequence
  chemically synthesized
tattttaattcagatgttat

SEQ ID NO: 621546 - DNA, 20 bp, Artificial Sequence
  chemically synthesized
atgtgacattgtcatcaaag

SEQ ID NO: 621547 - DNA, 20 bp, Artificial Sequence
  chemically synthesized
tcacatgcttcagcaataat

SEQ ID NO: 621548 - DNA, 20 bp, Artificial Sequence
  chemically synthesized
tttggccagtcctacctatc

SEQ ID NO: 621549 - DNA, 20 bp, Artificial Sequence
  chemically synthesized
aaataatatatatttccttg

SEQ ID NO: 621550 - DNA, 20 bp, Artificial Sequence
  chemically synthesized
tacaattattttctccatgt

SEQ ID NO: 621551 - DNA, 20 bp, Artificial Sequence
  chemically synthesized
ttttattacaattattttct

SEQ ID NO: 621552 - DNA, 20 bp, Artificial Sequence
  chemically synthesized
ctaactctcagttacgaaca

SEQ ID NO: 621553 - DNA, 20 bp, Artificial Sequence
  chemically synthesized
tggggcgcaacgtttagatt

SEQ ID NO: 621554 - DNA, 20 bp, Artificial Sequence
  chemically synthesized
tattctaatggggcgcaacg

SEQ ID NO: 621555 - DNA, 20 bp, Artificial Sequence
  chemically synthesized
tgatgtattctaatggggcg

SEQ ID NO: 621556 - DNA, 20 bp, Artificial Sequence
  chemically synthesized
gcgccccattagaatacatc

SEQ ID NO: 621557 - DNA, 20 bp, Artificial Sequence
  chemically synthesized
tcactttcttttagtaaaat

SEQ ID NO: 621558 - DNA, 20 bp, Artificial Sequence
  chemically synthesized
tagcaaaggttataattttt

SEQ ID NO: 621559 - DNA, 20 bp, Artificial Sequence
  chemically synthesized
ctggatattttgcttaatta

SEQ ID NO: 621560 - DNA, 20 bp, Artificial Sequence
  chemically synthesized
cattataattaagcaaaata

SEQ ID NO: 621561 - DNA, 20 bp, Artificial Sequence
  chemically synthesized
aactatgaaaaaactggata

SEQ ID NO: 621562 - DNA, 20 bp, Artificial Sequence
  chemically synthesized
agcaaaatatccagtttttt

SEQ ID NO: 621563 - DNA, 20 bp, Artificial Sequence
  chemically synthesized
atatccagttttttcatagt

SEQ ID NO: 621564 - DNA, 20 bp, Artificial Sequence
  chemically synthesized
catagtttcagttttcaaac

SEQ ID NO: 621565 - DNA, 20 bp, Artificial Sequence
  chemically synthesized
ccaacttaccttaccaaagc

SEQ ID NO: 621566 - DNA, 20 bp, Artificial Sequence
  chemically synthesized
taaggtaagttggaaaacat

SEQ ID NO: 621567 - DNA, 20 bp, Artificial Sequence
  chemically synthesized
cttttgggccattaaaacta

SEQ ID NO: 621568 - DNA, 20 bp, Artificial Sequence
  chemically synthesized
ggggagactttgatgtatag

SEQ ID NO: 621569 - DNA, 20 bp, Artificial Sequence
  chemically synthesized
ttgatgtatagtatagattc

SEQ ID NO: 621570 - DNA, 20 bp, Artificial Sequence
  chemically synthesized
tcaagtgcttatctcatgga

SEQ ID NO: 621571 - DNA, 20 bp, Artificial Sequence
  chemically synthesized
ctctgcgatttctccctatg

SEQ ID NO: 621572 - DNA, 20 bp, Artificial Sequence
  chemically synthesized
actcctttgattcttattct

SEQ ID NO: 621573 - DNA, 20 bp, Artificial Sequence
  chemically synthesized
ccctcaatttttaattactc

SEQ ID NO: 621574 - DNA, 20 bp, Artificial Sequence
  chemically synthesized
caaaggagtaattaaaaatt

SEQ ID NO: 621575 - DNA, 20 bp, Artificial Sequence
  chemically synthesized
aacctccacctcccatgttc

SEQ ID NO: 621576 - DNA, 20 bp, Artificial Sequence
  chemically synthesized
tcaagaaaaaaaaaaaaaat

SEQ ID NO: 621577 - DNA, 20 bp, Artificial Sequence
  chemically synthesized
gtatttgagacctaatgacc

SEQ ID NO: 621578 - DNA, 20 bp, Artificial Sequence
  chemically synthesized
gtaatttaagtaattttact

SEQ ID NO: 621579 - DNA, 20 bp, Artificial Sequence
  chemically synthesized
atattaatctttagtagaat

SEQ ID NO: 621580 - DNA, 20 bp, Artificial Sequence
  chemically synthesized
aattgaagcatatattctac

SEQ ID NO: 621581 - DNA, 20 bp, Artificial Sequence
  chemically synthesized
tgcttcaattttgtgaggat

SEQ ID NO: 621582 - DNA, 20 bp, Artificial Sequence
  chemically synthesized
tgtgttctctttatgcgttg

SEQ ID NO: 621583 - DNA, 20 bp, Artificial Sequence
  chemically synthesized
ttacctgtgttctctttatg

SEQ ID NO: 621584 - DNA, 20 bp, Artificial Sequence
  chemically synthesized
gcataaagagaacacaggta

SEQ ID NO: 621585 - DNA, 20 bp, Artificial Sequence
  chemically synthesized
ttttaggagatgctgatgct

SEQ ID NO: 621586 - DNA, 20 bp, Artificial Sequence
  chemically synthesized
gccccaacctctgcattttt

SEQ ID NO: 621587 - DNA, 20 bp, Artificial Sequence
  chemically synthesized
ctggatgccacccccagagt

SEQ ID NO: 621588 - DNA, 20 bp, Artificial Sequence
  chemically synthesized
agcttgctggatgccacccc

SEQ ID NO: 621589 - DNA, 20 bp, Artificial Sequence
  chemically synthesized
gggggtggcatccagcaagc

SEQ ID NO: 621590 - DNA, 20 bp, Artificial Sequence
  chemically synthesized
acctggagggctggttaaac

SEQ ID NO: 621591 - DNA, 20 bp, Artificial Sequence
  chemically synthesized
tcactcttccttgagtgggc

SEQ ID NO: 621592 - DNA, 20 bp, Artificial Sequence
  chemically synthesized
cccacacactcttggaagac

SEQ ID NO: 621593 - DNA, 20 bp, Artificial Sequence
  chemically synthesized
atcaaagaaaaatcaggtca

SEQ ID NO: 621594 - DNA, 20 bp, Artificial Sequence
  chemically synthesized
gttctccgcaaagccccatg

SEQ ID NO: 621595 - DNA, 20 bp, Artificial Sequence
  chemically synthesized
agtccttgatttatgtattt

SEQ ID NO: 621596 - DNA, 20 bp, Artificial Sequence
  chemically synthesized
atagagtccttgatttatgt

SEQ ID NO: 621597 - DNA, 20 bp, Artificial Sequence
  chemically synthesized
ttaaattatgcttatagagt

SEQ ID NO: 621598 - DNA, 20 bp, Artificial Sequence
  chemically synthesized
tcatccgtctatttattaaa

SEQ ID NO: 621599 - DNA, 20 bp, Artificial Sequence
  chemically synthesized
gcataatttaataaatagac

SEQ ID NO: 621600 - DNA, 20 bp, Artificial Sequence
  chemically synthesized
aatttaataaatagacggat

SEQ ID NO: 621601 - DNA, 20 bp, Artificial Sequence
  chemically synthesized
acttatttttcaatttcctc

SEQ ID NO: 621602 - DNA, 20 bp, Artificial Sequence
  chemically synthesized
caccaagctcgctgacattg

SEQ ID NO: 621603 - DNA, 20 bp, Artificial Sequence
  chemically synthesized
agataatctcagcaatgtca

SEQ ID NO: 621604 - DNA, 20 bp, Artificial Sequence
  chemically synthesized
cgacctatttattgaacctt

SEQ ID NO: 621605 - DNA, 20 bp, Artificial Sequence
  chemically synthesized
tcaaaagctgtgttgatttg

SEQ ID NO: 621606 - DNA, 20 bp, Artificial Sequence
  chemically synthesized
cggtaaacattgcaaatcaa

SEQ ID NO: 621607 - DNA, 20 bp, Artificial Sequence
  chemically synthesized
tgacatttcatcaaaagctg

SEQ ID NO: 621608 - DNA, 20 bp, Artificial Sequence
  chemically synthesized
tgatgaaatgtcaggcaaga

SEQ ID NO: 621609 - DNA, 20 bp, Artificial Sequence
  chemically synthesized
cagggcttagctatattcgg

SEQ ID NO: 621610 - DNA, 20 bp, Artificial Sequence
  chemically synthesized
tggaagtacagaggccagtt

SEQ ID NO: 621611 - DNA, 20 bp, Artificial Sequence
  chemically synthesized
tttatatctgtattttattc

SEQ ID NO: 621612 - DNA, 20 bp, Artificial Sequence
  chemically synthesized
aattaaaaaatatatttata

SEQ ID NO: 621613 - DNA, 20 bp, Artificial Sequence
  chemically synthesized
gtcatttctcacttacagat

SEQ ID NO: 621614 - DNA, 20 bp, Artificial Sequence
  chemically synthesized
agtggttgtcatttctcact

SEQ ID NO: 621615 - DNA, 20 bp, Artificial Sequence
  chemically synthesized
ggatctcaaattttcccata

SEQ ID NO: 621616 - DNA, 20 bp, Artificial Sequence
  chemically synthesized
gatccaaatagacttttaac

SEQ ID NO: 621617 - DNA, 20 bp, Artificial Sequence
  chemically synthesized
ggattgtctttattcccaac

SEQ ID NO: 621618 - DNA, 20 bp, Artificial Sequence
  chemically synthesized
tctctatctttaggaagaca

SEQ ID NO: 621619 - DNA, 20 bp, Artificial Sequence
  chemically synthesized
ccaaagagtttctgacttgg

SEQ ID NO: 621620 - DNA, 20 bp, Artificial Sequence
  chemically synthesized
ttacttttattaaaattcca

SEQ ID NO: 621621 - DNA, 20 bp, Artificial Sequence
  chemically synthesized
tgaaaaggtgtagtgattta

SEQ ID NO: 621622 - DNA, 20 bp, Artificial Sequence
  chemically synthesized
ctaaataaagtgaaaaggtg

SEQ ID NO: 621623 - DNA, 20 bp, Artificial Sequence
  chemically synthesized
ttaaacacttattattaaat

SEQ ID NO: 621624 - DNA, 20 bp, Artificial Sequence
  chemically synthesized
agaagctaccatttaataat

SEQ ID NO: 621625 - DNA, 20 bp, Artificial Sequence
  chemically synthesized
taattatctgaaatatctca

SEQ ID NO: 621626 - DNA, 20 bp, Artificial Sequence
  chemically synthesized
ataattaggcagcctggaat

SEQ ID NO: 621627 - DNA, 20 bp, Artificial Sequence
  chemically synthesized
gaattactgtttacaattgt

SEQ ID NO: 621628 - DNA, 20 bp, Artificial Sequence
  chemically synthesized
tactgtttacaattgtccca

SEQ ID NO: 621629 - DNA, 20 bp, Artificial Sequence
  chemically synthesized
ccagtttgcttcctaataag

SEQ ID NO: 621630 - DNA, 20 bp, Artificial Sequence
  chemically synthesized
ccttgtgaatagtaatttag

SEQ ID NO: 621631 - DNA, 20 bp, Artificial Sequence
  chemically synthesized
atccttgttatttccgtctt

SEQ ID NO: 621632 - DNA, 20 bp, Artificial Sequence
  chemically synthesized
catatacactcacattttta

SEQ ID NO: 621633 - DNA, 20 bp, Artificial Sequence
  chemically synthesized
cctgtgtttcacatatatat

SEQ ID NO: 621634 - DNA, 20 bp, Artificial Sequence
  chemically synthesized
cccatatatatatgtgaaac

SEQ ID NO: 621635 - DNA, 20 bp, Artificial Sequence
  chemically synthesized
tatattaacaatagaaaaac

SEQ ID NO: 621636 - DNA, 20 bp, Artificial Sequence
  chemically synthesized
tgttaatataaaaatccctc

SEQ ID NO: 621637 - DNA, 20 bp, Artificial Sequence
  chemically synthesized
aaactcattagaaaactaat

SEQ ID NO: 621638 - DNA, 20 bp, Artificial Sequence
  chemically synthesized
aatccctcattagttttcta

SEQ ID NO: 621639 - DNA, 20 bp, Artificial Sequence
  chemically synthesized
ttaatttgaggtaaaaatat

SEQ ID NO: 621640 - DNA, 20 bp, Artificial Sequence
  chemically synthesized
gaggtaaaaatattatcgtt

SEQ ID NO: 621641 - DNA, 20 bp, Artificial Sequence
  chemically synthesized
ccatattctactttttgggt

SEQ ID NO: 621642 - DNA, 20 bp, Artificial Sequence
  chemically synthesized
atatgggttccttcttattt

SEQ ID NO: 621643 - DNA, 20 bp, Artificial Sequence
  chemically synthesized
tgttgtgaggaagggaagaa

SEQ ID NO: 621644 - DNA, 20 bp, Artificial Sequence
  chemically synthesized
cctttctataaaagttaaat

SEQ ID NO: 621645 - DNA, 20 bp, Artificial Sequence
  chemically synthesized
aaagagtcacctttagggaa

SEQ ID NO: 621646 - DNA, 20 bp, Artificial Sequence
  chemically synthesized
ctttagggaagcctgcttct

SEQ ID NO: 621647 - DNA, 20 bp, Artificial Sequence
  chemically synthesized
aattccacaagcattcagaa

SEQ ID NO: 621648 - DNA, 20 bp, Artificial Sequence
  chemically synthesized
gaatggctgttgcatttatc

SEQ ID NO: 621649 - DNA, 20 bp, Artificial Sequence
  chemically synthesized
ctggctacacaccttcatag

SEQ ID NO: 621650 - DNA, 20 bp, Artificial Sequence
  chemically synthesized
accttcataggaaagctttt

SEQ ID NO: 621651 - DNA, 20 bp, Artificial Sequence
  chemically synthesized
taccaacagggaaatcagca

SEQ ID NO: 621652 - DNA, 20 bp, Artificial Sequence
  chemically synthesized
gcttggctatgactctacct

SEQ ID NO: 621653 - DNA, 20 bp, Artificial Sequence
  chemically synthesized
agattctgtgcctgctttat

SEQ ID NO: 621654 - DNA, 20 bp, Artificial Sequence
  chemically synthesized
aggctggtcagagattctgt

SEQ ID NO: 621655 - DNA, 20 bp, Artificial Sequence
  chemically synthesized
tctgcttttgtgaggctggt

SEQ ID NO: 621656 - DNA, 20 bp, Artificial Sequence
  chemically synthesized
tgcaaaaagattgtgtgttt

SEQ ID NO: 621657 - DNA, 20 bp, Artificial Sequence
  chemically synthesized
gaaacaggtgcaaaaagatt

SEQ ID NO: 621658 - DNA, 20 bp, Artificial Sequence
  chemically synthesized
caaacacacaatctttttgc

SEQ ID NO: 621659 - DNA, 20 bp, Artificial Sequence
  chemically synthesized
gagtggaagaaacaggtgca

SEQ ID NO: 621660 - DNA, 20 bp, Artificial Sequence
  chemically synthesized
cgtgaatagtgaggtgttct

SEQ ID NO: 621661 - DNA, 20 bp, Artificial Sequence
  chemically synthesized
tagtgaggtgttctcacaga

SEQ ID NO: 621662 - DNA, 20 bp, Artificial Sequence
  chemically synthesized
aaaccattgctgtgagaggg

SEQ ID NO: 621663 - DNA, 20 bp, Artificial Sequence
  chemically synthesized
aaacactcccctctcacagc

SEQ ID NO: 621664 - DNA, 20 bp, Artificial Sequence
  chemically synthesized
ttccctcaccggctcaatct

SEQ ID NO: 621665 - DNA, 20 bp, Artificial Sequence
  chemically synthesized
attagaagggaacgtaatca

SEQ ID NO: 621666 - DNA, 20 bp, Artificial Sequence
  chemically synthesized
atttctagaggaactgaggt

SEQ ID NO: 621667 - DNA, 20 bp, Artificial Sequence
  chemically synthesized
cctctagaaataactgtgtc

SEQ ID NO: 621668 - DNA, 20 bp, Artificial Sequence
  chemically synthesized
aactgtgtcgtctgctttat

SEQ ID NO: 621669 - DNA, 20 bp, Artificial Sequence
  chemically synthesized
ctctaagtctactttccagt

SEQ ID NO: 621670 - DNA, 20 bp, Artificial Sequence
  chemically synthesized
cagctcctctaagtctactt

SEQ ID NO: 621671 - DNA, 20 bp, Artificial Sequence
  chemically synthesized
ctggaaagtagacttagagg

SEQ ID NO: 621672 - DNA, 20 bp, Artificial Sequence
  chemically synthesized
tctttttctttttcactaac

SEQ ID NO: 621673 - DNA, 20 bp, Artificial Sequence
  chemically synthesized
tctcttctttttgcttcctt

SEQ ID NO: 621674 - DNA, 20 bp, Artificial Sequence
  chemically synthesized
ttataggtccagtctcttct

SEQ ID NO: 621675 - DNA, 20 bp, Artificial Sequence
  chemically synthesized
aatgtgttttcagcagcact

SEQ ID NO: 621676 - DNA, 20 bp, Artificial Sequence
  chemically synthesized
ggttttcataggaagttcaa

SEQ ID NO: 621677 - DNA, 20 bp, Artificial Sequence
  chemically synthesized
gaacttcctatgaaaaccaa

SEQ ID NO: 621678 - DNA, 20 bp, Artificial Sequence
  chemically synthesized
atatttgtatgtcaagcact

SEQ ID NO: 621679 - DNA, 20 bp, Artificial Sequence
  chemically synthesized
tagattgagtttaagattgt

SEQ ID NO: 621680 - DNA, 20 bp, Artificial Sequence
  chemically synthesized
gtggtttagattgagtttaa

SEQ ID NO: 621681 - DNA, 20 bp, Artificial Sequence
  chemically synthesized
cattgtggtttagattgagt

SEQ ID NO: 621682 - DNA, 20 bp, Artificial Sequence
  chemically synthesized
cttctgcattgtggtttaga

SEQ ID NO: 621683 - DNA, 20 bp, Artificial Sequence
  chemically synthesized
aattaacttctgcattgtgg

SEQ ID NO: 621684 - DNA, 20 bp, Artificial Sequence
  chemically synthesized
ttaagaattaacttctgcat

SEQ ID NO: 621685 - DNA, 20 bp, Artificial Sequence
  chemically synthesized
aagttaattcttaaggcaaa

SEQ ID NO: 621686 - DNA, 20 bp, Artificial Sequence
  chemically synthesized
aaacacagggtttatgtgga

SEQ ID NO: 621687 - DNA, 20 bp, Artificial Sequence
  chemically synthesized
aaacttcatccacataaacc

SEQ ID NO: 621688 - DNA, 20 bp, Artificial Sequence
  chemically synthesized
ttaattctttttttaaaaca

SEQ ID NO: 621689 - DNA, 20 bp, Artificial Sequence
  chemically synthesized
atacaaatttgagtaagtta

SEQ ID NO: 621690 - DNA, 20 bp, Artificial Sequence
  chemically synthesized
atttgaagttaaaccttgaa

SEQ ID NO: 621691 - DNA, 20 bp, Artificial Sequence
  chemically synthesized
ttttttcaagaagcaggatt

SEQ ID NO: 621692 - DNA, 20 bp, Artificial Sequence
  chemically synthesized
caattctgttttttcaagaa

SEQ ID NO: 621693 - DNA, 20 bp, Artificial Sequence
  chemically synthesized
cttgaaaaaacagaattgtg

SEQ ID NO: 621694 - DNA, 20 bp, Artificial Sequence
  chemically synthesized
attacagaagcctgacacaa

SEQ ID NO: 621695 - DNA, 20 bp, Artificial Sequence
  chemically synthesized
ttgtgtcaggcttctgtaat

SEQ ID NO: 621696 - DNA, 20 bp, Artificial Sequence
  chemically synthesized
aatgactgtttacccagagc

SEQ ID NO: 621697 - DNA, 20 bp, Artificial Sequence
  chemically synthesized
tacccagagcataagattga

SEQ ID NO: 621698 - DNA, 20 bp, Artificial Sequence
  chemically synthesized
gcataagattgaagtggatt

SEQ ID NO: 621699 - DNA, 20 bp, Artificial Sequence
  chemically synthesized
agatggggattgacatactt

SEQ ID NO: 621700 - DNA, 20 bp, Artificial Sequence
  chemically synthesized
gtttatatgctttgatcaga

SEQ ID NO: 621701 - DNA, 20 bp, Artificial Sequence
  chemically synthesized
tccttggaaaaatttagttt

SEQ ID NO: 621702 - DNA, 20 bp, Artificial Sequence
  chemically synthesized
taatgaagtccttggaaaaa

SEQ ID NO: 621703 - DNA, 20 bp, Artificial Sequence
  chemically synthesized
aaccaagtagagctgcagtt

SEQ ID NO: 621704 - DNA, 20 bp, Artificial Sequence
  chemically synthesized
ttctttagagtaagttgtta

SEQ ID NO: 621705 - DNA, 20 bp, Artificial Sequence
  chemically synthesized
aagcaaaccttaactgtaac

SEQ ID NO: 621706 - DNA, 20 bp, Artificial Sequence
  chemically synthesized
aagaaatccagagttacagt

SEQ ID NO: 621707 - DNA, 20 bp, Artificial Sequence
  chemically synthesized
aatccagagttacagttaag

SEQ ID NO: 621708 - DNA, 20 bp, Artificial Sequence
  chemically synthesized
ataaacatatgttgagcaca

SEQ ID NO: 621709 - DNA, 20 bp, Artificial Sequence
  chemically synthesized
gcaaacagtatgtgctcaac

SEQ ID NO: 621710 - DNA, 20 bp, Artificial Sequence
  chemically synthesized
tgataatgacactttatatt

SEQ ID NO: 621711 - DNA, 20 bp, Artificial Sequence
  chemically synthesized
aaaatgaaataagtatagaa

SEQ ID NO: 621712 - DNA, 20 bp, Artificial Sequence
  chemically synthesized
ttacgtaagccacaatttta

SEQ ID NO: 621713 - DNA, 20 bp, Artificial Sequence
  chemically synthesized
tgtttgaaaccttgtaaaat

SEQ ID NO: 621714 - DNA, 20 bp, Artificial Sequence
  chemically synthesized
aacaaggtgtgggttttttt

SEQ ID NO: 621715 - DNA, 20 bp, Artificial Sequence
  chemically synthesized
aacaaaaaaaaaaacccaca

SEQ ID NO: 621716 - DNA, 20 bp, Artificial Sequence
  chemically synthesized
tatattaaagaaaacaaggt

SEQ ID NO: 621717 - DNA, 20 bp, Artificial Sequence
  chemically synthesized
taacttactgccagcacggt

SEQ ID NO: 621718 - DNA, 20 bp, Artificial Sequence
  chemically synthesized
ctggcagtaagttaaaatgt

SEQ ID NO: 621719 - DNA, 20 bp, Artificial Sequence
  chemically synthesized
aagggaatacggtacgatta

SEQ ID NO: 621720 - DNA, 20 bp, Artificial Sequence
  chemically synthesized
tttgtagacaagggaatacg

SEQ ID NO: 621721 - DNA, 20 bp, Artificial Sequence
  chemically synthesized
tgctaattatactcatgcta

SEQ ID NO: 621722 - DNA, 20 bp, Artificial Sequence
  chemically synthesized
ctaagcagtacgacaatgag

SEQ ID NO: 621723 - DNA, 20 bp, Artificial Sequence
  chemically synthesized
gtaatcattactcattgtcg

SEQ ID NO: 621724 - DNA, 20 bp, Artificial Sequence
  chemically synthesized
actcattgtcgtactgctta

SEQ ID NO: 621725 - DNA, 20 bp, Artificial Sequence
  chemically synthesized
ttcttctgtggtattacttt

SEQ ID NO: 621726 - DNA, 20 bp, Artificial Sequence
  chemically synthesized
taattctttctttatagtgt

SEQ ID NO: 621727 - DNA, 20 bp, Artificial Sequence
  chemically synthesized
gcatgccctttcaatcagat

SEQ ID NO: 621728 - DNA, 20 bp, Artificial Sequence
  chemically synthesized
acttgttcggaaaagcttct

SEQ ID NO: 621729 - DNA, 20 bp, Artificial Sequence
  chemically synthesized
catggaacttacttgttcgg

SEQ ID NO: 621730 - DNA, 20 bp, Artificial Sequence
  chemically synthesized
actaaatattttcccatcat

SEQ ID NO: 621731 - DNA, 20 bp, Artificial Sequence
  chemically synthesized
ggaaaaaaggaaccctatat

SEQ ID NO: 621732 - DNA, 20 bp, Artificial Sequence
  chemically synthesized
gttcacaattgcacaacagt

SEQ ID NO: 621733 - DNA, 20 bp, Artificial Sequence
  chemically synthesized
accttcaaggacactgtagc

SEQ ID NO: 621734 - DNA, 20 bp, Artificial Sequence
  chemically synthesized
tcaaggacactgtagctaag

SEQ ID NO: 621735 - DNA, 20 bp, Artificial Sequence
  chemically synthesized
aaaggttccttttaggtatg

SEQ ID NO: 621736 - DNA, 20 bp, Artificial Sequence
  chemically synthesized
atgatcgtcgtcacagacat

SEQ ID NO: 621737 - DNA, 20 bp, Artificial Sequence
  chemically synthesized
tctgtgacgacgatcattgg

SEQ ID NO: 621738 - DNA, 20 bp, Artificial Sequence
  chemically synthesized
ataaatatatatatatatga

SEQ ID NO: 621739 - DNA, 20 bp, Artificial Sequence
  chemically synthesized
aacctctgcctcccgggttc

SEQ ID NO: 621740 - DNA, 20 bp, Artificial Sequence
  chemically synthesized
tccggaggctgaggcaggag

SEQ ID NO: 621741 - DNA, 20 bp, Artificial Sequence
  chemically synthesized
ttttgtatttttagtagaga

SEQ ID NO: 621742 - DNA, 20 bp, Artificial Sequence
  chemically synthesized
tgcctcggcctcccaaagtg

SEQ ID NO: 621743 - DNA, 20 bp, Artificial Sequence
  chemically synthesized
ggccgggacttcatatttaa

SEQ ID NO: 621744 - DNA, 20 bp, Artificial Sequence
  chemically synthesized
tcactgttctaggaattaaa

SEQ ID NO: 621745 - DNA, 20 bp, Artificial Sequence
  chemically synthesized
cttgaatgcaatacctgaaa

SEQ ID NO: 621746 - DNA, 20 bp, Artificial Sequence
  chemically synthesized
ccaatattgcaggtttgctg

SEQ ID NO: 621747 - DNA, 20 bp, Artificial Sequence
  chemically synthesized
ggaataacattaccaatatt

SEQ ID NO: 621748 - DNA, 20 bp, Artificial Sequence
  chemically synthesized
ttggtaatgttattccttaa

SEQ ID NO: 621749 - DNA, 20 bp, Artificial Sequence
  chemically synthesized
ccaatctcctcacctgtaaa

SEQ ID NO: 621750 - DNA, 20 bp, Artificial Sequence
  chemically synthesized
ttaaactcgttttacaggtg

SEQ ID NO: 621751 - DNA, 20 bp, Artificial Sequence
  chemically synthesized
gtgaggagattggagctcag

SEQ ID NO: 621752 - DNA, 20 bp, Artificial Sequence
  chemically synthesized
tcagtcatccaactaaccgg

SEQ ID NO: 621753 - DNA, 20 bp, Artificial Sequence
  chemically synthesized
tgtttagggagtcaggtaga

SEQ ID NO: 621754 - DNA, 20 bp, Artificial Sequence
  chemically synthesized
cccattaactcttgacacac

SEQ ID NO: 621755 - DNA, 20 bp, Artificial Sequence
  chemically synthesized
gtattttaccaagataccca

SEQ ID NO: 621756 - DNA, 20 bp, Artificial Sequence
  chemically synthesized
gtatcttggtaaaatacggg

SEQ ID NO: 621757 - DNA, 20 bp, Artificial Sequence
  chemically synthesized
tcggtaattttaggtgggac

SEQ ID NO: 621758 - DNA, 20 bp, Artificial Sequence
  chemically synthesized
ttttcttaaagaagttcttc

SEQ ID NO: 621759 - DNA, 20 bp, Artificial Sequence
  chemically synthesized
tatgaagtgcagtttgggca

SEQ ID NO: 621760 - DNA, 20 bp, Artificial Sequence
  chemically synthesized
ctgatttcattgatatgaag

SEQ ID NO: 621761 - DNA, 20 bp, Artificial Sequence
  chemically synthesized
ttgagtctcatttctagaga

SEQ ID NO: 621762 - DNA, 20 bp, Artificial Sequence
  chemically synthesized
caaacttggctgttcattag

SEQ ID NO: 621763 - DNA, 20 bp, Artificial Sequence
  chemically synthesized
caagcaattctaatgaacag

SEQ ID NO: 621764 - DNA, 20 bp, Artificial Sequence
  chemically synthesized
gataacaacatgtcaatggg

SEQ ID NO: 621765 - DNA, 20 bp, Artificial Sequence
  chemically synthesized
gggtttataatgagctcgtc

SEQ ID NO: 621766 - DNA, 20 bp, Artificial Sequence
  chemically synthesized
gctttaatgaatgtaggtct

SEQ ID NO: 621767 - DNA, 20 bp, Artificial Sequence
  chemically synthesized
tgcaaaggcctaagtcttat

SEQ ID NO: 621768 - DNA, 20 bp, Artificial Sequence
  chemically synthesized
cacatttaggtagacccccc

SEQ ID NO: 621769 - DNA, 20 bp, Artificial Sequence
  chemically synthesized
cccaggtgattctgttatcc

SEQ ID NO: 621770 - DNA, 20 bp, Artificial Sequence
  chemically synthesized
ttgtctgcagggcttggtct

SEQ ID NO: 621771 - DNA, 20 bp, Artificial Sequence
  chemically synthesized
aagtttgtctgcagggcttg

SEQ ID NO: 621772 - DNA, 20 bp, Artificial Sequence
  chemically synthesized
ctgaatggtaagtttgtctg

SEQ ID NO: 621773 - DNA, 20 bp, Artificial Sequence
  chemically synthesized
caactttttttgcctgaatg

SEQ ID NO: 621774 - DNA, 20 bp, Artificial Sequence
  chemically synthesized
aggcaaaaaaagttgtgagt

SEQ ID NO: 621775 - DNA, 20 bp, Artificial Sequence
  chemically synthesized
aaaaaaagttgtgagtagga

SEQ ID NO: 621776 - DNA, 20 bp, Artificial Sequence
  chemically synthesized
gtgtgagggccccatgaatt

SEQ ID NO: 621777 - DNA, 20 bp, Artificial Sequence
  chemically synthesized
agtacactgatactcacaaa

SEQ ID NO: 621778 - DNA, 20 bp, Artificial Sequence
  chemically synthesized
tgagtatcagtgtactcatt

SEQ ID NO: 621779 - DNA, 20 bp, Artificial Sequence
  chemically synthesized
attgtatgcttacactgtgt

SEQ ID NO: 621780 - DNA, 20 bp, Artificial Sequence
  chemically synthesized
ccctgaagtactgacaaagt

SEQ ID NO: 621781 - DNA, 20 bp, Artificial Sequence
  chemically synthesized
ttaaatgtcttacaacattg

SEQ ID NO: 621782 - DNA, 20 bp, Artificial Sequence
  chemically synthesized
gtagctgtataattaaaagg

SEQ ID NO: 621783 - DNA, 20 bp, Artificial Sequence
  chemically synthesized
acattgtgctgcagttgtta

SEQ ID NO: 621784 - DNA, 20 bp, Artificial Sequence
  chemically synthesized
agttgaggattatttatgaa

SEQ ID NO: 621785 - DNA, 20 bp, Artificial Sequence
  chemically synthesized
acaagcccttgaagaggagt

SEQ ID NO: 621786 - DNA, 20 bp, Artificial Sequence
  chemically synthesized
ataatcctcaactcctcttc

SEQ ID NO: 621787 - DNA, 20 bp, Artificial Sequence
  chemically synthesized
cattttgagaagtgacacat

SEQ ID NO: 621788 - DNA, 20 bp, Artificial Sequence
  chemically synthesized
gtgacacattttggcttcag

SEQ ID NO: 621789 - DNA, 20 bp, Artificial Sequence
  chemically synthesized
ggagttttagcataactgct

SEQ ID NO: 621790 - DNA, 20 bp, Artificial Sequence
  chemically synthesized
cttcccttcactgccaacga

SEQ ID NO: 621791 - DNA, 20 bp, Artificial Sequence
  chemically synthesized
atattaagggagatatccaa

SEQ ID NO: 621792 - DNA, 20 bp, Artificial Sequence
  chemically synthesized
gggcattgcaccttgcacaa

SEQ ID NO: 621793 - DNA, 20 bp, Artificial Sequence
  chemically synthesized
acgcttttttttcagtatga

SEQ ID NO: 621794 - DNA, 20 bp, Artificial Sequence
  chemically synthesized
agagtcatactgaaaaaaaa

SEQ ID NO: 621795 - DNA, 20 bp, Artificial Sequence
  chemically synthesized
atagccaattttgaaagaaa

SEQ ID NO: 621796 - DNA, 20 bp, Artificial Sequence
  chemically synthesized
tctttcaaaattggctattc

SEQ ID NO: 621797 - DNA, 20 bp, Artificial Sequence
  chemically synthesized
gggaagtggggaggatgcct

SEQ ID NO: 621798 - DNA, 20 bp, Artificial Sequence
  chemically synthesized
ttgttgtccgcaggactgct

SEQ ID NO: 621799 - DNA, 20 bp, Artificial Sequence
  chemically synthesized
ggacaacaaagtgtaataaa

SEQ ID NO: 621800 - DNA, 20 bp, Artificial Sequence
  chemically synthesized
caaagtgtaataaaaaatgt

SEQ ID NO: 621801 - DNA, 20 bp, Artificial Sequence
  chemically synthesized
tatttaaacttttagcatca

SEQ ID NO: 621802 - DNA, 20 bp, Artificial Sequence
  chemically synthesized
ctggaaagcctggtgatgct

SEQ ID NO: 621803 - DNA, 20 bp, Artificial Sequence
  chemically synthesized
accaggctttccagctataa

SEQ ID NO: 621804 - DNA, 20 bp, Artificial Sequence
  chemically synthesized
ctttgacttcggagcctgag

SEQ ID NO: 621805 - DNA, 20 bp, Artificial Sequence
  chemically synthesized
cgaagtcaaagcaatttaac

SEQ ID NO: 621806 - DNA, 20 bp, Artificial Sequence
  chemically synthesized
tggaattcaagccctagtta

SEQ ID NO: 621807 - DNA, 20 bp, Artificial Sequence
  chemically synthesized
gatataaataacataacgtg

SEQ ID NO: 621808 - DNA, 20 bp, Artificial Sequence
  chemically synthesized
tccagcctcctgaggctatt

SEQ ID NO: 621809 - DNA, 20 bp, Artificial Sequence
  chemically synthesized
tattgttagtttccactaca

SEQ ID NO: 621810 - DNA, 20 bp, Artificial Sequence
  chemically synthesized
tccaaagccttgggaaatgt

SEQ ID NO: 621811 - DNA, 20 bp, Artificial Sequence
  chemically synthesized
tgataatcactcacatttcc

SEQ ID NO: 621812 - DNA, 20 bp, Artificial Sequence
  chemically synthesized
aggcttattttgtatgcatc

SEQ ID NO: 621813 - DNA, 20 bp, Artificial Sequence
  chemically synthesized
attatggtgtttttcacttc

SEQ ID NO: 621814 - DNA, 20 bp, Artificial Sequence
  chemically synthesized
acccatcttcaacaacatta

SEQ ID NO: 621815 - DNA, 20 bp, Artificial Sequence
  chemically synthesized
acaccataatgttgttgaag

SEQ ID NO: 621816 - DNA, 20 bp, Artificial Sequence
  chemically synthesized
gggttttcttccttttagta

SEQ ID NO: 621817 - DNA, 20 bp, Artificial Sequence
  chemically synthesized
tagtaatatgtttgccatat

SEQ ID NO: 621818 - DNA, 20 bp, Artificial Sequence
  chemically synthesized
agatctttggtggccctact

SEQ ID NO: 621819 - DNA, 20 bp, Artificial Sequence
  chemically synthesized
tgtactactacatataggtg

SEQ ID NO: 621820 - DNA, 20 bp, Artificial Sequence
  chemically synthesized
ttccctgatgtactgtatat

SEQ ID NO: 621821 - DNA, 20 bp, Artificial Sequence
  chemically synthesized
aacaacgtagacttcgaatg

SEQ ID NO: 621822 - DNA, 20 bp, Artificial Sequence
  chemically synthesized
tgtcaccaggttattgcagt

SEQ ID NO: 621823 - DNA, 20 bp, Artificial Sequence
  chemically synthesized
tgggaataataactctagag

SEQ ID NO: 621824 - DNA, 20 bp, Artificial Sequence
  chemically synthesized
aagatggtcattttaaaaaa

SEQ ID NO: 621825 - DNA, 20 bp, Artificial Sequence
  chemically synthesized
taaaatgaccatcttgaaaa

SEQ ID NO: 621826 - DNA, 20 bp, Artificial Sequence
  chemically synthesized
tttggaggtgactccaggaa

SEQ ID NO: 621827 - DNA, 20 bp, Artificial Sequence
  chemically synthesized
tctttttgtaataggagatg

SEQ ID NO: 621828 - DNA, 20 bp, Artificial Sequence
  chemically synthesized
attacaaaaagaaaaatgag

SEQ ID NO: 621829 - DNA, 20 bp, Artificial Sequence
  chemically synthesized
gtaaggtactttattgggta

SEQ ID NO: 621830 - DNA, 20 bp, Artificial Sequence
  chemically synthesized
tccattgagcaataatgcct

SEQ ID NO: 621831 - DNA, 20 bp, Artificial Sequence
  chemically synthesized
caatttaaaataagaggtta

SEQ ID NO: 621832 - DNA, 20 bp, Artificial Sequence
  chemically synthesized
gtacttttattcaaaccgtg

SEQ ID NO: 621833 - DNA, 20 bp, Artificial Sequence
  chemically synthesized
tattcaaaccgtgctatgat

SEQ ID NO: 621834 - DNA, 20 bp, Artificial Sequence
  chemically synthesized
gagagaagccaaaatcatag

SEQ ID NO: 621835 - DNA, 20 bp, Artificial Sequence
  chemically synthesized
agctgaagagctgcaaagag

SEQ ID NO: 621836 - DNA, 20 bp, Artificial Sequence
  chemically synthesized
ctgccagctgaagagctgca

SEQ ID NO: 621837 - DNA, 20 bp, Artificial Sequence
  chemically synthesized
cttcagctggcagcattttt

SEQ ID NO: 621838 - DNA, 20 bp, Artificial Sequence
  chemically synthesized
aacagacacacaccacagtg

SEQ ID NO: 621839 - DNA, 20 bp, Artificial Sequence
  chemically synthesized
atctcatcactgtggtgtgt

SEQ ID NO: 621840 - DNA, 20 bp, Artificial Sequence
  chemically synthesized
gtggtgtgtgtctgtttact

SEQ ID NO: 621841 - DNA, 20 bp, Artificial Sequence
  chemically synthesized
aataaatgggtcatgaagaa

SEQ ID NO: 621842 - DNA, 20 bp, Artificial Sequence
  chemically synthesized
ttttggatactgttctttta

SEQ ID NO: 621843 - DNA, 20 bp, Artificial Sequence
  chemically synthesized
atctttcccatagggttaca

SEQ ID NO: 621844 - DNA, 20 bp, Artificial Sequence
  chemically synthesized
tattgagtgagtgttttatt

SEQ ID NO: 621845 - DNA, 20 bp, Artificial Sequence
  chemically synthesized
atgatattgagtgagtgttt

SEQ ID NO: 621846 - DNA, 20 bp, Artificial Sequence
  chemically synthesized
atacccctatgatattgagt

SEQ ID NO: 621847 - DNA, 20 bp, Artificial Sequence
  chemically synthesized
tcactcaatatcataggggt

SEQ ID NO: 621848 - DNA, 20 bp, Artificial Sequence
  chemically synthesized
accaaccagatagattttca

SEQ ID NO: 621849 - DNA, 20 bp, Artificial Sequence
  chemically synthesized
tcatctaaaataaccaacca

SEQ ID NO: 621850 - DNA, 20 bp, Artificial Sequence
  chemically synthesized
tctatctggttggttatttt

SEQ ID NO: 621851 - DNA, 20 bp, Artificial Sequence
  chemically synthesized
gttccttatatcaaattcta

SEQ ID NO: 621852 - DNA, 20 bp, Artificial Sequence
  chemically synthesized
acatggaatatctctaagtg

SEQ ID NO: 621853 - DNA, 20 bp, Artificial Sequence
  chemically synthesized
gctcaagttcttccagatgt

SEQ ID NO: 621854 - DNA, 20 bp, Artificial Sequence
  chemically synthesized
taacggaggggagttctgag

SEQ ID NO: 621855 - DNA, 20 bp, Artificial Sequence
  chemically synthesized
agagctcagaactcccctcc

SEQ ID NO: 621856 - DNA, 20 bp, Artificial Sequence
  chemically synthesized
agaactcccctccgttagct

SEQ ID NO: 621857 - DNA, 20 bp, Artificial Sequence
  chemically synthesized
ccattactcagttcattgag

SEQ ID NO: 621858 - DNA, 20 bp, Artificial Sequence
  chemically synthesized
gctggatttaaaggtgtccc

SEQ ID NO: 621859 - DNA, 20 bp, Artificial Sequence
  chemically synthesized
ggaaggtttttgcttctact

SEQ ID NO: 621860 - DNA, 20 bp, Artificial Sequence
  chemically synthesized
tgcttatcagtggggaaggt

SEQ ID NO: 621861 - DNA, 20 bp, Artificial Sequence
  chemically synthesized
ttcttttgcttatcagtggg

SEQ ID NO: 621862 - DNA, 20 bp, Artificial Sequence
  chemically synthesized
ttttgttgccagaaatattc

SEQ ID NO: 621863 - DNA, 20 bp, Artificial Sequence
  chemically synthesized
atatataccgcctatagttg

SEQ ID NO: 621864 - DNA, 20 bp, Artificial Sequence
  chemically synthesized
tgccttcaggggttactgac

SEQ ID NO: 621865 - DNA, 20 bp, Artificial Sequence
  chemically synthesized
taacccctgaaggcaacaac

SEQ ID NO: 621866 - DNA, 20 bp, Artificial Sequence
  chemically synthesized
agatccagtctcagagaatg

SEQ ID NO: 621867 - DNA, 20 bp, Artificial Sequence
  chemically synthesized
gatctgcttaacacttggcc

SEQ ID NO: 621868 - DNA, 20 bp, Artificial Sequence
  chemically synthesized
tgtggtcactgtgaggtgtt

SEQ ID NO: 621869 - DNA, 20 bp, Artificial Sequence
  chemically synthesized
acagttaaaaataatgtatt

SEQ ID NO: 621870 - DNA, 20 bp, Artificial Sequence
  chemically synthesized
ggtttcaaaattgctaaaag

SEQ ID NO: 621871 - DNA, 20 bp, Artificial Sequence
  chemically synthesized
catatttaccgagtacaacg

SEQ ID NO: 621872 - DNA, 20 bp, Artificial Sequence
  chemically synthesized
ttcccagatcttggaagtat

SEQ ID NO: 621873 - DNA, 20 bp, Artificial Sequence
  chemically synthesized
acagtcccagttataaatta

SEQ ID NO: 621874 - DNA, 20 bp, Artificial Sequence
  chemically synthesized
taagtggaagaattcgttct

SEQ ID NO: 621875 - DNA, 20 bp, Artificial Sequence
  chemically synthesized
ttcttccacttaaaatcagc

SEQ ID NO: 621876 - DNA, 20 bp, Artificial Sequence
  chemically synthesized
tgggtatgccattaatcaaa

SEQ ID NO: 621877 - DNA, 20 bp, Artificial Sequence
  chemically synthesized
tagacatatggggatttaga

SEQ ID NO: 621878 - DNA, 20 bp, Artificial Sequence
  chemically synthesized
gtggcagcattatagacata

SEQ ID NO: 621879 - DNA, 20 bp, Artificial Sequence
  chemically synthesized
cacatatatcttcttaaaac

SEQ ID NO: 621880 - DNA, 20 bp, Artificial Sequence
  chemically synthesized
agtaggtgatatgaagaaac

SEQ ID NO: 621881 - DNA, 20 bp, Artificial Sequence
  chemically synthesized
ataaccccaactcttgataa

SEQ ID NO: 621882 - DNA, 20 bp, Artificial Sequence
  chemically synthesized
gagaaatgaaaggcagatga

SEQ ID NO: 621883 - DNA, 20 bp, Artificial Sequence
  chemically synthesized
gcctttcatttctcagtaca

SEQ ID NO: 621884 - DNA, 20 bp, Artificial Sequence
  chemically synthesized
ttcatttctcagtacactaa

SEQ ID NO: 621885 - DNA, 20 bp, Artificial Sequence
  chemically synthesized
aatagtgcgtttcagtagaa

SEQ ID NO: 621886 - DNA, 20 bp, Artificial Sequence
  chemically synthesized
ctactgaaacgcactattct

SEQ ID NO: 621887 - DNA, 20 bp, Artificial Sequence
  chemically synthesized
agagagaaacctgtagaata

SEQ ID NO: 621888 - DNA, 20 bp, Artificial Sequence
  chemically synthesized
ttctacaggtttctctctcc

SEQ ID NO: 621889 - DNA, 20 bp, Artificial Sequence
  chemically synthesized
agatatttaagaacagaaag

SEQ ID NO: 621890 - DNA, 20 bp, Artificial Sequence
  chemically synthesized
aacagaaagactggcttttt

SEQ ID NO: 621891 - DNA, 20 bp, Artificial Sequence
  chemically synthesized
ttttacagctttccagtccc

SEQ ID NO: 621892 - DNA, 20 bp, Artificial Sequence
  chemically synthesized
ccacaaagcaaacatctact

SEQ ID NO: 621893 - DNA, 20 bp, Artificial Sequence
  chemically synthesized
atgtgaaacatgaagtagat

SEQ ID NO: 621894 - DNA, 20 bp, Artificial Sequence
  chemically synthesized
atcaatgtgaaacatgaagt

SEQ ID NO: 621895 - DNA, 20 bp, Artificial Sequence
  chemically synthesized
acaagtatttagagactagt

SEQ ID NO: 621896 - DNA, 20 bp, Artificial Sequence
  chemically synthesized
ttctatttcatgaatattta

SEQ ID NO: 621897 - DNA, 20 bp, Artificial Sequence
  chemically synthesized
tcatttctatttcatgaata

SEQ ID NO: 621898 - DNA, 20 bp, Artificial Sequence
  chemically synthesized
atattaataggatgtaccag

SEQ ID NO: 621899 - DNA, 20 bp, Artificial Sequence
  chemically synthesized
tagttaaatattccataaga

SEQ ID NO: 621900 - DNA, 20 bp, Artificial Sequence
  chemically synthesized
ttaattcacttaatatatca

SEQ ID NO: 621901 - DNA, 20 bp, Artificial Sequence
  chemically synthesized
atgatatattaagtgaatta

SEQ ID NO: 621902 - DNA, 20 bp, Artificial Sequence
  chemically synthesized
agcatacacatagttttgga

SEQ ID NO: 621903 - DNA, 20 bp, Artificial Sequence
  chemically synthesized
ttttagtattttagcataca

SEQ ID NO: 621904 - DNA, 20 bp, Artificial Sequence
  chemically synthesized
aggcattcaggctccagagc

SEQ ID NO: 621905 - DNA, 20 bp, Artificial Sequence
  chemically synthesized
taggctctggagcctgaatg

SEQ ID NO: 621906 - DNA, 20 bp, Artificial Sequence
  chemically synthesized
tactagcacttggtacatac

SEQ ID NO: 621907 - DNA, 20 bp, Artificial Sequence
  chemically synthesized
attcaggaataaccagtgtt

SEQ ID NO: 621908 - DNA, 20 bp, Artificial Sequence
  chemically synthesized
ataggcaactattaccttta

SEQ ID NO: 621909 - DNA, 20 bp, Artificial Sequence
  chemically synthesized
ttgtattataaaaaatcagg

SEQ ID NO: 621910 - DNA, 20 bp, Artificial Sequence
  chemically synthesized
ggcatgagccaccaaaccca

SEQ ID NO: 621911 - DNA, 20 bp, Artificial Sequence
  chemically synthesized
ggccttggccttccaaagtg

SEQ ID NO: 621912 - DNA, 20 bp, Artificial Sequence
  chemically synthesized
aggtgcgtgccaccacgcct

SEQ ID NO: 621913 - DNA, 20 bp, Artificial Sequence
  chemically synthesized
gagggcaaggctgcagtgag

SEQ ID NO: 621914 - DNA, 20 bp, Artificial Sequence
  chemically synthesized
tgccacccaggctgaagtgc

SEQ ID NO: 621915 - DNA, 20 bp, Artificial Sequence
  chemically synthesized
aaaaaaaaaaaaaaaaccac

SEQ ID NO: 621916 - DNA, 20 bp, Artificial Sequence
  chemically synthesized
atattttaagaggaatctgt

SEQ ID NO: 621917 - DNA, 20 bp, Artificial Sequence
  chemically synthesized
gcaatgtctactattttaca

SEQ ID NO: 621918 - DNA, 20 bp, Artificial Sequence
  chemically synthesized
taatactgtggcattgggga

SEQ ID NO: 621919 - DNA, 20 bp, Artificial Sequence
  chemically synthesized
acctcttaatactgtggcat

SEQ ID NO: 621920 - DNA, 20 bp, Artificial Sequence
  chemically synthesized
aatgccacagtattaagagg

SEQ ID NO: 621921 - DNA, 20 bp, Artificial Sequence
  chemically synthesized
taagaggtagggttttaaga

SEQ ID NO: 621922 - DNA, 20 bp, Artificial Sequence
  chemically synthesized
actaatcccattcatgaggg

SEQ ID NO: 621923 - DNA, 20 bp, Artificial Sequence
  chemically synthesized
tataagcggagccctcatga

SEQ ID NO: 621924 - DNA, 20 bp, Artificial Sequence
  chemically synthesized
ttataaaagaggccaaggga

SEQ ID NO: 621925 - DNA, 20 bp, Artificial Sequence
  chemically synthesized
tggtgtctggtgagggttct

SEQ ID NO: 621926 - DNA, 20 bp, Artificial Sequence
  chemically synthesized
aaatccaagatcaaaatgtt

SEQ ID NO: 621927 - DNA, 20 bp, Artificial Sequence
  chemically synthesized
aaatctgccaacattttgat

SEQ ID NO: 621928 - DNA, 20 bp, Artificial Sequence
  chemically synthesized
acgaagatttattgctgcag

SEQ ID NO: 621929 - DNA, 20 bp, Artificial Sequence
  chemically synthesized
gttctgcagcaataaatctt

SEQ ID NO: 621930 - DNA, 20 bp, Artificial Sequence
  chemically synthesized
actgtgtaatttataaacaa

SEQ ID NO: 621931 - DNA, 20 bp, Artificial Sequence
  chemically synthesized
cagaagaatttttaagtggt

SEQ ID NO: 621932 - DNA, 20 bp, Artificial Sequence
  chemically synthesized
tttaatacatatataaatat

SEQ ID NO: 621933 - DNA, 20 bp, Artificial Sequence
  chemically synthesized
ttagtatatattttatatat

SEQ ID NO: 621934 - DNA, 20 bp, Artificial Sequence
  chemically synthesized
taaattttaatatatatgta

SEQ ID NO: 621935 - DNA, 20 bp, Artificial Sequence
  chemically synthesized
gagatcgtcccctgctccct

SEQ ID NO: 621936 - DNA, 20 bp, Artificial Sequence
  chemically synthesized
gttttatttatcttgctaca

SEQ ID NO: 621937 - DNA, 20 bp, Artificial Sequence
  chemically synthesized
tcctagcacaccttgcctaa

SEQ ID NO: 621938 - DNA, 20 bp, Artificial Sequence
  chemically synthesized
acacacttaggcaaggtgtg

SEQ ID NO: 621939 - DNA, 20 bp, Artificial Sequence
  chemically synthesized
aaaagagaacatttatgctt

SEQ ID NO: 621940 - DNA, 20 bp, Artificial Sequence
  chemically synthesized
ccactataaaaagagaacat

SEQ ID NO: 621941 - DNA, 20 bp, Artificial Sequence
  chemically synthesized
acgggagaaatgagtaaaaa

SEQ ID NO: 621942 - DNA, 20 bp, Artificial Sequence
  chemically synthesized
gaaatgagtaaaaatgtggt

SEQ ID NO: 621943 - DNA, 20 bp, Artificial Sequence
  chemically synthesized
gtaaaaatgtggtttcagct

SEQ ID NO: 621944 - DNA, 20 bp, Artificial Sequence
  chemically synthesized
aagtgaaatgtgagacaata

SEQ ID NO: 621945 - DNA, 20 bp, Artificial Sequence
  chemically synthesized
tattattttaacatttttgg

SEQ ID NO: 621946 - DNA, 20 bp, Artificial Sequence
  chemically synthesized
tggtcctcttggatgtaaaa

SEQ ID NO: 621947 - DNA, 20 bp, Artificial Sequence
  chemically synthesized
tatgggtaaatataagaaca

SEQ ID NO: 621948 - DNA, 20 bp, Artificial Sequence
  chemically synthesized
gtatatggtaagtgctcaat

SEQ ID NO: 621949 - DNA, 20 bp, Artificial Sequence
  chemically synthesized
tgatatgttacattcatatt

SEQ ID NO: 621950 - DNA, 20 bp, Artificial Sequence
  chemically synthesized
ctcaactatattcattgtgg

SEQ ID NO: 621951 - DNA, 20 bp, Artificial Sequence
  chemically synthesized
catcaccacaatgaatatag

SEQ ID NO: 621952 - DNA, 20 bp, Artificial Sequence
  chemically synthesized
tatgtgataggtactggtct

SEQ ID NO: 621953 - DNA, 20 bp, Artificial Sequence
  chemically synthesized
ttaataatagcacctacctc

SEQ ID NO: 621954 - DNA, 20 bp, Artificial Sequence
  chemically synthesized
tacactgactctcttttttc

SEQ ID NO: 621955 - DNA, 20 bp, Artificial Sequence
  chemically synthesized
tactgagagaaaatgaaaga

SEQ ID NO: 621956 - DNA, 20 bp, Artificial Sequence
  chemically synthesized
agagttggatttccaaccca

SEQ ID NO: 621957 - DNA, 20 bp, Artificial Sequence
  chemically synthesized
tggatttccaacccagaaag

SEQ ID NO: 621958 - DNA, 20 bp, Artificial Sequence
  chemically synthesized
taaatggagacaatatagac

SEQ ID NO: 621959 - DNA, 20 bp, Artificial Sequence
  chemically synthesized
caggccacgtcatttctgtc

SEQ ID NO: 621960 - DNA, 20 bp, Artificial Sequence
  chemically synthesized
cgaattaagtaatgccagag

SEQ ID NO: 621961 - DNA, 20 bp, Artificial Sequence
  chemically synthesized
attctcctatccctaattct

SEQ ID NO: 621962 - DNA, 20 bp, Artificial Sequence
  chemically synthesized
aaatcagcacaatggagata

SEQ ID NO: 621963 - DNA, 20 bp, Artificial Sequence
  chemically synthesized
taaacactctatctccattg

SEQ ID NO: 621964 - DNA, 20 bp, Artificial Sequence
  chemically synthesized
tttttgaagatattcatcta

SEQ ID NO: 621965 - DNA, 20 bp, Artificial Sequence
  chemically synthesized
attttctttttgccttggag

SEQ ID NO: 621966 - DNA, 20 bp, Artificial Sequence
  chemically synthesized
tccttttcttttcatcctgg

SEQ ID NO: 621967 - DNA, 20 bp, Artificial Sequence
  chemically synthesized
ataacagttctccttttctt

SEQ ID NO: 621968 - DNA, 20 bp, Artificial Sequence
  chemically synthesized
ttttcttgctggcttctggc

SEQ ID NO: 621969 - DNA, 20 bp, Artificial Sequence
  chemically synthesized
tgttgctatttcttgttctt

SEQ ID NO: 621970 - DNA, 20 bp, Artificial Sequence
  chemically synthesized
tgttctttgatgtttcgcat

SEQ ID NO: 621971 - DNA, 20 bp, Artificial Sequence
  chemically synthesized
ctgattgttccctttctcac

SEQ ID NO: 621972 - DNA, 20 bp, Artificial Sequence
  chemically synthesized
tttctcacccctgctttctg

SEQ ID NO: 621973 - DNA, 20 bp, Artificial Sequence
  chemically synthesized
acgtttacctctttgctatt

SEQ ID NO: 621974 - DNA, 20 bp, Artificial Sequence
  chemically synthesized
ggggacagtatcattcctta

SEQ ID NO: 621975 - DNA, 20 bp, Artificial Sequence
  chemically synthesized
atcattccttaatgtgtttc

SEQ ID NO: 621976 - DNA, 20 bp, Artificial Sequence
  chemically synthesized
ttatgtgtgaaggaggctgc

SEQ ID NO: 621977 - DNA, 20 bp, Artificial Sequence
  chemically synthesized
gagtcactttgccctcccgg

SEQ ID NO: 621978 - DNA, 20 bp, Artificial Sequence
  chemically synthesized
catctcggcctctcggagtg

SEQ ID NO: 621979 - DNA, 20 bp, Artificial Sequence
  chemically synthesized
tgggcggatcacttaaggcc

SEQ ID NO: 621980 - DNA, 20 bp, Artificial Sequence
  chemically synthesized
aaatggggtctccttatgtt

SEQ ID NO: 621981 - DNA, 20 bp, Artificial Sequence
  chemically synthesized
tattccggcgatcctcccac

SEQ ID NO: 621982 - DNA, 20 bp, Artificial Sequence
  chemically synthesized
caggggtctcgctctgtctc

SEQ ID NO: 621983 - DNA, 20 bp, Artificial Sequence
  chemically synthesized
agacagagcgagacccctga

SEQ ID NO: 621984 - DNA, 20 bp, Artificial Sequence
  chemically synthesized
attggggattacatttcaat

SEQ ID NO: 621985 - DNA, 20 bp, Artificial Sequence
  chemically synthesized
tcatattgaaatgtaatccc

SEQ ID NO: 621986 - DNA, 20 bp, Artificial Sequence
  chemically synthesized
attgaaatgtaatccccaat

SEQ ID NO: 621987 - DNA, 20 bp, Artificial Sequence
  chemically synthesized
aaatgtaatccccaatgttt

SEQ ID NO: 621988 - DNA, 20 bp, Artificial Sequence
  chemically synthesized
aaaaacaaacaaacaaacat

SEQ ID NO: 621989 - DNA, 20 bp, Artificial Sequence
  chemically synthesized
gtaatccccaatgtttgttt

SEQ ID NO: 621990 - DNA, 20 bp, Artificial Sequence
  chemically synthesized
aacgtctgtctcccaagtag

SEQ ID NO: 621991 - DNA, 20 bp, Artificial Sequence
  chemically synthesized
ggaggtgatcggagcatgcg

SEQ ID NO: 621992 - DNA, 20 bp, Artificial Sequence
  chemically synthesized
atgcgggtggatttctcacg

SEQ ID NO: 621993 - DNA, 20 bp, Artificial Sequence
  chemically synthesized
agtgtattctcatgagatac

SEQ ID NO: 621994 - DNA, 20 bp, Artificial Sequence
  chemically synthesized
catgagatacggttgcttaa

SEQ ID NO: 621995 - DNA, 20 bp, Artificial Sequence
  chemically synthesized
gttcctgccctggccacatg

SEQ ID NO: 621996 - DNA, 20 bp, Artificial Sequence
  chemically synthesized
ttgctcccccttcatttcca

SEQ ID NO: 621997 - DNA, 20 bp, Artificial Sequence
  chemically synthesized
ccttcatttccaccatgatt

SEQ ID NO: 621998 - DNA, 20 bp, Artificial Sequence
  chemically synthesized
caccatgattttgagcttcc

SEQ ID NO: 621999 - DNA, 20 bp, Artificial Sequence
  chemically synthesized
aagcataatgctggcatctt

SEQ ID NO: 622000 - DNA, 20 bp, Artificial Sequence
  chemically synthesized
aagccgagaagatgccagca

SEQ ID NO: 622001 - DNA, 20 bp, Artificial Sequence
  chemically synthesized
ccctaatgttcactttccaa

SEQ ID NO: 622002 - DNA, 20 bp, Artificial Sequence
  chemically synthesized
ataaataaatcctttggact

SEQ ID NO: 622003 - DNA, 20 bp, Artificial Sequence
  chemically synthesized
aaggaagaagctgggagtcc

SEQ ID NO: 622004 - DNA, 20 bp, Artificial Sequence
  chemically synthesized
cccagcttcttcctttgccg

SEQ ID NO: 622005 - DNA, 20 bp, Artificial Sequence
  chemically synthesized
tcagctttaagggacagtgg

SEQ ID NO: 622006 - DNA, 20 bp, Artificial Sequence
  chemically synthesized
catttctgctatcaatagtt

SEQ ID NO: 622007 - DNA, 20 bp, Artificial Sequence
  chemically synthesized
gttggaatgatgttctgaaa

SEQ ID NO: 622008 - DNA, 20 bp, Artificial Sequence
  chemically synthesized
ttaatttctatgaatttcaa

SEQ ID NO: 622009 - DNA, 20 bp, Artificial Sequence
  chemically synthesized
agtaagtaggtaattttctt

SEQ ID NO: 622010 - DNA, 20 bp, Artificial Sequence
  chemically synthesized
atgttattctcaaaatttta

SEQ ID NO: 622011 - DNA, 20 bp, Artificial Sequence
  chemically synthesized
tgtttttataagggacagtg

SEQ ID NO: 622012 - DNA, 20 bp, Artificial Sequence
  chemically synthesized
tataagggacagtgtacagt

SEQ ID NO: 622013 - DNA, 20 bp, Artificial Sequence
  chemically synthesized
aggttgacaagggaaaaagg

SEQ ID NO: 622014 - DNA, 20 bp, Artificial Sequence
  chemically synthesized
gaaaaagggatagttttcca

SEQ ID NO: 622015 - DNA, 20 bp, Artificial Sequence
  chemically synthesized
atagttttccagcatgcttt

SEQ ID NO: 622016 - DNA, 20 bp, Artificial Sequence
  chemically synthesized
atgtctgcttaaatactgag

SEQ ID NO: 622017 - DNA, 20 bp, Artificial Sequence
  chemically synthesized
gatgaggaaaatatccaaat

SEQ ID NO: 622018 - DNA, 20 bp, Artificial Sequence
  chemically synthesized
cttgaacaaatccctccatt

SEQ ID NO: 622019 - DNA, 20 bp, Artificial Sequence
  chemically synthesized
aaactgagaatcagaaaatg

SEQ ID NO: 622020 - DNA, 20 bp, Artificial Sequence
  chemically synthesized
aatccctccattttctgatt

SEQ ID NO: 622021 - DNA, 20 bp, Artificial Sequence
  chemically synthesized
atgggaattggactaaataa

SEQ ID NO: 622022 - DNA, 20 bp, Artificial Sequence
  chemically synthesized
actaaataactttgtttcca

SEQ ID NO: 622023 - DNA, 20 bp, Artificial Sequence
  chemically synthesized
atccctataattgcataaat

SEQ ID NO: 622024 - DNA, 20 bp, Artificial Sequence
  chemically synthesized
aatctattaaatgaagtcct

SEQ ID NO: 622025 - DNA, 20 bp, Artificial Sequence
  chemically synthesized
aaacacccaggacttcattt

SEQ ID NO: 622026 - DNA, 20 bp, Artificial Sequence
  chemically synthesized
caccccattagcatctgcag

SEQ ID NO: 622027 - DNA, 20 bp, Artificial Sequence
  chemically synthesized
tttttgtttgtttatttttg

SEQ ID NO: 622028 - DNA, 20 bp, Artificial Sequence
  chemically synthesized
tatgccacggctagtttttt

SEQ ID NO: 622029 - DNA, 20 bp, Artificial Sequence
  chemically synthesized
tctgtatgccacggctagtt

SEQ ID NO: 622030 - DNA, 20 bp, Artificial Sequence
  chemically synthesized
acaaaaaactagccgtggca

SEQ ID NO: 622031 - DNA, 20 bp, Artificial Sequence
  chemically synthesized
tacttaatctgtatgccacg

SEQ ID NO: 622032 - DNA, 20 bp, Artificial Sequence
  chemically synthesized
ttaagtatatttacaccaag

SEQ ID NO: 622033 - DNA, 20 bp, Artificial Sequence
  chemically synthesized
ttatctaggggaaaatatac

SEQ ID NO: 622034 - DNA, 20 bp, Artificial Sequence
  chemically synthesized
cttacattttaggtttgttg

SEQ ID NO: 622035 - DNA, 20 bp, Artificial Sequence
  chemically synthesized
ggaaaagaactacttacatt

SEQ ID NO: 622036 - DNA, 20 bp, Artificial Sequence
  chemically synthesized
aatgactgtgaccttaggca

SEQ ID NO: 622037 - DNA, 20 bp, Artificial Sequence
  chemically synthesized
acagtcattaaatagcagca

SEQ ID NO: 622038 - DNA, 20 bp, Artificial Sequence
  chemically synthesized
acgcatgggttctggagcca

SEQ ID NO: 622039 - DNA, 20 bp, Artificial Sequence
  chemically synthesized
ccagaacccatgcgtctgat

SEQ ID NO: 622040 - DNA, 20 bp, Artificial Sequence
  chemically synthesized
catctattgtgaggttgcca

SEQ ID NO: 622041 - DNA, 20 bp, Artificial Sequence
  chemically synthesized
taccgctcaggagaattgag

SEQ ID NO: 622042 - DNA, 20 bp, Artificial Sequence
  chemically synthesized
gcagcaaaaaatatgtaact

SEQ ID NO: 622043 - DNA, 20 bp, Artificial Sequence
  chemically synthesized
cattttgagtgcacaagtca

SEQ ID NO: 622044 - DNA, 20 bp, Artificial Sequence
  chemically synthesized
acaatttaaaaatttaaaat

SEQ ID NO: 622045 - DNA, 20 bp, Artificial Sequence
  chemically synthesized
aagagcctcagtgatattca

SEQ ID NO: 622046 - DNA, 20 bp, Artificial Sequence
  chemically synthesized
agtgatattcagtatgattg

SEQ ID NO: 622047 - DNA, 20 bp, Artificial Sequence
  chemically synthesized
gtttctagctagtctcttaa

SEQ ID NO: 622048 - DNA, 20 bp, Artificial Sequence
  chemically synthesized
gagactagctagaaactcag

SEQ ID NO: 622049 - DNA, 20 bp, Artificial Sequence
  chemically synthesized
tgcaatccatgaaaactctg

SEQ ID NO: 622050 - DNA, 20 bp, Artificial Sequence
  chemically synthesized
tagaaactcagcagagtttt

SEQ ID NO: 622051 - DNA, 20 bp, Artificial Sequence
  chemically synthesized
tttttgtggattcactgctt

SEQ ID NO: 622052 - DNA, 20 bp, Artificial Sequence
  chemically synthesized
ctgaactgtttttgtggatt

SEQ ID NO: 622053 - DNA, 20 bp, Artificial Sequence
  chemically synthesized
gaaactcactgaactgtttt

SEQ ID NO: 622054 - DNA, 20 bp, Artificial Sequence
  chemically synthesized
gaatccacaaaaacagttca

SEQ ID NO: 622055 - DNA, 20 bp, Artificial Sequence
  chemically synthesized
ggtttaaatgaaactcactg

SEQ ID NO: 622056 - DNA, 20 bp, Artificial Sequence
  chemically synthesized
tcactttttggtagtgtatg

SEQ ID NO: 622057 - DNA, 20 bp, Artificial Sequence
  chemically synthesized
agtgttgggatcattaagaa

SEQ ID NO: 622058 - DNA, 20 bp, Artificial Sequence
  chemically synthesized
tgcttaggcatttcagtttg

SEQ ID NO: 622059 - DNA, 20 bp, Artificial Sequence
  chemically synthesized
tttaagggttgcttaggcat

SEQ ID NO: 622060 - DNA, 20 bp, Artificial Sequence
  chemically synthesized
atgcctaagcaacccttaaa

SEQ ID NO: 622061 - DNA, 20 bp, Artificial Sequence
  chemically synthesized
tgacaaaagctatctttaag

SEQ ID NO: 622062 - DNA, 20 bp, Artificial Sequence
  chemically synthesized
ctttcattttctcaccagat

SEQ ID NO: 622063 - DNA, 20 bp, Artificial Sequence
  chemically synthesized
gccttaactttcattttctc

SEQ ID NO: 622064 - DNA, 20 bp, Artificial Sequence
  chemically synthesized
tctggtgagaaaatgaaagt

SEQ ID NO: 622065 - DNA, 20 bp, Artificial Sequence
  chemically synthesized
ttttattttattttttgaga

SEQ ID NO: 622066 - DNA, 20 bp, Artificial Sequence
  chemically synthesized
gaggcggaggttgcagtgag

SEQ ID NO: 622067 - DNA, 20 bp, Artificial Sequence
  chemically synthesized
gctcactgcaacctccgcct

SEQ ID NO: 622068 - DNA, 20 bp, Artificial Sequence
  chemically synthesized
ttgggaggctgagacaggag

SEQ ID NO: 622069 - DNA, 20 bp, Artificial Sequence
  chemically synthesized
tgtctcagcctcccaagtag

SEQ ID NO: 622070 - DNA, 20 bp, Artificial Sequence
  chemically synthesized
gccaccatgctcggctaatt

SEQ ID NO: 622071 - DNA, 20 bp, Artificial Sequence
  chemically synthesized
ttttgcgtttttagtagaga

SEQ ID NO: 622072 - DNA, 20 bp, Artificial Sequence
  chemically synthesized
cgccttggcctcccaaagta

SEQ ID NO: 622073 - DNA, 20 bp, Artificial Sequence
  chemically synthesized
gcgtgagccgctgtgcccgg

SEQ ID NO: 622074 - DNA, 20 bp, Artificial Sequence
  chemically synthesized
actttgaataatcaaaactg

SEQ ID NO: 622075 - DNA, 20 bp, Artificial Sequence
  chemically synthesized
cactacttgaatcacttcag

SEQ ID NO: 622076 - DNA, 20 bp, Artificial Sequence
  chemically synthesized
tgaatcactacttgaatcac

SEQ ID NO: 622077 - DNA, 20 bp, Artificial Sequence
  chemically synthesized
caaaactgaagtgattcaag

SEQ ID NO: 622078 - DNA, 20 bp, Artificial Sequence
  chemically synthesized
agtgtaatctagcacagcaa

SEQ ID NO: 622079 - DNA, 20 bp, Artificial Sequence
  chemically synthesized
cacaaaatctccattgctgt

SEQ ID NO: 622080 - DNA, 20 bp, Artificial Sequence
  chemically synthesized
tgtgtgaaacataccaaagg

SEQ ID NO: 622081 - DNA, 20 bp, Artificial Sequence
  chemically synthesized
aaccccaaacctttcctttg

SEQ ID NO: 622082 - DNA, 20 bp, Artificial Sequence
  chemically synthesized
aacataccaaaggaaaggtt

SEQ ID NO: 622083 - DNA, 20 bp, Artificial Sequence
  chemically synthesized
gaactattcagatgatgtat

SEQ ID NO: 622084 - DNA, 20 bp, Artificial Sequence
  chemically synthesized
ttaatggaattaagtaacca

SEQ ID NO: 622085 - DNA, 20 bp, Artificial Sequence
  chemically synthesized
agtaccataaattttccttt

SEQ ID NO: 622086 - DNA, 20 bp, Artificial Sequence
  chemically synthesized
tctcttgtgcgtgctaaagc

SEQ ID NO: 622087 - DNA, 20 bp, Artificial Sequence
  chemically synthesized
gcgtgctaaagcataggctt

SEQ ID NO: 622088 - DNA, 20 bp, Artificial Sequence
  chemically synthesized
gagttgacaaacataaaagc

SEQ ID NO: 622089 - DNA, 20 bp, Artificial Sequence
  chemically synthesized
aatatggagtcagatgttca

SEQ ID NO: 622090 - DNA, 20 bp, Artificial Sequence
  chemically synthesized
tttatgtaccctccctctat

SEQ ID NO: 622091 - DNA, 20 bp, Artificial Sequence
  chemically synthesized
tcactgttaggttattttac

SEQ ID NO: 622092 - DNA, 20 bp, Artificial Sequence
  chemically synthesized
tcacaagtaaaataacctaa

SEQ ID NO: 622093 - DNA, 20 bp, Artificial Sequence
  chemically synthesized
ttattatcataatcatcaag

SEQ ID NO: 622094 - DNA, 20 bp, Artificial Sequence
  chemically synthesized
ttgctctgtaaatctaacct

SEQ ID NO: 622095 - DNA, 20 bp, Artificial Sequence
  chemically synthesized
ttagatttacagagcaaaac

SEQ ID NO: 622096 - DNA, 20 bp, Artificial Sequence
  chemically synthesized
ctaaaccaacatagaaaagc

SEQ ID NO: 622097 - DNA, 20 bp, Artificial Sequence
  chemically synthesized
caaaacaaatgcttttctat

SEQ ID NO: 622098 - DNA, 20 bp, Artificial Sequence
  chemically synthesized
attttcacagctatatgtat

SEQ ID NO: 622099 - DNA, 20 bp, Artificial Sequence
  chemically synthesized
atgtaattctagtaccaaag

SEQ ID NO: 622100 - DNA, 20 bp, Artificial Sequence
  chemically synthesized
cttgtaaaaattataacgtt

SEQ ID NO: 622101 - DNA, 20 bp, Artificial Sequence
  chemically synthesized
aatttttacaaggagaaagg

SEQ ID NO: 622102 - DNA, 20 bp, Artificial Sequence
  chemically synthesized
aggagaaaggtaatgttttg

SEQ ID NO: 622103 - DNA, 20 bp, Artificial Sequence
  chemically synthesized
aatattggttatctcagaaa

SEQ ID NO: 622104 - DNA, 20 bp, Artificial Sequence
  chemically synthesized
gccatgagaaaagtattaag

SEQ ID NO: 622105 - DNA, 20 bp, Artificial Sequence
  chemically synthesized
actcaattgccttataaata

SEQ ID NO: 622106 - DNA, 20 bp, Artificial Sequence
  chemically synthesized
tgagtgacaaatttaaactt

SEQ ID NO: 622107 - DNA, 20 bp, Artificial Sequence
  chemically synthesized
aatttaaacttagatgattt

SEQ ID NO: 622108 - DNA, 20 bp, Artificial Sequence
  chemically synthesized
agaataagcttagaaatcat

SEQ ID NO: 622109 - DNA, 20 bp, Artificial Sequence
  chemically synthesized
ataatgctacagtcaaaaga

SEQ ID NO: 622110 - DNA, 20 bp, Artificial Sequence
  chemically synthesized
aataagggaataaaatgatt

SEQ ID NO: 622111 - DNA, 20 bp, Artificial Sequence
  chemically synthesized
ctaccctaaataagggaata

SEQ ID NO: 622112 - DNA, 20 bp, Artificial Sequence
  chemically synthesized
aagaactgtgacagtaggtt

SEQ ID NO: 622113 - DNA, 20 bp, Artificial Sequence
  chemically synthesized
caacagtaagaactgtgaca

SEQ ID NO: 622114 - DNA, 20 bp, Artificial Sequence
  chemically synthesized
ctgtcacagttcttactgtt

SEQ ID NO: 622115 - DNA, 20 bp, Artificial Sequence
  chemically synthesized
aataaaagaaaaaatgtctt

SEQ ID NO: 622116 - DNA, 20 bp, Artificial Sequence
  chemically synthesized
ttaaccgaatgatattaata

SEQ ID NO: 622117 - DNA, 20 bp, Artificial Sequence
  chemically synthesized
ttttttccctgtattatcgg

SEQ ID NO: 622118 - DNA, 20 bp, Artificial Sequence
  chemically synthesized
cgataatacagggaaaaaaa

SEQ ID NO: 622119 - DNA, 20 bp, Artificial Sequence
  chemically synthesized
catcagattgcattttcttg

SEQ ID NO: 622120 - DNA, 20 bp, Artificial Sequence
  chemically synthesized
tttggcatcagattgcattt

SEQ ID NO: 622121 - DNA, 20 bp, Artificial Sequence
  chemically synthesized
tcatatttatttgttttggc

SEQ ID NO: 622122 - DNA, 20 bp, Artificial Sequence
  chemically synthesized
tttctctggtcttcatattt

SEQ ID NO: 622123 - DNA, 20 bp, Artificial Sequence
  chemically synthesized
ttagattccagtctttggat

SEQ ID NO: 622124 - DNA, 20 bp, Artificial Sequence
  chemically synthesized
ctaatatcttcatcatttac

SEQ ID NO: 622125 - DNA, 20 bp, Artificial Sequence
  chemically synthesized
aaatgatgaagatattagca

SEQ ID NO: 622126 - DNA, 20 bp, Artificial Sequence
  chemically synthesized
gaggaatccatttaacagaa

SEQ ID NO: 622127 - DNA, 20 bp, Artificial Sequence
  chemically synthesized
tagcaatctgttttctgtta

SEQ ID NO: 622128 - DNA, 20 bp, Artificial Sequence
  chemically synthesized
ttcaaaatattagaaaaaaa

SEQ ID NO: 622129 - DNA, 20 bp, Artificial Sequence
  chemically synthesized
gaaaaaaatcaagtttcaac

SEQ ID NO: 622130 - DNA, 20 bp, Artificial Sequence
  chemically synthesized
taaagcaaaccacagttgaa

SEQ ID NO: 622131 - DNA, 20 bp, Artificial Sequence
  chemically synthesized
aaaatcaagtttcaactgtg

SEQ ID NO: 622132 - DNA, 20 bp, Artificial Sequence
  chemically synthesized
gacaacctcttatttctaaa

SEQ ID NO: 622133 - DNA, 20 bp, Artificial Sequence
  chemically synthesized
atttgtctttctaggttgtg

SEQ ID NO: 622134 - DNA, 20 bp, Artificial Sequence
  chemically synthesized
gcaatatttgtctttctagg

SEQ ID NO: 622135 - DNA, 20 bp, Artificial Sequence
  chemically synthesized
tctcatggaggtagaaagtg

SEQ ID NO: 622136 - DNA, 20 bp, Artificial Sequence
  chemically synthesized
gtggggagggggtgatgaag

SEQ ID NO: 622137 - DNA, 20 bp, Artificial Sequence
  chemically synthesized
ggagggggtgatgaagaggg

SEQ ID NO: 622138 - DNA, 20 bp, Artificial Sequence
  chemically synthesized
accctattgtggtacagaac

SEQ ID NO: 622139 - DNA, 20 bp, Artificial Sequence
  chemically synthesized
tagtgttctgtaccacaata

SEQ ID NO: 622140 - DNA, 20 bp, Artificial Sequence
  chemically synthesized
gattatagttaacaataatt

SEQ ID NO: 622141 - DNA, 20 bp, Artificial Sequence
  chemically synthesized
tcccaacacaaataaatgat

SEQ ID NO: 622142 - DNA, 20 bp, Artificial Sequence
  chemically synthesized
ggtaatgaatattccaatta

SEQ ID NO: 622143 - DNA, 20 bp, Artificial Sequence
  chemically synthesized
tgaatattccaattatcctg

SEQ ID NO: 622144 - DNA, 20 bp, Artificial Sequence
  chemically synthesized
aattatcctgatttgattat

SEQ ID NO: 622145 - DNA, 20 bp, Artificial Sequence
  chemically synthesized
acgtcatcctttgtgatatg

SEQ ID NO: 622146 - DNA, 20 bp, Artificial Sequence
  chemically synthesized
aagctacgtcatcctttgtg

SEQ ID NO: 622147 - DNA, 20 bp, Artificial Sequence
  chemically synthesized
aaacatatcacaaaggatga

SEQ ID NO: 622148 - DNA, 20 bp, Artificial Sequence
  chemically synthesized
atatcacaaaggatgacgta

SEQ ID NO: 622149 - DNA, 20 bp, Artificial Sequence
  chemically synthesized
attaatagtgtatgcaacta

SEQ ID NO: 622150 - DNA, 20 bp, Artificial Sequence
  chemically synthesized
ttagtccatgaaaggaaaat

SEQ ID NO: 622151 - DNA, 20 bp, Artificial Sequence
  chemically synthesized
ccttttgctctctgtgaaaa

SEQ ID NO: 622152 - DNA, 20 bp, Artificial Sequence
  chemically synthesized
agttttcacagagagcaaaa

SEQ ID NO: 622153 - DNA, 20 bp, Artificial Sequence
  chemically synthesized
aagggtgattctatcttgtc

SEQ ID NO: 622154 - DNA, 20 bp, Artificial Sequence
  chemically synthesized
ataccttactccaccatcta

SEQ ID NO: 622155 - DNA, 20 bp, Artificial Sequence
  chemically synthesized
aatctatgatgaaggaaatg

SEQ ID NO: 622156 - DNA, 20 bp, Artificial Sequence
  chemically synthesized
aaacccaccatttccttcat

SEQ ID NO: 622157 - DNA, 20 bp, Artificial Sequence
  chemically synthesized
tcatcatagattaagaaaga

SEQ ID NO: 622158 - DNA, 20 bp, Artificial Sequence
  chemically synthesized
gaagttccaactaccattgt

SEQ ID NO: 622159 - DNA, 20 bp, Artificial Sequence
  chemically synthesized
cataagcatggaaaatagac

SEQ ID NO: 622160 - DNA, 20 bp, Artificial Sequence
  chemically synthesized
ttcaatctattgtctatttt

SEQ ID NO: 622161 - DNA, 20 bp, Artificial Sequence
  chemically synthesized
ctattgtctattttccatgc

SEQ ID NO: 622162 - DNA, 20 bp, Artificial Sequence
  chemically synthesized
atatatgaaataactaacat

SEQ ID NO: 622163 - DNA, 20 bp, Artificial Sequence
  chemically synthesized
atagcctggaaggagccttc

SEQ ID NO: 622164 - DNA, 20 bp, Artificial Sequence
  chemically synthesized
gacactgaatttcttatatt

SEQ ID NO: 622165 - DNA, 20 bp, Artificial Sequence
  chemically synthesized
ttccttctggaaggttcttc

SEQ ID NO: 622166 - DNA, 20 bp, Artificial Sequence
  chemically synthesized
cagctgacatgcctcttcag

SEQ ID NO: 622167 - DNA, 20 bp, Artificial Sequence
  chemically synthesized
gtgagtgattgggtagttat

SEQ ID NO: 622168 - DNA, 20 bp, Artificial Sequence
  chemically synthesized
acaaactgagttgagatagt

SEQ ID NO: 622169 - DNA, 20 bp, Artificial Sequence
  chemically synthesized
ccaatcactcactatctcaa

SEQ ID NO: 622170 - DNA, 20 bp, Artificial Sequence
  chemically synthesized
caatgcaacacttttatctg

SEQ ID NO: 622171 - DNA, 20 bp, Artificial Sequence
  chemically synthesized
acacttttatctgatatgtt

SEQ ID NO: 622172 - DNA, 20 bp, Artificial Sequence
  chemically synthesized
tcacttccatcattgaagat

SEQ ID NO: 622173 - DNA, 20 bp, Artificial Sequence
  chemically synthesized
cagaatagtgcacttaaaaa

SEQ ID NO: 622174 - DNA, 20 bp, Artificial Sequence
  chemically synthesized
gtgtgagttatagctcaata

SEQ ID NO: 622175 - DNA, 20 bp, Artificial Sequence
  chemically synthesized
tcgggagactgaggcaggag

SEQ ID NO: 622176 - DNA, 20 bp, Artificial Sequence
  chemically synthesized
aatatatattttcagtagag

SEQ ID NO: 622177 - DNA, 20 bp, Artificial Sequence
  chemically synthesized
tgccttggcctcccaaagtg

SEQ ID NO: 622178 - DNA, 20 bp, Artificial Sequence
  chemically synthesized
tttcttttttgggctgacga

SEQ ID NO: 622179 - DNA, 20 bp, Artificial Sequence
  chemically synthesized
agagtgattcctaatgagta

SEQ ID NO: 622180 - DNA, 20 bp, Artificial Sequence
  chemically synthesized
ctggggacgtggagaaagga

SEQ ID NO: 622181 - DNA, 20 bp, Artificial Sequence
  chemically synthesized
tctaatcaatacagacagaa

SEQ ID NO: 622182 - DNA, 20 bp, Artificial Sequence
  chemically synthesized
actaatctactttctgtctg

SEQ ID NO: 622183 - DNA, 20 bp, Artificial Sequence
  chemically synthesized
tttaaattatgagatttaca

SEQ ID NO: 622184 - DNA, 20 bp, Artificial Sequence
  chemically synthesized
attatgaaattttttaaatt

SEQ ID NO: 622185 - DNA, 20 bp, Artificial Sequence
  chemically synthesized
ttgagagctaactcagggtt

SEQ ID NO: 622186 - DNA, 20 bp, Artificial Sequence
  chemically synthesized
gttagctgctttatatttct

SEQ ID NO: 622187 - DNA, 20 bp, Artificial Sequence
  chemically synthesized
agaaactaccttctctgtta

SEQ ID NO: 622188 - DNA, 20 bp, Artificial Sequence
  chemically synthesized
ataatcattataacagagaa

SEQ ID NO: 622189 - DNA, 20 bp, Artificial Sequence
  chemically synthesized
tttttccatttgcatctgta

SEQ ID NO: 622190 - DNA, 20 bp, Artificial Sequence
  chemically synthesized
aaatggaaaaactgaggcac

SEQ ID NO: 622191 - DNA, 20 bp, Artificial Sequence
  chemically synthesized
agtttcttaaactcgtgtgc

SEQ ID NO: 622192 - DNA, 20 bp, Artificial Sequence
  chemically synthesized
ttttttaactgtgtagttct

SEQ ID NO: 622193 - DNA, 20 bp, Artificial Sequence
  chemically synthesized
acagttaaaaaatgtagaag

SEQ ID NO: 622194 - DNA, 20 bp, Artificial Sequence
  chemically synthesized
gtagaagtcaggattccaag

SEQ ID NO: 622195 - DNA, 20 bp, Artificial Sequence
  chemically synthesized
agtcgggcttttcagtcttc

SEQ ID NO: 622196 - DNA, 20 bp, Artificial Sequence
  chemically synthesized
catcatttcaatccacaaaa

SEQ ID NO: 622197 - DNA, 20 bp, Artificial Sequence
  chemically synthesized
ttgaggactaagcctatttt

SEQ ID NO: 622198 - DNA, 20 bp, Artificial Sequence
  chemically synthesized
ctaactctgcagtgccctca

SEQ ID NO: 622199 - DNA, 20 bp, Artificial Sequence
  chemically synthesized
ctcgtctcaaaaagaaaaaa

SEQ ID NO: 622200 - DNA, 20 bp, Artificial Sequence
  chemically synthesized
gaggcggaggttgcagtgag

SEQ ID NO: 622201 - DNA, 20 bp, Artificial Sequence
  chemically synthesized
aacctccgcctcccaggttc

SEQ ID NO: 622202 - DNA, 20 bp, Artificial Sequence
  chemically synthesized
tcgggaggctgaggcaggag

SEQ ID NO: 622203 - DNA, 20 bp, Artificial Sequence
  chemically synthesized
tttttattttttagtagaga

SEQ ID NO: 622204 - DNA, 20 bp, Artificial Sequence
  chemically synthesized
cgcctcagcctcccaaagtg

SEQ ID NO: 622205 - DNA, 20 bp, Artificial Sequence
  chemically synthesized
aggagagcaggaagaatatt

SEQ ID NO: 622206 - DNA, 20 bp, Artificial Sequence
  chemically synthesized
tgcacctccctctcattttt

SEQ ID NO: 622207 - DNA, 20 bp, Artificial Sequence
  chemically synthesized
cccctatacatttaaaataa

SEQ ID NO: 622208 - DNA, 20 bp, Artificial Sequence
  chemically synthesized
caaaatacataaacataaac

SEQ ID NO: 622209 - DNA, 20 bp, Artificial Sequence
  chemically synthesized
taaatcaaataatcaagtgt

SEQ ID NO: 622210 - DNA, 20 bp, Artificial Sequence
  chemically synthesized
ataaacataaacacttgatt

SEQ ID NO: 622211 - DNA, 20 bp, Artificial Sequence
  chemically synthesized
taatgctaaatcaaataatc

SEQ ID NO: 622212 - DNA, 20 bp, Artificial Sequence
  chemically synthesized
ggaccttcttctggaactaa

SEQ ID NO: 622213 - DNA, 20 bp, Artificial Sequence
  chemically synthesized
aatagccctgatatttataa

SEQ ID NO: 622214 - DNA, 20 bp, Artificial Sequence
  chemically synthesized
ttttttcatcatttctaaaa

SEQ ID NO: 622215 - DNA, 20 bp, Artificial Sequence
  chemically synthesized
tttgtaaatttagagacaaa

SEQ ID NO: 622216 - DNA, 20 bp, Artificial Sequence
  chemically synthesized
tacttagaaaattgcatgtt

SEQ ID NO: 622217 - DNA, 20 bp, Artificial Sequence
  chemically synthesized
gttattctacttagaaaatt

SEQ ID NO: 622218 - DNA, 20 bp, Artificial Sequence
  chemically synthesized
aattttggtctctggatgtt

SEQ ID NO: 622219 - DNA, 20 bp, Artificial Sequence
  chemically synthesized
gatgttcttggcttttggtc

SEQ ID NO: 622220 - DNA, 20 bp, Artificial Sequence
  chemically synthesized
gcccttcagaaattactggt

SEQ ID NO: 622221 - DNA, 20 bp, Artificial Sequence
  chemically synthesized
gtctgaatagaattttaaga

SEQ ID NO: 622222 - DNA, 20 bp, Artificial Sequence
  chemically synthesized
atgaactttaaaatacagct

SEQ ID NO: 622223 - DNA, 20 bp, Artificial Sequence
  chemically synthesized
gtgcaacatgaactttaaaa

SEQ ID NO: 622224 - DNA, 20 bp, Artificial Sequence
  chemically synthesized
tattttaaagttcatgttgc

SEQ ID NO: 622225 - DNA, 20 bp, Artificial Sequence
  chemically synthesized
agattcatctgaatatctat

SEQ ID NO: 622226 - DNA, 20 bp, Artificial Sequence
  chemically synthesized
ttccttcttcatttctggta

SEQ ID NO: 622227 - DNA, 20 bp, Artificial Sequence
  chemically synthesized
aagaaggaacgctgctaatc

SEQ ID NO: 622228 - DNA, 20 bp, Artificial Sequence
  chemically synthesized
gctgctaatcttgggctttc

SEQ ID NO: 622229 - DNA, 20 bp, Artificial Sequence
  chemically synthesized
gtaatcaaaccaatgaaagc

SEQ ID NO: 622230 - DNA, 20 bp, Artificial Sequence
  chemically synthesized
ctaatcttgggctttcattg

SEQ ID NO: 622231 - DNA, 20 bp, Artificial Sequence
  chemically synthesized
ctttgtttttcagtaaaggc

SEQ ID NO: 622232 - DNA, 20 bp, Artificial Sequence
  chemically synthesized
caattgcctttactgaaaaa

SEQ ID NO: 622233 - DNA, 20 bp, Artificial Sequence
  chemically synthesized
ttactgtgcttctttcgaaa

SEQ ID NO: 622234 - DNA, 20 bp, Artificial Sequence
  chemically synthesized
tgattgtctcttggagttta

SEQ ID NO: 622235 - DNA, 20 bp, Artificial Sequence
  chemically synthesized
agattgaattgattgtctct

SEQ ID NO: 622236 - DNA, 20 bp, Artificial Sequence
  chemically synthesized
cagggaggtgtgtaagattg

SEQ ID NO: 622237 - DNA, 20 bp, Artificial Sequence
  chemically synthesized
aaactatggcagggaggtgt

SEQ ID NO: 622238 - DNA, 20 bp, Artificial Sequence
  chemically synthesized
aatcttacacacctccctgc

SEQ ID NO: 622239 - DNA, 20 bp, Artificial Sequence
  chemically synthesized
gaaatatcaaccgtcttctc

SEQ ID NO: 622240 - DNA, 20 bp, Artificial Sequence
  chemically synthesized
tcaagtgctggatattctat

SEQ ID NO: 622241 - DNA, 20 bp, Artificial Sequence
  chemically synthesized
ttgactgcccatatttttca

SEQ ID NO: 622242 - DNA, 20 bp, Artificial Sequence
  chemically synthesized
taaatagtctacacgagcgt

SEQ ID NO: 622243 - DNA, 20 bp, Artificial Sequence
  chemically synthesized
ttggactttttccctatcag

SEQ ID NO: 622244 - DNA, 20 bp, Artificial Sequence
  chemically synthesized
tatttaatttaactctactt

SEQ ID NO: 622245 - DNA, 20 bp, Artificial Sequence
  chemically synthesized
ttaaattaaataaaagaagg

SEQ ID NO: 622246 - DNA, 20 bp, Artificial Sequence
  chemically synthesized
aaaagttagagaacgaacaa

SEQ ID NO: 622247 - DNA, 20 bp, Artificial Sequence
  chemically synthesized
cattcctatatattaaatgt

SEQ ID NO: 622248 - DNA, 20 bp, Artificial Sequence
  chemically synthesized
ttctaattttttattattca

SEQ ID NO: 622249 - DNA, 20 bp, Artificial Sequence
  chemically synthesized
gttaaatggagatccattaa

SEQ ID NO: 622250 - DNA, 20 bp, Artificial Sequence
  chemically synthesized
gatctccatttaactgaatc

SEQ ID NO: 622251 - DNA, 20 bp, Artificial Sequence
  chemically synthesized
atggagagctttggttaatc

SEQ ID NO: 622252 - DNA, 20 bp, Artificial Sequence
  chemically synthesized
taaatctaacaaagggaatg

SEQ ID NO: 622253 - DNA, 20 bp, Artificial Sequence
  chemically synthesized
caaagctctccattcccttt

SEQ ID NO: 622254 - DNA, 20 bp, Artificial Sequence
  chemically synthesized
ctcatagagagatttctagt

SEQ ID NO: 622255 - DNA, 20 bp, Artificial Sequence
  chemically synthesized
catacgatttatctctcata

SEQ ID NO: 622256 - DNA, 20 bp, Artificial Sequence
  chemically synthesized
ctctctatgagagataaatc

SEQ ID NO: 622257 - DNA, 20 bp, Artificial Sequence
  chemically synthesized
agagataaatcgtatgcttt

SEQ ID NO: 622258 - DNA, 20 bp, Artificial Sequence
  chemically synthesized
tatctttaatccgccaaagc

SEQ ID NO: 622259 - DNA, 20 bp, Artificial Sequence
  chemically synthesized
cttcactggggaggtaaagt

SEQ ID NO: 622260 - DNA, 20 bp, Artificial Sequence
  chemically synthesized
gcctttttggcaccagagac

SEQ ID NO: 622261 - DNA, 20 bp, Artificial Sequence
  chemically synthesized
tcatagaatcagtgggagcc

SEQ ID NO: 622262 - DNA, 20 bp, Artificial Sequence
  chemically synthesized
gaaagaaagctcagggctcc

SEQ ID NO: 622263 - DNA, 20 bp, Artificial Sequence
  chemically synthesized
acagtgacacatcatcagtc

SEQ ID NO: 622264 - DNA, 20 bp, Artificial Sequence
  chemically synthesized
ctgcctcctgtcagatcagc

SEQ ID NO: 622265 - DNA, 20 bp, Artificial Sequence
  chemically synthesized
gaagtggctgtaaatacaga

SEQ ID NO: 622266 - DNA, 20 bp, Artificial Sequence
  chemically synthesized
ggaggcgagcggtgagccag

SEQ ID NO: 622267 - DNA, 20 bp, Artificial Sequence
  chemically synthesized
tgcagtgaaagagctgctgt

SEQ ID NO: 622268 - DNA, 20 bp, Artificial Sequence
  chemically synthesized
tgatacaaaagacggaaaat

SEQ ID NO: 622269 - DNA, 20 bp, Artificial Sequence
  chemically synthesized
gcctcttcagcatggtagac

SEQ ID NO: 622270 - DNA, 20 bp, Artificial Sequence
  chemically synthesized
gacagctgtactcatatgta

SEQ ID NO: 622271 - DNA, 20 bp, Artificial Sequence
  chemically synthesized
atacatatgagtacagctgt

SEQ ID NO: 622272 - DNA, 20 bp, Artificial Sequence
  chemically synthesized
aatttgagcgtgggtcaact

SEQ ID NO: 622273 - DNA, 20 bp, Artificial Sequence
  chemically synthesized
caccagtcactttttatagc

SEQ ID NO: 622274 - DNA, 20 bp, Artificial Sequence
  chemically synthesized
catgagctataaaaagtgac

SEQ ID NO: 622275 - DNA, 20 bp, Artificial Sequence
  chemically synthesized
gtgactggtgttttaagcta

SEQ ID NO: 622276 - DNA, 20 bp, Artificial Sequence
  chemically synthesized
aacaatttattataaaactt

SEQ ID NO: 622277 - DNA, 20 bp, Artificial Sequence
  chemically synthesized
cggaacatagcaagaatcaa

SEQ ID NO: 622278 - DNA, 20 bp, Artificial Sequence
  chemically synthesized
gcaggaatgggaacaatcac

SEQ ID NO: 622279 - DNA, 20 bp, Artificial Sequence
  chemically synthesized
ctaatatccctctcccaaag

SEQ ID NO: 622280 - DNA, 20 bp, Artificial Sequence
  chemically synthesized
attgaaggaatcccctctta

SEQ ID NO: 622281 - DNA, 20 bp, Artificial Sequence
  chemically synthesized
catttgcaaaacaatttaag

SEQ ID NO: 622282 - DNA, 20 bp, Artificial Sequence
  chemically synthesized
cagattagagacttgtacgt

SEQ ID NO: 622283 - DNA, 20 bp, Artificial Sequence
  chemically synthesized
gtggtacagattagagactt

SEQ ID NO: 622284 - DNA, 20 bp, Artificial Sequence
  chemically synthesized
aaatcaagaggatttggtgg

SEQ ID NO: 622285 - DNA, 20 bp, Artificial Sequence
  chemically synthesized
taatctgtaccaccaaatcc

SEQ ID NO: 622286 - DNA, 20 bp, Artificial Sequence
  chemically synthesized
agtaagagatcataaaatca

SEQ ID NO: 622287 - DNA, 20 bp, Artificial Sequence
  chemically synthesized
ggctcactgcaacctctgcc

SEQ ID NO: 622288 - DNA, 20 bp, Artificial Sequence
  chemically synthesized
caacctctgccttcagtttc

SEQ ID NO: 622289 - DNA, 20 bp, Artificial Sequence
  chemically synthesized
tgcctcagcctcctgagtag

SEQ ID NO: 622290 - DNA, 20 bp, Artificial Sequence
  chemically synthesized
accacgcccggctaatcttt

SEQ ID NO: 622291 - DNA, 20 bp, Artificial Sequence
  chemically synthesized
ccccaactctactaaacata

SEQ ID NO: 622292 - DNA, 20 bp, Artificial Sequence
  chemically synthesized
ctttgtatgtttagtagagt

SEQ ID NO: 622293 - DNA, 20 bp, Artificial Sequence
  chemically synthesized
gcctcggcctcccaaaaatg

SEQ ID NO: 622294 - DNA, 20 bp, Artificial Sequence
  chemically synthesized
ggaacaatcttctctatcta

SEQ ID NO: 622295 - DNA, 20 bp, Artificial Sequence
  chemically synthesized
acaagaagccaactagatag

SEQ ID NO: 622296 - DNA, 20 bp, Artificial Sequence
  chemically synthesized
ctagttggcttcttgtctcg

SEQ ID NO: 622297 - DNA, 20 bp, Artificial Sequence
  chemically synthesized
tcttttccaggccctagtat

SEQ ID NO: 622298 - DNA, 20 bp, Artificial Sequence
  chemically synthesized
attaacctaccaaattactg

SEQ ID NO: 622299 - DNA, 20 bp, Artificial Sequence
  chemically synthesized
gtcctgattgtgggaaatca

SEQ ID NO: 622300 - DNA, 20 bp, Artificial Sequence
  chemically synthesized
tttgcttcagggtaaaagcc

SEQ ID NO: 622301 - DNA, 20 bp, Artificial Sequence
  chemically synthesized
tagtctatttctctgttgtg

SEQ ID NO: 622302 - DNA, 20 bp, Artificial Sequence
  chemically synthesized
aaaatagtctatttctctgt

SEQ ID NO: 622303 - DNA, 20 bp, Artificial Sequence
  chemically synthesized
gaaatagactattttgaagc

SEQ ID NO: 622304 - DNA, 20 bp, Artificial Sequence
  chemically synthesized
ctatatgtgatctcctaaac

SEQ ID NO: 622305 - DNA, 20 bp, Artificial Sequence
  chemically synthesized
ttcttcttaatagtctggta

SEQ ID NO: 622306 - DNA, 20 bp, Artificial Sequence
  chemically synthesized
ccagactattaagaagaact

SEQ ID NO: 622307 - DNA, 20 bp, Artificial Sequence
  chemically synthesized
gcagtgataaggagaggtca

SEQ ID NO: 622308 - DNA, 20 bp, Artificial Sequence
  chemically synthesized
tccattcaaaaatacatgaa

SEQ ID NO: 622309 - DNA, 20 bp, Artificial Sequence
  chemically synthesized
gctgtactcatctagaggga

SEQ ID NO: 622310 - DNA, 20 bp, Artificial Sequence
  chemically synthesized
aaagtccctctagatgagta

SEQ ID NO: 622311 - DNA, 20 bp, Artificial Sequence
  chemically synthesized
tccctctagatgagtacagc

SEQ ID NO: 622312 - DNA, 20 bp, Artificial Sequence
  chemically synthesized
ctacactatttcaggtaacc

SEQ ID NO: 622313 - DNA, 20 bp, Artificial Sequence
  chemically synthesized
acttatatgtttcagacaag

SEQ ID NO: 622314 - DNA, 20 bp, Artificial Sequence
  chemically synthesized
ccagagacctgtcataactt

SEQ ID NO: 622315 - DNA, 20 bp, Artificial Sequence
  chemically synthesized
tgtttggtgacacaagtaaa

SEQ ID NO: 622316 - DNA, 20 bp, Artificial Sequence
  chemically synthesized
gtcagcagctaaaatgtaag

SEQ ID NO: 622317 - DNA, 20 bp, Artificial Sequence
  chemically synthesized
gtattaatacagaatattat

SEQ ID NO: 622318 - DNA, 20 bp, Artificial Sequence
  chemically synthesized
tcaattaaatctgaatagtg

SEQ ID NO: 622319 - DNA, 20 bp, Artificial Sequence
  chemically synthesized
taaataaaatctagtcacta

SEQ ID NO: 622320 - DNA, 20 bp, Artificial Sequence
  chemically synthesized
cagctgcctgaaggcagaga

SEQ ID NO: 622321 - DNA, 20 bp, Artificial Sequence
  chemically synthesized
gagctagaatttgaccccag

SEQ ID NO: 622322 - DNA, 20 bp, Artificial Sequence
  chemically synthesized
ttttaaactgctttattgag

SEQ ID NO: 622323 - DNA, 20 bp, Artificial Sequence
  chemically synthesized
tgccaatcatacctcaataa

SEQ ID NO: 622324 - DNA, 20 bp, Artificial Sequence
  chemically synthesized
attgattcttcagtttttta

SEQ ID NO: 622325 - DNA, 20 bp, Artificial Sequence
  chemically synthesized
tcttcagaaataattgattc

SEQ ID NO: 622326 - DNA, 20 bp, Artificial Sequence
  chemically synthesized
tcttttttttcttcagaaat

SEQ ID NO: 622327 - DNA, 20 bp, Artificial Sequence
  chemically synthesized
tcccatgcctgccactttgt

SEQ ID NO: 622328 - DNA, 20 bp, Artificial Sequence
  chemically synthesized
catggtccatattcagagct

SEQ ID NO: 622329 - DNA, 20 bp, Artificial Sequence
  chemically synthesized
attaaaagaaaatattttca

SEQ ID NO: 622330 - DNA, 20 bp, Artificial Sequence
  chemically synthesized
aaaatattttcttttaataa

SEQ ID NO: 622331 - DNA, 20 bp, Artificial Sequence
  chemically synthesized
aattttgaaaaaagtaatca

SEQ ID NO: 622332 - DNA, 20 bp, Artificial Sequence
  chemically synthesized
gtcagtagtacagcaaatct

SEQ ID NO: 622333 - DNA, 20 bp, Artificial Sequence
  chemically synthesized
actgtatgttctttacattt

SEQ ID NO: 622334 - DNA, 20 bp, Artificial Sequence
  chemically synthesized
atgttctttacatttgtatg

SEQ ID NO: 622335 - DNA, 20 bp, Artificial Sequence
  chemically synthesized
aactatacaatatcttacct

SEQ ID NO: 622336 - DNA, 20 bp, Artificial Sequence
  chemically synthesized
aggtaagatattgtatagtt

SEQ ID NO: 622337 - DNA, 20 bp, Artificial Sequence
  chemically synthesized
gaggcagaggttgcagtgag

SEQ ID NO: 622338 - DNA, 20 bp, Artificial Sequence
  chemically synthesized
aacctctgcctcccaggttc

SEQ ID NO: 622339 - DNA, 20 bp, Artificial Sequence
  chemically synthesized
tgcctcagcctcccaggtag

SEQ ID NO: 622340 - DNA, 20 bp, Artificial Sequence
  chemically synthesized
ttttgtatttttagtagaga

SEQ ID NO: 622341 - DNA, 20 bp, Artificial Sequence
  chemically synthesized
cattttgggaggccaaggca

SEQ ID NO: 622342 - DNA, 20 bp, Artificial Sequence
  chemically synthesized
tgccttggcctcccaaaatg

SEQ ID NO: 622343 - DNA, 20 bp, Artificial Sequence
  chemically synthesized
agtgtgagccactgtacctg

SEQ ID NO: 622344 - DNA, 20 bp, Artificial Sequence
  chemically synthesized
tatttttctaatgagaaaat

SEQ ID NO: 622345 - DNA, 20 bp, Artificial Sequence
  chemically synthesized
agcttgttgagagccacaca

SEQ ID NO: 622346 - DNA, 20 bp, Artificial Sequence
  chemically synthesized
ttgagagccacacacggagt

SEQ ID NO: 622347 - DNA, 20 bp, Artificial Sequence
  chemically synthesized
taaagtgtgtggaagccctc

SEQ ID NO: 622348 - DNA, 20 bp, Artificial Sequence
  chemically synthesized
tccacatgtaaaaatctcca

SEQ ID NO: 622349 - DNA, 20 bp, Artificial Sequence
  chemically synthesized
ggttttccatacgtgaactt

SEQ ID NO: 622350 - DNA, 20 bp, Artificial Sequence
  chemically synthesized
gtgttacagcaatgggtctt

SEQ ID NO: 622351 - DNA, 20 bp, Artificial Sequence
  chemically synthesized
tggtcattccaaacgagaaa

SEQ ID NO: 622352 - DNA, 20 bp, Artificial Sequence
  chemically synthesized
tcctggaatgaagcagcttt

SEQ ID NO: 622353 - DNA, 20 bp, Artificial Sequence
  chemically synthesized
caatatgattcctggaatga

SEQ ID NO: 622354 - DNA, 20 bp, Artificial Sequence
  chemically synthesized
tctggtgaattataatagca

SEQ ID NO: 622355 - DNA, 20 bp, Artificial Sequence
  chemically synthesized
ctattggaggaaaagaaagt

SEQ ID NO: 622356 - DNA, 20 bp, Artificial Sequence
  chemically synthesized
ccattgtattttttttgtac

SEQ ID NO: 622357 - DNA, 20 bp, Artificial Sequence
  chemically synthesized
acaaaaaaaatacaatggaa

SEQ ID NO: 622358 - DNA, 20 bp, Artificial Sequence
  chemically synthesized
ttctgtcttctcaatgggat

SEQ ID NO: 622359 - DNA, 20 bp, Artificial Sequence
  chemically synthesized
tattgccttctgtcttctca

SEQ ID NO: 622360 - DNA, 20 bp, Artificial Sequence
  chemically synthesized
aaattttcccttgcataatg

SEQ ID NO: 622361 - DNA, 20 bp, Artificial Sequence
  chemically synthesized
attatgcaagggaaaatttg

SEQ ID NO: 622362 - DNA, 20 bp, Artificial Sequence
  chemically synthesized
gtgcagcatttactacagac

SEQ ID NO: 622363 - DNA, 20 bp, Artificial Sequence
  chemically synthesized
atataaatgatttgtagccc

SEQ ID NO: 622364 - DNA, 20 bp, Artificial Sequence
  chemically synthesized
atattttttctctgaaatat

SEQ ID NO: 622365 - DNA, 20 bp, Artificial Sequence
  chemically synthesized
tgagccaacgccccctgcct

SEQ ID NO: 622366 - DNA, 20 bp, Artificial Sequence
  chemically synthesized
tgcctcggcctcccaaagtt

SEQ ID NO: 622367 - DNA, 20 bp, Artificial Sequence
  chemically synthesized
caggcggatcacctaaggtt

SEQ ID NO: 622368 - DNA, 20 bp, Artificial Sequence
  chemically synthesized
gcctgaccaacatggagaaa

SEQ ID NO: 622369 - DNA, 20 bp, Artificial Sequence
  chemically synthesized
ctttgtatttttaatagaaa

SEQ ID NO: 622370 - DNA, 20 bp, Artificial Sequence
  chemically synthesized
tgcctcagcctcccaagtag

SEQ ID NO: 622371 - DNA, 20 bp, Artificial Sequence
  chemically synthesized
aacctccacctcctgggttc

SEQ ID NO: 622372 - DNA, 20 bp, Artificial Sequence
  chemically synthesized
tttgtttgtttgttttgaga

SEQ ID NO: 622373 - DNA, 20 bp, Artificial Sequence
  chemically synthesized
ttgttttgttttgtttgttt

SEQ ID NO: 622374 - DNA, 20 bp, Artificial Sequence
  chemically synthesized
agttttgttttgttttgttt

SEQ ID NO: 622375 - DNA, 20 bp, Artificial Sequence
  chemically synthesized
atacagttttgttttgtttt

SEQ ID NO: 622376 - DNA, 20 bp, Artificial Sequence
  chemically synthesized
ggaaatacagttttgttttg

SEQ ID NO: 622377 - DNA, 20 bp, Artificial Sequence
  chemically synthesized
ttgtgggaaatacagttttg

SEQ ID NO: 622378 - DNA, 20 bp, Artificial Sequence
  chemically synthesized
gtctcttgtgggaaatacag

SEQ ID NO: 622379 - DNA, 20 bp, Artificial Sequence
  chemically synthesized
ttaatgtctcttgtgggaaa

SEQ ID NO: 622380 - DNA, 20 bp, Artificial Sequence
  chemically synthesized
cacaagagacattaaactat

SEQ ID NO: 622381 - DNA, 20 bp, Artificial Sequence
  chemically synthesized
aggtagtaaataaaaacaaa

SEQ ID NO: 622382 - DNA, 20 bp, Artificial Sequence
  chemically synthesized
attgatatatcccagttttc

SEQ ID NO: 622383 - DNA, 20 bp, Artificial Sequence
  chemically synthesized
ctttaagataattgatatat

SEQ ID NO: 622384 - DNA, 20 bp, Artificial Sequence
  chemically synthesized
aagatattcctgaaacatac

SEQ ID NO: 622385 - DNA, 20 bp, Artificial Sequence
  chemically synthesized
atttcaatattaaatcttaa

SEQ ID NO: 622386 - DNA, 20 bp, Artificial Sequence
  chemically synthesized
gatttaatattgaaatatat

SEQ ID NO: 622387 - DNA, 20 bp, Artificial Sequence
  chemically synthesized
ttgtttaaaaatacattaaa

SEQ ID NO: 622388 - DNA, 20 bp, Artificial Sequence
  chemically synthesized
attgccttcataatgtgccc

SEQ ID NO: 622389 - DNA, 20 bp, Artificial Sequence
  chemically synthesized
tccatcaatttttcatcaat

SEQ ID NO: 622390 - DNA, 20 bp, Artificial Sequence
  chemically synthesized
ttttcaagtgtatagataaa

SEQ ID NO: 622391 - DNA, 20 bp, Artificial Sequence
  chemically synthesized
tgctatcttttcaagatccc

SEQ ID NO: 622392 - DNA, 20 bp, Artificial Sequence
  chemically synthesized
agatgtctgtgcctttctgc

SEQ ID NO: 622393 - DNA, 20 bp, Artificial Sequence
  chemically synthesized
tagccagaaggagcagtatg

SEQ ID NO: 622394 - DNA, 20 bp, Artificial Sequence
  chemically synthesized
ttgccatactgctccttctg

SEQ ID NO: 622395 - DNA, 20 bp, Artificial Sequence
  chemically synthesized
tttttagcaagattcttgga

SEQ ID NO: 622396 - DNA, 20 bp, Artificial Sequence
  chemically synthesized
taacacagctgatattttta

SEQ ID NO: 622397 - DNA, 20 bp, Artificial Sequence
  chemically synthesized
aaaatagaatgtttgaaaga

SEQ ID NO: 622398 - DNA, 20 bp, Artificial Sequence
  chemically synthesized
aaacctaattttgaaaaata

SEQ ID NO: 622399 - DNA, 20 bp, Artificial Sequence
  chemically synthesized
aaacattctatttttcaaaa

SEQ ID NO: 622400 - DNA, 20 bp, Artificial Sequence
  chemically synthesized
tgcctcggcctcccaaagtg

SEQ ID NO: 622401 - DNA, 20 bp, Artificial Sequence
  chemically synthesized
ttttgtatttttagtagaga

SEQ ID NO: 622402 - DNA, 20 bp, Artificial Sequence
  chemically synthesized
tgcctcagcctcctaagtag

SEQ ID NO: 622403 - DNA, 20 bp, Artificial Sequence
  chemically synthesized
ttaggaggctgaggcaggag

SEQ ID NO: 622404 - DNA, 20 bp, Artificial Sequence
  chemically synthesized
ctactaatttttttcttagt

SEQ ID NO: 622405 - DNA, 20 bp, Artificial Sequence
  chemically synthesized
gcaaagtcaggtctcagagc

SEQ ID NO: 622406 - DNA, 20 bp, Artificial Sequence
  chemically synthesized
agtctttgaatttagtctaa

SEQ ID NO: 622407 - DNA, 20 bp, Artificial Sequence
  chemically synthesized
tggcagggagctagaaagat

SEQ ID NO: 622408 - DNA, 20 bp, Artificial Sequence
  chemically synthesized
atctttgtggcagggagcta

SEQ ID NO: 622409 - DNA, 20 bp, Artificial Sequence
  chemically synthesized
actatggaatatttcactat

SEQ ID NO: 622410 - DNA, 20 bp, Artificial Sequence
  chemically synthesized
ttcactattcctgttttatt

SEQ ID NO: 622411 - DNA, 20 bp, Artificial Sequence
  chemically synthesized
aaatttctgtctccttgttt

SEQ ID NO: 622412 - DNA, 20 bp, Artificial Sequence
  chemically synthesized
aagatataaaatttctgtct

SEQ ID NO: 622413 - DNA, 20 bp, Artificial Sequence
  chemically synthesized
aaaggtcagtataattgata

SEQ ID NO: 622414 - DNA, 20 bp, Artificial Sequence
  chemically synthesized
ttgtaggcatttctttatat

SEQ ID NO: 622415 - DNA, 20 bp, Artificial Sequence
  chemically synthesized
tctttatatttgtgtttttt

SEQ ID NO: 622416 - DNA, 20 bp, Artificial Sequence
  chemically synthesized
ttggcaaaagaccccatgaa

SEQ ID NO: 622417 - DNA, 20 bp, Artificial Sequence
  chemically synthesized
aatgacaattggattgtaaa

SEQ ID NO: 622418 - DNA, 20 bp, Artificial Sequence
  chemically synthesized
atatcctcttagaaatgaca

SEQ ID NO: 622419 - DNA, 20 bp, Artificial Sequence
  chemically synthesized
atcactaaaaataagaatgt

SEQ ID NO: 622420 - DNA, 20 bp, Artificial Sequence
  chemically synthesized
aacaatgacattcttatttt

SEQ ID NO: 622421 - DNA, 20 bp, Artificial Sequence
  chemically synthesized
ttaattacattttcttatcc

SEQ ID NO: 622422 - DNA, 20 bp, Artificial Sequence
  chemically synthesized
acaaaattatcagagacatg

SEQ ID NO: 622423 - DNA, 20 bp, Artificial Sequence
  chemically synthesized
gaagtacaagacaaaactaa

SEQ ID NO: 622424 - DNA, 20 bp, Artificial Sequence
  chemically synthesized
aagacaaaactaaccttgat

SEQ ID NO: 622425 - DNA, 20 bp, Artificial Sequence
  chemically synthesized
gattataagcagaaatcaag

SEQ ID NO: 622426 - DNA, 20 bp, Artificial Sequence
  chemically synthesized
tgtgaatccatggggagaat

SEQ ID NO: 622427 - DNA, 20 bp, Artificial Sequence
  chemically synthesized
ttataatcttacattctccc

SEQ ID NO: 622428 - DNA, 20 bp, Artificial Sequence
  chemically synthesized
catggattcacacagctcta

SEQ ID NO: 622429 - DNA, 20 bp, Artificial Sequence
  chemically synthesized
tctctgaaaaatgaatgcct

SEQ ID NO: 622430 - DNA, 20 bp, Artificial Sequence
  chemically synthesized
gggagggaaaaattctcctt

SEQ ID NO: 622431 - DNA, 20 bp, Artificial Sequence
  chemically synthesized
tgcaacaatgattgatattg

SEQ ID NO: 622432 - DNA, 20 bp, Artificial Sequence
  chemically synthesized
ttcacaatatcaatcattgt

SEQ ID NO: 622433 - DNA, 20 bp, Artificial Sequence
  chemically synthesized
tgtctatgtctaagctgcaa

SEQ ID NO: 622434 - DNA, 20 bp, Artificial Sequence
  chemically synthesized
tgttgcagcttagacataga

SEQ ID NO: 622435 - DNA, 20 bp, Artificial Sequence
  chemically synthesized
gaggcggaggttgcagtgag

SEQ ID NO: 622436 - DNA, 20 bp, Artificial Sequence
  chemically synthesized
gctcactgcaacctccgcct

SEQ ID NO: 622437 - DNA, 20 bp, Artificial Sequence
  chemically synthesized
aacctccgcctcccagattc

SEQ ID NO: 622438 - DNA, 20 bp, Artificial Sequence
  chemically synthesized
tcaggaggccaaggcaggag

SEQ ID NO: 622439 - DNA, 20 bp, Artificial Sequence
  chemically synthesized
ttttgtatttttaatagaga

SEQ ID NO: 622440 - DNA, 20 bp, Artificial Sequence
  chemically synthesized
cccctgacctcaggtgatcc

SEQ ID NO: 622441 - DNA, 20 bp, Artificial Sequence
  chemically synthesized
tgctttggcctcccaaagtg

SEQ ID NO: 622442 - DNA, 20 bp, Artificial Sequence
  chemically synthesized
cctcccaaagtgctgggatt

SEQ ID NO: 622443 - DNA, 20 bp, Artificial Sequence
  chemically synthesized
cagagcctcctgtggtagca

SEQ ID NO: 622444 - DNA, 20 bp, Artificial Sequence
  chemically synthesized
tgggaagatcacttgaggcc

SEQ ID NO: 622445 - DNA, 20 bp, Artificial Sequence
  chemically synthesized
ctcctgggctaaagtgatcc

SEQ ID NO: 622446 - DNA, 20 bp, Artificial Sequence
  chemically synthesized
caggaggatcactttagccc

SEQ ID NO: 622447 - DNA, 20 bp, Artificial Sequence
  chemically synthesized
atcactttagcccaggagtt

SEQ ID NO: 622448 - DNA, 20 bp, Artificial Sequence
  chemically synthesized
tcagtgagcagatcgcgcca

SEQ ID NO: 622449 - DNA, 20 bp, Artificial Sequence
  chemically synthesized
atgcagccacttggaaccaa

SEQ ID NO: 622450 - DNA, 20 bp, Artificial Sequence
  chemically synthesized
ataattgactgcaaatggct

SEQ ID NO: 622451 - DNA, 20 bp, Artificial Sequence
  chemically synthesized
tattttcactttttttaaat

SEQ ID NO: 622452 - DNA, 20 bp, Artificial Sequence
  chemically synthesized
tgtgattttgtgaacacaat

SEQ ID NO: 622453 - DNA, 20 bp, Artificial Sequence
  chemically synthesized
tcatttgatgtacatgtatt

SEQ ID NO: 622454 - DNA, 20 bp, Artificial Sequence
  chemically synthesized
ggagtattctcagagatgaa

SEQ ID NO: 622455 - DNA, 20 bp, Artificial Sequence
  chemically synthesized
ttccattgatactcagatgg

SEQ ID NO: 622456 - DNA, 20 bp, Artificial Sequence
  chemically synthesized
agaattccttttaataaaga

SEQ ID NO: 622457 - DNA, 20 bp, Artificial Sequence
  chemically synthesized
gtagtgatgtaagtacattc

SEQ ID NO: 622458 - DNA, 20 bp, Artificial Sequence
  chemically synthesized
tcttcagggctcaaatattt

SEQ ID NO: 622459 - DNA, 20 bp, Artificial Sequence
  chemically synthesized
atttaaccttcaccatggca

SEQ ID NO: 622460 - DNA, 20 bp, Artificial Sequence
  chemically synthesized
ctggctctcttgcttatctt

SEQ ID NO: 622461 - DNA, 20 bp, Artificial Sequence
  chemically synthesized
ctttgaagataagcaagaga

SEQ ID NO: 622462 - DNA, 20 bp, Artificial Sequence
  chemically synthesized
ttttatttttaatctggctc

SEQ ID NO: 622463 - DNA, 20 bp, Artificial Sequence
  chemically synthesized
cccattctttcctccttcta

SEQ ID NO: 622464 - DNA, 20 bp, Artificial Sequence
  chemically synthesized
aagtagaaggaggaaagaat

SEQ ID NO: 622465 - DNA, 20 bp, Artificial Sequence
  chemically synthesized
catcagcaagagcacattat

SEQ ID NO: 622466 - DNA, 20 bp, Artificial Sequence
  chemically synthesized
gtaaataactgtatcttctc

SEQ ID NO: 622467 - DNA, 20 bp, Artificial Sequence
  chemically synthesized
atatcagcaagggcatttga

SEQ ID NO: 622468 - DNA, 20 bp, Artificial Sequence
  chemically synthesized
attggcctgacccacaattc

SEQ ID NO: 622469 - DNA, 20 bp, Artificial Sequence
  chemically synthesized
acattttcttgaaggtaccc

SEQ ID NO: 622470 - DNA, 20 bp, Artificial Sequence
  chemically synthesized
agcttactgttccattggac

SEQ ID NO: 622471 - DNA, 20 bp, Artificial Sequence
  chemically synthesized
aactgatgtccaatggaaca

SEQ ID NO: 622472 - DNA, 20 bp, Artificial Sequence
  chemically synthesized
ctataaagaatgtgaactgt

SEQ ID NO: 622473 - DNA, 20 bp, Artificial Sequence
  chemically synthesized
cacattctttatagataata

SEQ ID NO: 622474 - DNA, 20 bp, Artificial Sequence
  chemically synthesized
taaattcatttccatgatgt

SEQ ID NO: 622475 - DNA, 20 bp, Artificial Sequence
  chemically synthesized
aaaaagtactacaaactggg

SEQ ID NO: 622476 - DNA, 20 bp, Artificial Sequence
  chemically synthesized
acaaacaactacaaacccta

SEQ ID NO: 622477 - DNA, 20 bp, Artificial Sequence
  chemically synthesized
acaaactgggtagggtttgt

SEQ ID NO: 622478 - DNA, 20 bp, Artificial Sequence
  chemically synthesized
actgggtagggtttgtagtt

SEQ ID NO: 622479 - DNA, 20 bp, Artificial Sequence
  chemically synthesized
ggtagggtttgtagttgttt

SEQ ID NO: 622480 - DNA, 20 bp, Artificial Sequence
  chemically synthesized
gccaccagaactgggagaca

SEQ ID NO: 622481 - DNA, 20 bp, Artificial Sequence
  chemically synthesized
agagcatggccctgctaata

SEQ ID NO: 622482 - DNA, 20 bp, Artificial Sequence
  chemically synthesized
agtctgttccgtgcctcttt

SEQ ID NO: 622483 - DNA, 20 bp, Artificial Sequence
  chemically synthesized
gccagcaatccttgccattc

SEQ ID NO: 622484 - DNA, 20 bp, Artificial Sequence
  chemically synthesized
gtctataagccaaagaatgg

SEQ ID NO: 622485 - DNA, 20 bp, Artificial Sequence
  chemically synthesized
ctcgggatagcctctgtcat

SEQ ID NO: 622486 - DNA, 20 bp, Artificial Sequence
  chemically synthesized
cttataaggacatcagccat

SEQ ID NO: 622487 - DNA, 20 bp, Artificial Sequence
  chemically synthesized
tggaacttcaaaaatgtggt

SEQ ID NO: 622488 - DNA, 20 bp, Artificial Sequence
  chemically synthesized
cttttctggaacttcaaaaa

SEQ ID NO: 622489 - DNA, 20 bp, Artificial Sequence
  chemically synthesized
attgacagcagtcagttcat

SEQ ID NO: 622490 - DNA, 20 bp, Artificial Sequence
  chemically synthesized
gaactgactgctgtcaatct

SEQ ID NO: 622491 - DNA, 20 bp, Artificial Sequence
  chemically synthesized
gagtagtggagttgaaaact

SEQ ID NO: 622492 - DNA, 20 bp, Artificial Sequence
  chemically synthesized
gtttctcattcaatacatat

SEQ ID NO: 622493 - DNA, 20 bp, Artificial Sequence
  chemically synthesized
ctttacttttaccagctagg

SEQ ID NO: 622494 - DNA, 20 bp, Artificial Sequence
  chemically synthesized
cacctcagcctcccaaagtg

SEQ ID NO: 622495 - DNA, 20 bp, Artificial Sequence
  chemically synthesized
ttttgtatttttagtagaga

SEQ ID NO: 622496 - DNA, 20 bp, Artificial Sequence
  chemically synthesized
cgcctcagcctccagggtag

SEQ ID NO: 622497 - DNA, 20 bp, Artificial Sequence
  chemically synthesized
cctggaggctgaggcgggag

SEQ ID NO: 622498 - DNA, 20 bp, Artificial Sequence
  chemically synthesized
aacctccacctcctgggttt

SEQ ID NO: 622499 - DNA, 20 bp, Artificial Sequence
  chemically synthesized
ctcactgcaacctccacctc

SEQ ID NO: 622500 - DNA, 20 bp, Artificial Sequence
  chemically synthesized
tttactttctttttttgaga

SEQ ID NO: 622501 - DNA, 20 bp, Artificial Sequence
  chemically synthesized
aaatcctgcctgatttactc

SEQ ID NO: 622502 - DNA, 20 bp, Artificial Sequence
  chemically synthesized
gaagctaaagagtaaatcag

SEQ ID NO: 622503 - DNA, 20 bp, Artificial Sequence
  chemically synthesized
ttctctgcccagaaaatcct

SEQ ID NO: 622504 - DNA, 20 bp, Artificial Sequence
  chemically synthesized
ggattttctgggcagagaag

SEQ ID NO: 622505 - DNA, 20 bp, Artificial Sequence
  chemically synthesized
gtttgatttctgtgtacttt

SEQ ID NO: 622506 - DNA, 20 bp, Artificial Sequence
  chemically synthesized
gcctgatctaaatgagctat

SEQ ID NO: 622507 - DNA, 20 bp, Artificial Sequence
  chemically synthesized
ttatgcctgatctaaatgag

SEQ ID NO: 622508 - DNA, 20 bp, Artificial Sequence
  chemically synthesized
tgtgttggtccttcataata

SEQ ID NO: 622509 - DNA, 20 bp, Artificial Sequence
  chemically synthesized
tatgccaacctgaagaacgt

SEQ ID NO: 622510 - DNA, 20 bp, Artificial Sequence
  chemically synthesized
aatgagagaagcccatggtg

SEQ ID NO: 622511 - DNA, 20 bp, Artificial Sequence
  chemically synthesized
ttctgatgaagctggccacc

SEQ ID NO: 622512 - DNA, 20 bp, Artificial Sequence
  chemically synthesized
catcagaaacctagtgtggc

SEQ ID NO: 622513 - DNA, 20 bp, Artificial Sequence
  chemically synthesized
tggcgaaaaccagagccaca

SEQ ID NO: 622514 - DNA, 20 bp, Artificial Sequence
  chemically synthesized
tgaagaaatggaacagagtg

SEQ ID NO: 622515 - DNA, 20 bp, Artificial Sequence
  chemically synthesized
gagcaacagatgctaggtta

SEQ ID NO: 622516 - DNA, 20 bp, Artificial Sequence
  chemically synthesized
ttgcatacagaccaaataaa

SEQ ID NO: 622517 - DNA, 20 bp, Artificial Sequence
  chemically synthesized
tgaatgtgatttaaatgggg

SEQ ID NO: 622518 - DNA, 20 bp, Artificial Sequence
  chemically synthesized
gtagatgaatgtgatttaaa

SEQ ID NO: 622519 - DNA, 20 bp, Artificial Sequence
  chemically synthesized
tgagagtcctgggtagatga

SEQ ID NO: 622520 - DNA, 20 bp, Artificial Sequence
  chemically synthesized
atctgacatttaaaatgtca

SEQ ID NO: 622521 - DNA, 20 bp, Artificial Sequence
  chemically synthesized
actcatctgacatttaaaat

SEQ ID NO: 622522 - DNA, 20 bp, Artificial Sequence
  chemically synthesized
taaaaatattgatgtatgca

SEQ ID NO: 622523 - DNA, 20 bp, Artificial Sequence
  chemically synthesized
cagacctttgacacttactt

SEQ ID NO: 622524 - DNA, 20 bp, Artificial Sequence
  chemically synthesized
atttatcacttcagtattct

SEQ ID NO: 622525 - DNA, 20 bp, Artificial Sequence
  chemically synthesized
tatttgttgtatgatagata

SEQ ID NO: 622526 - DNA, 20 bp, Artificial Sequence
  chemically synthesized
tattttcccacttcatagac

SEQ ID NO: 622527 - DNA, 20 bp, Artificial Sequence
  chemically synthesized
aacattacaatgaaaaatat

SEQ ID NO: 622528 - DNA, 20 bp, Artificial Sequence
  chemically synthesized
aaaaatatctgagtttcttt

SEQ ID NO: 622529 - DNA, 20 bp, Artificial Sequence
  chemically synthesized
gggatacatgtgcagaacat

SEQ ID NO: 622530 - DNA, 20 bp, Artificial Sequence
  chemically synthesized
cataggtatacacatgccat

SEQ ID NO: 622531 - DNA, 20 bp, Artificial Sequence
  chemically synthesized
cacttatgagtgagaacatg

SEQ ID NO: 622532 - DNA, 20 bp, Artificial Sequence
  chemically synthesized
tatgagtgagaacatgcggt

SEQ ID NO: 622533 - DNA, 20 bp, Artificial Sequence
  chemically synthesized
tgtgttagtctgatgagaat

SEQ ID NO: 622534 - DNA, 20 bp, Artificial Sequence
  chemically synthesized
gtctgatgagaatgatggtt

SEQ ID NO: 622535 - DNA, 20 bp, Artificial Sequence
  chemically synthesized
ctataaagacacatgtacac

SEQ ID NO: 622536 - DNA, 20 bp, Artificial Sequence
  chemically synthesized
gtacatgtgtctttatagta

SEQ ID NO: 622537 - DNA, 20 bp, Artificial Sequence
  chemically synthesized
ccattactgggtgtatactc

SEQ ID NO: 622538 - DNA, 20 bp, Artificial Sequence
  chemically synthesized
ctttgagtatacacccagta

SEQ ID NO: 622539 - DNA, 20 bp, Artificial Sequence
  chemically synthesized
tgaatgtgatatagataaaa

SEQ ID NO: 622540 - DNA, 20 bp, Artificial Sequence
  chemically synthesized
ctaaagtatataatgacaat

SEQ ID NO: 622541 - DNA, 20 bp, Artificial Sequence
  chemically synthesized
taagtggaaccattgtaaat

SEQ ID NO: 622542 - DNA, 20 bp, Artificial Sequence
  chemically synthesized
ggttgtatggatacttgaag

SEQ ID NO: 622543 - DNA, 20 bp, Artificial Sequence
  chemically synthesized
tcaagtatccatacaaccat

SEQ ID NO: 622544 - DNA, 20 bp, Artificial Sequence
  chemically synthesized
ccttaatcatgctcagaaca

SEQ ID NO: 622545 - DNA, 20 bp, Artificial Sequence
  chemically synthesized
ggctaatctcagtgttctga

SEQ ID NO: 622546 - DNA, 20 bp, Artificial Sequence
  chemically synthesized
aggtaggctagtctaagcta

SEQ ID NO: 622547 - DNA, 20 bp, Artificial Sequence
  chemically synthesized
tagtctaagctatgatgttt

SEQ ID NO: 622548 - DNA, 20 bp, Artificial Sequence
  chemically synthesized
atacctaatctaccaaacat

SEQ ID NO: 622549 - DNA, 20 bp, Artificial Sequence
  chemically synthesized
tataatattttcaaattatg

SEQ ID NO: 622550 - DNA, 20 bp, Artificial Sequence
  chemically synthesized
taagtcgagggatatcagca

SEQ ID NO: 622551 - DNA, 20 bp, Artificial Sequence
  chemically synthesized
aaggcatccaagacacactc

SEQ ID NO: 622552 - DNA, 20 bp, Artificial Sequence
  chemically synthesized
cttggatgcctttacaaagg

SEQ ID NO: 622553 - DNA, 20 bp, Artificial Sequence
  chemically synthesized
ttgccctgccaaatttatgt

SEQ ID NO: 622554 - DNA, 20 bp, Artificial Sequence
  chemically synthesized
ataaatttggcagggcaaag

SEQ ID NO: 622555 - DNA, 20 bp, Artificial Sequence
  chemically synthesized
atccttgctggcttttgaat

SEQ ID NO: 622556 - DNA, 20 bp, Artificial Sequence
  chemically synthesized
atctattattcaaaagccag

SEQ ID NO: 622557 - DNA, 20 bp, Artificial Sequence
  chemically synthesized
tgaaggactttagaatcctt

SEQ ID NO: 622558 - DNA, 20 bp, Artificial Sequence
  chemically synthesized
ttctaaagtccttcagtgat

SEQ ID NO: 622559 - DNA, 20 bp, Artificial Sequence
  chemically synthesized
ctcatttatcaagaggaaat

SEQ ID NO: 622560 - DNA, 20 bp, Artificial Sequence
  chemically synthesized
aagggtgttgagtagatatc

SEQ ID NO: 622561 - DNA, 20 bp, Artificial Sequence
  chemically synthesized
aagattatcatctggatgag

SEQ ID NO: 622562 - DNA, 20 bp, Artificial Sequence
  chemically synthesized
atcatcaccggcaggcaaga

SEQ ID NO: 622563 - DNA, 20 bp, Artificial Sequence
  chemically synthesized
gctaaaaaattgctgtgtct

SEQ ID NO: 622564 - DNA, 20 bp, Artificial Sequence
  chemically synthesized
taaattttgttatactatct

SEQ ID NO: 622565 - DNA, 20 bp, Artificial Sequence
  chemically synthesized
acaaaatttaaagacaaaac

SEQ ID NO: 622566 - DNA, 20 bp, Artificial Sequence
  chemically synthesized
agattaaaggtttaaaaatc

SEQ ID NO: 622567 - DNA, 20 bp, Artificial Sequence
  chemically synthesized
gttctaatttaaataagatt

SEQ ID NO: 622568 - DNA, 20 bp, Artificial Sequence
  chemically synthesized
ttgatagagttctaatttaa

SEQ ID NO: 622569 - DNA, 20 bp, Artificial Sequence
  chemically synthesized
cagtaatttttcctttaatg

SEQ ID NO: 622570 - DNA, 20 bp, Artificial Sequence
  chemically synthesized
tgggacagtaatttttcctt

SEQ ID NO: 622571 - DNA, 20 bp, Artificial Sequence
  chemically synthesized
gagactcaatttcctcatct

SEQ ID NO: 622572 - DNA, 20 bp, Artificial Sequence
  chemically synthesized
aattgataaagacaaaagtc

SEQ ID NO: 622573 - DNA, 20 bp, Artificial Sequence
  chemically synthesized
cctacaccttgttggactgt

SEQ ID NO: 622574 - DNA, 20 bp, Artificial Sequence
  chemically synthesized
tgtaggtgctgttattttcc

SEQ ID NO: 622575 - DNA, 20 bp, Artificial Sequence
  chemically synthesized
ttccccatgtttacagaaga

SEQ ID NO: 622576 - DNA, 20 bp, Artificial Sequence
  chemically synthesized
ataggcactcatacataaaa

SEQ ID NO: 622577 - DNA, 20 bp, Artificial Sequence
  chemically synthesized
tactgaacataatatatata

SEQ ID NO: 622578 - DNA, 20 bp, Artificial Sequence
  chemically synthesized
gttgtttaacctttctcaac

SEQ ID NO: 622579 - DNA, 20 bp, Artificial Sequence
  chemically synthesized
tagtcacgtaaatttggttg

SEQ ID NO: 622580 - DNA, 20 bp, Artificial Sequence
  chemically synthesized
tcagaaacagcaaaaggtgg

SEQ ID NO: 622581 - DNA, 20 bp, Artificial Sequence
  chemically synthesized
caggaatcgagcccaccttt

SEQ ID NO: 622582 - DNA, 20 bp, Artificial Sequence
  chemically synthesized
aaggttattctgggaagaat

SEQ ID NO: 622583 - DNA, 20 bp, Artificial Sequence
  chemically synthesized
gaattgtatgagctgttatt

SEQ ID NO: 622584 - DNA, 20 bp, Artificial Sequence
  chemically synthesized
tggtagacatagagctcaga

SEQ ID NO: 622585 - DNA, 20 bp, Artificial Sequence
  chemically synthesized
gagataaattctctctactc

SEQ ID NO: 622586 - DNA, 20 bp, Artificial Sequence
  chemically synthesized
agtagagagaatttatctca

SEQ ID NO: 622587 - DNA, 20 bp, Artificial Sequence
  chemically synthesized
caacttcagattagtgtagg

SEQ ID NO: 622588 - DNA, 20 bp, Artificial Sequence
  chemically synthesized
taacttagtaatttaacaac

SEQ ID NO: 622589 - DNA, 20 bp, Artificial Sequence
  chemically synthesized
tataattaccttccccatcc

SEQ ID NO: 622590 - DNA, 20 bp, Artificial Sequence
  chemically synthesized
gtcttagtcacactaccccc

SEQ ID NO: 622591 - DNA, 20 bp, Artificial Sequence
  chemically synthesized
tgggggtagtgtgactaaga

SEQ ID NO: 622592 - DNA, 20 bp, Artificial Sequence
  chemically synthesized
gtggaacttgaactcatatc

SEQ ID NO: 622593 - DNA, 20 bp, Artificial Sequence
  chemically synthesized
aagttccacagctaacacct

SEQ ID NO: 622594 - DNA, 20 bp, Artificial Sequence
  chemically synthesized
atctcttatccaagaggaat

SEQ ID NO: 622595 - DNA, 20 bp, Artificial Sequence
  chemically synthesized
aataaaaactacctggcaca

SEQ ID NO: 622596 - DNA, 20 bp, Artificial Sequence
  chemically synthesized
ctacaaaaccatctgtgcca

SEQ ID NO: 622597 - DNA, 20 bp, Artificial Sequence
  chemically synthesized
aaagtttccacagttatttt

SEQ ID NO: 622598 - DNA, 20 bp, Artificial Sequence
  chemically synthesized
ttaatggcacttgaaaattt

SEQ ID NO: 622599 - DNA, 20 bp, Artificial Sequence
  chemically synthesized
tatcaaataccaatttaata

SEQ ID NO: 622600 - DNA, 20 bp, Artificial Sequence
  chemically synthesized
tatattcaaatcaatgcagt

SEQ ID NO: 622601 - DNA, 20 bp, Artificial Sequence
  chemically synthesized
ctactttaaagcctatactg

SEQ ID NO: 622602 - DNA, 20 bp, Artificial Sequence
  chemically synthesized
tacacttattaaaatgcatt

SEQ ID NO: 622603 - DNA, 20 bp, Artificial Sequence
  chemically synthesized
attttaataagtgtacactt

SEQ ID NO: 622604 - DNA, 20 bp, Artificial Sequence
  chemically synthesized
taagtgctatcatcctagtg

SEQ ID NO: 622605 - DNA, 20 bp, Artificial Sequence
  chemically synthesized
aagtgaatagatgtgtcaaa

SEQ ID NO: 622606 - DNA, 20 bp, Artificial Sequence
  chemically synthesized
tttttgtcaattcccattaa

SEQ ID NO: 622607 - DNA, 20 bp, Artificial Sequence
  chemically synthesized
acgaatacttgaaactgact

SEQ ID NO: 622608 - DNA, 20 bp, Artificial Sequence
  chemically synthesized
ctcagactcaaaatctttga

SEQ ID NO: 622609 - DNA, 20 bp, Artificial Sequence
  chemically synthesized
gactcaaagattttgagtct

SEQ ID NO: 622610 - DNA, 20 bp, Artificial Sequence
  chemically synthesized
ttttggtgtgtgcgtgtgtt

SEQ ID NO: 622611 - DNA, 20 bp, Artificial Sequence
  chemically synthesized
cagttatttttggtgtgtgc

SEQ ID NO: 622612 - DNA, 20 bp, Artificial Sequence
  chemically synthesized
acacgcacacaccaaaaata

SEQ ID NO: 622613 - DNA, 20 bp, Artificial Sequence
  chemically synthesized
taattcaacatagaacagcc

SEQ ID NO: 622614 - DNA, 20 bp, Artificial Sequence
  chemically synthesized
tatcaaagccactttctgat

SEQ ID NO: 622615 - DNA, 20 bp, Artificial Sequence
  chemically synthesized
cataaaaacagagatcagaa

SEQ ID NO: 622616 - DNA, 20 bp, Artificial Sequence
  chemically synthesized
ctttctgatctctgttttta

SEQ ID NO: 622617 - DNA, 20 bp, Artificial Sequence
  chemically synthesized
attttcaaatttttcctcac

SEQ ID NO: 622618 - DNA, 20 bp, Artificial Sequence
  chemically synthesized
ttaagattctgtaaaatttt

SEQ ID NO: 622619 - DNA, 20 bp, Artificial Sequence
  chemically synthesized
ctgtaaaatttttattgctt

SEQ ID NO: 622620 - DNA, 20 bp, Artificial Sequence
  chemically synthesized
ttgtgtaagaaattcatatc

SEQ ID NO: 622621 - DNA, 20 bp, Artificial Sequence
  chemically synthesized
ttagtaggataatagcattt

SEQ ID NO: 622622 - DNA, 20 bp, Artificial Sequence
  chemically synthesized
aaacttcagtcaatagttta

SEQ ID NO: 622623 - DNA, 20 bp, Artificial Sequence
  chemically synthesized
aaacagcataaactattgac

SEQ ID NO: 622624 - DNA, 20 bp, Artificial Sequence
  chemically synthesized
taaaatgtcaaacttcagtc

SEQ ID NO: 622625 - DNA, 20 bp, Artificial Sequence
  chemically synthesized
ccagcagaggtggactttcc

SEQ ID NO: 622626 - DNA, 20 bp, Artificial Sequence
  chemically synthesized
ataatagactgctatcctgc

SEQ ID NO: 622627 - DNA, 20 bp, Artificial Sequence
  chemically synthesized
agactgctatcctgccatgg

SEQ ID NO: 622628 - DNA, 20 bp, Artificial Sequence
  chemically synthesized
gttactggcctgacatatca

SEQ ID NO: 622629 - DNA, 20 bp, Artificial Sequence
  chemically synthesized
taaacacgtattctgtgagg

SEQ ID NO: 622630 - DNA, 20 bp, Artificial Sequence
  chemically synthesized
gaatcaaatcctcacagaat

SEQ ID NO: 622631 - DNA, 20 bp, Artificial Sequence
  chemically synthesized
tgttctaaacacgtattctg

SEQ ID NO: 622632 - DNA, 20 bp, Artificial Sequence
  chemically synthesized
tgcctcggcctcgcaaagtg

SEQ ID NO: 622633 - DNA, 20 bp, Artificial Sequence
  chemically synthesized
ttttgtatttttagtagtga

SEQ ID NO: 622634 - DNA, 20 bp, Artificial Sequence
  chemically synthesized
ctcctgggttctagcgattc

SEQ ID NO: 622635 - DNA, 20 bp, Artificial Sequence
  chemically synthesized
aacctccgcctcctgggttc

SEQ ID NO: 622636 - DNA, 20 bp, Artificial Sequence
  chemically synthesized
tatctatctatctatctata

SEQ ID NO: 622637 - DNA, 20 bp, Artificial Sequence
  chemically synthesized
aagagaggaatgcaattctg

SEQ ID NO: 622638 - DNA, 20 bp, Artificial Sequence
  chemically synthesized
atgttgttttctggagttga

SEQ ID NO: 622639 - DNA, 20 bp, Artificial Sequence
  chemically synthesized
catgagtgggttgacttaca

SEQ ID NO: 622640 - DNA, 20 bp, Artificial Sequence
  chemically synthesized
caacatgtaagtcaacccac

SEQ ID NO: 622641 - DNA, 20 bp, Artificial Sequence
  chemically synthesized
cgacaacaactttctaagat

SEQ ID NO: 622642 - DNA, 20 bp, Artificial Sequence
  chemically synthesized
aagaattcacaacatttagc

SEQ ID NO: 622643 - DNA, 20 bp, Artificial Sequence
  chemically synthesized
gcagtagggtggggggagca

SEQ ID NO: 622644 - DNA, 20 bp, Artificial Sequence
  chemically synthesized
gtaaagactatagatatttt

SEQ ID NO: 622645 - DNA, 20 bp, Artificial Sequence
  chemically synthesized
ctgcttatttatatatatta

SEQ ID NO: 622646 - DNA, 20 bp, Artificial Sequence
  chemically synthesized
tttgcaacttcaaagagaca

SEQ ID NO: 622647 - DNA, 20 bp, Artificial Sequence
  chemically synthesized
ggctggttcatgcccataaa

SEQ ID NO: 622648 - DNA, 20 bp, Artificial Sequence
  chemically synthesized
gtaatactctgtcatatcaa

SEQ ID NO: 622649 - DNA, 20 bp, Artificial Sequence
  chemically synthesized
gtggacggaatatgcacaaa

SEQ ID NO: 622650 - DNA, 20 bp, Artificial Sequence
  chemically synthesized
ttcacttccttttgtgaaaa

SEQ ID NO: 622651 - DNA, 20 bp, Artificial Sequence
  chemically synthesized
gtttttcacaaaaggaagtg

SEQ ID NO: 622652 - DNA, 20 bp, Artificial Sequence
  chemically synthesized
gttacacagatgaatttggc

SEQ ID NO: 622653 - DNA, 20 bp, Artificial Sequence
  chemically synthesized
aaatattttaaaaatatatt

SEQ ID NO: 622654 - DNA, 20 bp, Artificial Sequence
  chemically synthesized
ttttaaaaatatatttattg

SEQ ID NO: 622655 - DNA, 20 bp, Artificial Sequence
  chemically synthesized
gtttaaaaaactggccattt

SEQ ID NO: 622656 - DNA, 20 bp, Artificial Sequence
  chemically synthesized
tagcttaaagctcagaaatg

SEQ ID NO: 622657 - DNA, 20 bp, Artificial Sequence
  chemically synthesized
ctgagctttaagctatcatt

SEQ ID NO: 622658 - DNA, 20 bp, Artificial Sequence
  chemically synthesized
taaattataaagcttccaat

SEQ ID NO: 622659 - DNA, 20 bp, Artificial Sequence
  chemically synthesized
tcattggaagctttataatt

SEQ ID NO: 622660 - DNA, 20 bp, Artificial Sequence
  chemically synthesized
gcaaataaaaccttaaatta

SEQ ID NO: 622661 - DNA, 20 bp, Artificial Sequence
  chemically synthesized
gctttataatttaaggtttt

SEQ ID NO: 622662 - DNA, 20 bp, Artificial Sequence
  chemically synthesized
ttgcttgctaaatataattg

SEQ ID NO: 622663 - DNA, 20 bp, Artificial Sequence
  chemically synthesized
attggctaaggagccaaggc

SEQ ID NO: 622664 - DNA, 20 bp, Artificial Sequence
  chemically synthesized
ccttggctccttagccaatg

SEQ ID NO: 622665 - DNA, 20 bp, Artificial Sequence
  chemically synthesized
tagagcttaataaattcacc

SEQ ID NO: 622666 - DNA, 20 bp, Artificial Sequence
  chemically synthesized
gcaatattagattttaccat

SEQ ID NO: 622667 - DNA, 20 bp, Artificial Sequence
  chemically synthesized
agtttacggactattgcaat

SEQ ID NO: 622668 - DNA, 20 bp, Artificial Sequence
  chemically synthesized
ttgcaatagtccgtaaactt

SEQ ID NO: 622669 - DNA, 20 bp, Artificial Sequence
  chemically synthesized
tgcttttagaaagtaagccc

SEQ ID NO: 622670 - DNA, 20 bp, Artificial Sequence
  chemically synthesized
cttcttcaataactctgctt

SEQ ID NO: 622671 - DNA, 20 bp, Artificial Sequence
  chemically synthesized
acacgattcttcttcaataa

SEQ ID NO: 622672 - DNA, 20 bp, Artificial Sequence
  chemically synthesized
tatgcctctgaaatatagac

SEQ ID NO: 622673 - DNA, 20 bp, Artificial Sequence
  chemically synthesized
tagtaataatgactcctaaa

SEQ ID NO: 622674 - DNA, 20 bp, Artificial Sequence
  chemically synthesized
tgttctactttatttctgat

SEQ ID NO: 622675 - DNA, 20 bp, Artificial Sequence
  chemically synthesized
tctgcatttcaggtgtggta

SEQ ID NO: 622676 - DNA, 20 bp, Artificial Sequence
  chemically synthesized
gagaaggaagagaacaggat

SEQ ID NO: 622677 - DNA, 20 bp, Artificial Sequence
  chemically synthesized
agcccaggagaaggaagaga

SEQ ID NO: 622678 - DNA, 20 bp, Artificial Sequence
  chemically synthesized
agttggcacttgaggttatt

SEQ ID NO: 622679 - DNA, 20 bp, Artificial Sequence
  chemically synthesized
gcacttgaggttattatttg

SEQ ID NO: 622680 - DNA, 20 bp, Artificial Sequence
  chemically synthesized
cacattgaaggagatgttca

SEQ ID NO: 622681 - DNA, 20 bp, Artificial Sequence
  chemically synthesized
tgatattaggacatttctag

SEQ ID NO: 622682 - DNA, 20 bp, Artificial Sequence
  chemically synthesized
tagaagtgtttacttgaatc

SEQ ID NO: 622683 - DNA, 20 bp, Artificial Sequence
  chemically synthesized
gtcccttatagctcaaaatc

SEQ ID NO: 622684 - DNA, 20 bp, Artificial Sequence
  chemically synthesized
gattttgagctataagggac

SEQ ID NO: 622685 - DNA, 20 bp, Artificial Sequence
  chemically synthesized
aagggacttgagtttaggaa

SEQ ID NO: 622686 - DNA, 20 bp, Artificial Sequence
  chemically synthesized
tttaaatttgactaatagca

SEQ ID NO: 622687 - DNA, 20 bp, Artificial Sequence
  chemically synthesized
caaattcgttattagagtca

SEQ ID NO: 622688 - DNA, 20 bp, Artificial Sequence
  chemically synthesized
ttgtcaggatgctaaggaca

SEQ ID NO: 622689 - DNA, 20 bp, Artificial Sequence
  chemically synthesized
gaggaaggagcagcagttct

SEQ ID NO: 622690 - DNA, 20 bp, Artificial Sequence
  chemically synthesized
gctgctccttcctcctacat

SEQ ID NO: 622691 - DNA, 20 bp, Artificial Sequence
  chemically synthesized
ccttcctcctacatgtcagt

SEQ ID NO: 622692 - DNA, 20 bp, Artificial Sequence
  chemically synthesized
cttctaacacataaagaaaa

SEQ ID NO: 622693 - DNA, 20 bp, Artificial Sequence
  chemically synthesized
agattatcttttcctgctgc

SEQ ID NO: 622694 - DNA, 20 bp, Artificial Sequence
  chemically synthesized
aagataatctttactgtctg

SEQ ID NO: 622695 - DNA, 20 bp, Artificial Sequence
  chemically synthesized
ctctaaaactagacagacag

SEQ ID NO: 622696 - DNA, 20 bp, Artificial Sequence
  chemically synthesized
aagagttttttgatggatgt

SEQ ID NO: 622697 - DNA, 20 bp, Artificial Sequence
  chemically synthesized
catccatcaaaaaactcttt

SEQ ID NO: 622698 - DNA, 20 bp, Artificial Sequence
  chemically synthesized
cacatttcctcaagccacca

SEQ ID NO: 622699 - DNA, 20 bp, Artificial Sequence
  chemically synthesized
ataatacatgtctgtagtaa

SEQ ID NO: 622700 - DNA, 20 bp, Artificial Sequence
  chemically synthesized
gtttagttagtagttgtgaa

SEQ ID NO: 622701 - DNA, 20 bp, Artificial Sequence
  chemically synthesized
gtgaaattgttggaattata

SEQ ID NO: 622702 - DNA, 20 bp, Artificial Sequence
  chemically synthesized
ttcacctaaattacacaaag

SEQ ID NO: 622703 - DNA, 20 bp, Artificial Sequence
  chemically synthesized
aataatacagctcaggaatg

SEQ ID NO: 622704 - DNA, 20 bp, Artificial Sequence
  chemically synthesized
cataggatcacaattcatct

SEQ ID NO: 622705 - DNA, 20 bp, Artificial Sequence
  chemically synthesized
catctaggtgttttttccgc

SEQ ID NO: 622706 - DNA, 20 bp, Artificial Sequence
  chemically synthesized
tggttccggtacttctttta

SEQ ID NO: 622707 - DNA, 20 bp, Artificial Sequence
  chemically synthesized
acaaaatcatctctttcccc

SEQ ID NO: 622708 - DNA, 20 bp, Artificial Sequence
  chemically synthesized
tagtaaacaaagggggaaag

SEQ ID NO: 622709 - DNA, 20 bp, Artificial Sequence
  chemically synthesized
ttcctcttcttacttgatgc

SEQ ID NO: 622710 - DNA, 20 bp, Artificial Sequence
  chemically synthesized
catcttcttgtcctgtgtgt

SEQ ID NO: 622711 - DNA, 20 bp, Artificial Sequence
  chemically synthesized
acgccccatcttcttgtcct

SEQ ID NO: 622712 - DNA, 20 bp, Artificial Sequence
  chemically synthesized
ttactgctccactagagctt

SEQ ID NO: 622713 - DNA, 20 bp, Artificial Sequence
  chemically synthesized
accctcagttactgctccac

SEQ ID NO: 622714 - DNA, 20 bp, Artificial Sequence
  chemically synthesized
actgagggtaaaggaagcgc

SEQ ID NO: 622715 - DNA, 20 bp, Artificial Sequence
  chemically synthesized
cttcctatacatcaaaactt

SEQ ID NO: 622716 - DNA, 20 bp, Artificial Sequence
  chemically synthesized
taatcactttcagttacctt

SEQ ID NO: 622717 - DNA, 20 bp, Artificial Sequence
  chemically synthesized
gaagcaaagaaggtaactga

SEQ ID NO: 622718 - DNA, 20 bp, Artificial Sequence
  chemically synthesized
taactgaaagtgattaatga

SEQ ID NO: 622719 - DNA, 20 bp, Artificial Sequence
  chemically synthesized
tgttgttttggcaacagaat

SEQ ID NO: 622720 - DNA, 20 bp, Artificial Sequence
  chemically synthesized
caacagaatagcagattaag

SEQ ID NO: 622721 - DNA, 20 bp, Artificial Sequence
  chemically synthesized
agattaagggcagctttctg

SEQ ID NO: 622722 - DNA, 20 bp, Artificial Sequence
  chemically synthesized
gtattcctgtatcctgccat

SEQ ID NO: 622723 - DNA, 20 bp, Artificial Sequence
  chemically synthesized
agagatctcagtagtatatt

SEQ ID NO: 622724 - DNA, 20 bp, Artificial Sequence
  chemically synthesized
taggttttaaaaatataatg

SEQ ID NO: 622725 - DNA, 20 bp, Artificial Sequence
  chemically synthesized
aaatataatggagtgattga

SEQ ID NO: 622726 - DNA, 20 bp, Artificial Sequence
  chemically synthesized
tactccttgccttttctcag

SEQ ID NO: 622727 - DNA, 20 bp, Artificial Sequence
  chemically synthesized
ggagtaatttaacaggaatg

SEQ ID NO: 622728 - DNA, 20 bp, Artificial Sequence
  chemically synthesized
tatttcacttttaatttcct

SEQ ID NO: 622729 - DNA, 20 bp, Artificial Sequence
  chemically synthesized
atatatgagaagatgtgaga

SEQ ID NO: 622730 - DNA, 20 bp, Artificial Sequence
  chemically synthesized
aagatgtgagaaagagatta

SEQ ID NO: 622731 - DNA, 20 bp, Artificial Sequence
  chemically synthesized
aatgtttctcaaatttactt

SEQ ID NO: 622732 - DNA, 20 bp, Artificial Sequence
  chemically synthesized
gggttattatttggaaaggg

SEQ ID NO: 622733 - DNA, 20 bp, Artificial Sequence
  chemically synthesized
ttatgctgtattatttcacc

SEQ ID NO: 622734 - DNA, 20 bp, Artificial Sequence
  chemically synthesized
aaattgaaagcgcaaagtta

SEQ ID NO: 622735 - DNA, 20 bp, Artificial Sequence
  chemically synthesized
ctttacaaatcaaaataact

SEQ ID NO: 622736 - DNA, 20 bp, Artificial Sequence
  chemically synthesized
cgcaaagttattttgatttg

SEQ ID NO: 622737 - DNA, 20 bp, Artificial Sequence
  chemically synthesized
cctctattaaatatcagtga

SEQ ID NO: 622738 - DNA, 20 bp, Artificial Sequence
  chemically synthesized
tgtatccaaaaaagtgtgtt

SEQ ID NO: 622739 - DNA, 20 bp, Artificial Sequence
  chemically synthesized
tttatgtctattttttaaaa

SEQ ID NO: 622740 - DNA, 20 bp, Artificial Sequence
  chemically synthesized
aggagaaattatagaagaag

SEQ ID NO: 622741 - DNA, 20 bp, Artificial Sequence
  chemically synthesized
ccttgaacaaaaagtcatgg

SEQ ID NO: 622742 - DNA, 20 bp, Artificial Sequence
  chemically synthesized
gactagtaaaaggcagccta

SEQ ID NO: 622743 - DNA, 20 bp, Artificial Sequence
  chemically synthesized
taatatcccattaatagcct

SEQ ID NO: 622744 - DNA, 20 bp, Artificial Sequence
  chemically synthesized
gggatattaacacatttaaa

SEQ ID NO: 622745 - DNA, 20 bp, Artificial Sequence
  chemically synthesized
aaatcagtgatacatatcga

SEQ ID NO: 622746 - DNA, 20 bp, Artificial Sequence
  chemically synthesized
aaagcaccatcgatatgtat

SEQ ID NO: 622747 - DNA, 20 bp, Artificial Sequence
  chemically synthesized
accatcgatatgtatcactg

SEQ ID NO: 622748 - DNA, 20 bp, Artificial Sequence
  chemically synthesized
tcaggacttctcagaaatac

SEQ ID NO: 622749 - DNA, 20 bp, Artificial Sequence
  chemically synthesized
attctttctgtagtaggaaa

SEQ ID NO: 622750 - DNA, 20 bp, Artificial Sequence
  chemically synthesized
ttcagcagaaattattcaag

SEQ ID NO: 622751 - DNA, 20 bp, Artificial Sequence
  chemically synthesized
ttactctccagctttcataa

SEQ ID NO: 622752 - DNA, 20 bp, Artificial Sequence
  chemically synthesized
gacaataatatggattactc

SEQ ID NO: 622753 - DNA, 20 bp, Artificial Sequence
  chemically synthesized
agagtaatccatattattgt

SEQ ID NO: 622754 - DNA, 20 bp, Artificial Sequence
  chemically synthesized
aactgaagcaaggacaataa

SEQ ID NO: 622755 - DNA, 20 bp, Artificial Sequence
  chemically synthesized
atccatattattgtccttgc

SEQ ID NO: 622756 - DNA, 20 bp, Artificial Sequence
  chemically synthesized
ttttaatgtaggtaaactaa

SEQ ID NO: 622757 - DNA, 20 bp, Artificial Sequence
  chemically synthesized
ggagaaagacctaaatcgaa

SEQ ID NO: 622758 - DNA, 20 bp, Artificial Sequence
  chemically synthesized
tgaatttatgcactaaatgg

SEQ ID NO: 622759 - DNA, 20 bp, Artificial Sequence
  chemically synthesized
aattcgactagtaattattt

SEQ ID NO: 622760 - DNA, 20 bp, Artificial Sequence
  chemically synthesized
ggtgaaggatacattagaat

SEQ ID NO: 622761 - DNA, 20 bp, Artificial Sequence
  chemically synthesized
ttctgtgccacacacatttt

SEQ ID NO: 622762 - DNA, 20 bp, Artificial Sequence
  chemically synthesized
aaaatgtgtgtggcacagaa

SEQ ID NO: 622763 - DNA, 20 bp, Artificial Sequence
  chemically synthesized
ctgagaaaagttttggtccc

SEQ ID NO: 622764 - DNA, 20 bp, Artificial Sequence
  chemically synthesized
ctagacatgatattgctgag

SEQ ID NO: 622765 - DNA, 20 bp, Artificial Sequence
  chemically synthesized
aagagcagaggaaaatattt

SEQ ID NO: 622766 - DNA, 20 bp, Artificial Sequence
  chemically synthesized
gggccattttgttcccaagt

SEQ ID NO: 622767 - DNA, 20 bp, Artificial Sequence
  chemically synthesized
aatattatcatatatcattt

SEQ ID NO: 622768 - DNA, 20 bp, Artificial Sequence
  chemically synthesized
tatatcatttaaaggcttta

SEQ ID NO: 622769 - DNA, 20 bp, Artificial Sequence
  chemically synthesized
taaatgagttaatatttata

SEQ ID NO: 622770 - DNA, 20 bp, Artificial Sequence
  chemically synthesized
ggcacacagtaagcaccatt

SEQ ID NO: 622771 - DNA, 20 bp, Artificial Sequence
  chemically synthesized
tacttttatcaagccattaa

SEQ ID NO: 622772 - DNA, 20 bp, Artificial Sequence
  chemically synthesized
tacaaaatagaaagagtact

SEQ ID NO: 622773 - DNA, 20 bp, Artificial Sequence
  chemically synthesized
atctcagagttcaagtgtag

SEQ ID NO: 622774 - DNA, 20 bp, Artificial Sequence
  chemically synthesized
cttgaactctgagataaaga

SEQ ID NO: 622775 - DNA, 20 bp, Artificial Sequence
  chemically synthesized
tagcgtgtgtgcatgtgtgt

SEQ ID NO: 622776 - DNA, 20 bp, Artificial Sequence
  chemically synthesized
taggtgttaaaatattttat

SEQ ID NO: 622777 - DNA, 20 bp, Artificial Sequence
  chemically synthesized
gtgaaaataaattggtaaaa

SEQ ID NO: 622778 - DNA, 20 bp, Artificial Sequence
  chemically synthesized
atgtttgccattagccataa

SEQ ID NO: 622779 - DNA, 20 bp, Artificial Sequence
  chemically synthesized
tagtaattgccacattgtat

SEQ ID NO: 622780 - DNA, 20 bp, Artificial Sequence
  chemically synthesized
gatcctacaatcctgccaaa

SEQ ID NO: 622781 - DNA, 20 bp, Artificial Sequence
  chemically synthesized
caggtcaaaatcaagatttg

SEQ ID NO: 622782 - DNA, 20 bp, Artificial Sequence
  chemically synthesized
cagtaccatacaggtcaaaa

SEQ ID NO: 622783 - DNA, 20 bp, Artificial Sequence
  chemically synthesized
tgattttgacctgtatggta

SEQ ID NO: 622784 - DNA, 20 bp, Artificial Sequence
  chemically synthesized
actgggattgtagtgggctc

SEQ ID NO: 622785 - DNA, 20 bp, Artificial Sequence
  chemically synthesized
attattagccatactctgaa

SEQ ID NO: 622786 - DNA, 20 bp, Artificial Sequence
  chemically synthesized
agctatatatcaggaatttt

SEQ ID NO: 622787 - DNA, 20 bp, Artificial Sequence
  chemically synthesized
atcctagaaaattcctgata

SEQ ID NO: 622788 - DNA, 20 bp, Artificial Sequence
  chemically synthesized
aagacccaaattatctgaat

SEQ ID NO: 622789 - DNA, 20 bp, Artificial Sequence
  chemically synthesized
tttaatatgtttaatttcct

SEQ ID NO: 622790 - DNA, 20 bp, Artificial Sequence
  chemically synthesized
gtgacaccaatatctcttta

SEQ ID NO: 622791 - DNA, 20 bp, Artificial Sequence
  chemically synthesized
tcttcctaaagaaggctcat

SEQ ID NO: 622792 - DNA, 20 bp, Artificial Sequence
  chemically synthesized
tttctaattttcatttatct

SEQ ID NO: 622793 - DNA, 20 bp, Artificial Sequence
  chemically synthesized
tatttttctaattttcattt

SEQ ID NO: 622794 - DNA, 20 bp, Artificial Sequence
  chemically synthesized
actaatttttcctcattgac

SEQ ID NO: 622795 - DNA, 20 bp, Artificial Sequence
  chemically synthesized
caatgatctcagagtactac

SEQ ID NO: 622796 - DNA, 20 bp, Artificial Sequence
  chemically synthesized
tgagtgtggctgggagtcta

SEQ ID NO: 622797 - DNA, 20 bp, Artificial Sequence
  chemically synthesized
attttgtcaccatgatcatc

SEQ ID NO: 622798 - DNA, 20 bp, Artificial Sequence
  chemically synthesized
ctgtatcctttacgccttct

SEQ ID NO: 622799 - DNA, 20 bp, Artificial Sequence
  chemically synthesized
cctaagtaaaataattagtt

SEQ ID NO: 622800 - DNA, 20 bp, Artificial Sequence
  chemically synthesized
atataataaatgcttttcca

SEQ ID NO: 622801 - DNA, 20 bp, Artificial Sequence
  chemically synthesized
agttacattatttatataat

SEQ ID NO: 622802 - DNA, 20 bp, Artificial Sequence
  chemically synthesized
ccttttgaatttccaaataa

SEQ ID NO: 622803 - DNA, 20 bp, Artificial Sequence
  chemically synthesized
tcctgtcaactctctagaag

SEQ ID NO: 622804 - DNA, 20 bp, Artificial Sequence
  chemically synthesized
taggtttttttttttgcctc

SEQ ID NO: 622805 - DNA, 20 bp, Artificial Sequence
  chemically synthesized
catgcacaaagtctttgaat

SEQ ID NO: 622806 - DNA, 20 bp, Artificial Sequence
  chemically synthesized
tctttgaatatttgtttctc

SEQ ID NO: 622807 - DNA, 20 bp, Artificial Sequence
  chemically synthesized
ttggggcctcccaattacat

SEQ ID NO: 622808 - DNA, 20 bp, Artificial Sequence
  chemically synthesized
gttgaaataatatgaacagt

SEQ ID NO: 622809 - DNA, 20 bp, Artificial Sequence
  chemically synthesized
tcatattatttcaactgaaa

SEQ ID NO: 622810 - DNA, 20 bp, Artificial Sequence
  chemically synthesized
tgtgagagagcttttaacaa

SEQ ID NO: 622811 - DNA, 20 bp, Artificial Sequence
  chemically synthesized
caattgtgagagagctttta

SEQ ID NO: 622812 - DNA, 20 bp, Artificial Sequence
  chemically synthesized
tacaaaattaacaattgtga

SEQ ID NO: 622813 - DNA, 20 bp, Artificial Sequence
  chemically synthesized
tgtctagtaaattttctagc

SEQ ID NO: 622814 - DNA, 20 bp, Artificial Sequence
  chemically synthesized
tagggcataaagatcatttg

SEQ ID NO: 622815 - DNA, 20 bp, Artificial Sequence
  chemically synthesized
gttaacaatccttgggtaat

SEQ ID NO: 622816 - DNA, 20 bp, Artificial Sequence
  chemically synthesized
agaagtaagctgtcattacc

SEQ ID NO: 622817 - DNA, 20 bp, Artificial Sequence
  chemically synthesized
cttctcttctgaatctagcc

SEQ ID NO: 622818 - DNA, 20 bp, Artificial Sequence
  chemically synthesized
atatttaatggaatctttag

SEQ ID NO: 622819 - DNA, 20 bp, Artificial Sequence
  chemically synthesized
gactctcatctagacatttt

SEQ ID NO: 622820 - DNA, 20 bp, Artificial Sequence
  chemically synthesized
aatgtctagatgagagtcta

SEQ ID NO: 622821 - DNA, 20 bp, Artificial Sequence
  chemically synthesized
tgagagtctaaactgatttc

SEQ ID NO: 622822 - DNA, 20 bp, Artificial Sequence
  chemically synthesized
agtctaaactgatttcaagt

SEQ ID NO: 622823 - DNA, 20 bp, Artificial Sequence
  chemically synthesized
ctttgaagcaaacacttgaa

SEQ ID NO: 622824 - DNA, 20 bp, Artificial Sequence
  chemically synthesized
ggctggaagggagcatctgt

SEQ ID NO: 622825 - DNA, 20 bp, Artificial Sequence
  chemically synthesized
atgacttagacaatccatat

SEQ ID NO: 622826 - DNA, 20 bp, Artificial Sequence
  chemically synthesized
ccattgacttcaatctttaa

SEQ ID NO: 622827 - DNA, 20 bp, Artificial Sequence
  chemically synthesized
tgatatactaggttgggcaa

SEQ ID NO: 622828 - DNA, 20 bp, Artificial Sequence
  chemically synthesized
ccagtcaatgtcacattcaa

SEQ ID NO: 622829 - DNA, 20 bp, Artificial Sequence
  chemically synthesized
ctggcttgaatgtgacattg

SEQ ID NO: 622830 - DNA, 20 bp, Artificial Sequence
  chemically synthesized
tcaaaatatttcatccatca

SEQ ID NO: 622831 - DNA, 20 bp, Artificial Sequence
  chemically synthesized
atacaaataaaaataatttt

SEQ ID NO: 622832 - DNA, 20 bp, Artificial Sequence
  chemically synthesized
tgtatttcctttttaatttt

SEQ ID NO: 622833 - DNA, 20 bp, Artificial Sequence
  chemically synthesized
ttaatagctttaggggtgga

SEQ ID NO: 622834 - DNA, 20 bp, Artificial Sequence
  chemically synthesized
gagttctatagtggtgaatt

SEQ ID NO: 622835 - DNA, 20 bp, Artificial Sequence
  chemically synthesized
aagagttctaggaggggggc

SEQ ID NO: 622836 - DNA, 20 bp, Artificial Sequence
  chemically synthesized
attgcttttctgactttctc

SEQ ID NO: 622837 - DNA, 20 bp, Artificial Sequence
  chemically synthesized
tgtactacgttgtattgact

SEQ ID NO: 622838 - DNA, 20 bp, Artificial Sequence
  chemically synthesized
cctctgtactacgttgtatt

SEQ ID NO: 622839 - DNA, 20 bp, Artificial Sequence
  chemically synthesized
tggttacatggaagtctatt

SEQ ID NO: 622840 - DNA, 20 bp, Artificial Sequence
  chemically synthesized
aatgcctactcaggtaattt

SEQ ID NO: 622841 - DNA, 20 bp, Artificial Sequence
  chemically synthesized
tacttttcagaggaaatgca

SEQ ID NO: 622842 - DNA, 20 bp, Artificial Sequence
  chemically synthesized
attataactggcttaactaa

SEQ ID NO: 622843 - DNA, 20 bp, Artificial Sequence
  chemically synthesized
taactctagaaataattata

SEQ ID NO: 622844 - DNA, 20 bp, Artificial Sequence
  chemically synthesized
taattatttctagagttaca

SEQ ID NO: 622845 - DNA, 20 bp, Artificial Sequence
  chemically synthesized
aatgtaagctccatgaagac

SEQ ID NO: 622846 - DNA, 20 bp, Artificial Sequence
  chemically synthesized
cggcaaagccctcgtcttca

SEQ ID NO: 622847 - DNA, 20 bp, Artificial Sequence
  chemically synthesized
tcccaagtaactagactaga

SEQ ID NO: 622848 - DNA, 20 bp, Artificial Sequence
  chemically synthesized
ttattaagtcatacacttac

SEQ ID NO: 622849 - DNA, 20 bp, Artificial Sequence
  chemically synthesized
attatttctacaacattcag

SEQ ID NO: 622850 - DNA, 20 bp, Artificial Sequence
  chemically synthesized
tattgattatttctacaaca

SEQ ID NO: 622851 - DNA, 20 bp, Artificial Sequence
  chemically synthesized
aatcattttgcaaccatatt

SEQ ID NO: 622852 - DNA, 20 bp, Artificial Sequence
  chemically synthesized
aatcaataaatatggttgca

SEQ ID NO: 622853 - DNA, 20 bp, Artificial Sequence
  chemically synthesized
atatggttgcaaaatgattc

SEQ ID NO: 622854 - DNA, 20 bp, Artificial Sequence
  chemically synthesized
aagcaatctgcacatagaac

SEQ ID NO: 622855 - DNA, 20 bp, Artificial Sequence
  chemically synthesized
taaaaatctttagttctatg

SEQ ID NO: 622856 - DNA, 20 bp, Artificial Sequence
  chemically synthesized
aatctttagttctatgtgca

SEQ ID NO: 622857 - DNA, 20 bp, Artificial Sequence
  chemically synthesized
cataatctataatttccagt

SEQ ID NO: 622858 - DNA, 20 bp, Artificial Sequence
  chemically synthesized
aagaaactgaaactggaaat

SEQ ID NO: 622859 - DNA, 20 bp, Artificial Sequence
  chemically synthesized
agctagcataatctataatt

SEQ ID NO: 622860 - DNA, 20 bp, Artificial Sequence
  chemically synthesized
agacaaattaaaattaccta

SEQ ID NO: 622861 - DNA, 20 bp, Artificial Sequence
  chemically synthesized
aagtaaaatacagtatggat

SEQ ID NO: 622862 - DNA, 20 bp, Artificial Sequence
  chemically synthesized
ttgaaatgatagtatttggg

SEQ ID NO: 622863 - DNA, 20 bp, Artificial Sequence
  chemically synthesized
cacagaagtagacaatatgg

SEQ ID NO: 622864 - DNA, 20 bp, Artificial Sequence
  chemically synthesized
acagaaattcacagattaga

SEQ ID NO: 622865 - DNA, 20 bp, Artificial Sequence
  chemically synthesized
tcatacctactacagaaatt

SEQ ID NO: 622866 - DNA, 20 bp, Artificial Sequence
  chemically synthesized
gaggtctaggtctatgtaca

SEQ ID NO: 622867 - DNA, 20 bp, Artificial Sequence
  chemically synthesized
taaattcagtggaggaagag

SEQ ID NO: 622868 - DNA, 20 bp, Artificial Sequence
  chemically synthesized
tatgcccaacatatttttga

SEQ ID NO: 622869 - DNA, 20 bp, Artificial Sequence
  chemically synthesized
tgttgggcatatttgtgtgg

SEQ ID NO: 622870 - DNA, 20 bp, Artificial Sequence
  chemically synthesized
aatattgtgttatattgtca

SEQ ID NO: 622871 - DNA, 20 bp, Artificial Sequence
  chemically synthesized
tttgttgctgtggttatgtg

SEQ ID NO: 622872 - DNA, 20 bp, Artificial Sequence
  chemically synthesized
tgttaagcttatacaataag

SEQ ID NO: 622873 - DNA, 20 bp, Artificial Sequence
  chemically synthesized
ttaaaatcagatcttattgt

SEQ ID NO: 622874 - DNA, 20 bp, Artificial Sequence
  chemically synthesized
ttcagtaacattatatgttg

SEQ ID NO: 622875 - DNA, 20 bp, Artificial Sequence
  chemically synthesized
tttggggaaaaaacagacca

SEQ ID NO: 622876 - DNA, 20 bp, Artificial Sequence
  chemically synthesized
aggagtgttcaatccatctg

SEQ ID NO: 622877 - DNA, 20 bp, Artificial Sequence
  chemically synthesized
agacagctgagagagagaga

SEQ ID NO: 622878 - DNA, 20 bp, Artificial Sequence
  chemically synthesized
aaaatggaaattcaacagat

SEQ ID NO: 622879 - DNA, 20 bp, Artificial Sequence
  chemically synthesized
caaaccagagaggtggtcaa

SEQ ID NO: 622880 - DNA, 20 bp, Artificial Sequence
  chemically synthesized
gaatctattttgaccacctc

SEQ ID NO: 622881 - DNA, 20 bp, Artificial Sequence
  chemically synthesized
ctctctggtttgaaacctct

SEQ ID NO: 622882 - DNA, 20 bp, Artificial Sequence
  chemically synthesized
tccttttctcttaaaccccc

SEQ ID NO: 622883 - DNA, 20 bp, Artificial Sequence
  chemically synthesized
ctctgggggtttaagagaaa

SEQ ID NO: 622884 - DNA, 20 bp, Artificial Sequence
  chemically synthesized
agagaaaaggagattcaaga

SEQ ID NO: 622885 - DNA, 20 bp, Artificial Sequence
  chemically synthesized
aaaggagattcaagatatgg

SEQ ID NO: 622886 - DNA, 20 bp, Artificial Sequence
  chemically synthesized
ctgctttcagaatgctagga

SEQ ID NO: 622887 - DNA, 20 bp, Artificial Sequence
  chemically synthesized
ctagatcctagcattctgaa

SEQ ID NO: 622888 - DNA, 20 bp, Artificial Sequence
  chemically synthesized
aatagctttagaggtctcaa

SEQ ID NO: 622889 - DNA, 20 bp, Artificial Sequence
  chemically synthesized
acctctaaagctatttcttt

SEQ ID NO: 622890 - DNA, 20 bp, Artificial Sequence
  chemically synthesized
gtggaaaaaactgtaaaaga

SEQ ID NO: 622891 - DNA, 20 bp, Artificial Sequence
  chemically synthesized
ggttgcagtctattgtattg

SEQ ID NO: 622892 - DNA, 20 bp, Artificial Sequence
  chemically synthesized
acatagaagtggttggtttc

SEQ ID NO: 622893 - DNA, 20 bp, Artificial Sequence
  chemically synthesized
aaatcatatacatagaagtg

SEQ ID NO: 622894 - DNA, 20 bp, Artificial Sequence
  chemically synthesized
gaaaccaaccacttctatgt

SEQ ID NO: 622895 - DNA, 20 bp, Artificial Sequence
  chemically synthesized
accacttctatgtatatgat

SEQ ID NO: 622896 - DNA, 20 bp, Artificial Sequence
  chemically synthesized
gtcagatatacttttactga

SEQ ID NO: 622897 - DNA, 20 bp, Artificial Sequence
  chemically synthesized
tatacttttactgacagaga

SEQ ID NO: 622898 - DNA, 20 bp, Artificial Sequence
  chemically synthesized
cttaaccattttgctctctc

SEQ ID NO: 622899 - DNA, 20 bp, Artificial Sequence
  chemically synthesized
ttattaatatatggttggtg

SEQ ID NO: 622900 - DNA, 20 bp, Artificial Sequence
  chemically synthesized
aggaaaaggatctctaaata

SEQ ID NO: 622901 - DNA, 20 bp, Artificial Sequence
  chemically synthesized
tcatcctgacttgaaatttc

SEQ ID NO: 622902 - DNA, 20 bp, Artificial Sequence
  chemically synthesized
aataatatattcagtacatt

SEQ ID NO: 622903 - DNA, 20 bp, Artificial Sequence
  chemically synthesized
aataaaggtttgttgaatac

SEQ ID NO: 622904 - DNA, 20 bp, Artificial Sequence
  chemically synthesized
ccatataatagacactcaat

SEQ ID NO: 622905 - DNA, 20 bp, Artificial Sequence
  chemically synthesized
acttttatttcctttgaatt

SEQ ID NO: 622906 - DNA, 20 bp, Artificial Sequence
  chemically synthesized
aaaagttgcctgtctatgct

SEQ ID NO: 622907 - DNA, 20 bp, Artificial Sequence
  chemically synthesized
aacttttcaaagataccata

SEQ ID NO: 622908 - DNA, 20 bp, Artificial Sequence
  chemically synthesized
aagatggatgaaattttagc

SEQ ID NO: 622909 - DNA, 20 bp, Artificial Sequence
  chemically synthesized
gatatccttcacctctctca

SEQ ID NO: 622910 - DNA, 20 bp, Artificial Sequence
  chemically synthesized
tttctcctttgtctattgct

SEQ ID NO: 622911 - DNA, 20 bp, Artificial Sequence
  chemically synthesized
caaaccattctttctctctg

SEQ ID NO: 622912 - DNA, 20 bp, Artificial Sequence
  chemically synthesized
aaatcgaaacagagagaaag

SEQ ID NO: 622913 - DNA, 20 bp, Artificial Sequence
  chemically synthesized
agcaccaaaccattctttct

SEQ ID NO: 622914 - DNA, 20 bp, Artificial Sequence
  chemically synthesized
gagtggccagagttgtataa

SEQ ID NO: 622915 - DNA, 20 bp, Artificial Sequence
  chemically synthesized
catcgaagttggctcattta

SEQ ID NO: 622916 - DNA, 20 bp, Artificial Sequence
  chemically synthesized
gtgtaatctctcccaatagt

SEQ ID NO: 622917 - DNA, 20 bp, Artificial Sequence
  chemically synthesized
gatgaaacaaacactattgg

SEQ ID NO: 622918 - DNA, 20 bp, Artificial Sequence
  chemically synthesized
gggagtgtaatctctcccaa

SEQ ID NO: 622919 - DNA, 20 bp, Artificial Sequence
  chemically synthesized
aacagttaatgttagactaa

SEQ ID NO: 622920 - DNA, 20 bp, Artificial Sequence
  chemically synthesized
aacattattagtctaacatt

SEQ ID NO: 622921 - DNA, 20 bp, Artificial Sequence
  chemically synthesized
aacattaactgtttctatca

SEQ ID NO: 622922 - DNA, 20 bp, Artificial Sequence
  chemically synthesized
ttttctctattttattattt

SEQ ID NO: 622923 - DNA, 20 bp, Artificial Sequence
  chemically synthesized
aaaaatttaatttacttaga

SEQ ID NO: 622924 - DNA, 20 bp, Artificial Sequence
  chemically synthesized
tgacaagaggatttaccaag

SEQ ID NO: 622925 - DNA, 20 bp, Artificial Sequence
  chemically synthesized
tgattttactaatagtgaca

SEQ ID NO: 622926 - DNA, 20 bp, Artificial Sequence
  chemically synthesized
ataaagttttggactaatta

SEQ ID NO: 622927 - DNA, 20 bp, Artificial Sequence
  chemically synthesized
aaaagtatagtgtattaaaa

SEQ ID NO: 622928 - DNA, 20 bp, Artificial Sequence
  chemically synthesized
tcctatacttcagtcaataa

SEQ ID NO: 622929 - DNA, 20 bp, Artificial Sequence
  chemically synthesized
cttcagtcaataacttagtt

SEQ ID NO: 622930 - DNA, 20 bp, Artificial Sequence
  chemically synthesized
ggttttctataattcaatca

SEQ ID NO: 622931 - DNA, 20 bp, Artificial Sequence
  chemically synthesized
tatttttctctaaataaact

SEQ ID NO: 622932 - DNA, 20 bp, Artificial Sequence
  chemically synthesized
taaaatattgcatatatttt

SEQ ID NO: 622933 - DNA, 20 bp, Artificial Sequence
  chemically synthesized
ccatgtgtgtacatcatgag

SEQ ID NO: 622934 - DNA, 20 bp, Artificial Sequence
  chemically synthesized
gtacatcatgagtatagatt

SEQ ID NO: 622935 - DNA, 20 bp, Artificial Sequence
  chemically synthesized
agtatagattctgtgtttac

SEQ ID NO: 622936 - DNA, 20 bp, Artificial Sequence
  chemically synthesized
catttgatttttaaaaagat

SEQ ID NO: 622937 - DNA, 20 bp, Artificial Sequence
  chemically synthesized
tccaactaaaatcatgaatt

SEQ ID NO: 622938 - DNA, 20 bp, Artificial Sequence
  chemically synthesized
ttaaatttaaaacaataaat

SEQ ID NO: 622939 - DNA, 20 bp, Artificial Sequence
  chemically synthesized
aaaagttggctaaatggcta

SEQ ID NO: 622940 - DNA, 20 bp, Artificial Sequence
  chemically synthesized
tgtattttcatcaaaagggt

SEQ ID NO: 622941 - DNA, 20 bp, Artificial Sequence
  chemically synthesized
ttcatcaaaagggtagttgt

SEQ ID NO: 622942 - DNA, 20 bp, Artificial Sequence
  chemically synthesized
tttggggtacgatacagtgt

SEQ ID NO: 622943 - DNA, 20 bp, Artificial Sequence
  chemically synthesized
tatcgtaccccaaaaacata

SEQ ID NO: 622944 - DNA, 20 bp, Artificial Sequence
  chemically synthesized
cctctctcttttgaatctga

SEQ ID NO: 622945 - DNA, 20 bp, Artificial Sequence
  chemically synthesized
ttagaaaaataatgaaacat

SEQ ID NO: 622946 - DNA, 20 bp, Artificial Sequence
  chemically synthesized
tgagaagacactttaaactg

SEQ ID NO: 622947 - DNA, 20 bp, Artificial Sequence
  chemically synthesized
gtttaaagtgtcttctcagt

SEQ ID NO: 622948 - DNA, 20 bp, Artificial Sequence
  chemically synthesized
agattcagtgtattcattac

SEQ ID NO: 622949 - DNA, 20 bp, Artificial Sequence
  chemically synthesized
ttcattacttttgcttcttc

SEQ ID NO: 622950 - DNA, 20 bp, Artificial Sequence
  chemically synthesized
aattagctactgtttatgag

SEQ ID NO: 622951 - DNA, 20 bp, Artificial Sequence
  chemically synthesized
gtatgaattagctactgttt

SEQ ID NO: 622952 - DNA, 20 bp, Artificial Sequence
  chemically synthesized
ttaagccagtatgaattagc

SEQ ID NO: 622953 - DNA, 20 bp, Artificial Sequence
  chemically synthesized
ataaacagtagctaattcat

SEQ ID NO: 622954 - DNA, 20 bp, Artificial Sequence
  chemically synthesized
gtaataatgttatcattcta

SEQ ID NO: 622955 - DNA, 20 bp, Artificial Sequence
  chemically synthesized
tattagtcttatccatcttg

SEQ ID NO: 622956 - DNA, 20 bp, Artificial Sequence
  chemically synthesized
tattttattagtcttatcca

SEQ ID NO: 622957 - DNA, 20 bp, Artificial Sequence
  chemically synthesized
tacaaagaataaagaaaaag

SEQ ID NO: 622958 - DNA, 20 bp, Artificial Sequence
  chemically synthesized
taagatttatgatagtctat

SEQ ID NO: 622959 - DNA, 20 bp, Artificial Sequence
  chemically synthesized
gaacagactatatgaattac

SEQ ID NO: 622960 - DNA, 20 bp, Artificial Sequence
  chemically synthesized
ctttatcgtttagttattaa

SEQ ID NO: 622961 - DNA, 20 bp, Artificial Sequence
  chemically synthesized
tgtcttgaattttatcactt

SEQ ID NO: 622962 - DNA, 20 bp, Artificial Sequence
  chemically synthesized
aaataagagggcagagggaa

SEQ ID NO: 622963 - DNA, 20 bp, Artificial Sequence
  chemically synthesized
tgtattgatgtttattgaca

SEQ ID NO: 622964 - DNA, 20 bp, Artificial Sequence
  chemically synthesized
acaataatttttatgtgtat

SEQ ID NO: 622965 - DNA, 20 bp, Artificial Sequence
  chemically synthesized
ataaaaattattgtatctat

SEQ ID NO: 622966 - DNA, 20 bp, Artificial Sequence
  chemically synthesized
tctgcagggtctggggattc

SEQ ID NO: 622967 - DNA, 20 bp, Artificial Sequence
  chemically synthesized
aatcccaattctgcagggtc

SEQ ID NO: 622968 - DNA, 20 bp, Artificial Sequence
  chemically synthesized
aatccccagaccctgcagaa

SEQ ID NO: 622969 - DNA, 20 bp, Artificial Sequence
  chemically synthesized
ttttgttctccttgtcgttc

SEQ ID NO: 622970 - DNA, 20 bp, Artificial Sequence
  chemically synthesized
aagacatttcacacttctca

SEQ ID NO: 622971 - DNA, 20 bp, Artificial Sequence
  chemically synthesized
cacttctcaaagagattact

SEQ ID NO: 622972 - DNA, 20 bp, Artificial Sequence
  chemically synthesized
aaggatggtgatgaggaatg

SEQ ID NO: 622973 - DNA, 20 bp, Artificial Sequence
  chemically synthesized
tctcgagttcataggagact

SEQ ID NO: 622974 - DNA, 20 bp, Artificial Sequence
  chemically synthesized
ctctttctcttccttggttt

SEQ ID NO: 622975 - DNA, 20 bp, Artificial Sequence
  chemically synthesized
taaaattactctttctcttc

SEQ ID NO: 622976 - DNA, 20 bp, Artificial Sequence
  chemically synthesized
aattttataataaatgttgc

SEQ ID NO: 622977 - DNA, 20 bp, Artificial Sequence
  chemically synthesized
gttgctgtggatttcttcat

SEQ ID NO: 622978 - DNA, 20 bp, Artificial Sequence
  chemically synthesized
acttaattaatttttgttat

SEQ ID NO: 622979 - DNA, 20 bp, Artificial Sequence
  chemically synthesized
tgcattggtctctgtattta

SEQ ID NO: 622980 - DNA, 20 bp, Artificial Sequence
  chemically synthesized
tgtaatcactttcccctata

SEQ ID NO: 622981 - DNA, 20 bp, Artificial Sequence
  chemically synthesized
aacaatccagatatagggga

SEQ ID NO: 622982 - DNA, 20 bp, Artificial Sequence
  chemically synthesized
agtttaccctaatttcatga

SEQ ID NO: 622983 - DNA, 20 bp, Artificial Sequence
  chemically synthesized
ttttttatttttttcttgtt

SEQ ID NO: 622984 - DNA, 20 bp, Artificial Sequence
  chemically synthesized
cccatccttttttatttttt

SEQ ID NO: 622985 - DNA, 20 bp, Artificial Sequence
  chemically synthesized
aaggatgggttgaaactagg

SEQ ID NO: 622986 - DNA, 20 bp, Artificial Sequence
  chemically synthesized
ccttcttatttcaatcctac

SEQ ID NO: 622987 - DNA, 20 bp, Artificial Sequence
  chemically synthesized
tcaattttatgttttcactt

SEQ ID NO: 622988 - DNA, 20 bp, Artificial Sequence
  chemically synthesized
atgataaggcattctcaatt

SEQ ID NO: 622989 - DNA, 20 bp, Artificial Sequence
  chemically synthesized
aaattctgtcatgcctgttg

SEQ ID NO: 622990 - DNA, 20 bp, Artificial Sequence
  chemically synthesized
tatgattactcttggggtcc

SEQ ID NO: 622991 - DNA, 20 bp, Artificial Sequence
  chemically synthesized
gttatttagctcccttaggg

SEQ ID NO: 622992 - DNA, 20 bp, Artificial Sequence
  chemically synthesized
agtgtagatgtctattgcaa

SEQ ID NO: 622993 - DNA, 20 bp, Artificial Sequence
  chemically synthesized
atttgttgacttccttcaag

SEQ ID NO: 622994 - DNA, 20 bp, Artificial Sequence
  chemically synthesized
ttgacttccttcaaggttgg

SEQ ID NO: 622995 - DNA, 20 bp, Artificial Sequence
  chemically synthesized
tctcagcctccaaaaggcta

SEQ ID NO: 622996 - DNA, 20 bp, Artificial Sequence
  chemically synthesized
agttctttgagatgatcgat

SEQ ID NO: 622997 - DNA, 20 bp, Artificial Sequence
  chemically synthesized
tatagccaccttctgtatca

SEQ ID NO: 622998 - DNA, 20 bp, Artificial Sequence
  chemically synthesized
tcagaacaatcaaagaagct

SEQ ID NO: 622999 - DNA, 20 bp, Artificial Sequence
  chemically synthesized
ctccagtaatcagatagctt

SEQ ID NO: 623000 - DNA, 20 bp, Artificial Sequence
  chemically synthesized
agtctctcctccagtaatca

SEQ ID NO: 623001 - DNA, 20 bp, Artificial Sequence
  chemically synthesized
aggagagactgacataaaat

SEQ ID NO: 623002 - DNA, 20 bp, Artificial Sequence
  chemically synthesized
taacttcttgtgaaagttgt

SEQ ID NO: 623003 - DNA, 20 bp, Artificial Sequence
  chemically synthesized
cttaagaacaatcttccctc

SEQ ID NO: 623004 - DNA, 20 bp, Artificial Sequence
  chemically synthesized
gtgatttcaaagccacagag

SEQ ID NO: 623005 - DNA, 20 bp, Artificial Sequence
  chemically synthesized
ccttgtagttatcccacatg

SEQ ID NO: 623006 - DNA, 20 bp, Artificial Sequence
  chemically synthesized
tattgttggaagagctaagc

SEQ ID NO: 623007 - DNA, 20 bp, Artificial Sequence
  chemically synthesized
aaatctagttctctttaaac

SEQ ID NO: 623008 - DNA, 20 bp, Artificial Sequence
  chemically synthesized
taagcaatagtttaaagaga

SEQ ID NO: 623009 - DNA, 20 bp, Artificial Sequence
  chemically synthesized
tgttgaattttaggcagcca

SEQ ID NO: 623010 - DNA, 20 bp, Artificial Sequence
  chemically synthesized
ggcaagaactaattttcttt

SEQ ID NO: 623011 - DNA, 20 bp, Artificial Sequence
  chemically synthesized
tatttatgtcatccaatgca

SEQ ID NO: 623012 - DNA, 20 bp, Artificial Sequence
  chemically synthesized
atccaatgcacaaagcttta

SEQ ID NO: 623013 - DNA, 20 bp, Artificial Sequence
  chemically synthesized
taatatttcctaaatcataa

SEQ ID NO: 623014 - DNA, 20 bp, Artificial Sequence
  chemically synthesized
tcaatgttcttttcacttca

SEQ ID NO: 623015 - DNA, 20 bp, Artificial Sequence
  chemically synthesized
gactacagagtcagacacac

SEQ ID NO: 623016 - DNA, 20 bp, Artificial Sequence
  chemically synthesized
agacacacctgagtttgaag

SEQ ID NO: 623017 - DNA, 20 bp, Artificial Sequence
  chemically synthesized
aggaatttaacctcttcgag

SEQ ID NO: 623018 - DNA, 20 bp, Artificial Sequence
  chemically synthesized
taacctcttcgaggccagtt

SEQ ID NO: 623019 - DNA, 20 bp, Artificial Sequence
  chemically synthesized
caatagaaggtaatatgctt

SEQ ID NO: 623020 - DNA, 20 bp, Artificial Sequence
  chemically synthesized
ctccttcacaatagaaggta

SEQ ID NO: 623021 - DNA, 20 bp, Artificial Sequence
  chemically synthesized
gaaggagcaaataccggcta

SEQ ID NO: 623022 - DNA, 20 bp, Artificial Sequence
  chemically synthesized
ccctcctcacctggttgcta

SEQ ID NO: 623023 - DNA, 20 bp, Artificial Sequence
  chemically synthesized
tacagttaaggaaactaaag

SEQ ID NO: 623024 - DNA, 20 bp, Artificial Sequence
  chemically synthesized
aggtttctttaaatctgagc

SEQ ID NO: 623025 - DNA, 20 bp, Artificial Sequence
  chemically synthesized
gcacccaggtttctttaaat

SEQ ID NO: 623026 - DNA, 20 bp, Artificial Sequence
  chemically synthesized
cttttttgatttgactgcac

SEQ ID NO: 623027 - DNA, 20 bp, Artificial Sequence
  chemically synthesized
cctgggtgcagtcaaatcaa

SEQ ID NO: 623028 - DNA, 20 bp, Artificial Sequence
  chemically synthesized
cggttcagccacttaatctt

SEQ ID NO: 623029 - DNA, 20 bp, Artificial Sequence
  chemically synthesized
aacagctctttctctgaccc

SEQ ID NO: 623030 - DNA, 20 bp, Artificial Sequence
  chemically synthesized
gaagtgggcatgtggaaggg

SEQ ID NO: 623031 - DNA, 20 bp, Artificial Sequence
  chemically synthesized
catgcccacttcaacccttg

SEQ ID NO: 623032 - DNA, 20 bp, Artificial Sequence
  chemically synthesized
tgagtaactctgttacctag

SEQ ID NO: 623033 - DNA, 20 bp, Artificial Sequence
  chemically synthesized
aagaagtgcttgaagaggaa

SEQ ID NO: 623034 - DNA, 20 bp, Artificial Sequence
  chemically synthesized
tgttcctcttcaagcacttc

SEQ ID NO: 623035 - DNA, 20 bp, Artificial Sequence
  chemically synthesized
tagaaaacctgaagctaaag

SEQ ID NO: 623036 - DNA, 20 bp, Artificial Sequence
  chemically synthesized
cttcaagcacttctttagct

SEQ ID NO: 623037 - DNA, 20 bp, Artificial Sequence
  chemically synthesized
aggttttctaatctggaaac

SEQ ID NO: 623038 - DNA, 20 bp, Artificial Sequence
  chemically synthesized
ctaattcagaaacagaagtt

SEQ ID NO: 623039 - DNA, 20 bp, Artificial Sequence
  chemically synthesized
ttcaggtctaattcagaaac

SEQ ID NO: 623040 - DNA, 20 bp, Artificial Sequence
  chemically synthesized
tgaactaatttaggctgtca

SEQ ID NO: 623041 - DNA, 20 bp, Artificial Sequence
  chemically synthesized
atttattgttccgactcagg

SEQ ID NO: 623042 - DNA, 20 bp, Artificial Sequence
  chemically synthesized
aactcttctccttatttcag

SEQ ID NO: 623043 - DNA, 20 bp, Artificial Sequence
  chemically synthesized
acaatataattatacgtata

SEQ ID NO: 623044 - DNA, 20 bp, Artificial Sequence
  chemically synthesized
actaaaaaataaaatgaaat

SEQ ID NO: 623045 - DNA, 20 bp, Artificial Sequence
  chemically synthesized
aaataaaatgaaataaaagc

SEQ ID NO: 623046 - DNA, 20 bp, Artificial Sequence
  chemically synthesized
cctgaatccacgtatgaagc

SEQ ID NO: 623047 - DNA, 20 bp, Artificial Sequence
  chemically synthesized
ataaaagcttcggcttcata

SEQ ID NO: 623048 - DNA, 20 bp, Artificial Sequence
  chemically synthesized
ttcggcttcatacgtggatt

SEQ ID NO: 623049 - DNA, 20 bp, Artificial Sequence
  chemically synthesized
attcagggattcacaagaga

SEQ ID NO: 623050 - DNA, 20 bp, Artificial Sequence
  chemically synthesized
acacacacacacacttctgt

SEQ ID NO: 623051 - DNA, 20 bp, Artificial Sequence
  chemically synthesized
acacacacacacacacactt

SEQ ID NO: 623052 - DNA, 20 bp, Artificial Sequence
  chemically synthesized
cacaaatgctatgttccatc

SEQ ID NO: 623053 - DNA, 20 bp, Artificial Sequence
  chemically synthesized
cgccttggcttcccaaagtg

SEQ ID NO: 623054 - DNA, 20 bp, Artificial Sequence
  chemically synthesized
acgtcaaatgatccacccgc

SEQ ID NO: 623055 - DNA, 20 bp, Artificial Sequence
  chemically synthesized
ttttgtatttttagtagaga

SEQ ID NO: 623056 - DNA, 20 bp, Artificial Sequence
  chemically synthesized
tgcctcagcctcccgagtag

SEQ ID NO: 623057 - DNA, 20 bp, Artificial Sequence
  chemically synthesized
tcgggaggctgaggcaggac

SEQ ID NO: 623058 - DNA, 20 bp, Artificial Sequence
  chemically synthesized
gctcactgcaacctccgcct

SEQ ID NO: 623059 - DNA, 20 bp, Artificial Sequence
  chemically synthesized
ttttattttattttttgaga

SEQ ID NO: 623060 - DNA, 20 bp, Artificial Sequence
  chemically synthesized
aagagaaactgtgtgaaggg

SEQ ID NO: 623061 - DNA, 20 bp, Artificial Sequence
  chemically synthesized
gccctaaactgtccccttca

SEQ ID NO: 623062 - DNA, 20 bp, Artificial Sequence
  chemically synthesized
actgtgtgaaggggacagtt

SEQ ID NO: 623063 - DNA, 20 bp, Artificial Sequence
  chemically synthesized
taggtgagatcgcattcttg

SEQ ID NO: 623064 - DNA, 20 bp, Artificial Sequence
  chemically synthesized
gtctctaggtgagatcgcat

SEQ ID NO: 623065 - DNA, 20 bp, Artificial Sequence
  chemically synthesized
ccatatgtgccccacctcag

SEQ ID NO: 623066 - DNA, 20 bp, Artificial Sequence
  chemically synthesized
cacatatggcctttcaggct

SEQ ID NO: 623067 - DNA, 20 bp, Artificial Sequence
  chemically synthesized
tgggagtgcttgttgcccac

SEQ ID NO: 623068 - DNA, 20 bp, Artificial Sequence
  chemically synthesized
acccatcccctagctgctgg

SEQ ID NO: 623069 - DNA, 20 bp, Artificial Sequence
  chemically synthesized
tgcccactagagtcagagag

SEQ ID NO: 623070 - DNA, 20 bp, Artificial Sequence
  chemically synthesized
aaaacaaaataaaataaaat

SEQ ID NO: 623071 - DNA, 20 bp, Artificial Sequence
  chemically synthesized
caaacggaaattttatttta

SEQ ID NO: 623072 - DNA, 20 bp, Artificial Sequence
  chemically synthesized
gaggcggcagttgcagtgag

SEQ ID NO: 623073 - DNA, 20 bp, Artificial Sequence
  chemically synthesized
tgcctcagcctccctagtag

SEQ ID NO: 623074 - DNA, 20 bp, Artificial Sequence
  chemically synthesized
ttttgtatttttagtagaga

SEQ ID NO: 623075 - DNA, 20 bp, Artificial Sequence
  chemically synthesized
cgcctcagactcccaaagtc

SEQ ID NO: 623076 - DNA, 20 bp, Artificial Sequence
  chemically synthesized
ataagatctactctcttaac

SEQ ID NO: 623077 - DNA, 20 bp, Artificial Sequence
  chemically synthesized
tttcccgttgtcaacagata

SEQ ID NO: 623078 - DNA, 20 bp, Artificial Sequence
  chemically synthesized
tattaaaaatgtatctgaat

SEQ ID NO: 623079 - DNA, 20 bp, Artificial Sequence
  chemically synthesized
ttttgcccaatagtctctat

SEQ ID NO: 623080 - DNA, 20 bp, Artificial Sequence
  chemically synthesized
gggcaaaatacgaacagatg

SEQ ID NO: 623081 - DNA, 20 bp, Artificial Sequence
  chemically synthesized
taactcaagttttttaaaat

SEQ ID NO: 623082 - DNA, 20 bp, Artificial Sequence
  chemically synthesized
ggaattttaaaaaacttgag

SEQ ID NO: 623083 - DNA, 20 bp, Artificial Sequence
  chemically synthesized
aaatatgcatgaatcttaac

SEQ ID NO: 623084 - DNA, 20 bp, Artificial Sequence
  chemically synthesized
tctagtgacaatactttaga

SEQ ID NO: 623085 - DNA, 20 bp, Artificial Sequence
  chemically synthesized
tcaatctctagtgacaatac

SEQ ID NO: 623086 - DNA, 20 bp, Artificial Sequence
  chemically synthesized
agaatctaaagtattgtcac

SEQ ID NO: 623087 - DNA, 20 bp, Artificial Sequence
  chemically synthesized
attgtcactagagattgaaa

SEQ ID NO: 623088 - DNA, 20 bp, Artificial Sequence
  chemically synthesized
ataacaattggagttgaaag

SEQ ID NO: 623089 - DNA, 20 bp, Artificial Sequence
  chemically synthesized
cttttataacaattggagtt

SEQ ID NO: 623090 - DNA, 20 bp, Artificial Sequence
  chemically synthesized
ttctgcttactttcccttgc

SEQ ID NO: 623091 - DNA, 20 bp, Artificial Sequence
  chemically synthesized
aaagtaagcagaaatatcca

SEQ ID NO: 623092 - DNA, 20 bp, Artificial Sequence
  chemically synthesized
ctccaaatcccactggatat

SEQ ID NO: 623093 - DNA, 20 bp, Artificial Sequence
  chemically synthesized
ttggaggaaagctgtgtaaa

SEQ ID NO: 623094 - DNA, 20 bp, Artificial Sequence
  chemically synthesized
aatttaagaagcgcccttta

SEQ ID NO: 623095 - DNA, 20 bp, Artificial Sequence
  chemically synthesized
gaaggactccagcagagtga

SEQ ID NO: 623096 - DNA, 20 bp, Artificial Sequence
  chemically synthesized
gccctgctctaccggcaatg

SEQ ID NO: 623097 - DNA, 20 bp, Artificial Sequence
  chemically synthesized
aatagaagtgtgttaagtaa

SEQ ID NO: 623098 - DNA, 20 bp, Artificial Sequence
  chemically synthesized
ttacttaacacacttctatt

SEQ ID NO: 623099 - DNA, 20 bp, Artificial Sequence
  chemically synthesized
aatgagtgcatcaggtagga

SEQ ID NO: 623100 - DNA, 20 bp, Artificial Sequence
  chemically synthesized
ttaaaaaatgagtgcatcag

SEQ ID NO: 623101 - DNA, 20 bp, Artificial Sequence
  chemically synthesized
attatcactttttgttacac

SEQ ID NO: 623102 - DNA, 20 bp, Artificial Sequence
  chemically synthesized
tctttgttttaaaaataatg

SEQ ID NO: 623103 - DNA, 20 bp, Artificial Sequence
  chemically synthesized
taataatacatttatacact

SEQ ID NO: 623104 - DNA, 20 bp, Artificial Sequence
  chemically synthesized
cattaatttatgagcctttg

SEQ ID NO: 623105 - DNA, 20 bp, Artificial Sequence
  chemically synthesized
aaattaatgcaaacgtgtgg

SEQ ID NO: 623106 - DNA, 20 bp, Artificial Sequence
  chemically synthesized
ttgtgtgatgaaactattcc

SEQ ID NO: 623107 - DNA, 20 bp, Artificial Sequence
  chemically synthesized
actgctctgccataataaag

SEQ ID NO: 623108 - DNA, 20 bp, Artificial Sequence
  chemically synthesized
gccataataaagctctgttt

SEQ ID NO: 623109 - DNA, 20 bp, Artificial Sequence
  chemically synthesized
ttcatttcaaagcaggcaaa

SEQ ID NO: 623110 - DNA, 20 bp, Artificial Sequence
  chemically synthesized
acgcagcagtaaaagttgca

SEQ ID NO: 623111 - DNA, 20 bp, Artificial Sequence
  chemically synthesized
gcatcatgcaacttttactg

SEQ ID NO: 623112 - DNA, 20 bp, Artificial Sequence
  chemically synthesized
aagacaagagcaactcagaa

SEQ ID NO: 623113 - DNA, 20 bp, Artificial Sequence
  chemically synthesized
gcatcatgtgaccatcaaca

SEQ ID NO: 623114 - DNA, 20 bp, Artificial Sequence
  chemically synthesized
tggtcacatgatgcaggcag

SEQ ID NO: 623115 - DNA, 20 bp, Artificial Sequence
  chemically synthesized
accctcaggcagccagatag

SEQ ID NO: 623116 - DNA, 20 bp, Artificial Sequence
  chemically synthesized
ctttaaataaggagcactga

SEQ ID NO: 623117 - DNA, 20 bp, Artificial Sequence
  chemically synthesized
taaaattgtaacagagtaag

SEQ ID NO: 623118 - DNA, 20 bp, Artificial Sequence
  chemically synthesized
ttttctgagagatctctgaa

SEQ ID NO: 623119 - DNA, 20 bp, Artificial Sequence
  chemically synthesized
ttcaaatctgcatggttcca

SEQ ID NO: 623120 - DNA, 20 bp, Artificial Sequence
  chemically synthesized
aaataatcagcatggaacca

SEQ ID NO: 623121 - DNA, 20 bp, Artificial Sequence
  chemically synthesized
tttgaaagtacatgtttgtc

SEQ ID NO: 623122 - DNA, 20 bp, Artificial Sequence
  chemically synthesized
aatgttcatgctttgaaagt

SEQ ID NO: 623123 - DNA, 20 bp, Artificial Sequence
  chemically synthesized
aagttactgttttcaaatgt

SEQ ID NO: 623124 - DNA, 20 bp, Artificial Sequence
  chemically synthesized
atttgaaaacagtaacttgc

SEQ ID NO: 623125 - DNA, 20 bp, Artificial Sequence
  chemically synthesized
gtttagaaactgatgcaagt

SEQ ID NO: 623126 - DNA, 20 bp, Artificial Sequence
  chemically synthesized
acttgcatcagtttctaaac

SEQ ID NO: 623127 - DNA, 20 bp, Artificial Sequence
  chemically synthesized
tctgatagttacattaaatc

SEQ ID NO: 623128 - DNA, 20 bp, Artificial Sequence
  chemically synthesized
ttttatatttcagtatctca

SEQ ID NO: 623129 - DNA, 20 bp, Artificial Sequence
  chemically synthesized
acaatgacctcctttttctg

SEQ ID NO: 623130 - DNA, 20 bp, Artificial Sequence
  chemically synthesized
gtagaaatgttacgaaataa

SEQ ID NO: 623131 - DNA, 20 bp, Artificial Sequence
  chemically synthesized
cgcctcggcctcccaaagtg

SEQ ID NO: 623132 - DNA, 20 bp, Artificial Sequence
  chemically synthesized
tcctggctaacgcagtgaaa

SEQ ID NO: 623133 - DNA, 20 bp, Artificial Sequence
  chemically synthesized
ttttgtatttttagtagaaa

SEQ ID NO: 623134 - DNA, 20 bp, Artificial Sequence
  chemically synthesized
aatggcgtgaacctgggagg

SEQ ID NO: 623135 - DNA, 20 bp, Artificial Sequence
  chemically synthesized
atgaaagttcattgataatg

SEQ ID NO: 623136 - DNA, 20 bp, Artificial Sequence
  chemically synthesized
gtaatagttttggtatgctg

SEQ ID NO: 623137 - DNA, 20 bp, Artificial Sequence
  chemically synthesized
agattgtaatagttttggta

SEQ ID NO: 623138 - DNA, 20 bp, Artificial Sequence
  chemically synthesized
taatggatttctaagattgt

SEQ ID NO: 623139 - DNA, 20 bp, Artificial Sequence
  chemically synthesized
attacaatcttagaaatcca

SEQ ID NO: 623140 - DNA, 20 bp, Artificial Sequence
  chemically synthesized
ttaaaaatcataatggattt

SEQ ID NO: 623141 - DNA, 20 bp, Artificial Sequence
  chemically synthesized
aagcactttttaaaaatcat

SEQ ID NO: 623142 - DNA, 20 bp, Artificial Sequence
  chemically synthesized
aatccattatgatttttaaa

SEQ ID NO: 623143 - DNA, 20 bp, Artificial Sequence
  chemically synthesized
tttttttttttcctctgaga

SEQ ID NO: 623144 - DNA, 20 bp, Artificial Sequence
  chemically synthesized
ggttcaagcaattctcctgc

SEQ ID NO: 623145 - DNA, 20 bp, Artificial Sequence
  chemically synthesized
tcaggaagctgaggcaggag

SEQ ID NO: 623146 - DNA, 20 bp, Artificial Sequence
  chemically synthesized
tgcctcagcttcctgagtag

SEQ ID NO: 623147 - DNA, 20 bp, Artificial Sequence
  chemically synthesized
ttttgtatttttagtagaga

SEQ ID NO: 623148 - DNA, 20 bp, Artificial Sequence
  chemically synthesized
tgggcagatcacttcagatc

SEQ ID NO: 623149 - DNA, 20 bp, Artificial Sequence
  chemically synthesized
caccttggcctcccaaagtg

SEQ ID NO: 623150 - DNA, 20 bp, Artificial Sequence
  chemically synthesized
tattctgaaagagacatatc

SEQ ID NO: 623151 - DNA, 20 bp, Artificial Sequence
  chemically synthesized
aggaggtttgttcgttattt

SEQ ID NO: 623152 - DNA, 20 bp, Artificial Sequence
  chemically synthesized
tgataaatatgatgatccca

SEQ ID NO: 623153 - DNA, 20 bp, Artificial Sequence
  chemically synthesized
cactttttaaagaaaatcaa

SEQ ID NO: 623154 - DNA, 20 bp, Artificial Sequence
  chemically synthesized
ttaaagaaaatcaaacatgc

SEQ ID NO: 623155 - DNA, 20 bp, Artificial Sequence
  chemically synthesized
atttgtataaacagaagcat

SEQ ID NO: 623156 - DNA, 20 bp, Artificial Sequence
  chemically synthesized
ataaatttgtataaacagaa

SEQ ID NO: 623157 - DNA, 20 bp, Artificial Sequence
  chemically synthesized
cccaagaatataagaaagta

SEQ ID NO: 623158 - DNA, 20 bp, Artificial Sequence
  chemically synthesized
agacacccttctgttgataa

SEQ ID NO: 623159 - DNA, 20 bp, Artificial Sequence
  chemically synthesized
ccctcaaaagtatacaagta

SEQ ID NO: 623160 - DNA, 20 bp, Artificial Sequence
  chemically synthesized
cacatgcacacacatacaca

SEQ ID NO: 623161 - DNA, 20 bp, Artificial Sequence
  chemically synthesized
tgaaatgggtagcaggcata

SEQ ID NO: 623162 - DNA, 20 bp, Artificial Sequence
  chemically synthesized
acccatttcatcttcttctt

SEQ ID NO: 623163 - DNA, 20 bp, Artificial Sequence
  chemically synthesized
acccacccctgctcctctct

SEQ ID NO: 623164 - DNA, 20 bp, Artificial Sequence
  chemically synthesized
cctagttcaggagtacagtg

SEQ ID NO: 623165 - DNA, 20 bp, Artificial Sequence
  chemically synthesized
aacactgtactcctgaacta

SEQ ID NO: 623166 - DNA, 20 bp, Artificial Sequence
  chemically synthesized
ctgtactcctgaactaggtt

SEQ ID NO: 623167 - DNA, 20 bp, Artificial Sequence
  chemically synthesized
tgattgattcaggaatgtgt

SEQ ID NO: 623168 - DNA, 20 bp, Artificial Sequence
  chemically synthesized
cattctctccaacagaagac

SEQ ID NO: 623169 - DNA, 20 bp, Artificial Sequence
  chemically synthesized
aggtcttctgttggagagaa

SEQ ID NO: 623170 - DNA, 20 bp, Artificial Sequence
  chemically synthesized
catatcgagagataatgtct

SEQ ID NO: 623171 - DNA, 20 bp, Artificial Sequence
  chemically synthesized
cctctctcaccctttctcca

SEQ ID NO: 623172 - DNA, 20 bp, Artificial Sequence
  chemically synthesized
tattacttacttcagataca

SEQ ID NO: 623173 - DNA, 20 bp, Artificial Sequence
  chemically synthesized
caaaccagtttaagaaaaaa

SEQ ID NO: 623174 - DNA, 20 bp, Artificial Sequence
  chemically synthesized
gaaacttttttttttcttaa

SEQ ID NO: 623175 - DNA, 20 bp, Artificial Sequence
  chemically synthesized
ttttttcttaaactggtttg

SEQ ID NO: 623176 - DNA, 20 bp, Artificial Sequence
  chemically synthesized
aatttacaaaaacctagcaa

SEQ ID NO: 623177 - DNA, 20 bp, Artificial Sequence
  chemically synthesized
tttttgtaaattagcagaaa

SEQ ID NO: 623178 - DNA, 20 bp, Artificial Sequence
  chemically synthesized
tgtatgtatgtatattttgg

SEQ ID NO: 623179 - DNA, 20 bp, Artificial Sequence
  chemically synthesized
ataaaattaatccaattatt

SEQ ID NO: 623180 - DNA, 20 bp, Artificial Sequence
  chemically synthesized
aggtgctgaaactttcaata

SEQ ID NO: 623181 - DNA, 20 bp, Artificial Sequence
  chemically synthesized
cctctttaaacaatgagtta

SEQ ID NO: 623182 - DNA, 20 bp, Artificial Sequence
  chemically synthesized
gtcatgtaatctaactaact

SEQ ID NO: 623183 - DNA, 20 bp, Artificial Sequence
  chemically synthesized
gaaaatcaattgattggatc

SEQ ID NO: 623184 - DNA, 20 bp, Artificial Sequence
  chemically synthesized
taaaatcattggatccaatc

SEQ ID NO: 623185 - DNA, 20 bp, Artificial Sequence
  chemically synthesized
tttgttcattcatgaaaatc

SEQ ID NO: 623186 - DNA, 20 bp, Artificial Sequence
  chemically synthesized
taggtttaatagaacttact

SEQ ID NO: 623187 - DNA, 20 bp, Artificial Sequence
  chemically synthesized
ggcctggggttatcaagata

SEQ ID NO: 623188 - DNA, 20 bp, Artificial Sequence
  chemically synthesized
gagaccagtcattttttttt

SEQ ID NO: 623189 - DNA, 20 bp, Artificial Sequence
  chemically synthesized
gattacctacaatgaggttt

SEQ ID NO: 623190 - DNA, 20 bp, Artificial Sequence
  chemically synthesized
agctcagtgattacctacaa

SEQ ID NO: 623191 - DNA, 20 bp, Artificial Sequence
  chemically synthesized
tcatgctacctccctgagct

SEQ ID NO: 623192 - DNA, 20 bp, Artificial Sequence
  chemically synthesized
cagcaagggatagggaagga

SEQ ID NO: 623193 - DNA, 20 bp, Artificial Sequence
  chemically synthesized
ggaacaataatagctctctc

SEQ ID NO: 623194 - DNA, 20 bp, Artificial Sequence
  chemically synthesized
tttgtgctacgtactgtaat

SEQ ID NO: 623195 - DNA, 20 bp, Artificial Sequence
  chemically synthesized
gcggagctattgcactgacc

SEQ ID NO: 623196 - DNA, 20 bp, Artificial Sequence
  chemically synthesized
cactcacgccaaaggaaatg

SEQ ID NO: 623197 - DNA, 20 bp, Artificial Sequence
  chemically synthesized
attaacactcacgccaaagg

SEQ ID NO: 623198 - DNA, 20 bp, Artificial Sequence
  chemically synthesized
tggcgtgagtgttaatgcac

SEQ ID NO: 623199 - DNA, 20 bp, Artificial Sequence
  chemically synthesized
ttaaaaaaagaaaacctctc

SEQ ID NO: 623200 - DNA, 20 bp, Artificial Sequence
  chemically synthesized
aaaagaaaacctctcagcag

SEQ ID NO: 623201 - DNA, 20 bp, Artificial Sequence
  chemically synthesized
tgaaggaagctaatctgctg

SEQ ID NO: 623202 - DNA, 20 bp, Artificial Sequence
  chemically synthesized
ttccttcaacctttgtaaga

SEQ ID NO: 623203 - DNA, 20 bp, Artificial Sequence
  chemically synthesized
cctgcttttgacggccaacc

SEQ ID NO: 623204 - DNA, 20 bp, Artificial Sequence
  chemically synthesized
ttatatgaaccagaaatacc

SEQ ID NO: 623205 - DNA, 20 bp, Artificial Sequence
  chemically synthesized
tcctctatttacagctaagc

SEQ ID NO: 623206 - DNA, 20 bp, Artificial Sequence
  chemically synthesized
caatattttccacagtaatc

SEQ ID NO: 623207 - DNA, 20 bp, Artificial Sequence
  chemically synthesized
cacagcaatacattttgggg

SEQ ID NO: 623208 - DNA, 20 bp, Artificial Sequence
  chemically synthesized
gttatcgattcggtttaggg

SEQ ID NO: 623209 - DNA, 20 bp, Artificial Sequence
  chemically synthesized
gtgctgttatcgattcggtt

SEQ ID NO: 623210 - DNA, 20 bp, Artificial Sequence
  chemically synthesized
gacatgagtgctgttatcga

SEQ ID NO: 623211 - DNA, 20 bp, Artificial Sequence
  chemically synthesized
atccaagacatgagtgctgt

SEQ ID NO: 623212 - DNA, 20 bp, Artificial Sequence
  chemically synthesized
ataacagcactcatgtcttg

SEQ ID NO: 623213 - DNA, 20 bp, Artificial Sequence
  chemically synthesized
taaaatatttaaagttactt

SEQ ID NO: 623214 - DNA, 20 bp, Artificial Sequence
  chemically synthesized
taaagttacttctctgattg

SEQ ID NO: 623215 - DNA, 20 bp, Artificial Sequence
  chemically synthesized
attccaacttgggcaacaga

SEQ ID NO: 623216 - DNA, 20 bp, Artificial Sequence
  chemically synthesized
tgagccaccacacccagcca

SEQ ID NO: 623217 - DNA, 20 bp, Artificial Sequence
  chemically synthesized
actactttataagtttgcta

SEQ ID NO: 623218 - DNA, 20 bp, Artificial Sequence
  chemically synthesized
aaagtagcaaacttataaag

SEQ ID NO: 623219 - DNA, 20 bp, Artificial Sequence
  chemically synthesized
tgtgatgaaatcactacttt

SEQ ID NO: 623220 - DNA, 20 bp, Artificial Sequence
  chemically synthesized
atattttacagtatcagtta

SEQ ID NO: 623221 - DNA, 20 bp, Artificial Sequence
  chemically synthesized
tttacattttaattcatata

SEQ ID NO: 623222 - DNA, 20 bp, Artificial Sequence
  chemically synthesized
ctgtaggcttattttccttg

SEQ ID NO: 623223 - DNA, 20 bp, Artificial Sequence
  chemically synthesized
tcacaaaaagttagttttct

SEQ ID NO: 623224 - DNA, 20 bp, Artificial Sequence
  chemically synthesized
aaatcattttatcacaaaaa

SEQ ID NO: 623225 - DNA, 20 bp, Artificial Sequence
  chemically synthesized
aaaactaactttttgtgata

SEQ ID NO: 623226 - DNA, 20 bp, Artificial Sequence
  chemically synthesized
tacttctttaaatgcttatt

SEQ ID NO: 623227 - DNA, 20 bp, Artificial Sequence
  chemically synthesized
tcatgttctagtacttcttt

SEQ ID NO: 623228 - DNA, 20 bp, Artificial Sequence
  chemically synthesized
cctttaacacatatccaatc

SEQ ID NO: 623229 - DNA, 20 bp, Artificial Sequence
  chemically synthesized
ttcttaattttttctaaaac

SEQ ID NO: 623230 - DNA, 20 bp, Artificial Sequence
  chemically synthesized
tgttttagaaaaaattaaga

SEQ ID NO: 623231 - DNA, 20 bp, Artificial Sequence
  chemically synthesized
aaaatgtatgcaacgcaaat

SEQ ID NO: 623232 - DNA, 20 bp, Artificial Sequence
  chemically synthesized
atttattagattacaggata

SEQ ID NO: 623233 - DNA, 20 bp, Artificial Sequence
  chemically synthesized
aaaaaatcatctccatattt

SEQ ID NO: 623234 - DNA, 20 bp, Artificial Sequence
  chemically synthesized
ctgtaatctaataaatatgg

SEQ ID NO: 623235 - DNA, 20 bp, Artificial Sequence
  chemically synthesized
tttttatagtgatgtaatgg

SEQ ID NO: 623236 - DNA, 20 bp, Artificial Sequence
  chemically synthesized
gtagaatttaaaagatttaa

SEQ ID NO: 623237 - DNA, 20 bp, Artificial Sequence
  chemically synthesized
tatttaatttagtagaattt

SEQ ID NO: 623238 - DNA, 20 bp, Artificial Sequence
  chemically synthesized
tttgagttagccactcaaac

SEQ ID NO: 623239 - DNA, 20 bp, Artificial Sequence
  chemically synthesized
ttaaatcagaataacaaatc

SEQ ID NO: 623240 - DNA, 20 bp, Artificial Sequence
  chemically synthesized
ctcaaacaggagatttgtta

SEQ ID NO: 623241 - DNA, 20 bp, Artificial Sequence
  chemically synthesized
gagtgattgttaccaaaggc

SEQ ID NO: 623242 - DNA, 20 bp, Artificial Sequence
  chemically synthesized
atttttctcgaactgtttga

SEQ ID NO: 623243 - DNA, 20 bp, Artificial Sequence
  chemically synthesized
acatacatatatttttctcg

SEQ ID NO: 623244 - DNA, 20 bp, Artificial Sequence
  chemically synthesized
tatatattcatgggcaagga

SEQ ID NO: 623245 - DNA, 20 bp, Artificial Sequence
  chemically synthesized
tagaaaaggagaaaattttt

SEQ ID NO: 623246 - DNA, 20 bp, Artificial Sequence
  chemically synthesized
acctgttgagacagaaagtg

SEQ ID NO: 623247 - DNA, 20 bp, Artificial Sequence
  chemically synthesized
tgacaaatagctgagagttg

SEQ ID NO: 623248 - DNA, 20 bp, Artificial Sequence
  chemically synthesized
ggggactggctatctttttc

SEQ ID NO: 623249 - DNA, 20 bp, Artificial Sequence
  chemically synthesized
agaatgaggctcggctattt

SEQ ID NO: 623250 - DNA, 20 bp, Artificial Sequence
  chemically synthesized
ttgtggtgctgctgagattt

SEQ ID NO: 623251 - DNA, 20 bp, Artificial Sequence
  chemically synthesized
cacatgctcttgtggtgctg

SEQ ID NO: 623252 - DNA, 20 bp, Artificial Sequence
  chemically synthesized
tctgtggtcaccaagtcacc

SEQ ID NO: 623253 - DNA, 20 bp, Artificial Sequence
  chemically synthesized
gatccgcgaaatctacattt

SEQ ID NO: 623254 - DNA, 20 bp, Artificial Sequence
  chemically synthesized
agctgggaaaagcacagaaa

SEQ ID NO: 623255 - DNA, 20 bp, Artificial Sequence
  chemically synthesized
ggaactaataaggaaaattt

SEQ ID NO: 623256 - DNA, 20 bp, Artificial Sequence
  chemically synthesized
gaagcagctgcagagtgttc

SEQ ID NO: 623257 - DNA, 20 bp, Artificial Sequence
  chemically synthesized
aaaacctcagaacactctgc

SEQ ID NO: 623258 - DNA, 20 bp, Artificial Sequence
  chemically synthesized
gcttctataaagaaagcagt

SEQ ID NO: 623259 - DNA, 20 bp, Artificial Sequence
  chemically synthesized
ttataaacaaattaaaccca

SEQ ID NO: 623260 - DNA, 20 bp, Artificial Sequence
  chemically synthesized
aagaaagcagtgtgggttta

SEQ ID NO: 623261 - DNA, 20 bp, Artificial Sequence
  chemically synthesized
agaggcttaatgaaatgaag

SEQ ID NO: 623262 - DNA, 20 bp, Artificial Sequence
  chemically synthesized
ggtagcaatggccatgactt

SEQ ID NO: 623263 - DNA, 20 bp, Artificial Sequence
  chemically synthesized
agtcatggccattgctacca

SEQ ID NO: 623264 - DNA, 20 bp, Artificial Sequence
  chemically synthesized
cttaaaaacaagagaaaagt

SEQ ID NO: 623265 - DNA, 20 bp, Artificial Sequence
  chemically synthesized
tttataagcattcacttttc

SEQ ID NO: 623266 - DNA, 20 bp, Artificial Sequence
  chemically synthesized
tgatgtacaaagaaggaaaa

SEQ ID NO: 623267 - DNA, 20 bp, Artificial Sequence
  chemically synthesized
aagaaggaaaacacagatta

SEQ ID NO: 623268 - DNA, 20 bp, Artificial Sequence
  chemically synthesized
aactatcaaaacacagtaat

SEQ ID NO: 623269 - DNA, 20 bp, Artificial Sequence
  chemically synthesized
tggaaatcatgcaacaccta

SEQ ID NO: 623270 - DNA, 20 bp, Artificial Sequence
  chemically synthesized
gcataatctcactaggtgtt

SEQ ID NO: 623271 - DNA, 20 bp, Artificial Sequence
  chemically synthesized
catgatttccatgaggaaag

SEQ ID NO: 623272 - DNA, 20 bp, Artificial Sequence
  chemically synthesized
aataatttattccactaaaa

SEQ ID NO: 623273 - DNA, 20 bp, Artificial Sequence
  chemically synthesized
agtggaataaattattctac

SEQ ID NO: 623274 - DNA, 20 bp, Artificial Sequence
  chemically synthesized
agatttttttgtcttctcat

SEQ ID NO: 623275 - DNA, 20 bp, Artificial Sequence
  chemically synthesized
ccgtaaatgtgtgcatgtac

SEQ ID NO: 623276 - DNA, 20 bp, Artificial Sequence
  chemically synthesized
agaatagtgcgttattttat

SEQ ID NO: 623277 - DNA, 20 bp, Artificial Sequence
  chemically synthesized
aataacgcactattcttttt

SEQ ID NO: 623278 - DNA, 20 bp, Artificial Sequence
  chemically synthesized
tttttttgttgtgaactgac

SEQ ID NO: 623279 - DNA, 20 bp, Artificial Sequence
  chemically synthesized
catgagctttcatatacgaa

SEQ ID NO: 623280 - DNA, 20 bp, Artificial Sequence
  chemically synthesized
aatgtgccttatatttcaaa

SEQ ID NO: 623281 - DNA, 20 bp, Artificial Sequence
  chemically synthesized
tttggctttgctttgtttga

SEQ ID NO: 623282 - DNA, 20 bp, Artificial Sequence
  chemically synthesized
aaaattaaggtttggctttg

SEQ ID NO: 623283 - DNA, 20 bp, Artificial Sequence
  chemically synthesized
tctgtaaaattaaggtttgg

SEQ ID NO: 623284 - DNA, 20 bp, Artificial Sequence
  chemically synthesized
acagttctgtaaaattaagg

SEQ ID NO: 623285 - DNA, 20 bp, Artificial Sequence
  chemically synthesized
gtagaacagttctgtaaaat

SEQ ID NO: 623286 - DNA, 20 bp, Artificial Sequence
  chemically synthesized
tacaaaaagtcactcaaaac

SEQ ID NO: 623287 - DNA, 20 bp, Artificial Sequence
  chemically synthesized
ttattgcacacaatttaaac

SEQ ID NO: 623288 - DNA, 20 bp, Artificial Sequence
  chemically synthesized
aattgatactttatttccta

SEQ ID NO: 623289 - DNA, 20 bp, Artificial Sequence
  chemically synthesized
tcaatatggcagataaattg

SEQ ID NO: 623290 - DNA, 20 bp, Artificial Sequence
  chemically synthesized
aacctccacctcctgggttc

SEQ ID NO: 623291 - DNA, 20 bp, Artificial Sequence
  chemically synthesized
tcaggaggctgaggcaggag

SEQ ID NO: 623292 - DNA, 20 bp, Artificial Sequence
  chemically synthesized
tgcctcagcctcctgagtag

SEQ ID NO: 623293 - DNA, 20 bp, Artificial Sequence
  chemically synthesized
ttttgtatttttactagaga

SEQ ID NO: 623294 - DNA, 20 bp, Artificial Sequence
  chemically synthesized
cacctcggcctcccaaagtg

SEQ ID NO: 623295 - DNA, 20 bp, Artificial Sequence
  chemically synthesized
agccaccgcgcccggcccag

SEQ ID NO: 623296 - DNA, 20 bp, Artificial Sequence
  chemically synthesized
ccagtattatgcagagatca

SEQ ID NO: 623297 - DNA, 20 bp, Artificial Sequence
  chemically synthesized
ttggcctgagaagaagatac

SEQ ID NO: 623298 - DNA, 20 bp, Artificial Sequence
  chemically synthesized
tacaggattgtcttttttat

SEQ ID NO: 623299 - DNA, 20 bp, Artificial Sequence
  chemically synthesized
tacaataaccatataatttt

SEQ ID NO: 623300 - DNA, 20 bp, Artificial Sequence
  chemically synthesized
tggttattgtatctctacaa

SEQ ID NO: 623301 - DNA, 20 bp, Artificial Sequence
  chemically synthesized
aatatattttacaatattaa

SEQ ID NO: 623302 - DNA, 20 bp, Artificial Sequence
  chemically synthesized
taaaacttgctcctcaattt

SEQ ID NO: 623303 - DNA, 20 bp, Artificial Sequence
  chemically synthesized
gtaaacattcaaattgagga

SEQ ID NO: 623304 - DNA, 20 bp, Artificial Sequence
  chemically synthesized
ataactaataagtggcagat

SEQ ID NO: 623305 - DNA, 20 bp, Artificial Sequence
  chemically synthesized
ttgagaaagttacttaagca

SEQ ID NO: 623306 - DNA, 20 bp, Artificial Sequence
  chemically synthesized
aagttacttaagcactgtgc

SEQ ID NO: 623307 - DNA, 20 bp, Artificial Sequence
  chemically synthesized
taaaaaacaaaaccgaagca

SEQ ID NO: 623308 - DNA, 20 bp, Artificial Sequence
  chemically synthesized
acttaagcactgtgcttcgg

SEQ ID NO: 623309 - DNA, 20 bp, Artificial Sequence
  chemically synthesized
ggaaagaatacttcccattt

SEQ ID NO: 623310 - DNA, 20 bp, Artificial Sequence
  chemically synthesized
gagggaatacactatcaagg

SEQ ID NO: 623311 - DNA, 20 bp, Artificial Sequence
  chemically synthesized
agttgaagttaaagaagaga

SEQ ID NO: 623312 - DNA, 20 bp, Artificial Sequence
  chemically synthesized
actatcatctatctccatgt

SEQ ID NO: 623313 - DNA, 20 bp, Artificial Sequence
  chemically synthesized
ttctctcttaagtctaactc

SEQ ID NO: 623314 - DNA, 20 bp, Artificial Sequence
  chemically synthesized
tatccaggtgggtagataat

SEQ ID NO: 623315 - DNA, 20 bp, Artificial Sequence
  chemically synthesized
aggggaaggggaaaagggcc

SEQ ID NO: 623316 - DNA, 20 bp, Artificial Sequence
  chemically synthesized
cctccaattttgatcctatt

SEQ ID NO: 623317 - DNA, 20 bp, Artificial Sequence
  chemically synthesized
atcatctcaccagttcctca

SEQ ID NO: 623318 - DNA, 20 bp, Artificial Sequence
  chemically synthesized
acaattttaagaattccaac

SEQ ID NO: 623319 - DNA, 20 bp, Artificial Sequence
  chemically synthesized
tcaataaatgcccatttatc

SEQ ID NO: 623320 - DNA, 20 bp, Artificial Sequence
  chemically synthesized
taaagaagttccatggtgaa

SEQ ID NO: 623321 - DNA, 20 bp, Artificial Sequence
  chemically synthesized
gacagctgtttaacttttaa

SEQ ID NO: 623322 - DNA, 20 bp, Artificial Sequence
  chemically synthesized
tggaatcctgcaggaaagac

SEQ ID NO: 623323 - DNA, 20 bp, Artificial Sequence
  chemically synthesized
gttaaacagctgtctttcct

SEQ ID NO: 623324 - DNA, 20 bp, Artificial Sequence
  chemically synthesized
cattacattgagaaactcta

SEQ ID NO: 623325 - DNA, 20 bp, Artificial Sequence
  chemically synthesized
tactacatactaaatcccct

SEQ ID NO: 623326 - DNA, 20 bp, Artificial Sequence
  chemically synthesized
atttagtatgtagtattccc

SEQ ID NO: 623327 - DNA, 20 bp, Artificial Sequence
  chemically synthesized
aattattcattatgggcccc

SEQ ID NO: 623328 - DNA, 20 bp, Artificial Sequence
  chemically synthesized
ctgtgccatagagcactctt

SEQ ID NO: 623329 - DNA, 20 bp, Artificial Sequence
  chemically synthesized
agcagtagctcagaatgaga

SEQ ID NO: 623330 - DNA, 20 bp, Artificial Sequence
  chemically synthesized
atccctatctcattctgagc

SEQ ID NO: 623331 - DNA, 20 bp, Artificial Sequence
  chemically synthesized
agagcctacatgtagcctag

SEQ ID NO: 623332 - DNA, 20 bp, Artificial Sequence
  chemically synthesized
tctacagaagatattgaatt

SEQ ID NO: 623333 - DNA, 20 bp, Artificial Sequence
  chemically synthesized
tataagcattgactgctatt

SEQ ID NO: 623334 - DNA, 20 bp, Artificial Sequence
  chemically synthesized
gtgaaacaagaaatagcagt

SEQ ID NO: 623335 - DNA, 20 bp, Artificial Sequence
  chemically synthesized
cttatatgggaaaggttaca

SEQ ID NO: 623336 - DNA, 20 bp, Artificial Sequence
  chemically synthesized
tagtccaggaacttctaaat

SEQ ID NO: 623337 - DNA, 20 bp, Artificial Sequence
  chemically synthesized
cttctcatcttaaactaaaa

SEQ ID NO: 623338 - DNA, 20 bp, Artificial Sequence
  chemically synthesized
aattatattttaaacttatt

SEQ ID NO: 623339 - DNA, 20 bp, Artificial Sequence
  chemically synthesized
atttacatttttattttttt

SEQ ID NO: 623340 - DNA, 20 bp, Artificial Sequence
  chemically synthesized
tatctagggtgaaattacac

SEQ ID NO: 623341 - DNA, 20 bp, Artificial Sequence
  chemically synthesized
tgtctacaagtcaacaattc

SEQ ID NO: 623342 - DNA, 20 bp, Artificial Sequence
  chemically synthesized
caagtcaacaattctaaaga

SEQ ID NO: 623343 - DNA, 20 bp, Artificial Sequence
  chemically synthesized
aaagatttagcttccagagc

SEQ ID NO: 623344 - DNA, 20 bp, Artificial Sequence
  chemically synthesized
ttctaacaataatgccaatt

SEQ ID NO: 623345 - DNA, 20 bp, Artificial Sequence
  chemically synthesized
aaggttaattataaaagata

SEQ ID NO: 623346 - DNA, 20 bp, Artificial Sequence
  chemically synthesized
gtcacctcctgttcacaaca

SEQ ID NO: 623347 - DNA, 20 bp, Artificial Sequence
  chemically synthesized
ttgacaatttacaacgctca

SEQ ID NO: 623348 - DNA, 20 bp, Artificial Sequence
  chemically synthesized
tcaagttgaacttaacaaag

SEQ ID NO: 623349 - DNA, 20 bp, Artificial Sequence
  chemically synthesized
aagaaatggatcccatttta

SEQ ID NO: 623350 - DNA, 20 bp, Artificial Sequence
  chemically synthesized
aatcaatgttcaattcatat

SEQ ID NO: 623351 - DNA, 20 bp, Artificial Sequence
  chemically synthesized
aatcatctatatgaattgaa

SEQ ID NO: 623352 - DNA, 20 bp, Artificial Sequence
  chemically synthesized
caatacccatatacacatta

SEQ ID NO: 623353 - DNA, 20 bp, Artificial Sequence
  chemically synthesized
atatacacattagaatgttt

SEQ ID NO: 623354 - DNA, 20 bp, Artificial Sequence
  chemically synthesized
tagaatgtttttatgattta

SEQ ID NO: 623355 - DNA, 20 bp, Artificial Sequence
  chemically synthesized
taacatagagcttcatactt

SEQ ID NO: 623356 - DNA, 20 bp, Artificial Sequence
  chemically synthesized
aatagtgattgcaattaaca

SEQ ID NO: 623357 - DNA, 20 bp, Artificial Sequence
  chemically synthesized
ttgggcaaattgtttatgaa

SEQ ID NO: 623358 - DNA, 20 bp, Artificial Sequence
  chemically synthesized
tgtttaggcaatgttgggca

SEQ ID NO: 623359 - DNA, 20 bp, Artificial Sequence
  chemically synthesized
ataaacccttgaatggcaag

SEQ ID NO: 623360 - DNA, 20 bp, Artificial Sequence
  chemically synthesized
ctaaacatttcttgccattc

SEQ ID NO: 623361 - DNA, 20 bp, Artificial Sequence
  chemically synthesized
tttctctttaaggatctgtg

SEQ ID NO: 623362 - DNA, 20 bp, Artificial Sequence
  chemically synthesized
cctgttgccacagtaaattc

SEQ ID NO: 623363 - DNA, 20 bp, Artificial Sequence
  chemically synthesized
catttgtacatttccttttt

SEQ ID NO: 623364 - DNA, 20 bp, Artificial Sequence
  chemically synthesized
tccttttctaaaaaaaataa

SEQ ID NO: 623365 - DNA, 20 bp, Artificial Sequence
  chemically synthesized
caaataaaggaccagtaacg

SEQ ID NO: 623366 - DNA, 20 bp, Artificial Sequence
  chemically synthesized
atttatttcaggtctgggag

SEQ ID NO: 623367 - DNA, 20 bp, Artificial Sequence
  chemically synthesized
tgatgattttgacttaattc

SEQ ID NO: 623368 - DNA, 20 bp, Artificial Sequence
  chemically synthesized
aattccctggttttctctaa

SEQ ID NO: 623369 - DNA, 20 bp, Artificial Sequence
  chemically synthesized
tctctaatactgtttgttgt

SEQ ID NO: 623370 - DNA, 20 bp, Artificial Sequence
  chemically synthesized
ttctgcatatatagaaaatt

SEQ ID NO: 623371 - DNA, 20 bp, Artificial Sequence
  chemically synthesized
atgtgcattacatatgtatt

SEQ ID NO: 623372 - DNA, 20 bp, Artificial Sequence
  chemically synthesized
taaatttaattattgcaact

SEQ ID NO: 623373 - DNA, 20 bp, Artificial Sequence
  chemically synthesized
gaggaccatgtagtacctta

SEQ ID NO: 623374 - DNA, 20 bp, Artificial Sequence
  chemically synthesized
actacatggtcctcttatac

SEQ ID NO: 623375 - DNA, 20 bp, Artificial Sequence
  chemically synthesized
ataccacacgctatacagtt

SEQ ID NO: 623376 - DNA, 20 bp, Artificial Sequence
  chemically synthesized
agacccagctagttctcagc

SEQ ID NO: 623377 - DNA, 20 bp, Artificial Sequence
  chemically synthesized
tggctgagaactagctgggt

SEQ ID NO: 623378 - DNA, 20 bp, Artificial Sequence
  chemically synthesized
tgggtcttagttttgtatct

SEQ ID NO: 623379 - DNA, 20 bp, Artificial Sequence
  chemically synthesized
gaggaaatggaaaatattct

SEQ ID NO: 623380 - DNA, 20 bp, Artificial Sequence
  chemically synthesized
gtctgcagttttgctgtttc

SEQ ID NO: 623381 - DNA, 20 bp, Artificial Sequence
  chemically synthesized
tggtatttggtctgcagttt

SEQ ID NO: 623382 - DNA, 20 bp, Artificial Sequence
  chemically synthesized
aggaaaactggtatttggtc

SEQ ID NO: 623383 - DNA, 20 bp, Artificial Sequence
  chemically synthesized
agcaaaactgcagaccaaat

SEQ ID NO: 623384 - DNA, 20 bp, Artificial Sequence
  chemically synthesized
aagatatgcattgagaagac

SEQ ID NO: 623385 - DNA, 20 bp, Artificial Sequence
  chemically synthesized
gttactgaggactgctgtca

SEQ ID NO: 623386 - DNA, 20 bp, Artificial Sequence
  chemically synthesized
atccccactgctgcttaaga

SEQ ID NO: 623387 - DNA, 20 bp, Artificial Sequence
  chemically synthesized
aatggtctttggatccccac

SEQ ID NO: 623388 - DNA, 20 bp, Artificial Sequence
  chemically synthesized
gtgggaagaggaaaataact

SEQ ID NO: 623389 - DNA, 20 bp, Artificial Sequence
  chemically synthesized
tatttcactcagatgccaat

SEQ ID NO: 623390 - DNA, 20 bp, Artificial Sequence
  chemically synthesized
caatttttgtttgctctcaa

SEQ ID NO: 623391 - DNA, 20 bp, Artificial Sequence
  chemically synthesized
caaggagccctgtcaaataa

SEQ ID NO: 623392 - DNA, 20 bp, Artificial Sequence
  chemically synthesized
ctaaggtgagctctaatcca

SEQ ID NO: 623393 - DNA, 20 bp, Artificial Sequence
  chemically synthesized
tttataaggatactaatcag

SEQ ID NO: 623394 - DNA, 20 bp, Artificial Sequence
  chemically synthesized
atctttttataaggatacta

SEQ ID NO: 623395 - DNA, 20 bp, Artificial Sequence
  chemically synthesized
attagtatccttataaaaag

SEQ ID NO: 623396 - DNA, 20 bp, Artificial Sequence
  chemically synthesized
agcctctgcaaactaaggag

SEQ ID NO: 623397 - DNA, 20 bp, Artificial Sequence
  chemically synthesized
tttcttctgaagcctccctc

SEQ ID NO: 623398 - DNA, 20 bp, Artificial Sequence
  chemically synthesized
gaggcttcagaagaaatcag

SEQ ID NO: 623399 - DNA, 20 bp, Artificial Sequence
  chemically synthesized
taaaggctaggtataatcag

SEQ ID NO: 623400 - DNA, 20 bp, Artificial Sequence
  chemically synthesized
ctactgtggagaaaataaat

SEQ ID NO: 623401 - DNA, 20 bp, Artificial Sequence
  chemically synthesized
taacaaaataccacagtaga

SEQ ID NO: 623402 - DNA, 20 bp, Artificial Sequence
  chemically synthesized
atacattccttattcatttg

SEQ ID NO: 623403 - DNA, 20 bp, Artificial Sequence
  chemically synthesized
ctgctagaacaataacaaaa

SEQ ID NO: 623404 - DNA, 20 bp, Artificial Sequence
  chemically synthesized
caacagagttcattgtaaca

SEQ ID NO: 623405 - DNA, 20 bp, Artificial Sequence
  chemically synthesized
tcacatgcccttagatatgt

SEQ ID NO: 623406 - DNA, 20 bp, Artificial Sequence
  chemically synthesized
aatatataaagttatttggt

SEQ ID NO: 623407 - DNA, 20 bp, Artificial Sequence
  chemically synthesized
cccatacctagagatgagca

SEQ ID NO: 623408 - DNA, 20 bp, Artificial Sequence
  chemically synthesized
cggatactgttattttatca

SEQ ID NO: 623409 - DNA, 20 bp, Artificial Sequence
  chemically synthesized
atgagaatacaaatatcttg

SEQ ID NO: 623410 - DNA, 20 bp, Artificial Sequence
  chemically synthesized
ctccgccaatggaggttagg

SEQ ID NO: 623411 - DNA, 20 bp, Artificial Sequence
  chemically synthesized
acctccattggcggagtcaa

SEQ ID NO: 623412 - DNA, 20 bp, Artificial Sequence
  chemically synthesized
ttcctgagatgaagtggaaa

SEQ ID NO: 623413 - DNA, 20 bp, Artificial Sequence
  chemically synthesized
aatcacttaattaattaaag

SEQ ID NO: 623414 - DNA, 20 bp, Artificial Sequence
  chemically synthesized
aaaccaggctttaattaatt

SEQ ID NO: 623415 - DNA, 20 bp, Artificial Sequence
  chemically synthesized
ccctgacaacacgaaagcat

SEQ ID NO: 623416 - DNA, 20 bp, Artificial Sequence
  chemically synthesized
atgtgcgggcccccaaacta

SEQ ID NO: 623417 - DNA, 20 bp, Artificial Sequence
  chemically synthesized
gtaaggtcatgttatcagga

SEQ ID NO: 623418 - DNA, 20 bp, Artificial Sequence
  chemically synthesized
taaagagattactacaggtg

SEQ ID NO: 623419 - DNA, 20 bp, Artificial Sequence
  chemically synthesized
agggaaatttcattcattta

SEQ ID NO: 623420 - DNA, 20 bp, Artificial Sequence
  chemically synthesized
aatttccttgcagtgaaaga

SEQ ID NO: 623421 - DNA, 20 bp, Artificial Sequence
  chemically synthesized
ttgtgaaaatattgaatgag

SEQ ID NO: 623422 - DNA, 20 bp, Artificial Sequence
  chemically synthesized
tcattttgtgaaaatattga

SEQ ID NO: 623423 - DNA, 20 bp, Artificial Sequence
  chemically synthesized
tgataactgtaatcaaggca

SEQ ID NO: 623424 - DNA, 20 bp, Artificial Sequence
  chemically synthesized
agctgaaataaagctctctg

SEQ ID NO: 623425 - DNA, 20 bp, Artificial Sequence
  chemically synthesized
ttgaaggatactacttcctg

SEQ ID NO: 623426 - DNA, 20 bp, Artificial Sequence
  chemically synthesized
actataaggatcatgatacc

SEQ ID NO: 623427 - DNA, 20 bp, Artificial Sequence
  chemically synthesized
tccttatagtccaggaaatg

SEQ ID NO: 623428 - DNA, 20 bp, Artificial Sequence
  chemically synthesized
aggctgggtttggaatgtga

SEQ ID NO: 623429 - DNA, 20 bp, Artificial Sequence
  chemically synthesized
cattccaaacccagcctagg

SEQ ID NO: 623430 - DNA, 20 bp, Artificial Sequence
  chemically synthesized
atcataaatcctgtcctagg

SEQ ID NO: 623431 - DNA, 20 bp, Artificial Sequence
  chemically synthesized
ccattttgatgtagccaagt

SEQ ID NO: 623432 - DNA, 20 bp, Artificial Sequence
  chemically synthesized
atttagccattttgatgtag

SEQ ID NO: 623433 - DNA, 20 bp, Artificial Sequence
  chemically synthesized
aaatggctaaatatttggtc

SEQ ID NO: 623434 - DNA, 20 bp, Artificial Sequence
  chemically synthesized
tttttctttaaacttaaatt

SEQ ID NO: 623435 - DNA, 20 bp, Artificial Sequence
  chemically synthesized
atgtaatctaaacttataat

SEQ ID NO: 623436 - DNA, 20 bp, Artificial Sequence
  chemically synthesized
ctttaaacttaaattataag

SEQ ID NO: 623437 - DNA, 20 bp, Artificial Sequence
  chemically synthesized
attttttcaaatgtccagcc

SEQ ID NO: 623438 - DNA, 20 bp, Artificial Sequence
  chemically synthesized
gaagcggagcttgcagtgag

SEQ ID NO: 623439 - DNA, 20 bp, Artificial Sequence
  chemically synthesized
caatctcggctcactgcaag

SEQ ID NO: 623440 - DNA, 20 bp, Artificial Sequence
  chemically synthesized
aatggcgtgaacccgggaag

SEQ ID NO: 623441 - DNA, 20 bp, Artificial Sequence
  chemically synthesized
ttttgtatttttagtagaga

SEQ ID NO: 623442 - DNA, 20 bp, Artificial Sequence
  chemically synthesized
cgcctcggcctcccaaagtg

SEQ ID NO: 623443 - DNA, 20 bp, Artificial Sequence
  chemically synthesized
tgatctttctttctatacat

SEQ ID NO: 623444 - DNA, 20 bp, Artificial Sequence
  chemically synthesized
ttccttttataaattggaca

SEQ ID NO: 623445 - DNA, 20 bp, Artificial Sequence
  chemically synthesized
gcaaatcatcaatactgact

SEQ ID NO: 623446 - DNA, 20 bp, Artificial Sequence
  chemically synthesized
agaaatcaggaagtcagtat

SEQ ID NO: 623447 - DNA, 20 bp, Artificial Sequence
  chemically synthesized
tctcctcattacccgcgcaa

SEQ ID NO: 623448 - DNA, 20 bp, Artificial Sequence
  chemically synthesized
taattaaatatctaaatatc

SEQ ID NO: 623449 - DNA, 20 bp, Artificial Sequence
  chemically synthesized
tataactgcaaccctcttac

SEQ ID NO: 623450 - DNA, 20 bp, Artificial Sequence
  chemically synthesized
acaggcacaccaagtgcaga

SEQ ID NO: 623451 - DNA, 20 bp, Artificial Sequence
  chemically synthesized
gaacatacaggcacaccaag

SEQ ID NO: 623452 - DNA, 20 bp, Artificial Sequence
  chemically synthesized
gcacttggtgtgcctgtatg

SEQ ID NO: 623453 - DNA, 20 bp, Artificial Sequence
  chemically synthesized
ttctgatttcattggtctgc

SEQ ID NO: 623454 - DNA, 20 bp, Artificial Sequence
  chemically synthesized
gatctatttgttagatgaca

SEQ ID NO: 623455 - DNA, 20 bp, Artificial Sequence
  chemically synthesized
gcaaactatgtgttgtcaag

SEQ ID NO: 623456 - DNA, 20 bp, Artificial Sequence
  chemically synthesized
ataaacacttcttgacaaca

SEQ ID NO: 623457 - DNA, 20 bp, Artificial Sequence
  chemically synthesized
acacttcttgacaacacata

SEQ ID NO: 623458 - DNA, 20 bp, Artificial Sequence
  chemically synthesized
gacaacacatagtttgcttt

SEQ ID NO: 623459 - DNA, 20 bp, Artificial Sequence
  chemically synthesized
cttttttacttttacttttt

SEQ ID NO: 623460 - DNA, 20 bp, Artificial Sequence
  chemically synthesized
aacctctgcctcctgggttc

SEQ ID NO: 623461 - DNA, 20 bp, Artificial Sequence
  chemically synthesized
tgcctcagcctcccaagcag

SEQ ID NO: 623462 - DNA, 20 bp, Artificial Sequence
  chemically synthesized
tggtgcacacgtgtaatccc

SEQ ID NO: 623463 - DNA, 20 bp, Artificial Sequence
  chemically synthesized
tgtgcaccaccacgtccagc

SEQ ID NO: 623464 - DNA, 20 bp, Artificial Sequence
  chemically synthesized
cgccttggcctcccaaagtg

SEQ ID NO: 623465 - DNA, 20 bp, Artificial Sequence
  chemically synthesized
tgcatgagccaccatgcctg

SEQ ID NO: 623466 - DNA, 20 bp, Artificial Sequence
  chemically synthesized
ccaccatgcctggcctgctt

SEQ ID NO: 623467 - DNA, 20 bp, Artificial Sequence
  chemically synthesized
gcatctactcctcacctagt

SEQ ID NO: 623468 - DNA, 20 bp, Artificial Sequence
  chemically synthesized
gctctgagcaacatattaca

SEQ ID NO: 623469 - DNA, 20 bp, Artificial Sequence
  chemically synthesized
tcacattattcttgtttggt

SEQ ID NO: 623470 - DNA, 20 bp, Artificial Sequence
  chemically synthesized
gatctctcacattattcttg

SEQ ID NO: 623471 - DNA, 20 bp, Artificial Sequence
  chemically synthesized
tggctgatctctcacattat

SEQ ID NO: 623472 - DNA, 20 bp, Artificial Sequence
  chemically synthesized
tgtactaagtctctagtgat

SEQ ID NO: 623473 - DNA, 20 bp, Artificial Sequence
  chemically synthesized
tatcacatgtactaagtctc

SEQ ID NO: 623474 - DNA, 20 bp, Artificial Sequence
  chemically synthesized
tctgtttctcacaataggcg

SEQ ID NO: 623475 - DNA, 20 bp, Artificial Sequence
  chemically synthesized
cctttatccactgtttacag

SEQ ID NO: 623476 - DNA, 20 bp, Artificial Sequence
  chemically synthesized
tgcaattcttgtcctttatc

SEQ ID NO: 623477 - DNA, 20 bp, Artificial Sequence
  chemically synthesized
ctgaattcccagggtatttt

SEQ ID NO: 623478 - DNA, 20 bp, Artificial Sequence
  chemically synthesized
tctttagatgtaggtgaact

SEQ ID NO: 623479 - DNA, 20 bp, Artificial Sequence
  chemically synthesized
ccagttcacctacatctaaa

SEQ ID NO: 623480 - DNA, 20 bp, Artificial Sequence
  chemically synthesized
tttttacccttttgtgtaaa

SEQ ID NO: 623481 - DNA, 20 bp, Artificial Sequence
  chemically synthesized
tgatcttcaaagcataacag

SEQ ID NO: 623482 - DNA, 20 bp, Artificial Sequence
  chemically synthesized
agtaaaataaaacatgactg

SEQ ID NO: 623483 - DNA, 20 bp, Artificial Sequence
  chemically synthesized
atgttttattttactctatg

SEQ ID NO: 623484 - DNA, 20 bp, Artificial Sequence
  chemically synthesized
ttcattgactgcaattacta

SEQ ID NO: 623485 - DNA, 20 bp, Artificial Sequence
  chemically synthesized
cttagaacagcagaaggagc

SEQ ID NO: 623486 - DNA, 20 bp, Artificial Sequence
  chemically synthesized
gggccttggaaattacatat

SEQ ID NO: 623487 - DNA, 20 bp, Artificial Sequence
  chemically synthesized
aggttttgcagtcaaatgag

SEQ ID NO: 623488 - DNA, 20 bp, Artificial Sequence
  chemically synthesized
gtgctgagatctaaaatttc

SEQ ID NO: 623489 - DNA, 20 bp, Artificial Sequence
  chemically synthesized
ccattagggtatatttcccc

SEQ ID NO: 623490 - DNA, 20 bp, Artificial Sequence
  chemically synthesized
tataaaccagaatttaaatt

SEQ ID NO: 623491 - DNA, 20 bp, Artificial Sequence
  chemically synthesized
caaaaaccctcaatttaaat

SEQ ID NO: 623492 - DNA, 20 bp, Artificial Sequence
  chemically synthesized
actttaaatttatttctaag

SEQ ID NO: 623493 - DNA, 20 bp, Artificial Sequence
  chemically synthesized
tgccactaaaagaaaaaaat

SEQ ID NO: 623494 - DNA, 20 bp, Artificial Sequence
  chemically synthesized
gaattactttttgttggtgg

SEQ ID NO: 623495 - DNA, 20 bp, Artificial Sequence
  chemically synthesized
cttaccttgcgacttatgct

SEQ ID NO: 623496 - DNA, 20 bp, Artificial Sequence
  chemically synthesized
tcacgtacacactatgaaac

SEQ ID NO: 623497 - DNA, 20 bp, Artificial Sequence
  chemically synthesized
aaatttttttcctgtaaaac

SEQ ID NO: 623498 - DNA, 20 bp, Artificial Sequence
  chemically synthesized
cacctcagcctcccaaagtg

SEQ ID NO: 623499 - DNA, 20 bp, Artificial Sequence
  chemically synthesized
ttttatatttttagtagaga

SEQ ID NO: 623500 - DNA, 20 bp, Artificial Sequence
  chemically synthesized
tgtctcagcctcctgagtaa

SEQ ID NO: 623501 - DNA, 20 bp, Artificial Sequence
  chemically synthesized
tcaggaggctgagacaggag

SEQ ID NO: 623502 - DNA, 20 bp, Artificial Sequence
  chemically synthesized
aaccttcacctcctgagttc

SEQ ID NO: 623503 - DNA, 20 bp, Artificial Sequence
  chemically synthesized
atttgtacataagagagaag

SEQ ID NO: 623504 - DNA, 20 bp, Artificial Sequence
  chemically synthesized
tatgtatctggtatgattac

SEQ ID NO: 623505 - DNA, 20 bp, Artificial Sequence
  chemically synthesized
ttgaaatatttatgtatctg

SEQ ID NO: 623506 - DNA, 20 bp, Artificial Sequence
  chemically synthesized
aatatttcaatatgtatagc

SEQ ID NO: 623507 - DNA, 20 bp, Artificial Sequence
  chemically synthesized
cagtgtatagacacaatttt

SEQ ID NO: 623508 - DNA, 20 bp, Artificial Sequence
  chemically synthesized
ttatacttctattagaaagg

SEQ ID NO: 623509 - DNA, 20 bp, Artificial Sequence
  chemically synthesized
ttctattagaaaggctatgt

SEQ ID NO: 623510 - DNA, 20 bp, Artificial Sequence
  chemically synthesized
ctatgtttttgtttaagtac

SEQ ID NO: 623511 - DNA, 20 bp, Artificial Sequence
  chemically synthesized
agtgaatttgtatctatgaa

SEQ ID NO: 623512 - DNA, 20 bp, Artificial Sequence
  chemically synthesized
aattcatttgagttttgcat

SEQ ID NO: 623513 - DNA, 20 bp, Artificial Sequence
  chemically synthesized
ctgccaggtatacaattcat

SEQ ID NO: 623514 - DNA, 20 bp, Artificial Sequence
  chemically synthesized
tagaattatgcatacataca

SEQ ID NO: 623515 - DNA, 20 bp, Artificial Sequence
  chemically synthesized
tgagtgtatgtatgcataat

SEQ ID NO: 623516 - DNA, 20 bp, Artificial Sequence
  chemically synthesized
aaaattaagtgtcatcatct

SEQ ID NO: 623517 - DNA, 20 bp, Artificial Sequence
  chemically synthesized
ataagttacttataaatttc

SEQ ID NO: 623518 - DNA, 20 bp, Artificial Sequence
  chemically synthesized
actaggaagaagttttataa

SEQ ID NO: 623519 - DNA, 20 bp, Artificial Sequence
  chemically synthesized
aatatttccttgtactagga

SEQ ID NO: 623520 - DNA, 20 bp, Artificial Sequence
  chemically synthesized
tctatgtgtttatattctca

SEQ ID NO: 623521 - DNA, 20 bp, Artificial Sequence
  chemically synthesized
gaatataaacacatagaaga

SEQ ID NO: 623522 - DNA, 20 bp, Artificial Sequence
  chemically synthesized
tgccgcaaaccacatcttct

SEQ ID NO: 623523 - DNA, 20 bp, Artificial Sequence
  chemically synthesized
aaaattatattatctccgct

SEQ ID NO: 623524 - DNA, 20 bp, Artificial Sequence
  chemically synthesized
aatggtaatatattttttgc

SEQ ID NO: 623525 - DNA, 20 bp, Artificial Sequence
  chemically synthesized
ataaagataatatacatata

SEQ ID NO: 623526 - DNA, 20 bp, Artificial Sequence
  chemically synthesized
attaatttttcagtggtaga

SEQ ID NO: 623527 - DNA, 20 bp, Artificial Sequence
  chemically synthesized
ttgaaagttgaaaatataga

SEQ ID NO: 623528 - DNA, 20 bp, Artificial Sequence
  chemically synthesized
aatgtgagccccaggcagaa

SEQ ID NO: 623529 - DNA, 20 bp, Artificial Sequence
  chemically synthesized
ccccaggcagaagaatgctt

SEQ ID NO: 623530 - DNA, 20 bp, Artificial Sequence
  chemically synthesized
ataatatattgtgcctagat

SEQ ID NO: 623531 - DNA, 20 bp, Artificial Sequence
  chemically synthesized
aatatattatataaggcctg

SEQ ID NO: 623532 - DNA, 20 bp, Artificial Sequence
  chemically synthesized
ggttttctggctggtcaatt

SEQ ID NO: 623533 - DNA, 20 bp, Artificial Sequence
  chemically synthesized
gttgaaattttataagtcaa

SEQ ID NO: 623534 - DNA, 20 bp, Artificial Sequence
  chemically synthesized
tctttgaggagatttgttaa

SEQ ID NO: 623535 - DNA, 20 bp, Artificial Sequence
  chemically synthesized
tctttaatattttatctttg

SEQ ID NO: 623536 - DNA, 20 bp, Artificial Sequence
  chemically synthesized
gaaaaagttactatggtctt

SEQ ID NO: 623537 - DNA, 20 bp, Artificial Sequence
  chemically synthesized
gacctgcttttataataaaa

SEQ ID NO: 623538 - DNA, 20 bp, Artificial Sequence
  chemically synthesized
ctgaagtagtaggccctctg

SEQ ID NO: 623539 - DNA, 20 bp, Artificial Sequence
  chemically synthesized
aattaatgatatcactcaag

SEQ ID NO: 623540 - DNA, 20 bp, Artificial Sequence
  chemically synthesized
acaggcattttatgagaaaa

SEQ ID NO: 623541 - DNA, 20 bp, Artificial Sequence
  chemically synthesized
atgcctgtgcataccagatc

SEQ ID NO: 623542 - DNA, 20 bp, Artificial Sequence
  chemically synthesized
aaattgaaagggttcaagac

SEQ ID NO: 623543 - DNA, 20 bp, Artificial Sequence
  chemically synthesized
tatttattatttttgcactt

SEQ ID NO: 623544 - DNA, 20 bp, Artificial Sequence
  chemically synthesized
actggctctgtagatcctat

SEQ ID NO: 623545 - DNA, 20 bp, Artificial Sequence
  chemically synthesized
atgcccaaattcaaggtgag

SEQ ID NO: 623546 - DNA, 20 bp, Artificial Sequence
  chemically synthesized
gggcatacttgtatggggct

SEQ ID NO: 623547 - DNA, 20 bp, Artificial Sequence
  chemically synthesized
cacacatatttatccagaca

SEQ ID NO: 623548 - DNA, 20 bp, Artificial Sequence
  chemically synthesized
cttttataaatgagctcaat

SEQ ID NO: 623549 - DNA, 20 bp, Artificial Sequence
  chemically synthesized
aatctttcatctgttttaat

SEQ ID NO: 623550 - DNA, 20 bp, Artificial Sequence
  chemically synthesized
aatcccagattaaaacagat

SEQ ID NO: 623551 - DNA, 20 bp, Artificial Sequence
  chemically synthesized
acaatgattggaaatctttc

SEQ ID NO: 623552 - DNA, 20 bp, Artificial Sequence
  chemically synthesized
tccaccctgggagctggcca

SEQ ID NO: 623553 - DNA, 20 bp, Artificial Sequence
  chemically synthesized
gccagctcccagggtggaaa

SEQ ID NO: 623554 - DNA, 20 bp, Artificial Sequence
  chemically synthesized
agtttcagtttgctgcattc

SEQ ID NO: 623555 - DNA, 20 bp, Artificial Sequence
  chemically synthesized
cattccagagagtattcagt

SEQ ID NO: 623556 - DNA, 20 bp, Artificial Sequence
  chemically synthesized
aatgtccattccagagagta

SEQ ID NO: 623557 - DNA, 20 bp, Artificial Sequence
  chemically synthesized
ctcctgcttgagctattgtt

SEQ ID NO: 623558 - DNA, 20 bp, Artificial Sequence
  chemically synthesized
cctcaaagacaagtgtttgc

SEQ ID NO: 623559 - DNA, 20 bp, Artificial Sequence
  chemically synthesized
gcttggactacctcaaagac

SEQ ID NO: 623560 - DNA, 20 bp, Artificial Sequence
  chemically synthesized
gattactgagaaagtgaatg

SEQ ID NO: 623561 - DNA, 20 bp, Artificial Sequence
  chemically synthesized
aagtccagtgggtgtctgag

SEQ ID NO: 623562 - DNA, 20 bp, Artificial Sequence
  chemically synthesized
tgcatgcactataggagcag

SEQ ID NO: 623563 - DNA, 20 bp, Artificial Sequence
  chemically synthesized
tttggcatctcctaagatat

SEQ ID NO: 623564 - DNA, 20 bp, Artificial Sequence
  chemically synthesized
taaaaaagagccccaatttg

SEQ ID NO: 623565 - DNA, 20 bp, Artificial Sequence
  chemically synthesized
tgtttttggttatctgtgta

SEQ ID NO: 623566 - DNA, 20 bp, Artificial Sequence
  chemically synthesized
acacagataaccaaaaacac

SEQ ID NO: 623567 - DNA, 20 bp, Artificial Sequence
  chemically synthesized
tggatgattcatataatctg

SEQ ID NO: 623568 - DNA, 20 bp, Artificial Sequence
  chemically synthesized
aaatgttggttgcttaattt

SEQ ID NO: 623569 - DNA, 20 bp, Artificial Sequence
  chemically synthesized
aaatcttagactaaaatgtt

SEQ ID NO: 623570 - DNA, 20 bp, Artificial Sequence
  chemically synthesized
taagcaaccaacattttagt

SEQ ID NO: 623571 - DNA, 20 bp, Artificial Sequence
  chemically synthesized
ctggacaaaaaagtatctac

SEQ ID NO: 623572 - DNA, 20 bp, Artificial Sequence
  chemically synthesized
ataatgcatgccagtattca

SEQ ID NO: 623573 - DNA, 20 bp, Artificial Sequence
  chemically synthesized
ttttccaatctgaatgatgc

SEQ ID NO: 623574 - DNA, 20 bp, Artificial Sequence
  chemically synthesized
tatttgaaactcaggcatca

SEQ ID NO: 623575 - DNA, 20 bp, Artificial Sequence
  chemically synthesized
ctacacagcatttatctgac

SEQ ID NO: 623576 - DNA, 20 bp, Artificial Sequence
  chemically synthesized
tatgtggattaattgtgcct

SEQ ID NO: 623577 - DNA, 20 bp, Artificial Sequence
  chemically synthesized
gatagcctgtgcttattata

SEQ ID NO: 623578 - DNA, 20 bp, Artificial Sequence
  chemically synthesized
ttgctccttgaggagatagc

SEQ ID NO: 623579 - DNA, 20 bp, Artificial Sequence
  chemically synthesized
ttttagctgtcagtttgctt

SEQ ID NO: 623580 - DNA, 20 bp, Artificial Sequence
  chemically synthesized
atcccctattttagctgtca

SEQ ID NO: 623581 - DNA, 20 bp, Artificial Sequence
  chemically synthesized
ttatatcccctattttagct

SEQ ID NO: 623582 - DNA, 20 bp, Artificial Sequence
  chemically synthesized
acagctaaaataggggatat

SEQ ID NO: 623583 - DNA, 20 bp, Artificial Sequence
  chemically synthesized
cttgtctagaattatccata

SEQ ID NO: 623584 - DNA, 20 bp, Artificial Sequence
  chemically synthesized
ttttatctttccttatagaa

SEQ ID NO: 623585 - DNA, 20 bp, Artificial Sequence
  chemically synthesized
ggtggaagagacatggtgat

SEQ ID NO: 623586 - DNA, 20 bp, Artificial Sequence
  chemically synthesized
aagaccttgtacgttaggac

SEQ ID NO: 623587 - DNA, 20 bp, Artificial Sequence
  chemically synthesized
ttggattttaccctgaagct

SEQ ID NO: 623588 - DNA, 20 bp, Artificial Sequence
  chemically synthesized
taacgtcctttagagaatct

SEQ ID NO: 623589 - DNA, 20 bp, Artificial Sequence
  chemically synthesized
aacaaataagattgtgtgcc

SEQ ID NO: 623590 - DNA, 20 bp, Artificial Sequence
  chemically synthesized
agctggaggcacacaatctt

SEQ ID NO: 623591 - DNA, 20 bp, Artificial Sequence
  chemically synthesized
ccgttgagtttctaaaacaa

SEQ ID NO: 623592 - DNA, 20 bp, Artificial Sequence
  chemically synthesized
ccttgtaattgctgcccccg

SEQ ID NO: 623593 - DNA, 20 bp, Artificial Sequence
  chemically synthesized
acgggggcagcaattacaag

SEQ ID NO: 623594 - DNA, 20 bp, Artificial Sequence
  chemically synthesized
caaggtgggattttctgaag

SEQ ID NO: 623595 - DNA, 20 bp, Artificial Sequence
  chemically synthesized
tgtgcgtgtgtgaatgatct

SEQ ID NO: 623596 - DNA, 20 bp, Artificial Sequence
  chemically synthesized
tcaaaagactacctctgatt

SEQ ID NO: 623597 - DNA, 20 bp, Artificial Sequence
  chemically synthesized
tacatagatcaaaagactac

SEQ ID NO: 623598 - DNA, 20 bp, Artificial Sequence
  chemically synthesized
ggtagtcttttgatctatgt

SEQ ID NO: 623599 - DNA, 20 bp, Artificial Sequence
  chemically synthesized
gagttatatacattagttat

SEQ ID NO: 623600 - DNA, 20 bp, Artificial Sequence
  chemically synthesized
ggctttaaaagggggatata

SEQ ID NO: 623601 - DNA, 20 bp, Artificial Sequence
  chemically synthesized
ccttttaaagccaacaataa

SEQ ID NO: 623602 - DNA, 20 bp, Artificial Sequence
  chemically synthesized
ccttcacaagcttacttatt

SEQ ID NO: 623603 - DNA, 20 bp, Artificial Sequence
  chemically synthesized
aggaaaaataatgccccttc

SEQ ID NO: 623604 - DNA, 20 bp, Artificial Sequence
  chemically synthesized
ttaatactagttaaataaat

SEQ ID NO: 623605 - DNA, 20 bp, Artificial Sequence
  chemically synthesized
ttaaataaatattggcttgt

SEQ ID NO: 623606 - DNA, 20 bp, Artificial Sequence
  chemically synthesized
acttgcctttgtaggtagag

SEQ ID NO: 623607 - DNA, 20 bp, Artificial Sequence
  chemically synthesized
ttgacaatgcctgagactac

SEQ ID NO: 623608 - DNA, 20 bp, Artificial Sequence
  chemically synthesized
ccgtggaccagcataacttc

SEQ ID NO: 623609 - DNA, 20 bp, Artificial Sequence
  chemically synthesized
aacttctagcgcttgtcata

SEQ ID NO: 623610 - DNA, 20 bp, Artificial Sequence
  chemically synthesized
ttgtaaggtgttgtgtttca

SEQ ID NO: 623611 - DNA, 20 bp, Artificial Sequence
  chemically synthesized
atgtcctactttgtaaggtg

SEQ ID NO: 623612 - DNA, 20 bp, Artificial Sequence
  chemically synthesized
tattatatgggaacgtgcat

SEQ ID NO: 623613 - DNA, 20 bp, Artificial Sequence
  chemically synthesized
gcacgttcccatataataga

SEQ ID NO: 623614 - DNA, 20 bp, Artificial Sequence
  chemically synthesized
atagaaatggattgcattct

SEQ ID NO: 623615 - DNA, 20 bp, Artificial Sequence
  chemically synthesized
ctatcactcaaggtacaaag

SEQ ID NO: 623616 - DNA, 20 bp, Artificial Sequence
  chemically synthesized
tattaatttacaagacttat

SEQ ID NO: 623617 - DNA, 20 bp, Artificial Sequence
  chemically synthesized
tttacaagacttatcctcga

SEQ ID NO: 623618 - DNA, 20 bp, Artificial Sequence
  chemically synthesized
accctagccttcagaaaacc

SEQ ID NO: 623619 - DNA, 20 bp, Artificial Sequence
  chemically synthesized
cattagacctttaataagct

SEQ ID NO: 623620 - DNA, 20 bp, Artificial Sequence
  chemically synthesized
tgcgacttcctgtgagtcta

SEQ ID NO: 623621 - DNA, 20 bp, Artificial Sequence
  chemically synthesized
caacattgggagaggtaaag

SEQ ID NO: 623622 - DNA, 20 bp, Artificial Sequence
  chemically synthesized
atgaattatagcaataattt

SEQ ID NO: 623623 - DNA, 20 bp, Artificial Sequence
  chemically synthesized
gaaattattgctataattca

SEQ ID NO: 623624 - DNA, 20 bp, Artificial Sequence
  chemically synthesized
ctataattcatagagcttat

SEQ ID NO: 623625 - DNA, 20 bp, Artificial Sequence
  chemically synthesized
tgactctggtgtgtgtgtgt

SEQ ID NO: 623626 - DNA, 20 bp, Artificial Sequence
  chemically synthesized
ctacacttgataatgtcgaa

SEQ ID NO: 623627 - DNA, 20 bp, Artificial Sequence
  chemically synthesized
ctctattcgacattatcaag

SEQ ID NO: 623628 - DNA, 20 bp, Artificial Sequence
  chemically synthesized
cctgctcaatattttgattg

SEQ ID NO: 623629 - DNA, 20 bp, Artificial Sequence
  chemically synthesized
ggtgatggacctgctcaata

SEQ ID NO: 623630 - DNA, 20 bp, Artificial Sequence
  chemically synthesized
atttagtggtatgagtatat

SEQ ID NO: 623631 - DNA, 20 bp, Artificial Sequence
  chemically synthesized
agtggtatgagtatataaca

SEQ ID NO: 623632 - DNA, 20 bp, Artificial Sequence
  chemically synthesized
cactcattgatggatacttg

SEQ ID NO: 623633 - DNA, 20 bp, Artificial Sequence
  chemically synthesized
tgatggatacttgagctgtt

SEQ ID NO: 623634 - DNA, 20 bp, Artificial Sequence
  chemically synthesized
tctagctactgcattcatgt

SEQ ID NO: 623635 - DNA, 20 bp, Artificial Sequence
  chemically synthesized
tgatatttatcccagaaaat

SEQ ID NO: 623636 - DNA, 20 bp, Artificial Sequence
  chemically synthesized
tgctgggctgtatggtgact

SEQ ID NO: 623637 - DNA, 20 bp, Artificial Sequence
  chemically synthesized
aattttagaagaaactccta

SEQ ID NO: 623638 - DNA, 20 bp, Artificial Sequence
  chemically synthesized
accattctagaaaacagttt

SEQ ID NO: 623639 - DNA, 20 bp, Artificial Sequence
  chemically synthesized
atggtacaaccattctagaa

SEQ ID NO: 623640 - DNA, 20 bp, Artificial Sequence
  chemically synthesized
cccagttcctttgcatccct

SEQ ID NO: 623641 - DNA, 20 bp, Artificial Sequence
  chemically synthesized
ctgttagctttcagtgttgt

SEQ ID NO: 623642 - DNA, 20 bp, Artificial Sequence
  chemically synthesized
aagaaatgcataaaaagatg

SEQ ID NO: 623643 - DNA, 20 bp, Artificial Sequence
  chemically synthesized
ctcttcagtgaaatgtctat

SEQ ID NO: 623644 - DNA, 20 bp, Artificial Sequence
  chemically synthesized
cttttcccacatttttttcc

SEQ ID NO: 623645 - DNA, 20 bp, Artificial Sequence
  chemically synthesized
tttttttccactagattatt

SEQ ID NO: 623646 - DNA, 20 bp, Artificial Sequence
  chemically synthesized
gattatttgtggttttagtg

SEQ ID NO: 623647 - DNA, 20 bp, Artificial Sequence
  chemically synthesized
gttctttgagactttacaaa

SEQ ID NO: 623648 - DNA, 20 bp, Artificial Sequence
  chemically synthesized
tggttcttgattttgttttt

SEQ ID NO: 623649 - DNA, 20 bp, Artificial Sequence
  chemically synthesized
ttttcacttgtggttcttga

SEQ ID NO: 623650 - DNA, 20 bp, Artificial Sequence
  chemically synthesized
tactgcttttcacttgtggt

SEQ ID NO: 623651 - DNA, 20 bp, Artificial Sequence
  chemically synthesized
ttcccttttttgatttccca

SEQ ID NO: 623652 - DNA, 20 bp, Artificial Sequence
  chemically synthesized
tcattgggtgctgttccctt

SEQ ID NO: 623653 - DNA, 20 bp, Artificial Sequence
  chemically synthesized
tatataaatatataataaag

SEQ ID NO: 623654 - DNA, 20 bp, Artificial Sequence
  chemically synthesized
cttcatatataaatatataa

SEQ ID NO: 623655 - DNA, 20 bp, Artificial Sequence
  chemically synthesized
ctttattatatatttatata

SEQ ID NO: 623656 - DNA, 20 bp, Artificial Sequence
  chemically synthesized
caaagcactttcattttggt

SEQ ID NO: 623657 - DNA, 20 bp, Artificial Sequence
  chemically synthesized
tgaagctttaaccaaaatga

SEQ ID NO: 623658 - DNA, 20 bp, Artificial Sequence
  chemically synthesized
aatatgttataataatgata

SEQ ID NO: 623659 - DNA, 20 bp, Artificial Sequence
  chemically synthesized
gctttaatgaacataattac

SEQ ID NO: 623660 - DNA, 20 bp, Artificial Sequence
  chemically synthesized
taaataagttacttgatgtg

SEQ ID NO: 623661 - DNA, 20 bp, Artificial Sequence
  chemically synthesized
aatatatatggggaaaccta

SEQ ID NO: 623662 - DNA, 20 bp, Artificial Sequence
  chemically synthesized
attacctggaaccaaacaca

SEQ ID NO: 623663 - DNA, 20 bp, Artificial Sequence
  chemically synthesized
tgactaattaatacttgcca

SEQ ID NO: 623664 - DNA, 20 bp, Artificial Sequence
  chemically synthesized
gttcataacacatagcactg

SEQ ID NO: 623665 - DNA, 20 bp, Artificial Sequence
  chemically synthesized
tagaggaatttgatgtactt

SEQ ID NO: 623666 - DNA, 20 bp, Artificial Sequence
  chemically synthesized
attttgatgtctatccagag

SEQ ID NO: 623667 - DNA, 20 bp, Artificial Sequence
  chemically synthesized
gatgacaccattttccacct

SEQ ID NO: 623668 - DNA, 20 bp, Artificial Sequence
  chemically synthesized
tttctatttgtctagaacct

SEQ ID NO: 623669 - DNA, 20 bp, Artificial Sequence
  chemically synthesized
tttatctacagtacttttgt

SEQ ID NO: 623670 - DNA, 20 bp, Artificial Sequence
  chemically synthesized
ctttttgttccctgactagg

SEQ ID NO: 623671 - DNA, 20 bp, Artificial Sequence
  chemically synthesized
ttcctttgcctcgccccctt

SEQ ID NO: 623672 - DNA, 20 bp, Artificial Sequence
  chemically synthesized
ctctcctatctcatttccca

SEQ ID NO: 623673 - DNA, 20 bp, Artificial Sequence
  chemically synthesized
agaggtaggcagtgtctaga

SEQ ID NO: 623674 - DNA, 20 bp, Artificial Sequence
  chemically synthesized
gtctagactttgatttttaa

SEQ ID NO: 623675 - DNA, 20 bp, Artificial Sequence
  chemically synthesized
gactttgatttttaaatgtg

SEQ ID NO: 623676 - DNA, 20 bp, Artificial Sequence
  chemically synthesized
tgatttttaaatgtgttttg

SEQ ID NO: 623677 - DNA, 20 bp, Artificial Sequence
  chemically synthesized
tttaaatgtgttttgttttg

SEQ ID NO: 623678 - DNA, 20 bp, Artificial Sequence
  chemically synthesized
atgtgttttgttttgttttg

SEQ ID NO: 623679 - DNA, 20 bp, Artificial Sequence
  chemically synthesized
gcaaccaagagaaactacta

SEQ ID NO: 623680 - DNA, 20 bp, Artificial Sequence
  chemically synthesized
accacttgttaaatcatgtt

SEQ ID NO: 623681 - DNA, 20 bp, Artificial Sequence
  chemically synthesized
ttcgaatttaattggctgca

SEQ ID NO: 623682 - DNA, 20 bp, Artificial Sequence
  chemically synthesized
tggctgcatgaagtttagag

SEQ ID NO: 623683 - DNA, 20 bp, Artificial Sequence
  chemically synthesized
gaatacagcagcctttcctt

SEQ ID NO: 623684 - DNA, 20 bp, Artificial Sequence
  chemically synthesized
ctaagtcattgccagtcact

SEQ ID NO: 623685 - DNA, 20 bp, Artificial Sequence
  chemically synthesized
aataactgggtaaaaaagat

SEQ ID NO: 623686 - DNA, 20 bp, Artificial Sequence
  chemically synthesized
atcagagtttcaaggatgag

SEQ ID NO: 623687 - DNA, 20 bp, Artificial Sequence
  chemically synthesized
tttcaaggatgagatatgtt

SEQ ID NO: 623688 - DNA, 20 bp, Artificial Sequence
  chemically synthesized
ttgaatggtgcaaccattca

SEQ ID NO: 623689 - DNA, 20 bp, Artificial Sequence
  chemically synthesized
cacaaaacctgcttccttct

SEQ ID NO: 623690 - DNA, 20 bp, Artificial Sequence
  chemically synthesized
agaaaaacaatgagaaggaa

SEQ ID NO: 623691 - DNA, 20 bp, Artificial Sequence
  chemically synthesized
ctttctcttcaccgcacaaa

SEQ ID NO: 623692 - DNA, 20 bp, Artificial Sequence
  chemically synthesized
tttgtgcggtgaagagaaag

SEQ ID NO: 623693 - DNA, 20 bp, Artificial Sequence
  chemically synthesized
ttctccaatgaattccagaa

SEQ ID NO: 623694 - DNA, 20 bp, Artificial Sequence
  chemically synthesized
taaccaagttatacctctag

SEQ ID NO: 623695 - DNA, 20 bp, Artificial Sequence
  chemically synthesized
ataactaaccaagttatacc

SEQ ID NO: 623696 - DNA, 20 bp, Artificial Sequence
  chemically synthesized
tcgatcattgcacttatgtc

SEQ ID NO: 623697 - DNA, 20 bp, Artificial Sequence
  chemically synthesized
ctcttctcagcctttaaaaa

SEQ ID NO: 623698 - DNA, 20 bp, Artificial Sequence
  chemically synthesized
ggcttcactactactttgga

SEQ ID NO: 623699 - DNA, 20 bp, Artificial Sequence
  chemically synthesized
agatctgtgcactgtcctct

SEQ ID NO: 623700 - DNA, 20 bp, Artificial Sequence
  chemically synthesized
ttcacttgaacttagcaggg

SEQ ID NO: 623701 - DNA, 20 bp, Artificial Sequence
  chemically synthesized
tgctttcattatttttctat

SEQ ID NO: 623702 - DNA, 20 bp, Artificial Sequence
  chemically synthesized
gattctcttttcttttaatt

SEQ ID NO: 623703 - DNA, 20 bp, Artificial Sequence
  chemically synthesized
tgcatcagttggacaagata

SEQ ID NO: 623704 - DNA, 20 bp, Artificial Sequence
  chemically synthesized
gagatagaaagaagataata

SEQ ID NO: 623705 - DNA, 20 bp, Artificial Sequence
  chemically synthesized
ttgataatttgtttaagaaa

SEQ ID NO: 623706 - DNA, 20 bp, Artificial Sequence
  chemically synthesized
tgttggtttcttttttgata

SEQ ID NO: 623707 - DNA, 20 bp, Artificial Sequence
  chemically synthesized
tcaacattagcagtaacttt

SEQ ID NO: 623708 - DNA, 20 bp, Artificial Sequence
  chemically synthesized
aatattaaagtactattatt

SEQ ID NO: 623709 - DNA, 20 bp, Artificial Sequence
  chemically synthesized
taattaagaaataaataatt

SEQ ID NO: 623710 - DNA, 20 bp, Artificial Sequence
  chemically synthesized
aatgacatttgaatataata

SEQ ID NO: 623711 - DNA, 20 bp, Artificial Sequence
  chemically synthesized
gtggtttacgtatgaaagtt

SEQ ID NO: 623712 - DNA, 20 bp, Artificial Sequence
  chemically synthesized
aaattaagtggtttacgtat

SEQ ID NO: 623713 - DNA, 20 bp, Artificial Sequence
  chemically synthesized
tacacattacttggaaatta

SEQ ID NO: 623714 - DNA, 20 bp, Artificial Sequence
  chemically synthesized
ctgatccatttttctagtgt

SEQ ID NO: 623715 - DNA, 20 bp, Artificial Sequence
  chemically synthesized
acactagaaaaatggatcag

SEQ ID NO: 623716 - DNA, 20 bp, Artificial Sequence
  chemically synthesized
tgctataatgacactaagat

SEQ ID NO: 623717 - DNA, 20 bp, Artificial Sequence
  chemically synthesized
atattaaatatacaaatata

SEQ ID NO: 623718 - DNA, 20 bp, Artificial Sequence
  chemically synthesized
tccgaaatatatttctgaat

SEQ ID NO: 623719 - DNA, 20 bp, Artificial Sequence
  chemically synthesized
tctgaattaaggcttatttc

SEQ ID NO: 623720 - DNA, 20 bp, Artificial Sequence
  chemically synthesized
gttaaaatttatattatcct

SEQ ID NO: 623721 - DNA, 20 bp, Artificial Sequence
  chemically synthesized
atgtgcgtttccatggtatc

SEQ ID NO: 623722 - DNA, 20 bp, Artificial Sequence
  chemically synthesized
aaaagtctattgattatcat

SEQ ID NO: 623723 - DNA, 20 bp, Artificial Sequence
  chemically synthesized
aaaaaaaaaaaaaaaaagtc

SEQ ID NO: 623724 - DNA, 20 bp, Artificial Sequence
  chemically synthesized
aacttccacctcccgggctc

SEQ ID NO: 623725 - DNA, 20 bp, Artificial Sequence
  chemically synthesized
tgccacagcctcctgagtag

SEQ ID NO: 623726 - DNA, 20 bp, Artificial Sequence
  chemically synthesized
tttttgtattttagtagaga

SEQ ID NO: 623727 - DNA, 20 bp, Artificial Sequence
  chemically synthesized
cgccttggcctcccaaagtg

SEQ ID NO: 623728 - DNA, 20 bp, Artificial Sequence
  chemically synthesized
ccgcgaccagccaataacca

SEQ ID NO: 623729 - DNA, 20 bp, Artificial Sequence
  chemically synthesized
tttatgagatgagagaataa

SEQ ID NO: 623730 - DNA, 20 bp, Artificial Sequence
  chemically synthesized
atatatgattagaaataata

SEQ ID NO: 623731 - DNA, 20 bp, Artificial Sequence
  chemically synthesized
caacattggcattctcatat

SEQ ID NO: 623732 - DNA, 20 bp, Artificial Sequence
  chemically synthesized
acgttatcgtacagagtgca

SEQ ID NO: 623733 - DNA, 20 bp, Artificial Sequence
  chemically synthesized
ataatgaagataagagaaaa

SEQ ID NO: 623734 - DNA, 20 bp, Artificial Sequence
  chemically synthesized
ttatagtaacttaaataacc

SEQ ID NO: 623735 - DNA, 20 bp, Artificial Sequence
  chemically synthesized
tattgtaaaaaaatggttta

SEQ ID NO: 623736 - DNA, 20 bp, Artificial Sequence
  chemically synthesized
atgatttagtattgtaaaaa

SEQ ID NO: 623737 - DNA, 20 bp, Artificial Sequence
  chemically synthesized
taagaactgggctaacctga

SEQ ID NO: 623738 - DNA, 20 bp, Artificial Sequence
  chemically synthesized
atgttcaggttagcccagtt

SEQ ID NO: 623739 - DNA, 20 bp, Artificial Sequence
  chemically synthesized
ggtctcactagttgttcttt

SEQ ID NO: 623740 - DNA, 20 bp, Artificial Sequence
  chemically synthesized
ctctaaggatggctaactgt

SEQ ID NO: 623741 - DNA, 20 bp, Artificial Sequence
  chemically synthesized
ataaaactaatgcagccctg

SEQ ID NO: 623742 - DNA, 20 bp, Artificial Sequence
  chemically synthesized
tacaaacaaaccagggctgc

SEQ ID NO: 623743 - DNA, 20 bp, Artificial Sequence
  chemically synthesized
aaaaataaaactaatgcagc

SEQ ID NO: 623744 - DNA, 20 bp, Artificial Sequence
  chemically synthesized
gataatatccataacagtta

SEQ ID NO: 623745 - DNA, 20 bp, Artificial Sequence
  chemically synthesized
gcatgagttatttaggatat

SEQ ID NO: 623746 - DNA, 20 bp, Artificial Sequence
  chemically synthesized
aatataatatgccaatgtct

SEQ ID NO: 623747 - DNA, 20 bp, Artificial Sequence
  chemically synthesized
taaaacccattaaaattttg

SEQ ID NO: 623748 - DNA, 20 bp, Artificial Sequence
  chemically synthesized
gtaaacaacccaaaatttta

SEQ ID NO: 623749 - DNA, 20 bp, Artificial Sequence
  chemically synthesized
ctagttcttgttagaagata

SEQ ID NO: 623750 - DNA, 20 bp, Artificial Sequence
  chemically synthesized
ccagtcagttgtcacgatct

SEQ ID NO: 623751 - DNA, 20 bp, Artificial Sequence
  chemically synthesized
tggcagcatgacagtaggat

SEQ ID NO: 623752 - DNA, 20 bp, Artificial Sequence
  chemically synthesized
ttaatggtggcagcatgaca

SEQ ID NO: 623753 - DNA, 20 bp, Artificial Sequence
  chemically synthesized
tcagctggtacgtggtagag

SEQ ID NO: 623754 - DNA, 20 bp, Artificial Sequence
  chemically synthesized
aggtacagggagattaagta

SEQ ID NO: 623755 - DNA, 20 bp, Artificial Sequence
  chemically synthesized
gatgaatatgtagaggtaca

SEQ ID NO: 623756 - DNA, 20 bp, Artificial Sequence
  chemically synthesized
catattcatctggtaaattt

SEQ ID NO: 623757 - DNA, 20 bp, Artificial Sequence
  chemically synthesized
catctggtaaatttagatga

SEQ ID NO: 623758 - DNA, 20 bp, Artificial Sequence
  chemically synthesized
gtaataagtgtcaggcactt

SEQ ID NO: 623759 - DNA, 20 bp, Artificial Sequence
  chemically synthesized
agaagtgcctgacacttatt

SEQ ID NO: 623760 - DNA, 20 bp, Artificial Sequence
  chemically synthesized
ggtaaatacagtattatcat

SEQ ID NO: 623761 - DNA, 20 bp, Artificial Sequence
  chemically synthesized
ttgtgtgtgcatagcactat

SEQ ID NO: 623762 - DNA, 20 bp, Artificial Sequence
  chemically synthesized
gctgtgtatgtaagacagat

SEQ ID NO: 623763 - DNA, 20 bp, Artificial Sequence
  chemically synthesized
ttcattaatcctttttgcct

SEQ ID NO: 623764 - DNA, 20 bp, Artificial Sequence
  chemically synthesized
tgcaagaagcagtgaggcaa

SEQ ID NO: 623765 - DNA, 20 bp, Artificial Sequence
  chemically synthesized
atacagagatgtgaattaga

SEQ ID NO: 623766 - DNA, 20 bp, Artificial Sequence
  chemically synthesized
ctcttatgcctatttataaa

SEQ ID NO: 623767 - DNA, 20 bp, Artificial Sequence
  chemically synthesized
taaatgattacttatgaata

SEQ ID NO: 623768 - DNA, 20 bp, Artificial Sequence
  chemically synthesized
cactattcataagtaatcat

SEQ ID NO: 623769 - DNA, 20 bp, Artificial Sequence
  chemically synthesized
attcataagtaatcatttat

SEQ ID NO: 623770 - DNA, 20 bp, Artificial Sequence
  chemically synthesized
gcatggtacaaatcaatcat

SEQ ID NO: 623771 - DNA, 20 bp, Artificial Sequence
  chemically synthesized
tcatttatgattgatttgta

SEQ ID NO: 623772 - DNA, 20 bp, Artificial Sequence
  chemically synthesized
ttgttgaacacctatgttct

SEQ ID NO: 623773 - DNA, 20 bp, Artificial Sequence
  chemically synthesized
ttttttaacattaggttttt

SEQ ID NO: 623774 - DNA, 20 bp, Artificial Sequence
  chemically synthesized
ttgagcaactttttttaaca

SEQ ID NO: 623775 - DNA, 20 bp, Artificial Sequence
  chemically synthesized
tgaatgtaatgtacttatca

SEQ ID NO: 623776 - DNA, 20 bp, Artificial Sequence
  chemically synthesized
gataagtacattacattcat

SEQ ID NO: 623777 - DNA, 20 bp, Artificial Sequence
  chemically synthesized
gtacattacattcatccatg

SEQ ID NO: 623778 - DNA, 20 bp, Artificial Sequence
  chemically synthesized
aaatgccttctatctcttta

SEQ ID NO: 623779 - DNA, 20 bp, Artificial Sequence
  chemically synthesized
ttctatctctttattgtgat

SEQ ID NO: 623780 - DNA, 20 bp, Artificial Sequence
  chemically synthesized
ctttatttaaactgaaatgt

SEQ ID NO: 623781 - DNA, 20 bp, Artificial Sequence
  chemically synthesized
tacctagaaaacattgacat

SEQ ID NO: 623782 - DNA, 20 bp, Artificial Sequence
  chemically synthesized
ttctggaggaccgttagtga

SEQ ID NO: 623783 - DNA, 20 bp, Artificial Sequence
  chemically synthesized
aatgctagtttagttaatat

SEQ ID NO: 623784 - DNA, 20 bp, Artificial Sequence
  chemically synthesized
aagtttgcactttatttaat

SEQ ID NO: 623785 - DNA, 20 bp, Artificial Sequence
  chemically synthesized
aattgcatagttatgacaag

SEQ ID NO: 623786 - DNA, 20 bp, Artificial Sequence
  chemically synthesized
gcaattctgtattctctaaa

SEQ ID NO: 623787 - DNA, 20 bp, Artificial Sequence
  chemically synthesized
attgaaattgagactatgat

SEQ ID NO: 623788 - DNA, 20 bp, Artificial Sequence
  chemically synthesized
tatacagtagtcagttgaaa

SEQ ID NO: 623789 - DNA, 20 bp, Artificial Sequence
  chemically synthesized
tatttaaattgtataacgta

SEQ ID NO: 623790 - DNA, 20 bp, Artificial Sequence
  chemically synthesized
tatacaatttaaatatttat

SEQ ID NO: 623791 - DNA, 20 bp, Artificial Sequence
  chemically synthesized
ccaaaatgttgccttagtag

SEQ ID NO: 623792 - DNA, 20 bp, Artificial Sequence
  chemically synthesized
ccacttttagcattaggtgt

SEQ ID NO: 623793 - DNA, 20 bp, Artificial Sequence
  chemically synthesized
attttttctagatgtgtctt

SEQ ID NO: 623794 - DNA, 20 bp, Artificial Sequence
  chemically synthesized
cttctctgattttttttttt

SEQ ID NO: 623795 - DNA, 20 bp, Artificial Sequence
  chemically synthesized
cctagaaatgaagtcattat

SEQ ID NO: 623796 - DNA, 20 bp, Artificial Sequence
  chemically synthesized
tgtggatgctaaggtgtttg

SEQ ID NO: 623797 - DNA, 20 bp, Artificial Sequence
  chemically synthesized
aggggtgtggatgctaaggt

SEQ ID NO: 623798 - DNA, 20 bp, Artificial Sequence
  chemically synthesized
gattaggggtgtggatgcta

SEQ ID NO: 623799 - DNA, 20 bp, Artificial Sequence
  chemically synthesized
aagggaaattggaacaacag

SEQ ID NO: 623800 - DNA, 20 bp, Artificial Sequence
  chemically synthesized
ggataatggtgccatttgca

SEQ ID NO: 623801 - DNA, 20 bp, Artificial Sequence
  chemically synthesized
tgcaatacaacaccaattcc

SEQ ID NO: 623802 - DNA, 20 bp, Artificial Sequence
  chemically synthesized
tatctcatatacaaatcttg

SEQ ID NO: 623803 - DNA, 20 bp, Artificial Sequence
  chemically synthesized
gatgaaagaagtaaatctat

SEQ ID NO: 623804 - DNA, 20 bp, Artificial Sequence
  chemically synthesized
acggtagctcatccaaaaga

SEQ ID NO: 623805 - DNA, 20 bp, Artificial Sequence
  chemically synthesized
tcttttggatgagctaccgt

SEQ ID NO: 623806 - DNA, 20 bp, Artificial Sequence
  chemically synthesized
ggatgagctaccgtaattgc

SEQ ID NO: 623807 - DNA, 20 bp, Artificial Sequence
  chemically synthesized
tatcactctgttttgtgtga

SEQ ID NO: 623808 - DNA, 20 bp, Artificial Sequence
  chemically synthesized
tgtattttttaagactatca

SEQ ID NO: 623809 - DNA, 20 bp, Artificial Sequence
  chemically synthesized
gatagtcttaaaaaatacaa

SEQ ID NO: 623810 - DNA, 20 bp, Artificial Sequence
  chemically synthesized
aaaaatacaaatatgtttac

SEQ ID NO: 623811 - DNA, 20 bp, Artificial Sequence
  chemically synthesized
taagatcaatggacagcctt

SEQ ID NO: 623812 - DNA, 20 bp, Artificial Sequence
  chemically synthesized
tctataaccttcaaggctct

SEQ ID NO: 623813 - DNA, 20 bp, Artificial Sequence
  chemically synthesized
ccccagtcggccattcagat

SEQ ID NO: 623814 - DNA, 20 bp, Artificial Sequence
  chemically synthesized
tgagggcagaaaagtgtgga

SEQ ID NO: 623815 - DNA, 20 bp, Artificial Sequence
  chemically synthesized
ctgtactctaggaaagctgt

SEQ ID NO: 623816 - DNA, 20 bp, Artificial Sequence
  chemically synthesized
ggagaaagatctaaaacaag

SEQ ID NO: 623817 - DNA, 20 bp, Artificial Sequence
  chemically synthesized
aatgtccctgtcagagggag

SEQ ID NO: 623818 - DNA, 20 bp, Artificial Sequence
  chemically synthesized
tctaacctcattcttctttg

SEQ ID NO: 623819 - DNA, 20 bp, Artificial Sequence
  chemically synthesized
ttatacattcttattacaat

SEQ ID NO: 623820 - DNA, 20 bp, Artificial Sequence
  chemically synthesized
tagcccttatctccaatgca

SEQ ID NO: 623821 - DNA, 20 bp, Artificial Sequence
  chemically synthesized
gctagtctctctttgagttc

SEQ ID NO: 623822 - DNA, 20 bp, Artificial Sequence
  chemically synthesized
ctgatgatttgttatccatt

SEQ ID NO: 623823 - DNA, 20 bp, Artificial Sequence
  chemically synthesized
ttaaagaagggacttacagc

SEQ ID NO: 623824 - DNA, 20 bp, Artificial Sequence
  chemically synthesized
attgtgtggttttgggtgac

SEQ ID NO: 623825 - DNA, 20 bp, Artificial Sequence
  chemically synthesized
gtcacccaaaaccacacaat

SEQ ID NO: 623826 - DNA, 20 bp, Artificial Sequence
  chemically synthesized
actctctaaaacttgtattg

SEQ ID NO: 623827 - DNA, 20 bp, Artificial Sequence
  chemically synthesized
cttattttgatacttttatt

SEQ ID NO: 623828 - DNA, 20 bp, Artificial Sequence
  chemically synthesized
ttttactttaaatgtctgaa

SEQ ID NO: 623829 - DNA, 20 bp, Artificial Sequence
  chemically synthesized
gctcaagcctatggcttttg

SEQ ID NO: 623830 - DNA, 20 bp, Artificial Sequence
  chemically synthesized
agtaaaacactgcaaaagcc

SEQ ID NO: 623831 - DNA, 20 bp, Artificial Sequence
  chemically synthesized
aggttcactttgctcaagcc

SEQ ID NO: 623832 - DNA, 20 bp, Artificial Sequence
  chemically synthesized
ctgaagagctagaggattcc

SEQ ID NO: 623833 - DNA, 20 bp, Artificial Sequence
  chemically synthesized
tgaacagctgctgaagagct

SEQ ID NO: 623834 - DNA, 20 bp, Artificial Sequence
  chemically synthesized
gcccttcagcgtctactaaa

SEQ ID NO: 623835 - DNA, 20 bp, Artificial Sequence
  chemically synthesized
aagctcagacagctggggaa

SEQ ID NO: 623836 - DNA, 20 bp, Artificial Sequence
  chemically synthesized
aatcaggattccccagctgt

SEQ ID NO: 623837 - DNA, 20 bp, Artificial Sequence
  chemically synthesized
cagctgtctgagcttcccgt

SEQ ID NO: 623838 - DNA, 20 bp, Artificial Sequence
  chemically synthesized
gcttgtaggtggttaactaa

SEQ ID NO: 623839 - DNA, 20 bp, Artificial Sequence
  chemically synthesized
cgtaatcagatgcaagaaat

SEQ ID NO: 623840 - DNA, 20 bp, Artificial Sequence
  chemically synthesized
tacaagccaacatttcttgc

SEQ ID NO: 623841 - DNA, 20 bp, Artificial Sequence
  chemically synthesized
tctttaaagtctaatttccc

SEQ ID NO: 623842 - DNA, 20 bp, Artificial Sequence
  chemically synthesized
attttgcaacatgtgagtca

SEQ ID NO: 623843 - DNA, 20 bp, Artificial Sequence
  chemically synthesized
tcattgggattcatcatttt

SEQ ID NO: 623844 - DNA, 20 bp, Artificial Sequence
  chemically synthesized
attattttttcacttactca

SEQ ID NO: 623845 - DNA, 20 bp, Artificial Sequence
  chemically synthesized
tgagtaattcctttttatgt

SEQ ID NO: 623846 - DNA, 20 bp, Artificial Sequence
  chemically synthesized
tgatgaaaatacgtgggcca

SEQ ID NO: 623847 - DNA, 20 bp, Artificial Sequence
  chemically synthesized
atacgtgggccattctgatt

SEQ ID NO: 623848 - DNA, 20 bp, Artificial Sequence
  chemically synthesized
atttctttaatttttcctca

SEQ ID NO: 623849 - DNA, 20 bp, Artificial Sequence
  chemically synthesized
agtcagtacactgttacaag

SEQ ID NO: 623850 - DNA, 20 bp, Artificial Sequence
  chemically synthesized
ctcaacttgtctcttccttt

SEQ ID NO: 623851 - DNA, 20 bp, Artificial Sequence
  chemically synthesized
aggaatgagaaaaaagctac

SEQ ID NO: 623852 - DNA, 20 bp, Artificial Sequence
  chemically synthesized
tataaaagggcataaacatc

SEQ ID NO: 623853 - DNA, 20 bp, Artificial Sequence
  chemically synthesized
atgtttatgcccttttatag

SEQ ID NO: 623854 - DNA, 20 bp, Artificial Sequence
  chemically synthesized
aagcgttctcccttcttcca

SEQ ID NO: 623855 - DNA, 20 bp, Artificial Sequence
  chemically synthesized
aagcagagtggaagaaggga

SEQ ID NO: 623856 - DNA, 20 bp, Artificial Sequence
  chemically synthesized
tcttcttggcttttgttttg

SEQ ID NO: 623857 - DNA, 20 bp, Artificial Sequence
  chemically synthesized
taccctcttcttggcttttg

SEQ ID NO: 623858 - DNA, 20 bp, Artificial Sequence
  chemically synthesized
gtttttaccctcttcttggc

SEQ ID NO: 623859 - DNA, 20 bp, Artificial Sequence
  chemically synthesized
ttaaatgtttttaccctctt

SEQ ID NO: 623860 - DNA, 20 bp, Artificial Sequence
  chemically synthesized
aaataaaatgcttacccttt

SEQ ID NO: 623861 - DNA, 20 bp, Artificial Sequence
  chemically synthesized
tttccaattatgggcaaata

SEQ ID NO: 623862 - DNA, 20 bp, Artificial Sequence
  chemically synthesized
tgtcttcactatcatgaaaa

SEQ ID NO: 623863 - DNA, 20 bp, Artificial Sequence
  chemically synthesized
tcattgttgatatgcccatg

SEQ ID NO: 623864 - DNA, 20 bp, Artificial Sequence
  chemically synthesized
ttaaatataaacaaaaaaca

SEQ ID NO: 623865 - DNA, 20 bp, Artificial Sequence
  chemically synthesized
gatgctcgaatcatgatgtt

SEQ ID NO: 623866 - DNA, 20 bp, Artificial Sequence
  chemically synthesized
aaaatcagatgctcgaatca

SEQ ID NO: 623867 - DNA, 20 bp, Artificial Sequence
  chemically synthesized
aaaaacatcatgattcgagc

SEQ ID NO: 623868 - DNA, 20 bp, Artificial Sequence
  chemically synthesized
gattcgagcatctgattttt

SEQ ID NO: 623869 - DNA, 20 bp, Artificial Sequence
  chemically synthesized
gatggcttaatgggttttgg

SEQ ID NO: 623870 - DNA, 20 bp, Artificial Sequence
  chemically synthesized
atgagaatgtagatggctta

SEQ ID NO: 623871 - DNA, 20 bp, Artificial Sequence
  chemically synthesized
tgtaatgaaatgagaatgta

SEQ ID NO: 623872 - DNA, 20 bp, Artificial Sequence
  chemically synthesized
atttcattacatggataagc

SEQ ID NO: 623873 - DNA, 20 bp, Artificial Sequence
  chemically synthesized
ttaaaatgcattattaaagc

SEQ ID NO: 623874 - DNA, 20 bp, Artificial Sequence
  chemically synthesized
tatttttgtttattattcat

SEQ ID NO: 623875 - DNA, 20 bp, Artificial Sequence
  chemically synthesized
aggaagagctttgcctttat

SEQ ID NO: 623876 - DNA, 20 bp, Artificial Sequence
  chemically synthesized
aaataaaggcaaagctcttc

SEQ ID NO: 623877 - DNA, 20 bp, Artificial Sequence
  chemically synthesized
ttgaataaaagaatctgagg

SEQ ID NO: 623878 - DNA, 20 bp, Artificial Sequence
  chemically synthesized
ttcaccagtcttagatatat

SEQ ID NO: 623879 - DNA, 20 bp, Artificial Sequence
  chemically synthesized
aaaatgctagcaaattgatg

SEQ ID NO: 623880 - DNA, 20 bp, Artificial Sequence
  chemically synthesized
tcagaatttttaactcagta

SEQ ID NO: 623881 - DNA, 20 bp, Artificial Sequence
  chemically synthesized
tgataaaatgttgttgctgt

SEQ ID NO: 623882 - DNA, 20 bp, Artificial Sequence
  chemically synthesized
cacaaaagaaagcaggaata

SEQ ID NO: 623883 - DNA, 20 bp, Artificial Sequence
  chemically synthesized
tggtttagaaatcaatgtat

SEQ ID NO: 623884 - DNA, 20 bp, Artificial Sequence
  chemically synthesized
aatgttcttagtagtctgga

SEQ ID NO: 623885 - DNA, 20 bp, Artificial Sequence
  chemically synthesized
aaaaccaatgttcttagtag

SEQ ID NO: 623886 - DNA, 20 bp, Artificial Sequence
  chemically synthesized
aaatccagactactaagaac

SEQ ID NO: 623887 - DNA, 20 bp, Artificial Sequence
  chemically synthesized
actaagaacattggttttct

SEQ ID NO: 623888 - DNA, 20 bp, Artificial Sequence
  chemically synthesized
aagtattttgaacgagtgat

SEQ ID NO: 623889 - DNA, 20 bp, Artificial Sequence
  chemically synthesized
cctcttttatagctcacatc

SEQ ID NO: 623890 - DNA, 20 bp, Artificial Sequence
  chemically synthesized
aaaagagggagtactgatct

SEQ ID NO: 623891 - DNA, 20 bp, Artificial Sequence
  chemically synthesized
ttaagttcagggctacaagt

SEQ ID NO: 623892 - DNA, 20 bp, Artificial Sequence
  chemically synthesized
cataggtaaacttgtgccat

SEQ ID NO: 623893 - DNA, 20 bp, Artificial Sequence
  chemically synthesized
gtacagcaaacccctatggc

SEQ ID NO: 623894 - DNA, 20 bp, Artificial Sequence
  chemically synthesized
tgtgccataggggtttgctg

SEQ ID NO: 623895 - DNA, 20 bp, Artificial Sequence
  chemically synthesized
ggaaaagcaactaatgggta

SEQ ID NO: 623896 - DNA, 20 bp, Artificial Sequence
  chemically synthesized
tatcaagcctagtacccatt

SEQ ID NO: 623897 - DNA, 20 bp, Artificial Sequence
  chemically synthesized
ctccgaaaggccccagggtg

SEQ ID NO: 623898 - DNA, 20 bp, Artificial Sequence
  chemically synthesized
agggaaatggctctgctgtc

SEQ ID NO: 623899 - DNA, 20 bp, Artificial Sequence
  chemically synthesized
ttgtctgctgcctatcagaa

SEQ ID NO: 623900 - DNA, 20 bp, Artificial Sequence
  chemically synthesized
caaaaaaatacatttggctc

SEQ ID NO: 623901 - DNA, 20 bp, Artificial Sequence
  chemically synthesized
tagcctttctgtttccccat

SEQ ID NO: 623902 - DNA, 20 bp, Artificial Sequence
  chemically synthesized
taacacccagggcatagcct

SEQ ID NO: 623903 - DNA, 20 bp, Artificial Sequence
  chemically synthesized
cttaaaccagatggctcctc

SEQ ID NO: 623904 - DNA, 20 bp, Artificial Sequence
  chemically synthesized
cataatctctagaggagcca

SEQ ID NO: 623905 - DNA, 20 bp, Artificial Sequence
  chemically synthesized
aaggcttgatagtataaaaa

SEQ ID NO: 623906 - DNA, 20 bp, Artificial Sequence
  chemically synthesized
tttcatgaaattttttcatg

SEQ ID NO: 623907 - DNA, 20 bp, Artificial Sequence
  chemically synthesized
gaaaaaataaacaaaatcat

SEQ ID NO: 623908 - DNA, 20 bp, Artificial Sequence
  chemically synthesized
aagattaaaagctaaaatga

SEQ ID NO: 623909 - DNA, 20 bp, Artificial Sequence
  chemically synthesized
agttccaagattaaaagcta

SEQ ID NO: 623910 - DNA, 20 bp, Artificial Sequence
  chemically synthesized
ctcctatactaaatatagtt

SEQ ID NO: 623911 - DNA, 20 bp, Artificial Sequence
  chemically synthesized
tggaactatatttagtatag

SEQ ID NO: 623912 - DNA, 20 bp, Artificial Sequence
  chemically synthesized
ctaaaagtgaatgtgtcttc

SEQ ID NO: 623913 - DNA, 20 bp, Artificial Sequence
  chemically synthesized
cacttttagtattaagtaga

SEQ ID NO: 623914 - DNA, 20 bp, Artificial Sequence
  chemically synthesized
agagggagcttgaaattttg

SEQ ID NO: 623915 - DNA, 20 bp, Artificial Sequence
  chemically synthesized
ttattattttaccaagtttg

SEQ ID NO: 623916 - DNA, 20 bp, Artificial Sequence
  chemically synthesized
tgggataatttattatttta

SEQ ID NO: 623917 - DNA, 20 bp, Artificial Sequence
  chemically synthesized
ttgacatatgtttggagttc

SEQ ID NO: 623918 - DNA, 20 bp, Artificial Sequence
  chemically synthesized
tcatgctataaaatattgac

SEQ ID NO: 623919 - DNA, 20 bp, Artificial Sequence
  chemically synthesized
atctattagttagacttcct

SEQ ID NO: 623920 - DNA, 20 bp, Artificial Sequence
  chemically synthesized
cccaaggaagtctaactaat

SEQ ID NO: 623921 - DNA, 20 bp, Artificial Sequence
  chemically synthesized
gtgaagactacaaactattt

SEQ ID NO: 623922 - DNA, 20 bp, Artificial Sequence
  chemically synthesized
gactacaaactatttatttg

SEQ ID NO: 623923 - DNA, 20 bp, Artificial Sequence
  chemically synthesized
acaaacaaaccaagcaaata

SEQ ID NO: 623924 - DNA, 20 bp, Artificial Sequence
  chemically synthesized
acaaactatttatttgcttg

SEQ ID NO: 623925 - DNA, 20 bp, Artificial Sequence
  chemically synthesized
actatttatttgcttggttt

SEQ ID NO: 623926 - DNA, 20 bp, Artificial Sequence
  chemically synthesized
aacgtttttattaaatgcaa

SEQ ID NO: 623927 - DNA, 20 bp, Artificial Sequence
  chemically synthesized
aacctggttgcatttaataa

SEQ ID NO: 623928 - DNA, 20 bp, Artificial Sequence
  chemically synthesized
tgggctgcagtgtgggaaat

SEQ ID NO: 623929 - DNA, 20 bp, Artificial Sequence
  chemically synthesized
aaagtcctgctatagtccta

SEQ ID NO: 623930 - DNA, 20 bp, Artificial Sequence
  chemically synthesized
gattggattcagagagaggc

SEQ ID NO: 623931 - DNA, 20 bp, Artificial Sequence
  chemically synthesized
tacagtacattcaggttttg

SEQ ID NO: 623932 - DNA, 20 bp, Artificial Sequence
  chemically synthesized
ttttatacagtacattcagg

SEQ ID NO: 623933 - DNA, 20 bp, Artificial Sequence
  chemically synthesized
tttatttttatacagtacat

SEQ ID NO: 623934 - DNA, 20 bp, Artificial Sequence
  chemically synthesized
tgacaaggaataatgatgac

SEQ ID NO: 623935 - DNA, 20 bp, Artificial Sequence
  chemically synthesized
gtcatcattattccttgtca

SEQ ID NO: 623936 - DNA, 20 bp, Artificial Sequence
  chemically synthesized
aactgcaccgcctccattaa

SEQ ID NO: 623937 - DNA, 20 bp, Artificial Sequence
  chemically synthesized
cctttcattctgaaaagata

SEQ ID NO: 623938 - DNA, 20 bp, Artificial Sequence
  chemically synthesized
aaagacaaccttttatttaa

SEQ ID NO: 623939 - DNA, 20 bp, Artificial Sequence
  chemically synthesized
tattttaaaatgtaactggg

SEQ ID NO: 623940 - DNA, 20 bp, Artificial Sequence
  chemically synthesized
caacacatctcttcatacag

SEQ ID NO: 623941 - DNA, 20 bp, Artificial Sequence
  chemically synthesized
cctcatgtaagtaaggcttt

SEQ ID NO: 623942 - DNA, 20 bp, Artificial Sequence
  chemically synthesized
ggaggggcccctcatgtaag

SEQ ID NO: 623943 - DNA, 20 bp, Artificial Sequence
  chemically synthesized
acacagaacgaaccaggaag

SEQ ID NO: 623944 - DNA, 20 bp, Artificial Sequence
  chemically synthesized
tcaattccttaaaaaatgat

SEQ ID NO: 623945 - DNA, 20 bp, Artificial Sequence
  chemically synthesized
ctcttaggaaactttatacc

SEQ ID NO: 623946 - DNA, 20 bp, Artificial Sequence
  chemically synthesized
tgcattcaaatcacagggta

SEQ ID NO: 623947 - DNA, 20 bp, Artificial Sequence
  chemically synthesized
tatatactcataccaaaata

SEQ ID NO: 623948 - DNA, 20 bp, Artificial Sequence
  chemically synthesized
atattttcctaacttattaa

SEQ ID NO: 623949 - DNA, 20 bp, Artificial Sequence
  chemically synthesized
atagaaggtggaaggagaag

SEQ ID NO: 623950 - DNA, 20 bp, Artificial Sequence
  chemically synthesized
aaggaaagtttgggaaatga

SEQ ID NO: 623951 - DNA, 20 bp, Artificial Sequence
  chemically synthesized
atagaattttgaaaaacacc

SEQ ID NO: 623952 - DNA, 20 bp, Artificial Sequence
  chemically synthesized
atcattgtcttggaaacatc

SEQ ID NO: 623953 - DNA, 20 bp, Artificial Sequence
  chemically synthesized
aacacctgatgtttccaaga

SEQ ID NO: 623954 - DNA, 20 bp, Artificial Sequence
  chemically synthesized
ccacttgtgtagtttaataa

SEQ ID NO: 623955 - DNA, 20 bp, Artificial Sequence
  chemically synthesized
gtcaagtttttaaccacttg

SEQ ID NO: 623956 - DNA, 20 bp, Artificial Sequence
  chemically synthesized
aagtggttaaaaacttgaca

SEQ ID NO: 623957 - DNA, 20 bp, Artificial Sequence
  chemically synthesized
gctacatatgaaacaaattg

SEQ ID NO: 623958 - DNA, 20 bp, Artificial Sequence
  chemically synthesized
gtagcaaatgacatggagta

SEQ ID NO: 623959 - DNA, 20 bp, Artificial Sequence
  chemically synthesized
catttgggcacagatattaa

SEQ ID NO: 623960 - DNA, 20 bp, Artificial Sequence
  chemically synthesized
aacactttgtagtctttttt

SEQ ID NO: 623961 - DNA, 20 bp, Artificial Sequence
  chemically synthesized
tatgtcatgtaagatacacc

SEQ ID NO: 623962 - DNA, 20 bp, Artificial Sequence
  chemically synthesized
ttgatgatatactgttaata

SEQ ID NO: 623963 - DNA, 20 bp, Artificial Sequence
  chemically synthesized
aagacatcttaactacgaaa

SEQ ID NO: 623964 - DNA, 20 bp, Artificial Sequence
  chemically synthesized
ttcgtagttaagatgtcttt

SEQ ID NO: 623965 - DNA, 20 bp, Artificial Sequence
  chemically synthesized
tctgcagatgaaattctaaa

SEQ ID NO: 623966 - DNA, 20 bp, Artificial Sequence
  chemically synthesized
ttctaaaagtgaacaataca

SEQ ID NO: 623967 - DNA, 20 bp, Artificial Sequence
  chemically synthesized
agtgatctcttttaaagggt

SEQ ID NO: 623968 - DNA, 20 bp, Artificial Sequence
  chemically synthesized
aaacttacaaaagtacgttt

SEQ ID NO: 623969 - DNA, 20 bp, Artificial Sequence
  chemically synthesized
aaacaacaaaacgtactttt

SEQ ID NO: 623970 - DNA, 20 bp, Artificial Sequence
  chemically synthesized
agtttgataaacttacaaaa

SEQ ID NO: 623971 - DNA, 20 bp, Artificial Sequence
  chemically synthesized
aatccagtttgtaaatttgc

SEQ ID NO: 623972 - DNA, 20 bp, Artificial Sequence
  chemically synthesized
aaactacggcaaatttacaa

SEQ ID NO: 623973 - DNA, 20 bp, Artificial Sequence
  chemically synthesized
ttggatgtttgacatttgaa

SEQ ID NO: 623974 - DNA, 20 bp, Artificial Sequence
  chemically synthesized
ttgacaacatactgctactt

SEQ ID NO: 623975 - DNA, 20 bp, Artificial Sequence
  chemically synthesized
ctatattatacattaaattt

SEQ ID NO: 623976 - DNA, 20 bp, Artificial Sequence
  chemically synthesized
taatatagccctgagtatat

SEQ ID NO: 623977 - DNA, 20 bp, Artificial Sequence
  chemically synthesized
aatgcctatgcaacatgaca

SEQ ID NO: 623978 - DNA, 20 bp, Artificial Sequence
  chemically synthesized
catgttgcataggcattact

SEQ ID NO: 623979 - DNA, 20 bp, Artificial Sequence
  chemically synthesized
atctttttgggacatgccct

SEQ ID NO: 623980 - DNA, 20 bp, Artificial Sequence
  chemically synthesized
atcctacagggcatgtccca

SEQ ID NO: 623981 - DNA, 20 bp, Artificial Sequence
  chemically synthesized
atatctatgacaaagcagag

SEQ ID NO: 623982 - DNA, 20 bp, Artificial Sequence
  chemically synthesized
ttaagcaaggtaaatctaca

SEQ ID NO: 623983 - DNA, 20 bp, Artificial Sequence
  chemically synthesized
caaagcagagtgtagattta

SEQ ID NO: 623984 - DNA, 20 bp, Artificial Sequence
  chemically synthesized
atatatatatataaaatcac

SEQ ID NO: 623985 - DNA, 20 bp, Artificial Sequence
  chemically synthesized
ataaataccatcaaaatcac

SEQ ID NO: 623986 - DNA, 20 bp, Artificial Sequence
  chemically synthesized
tatacacacacatttttatt

SEQ ID NO: 623987 - DNA, 20 bp, Artificial Sequence
  chemically synthesized
atatatgcatggcatatatc

SEQ ID NO: 623988 - DNA, 20 bp, Artificial Sequence
  chemically synthesized
tttgtaatgatagtaaatat

SEQ ID NO: 623989 - DNA, 20 bp, Artificial Sequence
  chemically synthesized
tggtggacatcattattact

SEQ ID NO: 623990 - DNA, 20 bp, Artificial Sequence
  chemically synthesized
aatatttacttacattgttg

SEQ ID NO: 623991 - DNA, 20 bp, Artificial Sequence
  chemically synthesized
atacaatatttacttacatt

SEQ ID NO: 623992 - DNA, 20 bp, Artificial Sequence
  chemically synthesized
aatattgtattataaagtct

SEQ ID NO: 623993 - DNA, 20 bp, Artificial Sequence
  chemically synthesized
acaatgttaacttatttcca

SEQ ID NO: 623994 - DNA, 20 bp, Artificial Sequence
  chemically synthesized
caactactaaaaaaaaaggc

SEQ ID NO: 623995 - DNA, 20 bp, Artificial Sequence
  chemically synthesized
tgtggagcattacttatttg

SEQ ID NO: 623996 - DNA, 20 bp, Artificial Sequence
  chemically synthesized
actgtgtgtcccgaagagat

SEQ ID NO: 623997 - DNA, 20 bp, Artificial Sequence
  chemically synthesized
agaaagtcatgatgactaat

SEQ ID NO: 623998 - DNA, 20 bp, Artificial Sequence
  chemically synthesized
ttcatatagaaatacaacta

SEQ ID NO: 623999 - DNA, 20 bp, Artificial Sequence
  chemically synthesized
ccagcttttcagttcaattt

SEQ ID NO: 624000 - DNA, 20 bp, Artificial Sequence
  chemically synthesized
ttgtttcatgtctattatga

SEQ ID NO: 624001 - DNA, 20 bp, Artificial Sequence
  chemically synthesized
atttagtagtaaagtcacct

SEQ ID NO: 624002 - DNA, 20 bp, Artificial Sequence
  chemically synthesized
taaatataattaggagttcc

SEQ ID NO: 624003 - DNA, 20 bp, Artificial Sequence
  chemically synthesized
aggagttcctcaagtttgta

SEQ ID NO: 624004 - DNA, 20 bp, Artificial Sequence
  chemically synthesized
atctatgctatcaaatgatc

SEQ ID NO: 624005 - DNA, 20 bp, Artificial Sequence
  chemically synthesized
tattgataaagatttaattt

SEQ ID NO: 624006 - DNA, 20 bp, Artificial Sequence
  chemically synthesized
aaggatgtgaaaagtattga

SEQ ID NO: 624007 - DNA, 20 bp, Artificial Sequence
  chemically synthesized
atggaggcctaaaagttaga

SEQ ID NO: 624008 - DNA, 20 bp, Artificial Sequence
  chemically synthesized
tttgtatatctgagttatta

SEQ ID NO: 624009 - DNA, 20 bp, Artificial Sequence
  chemically synthesized
atttattttgattgctgtga

SEQ ID NO: 624010 - DNA, 20 bp, Artificial Sequence
  chemically synthesized
atttgactataacagattta

SEQ ID NO: 624011 - DNA, 20 bp, Artificial Sequence
  chemically synthesized
gcagaatgtcatttgactat

SEQ ID NO: 624012 - DNA, 20 bp, Artificial Sequence
  chemically synthesized
tctgcatattctattactgc

SEQ ID NO: 624013 - DNA, 20 bp, Artificial Sequence
  chemically synthesized
ggtttgttaatcaagaaatc

SEQ ID NO: 624014 - DNA, 20 bp, Artificial Sequence
  chemically synthesized
atagaactaaacacatgatt

SEQ ID NO: 624015 - DNA, 20 bp, Artificial Sequence
  chemically synthesized
tctttgcgatagaactaaac

SEQ ID NO: 624016 - DNA, 20 bp, Artificial Sequence
  chemically synthesized
tttcaacagaaatggagtgt

SEQ ID NO: 624017 - DNA, 20 bp, Artificial Sequence
  chemically synthesized
tttacactccatttctgttg

SEQ ID NO: 624018 - DNA, 20 bp, Artificial Sequence
  chemically synthesized
atatgcagtatatataacat

SEQ ID NO: 624019 - DNA, 20 bp, Artificial Sequence
  chemically synthesized
gattgattttaaattatcac

SEQ ID NO: 624020 - DNA, 20 bp, Artificial Sequence
  chemically synthesized
acaagctcactaattaggta

SEQ ID NO: 624021 - DNA, 20 bp, Artificial Sequence
  chemically synthesized
aaaatcaatctacctaatta

SEQ ID NO: 624022 - DNA, 20 bp, Artificial Sequence
  chemically synthesized
tgtgacaagctcactaatta

SEQ ID NO: 624023 - DNA, 20 bp, Artificial Sequence
  chemically synthesized
tattttactgtggcataacg

SEQ ID NO: 624024 - DNA, 20 bp, Artificial Sequence
  chemically synthesized
aaatatattttactgtggca

SEQ ID NO: 624025 - DNA, 20 bp, Artificial Sequence
  chemically synthesized
gccttgatatacacttttca

SEQ ID NO: 624026 - DNA, 20 bp, Artificial Sequence
  chemically synthesized
taaagtttgaagaactttta

SEQ ID NO: 624027 - DNA, 20 bp, Artificial Sequence
  chemically synthesized
ttttaagcctactggagcaa

SEQ ID NO: 624028 - DNA, 20 bp, Artificial Sequence
  chemically synthesized
cttcaaactttattgctcca

SEQ ID NO: 624029 - DNA, 20 bp, Artificial Sequence
  chemically synthesized
gctgaagtttgttggtttct

SEQ ID NO: 624030 - DNA, 20 bp, Artificial Sequence
  chemically synthesized
atgagaaaccaacaaacttc

SEQ ID NO: 624031 - DNA, 20 bp, Artificial Sequence
  chemically synthesized
ttttaaagctgctgaagttt

SEQ ID NO: 624032 - DNA, 20 bp, Artificial Sequence
  chemically synthesized
gttactttttttaaagctgc

SEQ ID NO: 624033 - DNA, 20 bp, Artificial Sequence
  chemically synthesized
agctttaaaaaaagtaacac

SEQ ID NO: 624034 - DNA, 20 bp, Artificial Sequence
  chemically synthesized
gtaacacttcagtttttcct

SEQ ID NO: 624035 - DNA, 20 bp, Artificial Sequence
  chemically synthesized
agtcaacacagtaactgatg

SEQ ID NO: 624036 - DNA, 20 bp, Artificial Sequence
  chemically synthesized
cttgagagagaaggcgggtc

SEQ ID NO: 624037 - DNA, 20 bp, Artificial Sequence
  chemically synthesized
tgacccgccttctctctcaa

SEQ ID NO: 624038 - DNA, 20 bp, Artificial Sequence
  chemically synthesized
catggtcactacatataagg

SEQ ID NO: 624039 - DNA, 20 bp, Artificial Sequence
  chemically synthesized
ttgagcattgtttgaattca

SEQ ID NO: 624040 - DNA, 20 bp, Artificial Sequence
  chemically synthesized
ttaatcagaacacagttgag

SEQ ID NO: 624041 - DNA, 20 bp, Artificial Sequence
  chemically synthesized
tcaaacaatgctcaactgtg

SEQ ID NO: 624042 - DNA, 20 bp, Artificial Sequence
  chemically synthesized
tactatgtccactgtgctat

SEQ ID NO: 624043 - DNA, 20 bp, Artificial Sequence
  chemically synthesized
aatagcacagtggacatagt

SEQ ID NO: 624044 - DNA, 20 bp, Artificial Sequence
  chemically synthesized
ctgaatagtttttgtgttta

SEQ ID NO: 624045 - DNA, 20 bp, Artificial Sequence
  chemically synthesized
gcttttgtactgaatagttt

SEQ ID NO: 624046 - DNA, 20 bp, Artificial Sequence
  chemically synthesized
attgttatgcttttgtactg

SEQ ID NO: 624047 - DNA, 20 bp, Artificial Sequence
  chemically synthesized
gaaagttacagaaagtattg

SEQ ID NO: 624048 - DNA, 20 bp, Artificial Sequence
  chemically synthesized
tttattaacagagcagaaaa

SEQ ID NO: 624049 - DNA, 20 bp, Artificial Sequence
  chemically synthesized
atttaaaagtcaattttgaa

SEQ ID NO: 624050 - DNA, 20 bp, Artificial Sequence
  chemically synthesized
cagtggatacataacaaatg

SEQ ID NO: 624051 - DNA, 20 bp, Artificial Sequence
  chemically synthesized
accaaagttattttttcccc

SEQ ID NO: 624052 - DNA, 20 bp, Artificial Sequence
  chemically synthesized
tggcatcatcaatacataac

SEQ ID NO: 624053 - DNA, 20 bp, Artificial Sequence
  chemically synthesized
attcagctgctgcattctgc

SEQ ID NO: 624054 - DNA, 20 bp, Artificial Sequence
  chemically synthesized
gtgtgtataggtctcatggg

SEQ ID NO: 624055 - DNA, 20 bp, Artificial Sequence
  chemically synthesized
gcataattcacaactgaaat

SEQ ID NO: 624056 - DNA, 20 bp, Artificial Sequence
  chemically synthesized
aaagaataatttgttagtaa

SEQ ID NO: 624057 - DNA, 20 bp, Artificial Sequence
  chemically synthesized
taactcaatgtctaaaaaaa

SEQ ID NO: 624058 - DNA, 20 bp, Artificial Sequence
  chemically synthesized
atcatttaatggttctgaat

SEQ ID NO: 624059 - DNA, 20 bp, Artificial Sequence
  chemically synthesized
tttaatggttctgaatagag

SEQ ID NO: 624060 - DNA, 20 bp, Artificial Sequence
  chemically synthesized
agaagctttctattggcaaa

SEQ ID NO: 624061 - DNA, 20 bp, Artificial Sequence
  chemically synthesized
taaatcattctttgccaata

SEQ ID NO: 624062 - DNA, 20 bp, Artificial Sequence
  chemically synthesized
agtaataaggaacaagatga

SEQ ID NO: 624063 - DNA, 20 bp, Artificial Sequence
  chemically synthesized
ctttctttaaaaaatgtttc

SEQ ID NO: 624064 - DNA, 20 bp, Artificial Sequence
  chemically synthesized
aaagaatatctttctttaaa

SEQ ID NO: 624065 - DNA, 20 bp, Artificial Sequence
  chemically synthesized
ataataatccctactaaaat

SEQ ID NO: 624066 - DNA, 20 bp, Artificial Sequence
  chemically synthesized
cactcaaacaaaaattttag

SEQ ID NO: 624067 - DNA, 20 bp, Artificial Sequence
  chemically synthesized
ccctactaaaatttttgttt

SEQ ID NO: 624068 - DNA, 20 bp, Artificial Sequence
  chemically synthesized
tttttctatgtcaaacattc

SEQ ID NO: 624069 - DNA, 20 bp, Artificial Sequence
  chemically synthesized
cattgcagtcgcaagcagtt

SEQ ID NO: 624070 - DNA, 20 bp, Artificial Sequence
  chemically synthesized
aaaaatattgagtcagactg

SEQ ID NO: 624071 - DNA, 20 bp, Artificial Sequence
  chemically synthesized
ttaatagttaattgtacatt

SEQ ID NO: 624072 - DNA, 20 bp, Artificial Sequence
  chemically synthesized
ttttaaattaaaattaggcc

SEQ ID NO: 624073 - DNA, 20 bp, Artificial Sequence
  chemically synthesized
aggaggtgacctagggaaaa

SEQ ID NO: 624074 - DNA, 20 bp, Artificial Sequence
  chemically synthesized
tctatgttgttttatgaaaa

SEQ ID NO: 624075 - DNA, 20 bp, Artificial Sequence
  chemically synthesized
caattttttcattttttcta

SEQ ID NO: 624076 - DNA, 20 bp, Artificial Sequence
  chemically synthesized
caacatagaaaaaatgaaaa

SEQ ID NO: 624077 - DNA, 20 bp, Artificial Sequence
  chemically synthesized
aaatgaaaaaattgttttgg

SEQ ID NO: 624078 - DNA, 20 bp, Artificial Sequence
  chemically synthesized
tgccctttgtatcttgcact

SEQ ID NO: 624079 - DNA, 20 bp, Artificial Sequence
  chemically synthesized
agttttctacaaacataaac

SEQ ID NO: 624080 - DNA, 20 bp, Artificial Sequence
  chemically synthesized
gccttggcctaaacaagggt

SEQ ID NO: 624081 - DNA, 20 bp, Artificial Sequence
  chemically synthesized
attcacgccttggcctaaac

SEQ ID NO: 624082 - DNA, 20 bp, Artificial Sequence
  chemically synthesized
agttcccacgtgatattgat

SEQ ID NO: 624083 - DNA, 20 bp, Artificial Sequence
  chemically synthesized
tggggttgggacacagcact

SEQ ID NO: 624084 - DNA, 20 bp, Artificial Sequence
  chemically synthesized
cacagcactctgtgttttac

SEQ ID NO: 624085 - DNA, 20 bp, Artificial Sequence
  chemically synthesized
actttgagaaaccctaaagt

SEQ ID NO: 624086 - DNA, 20 bp, Artificial Sequence
  chemically synthesized
gtttttagaaacatacactt

SEQ ID NO: 624087 - DNA, 20 bp, Artificial Sequence
  chemically synthesized
tttgttacatttagaaccac

SEQ ID NO: 624088 - DNA, 20 bp, Artificial Sequence
  chemically synthesized
cattcagatctatcaggatt

SEQ ID NO: 624089 - DNA, 20 bp, Artificial Sequence
  chemically synthesized
tctcagggcattcagatcta

SEQ ID NO: 624090 - DNA, 20 bp, Artificial Sequence
  chemically synthesized
cattataggtgccaaataaa

SEQ ID NO: 624091 - DNA, 20 bp, Artificial Sequence
  chemically synthesized
cagaatttatttggcaccta

SEQ ID NO: 624092 - DNA, 20 bp, Artificial Sequence
  chemically synthesized
gtggaatgcatatacttccc

SEQ ID NO: 624093 - DNA, 20 bp, Artificial Sequence
  chemically synthesized
tttataatccaggtgcaaat

SEQ ID NO: 624094 - DNA, 20 bp, Artificial Sequence
  chemically synthesized
attgtaagcatatatttgca

SEQ ID NO: 624095 - DNA, 20 bp, Artificial Sequence
  chemically synthesized
gaggactaaaggagaaagat

SEQ ID NO: 624096 - DNA, 20 bp, Artificial Sequence
  chemically synthesized
acttgttattttcaaatact

SEQ ID NO: 624097 - DNA, 20 bp, Artificial Sequence
  chemically synthesized
gagatcccatgtacccttca

SEQ ID NO: 624098 - DNA, 20 bp, Artificial Sequence
  chemically synthesized
acccttcacccagtttctcc

SEQ ID NO: 624099 - DNA, 20 bp, Artificial Sequence
  chemically synthesized
atacatatcaatgtcagttt

SEQ ID NO: 624100 - DNA, 20 bp, Artificial Sequence
  chemically synthesized
aaatatgtatacatatcaat

SEQ ID NO: 624101 - DNA, 20 bp, Artificial Sequence
  chemically synthesized
tatacatatttctatttcat

SEQ ID NO: 624102 - DNA, 20 bp, Artificial Sequence
  chemically synthesized
ctcaacctccacaaataaac

SEQ ID NO: 624103 - DNA, 20 bp, Artificial Sequence
  chemically synthesized
aatctctgtggtgatgaaac

SEQ ID NO: 624104 - DNA, 20 bp, Artificial Sequence
  chemically synthesized
aaacacctgtttcatcacca

SEQ ID NO: 624105 - DNA, 20 bp, Artificial Sequence
  chemically synthesized
ggagaacaaattgattggta

SEQ ID NO: 624106 - DNA, 20 bp, Artificial Sequence
  chemically synthesized
aattacagtgatggagaaca

SEQ ID NO: 624107 - DNA, 20 bp, Artificial Sequence
  chemically synthesized
ttaagaatattagataaatg

SEQ ID NO: 624108 - DNA, 20 bp, Artificial Sequence
  chemically synthesized
atgattcggtatgtaacctt

SEQ ID NO: 624109 - DNA, 20 bp, Artificial Sequence
  chemically synthesized
tcggtatgtaaccttttgag

SEQ ID NO: 624110 - DNA, 20 bp, Artificial Sequence
  chemically synthesized
gatccatttaagttgtcatc

SEQ ID NO: 624111 - DNA, 20 bp, Artificial Sequence
  chemically synthesized
cacatactgtgggatatttt

SEQ ID NO: 624112 - DNA, 20 bp, Artificial Sequence
  chemically synthesized
tgggatattttcgttgtttc

SEQ ID NO: 624113 - DNA, 20 bp, Artificial Sequence
  chemically synthesized
gaaaaactacatgattgttt

SEQ ID NO: 624114 - DNA, 20 bp, Artificial Sequence
  chemically synthesized
ataaagctgcaaaacaatca

SEQ ID NO: 624115 - DNA, 20 bp, Artificial Sequence
  chemically synthesized
tgaaaaatgaaaaactacat

SEQ ID NO: 624116 - DNA, 20 bp, Artificial Sequence
  chemically synthesized
ggaatgaaaaatgaaaaact

SEQ ID NO: 624117 - DNA, 20 bp, Artificial Sequence
  chemically synthesized
agtttttcatttttcattcc

SEQ ID NO: 624118 - DNA, 20 bp, Artificial Sequence
  chemically synthesized
tttaccatataaattttaga

SEQ ID NO: 624119 - DNA, 20 bp, Artificial Sequence
  chemically synthesized
tgaatacattttggaagaat

SEQ ID NO: 624120 - DNA, 20 bp, Artificial Sequence
  chemically synthesized
aagaattgatgtttttaccg

SEQ ID NO: 624121 - DNA, 20 bp, Artificial Sequence
  chemically synthesized
ctttaatttatttcatcata

SEQ ID NO: 624122 - DNA, 20 bp, Artificial Sequence
  chemically synthesized
tcatactcggcttttttaca

SEQ ID NO: 624123 - DNA, 20 bp, Artificial Sequence
  chemically synthesized
tttttacacagtgctttgtg

SEQ ID NO: 624124 - DNA, 20 bp, Artificial Sequence
  chemically synthesized
ggcactactgtcggttatgc

SEQ ID NO: 624125 - DNA, 20 bp, Artificial Sequence
  chemically synthesized
gcacaaaaaaaggaaaacag

SEQ ID NO: 624126 - DNA, 20 bp, Artificial Sequence
  chemically synthesized
agaacgggttttggaaactc

SEQ ID NO: 624127 - DNA, 20 bp, Artificial Sequence
  chemically synthesized
gtttccaaaacccgttcttt

SEQ ID NO: 624128 - DNA, 20 bp, Artificial Sequence
  chemically synthesized
caaaaacaaacaggaaaaga

SEQ ID NO: 624129 - DNA, 20 bp, Artificial Sequence
  chemically synthesized
ccaaaacccgttcttttcct

SEQ ID NO: 624130 - DNA, 20 bp, Artificial Sequence
  chemically synthesized
cccgttcttttcctgtttgt

SEQ ID NO: 624131 - DNA, 20 bp, Artificial Sequence
  chemically synthesized
gaaattttcatttaagagat

SEQ ID NO: 624132 - DNA, 20 bp, Artificial Sequence
  chemically synthesized
gagtttgagactataacgag

SEQ ID NO: 624133 - DNA, 20 bp, Artificial Sequence
  chemically synthesized
caggaggatcacttgagccc

SEQ ID NO: 624134 - DNA, 20 bp, Artificial Sequence
  chemically synthesized
acctgtagacccagctactc

SEQ ID NO: 624135 - DNA, 20 bp, Artificial Sequence
  chemically synthesized
ctcctggggaggctgaggca

SEQ ID NO: 624136 - DNA, 20 bp, Artificial Sequence
  chemically synthesized
tgcctcagcctccccaggag

SEQ ID NO: 624137 - DNA, 20 bp, Artificial Sequence
  chemically synthesized
ggcatgagccaccacactcg

SEQ ID NO: 624138 - DNA, 20 bp, Artificial Sequence
  chemically synthesized
gtaaaaagaagcacatttaa

SEQ ID NO: 624139 - DNA, 20 bp, Artificial Sequence
  chemically synthesized
aacaacgtaaacatttttaa

SEQ ID NO: 624140 - DNA, 20 bp, Artificial Sequence
  chemically synthesized
ttacgttgttaaaaaatgtt

SEQ ID NO: 624141 - DNA, 20 bp, Artificial Sequence
  chemically synthesized
aaaaatgttatatgcttgtt

SEQ ID NO: 624142 - DNA, 20 bp, Artificial Sequence
  chemically synthesized
ttgagaagttgaggcaggca

SEQ ID NO: 624143 - DNA, 20 bp, Artificial Sequence
  chemically synthesized
ggctgtattttttttagaga

SEQ ID NO: 624144 - DNA, 20 bp, Artificial Sequence
  chemically synthesized
tcaggaggctgaggctggag

SEQ ID NO: 624145 - DNA, 20 bp, Artificial Sequence
  chemically synthesized
aaacttcacctcccctgctc

SEQ ID NO: 624146 - DNA, 20 bp, Artificial Sequence
  chemically synthesized
aatcgcttgagcaggggagg

SEQ ID NO: 624147 - DNA, 20 bp, Artificial Sequence
  chemically synthesized
ttttaatgaatgtatttgta

SEQ ID NO: 624148 - DNA, 20 bp, Artificial Sequence
  chemically synthesized
gaatgtatttgtatttggtt

SEQ ID NO: 624149 - DNA, 20 bp, Artificial Sequence
  chemically synthesized
tttgtatttggtttgttgat

SEQ ID NO: 624150 - DNA, 20 bp, Artificial Sequence
  chemically synthesized
gtttgttgatttaagtttct

SEQ ID NO: 624151 - DNA, 20 bp, Artificial Sequence
  chemically synthesized
aatattttctcccattcttc

SEQ ID NO: 624152 - DNA, 20 bp, Artificial Sequence
  chemically synthesized
tcttcgtctgtttactttgt

SEQ ID NO: 624153 - DNA, 20 bp, Artificial Sequence
  chemically synthesized
gtttactttgttgatgtttc

SEQ ID NO: 624154 - DNA, 20 bp, Artificial Sequence
  chemically synthesized
cttttgctttgcagaagctc

SEQ ID NO: 624155 - DNA, 20 bp, Artificial Sequence
  chemically synthesized
agtggaacttgactaagcca

SEQ ID NO: 624156 - DNA, 20 bp, Artificial Sequence
  chemically synthesized
gtcaagttccacttgtcaat

SEQ ID NO: 624157 - DNA, 20 bp, Artificial Sequence
  chemically synthesized
tcaatttttgtttttgttgc

SEQ ID NO: 624158 - DNA, 20 bp, Artificial Sequence
  chemically synthesized
aatgtaaaaaagggtacttc

SEQ ID NO: 624159 - DNA, 20 bp, Artificial Sequence
  chemically synthesized
ggtacttcctaggttttctt

SEQ ID NO: 624160 - DNA, 20 bp, Artificial Sequence
  chemically synthesized
aaatcaactgacggtgaact

SEQ ID NO: 624161 - DNA, 20 bp, Artificial Sequence
  chemically synthesized
taaacctttagttcaccgtc

SEQ ID NO: 624162 - DNA, 20 bp, Artificial Sequence
  chemically synthesized
aaaactggctggccacatgc

SEQ ID NO: 624163 - DNA, 20 bp, Artificial Sequence
  chemically synthesized
caatcttctgcatgtggcca

SEQ ID NO: 624164 - DNA, 20 bp, Artificial Sequence
  chemically synthesized
tgaataggaagtcctttccc

SEQ ID NO: 624165 - DNA, 20 bp, Artificial Sequence
  chemically synthesized
agatcagatggttataggtg

SEQ ID NO: 624166 - DNA, 20 bp, Artificial Sequence
  chemically synthesized
agatggttataggtgtgtcg

SEQ ID NO: 624167 - DNA, 20 bp, Artificial Sequence
  chemically synthesized
ttctgttccattggtctatg

SEQ ID NO: 624168 - DNA, 20 bp, Artificial Sequence
  chemically synthesized
ctgtttttgtaccagtacca

SEQ ID NO: 624169 - DNA, 20 bp, Artificial Sequence
  chemically synthesized
accatgctgtttgggttact

SEQ ID NO: 624170 - DNA, 20 bp, Artificial Sequence
  chemically synthesized
gggttactgtaggcttatag

SEQ ID NO: 624171 - DNA, 20 bp, Artificial Sequence
  chemically synthesized
aagtcaggtagtgtgatgcc

SEQ ID NO: 624172 - DNA, 20 bp, Artificial Sequence
  chemically synthesized
gatgcctcttgctttattct

SEQ ID NO: 624173 - DNA, 20 bp, Artificial Sequence
  chemically synthesized
tcttgctttattcttttagc

SEQ ID NO: 624174 - DNA, 20 bp, Artificial Sequence
  chemically synthesized
gctttattcttttagcttaa

SEQ ID NO: 624175 - DNA, 20 bp, Artificial Sequence
  chemically synthesized
ctcttttggttccatacaaa

SEQ ID NO: 624176 - DNA, 20 bp, Artificial Sequence
  chemically synthesized
gaaaaatgaaaattgacgtt

SEQ ID NO: 624177 - DNA, 20 bp, Artificial Sequence
  chemically synthesized
aaattgacgttggtagtttg

SEQ ID NO: 624178 - DNA, 20 bp, Artificial Sequence
  chemically synthesized
agattagcactgaatctgta

SEQ ID NO: 624179 - DNA, 20 bp, Artificial Sequence
  chemically synthesized
ccatactgcccaaagcaatt

SEQ ID NO: 624180 - DNA, 20 bp, Artificial Sequence
  chemically synthesized
tcttccaatccaagagcatg

SEQ ID NO: 624181 - DNA, 20 bp, Artificial Sequence
  chemically synthesized
aatgcaaaacatttcatgct

SEQ ID NO: 624182 - DNA, 20 bp, Artificial Sequence
  chemically synthesized
tttgcatttatttgtgttgt

SEQ ID NO: 624183 - DNA, 20 bp, Artificial Sequence
  chemically synthesized
ttgtctctgatttctttcag

SEQ ID NO: 624184 - DNA, 20 bp, Artificial Sequence
  chemically synthesized
cattcatcttgctgcaaagt

SEQ ID NO: 624185 - DNA, 20 bp, Artificial Sequence
  chemically synthesized
ataagtgagaacatgcggta

SEQ ID NO: 624186 - DNA, 20 bp, Artificial Sequence
  chemically synthesized
ctttatgtccactgtgtact

SEQ ID NO: 624187 - DNA, 20 bp, Artificial Sequence
  chemically synthesized
taggtagtttttcagctcac

SEQ ID NO: 624188 - DNA, 20 bp, Artificial Sequence
  chemically synthesized
agtgagcattgtacccagta

SEQ ID NO: 624189 - DNA, 20 bp, Artificial Sequence
  chemically synthesized
aagggcatattgtgtgatgt

SEQ ID NO: 624190 - DNA, 20 bp, Artificial Sequence
  chemically synthesized
tgaatcgggggtacatgttc

SEQ ID NO: 624191 - DNA, 20 bp, Artificial Sequence
  chemically synthesized
acaaactcctgaacatgtac

SEQ ID NO: 624192 - DNA, 20 bp, Artificial Sequence
  chemically synthesized
taaaattttaatgaaattac

SEQ ID NO: 624193 - DNA, 20 bp, Artificial Sequence
  chemically synthesized
tgagttcactgtaataaaaa

SEQ ID NO: 624194 - DNA, 20 bp, Artificial Sequence
  chemically synthesized
gttgtaaaatgaagactggc

SEQ ID NO: 624195 - DNA, 20 bp, Artificial Sequence
  chemically synthesized
gaattaactccttgttcact

SEQ ID NO: 624196 - DNA, 20 bp, Artificial Sequence
  chemically synthesized
gtaatataaaataatgcctt

SEQ ID NO: 624197 - DNA, 20 bp, Artificial Sequence
  chemically synthesized
agtgcagggtcattttccca

SEQ ID NO: 624198 - DNA, 20 bp, Artificial Sequence
  chemically synthesized
cagggtcattttcccaactt

SEQ ID NO: 624199 - DNA, 20 bp, Artificial Sequence
  chemically synthesized
atttaatataattccaagca

SEQ ID NO: 624200 - DNA, 20 bp, Artificial Sequence
  chemically synthesized
attccaagcattatgattaa

SEQ ID NO: 624201 - DNA, 20 bp, Artificial Sequence
  chemically synthesized
ctgtgaagctgcattaatca

SEQ ID NO: 624202 - DNA, 20 bp, Artificial Sequence
  chemically synthesized
gacaaataagttgaagagaa

SEQ ID NO: 624203 - DNA, 20 bp, Artificial Sequence
  chemically synthesized
ataagtatattacctaataa

SEQ ID NO: 624204 - DNA, 20 bp, Artificial Sequence
  chemically synthesized
ttatataaaattcacaaatt

SEQ ID NO: 624205 - DNA, 20 bp, Artificial Sequence
  chemically synthesized
aaggaagtagaaatgatcca

SEQ ID NO: 624206 - DNA, 20 bp, Artificial Sequence
  chemically synthesized
ttataaggcatatatttctt

SEQ ID NO: 624207 - DNA, 20 bp, Artificial Sequence
  chemically synthesized
tttcccattggacttaacta

SEQ ID NO: 624208 - DNA, 20 bp, Artificial Sequence
  chemically synthesized
taagtccaatgggaaaatat

SEQ ID NO: 624209 - DNA, 20 bp, Artificial Sequence
  chemically synthesized
gaaaatatgctagtttgtga

SEQ ID NO: 624210 - DNA, 20 bp, Artificial Sequence
  chemically synthesized
gtctatttggacaccctcca

SEQ ID NO: 624211 - DNA, 20 bp, Artificial Sequence
  chemically synthesized
gagggtgtccaaatagacaa

SEQ ID NO: 624212 - DNA, 20 bp, Artificial Sequence
  chemically synthesized
aatagacaaaaatgtttcac

SEQ ID NO: 624213 - DNA, 20 bp, Artificial Sequence
  chemically synthesized
gataggaattgcattcaaac

SEQ ID NO: 624214 - DNA, 20 bp, Artificial Sequence
  chemically synthesized
gaattgcattcaaactatag

SEQ ID NO: 624215 - DNA, 20 bp, Artificial Sequence
  chemically synthesized
caattcttccaaaactaatc

SEQ ID NO: 624216 - DNA, 20 bp, Artificial Sequence
  chemically synthesized
tccattaatacagtatatat

SEQ ID NO: 624217 - DNA, 20 bp, Artificial Sequence
  chemically synthesized
ttaagtctttgcattatttc

SEQ ID NO: 624218 - DNA, 20 bp, Artificial Sequence
  chemically synthesized
ttgcattatttccttagctt

SEQ ID NO: 624219 - DNA, 20 bp, Artificial Sequence
  chemically synthesized
ttgtagtatatagatctggt

SEQ ID NO: 624220 - DNA, 20 bp, Artificial Sequence
  chemically synthesized
atagatctggtaaatgtttt

SEQ ID NO: 624221 - DNA, 20 bp, Artificial Sequence
  chemically synthesized
tattagattcataagtattt

SEQ ID NO: 624222 - DNA, 20 bp, Artificial Sequence
  chemically synthesized
aagatactatgtgaaaaatt

SEQ ID NO: 624223 - DNA, 20 bp, Artificial Sequence
  chemically synthesized
aattttgggtttcagtagtt

SEQ ID NO: 624224 - DNA, 20 bp, Artificial Sequence
  chemically synthesized
ttaataatcattttactgtg

SEQ ID NO: 624225 - DNA, 20 bp, Artificial Sequence
  chemically synthesized
tattaaatcttatcacagta

SEQ ID NO: 624226 - DNA, 20 bp, Artificial Sequence
  chemically synthesized
aatatgagatctacccaacg

SEQ ID NO: 624227 - DNA, 20 bp, Artificial Sequence
  chemically synthesized
tataaatgaaacttcatatt

SEQ ID NO: 624228 - DNA, 20 bp, Artificial Sequence
  chemically synthesized
caattgctaatcaatgaata

SEQ ID NO: 624229 - DNA, 20 bp, Artificial Sequence
  chemically synthesized
caaagttactcttagaaatg

SEQ ID NO: 624230 - DNA, 20 bp, Artificial Sequence
  chemically synthesized
agagtaactttgtagaatac

SEQ ID NO: 624231 - DNA, 20 bp, Artificial Sequence
  chemically synthesized
gagacagtataacttttcct

SEQ ID NO: 624232 - DNA, 20 bp, Artificial Sequence
  chemically synthesized
taacttttccttcctgattt

SEQ ID NO: 624233 - DNA, 20 bp, Artificial Sequence
  chemically synthesized
attaggattaaggcaaagac

SEQ ID NO: 624234 - DNA, 20 bp, Artificial Sequence
  chemically synthesized
ttacacctttcttcctaata

SEQ ID NO: 624235 - DNA, 20 bp, Artificial Sequence
  chemically synthesized
ttattattacaatgttagct

SEQ ID NO: 624236 - DNA, 20 bp, Artificial Sequence
  chemically synthesized
tgaggacgttctcctccatt

SEQ ID NO: 624237 - DNA, 20 bp, Artificial Sequence
  chemically synthesized
tcctccattgttagttttct

SEQ ID NO: 624238 - DNA, 20 bp, Artificial Sequence
  chemically synthesized
atggggcactgaattttgtc

SEQ ID NO: 624239 - DNA, 20 bp, Artificial Sequence
  chemically synthesized
atcaattgatggaggggaaa

SEQ ID NO: 624240 - DNA, 20 bp, Artificial Sequence
  chemically synthesized
ctccatcaattgatatgatc

SEQ ID NO: 624241 - DNA, 20 bp, Artificial Sequence
  chemically synthesized
tgatcaagtgattattcttc

SEQ ID NO: 624242 - DNA, 20 bp, Artificial Sequence
  chemically synthesized
tataatgtgtaaaaatttgt

SEQ ID NO: 624243 - DNA, 20 bp, Artificial Sequence
  chemically synthesized
ggctttttgtctctatatcc

SEQ ID NO: 624244 - DNA, 20 bp, Artificial Sequence
  chemically synthesized
gtaatttgttgactcttcta

SEQ ID NO: 624245 - DNA, 20 bp, Artificial Sequence
  chemically synthesized
tgactcttctactgtgctta

SEQ ID NO: 624246 - DNA, 20 bp, Artificial Sequence
  chemically synthesized
aaaatgtcatacttcttcct

SEQ ID NO: 624247 - DNA, 20 bp, Artificial Sequence
  chemically synthesized
tacttcttccttcgggcttt

SEQ ID NO: 624248 - DNA, 20 bp, Artificial Sequence
  chemically synthesized
ggcaaaaaagttcaaatggc

SEQ ID NO: 624249 - DNA, 20 bp, Artificial Sequence
  chemically synthesized
taaagtgtctttttctcttt

SEQ ID NO: 624250 - DNA, 20 bp, Artificial Sequence
  chemically synthesized
ttttttaaaaaaaaaatata

SEQ ID NO: 624251 - DNA, 20 bp, Artificial Sequence
  chemically synthesized
tgactatgatgcgtctaagc

SEQ ID NO: 624252 - DNA, 20 bp, Artificial Sequence
  chemically synthesized
gcgtctaagcatgagtttct

SEQ ID NO: 624253 - DNA, 20 bp, Artificial Sequence
  chemically synthesized
caggataaacccaaagaaac

SEQ ID NO: 624254 - DNA, 20 bp, Artificial Sequence
  chemically synthesized
tactcagctccttgaatctg

SEQ ID NO: 624255 - DNA, 20 bp, Artificial Sequence
  chemically synthesized
ttttgtaaaatgcaaaaccc

SEQ ID NO: 624256 - DNA, 20 bp, Artificial Sequence
  chemically synthesized
tttggtatttttcaatcatt

SEQ ID NO: 624257 - DNA, 20 bp, Artificial Sequence
  chemically synthesized
tgaacaagtactcaagcaca

SEQ ID NO: 624258 - DNA, 20 bp, Artificial Sequence
  chemically synthesized
agatctacggtttatgccat

SEQ ID NO: 624259 - DNA, 20 bp, Artificial Sequence
  chemically synthesized
tgggattataataaaagatc

SEQ ID NO: 624260 - DNA, 20 bp, Artificial Sequence
  chemically synthesized
aaaatattctcagttgtcct

SEQ ID NO: 624261 - DNA, 20 bp, Artificial Sequence
  chemically synthesized
gagaatattttcattttaaa

SEQ ID NO: 624262 - DNA, 20 bp, Artificial Sequence
  chemically synthesized
agtcgtaacaagaaggaaaa

SEQ ID NO: 624263 - DNA, 20 bp, Artificial Sequence
  chemically synthesized
tattgtcctatctttctgca

SEQ ID NO: 624264 - DNA, 20 bp, Artificial Sequence
  chemically synthesized
agaccatttattgaactttt

SEQ ID NO: 624265 - DNA, 20 bp, Artificial Sequence
  chemically synthesized
cccattttttatttgttgca

SEQ ID NO: 624266 - DNA, 20 bp, Artificial Sequence
  chemically synthesized
atttgttgcaaaatgtttta

SEQ ID NO: 624267 - DNA, 20 bp, Artificial Sequence
  chemically synthesized
gccatcccgaaaattgttga

SEQ ID NO: 624268 - DNA, 20 bp, Artificial Sequence
  chemically synthesized
actatctttttgcattccag

SEQ ID NO: 624269 - DNA, 20 bp, Artificial Sequence
  chemically synthesized
gtcagaaggggacgagctaa

SEQ ID NO: 624270 - DNA, 20 bp, Artificial Sequence
  chemically synthesized
tccatctatggttgatactt

SEQ ID NO: 624271 - DNA, 20 bp, Artificial Sequence
  chemically synthesized
tgtgagttcatttttaaatg

SEQ ID NO: 624272 - DNA, 20 bp, Artificial Sequence
  chemically synthesized
ccactggacaaaaaaaaaaa

SEQ ID NO: 624273 - DNA, 20 bp, Artificial Sequence
  chemically synthesized
cacatcgttatgtgaatgcc

SEQ ID NO: 624274 - DNA, 20 bp, Artificial Sequence
  chemically synthesized
cccatggcattcacataacg

SEQ ID NO: 624275 - DNA, 20 bp, Artificial Sequence
  chemically synthesized
atagagtcaagaaagaaaac

SEQ ID NO: 624276 - DNA, 20 bp, Artificial Sequence
  chemically synthesized
tttgcttatatttggtaagc

SEQ ID NO: 624277 - DNA, 20 bp, Artificial Sequence
  chemically synthesized
acaggcaaattagttttgag

SEQ ID NO: 624278 - DNA, 20 bp, Artificial Sequence
  chemically synthesized
acaacacaggcaaattagtt

SEQ ID NO: 624279 - DNA, 20 bp, Artificial Sequence
  chemically synthesized
tattttcacaacacaggcaa

SEQ ID NO: 624280 - DNA, 20 bp, Artificial Sequence
  chemically synthesized
aaaataatgactcctcactt

SEQ ID NO: 624281 - DNA, 20 bp, Artificial Sequence
  chemically synthesized
taatgactcctcactttgtg

SEQ ID NO: 624282 - DNA, 20 bp, Artificial Sequence
  chemically synthesized
cactttgtggattgattccc

SEQ ID NO: 624283 - DNA, 20 bp, Artificial Sequence
  chemically synthesized
tgttttatgaggtaaatgta

SEQ ID NO: 624284 - DNA, 20 bp, Artificial Sequence
  chemically synthesized
ggtaaatgtacagggattaa

SEQ ID NO: 624285 - DNA, 20 bp, Artificial Sequence
  chemically synthesized
cagggattaatgaagatttt

SEQ ID NO: 624286 - DNA, 20 bp, Artificial Sequence
  chemically synthesized
tagtgagctgagaatcagta

SEQ ID NO: 624287 - DNA, 20 bp, Artificial Sequence
  chemically synthesized
atacaactattaaaacatgt

SEQ ID NO: 624288 - DNA, 20 bp, Artificial Sequence
  chemically synthesized
tcctggtaggaaatataggt

SEQ ID NO: 624289 - DNA, 20 bp, Artificial Sequence
  chemically synthesized
tcaccgaattattatctgtt

SEQ ID NO: 624290 - DNA, 20 bp, Artificial Sequence
  chemically synthesized
ttgttctcatcagcctgcct

SEQ ID NO: 624291 - DNA, 20 bp, Artificial Sequence
  chemically synthesized
tagaaacaaattacctctct

SEQ ID NO: 624292 - DNA, 20 bp, Artificial Sequence
  chemically synthesized
agcaagcagcaagagaggta

SEQ ID NO: 624293 - DNA, 20 bp, Artificial Sequence
  chemically synthesized
catcagagggcaagggaaaa

SEQ ID NO: 624294 - DNA, 20 bp, Artificial Sequence
  chemically synthesized
ttggtgatacaaatgaagag

SEQ ID NO: 624295 - DNA, 20 bp, Artificial Sequence
  chemically synthesized
ctgccctgttttttgccctg

SEQ ID NO: 624296 - DNA, 20 bp, Artificial Sequence
  chemically synthesized
acccattttgcaattctctg

SEQ ID NO: 624297 - DNA, 20 bp, Artificial Sequence
  chemically synthesized
gactgaaatggtaggggtga

SEQ ID NO: 624298 - DNA, 20 bp, Artificial Sequence
  chemically synthesized
gaacttccttgagttatgtt

SEQ ID NO: 624299 - DNA, 20 bp, Artificial Sequence
  chemically synthesized
gtgctttcctactattatat

SEQ ID NO: 624300 - DNA, 20 bp, Artificial Sequence
  chemically synthesized
ttatttaaaaaattcatcat

SEQ ID NO: 624301 - DNA, 20 bp, Artificial Sequence
  chemically synthesized
tcatacatgttttctgagca

SEQ ID NO: 624302 - DNA, 20 bp, Artificial Sequence
  chemically synthesized
gtgtgataaataaattgggt

SEQ ID NO: 624303 - DNA, 20 bp, Artificial Sequence
  chemically synthesized
ataaattgggtgtatgttta

SEQ ID NO: 624304 - DNA, 20 bp, Artificial Sequence
  chemically synthesized
ggaagacacaactgttttga

SEQ ID NO: 624305 - DNA, 20 bp, Artificial Sequence
  chemically synthesized
gcaactaaaaaggaagacac

SEQ ID NO: 624306 - DNA, 20 bp, Artificial Sequence
  chemically synthesized
acagttgtgtcttccttttt

SEQ ID NO: 624307 - DNA, 20 bp, Artificial Sequence
  chemically synthesized
ctttttagttgctttatcac

SEQ ID NO: 624308 - DNA, 20 bp, Artificial Sequence
  chemically synthesized
ttatatgctccctcattctt

SEQ ID NO: 624309 - DNA, 20 bp, Artificial Sequence
  chemically synthesized
tgctccctcattcttctggg

SEQ ID NO: 624310 - DNA, 20 bp, Artificial Sequence
  chemically synthesized
ctttgtttaaatttacttta

SEQ ID NO: 624311 - DNA, 20 bp, Artificial Sequence
  chemically synthesized
actttatgaagattattttt

SEQ ID NO: 624312 - DNA, 20 bp, Artificial Sequence
  chemically synthesized
gcaattaattcttaatatca

SEQ ID NO: 624313 - DNA, 20 bp, Artificial Sequence
  chemically synthesized
ctaaactcctattacaccca

SEQ ID NO: 624314 - DNA, 20 bp, Artificial Sequence
  chemically synthesized
aaaagcacattgggtgtaat

SEQ ID NO: 624315 - DNA, 20 bp, Artificial Sequence
  chemically synthesized
tttctttatttccctctctt

SEQ ID NO: 624316 - DNA, 20 bp, Artificial Sequence
  chemically synthesized
taaaatttaaaataaacttt

SEQ ID NO: 624317 - DNA, 20 bp, Artificial Sequence
  chemically synthesized
gtttgctactctcaaacatt

SEQ ID NO: 624318 - DNA, 20 bp, Artificial Sequence
  chemically synthesized
agcatacactctcaaagaga

SEQ ID NO: 624319 - DNA, 20 bp, Artificial Sequence
  chemically synthesized
tcttttagcatacactctca

SEQ ID NO: 624320 - DNA, 20 bp, Artificial Sequence
  chemically synthesized
tttattccacggcccagttc

SEQ ID NO: 624321 - DNA, 20 bp, Artificial Sequence
  chemically synthesized
tttatgaaacatttattagg

SEQ ID NO: 624322 - DNA, 20 bp, Artificial Sequence
  chemically synthesized
gcagaaaatctggccctaat

SEQ ID NO: 624323 - DNA, 20 bp, Artificial Sequence
  chemically synthesized
acttcaggtccctgccctca

SEQ ID NO: 624324 - DNA, 20 bp, Artificial Sequence
  chemically synthesized
ttgaagtttatcaattagca

SEQ ID NO: 624325 - DNA, 20 bp, Artificial Sequence
  chemically synthesized
ctgctaattgataaacttca

SEQ ID NO: 624326 - DNA, 20 bp, Artificial Sequence
  chemically synthesized
acgaaagtcttcaagcttat

SEQ ID NO: 624327 - DNA, 20 bp, Artificial Sequence
  chemically synthesized
cctctctgagacgaaagtct

SEQ ID NO: 624328 - DNA, 20 bp, Artificial Sequence
  chemically synthesized
agaggtacctaatagcaaga

SEQ ID NO: 624329 - DNA, 20 bp, Artificial Sequence
  chemically synthesized
catttaggttaaattaagca

SEQ ID NO: 624330 - DNA, 20 bp, Artificial Sequence
  chemically synthesized
gggagcagctttttaaaacg

SEQ ID NO: 624331 - DNA, 20 bp, Artificial Sequence
  chemically synthesized
gtctagtgtatgcgtttggg

SEQ ID NO: 624332 - DNA, 20 bp, Artificial Sequence
  chemically synthesized
cttttcatcttgtctagtgt

SEQ ID NO: 624333 - DNA, 20 bp, Artificial Sequence
  chemically synthesized
ttttcttcttgagatgagaa

SEQ ID NO: 624334 - DNA, 20 bp, Artificial Sequence
  chemically synthesized
gtttttctgtttttattttg

SEQ ID NO: 624335 - DNA, 20 bp, Artificial Sequence
  chemically synthesized
ttactgtttttctgttttta

SEQ ID NO: 624336 - DNA, 20 bp, Artificial Sequence
  chemically synthesized
atgaatcttctttactgttt

SEQ ID NO: 624337 - DNA, 20 bp, Artificial Sequence
  chemically synthesized
taaaaacagaaaaacagtaa

SEQ ID NO: 624338 - DNA, 20 bp, Artificial Sequence
  chemically synthesized
ctttgttaatgaatcttctt

SEQ ID NO: 624339 - DNA, 20 bp, Artificial Sequence
  chemically synthesized
agcacattgtcaattttatt

SEQ ID NO: 624340 - DNA, 20 bp, Artificial Sequence
  chemically synthesized
caaagaaaaaaaaagacagt

SEQ ID NO: 624341 - DNA, 20 bp, Artificial Sequence
  chemically synthesized
gtatttaataatttagatga

SEQ ID NO: 624342 - DNA, 20 bp, Artificial Sequence
  chemically synthesized
ttaataatttagatgaaata

SEQ ID NO: 624343 - DNA, 20 bp, Artificial Sequence
  chemically synthesized
ttttatattcattgatttac

SEQ ID NO: 624344 - DNA, 20 bp, Artificial Sequence
  chemically synthesized
caaattatccattttatatt

SEQ ID NO: 624345 - DNA, 20 bp, Artificial Sequence
  chemically synthesized
ttatagaagtttgcttttgt

SEQ ID NO: 624346 - DNA, 20 bp, Artificial Sequence
  chemically synthesized
tttccaatgcagttatagaa

SEQ ID NO: 624347 - DNA, 20 bp, Artificial Sequence
  chemically synthesized
tacttttccaatgcagttat

SEQ ID NO: 624348 - DNA, 20 bp, Artificial Sequence
  chemically synthesized
agaattggtgttaattcttc

SEQ ID NO: 624349 - DNA, 20 bp, Artificial Sequence
  chemically synthesized
gactcaacacatatactcag

SEQ ID NO: 624350 - DNA, 20 bp, Artificial Sequence
  chemically synthesized
ttcttcttttgtactgtttt

SEQ ID NO: 624351 - DNA, 20 bp, Artificial Sequence
  chemically synthesized
tttatagttttcttcttttg

SEQ ID NO: 624352 - DNA, 20 bp, Artificial Sequence
  chemically synthesized
atttgtaaggaatatggatt

SEQ ID NO: 624353 - DNA, 20 bp, Artificial Sequence
  chemically synthesized
ccattaatatttgtaaggaa

SEQ ID NO: 624354 - DNA, 20 bp, Artificial Sequence
  chemically synthesized
caatgtactaatggatcact

SEQ ID NO: 624355 - DNA, 20 bp, Artificial Sequence
  chemically synthesized
gtttatttccaggatgtaaa

SEQ ID NO: 624356 - DNA, 20 bp, Artificial Sequence
  chemically synthesized
gactaattttcaaatatcaa

SEQ ID NO: 624357 - DNA, 20 bp, Artificial Sequence
  chemically synthesized
cctctatgacctgttaatat

SEQ ID NO: 624358 - DNA, 20 bp, Artificial Sequence
  chemically synthesized
gtacatttactgataacatc

SEQ ID NO: 624359 - DNA, 20 bp, Artificial Sequence
  chemically synthesized
attagatatatcagtttgtc

SEQ ID NO: 624360 - DNA, 20 bp, Artificial Sequence
  chemically synthesized
gttgtttcaagattagatat

SEQ ID NO: 624361 - DNA, 20 bp, Artificial Sequence
  chemically synthesized
tatttttcagacaggttgtt

SEQ ID NO: 624362 - DNA, 20 bp, Artificial Sequence
  chemically synthesized
ttagtcctatttttcagaca

SEQ ID NO: 624363 - DNA, 20 bp, Artificial Sequence
  chemically synthesized
tagctgtaggtttatgtaga

SEQ ID NO: 624364 - DNA, 20 bp, Artificial Sequence
  chemically synthesized
tattaagtatgaagttagct

SEQ ID NO: 624365 - DNA, 20 bp, Artificial Sequence
  chemically synthesized
atacttaatagtgaagtatt

SEQ ID NO: 624366 - DNA, 20 bp, Artificial Sequence
  chemically synthesized
cttcctttcccatctgtatg

SEQ ID NO: 624367 - DNA, 20 bp, Artificial Sequence
  chemically synthesized
atgtcttcctttcccatctg

SEQ ID NO: 624368 - DNA, 20 bp, Artificial Sequence
  chemically synthesized
tttctaggagattatttata

SEQ ID NO: 624369 - DNA, 20 bp, Artificial Sequence
  chemically synthesized
ttcacttatcaataatttct

SEQ ID NO: 624370 - DNA, 20 bp, Artificial Sequence
  chemically synthesized
atgcaagataaatatacaaa

SEQ ID NO: 624371 - DNA, 20 bp, Artificial Sequence
  chemically synthesized
atagatatggtatgtatttt

SEQ ID NO: 624372 - DNA, 20 bp, Artificial Sequence
  chemically synthesized
gatttctttcatcagagggt

SEQ ID NO: 624373 - DNA, 20 bp, Artificial Sequence
  chemically synthesized
ccatgaatatggattatctt

SEQ ID NO: 624374 - DNA, 20 bp, Artificial Sequence
  chemically synthesized
tgagccttcccatccatgaa

SEQ ID NO: 624375 - DNA, 20 bp, Artificial Sequence
  chemically synthesized
agtaactactgagattttga

SEQ ID NO: 624376 - DNA, 20 bp, Artificial Sequence
  chemically synthesized
ctgcaaagtaactactgaga

SEQ ID NO: 624377 - DNA, 20 bp, Artificial Sequence
  chemically synthesized
taatatctgcaaagtaacta

SEQ ID NO: 624378 - DNA, 20 bp, Artificial Sequence
  chemically synthesized
ttactttgcagatattaaca

SEQ ID NO: 624379 - DNA, 20 bp, Artificial Sequence
  chemically synthesized
tcaatgttgttttggctatt

SEQ ID NO: 624380 - DNA, 20 bp, Artificial Sequence
  chemically synthesized
caccacgcccagcccttcaa

SEQ ID NO: 624381 - DNA, 20 bp, Artificial Sequence
  chemically synthesized
caccttggcctcccaaagtg

SEQ ID NO: 624382 - DNA, 20 bp, Artificial Sequence
  chemically synthesized
tttgttgtttttagtacaga

SEQ ID NO: 624383 - DNA, 20 bp, Artificial Sequence
  chemically synthesized
caccactcccagctaatttt

SEQ ID NO: 624384 - DNA, 20 bp, Artificial Sequence
  chemically synthesized
catttcagcctctcaagtag

SEQ ID NO: 624385 - DNA, 20 bp, Artificial Sequence
  chemically synthesized
ttgagaggctgaaatgaaag

SEQ ID NO: 624386 - DNA, 20 bp, Artificial Sequence
  chemically synthesized
aatctccgcctcctgggttc

SEQ ID NO: 624387 - DNA, 20 bp, Artificial Sequence
  chemically synthesized
aatcgcttgaacccaggagg

SEQ ID NO: 624388 - DNA, 20 bp, Artificial Sequence
  chemically synthesized
ttgtttttgtttgtttgttt

SEQ ID NO: 624389 - DNA, 20 bp, Artificial Sequence
  chemically synthesized
aatattgtttttgtttgttt

SEQ ID NO: 624390 - DNA, 20 bp, Artificial Sequence
  chemically synthesized
cttcaatattgtttttgttt

SEQ ID NO: 624391 - DNA, 20 bp, Artificial Sequence
  chemically synthesized
tgtccttcaatattgttttt

SEQ ID NO: 624392 - DNA, 20 bp, Artificial Sequence
  chemically synthesized
tgcttgtccttcaatattgt

SEQ ID NO: 624393 - DNA, 20 bp, Artificial Sequence
  chemically synthesized
actttgtgcttgtccttcaa

SEQ ID NO: 624394 - DNA, 20 bp, Artificial Sequence
  chemically synthesized
tgaaggacaagcacaaagtc

SEQ ID NO: 624395 - DNA, 20 bp, Artificial Sequence
  chemically synthesized
gcagtctcaatcttctgact

SEQ ID NO: 624396 - DNA, 20 bp, Artificial Sequence
  chemically synthesized
cttttgccaataagacactg

SEQ ID NO: 624397 - DNA, 20 bp, Artificial Sequence
  chemically synthesized
agtcagttgactatatttat

SEQ ID NO: 624398 - DNA, 20 bp, Artificial Sequence
  chemically synthesized
cataaatatagtcaactgac

SEQ ID NO: 624399 - DNA, 20 bp, Artificial Sequence
  chemically synthesized
tttgagttaatgtttgtgaa

SEQ ID NO: 624400 - DNA, 20 bp, Artificial Sequence
  chemically synthesized
gtttctgatccattttgagt

SEQ ID NO: 624401 - DNA, 20 bp, Artificial Sequence
  chemically synthesized
tatagttttgcattttacat

SEQ ID NO: 624402 - DNA, 20 bp, Artificial Sequence
  chemically synthesized
atgttatcttctgtgggctt

SEQ ID NO: 624403 - DNA, 20 bp, Artificial Sequence
  chemically synthesized
tttctcctatgttatcttct

SEQ ID NO: 624404 - DNA, 20 bp, Artificial Sequence
  chemically synthesized
aaaagtcatcaccagaccca

SEQ ID NO: 624405 - DNA, 20 bp, Artificial Sequence
  chemically synthesized
atttttcaatattaatgaag

SEQ ID NO: 624406 - DNA, 20 bp, Artificial Sequence
  chemically synthesized
gcaaatattctctcctattc

SEQ ID NO: 624407 - DNA, 20 bp, Artificial Sequence
  chemically synthesized
agagttgtttgttttcttat

SEQ ID NO: 624408 - DNA, 20 bp, Artificial Sequence
  chemically synthesized
cccatttttaaaatagagtt

SEQ ID NO: 624409 - DNA, 20 bp, Artificial Sequence
  chemically synthesized
tttgcccatttttaaaatag

SEQ ID NO: 624410 - DNA, 20 bp, Artificial Sequence
  chemically synthesized
ctttggtgagttatctgtta

SEQ ID NO: 624411 - DNA, 20 bp, Artificial Sequence
  chemically synthesized
tgtgaagcgtcttttcatac

SEQ ID NO: 624412 - DNA, 20 bp, Artificial Sequence
  chemically synthesized
tggaaaacaggcgtatgaaa

SEQ ID NO: 624413 - DNA, 20 bp, Artificial Sequence
  chemically synthesized
ggtatgtagtagcatcacat

SEQ ID NO: 624414 - DNA, 20 bp, Artificial Sequence
  chemically synthesized
gagtaataggaactcttgtt

SEQ ID NO: 624415 - DNA, 20 bp, Artificial Sequence
  chemically synthesized
aactgattttcagtggttgt

SEQ ID NO: 624416 - DNA, 20 bp, Artificial Sequence
  chemically synthesized
aacttgtacaaccactgaaa

SEQ ID NO: 624417 - DNA, 20 bp, Artificial Sequence
  chemically synthesized
acaaccactgaaaatcagtt

SEQ ID NO: 624418 - DNA, 20 bp, Artificial Sequence
  chemically synthesized
agttttgtaaaaaatcctta

SEQ ID NO: 624419 - DNA, 20 bp, Artificial Sequence
  chemically synthesized
gatcatatagcaagagtatg

SEQ ID NO: 624420 - DNA, 20 bp, Artificial Sequence
  chemically synthesized
tacttgatcatatagcaaga

SEQ ID NO: 624421 - DNA, 20 bp, Artificial Sequence
  chemically synthesized
tttttgtgcggacataagtt

SEQ ID NO: 624422 - DNA, 20 bp, Artificial Sequence
  chemically synthesized
ctgcaggtttttgtgcggac

SEQ ID NO: 624423 - DNA, 20 bp, Artificial Sequence
  chemically synthesized
ccgcacaaaaacctgcagat

SEQ ID NO: 624424 - DNA, 20 bp, Artificial Sequence
  chemically synthesized
gctgctataaacatccatct

SEQ ID NO: 624425 - DNA, 20 bp, Artificial Sequence
  chemically synthesized
acctgcagatggatgtttat

SEQ ID NO: 624426 - DNA, 20 bp, Artificial Sequence
  chemically synthesized
tcacctactgaagaacatct

SEQ ID NO: 624427 - DNA, 20 bp, Artificial Sequence
  chemically synthesized
agcatctatagtctgaatgt

SEQ ID NO: 624428 - DNA, 20 bp, Artificial Sequence
  chemically synthesized
tacactaaggaaacttaaat

SEQ ID NO: 624429 - DNA, 20 bp, Artificial Sequence
  chemically synthesized
cttcagttagaaacaggcat

SEQ ID NO: 624430 - DNA, 20 bp, Artificial Sequence
  chemically synthesized
actgaaggaagccaatctga

SEQ ID NO: 624431 - DNA, 20 bp, Artificial Sequence
  chemically synthesized
gtatatagaagcattttcag

SEQ ID NO: 624432 - DNA, 20 bp, Artificial Sequence
  chemically synthesized
ctacagtatatagaagcatt

SEQ ID NO: 624433 - DNA, 20 bp, Artificial Sequence
  chemically synthesized
tgaaaatgcttctatatact

SEQ ID NO: 624434 - DNA, 20 bp, Artificial Sequence
  chemically synthesized
actatgataatatcatacag

SEQ ID NO: 624435 - DNA, 20 bp, Artificial Sequence
  chemically synthesized
ctcttgttgttgtgttttct

SEQ ID NO: 624436 - DNA, 20 bp, Artificial Sequence
  chemically synthesized
attagagtttactcttgttg

SEQ ID NO: 624437 - DNA, 20 bp, Artificial Sequence
  chemically synthesized
ctcagatccataggttccat

SEQ ID NO: 624438 - DNA, 20 bp, Artificial Sequence
  chemically synthesized
ttcacagcaaaattgaaaga

SEQ ID NO: 624439 - DNA, 20 bp, Artificial Sequence
  chemically synthesized
attattaattcacagaatgc

SEQ ID NO: 624440 - DNA, 20 bp, Artificial Sequence
  chemically synthesized
accatgtaagtacatggctt

SEQ ID NO: 624441 - DNA, 20 bp, Artificial Sequence
  chemically synthesized
ttgctttcaccatgtaagta

SEQ ID NO: 624442 - DNA, 20 bp, Artificial Sequence
  chemically synthesized
cttacatggtgaaagcaaaa

SEQ ID NO: 624443 - DNA, 20 bp, Artificial Sequence
  chemically synthesized
gatttacttctaaaactttt

SEQ ID NO: 624444 - DNA, 20 bp, Artificial Sequence
  chemically synthesized
tcttcattaatttagatgtt

SEQ ID NO: 624445 - DNA, 20 bp, Artificial Sequence
  chemically synthesized
atgaagaaatatattgtgct

SEQ ID NO: 624446 - DNA, 20 bp, Artificial Sequence
  chemically synthesized
atatattgtgctcgtggatt

SEQ ID NO: 624447 - DNA, 20 bp, Artificial Sequence
  chemically synthesized
caattttacccaaactgtta

SEQ ID NO: 624448 - DNA, 20 bp, Artificial Sequence
  chemically synthesized
aaaaattgtgtaaactgtgt

SEQ ID NO: 624449 - DNA, 20 bp, Artificial Sequence
  chemically synthesized
cctaaattccaaaaatattg

SEQ ID NO: 624450 - DNA, 20 bp, Artificial Sequence
  chemically synthesized
taaaatttatgtgaaaaggc

SEQ ID NO: 624451 - DNA, 20 bp, Artificial Sequence
  chemically synthesized
acttcattcttccttttcaa

SEQ ID NO: 624452 - DNA, 20 bp, Artificial Sequence
  chemically synthesized
ccaacaccaacaccacacta

SEQ ID NO: 624453 - DNA, 20 bp, Artificial Sequence
  chemically synthesized
tgttggtgttgggatagaca

SEQ ID NO: 624454 - DNA, 20 bp, Artificial Sequence
  chemically synthesized
tagacccacacaaattgctc

SEQ ID NO: 624455 - DNA, 20 bp, Artificial Sequence
  chemically synthesized
tttgtaaaatatttattatt

SEQ ID NO: 624456 - DNA, 20 bp, Artificial Sequence
  chemically synthesized
ttcatcctgaagactctcct

SEQ ID NO: 624457 - DNA, 20 bp, Artificial Sequence
  chemically synthesized
atgaaaggctaggaggagtt

SEQ ID NO: 624458 - DNA, 20 bp, Artificial Sequence
  chemically synthesized
caaattgtgtcttttaaggc

SEQ ID NO: 624459 - DNA, 20 bp, Artificial Sequence
  chemically synthesized
tactagtgcatggtcagata

SEQ ID NO: 624460 - DNA, 20 bp, Artificial Sequence
  chemically synthesized
aatggatttttttgtgtcta

SEQ ID NO: 624461 - DNA, 20 bp, Artificial Sequence
  chemically synthesized
tgtcttttgcccatttttct

SEQ ID NO: 624462 - DNA, 20 bp, Artificial Sequence
  chemically synthesized
agacaacacatagatggcgg

SEQ ID NO: 624463 - DNA, 20 bp, Artificial Sequence
  chemically synthesized
atgatgctgaacatcttttc

SEQ ID NO: 624464 - DNA, 20 bp, Artificial Sequence
  chemically synthesized
tgcacagagttatatcgtat

SEQ ID NO: 624465 - DNA, 20 bp, Artificial Sequence
  chemically synthesized
tcatttctctgcattcttgc

SEQ ID NO: 624466 - DNA, 20 bp, Artificial Sequence
  chemically synthesized
tacagagtacctttaccatc

SEQ ID NO: 624467 - DNA, 20 bp, Artificial Sequence
  chemically synthesized
agatggtaaaggtactctgt

SEQ ID NO: 624468 - DNA, 20 bp, Artificial Sequence
  chemically synthesized
ggctgtaggttagttgtatg

SEQ ID NO: 624469 - DNA, 20 bp, Artificial Sequence
  chemically synthesized
ttctgggctgtaggttagtt

SEQ ID NO: 624470 - DNA, 20 bp, Artificial Sequence
  chemically synthesized
atgagcaaattttcatttat

SEQ ID NO: 624471 - DNA, 20 bp, Artificial Sequence
  chemically synthesized
agctgctatgaagactcatg

SEQ ID NO: 624472 - DNA, 20 bp, Artificial Sequence
  chemically synthesized
tgaaggacatctgggttgtt

SEQ ID NO: 624473 - DNA, 20 bp, Artificial Sequence
  chemically synthesized
tgcctgttgaaggacatctg

SEQ ID NO: 624474 - DNA, 20 bp, Artificial Sequence
  chemically synthesized
tccatggtatgaatatgcca

SEQ ID NO: 624475 - DNA, 20 bp, Artificial Sequence
  chemically synthesized
gtattccatggtatgaatat

SEQ ID NO: 624476 - DNA, 20 bp, Artificial Sequence
  chemically synthesized
cataattctctggagattct

SEQ ID NO: 624477 - DNA, 20 bp, Artificial Sequence
  chemically synthesized
gttcactcagcataattctc

SEQ ID NO: 624478 - DNA, 20 bp, Artificial Sequence
  chemically synthesized
tcctaaatagctacataata

SEQ ID NO: 624479 - DNA, 20 bp, Artificial Sequence
  chemically synthesized
gagatcatattagtagttgc

SEQ ID NO: 624480 - DNA, 20 bp, Artificial Sequence
  chemically synthesized
tttttttaaaagacagtggg

SEQ ID NO: 624481 - DNA, 20 bp, Artificial Sequence
  chemically synthesized
gctgggtttagcctatgagc

SEQ ID NO: 624482 - DNA, 20 bp, Artificial Sequence
  chemically synthesized
atctccatcaggcttcacaa

SEQ ID NO: 624483 - DNA, 20 bp, Artificial Sequence
  chemically synthesized
aactacattgtgaagcctga

SEQ ID NO: 624484 - DNA, 20 bp, Artificial Sequence
  chemically synthesized
ttgatgccacctaatctcca

SEQ ID NO: 624485 - DNA, 20 bp, Artificial Sequence
  chemically synthesized
gagattaggtggcatcaatg

SEQ ID NO: 624486 - DNA, 20 bp, Artificial Sequence
  chemically synthesized
gtcatgtttaacactgttgc

SEQ ID NO: 624487 - DNA, 20 bp, Artificial Sequence
  chemically synthesized
tttgttaaaaggatactgca

SEQ ID NO: 624488 - DNA, 20 bp, Artificial Sequence
  chemically synthesized
atgcaaatcagaattctggg

SEQ ID NO: 624489 - DNA, 20 bp, Artificial Sequence
  chemically synthesized
tatttaaacgatacccagaa

SEQ ID NO: 624490 - DNA, 20 bp, Artificial Sequence
  chemically synthesized
ataacacaatggcactgaga

SEQ ID NO: 624491 - DNA, 20 bp, Artificial Sequence
  chemically synthesized
gtgttattgttaatactcaa

SEQ ID NO: 624492 - DNA, 20 bp, Artificial Sequence
  chemically synthesized
ttaatactcaaaactgtttc

SEQ ID NO: 624493 - DNA, 20 bp, Artificial Sequence
  chemically synthesized
ttcaataaataaacttatga

SEQ ID NO: 624494 - DNA, 20 bp, Artificial Sequence
  chemically synthesized
ttgtgtagtaataacttggt

SEQ ID NO: 624495 - DNA, 20 bp, Artificial Sequence
  chemically synthesized
atgtcatccacatagattta

SEQ ID NO: 624496 - DNA, 20 bp, Artificial Sequence
  chemically synthesized
gcactctaaaatgtcatcca

SEQ ID NO: 624497 - DNA, 20 bp, Artificial Sequence
  chemically synthesized
aaggattttaatttgagcct

SEQ ID NO: 624498 - DNA, 20 bp, Artificial Sequence
  chemically synthesized
ttttaaagaaagaaattagg

SEQ ID NO: 624499 - DNA, 20 bp, Artificial Sequence
  chemically synthesized
acagggaggggatttttttc

SEQ ID NO: 624500 - DNA, 20 bp, Artificial Sequence
  chemically synthesized
aaaaaataattctaacaggg

SEQ ID NO: 624501 - DNA, 20 bp, Artificial Sequence
  chemically synthesized
gccttgccatggaaaaaaat

SEQ ID NO: 624502 - DNA, 20 bp, Artificial Sequence
  chemically synthesized
catttttttccatggcaagg

SEQ ID NO: 624503 - DNA, 20 bp, Artificial Sequence
  chemically synthesized
aggctaagttttcatcctga

SEQ ID NO: 624504 - DNA, 20 bp, Artificial Sequence
  chemically synthesized
catcctgataaggtttttct

SEQ ID NO: 624505 - DNA, 20 bp, Artificial Sequence
  chemically synthesized
tgttcttatcaattcttacc

SEQ ID NO: 624506 - DNA, 20 bp, Artificial Sequence
  chemically synthesized
attgataagaacagaagatc

SEQ ID NO: 624507 - DNA, 20 bp, Artificial Sequence
  chemically synthesized
atgcacaactaagaatagcc

SEQ ID NO: 624508 - DNA, 20 bp, Artificial Sequence
  chemically synthesized
gttgtgcatatttttcgagc

SEQ ID NO: 624509 - DNA, 20 bp, Artificial Sequence
  chemically synthesized
tctatgaaataaaggggccc

SEQ ID NO: 624510 - DNA, 20 bp, Artificial Sequence
  chemically synthesized
aaataaaggggcccaaaagc

SEQ ID NO: 624511 - DNA, 20 bp, Artificial Sequence
  chemically synthesized
ggcccaaaagcttaagcttc

SEQ ID NO: 624512 - DNA, 20 bp, Artificial Sequence
  chemically synthesized
tgtcaggaagcaaatgaagc

SEQ ID NO: 624513 - DNA, 20 bp, Artificial Sequence
  chemically synthesized
ttgagttgtcaggaagcaaa

SEQ ID NO: 624514 - DNA, 20 bp, Artificial Sequence
  chemically synthesized
tcaaagcttctctcctttcc

SEQ ID NO: 624515 - DNA, 20 bp, Artificial Sequence
  chemically synthesized
tcaaatcatctggaaaggag

SEQ ID NO: 624516 - DNA, 20 bp, Artificial Sequence
  chemically synthesized
tggaaaggagagaagctttg

SEQ ID NO: 624517 - DNA, 20 bp, Artificial Sequence
  chemically synthesized
atctgctacataaatcctct

SEQ ID NO: 624518 - DNA, 20 bp, Artificial Sequence
  chemically synthesized
ctattagagaaaatagcatg

SEQ ID NO: 624519 - DNA, 20 bp, Artificial Sequence
  chemically synthesized
ctgcacatgctattttctct

SEQ ID NO: 624520 - DNA, 20 bp, Artificial Sequence
  chemically synthesized
gagagagtctttgagtggca

SEQ ID NO: 624521 - DNA, 20 bp, Artificial Sequence
  chemically synthesized
aaattataaatggtgtttat

SEQ ID NO: 624522 - DNA, 20 bp, Artificial Sequence
  chemically synthesized
attttgaaccaaattataaa

SEQ ID NO: 624523 - DNA, 20 bp, Artificial Sequence
  chemically synthesized
ccattaacaggctctgactc

SEQ ID NO: 624524 - DNA, 20 bp, Artificial Sequence
  chemically synthesized
taatggaaatcagagaaaat

SEQ ID NO: 624525 - DNA, 20 bp, Artificial Sequence
  chemically synthesized
aaattcgaatcaaatatttt

SEQ ID NO: 624526 - DNA, 20 bp, Artificial Sequence
  chemically synthesized
atatttgattcgaatttaaa

SEQ ID NO: 624527 - DNA, 20 bp, Artificial Sequence
  chemically synthesized
aatttaaatgaggtttcaca

SEQ ID NO: 624528 - DNA, 20 bp, Artificial Sequence
  chemically synthesized
tgaatttagaggaggataaa

SEQ ID NO: 624529 - DNA, 20 bp, Artificial Sequence
  chemically synthesized
gaggataaaaaaagttttat

SEQ ID NO: 624530 - DNA, 20 bp, Artificial Sequence
  chemically synthesized
gtttatgtctcaaaattctg

SEQ ID NO: 624531 - DNA, 20 bp, Artificial Sequence
  chemically synthesized
aaattctgttcagttttata

SEQ ID NO: 624532 - DNA, 20 bp, Artificial Sequence
  chemically synthesized
tttcaaataaccagacttca

SEQ ID NO: 624533 - DNA, 20 bp, Artificial Sequence
  chemically synthesized
tgaagtctggttatttgaaa

SEQ ID NO: 624534 - DNA, 20 bp, Artificial Sequence
  chemically synthesized
gcttttaatctatagtatat

SEQ ID NO: 624535 - DNA, 20 bp, Artificial Sequence
  chemically synthesized
agcactaatctttaatatac

SEQ ID NO: 624536 - DNA, 20 bp, Artificial Sequence
  chemically synthesized
atctatagtatattaaagat

SEQ ID NO: 624537 - DNA, 20 bp, Artificial Sequence
  chemically synthesized
attagtgcttaaagtatatt

SEQ ID NO: 624538 - DNA, 20 bp, Artificial Sequence
  chemically synthesized
taaatgctttaggttgttta

SEQ ID NO: 624539 - DNA, 20 bp, Artificial Sequence
  chemically synthesized
aaggaaatataaatgcttta

SEQ ID NO: 624540 - DNA, 20 bp, Artificial Sequence
  chemically synthesized
aaaaatgtttaaggaaatat

SEQ ID NO: 624541 - DNA, 20 bp, Artificial Sequence
  chemically synthesized
taagattttcaatattttaa

SEQ ID NO: 624542 - DNA, 20 bp, Artificial Sequence
  chemically synthesized
gttaactctaaagattcacc

SEQ ID NO: 624543 - DNA, 20 bp, Artificial Sequence
  chemically synthesized
attccaaataaagttaactc

SEQ ID NO: 624544 - DNA, 20 bp, Artificial Sequence
  chemically synthesized
gaagtatgatgttattgaac

SEQ ID NO: 624545 - DNA, 20 bp, Artificial Sequence
  chemically synthesized
agtttaatatgttattgaac

SEQ ID NO: 624546 - DNA, 20 bp, Artificial Sequence
  chemically synthesized
gtgtgtgtgtgtgtgtaggc

SEQ ID NO: 624547 - DNA, 20 bp, Artificial Sequence
  chemically synthesized
ttagcaaatgaggtacattt

SEQ ID NO: 624548 - DNA, 20 bp, Artificial Sequence
  chemically synthesized
tcaggaacttggagaagaga

SEQ ID NO: 624549 - DNA, 20 bp, Artificial Sequence
  chemically synthesized
gagaagagagtaagattaga

SEQ ID NO: 624550 - DNA, 20 bp, Artificial Sequence
  chemically synthesized
tcccctttttattttaaata

SEQ ID NO: 624551 - DNA, 20 bp, Artificial Sequence
  chemically synthesized
agatttccccgttttcatac

SEQ ID NO: 624552 - DNA, 20 bp, Artificial Sequence
  chemically synthesized
ccaattgtactctcagattt

SEQ ID NO: 624553 - DNA, 20 bp, Artificial Sequence
  chemically synthesized
ttctaggagccaattgtact

SEQ ID NO: 624554 - DNA, 20 bp, Artificial Sequence
  chemically synthesized
tatttaactgctgctcttat

SEQ ID NO: 624555 - DNA, 20 bp, Artificial Sequence
  chemically synthesized
cccatttaaaaaaatttttc

SEQ ID NO: 624556 - DNA, 20 bp, Artificial Sequence
  chemically synthesized
gctggagtggtaaacataca

SEQ ID NO: 624557 - DNA, 20 bp, Artificial Sequence
  chemically synthesized
gagtggtaaacatacacagt

SEQ ID NO: 624558 - DNA, 20 bp, Artificial Sequence
  chemically synthesized
taaaaataaacaaacactgt

SEQ ID NO: 624559 - DNA, 20 bp, Artificial Sequence
  chemically synthesized
atcagtctggaaaatagttt

SEQ ID NO: 624560 - DNA, 20 bp, Artificial Sequence
  chemically synthesized
aaaagaatatcagtctggaa

SEQ ID NO: 624561 - DNA, 20 bp, Artificial Sequence
  chemically synthesized
ttcagacactctgaaaaatg

SEQ ID NO: 624562 - DNA, 20 bp, Artificial Sequence
  chemically synthesized
aatgtgtagttttatctcac

SEQ ID NO: 624563 - DNA, 20 bp, Artificial Sequence
  chemically synthesized
tcactgtggtttcaatttat

SEQ ID NO: 624564 - DNA, 20 bp, Artificial Sequence
  chemically synthesized
tgatatttaatatcttttcc

SEQ ID NO: 624565 - DNA, 20 bp, Artificial Sequence
  chemically synthesized
catttcctaattaatttatt

SEQ ID NO: 624566 - DNA, 20 bp, Artificial Sequence
  chemically synthesized
taattaatttatttttggat

SEQ ID NO: 624567 - DNA, 20 bp, Artificial Sequence
  chemically synthesized
ttatttttggatttttgctt

SEQ ID NO: 624568 - DNA, 20 bp, Artificial Sequence
  chemically synthesized
ctaagttcttcgtatatagt

SEQ ID NO: 624569 - DNA, 20 bp, Artificial Sequence
  chemically synthesized
aagaggatccttttcagatc

SEQ ID NO: 624570 - DNA, 20 bp, Artificial Sequence
  chemically synthesized
attttaacgaagtccaattt

SEQ ID NO: 624571 - DNA, 20 bp, Artificial Sequence
  chemically synthesized
atttatcagtttttcttttt

SEQ ID NO: 624572 - DNA, 20 bp, Artificial Sequence
  chemically synthesized
cagtcacaaaattttctccc

SEQ ID NO: 624573 - DNA, 20 bp, Artificial Sequence
  chemically synthesized
atatgtttttctaaaatatt

SEQ ID NO: 624574 - DNA, 20 bp, Artificial Sequence
  chemically synthesized
tttctaaaatatttgtagtt

SEQ ID NO: 624575 - DNA, 20 bp, Artificial Sequence
  chemically synthesized
atttacttatatatttatgg

SEQ ID NO: 624576 - DNA, 20 bp, Artificial Sequence
  chemically synthesized
cttatatatttatgggtggg

SEQ ID NO: 624577 - DNA, 20 bp, Artificial Sequence
  chemically synthesized
tatatttatgggtgggcttt

SEQ ID NO: 624578 - DNA, 20 bp, Artificial Sequence
  chemically synthesized
gtgcgttttttctaagtgag

SEQ ID NO: 624579 - DNA, 20 bp, Artificial Sequence
  chemically synthesized
tagccttttcaacaaatagt

SEQ ID NO: 624580 - DNA, 20 bp, Artificial Sequence
  chemically synthesized
ctgttaaaattcctccttgg

SEQ ID NO: 624581 - DNA, 20 bp, Artificial Sequence
  chemically synthesized
ctttcacaactttttaaaaa

SEQ ID NO: 624582 - DNA, 20 bp, Artificial Sequence
  chemically synthesized
catagttcaatgcaatagaa

SEQ ID NO: 624583 - DNA, 20 bp, Artificial Sequence
  chemically synthesized
tctcccccaattccacactg

SEQ ID NO: 624584 - DNA, 20 bp, Artificial Sequence
  chemically synthesized
agaatcactccactaaatat

SEQ ID NO: 624585 - DNA, 20 bp, Artificial Sequence
  chemically synthesized
ataagccttaatatttagtg

SEQ ID NO: 624586 - DNA, 20 bp, Artificial Sequence
  chemically synthesized
ttccactttattcttctttg

SEQ ID NO: 624587 - DNA, 20 bp, Artificial Sequence
  chemically synthesized
caagattgtattagctatta

SEQ ID NO: 624588 - DNA, 20 bp, Artificial Sequence
  chemically synthesized
ggtctttttagtagacttgg

SEQ ID NO: 624589 - DNA, 20 bp, Artificial Sequence
  chemically synthesized
agtagaaatggcattaaaac

SEQ ID NO: 624590 - DNA, 20 bp, Artificial Sequence
  chemically synthesized
caattatctccaaattaatc

SEQ ID NO: 624591 - DNA, 20 bp, Artificial Sequence
  chemically synthesized
atggagagatatactctgct

SEQ ID NO: 624592 - DNA, 20 bp, Artificial Sequence
  chemically synthesized
taagttaattttttatcatg

SEQ ID NO: 624593 - DNA, 20 bp, Artificial Sequence
  chemically synthesized
tatcatgctgtgtttttcaa

SEQ ID NO: 624594 - DNA, 20 bp, Artificial Sequence
  chemically synthesized
tttttcaacagtgttttgca

SEQ ID NO: 624595 - DNA, 20 bp, Artificial Sequence
  chemically synthesized
tgttttgcattgagattaga

SEQ ID NO: 624596 - DNA, 20 bp, Artificial Sequence
  chemically synthesized
tgtgctattgtctgctatgc

SEQ ID NO: 624597 - DNA, 20 bp, Artificial Sequence
  chemically synthesized
ctgctatgcatgtgattaca

SEQ ID NO: 624598 - DNA, 20 bp, Artificial Sequence
  chemically synthesized
acatagcaaaaggtctaaaa

SEQ ID NO: 624599 - DNA, 20 bp, Artificial Sequence
  chemically synthesized
aattatgatttagaaaagaa

SEQ ID NO: 624600 - DNA, 20 bp, Artificial Sequence
  chemically synthesized
tagtcgtttaggtttttaaa

SEQ ID NO: 624601 - DNA, 20 bp, Artificial Sequence
  chemically synthesized
gtatatttagctatagtcgt

SEQ ID NO: 624602 - DNA, 20 bp, Artificial Sequence
  chemically synthesized
tatggtgtatatttagctat

SEQ ID NO: 624603 - DNA, 20 bp, Artificial Sequence
  chemically synthesized
tgttgaaataattttaagta

SEQ ID NO: 624604 - DNA, 20 bp, Artificial Sequence
  chemically synthesized
attttaagtaataagattat

SEQ ID NO: 624605 - DNA, 20 bp, Artificial Sequence
  chemically synthesized
taagattataattgtttata

SEQ ID NO: 624606 - DNA, 20 bp, Artificial Sequence
  chemically synthesized
tacattaaagtcatgcatca

SEQ ID NO: 624607 - DNA, 20 bp, Artificial Sequence
  chemically synthesized
ttaattacttttctttagcc

SEQ ID NO: 624608 - DNA, 20 bp, Artificial Sequence
  chemically synthesized
gttgtaaaatgaagactggt

SEQ ID NO: 624609 - DNA, 20 bp, Artificial Sequence
  chemically synthesized
cttagttctaagagtttgtc

SEQ ID NO: 624610 - DNA, 20 bp, Artificial Sequence
  chemically synthesized
aatttagtgctcttagttct

SEQ ID NO: 624611 - DNA, 20 bp, Artificial Sequence
  chemically synthesized
tttatttttaaaaatgcctt

SEQ ID NO: 624612 - DNA, 20 bp, Artificial Sequence
  chemically synthesized
tatctaattcaacatggaat

SEQ ID NO: 624613 - DNA, 20 bp, Artificial Sequence
  chemically synthesized
ccagtaattacccaatctct

SEQ ID NO: 624614 - DNA, 20 bp, Artificial Sequence
  chemically synthesized
cttaagaacactgaatcgca

SEQ ID NO: 624615 - DNA, 20 bp, Artificial Sequence
  chemically synthesized
aataattaagagcaagaaaa

SEQ ID NO: 624616 - DNA, 20 bp, Artificial Sequence
  chemically synthesized
aacttttcttgctcttaatt

SEQ ID NO: 624617 - DNA, 20 bp, Artificial Sequence
  chemically synthesized
ctcacatagacctaatagct

SEQ ID NO: 624618 - DNA, 20 bp, Artificial Sequence
  chemically synthesized
acagccacttaaccaacgtg

SEQ ID NO: 624619 - DNA, 20 bp, Artificial Sequence
  chemically synthesized
ttttccagaatccaaaacaa

SEQ ID NO: 624620 - DNA, 20 bp, Artificial Sequence
  chemically synthesized
tacctcttaaactgatttgt

SEQ ID NO: 624621 - DNA, 20 bp, Artificial Sequence
  chemically synthesized
catacctacctcttaaactg

SEQ ID NO: 624622 - DNA, 20 bp, Artificial Sequence
  chemically synthesized
ctttgcatacctacctctta

SEQ ID NO: 624623 - DNA, 20 bp, Artificial Sequence
  chemically synthesized
atgcaaagaccctgtaatac

SEQ ID NO: 624624 - DNA, 20 bp, Artificial Sequence
  chemically synthesized
taagtaccatgagaaaatga

SEQ ID NO: 624625 - DNA, 20 bp, Artificial Sequence
  chemically synthesized
tactcatgaagtaccaaggt

SEQ ID NO: 624626 - DNA, 20 bp, Artificial Sequence
  chemically synthesized
aatagggcctttcagtaatg

SEQ ID NO: 624627 - DNA, 20 bp, Artificial Sequence
  chemically synthesized
tgatatttttagtaactgaa

SEQ ID NO: 624628 - DNA, 20 bp, Artificial Sequence
  chemically synthesized
tttttagtaactgaatttag

SEQ ID NO: 624629 - DNA, 20 bp, Artificial Sequence
  chemically synthesized
atgcacgtcacccttgagtt

SEQ ID NO: 624630 - DNA, 20 bp, Artificial Sequence
  chemically synthesized
agagcccaagttgtacatat

SEQ ID NO: 624631 - DNA, 20 bp, Artificial Sequence
  chemically synthesized
tctaagagcccaagttgtac

SEQ ID NO: 624632 - DNA, 20 bp, Artificial Sequence
  chemically synthesized
ttgtcaccagttgaattgtc

SEQ ID NO: 624633 - DNA, 20 bp, Artificial Sequence
  chemically synthesized
cagttgaattgtcatatgat

SEQ ID NO: 624634 - DNA, 20 bp, Artificial Sequence
  chemically synthesized
gattaaagtttgccactcca

SEQ ID NO: 624635 - DNA, 20 bp, Artificial Sequence
  chemically synthesized
tactcactagaacgtgagat

SEQ ID NO: 624636 - DNA, 20 bp, Artificial Sequence
  chemically synthesized
tataaaatactcactagaac

SEQ ID NO: 624637 - DNA, 20 bp, Artificial Sequence
  chemically synthesized
tacttttcatgactctatct

SEQ ID NO: 624638 - DNA, 20 bp, Artificial Sequence
  chemically synthesized
atagagtcatgaaaagtaga

SEQ ID NO: 624639 - DNA, 20 bp, Artificial Sequence
  chemically synthesized
ctcatagttactttaagaaa

SEQ ID NO: 624640 - DNA, 20 bp, Artificial Sequence
  chemically synthesized
cgcattttcttaaagtaact

SEQ ID NO: 624641 - DNA, 20 bp, Artificial Sequence
  chemically synthesized
gttacttcaaagggagaagt

SEQ ID NO: 624642 - DNA, 20 bp, Artificial Sequence
  chemically synthesized
ctctgaaagtagttcctttg

SEQ ID NO: 624643 - DNA, 20 bp, Artificial Sequence
  chemically synthesized
aactactttcagaggtgtga

SEQ ID NO: 624644 - DNA, 20 bp, Artificial Sequence
  chemically synthesized
taggtgcctcgatagcccct

SEQ ID NO: 624645 - DNA, 20 bp, Artificial Sequence
  chemically synthesized
tgaagagtcaagtgaaggaa

SEQ ID NO: 624646 - DNA, 20 bp, Artificial Sequence
  chemically synthesized
cctctatggctctatctctt

SEQ ID NO: 624647 - DNA, 20 bp, Artificial Sequence
  chemically synthesized
agtaagagatagagccatag

SEQ ID NO: 624648 - DNA, 20 bp, Artificial Sequence
  chemically synthesized
tgtgccttatttcccaccat

SEQ ID NO: 624649 - DNA, 20 bp, Artificial Sequence
  chemically synthesized
tctctttctgcctttctgtc

SEQ ID NO: 624650 - DNA, 20 bp, Artificial Sequence
  chemically synthesized
cccttgccgagtagtctcct

SEQ ID NO: 624651 - DNA, 20 bp, Artificial Sequence
  chemically synthesized
aggaaatgcaatttataggg

SEQ ID NO: 624652 - DNA, 20 bp, Artificial Sequence
  chemically synthesized
cagaacaaaaaagagcataa

SEQ ID NO: 624653 - DNA, 20 bp, Artificial Sequence
  chemically synthesized
tttcagtacactcttttctt

SEQ ID NO: 624654 - DNA, 20 bp, Artificial Sequence
  chemically synthesized
ccaatacagcattttaggtt

SEQ ID NO: 624655 - DNA, 20 bp, Artificial Sequence
  chemically synthesized
actggcagcaaattccctca

SEQ ID NO: 624656 - DNA, 20 bp, Artificial Sequence
  chemically synthesized
cttcctttctttatgtagat

SEQ ID NO: 624657 - DNA, 20 bp, Artificial Sequence
  chemically synthesized
ggaataggaagaatagataa

SEQ ID NO: 624658 - DNA, 20 bp, Artificial Sequence
  chemically synthesized
aaattatctattcttcctat

SEQ ID NO: 624659 - DNA, 20 bp, Artificial Sequence
  chemically synthesized
taacagcaagaagaaacatt

SEQ ID NO: 624660 - DNA, 20 bp, Artificial Sequence
  chemically synthesized
aagaagaaacattggatgat

SEQ ID NO: 624661 - DNA, 20 bp, Artificial Sequence
  chemically synthesized
atccataagctctaatcatc

SEQ ID NO: 624662 - DNA, 20 bp, Artificial Sequence
  chemically synthesized
acctttgtaacattactggc

SEQ ID NO: 624663 - DNA, 20 bp, Artificial Sequence
  chemically synthesized
gaatattctgtgtgggaaaa

SEQ ID NO: 624664 - DNA, 20 bp, Artificial Sequence
  chemically synthesized
gtttttctgctcccactcca

SEQ ID NO: 624665 - DNA, 20 bp, Artificial Sequence
  chemically synthesized
ttacgtaaaggaattgtgat

SEQ ID NO: 624666 - DNA, 20 bp, Artificial Sequence
  chemically synthesized
tgttaatttacgtaaaggaa

SEQ ID NO: 624667 - DNA, 20 bp, Artificial Sequence
  chemically synthesized
aagaagagaaagaattgaaa

SEQ ID NO: 624668 - DNA, 20 bp, Artificial Sequence
  chemically synthesized
gagactccgcacctggctcc

SEQ ID NO: 624669 - DNA, 20 bp, Artificial Sequence
  chemically synthesized
cctctcggcctcccaaagtg

SEQ ID NO: 624670 - DNA, 20 bp, Artificial Sequence
  chemically synthesized
ggggcagatcacttgaggtc

SEQ ID NO: 624671 - DNA, 20 bp, Artificial Sequence
  chemically synthesized
ttttgtatttttagtagaga

SEQ ID NO: 624672 - DNA, 20 bp, Artificial Sequence
  chemically synthesized
tcaagagactgaggcatgag

SEQ ID NO: 624673 - DNA, 20 bp, Artificial Sequence
  chemically synthesized
agcctccacctgctgggttt

SEQ ID NO: 624674 - DNA, 20 bp, Artificial Sequence
  chemically synthesized
taaaatgcagcctccacctg

SEQ ID NO: 624675 - DNA, 20 bp, Artificial Sequence
  chemically synthesized
atttctatgagttcaacttt

SEQ ID NO: 624676 - DNA, 20 bp, Artificial Sequence
  chemically synthesized
aaaagttgaactcatagaaa

SEQ ID NO: 624677 - DNA, 20 bp, Artificial Sequence
  chemically synthesized
catagaaatacagattagaa

SEQ ID NO: 624678 - DNA, 20 bp, Artificial Sequence
  chemically synthesized
tttttagttaggtaggagga

SEQ ID NO: 624679 - DNA, 20 bp, Artificial Sequence
  chemically synthesized
catcatgtacaatagatcac

SEQ ID NO: 624680 - DNA, 20 bp, Artificial Sequence
  chemically synthesized
tatttcaaaattgctgaaat

SEQ ID NO: 624681 - DNA, 20 bp, Artificial Sequence
  chemically synthesized
ccacaaaaaaaatatgaggt

SEQ ID NO: 624682 - DNA, 20 bp, Artificial Sequence
  chemically synthesized
atgaggtaacagattcatta

SEQ ID NO: 624683 - DNA, 20 bp, Artificial Sequence
  chemically synthesized
tgatatatgcttacaatgca

SEQ ID NO: 624684 - DNA, 20 bp, Artificial Sequence
  chemically synthesized
ttacaatatggtgctttgat

SEQ ID NO: 624685 - DNA, 20 bp, Artificial Sequence
  chemically synthesized
tgtatttataggttacaata

SEQ ID NO: 624686 - DNA, 20 bp, Artificial Sequence
  chemically synthesized
ctttttcattgacaattaat

SEQ ID NO: 624687 - DNA, 20 bp, Artificial Sequence
  chemically synthesized
ctcatatgtcgtattgatgt

SEQ ID NO: 624688 - DNA, 20 bp, Artificial Sequence
  chemically synthesized
attgctgtgaaccctaatgt

SEQ ID NO: 624689 - DNA, 20 bp, Artificial Sequence
  chemically synthesized
attcactgactgagagatat

SEQ ID NO: 624690 - DNA, 20 bp, Artificial Sequence
  chemically synthesized
atttatggttgtggacatcc

SEQ ID NO: 624691 - DNA, 20 bp, Artificial Sequence
  chemically synthesized
tttttattactaatatatgt

SEQ ID NO: 624692 - DNA, 20 bp, Artificial Sequence
  chemically synthesized
tctaaattgttgcatattgc

SEQ ID NO: 624693 - DNA, 20 bp, Artificial Sequence
  chemically synthesized
tagcttttttcagccagcat

SEQ ID NO: 624694 - DNA, 20 bp, Artificial Sequence
  chemically synthesized
ggctgaaaaaagctagttcg

SEQ ID NO: 624695 - DNA, 20 bp, Artificial Sequence
  chemically synthesized
atggtatttaatcctttcga

SEQ ID NO: 624696 - DNA, 20 bp, Artificial Sequence
  chemically synthesized
acaaaattatagacatgaag

SEQ ID NO: 624697 - DNA, 20 bp, Artificial Sequence
  chemically synthesized
catgggacagggtgacaaga

SEQ ID NO: 624698 - DNA, 20 bp, Artificial Sequence
  chemically synthesized
cagggtgacaagaggaagct

SEQ ID NO: 624699 - DNA, 20 bp, Artificial Sequence
  chemically synthesized
gttgacctttaataaaatca

SEQ ID NO: 624700 - DNA, 20 bp, Artificial Sequence
  chemically synthesized
ttaaatgcaatttttacaca

SEQ ID NO: 624701 - DNA, 20 bp, Artificial Sequence
  chemically synthesized
acctctctaattcagatttt

SEQ ID NO: 624702 - DNA, 20 bp, Artificial Sequence
  chemically synthesized
gttacaattaacctctctaa

SEQ ID NO: 624703 - DNA, 20 bp, Artificial Sequence
  chemically synthesized
ttgtaacaaaatcctcatta

SEQ ID NO: 624704 - DNA, 20 bp, Artificial Sequence
  chemically synthesized
attatattcaaacattataa

SEQ ID NO: 624705 - DNA, 20 bp, Artificial Sequence
  chemically synthesized
atcctatgtgaaatatcctg

SEQ ID NO: 624706 - DNA, 20 bp, Artificial Sequence
  chemically synthesized
tctacaactctttgaaaata

SEQ ID NO: 624707 - DNA, 20 bp, Artificial Sequence
  chemically synthesized
aataaaatgtttaactttta

SEQ ID NO: 624708 - DNA, 20 bp, Artificial Sequence
  chemically synthesized
tttaacttttaaaaagtttc

SEQ ID NO: 624709 - DNA, 20 bp, Artificial Sequence
  chemically synthesized
acttttaaaaagtttctcaa

SEQ ID NO: 624710 - DNA, 20 bp, Artificial Sequence
  chemically synthesized
taaaaagtttctcaagcttg

SEQ ID NO: 624711 - DNA, 20 bp, Artificial Sequence
  chemically synthesized
caagctctgacacaagctaa

SEQ ID NO: 624712 - DNA, 20 bp, Artificial Sequence
  chemically synthesized
caagcttgcttagcttgtgt

SEQ ID NO: 624713 - DNA, 20 bp, Artificial Sequence
  chemically synthesized
ttgcttagcttgtgtcagag

SEQ ID NO: 624714 - DNA, 20 bp, Artificial Sequence
  chemically synthesized
tgcagatatgaagccagagc

SEQ ID NO: 624715 - DNA, 20 bp, Artificial Sequence
  chemically synthesized
caatgacaggaagcaagggc

SEQ ID NO: 624716 - DNA, 20 bp, Artificial Sequence
  chemically synthesized
gagttcccaggacgcaggaa

SEQ ID NO: 624717 - DNA, 20 bp, Artificial Sequence
  chemically synthesized
tacataaattctaagctacc

SEQ ID NO: 624718 - DNA, 20 bp, Artificial Sequence
  chemically synthesized
catatgatctaaaatctatt

SEQ ID NO: 624719 - DNA, 20 bp, Artificial Sequence
  chemically synthesized
cttaatagatgggtgtgtgt

SEQ ID NO: 624720 - DNA, 20 bp, Artificial Sequence
  chemically synthesized
gagaagaaaatttttcacac

SEQ ID NO: 624721 - DNA, 20 bp, Artificial Sequence
  chemically synthesized
ttagatattattattactac

SEQ ID NO: 624722 - DNA, 20 bp, Artificial Sequence
  chemically synthesized
gaaatgtggcaaacacactg

SEQ ID NO: 624723 - DNA, 20 bp, Artificial Sequence
  chemically synthesized
ctgttcattgaatcatgtca

SEQ ID NO: 624724 - DNA, 20 bp, Artificial Sequence
  chemically synthesized
catgattcaatgaacagcag

SEQ ID NO: 624725 - DNA, 20 bp, Artificial Sequence
  chemically synthesized
gccaccgctgccattccaag

SEQ ID NO: 624726 - DNA, 20 bp, Artificial Sequence
  chemically synthesized
tttttgtaaaattctgggaa

SEQ ID NO: 624727 - DNA, 20 bp, Artificial Sequence
  chemically synthesized
taaaattctgggaaaagaga

SEQ ID NO: 624728 - DNA, 20 bp, Artificial Sequence
  chemically synthesized
tctattgggtaatcacttct

SEQ ID NO: 624729 - DNA, 20 bp, Artificial Sequence
  chemically synthesized
ggagggatctaaacccagag

SEQ ID NO: 624730 - DNA, 20 bp, Artificial Sequence
  chemically synthesized
agatccctcctggccactct

SEQ ID NO: 624731 - DNA, 20 bp, Artificial Sequence
  chemically synthesized
ttcgcccaggccactgttcg

SEQ ID NO: 624732 - DNA, 20 bp, Artificial Sequence
  chemically synthesized
gttcgctaagcttgtcacca

SEQ ID NO: 624733 - DNA, 20 bp, Artificial Sequence
  chemically synthesized
tccagtaaatccatgtggtg

SEQ ID NO: 624734 - DNA, 20 bp, Artificial Sequence
  chemically synthesized
gtgtgctgctgcccctcagc

SEQ ID NO: 624735 - DNA, 20 bp, Artificial Sequence
  chemically synthesized
taacaggaggagagcctgtt

SEQ ID NO: 624736 - DNA, 20 bp, Artificial Sequence
  chemically synthesized
tactggcctttactggaggg

SEQ ID NO: 624737 - DNA, 20 bp, Artificial Sequence
  chemically synthesized
aggccaaactctatactaac

SEQ ID NO: 624738 - DNA, 20 bp, Artificial Sequence
  chemically synthesized
agaccaagccattgttagta

SEQ ID NO: 624739 - DNA, 20 bp, Artificial Sequence
  chemically synthesized
ttgtgtaggggttaattttt

SEQ ID NO: 624740 - DNA, 20 bp, Artificial Sequence
  chemically synthesized
ggaaaaaattaacccctaca

SEQ ID NO: 624741 - DNA, 20 bp, Artificial Sequence
  chemically synthesized
actctttcctattgaaggct

SEQ ID NO: 624742 - DNA, 20 bp, Artificial Sequence
  chemically synthesized
cctgaaggaaggcagtcatt

SEQ ID NO: 624743 - DNA, 20 bp, Artificial Sequence
  chemically synthesized
cttggcatatagtaaatgat

SEQ ID NO: 624744 - DNA, 20 bp, Artificial Sequence
  chemically synthesized
tacagtagttaattctgatg

SEQ ID NO: 624745 - DNA, 20 bp, Artificial Sequence
  chemically synthesized
cagaattaactactgtattt

SEQ ID NO: 624746 - DNA, 20 bp, Artificial Sequence
  chemically synthesized
acactaatgattttaagaca

SEQ ID NO: 624747 - DNA, 20 bp, Artificial Sequence
  chemically synthesized
gtcttaaaatcattagtgta

SEQ ID NO: 624748 - DNA, 20 bp, Artificial Sequence
  chemically synthesized
tacccctaaacgctatacac

SEQ ID NO: 624749 - DNA, 20 bp, Artificial Sequence
  chemically synthesized
gtgtatagcgtttaggggta

SEQ ID NO: 624750 - DNA, 20 bp, Artificial Sequence
  chemically synthesized
tatcttgcaatttattattt

SEQ ID NO: 624751 - DNA, 20 bp, Artificial Sequence
  chemically synthesized
gattcaatgacatacagcaa

SEQ ID NO: 624752 - DNA, 20 bp, Artificial Sequence
  chemically synthesized
tacagcaatatagttttcac

SEQ ID NO: 624753 - DNA, 20 bp, Artificial Sequence
  chemically synthesized
tgttgataaaataagtccct

SEQ ID NO: 624754 - DNA, 20 bp, Artificial Sequence
  chemically synthesized
aggtgtgtatcacctctgag

SEQ ID NO: 624755 - DNA, 20 bp, Artificial Sequence
  chemically synthesized
aggtcacacagctagtcaat

SEQ ID NO: 624756 - DNA, 20 bp, Artificial Sequence
  chemically synthesized
aggctcttggatcaggctat

SEQ ID NO: 624757 - DNA, 20 bp, Artificial Sequence
  chemically synthesized
ttagaatataatctgctcct

SEQ ID NO: 624758 - DNA, 20 bp, Artificial Sequence
  chemically synthesized
gatggcgctaatctgggagg

SEQ ID NO: 624759 - DNA, 20 bp, Artificial Sequence
  chemically synthesized
gtttctcttcctcactatga

SEQ ID NO: 624760 - DNA, 20 bp, Artificial Sequence
  chemically synthesized
tgaggaagagaaacattttc

SEQ ID NO: 624761 - DNA, 20 bp, Artificial Sequence
  chemically synthesized
caagttttgcaaactttgga

SEQ ID NO: 624762 - DNA, 20 bp, Artificial Sequence
  chemically synthesized
aatataagttggccagcttg

SEQ ID NO: 624763 - DNA, 20 bp, Artificial Sequence
  chemically synthesized
aataataataatataagttg

SEQ ID NO: 624764 - DNA, 20 bp, Artificial Sequence
  chemically synthesized
actccagcctggacgactga

SEQ ID NO: 624765 - DNA, 20 bp, Artificial Sequence
  chemically synthesized
aatggcatgaacccgggagg

SEQ ID NO: 624766 - DNA, 20 bp, Artificial Sequence
  chemically synthesized
ttttgtatttttagtagaga

SEQ ID NO: 624767 - DNA, 20 bp, Artificial Sequence
  chemically synthesized
cgcctcggcctcccaaagtg

SEQ ID NO: 624768 - DNA, 20 bp, Artificial Sequence
  chemically synthesized
aagccaaatattggcactcg

SEQ ID NO: 624769 - DNA, 20 bp, Artificial Sequence
  chemically synthesized
aagcaaaacgagtgccaata

SEQ ID NO: 624770 - DNA, 20 bp, Artificial Sequence
  chemically synthesized
aggagaagccaaatattggc

SEQ ID NO: 624771 - DNA, 20 bp, Artificial Sequence
  chemically synthesized
ttttttttctttttttttga

SEQ ID NO: 624772 - DNA, 20 bp, Artificial Sequence
  chemically synthesized
aacctcagccttccaggttc

SEQ ID NO: 624773 - DNA, 20 bp, Artificial Sequence
  chemically synthesized
tgcctcagcctctcaagtag

SEQ ID NO: 624774 - DNA, 20 bp, Artificial Sequence
  chemically synthesized
tgttgtatttttagtacaga

SEQ ID NO: 624775 - DNA, 20 bp, Artificial Sequence
  chemically synthesized
caacttggcctcccaaactt

SEQ ID NO: 624776 - DNA, 20 bp, Artificial Sequence
  chemically synthesized
tggctcacacctgtaatccc

SEQ ID NO: 624777 - DNA, 20 bp, Artificial Sequence
  chemically synthesized
ggactctccttcctctttca

SEQ ID NO: 624778 - DNA, 20 bp, Artificial Sequence
  chemically synthesized
tgcctacacaaaaagctggc

SEQ ID NO: 624779 - DNA, 20 bp, Artificial Sequence
  chemically synthesized
acaaaaagctggcagaagct

SEQ ID NO: 624780 - DNA, 20 bp, Artificial Sequence
  chemically synthesized
aaataaagcaaaaagcttct

SEQ ID NO: 624781 - DNA, 20 bp, Artificial Sequence
  chemically synthesized
aaggcctccaaaataaagca

SEQ ID NO: 624782 - DNA, 20 bp, Artificial Sequence
  chemically synthesized
gattacagatcattctgccc

SEQ ID NO: 624783 - DNA, 20 bp, Artificial Sequence
  chemically synthesized
tcctcactagcttctcacct

SEQ ID NO: 624784 - DNA, 20 bp, Artificial Sequence
  chemically synthesized
tctctgaggtgagaagctag

SEQ ID NO: 624785 - DNA, 20 bp, Artificial Sequence
  chemically synthesized
gagaaaagtggttaatcctc

SEQ ID NO: 624786 - DNA, 20 bp, Artificial Sequence
  chemically synthesized
ccccactagcctcaccattt

SEQ ID NO: 624787 - DNA, 20 bp, Artificial Sequence
  chemically synthesized
gggaagtgtgacacaagaag

SEQ ID NO: 624788 - DNA, 20 bp, Artificial Sequence
  chemically synthesized
tatccttacttcaaagtagt

SEQ ID NO: 624789 - DNA, 20 bp, Artificial Sequence
  chemically synthesized
gaaatggttttatattgtac

SEQ ID NO: 624790 - DNA, 20 bp, Artificial Sequence
  chemically synthesized
tgactcctctaaaattcaga

SEQ ID NO: 624791 - DNA, 20 bp, Artificial Sequence
  chemically synthesized
aattttagaggagtcaaata

SEQ ID NO: 624792 - DNA, 20 bp, Artificial Sequence
  chemically synthesized
aataatataaaacgcacgcc

SEQ ID NO: 624793 - DNA, 20 bp, Artificial Sequence
  chemically synthesized
ggagggaggaaaccaatggc

SEQ ID NO: 624794 - DNA, 20 bp, Artificial Sequence
  chemically synthesized
tctctcttttttttttgaaa

SEQ ID NO: 624795 - DNA, 20 bp, Artificial Sequence
  chemically synthesized
aacctgtgccttccaggttc

SEQ ID NO: 624796 - DNA, 20 bp, Artificial Sequence
  chemically synthesized
ttgggaggctgaggcagaag

SEQ ID NO: 624797 - DNA, 20 bp, Artificial Sequence
  chemically synthesized
tgcctcagcctcccaagtag

SEQ ID NO: 624798 - DNA, 20 bp, Artificial Sequence
  chemically synthesized
ttgtatttttttagtagaga

SEQ ID NO: 624799 - DNA, 20 bp, Artificial Sequence
  chemically synthesized
acctcaagtgatccactcac

SEQ ID NO: 624800 - DNA, 20 bp, Artificial Sequence
  chemically synthesized
caccttggcttcccaaaatg

SEQ ID NO: 624801 - DNA, 20 bp, Artificial Sequence
  chemically synthesized
aacttaatatttctcataca

SEQ ID NO: 624802 - DNA, 20 bp, Artificial Sequence
  chemically synthesized
aaaattttaaatgagaacag

SEQ ID NO: 624803 - DNA, 20 bp, Artificial Sequence
  chemically synthesized
acaaaatgaaaatatgtatt

SEQ ID NO: 624804 - DNA, 20 bp, Artificial Sequence
  chemically synthesized
tcgattttgatatatcttgt

SEQ ID NO: 624805 - DNA, 20 bp, Artificial Sequence
  chemically synthesized
atgggtgtgtagttcacatt

SEQ ID NO: 624806 - DNA, 20 bp, Artificial Sequence
  chemically synthesized
cacccatatacgtgcacaac

SEQ ID NO: 624807 - DNA, 20 bp, Artificial Sequence
  chemically synthesized
ggcttattatagataccatg

SEQ ID NO: 624808 - DNA, 20 bp, Artificial Sequence
  chemically synthesized
gtttagtttaaaagaactct

SEQ ID NO: 624809 - DNA, 20 bp, Artificial Sequence
  chemically synthesized
cccttttggcaactattatg

SEQ ID NO: 624810 - DNA, 20 bp, Artificial Sequence
  chemically synthesized
tgaatcccttttggcaacta

SEQ ID NO: 624811 - DNA, 20 bp, Artificial Sequence
  chemically synthesized
ctaaacataatagttgccaa

SEQ ID NO: 624812 - DNA, 20 bp, Artificial Sequence
  chemically synthesized
aatagttgccaaaagggatt

SEQ ID NO: 624813 - DNA, 20 bp, Artificial Sequence
  chemically synthesized
aaagggattcatagcttttg

SEQ ID NO: 624814 - DNA, 20 bp, Artificial Sequence
  chemically synthesized
ggaataaatgtattccggct

SEQ ID NO: 624815 - DNA, 20 bp, Artificial Sequence
  chemically synthesized
cctttccaagtggcacacca

SEQ ID NO: 624816 - DNA, 20 bp, Artificial Sequence
  chemically synthesized
ctgcatgtcatatacctggt

SEQ ID NO: 624817 - DNA, 20 bp, Artificial Sequence
  chemically synthesized
gcctgtactcacttgagcac

SEQ ID NO: 624818 - DNA, 20 bp, Artificial Sequence
  chemically synthesized
tacctacataatactgggtt

SEQ ID NO: 624819 - DNA, 20 bp, Artificial Sequence
  chemically synthesized
tggggcagtttagatgcttc

SEQ ID NO: 624820 - DNA, 20 bp, Artificial Sequence
  chemically synthesized
tgatatttgtggggcagttt

SEQ ID NO: 624821 - DNA, 20 bp, Artificial Sequence
  chemically synthesized
aatatgcatgatatttgtgg

SEQ ID NO: 624822 - DNA, 20 bp, Artificial Sequence
  chemically synthesized
tatcatgcatatttagaaat

SEQ ID NO: 624823 - DNA, 20 bp, Artificial Sequence
  chemically synthesized
cagattcattttgcatatct

SEQ ID NO: 624824 - DNA, 20 bp, Artificial Sequence
  chemically synthesized
tatacagcaccctctctccc

SEQ ID NO: 624825 - DNA, 20 bp, Artificial Sequence
  chemically synthesized
tatcatgtgaatttagaaat

SEQ ID NO: 624826 - DNA, 20 bp, Artificial Sequence
  chemically synthesized
tgataattgtggggcatttt

SEQ ID NO: 624827 - DNA, 20 bp, Artificial Sequence
  chemically synthesized
tggggcattttagatgcttt

SEQ ID NO: 624828 - DNA, 20 bp, Artificial Sequence
  chemically synthesized
tacttacacaatactgtgtt

SEQ ID NO: 624829 - DNA, 20 bp, Artificial Sequence
  chemically synthesized
acattttgcagataagaaaa

SEQ ID NO: 624830 - DNA, 20 bp, Artificial Sequence
  chemically synthesized
gataagaaaactgagattta

SEQ ID NO: 624831 - DNA, 20 bp, Artificial Sequence
  chemically synthesized
ggacaaaaaacttactaaat

SEQ ID NO: 624832 - DNA, 20 bp, Artificial Sequence
  chemically synthesized
ttttttgtccaaagctataa

SEQ ID NO: 624833 - DNA, 20 bp, Artificial Sequence
  chemically synthesized
caggactttaaaatctcggt

SEQ ID NO: 624834 - DNA, 20 bp, Artificial Sequence
  chemically synthesized
gtgacgttaaaccctaaaac

SEQ ID NO: 624835 - DNA, 20 bp, Artificial Sequence
  chemically synthesized
gatactaaaagcatatgttt

SEQ ID NO: 624836 - DNA, 20 bp, Artificial Sequence
  chemically synthesized
aagattatgatactaaaagc

SEQ ID NO: 624837 - DNA, 20 bp, Artificial Sequence
  chemically synthesized
atgtcatctggtaaccatgg

SEQ ID NO: 624838 - DNA, 20 bp, Artificial Sequence
  chemically synthesized
tggtgtcctatcctttactt

SEQ ID NO: 624839 - DNA, 20 bp, Artificial Sequence
  chemically synthesized
cccaaattattaaatgctat

SEQ ID NO: 624840 - DNA, 20 bp, Artificial Sequence
  chemically synthesized
aatgctatctaggtttaagt

SEQ ID NO: 624841 - DNA, 20 bp, Artificial Sequence
  chemically synthesized
gtagcaagggtgcatgcagg

SEQ ID NO: 624842 - DNA, 20 bp, Artificial Sequence
  chemically synthesized
taacagcatcgccgttatat

SEQ ID NO: 624843 - DNA, 20 bp, Artificial Sequence
  chemically synthesized
cccctcagcctcccaaagtt

SEQ ID NO: 624844 - DNA, 20 bp, Artificial Sequence
  chemically synthesized
ttttgtatttttagtagaga

SEQ ID NO: 624845 - DNA, 20 bp, Artificial Sequence
  chemically synthesized
tgcctcagcccccagagtag

SEQ ID NO: 624846 - DNA, 20 bp, Artificial Sequence
  chemically synthesized
aacctccacctccggggttc

SEQ ID NO: 624847 - DNA, 20 bp, Artificial Sequence
  chemically synthesized
aaattttagagtctgtttca

SEQ ID NO: 624848 - DNA, 20 bp, Artificial Sequence
  chemically synthesized
ggttcttgttaaattttaga

SEQ ID NO: 624849 - DNA, 20 bp, Artificial Sequence
  chemically synthesized
ctctaaaatttaacaagaac

SEQ ID NO: 624850 - DNA, 20 bp, Artificial Sequence
  chemically synthesized
atgtttagattggtccttag

SEQ ID NO: 624851 - DNA, 20 bp, Artificial Sequence
  chemically synthesized
aggaaatgtttagattggtc

SEQ ID NO: 624852 - DNA, 20 bp, Artificial Sequence
  chemically synthesized
ttttttttccttaggaaatg

SEQ ID NO: 624853 - DNA, 20 bp, Artificial Sequence
  chemically synthesized
cctccttttttttccttagg

SEQ ID NO: 624854 - DNA, 20 bp, Artificial Sequence
  chemically synthesized
ttattcctttattactttca

SEQ ID NO: 624855 - DNA, 20 bp, Artificial Sequence
  chemically synthesized
ttactttcaaaaagatttta

SEQ ID NO: 624856 - DNA, 20 bp, Artificial Sequence
  chemically synthesized
tttacaagtttgattttgat

SEQ ID NO: 624857 - DNA, 20 bp, Artificial Sequence
  chemically synthesized
caagaattttacaagtttga

SEQ ID NO: 624858 - DNA, 20 bp, Artificial Sequence
  chemically synthesized
tgaaaacaagaattttacaa

SEQ ID NO: 624859 - DNA, 20 bp, Artificial Sequence
  chemically synthesized
caaaatcaaacttgtaaaat

SEQ ID NO: 624860 - DNA, 20 bp, Artificial Sequence
  chemically synthesized
agcttgaaaacaagaatttt

SEQ ID NO: 624861 - DNA, 20 bp, Artificial Sequence
  chemically synthesized
aacttgtaaaattcttgttt

SEQ ID NO: 624862 - DNA, 20 bp, Artificial Sequence
  chemically synthesized
tctctatgttcatttaaaaa

SEQ ID NO: 624863 - DNA, 20 bp, Artificial Sequence
  chemically synthesized
gtatttattgtgttcaacat

SEQ ID NO: 624864 - DNA, 20 bp, Artificial Sequence
  chemically synthesized
gggaatgcatttgttaatta

SEQ ID NO: 624865 - DNA, 20 bp, Artificial Sequence
  chemically synthesized
agcatttcagagtgtgtatt

SEQ ID NO: 624866 - DNA, 20 bp, Artificial Sequence
  chemically synthesized
catttcagtgctcaaaaagt

SEQ ID NO: 624867 - DNA, 20 bp, Artificial Sequence
  chemically synthesized
tgacatcatttcagtgctca

SEQ ID NO: 624868 - DNA, 20 bp, Artificial Sequence
  chemically synthesized
tagcagttttgtgcttgaaa

SEQ ID NO: 624869 - DNA, 20 bp, Artificial Sequence
  chemically synthesized
atacagtatttttagcagtt

SEQ ID NO: 624870 - DNA, 20 bp, Artificial Sequence
  chemically synthesized
taattttatacagtattttt

SEQ ID NO: 624871 - DNA, 20 bp, Artificial Sequence
  chemically synthesized
gcaggaaaacataagtgaat

SEQ ID NO: 624872 - DNA, 20 bp, Artificial Sequence
  chemically synthesized
aagactaaacacaaattcac

SEQ ID NO: 624873 - DNA, 20 bp, Artificial Sequence
  chemically synthesized
ttcagatttgggattttatg

SEQ ID NO: 624874 - DNA, 20 bp, Artificial Sequence
  chemically synthesized
ggacctgaagtgtttcagat

SEQ ID NO: 624875 - DNA, 20 bp, Artificial Sequence
  chemically synthesized
atgcttgggacctgaagtgt

SEQ ID NO: 624876 - DNA, 20 bp, Artificial Sequence
  chemically synthesized
tccaaaatgcttgggacctg

SEQ ID NO: 624877 - DNA, 20 bp, Artificial Sequence
  chemically synthesized
gattgagtattccttatcca

SEQ ID NO: 624878 - DNA, 20 bp, Artificial Sequence
  chemically synthesized
gtgactatagttaatgatga

SEQ ID NO: 624879 - DNA, 20 bp, Artificial Sequence
  chemically synthesized
accatattgtacaatagatc

SEQ ID NO: 624880 - DNA, 20 bp, Artificial Sequence
  chemically synthesized
gtgaggtagttaagagagag

SEQ ID NO: 624881 - DNA, 20 bp, Artificial Sequence
  chemically synthesized
tctactttaaaatcaacctt

SEQ ID NO: 624882 - DNA, 20 bp, Artificial Sequence
  chemically synthesized
ctttatgcggaatctgaaaa

SEQ ID NO: 624883 - DNA, 20 bp, Artificial Sequence
  chemically synthesized
tggtattttttctttctctg

SEQ ID NO: 624884 - DNA, 20 bp, Artificial Sequence
  chemically synthesized
cattcatgttgctgcaaatg

SEQ ID NO: 624885 - DNA, 20 bp, Artificial Sequence
  chemically synthesized
caccagttgatggaccctta

SEQ ID NO: 624886 - DNA, 20 bp, Artificial Sequence
  chemically synthesized
ttgaagagatatctgcacac

SEQ ID NO: 624887 - DNA, 20 bp, Artificial Sequence
  chemically synthesized
gtgcagatatctcttcaacg

SEQ ID NO: 624888 - DNA, 20 bp, Artificial Sequence
  chemically synthesized
ctgctggatcatatgttagt

SEQ ID NO: 624889 - DNA, 20 bp, Artificial Sequence
  chemically synthesized
aatttttttgagaaagcccc

SEQ ID NO: 624890 - DNA, 20 bp, Artificial Sequence
  chemically synthesized
taaccattattgaaaacagt

SEQ ID NO: 624891 - DNA, 20 bp, Artificial Sequence
  chemically synthesized
gccttcttgatgtcattcta

SEQ ID NO: 624892 - DNA, 20 bp, Artificial Sequence
  chemically synthesized
ggtttgagttgatatctcac

SEQ ID NO: 624893 - DNA, 20 bp, Artificial Sequence
  chemically synthesized
tggatttatttacatttacc

SEQ ID NO: 624894 - DNA, 20 bp, Artificial Sequence
  chemically synthesized
ctgatgtttaatgatgctga

SEQ ID NO: 624895 - DNA, 20 bp, Artificial Sequence
  chemically synthesized
tgctcatttttaattgggtt

SEQ ID NO: 624896 - DNA, 20 bp, Artificial Sequence
  chemically synthesized
tatttgttttcttgctattt

SEQ ID NO: 624897 - DNA, 20 bp, Artificial Sequence
  chemically synthesized
caaatatttcatcccattct

SEQ ID NO: 624898 - DNA, 20 bp, Artificial Sequence
  chemically synthesized
tgtaggttttctcttcactc

SEQ ID NO: 624899 - DNA, 20 bp, Artificial Sequence
  chemically synthesized
cctttactgtgcagaacttt

SEQ ID NO: 624900 - DNA, 20 bp, Artificial Sequence
  chemically synthesized
acaaaaccaaatatagacaa

SEQ ID NO: 624901 - DNA, 20 bp, Artificial Sequence
  chemically synthesized
tgtaatcccatttgtctata

SEQ ID NO: 624902 - DNA, 20 bp, Artificial Sequence
  chemically synthesized
tcccatttgtctatatttgg

SEQ ID NO: 624903 - DNA, 20 bp, Artificial Sequence
  chemically synthesized
tctatatttggttttgtttc

SEQ ID NO: 624904 - DNA, 20 bp, Artificial Sequence
  chemically synthesized
catagtcatggagacttccc

SEQ ID NO: 624905 - DNA, 20 bp, Artificial Sequence
  chemically synthesized
atgtttccttctggtagtct

SEQ ID NO: 624906 - DNA, 20 bp, Artificial Sequence
  chemically synthesized
tagtcttatagtttcaggtc

SEQ ID NO: 624907 - DNA, 20 bp, Artificial Sequence
  chemically synthesized
atgtacaaaaattaactcat

SEQ ID NO: 624908 - DNA, 20 bp, Artificial Sequence
  chemically synthesized
ttttccagcaccatttattg

SEQ ID NO: 624909 - DNA, 20 bp, Artificial Sequence
  chemically synthesized
aaatccacagaattatagcc

SEQ ID NO: 624910 - DNA, 20 bp, Artificial Sequence
  chemically synthesized
aaatcagctggctataattc

SEQ ID NO: 624911 - DNA, 20 bp, Artificial Sequence
  chemically synthesized
tctgtggatttatttctggc

SEQ ID NO: 624912 - DNA, 20 bp, Artificial Sequence
  chemically synthesized
tttattccattggtctatgt

SEQ ID NO: 624913 - DNA, 20 bp, Artificial Sequence
  chemically synthesized
tctgtttttatgccagcacc

SEQ ID NO: 624914 - DNA, 20 bp, Artificial Sequence
  chemically synthesized
gcaccatctgttttggttac

SEQ ID NO: 624915 - DNA, 20 bp, Artificial Sequence
  chemically synthesized
gtgtcaagtagtgtgatgac

SEQ ID NO: 624916 - DNA, 20 bp, Artificial Sequence
  chemically synthesized
tacagaaattggaaccacaa

SEQ ID NO: 624917 - DNA, 20 bp, Artificial Sequence
  chemically synthesized
atttctgtaaaaaatgtcac

SEQ ID NO: 624918 - DNA, 20 bp, Artificial Sequence
  chemically synthesized
aaatgtcactggtgttttga

SEQ ID NO: 624919 - DNA, 20 bp, Artificial Sequence
  chemically synthesized
taaagattgcattgactgta

SEQ ID NO: 624920 - DNA, 20 bp, Artificial Sequence
  chemically synthesized
gttaaaattcctacactacc

SEQ ID NO: 624921 - DNA, 20 bp, Artificial Sequence
  chemically synthesized
agaatacctttccatttatt

SEQ ID NO: 624922 - DNA, 20 bp, Artificial Sequence
  chemically synthesized
catttatttgtggcttcttc

SEQ ID NO: 624923 - DNA, 20 bp, Artificial Sequence
  chemically synthesized
aattgctttcatcaatgtct

SEQ ID NO: 624924 - DNA, 20 bp, Artificial Sequence
  chemically synthesized
gctcactgcaacctctgcct

SEQ ID NO: 624925 - DNA, 20 bp, Artificial Sequence
  chemically synthesized
aacctctgcctcctggattc

SEQ ID NO: 624926 - DNA, 20 bp, Artificial Sequence
  chemically synthesized
tgcctcggccacccaggtag

SEQ ID NO: 624927 - DNA, 20 bp, Artificial Sequence
  chemically synthesized
ttttgtatttttagtagaga

SEQ ID NO: 624928 - DNA, 20 bp, Artificial Sequence
  chemically synthesized
ggcttcaccacgttggtcag

SEQ ID NO: 624929 - DNA, 20 bp, Artificial Sequence
  chemically synthesized
ttggcggatcacctgaggtc

SEQ ID NO: 624930 - DNA, 20 bp, Artificial Sequence
  chemically synthesized
aacctcggcctcccaaagtg

SEQ ID NO: 624931 - DNA, 20 bp, Artificial Sequence
  chemically synthesized
attttttgtagctattgtaa

SEQ ID NO: 624932 - DNA, 20 bp, Artificial Sequence
  chemically synthesized
gttattggggtacaggtggt

SEQ ID NO: 624933 - DNA, 20 bp, Artificial Sequence
  chemically synthesized
tgcatgactaagttctttag

SEQ ID NO: 624934 - DNA, 20 bp, Artificial Sequence
  chemically synthesized
aagttctttagtggtgattt

SEQ ID NO: 624935 - DNA, 20 bp, Artificial Sequence
  chemically synthesized
tacaaatacggtgctgtgta

SEQ ID NO: 624936 - DNA, 20 bp, Artificial Sequence
  chemically synthesized
ttcttatgcctttgtgttct

SEQ ID NO: 624937 - DNA, 20 bp, Artificial Sequence
  chemically synthesized
tacatatcagtgagaacaca

SEQ ID NO: 624938 - DNA, 20 bp, Artificial Sequence
  chemically synthesized
atcagtgagaacacacgatg

SEQ ID NO: 624939 - DNA, 20 bp, Artificial Sequence
  chemically synthesized
cagcatttgcagtgacctgg

SEQ ID NO: 624940 - DNA, 20 bp, Artificial Sequence
  chemically synthesized
ttttgtggccacagttatac

SEQ ID NO: 624941 - DNA, 20 bp, Artificial Sequence
  chemically synthesized
acagtttctctttatccact

SEQ ID NO: 624942 - DNA, 20 bp, Artificial Sequence
  chemically synthesized
gatgggcctttgggttggtt

SEQ ID NO: 624943 - DNA, 20 bp, Artificial Sequence
  chemically synthesized
ttggttccacgattttgcaa

SEQ ID NO: 624944 - DNA, 20 bp, Artificial Sequence
  chemically synthesized
tgtaaaagatacttgcacac

SEQ ID NO: 624945 - DNA, 20 bp, Artificial Sequence
  chemically synthesized
gtctgggtagatatctggta

SEQ ID NO: 624946 - DNA, 20 bp, Artificial Sequence
  chemically synthesized
taactaaaagtagaactacc

SEQ ID NO: 624947 - DNA, 20 bp, Artificial Sequence
  chemically synthesized
agttatttaaggaatctcca

SEQ ID NO: 624948 - DNA, 20 bp, Artificial Sequence
  chemically synthesized
aaccgctatggaaaacagtg

SEQ ID NO: 624949 - DNA, 20 bp, Artificial Sequence
  chemically synthesized
accacatccatgccaacatc

SEQ ID NO: 624950 - DNA, 20 bp, Artificial Sequence
  chemically synthesized
ccatgccaacatctaccgtt

SEQ ID NO: 624951 - DNA, 20 bp, Artificial Sequence
  chemically synthesized
acatctaccgttttttgatt

SEQ ID NO: 624952 - DNA, 20 bp, Artificial Sequence
  chemically synthesized
ggagtaaggtggtatcacat

SEQ ID NO: 624953 - DNA, 20 bp, Artificial Sequence
  chemically synthesized
aaggtggtatcacatcgtgg

SEQ ID NO: 624954 - DNA, 20 bp, Artificial Sequence
  chemically synthesized
gtgatgttgagcattttttc

SEQ ID NO: 624955 - DNA, 20 bp, Artificial Sequence
  chemically synthesized
tatccttagaacactttttg

SEQ ID NO: 624956 - DNA, 20 bp, Artificial Sequence
  chemically synthesized
cttagaacactttttgatgg

SEQ ID NO: 624957 - DNA, 20 bp, Artificial Sequence
  chemically synthesized
gaacactttttgatgggatt

SEQ ID NO: 624958 - DNA, 20 bp, Artificial Sequence
  chemically synthesized
gggattgtttgtttccttct

SEQ ID NO: 624959 - DNA, 20 bp, Artificial Sequence
  chemically synthesized
tgtttgtttccttcttactg

SEQ ID NO: 624960 - DNA, 20 bp, Artificial Sequence
  chemically synthesized
actgatttgtttgtgttcat

SEQ ID NO: 624961 - DNA, 20 bp, Artificial Sequence
  chemically synthesized
tattagtcctctgtcagatg

SEQ ID NO: 624962 - DNA, 20 bp, Artificial Sequence
  chemically synthesized
tctgtcagatgtatagattg

SEQ ID NO: 624963 - DNA, 20 bp, Artificial Sequence
  chemically synthesized
tttctaccgctctgtgtgtt

SEQ ID NO: 624964 - DNA, 20 bp, Artificial Sequence
  chemically synthesized
taccgctctgtgtgttgtct

SEQ ID NO: 624965 - DNA, 20 bp, Artificial Sequence
  chemically synthesized
cttttgccctgcaaaagctc

SEQ ID NO: 624966 - DNA, 20 bp, Artificial Sequence
  chemically synthesized
gctggggcctaatgaaacta

SEQ ID NO: 624967 - DNA, 20 bp, Artificial Sequence
  chemically synthesized
attaggccccagctatttat

SEQ ID NO: 624968 - DNA, 20 bp, Artificial Sequence
  chemically synthesized
tttatctttgtttttactgc

SEQ ID NO: 624969 - DNA, 20 bp, Artificial Sequence
  chemically synthesized
cttctagacattggcttagg

SEQ ID NO: 624970 - DNA, 20 bp, Artificial Sequence
  chemically synthesized
ttgcctaagccaatgtctag

SEQ ID NO: 624971 - DNA, 20 bp, Artificial Sequence
  chemically synthesized
ttggaaaaacccttctagac

SEQ ID NO: 624972 - DNA, 20 bp, Artificial Sequence
  chemically synthesized
atgttatcttctagaatttt

SEQ ID NO: 624973 - DNA, 20 bp, Artificial Sequence
  chemically synthesized
agaatttttatagtttcagg

SEQ ID NO: 624974 - DNA, 20 bp, Artificial Sequence
  chemically synthesized
aggtctggatttctttttca

SEQ ID NO: 624975 - DNA, 20 bp, Artificial Sequence
  chemically synthesized
ctatgggaatgctactgata

SEQ ID NO: 624976 - DNA, 20 bp, Artificial Sequence
  chemically synthesized
gtatcctgcaattttactga

SEQ ID NO: 624977 - DNA, 20 bp, Artificial Sequence
  chemically synthesized
tgaatttgtttattatttct

SEQ ID NO: 624978 - DNA, 20 bp, Artificial Sequence
  chemically synthesized
atgtggagatttttttgttt

SEQ ID NO: 624979 - DNA, 20 bp, Artificial Sequence
  chemically synthesized
ttgccaacatgtggagattt

SEQ ID NO: 624980 - DNA, 20 bp, Artificial Sequence
  chemically synthesized
tccatatccttgccaacatg

SEQ ID NO: 624981 - DNA, 20 bp, Artificial Sequence
  chemically synthesized
gcaaggatatggagaaaaga

SEQ ID NO: 624982 - DNA, 20 bp, Artificial Sequence
  chemically synthesized
tacatctatgaaaaatagaa

SEQ ID NO: 624983 - DNA, 20 bp, Artificial Sequence
  chemically synthesized
attaaaaagatacctcactc

SEQ ID NO: 624984 - DNA, 20 bp, Artificial Sequence
  chemically synthesized
aaatatatagaatttactta

SEQ ID NO: 624985 - DNA, 20 bp, Artificial Sequence
  chemically synthesized
ttattccttttgtggctaaa

SEQ ID NO: 624986 - DNA, 20 bp, Artificial Sequence
  chemically synthesized
catccatgttgttgcaaaag

SEQ ID NO: 624987 - DNA, 20 bp, Artificial Sequence
  chemically synthesized
tatttgtctttcagtgtctg

SEQ ID NO: 624988 - DNA, 20 bp, Artificial Sequence
  chemically synthesized
acatttgaaagtagagtgtg

SEQ ID NO: 624989 - DNA, 20 bp, Artificial Sequence
  chemically synthesized
cccctcccatgcctccaccc

SEQ ID NO: 624990 - DNA, 20 bp, Artificial Sequence
  chemically synthesized
ttttttcctatttggatgcc

SEQ ID NO: 624991 - DNA, 20 bp, Artificial Sequence
  chemically synthesized
cttgtgccagatcttagagg

SEQ ID NO: 624992 - DNA, 20 bp, Artificial Sequence
  chemically synthesized
atactggatggggaaaagtt

SEQ ID NO: 624993 - DNA, 20 bp, Artificial Sequence
  chemically synthesized
ttttccccatccagtataat

SEQ ID NO: 624994 - DNA, 20 bp, Artificial Sequence
  chemically synthesized
tgtcaaccactggtatagac

SEQ ID NO: 624995 - DNA, 20 bp, Artificial Sequence
  chemically synthesized
agtcagcaaaattaaagtgt

SEQ ID NO: 624996 - DNA, 20 bp, Artificial Sequence
  chemically synthesized
gctgctttttatataatttt

SEQ ID NO: 624997 - DNA, 20 bp, Artificial Sequence
  chemically synthesized
tttaaaggattccgaaaaca

SEQ ID NO: 624998 - DNA, 20 bp, Artificial Sequence
  chemically synthesized
ttcagattttatcgtaatca

SEQ ID NO: 624999 - DNA, 20 bp, Artificial Sequence
  chemically synthesized
atagatatccatttactttt

SEQ ID NO: 625000 - DNA, 20 bp, Artificial Sequence
  chemically synthesized
aaaagtaaatggatatctat

SEQ ID NO: 625001 - DNA, 20 bp, Artificial Sequence
  chemically synthesized
ctatataaggatggtatcag

SEQ ID NO: 625002 - DNA, 20 bp, Artificial Sequence
  chemically synthesized
caactcaagctatttctact

SEQ ID NO: 625003 - DNA, 20 bp, Artificial Sequence
  chemically synthesized
acttgcaaactcagagtaga

SEQ ID NO: 625004 - DNA, 20 bp, Artificial Sequence
  chemically synthesized
gctatttctactctgagttt

SEQ ID NO: 625005 - DNA, 20 bp, Artificial Sequence
  chemically synthesized
ctgagtttgcaagtttagtt

SEQ ID NO: 625006 - DNA, 20 bp, Artificial Sequence
  chemically synthesized
tatttgatttcaaatgatcc

SEQ ID NO: 625007 - DNA, 20 bp, Artificial Sequence
  chemically synthesized
gatttcaaatgatccttttg

SEQ ID NO: 625008 - DNA, 20 bp, Artificial Sequence
  chemically synthesized
tcaaatgatccttttgcttg

SEQ ID NO: 625009 - DNA, 20 bp, Artificial Sequence
  chemically synthesized
gaaatggtcaattgtgaata

SEQ ID NO: 625010 - DNA, 20 bp, Artificial Sequence
  chemically synthesized
tggtcaattgtgaataaatt

SEQ ID NO: 625011 - DNA, 20 bp, Artificial Sequence
  chemically synthesized
aattgtgaataaattgtttg

SEQ ID NO: 625012 - DNA, 20 bp, Artificial Sequence
  chemically synthesized
ataaattgtttgatttgatt

SEQ ID NO: 625013 - DNA, 20 bp, Artificial Sequence
  chemically synthesized
tttaactgagtaggcaaggt

SEQ ID NO: 625014 - DNA, 20 bp, Artificial Sequence
  chemically synthesized
aaagaagacattaatatcta

SEQ ID NO: 625015 - DNA, 20 bp, Artificial Sequence
  chemically synthesized
atctaacctgtttacaggaa

SEQ ID NO: 625016 - DNA, 20 bp, Artificial Sequence
  chemically synthesized
acagagtttcttgagcacag

SEQ ID NO: 625017 - DNA, 20 bp, Artificial Sequence
  chemically synthesized
agataaattcttccatttcg

SEQ ID NO: 625018 - DNA, 20 bp, Artificial Sequence
  chemically synthesized
ctaccagataaattcttcca

SEQ ID NO: 625019 - DNA, 20 bp, Artificial Sequence
  chemically synthesized
tgtgacctaatagaattcaa

SEQ ID NO: 625020 - DNA, 20 bp, Artificial Sequence
  chemically synthesized
ttgtatagcaagttataaaa

SEQ ID NO: 625021 - DNA, 20 bp, Artificial Sequence
  chemically synthesized
tatgcatgacttgaagacac

SEQ ID NO: 625022 - DNA, 20 bp, Artificial Sequence
  chemically synthesized
gtgtcttcaagtcatgcata

SEQ ID NO: 625023 - DNA, 20 bp, Artificial Sequence
  chemically synthesized
ctcacaaataaatgctgata

SEQ ID NO: 625024 - DNA, 20 bp, Artificial Sequence
  chemically synthesized
aggaagaatatgccaaaaag

SEQ ID NO: 625025 - DNA, 20 bp, Artificial Sequence
  chemically synthesized
gaaaatgaaatatacaaatg

SEQ ID NO: 625026 - DNA, 20 bp, Artificial Sequence
  chemically synthesized
atatgtgacttccttcctgt

SEQ ID NO: 625027 - DNA, 20 bp, Artificial Sequence
  chemically synthesized
gcttattttatgtttaaaaa

SEQ ID NO: 625028 - DNA, 20 bp, Artificial Sequence
  chemically synthesized
tatttttaaacataaaataa

SEQ ID NO: 625029 - DNA, 20 bp, Artificial Sequence
  chemically synthesized
aaaagttaagctagcttatt

SEQ ID NO: 625030 - DNA, 20 bp, Artificial Sequence
  chemically synthesized
tctgttgtaataaaagttaa

SEQ ID NO: 625031 - DNA, 20 bp, Artificial Sequence
  chemically synthesized
taacttttattacaacagaa

SEQ ID NO: 625032 - DNA, 20 bp, Artificial Sequence
  chemically synthesized
agaagtctgtttatctggag

SEQ ID NO: 625033 - DNA, 20 bp, Artificial Sequence
  chemically synthesized
agacatttttgctccttcag

SEQ ID NO: 625034 - DNA, 20 bp, Artificial Sequence
  chemically synthesized
aactagtcttattgaaatgc

SEQ ID NO: 625035 - DNA, 20 bp, Artificial Sequence
  chemically synthesized
aactaatgcatttcaataag

SEQ ID NO: 625036 - DNA, 20 bp, Artificial Sequence
  chemically synthesized
cctaagaatgatatttcggg

SEQ ID NO: 625037 - DNA, 20 bp, Artificial Sequence
  chemically synthesized
tattcactttccaattaact

SEQ ID NO: 625038 - DNA, 20 bp, Artificial Sequence
  chemically synthesized
cagttttgactattcagagt

SEQ ID NO: 625039 - DNA, 20 bp, Artificial Sequence
  chemically synthesized
tatgtagttttattaatttc

SEQ ID NO: 625040 - DNA, 20 bp, Artificial Sequence
  chemically synthesized
acataaataaatgcaacata

SEQ ID NO: 625041 - DNA, 20 bp, Artificial Sequence
  chemically synthesized
ggaaaaattataggtttagt

SEQ ID NO: 625042 - DNA, 20 bp, Artificial Sequence
  chemically synthesized
aagtgaataatggaaaaatt

SEQ ID NO: 625043 - DNA, 20 bp, Artificial Sequence
  chemically synthesized
tcttgttctgctgaagttat

SEQ ID NO: 625044 - DNA, 20 bp, Artificial Sequence
  chemically synthesized
gcaattctgttaaaattcat

SEQ ID NO: 625045 - DNA, 20 bp, Artificial Sequence
  chemically synthesized
attgcatgaagtgctagaat

SEQ ID NO: 625046 - DNA, 20 bp, Artificial Sequence
  chemically synthesized
agccactgcattcatttaaa

SEQ ID NO: 625047 - DNA, 20 bp, Artificial Sequence
  chemically synthesized
gtaaatttacaactttgttg

SEQ ID NO: 625048 - DNA, 20 bp, Artificial Sequence
  chemically synthesized
caactttgttgatgagtttt

SEQ ID NO: 625049 - DNA, 20 bp, Artificial Sequence
  chemically synthesized
taatggattacaaaaatatg

SEQ ID NO: 625050 - DNA, 20 bp, Artificial Sequence
  chemically synthesized
tcagttttcattctgttctt

SEQ ID NO: 625051 - DNA, 20 bp, Artificial Sequence
  chemically synthesized
caacatagatcatattgtta

SEQ ID NO: 625052 - DNA, 20 bp, Artificial Sequence
  chemically synthesized
tttttttacaggaaaataca

SEQ ID NO: 625053 - DNA, 20 bp, Artificial Sequence
  chemically synthesized
ttcctgtaaaaaaataaaaa

SEQ ID NO: 625054 - DNA, 20 bp, Artificial Sequence
  chemically synthesized
tagtgttcctagttacagaa

SEQ ID NO: 625055 - DNA, 20 bp, Artificial Sequence
  chemically synthesized
gaaattaaagagtctacagt

SEQ ID NO: 625056 - DNA, 20 bp, Artificial Sequence
  chemically synthesized
aaccctgaaattaaagagtc

SEQ ID NO: 625057 - DNA, 20 bp, Artificial Sequence
  chemically synthesized
atccccattggttgtgacct

SEQ ID NO: 625058 - DNA, 20 bp, Artificial Sequence
  chemically synthesized
aatgtaatgtacgtatttaa

SEQ ID NO: 625059 - DNA, 20 bp, Artificial Sequence
  chemically synthesized
gatagatgctcaattatgaa

SEQ ID NO: 625060 - DNA, 20 bp, Artificial Sequence
  chemically synthesized
agatattccaccttgaaaaa

SEQ ID NO: 625061 - DNA, 20 bp, Artificial Sequence
  chemically synthesized
caaggtggaatatctgagaa

SEQ ID NO: 625062 - DNA, 20 bp, Artificial Sequence
  chemically synthesized
caggacatttgatcagtgaa

SEQ ID NO: 625063 - DNA, 20 bp, Artificial Sequence
  chemically synthesized
actaaatgctcactgcctca

SEQ ID NO: 625064 - DNA, 20 bp, Artificial Sequence
  chemically synthesized
cccaggtgtgttctgcactg

SEQ ID NO: 625065 - DNA, 20 bp, Artificial Sequence
  chemically synthesized
gaaacaactctgttgccact

SEQ ID NO: 625066 - DNA, 20 bp, Artificial Sequence
  chemically synthesized
caagctaacagtggcaacag

SEQ ID NO: 625067 - DNA, 20 bp, Artificial Sequence
  chemically synthesized
tcgttgccttcctggctgtg

SEQ ID NO: 625068 - DNA, 20 bp, Artificial Sequence
  chemically synthesized
attatctttagtgtggccct

SEQ ID NO: 625069 - DNA, 20 bp, Artificial Sequence
  chemically synthesized
atttcatttaatgcctgaga

SEQ ID NO: 625070 - DNA, 20 bp, Artificial Sequence
  chemically synthesized
attagagaaattatttcatt

SEQ ID NO: 625071 - DNA, 20 bp, Artificial Sequence
  chemically synthesized
attatttcatttttggtttt

SEQ ID NO: 625072 - DNA, 20 bp, Artificial Sequence
  chemically synthesized
tttcatttttggtttttttt

SEQ ID NO: 625073 - DNA, 20 bp, Artificial Sequence
  chemically synthesized
atttttggttttttttgctt

SEQ ID NO: 625074 - DNA, 20 bp, Artificial Sequence
  chemically synthesized
ttggttttttttgcttgttt

SEQ ID NO: 625075 - DNA, 20 bp, Artificial Sequence
  chemically synthesized
tttttttgcttgtttgtttg

SEQ ID NO: 625076 - DNA, 20 bp, Artificial Sequence
  chemically synthesized
ttgcttgtttgtttgttttg

SEQ ID NO: 625077 - DNA, 20 bp, Artificial Sequence
  chemically synthesized
actccagcctgggcaacaga

SEQ ID NO: 625078 - DNA, 20 bp, Artificial Sequence
  chemically synthesized
tgcctcagcctcctgaatag

SEQ ID NO: 625079 - DNA, 20 bp, Artificial Sequence
  chemically synthesized
caccacccccagctaatttt

SEQ ID NO: 625080 - DNA, 20 bp, Artificial Sequence
  chemically synthesized
ttttgtagttttagtagaga

SEQ ID NO: 625081 - DNA, 20 bp, Artificial Sequence
  chemically synthesized
ttagtagagacggggcttca

SEQ ID NO: 625082 - DNA, 20 bp, Artificial Sequence
  chemically synthesized
tgacctcatgatctgcccac

SEQ ID NO: 625083 - DNA, 20 bp, Artificial Sequence
  chemically synthesized
caattatctcggtcttcaaa

SEQ ID NO: 625084 - DNA, 20 bp, Artificial Sequence
  chemically synthesized
gctttgtttaagtactaaaa

SEQ ID NO: 625085 - DNA, 20 bp, Artificial Sequence
  chemically synthesized
agtacttaaacaaagcctta

SEQ ID NO: 625086 - DNA, 20 bp, Artificial Sequence
  chemically synthesized
gttcttgaagcagtttaagg

SEQ ID NO: 625087 - DNA, 20 bp, Artificial Sequence
  chemically synthesized
tcagtgttcttgaagcagtt

SEQ ID NO: 625088 - DNA, 20 bp, Artificial Sequence
  chemically synthesized
ttatcattcagtgttcttga

SEQ ID NO: 625089 - DNA, 20 bp, Artificial Sequence
  chemically synthesized
ttttatcaattttagttgaa

SEQ ID NO: 625090 - DNA, 20 bp, Artificial Sequence
  chemically synthesized
cttccttgagtccagttaaa

SEQ ID NO: 625091 - DNA, 20 bp, Artificial Sequence
  chemically synthesized
aaaggactgattcggaatat

SEQ ID NO: 625092 - DNA, 20 bp, Artificial Sequence
  chemically synthesized
cctggctgtcttacttaaag

SEQ ID NO: 625093 - DNA, 20 bp, Artificial Sequence
  chemically synthesized
atgtgacggataggattttg

SEQ ID NO: 625094 - DNA, 20 bp, Artificial Sequence
  chemically synthesized
gcttgtaatggatgtgacgg

SEQ ID NO: 625095 - DNA, 20 bp, Artificial Sequence
  chemically synthesized
tcaggttatctgttacattg

SEQ ID NO: 625096 - DNA, 20 bp, Artificial Sequence
  chemically synthesized
aacctgaattttcttatata

SEQ ID NO: 625097 - DNA, 20 bp, Artificial Sequence
  chemically synthesized
cctattgaaaatttatcata

SEQ ID NO: 625098 - DNA, 20 bp, Artificial Sequence
  chemically synthesized
tggggaaatatttttaattt

SEQ ID NO: 625099 - DNA, 20 bp, Artificial Sequence
  chemically synthesized
atatttaacttctgtactcc

SEQ ID NO: 625100 - DNA, 20 bp, Artificial Sequence
  chemically synthesized
tccattgaatgatatttaca

SEQ ID NO: 625101 - DNA, 20 bp, Artificial Sequence
  chemically synthesized
gccacattaagtagaccaat

SEQ ID NO: 625102 - DNA, 20 bp, Artificial Sequence
  chemically synthesized
actctaattcagaaaatata

SEQ ID NO: 625103 - DNA, 20 bp, Artificial Sequence
  chemically synthesized
tatatgtgactcatcctgaa

SEQ ID NO: 625104 - DNA, 20 bp, Artificial Sequence
  chemically synthesized
gtcttaatttaccaacataa

SEQ ID NO: 625105 - DNA, 20 bp, Artificial Sequence
  chemically synthesized
tgtccattctgtataaatac

SEQ ID NO: 625106 - DNA, 20 bp, Artificial Sequence
  chemically synthesized
aatggtgtgaacccgggagg

SEQ ID NO: 625107 - DNA, 20 bp, Artificial Sequence
  chemically synthesized
ttttgtatttttagtataga

SEQ ID NO: 625108 - DNA, 20 bp, Artificial Sequence
  chemically synthesized
cacctcagcctcccaaagtg

SEQ ID NO: 625109 - DNA, 20 bp, Artificial Sequence
  chemically synthesized
tcatagaaaaaaatggaaaa

SEQ ID NO: 625110 - DNA, 20 bp, Artificial Sequence
  chemically synthesized
ggaaattatcattattttat

SEQ ID NO: 625111 - DNA, 20 bp, Artificial Sequence
  chemically synthesized
attttatttttgttttaaaa

SEQ ID NO: 625112 - DNA, 20 bp, Artificial Sequence
  chemically synthesized
aacatactcctatctgtgaa

SEQ ID NO: 625113 - DNA, 20 bp, Artificial Sequence
  chemically synthesized
tggtctgtaaaaaaatgaca

SEQ ID NO: 625114 - DNA, 20 bp, Artificial Sequence
  chemically synthesized
gaatgtcactttctaatttt

SEQ ID NO: 625115 - DNA, 20 bp, Artificial Sequence
  chemically synthesized
cacaggaataaatgttagaa

SEQ ID NO: 625116 - DNA, 20 bp, Artificial Sequence
  chemically synthesized
ctctaatttagatatgttct

SEQ ID NO: 625117 - DNA, 20 bp, Artificial Sequence
  chemically synthesized
gatttgctgaaacaacccag

SEQ ID NO: 625118 - DNA, 20 bp, Artificial Sequence
  chemically synthesized
ttctggatcaatcatttctg

SEQ ID NO: 625119 - DNA, 20 bp, Artificial Sequence
  chemically synthesized
caatgatttatctaatttgc

SEQ ID NO: 625120 - DNA, 20 bp, Artificial Sequence
  chemically synthesized
ttgattttttaagttgttgc

SEQ ID NO: 625121 - DNA, 20 bp, Artificial Sequence
  chemically synthesized
aataattttaattttcaaat

SEQ ID NO: 625122 - DNA, 20 bp, Artificial Sequence
  chemically synthesized
tttttggtatatagtatgtg

SEQ ID NO: 625123 - DNA, 20 bp, Artificial Sequence
  chemically synthesized
tattggctttatgtttaata

SEQ ID NO: 625124 - DNA, 20 bp, Artificial Sequence
  chemically synthesized
ctgaattgcatttattggct

SEQ ID NO: 625125 - DNA, 20 bp, Artificial Sequence
  chemically synthesized
tcacatgctgaattgcattt

SEQ ID NO: 625126 - DNA, 20 bp, Artificial Sequence
  chemically synthesized
agagggttgtatttattact

SEQ ID NO: 625127 - DNA, 20 bp, Artificial Sequence
  chemically synthesized
catacaaatttctgtcaata

SEQ ID NO: 625128 - DNA, 20 bp, Artificial Sequence
  chemically synthesized
tggaaagttacttattttca

SEQ ID NO: 625129 - DNA, 20 bp, Artificial Sequence
  chemically synthesized
cgataataaagggtggttat

SEQ ID NO: 625130 - DNA, 20 bp, Artificial Sequence
  chemically synthesized
ttatttatttatttttgaga

SEQ ID NO: 625131 - DNA, 20 bp, Artificial Sequence
  chemically synthesized
gaggtggaggtcgcaatgag

SEQ ID NO: 625132 - DNA, 20 bp, Artificial Sequence
  chemically synthesized
tagggaggctgaggcaggag

SEQ ID NO: 625133 - DNA, 20 bp, Artificial Sequence
  chemically synthesized
ttttgtattttcagtagaga

SEQ ID NO: 625134 - DNA, 20 bp, Artificial Sequence
  chemically synthesized
cataagacatacttacataa

SEQ ID NO: 625135 - DNA, 20 bp, Artificial Sequence
  chemically synthesized
gacatacttacataaatttg

SEQ ID NO: 625136 - DNA, 20 bp, Artificial Sequence
  chemically synthesized
caggagtaaggagtgtttgc

SEQ ID NO: 625137 - DNA, 20 bp, Artificial Sequence
  chemically synthesized
tgcatttttgcaggagtaag

SEQ ID NO: 625138 - DNA, 20 bp, Artificial Sequence
  chemically synthesized
ggaatgtttgcaaaagtgca

SEQ ID NO: 625139 - DNA, 20 bp, Artificial Sequence
  chemically synthesized
ttcatttggggagaggtagg

SEQ ID NO: 625140 - DNA, 20 bp, Artificial Sequence
  chemically synthesized
cctctccccaaatgaagtaa

SEQ ID NO: 625141 - DNA, 20 bp, Artificial Sequence
  chemically synthesized
tcatcatttcttttcttttt

SEQ ID NO: 625142 - DNA, 20 bp, Artificial Sequence
  chemically synthesized
agtctttaggaataatatgt

SEQ ID NO: 625143 - DNA, 20 bp, Artificial Sequence
  chemically synthesized
agactaaaattttattttca

SEQ ID NO: 625144 - DNA, 20 bp, Artificial Sequence
  chemically synthesized
aaaattttattttcaatatg

SEQ ID NO: 625145 - DNA, 20 bp, Artificial Sequence
  chemically synthesized
ctgacatttttattaaattt

SEQ ID NO: 625146 - DNA, 20 bp, Artificial Sequence
  chemically synthesized
taaatttattggatttaata

SEQ ID NO: 625147 - DNA, 20 bp, Artificial Sequence
  chemically synthesized
tgggttttttgaattataat

SEQ ID NO: 625148 - DNA, 20 bp, Artificial Sequence
  chemically synthesized
atactgctaacattcatcga

SEQ ID NO: 625149 - DNA, 20 bp, Artificial Sequence
  chemically synthesized
atatatatatatatataatg

SEQ ID NO: 625150 - DNA, 20 bp, Artificial Sequence
  chemically synthesized
caacctttttggcactaggg

SEQ ID NO: 625151 - DNA, 20 bp, Artificial Sequence
  chemically synthesized
aagacaattattccacagac

SEQ ID NO: 625152 - DNA, 20 bp, Artificial Sequence
  chemically synthesized
caaaccacaacccctatacc

SEQ ID NO: 625153 - DNA, 20 bp, Artificial Sequence
  chemically synthesized
aaatctgggggtataggggt

SEQ ID NO: 625154 - DNA, 20 bp, Artificial Sequence
  chemically synthesized
tgcctaatgagctgaggtgg

SEQ ID NO: 625155 - DNA, 20 bp, Artificial Sequence
  chemically synthesized
tccacctcagctcattaggc

SEQ ID NO: 625156 - DNA, 20 bp, Artificial Sequence
  chemically synthesized
cctgtcatatcagtggcagc

SEQ ID NO: 625157 - DNA, 20 bp, Artificial Sequence
  chemically synthesized
aggaggcagagctcaggcag

SEQ ID NO: 625158 - DNA, 20 bp, Artificial Sequence
  chemically synthesized
tatatatgtttgtgatttgt

SEQ ID NO: 625159 - DNA, 20 bp, Artificial Sequence
  chemically synthesized
ttgtatatatgtatatatgt

SEQ ID NO: 625160 - DNA, 20 bp, Artificial Sequence
  chemically synthesized
atgtgtttgtatatatgtat

SEQ ID NO: 625161 - DNA, 20 bp, Artificial Sequence
  chemically synthesized
tagacaatacgtatttatat

SEQ ID NO: 625162 - DNA, 20 bp, Artificial Sequence
  chemically synthesized
ttgtctatttttaattcaag

SEQ ID NO: 625163 - DNA, 20 bp, Artificial Sequence
  chemically synthesized
aagttttggcaaatagaaag

SEQ ID NO: 625164 - DNA, 20 bp, Artificial Sequence
  chemically synthesized
aatagttacttctattctcc

SEQ ID NO: 625165 - DNA, 20 bp, Artificial Sequence
  chemically synthesized
ataattatatttatatttta

SEQ ID NO: 625166 - DNA, 20 bp, Artificial Sequence
  chemically synthesized
atataatttagaatatatag

SEQ ID NO: 625167 - DNA, 20 bp, Artificial Sequence
  chemically synthesized
ggcttagccctacatataaa

SEQ ID NO: 625168 - DNA, 20 bp, Artificial Sequence
  chemically synthesized
gccagaaaatatatatagga

SEQ ID NO: 625169 - DNA, 20 bp, Artificial Sequence
  chemically synthesized
ctaattagcaatggtaaaga

SEQ ID NO: 625170 - DNA, 20 bp, Artificial Sequence
  chemically synthesized
gtaaagatcaagttttacat

SEQ ID NO: 625171 - DNA, 20 bp, Artificial Sequence
  chemically synthesized
acatcaatgctttcaaatca

SEQ ID NO: 625172 - DNA, 20 bp, Artificial Sequence
  chemically synthesized
gcaagtagaaaaaataaaca

SEQ ID NO: 625173 - DNA, 20 bp, Artificial Sequence
  chemically synthesized
aataagataaaggtaattat

SEQ ID NO: 625174 - DNA, 20 bp, Artificial Sequence
  chemically synthesized
gcactaacttaggtcagttt

SEQ ID NO: 625175 - DNA, 20 bp, Artificial Sequence
  chemically synthesized
tatagtacgcactaacttag

SEQ ID NO: 625176 - DNA, 20 bp, Artificial Sequence
  chemically synthesized
agacatagacaaagaaataa

SEQ ID NO: 625177 - DNA, 20 bp, Artificial Sequence
  chemically synthesized
ggaaactggatgggcaggtc

SEQ ID NO: 625178 - DNA, 20 bp, Artificial Sequence
  chemically synthesized
ataaactctagacctgccca

SEQ ID NO: 625179 - DNA, 20 bp, Artificial Sequence
  chemically synthesized
tttgttctttgggatgagta

SEQ ID NO: 625180 - DNA, 20 bp, Artificial Sequence
  chemically synthesized
tactcatcccaaagaacaaa

SEQ ID NO: 625181 - DNA, 20 bp, Artificial Sequence
  chemically synthesized
aacatgattagcctggccaa

SEQ ID NO: 625182 - DNA, 20 bp, Artificial Sequence
  chemically synthesized
gcagaaaaagaacaggatca

SEQ ID NO: 625183 - DNA, 20 bp, Artificial Sequence
  chemically synthesized
gcagaggtagcttttctgtc

SEQ ID NO: 625184 - DNA, 20 bp, Artificial Sequence
  chemically synthesized
catgtagcaaggagtgcaga

SEQ ID NO: 625185 - DNA, 20 bp, Artificial Sequence
  chemically synthesized
tgcagtagatatatgaccaa

SEQ ID NO: 625186 - DNA, 20 bp, Artificial Sequence
  chemically synthesized
atataccattatattaaaaa

SEQ ID NO: 625187 - DNA, 20 bp, Artificial Sequence
  chemically synthesized
tggatattttttatactatc

SEQ ID NO: 625188 - DNA, 20 bp, Artificial Sequence
  chemically synthesized
agccacctgcactgccaacc

SEQ ID NO: 625189 - DNA, 20 bp, Artificial Sequence
  chemically synthesized
aacctgtggttggcagtgca

SEQ ID NO: 625190 - DNA, 20 bp, Artificial Sequence
  chemically synthesized
gaaataaataaataaggaaa

SEQ ID NO: 625191 - DNA, 20 bp, Artificial Sequence
  chemically synthesized
aaataaataaggaaaatatg

SEQ ID NO: 625192 - DNA, 20 bp, Artificial Sequence
  chemically synthesized
ttatttcacacattaacatt

SEQ ID NO: 625193 - DNA, 20 bp, Artificial Sequence
  chemically synthesized
ggggatacccttagagctac

SEQ ID NO: 625194 - DNA, 20 bp, Artificial Sequence
  chemically synthesized
ctacaatagtttacatttac

SEQ ID NO: 625195 - DNA, 20 bp, Artificial Sequence
  chemically synthesized
ttgctttctatttcagttgg

SEQ ID NO: 625196 - DNA, 20 bp, Artificial Sequence
  chemically synthesized
tagtttaagtattgacataa

SEQ ID NO: 625197 - DNA, 20 bp, Artificial Sequence
  chemically synthesized
taacatgttctaaatgcttg

SEQ ID NO: 625198 - DNA, 20 bp, Artificial Sequence
  chemically synthesized
acattttagtaacatgttct

SEQ ID NO: 625199 - DNA, 20 bp, Artificial Sequence
  chemically synthesized
aacatttttataggctacct

SEQ ID NO: 625200 - DNA, 20 bp, Artificial Sequence
  chemically synthesized
atctctgaggtagcctataa

SEQ ID NO: 625201 - DNA, 20 bp, Artificial Sequence
  chemically synthesized
gaggtagcctataaaaatgt

SEQ ID NO: 625202 - DNA, 20 bp, Artificial Sequence
  chemically synthesized
cttgaagatgaagctagaaa

SEQ ID NO: 625203 - DNA, 20 bp, Artificial Sequence
  chemically synthesized
gaacacgagaaaacgctgtt

SEQ ID NO: 625204 - DNA, 20 bp, Artificial Sequence
  chemically synthesized
gcctcttgaacacgagaaaa

SEQ ID NO: 625205 - DNA, 20 bp, Artificial Sequence
  chemically synthesized
ttcactcatttcattctgta

SEQ ID NO: 625206 - DNA, 20 bp, Artificial Sequence
  chemically synthesized
atcatctcaaaatatctgac

SEQ ID NO: 625207 - DNA, 20 bp, Artificial Sequence
  chemically synthesized
agctacagtcagatattttg

SEQ ID NO: 625208 - DNA, 20 bp, Artificial Sequence
  chemically synthesized
ttgttttatttttgtttgtt

SEQ ID NO: 625209 - DNA, 20 bp, Artificial Sequence
  chemically synthesized
ttttgttttgttttattttt

SEQ ID NO: 625210 - DNA, 20 bp, Artificial Sequence
  chemically synthesized
ttgtttttgttttgttttat

SEQ ID NO: 625211 - DNA, 20 bp, Artificial Sequence
  chemically synthesized
tggtagctgccttgtttttg

SEQ ID NO: 625212 - DNA, 20 bp, Artificial Sequence
  chemically synthesized
ctctctggtagctgccttgt

SEQ ID NO: 625213 - DNA, 20 bp, Artificial Sequence
  chemically synthesized
gtatctctctctggtagctg

SEQ ID NO: 625214 - DNA, 20 bp, Artificial Sequence
  chemically synthesized
agctaccagagagagatact

SEQ ID NO: 625215 - DNA, 20 bp, Artificial Sequence
  chemically synthesized
tatccacctcactcacttcc

SEQ ID NO: 625216 - DNA, 20 bp, Artificial Sequence
  chemically synthesized
tgtcttctctctgctctcca

SEQ ID NO: 625217 - DNA, 20 bp, Artificial Sequence
  chemically synthesized
tttaaatgtcatgtccatta

SEQ ID NO: 625218 - DNA, 20 bp, Artificial Sequence
  chemically synthesized
aaagcaaagaatgtagaaca

SEQ ID NO: 625219 - DNA, 20 bp, Artificial Sequence
  chemically synthesized
aaaacttgatgttctacatt

SEQ ID NO: 625220 - DNA, 20 bp, Artificial Sequence
  chemically synthesized
ctaaggctaacatgaatgcc

SEQ ID NO: 625221 - DNA, 20 bp, Artificial Sequence
  chemically synthesized
ctagtcctccctgagaatgt

SEQ ID NO: 625222 - DNA, 20 bp, Artificial Sequence
  chemically synthesized
tggagaggatccaatgccac

SEQ ID NO: 625223 - DNA, 20 bp, Artificial Sequence
  chemically synthesized
taaatgtgtgtgtatgtata

SEQ ID NO: 625224 - DNA, 20 bp, Artificial Sequence
  chemically synthesized
catcacacaaataaccattt

SEQ ID NO: 625225 - DNA, 20 bp, Artificial Sequence
  chemically synthesized
cacaaataaccatttatttg

SEQ ID NO: 625226 - DNA, 20 bp, Artificial Sequence
  chemically synthesized
catttatttgcttagcttaa

SEQ ID NO: 625227 - DNA, 20 bp, Artificial Sequence
  chemically synthesized
ataaatataaatgactgatt

SEQ ID NO: 625228 - DNA, 20 bp, Artificial Sequence
  chemically synthesized
ttttaaatataaatataaat

SEQ ID NO: 625229 - DNA, 20 bp, Artificial Sequence
  chemically synthesized
aaatgtgaaagaaacttctt

SEQ ID NO: 625230 - DNA, 20 bp, Artificial Sequence
  chemically synthesized
ctgtcatatacaaacatgta

SEQ ID NO: 625231 - DNA, 20 bp, Artificial Sequence
  chemically synthesized
agcaacaatgctaaattttt

SEQ ID NO: 625232 - DNA, 20 bp, Artificial Sequence
  chemically synthesized
ttagccaataatactttctg

SEQ ID NO: 625233 - DNA, 20 bp, Artificial Sequence
  chemically synthesized
ttatgatttagttggataat

SEQ ID NO: 625234 - DNA, 20 bp, Artificial Sequence
  chemically synthesized
tggataattctggattatga

SEQ ID NO: 625235 - DNA, 20 bp, Artificial Sequence
  chemically synthesized
gttcgatatttttagtttta

SEQ ID NO: 625236 - DNA, 20 bp, Artificial Sequence
  chemically synthesized
ctctcttgatgttcgatatt

SEQ ID NO: 625237 - DNA, 20 bp, Artificial Sequence
  chemically synthesized
caagagagtatccatctcct

SEQ ID NO: 625238 - DNA, 20 bp, Artificial Sequence
  chemically synthesized
ggtgatgagtatcccaatta

SEQ ID NO: 625239 - DNA, 20 bp, Artificial Sequence
  chemically synthesized
tgaggtcacataagattttg

SEQ ID NO: 625240 - DNA, 20 bp, Artificial Sequence
  chemically synthesized
tgtacatattttgaggtcac

SEQ ID NO: 625241 - DNA, 20 bp, Artificial Sequence
  chemically synthesized
catactaaaatgggttcaag

SEQ ID NO: 625242 - DNA, 20 bp, Artificial Sequence
  chemically synthesized
taatgaatggacatttatct

SEQ ID NO: 625243 - DNA, 20 bp, Artificial Sequence
  chemically synthesized
acatattagttcttgataac

SEQ ID NO: 625244 - DNA, 20 bp, Artificial Sequence
  chemically synthesized
attctatacagcttgtcttt

SEQ ID NO: 625245 - DNA, 20 bp, Artificial Sequence
  chemically synthesized
ttcttccactttaaattcta

SEQ ID NO: 625246 - DNA, 20 bp, Artificial Sequence
  chemically synthesized
ggaagaatttattatagagt

SEQ ID NO: 625247 - DNA, 20 bp, Artificial Sequence
  chemically synthesized
tttagcattaataaaatgga

SEQ ID NO: 625248 - DNA, 20 bp, Artificial Sequence
  chemically synthesized
aaattcactcattgaaattt

SEQ ID NO: 625249 - DNA, 20 bp, Artificial Sequence
  chemically synthesized
ctgtagactgtggagatatt

SEQ ID NO: 625250 - DNA, 20 bp, Artificial Sequence
  chemically synthesized
gtttaactgaagaaaatctg

SEQ ID NO: 625251 - DNA, 20 bp, Artificial Sequence
  chemically synthesized
atggatgagaagtaaagcta

SEQ ID NO: 625252 - DNA, 20 bp, Artificial Sequence
  chemically synthesized
tcatccattaaatagagcaa

SEQ ID NO: 625253 - DNA, 20 bp, Artificial Sequence
  chemically synthesized
cggtgatatttttacttcat

SEQ ID NO: 625254 - DNA, 20 bp, Artificial Sequence
  chemically synthesized
tcattagtatttatggattt

SEQ ID NO: 625255 - DNA, 20 bp, Artificial Sequence
  chemically synthesized
tgaaaaatttcattagtatt

SEQ ID NO: 625256 - DNA, 20 bp, Artificial Sequence
  chemically synthesized
tgataactaagaatggggat

SEQ ID NO: 625257 - DNA, 20 bp, Artificial Sequence
  chemically synthesized
caaaaattgataactaagaa

SEQ ID NO: 625258 - DNA, 20 bp, Artificial Sequence
  chemically synthesized
gctaattaatgatgggattt

SEQ ID NO: 625259 - DNA, 20 bp, Artificial Sequence
  chemically synthesized
agagctattgctaattaatg

SEQ ID NO: 625260 - DNA, 20 bp, Artificial Sequence
  chemically synthesized
gctctttattaatattttaa

SEQ ID NO: 625261 - DNA, 20 bp, Artificial Sequence
  chemically synthesized
gacattaggcatattaagag

SEQ ID NO: 625262 - DNA, 20 bp, Artificial Sequence
  chemically synthesized
atcatgacattaggcatatt

SEQ ID NO: 625263 - DNA, 20 bp, Artificial Sequence
  chemically synthesized
taagctattttcttttaatg

SEQ ID NO: 625264 - DNA, 20 bp, Artificial Sequence
  chemically synthesized
gaaactagccattaaaagaa

SEQ ID NO: 625265 - DNA, 20 bp, Artificial Sequence
  chemically synthesized
taacggtgaaattttctgct

SEQ ID NO: 625266 - DNA, 20 bp, Artificial Sequence
  chemically synthesized
aatatgttcccgatattctt

SEQ ID NO: 625267 - DNA, 20 bp, Artificial Sequence
  chemically synthesized
attaccagtactgttaaaat

SEQ ID NO: 625268 - DNA, 20 bp, Artificial Sequence
  chemically synthesized
ctatattttaacagtactgg

SEQ ID NO: 625269 - DNA, 20 bp, Artificial Sequence
  chemically synthesized
taatgcttaattatacacaa

SEQ ID NO: 625270 - DNA, 20 bp, Artificial Sequence
  chemically synthesized
atttgctttatttcacatca

SEQ ID NO: 625271 - DNA, 20 bp, Artificial Sequence
  chemically synthesized
ctttatttcacatcacaagg

SEQ ID NO: 625272 - DNA, 20 bp, Artificial Sequence
  chemically synthesized
tgtttgtctggagcatacac

SEQ ID NO: 625273 - DNA, 20 bp, Artificial Sequence
  chemically synthesized
acactgtacagttctttttg

SEQ ID NO: 625274 - DNA, 20 bp, Artificial Sequence
  chemically synthesized
agttctttttgttacgattt

SEQ ID NO: 625275 - DNA, 20 bp, Artificial Sequence
  chemically synthesized
tacgatttggatgcttttaa

SEQ ID NO: 625276 - DNA, 20 bp, Artificial Sequence
  chemically synthesized
gagattttaaatatttgctc

SEQ ID NO: 625277 - DNA, 20 bp, Artificial Sequence
  chemically synthesized
tatcatatcttttttcaagt

SEQ ID NO: 625278 - DNA, 20 bp, Artificial Sequence
  chemically synthesized
aaattgtattaacaaattct

SEQ ID NO: 625279 - DNA, 20 bp, Artificial Sequence
  chemically synthesized
aaaaattttcacttgcgacc

SEQ ID NO: 625280 - DNA, 20 bp, Artificial Sequence
  chemically synthesized
tgtcaattaaaattgatttc

SEQ ID NO: 625281 - DNA, 20 bp, Artificial Sequence
  chemically synthesized
atcttaaagttgtcaattaa

SEQ ID NO: 625282 - DNA, 20 bp, Artificial Sequence
  chemically synthesized
atcaattttaattgacaact

SEQ ID NO: 625283 - DNA, 20 bp, Artificial Sequence
  chemically synthesized
ttaagatttattatttgatg

SEQ ID NO: 625284 - DNA, 20 bp, Artificial Sequence
  chemically synthesized
attttagcatgctgtttttt

SEQ ID NO: 625285 - DNA, 20 bp, Artificial Sequence
  chemically synthesized
ataagatttacattttagca

SEQ ID NO: 625286 - DNA, 20 bp, Artificial Sequence
  chemically synthesized
taaaatgtaaatcttataca

SEQ ID NO: 625287 - DNA, 20 bp, Artificial Sequence
  chemically synthesized
atgtaaatcttatacagact

SEQ ID NO: 625288 - DNA, 20 bp, Artificial Sequence
  chemically synthesized
taccaaagcaatcagtctgt

SEQ ID NO: 625289 - DNA, 20 bp, Artificial Sequence
  chemically synthesized
aaataataagagttattaaa

SEQ ID NO: 625290 - DNA, 20 bp, Artificial Sequence
  chemically synthesized
caaattttgggtttttctaa

SEQ ID NO: 625291 - DNA, 20 bp, Artificial Sequence
  chemically synthesized
tagaaaaacccaaaatttgg

SEQ ID NO: 625292 - DNA, 20 bp, Artificial Sequence
  chemically synthesized
tcctcaatcttgtccaaatt

SEQ ID NO: 625293 - DNA, 20 bp, Artificial Sequence
  chemically synthesized
ggacaagattgaggaacaaa

SEQ ID NO: 625294 - DNA, 20 bp, Artificial Sequence
  chemically synthesized
gaacaaaggtggttttggat

SEQ ID NO: 625295 - DNA, 20 bp, Artificial Sequence
  chemically synthesized
aaggtggttttggataaagg

SEQ ID NO: 625296 - DNA, 20 bp, Artificial Sequence
  chemically synthesized
caaaatgtgatggtctattc

SEQ ID NO: 625297 - DNA, 20 bp, Artificial Sequence
  chemically synthesized
aatatcttttaggttactaa

SEQ ID NO: 625298 - DNA, 20 bp, Artificial Sequence
  chemically synthesized
tagtaacctaaaagatattt

SEQ ID NO: 625299 - DNA, 20 bp, Artificial Sequence
  chemically synthesized
atatttgaatgattttaaga

SEQ ID NO: 625300 - DNA, 20 bp, Artificial Sequence
  chemically synthesized
attacttttgaatatctatt

SEQ ID NO: 625301 - DNA, 20 bp, Artificial Sequence
  chemically synthesized
tatcacttactgtgcattct

SEQ ID NO: 625302 - DNA, 20 bp, Artificial Sequence
  chemically synthesized
aatgacatttgctcaatgtc

SEQ ID NO: 625303 - DNA, 20 bp, Artificial Sequence
  chemically synthesized
acttagatttgttaaatatg

SEQ ID NO: 625304 - DNA, 20 bp, Artificial Sequence
  chemically synthesized
gaattccccttggacttcca

SEQ ID NO: 625305 - DNA, 20 bp, Artificial Sequence
  chemically synthesized
gactacattcagtataacag

SEQ ID NO: 625306 - DNA, 20 bp, Artificial Sequence
  chemically synthesized
catttctaaataaatgtggg

SEQ ID NO: 625307 - DNA, 20 bp, Artificial Sequence
  chemically synthesized
agacggaataacaatgctaa

SEQ ID NO: 625308 - DNA, 20 bp, Artificial Sequence
  chemically synthesized
ttataggaaaggtactccag

SEQ ID NO: 625309 - DNA, 20 bp, Artificial Sequence
  chemically synthesized
agtttgactaatattagtaa

SEQ ID NO: 625310 - DNA, 20 bp, Artificial Sequence
  chemically synthesized
tataaatccgatttatatgg

SEQ ID NO: 625311 - DNA, 20 bp, Artificial Sequence
  chemically synthesized
agtcaaacttgaccatataa

SEQ ID NO: 625312 - DNA, 20 bp, Artificial Sequence
  chemically synthesized
ttaagatatggattatataa

SEQ ID NO: 625313 - DNA, 20 bp, Artificial Sequence
  chemically synthesized
aagaagttagaattttaaga

SEQ ID NO: 625314 - DNA, 20 bp, Artificial Sequence
  chemically synthesized
ctaacttcttaacaaatacc

SEQ ID NO: 625315 - DNA, 20 bp, Artificial Sequence
  chemically synthesized
ctctcagtgttcttttcatc

SEQ ID NO: 625316 - DNA, 20 bp, Artificial Sequence
  chemically synthesized
gatgaaaagaacactgagag

SEQ ID NO: 625317 - DNA, 20 bp, Artificial Sequence
  chemically synthesized
ggtttagaagcaggatatat

SEQ ID NO: 625318 - DNA, 20 bp, Artificial Sequence
  chemically synthesized
gcatcaaaatcatacatata

SEQ ID NO: 625319 - DNA, 20 bp, Artificial Sequence
  chemically synthesized
gcaggatatatgtatgattt

SEQ ID NO: 625320 - DNA, 20 bp, Artificial Sequence
  chemically synthesized
aaacacagaggtgaattgtc

SEQ ID NO: 625321 - DNA, 20 bp, Artificial Sequence
  chemically synthesized
aagccttggacaattcacct

SEQ ID NO: 625322 - DNA, 20 bp, Artificial Sequence
  chemically synthesized
acaattcacctctgtgtttc

SEQ ID NO: 625323 - DNA, 20 bp, Artificial Sequence
  chemically synthesized
ttcttttgagagatcatcta

SEQ ID NO: 625324 - DNA, 20 bp, Artificial Sequence
  chemically synthesized
aaaggcaggacacagaaaaa

SEQ ID NO: 625325 - DNA, 20 bp, Artificial Sequence
  chemically synthesized
ataagatcaaagaagaaaat

SEQ ID NO: 625326 - DNA, 20 bp, Artificial Sequence
  chemically synthesized
ttttatcaaattggctttgt

SEQ ID NO: 625327 - DNA, 20 bp, Artificial Sequence
  chemically synthesized
gtgatattttatcaaattgg

SEQ ID NO: 625328 - DNA, 20 bp, Artificial Sequence
  chemically synthesized
agaatgtgatattttatcaa

SEQ ID NO: 625329 - DNA, 20 bp, Artificial Sequence
  chemically synthesized
taaaatatcacattctctat

SEQ ID NO: 625330 - DNA, 20 bp, Artificial Sequence
  chemically synthesized
tctgagctgttacaaaagtg

SEQ ID NO: 625331 - DNA, 20 bp, Artificial Sequence
  chemically synthesized
aagtttttctttcttcatgc

SEQ ID NO: 625332 - DNA, 20 bp, Artificial Sequence
  chemically synthesized
ttagactcctacacaagttg

SEQ ID NO: 625333 - DNA, 20 bp, Artificial Sequence
  chemically synthesized
ttagtattgacagtctgacc

SEQ ID NO: 625334 - DNA, 20 bp, Artificial Sequence
  chemically synthesized
gtctgaccatgggtttgagt

SEQ ID NO: 625335 - DNA, 20 bp, Artificial Sequence
  chemically synthesized
accatgggtttgagtgaaag

SEQ ID NO: 625336 - DNA, 20 bp, Artificial Sequence
  chemically synthesized
agtttagattttgtagatac

SEQ ID NO: 625337 - DNA, 20 bp, Artificial Sequence
  chemically synthesized
tataaagtataactgagctt

SEQ ID NO: 625338 - DNA, 20 bp, Artificial Sequence
  chemically synthesized
ataaatattataaagtataa

SEQ ID NO: 625339 - DNA, 20 bp, Artificial Sequence
  chemically synthesized
tcagttatactttataatat

SEQ ID NO: 625340 - DNA, 20 bp, Artificial Sequence
  chemically synthesized
agaaatatatgtaaagactt

SEQ ID NO: 625341 - DNA, 20 bp, Artificial Sequence
  chemically synthesized
tcagagaaggtgataatatt

SEQ ID NO: 625342 - DNA, 20 bp, Artificial Sequence
  chemically synthesized
atccatatgatgtatagcat

SEQ ID NO: 625343 - DNA, 20 bp, Artificial Sequence
  chemically synthesized
aaattatctggcaagaaatt

SEQ ID NO: 625344 - DNA, 20 bp, Artificial Sequence
  chemically synthesized
ttcttgccagataattttga

SEQ ID NO: 625345 - DNA, 20 bp, Artificial Sequence
  chemically synthesized
tttattatatcatgactact

SEQ ID NO: 625346 - DNA, 20 bp, Artificial Sequence
  chemically synthesized
aaagtataatagacaattcc

SEQ ID NO: 625347 - DNA, 20 bp, Artificial Sequence
  chemically synthesized
acagtcacagaaagaggaaa

SEQ ID NO: 625348 - DNA, 20 bp, Artificial Sequence
  chemically synthesized
acagaaagaggaaattatgc

SEQ ID NO: 625349 - DNA, 20 bp, Artificial Sequence
  chemically synthesized
aaatattaagagaaatgtaa

SEQ ID NO: 625350 - DNA, 20 bp, Artificial Sequence
  chemically synthesized
taatatttttcctagaaaag

SEQ ID NO: 625351 - DNA, 20 bp, Artificial Sequence
  chemically synthesized
tttcctagaaaagcgtggct

SEQ ID NO: 625352 - DNA, 20 bp, Artificial Sequence
  chemically synthesized
ttaatcaaataagctagaag

SEQ ID NO: 625353 - DNA, 20 bp, Artificial Sequence
  chemically synthesized
aaaagcgtggcttctagctt

SEQ ID NO: 625354 - DNA, 20 bp, Artificial Sequence
  chemically synthesized
gaacagaataaaaagatttt

SEQ ID NO: 625355 - DNA, 20 bp, Artificial Sequence
  chemically synthesized
tctcatcctagaacagaata

SEQ ID NO: 625356 - DNA, 20 bp, Artificial Sequence
  chemically synthesized
aatcaagattaatgtatagt

SEQ ID NO: 625357 - DNA, 20 bp, Artificial Sequence
  chemically synthesized
aatcataaactatacattaa

SEQ ID NO: 625358 - DNA, 20 bp, Artificial Sequence
  chemically synthesized
attttaaatcaagattaatg

SEQ ID NO: 625359 - DNA, 20 bp, Artificial Sequence
  chemically synthesized
aagtaggtttctattttaaa

SEQ ID NO: 625360 - DNA, 20 bp, Artificial Sequence
  chemically synthesized
tgtacattctcggttgaaaa

SEQ ID NO: 625361 - DNA, 20 bp, Artificial Sequence
  chemically synthesized
acaaaaaatgagaatttaat

SEQ ID NO: 625362 - DNA, 20 bp, Artificial Sequence
  chemically synthesized
acatttattaaattctcatt

SEQ ID NO: 625363 - DNA, 20 bp, Artificial Sequence
  chemically synthesized
tcttactcaaaataattcac

SEQ ID NO: 625364 - DNA, 20 bp, Artificial Sequence
  chemically synthesized
caattattaaatggcaagtg

SEQ ID NO: 625365 - DNA, 20 bp, Artificial Sequence
  chemically synthesized
tttcctgttacttcctataa

SEQ ID NO: 625366 - DNA, 20 bp, Artificial Sequence
  chemically synthesized
tcaagatgtgttactccgtt

SEQ ID NO: 625367 - DNA, 20 bp, Artificial Sequence
  chemically synthesized
gatcacaccaaaagagcaag

SEQ ID NO: 625368 - DNA, 20 bp, Artificial Sequence
  chemically synthesized
ttgctcttttggtgtgatca

SEQ ID NO: 625369 - DNA, 20 bp, Artificial Sequence
  chemically synthesized
agcaccttctttcctacagt

SEQ ID NO: 625370 - DNA, 20 bp, Artificial Sequence
  chemically synthesized
tgtttagaatatagaagggt

SEQ ID NO: 625371 - DNA, 20 bp, Artificial Sequence
  chemically synthesized
tttttatgtttagaatatag

SEQ ID NO: 625372 - DNA, 20 bp, Artificial Sequence
  chemically synthesized
atattctaaacataaaaaat

SEQ ID NO: 625373 - DNA, 20 bp, Artificial Sequence
  chemically synthesized
tgagaaaaaacttttatttt

SEQ ID NO: 625374 - DNA, 20 bp, Artificial Sequence
  chemically synthesized
aagttttttctcaatatggt

SEQ ID NO: 625375 - DNA, 20 bp, Artificial Sequence
  chemically synthesized
tgagtcttttgctgaaacca

SEQ ID NO: 625376 - DNA, 20 bp, Artificial Sequence
  chemically synthesized
gagcttattaggaaaatcac

SEQ ID NO: 625377 - DNA, 20 bp, Artificial Sequence
  chemically synthesized
ctgttggatcacttagcatg

SEQ ID NO: 625378 - DNA, 20 bp, Artificial Sequence
  chemically synthesized
taagtgatccaacagaattg

SEQ ID NO: 625379 - DNA, 20 bp, Artificial Sequence
  chemically synthesized
gacagaaacgctctttcaat

SEQ ID NO: 625380 - DNA, 20 bp, Artificial Sequence
  chemically synthesized
ggaataaaccaccattgaaa

SEQ ID NO: 625381 - DNA, 20 bp, Artificial Sequence
  chemically synthesized
tttcaatggtggtttattcc

SEQ ID NO: 625382 - DNA, 20 bp, Artificial Sequence
  chemically synthesized
cttattcaattatgataatt

SEQ ID NO: 625383 - DNA, 20 bp, Artificial Sequence
  chemically synthesized
ggtatcacatagtttcatca

SEQ ID NO: 625384 - DNA, 20 bp, Artificial Sequence
  chemically synthesized
ttgcttctaatatggtatca

SEQ ID NO: 625385 - DNA, 20 bp, Artificial Sequence
  chemically synthesized
atggatctctaataccttgg

SEQ ID NO: 625386 - DNA, 20 bp, Artificial Sequence
  chemically synthesized
ggaaaaatataactgtgcaa

SEQ ID NO: 625387 - DNA, 20 bp, Artificial Sequence
  chemically synthesized
ttttgcacagttatattttt

SEQ ID NO: 625388 - DNA, 20 bp, Artificial Sequence
  chemically synthesized
tttttccaagcttcttgtcc

SEQ ID NO: 625389 - DNA, 20 bp, Artificial Sequence
  chemically synthesized
ctaactaaatctgaaggaca

SEQ ID NO: 625390 - DNA, 20 bp, Artificial Sequence
  chemically synthesized
ctatggcaccttcagtgata

SEQ ID NO: 625391 - DNA, 20 bp, Artificial Sequence
  chemically synthesized
ctggcttgatctttagatac

SEQ ID NO: 625392 - DNA, 20 bp, Artificial Sequence
  chemically synthesized
tgtatctaaagatcaagcca

SEQ ID NO: 625393 - DNA, 20 bp, Artificial Sequence
  chemically synthesized
atctaatgtttgaaaagcat

SEQ ID NO: 625394 - DNA, 20 bp, Artificial Sequence
  chemically synthesized
gaattgctttgggaaggatc

SEQ ID NO: 625395 - DNA, 20 bp, Artificial Sequence
  chemically synthesized
tggaaactggttacacaaag

SEQ ID NO: 625396 - DNA, 20 bp, Artificial Sequence
  chemically synthesized
ccaaagcaattctttgtgta

SEQ ID NO: 625397 - DNA, 20 bp, Artificial Sequence
  chemically synthesized
aaagtctgaggaaaaatttc

SEQ ID NO: 625398 - DNA, 20 bp, Artificial Sequence
  chemically synthesized
gtaataaatatacaaatcac

SEQ ID NO: 625399 - DNA, 20 bp, Artificial Sequence
  chemically synthesized
aaaacattgtgctgaaacaa

SEQ ID NO: 625400 - DNA, 20 bp, Artificial Sequence
  chemically synthesized
aaatcactattgtttcagca

SEQ ID NO: 625401 - DNA, 20 bp, Artificial Sequence
  chemically synthesized
ttcacttcagaattttaata

SEQ ID NO: 625402 - DNA, 20 bp, Artificial Sequence
  chemically synthesized
ctcattacattctatattgt

SEQ ID NO: 625403 - DNA, 20 bp, Artificial Sequence
  chemically synthesized
tcactttaaaagatccgcta

SEQ ID NO: 625404 - DNA, 20 bp, Artificial Sequence
  chemically synthesized
gtataactataccaaagtgt

SEQ ID NO: 625405 - DNA, 20 bp, Artificial Sequence
  chemically synthesized
ccggtttggaaacatagtgt

SEQ ID NO: 625406 - DNA, 20 bp, Artificial Sequence
  chemically synthesized
aatatttttaaacatttaca

SEQ ID NO: 625407 - DNA, 20 bp, Artificial Sequence
  chemically synthesized
tggtggttctgtaactgatg

SEQ ID NO: 625408 - DNA, 20 bp, Artificial Sequence
  chemically synthesized
tttgttggtggttctgtaac

SEQ ID NO: 625409 - DNA, 20 bp, Artificial Sequence
  chemically synthesized
acaaaagttctgctactaca

SEQ ID NO: 625410 - DNA, 20 bp, Artificial Sequence
  chemically synthesized
aatgtttagtacgttgtttg

SEQ ID NO: 625411 - DNA, 20 bp, Artificial Sequence
  chemically synthesized
ttattccaaaatgtttagta

SEQ ID NO: 625412 - DNA, 20 bp, Artificial Sequence
  chemically synthesized
aatattgaaaaattattcca

SEQ ID NO: 625413 - DNA, 20 bp, Artificial Sequence
  chemically synthesized
ttttcaatattattattacc

SEQ ID NO: 625414 - DNA, 20 bp, Artificial Sequence
  chemically synthesized
tctgatttgttcttagactt

SEQ ID NO: 625415 - DNA, 20 bp, Artificial Sequence
  chemically synthesized
tcaaagcaatatttttagaa

SEQ ID NO: 625416 - DNA, 20 bp, Artificial Sequence
  chemically synthesized
tggaaacctttttctaaaaa

SEQ ID NO: 625417 - DNA, 20 bp, Artificial Sequence
  chemically synthesized
tcttctgtcattttgttgcc

SEQ ID NO: 625418 - DNA, 20 bp, Artificial Sequence
  chemically synthesized
atatatgatattccaagacc

SEQ ID NO: 625419 - DNA, 20 bp, Artificial Sequence
  chemically synthesized
ttttacacagtcactcctac

SEQ ID NO: 625420 - DNA, 20 bp, Artificial Sequence
  chemically synthesized
gatgatcctacagttatgag

SEQ ID NO: 625421 - DNA, 20 bp, Artificial Sequence
  chemically synthesized
ctgtaggatcatctgccgct

SEQ ID NO: 625422 - DNA, 20 bp, Artificial Sequence
  chemically synthesized
ctagacagtcctgctccagc

SEQ ID NO: 625423 - DNA, 20 bp, Artificial Sequence
  chemically synthesized
aggactgtctagactttggt

SEQ ID NO: 625424 - DNA, 20 bp, Artificial Sequence
  chemically synthesized
gacaaattagcaaacatata

SEQ ID NO: 625425 - DNA, 20 bp, Artificial Sequence
  chemically synthesized
gctgttattcaaagcctcat

SEQ ID NO: 625426 - DNA, 20 bp, Artificial Sequence
  chemically synthesized
cttcaaacaagtatattaag

SEQ ID NO: 625427 - DNA, 20 bp, Artificial Sequence
  chemically synthesized
gacaaaacttatcttaatat

SEQ ID NO: 625428 - DNA, 20 bp, Artificial Sequence
  chemically synthesized
taatatacttgtttgaagat

SEQ ID NO: 625429 - DNA, 20 bp, Artificial Sequence
  chemically synthesized
aaaggaagctcatgagcata

SEQ ID NO: 625430 - DNA, 20 bp, Artificial Sequence
  chemically synthesized
cagtaaagcgccatatgctc

SEQ ID NO: 625431 - DNA, 20 bp, Artificial Sequence
  chemically synthesized
tgagcatatggcgctttact

SEQ ID NO: 625432 - DNA, 20 bp, Artificial Sequence
  chemically synthesized
tttaaaaaattgtgctaaaa

SEQ ID NO: 625433 - DNA, 20 bp, Artificial Sequence
  chemically synthesized
aaaacatttactaggacaaa

SEQ ID NO: 625434 - DNA, 20 bp, Artificial Sequence
  chemically synthesized
aaaacatgttttgtcctagt

SEQ ID NO: 625435 - DNA, 20 bp, Artificial Sequence
  chemically synthesized
aatgtttttttaaaaataga

SEQ ID NO: 625436 - DNA, 20 bp, Artificial Sequence
  chemically synthesized
aaatagactttgttttttag

SEQ ID NO: 625437 - DNA, 20 bp, Artificial Sequence
  chemically synthesized
caggactaagtggaaggaag

SEQ ID NO: 625438 - DNA, 20 bp, Artificial Sequence
  chemically synthesized
accatctagccctacgaaca

SEQ ID NO: 625439 - DNA, 20 bp, Artificial Sequence
  chemically synthesized
tgtaacataccattgtggta

SEQ ID NO: 625440 - DNA, 20 bp, Artificial Sequence
  chemically synthesized
atacaatgtcagccaaagtc

SEQ ID NO: 625441 - DNA, 20 bp, Artificial Sequence
  chemically synthesized
gccaaagtccatagattaca

SEQ ID NO: 625442 - DNA, 20 bp, Artificial Sequence
  chemically synthesized
cactcagtgttgtacatgct

SEQ ID NO: 625443 - DNA, 20 bp, Artificial Sequence
  chemically synthesized
agatttgagatgttcaacct

SEQ ID NO: 625444 - DNA, 20 bp, Artificial Sequence
  chemically synthesized
gagcatttgaattttagatt

SEQ ID NO: 625445 - DNA, 20 bp, Artificial Sequence
  chemically synthesized
gaattttggagcatttgaat

SEQ ID NO: 625446 - DNA, 20 bp, Artificial Sequence
  chemically synthesized
ggacatcttatcagcacttc

SEQ ID NO: 625447 - DNA, 20 bp, Artificial Sequence
  chemically synthesized
tccaaaatgctccaatgagc

SEQ ID NO: 625448 - DNA, 20 bp, Artificial Sequence
  chemically synthesized
gcaaatgctcattggagcat

SEQ ID NO: 625449 - DNA, 20 bp, Artificial Sequence
  chemically synthesized
agcattttggatttcaaatt

SEQ ID NO: 625450 - DNA, 20 bp, Artificial Sequence
  chemically synthesized
tttttttttttggggggggg

SEQ ID NO: 625451 - DNA, 20 bp, Artificial Sequence
  chemically synthesized
atgcttgcgaccagaagtgt

SEQ ID NO: 625452 - DNA, 20 bp, Artificial Sequence
  chemically synthesized
tccgaaatgcttgcgaccag

SEQ ID NO: 625453 - DNA, 20 bp, Artificial Sequence
  chemically synthesized
cagtgattatatattatccg

SEQ ID NO: 625454 - DNA, 20 bp, Artificial Sequence
  chemically synthesized
attacagaagatctttaagg

SEQ ID NO: 625455 - DNA, 20 bp, Artificial Sequence
  chemically synthesized
ggcaggaggtggaatgtata

SEQ ID NO: 625456 - DNA, 20 bp, Artificial Sequence
  chemically synthesized
ggcaaccactgaaaccactc

SEQ ID NO: 625457 - DNA, 20 bp, Artificial Sequence
  chemically synthesized
atgatcacagtaaacagatg

SEQ ID NO: 625458 - DNA, 20 bp, Artificial Sequence
  chemically synthesized
actcatctgtttactgtgat

SEQ ID NO: 625459 - DNA, 20 bp, Artificial Sequence
  chemically synthesized
acagtatgtaaccctttcaa

SEQ ID NO: 625460 - DNA, 20 bp, Artificial Sequence
  chemically synthesized
catatttgttggtctttttt

SEQ ID NO: 625461 - DNA, 20 bp, Artificial Sequence
  chemically synthesized
cattcactcacctatggaag

SEQ ID NO: 625462 - DNA, 20 bp, Artificial Sequence
  chemically synthesized
cactcacctatggaaggaga

SEQ ID NO: 625463 - DNA, 20 bp, Artificial Sequence
  chemically synthesized
cacctatggaaggagagctt

SEQ ID NO: 625464 - DNA, 20 bp, Artificial Sequence
  chemically synthesized
gaaggagagcttgattgttt

SEQ ID NO: 625465 - DNA, 20 bp, Artificial Sequence
  chemically synthesized
ataattataaatatttgcac

SEQ ID NO: 625466 - DNA, 20 bp, Artificial Sequence
  chemically synthesized
gcactcaggtttttgtgtgg

SEQ ID NO: 625467 - DNA, 20 bp, Artificial Sequence
  chemically synthesized
ggtttttgtgtggatatgtt

SEQ ID NO: 625468 - DNA, 20 bp, Artificial Sequence
  chemically synthesized
actccttggtatttacccag

SEQ ID NO: 625469 - DNA, 20 bp, Artificial Sequence
  chemically synthesized
tgctagatcatatgataagt

SEQ ID NO: 625470 - DNA, 20 bp, Artificial Sequence
  chemically synthesized
gatcatatgataagtgtgtg

SEQ ID NO: 625471 - DNA, 20 bp, Artificial Sequence
  chemically synthesized
agttttgtgagaaactgcca

SEQ ID NO: 625472 - DNA, 20 bp, Artificial Sequence
  chemically synthesized
gcctctttggaaaacaattt

SEQ ID NO: 625473 - DNA, 20 bp, Artificial Sequence
  chemically synthesized
tgcattcccaccagcaatga

SEQ ID NO: 625474 - DNA, 20 bp, Artificial Sequence
  chemically synthesized
tggtcagcatttgatgttgt

SEQ ID NO: 625475 - DNA, 20 bp, Artificial Sequence
  chemically synthesized
gcatttgatgttgtcagtgt

SEQ ID NO: 625476 - DNA, 20 bp, Artificial Sequence
  chemically synthesized
tggattttggccattctaag

SEQ ID NO: 625477 - DNA, 20 bp, Artificial Sequence
  chemically synthesized
atatttttaagtaacaataa

SEQ ID NO: 625478 - DNA, 20 bp, Artificial Sequence
  chemically synthesized
acaataatgatgctttctta

SEQ ID NO: 625479 - DNA, 20 bp, Artificial Sequence
  chemically synthesized
tttggattttaggagtgtgt

SEQ ID NO: 625480 - DNA, 20 bp, Artificial Sequence
  chemically synthesized
acatgcactcctgttcagta

SEQ ID NO: 625481 - DNA, 20 bp, Artificial Sequence
  chemically synthesized
tgttttgagaacacatcact

SEQ ID NO: 625482 - DNA, 20 bp, Artificial Sequence
  chemically synthesized
cgctaattttaattctctga

SEQ ID NO: 625483 - DNA, 20 bp, Artificial Sequence
  chemically synthesized
tatccctttaaaaggtatct

SEQ ID NO: 625484 - DNA, 20 bp, Artificial Sequence
  chemically synthesized
attactgttacaaaatatag

SEQ ID NO: 625485 - DNA, 20 bp, Artificial Sequence
  chemically synthesized
aattctcagtgaggcatttg

SEQ ID NO: 625486 - DNA, 20 bp, Artificial Sequence
  chemically synthesized
gaatttaaaaagtattttgt

SEQ ID NO: 625487 - DNA, 20 bp, Artificial Sequence
  chemically synthesized
ttaatcccatttcacttttg

SEQ ID NO: 625488 - DNA, 20 bp, Artificial Sequence
  chemically synthesized
aaaagcctatcaaaagtgaa

SEQ ID NO: 625489 - DNA, 20 bp, Artificial Sequence
  chemically synthesized
ctattacacattcttattca

SEQ ID NO: 625490 - DNA, 20 bp, Artificial Sequence
  chemically synthesized
aggagacacacaggcataga

SEQ ID NO: 625491 - DNA, 20 bp, Artificial Sequence
  chemically synthesized
ctgtgtgtctcctaaacagt

SEQ ID NO: 625492 - DNA, 20 bp, Artificial Sequence
  chemically synthesized
caaatattaattgaatcaat

SEQ ID NO: 625493 - DNA, 20 bp, Artificial Sequence
  chemically synthesized
gattcaattaatatttgtgg

SEQ ID NO: 625494 - DNA, 20 bp, Artificial Sequence
  chemically synthesized
acctgttttccagctatcat

SEQ ID NO: 625495 - DNA, 20 bp, Artificial Sequence
  chemically synthesized
ctgttgtgtgtgtaagtgtg

SEQ ID NO: 625496 - DNA, 20 bp, Artificial Sequence
  chemically synthesized
atacataaaaacaattaaaa

SEQ ID NO: 625497 - DNA, 20 bp, Artificial Sequence
  chemically synthesized
tcttattaaagctgaatttt

SEQ ID NO: 625498 - DNA, 20 bp, Artificial Sequence
  chemically synthesized
gctttaataagagaaacctc

SEQ ID NO: 625499 - DNA, 20 bp, Artificial Sequence
  chemically synthesized
aataagagaaacctctggtg

SEQ ID NO: 625500 - DNA, 20 bp, Artificial Sequence
  chemically synthesized
ttaacataaaaccaaacacc

SEQ ID NO: 625501 - DNA, 20 bp, Artificial Sequence
  chemically synthesized
ttttccctaaacataatgat

SEQ ID NO: 625502 - DNA, 20 bp, Artificial Sequence
  chemically synthesized
tagaagacaaactaggatca

SEQ ID NO: 625503 - DNA, 20 bp, Artificial Sequence
  chemically synthesized
ttagtagtatatgcctgaat

SEQ ID NO: 625504 - DNA, 20 bp, Artificial Sequence
  chemically synthesized
ttgtaaagtcaataaataac

SEQ ID NO: 625505 - DNA, 20 bp, Artificial Sequence
  chemically synthesized
catcttaactgaagaggttt

SEQ ID NO: 625506 - DNA, 20 bp, Artificial Sequence
  chemically synthesized
ttccatgccatcttaactga

SEQ ID NO: 625507 - DNA, 20 bp, Artificial Sequence
  chemically synthesized
gtgtctgatatgtggaggtg

SEQ ID NO: 625508 - DNA, 20 bp, Artificial Sequence
  chemically synthesized
actattttccccccatgggt

SEQ ID NO: 625509 - DNA, 20 bp, Artificial Sequence
  chemically synthesized
ccatgggtagtggcttcgca

SEQ ID NO: 625510 - DNA, 20 bp, Artificial Sequence
  chemically synthesized
cttcaagcagtgatcttaat

SEQ ID NO: 625511 - DNA, 20 bp, Artificial Sequence
  chemically synthesized
ggataaactagaattaagat

SEQ ID NO: 625512 - DNA, 20 bp, Artificial Sequence
  chemically synthesized
taagacatttttcttttcaa

SEQ ID NO: 625513 - DNA, 20 bp, Artificial Sequence
  chemically synthesized
tcttcccgtatctctagtgt

SEQ ID NO: 625514 - DNA, 20 bp, Artificial Sequence
  chemically synthesized
actcaaattcatttgttttg

SEQ ID NO: 625515 - DNA, 20 bp, Artificial Sequence
  chemically synthesized
aagattcagtactcaaattc

SEQ ID NO: 625516 - DNA, 20 bp, Artificial Sequence
  chemically synthesized
tgataattaattagaaatat

SEQ ID NO: 625517 - DNA, 20 bp, Artificial Sequence
  chemically synthesized
tagtctactaccacgtggag

SEQ ID NO: 625518 - DNA, 20 bp, Artificial Sequence
  chemically synthesized
tctggcccctggaatagctg

SEQ ID NO: 625519 - DNA, 20 bp, Artificial Sequence
  chemically synthesized
agggtttgcttttattgtca

SEQ ID NO: 625520 - DNA, 20 bp, Artificial Sequence
  chemically synthesized
ggagcatttagagtaaaagg

SEQ ID NO: 625521 - DNA, 20 bp, Artificial Sequence
  chemically synthesized
ttctggagcatttagagtaa

SEQ ID NO: 625522 - DNA, 20 bp, Artificial Sequence
  chemically synthesized
tttttaggcctttatttatt

SEQ ID NO: 625523 - DNA, 20 bp, Artificial Sequence
  chemically synthesized
gtggtggtggtggtggtggt

SEQ ID NO: 625524 - DNA, 20 bp, Artificial Sequence
  chemically synthesized
caccaccaccaccacaacca

SEQ ID NO: 625525 - DNA, 20 bp, Artificial Sequence
  chemically synthesized
ctgaagaacatttttaaata

SEQ ID NO: 625526 - DNA, 20 bp, Artificial Sequence
  chemically synthesized
ataactacttgttcttttta

SEQ ID NO: 625527 - DNA, 20 bp, Artificial Sequence
  chemically synthesized
ttattttaatttctacatgc

SEQ ID NO: 625528 - DNA, 20 bp, Artificial Sequence
  chemically synthesized
atgaaattattttaatttct

SEQ ID NO: 625529 - DNA, 20 bp, Artificial Sequence
  chemically synthesized
catttttcatttccaacatt

SEQ ID NO: 625530 - DNA, 20 bp, Artificial Sequence
  chemically synthesized
taagctgtttatttctttaa

SEQ ID NO: 625531 - DNA, 20 bp, Artificial Sequence
  chemically synthesized
gaatcaattttaaagaaata

SEQ ID NO: 625532 - DNA, 20 bp, Artificial Sequence
  chemically synthesized
agaaataaacagcttaagta

SEQ ID NO: 625533 - DNA, 20 bp, Artificial Sequence
  chemically synthesized
ttgttcaatccagatactta

SEQ ID NO: 625534 - DNA, 20 bp, Artificial Sequence
  chemically synthesized
atgaatggaattgcagagaa

SEQ ID NO: 625535 - DNA, 20 bp, Artificial Sequence
  chemically synthesized
tatcagccattatctttaaa

SEQ ID NO: 625536 - DNA, 20 bp, Artificial Sequence
  chemically synthesized
aactgatgatagacaaaggg

SEQ ID NO: 625537 - DNA, 20 bp, Artificial Sequence
  chemically synthesized
aaagggcaaggtttatctaa

SEQ ID NO: 625538 - DNA, 20 bp, Artificial Sequence
  chemically synthesized
tggtagggccagacacccta

SEQ ID NO: 625539 - DNA, 20 bp, Artificial Sequence
  chemically synthesized
ctataatatgtctcaattac

SEQ ID NO: 625540 - DNA, 20 bp, Artificial Sequence
  chemically synthesized
agattagtatatacatgtac

SEQ ID NO: 625541 - DNA, 20 bp, Artificial Sequence
  chemically synthesized
agtgtcacctctgttttgca

SEQ ID NO: 625542 - DNA, 20 bp, Artificial Sequence
  chemically synthesized
ctattcacctgtagtgtcac

SEQ ID NO: 625543 - DNA, 20 bp, Artificial Sequence
  chemically synthesized
gtaaataactgtcctaccat

SEQ ID NO: 625544 - DNA, 20 bp, Artificial Sequence
  chemically synthesized
taaacttggaaataattttt

SEQ ID NO: 625545 - DNA, 20 bp, Artificial Sequence
  chemically synthesized
aaaacccctaaaaattattt

SEQ ID NO: 625546 - DNA, 20 bp, Artificial Sequence
  chemically synthesized
tcatgtaattctttaggtat

SEQ ID NO: 625547 - DNA, 20 bp, Artificial Sequence
  chemically synthesized
aattggcaaaggacatgaac

SEQ ID NO: 625548 - DNA, 20 bp, Artificial Sequence
  chemically synthesized
tgagtatgaaattatatctc

SEQ ID NO: 625549 - DNA, 20 bp, Artificial Sequence
  chemically synthesized
ttaatataacattttgccgt

SEQ ID NO: 625550 - DNA, 20 bp, Artificial Sequence
  chemically synthesized
attatttttagtcatcctcc

SEQ ID NO: 625551 - DNA, 20 bp, Artificial Sequence
  chemically synthesized
ctatctttaagaactagtct

SEQ ID NO: 625552 - DNA, 20 bp, Artificial Sequence
  chemically synthesized
atcctatatatttaatgtgt

SEQ ID NO: 625553 - DNA, 20 bp, Artificial Sequence
  chemically synthesized
ctggagacttctttaaatta

SEQ ID NO: 625554 - DNA, 20 bp, Artificial Sequence
  chemically synthesized
gctttatcaacatgcatcat

SEQ ID NO: 625555 - DNA, 20 bp, Artificial Sequence
  chemically synthesized
agctctctgactctggttaa

SEQ ID NO: 625556 - DNA, 20 bp, Artificial Sequence
  chemically synthesized
agcatccttaaccagagtca

SEQ ID NO: 625557 - DNA, 20 bp, Artificial Sequence
  chemically synthesized
taacacagaaagtaaaaggg

SEQ ID NO: 625558 - DNA, 20 bp, Artificial Sequence
  chemically synthesized
cccttttactttctgtgtta

SEQ ID NO: 625559 - DNA, 20 bp, Artificial Sequence
  chemically synthesized
ctttctgtgttatatggatt

SEQ ID NO: 625560 - DNA, 20 bp, Artificial Sequence
  chemically synthesized
gttatatggattttgagttt

SEQ ID NO: 625561 - DNA, 20 bp, Artificial Sequence
  chemically synthesized
agctatggaattttctttct

SEQ ID NO: 625562 - DNA, 20 bp, Artificial Sequence
  chemically synthesized
tctttttaaaagtagtgcta

SEQ ID NO: 625563 - DNA, 20 bp, Artificial Sequence
  chemically synthesized
tggtgcccttaagtctgatg

SEQ ID NO: 625564 - DNA, 20 bp, Artificial Sequence
  chemically synthesized
atgaatggtgcccttaagtc

SEQ ID NO: 625565 - DNA, 20 bp, Artificial Sequence
  chemically synthesized
agtaatacaatcatacaaga

SEQ ID NO: 625566 - DNA, 20 bp, Artificial Sequence
  chemically synthesized
acctgagcaaacaacttctt

SEQ ID NO: 625567 - DNA, 20 bp, Artificial Sequence
  chemically synthesized
ccctgaaataataagaatta

SEQ ID NO: 625568 - DNA, 20 bp, Artificial Sequence
  chemically synthesized
cagtttcccttttttgtaag

SEQ ID NO: 625569 - DNA, 20 bp, Artificial Sequence
  chemically synthesized
aaaatataagtactttatga

SEQ ID NO: 625570 - DNA, 20 bp, Artificial Sequence
  chemically synthesized
taagtgtaagattattttta

SEQ ID NO: 625571 - DNA, 20 bp, Artificial Sequence
  chemically synthesized
tttgaaagaagatcttaagt

SEQ ID NO: 625572 - DNA, 20 bp, Artificial Sequence
  chemically synthesized
cttccagtagacttgtttag

SEQ ID NO: 625573 - DNA, 20 bp, Artificial Sequence
  chemically synthesized
tatccaaagtcttccagtag

SEQ ID NO: 625574 - DNA, 20 bp, Artificial Sequence
  chemically synthesized
acatttttcttcattaactg

SEQ ID NO: 625575 - DNA, 20 bp, Artificial Sequence
  chemically synthesized
aaaaatgtacatattatagt

SEQ ID NO: 625576 - DNA, 20 bp, Artificial Sequence
  chemically synthesized
ttatttttttatttttggtt

SEQ ID NO: 625577 - DNA, 20 bp, Artificial Sequence
  chemically synthesized
caaaattttatttttttatt

SEQ ID NO: 625578 - DNA, 20 bp, Artificial Sequence
  chemically synthesized
ctactcccttgaaaggtaca

SEQ ID NO: 625579 - DNA, 20 bp, Artificial Sequence
  chemically synthesized
tcagcctagggtggtgtgtc

SEQ ID NO: 625580 - DNA, 20 bp, Artificial Sequence
  chemically synthesized
atgaactaccacttggctta

SEQ ID NO: 625581 - DNA, 20 bp, Artificial Sequence
  chemically synthesized
tttttgctgatgaactacca

SEQ ID NO: 625582 - DNA, 20 bp, Artificial Sequence
  chemically synthesized
ttatcagttcattgttaatt

SEQ ID NO: 625583 - DNA, 20 bp, Artificial Sequence
  chemically synthesized
aattcctggtttatttctct

SEQ ID NO: 625584 - DNA, 20 bp, Artificial Sequence
  chemically synthesized
tcagtttttaccgcctaaag

SEQ ID NO: 625585 - DNA, 20 bp, Artificial Sequence
  chemically synthesized
tgtttaaaacttttgactgg

SEQ ID NO: 625586 - DNA, 20 bp, Artificial Sequence
  chemically synthesized
atcttaaatctggcccagtc

SEQ ID NO: 625587 - DNA, 20 bp, Artificial Sequence
  chemically synthesized
aacttttgactgggccagat

SEQ ID NO: 625588 - DNA, 20 bp, Artificial Sequence
  chemically synthesized
tgttaaggggcaaggcaggt

SEQ ID NO: 625589 - DNA, 20 bp, Artificial Sequence
  chemically synthesized
aaggcaggtcctagtttacc

SEQ ID NO: 625590 - DNA, 20 bp, Artificial Sequence
  chemically synthesized
ctagggttattttgctggtt

SEQ ID NO: 625591 - DNA, 20 bp, Artificial Sequence
  chemically synthesized
ggaaagaagagtggagaccc

SEQ ID NO: 625592 - DNA, 20 bp, Artificial Sequence
  chemically synthesized
ctttactaaaatacatatcc

SEQ ID NO: 625593 - DNA, 20 bp, Artificial Sequence
  chemically synthesized
atatgtattttagtaaagat

SEQ ID NO: 625594 - DNA, 20 bp, Artificial Sequence
  chemically synthesized
aaaggttttttttttacata

SEQ ID NO: 625595 - DNA, 20 bp, Artificial Sequence
  chemically synthesized
tcaatgctaatttctttgaa

SEQ ID NO: 625596 - DNA, 20 bp, Artificial Sequence
  chemically synthesized
ggactataaactcccatatt

SEQ ID NO: 625597 - DNA, 20 bp, Artificial Sequence
  chemically synthesized
ggataacaagctcagaatat

SEQ ID NO: 625598 - DNA, 20 bp, Artificial Sequence
  chemically synthesized
tgtctacattatggaaactc

SEQ ID NO: 625599 - DNA, 20 bp, Artificial Sequence
  chemically synthesized
tcttatgtgaccataaacct

SEQ ID NO: 625600 - DNA, 20 bp, Artificial Sequence
  chemically synthesized
ctgcataatttttccttact

SEQ ID NO: 625601 - DNA, 20 bp, Artificial Sequence
  chemically synthesized
tgcagaaaggagaaaagcaa

SEQ ID NO: 625602 - DNA, 20 bp, Artificial Sequence
  chemically synthesized
tgattgttctcaccaagcat

SEQ ID NO: 625603 - DNA, 20 bp, Artificial Sequence
  chemically synthesized
catctttgttctcacactta

SEQ ID NO: 625604 - DNA, 20 bp, Artificial Sequence
  chemically synthesized
aacaaagatgatgtacctag

SEQ ID NO: 625605 - DNA, 20 bp, Artificial Sequence
  chemically synthesized
ggactcagcctaaagtcccc

SEQ ID NO: 625606 - DNA, 20 bp, Artificial Sequence
  chemically synthesized
aagtctatatttagtgtact

SEQ ID NO: 625607 - DNA, 20 bp, Artificial Sequence
  chemically synthesized
ggagatttcatggaaattct

SEQ ID NO: 625608 - DNA, 20 bp, Artificial Sequence
  chemically synthesized
taatggcatcttttgacttt

SEQ ID NO: 625609 - DNA, 20 bp, Artificial Sequence
  chemically synthesized
aaaaaaataaataaataaaa

SEQ ID NO: 625610 - DNA, 20 bp, Artificial Sequence
  chemically synthesized
gggcctatggaacaatacat

SEQ ID NO: 625611 - DNA, 20 bp, Artificial Sequence
  chemically synthesized
agacattaacgtaaattctc

SEQ ID NO: 625612 - DNA, 20 bp, Artificial Sequence
  chemically synthesized
tcttttattgccaaagtttc

SEQ ID NO: 625613 - DNA, 20 bp, Artificial Sequence
  chemically synthesized
cttattggatcttttattgc

SEQ ID NO: 625614 - DNA, 20 bp, Artificial Sequence
  chemically synthesized
taagttattgataatttaaa

SEQ ID NO: 625615 - DNA, 20 bp, Artificial Sequence
  chemically synthesized
aatgggatattggaatttaa

SEQ ID NO: 625616 - DNA, 20 bp, Artificial Sequence
  chemically synthesized
ttaaattccaatatcccatt

SEQ ID NO: 625617 - DNA, 20 bp, Artificial Sequence
  chemically synthesized
attttcagcttattttctat

SEQ ID NO: 625618 - DNA, 20 bp, Artificial Sequence
  chemically synthesized
gttctgcccatattggtatt

SEQ ID NO: 625619 - DNA, 20 bp, Artificial Sequence
  chemically synthesized
gaacgtatgatataaaaatt

SEQ ID NO: 625620 - DNA, 20 bp, Artificial Sequence
  chemically synthesized
atatggactcttaggactca

SEQ ID NO: 625621 - DNA, 20 bp, Artificial Sequence
  chemically synthesized
ataaagcttatattaagttc

SEQ ID NO: 625622 - DNA, 20 bp, Artificial Sequence
  chemically synthesized
ttaaaactcctgaacttaat

SEQ ID NO: 625623 - DNA, 20 bp, Artificial Sequence
  chemically synthesized
aatataagctttatcagcaa

SEQ ID NO: 625624 - DNA, 20 bp, Artificial Sequence
  chemically synthesized
actgaaagctatgttgctga

SEQ ID NO: 625625 - DNA, 20 bp, Artificial Sequence
  chemically synthesized
gtcattttagtactaaatat

SEQ ID NO: 625626 - DNA, 20 bp, Artificial Sequence
  chemically synthesized
taaagctgactaaataattt

SEQ ID NO: 625627 - DNA, 20 bp, Artificial Sequence
  chemically synthesized
ataagcaactaaattattta

SEQ ID NO: 625628 - DNA, 20 bp, Artificial Sequence
  chemically synthesized
ttattccagataagaagacc

SEQ ID NO: 625629 - DNA, 20 bp, Artificial Sequence
  chemically synthesized
gacccttggatttattaaat

SEQ ID NO: 625630 - DNA, 20 bp, Artificial Sequence
  chemically synthesized
ttctagacatagtggggctt

SEQ ID NO: 625631 - DNA, 20 bp, Artificial Sequence
  chemically synthesized
tatcaatattctagacatag

SEQ ID NO: 625632 - DNA, 20 bp, Artificial Sequence
  chemically synthesized
acataagtcgctatgctagt

SEQ ID NO: 625633 - DNA, 20 bp, Artificial Sequence
  chemically synthesized
tgagagattcaagatgaaac

SEQ ID NO: 625634 - DNA, 20 bp, Artificial Sequence
  chemically synthesized
tgatttaataaagagaaagc

SEQ ID NO: 625635 - DNA, 20 bp, Artificial Sequence
  chemically synthesized
taaaaataaggggaggccaa

SEQ ID NO: 625636 - DNA, 20 bp, Artificial Sequence
  chemically synthesized
tccccttatttttatgtagg

SEQ ID NO: 625637 - DNA, 20 bp, Artificial Sequence
  chemically synthesized
ttttatgtaggtattgattt

SEQ ID NO: 625638 - DNA, 20 bp, Artificial Sequence
  chemically synthesized
atttttctcaaaagaggaaa

SEQ ID NO: 625639 - DNA, 20 bp, Artificial Sequence
  chemically synthesized
atttatttttctcaaaagag

SEQ ID NO: 625640 - DNA, 20 bp, Artificial Sequence
  chemically synthesized
gagaaaaataaatcacaact

SEQ ID NO: 625641 - DNA, 20 bp, Artificial Sequence
  chemically synthesized
agagatggtaaagcaatgag

SEQ ID NO: 625642 - DNA, 20 bp, Artificial Sequence
  chemically synthesized
agtaaagagtcttacaacgt

SEQ ID NO: 625643 - DNA, 20 bp, Artificial Sequence
  chemically synthesized
tgatttttgacccaggaagt

SEQ ID NO: 625644 - DNA, 20 bp, Artificial Sequence
  chemically synthesized
agtgcaatgttgaaatcagc

SEQ ID NO: 625645 - DNA, 20 bp, Artificial Sequence
  chemically synthesized
aattcaaaaatacaaactct

SEQ ID NO: 625646 - DNA, 20 bp, Artificial Sequence
  chemically synthesized
cttttggttatttatttttc

SEQ ID NO: 625647 - DNA, 20 bp, Artificial Sequence
  chemically synthesized
aaccaaaagagaagctgcaa

SEQ ID NO: 625648 - DNA, 20 bp, Artificial Sequence
  chemically synthesized
tgtactcaatgaaacacttt

SEQ ID NO: 625649 - DNA, 20 bp, Artificial Sequence
  chemically synthesized
atacctcgtcaaataggagt

SEQ ID NO: 625650 - DNA, 20 bp, Artificial Sequence
  chemically synthesized
ggcaatacaaatatgaatta

SEQ ID NO: 625651 - DNA, 20 bp, Artificial Sequence
  chemically synthesized
aaatatgaattatgatgttt

SEQ ID NO: 625652 - DNA, 20 bp, Artificial Sequence
  chemically synthesized
tgcaggttttagaagaaagt

SEQ ID NO: 625653 - DNA, 20 bp, Artificial Sequence
  chemically synthesized
ctttttattacagaaataaa

SEQ ID NO: 625654 - DNA, 20 bp, Artificial Sequence
  chemically synthesized
tatctactttttacttgatg

SEQ ID NO: 625655 - DNA, 20 bp, Artificial Sequence
  chemically synthesized
ctttctgtctatgcttagcg

SEQ ID NO: 625656 - DNA, 20 bp, Artificial Sequence
  chemically synthesized
taaaataggacactttctgt

SEQ ID NO: 625657 - DNA, 20 bp, Artificial Sequence
  chemically synthesized
tgtcctattttaatgcagaa

SEQ ID NO: 625658 - DNA, 20 bp, Artificial Sequence
  chemically synthesized
ggtttttatcatgaagggat

SEQ ID NO: 625659 - DNA, 20 bp, Artificial Sequence
  chemically synthesized
ccttcagtgcctagtctgtt

SEQ ID NO: 625660 - DNA, 20 bp, Artificial Sequence
  chemically synthesized
ccattcggtatgatgttggc

SEQ ID NO: 625661 - DNA, 20 bp, Artificial Sequence
  chemically synthesized
taccgaatgggcaaaagttg

SEQ ID NO: 625662 - DNA, 20 bp, Artificial Sequence
  chemically synthesized
aaactggtgagagtgggcat

SEQ ID NO: 625663 - DNA, 20 bp, Artificial Sequence
  chemically synthesized
aaacaaggatgcccactctc

SEQ ID NO: 625664 - DNA, 20 bp, Artificial Sequence
  chemically synthesized
tgtggctaggacttccagta

SEQ ID NO: 625665 - DNA, 20 bp, Artificial Sequence
  chemically synthesized
tcataccgtcagtgaaaaaa

SEQ ID NO: 625666 - DNA, 20 bp, Artificial Sequence
  chemically synthesized
actatcttttttcactgacg

SEQ ID NO: 625667 - DNA, 20 bp, Artificial Sequence
  chemically synthesized
gtagccttttggtggagtct

SEQ ID NO: 625668 - DNA, 20 bp, Artificial Sequence
  chemically synthesized
gaactgataaacaattttaa

SEQ ID NO: 625669 - DNA, 20 bp, Artificial Sequence
  chemically synthesized
atatcttgaaacctcgttaa

SEQ ID NO: 625670 - DNA, 20 bp, Artificial Sequence
  chemically synthesized
tagaaatgctattaattttt

SEQ ID NO: 625671 - DNA, 20 bp, Artificial Sequence
  chemically synthesized
attgtgttcttcatttgact

SEQ ID NO: 625672 - DNA, 20 bp, Artificial Sequence
  chemically synthesized
attttctttggctattgtaa

SEQ ID NO: 625673 - DNA, 20 bp, Artificial Sequence
  chemically synthesized
tttatctgtgtttctttcaa

SEQ ID NO: 625674 - DNA, 20 bp, Artificial Sequence
  chemically synthesized
tggaatgctttttcgtttat

SEQ ID NO: 625675 - DNA, 20 bp, Artificial Sequence
  chemically synthesized
ccaatgagcatggaatgctt

SEQ ID NO: 625676 - DNA, 20 bp, Artificial Sequence
  chemically synthesized
tgtttcttccaatgagcatg

SEQ ID NO: 625677 - DNA, 20 bp, Artificial Sequence
  chemically synthesized
cagtatagccattttaatta

SEQ ID NO: 625678 - DNA, 20 bp, Artificial Sequence
  chemically synthesized
ctatactgcacaaaacaact

SEQ ID NO: 625679 - DNA, 20 bp, Artificial Sequence
  chemically synthesized
aggacagcattgaatctata

SEQ ID NO: 625680 - DNA, 20 bp, Artificial Sequence
  chemically synthesized
attctgtgaggaatgacctt

SEQ ID NO: 625681 - DNA, 20 bp, Artificial Sequence
  chemically synthesized
tggttgcatatgaattttag

SEQ ID NO: 625682 - DNA, 20 bp, Artificial Sequence
  chemically synthesized
attttgttcttgctgcttag

SEQ ID NO: 625683 - DNA, 20 bp, Artificial Sequence
  chemically synthesized
gatgcctccaattttgttct

SEQ ID NO: 625684 - DNA, 20 bp, Artificial Sequence
  chemically synthesized
tctgttccattggtctatat

SEQ ID NO: 625685 - DNA, 20 bp, Artificial Sequence
  chemically synthesized
gaaggtgtatggctttattt

SEQ ID NO: 625686 - DNA, 20 bp, Artificial Sequence
  chemically synthesized
tcgaaggctggttgaaggtg

SEQ ID NO: 625687 - DNA, 20 bp, Artificial Sequence
  chemically synthesized
taggaagtccttttaccatt

SEQ ID NO: 625688 - DNA, 20 bp, Artificial Sequence
  chemically synthesized
tgaataggaagtccttttac

SEQ ID NO: 625689 - DNA, 20 bp, Artificial Sequence
  chemically synthesized
tatatggcaaaaggtaggga

SEQ ID NO: 625690 - DNA, 20 bp, Artificial Sequence
  chemically synthesized
atatacaaaaataaactcat

SEQ ID NO: 625691 - DNA, 20 bp, Artificial Sequence
  chemically synthesized
attaatatctttaatccacc

SEQ ID NO: 625692 - DNA, 20 bp, Artificial Sequence
  chemically synthesized
ctaggtttgtttctaggatt

SEQ ID NO: 625693 - DNA, 20 bp, Artificial Sequence
  chemically synthesized
gacatttcctaggtttgttt

SEQ ID NO: 625694 - DNA, 20 bp, Artificial Sequence
  chemically synthesized
tcaagaaggacatttcctag

SEQ ID NO: 625695 - DNA, 20 bp, Artificial Sequence
  chemically synthesized
aatgtcaagaaggacatttc

SEQ ID NO: 625696 - DNA, 20 bp, Artificial Sequence
  chemically synthesized
ttgggaggctgaggcaggag

SEQ ID NO: 625697 - DNA, 20 bp, Artificial Sequence
  chemically synthesized
tgcctcagcctcccaagtag

SEQ ID NO: 625698 - DNA, 20 bp, Artificial Sequence
  chemically synthesized
ttttgtatttttggtagaga

SEQ ID NO: 625699 - DNA, 20 bp, Artificial Sequence
  chemically synthesized
gggttttgccacgttggtca

SEQ ID NO: 625700 - DNA, 20 bp, Artificial Sequence
  chemically synthesized
ggtcaggctgctttcgaact

SEQ ID NO: 625701 - DNA, 20 bp, Artificial Sequence
  chemically synthesized
cactttgggagaccaaggtg

SEQ ID NO: 625702 - DNA, 20 bp, Artificial Sequence
  chemically synthesized
caccttggtctcccaaagtg

SEQ ID NO: 625703 - DNA, 20 bp, Artificial Sequence
  chemically synthesized
agagggacctaattaaacta

SEQ ID NO: 625704 - DNA, 20 bp, Artificial Sequence
  chemically synthesized
ctttggctgtgcagaagctc

SEQ ID NO: 625705 - DNA, 20 bp, Artificial Sequence
  chemically synthesized
gattatctgtttactttgtt

SEQ ID NO: 625706 - DNA, 20 bp, Artificial Sequence
  chemically synthesized
tttctcccattctgtagatt

SEQ ID NO: 625707 - DNA, 20 bp, Artificial Sequence
  chemically synthesized
gtgaatattttctcccattc

SEQ ID NO: 625708 - DNA, 20 bp, Artificial Sequence
  chemically synthesized
tattagacttttgtcaggtg

SEQ ID NO: 625709 - DNA, 20 bp, Artificial Sequence
  chemically synthesized
cttgcatgtcttcctttgag

SEQ ID NO: 625710 - DNA, 20 bp, Artificial Sequence
  chemically synthesized
catttcttcgtatgtttgtt

SEQ ID NO: 625711 - DNA, 20 bp, Artificial Sequence
  chemically synthesized
atgatgatgagcatttcttc

SEQ ID NO: 625712 - DNA, 20 bp, Artificial Sequence
  chemically synthesized
ggttttgcttttcatttctc

SEQ ID NO: 625713 - DNA, 20 bp, Artificial Sequence
  chemically synthesized
gagatggtatctcattgtgg

SEQ ID NO: 625714 - DNA, 20 bp, Artificial Sequence
  chemically synthesized
ggtgtgagatggtatctcat

SEQ ID NO: 625715 - DNA, 20 bp, Artificial Sequence
  chemically synthesized
tgacttttaaataatagcca

SEQ ID NO: 625716 - DNA, 20 bp, Artificial Sequence
  chemically synthesized
agtcaagaaaggctgagtgc

SEQ ID NO: 625717 - DNA, 20 bp, Artificial Sequence
  chemically synthesized
cctgtaatcccagcactgta

SEQ ID NO: 625718 - DNA, 20 bp, Artificial Sequence
  chemically synthesized
tgcctaagcctcctacagtg

SEQ ID NO: 625719 - DNA, 20 bp, Artificial Sequence
  chemically synthesized
ttttgtatttttactagagt

SEQ ID NO: 625720 - DNA, 20 bp, Artificial Sequence
  chemically synthesized
tgctgcagcctccctagcag

SEQ ID NO: 625721 - DNA, 20 bp, Artificial Sequence
  chemically synthesized
cacctcaacctcctgggttc

SEQ ID NO: 625722 - DNA, 20 bp, Artificial Sequence
  chemically synthesized
ggaggttgaggtgcagtgag

SEQ ID NO: 625723 - DNA, 20 bp, Artificial Sequence
  chemically synthesized
cagcctcaccagcgtttatc

SEQ ID NO: 625724 - DNA, 20 bp, Artificial Sequence
  chemically synthesized
ccttttatctacagcctcac

SEQ ID NO: 625725 - DNA, 20 bp, Artificial Sequence
  chemically synthesized
gtgaggctgtagataaaagg

SEQ ID NO: 625726 - DNA, 20 bp, Artificial Sequence
  chemically synthesized
ttatttcagcccccgtggca

SEQ ID NO: 625727 - DNA, 20 bp, Artificial Sequence
  chemically synthesized
agcccccgtggcaagcagtt

SEQ ID NO: 625728 - DNA, 20 bp, Artificial Sequence
  chemically synthesized
agttctgtgagaaatctcca

SEQ ID NO: 625729 - DNA, 20 bp, Artificial Sequence
  chemically synthesized
attgctgaattgaatgatag

SEQ ID NO: 625730 - DNA, 20 bp, Artificial Sequence
  chemically synthesized
ctttgggtatatactcagta

SEQ ID NO: 625731 - DNA, 20 bp, Artificial Sequence
  chemically synthesized
caaccattgatgagctttta

SEQ ID NO: 625732 - DNA, 20 bp, Artificial Sequence
  chemically synthesized
ctttatccagtcaaccattg

SEQ ID NO: 625733 - DNA, 20 bp, Artificial Sequence
  chemically synthesized
ttgttcttttttatggctgc

SEQ ID NO: 625734 - DNA, 20 bp, Artificial Sequence
  chemically synthesized
catccatgtcgctgcaaagg

SEQ ID NO: 625735 - DNA, 20 bp, Artificial Sequence
  chemically synthesized
ggttttctgttcttgcatta

SEQ ID NO: 625736 - DNA, 20 bp, Artificial Sequence
  chemically synthesized
ataagtgagagcatgtggca

SEQ ID NO: 625737 - DNA, 20 bp, Artificial Sequence
  chemically synthesized
atgtttatgtccgttgtgct

SEQ ID NO: 625738 - DNA, 20 bp, Artificial Sequence
  chemically synthesized
gtccacagtgtctgttgttc

SEQ ID NO: 625739 - DNA, 20 bp, Artificial Sequence
  chemically synthesized
agtaagcatagtacccaata

SEQ ID NO: 625740 - DNA, 20 bp, Artificial Sequence
  chemically synthesized
taaaagctacctattgggta

SEQ ID NO: 625741 - DNA, 20 bp, Artificial Sequence
  chemically synthesized
cttactatctgggtgcaata

SEQ ID NO: 625742 - DNA, 20 bp, Artificial Sequence
  chemically synthesized
ttacatacagggagtacaca

SEQ ID NO: 625743 - DNA, 20 bp, Artificial Sequence
  chemically synthesized
tgctgtgtaataggtgcctg

SEQ ID NO: 625744 - DNA, 20 bp, Artificial Sequence
  chemically synthesized
attcgctcactacaattatt

SEQ ID NO: 625745 - DNA, 20 bp, Artificial Sequence
  chemically synthesized
attggggtgatataatacaa

SEQ ID NO: 625746 - DNA, 20 bp, Artificial Sequence
  chemically synthesized
gggtgatataatacaatgtg

SEQ ID NO: 625747 - DNA, 20 bp, Artificial Sequence
  chemically synthesized
tacaatgtggtttgtttagt

SEQ ID NO: 625748 - DNA, 20 bp, Artificial Sequence
  chemically synthesized
ttaatagtgttatatatgac

SEQ ID NO: 625749 - DNA, 20 bp, Artificial Sequence
  chemically synthesized
cagagaccccatcagactct

SEQ ID NO: 625750 - DNA, 20 bp, Artificial Sequence
  chemically synthesized
agtagaattatatgccttag

SEQ ID NO: 625751 - DNA, 20 bp, Artificial Sequence
  chemically synthesized
cttagtgatgtttgcaaatt

SEQ ID NO: 625752 - DNA, 20 bp, Artificial Sequence
  chemically synthesized
tcataataaataaaatcata

SEQ ID NO: 625753 - DNA, 20 bp, Artificial Sequence
  chemically synthesized
tatacatatatataagctcc

SEQ ID NO: 625754 - DNA, 20 bp, Artificial Sequence
  chemically synthesized
tatatgtatatatatataat

SEQ ID NO: 625755 - DNA, 20 bp, Artificial Sequence
  chemically synthesized
tatatataatcacagattta

SEQ ID NO: 625756 - DNA, 20 bp, Artificial Sequence
  chemically synthesized
acttggtaatcattataaat

SEQ ID NO: 625757 - DNA, 20 bp, Artificial Sequence
  chemically synthesized
accaagtggatcgtagctat

SEQ ID NO: 625758 - DNA, 20 bp, Artificial Sequence
  chemically synthesized
tataagtgatttaacagggg

SEQ ID NO: 625759 - DNA, 20 bp, Artificial Sequence
  chemically synthesized
taccctgatcaacacaatat

SEQ ID NO: 625760 - DNA, 20 bp, Artificial Sequence
  chemically synthesized
ggtttatgtctctagtgaga

SEQ ID NO: 625761 - DNA, 20 bp, Artificial Sequence
  chemically synthesized
tgtctctagtgagataacgc

SEQ ID NO: 625762 - DNA, 20 bp, Artificial Sequence
  chemically synthesized
tctgactatttattgtttct

SEQ ID NO: 625763 - DNA, 20 bp, Artificial Sequence
  chemically synthesized
acatcaagaaacaataaata

SEQ ID NO: 625764 - DNA, 20 bp, Artificial Sequence
  chemically synthesized
gttttaaaaatctgactatt

SEQ ID NO: 625765 - DNA, 20 bp, Artificial Sequence
  chemically synthesized
tctcaaaagatagtttggga

SEQ ID NO: 625766 - DNA, 20 bp, Artificial Sequence
  chemically synthesized
tacaattttggctctcaaaa

SEQ ID NO: 625767 - DNA, 20 bp, Artificial Sequence
  chemically synthesized
tagctgtgagtaaagtaagg

SEQ ID NO: 625768 - DNA, 20 bp, Artificial Sequence
  chemically synthesized
gatttttttttttccttgtc

SEQ ID NO: 625769 - DNA, 20 bp, Artificial Sequence
  chemically synthesized
gtatagagttgccattcttt

SEQ ID NO: 625770 - DNA, 20 bp, Artificial Sequence
  chemically synthesized
gtgcctcctattctcagccc

SEQ ID NO: 625771 - DNA, 20 bp, Artificial Sequence
  chemically synthesized
gcatggctctacgtgggtcc

SEQ ID NO: 625772 - DNA, 20 bp, Artificial Sequence
  chemically synthesized
ttaactctctgttgtgaggg

SEQ ID NO: 625773 - DNA, 20 bp, Artificial Sequence
  chemically synthesized
tcacaacagagagttaagtg

SEQ ID NO: 625774 - DNA, 20 bp, Artificial Sequence
  chemically synthesized
gccttgatttccagacagtg

SEQ ID NO: 625775 - DNA, 20 bp, Artificial Sequence
  chemically synthesized
tgagttttagtagggaacgc

SEQ ID NO: 625776 - DNA, 20 bp, Artificial Sequence
  chemically synthesized
cgggatggattttgctgccg

SEQ ID NO: 625777 - DNA, 20 bp, Artificial Sequence
  chemically synthesized
gttgaggacgtgtgcaacgg

SEQ ID NO: 625778 - DNA, 20 bp, Artificial Sequence
  chemically synthesized
ctaggaaatgttaacacctt

SEQ ID NO: 625779 - DNA, 20 bp, Artificial Sequence
  chemically synthesized
ttatatactattcccttata

SEQ ID NO: 625780 - DNA, 20 bp, Artificial Sequence
  chemically synthesized
gcttcctgtgttgaaattgt

SEQ ID NO: 625781 - DNA, 20 bp, Artificial Sequence
  chemically synthesized
tattcagcttcctgtgttga

SEQ ID NO: 625782 - DNA, 20 bp, Artificial Sequence
  chemically synthesized
ctctaaaaattaatagttta

SEQ ID NO: 625783 - DNA, 20 bp, Artificial Sequence
  chemically synthesized
tgaccctttctctaaaaatt

SEQ ID NO: 625784 - DNA, 20 bp, Artificial Sequence
  chemically synthesized
agaaagggtcaacataagat

SEQ ID NO: 625785 - DNA, 20 bp, Artificial Sequence
  chemically synthesized
ttatgtttgggggccatata

SEQ ID NO: 625786 - DNA, 20 bp, Artificial Sequence
  chemically synthesized
acagccaagattatattcat

SEQ ID NO: 625787 - DNA, 20 bp, Artificial Sequence
  chemically synthesized
agcaataaaaataaatacag

SEQ ID NO: 625788 - DNA, 20 bp, Artificial Sequence
  chemically synthesized
atcttggctgtatttatttt

SEQ ID NO: 625789 - DNA, 20 bp, Artificial Sequence
  chemically synthesized
tatcagggttataaatagtt

SEQ ID NO: 625790 - DNA, 20 bp, Artificial Sequence
  chemically synthesized
ccaacattttcatagtgtcc

SEQ ID NO: 625791 - DNA, 20 bp, Artificial Sequence
  chemically synthesized
taggaagtttagtttttcca

SEQ ID NO: 625792 - DNA, 20 bp, Artificial Sequence
  chemically synthesized
agtagcaataaaataggaag

SEQ ID NO: 625793 - DNA, 20 bp, Artificial Sequence
  chemically synthesized
caataagtagcaataaaata

SEQ ID NO: 625794 - DNA, 20 bp, Artificial Sequence
  chemically synthesized
ctttgatcatgttaacatat

SEQ ID NO: 625795 - DNA, 20 bp, Artificial Sequence
  chemically synthesized
taaatatttgcttttttttt

SEQ ID NO: 625796 - DNA, 20 bp, Artificial Sequence
  chemically synthesized
atattcagcatttgataaat

SEQ ID NO: 625797 - DNA, 20 bp, Artificial Sequence
  chemically synthesized
gacagatagataattgctaa

SEQ ID NO: 625798 - DNA, 20 bp, Artificial Sequence
  chemically synthesized
atggaatgcagtgttcagag

SEQ ID NO: 625799 - DNA, 20 bp, Artificial Sequence
  chemically synthesized
cagccttgtgttttcatatc

SEQ ID NO: 625800 - DNA, 20 bp, Artificial Sequence
  chemically synthesized
atgagccaccgcgcccagcc

SEQ ID NO: 625801 - DNA, 20 bp, Artificial Sequence
  chemically synthesized
caggcagatcacctgaggtc

SEQ ID NO: 625802 - DNA, 20 bp, Artificial Sequence
  chemically synthesized
ttttatatttttagtagaga

SEQ ID NO: 625803 - DNA, 20 bp, Artificial Sequence
  chemically synthesized
tgcctcagcctcccaagtag

SEQ ID NO: 625804 - DNA, 20 bp, Artificial Sequence
  chemically synthesized
ttgggaggctgaggcaggag

SEQ ID NO: 625805 - DNA, 20 bp, Artificial Sequence
  chemically synthesized
gttttttttttgagacagag

SEQ ID NO: 625806 - DNA, 20 bp, Artificial Sequence
  chemically synthesized
ttttttttggtttttttttt

SEQ ID NO: 625807 - DNA, 20 bp, Artificial Sequence
  chemically synthesized
tcttattgtgttttcttttt

SEQ ID NO: 625808 - DNA, 20 bp, Artificial Sequence
  chemically synthesized
taaatcattgaatggtctta

SEQ ID NO: 625809 - DNA, 20 bp, Artificial Sequence
  chemically synthesized
gaaaacacaataagaccatt

SEQ ID NO: 625810 - DNA, 20 bp, Artificial Sequence
  chemically synthesized
gccactcacatggtcactat

SEQ ID NO: 625811 - DNA, 20 bp, Artificial Sequence
  chemically synthesized
aaaaatgaaaaagaacacac

SEQ ID NO: 625812 - DNA, 20 bp, Artificial Sequence
  chemically synthesized
gaggcagaggttgcagtgag

SEQ ID NO: 625813 - DNA, 20 bp, Artificial Sequence
  chemically synthesized
aacctctgcctcctgggttc

SEQ ID NO: 625814 - DNA, 20 bp, Artificial Sequence
  chemically synthesized
tagggaggctgaggcaggag

SEQ ID NO: 625815 - DNA, 20 bp, Artificial Sequence
  chemically synthesized
tgcctcagcctccctagtag

SEQ ID NO: 625816 - DNA, 20 bp, Artificial Sequence
  chemically synthesized
ttttgtatttttagtagaga

SEQ ID NO: 625817 - DNA, 20 bp, Artificial Sequence
  chemically synthesized
caggcggatcacctgaggtc

SEQ ID NO: 625818 - DNA, 20 bp, Artificial Sequence
  chemically synthesized
tgcctcagtctcccaaagtg

SEQ ID NO: 625819 - DNA, 20 bp, Artificial Sequence
  chemically synthesized
attcaaagaaggaagagttc

SEQ ID NO: 625820 - DNA, 20 bp, Artificial Sequence
  chemically synthesized
ttgataattacttcactcta

SEQ ID NO: 625821 - DNA, 20 bp, Artificial Sequence
  chemically synthesized
tgactgatatgaattcaagg

SEQ ID NO: 625822 - DNA, 20 bp, Artificial Sequence
  chemically synthesized
gtaacccatttcacgattct

SEQ ID NO: 625823 - DNA, 20 bp, Artificial Sequence
  chemically synthesized
tgcaaataatgtaacccatt

SEQ ID NO: 625824 - DNA, 20 bp, Artificial Sequence
  chemically synthesized
gggttacattatttgcacca

SEQ ID NO: 625825 - DNA, 20 bp, Artificial Sequence
  chemically synthesized
atctcagaatattcccaata

SEQ ID NO: 625826 - DNA, 20 bp, Artificial Sequence
  chemically synthesized
ccatcagttcctccacaaca

SEQ ID NO: 625827 - DNA, 20 bp, Artificial Sequence
  chemically synthesized
acatgttgtggaggaactga

SEQ ID NO: 625828 - DNA, 20 bp, Artificial Sequence
  chemically synthesized
atggtgattgttgccccatt

SEQ ID NO: 625829 - DNA, 20 bp, Artificial Sequence
  chemically synthesized
tgcgtcattttcttgtgtgt

SEQ ID NO: 625830 - DNA, 20 bp, Artificial Sequence
  chemically synthesized
acacacacacaagaaaatga

SEQ ID NO: 625831 - DNA, 20 bp, Artificial Sequence
  chemically synthesized
cagattgtaattagaggtgg

SEQ ID NO: 625832 - DNA, 20 bp, Artificial Sequence
  chemically synthesized
cctttcattttgtctcacag

SEQ ID NO: 625833 - DNA, 20 bp, Artificial Sequence
  chemically synthesized
aaaaatagtgaataaaaaga

SEQ ID NO: 625834 - DNA, 20 bp, Artificial Sequence
  chemically synthesized
taaaaagagaaagattagaa

SEQ ID NO: 625835 - DNA, 20 bp, Artificial Sequence
  chemically synthesized
aggaagagcaagtgactaaa

SEQ ID NO: 625836 - DNA, 20 bp, Artificial Sequence
  chemically synthesized
cgcaaggaagagcaagtgac

SEQ ID NO: 625837 - DNA, 20 bp, Artificial Sequence
  chemically synthesized
ctgtttttttttaaattatt

SEQ ID NO: 625838 - DNA, 20 bp, Artificial Sequence
  chemically synthesized
aaaataatttaaaaaaaaac

SEQ ID NO: 625839 - DNA, 20 bp, Artificial Sequence
  chemically synthesized
ccctcatggtgattaaaatc

SEQ ID NO: 625840 - DNA, 20 bp, Artificial Sequence
  chemically synthesized
caagactatttttaccctca

SEQ ID NO: 625841 - DNA, 20 bp, Artificial Sequence
  chemically synthesized
caccatgagggtaaaaatag

SEQ ID NO: 625842 - DNA, 20 bp, Artificial Sequence
  chemically synthesized
tccctaaataattattgaat

SEQ ID NO: 625843 - DNA, 20 bp, Artificial Sequence
  chemically synthesized
tgcacagttacatctcaggg

SEQ ID NO: 625844 - DNA, 20 bp, Artificial Sequence
  chemically synthesized
agaacatgttacaacagggt

SEQ ID NO: 625845 - DNA, 20 bp, Artificial Sequence
  chemically synthesized
tggaagtatcatatttgaac

SEQ ID NO: 625846 - DNA, 20 bp, Artificial Sequence
  chemically synthesized
tatgtataaaatgcatcatt

SEQ ID NO: 625847 - DNA, 20 bp, Artificial Sequence
  chemically synthesized
tgtcctttttcttgcatggt

SEQ ID NO: 625848 - DNA, 20 bp, Artificial Sequence
  chemically synthesized
ccatgcaagaaaaaggacaa

SEQ ID NO: 625849 - DNA, 20 bp, Artificial Sequence
  chemically synthesized
tcattaagatgggtgccact

SEQ ID NO: 625850 - DNA, 20 bp, Artificial Sequence
  chemically synthesized
cagtggcacccatcttaatg

SEQ ID NO: 625851 - DNA, 20 bp, Artificial Sequence
  chemically synthesized
taatgagaggatttacatcc

SEQ ID NO: 625852 - DNA, 20 bp, Artificial Sequence
  chemically synthesized
acatataaacatttagaaaa

SEQ ID NO: 625853 - DNA, 20 bp, Artificial Sequence
  chemically synthesized
tactggaaacctgtttttct

SEQ ID NO: 625854 - DNA, 20 bp, Artificial Sequence
  chemically synthesized
cataacatgatctactggaa

SEQ ID NO: 625855 - DNA, 20 bp, Artificial Sequence
  chemically synthesized
tatttgaagtcaagaaccgg

SEQ ID NO: 625856 - DNA, 20 bp, Artificial Sequence
  chemically synthesized
tttgatatttgaagtcaaga

SEQ ID NO: 625857 - DNA, 20 bp, Artificial Sequence
  chemically synthesized
attttgaatgtctggtattg

SEQ ID NO: 625858 - DNA, 20 bp, Artificial Sequence
  chemically synthesized
tctggtattgagtggtttct

SEQ ID NO: 625859 - DNA, 20 bp, Artificial Sequence
  chemically synthesized
tacagcatatgctaattgcg

SEQ ID NO: 625860 - DNA, 20 bp, Artificial Sequence
  chemically synthesized
aagttctgttaacatcagct

SEQ ID NO: 625861 - DNA, 20 bp, Artificial Sequence
  chemically synthesized
aaaatactgctgtagtgttt

SEQ ID NO: 625862 - DNA, 20 bp, Artificial Sequence
  chemically synthesized
gaggttgtaaaatactgctg

SEQ ID NO: 625863 - DNA, 20 bp, Artificial Sequence
  chemically synthesized
ctctgtaaatatgagaggca

SEQ ID NO: 625864 - DNA, 20 bp, Artificial Sequence
  chemically synthesized
ttgtttggctccacatttta

SEQ ID NO: 625865 - DNA, 20 bp, Artificial Sequence
  chemically synthesized
ctccacattttattttgctt

SEQ ID NO: 625866 - DNA, 20 bp, Artificial Sequence
  chemically synthesized
tgaggcaatatttcttatta

SEQ ID NO: 625867 - DNA, 20 bp, Artificial Sequence
  chemically synthesized
ttcatctcctggcactggtg

SEQ ID NO: 625868 - DNA, 20 bp, Artificial Sequence
  chemically synthesized
acaatcactgaattatcata

SEQ ID NO: 625869 - DNA, 20 bp, Artificial Sequence
  chemically synthesized
tgaatctcattatgataatt

SEQ ID NO: 625870 - DNA, 20 bp, Artificial Sequence
  chemically synthesized
atgataattcagtgattgta

SEQ ID NO: 625871 - DNA, 20 bp, Artificial Sequence
  chemically synthesized
tgattgcttatcctacttgt

SEQ ID NO: 625872 - DNA, 20 bp, Artificial Sequence
  chemically synthesized
tatctgattgcttatcctac

SEQ ID NO: 625873 - DNA, 20 bp, Artificial Sequence
  chemically synthesized
aggataagcaatcagataac

SEQ ID NO: 625874 - DNA, 20 bp, Artificial Sequence
  chemically synthesized
aaaaaaaacttcagttatct

SEQ ID NO: 625875 - DNA, 20 bp, Artificial Sequence
  chemically synthesized
tgacaaaaaaaacttcagtt

SEQ ID NO: 625876 - DNA, 20 bp, Artificial Sequence
  chemically synthesized
agtaatagggagatgacatt

SEQ ID NO: 625877 - DNA, 20 bp, Artificial Sequence
  chemically synthesized
ttactggaaaaaatggaagc

SEQ ID NO: 625878 - DNA, 20 bp, Artificial Sequence
  chemically synthesized
tagagctaattatataaatc

SEQ ID NO: 625879 - DNA, 20 bp, Artificial Sequence
  chemically synthesized
aattagctctaggtcacaca

SEQ ID NO: 625880 - DNA, 20 bp, Artificial Sequence
  chemically synthesized
aatatgaacagtagaattct

SEQ ID NO: 625881 - DNA, 20 bp, Artificial Sequence
  chemically synthesized
taaagtataatgaagaaaat

SEQ ID NO: 625882 - DNA, 20 bp, Artificial Sequence
  chemically synthesized
gtcagcactaattataactt

SEQ ID NO: 625883 - DNA, 20 bp, Artificial Sequence
  chemically synthesized
acatgaattttctaaatatt

SEQ ID NO: 625884 - DNA, 20 bp, Artificial Sequence
  chemically synthesized
aattttcatctccctggcag

SEQ ID NO: 625885 - DNA, 20 bp, Artificial Sequence
  chemically synthesized
cattagctaaaataaggttc

SEQ ID NO: 625886 - DNA, 20 bp, Artificial Sequence
  chemically synthesized
gtatttacataactattgag

SEQ ID NO: 625887 - DNA, 20 bp, Artificial Sequence
  chemically synthesized
tagtactagccatcaaaatt

SEQ ID NO: 625888 - DNA, 20 bp, Artificial Sequence
  chemically synthesized
gggcttatgatgtacaaact

SEQ ID NO: 625889 - DNA, 20 bp, Artificial Sequence
  chemically synthesized
catcagtagtgtttgaaaca

SEQ ID NO: 625890 - DNA, 20 bp, Artificial Sequence
  chemically synthesized
tcgatggcagatcccatcag

SEQ ID NO: 625891 - DNA, 20 bp, Artificial Sequence
  chemically synthesized
tgccatcgaggagcccatga

SEQ ID NO: 625892 - DNA, 20 bp, Artificial Sequence
  chemically synthesized
ctgtatatctgcctcctcca

SEQ ID NO: 625893 - DNA, 20 bp, Artificial Sequence
  chemically synthesized
gggcctcagaaactttttcc

SEQ ID NO: 625894 - DNA, 20 bp, Artificial Sequence
  chemically synthesized
ccttgttataaacgtttgga

SEQ ID NO: 625895 - DNA, 20 bp, Artificial Sequence
  chemically synthesized
agtcttaggatccttgttat

SEQ ID NO: 625896 - DNA, 20 bp, Artificial Sequence
  chemically synthesized
tgtccaggatccagctcatt

SEQ ID NO: 625897 - DNA, 20 bp, Artificial Sequence
  chemically synthesized
ttctatagccttgactcacc

SEQ ID NO: 625898 - DNA, 20 bp, Artificial Sequence
  chemically synthesized
tcccgcacaatggcattggg

SEQ ID NO: 625899 - DNA, 20 bp, Artificial Sequence
  chemically synthesized
tttatgtctttgtcgtgttg

SEQ ID NO: 625900 - DNA, 20 bp, Artificial Sequence
  chemically synthesized
tgtctttgtcgtgttgtgct

SEQ ID NO: 625901 - DNA, 20 bp, Artificial Sequence
  chemically synthesized
gcatgagataggagactgcc

SEQ ID NO: 625902 - DNA, 20 bp, Artificial Sequence
  chemically synthesized
attcaggctgcatgaaatct

SEQ ID NO: 625903 - DNA, 20 bp, Artificial Sequence
  chemically synthesized
caaaagcttaagtgaaatct

SEQ ID NO: 625904 - DNA, 20 bp, Artificial Sequence
  chemically synthesized
tgaaatcttagagatttcac

SEQ ID NO: 625905 - DNA, 20 bp, Artificial Sequence
  chemically synthesized
tcaaaccaactaatttgcac

SEQ ID NO: 625906 - DNA, 20 bp, Artificial Sequence
  chemically synthesized
ttaagcttttgtgcaaatta

SEQ ID NO: 625907 - DNA, 20 bp, Artificial Sequence
  chemically synthesized
gcttttgtgcaaattagttg

SEQ ID NO: 625908 - DNA, 20 bp, Artificial Sequence
  chemically synthesized
atttactaggctgtaccata

SEQ ID NO: 625909 - DNA, 20 bp, Artificial Sequence
  chemically synthesized
ttatattcattcaaaagaat

SEQ ID NO: 625910 - DNA, 20 bp, Artificial Sequence
  chemically synthesized
ggtagagctgagatttatag

SEQ ID NO: 625911 - DNA, 20 bp, Artificial Sequence
  chemically synthesized
tcagctagtcagtggtagag

SEQ ID NO: 625912 - DNA, 20 bp, Artificial Sequence
  chemically synthesized
gaactttaagcccttttaac

SEQ ID NO: 625913 - DNA, 20 bp, Artificial Sequence
  chemically synthesized
atgagaaaagccaaagttaa

SEQ ID NO: 625914 - DNA, 20 bp, Artificial Sequence
  chemically synthesized
ctgaaaaatgggcagaaaat

SEQ ID NO: 625915 - DNA, 20 bp, Artificial Sequence
  chemically synthesized
aatactaagcaaaagttcag

SEQ ID NO: 625916 - DNA, 20 bp, Artificial Sequence
  chemically synthesized
catttaaaacggatctgaac

SEQ ID NO: 625917 - DNA, 20 bp, Artificial Sequence
  chemically synthesized
tatgtctcagcttgtcccag

SEQ ID NO: 625918 - DNA, 20 bp, Artificial Sequence
  chemically synthesized
gacacataattatggtatgt

SEQ ID NO: 625919 - DNA, 20 bp, Artificial Sequence
  chemically synthesized
gctagagaaggtcagaagaa

SEQ ID NO: 625920 - DNA, 20 bp, Artificial Sequence
  chemically synthesized
ggaagtgttccaaagaaaaa

SEQ ID NO: 625921 - DNA, 20 bp, Artificial Sequence
  chemically synthesized
gattgtgatggactatggaa

SEQ ID NO: 625922 - DNA, 20 bp, Artificial Sequence
  chemically synthesized
ggactaaatgaaagacatcc

SEQ ID NO: 625923 - DNA, 20 bp, Artificial Sequence
  chemically synthesized
tcatatgctttcccatgggc

SEQ ID NO: 625924 - DNA, 20 bp, Artificial Sequence
  chemically synthesized
tgtgtatgcaagtacatgtc

SEQ ID NO: 625925 - DNA, 20 bp, Artificial Sequence
  chemically synthesized
atatatgcatgcatctctgt

SEQ ID NO: 625926 - DNA, 20 bp, Artificial Sequence
  chemically synthesized
tatgattgtagtgttagtaa

SEQ ID NO: 625927 - DNA, 20 bp, Artificial Sequence
  chemically synthesized
tgtatagtcacaccacatat

SEQ ID NO: 625928 - DNA, 20 bp, Artificial Sequence
  chemically synthesized
tgtggtgtgactatacaatt

SEQ ID NO: 625929 - DNA, 20 bp, Artificial Sequence
  chemically synthesized
gtgtgactatacaattgtat

SEQ ID NO: 625930 - DNA, 20 bp, Artificial Sequence
  chemically synthesized
cggaaatttgcaagtaatat

SEQ ID NO: 625931 - DNA, 20 bp, Artificial Sequence
  chemically synthesized
cacatatattacttgcaaat

SEQ ID NO: 625932 - DNA, 20 bp, Artificial Sequence
  chemically synthesized
taataaagatgaaatttttg

SEQ ID NO: 625933 - DNA, 20 bp, Artificial Sequence
  chemically synthesized
ctcaaatggaccactgctag

SEQ ID NO: 625934 - DNA, 20 bp, Artificial Sequence
  chemically synthesized
cactgctagttaagtttctt

SEQ ID NO: 625935 - DNA, 20 bp, Artificial Sequence
  chemically synthesized
ttaagtttctttcaagtttt

SEQ ID NO: 625936 - DNA, 20 bp, Artificial Sequence
  chemically synthesized
catttgaggagttcattaac

SEQ ID NO: 625937 - DNA, 20 bp, Artificial Sequence
  chemically synthesized
ctccagcctcttcatgtgtt

SEQ ID NO: 625938 - DNA, 20 bp, Artificial Sequence
  chemically synthesized
aaaaatactccagcctcttc

SEQ ID NO: 625939 - DNA, 20 bp, Artificial Sequence
  chemically synthesized
aattctgtgatcaggtcctt

SEQ ID NO: 625940 - DNA, 20 bp, Artificial Sequence
  chemically synthesized
cattttcttactttgctaat

SEQ ID NO: 625941 - DNA, 20 bp, Artificial Sequence
  chemically synthesized
atggcaactcaaggttgatc

SEQ ID NO: 625942 - DNA, 20 bp, Artificial Sequence
  chemically synthesized
caactcaaggttgatctctg

SEQ ID NO: 625943 - DNA, 20 bp, Artificial Sequence
  chemically synthesized
tgatctctggtttgtttcta

SEQ ID NO: 625944 - DNA, 20 bp, Artificial Sequence
  chemically synthesized
gctctctggacttttagact

SEQ ID NO: 625945 - DNA, 20 bp, Artificial Sequence
  chemically synthesized
agatgttcaaattaatgtag

SEQ ID NO: 625946 - DNA, 20 bp, Artificial Sequence
  chemically synthesized
atgtcagatgttcaaattaa

SEQ ID NO: 625947 - DNA, 20 bp, Artificial Sequence
  chemically synthesized
tgatgctcaccccaatgatt

SEQ ID NO: 625948 - DNA, 20 bp, Artificial Sequence
  chemically synthesized
tataatattgatgctcaccc

SEQ ID NO: 625949 - DNA, 20 bp, Artificial Sequence
  chemically synthesized
tgaatttaatttcattagga

SEQ ID NO: 625950 - DNA, 20 bp, Artificial Sequence
  chemically synthesized
gctttaaagatctaaactaa

SEQ ID NO: 625951 - DNA, 20 bp, Artificial Sequence
  chemically synthesized
aaaagaaaaattcaaacagc

SEQ ID NO: 625952 - DNA, 20 bp, Artificial Sequence
  chemically synthesized
tttgaaacttcctgtgaact

SEQ ID NO: 625953 - DNA, 20 bp, Artificial Sequence
  chemically synthesized
tgataaactacaagttcaca

SEQ ID NO: 625954 - DNA, 20 bp, Artificial Sequence
  chemically synthesized
caattcttttgatattatac

SEQ ID NO: 625955 - DNA, 20 bp, Artificial Sequence
  chemically synthesized
ggtataatccataaaccttc

SEQ ID NO: 625956 - DNA, 20 bp, Artificial Sequence
  chemically synthesized
ggtgaaatcagaagaaggtt

SEQ ID NO: 625957 - DNA, 20 bp, Artificial Sequence
  chemically synthesized
cataaatggtgaaatcagaa

SEQ ID NO: 625958 - DNA, 20 bp, Artificial Sequence
  chemically synthesized
tggtacatctaccacttgtg

SEQ ID NO: 625959 - DNA, 20 bp, Artificial Sequence
  chemically synthesized
tttcactcagcataatgtga

SEQ ID NO: 625960 - DNA, 20 bp, Artificial Sequence
  chemically synthesized
gctgtatgcagccccttgtg

SEQ ID NO: 625961 - DNA, 20 bp, Artificial Sequence
  chemically synthesized
gtcacaaggggctgcataca

SEQ ID NO: 625962 - DNA, 20 bp, Artificial Sequence
  chemically synthesized
acgaaaccactttctgtctc

SEQ ID NO: 625963 - DNA, 20 bp, Artificial Sequence
  chemically synthesized
ccaaatccttagagacagaa

SEQ ID NO: 625964 - DNA, 20 bp, Artificial Sequence
  chemically synthesized
cagacttgcagggcagggtc

SEQ ID NO: 625965 - DNA, 20 bp, Artificial Sequence
  chemically synthesized
catgcatctcataaggacgt

SEQ ID NO: 625966 - DNA, 20 bp, Artificial Sequence
  chemically synthesized
ccctggaaatttctttcaca

SEQ ID NO: 625967 - DNA, 20 bp, Artificial Sequence
  chemically synthesized
gcaaaatatgattgagcatg

SEQ ID NO: 625968 - DNA, 20 bp, Artificial Sequence
  chemically synthesized
gctagtcatgctcaatcata

SEQ ID NO: 625969 - DNA, 20 bp, Artificial Sequence
  chemically synthesized
gaaaatgccatggaagcaaa

SEQ ID NO: 625970 - DNA, 20 bp, Artificial Sequence
  chemically synthesized
ggatccatagatatagcaga

SEQ ID NO: 625971 - DNA, 20 bp, Artificial Sequence
  chemically synthesized
tggcaaatagatgagtggtt

SEQ ID NO: 625972 - DNA, 20 bp, Artificial Sequence
  chemically synthesized
cgccttgacttctcgaaatg

SEQ ID NO: 625973 - DNA, 20 bp, Artificial Sequence
  chemically synthesized
acacctggcccatttttaaa

SEQ ID NO: 625974 - DNA, 20 bp, Artificial Sequence
  chemically synthesized
ggctcaagtaatactcctgc

SEQ ID NO: 625975 - DNA, 20 bp, Artificial Sequence
  chemically synthesized
gcccaggctagagtgcagtg

SEQ ID NO: 625976 - DNA, 20 bp, Artificial Sequence
  chemically synthesized
ccatttgtttttgcttgctt

SEQ ID NO: 625977 - DNA, 20 bp, Artificial Sequence
  chemically synthesized
gtttccatttgtttttgctt

SEQ ID NO: 625978 - DNA, 20 bp, Artificial Sequence
  chemically synthesized
gcatgtttccatttgttttt

SEQ ID NO: 625979 - DNA, 20 bp, Artificial Sequence
  chemically synthesized
tattgcatgtttccatttgt

SEQ ID NO: 625980 - DNA, 20 bp, Artificial Sequence
  chemically synthesized
aatgtatattgcatgtttcc

SEQ ID NO: 625981 - DNA, 20 bp, Artificial Sequence
  chemically synthesized
atctaaaatgaatgtatatt

SEQ ID NO: 625982 - DNA, 20 bp, Artificial Sequence
  chemically synthesized
aacatgcaatatacattcat

SEQ ID NO: 625983 - DNA, 20 bp, Artificial Sequence
  chemically synthesized
aatatacattcattttagat

SEQ ID NO: 625984 - DNA, 20 bp, Artificial Sequence
  chemically synthesized
tacatccagggggtatatat

SEQ ID NO: 625985 - DNA, 20 bp, Artificial Sequence
  chemically synthesized
agtgagcatagtacccaata

SEQ ID NO: 625986 - DNA, 20 bp, Artificial Sequence
  chemically synthesized
ctttgccccttcctccctcc

SEQ ID NO: 625987 - DNA, 20 bp, Artificial Sequence
  chemically synthesized
tctttatgttcatgtgtact

SEQ ID NO: 625988 - DNA, 20 bp, Artificial Sequence
  chemically synthesized
cacttataagtgagaacgtg

SEQ ID NO: 625989 - DNA, 20 bp, Artificial Sequence
  chemically synthesized
ataagtgagaacgtgtggtg

SEQ ID NO: 625990 - DNA, 20 bp, Artificial Sequence
  chemically synthesized
agaacgtgtggtgcttggtt

SEQ ID NO: 625991 - DNA, 20 bp, Artificial Sequence
  chemically synthesized
ggttttctgtttctgtgtta

SEQ ID NO: 625992 - DNA, 20 bp, Artificial Sequence
  chemically synthesized
catcaatgttgttgcaaagg

SEQ ID NO: 625993 - DNA, 20 bp, Artificial Sequence
  chemically synthesized
ttttctttttttattgctgc

SEQ ID NO: 625994 - DNA, 20 bp, Artificial Sequence
  chemically synthesized
tcaacctacatgcccacaat

SEQ ID NO: 625995 - DNA, 20 bp, Artificial Sequence
  chemically synthesized
tgtaatgaacatcccagtgc

SEQ ID NO: 625996 - DNA, 20 bp, Artificial Sequence
  chemically synthesized
tgggtttatacccaaaggaa

SEQ ID NO: 625997 - DNA, 20 bp, Artificial Sequence
  chemically synthesized
ctttgggtataaacccagta

SEQ ID NO: 625998 - DNA, 20 bp, Artificial Sequence
  chemically synthesized
ttgacccagcaatctcatta

SEQ ID NO: 625999 - DNA, 20 bp, Artificial Sequence
  chemically synthesized
agttcttcgagaaatctcca

SEQ ID NO: 626000 - DNA, 20 bp, Artificial Sequence
  chemically synthesized
ggctactgtgaaaagcagtt

SEQ ID NO: 626001 - DNA, 20 bp, Artificial Sequence
  chemically synthesized
ttaggtcggctactgtgaaa

SEQ ID NO: 626002 - DNA, 20 bp, Artificial Sequence
  chemically synthesized
ttctttgtccttttttactt

SEQ ID NO: 626003 - DNA, 20 bp, Artificial Sequence
  chemically synthesized
tttcgtaggtcttgaaaagt

SEQ ID NO: 626004 - DNA, 20 bp, Artificial Sequence
  chemically synthesized
ttattactgtgtggcttcct

SEQ ID NO: 626005 - DNA, 20 bp, Artificial Sequence
  chemically synthesized
gaagtcccccattattactg

SEQ ID NO: 626006 - DNA, 20 bp, Artificial Sequence
  chemically synthesized
atttaatccagaatttcttt

SEQ ID NO: 626007 - DNA, 20 bp, Artificial Sequence
  chemically synthesized
cagaaaactaacaaagaaat

SEQ ID NO: 626008 - DNA, 20 bp, Artificial Sequence
  chemically synthesized
gatgagaagaatgtatattc

SEQ ID NO: 626009 - DNA, 20 bp, Artificial Sequence
  chemically synthesized
attcgctttatggctgagca

SEQ ID NO: 626010 - DNA, 20 bp, Artificial Sequence
  chemically synthesized
aattttcgaaatttattgag

SEQ ID NO: 626011 - DNA, 20 bp, Artificial Sequence
  chemically synthesized
atttcaattttcgaaattta

SEQ ID NO: 626012 - DNA, 20 bp, Artificial Sequence
  chemically synthesized
ccactgtggtccaagaattt

SEQ ID NO: 626013 - DNA, 20 bp, Artificial Sequence
  chemically synthesized
tattccactgtggtccaaga

SEQ ID NO: 626014 - DNA, 20 bp, Artificial Sequence
  chemically synthesized
gttttgagaggtcctcttgg

SEQ ID NO: 626015 - DNA, 20 bp, Artificial Sequence
  chemically synthesized
gtttggtttccatgtaattg

SEQ ID NO: 626016 - DNA, 20 bp, Artificial Sequence
  chemically synthesized
agtcattcaggagcaagttg

SEQ ID NO: 626017 - DNA, 20 bp, Artificial Sequence
  chemically synthesized
ccaaaagtcattcaggagca

SEQ ID NO: 626018 - DNA, 20 bp, Artificial Sequence
  chemically synthesized
gggtgaacaacaaaattaag

SEQ ID NO: 626019 - DNA, 20 bp, Artificial Sequence
  chemically synthesized
gagtgaaaaaaaataacaat

SEQ ID NO: 626020 - DNA, 20 bp, Artificial Sequence
  chemically synthesized
ttcactcagtataaattaca

SEQ ID NO: 626021 - DNA, 20 bp, Artificial Sequence
  chemically synthesized
tccatggtatgcatgtacca

SEQ ID NO: 626022 - DNA, 20 bp, Artificial Sequence
  chemically synthesized
aaaaaagtcccttgatatgt

SEQ ID NO: 626023 - DNA, 20 bp, Artificial Sequence
  chemically synthesized
acatatcaagggactttttt

SEQ ID NO: 626024 - DNA, 20 bp, Artificial Sequence
  chemically synthesized
gctgctatgaatatttgtgg

SEQ ID NO: 626025 - DNA, 20 bp, Artificial Sequence
  chemically synthesized
ggatacgtttctgtatgaaa

SEQ ID NO: 626026 - DNA, 20 bp, Artificial Sequence
  chemically synthesized
tcattcttaaaaaaatgaaa

SEQ ID NO: 626027 - DNA, 20 bp, Artificial Sequence
  chemically synthesized
acaagttttcatttttttaa

SEQ ID NO: 626028 - DNA, 20 bp, Artificial Sequence
  chemically synthesized
tgtcatatgctaagtccatt

SEQ ID NO: 626029 - DNA, 20 bp, Artificial Sequence
  chemically synthesized
atggtatagccacactggaa

SEQ ID NO: 626030 - DNA, 20 bp, Artificial Sequence
  chemically synthesized
ttaacagtcccaccagcaat

SEQ ID NO: 626031 - DNA, 20 bp, Artificial Sequence
  chemically synthesized
caccagcaatatatgattta

SEQ ID NO: 626032 - DNA, 20 bp, Artificial Sequence
  chemically synthesized
atatatgatttacccagttt

SEQ ID NO: 626033 - DNA, 20 bp, Artificial Sequence
  chemically synthesized
actaggtaataatatctcac

SEQ ID NO: 626034 - DNA, 20 bp, Artificial Sequence
  chemically synthesized
aatggacaaaagacaggcac

SEQ ID NO: 626035 - DNA, 20 bp, Artificial Sequence
  chemically synthesized
tgtcttttgtccattttctt

SEQ ID NO: 626036 - DNA, 20 bp, Artificial Sequence
  chemically synthesized
cttattggatttttaaaatg

SEQ ID NO: 626037 - DNA, 20 bp, Artificial Sequence
  chemically synthesized
tgagttttgagagctcttta

SEQ ID NO: 626038 - DNA, 20 bp, Artificial Sequence
  chemically synthesized
tagttcttgatatctagata

SEQ ID NO: 626039 - DNA, 20 bp, Artificial Sequence
  chemically synthesized
aacctctgcctcctgggctc

SEQ ID NO: 626040 - DNA, 20 bp, Artificial Sequence
  chemically synthesized
ggctcaagcgattctcatgc

SEQ ID NO: 626041 - DNA, 20 bp, Artificial Sequence
  chemically synthesized
ttgggaagctgaggcatgag

SEQ ID NO: 626042 - DNA, 20 bp, Artificial Sequence
  chemically synthesized
ttttgtatttttactagaga

SEQ ID NO: 626043 - DNA, 20 bp, Artificial Sequence
  chemically synthesized
cgaactcctgagcgtaagcg

SEQ ID NO: 626044 - DNA, 20 bp, Artificial Sequence
  chemically synthesized
agcgtaagcgaccagcttgc

SEQ ID NO: 626045 - DNA, 20 bp, Artificial Sequence
  chemically synthesized
ttgggaagctgaggcaagct

SEQ ID NO: 626046 - DNA, 20 bp, Artificial Sequence
  chemically synthesized
aacagaatattttgcatagc

SEQ ID NO: 626047 - DNA, 20 bp, Artificial Sequence
  chemically synthesized
caaatatgttctatttttga

SEQ ID NO: 626048 - DNA, 20 bp, Artificial Sequence
  chemically synthesized
ttctatttttgagtaagttt

SEQ ID NO: 626049 - DNA, 20 bp, Artificial Sequence
  chemically synthesized
ttttacagtttaagttcttc

SEQ ID NO: 626050 - DNA, 20 bp, Artificial Sequence
  chemically synthesized
ttcttctgatgtttagatca

SEQ ID NO: 626051 - DNA, 20 bp, Artificial Sequence
  chemically synthesized
gatgtttagatcaaggtgtt

SEQ ID NO: 626052 - DNA, 20 bp, Artificial Sequence
  chemically synthesized
tttagatcaaggtgtttttt

SEQ ID NO: 626053 - DNA, 20 bp, Artificial Sequence
  chemically synthesized
tttgttttttgcctatgggt

SEQ ID NO: 626054 - DNA, 20 bp, Artificial Sequence
  chemically synthesized
taaaaaggctaaccctcctt

SEQ ID NO: 626055 - DNA, 20 bp, Artificial Sequence
  chemically synthesized
gctaaccctccttactggat

SEQ ID NO: 626056 - DNA, 20 bp, Artificial Sequence
  chemically synthesized
ggaaaagtttccttgtgtcc

SEQ ID NO: 626057 - DNA, 20 bp, Artificial Sequence
  chemically synthesized
aacaaacatcaattccctgg

SEQ ID NO: 626058 - DNA, 20 bp, Artificial Sequence
  chemically synthesized
aggaaacttttccagggaat

SEQ ID NO: 626059 - DNA, 20 bp, Artificial Sequence
  chemically synthesized
ccagggaattgatgtttgtt

SEQ ID NO: 626060 - DNA, 20 bp, Artificial Sequence
  chemically synthesized
gtttgttatttgattgtggt

SEQ ID NO: 626061 - DNA, 20 bp, Artificial Sequence
  chemically synthesized
tatttaatgtatacaatttg

SEQ ID NO: 626062 - DNA, 20 bp, Artificial Sequence
  chemically synthesized
aattgtatacattaaatatg

SEQ ID NO: 626063 - DNA, 20 bp, Artificial Sequence
  chemically synthesized
atgcccaatttatttatttt

SEQ ID NO: 626064 - DNA, 20 bp, Artificial Sequence
  chemically synthesized
atctatttctgggctctcta

SEQ ID NO: 626065 - DNA, 20 bp, Artificial Sequence
  chemically synthesized
attaactttaacaacagtaa

SEQ ID NO: 626066 - DNA, 20 bp, Artificial Sequence
  chemically synthesized
taattaatttttccttattc

SEQ ID NO: 626067 - DNA, 20 bp, Artificial Sequence
  chemically synthesized
agcaatgtttttgaacttac

SEQ ID NO: 626068 - DNA, 20 bp, Artificial Sequence
  chemically synthesized
aattcttacgaaaattttag

SEQ ID NO: 626069 - DNA, 20 bp, Artificial Sequence
  chemically synthesized
gaattcacatctttactatg

SEQ ID NO: 626070 - DNA, 20 bp, Artificial Sequence
  chemically synthesized
atatggagatacattatgtt

SEQ ID NO: 626071 - DNA, 20 bp, Artificial Sequence
  chemically synthesized
gcacttggtaacttttatca

SEQ ID NO: 626072 - DNA, 20 bp, Artificial Sequence
  chemically synthesized
ttttatcatacagattctgt

SEQ ID NO: 626073 - DNA, 20 bp, Artificial Sequence
  chemically synthesized
acagattctgtgcatgtttt

SEQ ID NO: 626074 - DNA, 20 bp, Artificial Sequence
  chemically synthesized
gttttgttagttttatatgt

SEQ ID NO: 626075 - DNA, 20 bp, Artificial Sequence
  chemically synthesized
aaaaaaaaatgcaatagcat

SEQ ID NO: 626076 - DNA, 20 bp, Artificial Sequence
  chemically synthesized
tgcctcagcctcctgagtag

SEQ ID NO: 626077 - DNA, 20 bp, Artificial Sequence
  chemically synthesized
ttttatatttttagtcgaga

SEQ ID NO: 626078 - DNA, 20 bp, Artificial Sequence
  chemically synthesized
cgccggggtctcccaaagtg

SEQ ID NO: 626079 - DNA, 20 bp, Artificial Sequence
  chemically synthesized
tagtcgatgtcttttctcat

SEQ ID NO: 626080 - DNA, 20 bp, Artificial Sequence
  chemically synthesized
gatgtcttttctcattctag

SEQ ID NO: 626081 - DNA, 20 bp, Artificial Sequence
  chemically synthesized
tcttttctcattctagtttt

SEQ ID NO: 626082 - DNA, 20 bp, Artificial Sequence
  chemically synthesized
ttctcattctagttttgttt

SEQ ID NO: 626083 - DNA, 20 bp, Artificial Sequence
  chemically synthesized
aataaaagattgaaataaga

SEQ ID NO: 626084 - DNA, 20 bp, Artificial Sequence
  chemically synthesized
tggtaaatacctgctaaaat

SEQ ID NO: 626085 - DNA, 20 bp, Artificial Sequence
  chemically synthesized
ttatgggctgtggtcccaaa

SEQ ID NO: 626086 - DNA, 20 bp, Artificial Sequence
  chemically synthesized
gtatttctcgtgttattgag

SEQ ID NO: 626087 - DNA, 20 bp, Artificial Sequence
  chemically synthesized
tctcgtgttattgaggcctg

SEQ ID NO: 626088 - DNA, 20 bp, Artificial Sequence
  chemically synthesized
gcccactcagaatgtaccat

SEQ ID NO: 626089 - DNA, 20 bp, Artificial Sequence
  chemically synthesized
ctggtgctgctaggtagagt

SEQ ID NO: 626090 - DNA, 20 bp, Artificial Sequence
  chemically synthesized
tcttagatctatagagataa

SEQ ID NO: 626091 - DNA, 20 bp, Artificial Sequence
  chemically synthesized
gagataaaagtgtttcctag

SEQ ID NO: 626092 - DNA, 20 bp, Artificial Sequence
  chemically synthesized
gcagctggagggtaccagta

SEQ ID NO: 626093 - DNA, 20 bp, Artificial Sequence
  chemically synthesized
aatgtctctgggtaaaagtg

SEQ ID NO: 626094 - DNA, 20 bp, Artificial Sequence
  chemically synthesized
tctcatggccatagcgtcca

SEQ ID NO: 626095 - DNA, 20 bp, Artificial Sequence
  chemically synthesized
tggatagccttaccagtgct

SEQ ID NO: 626096 - DNA, 20 bp, Artificial Sequence
  chemically synthesized
tcctaggtccatatgaccaa

SEQ ID NO: 626097 - DNA, 20 bp, Artificial Sequence
  chemically synthesized
tttctgaaccaggtcactta

SEQ ID NO: 626098 - DNA, 20 bp, Artificial Sequence
  chemically synthesized
cctcagttctgcaggtatga

SEQ ID NO: 626099 - DNA, 20 bp, Artificial Sequence
  chemically synthesized
ctgtgcctattgggaacaga

SEQ ID NO: 626100 - DNA, 20 bp, Artificial Sequence
  chemically synthesized
gaacagacagtgctttctgg

SEQ ID NO: 626101 - DNA, 20 bp, Artificial Sequence
  chemically synthesized
cctcagacccacaggaacaa

SEQ ID NO: 626102 - DNA, 20 bp, Artificial Sequence
  chemically synthesized
tggctgggtgcaactgccac

SEQ ID NO: 626103 - DNA, 20 bp, Artificial Sequence
  chemically synthesized
tcttaggcctgtagggacaa

SEQ ID NO: 626104 - DNA, 20 bp, Artificial Sequence
  chemically synthesized
gaaaaatagacaagtggcag

SEQ ID NO: 626105 - DNA, 20 bp, Artificial Sequence
  chemically synthesized
ggtaagtgcctctcctttcc

SEQ ID NO: 626106 - DNA, 20 bp, Artificial Sequence
  chemically synthesized
aaaggagaggcacttaccct

SEQ ID NO: 626107 - DNA, 20 bp, Artificial Sequence
  chemically synthesized
tagtagcagaaggcagccca

SEQ ID NO: 626108 - DNA, 20 bp, Artificial Sequence
  chemically synthesized
agctgggctgccttctgcta

SEQ ID NO: 626109 - DNA, 20 bp, Artificial Sequence
  chemically synthesized
gggcacatatgagaatgtgc

SEQ ID NO: 626110 - DNA, 20 bp, Artificial Sequence
  chemically synthesized
ctctagcgcgaggctctcaa

SEQ ID NO: 626111 - DNA, 20 bp, Artificial Sequence
  chemically synthesized
agcgcgaggctctcaaagca

SEQ ID NO: 626112 - DNA, 20 bp, Artificial Sequence
  chemically synthesized
aggatagtcagagaaaagca

SEQ ID NO: 626113 - DNA, 20 bp, Artificial Sequence
  chemically synthesized
acaattttcttttgatggcc

SEQ ID NO: 626114 - DNA, 20 bp, Artificial Sequence
  chemically synthesized
tttcttttgatggcctcttg

SEQ ID NO: 626115 - DNA, 20 bp, Artificial Sequence
  chemically synthesized
gatggcctcttgttttgttt

SEQ ID NO: 626116 - DNA, 20 bp, Artificial Sequence
  chemically synthesized
actatgaggagcagggaaaa

SEQ ID NO: 626117 - DNA, 20 bp, Artificial Sequence
  chemically synthesized
atttcggacaagatggcata

SEQ ID NO: 626118 - DNA, 20 bp, Artificial Sequence
  chemically synthesized
gtccgaaatggaattctcag

SEQ ID NO: 626119 - DNA, 20 bp, Artificial Sequence
  chemically synthesized
gaattctcagtcttgtttta

SEQ ID NO: 626120 - DNA, 20 bp, Artificial Sequence
  chemically synthesized
ttgttttaatatgttttaac

SEQ ID NO: 626121 - DNA, 20 bp, Artificial Sequence
  chemically synthesized
ttaacacgtgattcagataa

SEQ ID NO: 626122 - DNA, 20 bp, Artificial Sequence
  chemically synthesized
atggtacaattaaatgtata

SEQ ID NO: 626123 - DNA, 20 bp, Artificial Sequence
  chemically synthesized
tttcaaaggctgacatgtac

SEQ ID NO: 626124 - DNA, 20 bp, Artificial Sequence
  chemically synthesized
gccaccgcatttgaccaagt

SEQ ID NO: 626125 - DNA, 20 bp, Artificial Sequence
  chemically synthesized
cacgttggcctcccaaagtg

SEQ ID NO: 626126 - DNA, 20 bp, Artificial Sequence
  chemically synthesized
tgggtggatcacctgaggtc

SEQ ID NO: 626127 - DNA, 20 bp, Artificial Sequence
  chemically synthesized
ttttgtatttttagtagaga

SEQ ID NO: 626128 - DNA, 20 bp, Artificial Sequence
  chemically synthesized
tcgggaggctgaggcaggag

SEQ ID NO: 626129 - DNA, 20 bp, Artificial Sequence
  chemically synthesized
tactcatcacttggtatagt

SEQ ID NO: 626130 - DNA, 20 bp, Artificial Sequence
  chemically synthesized
agaatgactgtactaggtat

SEQ ID NO: 626131 - DNA, 20 bp, Artificial Sequence
  chemically synthesized
gtcggcactatttttagtta

SEQ ID NO: 626132 - DNA, 20 bp, Artificial Sequence
  chemically synthesized
aaatatataaaactttaata

SEQ ID NO: 626133 - DNA, 20 bp, Artificial Sequence
  chemically synthesized
ataaaatacaatctacatat

SEQ ID NO: 626134 - DNA, 20 bp, Artificial Sequence
  chemically synthesized
ccaccgcacctggcctcgac

SEQ ID NO: 626135 - DNA, 20 bp, Artificial Sequence
  chemically synthesized
cgcctcggcctcccaaagta

SEQ ID NO: 626136 - DNA, 20 bp, Artificial Sequence
  chemically synthesized
ggcgggtggatcacaaggtc

SEQ ID NO: 626137 - DNA, 20 bp, Artificial Sequence
  chemically synthesized
ttttgtatttttagtagaga

SEQ ID NO: 626138 - DNA, 20 bp, Artificial Sequence
  chemically synthesized
gacagatttgttttgttttg

SEQ ID NO: 626139 - DNA, 20 bp, Artificial Sequence
  chemically synthesized
gcataattttgacagatttg

SEQ ID NO: 626140 - DNA, 20 bp, Artificial Sequence
  chemically synthesized
tgtttgcataattttgacag

SEQ ID NO: 626141 - DNA, 20 bp, Artificial Sequence
  chemically synthesized
atttttgtttgcataatttt

SEQ ID NO: 626142 - DNA, 20 bp, Artificial Sequence
  chemically synthesized
aatttcaagttggtagacat

SEQ ID NO: 626143 - DNA, 20 bp, Artificial Sequence
  chemically synthesized
attcattaatcatttatgtc

SEQ ID NO: 626144 - DNA, 20 bp, Artificial Sequence
  chemically synthesized
gttgttcaaactagagacat

SEQ ID NO: 626145 - DNA, 20 bp, Artificial Sequence
  chemically synthesized
cactgcgtaagcctttctat

SEQ ID NO: 626146 - DNA, 20 bp, Artificial Sequence
  chemically synthesized
cttggctaaaacatctatag

SEQ ID NO: 626147 - DNA, 20 bp, Artificial Sequence
  chemically synthesized
caaaccaaatgtgcttgatt

SEQ ID NO: 626148 - DNA, 20 bp, Artificial Sequence
  chemically synthesized
aaaacatttaatcaagcaca

SEQ ID NO: 626149 - DNA, 20 bp, Artificial Sequence
  chemically synthesized
tttatattcaaaccaaatgt

SEQ ID NO: 626150 - DNA, 20 bp, Artificial Sequence
  chemically synthesized
tctttttatattcaaaccaa

SEQ ID NO: 626151 - DNA, 20 bp, Artificial Sequence
  chemically synthesized
ataaaaagatgatagagcaa

SEQ ID NO: 626152 - DNA, 20 bp, Artificial Sequence
  chemically synthesized
aacactaattgttgagaaaa

SEQ ID NO: 626153 - DNA, 20 bp, Artificial Sequence
  chemically synthesized
atcaggtttttctcaacaat

SEQ ID NO: 626154 - DNA, 20 bp, Artificial Sequence
  chemically synthesized
atttattaatttttggaact

SEQ ID NO: 626155 - DNA, 20 bp, Artificial Sequence
  chemically synthesized
aaaagttaagtatttttatc

SEQ ID NO: 626156 - DNA, 20 bp, Artificial Sequence
  chemically synthesized
tttatgttaaatattttatt

SEQ ID NO: 626157 - DNA, 20 bp, Artificial Sequence
  chemically synthesized
ttttattctatgctttttat

SEQ ID NO: 626158 - DNA, 20 bp, Artificial Sequence
  chemically synthesized
atatattgcagcaacattat

SEQ ID NO: 626159 - DNA, 20 bp, Artificial Sequence
  chemically synthesized
cccttttatgggcctataac

SEQ ID NO: 626160 - DNA, 20 bp, Artificial Sequence
  chemically synthesized
gcattagggcaaaaaaaaaa

SEQ ID NO: 626161 - DNA, 20 bp, Artificial Sequence
  chemically synthesized
tcatctttttttttttgccc

SEQ ID NO: 626162 - DNA, 20 bp, Artificial Sequence
  chemically synthesized
ttctcattaaaggtattgat

SEQ ID NO: 626163 - DNA, 20 bp, Artificial Sequence
  chemically synthesized
caacaaaactgtgagagagg

SEQ ID NO: 626164 - DNA, 20 bp, Artificial Sequence
  chemically synthesized
ggaaaaagctgctcctctct

SEQ ID NO: 626165 - DNA, 20 bp, Artificial Sequence
  chemically synthesized
cagctttttcctttgagaac

SEQ ID NO: 626166 - DNA, 20 bp, Artificial Sequence
  chemically synthesized
aatgacttcctatttcagtg

SEQ ID NO: 626167 - DNA, 20 bp, Artificial Sequence
  chemically synthesized
aagagcaggatgctatgaag

SEQ ID NO: 626168 - DNA, 20 bp, Artificial Sequence
  chemically synthesized
gaaccaaaaagagccacaga

SEQ ID NO: 626169 - DNA, 20 bp, Artificial Sequence
  chemically synthesized
ccaataagtgataaataaca

SEQ ID NO: 626170 - DNA, 20 bp, Artificial Sequence
  chemically synthesized
atgaatagcttaaccaactc

SEQ ID NO: 626171 - DNA, 20 bp, Artificial Sequence
  chemically synthesized
ttggttaagctattcataca

SEQ ID NO: 626172 - DNA, 20 bp, Artificial Sequence
  chemically synthesized
attacaaagcaacatgtatg

SEQ ID NO: 626173 - DNA, 20 bp, Artificial Sequence
  chemically synthesized
tacacaacctatgctttgta

SEQ ID NO: 626174 - DNA, 20 bp, Artificial Sequence
  chemically synthesized
ggttcattatattacacaac

SEQ ID NO: 626175 - DNA, 20 bp, Artificial Sequence
  chemically synthesized
tcttatctctctatttaaat

SEQ ID NO: 626176 - DNA, 20 bp, Artificial Sequence
  chemically synthesized
tatttaaatcatagatttca

SEQ ID NO: 626177 - DNA, 20 bp, Artificial Sequence
  chemically synthesized
cgtattaaactttttgaaat

SEQ ID NO: 626178 - DNA, 20 bp, Artificial Sequence
  chemically synthesized
tacagcattaaatgtatcaa

SEQ ID NO: 626179 - DNA, 20 bp, Artificial Sequence
  chemically synthesized
atgttacagcattaaatgta

SEQ ID NO: 626180 - DNA, 20 bp, Artificial Sequence
  chemically synthesized
tgtttttaatgccttcacat

SEQ ID NO: 626181 - DNA, 20 bp, Artificial Sequence
  chemically synthesized
tgtgaaggcattaaaaacat

SEQ ID NO: 626182 - DNA, 20 bp, Artificial Sequence
  chemically synthesized
attaaaaacatttttgtttg

SEQ ID NO: 626183 - DNA, 20 bp, Artificial Sequence
  chemically synthesized
ttcaaaatccttacaaacaa

SEQ ID NO: 626184 - DNA, 20 bp, Artificial Sequence
  chemically synthesized
gagttatattatttgatcct

SEQ ID NO: 626185 - DNA, 20 bp, Artificial Sequence
  chemically synthesized
tcccaaatatctcttgttta

SEQ ID NO: 626186 - DNA, 20 bp, Artificial Sequence
  chemically synthesized
agtagaacttcccaaatatc

SEQ ID NO: 626187 - DNA, 20 bp, Artificial Sequence
  chemically synthesized
tatcaaggactctgcttatg

SEQ ID NO: 626188 - DNA, 20 bp, Artificial Sequence
  chemically synthesized
atgatatcaaggactctgct

SEQ ID NO: 626189 - DNA, 20 bp, Artificial Sequence
  chemically synthesized
tacaaacatgatatcaagga

SEQ ID NO: 626190 - DNA, 20 bp, Artificial Sequence
  chemically synthesized
cataagcagagtccttgata

SEQ ID NO: 626191 - DNA, 20 bp, Artificial Sequence
  chemically synthesized
ctaggacaaggctgactgga

SEQ ID NO: 626192 - DNA, 20 bp, Artificial Sequence
  chemically synthesized
ctgactggaccaagattgag

SEQ ID NO: 626193 - DNA, 20 bp, Artificial Sequence
  chemically synthesized
taaagtattttaggaagtgc

SEQ ID NO: 626194 - DNA, 20 bp, Artificial Sequence
  chemically synthesized
caaggtgtatttgtgcatac

SEQ ID NO: 626195 - DNA, 20 bp, Artificial Sequence
  chemically synthesized
accttgaattttgaattgta

SEQ ID NO: 626196 - DNA, 20 bp, Artificial Sequence
  chemically synthesized
aattttgaattgtattttgt

SEQ ID NO: 626197 - DNA, 20 bp, Artificial Sequence
  chemically synthesized
gaattgtattttgtttgggt

SEQ ID NO: 626198 - DNA, 20 bp, Artificial Sequence
  chemically synthesized
catcttttcttttagaatat

SEQ ID NO: 626199 - DNA, 20 bp, Artificial Sequence
  chemically synthesized
atgttggtaatatttttgtt

SEQ ID NO: 626200 - DNA, 20 bp, Artificial Sequence
  chemically synthesized
aacatattatcgtgatgtag

SEQ ID NO: 626201 - DNA, 20 bp, Artificial Sequence
  chemically synthesized
tgtagataggatttttttca

SEQ ID NO: 626202 - DNA, 20 bp, Artificial Sequence
  chemically synthesized
aatgcaatactaatatgctc

SEQ ID NO: 626203 - DNA, 20 bp, Artificial Sequence
  chemically synthesized
ttctttatcgtatggtccta

SEQ ID NO: 626204 - DNA, 20 bp, Artificial Sequence
  chemically synthesized
aagtataccttaataacaac

SEQ ID NO: 626205 - DNA, 20 bp, Artificial Sequence
  chemically synthesized
acaatagcttttataaaaat

SEQ ID NO: 626206 - DNA, 20 bp, Artificial Sequence
  chemically synthesized
ttaggacagattattcataa

SEQ ID NO: 626207 - DNA, 20 bp, Artificial Sequence
  chemically synthesized
gattatgcacaataaattag

SEQ ID NO: 626208 - DNA, 20 bp, Artificial Sequence
  chemically synthesized
ttgaatcattttcttttata

SEQ ID NO: 626209 - DNA, 20 bp, Artificial Sequence
  chemically synthesized
cataatctaattataaaaga

SEQ ID NO: 626210 - DNA, 20 bp, Artificial Sequence
  chemically synthesized
ggcctggagataaggaagta

SEQ ID NO: 626211 - DNA, 20 bp, Artificial Sequence
  chemically synthesized
tcattaatttagctcaattg

SEQ ID NO: 626212 - DNA, 20 bp, Artificial Sequence
  chemically synthesized
tacacaacaacaacattatg

SEQ ID NO: 626213 - DNA, 20 bp, Artificial Sequence
  chemically synthesized
tgttctttacaaatttactt

SEQ ID NO: 626214 - DNA, 20 bp, Artificial Sequence
  chemically synthesized
ctgggtatggagtggatcaa

SEQ ID NO: 626215 - DNA, 20 bp, Artificial Sequence
  chemically synthesized
tcttgcatgcaggtgtggtt

SEQ ID NO: 626216 - DNA, 20 bp, Artificial Sequence
  chemically synthesized
catgcaggtgtggttatttg

SEQ ID NO: 626217 - DNA, 20 bp, Artificial Sequence
  chemically synthesized
ggaagtaatttgtgtcaatt

SEQ ID NO: 626218 - DNA, 20 bp, Artificial Sequence
  chemically synthesized
aatttgtgtcaattcagagc

SEQ ID NO: 626219 - DNA, 20 bp, Artificial Sequence
  chemically synthesized
agaaacagcagagaagatat

SEQ ID NO: 626220 - DNA, 20 bp, Artificial Sequence
  chemically synthesized
aaaagctaatatatcttctc

SEQ ID NO: 626221 - DNA, 20 bp, Artificial Sequence
  chemically synthesized
catggcattccatggcagcg

SEQ ID NO: 626222 - DNA, 20 bp, Artificial Sequence
  chemically synthesized
gccttaacacaacagatatt

SEQ ID NO: 626223 - DNA, 20 bp, Artificial Sequence
  chemically synthesized
tgtgttaaggcactgaaatt

SEQ ID NO: 626224 - DNA, 20 bp, Artificial Sequence
  chemically synthesized
taaggcactgaaattgtggg

SEQ ID NO: 626225 - DNA, 20 bp, Artificial Sequence
  chemically synthesized
ttaaaagaatgaatatacta

SEQ ID NO: 626226 - DNA, 20 bp, Artificial Sequence
  chemically synthesized
agtgaaaaaggaaagttgta

SEQ ID NO: 626227 - DNA, 20 bp, Artificial Sequence
  chemically synthesized
agatatggatctaattaata

SEQ ID NO: 626228 - DNA, 20 bp, Artificial Sequence
  chemically synthesized
tttttcaaaagtggcacttt

SEQ ID NO: 626229 - DNA, 20 bp, Artificial Sequence
  chemically synthesized
ttttaacgttttggactgat

SEQ ID NO: 626230 - DNA, 20 bp, Artificial Sequence
  chemically synthesized
aggccgtcctttgcattgta

SEQ ID NO: 626231 - DNA, 20 bp, Artificial Sequence
  chemically synthesized
ggcatctagtaggtagaaga

SEQ ID NO: 626232 - DNA, 20 bp, Artificial Sequence
  chemically synthesized
ataagacatttgacaatgtc

SEQ ID NO: 626233 - DNA, 20 bp, Artificial Sequence
  chemically synthesized
taagtggttctcaaccaggc

SEQ ID NO: 626234 - DNA, 20 bp, Artificial Sequence
  chemically synthesized
ttatctaatacactcttttt

SEQ ID NO: 626235 - DNA, 20 bp, Artificial Sequence
  chemically synthesized
tgaacaatgaaaatccttgt

SEQ ID NO: 626236 - DNA, 20 bp, Artificial Sequence
  chemically synthesized
attcagctcaaaatcagtta

SEQ ID NO: 626237 - DNA, 20 bp, Artificial Sequence
  chemically synthesized
tgaattatgatacccatact

SEQ ID NO: 626238 - DNA, 20 bp, Artificial Sequence
  chemically synthesized
cttttcagatctatataatt

SEQ ID NO: 626239 - DNA, 20 bp, Artificial Sequence
  chemically synthesized
gattgtgtcccagtttagag

SEQ ID NO: 626240 - DNA, 20 bp, Artificial Sequence
  chemically synthesized
caactaaggtgtgattgtgt

SEQ ID NO: 626241 - DNA, 20 bp, Artificial Sequence
  chemically synthesized
tacttaaattaacaactaag

SEQ ID NO: 626242 - DNA, 20 bp, Artificial Sequence
  chemically synthesized
tagttgttaatttaagtaat

SEQ ID NO: 626243 - DNA, 20 bp, Artificial Sequence
  chemically synthesized
atcataaaggattgcctgat

SEQ ID NO: 626244 - DNA, 20 bp, Artificial Sequence
  chemically synthesized
atccatcatcaggcaatcct

SEQ ID NO: 626245 - DNA, 20 bp, Artificial Sequence
  chemically synthesized
ttggagaaggtaagaatcat

SEQ ID NO: 626246 - DNA, 20 bp, Artificial Sequence
  chemically synthesized
cagatgagttgaatggtagg

SEQ ID NO: 626247 - DNA, 20 bp, Artificial Sequence
  chemically synthesized
attatttgcagggagcactg

SEQ ID NO: 626248 - DNA, 20 bp, Artificial Sequence
  chemically synthesized
aggctctttcacttttgcgg

SEQ ID NO: 626249 - DNA, 20 bp, Artificial Sequence
  chemically synthesized
gaaagagcctcctcgaggtg

SEQ ID NO: 626250 - DNA, 20 bp, Artificial Sequence
  chemically synthesized
acatcatcatcagtggctca

SEQ ID NO: 626251 - DNA, 20 bp, Artificial Sequence
  chemically synthesized
gatgatgtggcctttttatt

SEQ ID NO: 626252 - DNA, 20 bp, Artificial Sequence
  chemically synthesized
tgtggcctttttattctagg

SEQ ID NO: 626253 - DNA, 20 bp, Artificial Sequence
  chemically synthesized
tttttattctaggtttagtt

SEQ ID NO: 626254 - DNA, 20 bp, Artificial Sequence
  chemically synthesized
agagaatatttatataaata

SEQ ID NO: 626255 - DNA, 20 bp, Artificial Sequence
  chemically synthesized
tctcttgaatggaagcacat

SEQ ID NO: 626256 - DNA, 20 bp, Artificial Sequence
  chemically synthesized
agaatttgaactaatcatct

SEQ ID NO: 626257 - DNA, 20 bp, Artificial Sequence
  chemically synthesized
tgaacagggtaaggtaaaaa

SEQ ID NO: 626258 - DNA, 20 bp, Artificial Sequence
  chemically synthesized
aaatatggcttccccggtcc

SEQ ID NO: 626259 - DNA, 20 bp, Artificial Sequence
  chemically synthesized
acagataacctattcggaaa

SEQ ID NO: 626260 - DNA, 20 bp, Artificial Sequence
  chemically synthesized
tgttcctatttatgtggtca

SEQ ID NO: 626261 - DNA, 20 bp, Artificial Sequence
  chemically synthesized
taaggttagatgaagtttgc

SEQ ID NO: 626262 - DNA, 20 bp, Artificial Sequence
  chemically synthesized
atctatacaataaggttaga

SEQ ID NO: 626263 - DNA, 20 bp, Artificial Sequence
  chemically synthesized
tacaggttggccgaagtaaa

SEQ ID NO: 626264 - DNA, 20 bp, Artificial Sequence
  chemically synthesized
gggcaagatctcaggagata

SEQ ID NO: 626265 - DNA, 20 bp, Artificial Sequence
  chemically synthesized
acacttgggcattactctga

SEQ ID NO: 626266 - DNA, 20 bp, Artificial Sequence
  chemically synthesized
ttaggatgaagttaaaacac

SEQ ID NO: 626267 - DNA, 20 bp, Artificial Sequence
  chemically synthesized
acgggacacctgtgaatcta

SEQ ID NO: 626268 - DNA, 20 bp, Artificial Sequence
  chemically synthesized
ggagccatgaaatgaggcag

SEQ ID NO: 626269 - DNA, 20 bp, Artificial Sequence
  chemically synthesized
ccctaagttcgctaattctt

SEQ ID NO: 626270 - DNA, 20 bp, Artificial Sequence
  chemically synthesized
aataacatgtacaatggctc

SEQ ID NO: 626271 - DNA, 20 bp, Artificial Sequence
  chemically synthesized
cagaaaggtcattagaacat

SEQ ID NO: 626272 - DNA, 20 bp, Artificial Sequence
  chemically synthesized
gtaaccaagagacaatagct

SEQ ID NO: 626273 - DNA, 20 bp, Artificial Sequence
  chemically synthesized
ttgttggtagctcaggtcat

SEQ ID NO: 626274 - DNA, 20 bp, Artificial Sequence
  chemically synthesized
acaacaggaagacgagactg

SEQ ID NO: 626275 - DNA, 20 bp, Artificial Sequence
  chemically synthesized
aagacgagactgtgaggttt

SEQ ID NO: 626276 - DNA, 20 bp, Artificial Sequence
  chemically synthesized
tctatcttgcaacaacaaaa

SEQ ID NO: 626277 - DNA, 20 bp, Artificial Sequence
  chemically synthesized
tcctgcagcaatttcttaaa

SEQ ID NO: 626278 - DNA, 20 bp, Artificial Sequence
  chemically synthesized
aaacaatttcctttgaaaat

SEQ ID NO: 626279 - DNA, 20 bp, Artificial Sequence
  chemically synthesized
aaaccattattttcaaagga

SEQ ID NO: 626280 - DNA, 20 bp, Artificial Sequence
  chemically synthesized
ttacaccttattttaaaaaa

SEQ ID NO: 626281 - DNA, 20 bp, Artificial Sequence
  chemically synthesized
cttagggctcttctgtgaat

SEQ ID NO: 626282 - DNA, 20 bp, Artificial Sequence
  chemically synthesized
aataaagatgtaagtagaat

SEQ ID NO: 626283 - DNA, 20 bp, Artificial Sequence
  chemically synthesized
tattttgttctgaaattttc

SEQ ID NO: 626284 - DNA, 20 bp, Artificial Sequence
  chemically synthesized
tatttttggaggtgtccaat

SEQ ID NO: 626285 - DNA, 20 bp, Artificial Sequence
  chemically synthesized
ttggaggtgtccaatatttg

SEQ ID NO: 626286 - DNA, 20 bp, Artificial Sequence
  chemically synthesized
ataatcttatagaacatgtg

SEQ ID NO: 626287 - DNA, 20 bp, Artificial Sequence
  chemically synthesized
aaaaactgtacacatgttct

SEQ ID NO: 626288 - DNA, 20 bp, Artificial Sequence
  chemically synthesized
tttttcaaaaactatttttt

SEQ ID NO: 626289 - DNA, 20 bp, Artificial Sequence
  chemically synthesized
tgtcaaacaaacacttaaaa

SEQ ID NO: 626290 - DNA, 20 bp, Artificial Sequence
  chemically synthesized
tcaaaaactattttttaagt

SEQ ID NO: 626291 - DNA, 20 bp, Artificial Sequence
  chemically synthesized
aataagaaaattcttttagg

SEQ ID NO: 626292 - DNA, 20 bp, Artificial Sequence
  chemically synthesized
tccttaaatataacattcca

SEQ ID NO: 626293 - DNA, 20 bp, Artificial Sequence
  chemically synthesized
atttcaagtcttttatttcc

SEQ ID NO: 626294 - DNA, 20 bp, Artificial Sequence
  chemically synthesized
tttatttccaaaagattttc

SEQ ID NO: 626295 - DNA, 20 bp, Artificial Sequence
  chemically synthesized
cctggtatttgataaaactt

SEQ ID NO: 626296 - DNA, 20 bp, Artificial Sequence
  chemically synthesized
attcttgaaatggtaaacat

SEQ ID NO: 626297 - DNA, 20 bp, Artificial Sequence
  chemically synthesized
ttggatgtttaccatttcaa

SEQ ID NO: 626298 - DNA, 20 bp, Artificial Sequence
  chemically synthesized
aatggctgactttgaatatc

SEQ ID NO: 626299 - DNA, 20 bp, Artificial Sequence
  chemically synthesized
tattccaggcacatattttc

SEQ ID NO: 626300 - DNA, 20 bp, Artificial Sequence
  chemically synthesized
tgttttttattcatgtcatg

SEQ ID NO: 626301 - DNA, 20 bp, Artificial Sequence
  chemically synthesized
gtggaattcgttttgttttc

SEQ ID NO: 626302 - DNA, 20 bp, Artificial Sequence
  chemically synthesized
cacatttggggtggaattcg

SEQ ID NO: 626303 - DNA, 20 bp, Artificial Sequence
  chemically synthesized
aggagcacatttggggtgga

SEQ ID NO: 626304 - DNA, 20 bp, Artificial Sequence
  chemically synthesized
tgatacaaagttctgacaag

SEQ ID NO: 626305 - DNA, 20 bp, Artificial Sequence
  chemically synthesized
ttgtcagaactttgtatcat

SEQ ID NO: 626306 - DNA, 20 bp, Artificial Sequence
  chemically synthesized
tcttcctcaccttcatttaa

SEQ ID NO: 626307 - DNA, 20 bp, Artificial Sequence
  chemically synthesized
tagaatctacgtgtcttgaa

SEQ ID NO: 626308 - DNA, 20 bp, Artificial Sequence
  chemically synthesized
tttaatcaagcttcaagaca

SEQ ID NO: 626309 - DNA, 20 bp, Artificial Sequence
  chemically synthesized
gtggtagaatctacgtgtct

SEQ ID NO: 626310 - DNA, 20 bp, Artificial Sequence
  chemically synthesized
acgtagattctaccactaaa

SEQ ID NO: 626311 - DNA, 20 bp, Artificial Sequence
  chemically synthesized
attagaatagtaacaataga

SEQ ID NO: 626312 - DNA, 20 bp, Artificial Sequence
  chemically synthesized
aagtcataagtgtaatatga

SEQ ID NO: 626313 - DNA, 20 bp, Artificial Sequence
  chemically synthesized
cttataaagtcataagtgta

SEQ ID NO: 626314 - DNA, 20 bp, Artificial Sequence
  chemically synthesized
tgggaatagaggtacttata

SEQ ID NO: 626315 - DNA, 20 bp, Artificial Sequence
  chemically synthesized
ctctgccacatgaactcaca

SEQ ID NO: 626316 - DNA, 20 bp, Artificial Sequence
  chemically synthesized
agataaagatgatgatgtta

SEQ ID NO: 626317 - DNA, 20 bp, Artificial Sequence
  chemically synthesized
aaaaaaataaggagccgctt

SEQ ID NO: 626318 - DNA, 20 bp, Artificial Sequence
  chemically synthesized
ttataaccaaaaaaataagg

SEQ ID NO: 626319 - DNA, 20 bp, Artificial Sequence
  chemically synthesized
ctatagttcgtgtttagcat

SEQ ID NO: 626320 - DNA, 20 bp, Artificial Sequence
  chemically synthesized
ctcatgcagcatcctatagt

SEQ ID NO: 626321 - DNA, 20 bp, Artificial Sequence
  chemically synthesized
aggatgctgcatgaggtaat

SEQ ID NO: 626322 - DNA, 20 bp, Artificial Sequence
  chemically synthesized
ggttgggggagatatgtaaa

SEQ ID NO: 626323 - DNA, 20 bp, Artificial Sequence
  chemically synthesized
tacatatctcccccaaccca

SEQ ID NO: 626324 - DNA, 20 bp, Artificial Sequence
  chemically synthesized
ttcatctttcctcattctag

SEQ ID NO: 626325 - DNA, 20 bp, Artificial Sequence
  chemically synthesized
gactttagttcctcaaatat

SEQ ID NO: 626326 - DNA, 20 bp, Artificial Sequence
  chemically synthesized
agggtggtggtaagatgttt

SEQ ID NO: 626327 - DNA, 20 bp, Artificial Sequence
  chemically synthesized
attacttgagggtggtggta

SEQ ID NO: 626328 - DNA, 20 bp, Artificial Sequence
  chemically synthesized
aaagacattgtatgcacttg

SEQ ID NO: 626329 - DNA, 20 bp, Artificial Sequence
  chemically synthesized
aagtgaactttactataagt

SEQ ID NO: 626330 - DNA, 20 bp, Artificial Sequence
  chemically synthesized
actttactataagtgaaagc

SEQ ID NO: 626331 - DNA, 20 bp, Artificial Sequence
  chemically synthesized
tactataagtgaaagctttt

SEQ ID NO: 626332 - DNA, 20 bp, Artificial Sequence
  chemically synthesized
ataagtgaaagcttttgttt

SEQ ID NO: 626333 - DNA, 20 bp, Artificial Sequence
  chemically synthesized
catgtataaatcaagcaaac

SEQ ID NO: 626334 - DNA, 20 bp, Artificial Sequence
  chemically synthesized
ggaaagaaattcgactttct

SEQ ID NO: 626335 - DNA, 20 bp, Artificial Sequence
  chemically synthesized
gaaagtcgaatttctttcct

SEQ ID NO: 626336 - DNA, 20 bp, Artificial Sequence
  chemically synthesized
aaagaaaatgcatcttcata

SEQ ID NO: 626337 - DNA, 20 bp, Artificial Sequence
  chemically synthesized
acaacttttgaatataaaag

SEQ ID NO: 626338 - DNA, 20 bp, Artificial Sequence
  chemically synthesized
atatatgttgagaatatatc

SEQ ID NO: 626339 - DNA, 20 bp, Artificial Sequence
  chemically synthesized
tcagtttgccagtattttat

SEQ ID NO: 626340 - DNA, 20 bp, Artificial Sequence
  chemically synthesized
ctttttgatgtgctgctgga

SEQ ID NO: 626341 - DNA, 20 bp, Artificial Sequence
  chemically synthesized
ggtaagctttttgatgtgct

SEQ ID NO: 626342 - DNA, 20 bp, Artificial Sequence
  chemically synthesized
ctgaatccagcagcacatca

SEQ ID NO: 626343 - DNA, 20 bp, Artificial Sequence
  chemically synthesized
cacatcaaaaagcttaccca

SEQ ID NO: 626344 - DNA, 20 bp, Artificial Sequence
  chemically synthesized
agtcgacttaatcgtggtgg

SEQ ID NO: 626345 - DNA, 20 bp, Artificial Sequence
  chemically synthesized
atttgcatgtgttgaaccag

SEQ ID NO: 626346 - DNA, 20 bp, Artificial Sequence
  chemically synthesized
tttatgtgctggattatgtt

SEQ ID NO: 626347 - DNA, 20 bp, Artificial Sequence
  chemically synthesized
ggtgctgtttatgtgctgga

SEQ ID NO: 626348 - DNA, 20 bp, Artificial Sequence
  chemically synthesized
gtcattggtgctgtttatgt

SEQ ID NO: 626349 - DNA, 20 bp, Artificial Sequence
  chemically synthesized
atcgtagtttttgtcattgg

SEQ ID NO: 626350 - DNA, 20 bp, Artificial Sequence
  chemically synthesized
aacagcaccaatgacaaaaa

SEQ ID NO: 626351 - DNA, 20 bp, Artificial Sequence
  chemically synthesized
tctgcatctattgagataat

SEQ ID NO: 626352 - DNA, 20 bp, Artificial Sequence
  chemically synthesized
ccaacaatacctagtttatt

SEQ ID NO: 626353 - DNA, 20 bp, Artificial Sequence
  chemically synthesized
taagatatactccaacaata

SEQ ID NO: 626354 - DNA, 20 bp, Artificial Sequence
  chemically synthesized
ggtttgtcataaatagctct

SEQ ID NO: 626355 - DNA, 20 bp, Artificial Sequence
  chemically synthesized
cattcactatgatattgtct

SEQ ID NO: 626356 - DNA, 20 bp, Artificial Sequence
  chemically synthesized
gggttttcaaagtgaatgct

SEQ ID NO: 626357 - DNA, 20 bp, Artificial Sequence
  chemically synthesized
cttgtgcgggttttcaaagt

SEQ ID NO: 626358 - DNA, 20 bp, Artificial Sequence
  chemically synthesized
cgagggcatccttgtcttgt

SEQ ID NO: 626359 - DNA, 20 bp, Artificial Sequence
  chemically synthesized
accctttatttctttctctt

SEQ ID NO: 626360 - DNA, 20 bp, Artificial Sequence
  chemically synthesized
caaataggaagtcaaattgt

SEQ ID NO: 626361 - DNA, 20 bp, Artificial Sequence
  chemically synthesized
acaaaataacgagaacatca

SEQ ID NO: 626362 - DNA, 20 bp, Artificial Sequence
  chemically synthesized
tatttctctttttatttata

SEQ ID NO: 626363 - DNA, 20 bp, Artificial Sequence
  chemically synthesized
tttgaagactatttccaaac

SEQ ID NO: 626364 - DNA, 20 bp, Artificial Sequence
  chemically synthesized
gacggagacacagaaaaaac

SEQ ID NO: 626365 - DNA, 20 bp, Artificial Sequence
  chemically synthesized
ccgtcttcatctttcccaca

SEQ ID NO: 626366 - DNA, 20 bp, Artificial Sequence
  chemically synthesized
cctaaaaatcctactacata

SEQ ID NO: 626367 - DNA, 20 bp, Artificial Sequence
  chemically synthesized
gttacaaaacaatatatgta

SEQ ID NO: 626368 - DNA, 20 bp, Artificial Sequence
  chemically synthesized
actcacttgtaatatttttc

SEQ ID NO: 626369 - DNA, 20 bp, Artificial Sequence
  chemically synthesized
tatttttcaatagtttctgg

SEQ ID NO: 626370 - DNA, 20 bp, Artificial Sequence
  chemically synthesized
atgcagccatcaaattattg

SEQ ID NO: 626371 - DNA, 20 bp, Artificial Sequence
  chemically synthesized
agtgtggtcaaataaattat

SEQ ID NO: 626372 - DNA, 20 bp, Artificial Sequence
  chemically synthesized
gaatacatacattcttataa

SEQ ID NO: 626373 - DNA, 20 bp, Artificial Sequence
  chemically synthesized
acccaccgtggtaattactc

SEQ ID NO: 626374 - DNA, 20 bp, Artificial Sequence
  chemically synthesized
tcttaggagtaattaccacg

SEQ ID NO: 626375 - DNA, 20 bp, Artificial Sequence
  chemically synthesized
aggagtaattaccacggtgg

SEQ ID NO: 626376 - DNA, 20 bp, Artificial Sequence
  chemically synthesized
aaaaccccaaagattgttac

SEQ ID NO: 626377 - DNA, 20 bp, Artificial Sequence
  chemically synthesized
aaaacttccgtaacaatctt

SEQ ID NO: 626378 - DNA, 20 bp, Artificial Sequence
  chemically synthesized
agggagatgtgacaaaaccc

SEQ ID NO: 626379 - DNA, 20 bp, Artificial Sequence
  chemically synthesized
ttccaaaatgagtcctaact

SEQ ID NO: 626380 - DNA, 20 bp, Artificial Sequence
  chemically synthesized
tgactttgagctgtataaaa

SEQ ID NO: 626381 - DNA, 20 bp, Artificial Sequence
  chemically synthesized
tatcttcgctactcttttaa

SEQ ID NO: 626382 - DNA, 20 bp, Artificial Sequence
  chemically synthesized
aaatagatctatcatgaata

SEQ ID NO: 626383 - DNA, 20 bp, Artificial Sequence
  chemically synthesized
atgatctttcattgatacat

SEQ ID NO: 626384 - DNA, 20 bp, Artificial Sequence
  chemically synthesized
aagatcttccgaatatgtat

SEQ ID NO: 626385 - DNA, 20 bp, Artificial Sequence
  chemically synthesized
ggaagatcttcaaagtagta

SEQ ID NO: 626386 - DNA, 20 bp, Artificial Sequence
  chemically synthesized
gtacattgattcttatccaa

SEQ ID NO: 626387 - DNA, 20 bp, Artificial Sequence
  chemically synthesized
ccaaatttgatttgagagct

SEQ ID NO: 626388 - DNA, 20 bp, Artificial Sequence
  chemically synthesized
taatacaaattacgatgggg

SEQ ID NO: 626389 - DNA, 20 bp, Artificial Sequence
  chemically synthesized
atggggtgcggatttcctag

SEQ ID NO: 626390 - DNA, 20 bp, Artificial Sequence
  chemically synthesized
attgtatcctactatttttt

SEQ ID NO: 626391 - DNA, 20 bp, Artificial Sequence
  chemically synthesized
aaaaaatagtaggatacaat

SEQ ID NO: 626392 - DNA, 20 bp, Artificial Sequence
  chemically synthesized
agtaggatacaatcctggat

SEQ ID NO: 626393 - DNA, 20 bp, Artificial Sequence
  chemically synthesized
ctgtctccagaatccaaaat

SEQ ID NO: 626394 - DNA, 20 bp, Artificial Sequence
  chemically synthesized
gacagtggaccacattgtat

SEQ ID NO: 626395 - DNA, 20 bp, Artificial Sequence
  chemically synthesized
aagaaaatatacaaaggagg

SEQ ID NO: 626396 - DNA, 20 bp, Artificial Sequence
  chemically synthesized
gaggaaaaacagatgccagg

SEQ ID NO: 626397 - DNA, 20 bp, Artificial Sequence
  chemically synthesized
cttcagaatcttgtcctggc

SEQ ID NO: 626398 - DNA, 20 bp, Artificial Sequence
  chemically synthesized
aagattctgaagtatatatt

SEQ ID NO: 626399 - DNA, 20 bp, Artificial Sequence
  chemically synthesized
tctgaagtatatatttttgg

SEQ ID NO: 626400 - DNA, 20 bp, Artificial Sequence
  chemically synthesized
tttatccctcacctattaaa

SEQ ID NO: 626401 - DNA, 20 bp, Artificial Sequence
  chemically synthesized
agagtaggagtcaaatgaaa

SEQ ID NO: 626402 - DNA, 20 bp, Artificial Sequence
  chemically synthesized
ccaaccacacaagtcaattt

SEQ ID NO: 626403 - DNA, 20 bp, Artificial Sequence
  chemically synthesized
tttttagtccattcctccct

SEQ ID NO: 626404 - DNA, 20 bp, Artificial Sequence
  chemically synthesized
tccattcctccctttgtgct

SEQ ID NO: 626405 - DNA, 20 bp, Artificial Sequence
  chemically synthesized
tcatgtatcagctcagctat

SEQ ID NO: 626406 - DNA, 20 bp, Artificial Sequence
  chemically synthesized
tgaattgagaagcccttaaa

SEQ ID NO: 626407 - DNA, 20 bp, Artificial Sequence
  chemically synthesized
tagtgagtgaatctggattt

SEQ ID NO: 626408 - DNA, 20 bp, Artificial Sequence
  chemically synthesized
cataacctatagtgagtgaa

SEQ ID NO: 626409 - DNA, 20 bp, Artificial Sequence
  chemically synthesized
agattcactcactataggtt

SEQ ID NO: 626410 - DNA, 20 bp, Artificial Sequence
  chemically synthesized
aaaaatcaaatatttaaaga

SEQ ID NO: 626411 - DNA, 20 bp, Artificial Sequence
  chemically synthesized
caaaatcatattctttaaat

SEQ ID NO: 626412 - DNA, 20 bp, Artificial Sequence
  chemically synthesized
agggtgaaaaagagacatcg

SEQ ID NO: 626413 - DNA, 20 bp, Artificial Sequence
  chemically synthesized
gtcagtgactcttgcattca

SEQ ID NO: 626414 - DNA, 20 bp, Artificial Sequence
  chemically synthesized
ttgttcctgatattggttat

SEQ ID NO: 626415 - DNA, 20 bp, Artificial Sequence
  chemically synthesized
taaccaatatcaggaacaat

SEQ ID NO: 626416 - DNA, 20 bp, Artificial Sequence
  chemically synthesized
gacattggacaatttatatt

SEQ ID NO: 626417 - DNA, 20 bp, Artificial Sequence
  chemically synthesized
ttggatggcaatgtgatgat

SEQ ID NO: 626418 - DNA, 20 bp, Artificial Sequence
  chemically synthesized
ctgttacttggatggcaatg

SEQ ID NO: 626419 - DNA, 20 bp, Artificial Sequence
  chemically synthesized
gaagatggacttctcttcct

SEQ ID NO: 626420 - DNA, 20 bp, Artificial Sequence
  chemically synthesized
cttaaatgaacatcctacaa

SEQ ID NO: 626421 - DNA, 20 bp, Artificial Sequence
  chemically synthesized
cctagaggcaggtatcgaga

SEQ ID NO: 626422 - DNA, 20 bp, Artificial Sequence
  chemically synthesized
aggctaaacatataaaagga

SEQ ID NO: 626423 - DNA, 20 bp, Artificial Sequence
  chemically synthesized
gtgagaaacgggttcctttt

SEQ ID NO: 626424 - DNA, 20 bp, Artificial Sequence
  chemically synthesized
tattagctacactatgaatt

SEQ ID NO: 626425 - DNA, 20 bp, Artificial Sequence
  chemically synthesized
caaaaggtagataactgccc

SEQ ID NO: 626426 - DNA, 20 bp, Artificial Sequence
  chemically synthesized
tcttggtgaggaagaatata

SEQ ID NO: 626427 - DNA, 20 bp, Artificial Sequence
  chemically synthesized
cattcttctgcatgtgaatc

SEQ ID NO: 626428 - DNA, 20 bp, Artificial Sequence
  chemically synthesized
acaaacggtgctgagaaaac

SEQ ID NO: 626429 - DNA, 20 bp, Artificial Sequence
  chemically synthesized
tgaatctcaagttttctcag

SEQ ID NO: 626430 - DNA, 20 bp, Artificial Sequence
  chemically synthesized
tctcaagttttctcagcacc

SEQ ID NO: 626431 - DNA, 20 bp, Artificial Sequence
  chemically synthesized
ctcagcaccgtttgtttaaa

SEQ ID NO: 626432 - DNA, 20 bp, Artificial Sequence
  chemically synthesized
ggtcatagctgaagagatgt

SEQ ID NO: 626433 - DNA, 20 bp, Artificial Sequence
  chemically synthesized
cagacgtggtgataagccac

SEQ ID NO: 626434 - DNA, 20 bp, Artificial Sequence
  chemically synthesized
tacttatcagcagaagctgc

SEQ ID NO: 626435 - DNA, 20 bp, Artificial Sequence
  chemically synthesized
aaaaacagggtgcttcttct

SEQ ID NO: 626436 - DNA, 20 bp, Artificial Sequence
  chemically synthesized
agaatcacgtagaagaagca

SEQ ID NO: 626437 - DNA, 20 bp, Artificial Sequence
  chemically synthesized
gatagacatggccaaaaaca

SEQ ID NO: 626438 - DNA, 20 bp, Artificial Sequence
  chemically synthesized
ttggccatgtctatccagag

SEQ ID NO: 626439 - DNA, 20 bp, Artificial Sequence
  chemically synthesized
tagagagagtggggttgggg

SEQ ID NO: 626440 - DNA, 20 bp, Artificial Sequence
  chemically synthesized
attaactttcactgttctga

SEQ ID NO: 626441 - DNA, 20 bp, Artificial Sequence
  chemically synthesized
actgttctgactgagatttt

SEQ ID NO: 626442 - DNA, 20 bp, Artificial Sequence
  chemically synthesized
gactgagattttgcaggttt

SEQ ID NO: 626443 - DNA, 20 bp, Artificial Sequence
  chemically synthesized
ttacaattttcaccagttac

SEQ ID NO: 626444 - DNA, 20 bp, Artificial Sequence
  chemically synthesized
actacacactaccatttcag

SEQ ID NO: 626445 - DNA, 20 bp, Artificial Sequence
  chemically synthesized
agtgtttctctccaaaatgt

SEQ ID NO: 626446 - DNA, 20 bp, Artificial Sequence
  chemically synthesized
tgttcatgtttatatttcgc

SEQ ID NO: 626447 - DNA, 20 bp, Artificial Sequence
  chemically synthesized
ggtgaagatactcacatttt

SEQ ID NO: 626448 - DNA, 20 bp, Artificial Sequence
  chemically synthesized
aggccatgaataggaggtag

SEQ ID NO: 626449 - DNA, 20 bp, Artificial Sequence
  chemically synthesized
catgaataggaggtagagta

SEQ ID NO: 626450 - DNA, 20 bp, Artificial Sequence
  chemically synthesized
taggaggtagagtagattga

SEQ ID NO: 626451 - DNA, 20 bp, Artificial Sequence
  chemically synthesized
gtaacaattgcaggtaaaaa

SEQ ID NO: 626452 - DNA, 20 bp, Artificial Sequence
  chemically synthesized
ttagactttgcatttgtagg

SEQ ID NO: 626453 - DNA, 20 bp, Artificial Sequence
  chemically synthesized
gctctgttttcttatattta

SEQ ID NO: 626454 - DNA, 20 bp, Artificial Sequence
  chemically synthesized
atatttgatactaggtagta

SEQ ID NO: 626455 - DNA, 20 bp, Artificial Sequence
  chemically synthesized
aaaatttgacacattttggc

SEQ ID NO: 626456 - DNA, 20 bp, Artificial Sequence
  chemically synthesized
tatcttcagtgcccagttat

SEQ ID NO: 626457 - DNA, 20 bp, Artificial Sequence
  chemically synthesized
caaaaaggcactatattact

SEQ ID NO: 626458 - DNA, 20 bp, Artificial Sequence
  chemically synthesized
caaagagtaatatagtgcct

SEQ ID NO: 626459 - DNA, 20 bp, Artificial Sequence
  chemically synthesized
tagctcttattacccttggc

SEQ ID NO: 626460 - DNA, 20 bp, Artificial Sequence
  chemically synthesized
tgaaattgtatatactgctt

SEQ ID NO: 626461 - DNA, 20 bp, Artificial Sequence
  chemically synthesized
tgtgactttgaaattgtata

SEQ ID NO: 626462 - DNA, 20 bp, Artificial Sequence
  chemically synthesized
gtatattcttgaattattta

SEQ ID NO: 626463 - DNA, 20 bp, Artificial Sequence
  chemically synthesized
ctttaaattctcgatgtttt

SEQ ID NO: 626464 - DNA, 20 bp, Artificial Sequence
  chemically synthesized
tcatatgtcctttaaattct

SEQ ID NO: 626465 - DNA, 20 bp, Artificial Sequence
  chemically synthesized
ccatgctttaactcttttct

SEQ ID NO: 626466 - DNA, 20 bp, Artificial Sequence
  chemically synthesized
caaccagaaaagagttaaag

SEQ ID NO: 626467 - DNA, 20 bp, Artificial Sequence
  chemically synthesized
gaaaagagttaaagcatgga

SEQ ID NO: 626468 - DNA, 20 bp, Artificial Sequence
  chemically synthesized
gagttaaagcatggattacg

SEQ ID NO: 626469 - DNA, 20 bp, Artificial Sequence
  chemically synthesized
attgtaaaactaaacgtaat

SEQ ID NO: 626470 - DNA, 20 bp, Artificial Sequence
  chemically synthesized
atctttaatttcaaagtctc

SEQ ID NO: 626471 - DNA, 20 bp, Artificial Sequence
  chemically synthesized
agcaacagagactttgaaat

SEQ ID NO: 626472 - DNA, 20 bp, Artificial Sequence
  chemically synthesized
ctttgaaattaaagatttac

SEQ ID NO: 626473 - DNA, 20 bp, Artificial Sequence
  chemically synthesized
aaattccttaagatttagca

SEQ ID NO: 626474 - DNA, 20 bp, Artificial Sequence
  chemically synthesized
tagtatgccctcaaaattcc

SEQ ID NO: 626475 - DNA, 20 bp, Artificial Sequence
  chemically synthesized
ttatttaattttaacaaggg

SEQ ID NO: 626476 - DNA, 20 bp, Artificial Sequence
  chemically synthesized
cttgttaaaattaaataaac

SEQ ID NO: 626477 - DNA, 20 bp, Artificial Sequence
  chemically synthesized
ttaatataatttatttaatc

SEQ ID NO: 626478 - DNA, 20 bp, Artificial Sequence
  chemically synthesized
gagttttgaacatttattac

SEQ ID NO: 626479 - DNA, 20 bp, Artificial Sequence
  chemically synthesized
agtaaaataattaagaagtg

SEQ ID NO: 626480 - DNA, 20 bp, Artificial Sequence
  chemically synthesized
acactcagcaacatcatgtt

SEQ ID NO: 626481 - DNA, 20 bp, Artificial Sequence
  chemically synthesized
gtgtaaatacttcaaccaca

SEQ ID NO: 626482 - DNA, 20 bp, Artificial Sequence
  chemically synthesized
ctcaagctatgattcttagt

SEQ ID NO: 626483 - DNA, 20 bp, Artificial Sequence
  chemically synthesized
aataagcaaacactaagaat

SEQ ID NO: 626484 - DNA, 20 bp, Artificial Sequence
  chemically synthesized
agaactcaagctatgattct

SEQ ID NO: 626485 - DNA, 20 bp, Artificial Sequence
  chemically synthesized
tcagtgagaaagaactcaag

SEQ ID NO: 626486 - DNA, 20 bp, Artificial Sequence
  chemically synthesized
acttgagttgctgacgaatt

SEQ ID NO: 626487 - DNA, 20 bp, Artificial Sequence
  chemically synthesized
gtttctgaatttgtttagaa

SEQ ID NO: 626488 - DNA, 20 bp, Artificial Sequence
  chemically synthesized
gtctctgtgtttgtttctga

SEQ ID NO: 626489 - DNA, 20 bp, Artificial Sequence
  chemically synthesized
tgtcactggttagtctctgt

SEQ ID NO: 626490 - DNA, 20 bp, Artificial Sequence
  chemically synthesized
cagttgtcactggttagtct

SEQ ID NO: 626491 - DNA, 20 bp, Artificial Sequence
  chemically synthesized
attgcacaccgcaattgtca

SEQ ID NO: 626492 - DNA, 20 bp, Artificial Sequence
  chemically synthesized
ggaaataatggtagatgtgg

SEQ ID NO: 626493 - DNA, 20 bp, Artificial Sequence
  chemically synthesized
cagtaaatgtttggccagtg

SEQ ID NO: 626494 - DNA, 20 bp, Artificial Sequence
  chemically synthesized
ggagtagtcaataactcagt

SEQ ID NO: 626495 - DNA, 20 bp, Artificial Sequence
  chemically synthesized
tgagttattgactactccct

SEQ ID NO: 626496 - DNA, 20 bp, Artificial Sequence
  chemically synthesized
gatagccactatttgtcact

SEQ ID NO: 626497 - DNA, 20 bp, Artificial Sequence
  chemically synthesized
tagtatcatatttgtcacaa

SEQ ID NO: 626498 - DNA, 20 bp, Artificial Sequence
  chemically synthesized
agttaaatcatatcacatta

SEQ ID NO: 626499 - DNA, 20 bp, Artificial Sequence
  chemically synthesized
tatagaatctaaataatgtg

SEQ ID NO: 626500 - DNA, 20 bp, Artificial Sequence
  chemically synthesized
agacatggataaaagtcaac

SEQ ID NO: 626501 - DNA, 20 bp, Artificial Sequence
  chemically synthesized
tgacttttatccatgtcttt

SEQ ID NO: 626502 - DNA, 20 bp, Artificial Sequence
  chemically synthesized
tccatgtctttcatagcttt

SEQ ID NO: 626503 - DNA, 20 bp, Artificial Sequence
  chemically synthesized
tttattggcttttctcctag

SEQ ID NO: 626504 - DNA, 20 bp, Artificial Sequence
  chemically synthesized
attactttaacttggaataa

SEQ ID NO: 626505 - DNA, 20 bp, Artificial Sequence
  chemically synthesized
catgtgggagacatcaccac

SEQ ID NO: 626506 - DNA, 20 bp, Artificial Sequence
  chemically synthesized
agtttgctccattcagacag

SEQ ID NO: 626507 - DNA, 20 bp, Artificial Sequence
  chemically synthesized
ctgccttttattatttattt

SEQ ID NO: 626508 - DNA, 20 bp, Artificial Sequence
  chemically synthesized
ctaaaaaataaataataaaa

SEQ ID NO: 626509 - DNA, 20 bp, Artificial Sequence
  chemically synthesized
aatttaggtgacagagcaca

SEQ ID NO: 626510 - DNA, 20 bp, Artificial Sequence
  chemically synthesized
aaactgctataatttataga

SEQ ID NO: 626511 - DNA, 20 bp, Artificial Sequence
  chemically synthesized
aagcagattctataaattat

SEQ ID NO: 626512 - DNA, 20 bp, Artificial Sequence
  chemically synthesized
aatagttctgagaggttttc

SEQ ID NO: 626513 - DNA, 20 bp, Artificial Sequence
  chemically synthesized
caaaaatgtgaatagttctg

SEQ ID NO: 626514 - DNA, 20 bp, Artificial Sequence
  chemically synthesized
gaagaaaaaagaaaaaaata

SEQ ID NO: 626515 - DNA, 20 bp, Artificial Sequence
  chemically synthesized
tttttcaatataatatgaat

SEQ ID NO: 626516 - DNA, 20 bp, Artificial Sequence
  chemically synthesized
gtaggaagtataatggtacc

SEQ ID NO: 626517 - DNA, 20 bp, Artificial Sequence
  chemically synthesized
attttagaaaaaagaaaaat

SEQ ID NO: 626518 - DNA, 20 bp, Artificial Sequence
  chemically synthesized
ttatgaagctagacacaatg

SEQ ID NO: 626519 - DNA, 20 bp, Artificial Sequence
  chemically synthesized
atttgaaacatatcattgtg

SEQ ID NO: 626520 - DNA, 20 bp, Artificial Sequence
  chemically synthesized
aaaaccaaataatgggatat

SEQ ID NO: 626521 - DNA, 20 bp, Artificial Sequence
  chemically synthesized
taatcagaaatatcccatta

SEQ ID NO: 626522 - DNA, 20 bp, Artificial Sequence
  chemically synthesized
tgtcaaaggaagacacaaaa

SEQ ID NO: 626523 - DNA, 20 bp, Artificial Sequence
  chemically synthesized
ttttagtacctggttgaaat

SEQ ID NO: 626524 - DNA, 20 bp, Artificial Sequence
  chemically synthesized
tgtaagcttttgtgaataag

SEQ ID NO: 626525 - DNA, 20 bp, Artificial Sequence
  chemically synthesized
ctgaatctaaacttattcac

SEQ ID NO: 626526 - DNA, 20 bp, Artificial Sequence
  chemically synthesized
gtgaatgtaagcttttgtga

SEQ ID NO: 626527 - DNA, 20 bp, Artificial Sequence
  chemically synthesized
tcacaaaagcttacattcac

SEQ ID NO: 626528 - DNA, 20 bp, Artificial Sequence
  chemically synthesized
tcaaataagccaaagtgaat

SEQ ID NO: 626529 - DNA, 20 bp, Artificial Sequence
  chemically synthesized
tacattcactttggcttatt

SEQ ID NO: 626530 - DNA, 20 bp, Artificial Sequence
  chemically synthesized
tgatgtttagaaaattattt

SEQ ID NO: 626531 - DNA, 20 bp, Artificial Sequence
  chemically synthesized
ttcctgagatccaatacact

SEQ ID NO: 626532 - DNA, 20 bp, Artificial Sequence
  chemically synthesized
ctgttttagataacttacgc

SEQ ID NO: 626533 - DNA, 20 bp, Artificial Sequence
  chemically synthesized
cctacttatcaagcagtctg

SEQ ID NO: 626534 - DNA, 20 bp, Artificial Sequence
  chemically synthesized
ataattcttaaaacttgtca

SEQ ID NO: 626535 - DNA, 20 bp, Artificial Sequence
  chemically synthesized
aatttggcatatactattaa

SEQ ID NO: 626536 - DNA, 20 bp, Artificial Sequence
  chemically synthesized
aatatttaagtaaaagaaca

SEQ ID NO: 626537 - DNA, 20 bp, Artificial Sequence
  chemically synthesized
ttgttctataattttaaata

SEQ ID NO: 626538 - DNA, 20 bp, Artificial Sequence
  chemically synthesized
tctttaaaaatacgtgttgg

SEQ ID NO: 626539 - DNA, 20 bp, Artificial Sequence
  chemically synthesized
gagaaaaggaaaccctcatg

SEQ ID NO: 626540 - DNA, 20 bp, Artificial Sequence
  chemically synthesized
cattcccacaaacagtgcat

SEQ ID NO: 626541 - DNA, 20 bp, Artificial Sequence
  chemically synthesized
cattacaaaaaaaatagtag

SEQ ID NO: 626542 - DNA, 20 bp, Artificial Sequence
  chemically synthesized
ctcatggtaattctattttt

SEQ ID NO: 626543 - DNA, 20 bp, Artificial Sequence
  chemically synthesized
atgagatctagcaatttcac

SEQ ID NO: 626544 - DNA, 20 bp, Artificial Sequence
  chemically synthesized
agccaagatatagccacaac

SEQ ID NO: 626545 - DNA, 20 bp, Artificial Sequence
  chemically synthesized
gccataaaaagaaggaaatc

SEQ ID NO: 626546 - DNA, 20 bp, Artificial Sequence
  chemically synthesized
agttcaccttgttgcaaatc

SEQ ID NO: 626547 - DNA, 20 bp, Artificial Sequence
  chemically synthesized
acttatgatctactccctca

SEQ ID NO: 626548 - DNA, 20 bp, Artificial Sequence
  chemically synthesized
ttgtatatcttaaatatata

SEQ ID NO: 626549 - DNA, 20 bp, Artificial Sequence
  chemically synthesized
aacaacaaaaaagtatccct

SEQ ID NO: 626550 - DNA, 20 bp, Artificial Sequence
  chemically synthesized
tcacatgcttgtggctaaat

SEQ ID NO: 626551 - DNA, 20 bp, Artificial Sequence
  chemically synthesized
gccacaagcatgtgatgatc

SEQ ID NO: 626552 - DNA, 20 bp, Artificial Sequence
  chemically synthesized
gtgaaaatcagttgatcatc

SEQ ID NO: 626553 - DNA, 20 bp, Artificial Sequence
  chemically synthesized
gtaagaggaaaatagttcct

SEQ ID NO: 626554 - DNA, 20 bp, Artificial Sequence
  chemically synthesized
tctctgtgtttctggatgaa

SEQ ID NO: 626555 - DNA, 20 bp, Artificial Sequence
  chemically synthesized
gctaacacagggaattatct

SEQ ID NO: 626556 - DNA, 20 bp, Artificial Sequence
  chemically synthesized
aggaaattgttttccatcac

SEQ ID NO: 626557 - DNA, 20 bp, Artificial Sequence
  chemically synthesized
atatggtcttaatagaagga

SEQ ID NO: 626558 - DNA, 20 bp, Artificial Sequence
  chemically synthesized
cttctattttaaataacata

SEQ ID NO: 626559 - DNA, 20 bp, Artificial Sequence
  chemically synthesized
ttgtgtagttttctcctttt

SEQ ID NO: 626560 - DNA, 20 bp, Artificial Sequence
  chemically synthesized
ttgtgatggtaaaatatttg

SEQ ID NO: 626561 - DNA, 20 bp, Artificial Sequence
  chemically synthesized
ccatcacaacaaatgtgaat

SEQ ID NO: 626562 - DNA, 20 bp, Artificial Sequence
  chemically synthesized
atgtgaatcacagattcaat

SEQ ID NO: 626563 - DNA, 20 bp, Artificial Sequence
  chemically synthesized
ttaagaatcacatattgaat

SEQ ID NO: 626564 - DNA, 20 bp, Artificial Sequence
  chemically synthesized
ttcttaaacacatttcttaa

SEQ ID NO: 626565 - DNA, 20 bp, Artificial Sequence
  chemically synthesized
acagcaaacatatttaagaa

SEQ ID NO: 626566 - DNA, 20 bp, Artificial Sequence
  chemically synthesized
acacatttcttaaatatgtt

SEQ ID NO: 626567 - DNA, 20 bp, Artificial Sequence
  chemically synthesized
ccgatacgctcaacattgac

SEQ ID NO: 626568 - DNA, 20 bp, Artificial Sequence
  chemically synthesized
gtgtccgatacgctcaacat

SEQ ID NO: 626569 - DNA, 20 bp, Artificial Sequence
  chemically synthesized
agaatagaatttgttattac

SEQ ID NO: 626570 - DNA, 20 bp, Artificial Sequence
  chemically synthesized
gattacagtatgtagccatc

SEQ ID NO: 626571 - DNA, 20 bp, Artificial Sequence
  chemically synthesized
gttggctgttttatcttcct

SEQ ID NO: 626572 - DNA, 20 bp, Artificial Sequence
  chemically synthesized
ccaacaacactcaaaatgtt

SEQ ID NO: 626573 - DNA, 20 bp, Artificial Sequence
  chemically synthesized
accaacaacactcaaaagtt

SEQ ID NO: 626574 - DNA, 20 bp, Artificial Sequence
  chemically synthesized
ccattgaatgttttactgtg

SEQ ID NO: 626575 - DNA, 20 bp, Artificial Sequence
  chemically synthesized
cagatgttctaagagccatt

SEQ ID NO: 626576 - DNA, 20 bp, Artificial Sequence
  chemically synthesized
tcaacttcaagtgagtgcgg

SEQ ID NO: 626577 - DNA, 20 bp, Artificial Sequence
  chemically synthesized
attaagactcttgatagctg

SEQ ID NO: 626578 - DNA, 20 bp, Artificial Sequence
  chemically synthesized
aaagtttatttttaataatg

SEQ ID NO: 626579 - DNA, 20 bp, Artificial Sequence
  chemically synthesized
ataaatagagaaaatatttg

SEQ ID NO: 626580 - DNA, 20 bp, Artificial Sequence
  chemically synthesized
aaatttgcagaccttgctta

SEQ ID NO: 626581 - DNA, 20 bp, Artificial Sequence
  chemically synthesized
ttagaataaaaatttgcaga

SEQ ID NO: 626582 - DNA, 20 bp, Artificial Sequence
  chemically synthesized
tcatttttcttttctctcat

SEQ ID NO: 626583 - DNA, 20 bp, Artificial Sequence
  chemically synthesized
ttttacctatatctctctaa

SEQ ID NO: 626584 - DNA, 20 bp, Artificial Sequence
  chemically synthesized
caagtaccaaaagaaaaagt

SEQ ID NO: 626585 - DNA, 20 bp, Artificial Sequence
  chemically synthesized
gacttttgatctgaatggca

SEQ ID NO: 626586 - DNA, 20 bp, Artificial Sequence
  chemically synthesized
ctaccttaaataggtggtta

SEQ ID NO: 626587 - DNA, 20 bp, Artificial Sequence
  chemically synthesized
gttatagtgattacatgagc

SEQ ID NO: 626588 - DNA, 20 bp, Artificial Sequence
  chemically synthesized
tgtcttttactccttccctt

SEQ ID NO: 626589 - DNA, 20 bp, Artificial Sequence
  chemically synthesized
gaaaagctgcagctccttac

SEQ ID NO: 626590 - DNA, 20 bp, Artificial Sequence
  chemically synthesized
aaaaaactttggtaaggagc

SEQ ID NO: 626591 - DNA, 20 bp, Artificial Sequence
  chemically synthesized
gggccataaacttgactccg

SEQ ID NO: 626592 - DNA, 20 bp, Artificial Sequence
  chemically synthesized
tccttagaatctgcacggag

SEQ ID NO: 626593 - DNA, 20 bp, Artificial Sequence
  chemically synthesized
tgaggaaagatgggctaggt

SEQ ID NO: 626594 - DNA, 20 bp, Artificial Sequence
  chemically synthesized
tctttcttgcatatttcatt

SEQ ID NO: 626595 - DNA, 20 bp, Artificial Sequence
  chemically synthesized
atatttggctgaataatgga

SEQ ID NO: 626596 - DNA, 20 bp, Artificial Sequence
  chemically synthesized
tagccattctgacaattggt

SEQ ID NO: 626597 - DNA, 20 bp, Artificial Sequence
  chemically synthesized
ctccatgccatttttacaat

SEQ ID NO: 626598 - DNA, 20 bp, Artificial Sequence
  chemically synthesized
ctccactttcccattcacct

SEQ ID NO: 626599 - DNA, 20 bp, Artificial Sequence
  chemically synthesized
aaagaaagagctctcacact

SEQ ID NO: 626600 - DNA, 20 bp, Artificial Sequence
  chemically synthesized
tctgagctgtctctagtgga

SEQ ID NO: 626601 - DNA, 20 bp, Artificial Sequence
  chemically synthesized
caaccaagtgattctttctc

SEQ ID NO: 626602 - DNA, 20 bp, Artificial Sequence
  chemically synthesized
gctaaggcgtgaccacaacc

SEQ ID NO: 626603 - DNA, 20 bp, Artificial Sequence
  chemically synthesized
acagttgtcttttctggtaa

SEQ ID NO: 626604 - DNA, 20 bp, Artificial Sequence
  chemically synthesized
acccctttaccagaaaagac

SEQ ID NO: 626605 - DNA, 20 bp, Artificial Sequence
  chemically synthesized
ctttaaagtcgttgtgaagt

SEQ ID NO: 626606 - DNA, 20 bp, Artificial Sequence
  chemically synthesized
cgactttaaagtgaagatga

SEQ ID NO: 626607 - DNA, 20 bp, Artificial Sequence
  chemically synthesized
tgaagatgaatgagttttat

SEQ ID NO: 626608 - DNA, 20 bp, Artificial Sequence
  chemically synthesized
aaatactggatagtttcagg

SEQ ID NO: 626609 - DNA, 20 bp, Artificial Sequence
  chemically synthesized
acctgaaactatccagtatt

SEQ ID NO: 626610 - DNA, 20 bp, Artificial Sequence
  chemically synthesized
gcaacaatcataaaatactg

SEQ ID NO: 626611 - DNA, 20 bp, Artificial Sequence
  chemically synthesized
gaacatgcaaattagcaaat

SEQ ID NO: 626612 - DNA, 20 bp, Artificial Sequence
  chemically synthesized
aaataccacagccacaccca

SEQ ID NO: 626613 - DNA, 20 bp, Artificial Sequence
  chemically synthesized
gccacacccagaatgcttgt

SEQ ID NO: 626614 - DNA, 20 bp, Artificial Sequence
  chemically synthesized
gaattctggcctttgccaat

SEQ ID NO: 626615 - DNA, 20 bp, Artificial Sequence
  chemically synthesized
cattggcaaaggccagaatt

SEQ ID NO: 626616 - DNA, 20 bp, Artificial Sequence
  chemically synthesized
catataattcccataaaggc

SEQ ID NO: 626617 - DNA, 20 bp, Artificial Sequence
  chemically synthesized
aggttagttgaggatgaacc

SEQ ID NO: 626618 - DNA, 20 bp, Artificial Sequence
  chemically synthesized
agttatagtttgtctccaca

SEQ ID NO: 626619 - DNA, 20 bp, Artificial Sequence
  chemically synthesized
atccaaacattacaaagagt

SEQ ID NO: 626620 - DNA, 20 bp, Artificial Sequence
  chemically synthesized
agacaaactataactctttg

SEQ ID NO: 626621 - DNA, 20 bp, Artificial Sequence
  chemically synthesized
tgtaatgtttggatgccata

SEQ ID NO: 626622 - DNA, 20 bp, Artificial Sequence
  chemically synthesized
atgtttggatgccatactgt

SEQ ID NO: 626623 - DNA, 20 bp, Artificial Sequence
  chemically synthesized
ggtgattagaattcaacata

SEQ ID NO: 626624 - DNA, 20 bp, Artificial Sequence
  chemically synthesized
accttataatatagtcatct

SEQ ID NO: 626625 - DNA, 20 bp, Artificial Sequence
  chemically synthesized
tgagggctctaccttcatga

SEQ ID NO: 626626 - DNA, 20 bp, Artificial Sequence
  chemically synthesized
tcaaggtgcaggcacgctca

SEQ ID NO: 626627 - DNA, 20 bp, Artificial Sequence
  chemically synthesized
tttctgttctttataagcca

SEQ ID NO: 626628 - DNA, 20 bp, Artificial Sequence
  chemically synthesized
aacaaaaataccataaacag

SEQ ID NO: 626629 - DNA, 20 bp, Artificial Sequence
  chemically synthesized
ccagtctaaaaggactaaga

SEQ ID NO: 626630 - DNA, 20 bp, Artificial Sequence
  chemically synthesized
ggactaagacactgatttgg

SEQ ID NO: 626631 - DNA, 20 bp, Artificial Sequence
  chemically synthesized
aactcccttgattagattat

SEQ ID NO: 626632 - DNA, 20 bp, Artificial Sequence
  chemically synthesized
aacttctataatctaatcaa

SEQ ID NO: 626633 - DNA, 20 bp, Artificial Sequence
  chemically synthesized
attatgtttaaactcccttg

SEQ ID NO: 626634 - DNA, 20 bp, Artificial Sequence
  chemically synthesized
tggctattatgtttaaactc

SEQ ID NO: 626635 - DNA, 20 bp, Artificial Sequence
  chemically synthesized
ctgtgtctgttacatggcta

SEQ ID NO: 626636 - DNA, 20 bp, Artificial Sequence
  chemically synthesized
acagacacagtgtaaaatat

SEQ ID NO: 626637 - DNA, 20 bp, Artificial Sequence
  chemically synthesized
agaaccagtcgcgttagtat

SEQ ID NO: 626638 - DNA, 20 bp, Artificial Sequence
  chemically synthesized
aaggacagcgagtgcatgga

SEQ ID NO: 626639 - DNA, 20 bp, Artificial Sequence
  chemically synthesized
tacttctagcatattctgcc

SEQ ID NO: 626640 - DNA, 20 bp, Artificial Sequence
  chemically synthesized
tgataatggttattttaacc

SEQ ID NO: 626641 - DNA, 20 bp, Artificial Sequence
  chemically synthesized
accactcaaggccaggcatt

SEQ ID NO: 626642 - DNA, 20 bp, Artificial Sequence
  chemically synthesized
tgtctgatttagggagaagc

SEQ ID NO: 626643 - DNA, 20 bp, Artificial Sequence
  chemically synthesized
aataccacttggaaggaaac

SEQ ID NO: 626644 - DNA, 20 bp, Artificial Sequence
  chemically synthesized
ttacctggagagtgaattgc

SEQ ID NO: 626645 - DNA, 20 bp, Artificial Sequence
  chemically synthesized
atccacacactattttgaag

SEQ ID NO: 626646 - DNA, 20 bp, Artificial Sequence
  chemically synthesized
gtagagagccacctatttct

SEQ ID NO: 626647 - DNA, 20 bp, Artificial Sequence
  chemically synthesized
gaaataggtggctctctaca

SEQ ID NO: 626648 - DNA, 20 bp, Artificial Sequence
  chemically synthesized
ttcacaagggcataagatca

SEQ ID NO: 626649 - DNA, 20 bp, Artificial Sequence
  chemically synthesized
acactgtgttcacaatttta

SEQ ID NO: 626650 - DNA, 20 bp, Artificial Sequence
  chemically synthesized
acacagtgtatctcattcca

SEQ ID NO: 626651 - DNA, 20 bp, Artificial Sequence
  chemically synthesized
cgattttacaaaattatgca

SEQ ID NO: 626652 - DNA, 20 bp, Artificial Sequence
  chemically synthesized
aactgcgaacaattaatttc

SEQ ID NO: 626653 - DNA, 20 bp, Artificial Sequence
  chemically synthesized
gtgtctggtgaggacccagt

SEQ ID NO: 626654 - DNA, 20 bp, Artificial Sequence
  chemically synthesized
tgagggcagagccctaatga

SEQ ID NO: 626655 - DNA, 20 bp, Artificial Sequence
  chemically synthesized
cattcattagggctctgccc

SEQ ID NO: 626656 - DNA, 20 bp, Artificial Sequence
  chemically synthesized
aaaaggtggaggacattagg

SEQ ID NO: 626657 - DNA, 20 bp, Artificial Sequence
  chemically synthesized
tagtactatcatattggcaa

SEQ ID NO: 626658 - DNA, 20 bp, Artificial Sequence
  chemically synthesized
gtaggacacattcagatcat

SEQ ID NO: 626659 - DNA, 20 bp, Artificial Sequence
  chemically synthesized
acatttcatcatgtaagata

SEQ ID NO: 626660 - DNA, 20 bp, Artificial Sequence
  chemically synthesized
attataaaaatatatagcca

SEQ ID NO: 626661 - DNA, 20 bp, Artificial Sequence
  chemically synthesized
cttgaaaacataattttaat

SEQ ID NO: 626662 - DNA, 20 bp, Artificial Sequence
  chemically synthesized
acattaagcacttattaaaa

SEQ ID NO: 626663 - DNA, 20 bp, Artificial Sequence
  chemically synthesized
gttccgttgcaacagatatg

SEQ ID NO: 626664 - DNA, 20 bp, Artificial Sequence
  chemically synthesized
gttgcaacagatatgccaag

SEQ ID NO: 626665 - DNA, 20 bp, Artificial Sequence
  chemically synthesized
tctgagactcttccctaaag

SEQ ID NO: 626666 - DNA, 20 bp, Artificial Sequence
  chemically synthesized
actctttatgcatattgcca

SEQ ID NO: 626667 - DNA, 20 bp, Artificial Sequence
  chemically synthesized
aatgctttcaaaaaccatta

SEQ ID NO: 626668 - DNA, 20 bp, Artificial Sequence
  chemically synthesized
gtgaggttataaatcagtct

SEQ ID NO: 626669 - DNA, 20 bp, Artificial Sequence
  chemically synthesized
ataaatttaaaattaaaaac

SEQ ID NO: 626670 - DNA, 20 bp, Artificial Sequence
  chemically synthesized
attagtagaataactaaatc

SEQ ID NO: 626671 - DNA, 20 bp, Artificial Sequence
  chemically synthesized
tggaaagagtaaagagaaca

SEQ ID NO: 626672 - DNA, 20 bp, Artificial Sequence
  chemically synthesized
gcaaaattgagaggaaggta

SEQ ID NO: 626673 - DNA, 20 bp, Artificial Sequence
  chemically synthesized
taactatggaattttggtga

SEQ ID NO: 626674 - DNA, 20 bp, Artificial Sequence
  chemically synthesized
ttcttgggtgttgtgcattc

SEQ ID NO: 626675 - DNA, 20 bp, Artificial Sequence
  chemically synthesized
tatgtagacagttaaaagat

SEQ ID NO: 626676 - DNA, 20 bp, Artificial Sequence
  chemically synthesized
actgatcttttaactgtcta

SEQ ID NO: 626677 - DNA, 20 bp, Artificial Sequence
  chemically synthesized
cttttaactgtctacatagt

SEQ ID NO: 626678 - DNA, 20 bp, Artificial Sequence
  chemically synthesized
attgttgaaatcatatagta

SEQ ID NO: 626679 - DNA, 20 bp, Artificial Sequence
  chemically synthesized
tctgaaaaaatctacatact

SEQ ID NO: 626680 - DNA, 20 bp, Artificial Sequence
  chemically synthesized
tcatatagtatgtagatttt

SEQ ID NO: 626681 - DNA, 20 bp, Artificial Sequence
  chemically synthesized
tagtatgtagattttttcag

SEQ ID NO: 626682 - DNA, 20 bp, Artificial Sequence
  chemically synthesized
tttttcagatttgcttgttc

SEQ ID NO: 626683 - DNA, 20 bp, Artificial Sequence
  chemically synthesized
cttgttcactggtttcctct

SEQ ID NO: 626684 - DNA, 20 bp, Artificial Sequence
  chemically synthesized
cacctactgaaggacatctt

SEQ ID NO: 626685 - DNA, 20 bp, Artificial Sequence
  chemically synthesized
ccctgcacatggatgtttat

SEQ ID NO: 626686 - DNA, 20 bp, Artificial Sequence
  chemically synthesized
ctgtcataaacatccatgtg

SEQ ID NO: 626687 - DNA, 20 bp, Artificial Sequence
  chemically synthesized
ccacacaaaaccctgcacat

SEQ ID NO: 626688 - DNA, 20 bp, Artificial Sequence
  chemically synthesized
ggtatatataacaagccaaa

SEQ ID NO: 626689 - DNA, 20 bp, Artificial Sequence
  chemically synthesized
atataacaagccaaaataag

SEQ ID NO: 626690 - DNA, 20 bp, Artificial Sequence
  chemically synthesized
ttaactgaaactaagcttat

SEQ ID NO: 626691 - DNA, 20 bp, Artificial Sequence
  chemically synthesized
accataattcttaactgaaa

SEQ ID NO: 626692 - DNA, 20 bp, Artificial Sequence
  chemically synthesized
gcttagtttcagttaagaat

SEQ ID NO: 626693 - DNA, 20 bp, Artificial Sequence
  chemically synthesized
aattatggttttaaaatctt

SEQ ID NO: 626694 - DNA, 20 bp, Artificial Sequence
  chemically synthesized
tattttatcattttaatctt

SEQ ID NO: 626695 - DNA, 20 bp, Artificial Sequence
  chemically synthesized
tcttcggtggaaagaagaat

SEQ ID NO: 626696 - DNA, 20 bp, Artificial Sequence
  chemically synthesized
cttacatataatacaaattc

SEQ ID NO: 626697 - DNA, 20 bp, Artificial Sequence
  chemically synthesized
aattcagaagttttatgtct

SEQ ID NO: 626698 - DNA, 20 bp, Artificial Sequence
  chemically synthesized
ccatcccatattcctattac

SEQ ID NO: 626699 - DNA, 20 bp, Artificial Sequence
  chemically synthesized
atgggatgggaagaattaca

SEQ ID NO: 626700 - DNA, 20 bp, Artificial Sequence
  chemically synthesized
attatgtagatacttactga

SEQ ID NO: 626701 - DNA, 20 bp, Artificial Sequence
  chemically synthesized
tgggtctctcccaccacaca

SEQ ID NO: 626702 - DNA, 20 bp, Artificial Sequence
  chemically synthesized
ggagataactgaatcatggg

SEQ ID NO: 626703 - DNA, 20 bp, Artificial Sequence
  chemically synthesized
atagcatggggaaaccaccc

SEQ ID NO: 626704 - DNA, 20 bp, Artificial Sequence
  chemically synthesized
agtaagttctcatgagatct

SEQ ID NO: 626705 - DNA, 20 bp, Artificial Sequence
  chemically synthesized
gttttataagggacttcccc

SEQ ID NO: 626706 - DNA, 20 bp, Artificial Sequence
  chemically synthesized
gctgccgccatgtgatgagg

SEQ ID NO: 626707 - DNA, 20 bp, Artificial Sequence
  chemically synthesized
ccgccatgtgatgaggatgt

SEQ ID NO: 626708 - DNA, 20 bp, Artificial Sequence
  chemically synthesized
tgtgtttgcttccccttctg

SEQ ID NO: 626709 - DNA, 20 bp, Artificial Sequence
  chemically synthesized
cttccccttctgccatgatt

SEQ ID NO: 626710 - DNA, 20 bp, Artificial Sequence
  chemically synthesized
atgcataattcataaaggaa

SEQ ID NO: 626711 - DNA, 20 bp, Artificial Sequence
  chemically synthesized
tttcaaatttatttaatgtc

SEQ ID NO: 626712 - DNA, 20 bp, Artificial Sequence
  chemically synthesized
ataaataacttcagaagatt

SEQ ID NO: 626713 - DNA, 20 bp, Artificial Sequence
  chemically synthesized
tatttataataaataacttc

SEQ ID NO: 626714 - DNA, 20 bp, Artificial Sequence
  chemically synthesized
gatgtaaaatgatgttatat

SEQ ID NO: 626715 - DNA, 20 bp, Artificial Sequence
  chemically synthesized
aaaatgatgttatattttag

SEQ ID NO: 626716 - DNA, 20 bp, Artificial Sequence
  chemically synthesized
gtaacggtcaccaatatgta

SEQ ID NO: 626717 - DNA, 20 bp, Artificial Sequence
  chemically synthesized
ttctaattgttggagagaga

SEQ ID NO: 626718 - DNA, 20 bp, Artificial Sequence
  chemically synthesized
actgtagccttgtagtatag

SEQ ID NO: 626719 - DNA, 20 bp, Artificial Sequence
  chemically synthesized
tggttactgtagccttgtag

SEQ ID NO: 626720 - DNA, 20 bp, Artificial Sequence
  chemically synthesized
ctgttttggtaccagtacca

SEQ ID NO: 626721 - DNA, 20 bp, Artificial Sequence
  chemically synthesized
tctgttccattgatctgtat

SEQ ID NO: 626722 - DNA, 20 bp, Artificial Sequence
  chemically synthesized
ttccccattgcttgtttttc

SEQ ID NO: 626723 - DNA, 20 bp, Artificial Sequence
  chemically synthesized
gagaaaaacaagcaatgggg

SEQ ID NO: 626724 - DNA, 20 bp, Artificial Sequence
  chemically synthesized
tagggaatcctttccccatt

SEQ ID NO: 626725 - DNA, 20 bp, Artificial Sequence
  chemically synthesized
taaatagggaatcctttccc

SEQ ID NO: 626726 - DNA, 20 bp, Artificial Sequence
  chemically synthesized
cagctttctccatatggcta

SEQ ID NO: 626727 - DNA, 20 bp, Artificial Sequence
  chemically synthesized
gtgtgaggaagggatccagt

SEQ ID NO: 626728 - DNA, 20 bp, Artificial Sequence
  chemically synthesized
tataaggtgtgaggaaggga

SEQ ID NO: 626729 - DNA, 20 bp, Artificial Sequence
  chemically synthesized
ttatacaaaaattaattcaa

SEQ ID NO: 626730 - DNA, 20 bp, Artificial Sequence
  chemically synthesized
ggtttttatggttttaggtc

SEQ ID NO: 626731 - DNA, 20 bp, Artificial Sequence
  chemically synthesized
aggttttcttctagggtttt

SEQ ID NO: 626732 - DNA, 20 bp, Artificial Sequence
  chemically synthesized
gtaatgcctaggttttcttc

SEQ ID NO: 626733 - DNA, 20 bp, Artificial Sequence
  chemically synthesized
tatgtcctgaatggtaatgc

SEQ ID NO: 626734 - DNA, 20 bp, Artificial Sequence
  chemically synthesized
gcttttgttgccattgcttt

SEQ ID NO: 626735 - DNA, 20 bp, Artificial Sequence
  chemically synthesized
tcaattttggcttttgttgc

SEQ ID NO: 626736 - DNA, 20 bp, Artificial Sequence
  chemically synthesized
atgagatcccatttgtcaat

SEQ ID NO: 626737 - DNA, 20 bp, Artificial Sequence
  chemically synthesized
aatgggatctcatcaaacta

SEQ ID NO: 626738 - DNA, 20 bp, Artificial Sequence
  chemically synthesized
cttttgctgtgcagaagctc

SEQ ID NO: 626739 - DNA, 20 bp, Artificial Sequence
  chemically synthesized
ggttgcctgttcactctgat

SEQ ID NO: 626740 - DNA, 20 bp, Artificial Sequence
  chemically synthesized
gtaaatttgtttgagttcat

SEQ ID NO: 626741 - DNA, 20 bp, Artificial Sequence
  chemically synthesized
tgtttgtttttttcttgtaa

SEQ ID NO: 626742 - DNA, 20 bp, Artificial Sequence
  chemically synthesized
gcccactttttgatggggtt

SEQ ID NO: 626743 - DNA, 20 bp, Artificial Sequence
  chemically synthesized
cttcgcccactttttgatgg

SEQ ID NO: 626744 - DNA, 20 bp, Artificial Sequence
  chemically synthesized
gagatggtatctcattgtgg

SEQ ID NO: 626745 - DNA, 20 bp, Artificial Sequence
  chemically synthesized
ggtgtgagatggtatctcat

SEQ ID NO: 626746 - DNA, 20 bp, Artificial Sequence
  chemically synthesized
tccacatcctctccagcacc

SEQ ID NO: 626747 - DNA, 20 bp, Artificial Sequence
  chemically synthesized
ctgacttccacaatggttga

SEQ ID NO: 626748 - DNA, 20 bp, Artificial Sequence
  chemically synthesized
aaccattgtggaagtcagtg

SEQ ID NO: 626749 - DNA, 20 bp, Artificial Sequence
  chemically synthesized
gtgcatgtgtctttatagca

SEQ ID NO: 626750 - DNA, 20 bp, Artificial Sequence
  chemically synthesized
caaatgtccaacaatgatag

SEQ ID NO: 626751 - DNA, 20 bp, Artificial Sequence
  chemically synthesized
ttgcaatggtttgctgagaa

SEQ ID NO: 626752 - DNA, 20 bp, Artificial Sequence
  chemically synthesized
gtttggttttttgtccttgc

SEQ ID NO: 626753 - DNA, 20 bp, Artificial Sequence
  chemically synthesized
atgagtgagaacatgcggtg

SEQ ID NO: 626754 - DNA, 20 bp, Artificial Sequence
  chemically synthesized
cacctatgagtgagaacatg

SEQ ID NO: 626755 - DNA, 20 bp, Artificial Sequence
  chemically synthesized
aattttattattattatact

SEQ ID NO: 626756 - DNA, 20 bp, Artificial Sequence
  chemically synthesized
gttttgtctcctaaattagg

SEQ ID NO: 626757 - DNA, 20 bp, Artificial Sequence
  chemically synthesized
agacaaaacaaactaatgtc

SEQ ID NO: 626758 - DNA, 20 bp, Artificial Sequence
  chemically synthesized
caaacaaacttctgacatta

SEQ ID NO: 626759 - DNA, 20 bp, Artificial Sequence
  chemically synthesized
aaaacaaactaatgtcagaa

SEQ ID NO: 626760 - DNA, 20 bp, Artificial Sequence
  chemically synthesized
tgtgcaaacaaacttctgac

SEQ ID NO: 626761 - DNA, 20 bp, Artificial Sequence
  chemically synthesized
ataagagaatactcttgaat

SEQ ID NO: 626762 - DNA, 20 bp, Artificial Sequence
  chemically synthesized
ataatgtgacttatgagact

SEQ ID NO: 626763 - DNA, 20 bp, Artificial Sequence
  chemically synthesized
ataagtcacattatagagca

SEQ ID NO: 626764 - DNA, 20 bp, Artificial Sequence
  chemically synthesized
acgttttcctcccatggtga

SEQ ID NO: 626765 - DNA, 20 bp, Artificial Sequence
  chemically synthesized
gggataaatatttcctggtt

SEQ ID NO: 626766 - DNA, 20 bp, Artificial Sequence
  chemically synthesized
tactgaagtctgtgcccaaa

SEQ ID NO: 626767 - DNA, 20 bp, Artificial Sequence
  chemically synthesized
taaattctcttttatatttt

SEQ ID NO: 626768 - DNA, 20 bp, Artificial Sequence
  chemically synthesized
caaggcctagttcttagaaa

SEQ ID NO: 626769 - DNA, 20 bp, Artificial Sequence
  chemically synthesized
cattgtgtgtggctcaggct

SEQ ID NO: 626770 - DNA, 20 bp, Artificial Sequence
  chemically synthesized
aaaggccatagagacaagta

SEQ ID NO: 626771 - DNA, 20 bp, Artificial Sequence
  chemically synthesized
tgctggctggtcaatttagc

SEQ ID NO: 626772 - DNA, 20 bp, Artificial Sequence
  chemically synthesized
tacttactatgaaaagaaac

SEQ ID NO: 626773 - DNA, 20 bp, Artificial Sequence
  chemically synthesized
atgcacatgtaacataaagc

SEQ ID NO: 626774 - DNA, 20 bp, Artificial Sequence
  chemically synthesized
gaagatgtggttcctgatct

SEQ ID NO: 626775 - DNA, 20 bp, Artificial Sequence
  chemically synthesized
tggttcctgatcttgcagtt

SEQ ID NO: 626776 - DNA, 20 bp, Artificial Sequence
  chemically synthesized
ataacaaggaacagaaatat

SEQ ID NO: 626777 - DNA, 20 bp, Artificial Sequence
  chemically synthesized
tcatagtagagctgaaaatc

SEQ ID NO: 626778 - DNA, 20 bp, Artificial Sequence
  chemically synthesized
ttcctcattttagccaaagc

SEQ ID NO: 626779 - DNA, 20 bp, Artificial Sequence
  chemically synthesized
tactccttcctcattttagc

SEQ ID NO: 626780 - DNA, 20 bp, Artificial Sequence
  chemically synthesized
atttaattgaggaaataagt

SEQ ID NO: 626781 - DNA, 20 bp, Artificial Sequence
  chemically synthesized
aggggaaaggcaaatggcac

SEQ ID NO: 626782 - DNA, 20 bp, Artificial Sequence
  chemically synthesized
cagaggcttgaaaactcctg

SEQ ID NO: 626783 - DNA, 20 bp, Artificial Sequence
  chemically synthesized
acctctcacccaaacatgcc

SEQ ID NO: 626784 - DNA, 20 bp, Artificial Sequence
  chemically synthesized
ggcatgtttgggtgagaggt

SEQ ID NO: 626785 - DNA, 20 bp, Artificial Sequence
  chemically synthesized
ttgtactaattgagactttg

SEQ ID NO: 626786 - DNA, 20 bp, Artificial Sequence
  chemically synthesized
ggctttgtactaattgagac

SEQ ID NO: 626787 - DNA, 20 bp, Artificial Sequence
  chemically synthesized
agagacagagtctgggtccc

SEQ ID NO: 626788 - DNA, 20 bp, Artificial Sequence
  chemically synthesized
atactatggcgctaccctgc

SEQ ID NO: 626789 - DNA, 20 bp, Artificial Sequence
  chemically synthesized
atagttggtgactttggaca

SEQ ID NO: 626790 - DNA, 20 bp, Artificial Sequence
  chemically synthesized
gactaatacatgctctatgc

SEQ ID NO: 626791 - DNA, 20 bp, Artificial Sequence
  chemically synthesized
aggatattaatatttagctc

SEQ ID NO: 626792 - DNA, 20 bp, Artificial Sequence
  chemically synthesized
tattaatatttagctcattg

SEQ ID NO: 626793 - DNA, 20 bp, Artificial Sequence
  chemically synthesized
ttatatccttttaataacaa

SEQ ID NO: 626794 - DNA, 20 bp, Artificial Sequence
  chemically synthesized
tttaataacaacattgatta

SEQ ID NO: 626795 - DNA, 20 bp, Artificial Sequence
  chemically synthesized
ctcttttatttttggccact

SEQ ID NO: 626796 - DNA, 20 bp, Artificial Sequence
  chemically synthesized
gcatgatcattgcaactcga

SEQ ID NO: 626797 - DNA, 20 bp, Artificial Sequence
  chemically synthesized
aattcagatgttatattttt

SEQ ID NO: 626798 - DNA, 20 bp, Artificial Sequence
  chemically synthesized
aaaaataaataaataaataa

SEQ ID NO: 626799 - DNA, 20 bp, Artificial Sequence
  chemically synthesized
cgccttggcctcccaaagtt

SEQ ID NO: 626800 - DNA, 20 bp, Artificial Sequence
  chemically synthesized
ttttgtatttttagtagaga

SEQ ID NO: 626801 - DNA, 20 bp, Artificial Sequence
  chemically synthesized
aacttctgcctcccgggttc

SEQ ID NO: 626802 - DNA, 20 bp, Artificial Sequence
  chemically synthesized
ttctaccctaacaatagagg

SEQ ID NO: 626803 - DNA, 20 bp, Artificial Sequence
  chemically synthesized
tttattgaatttctgcctgt

SEQ ID NO: 626804 - DNA, 20 bp, Artificial Sequence
  chemically synthesized
atgagtaacttttgaaggag

SEQ ID NO: 626805 - DNA, 20 bp, Artificial Sequence
  chemically synthesized
tacagaatgttacagtttaa

SEQ ID NO: 626806 - DNA, 20 bp, Artificial Sequence
  chemically synthesized
ctggtgtctgtacagaatgt

SEQ ID NO: 626807 - DNA, 20 bp, Artificial Sequence
  chemically synthesized
ctgtaacattctgtacagac

SEQ ID NO: 626808 - DNA, 20 bp, Artificial Sequence
  chemically synthesized
gtactcaatgaaatttagat

SEQ ID NO: 626809 - DNA, 20 bp, Artificial Sequence
  chemically synthesized
ttacgtggtactcaatgaaa

SEQ ID NO: 626810 - DNA, 20 bp, Artificial Sequence
  chemically synthesized
tttcaacattcattttatcc

SEQ ID NO: 626811 - DNA, 20 bp, Artificial Sequence
  chemically synthesized
tggtatgtctaccaatgcgc

SEQ ID NO: 626812 - DNA, 20 bp, Artificial Sequence
  chemically synthesized
tggttcaattcaatgtcata

SEQ ID NO: 626813 - DNA, 20 bp, Artificial Sequence
  chemically synthesized
cagacattgttctaaaggct

SEQ ID NO: 626814 - DNA, 20 bp, Artificial Sequence
  chemically synthesized
gttctaaaggctaagagttt

SEQ ID NO: 626815 - DNA, 20 bp, Artificial Sequence
  chemically synthesized
attcaaaaacacaatagttc

SEQ ID NO: 626816 - DNA, 20 bp, Artificial Sequence
  chemically synthesized
gaaggcaaactagggaacta

SEQ ID NO: 626817 - DNA, 20 bp, Artificial Sequence
  chemically synthesized
caactttggcattttcccaa

SEQ ID NO: 626818 - DNA, 20 bp, Artificial Sequence
  chemically synthesized
caaaatatttccaaatacca

SEQ ID NO: 626819 - DNA, 20 bp, Artificial Sequence
  chemically synthesized
cagtggtatttggaaatatt

SEQ ID NO: 626820 - DNA, 20 bp, Artificial Sequence
  chemically synthesized
aattgattctcagaaaaatt

SEQ ID NO: 626821 - DNA, 20 bp, Artificial Sequence
  chemically synthesized
ttatttaaagttagacgatt

SEQ ID NO: 626822 - DNA, 20 bp, Artificial Sequence
  chemically synthesized
tttttactttatttaaagtt

SEQ ID NO: 626823 - DNA, 20 bp, Artificial Sequence
  chemically synthesized
gactgtttgcctcaatatat

SEQ ID NO: 626824 - DNA, 20 bp, Artificial Sequence
  chemically synthesized
aaaaggattttcaaaataaa

SEQ ID NO: 626825 - DNA, 20 bp, Artificial Sequence
  chemically synthesized
ttattttgaaaatccttttt

SEQ ID NO: 626826 - DNA, 20 bp, Artificial Sequence
  chemically synthesized
ttatttgtggaaacctttaa

SEQ ID NO: 626827 - DNA, 20 bp, Artificial Sequence
  chemically synthesized
cttgaagatctagtttggtt

SEQ ID NO: 626828 - DNA, 20 bp, Artificial Sequence
  chemically synthesized
attggtaaggggcttgaaga

SEQ ID NO: 626829 - DNA, 20 bp, Artificial Sequence
  chemically synthesized
attggggagaggaattggta

SEQ ID NO: 626830 - DNA, 20 bp, Artificial Sequence
  chemically synthesized
accaattcctctccccaatt

SEQ ID NO: 626831 - DNA, 20 bp, Artificial Sequence
  chemically synthesized
gatactgcaagactatcaca

SEQ ID NO: 626832 - DNA, 20 bp, Artificial Sequence
  chemically synthesized
ctgactgtgtggtctcgcat

SEQ ID NO: 626833 - DNA, 20 bp, Artificial Sequence
  chemically synthesized
tttactgactgtgtggtctc

SEQ ID NO: 626834 - DNA, 20 bp, Artificial Sequence
  chemically synthesized
gagttctccttttgtctata

SEQ ID NO: 626835 - DNA, 20 bp, Artificial Sequence
  chemically synthesized
gtgttcccatatgaacactg

SEQ ID NO: 626836 - DNA, 20 bp, Artificial Sequence
  chemically synthesized
ctttagtgttcccatatgaa

SEQ ID NO: 626837 - DNA, 20 bp, Artificial Sequence
  chemically synthesized
ttggctctgttatgtactgt

SEQ ID NO: 626838 - DNA, 20 bp, Artificial Sequence
  chemically synthesized
gaaattgttctggttcctgc

SEQ ID NO: 626839 - DNA, 20 bp, Artificial Sequence
  chemically synthesized
ttcacggtgttaaataatta

SEQ ID NO: 626840 - DNA, 20 bp, Artificial Sequence
  chemically synthesized
ctaagatctgtacttcaaaa

SEQ ID NO: 626841 - DNA, 20 bp, Artificial Sequence
  chemically synthesized
ccctttctttatattcccca

SEQ ID NO: 626842 - DNA, 20 bp, Artificial Sequence
  chemically synthesized
cagctttgacaaattgagta

SEQ ID NO: 626843 - DNA, 20 bp, Artificial Sequence
  chemically synthesized
tgtttaaatacagacagatt

SEQ ID NO: 626844 - DNA, 20 bp, Artificial Sequence
  chemically synthesized
tatatttatgtttaaataca

SEQ ID NO: 626845 - DNA, 20 bp, Artificial Sequence
  chemically synthesized
gttcatttatttatttatat

SEQ ID NO: 626846 - DNA, 20 bp, Artificial Sequence
  chemically synthesized
aatgaacaaataaataaata

SEQ ID NO: 626847 - DNA, 20 bp, Artificial Sequence
  chemically synthesized
ttgtaacctattctaaaata

SEQ ID NO: 626848 - DNA, 20 bp, Artificial Sequence
  chemically synthesized
ctttattattttttaagtat

SEQ ID NO: 626849 - DNA, 20 bp, Artificial Sequence
  chemically synthesized
caatgagtgacccacctact

SEQ ID NO: 626850 - DNA, 20 bp, Artificial Sequence
  chemically synthesized
atttttattacaagtatgtg

SEQ ID NO: 626851 - DNA, 20 bp, Artificial Sequence
  chemically synthesized
agtactatatataggaggcc

SEQ ID NO: 626852 - DNA, 20 bp, Artificial Sequence
  chemically synthesized
aatcaatactccaaatactt

SEQ ID NO: 626853 - DNA, 20 bp, Artificial Sequence
  chemically synthesized
aagcatagaagtatttggag

SEQ ID NO: 626854 - DNA, 20 bp, Artificial Sequence
  chemically synthesized
ttcactaaagtacatcttgc

SEQ ID NO: 626855 - DNA, 20 bp, Artificial Sequence
  chemically synthesized
aatgcaataaaaattaatat

SEQ ID NO: 626856 - DNA, 20 bp, Artificial Sequence
  chemically synthesized
ttttcagtagaaaaaggtgc

SEQ ID NO: 626857 - DNA, 20 bp, Artificial Sequence
  chemically synthesized
gaatggagactgaattatat

SEQ ID NO: 626858 - DNA, 20 bp, Artificial Sequence
  chemically synthesized
tccattcaaataacttataa

SEQ ID NO: 626859 - DNA, 20 bp, Artificial Sequence
  chemically synthesized
aataacttataaaatagctt

SEQ ID NO: 626860 - DNA, 20 bp, Artificial Sequence
  chemically synthesized
gaatatcttcttaataatat

SEQ ID NO: 626861 - DNA, 20 bp, Artificial Sequence
  chemically synthesized
aggctccatgcatttttaag

SEQ ID NO: 626862 - DNA, 20 bp, Artificial Sequence
  chemically synthesized
ggagcctattgtagctgcct

SEQ ID NO: 626863 - DNA, 20 bp, Artificial Sequence
  chemically synthesized
ttttgtaatatttttgttga

SEQ ID NO: 626864 - DNA, 20 bp, Artificial Sequence
  chemically synthesized
tgttgaagtggcttaagtac

SEQ ID NO: 626865 - DNA, 20 bp, Artificial Sequence
  chemically synthesized
tggcttaagtacaaaggttt

SEQ ID NO: 626866 - DNA, 20 bp, Artificial Sequence
  chemically synthesized
tgataagagagttaaattga

SEQ ID NO: 626867 - DNA, 20 bp, Artificial Sequence
  chemically synthesized
gtcaatttaactctcttatc

SEQ ID NO: 626868 - DNA, 20 bp, Artificial Sequence
  chemically synthesized
atatttttcttctaagagaa

SEQ ID NO: 626869 - DNA, 20 bp, Artificial Sequence
  chemically synthesized
agaagttcgcttctttaaaa

SEQ ID NO: 626870 - DNA, 20 bp, Artificial Sequence
  chemically synthesized
ttcattttaattaagtcatt

SEQ ID NO: 626871 - DNA, 20 bp, Artificial Sequence
  chemically synthesized
atactcaatttttgcagaat

SEQ ID NO: 626872 - DNA, 20 bp, Artificial Sequence
  chemically synthesized
ctaattctgcaaaaattgag

SEQ ID NO: 626873 - DNA, 20 bp, Artificial Sequence
  chemically synthesized
aaattgagtattgtttcatt

SEQ ID NO: 626874 - DNA, 20 bp, Artificial Sequence
  chemically synthesized
ttatttttgatctgactttc

SEQ ID NO: 626875 - DNA, 20 bp, Artificial Sequence
  chemically synthesized
acagaaagtcagatcaaaaa

SEQ ID NO: 626876 - DNA, 20 bp, Artificial Sequence
  chemically synthesized
caaaaataaagattacgagt

SEQ ID NO: 626877 - DNA, 20 bp, Artificial Sequence
  chemically synthesized
ttacagctataaaaatttta

SEQ ID NO: 626878 - DNA, 20 bp, Artificial Sequence
  chemically synthesized
taatgttgacaatatctggc

SEQ ID NO: 626879 - DNA, 20 bp, Artificial Sequence
  chemically synthesized
aatatctggcatgggatttg

SEQ ID NO: 626880 - DNA, 20 bp, Artificial Sequence
  chemically synthesized
gaagagattaatggcaagaa

SEQ ID NO: 626881 - DNA, 20 bp, Artificial Sequence
  chemically synthesized
ggcaagaagagggattttta

SEQ ID NO: 626882 - DNA, 20 bp, Artificial Sequence
  chemically synthesized
caccagagaaaatgaagcta

SEQ ID NO: 626883 - DNA, 20 bp, Artificial Sequence
  chemically synthesized
attcttgttttcaaaatccc

SEQ ID NO: 626884 - DNA, 20 bp, Artificial Sequence
  chemically synthesized
tttgaaaacaagaatgaatc

SEQ ID NO: 626885 - DNA, 20 bp, Artificial Sequence
  chemically synthesized
cagcaaaactctcgattcat

SEQ ID NO: 626886 - DNA, 20 bp, Artificial Sequence
  chemically synthesized
ataacttagaacagcaaaac

SEQ ID NO: 626887 - DNA, 20 bp, Artificial Sequence
  chemically synthesized
taactataatatatatatac

SEQ ID NO: 626888 - DNA, 20 bp, Artificial Sequence
  chemically synthesized
ctaaagtagggtcatgtaaa

SEQ ID NO: 626889 - DNA, 20 bp, Artificial Sequence
  chemically synthesized
attattttttatgtaaataa

SEQ ID NO: 626890 - DNA, 20 bp, Artificial Sequence
  chemically synthesized
gtttaacagacatacgatca

SEQ ID NO: 626891 - DNA, 20 bp, Artificial Sequence
  chemically synthesized
taagtaatgtcaatacaata

SEQ ID NO: 626892 - DNA, 20 bp, Artificial Sequence
  chemically synthesized
tactaaagtctgaatttttt

SEQ ID NO: 626893 - DNA, 20 bp, Artificial Sequence
  chemically synthesized
tttacctctattttcttgaa

SEQ ID NO: 626894 - DNA, 20 bp, Artificial Sequence
  chemically synthesized
acctgctcttatgcgtaggg

SEQ ID NO: 626895 - DNA, 20 bp, Artificial Sequence
  chemically synthesized
gcaccatttggcacttggca

SEQ ID NO: 626896 - DNA, 20 bp, Artificial Sequence
  chemically synthesized
tggtgcagggagttggaagt

SEQ ID NO: 626897 - DNA, 20 bp, Artificial Sequence
  chemically synthesized
gtatctccttattattttct

SEQ ID NO: 626898 - DNA, 20 bp, Artificial Sequence
  chemically synthesized
gaaaattctttttcttgccc

SEQ ID NO: 626899 - DNA, 20 bp, Artificial Sequence
  chemically synthesized
aaaacttgctatttttcatc

SEQ ID NO: 626900 - DNA, 20 bp, Artificial Sequence
  chemically synthesized
aaatcaaatgatgaaaaata

SEQ ID NO: 626901 - DNA, 20 bp, Artificial Sequence
  chemically synthesized
gaaattgaaatgacaccatt

SEQ ID NO: 626902 - DNA, 20 bp, Artificial Sequence
  chemically synthesized
tagttgagtcctgagaaaac

SEQ ID NO: 626903 - DNA, 20 bp, Artificial Sequence
  chemically synthesized
tggacccatgcagttcaaac

SEQ ID NO: 626904 - DNA, 20 bp, Artificial Sequence
  chemically synthesized
aaaattggccctctatatac

SEQ ID NO: 626905 - DNA, 20 bp, Artificial Sequence
  chemically synthesized
ggctgtgaaatgtgagtatg

SEQ ID NO: 626906 - DNA, 20 bp, Artificial Sequence
  chemically synthesized
tgcataacttgaatgtcgtt

SEQ ID NO: 626907 - DNA, 20 bp, Artificial Sequence
  chemically synthesized
cagtcaagtcttgttattca

SEQ ID NO: 626908 - DNA, 20 bp, Artificial Sequence
  chemically synthesized
cattgtatttctcctgggag

SEQ ID NO: 626909 - DNA, 20 bp, Artificial Sequence
  chemically synthesized
cctcccaggagaaatacaat

SEQ ID NO: 626910 - DNA, 20 bp, Artificial Sequence
  chemically synthesized
gcaatgtataatcccatttt

SEQ ID NO: 626911 - DNA, 20 bp, Artificial Sequence
  chemically synthesized
taaacagaaaaacaggcaaa

SEQ ID NO: 626912 - DNA, 20 bp, Artificial Sequence
  chemically synthesized
taatcccattttgcctgttt

SEQ ID NO: 626913 - DNA, 20 bp, Artificial Sequence
  chemically synthesized
tcaataatatatattcaata

SEQ ID NO: 626914 - DNA, 20 bp, Artificial Sequence
  chemically synthesized
gttccttaggtaagtttcct

SEQ ID NO: 626915 - DNA, 20 bp, Artificial Sequence
  chemically synthesized
aaagaaaataggttccttag

SEQ ID NO: 626916 - DNA, 20 bp, Artificial Sequence
  chemically synthesized
taaggtacttcacagccttc

SEQ ID NO: 626917 - DNA, 20 bp, Artificial Sequence
  chemically synthesized
tgaatttctgtctagtgttc

SEQ ID NO: 626918 - DNA, 20 bp, Artificial Sequence
  chemically synthesized
cactagacagaaattcacca

SEQ ID NO: 626919 - DNA, 20 bp, Artificial Sequence
  chemically synthesized
atgctttttcttggtgattt

SEQ ID NO: 626920 - DNA, 20 bp, Artificial Sequence
  chemically synthesized
catatttttatgctttttct

SEQ ID NO: 626921 - DNA, 20 bp, Artificial Sequence
  chemically synthesized
atgctatgtttttcatattt

SEQ ID NO: 626922 - DNA, 20 bp, Artificial Sequence
  chemically synthesized
tttcagcggtgtatttaatg

SEQ ID NO: 626923 - DNA, 20 bp, Artificial Sequence
  chemically synthesized
aaatacaccgctgaaaggac

SEQ ID NO: 626924 - DNA, 20 bp, Artificial Sequence
  chemically synthesized
aaaaaaggaacactctgcat

SEQ ID NO: 626925 - DNA, 20 bp, Artificial Sequence
  chemically synthesized
ggctgtgaaaatgctatgag

SEQ ID NO: 626926 - DNA, 20 bp, Artificial Sequence
  chemically synthesized
agggatacaaattaaattta

SEQ ID NO: 626927 - DNA, 20 bp, Artificial Sequence
  chemically synthesized
gttctcattattcacacatt

SEQ ID NO: 626928 - DNA, 20 bp, Artificial Sequence
  chemically synthesized
aataatgagaaccatctgta

SEQ ID NO: 626929 - DNA, 20 bp, Artificial Sequence
  chemically synthesized
gtacaaagtttcaatcaata

SEQ ID NO: 626930 - DNA, 20 bp, Artificial Sequence
  chemically synthesized
aaagtttcaatcaatatact

SEQ ID NO: 626931 - DNA, 20 bp, Artificial Sequence
  chemically synthesized
aagggcctaatcaagcagta

SEQ ID NO: 626932 - DNA, 20 bp, Artificial Sequence
  chemically synthesized
gccctttttataaagcacta

SEQ ID NO: 626933 - DNA, 20 bp, Artificial Sequence
  chemically synthesized
atttgcaactaaaaacagta

SEQ ID NO: 626934 - DNA, 20 bp, Artificial Sequence
  chemically synthesized
caccataaccaaatgggatg

SEQ ID NO: 626935 - DNA, 20 bp, Artificial Sequence
  chemically synthesized
cctttcatcccatttggtta

SEQ ID NO: 626936 - DNA, 20 bp, Artificial Sequence
  chemically synthesized
aacaatacacatgtctgtaa

SEQ ID NO: 626937 - DNA, 20 bp, Artificial Sequence
  chemically synthesized
ctgctggaccaaattgtacg

SEQ ID NO: 626938 - DNA, 20 bp, Artificial Sequence
  chemically synthesized
gtacgtcgagattataatat

SEQ ID NO: 626939 - DNA, 20 bp, Artificial Sequence
  chemically synthesized
gatgtactgcaattttaagc

SEQ ID NO: 626940 - DNA, 20 bp, Artificial Sequence
  chemically synthesized
attgagcatgtaaaaaaatc

SEQ ID NO: 626941 - DNA, 20 bp, Artificial Sequence
  chemically synthesized
ttgtcttctcctggttactt

SEQ ID NO: 626942 - DNA, 20 bp, Artificial Sequence
  chemically synthesized
tttttttttttttacatcca

SEQ ID NO: 626943 - DNA, 20 bp, Artificial Sequence
  chemically synthesized
caagctccactttttagaaa

SEQ ID NO: 626944 - DNA, 20 bp, Artificial Sequence
  chemically synthesized
aaagctgaatttctaaaaag

SEQ ID NO: 626945 - DNA, 20 bp, Artificial Sequence
  chemically synthesized
caaagggactgtaggtgcaa

SEQ ID NO: 626946 - DNA, 20 bp, Artificial Sequence
  chemically synthesized
agtgacacttgttattaaaa

SEQ ID NO: 626947 - DNA, 20 bp, Artificial Sequence
  chemically synthesized
gtgtttgattatattgatga

SEQ ID NO: 626948 - DNA, 20 bp, Artificial Sequence
  chemically synthesized
aggcagatggatatctaggt

SEQ ID NO: 626949 - DNA, 20 bp, Artificial Sequence
  chemically synthesized
atcaaggcagatggatatct

SEQ ID NO: 626950 - DNA, 20 bp, Artificial Sequence
  chemically synthesized
tagatatccatctgccttga

SEQ ID NO: 626951 - DNA, 20 bp, Artificial Sequence
  chemically synthesized
tagaatacactgggtttgac

SEQ ID NO: 626952 - DNA, 20 bp, Artificial Sequence
  chemically synthesized
aaatatgtgagtagaataca

SEQ ID NO: 626953 - DNA, 20 bp, Artificial Sequence
  chemically synthesized
tatgacatactacattctgt

SEQ ID NO: 626954 - DNA, 20 bp, Artificial Sequence
  chemically synthesized
gtgcatttatgcaactgagt

SEQ ID NO: 626955 - DNA, 20 bp, Artificial Sequence
  chemically synthesized
gtacaagaagtaagcatttg

SEQ ID NO: 626956 - DNA, 20 bp, Artificial Sequence
  chemically synthesized
aagaagtaagcatttggaaa

SEQ ID NO: 626957 - DNA, 20 bp, Artificial Sequence
  chemically synthesized
aatgtcaaagcaaactttcc

SEQ ID NO: 626958 - DNA, 20 bp, Artificial Sequence
  chemically synthesized
gtttaatataattattatgt

SEQ ID NO: 626959 - DNA, 20 bp, Artificial Sequence
  chemically synthesized
taataattatattaaactct

SEQ ID NO: 626960 - DNA, 20 bp, Artificial Sequence
  chemically synthesized
tatgagcaataggaaactag

SEQ ID NO: 626961 - DNA, 20 bp, Artificial Sequence
  chemically synthesized
ataataaattaccatgaact

SEQ ID NO: 626962 - DNA, 20 bp, Artificial Sequence
  chemically synthesized
ggcccaagcaattctgatgc

SEQ ID NO: 626963 - DNA, 20 bp, Artificial Sequence
  chemically synthesized
ttgggaagctgaggcatcag

SEQ ID NO: 626964 - DNA, 20 bp, Artificial Sequence
  chemically synthesized
tctctactaaaaatacaaaa

SEQ ID NO: 626965 - DNA, 20 bp, Artificial Sequence
  chemically synthesized
tttttgtatttttagtagag

SEQ ID NO: 626966 - DNA, 20 bp, Artificial Sequence
  chemically synthesized
tggacggatcacatgaggtc

SEQ ID NO: 626967 - DNA, 20 bp, Artificial Sequence
  chemically synthesized
caccttggcctcgcaaagtg

SEQ ID NO: 626968 - DNA, 20 bp, Artificial Sequence
  chemically synthesized
tgcgtgatccactgtgccca

SEQ ID NO: 626969 - DNA, 20 bp, Artificial Sequence
  chemically synthesized
ctgtgcccagcctgtttttt

SEQ ID NO: 626970 - DNA, 20 bp, Artificial Sequence
  chemically synthesized
gaacagcgccccattgacac

SEQ ID NO: 626971 - DNA, 20 bp, Artificial Sequence
  chemically synthesized
ctctaggggagaatccattt

SEQ ID NO: 626972 - DNA, 20 bp, Artificial Sequence
  chemically synthesized
gcagcctctagaagctagga

SEQ ID NO: 626973 - DNA, 20 bp, Artificial Sequence
  chemically synthesized
ttctagaggctgcctacatt

SEQ ID NO: 626974 - DNA, 20 bp, Artificial Sequence
  chemically synthesized
agactggaagatgctatact

SEQ ID NO: 626975 - DNA, 20 bp, Artificial Sequence
  chemically synthesized
atgtagactggaagatgcta

SEQ ID NO: 626976 - DNA, 20 bp, Artificial Sequence
  chemically synthesized
tacatcacattactctgaca

SEQ ID NO: 626977 - DNA, 20 bp, Artificial Sequence
  chemically synthesized
aacatctcctttgactcctt

SEQ ID NO: 626978 - DNA, 20 bp, Artificial Sequence
  chemically synthesized
tttcttccttttttttgata

SEQ ID NO: 626979 - DNA, 20 bp, Artificial Sequence
  chemically synthesized
ttgggaggctgaggcaggag

SEQ ID NO: 626980 - DNA, 20 bp, Artificial Sequence
  chemically synthesized
tgcctcagcctcccaagtag

SEQ ID NO: 626981 - DNA, 20 bp, Artificial Sequence
  chemically synthesized
tttgtattttgtagtagaga

SEQ ID NO: 626982 - DNA, 20 bp, Artificial Sequence
  chemically synthesized
cctgaggtcaggagttcaag

SEQ ID NO: 626983 - DNA, 20 bp, Artificial Sequence
  chemically synthesized
cgcctcagcctcccaaagtg

SEQ ID NO: 626984 - DNA, 20 bp, Artificial Sequence
  chemically synthesized
agccaccttgaaggatcttt

SEQ ID NO: 626985 - DNA, 20 bp, Artificial Sequence
  chemically synthesized
cttgaaggatctttgtgtgt

SEQ ID NO: 626986 - DNA, 20 bp, Artificial Sequence
  chemically synthesized
ctttgagatggtaagattat

SEQ ID NO: 626987 - DNA, 20 bp, Artificial Sequence
  chemically synthesized
aaattagggactttgagatg

SEQ ID NO: 626988 - DNA, 20 bp, Artificial Sequence
  chemically synthesized
aggcaaagtttactttgcag

SEQ ID NO: 626989 - DNA, 20 bp, Artificial Sequence
  chemically synthesized
taaaaaggcaaagtttactt

SEQ ID NO: 626990 - DNA, 20 bp, Artificial Sequence
  chemically synthesized
aatattttaccataaaaagg

SEQ ID NO: 626991 - DNA, 20 bp, Artificial Sequence
  chemically synthesized
agatatttctttggaatgta

SEQ ID NO: 626992 - DNA, 20 bp, Artificial Sequence
  chemically synthesized
aaagaaatatctggctcttg

SEQ ID NO: 626993 - DNA, 20 bp, Artificial Sequence
  chemically synthesized
ctggcttctgggcaatacca

SEQ ID NO: 626994 - DNA, 20 bp, Artificial Sequence
  chemically synthesized
tttattttaataatgtatgg

SEQ ID NO: 626995 - DNA, 20 bp, Artificial Sequence
  chemically synthesized
cagcttttaggttacactgt

SEQ ID NO: 626996 - DNA, 20 bp, Artificial Sequence
  chemically synthesized
cttggtgtctagaattgtat

SEQ ID NO: 626997 - DNA, 20 bp, Artificial Sequence
  chemically synthesized
ggaaagaccaggtgccacct

SEQ ID NO: 626998 - DNA, 20 bp, Artificial Sequence
  chemically synthesized
aaagcagttacactcatgat

SEQ ID NO: 626999 - DNA, 20 bp, Artificial Sequence
  chemically synthesized
taaactgtaatcatgagtgt

SEQ ID NO: 627000 - DNA, 20 bp, Artificial Sequence
  chemically synthesized
attcttaaaagcagttacac

SEQ ID NO: 627001 - DNA, 20 bp, Artificial Sequence
  chemically synthesized
gccatataaggcaacatatt

SEQ ID NO: 627002 - DNA, 20 bp, Artificial Sequence
  chemically synthesized
ggcaacatattcatagcttc

SEQ ID NO: 627003 - DNA, 20 bp, Artificial Sequence
  chemically synthesized
cctctggtcaaataaattga

SEQ ID NO: 627004 - DNA, 20 bp, Artificial Sequence
  chemically synthesized
tcaatttatttgaccagagg

SEQ ID NO: 627005 - DNA, 20 bp, Artificial Sequence
  chemically synthesized
tttttttttaatattgtcaa

SEQ ID NO: 627006 - DNA, 20 bp, Artificial Sequence
  chemically synthesized
caataaaggaacatatgttt

SEQ ID NO: 627007 - DNA, 20 bp, Artificial Sequence
  chemically synthesized
tcttgactcaataaaggaac

SEQ ID NO: 627008 - DNA, 20 bp, Artificial Sequence
  chemically synthesized
acatatgttcctttattgag

SEQ ID NO: 627009 - DNA, 20 bp, Artificial Sequence
  chemically synthesized
gttcctttattgagtcaaga

SEQ ID NO: 627010 - DNA, 20 bp, Artificial Sequence
  chemically synthesized
agtcaagattcagttttctt

SEQ ID NO: 627011 - DNA, 20 bp, Artificial Sequence
  chemically synthesized
tttcttaagagatttttatc

SEQ ID NO: 627012 - DNA, 20 bp, Artificial Sequence
  chemically synthesized
ttattctacatataggaaag

SEQ ID NO: 627013 - DNA, 20 bp, Artificial Sequence
  chemically synthesized
tgacaggtttttgcttttaa

SEQ ID NO: 627014 - DNA, 20 bp, Artificial Sequence
  chemically synthesized
tggaaagtaatatgacaggt

SEQ ID NO: 627015 - DNA, 20 bp, Artificial Sequence
  chemically synthesized
caaacatggaaagtaatatg

SEQ ID NO: 627016 - DNA, 20 bp, Artificial Sequence
  chemically synthesized
aaaacctgtcatattacttt

SEQ ID NO: 627017 - DNA, 20 bp, Artificial Sequence
  chemically synthesized
agtgtttattgctaggaaat

SEQ ID NO: 627018 - DNA, 20 bp, Artificial Sequence
  chemically synthesized
tgaaagttgagtatgttttt

SEQ ID NO: 627019 - DNA, 20 bp, Artificial Sequence
  chemically synthesized
tactcttagatgaaagttga

SEQ ID NO: 627020 - DNA, 20 bp, Artificial Sequence
  chemically synthesized
ctaattgagttttcccattc

SEQ ID NO: 627021 - DNA, 20 bp, Artificial Sequence
  chemically synthesized
ttacagtctctggtagctaa

SEQ ID NO: 627022 - DNA, 20 bp, Artificial Sequence
  chemically synthesized
tggagtttggttttcagaac

SEQ ID NO: 627023 - DNA, 20 bp, Artificial Sequence
  chemically synthesized
ttgatattgaattgttggag

SEQ ID NO: 627024 - DNA, 20 bp, Artificial Sequence
  chemically synthesized
agatattgatattgaattgt

SEQ ID NO: 627025 - DNA, 20 bp, Artificial Sequence
  chemically synthesized
tatcaatatctttaaaggga

SEQ ID NO: 627026 - DNA, 20 bp, Artificial Sequence
  chemically synthesized
atataattgagaattagtgc

SEQ ID NO: 627027 - DNA, 20 bp, Artificial Sequence
  chemically synthesized
tgcactaattctcaattata

SEQ ID NO: 627028 - DNA, 20 bp, Artificial Sequence
  chemically synthesized
ttatttccatctatgggtat

SEQ ID NO: 627029 - DNA, 20 bp, Artificial Sequence
  chemically synthesized
tatgtgtgtgtgtatgtata

SEQ ID NO: 627030 - DNA, 20 bp, Artificial Sequence
  chemically synthesized
atatgaaaaatctataagcg

SEQ ID NO: 627031 - DNA, 20 bp, Artificial Sequence
  chemically synthesized
ctaatataaaacctaacgct

SEQ ID NO: 627032 - DNA, 20 bp, Artificial Sequence
  chemically synthesized
atggatactaatataaaacc

SEQ ID NO: 627033 - DNA, 20 bp, Artificial Sequence
  chemically synthesized
atccatgatctattttgagt

SEQ ID NO: 627034 - DNA, 20 bp, Artificial Sequence
  chemically synthesized
taaagtatgaggtgttcagg

SEQ ID NO: 627035 - DNA, 20 bp, Artificial Sequence
  chemically synthesized
tagcatcatttgttgaaaat

SEQ ID NO: 627036 - DNA, 20 bp, Artificial Sequence
  chemically synthesized
aatgatagtttccttcattg

SEQ ID NO: 627037 - DNA, 20 bp, Artificial Sequence
  chemically synthesized
cttttacacctttgcaaaga

SEQ ID NO: 627038 - DNA, 20 bp, Artificial Sequence
  chemically synthesized
agaaggaaattattatgcca

SEQ ID NO: 627039 - DNA, 20 bp, Artificial Sequence
  chemically synthesized
ctgtattttattacattgct

SEQ ID NO: 627040 - DNA, 20 bp, Artificial Sequence
  chemically synthesized
agagcaattcctcccacatt

SEQ ID NO: 627041 - DNA, 20 bp, Artificial Sequence
  chemically synthesized
tctatagatttcatgactga

SEQ ID NO: 627042 - DNA, 20 bp, Artificial Sequence
  chemically synthesized
tttcagtcatgaaatctata

SEQ ID NO: 627043 - DNA, 20 bp, Artificial Sequence
  chemically synthesized
caattcttcccaaatcgatc

SEQ ID NO: 627044 - DNA, 20 bp, Artificial Sequence
  chemically synthesized
tttcagggatatattgcatt

SEQ ID NO: 627045 - DNA, 20 bp, Artificial Sequence
  chemically synthesized
tatccctgaaattatttagg

SEQ ID NO: 627046 - DNA, 20 bp, Artificial Sequence
  chemically synthesized
tatttttttcttttttcttt

SEQ ID NO: 627047 - DNA, 20 bp, Artificial Sequence
  chemically synthesized
cattattgctagaaggaact

SEQ ID NO: 627048 - DNA, 20 bp, Artificial Sequence
  chemically synthesized
ctagcaataatgggaaaaat

SEQ ID NO: 627049 - DNA, 20 bp, Artificial Sequence
  chemically synthesized
gaaaaattaacgtttatttt

SEQ ID NO: 627050 - DNA, 20 bp, Artificial Sequence
  chemically synthesized
gtttctttttaattgtgtaa

SEQ ID NO: 627051 - DNA, 20 bp, Artificial Sequence
  chemically synthesized
ttgttgtaatagttattgtg

SEQ ID NO: 627052 - DNA, 20 bp, Artificial Sequence
  chemically synthesized
caaaatgaacagactttggt

SEQ ID NO: 627053 - DNA, 20 bp, Artificial Sequence
  chemically synthesized
cagactttggtactggtttg

SEQ ID NO: 627054 - DNA, 20 bp, Artificial Sequence
  chemically synthesized
ggtactggtttgaagagatt

SEQ ID NO: 627055 - DNA, 20 bp, Artificial Sequence
  chemically synthesized
taagagcttaaatggtctta

SEQ ID NO: 627056 - DNA, 20 bp, Artificial Sequence
  chemically synthesized
tattgctcatttgccagaat

SEQ ID NO: 627057 - DNA, 20 bp, Artificial Sequence
  chemically synthesized
tggtcagccttctttgaaag

SEQ ID NO: 627058 - DNA, 20 bp, Artificial Sequence
  chemically synthesized
ttgtagtgtttgcagcatga

SEQ ID NO: 627059 - DNA, 20 bp, Artificial Sequence
  chemically synthesized
gatattgcagaaatatattg

SEQ ID NO: 627060 - DNA, 20 bp, Artificial Sequence
  chemically synthesized
ctaagaattttattcttttt

SEQ ID NO: 627061 - DNA, 20 bp, Artificial Sequence
  chemically synthesized
gcttacattttagaaaataa

SEQ ID NO: 627062 - DNA, 20 bp, Artificial Sequence
  chemically synthesized
caaccaaataactcctttta

SEQ ID NO: 627063 - DNA, 20 bp, Artificial Sequence
  chemically synthesized
tattaaattgtagatgcatt

SEQ ID NO: 627064 - DNA, 20 bp, Artificial Sequence
  chemically synthesized
tacaattattcattttatag

SEQ ID NO: 627065 - DNA, 20 bp, Artificial Sequence
  chemically synthesized
tgaataattgtagtagaaac

SEQ ID NO: 627066 - DNA, 20 bp, Artificial Sequence
  chemically synthesized
caaaaagaggggggtaaaac

SEQ ID NO: 627067 - DNA, 20 bp, Artificial Sequence
  chemically synthesized
tacccccctctttttgagaa

SEQ ID NO: 627068 - DNA, 20 bp, Artificial Sequence
  chemically synthesized
caattaattttgcagtgaca

SEQ ID NO: 627069 - DNA, 20 bp, Artificial Sequence
  chemically synthesized
tgtcactgcaaaattaattg

SEQ ID NO: 627070 - DNA, 20 bp, Artificial Sequence
  chemically synthesized
taatgtttcctatgcagaca

SEQ ID NO: 627071 - DNA, 20 bp, Artificial Sequence
  chemically synthesized
ctcaatagaaaaggaatctg

SEQ ID NO: 627072 - DNA, 20 bp, Artificial Sequence
  chemically synthesized
aataaatttggctgaaacta

SEQ ID NO: 627073 - DNA, 20 bp, Artificial Sequence
  chemically synthesized
atttatttagagtcagataa

SEQ ID NO: 627074 - DNA, 20 bp, Artificial Sequence
  chemically synthesized
gttcaatatggatacttgtt

SEQ ID NO: 627075 - DNA, 20 bp, Artificial Sequence
  chemically synthesized
ctgaggtgttcaatatggat

SEQ ID NO: 627076 - DNA, 20 bp, Artificial Sequence
  chemically synthesized
ttaataatggactagactgt

SEQ ID NO: 627077 - DNA, 20 bp, Artificial Sequence
  chemically synthesized
attaacagtattaagatcat

SEQ ID NO: 627078 - DNA, 20 bp, Artificial Sequence
  chemically synthesized
ttaagatcataagggattaa

SEQ ID NO: 627079 - DNA, 20 bp, Artificial Sequence
  chemically synthesized
agaagggaacattttccctt

SEQ ID NO: 627080 - DNA, 20 bp, Artificial Sequence
  chemically synthesized
ctgatttcagtaaaggagca

SEQ ID NO: 627081 - DNA, 20 bp, Artificial Sequence
  chemically synthesized
aatattttagaaaatgatga

SEQ ID NO: 627082 - DNA, 20 bp, Artificial Sequence
  chemically synthesized
atcattttctaaaatattct

SEQ ID NO: 627083 - DNA, 20 bp, Artificial Sequence
  chemically synthesized
tctaaaatattctttatgtt

SEQ ID NO: 627084 - DNA, 20 bp, Artificial Sequence
  chemically synthesized
ttctttatgttttatgtttc

SEQ ID NO: 627085 - DNA, 20 bp, Artificial Sequence
  chemically synthesized
tatgtttcttgggcttactg

SEQ ID NO: 627086 - DNA, 20 bp, Artificial Sequence
  chemically synthesized
aactaatagctctattactg

SEQ ID NO: 627087 - DNA, 20 bp, Artificial Sequence
  chemically synthesized
atcaatacagtaatagagct

SEQ ID NO: 627088 - DNA, 20 bp, Artificial Sequence
  chemically synthesized
gaccaaaaaatgataagttt

SEQ ID NO: 627089 - DNA, 20 bp, Artificial Sequence
  chemically synthesized
tccattttgaccaaaaaatg

SEQ ID NO: 627090 - DNA, 20 bp, Artificial Sequence
  chemically synthesized
ggaccaatatcagcaaattc

SEQ ID NO: 627091 - DNA, 20 bp, Artificial Sequence
  chemically synthesized
atatatacctaagatagata

SEQ ID NO: 627092 - DNA, 20 bp, Artificial Sequence
  chemically synthesized
gtatgaataaacagatatat

SEQ ID NO: 627093 - DNA, 20 bp, Artificial Sequence
  chemically synthesized
actcatcaaatcatatatat

SEQ ID NO: 627094 - DNA, 20 bp, Artificial Sequence
  chemically synthesized
ctgttctactgaaacaatta

SEQ ID NO: 627095 - DNA, 20 bp, Artificial Sequence
  chemically synthesized
tataaagatcaaaacaaatt

SEQ ID NO: 627096 - DNA, 20 bp, Artificial Sequence
  chemically synthesized
gttttgatctttatatacat

SEQ ID NO: 627097 - DNA, 20 bp, Artificial Sequence
  chemically synthesized
ctttatatacatgttcgatt

SEQ ID NO: 627098 - DNA, 20 bp, Artificial Sequence
  chemically synthesized
atttaaaattttaaagtatt

SEQ ID NO: 627099 - DNA, 20 bp, Artificial Sequence
  chemically synthesized
aaagtattaaaagtttaaaa

SEQ ID NO: 627100 - DNA, 20 bp, Artificial Sequence
  chemically synthesized
aaagtttaaaaactagtttt

SEQ ID NO: 627101 - DNA, 20 bp, Artificial Sequence
  chemically synthesized
attttaaaaaaacttttaaa

SEQ ID NO: 627102 - DNA, 20 bp, Artificial Sequence
  chemically synthesized
ttttaaaagtttttttaaaa

SEQ ID NO: 627103 - DNA, 20 bp, Artificial Sequence
  chemically synthesized
aacccccacctcccaggttc

SEQ ID NO: 627104 - DNA, 20 bp, Artificial Sequence
  chemically synthesized
catgcccagcaaaatttttt

SEQ ID NO: 627105 - DNA, 20 bp, Artificial Sequence
  chemically synthesized
cccagcaaaatttttttttt

SEQ ID NO: 627106 - DNA, 20 bp, Artificial Sequence
  chemically synthesized
tttgtatttcttagtagaga

SEQ ID NO: 627107 - DNA, 20 bp, Artificial Sequence
  chemically synthesized
tttgaggtcaggagttcgag

SEQ ID NO: 627108 - DNA, 20 bp, Artificial Sequence
  chemically synthesized
ccttaccacattccaaaatc

SEQ ID NO: 627109 - DNA, 20 bp, Artificial Sequence
  chemically synthesized
agcatgttaagaagagaatc

SEQ ID NO: 627110 - DNA, 20 bp, Artificial Sequence
  chemically synthesized
gtactaatacattattctaa

SEQ ID NO: 627111 - DNA, 20 bp, Artificial Sequence
  chemically synthesized
ctaataccaacctcttgggg

SEQ ID NO: 627112 - DNA, 20 bp, Artificial Sequence
  chemically synthesized
accccctaataccaacctct

SEQ ID NO: 627113 - DNA, 20 bp, Artificial Sequence
  chemically synthesized
tagggggtgaggtctttagg

SEQ ID NO: 627114 - DNA, 20 bp, Artificial Sequence
  chemically synthesized
aggttatgagtacagagcct

SEQ ID NO: 627115 - DNA, 20 bp, Artificial Sequence
  chemically synthesized
tgagtacagagccttcttgt

SEQ ID NO: 627116 - DNA, 20 bp, Artificial Sequence
  chemically synthesized
acactctgtgcctgatgaca

SEQ ID NO: 627117 - DNA, 20 bp, Artificial Sequence
  chemically synthesized
aactttgagcaatgaatctc

SEQ ID NO: 627118 - DNA, 20 bp, Artificial Sequence
  chemically synthesized
actgggtggcgtagaaacaa

SEQ ID NO: 627119 - DNA, 20 bp, Artificial Sequence
  chemically synthesized
tctctgttgtttctacgcca

SEQ ID NO: 627120 - DNA, 20 bp, Artificial Sequence
  chemically synthesized
gccacccagtttattatttt

SEQ ID NO: 627121 - DNA, 20 bp, Artificial Sequence
  chemically synthesized
tatttttttagtttacgcca

SEQ ID NO: 627122 - DNA, 20 bp, Artificial Sequence
  chemically synthesized
aactatcattcttcatccat

SEQ ID NO: 627123 - DNA, 20 bp, Artificial Sequence
  chemically synthesized
tctgattatggatgtagtga

SEQ ID NO: 627124 - DNA, 20 bp, Artificial Sequence
  chemically synthesized
cattatcccacccctccctt

SEQ ID NO: 627125 - DNA, 20 bp, Artificial Sequence
  chemically synthesized
ttcagtttatgggatttcat

SEQ ID NO: 627126 - DNA, 20 bp, Artificial Sequence
  chemically synthesized
cactcaactcaattcagttt

SEQ ID NO: 627127 - DNA, 20 bp, Artificial Sequence
  chemically synthesized
gaggagggcactcaactcaa

SEQ ID NO: 627128 - DNA, 20 bp, Artificial Sequence
  chemically synthesized
tcagagcatggtgaggatgg

SEQ ID NO: 627129 - DNA, 20 bp, Artificial Sequence
  chemically synthesized
tcaccatgctctgaactcct

SEQ ID NO: 627130 - DNA, 20 bp, Artificial Sequence
  chemically synthesized
ggtgataatgatgataaagg

SEQ ID NO: 627131 - DNA, 20 bp, Artificial Sequence
  chemically synthesized
ttttcttatatttgcattct

SEQ ID NO: 627132 - DNA, 20 bp, Artificial Sequence
  chemically synthesized
gactcacgtaagaagacttt

SEQ ID NO: 627133 - DNA, 20 bp, Artificial Sequence
  chemically synthesized
cttctatcaaaatctgacaa

SEQ ID NO: 627134 - DNA, 20 bp, Artificial Sequence
  chemically synthesized
cttcccttttaagccaactt

SEQ ID NO: 627135 - DNA, 20 bp, Artificial Sequence
  chemically synthesized
aaaagggaagatgtgttcat

SEQ ID NO: 627136 - DNA, 20 bp, Artificial Sequence
  chemically synthesized
ccattaaggtaaggatatag

SEQ ID NO: 627137 - DNA, 20 bp, Artificial Sequence
  chemically synthesized
agactctccatgagcaataa

SEQ ID NO: 627138 - DNA, 20 bp, Artificial Sequence
  chemically synthesized
aggtaaaatatatatatttc

SEQ ID NO: 627139 - DNA, 20 bp, Artificial Sequence
  chemically synthesized
ctctgattattgccctgtct

SEQ ID NO: 627140 - DNA, 20 bp, Artificial Sequence
  chemically synthesized
tttataaatgagtaatatgg

SEQ ID NO: 627141 - DNA, 20 bp, Artificial Sequence
  chemically synthesized
taattcagagaaaattttca

SEQ ID NO: 627142 - DNA, 20 bp, Artificial Sequence
  chemically synthesized
tgagcctcatccttctttgt

SEQ ID NO: 627143 - DNA, 20 bp, Artificial Sequence
  chemically synthesized
caccaaatgccaatggtaca

SEQ ID NO: 627144 - DNA, 20 bp, Artificial Sequence
  chemically synthesized
acaattgccatacttctatg

SEQ ID NO: 627145 - DNA, 20 bp, Artificial Sequence
  chemically synthesized
tgccatacttctatgtgatg

SEQ ID NO: 627146 - DNA, 20 bp, Artificial Sequence
  chemically synthesized
cattcaacttttaccctcta

SEQ ID NO: 627147 - DNA, 20 bp, Artificial Sequence
  chemically synthesized
aaagtgagtcacatgaatta

SEQ ID NO: 627148 - DNA, 20 bp, Artificial Sequence
  chemically synthesized
ggtatgtacattttttaaca

SEQ ID NO: 627149 - DNA, 20 bp, Artificial Sequence
  chemically synthesized
ctagcttttttagcaataaa

SEQ ID NO: 627150 - DNA, 20 bp, Artificial Sequence
  chemically synthesized
cactaaaggctcagatgatt

SEQ ID NO: 627151 - DNA, 20 bp, Artificial Sequence
  chemically synthesized
ttacaactcactaaaggctc

SEQ ID NO: 627152 - DNA, 20 bp, Artificial Sequence
  chemically synthesized
ggcaagagcctccactagca

SEQ ID NO: 627153 - DNA, 20 bp, Artificial Sequence
  chemically synthesized
cttgcctcaatgtggatggc

SEQ ID NO: 627154 - DNA, 20 bp, Artificial Sequence
  chemically synthesized
cagcagcacatgctacaaag

SEQ ID NO: 627155 - DNA, 20 bp, Artificial Sequence
  chemically synthesized
catttctttgtagcatgtgc

SEQ ID NO: 627156 - DNA, 20 bp, Artificial Sequence
  chemically synthesized
aacattgttgagatgacaac

SEQ ID NO: 627157 - DNA, 20 bp, Artificial Sequence
  chemically synthesized
atctgatggatgagcaaaga

SEQ ID NO: 627158 - DNA, 20 bp, Artificial Sequence
  chemically synthesized
agatgcaattcctcatccat

SEQ ID NO: 627159 - DNA, 20 bp, Artificial Sequence
  chemically synthesized
tcatccattcacgctttatt

SEQ ID NO: 627160 - DNA, 20 bp, Artificial Sequence
  chemically synthesized
agtcatccatgagggttgaa

SEQ ID NO: 627161 - DNA, 20 bp, Artificial Sequence
  chemically synthesized
tttaacaggagtttagaaga

SEQ ID NO: 627162 - DNA, 20 bp, Artificial Sequence
  chemically synthesized
gtcaaaatatcacatttaac

SEQ ID NO: 627163 - DNA, 20 bp, Artificial Sequence
  chemically synthesized
ctagatgccattaataacat

SEQ ID NO: 627164 - DNA, 20 bp, Artificial Sequence
  chemically synthesized
agaatggtgaattccttaca

SEQ ID NO: 627165 - DNA, 20 bp, Artificial Sequence
  chemically synthesized
ttcctttgctcatatccatc

SEQ ID NO: 627166 - DNA, 20 bp, Artificial Sequence
  chemically synthesized
gagatgtacaaggagactca

SEQ ID NO: 627167 - DNA, 20 bp, Artificial Sequence
  chemically synthesized
ctgagcacaaggtctcaacc

SEQ ID NO: 627168 - DNA, 20 bp, Artificial Sequence
  chemically synthesized
tgagagcacatctgtttaca

SEQ ID NO: 627169 - DNA, 20 bp, Artificial Sequence
  chemically synthesized
taaagcctggatgagagcac

SEQ ID NO: 627170 - DNA, 20 bp, Artificial Sequence
  chemically synthesized
gtaaacagatgtgctctcat

SEQ ID NO: 627171 - DNA, 20 bp, Artificial Sequence
  chemically synthesized
tagcataattcttaagggcc

SEQ ID NO: 627172 - DNA, 20 bp, Artificial Sequence
  chemically synthesized
ttttcagaatggtaaatgag

SEQ ID NO: 627173 - DNA, 20 bp, Artificial Sequence
  chemically synthesized
aaaagaatcaccctgtcctt

SEQ ID NO: 627174 - DNA, 20 bp, Artificial Sequence
  chemically synthesized
cttcaaagcttcaaaggaca

SEQ ID NO: 627175 - DNA, 20 bp, Artificial Sequence
  chemically synthesized
gagaagtcaatgcctggctt

SEQ ID NO: 627176 - DNA, 20 bp, Artificial Sequence
  chemically synthesized
ctagaaaggagaagtcaatg

SEQ ID NO: 627177 - DNA, 20 bp, Artificial Sequence
  chemically synthesized
ctatttgaagaagatgccat

SEQ ID NO: 627178 - DNA, 20 bp, Artificial Sequence
  chemically synthesized
taaaagtggttatactaaat

SEQ ID NO: 627179 - DNA, 20 bp, Artificial Sequence
  chemically synthesized
agaacttctggataacttgc

SEQ ID NO: 627180 - DNA, 20 bp, Artificial Sequence
  chemically synthesized
tgctgcctcaccttgcactt

SEQ ID NO: 627181 - DNA, 20 bp, Artificial Sequence
  chemically synthesized
cttgcacttttatgtttgga

SEQ ID NO: 627182 - DNA, 20 bp, Artificial Sequence
  chemically synthesized
agctagcagaagttggttta

SEQ ID NO: 627183 - DNA, 20 bp, Artificial Sequence
  chemically synthesized
aacttcataaaccaacttct

SEQ ID NO: 627184 - DNA, 20 bp, Artificial Sequence
  chemically synthesized
aaagttggaagctagcagaa

SEQ ID NO: 627185 - DNA, 20 bp, Artificial Sequence
  chemically synthesized
ctagcttccaacttttcttc

SEQ ID NO: 627186 - DNA, 20 bp, Artificial Sequence
  chemically synthesized
gaagagagttgggatcttcc

SEQ ID NO: 627187 - DNA, 20 bp, Artificial Sequence
  chemically synthesized
ttggttaagggaatattgtg

SEQ ID NO: 627188 - DNA, 20 bp, Artificial Sequence
  chemically synthesized
tttatccatatcagcagtaa

SEQ ID NO: 627189 - DNA, 20 bp, Artificial Sequence
  chemically synthesized
ccatatcagcagtaagactg

SEQ ID NO: 627190 - DNA, 20 bp, Artificial Sequence
  chemically synthesized
taactgtctggtgcaagacg

SEQ ID NO: 627191 - DNA, 20 bp, Artificial Sequence
  chemically synthesized
acgcctagatttcagcctaa

SEQ ID NO: 627192 - DNA, 20 bp, Artificial Sequence
  chemically synthesized
cctcactaaacataatcatc

SEQ ID NO: 627193 - DNA, 20 bp, Artificial Sequence
  chemically synthesized
aaatgaaaagctagagatga

SEQ ID NO: 627194 - DNA, 20 bp, Artificial Sequence
  chemically synthesized
catcttaaatgaaaagctag

SEQ ID NO: 627195 - DNA, 20 bp, Artificial Sequence
  chemically synthesized
agaccactgtggggttgtta

SEQ ID NO: 627196 - DNA, 20 bp, Artificial Sequence
  chemically synthesized
ttaactggcttcatttcaat

SEQ ID NO: 627197 - DNA, 20 bp, Artificial Sequence
  chemically synthesized
agcactcagaacacacacaa

SEQ ID NO: 627198 - DNA, 20 bp, Artificial Sequence
  chemically synthesized
cagaacacacacaacattga

SEQ ID NO: 627199 - DNA, 20 bp, Artificial Sequence
  chemically synthesized
atctccatatattctttcag

SEQ ID NO: 627200 - DNA, 20 bp, Artificial Sequence
  chemically synthesized
gcttttgtactctaaccagt

SEQ ID NO: 627201 - DNA, 20 bp, Artificial Sequence
  chemically synthesized
ttgttgagggcagaaatcat

SEQ ID NO: 627202 - DNA, 20 bp, Artificial Sequence
  chemically synthesized
agcatagaaagattaatcag

SEQ ID NO: 627203 - DNA, 20 bp, Artificial Sequence
  chemically synthesized
atcatttctgattaatcttt

SEQ ID NO: 627204 - DNA, 20 bp, Artificial Sequence
  chemically synthesized
ttagtaacactgaaagcata

SEQ ID NO: 627205 - DNA, 20 bp, Artificial Sequence
  chemically synthesized
agtcaagaaagaagatacct

SEQ ID NO: 627206 - DNA, 20 bp, Artificial Sequence
  chemically synthesized
gttaaagctatttatatctc

SEQ ID NO: 627207 - DNA, 20 bp, Artificial Sequence
  chemically synthesized
catgaaacagcagagatata

SEQ ID NO: 627208 - DNA, 20 bp, Artificial Sequence
  chemically synthesized
ataactctttagcataggga

SEQ ID NO: 627209 - DNA, 20 bp, Artificial Sequence
  chemically synthesized
agtattataactctttagca

SEQ ID NO: 627210 - DNA, 20 bp, Artificial Sequence
  chemically synthesized
gaaatttttcaatggcaaaa

SEQ ID NO: 627211 - DNA, 20 bp, Artificial Sequence
  chemically synthesized
tggcaaaatgaggcttggtg

SEQ ID NO: 627212 - DNA, 20 bp, Artificial Sequence
  chemically synthesized
cagtcttaagtattacttta

SEQ ID NO: 627213 - DNA, 20 bp, Artificial Sequence
  chemically synthesized
ggataatgttgatgaagata

SEQ ID NO: 627214 - DNA, 20 bp, Artificial Sequence
  chemically synthesized
tttggctaagtggctttgtt

SEQ ID NO: 627215 - DNA, 20 bp, Artificial Sequence
  chemically synthesized
tcaaacatgtgctttggcta

SEQ ID NO: 627216 - DNA, 20 bp, Artificial Sequence
  chemically synthesized
caaagccacttagccaaagc

SEQ ID NO: 627217 - DNA, 20 bp, Artificial Sequence
  chemically synthesized
agtctaattcatagtcaaac

SEQ ID NO: 627218 - DNA, 20 bp, Artificial Sequence
  chemically synthesized
tcaataggtttaaataatac

SEQ ID NO: 627219 - DNA, 20 bp, Artificial Sequence
  chemically synthesized
tattatttaaacctattgat

SEQ ID NO: 627220 - DNA, 20 bp, Artificial Sequence
  chemically synthesized
taagatggaagccagcatca

SEQ ID NO: 627221 - DNA, 20 bp, Artificial Sequence
  chemically synthesized
taacctgttggttgccagtt

SEQ ID NO: 627222 - DNA, 20 bp, Artificial Sequence
  chemically synthesized
gaaaataaaatttcctaatt

SEQ ID NO: 627223 - DNA, 20 bp, Artificial Sequence
  chemically synthesized
ggatgtattgttacatccaa

SEQ ID NO: 627224 - DNA, 20 bp, Artificial Sequence
  chemically synthesized
agcacaacaagtccaacagc

SEQ ID NO: 627225 - DNA, 20 bp, Artificial Sequence
  chemically synthesized
aacttgtgctgttggacttg

SEQ ID NO: 627226 - DNA, 20 bp, Artificial Sequence
  chemically synthesized
gttgtgcttgttgtactcag

SEQ ID NO: 627227 - DNA, 20 bp, Artificial Sequence
  chemically synthesized
aatgggctactttaaatgtg

SEQ ID NO: 627228 - DNA, 20 bp, Artificial Sequence
  chemically synthesized
cacatttaaagtagcccatt

SEQ ID NO: 627229 - DNA, 20 bp, Artificial Sequence
  chemically synthesized
tcgtagatattatctaattc

SEQ ID NO: 627230 - DNA, 20 bp, Artificial Sequence
  chemically synthesized
tcagtggctttcttcaagat

SEQ ID NO: 627231 - DNA, 20 bp, Artificial Sequence
  chemically synthesized
gcagttgaatcaaatcgtcc

SEQ ID NO: 627232 - DNA, 20 bp, Artificial Sequence
  chemically synthesized
tgaatgaaaacaagaggacg

SEQ ID NO: 627233 - DNA, 20 bp, Artificial Sequence
  chemically synthesized
catcttgaatgaaaacaaga

SEQ ID NO: 627234 - DNA, 20 bp, Artificial Sequence
  chemically synthesized
ttcaattcttcttttctttg

SEQ ID NO: 627235 - DNA, 20 bp, Artificial Sequence
  chemically synthesized
tttctttgctgggctttcat

SEQ ID NO: 627236 - DNA, 20 bp, Artificial Sequence
  chemically synthesized
gtagaatatactgtaataga

SEQ ID NO: 627237 - DNA, 20 bp, Artificial Sequence
  chemically synthesized
accatgtgcaattgcttgat

SEQ ID NO: 627238 - DNA, 20 bp, Artificial Sequence
  chemically synthesized
atgttgatcacaccatgtgc

SEQ ID NO: 627239 - DNA, 20 bp, Artificial Sequence
  chemically synthesized
tttctatcttctttattctt

SEQ ID NO: 627240 - DNA, 20 bp, Artificial Sequence
  chemically synthesized
ttctttaatgatttgtaatc

SEQ ID NO: 627241 - DNA, 20 bp, Artificial Sequence
  chemically synthesized
tcttctgaaaaaatggaagc

SEQ ID NO: 627242 - DNA, 20 bp, Artificial Sequence
  chemically synthesized
aaaattggtgtgtcacttct

SEQ ID NO: 627243 - DNA, 20 bp, Artificial Sequence
  chemically synthesized
gggcaattatcaaaatatgc

SEQ ID NO: 627244 - DNA, 20 bp, Artificial Sequence
  chemically synthesized
tatacttccctgtcagaaaa

SEQ ID NO: 627245 - DNA, 20 bp, Artificial Sequence
  chemically synthesized
caacatgatattttattatt

SEQ ID NO: 627246 - DNA, 20 bp, Artificial Sequence
  chemically synthesized
ccgtctcactcacttctttg

SEQ ID NO: 627247 - DNA, 20 bp, Artificial Sequence
  chemically synthesized
gaaaagaacaccagtacagt

SEQ ID NO: 627248 - DNA, 20 bp, Artificial Sequence
  chemically synthesized
accacttgagaccactagga

SEQ ID NO: 627249 - DNA, 20 bp, Artificial Sequence
  chemically synthesized
tgtgggaactaccctacctt

SEQ ID NO: 627250 - DNA, 20 bp, Artificial Sequence
  chemically synthesized
gttcttaacacattacacat

SEQ ID NO: 627251 - DNA, 20 bp, Artificial Sequence
  chemically synthesized
aataatccattatttaatta

SEQ ID NO: 627252 - DNA, 20 bp, Artificial Sequence
  chemically synthesized
aataatcattataattaaat

SEQ ID NO: 627253 - DNA, 20 bp, Artificial Sequence
  chemically synthesized
ttagtctgagccttaatgca

SEQ ID NO: 627254 - DNA, 20 bp, Artificial Sequence
  chemically synthesized
cagatttttgcaaacttcat

SEQ ID NO: 627255 - DNA, 20 bp, Artificial Sequence
  chemically synthesized
aaataaaatggaaacttcca

SEQ ID NO: 627256 - DNA, 20 bp, Artificial Sequence
  chemically synthesized
aagtttccattttatttgaa

SEQ ID NO: 627257 - DNA, 20 bp, Artificial Sequence
  chemically synthesized
ccattttatttgaaattagt

SEQ ID NO: 627258 - DNA, 20 bp, Artificial Sequence
  chemically synthesized
atggatctgctgatattttt

SEQ ID NO: 627259 - DNA, 20 bp, Artificial Sequence
  chemically synthesized
ttaaaaatatcagcagatcc

SEQ ID NO: 627260 - DNA, 20 bp, Artificial Sequence
  chemically synthesized
agcagatccatctgcttgga

SEQ ID NO: 627261 - DNA, 20 bp, Artificial Sequence
  chemically synthesized
ggaaaatgattcttcctgat

SEQ ID NO: 627262 - DNA, 20 bp, Artificial Sequence
  chemically synthesized
ttaagaacaattacccatgt

SEQ ID NO: 627263 - DNA, 20 bp, Artificial Sequence
  chemically synthesized
attctctatctttgttatat

SEQ ID NO: 627264 - DNA, 20 bp, Artificial Sequence
  chemically synthesized
tttgttatattaaagattgt

SEQ ID NO: 627265 - DNA, 20 bp, Artificial Sequence
  chemically synthesized
caaaaaagcaatcatgaatc

SEQ ID NO: 627266 - DNA, 20 bp, Artificial Sequence
  chemically synthesized
taaagaaacatgtgattcat

SEQ ID NO: 627267 - DNA, 20 bp, Artificial Sequence
  chemically synthesized
atattaaagaaacatgtgat

SEQ ID NO: 627268 - DNA, 20 bp, Artificial Sequence
  chemically synthesized
taactgtatattaaagaaac

SEQ ID NO: 627269 - DNA, 20 bp, Artificial Sequence
  chemically synthesized
atgtttctttaatatacagt

SEQ ID NO: 627270 - DNA, 20 bp, Artificial Sequence
  chemically synthesized
gattttgagttcatttccac

SEQ ID NO: 627271 - DNA, 20 bp, Artificial Sequence
  chemically synthesized
ccaccttccctttcctttca

SEQ ID NO: 627272 - DNA, 20 bp, Artificial Sequence
  chemically synthesized
tattaattatgcaacaagtg

SEQ ID NO: 627273 - DNA, 20 bp, Artificial Sequence
  chemically synthesized
tgcaacaagtgtcatgttta

SEQ ID NO: 627274 - DNA, 20 bp, Artificial Sequence
  chemically synthesized
tttgtaaatgtagtcacagt

SEQ ID NO: 627275 - DNA, 20 bp, Artificial Sequence
  chemically synthesized
ttaatataataaaatttatc

SEQ ID NO: 627276 - DNA, 20 bp, Artificial Sequence
  chemically synthesized
agaaaatgaaatgatcattt

SEQ ID NO: 627277 - DNA, 20 bp, Artificial Sequence
  chemically synthesized
ttaaaagtataatgtataca

SEQ ID NO: 627278 - DNA, 20 bp, Artificial Sequence
  chemically synthesized
atgtatacaattggattctg

SEQ ID NO: 627279 - DNA, 20 bp, Artificial Sequence
  chemically synthesized
acatagtggaatttaatgtg

SEQ ID NO: 627280 - DNA, 20 bp, Artificial Sequence
  chemically synthesized
gtcgatgctttttgtagcaa

SEQ ID NO: 627281 - DNA, 20 bp, Artificial Sequence
  chemically synthesized
gctacaaaaagcatcgacat

SEQ ID NO: 627282 - DNA, 20 bp, Artificial Sequence
  chemically synthesized
gtatatttaatcatttatgt

SEQ ID NO: 627283 - DNA, 20 bp, Artificial Sequence
  chemically synthesized
aatatacatagctcttggca

SEQ ID NO: 627284 - DNA, 20 bp, Artificial Sequence
  chemically synthesized
tggcttcctgttacacagaa

SEQ ID NO: 627285 - DNA, 20 bp, Artificial Sequence
  chemically synthesized
atgcattaagtatccagcaa

SEQ ID NO: 627286 - DNA, 20 bp, Artificial Sequence
  chemically synthesized
gctggatacttaatgcatct

SEQ ID NO: 627287 - DNA, 20 bp, Artificial Sequence
  chemically synthesized
ttgagattttccttccacag

SEQ ID NO: 627288 - DNA, 20 bp, Artificial Sequence
  chemically synthesized
tccttccacagagaagattt

SEQ ID NO: 627289 - DNA, 20 bp, Artificial Sequence
  chemically synthesized
atacctacttccttctaatg

SEQ ID NO: 627290 - DNA, 20 bp, Artificial Sequence
  chemically synthesized
gaaagcagagcaaatgcgtg

SEQ ID NO: 627291 - DNA, 20 bp, Artificial Sequence
  chemically synthesized
gtaaaccaatcacgcatttg

SEQ ID NO: 627292 - DNA, 20 bp, Artificial Sequence
  chemically synthesized
aatatgaaagcagagcaaat

SEQ ID NO: 627293 - DNA, 20 bp, Artificial Sequence
  chemically synthesized
gaaaatgagaactacatact

SEQ ID NO: 627294 - DNA, 20 bp, Artificial Sequence
  chemically synthesized
tggaaaaaatggaagtagat

SEQ ID NO: 627295 - DNA, 20 bp, Artificial Sequence
  chemically synthesized
ccatgctgcacagtacaatt

SEQ ID NO: 627296 - DNA, 20 bp, Artificial Sequence
  chemically synthesized
aaaatgtggttcttcatttg

SEQ ID NO: 627297 - DNA, 20 bp, Artificial Sequence
  chemically synthesized
agacaaatgaagaaccacat

SEQ ID NO: 627298 - DNA, 20 bp, Artificial Sequence
  chemically synthesized
acagtttcgtttataaggta

SEQ ID NO: 627299 - DNA, 20 bp, Artificial Sequence
  chemically synthesized
atagaagagtaaattgacag

SEQ ID NO: 627300 - DNA, 20 bp, Artificial Sequence
  chemically synthesized
aaataatagaagagtaaatt

SEQ ID NO: 627301 - DNA, 20 bp, Artificial Sequence
  chemically synthesized
tactcttctattattttagg

SEQ ID NO: 627302 - DNA, 20 bp, Artificial Sequence
  chemically synthesized
attgtcaagattcctcctca

SEQ ID NO: 627303 - DNA, 20 bp, Artificial Sequence
  chemically synthesized
gtacacgagcagtactattg

SEQ ID NO: 627304 - DNA, 20 bp, Artificial Sequence
  chemically synthesized
agttacacagccagtaagac

SEQ ID NO: 627305 - DNA, 20 bp, Artificial Sequence
  chemically synthesized
gctcttctggagggagctac

SEQ ID NO: 627306 - DNA, 20 bp, Artificial Sequence
  chemically synthesized
attctttttttttttttacc

SEQ ID NO: 627307 - DNA, 20 bp, Artificial Sequence
  chemically synthesized
attcatggccctcaggcact

SEQ ID NO: 627308 - DNA, 20 bp, Artificial Sequence
  chemically synthesized
ctgtgatgtacttttcaggt

SEQ ID NO: 627309 - DNA, 20 bp, Artificial Sequence
  chemically synthesized
aagtggtgaaacaagtatta

SEQ ID NO: 627310 - DNA, 20 bp, Artificial Sequence
  chemically synthesized
gtgcatagaatcttcctaat

SEQ ID NO: 627311 - DNA, 20 bp, Artificial Sequence
  chemically synthesized
aagattctatgcacaggggt

SEQ ID NO: 627312 - DNA, 20 bp, Artificial Sequence
  chemically synthesized
ggcactagctacactatttt

SEQ ID NO: 627313 - DNA, 20 bp, Artificial Sequence
  chemically synthesized
ttcacatatatttacttggt

SEQ ID NO: 627314 - DNA, 20 bp, Artificial Sequence
  chemically synthesized
agtaaatatatgtgaataag

SEQ ID NO: 627315 - DNA, 20 bp, Artificial Sequence
  chemically synthesized
gaagtgtgttacagtcagag

SEQ ID NO: 627316 - DNA, 20 bp, Artificial Sequence
  chemically synthesized
gaggcattcacatggtggat

SEQ ID NO: 627317 - DNA, 20 bp, Artificial Sequence
  chemically synthesized
acaggtggctttatattatt

SEQ ID NO: 627318 - DNA, 20 bp, Artificial Sequence
  chemically synthesized
tccactgcttaaagtccaca

SEQ ID NO: 627319 - DNA, 20 bp, Artificial Sequence
  chemically synthesized
caaaacttaataagttattc

SEQ ID NO: 627320 - DNA, 20 bp, Artificial Sequence
  chemically synthesized
ttaagcagtggaataactta

SEQ ID NO: 627321 - DNA, 20 bp, Artificial Sequence
  chemically synthesized
gtttacccttcacaaggctg

SEQ ID NO: 627322 - DNA, 20 bp, Artificial Sequence
  chemically synthesized
taccttccttcttgcttctc

SEQ ID NO: 627323 - DNA, 20 bp, Artificial Sequence
  chemically synthesized
gcttcctaatgtaccttcct

SEQ ID NO: 627324 - DNA, 20 bp, Artificial Sequence
  chemically synthesized
tatctgacttcgaatacact

SEQ ID NO: 627325 - DNA, 20 bp, Artificial Sequence
  chemically synthesized
tatctcctgacagtcaccac

SEQ ID NO: 627326 - DNA, 20 bp, Artificial Sequence
  chemically synthesized
agaggaaataagacttccta

SEQ ID NO: 627327 - DNA, 20 bp, Artificial Sequence
  chemically synthesized
ttaaaattaacaaaatactt

SEQ ID NO: 627328 - DNA, 20 bp, Artificial Sequence
  chemically synthesized
tgaaagtattttgttaattt

SEQ ID NO: 627329 - DNA, 20 bp, Artificial Sequence
  chemically synthesized
atcttaattccttaaatgta

SEQ ID NO: 627330 - DNA, 20 bp, Artificial Sequence
  chemically synthesized
agctttatacatttaaggaa

SEQ ID NO: 627331 - DNA, 20 bp, Artificial Sequence
  chemically synthesized
agtacttatgaattaaatgt

SEQ ID NO: 627332 - DNA, 20 bp, Artificial Sequence
  chemically synthesized
acagtgaaacaactataaac

SEQ ID NO: 627333 - DNA, 20 bp, Artificial Sequence
  chemically synthesized
taagtgaagcaaatgtttat

SEQ ID NO: 627334 - DNA, 20 bp, Artificial Sequence
  chemically synthesized
tcttaaggagtaagtgaagc

SEQ ID NO: 627335 - DNA, 20 bp, Artificial Sequence
  chemically synthesized
gtagcatgctaggtaactca

SEQ ID NO: 627336 - DNA, 20 bp, Artificial Sequence
  chemically synthesized
gagtccccttgccacacttc

SEQ ID NO: 627337 - DNA, 20 bp, Artificial Sequence
  chemically synthesized
agatagagagactgagagca

SEQ ID NO: 627338 - DNA, 20 bp, Artificial Sequence
  chemically synthesized
ttgtttctcaggcatctgtg

SEQ ID NO: 627339 - DNA, 20 bp, Artificial Sequence
  chemically synthesized
tttttagcaacctattccaa

SEQ ID NO: 627340 - DNA, 20 bp, Artificial Sequence
  chemically synthesized
ataggttgctaaaaagaatt

SEQ ID NO: 627341 - DNA, 20 bp, Artificial Sequence
  chemically synthesized
gttcagtctctaaatgcaag

SEQ ID NO: 627342 - DNA, 20 bp, Artificial Sequence
  chemically synthesized
aggtgagttaatatccagag

SEQ ID NO: 627343 - DNA, 20 bp, Artificial Sequence
  chemically synthesized
ttattcatgtgcaacctaaa

SEQ ID NO: 627344 - DNA, 20 bp, Artificial Sequence
  chemically synthesized
tagagaagtcacttcgttgg

SEQ ID NO: 627345 - DNA, 20 bp, Artificial Sequence
  chemically synthesized
aacgaagtgacttctctaat

SEQ ID NO: 627346 - DNA, 20 bp, Artificial Sequence
  chemically synthesized
gaaggaaattgagttagtga

SEQ ID NO: 627347 - DNA, 20 bp, Artificial Sequence
  chemically synthesized
cttccatgatctacttctgt

SEQ ID NO: 627348 - DNA, 20 bp, Artificial Sequence
  chemically synthesized
ctaatcagaaccagatcttt

SEQ ID NO: 627349 - DNA, 20 bp, Artificial Sequence
  chemically synthesized
agaatcttataaagatctgg

SEQ ID NO: 627350 - DNA, 20 bp, Artificial Sequence
  chemically synthesized
aaagatctggttctgattag

SEQ ID NO: 627351 - DNA, 20 bp, Artificial Sequence
  chemically synthesized
ctgattagagctgtttcaca

SEQ ID NO: 627352 - DNA, 20 bp, Artificial Sequence
  chemically synthesized
gtagcttaatctcacttagg

SEQ ID NO: 627353 - DNA, 20 bp, Artificial Sequence
  chemically synthesized
gatctagaagctgagcctaa

SEQ ID NO: 627354 - DNA, 20 bp, Artificial Sequence
  chemically synthesized
cgccaaaatgttttattatg

SEQ ID NO: 627355 - DNA, 20 bp, Artificial Sequence
  chemically synthesized
ctttggaacaacccccgcca

SEQ ID NO: 627356 - DNA, 20 bp, Artificial Sequence
  chemically synthesized
cattttggcgggggttgttc

SEQ ID NO: 627357 - DNA, 20 bp, Artificial Sequence
  chemically synthesized
aaatattaatgtactagtaa

SEQ ID NO: 627358 - DNA, 20 bp, Artificial Sequence
  chemically synthesized
tttcttttagtgagataaaa

SEQ ID NO: 627359 - DNA, 20 bp, Artificial Sequence
  chemically synthesized
ccaaatttggttctaattca

SEQ ID NO: 627360 - DNA, 20 bp, Artificial Sequence
  chemically synthesized
ttcataactttattattata

SEQ ID NO: 627361 - DNA, 20 bp, Artificial Sequence
  chemically synthesized
acctatatgttcttttcggc

SEQ ID NO: 627362 - DNA, 20 bp, Artificial Sequence
  chemically synthesized
tctgatgccgaaaagaacat

SEQ ID NO: 627363 - DNA, 20 bp, Artificial Sequence
  chemically synthesized
gaaaagaacatataggtttt

SEQ ID NO: 627364 - DNA, 20 bp, Artificial Sequence
  chemically synthesized
gaacatataggttttttttg

SEQ ID NO: 627365 - DNA, 20 bp, Artificial Sequence
  chemically synthesized
tataggttttttttgttttg

SEQ ID NO: 627366 - DNA, 20 bp, Artificial Sequence
  chemically synthesized
ttttgttttgttttgttttc

SEQ ID NO: 627367 - DNA, 20 bp, Artificial Sequence
  chemically synthesized
actccaacctgggtgacaga

SEQ ID NO: 627368 - DNA, 20 bp, Artificial Sequence
  chemically synthesized
aacctcagcctcctgggttc

SEQ ID NO: 627369 - DNA, 20 bp, Artificial Sequence
  chemically synthesized
tcgggaggctgaggcagaag

SEQ ID NO: 627370 - DNA, 20 bp, Artificial Sequence
  chemically synthesized
cacgtgagcccacctaattt

SEQ ID NO: 627371 - DNA, 20 bp, Artificial Sequence
  chemically synthesized
ttttgtgtttttagtagaga

SEQ ID NO: 627372 - DNA, 20 bp, Artificial Sequence
  chemically synthesized
cacctcgacctcccaaaatg

SEQ ID NO: 627373 - DNA, 20 bp, Artificial Sequence
  chemically synthesized
agccaccacgcccggcccat

SEQ ID NO: 627374 - DNA, 20 bp, Artificial Sequence
  chemically synthesized
attgcatggccatgctatac

SEQ ID NO: 627375 - DNA, 20 bp, Artificial Sequence
  chemically synthesized
tatttttgttcacaaaatca

SEQ ID NO: 627376 - DNA, 20 bp, Artificial Sequence
  chemically synthesized
gagtgatgcgtgattaatct

SEQ ID NO: 627377 - DNA, 20 bp, Artificial Sequence
  chemically synthesized
aatagcaagtatagagtgat

SEQ ID NO: 627378 - DNA, 20 bp, Artificial Sequence
  chemically synthesized
gtggccttccaaaagagaca

SEQ ID NO: 627379 - DNA, 20 bp, Artificial Sequence
  chemically synthesized
agacaagactaaagacccta

SEQ ID NO: 627380 - DNA, 20 bp, Artificial Sequence
  chemically synthesized
agtctcctgacactgaagta

SEQ ID NO: 627381 - DNA, 20 bp, Artificial Sequence
  chemically synthesized
tagagaaattgtcatttctt

SEQ ID NO: 627382 - DNA, 20 bp, Artificial Sequence
  chemically synthesized
aagaatatttagtcccatat

SEQ ID NO: 627383 - DNA, 20 bp, Artificial Sequence
  chemically synthesized
taaatattctttaatggtct

SEQ ID NO: 627384 - DNA, 20 bp, Artificial Sequence
  chemically synthesized
cctataaaagatatctgtct

SEQ ID NO: 627385 - DNA, 20 bp, Artificial Sequence
  chemically synthesized
tttttctattgatttacaat

SEQ ID NO: 627386 - DNA, 20 bp, Artificial Sequence
  chemically synthesized
taatctcatgctcatttttc

SEQ ID NO: 627387 - DNA, 20 bp, Artificial Sequence
  chemically synthesized
aaatcaatagaaaaatgagc

SEQ ID NO: 627388 - DNA, 20 bp, Artificial Sequence
  chemically synthesized
ttctatcaacttgattttta

SEQ ID NO: 627389 - DNA, 20 bp, Artificial Sequence
  chemically synthesized
taaagaaagtaattctatca

SEQ ID NO: 627390 - DNA, 20 bp, Artificial Sequence
  chemically synthesized
tttcattagtaatttccctt

SEQ ID NO: 627391 - DNA, 20 bp, Artificial Sequence
  chemically synthesized
attaatttgagaaccatttt

SEQ ID NO: 627392 - DNA, 20 bp, Artificial Sequence
  chemically synthesized
tgttatactatagtatctca

SEQ ID NO: 627393 - DNA, 20 bp, Artificial Sequence
  chemically synthesized
tatagaagttctggacatgt

SEQ ID NO: 627394 - DNA, 20 bp, Artificial Sequence
  chemically synthesized
tctataaagtaatgatggtt

SEQ ID NO: 627395 - DNA, 20 bp, Artificial Sequence
  chemically synthesized
atctttagttgaaaatgcca

SEQ ID NO: 627396 - DNA, 20 bp, Artificial Sequence
  chemically synthesized
ctactctggatgaacattta

SEQ ID NO: 627397 - DNA, 20 bp, Artificial Sequence
  chemically synthesized
ctgtttgtgagatctatcta

SEQ ID NO: 627398 - DNA, 20 bp, Artificial Sequence
  chemically synthesized
tagatctcacaaacagaatg

SEQ ID NO: 627399 - DNA, 20 bp, Artificial Sequence
  chemically synthesized
ctggctcctaaatctcaaca

SEQ ID NO: 627400 - DNA, 20 bp, Artificial Sequence
  chemically synthesized
gaagccatacagctgtactc

SEQ ID NO: 627401 - DNA, 20 bp, Artificial Sequence
  chemically synthesized
gaaacaaaagagtacagctg

SEQ ID NO: 627402 - DNA, 20 bp, Artificial Sequence
  chemically synthesized
aatactgacatctaacacac

SEQ ID NO: 627403 - DNA, 20 bp, Artificial Sequence
  chemically synthesized
ttgactaggaagtggtaaga

SEQ ID NO: 627404 - DNA, 20 bp, Artificial Sequence
  chemically synthesized
tgtccagcttcatgaatttt

SEQ ID NO: 627405 - DNA, 20 bp, Artificial Sequence
  chemically synthesized
aattcatgaagctggacacc

SEQ ID NO: 627406 - DNA, 20 bp, Artificial Sequence
  chemically synthesized
agttcacaaatcaataggtg

SEQ ID NO: 627407 - DNA, 20 bp, Artificial Sequence
  chemically synthesized
attcgtgttatagttcagta

SEQ ID NO: 627408 - DNA, 20 bp, Artificial Sequence
  chemically synthesized
aaggaaagtatttctgtcct

SEQ ID NO: 627409 - DNA, 20 bp, Artificial Sequence
  chemically synthesized
attcattagtaatttccctt

SEQ ID NO: 627410 - DNA, 20 bp, Artificial Sequence
  chemically synthesized
attaaattctttagaaaatg

SEQ ID NO: 627411 - DNA, 20 bp, Artificial Sequence
  chemically synthesized
ttgagagagaatgactttct

SEQ ID NO: 627412 - DNA, 20 bp, Artificial Sequence
  chemically synthesized
agagaatgactttctggatg

SEQ ID NO: 627413 - DNA, 20 bp, Artificial Sequence
  chemically synthesized
attcgattcttcagaaaata

SEQ ID NO: 627414 - DNA, 20 bp, Artificial Sequence
  chemically synthesized
gttgaaattggataaaacct

SEQ ID NO: 627415 - DNA, 20 bp, Artificial Sequence
  chemically synthesized
aaattgtgttagataatccg

SEQ ID NO: 627416 - DNA, 20 bp, Artificial Sequence
  chemically synthesized
taacacaatttcttattgtt

SEQ ID NO: 627417 - DNA, 20 bp, Artificial Sequence
  chemically synthesized
cctcctttgtaacctctgag

SEQ ID NO: 627418 - DNA, 20 bp, Artificial Sequence
  chemically synthesized
gtaacctctgaggtctgatt

SEQ ID NO: 627419 - DNA, 20 bp, Artificial Sequence
  chemically synthesized
acatgagtgaaacattttca

SEQ ID NO: 627420 - DNA, 20 bp, Artificial Sequence
  chemically synthesized
tttaattagaagctacctga

SEQ ID NO: 627421 - DNA, 20 bp, Artificial Sequence
  chemically synthesized
tctctaaagatagcatagga

SEQ ID NO: 627422 - DNA, 20 bp, Artificial Sequence
  chemically synthesized
gaaaacagttacctcccatt

SEQ ID NO: 627423 - DNA, 20 bp, Artificial Sequence
  chemically synthesized
ataaactaccaatgggaggt

SEQ ID NO: 627424 - DNA, 20 bp, Artificial Sequence
  chemically synthesized
aactgttttcaaatcctcct

SEQ ID NO: 627425 - DNA, 20 bp, Artificial Sequence
  chemically synthesized
catgaccatgcaaactttca

SEQ ID NO: 627426 - DNA, 20 bp, Artificial Sequence
  chemically synthesized
gtttgcatggtcatgctcat

SEQ ID NO: 627427 - DNA, 20 bp, Artificial Sequence
  chemically synthesized
gttgcatacaatgatattaa

SEQ ID NO: 627428 - DNA, 20 bp, Artificial Sequence
  chemically synthesized
atttaatatcattgtatgca

SEQ ID NO: 627429 - DNA, 20 bp, Artificial Sequence
  chemically synthesized
ccagcctagacattttcctt

SEQ ID NO: 627430 - DNA, 20 bp, Artificial Sequence
  chemically synthesized
cctagacattttccttctag

SEQ ID NO: 627431 - DNA, 20 bp, Artificial Sequence
  chemically synthesized
ttcaagtgacacttcaaata

SEQ ID NO: 627432 - DNA, 20 bp, Artificial Sequence
  chemically synthesized
actttgaattactatttttc

SEQ ID NO: 627433 - DNA, 20 bp, Artificial Sequence
  chemically synthesized
gaattactatttttcactgg

SEQ ID NO: 627434 - DNA, 20 bp, Artificial Sequence
  chemically synthesized
ttttgctctttgatggactt

SEQ ID NO: 627435 - DNA, 20 bp, Artificial Sequence
  chemically synthesized
agctgacttaggactgagct

SEQ ID NO: 627436 - DNA, 20 bp, Artificial Sequence
  chemically synthesized
aacctctagctcagtcctaa

SEQ ID NO: 627437 - DNA, 20 bp, Artificial Sequence
  chemically synthesized
ggttcacagttgctgttgct

SEQ ID NO: 627438 - DNA, 20 bp, Artificial Sequence
  chemically synthesized
ctgaggaatttagagacgaa

SEQ ID NO: 627439 - DNA, 20 bp, Artificial Sequence
  chemically synthesized
ctgaaatgaaaggttgtttc

SEQ ID NO: 627440 - DNA, 20 bp, Artificial Sequence
  chemically synthesized
gcccaccaactgaaatgaaa

SEQ ID NO: 627441 - DNA, 20 bp, Artificial Sequence
  chemically synthesized
ttctccattaggtcatccag

SEQ ID NO: 627442 - DNA, 20 bp, Artificial Sequence
  chemically synthesized
tgacctaatggagaaataga

SEQ ID NO: 627443 - DNA, 20 bp, Artificial Sequence
  chemically synthesized
ggctgctgacccattcatgg

SEQ ID NO: 627444 - DNA, 20 bp, Artificial Sequence
  chemically synthesized
gcagccaaagggagaggaac

SEQ ID NO: 627445 - DNA, 20 bp, Artificial Sequence
  chemically synthesized
cactaatgtgtccatcacat

SEQ ID NO: 627446 - DNA, 20 bp, Artificial Sequence
  chemically synthesized
gttctatgacaagtgtaaaa

SEQ ID NO: 627447 - DNA, 20 bp, Artificial Sequence
  chemically synthesized
taatgctaacctgaaattgt

SEQ ID NO: 627448 - DNA, 20 bp, Artificial Sequence
  chemically synthesized
attagtgtcactttcaataa

SEQ ID NO: 627449 - DNA, 20 bp, Artificial Sequence
  chemically synthesized
gttcggtccagcaacaataa

SEQ ID NO: 627450 - DNA, 20 bp, Artificial Sequence
  chemically synthesized
tcatagtctgtttttactag

SEQ ID NO: 627451 - DNA, 20 bp, Artificial Sequence
  chemically synthesized
atgtgataaggaccatcata

SEQ ID NO: 627452 - DNA, 20 bp, Artificial Sequence
  chemically synthesized
tctggtcatgacattgttac

SEQ ID NO: 627453 - DNA, 20 bp, Artificial Sequence
  chemically synthesized
accagagctgaatgatgctg

SEQ ID NO: 627454 - DNA, 20 bp, Artificial Sequence
  chemically synthesized
tacacctgaaggtaaatgga

SEQ ID NO: 627455 - DNA, 20 bp, Artificial Sequence
  chemically synthesized
ctggaaacgtaggtggtacg

SEQ ID NO: 627456 - DNA, 20 bp, Artificial Sequence
  chemically synthesized
aattaatctctgcgtaccac

SEQ ID NO: 627457 - DNA, 20 bp, Artificial Sequence
  chemically synthesized
tcatcctgtacctcctctat

SEQ ID NO: 627458 - DNA, 20 bp, Artificial Sequence
  chemically synthesized
actgagatgttcttttgagc

SEQ ID NO: 627459 - DNA, 20 bp, Artificial Sequence
  chemically synthesized
acgtttgctcaaaagaacat

SEQ ID NO: 627460 - DNA, 20 bp, Artificial Sequence
  chemically synthesized
tctagacaatatttttaccc

SEQ ID NO: 627461 - DNA, 20 bp, Artificial Sequence
  chemically synthesized
taaccccaaagctcaagaaa

SEQ ID NO: 627462 - DNA, 20 bp, Artificial Sequence
  chemically synthesized
cttccaaaaaacttattttc

SEQ ID NO: 627463 - DNA, 20 bp, Artificial Sequence
  chemically synthesized
taaattatatgcctaacatg

SEQ ID NO: 627464 - DNA, 20 bp, Artificial Sequence
  chemically synthesized
tcatgttaggcatataattt

SEQ ID NO: 627465 - DNA, 20 bp, Artificial Sequence
  chemically synthesized
atattgaatatttaaagtat

SEQ ID NO: 627466 - DNA, 20 bp, Artificial Sequence
  chemically synthesized
aaaatgtatggagttataaa

SEQ ID NO: 627467 - DNA, 20 bp, Artificial Sequence
  chemically synthesized
aaaaaggttttctttaaaaa

SEQ ID NO: 627468 - DNA, 20 bp, Artificial Sequence
  chemically synthesized
gaaaaaactcaagttagctg

SEQ ID NO: 627469 - DNA, 20 bp, Artificial Sequence
  chemically synthesized
actgaaacattacagctaac

SEQ ID NO: 627470 - DNA, 20 bp, Artificial Sequence
  chemically synthesized
ttttactaatatctatatag

SEQ ID NO: 627471 - DNA, 20 bp, Artificial Sequence
  chemically synthesized
tttatagactctgtgcagat

SEQ ID NO: 627472 - DNA, 20 bp, Artificial Sequence
  chemically synthesized
aggtcagaaaataaaccata

SEQ ID NO: 627473 - DNA, 20 bp, Artificial Sequence
  chemically synthesized
ttagaggaattaaatctttt

SEQ ID NO: 627474 - DNA, 20 bp, Artificial Sequence
  chemically synthesized
ataaaaagatttaattcctc

SEQ ID NO: 627475 - DNA, 20 bp, Artificial Sequence
  chemically synthesized
ttaacaaatgttagcatgct

SEQ ID NO: 627476 - DNA, 20 bp, Artificial Sequence
  chemically synthesized
gatcaagttaacaaatgtta

SEQ ID NO: 627477 - DNA, 20 bp, Artificial Sequence
  chemically synthesized
cttataaaatgacatttgag

SEQ ID NO: 627478 - DNA, 20 bp, Artificial Sequence
  chemically synthesized
taatttttattgatcaggtt

SEQ ID NO: 627479 - DNA, 20 bp, Artificial Sequence
  chemically synthesized
ttattgatcaggttataagt

SEQ ID NO: 627480 - DNA, 20 bp, Artificial Sequence
  chemically synthesized
tgcagtgttaacatgagtgt

SEQ ID NO: 627481 - DNA, 20 bp, Artificial Sequence
  chemically synthesized
ttaacactgcaaatacacat

SEQ ID NO: 627482 - DNA, 20 bp, Artificial Sequence
  chemically synthesized
taaatatgactctcctttcc

SEQ ID NO: 627483 - DNA, 20 bp, Artificial Sequence
  chemically synthesized
atagggacacatcacatttg

SEQ ID NO: 627484 - DNA, 20 bp, Artificial Sequence
  chemically synthesized
ttatttgacttcatcttact

SEQ ID NO: 627485 - DNA, 20 bp, Artificial Sequence
  chemically synthesized
gctcctagaagtttaaaaat

SEQ ID NO: 627486 - DNA, 20 bp, Artificial Sequence
  chemically synthesized
tcaaatatttttaaacttct

SEQ ID NO: 627487 - DNA, 20 bp, Artificial Sequence
  chemically synthesized
tttttaaacttctaggagct

SEQ ID NO: 627488 - DNA, 20 bp, Artificial Sequence
  chemically synthesized
aaagcaaacaaaaagctcct

SEQ ID NO: 627489 - DNA, 20 bp, Artificial Sequence
  chemically synthesized
taaacttctaggagcttttt

SEQ ID NO: 627490 - DNA, 20 bp, Artificial Sequence
  chemically synthesized
ttgtgtttttacatgtttta

SEQ ID NO: 627491 - DNA, 20 bp, Artificial Sequence
  chemically synthesized
gggtgagagtttgtgttttt

SEQ ID NO: 627492 - DNA, 20 bp, Artificial Sequence
  chemically synthesized
agaggatgctgggtgagagt

SEQ ID NO: 627493 - DNA, 20 bp, Artificial Sequence
  chemically synthesized
ttcgtaagaggatgctgggt

SEQ ID NO: 627494 - DNA, 20 bp, Artificial Sequence
  chemically synthesized
gtaataaatagagcaaatag

SEQ ID NO: 627495 - DNA, 20 bp, Artificial Sequence
  chemically synthesized
tcataattccctgagaagct

SEQ ID NO: 627496 - DNA, 20 bp, Artificial Sequence
  chemically synthesized
gttcacattactcataatca

SEQ ID NO: 627497 - DNA, 20 bp, Artificial Sequence
  chemically synthesized
cttttaaaggactttctttt

SEQ ID NO: 627498 - DNA, 20 bp, Artificial Sequence
  chemically synthesized
cctttcgctactcaagaaaa

SEQ ID NO: 627499 - DNA, 20 bp, Artificial Sequence
  chemically synthesized
cttgcctttcgctactcaag

SEQ ID NO: 627500 - DNA, 20 bp, Artificial Sequence
  chemically synthesized
tcacacagattttttcttta

SEQ ID NO: 627501 - DNA, 20 bp, Artificial Sequence
  chemically synthesized
attttatgtaattgaagtca

SEQ ID NO: 627502 - DNA, 20 bp, Artificial Sequence
  chemically synthesized
aagaaaaaattctgtgaaag

SEQ ID NO: 627503 - DNA, 20 bp, Artificial Sequence
  chemically synthesized
aataagaaccaacatacaag

SEQ ID NO: 627504 - DNA, 20 bp, Artificial Sequence
  chemically synthesized
ttgagaaaaagttgtcgtgg

SEQ ID NO: 627505 - DNA, 20 bp, Artificial Sequence
  chemically synthesized
aattgcctcttttgcctttc

SEQ ID NO: 627506 - DNA, 20 bp, Artificial Sequence
  chemically synthesized
gtctgaaagaaattcttcct

SEQ ID NO: 627507 - DNA, 20 bp, Artificial Sequence
  chemically synthesized
tgtctctatggtaacagaca

SEQ ID NO: 627508 - DNA, 20 bp, Artificial Sequence
  chemically synthesized
ggaaatacaataagaatcct

SEQ ID NO: 627509 - DNA, 20 bp, Artificial Sequence
  chemically synthesized
tggaaattcctgtaaaaccc

SEQ ID NO: 627510 - DNA, 20 bp, Artificial Sequence
  chemically synthesized
ctttccctagaaaaaaaatg

SEQ ID NO: 627511 - DNA, 20 bp, Artificial Sequence
  chemically synthesized
agttgcacattatggaacta

SEQ ID NO: 627512 - DNA, 20 bp, Artificial Sequence
  chemically synthesized
tggtggtaaattcagaatcc

SEQ ID NO: 627513 - DNA, 20 bp, Artificial Sequence
  chemically synthesized
aaattcagaatccctcagct

SEQ ID NO: 627514 - DNA, 20 bp, Artificial Sequence
  chemically synthesized
caaattctaagcataaagct

SEQ ID NO: 627515 - DNA, 20 bp, Artificial Sequence
  chemically synthesized
ccctcagctttatgcttaga

SEQ ID NO: 627516 - DNA, 20 bp, Artificial Sequence
  chemically synthesized
ctttatgcttagaatttgat

SEQ ID NO: 627517 - DNA, 20 bp, Artificial Sequence
  chemically synthesized
cctgaacatagggatatgag

SEQ ID NO: 627518 - DNA, 20 bp, Artificial Sequence
  chemically synthesized
gaacagttaagggttttagt

SEQ ID NO: 627519 - DNA, 20 bp, Artificial Sequence
  chemically synthesized
tgcactataaaagaacagtt

SEQ ID NO: 627520 - DNA, 20 bp, Artificial Sequence
  chemically synthesized
gttcttttatagtgcagtgc

SEQ ID NO: 627521 - DNA, 20 bp, Artificial Sequence
  chemically synthesized
tctctcagcagctttggaat

SEQ ID NO: 627522 - DNA, 20 bp, Artificial Sequence
  chemically synthesized
gtgggtttatagactctctc

SEQ ID NO: 627523 - DNA, 20 bp, Artificial Sequence
  chemically synthesized
agctaccctcttctctcttc

SEQ ID NO: 627524 - DNA, 20 bp, Artificial Sequence
  chemically synthesized
agaaaattccactcacttta

SEQ ID NO: 627525 - DNA, 20 bp, Artificial Sequence
  chemically synthesized
attgctgcttttccgttagt

SEQ ID NO: 627526 - DNA, 20 bp, Artificial Sequence
  chemically synthesized
taggattctgttatttttat

SEQ ID NO: 627527 - DNA, 20 bp, Artificial Sequence
  chemically synthesized
ttgctgaatttacctatttg

SEQ ID NO: 627528 - DNA, 20 bp, Artificial Sequence
  chemically synthesized
ctaccaaataggtaaattca

SEQ ID NO: 627529 - DNA, 20 bp, Artificial Sequence
  chemically synthesized
tgacttatatataatatctg

SEQ ID NO: 627530 - DNA, 20 bp, Artificial Sequence
  chemically synthesized
ggcagatattatatataagt

SEQ ID NO: 627531 - DNA, 20 bp, Artificial Sequence
  chemically synthesized
cttgttgaggaatgtttatt

SEQ ID NO: 627532 - DNA, 20 bp, Artificial Sequence
  chemically synthesized
gagataatttacttgttgag

SEQ ID NO: 627533 - DNA, 20 bp, Artificial Sequence
  chemically synthesized
tatgcagcctaacagataaa

SEQ ID NO: 627534 - DNA, 20 bp, Artificial Sequence
  chemically synthesized
gtagtatgggtggttacaat

SEQ ID NO: 627535 - DNA, 20 bp, Artificial Sequence
  chemically synthesized
gaactgttatttaactgtta

SEQ ID NO: 627536 - DNA, 20 bp, Artificial Sequence
  chemically synthesized
tgttatttaactgttacatt

SEQ ID NO: 627537 - DNA, 20 bp, Artificial Sequence
  chemically synthesized
gactataaagaaattttgtt

SEQ ID NO: 627538 - DNA, 20 bp, Artificial Sequence
  chemically synthesized
atctctagactataaagaaa

SEQ ID NO: 627539 - DNA, 20 bp, Artificial Sequence
  chemically synthesized
actatctggccctcgatagg

SEQ ID NO: 627540 - DNA, 20 bp, Artificial Sequence
  chemically synthesized
gagggccagatagtaaatat

SEQ ID NO: 627541 - DNA, 20 bp, Artificial Sequence
  chemically synthesized
tctctgtcataagtactcaa

SEQ ID NO: 627542 - DNA, 20 bp, Artificial Sequence
  chemically synthesized
gaagacagccacacccattt

SEQ ID NO: 627543 - DNA, 20 bp, Artificial Sequence
  chemically synthesized
aaaatttcaatttaagagtc

SEQ ID NO: 627544 - DNA, 20 bp, Artificial Sequence
  chemically synthesized
ttcaagaatatttctgacac

SEQ ID NO: 627545 - DNA, 20 bp, Artificial Sequence
  chemically synthesized
aaatggttttcacgtttctg

SEQ ID NO: 627546 - DNA, 20 bp, Artificial Sequence
  chemically synthesized
ccagtcatttaaaatggttt

SEQ ID NO: 627547 - DNA, 20 bp, Artificial Sequence
  chemically synthesized
ctgtttgaccagtcatttaa

SEQ ID NO: 627548 - DNA, 20 bp, Artificial Sequence
  chemically synthesized
gtccacattgtcacatctat

SEQ ID NO: 627549 - DNA, 20 bp, Artificial Sequence
  chemically synthesized
ataaatgtctaaaaaaaaga

SEQ ID NO: 627550 - DNA, 20 bp, Artificial Sequence
  chemically synthesized
aaagaacatgtttttaaaag

SEQ ID NO: 627551 - DNA, 20 bp, Artificial Sequence
  chemically synthesized
ttaaaagaaatgattggact

SEQ ID NO: 627552 - DNA, 20 bp, Artificial Sequence
  chemically synthesized
aaagtgttcagtgctaagaa

SEQ ID NO: 627553 - DNA, 20 bp, Artificial Sequence
  chemically synthesized
agttaatgttgtgagcagag

SEQ ID NO: 627554 - DNA, 20 bp, Artificial Sequence
  chemically synthesized
cgatgtgctataatgcagaa

SEQ ID NO: 627555 - DNA, 20 bp, Artificial Sequence
  chemically synthesized
tagcacatcgaatatttgaa

SEQ ID NO: 627556 - DNA, 20 bp, Artificial Sequence
  chemically synthesized
gaaaaaagtagagaaaatta

SEQ ID NO: 627557 - DNA, 20 bp, Artificial Sequence
  chemically synthesized
tttccatgcccctcaaatgt

SEQ ID NO: 627558 - DNA, 20 bp, Artificial Sequence
  chemically synthesized
atacatgtctaacaatatta

SEQ ID NO: 627559 - DNA, 20 bp, Artificial Sequence
  chemically synthesized
aatgatgaccaacaaaatca

SEQ ID NO: 627560 - DNA, 20 bp, Artificial Sequence
  chemically synthesized
ataattaattgaataaatct

SEQ ID NO: 627561 - DNA, 20 bp, Artificial Sequence
  chemically synthesized
atttattcaattaattatta

SEQ ID NO: 627562 - DNA, 20 bp, Artificial Sequence
  chemically synthesized
agtacaggacatgagagagt

SEQ ID NO: 627563 - DNA, 20 bp, Artificial Sequence
  chemically synthesized
ctctctcatgtcctgtactt

SEQ ID NO: 627564 - DNA, 20 bp, Artificial Sequence
  chemically synthesized
ctcatgtcctgtacttgcca

SEQ ID NO: 627565 - DNA, 20 bp, Artificial Sequence
  chemically synthesized
gccagattgattttatgaac

SEQ ID NO: 627566 - DNA, 20 bp, Artificial Sequence
  chemically synthesized
attattctctttgacctcac

SEQ ID NO: 627567 - DNA, 20 bp, Artificial Sequence
  chemically synthesized
cattgaactattagggtacc

SEQ ID NO: 627568 - DNA, 20 bp, Artificial Sequence
  chemically synthesized
ctaatagttcaatgtatttg

SEQ ID NO: 627569 - DNA, 20 bp, Artificial Sequence
  chemically synthesized
acaggctatctggatcgtcc

SEQ ID NO: 627570 - DNA, 20 bp, Artificial Sequence
  chemically synthesized
agagacataaggcacattac

SEQ ID NO: 627571 - DNA, 20 bp, Artificial Sequence
  chemically synthesized
gtcctgtgaaaggccctctt

SEQ ID NO: 627572 - DNA, 20 bp, Artificial Sequence
  chemically synthesized
aaggccctcttcctggttta

SEQ ID NO: 627573 - DNA, 20 bp, Artificial Sequence
  chemically synthesized
acaggcagggtcatttagcc

SEQ ID NO: 627574 - DNA, 20 bp, Artificial Sequence
  chemically synthesized
ggtgaaaatggagaaatatt

SEQ ID NO: 627575 - DNA, 20 bp, Artificial Sequence
  chemically synthesized
gattatagcatggactttgg

SEQ ID NO: 627576 - DNA, 20 bp, Artificial Sequence
  chemically synthesized
gtatgtaatatggctagtta

SEQ ID NO: 627577 - DNA, 20 bp, Artificial Sequence
  chemically synthesized
gagtgcaaagataatatatg

SEQ ID NO: 627578 - DNA, 20 bp, Artificial Sequence
  chemically synthesized
acaattcctgaagaaggtga

SEQ ID NO: 627579 - DNA, 20 bp, Artificial Sequence
  chemically synthesized
tatttttctggaaaaatatt

SEQ ID NO: 627580 - DNA, 20 bp, Artificial Sequence
  chemically synthesized
aataggaaggaaagtccata

SEQ ID NO: 627581 - DNA, 20 bp, Artificial Sequence
  chemically synthesized
ctttccttcctatttttcac

SEQ ID NO: 627582 - DNA, 20 bp, Artificial Sequence
  chemically synthesized
aggaccaactaaaatattgt

SEQ ID NO: 627583 - DNA, 20 bp, Artificial Sequence
  chemically synthesized
tggaaaaaaaaaaaagtcag

SEQ ID NO: 627584 - DNA, 20 bp, Artificial Sequence
  chemically synthesized
acacacacacacacacacac

SEQ ID NO: 627585 - DNA, 20 bp, Artificial Sequence
  chemically synthesized
gtgtgtgtgtgtgtgtatgc

SEQ ID NO: 627586 - DNA, 20 bp, Artificial Sequence
  chemically synthesized
tgtgtgtatgcacatgctta

SEQ ID NO: 627587 - DNA, 20 bp, Artificial Sequence
  chemically synthesized
tgtatgcacatgcttaagtg

SEQ ID NO: 627588 - DNA, 20 bp, Artificial Sequence
  chemically synthesized
tgcttaagtggtttgttttt

SEQ ID NO: 627589 - DNA, 20 bp, Artificial Sequence
  chemically synthesized
ttgctttttccttcttaaaa

SEQ ID NO: 627590 - DNA, 20 bp, Artificial Sequence
  chemically synthesized
tgggaggataataggatgga

SEQ ID NO: 627591 - DNA, 20 bp, Artificial Sequence
  chemically synthesized
gctttgaaatgttttgcctg

SEQ ID NO: 627592 - DNA, 20 bp, Artificial Sequence
  chemically synthesized
cggttaagaaatatgctttg

SEQ ID NO: 627593 - DNA, 20 bp, Artificial Sequence
  chemically synthesized
aagacactatcggttaagaa

SEQ ID NO: 627594 - DNA, 20 bp, Artificial Sequence
  chemically synthesized
tatcacaaaaagagaaataa

SEQ ID NO: 627595 - DNA, 20 bp, Artificial Sequence
  chemically synthesized
tttacctaaaagagataaat

SEQ ID NO: 627596 - DNA, 20 bp, Artificial Sequence
  chemically synthesized
aatgccttagagaaaacaat

SEQ ID NO: 627597 - DNA, 20 bp, Artificial Sequence
  chemically synthesized
ccccaattctctcaaactca

SEQ ID NO: 627598 - DNA, 20 bp, Artificial Sequence
  chemically synthesized
ttttccccaattctctcaaa

SEQ ID NO: 627599 - DNA, 20 bp, Artificial Sequence
  chemically synthesized
agagaattggggaaaactca

SEQ ID NO: 627600 - DNA, 20 bp, Artificial Sequence
  chemically synthesized
agtgacttttataaatctat

SEQ ID NO: 627601 - DNA, 20 bp, Artificial Sequence
  chemically synthesized
gatttataaaagtcactaat

SEQ ID NO: 627602 - DNA, 20 bp, Artificial Sequence
  chemically synthesized
ctggatttaaaaatatatta

SEQ ID NO: 627603 - DNA, 20 bp, Artificial Sequence
  chemically synthesized
atttttatgcatttctcctt

SEQ ID NO: 627604 - DNA, 20 bp, Artificial Sequence
  chemically synthesized
gcttaatcctgtgtcttctg

SEQ ID NO: 627605 - DNA, 20 bp, Artificial Sequence
  chemically synthesized
cttaaagcacttcagaagac

SEQ ID NO: 627606 - DNA, 20 bp, Artificial Sequence
  chemically synthesized
gaagacacaggattaagcaa

SEQ ID NO: 627607 - DNA, 20 bp, Artificial Sequence
  chemically synthesized
acgtgaagtcttcaaatccc

SEQ ID NO: 627608 - DNA, 20 bp, Artificial Sequence
  chemically synthesized
ctcatcactctgcaggctga

SEQ ID NO: 627609 - DNA, 20 bp, Artificial Sequence
  chemically synthesized
cttacaatgcatttatcaat

SEQ ID NO: 627610 - DNA, 20 bp, Artificial Sequence
  chemically synthesized
aggtgcgtggcatatagact

SEQ ID NO: 627611 - DNA, 20 bp, Artificial Sequence
  chemically synthesized
agacgctaggtggcaccagc

SEQ ID NO: 627612 - DNA, 20 bp, Artificial Sequence
  chemically synthesized
tgtatttggtcccactgatg

SEQ ID NO: 627613 - DNA, 20 bp, Artificial Sequence
  chemically synthesized
ttttttagtttatagtttag

SEQ ID NO: 627614 - DNA, 20 bp, Artificial Sequence
  chemically synthesized
tgtattttttagtttatagt

SEQ ID NO: 627615 - DNA, 20 bp, Artificial Sequence
  chemically synthesized
tgtttttgtattttttagtt

SEQ ID NO: 627616 - DNA, 20 bp, Artificial Sequence
  chemically synthesized
caaactgtgtttttgtattt

SEQ ID NO: 627617 - DNA, 20 bp, Artificial Sequence
  chemically synthesized
taaactaaaaaatacaaaaa

SEQ ID NO: 627618 - DNA, 20 bp, Artificial Sequence
  chemically synthesized
aaaaatacaaaaacacagtt

SEQ ID NO: 627619 - DNA, 20 bp, Artificial Sequence
  chemically synthesized
cagccactggaatccccaaa

SEQ ID NO: 627620 - DNA, 20 bp, Artificial Sequence
  chemically synthesized
cacagtttggggattccagt

SEQ ID NO: 627621 - DNA, 20 bp, Artificial Sequence
  chemically synthesized
taccatagttacttttaaaa

SEQ ID NO: 627622 - DNA, 20 bp, Artificial Sequence
  chemically synthesized
attgtctccttcgaaaaaat

SEQ ID NO: 627623 - DNA, 20 bp, Artificial Sequence
  chemically synthesized
ctactaaagatgcagtgtaa

SEQ ID NO: 627624 - DNA, 20 bp, Artificial Sequence
  chemically synthesized
gttacttttcaactttttat

SEQ ID NO: 627625 - DNA, 20 bp, Artificial Sequence
  chemically synthesized
aaattcagctctgtctatac

SEQ ID NO: 627626 - DNA, 20 bp, Artificial Sequence
  chemically synthesized
atgcaaaattctgtcagtct

SEQ ID NO: 627627 - DNA, 20 bp, Artificial Sequence
  chemically synthesized
ctgtcagtctttgagcttcc

SEQ ID NO: 627628 - DNA, 20 bp, Artificial Sequence
  chemically synthesized
ttaatacttttaagtactgt

SEQ ID NO: 627629 - DNA, 20 bp, Artificial Sequence
  chemically synthesized
ggttcaggcactctgattat

SEQ ID NO: 627630 - DNA, 20 bp, Artificial Sequence
  chemically synthesized
tttataatgtggttcaggca

SEQ ID NO: 627631 - DNA, 20 bp, Artificial Sequence
  chemically synthesized
atatatacagcaggaaagaa

SEQ ID NO: 627632 - DNA, 20 bp, Artificial Sequence
  chemically synthesized
tgatattcaaccacggtaat

SEQ ID NO: 627633 - DNA, 20 bp, Artificial Sequence
  chemically synthesized
cttctgttttgaaaaatagt

SEQ ID NO: 627634 - DNA, 20 bp, Artificial Sequence
  chemically synthesized
tctccaaaataattgctaac

SEQ ID NO: 627635 - DNA, 20 bp, Artificial Sequence
  chemically synthesized
caagtggtgggctaattaca

SEQ ID NO: 627636 - DNA, 20 bp, Artificial Sequence
  chemically synthesized
tttactgatatttaaataca

SEQ ID NO: 627637 - DNA, 20 bp, Artificial Sequence
  chemically synthesized
tttttttctgaatgttagtc

SEQ ID NO: 627638 - DNA, 20 bp, Artificial Sequence
  chemically synthesized
atatgatagtctattaactt

SEQ ID NO: 627639 - DNA, 20 bp, Artificial Sequence
  chemically synthesized
aggagactgggtagagagcc

SEQ ID NO: 627640 - DNA, 20 bp, Artificial Sequence
  chemically synthesized
attacatagacagttaataa

SEQ ID NO: 627641 - DNA, 20 bp, Artificial Sequence
  chemically synthesized
gattttcctaagtgtgaaaa

SEQ ID NO: 627642 - DNA, 20 bp, Artificial Sequence
  chemically synthesized
cagatgttaaataatataga

SEQ ID NO: 627643 - DNA, 20 bp, Artificial Sequence
  chemically synthesized
ctatttctatattatttaac

SEQ ID NO: 627644 - DNA, 20 bp, Artificial Sequence
  chemically synthesized
gttttaaacaatcacttgtt

SEQ ID NO: 627645 - DNA, 20 bp, Artificial Sequence
  chemically synthesized
cattcaaacatttaacaagt

SEQ ID NO: 627646 - DNA, 20 bp, Artificial Sequence
  chemically synthesized
aaaacattcaaacatttaac

SEQ ID NO: 627647 - DNA, 20 bp, Artificial Sequence
  chemically synthesized
caatcacttgttaaatgttt

SEQ ID NO: 627648 - DNA, 20 bp, Artificial Sequence
  chemically synthesized
gttaaatgtttgaatgtttt

SEQ ID NO: 627649 - DNA, 20 bp, Artificial Sequence
  chemically synthesized
gcttgttaccctagtggtga

SEQ ID NO: 627650 - DNA, 20 bp, Artificial Sequence
  chemically synthesized
agattatttcaatatgttca

SEQ ID NO: 627651 - DNA, 20 bp, Artificial Sequence
  chemically synthesized
gataggttatagaaacgatg

SEQ ID NO: 627652 - DNA, 20 bp, Artificial Sequence
  chemically synthesized
tgctttttgtataaactatg

SEQ ID NO: 627653 - DNA, 20 bp, Artificial Sequence
  chemically synthesized
tttggagaaaggggagcaat

SEQ ID NO: 627654 - DNA, 20 bp, Artificial Sequence
  chemically synthesized
acagtatttggctccaaaaa

SEQ ID NO: 627655 - DNA, 20 bp, Artificial Sequence
  chemically synthesized
actgtccatgctcatgctcc

SEQ ID NO: 627656 - DNA, 20 bp, Artificial Sequence
  chemically synthesized
aagtacttataattataatc

SEQ ID NO: 627657 - DNA, 20 bp, Artificial Sequence
  chemically synthesized
tatttctttcccctacaatc

SEQ ID NO: 627658 - DNA, 20 bp, Artificial Sequence
  chemically synthesized
tacgatttttagaacccttt

SEQ ID NO: 627659 - DNA, 20 bp, Artificial Sequence
  chemically synthesized
ttacattctttcttgcctgc

SEQ ID NO: 627660 - DNA, 20 bp, Artificial Sequence
  chemically synthesized
tttatttattttgcccttta

SEQ ID NO: 627661 - DNA, 20 bp, Artificial Sequence
  chemically synthesized
ctgtatcagcttgtttcaga

SEQ ID NO: 627662 - DNA, 20 bp, Artificial Sequence
  chemically synthesized
ctcttaatttctctgtatca

SEQ ID NO: 627663 - DNA, 20 bp, Artificial Sequence
  chemically synthesized
actgctcttaatttctctgt

SEQ ID NO: 627664 - DNA, 20 bp, Artificial Sequence
  chemically synthesized
cagctggtctatgatttctc

SEQ ID NO: 627665 - DNA, 20 bp, Artificial Sequence
  chemically synthesized
gacccagctggtctatgatt

SEQ ID NO: 627666 - DNA, 20 bp, Artificial Sequence
  chemically synthesized
ttgatgtcgacccagctggt

SEQ ID NO: 627667 - DNA, 20 bp, Artificial Sequence
  chemically synthesized
tttcagctattgaactgtat

SEQ ID NO: 627668 - DNA, 20 bp, Artificial Sequence
  chemically synthesized
ggtttttcaacaactctagc

SEQ ID NO: 627669 - DNA, 20 bp, Artificial Sequence
  chemically synthesized
aaatatatcaatatctcctg

SEQ ID NO: 627670 - DNA, 20 bp, Artificial Sequence
  chemically synthesized
gtcatttctcctcatcaatt

SEQ ID NO: 627671 - DNA, 20 bp, Artificial Sequence
  chemically synthesized
tacttggtttctattttata

SEQ ID NO: 627672 - DNA, 20 bp, Artificial Sequence
  chemically synthesized
ataggttgaaaattgttata

SEQ ID NO: 627673 - DNA, 20 bp, Artificial Sequence
  chemically synthesized
gagagaaatgagaatgtaca

SEQ ID NO: 627674 - DNA, 20 bp, Artificial Sequence
  chemically synthesized
atatgcaatttagttgcaag

SEQ ID NO: 627675 - DNA, 20 bp, Artificial Sequence
  chemically synthesized
attgcatataactaatctgg

SEQ ID NO: 627676 - DNA, 20 bp, Artificial Sequence
  chemically synthesized
aaatcttcggggaaatctac

SEQ ID NO: 627677 - DNA, 20 bp, Artificial Sequence
  chemically synthesized
taatctggggtagatttccc

SEQ ID NO: 627678 - DNA, 20 bp, Artificial Sequence
  chemically synthesized
ataaagtattgttcaggagt

SEQ ID NO: 627679 - DNA, 20 bp, Artificial Sequence
  chemically synthesized
tttattctaaaatcttctaa

SEQ ID NO: 627680 - DNA, 20 bp, Artificial Sequence
  chemically synthesized
ctgggatagaaatcagtgtt

SEQ ID NO: 627681 - DNA, 20 bp, Artificial Sequence
  chemically synthesized
aacactgatttctatcccag

SEQ ID NO: 627682 - DNA, 20 bp, Artificial Sequence
  chemically synthesized
cgttagattttggggagggg

SEQ ID NO: 627683 - DNA, 20 bp, Artificial Sequence
  chemically synthesized
ttaaaattgccttgtgctgc

SEQ ID NO: 627684 - DNA, 20 bp, Artificial Sequence
  chemically synthesized
aaacagtgttgcttttacag

SEQ ID NO: 627685 - DNA, 20 bp, Artificial Sequence
  chemically synthesized
aatccattctgtaaaagcaa

SEQ ID NO: 627686 - DNA, 20 bp, Artificial Sequence
  chemically synthesized
tgtaaaagcaacactgtttg

SEQ ID NO: 627687 - DNA, 20 bp, Artificial Sequence
  chemically synthesized
tcttcaaactctgcaaacag

SEQ ID NO: 627688 - DNA, 20 bp, Artificial Sequence
  chemically synthesized
aacaagcagctgttggtagc

SEQ ID NO: 627689 - DNA, 20 bp, Artificial Sequence
  chemically synthesized
aacaaaccccagctaccaac

SEQ ID NO: 627690 - DNA, 20 bp, Artificial Sequence
  chemically synthesized
caacagctgcttgttcaaac

SEQ ID NO: 627691 - DNA, 20 bp, Artificial Sequence
  chemically synthesized
gaagctggccatgacaaagc

SEQ ID NO: 627692 - DNA, 20 bp, Artificial Sequence
  chemically synthesized
caaacatatgctttgtcatg

SEQ ID NO: 627693 - DNA, 20 bp, Artificial Sequence
  chemically synthesized
aattgtatttgtaatgatgt

SEQ ID NO: 627694 - DNA, 20 bp, Artificial Sequence
  chemically synthesized
aaaaacagctggcatggaag

SEQ ID NO: 627695 - DNA, 20 bp, Artificial Sequence
  chemically synthesized
ataatcctaccttccatgcc

SEQ ID NO: 627696 - DNA, 20 bp, Artificial Sequence
  chemically synthesized
aaagatgctgttttgcacta

SEQ ID NO: 627697 - DNA, 20 bp, Artificial Sequence
  chemically synthesized
agtgcaaaacagcatctttc

SEQ ID NO: 627698 - DNA, 20 bp, Artificial Sequence
  chemically synthesized
tgacagaatcaggagaaaga

SEQ ID NO: 627699 - DNA, 20 bp, Artificial Sequence
  chemically synthesized
cccagcagtcggcagtaata

SEQ ID NO: 627700 - DNA, 20 bp, Artificial Sequence
  chemically synthesized
attccaacagctcccctttc

SEQ ID NO: 627701 - DNA, 20 bp, Artificial Sequence
  chemically synthesized
aggttaggtgggcatgccta

SEQ ID NO: 627702 - DNA, 20 bp, Artificial Sequence
  chemically synthesized
tcatgtgtttgctccgaggt

SEQ ID NO: 627703 - DNA, 20 bp, Artificial Sequence
  chemically synthesized
tgcaaacgctgctctggctc

SEQ ID NO: 627704 - DNA, 20 bp, Artificial Sequence
  chemically synthesized
agcaaacacatgagccagag

SEQ ID NO: 627705 - DNA, 20 bp, Artificial Sequence
  chemically synthesized
ctgaaagagatttgcagatc

SEQ ID NO: 627706 - DNA, 20 bp, Artificial Sequence
  chemically synthesized
gaagagcgagtagatactga

SEQ ID NO: 627707 - DNA, 20 bp, Artificial Sequence
  chemically synthesized
ttctgtacagatgcaaagcc

SEQ ID NO: 627708 - DNA, 20 bp, Artificial Sequence
  chemically synthesized
tacagatgcaaagcctttgg

SEQ ID NO: 627709 - DNA, 20 bp, Artificial Sequence
  chemically synthesized
ttaggaaaataatctaatcc

SEQ ID NO: 627710 - DNA, 20 bp, Artificial Sequence
  chemically synthesized
aaatttcagtgtgaataata

SEQ ID NO: 627711 - DNA, 20 bp, Artificial Sequence
  chemically synthesized
attattcacactgaaatttt

SEQ ID NO: 627712 - DNA, 20 bp, Artificial Sequence
  chemically synthesized
tgcaaaagtacaattcagaa

SEQ ID NO: 627713 - DNA, 20 bp, Artificial Sequence
  chemically synthesized
tatttaaagtctggcaccct

SEQ ID NO: 627714 - DNA, 20 bp, Artificial Sequence
  chemically synthesized
ttgatattttgactttagat

SEQ ID NO: 627715 - DNA, 20 bp, Artificial Sequence
  chemically synthesized
atttcttcacaaagtaagaa

SEQ ID NO: 627716 - DNA, 20 bp, Artificial Sequence
  chemically synthesized
acttgttaaagaagttgtgt

SEQ ID NO: 627717 - DNA, 20 bp, Artificial Sequence
  chemically synthesized
ttcttttaacaaatactgat

SEQ ID NO: 627718 - DNA, 20 bp, Artificial Sequence
  chemically synthesized
ttacagtttcttttaacaaa

SEQ ID NO: 627719 - DNA, 20 bp, Artificial Sequence
  chemically synthesized
acggtataattgataacaat

SEQ ID NO: 627720 - DNA, 20 bp, Artificial Sequence
  chemically synthesized
tataattttctctaaaactt

SEQ ID NO: 627721 - DNA, 20 bp, Artificial Sequence
  chemically synthesized
cccccaagacaggcaaactt

SEQ ID NO: 627722 - DNA, 20 bp, Artificial Sequence
  chemically synthesized
ttgcctgtcttgggggcact

SEQ ID NO: 627723 - DNA, 20 bp, Artificial Sequence
  chemically synthesized
ggtttgaaattataacacaa

SEQ ID NO: 627724 - DNA, 20 bp, Artificial Sequence
  chemically synthesized
attataacacaagaaagttt

SEQ ID NO: 627725 - DNA, 20 bp, Artificial Sequence
  chemically synthesized
tgagaaaaattaataaaatc

SEQ ID NO: 627726 - DNA, 20 bp, Artificial Sequence
  chemically synthesized
aataaaatcatatgtttcct

SEQ ID NO: 627727 - DNA, 20 bp, Artificial Sequence
  chemically synthesized
atacaaatctgagaggaaac

SEQ ID NO: 627728 - DNA, 20 bp, Artificial Sequence
  chemically synthesized
tctcagatttgtattaggta

SEQ ID NO: 627729 - DNA, 20 bp, Artificial Sequence
  chemically synthesized
ttactttttgtggtaggggg

SEQ ID NO: 627730 - DNA, 20 bp, Artificial Sequence
  chemically synthesized
ccacaaaaagtaaacagaca

SEQ ID NO: 627731 - DNA, 20 bp, Artificial Sequence
  chemically synthesized
atgtaactatgaaaccagct

SEQ ID NO: 627732 - DNA, 20 bp, Artificial Sequence
  chemically synthesized
atgctaaatgagttattcct

SEQ ID NO: 627733 - DNA, 20 bp, Artificial Sequence
  chemically synthesized
ccaatatcgctattctgaaa

SEQ ID NO: 627734 - DNA, 20 bp, Artificial Sequence
  chemically synthesized
gtgtgtgtgtgtgtgtgtgt

SEQ ID NO: 627735 - DNA, 20 bp, Artificial Sequence
  chemically synthesized
attttagctattctacttcc

SEQ ID NO: 627736 - DNA, 20 bp, Artificial Sequence
  chemically synthesized
tcttgatatatagggattat

SEQ ID NO: 627737 - DNA, 20 bp, Artificial Sequence
  chemically synthesized
gttgtgtatatcttgatata

SEQ ID NO: 627738 - DNA, 20 bp, Artificial Sequence
  chemically synthesized
atacacaacaatcagtaact

SEQ ID NO: 627739 - DNA, 20 bp, Artificial Sequence
  chemically synthesized
atatctaataaactataagt

SEQ ID NO: 627740 - DNA, 20 bp, Artificial Sequence
  chemically synthesized
atatggactcaacttatctt

SEQ ID NO: 627741 - DNA, 20 bp, Artificial Sequence
  chemically synthesized
gttgagtccatatgaatcca

SEQ ID NO: 627742 - DNA, 20 bp, Artificial Sequence
  chemically synthesized
tattattttagagaaatctt

SEQ ID NO: 627743 - DNA, 20 bp, Artificial Sequence
  chemically synthesized
tattttacataaaaagtctt

SEQ ID NO: 627744 - DNA, 20 bp, Artificial Sequence
  chemically synthesized
ggtgattagcatatctattt

SEQ ID NO: 627745 - DNA, 20 bp, Artificial Sequence
  chemically synthesized
ttgagaatagcataaatgcc

SEQ ID NO: 627746 - DNA, 20 bp, Artificial Sequence
  chemically synthesized
tgtgttttttttgttgtatt

SEQ ID NO: 627747 - DNA, 20 bp, Artificial Sequence
  chemically synthesized
tcttggcttctactagcctc

SEQ ID NO: 627748 - DNA, 20 bp, Artificial Sequence
  chemically synthesized
gtataaagaggaagagaggc

SEQ ID NO: 627749 - DNA, 20 bp, Artificial Sequence
  chemically synthesized
ttctaaaatgctggactcct

SEQ ID NO: 627750 - DNA, 20 bp, Artificial Sequence
  chemically synthesized
tgtttcagatattttccgta

SEQ ID NO: 627751 - DNA, 20 bp, Artificial Sequence
  chemically synthesized
atctattcataagtctgtct

SEQ ID NO: 627752 - DNA, 20 bp, Artificial Sequence
  chemically synthesized
aaatgtatacaagttgtaca

SEQ ID NO: 627753 - DNA, 20 bp, Artificial Sequence
  chemically synthesized
gtttcaatatacatatagtg

SEQ ID NO: 627754 - DNA, 20 bp, Artificial Sequence
  chemically synthesized
tgtgtatttggtgataacac

SEQ ID NO: 627755 - DNA, 20 bp, Artificial Sequence
  chemically synthesized
aagatattggtcaaaggaca

SEQ ID NO: 627756 - DNA, 20 bp, Artificial Sequence
  chemically synthesized
ttggtaacaatcaatctacc

SEQ ID NO: 627757 - DNA, 20 bp, Artificial Sequence
  chemically synthesized
ctataaagaagcagagggta

SEQ ID NO: 627758 - DNA, 20 bp, Artificial Sequence
  chemically synthesized
tcagctataaagaagcagag

SEQ ID NO: 627759 - DNA, 20 bp, Artificial Sequence
  chemically synthesized
tgcttctttatagctgactg

SEQ ID NO: 627760 - DNA, 20 bp, Artificial Sequence
  chemically synthesized
gcagtattattcttcctatg

SEQ ID NO: 627761 - DNA, 20 bp, Artificial Sequence
  chemically synthesized
cacccacattatcacaaata

SEQ ID NO: 627762 - DNA, 20 bp, Artificial Sequence
  chemically synthesized
tatctgttgatgtacactca

SEQ ID NO: 627763 - DNA, 20 bp, Artificial Sequence
  chemically synthesized
gtgcagatatctcatctaga

SEQ ID NO: 627764 - DNA, 20 bp, Artificial Sequence
  chemically synthesized
aactttttgaggaatctcca

SEQ ID NO: 627765 - DNA, 20 bp, Artificial Sequence
  chemically synthesized
agccattatggaaaacagta

SEQ ID NO: 627766 - DNA, 20 bp, Artificial Sequence
  chemically synthesized
acattcccgccaacaatgta

SEQ ID NO: 627767 - DNA, 20 bp, Artificial Sequence
  chemically synthesized
tcaaaaagataaaaaaaata

SEQ ID NO: 627768 - DNA, 20 bp, Artificial Sequence
  chemically synthesized
ttttgataatagccatccta

SEQ ID NO: 627769 - DNA, 20 bp, Artificial Sequence
  chemically synthesized
agtttgaggtgatatttcac

SEQ ID NO: 627770 - DNA, 20 bp, Artificial Sequence
  chemically synthesized
tgctttaatttgcatttcct

SEQ ID NO: 627771 - DNA, 20 bp, Artificial Sequence
  chemically synthesized
atttgcatttccttgatgat

SEQ ID NO: 627772 - DNA, 20 bp, Artificial Sequence
  chemically synthesized
aaatggccaacaggtatatg

SEQ ID NO: 627773 - DNA, 20 bp, Artificial Sequence
  chemically synthesized
ctttggagaactgtctattc

SEQ ID NO: 627774 - DNA, 20 bp, Artificial Sequence
  chemically synthesized
aggggctttgaccattttta

SEQ ID NO: 627775 - DNA, 20 bp, Artificial Sequence
  chemically synthesized
tgaccatttttaatcagatt

SEQ ID NO: 627776 - DNA, 20 bp, Artificial Sequence
  chemically synthesized
acacaaacaaaaaacaaaaa

SEQ ID NO: 627777 - DNA, 20 bp, Artificial Sequence
  chemically synthesized
ttttaatcagattttttgtt

SEQ ID NO: 627778 - DNA, 20 bp, Artificial Sequence
  chemically synthesized
agattttttgttttttgttt

SEQ ID NO: 627779 - DNA, 20 bp, Artificial Sequence
  chemically synthesized
ttttgttttttgtttgtgtg

SEQ ID NO: 627780 - DNA, 20 bp, Artificial Sequence
  chemically synthesized
agcaaaccatatgaccaata

SEQ ID NO: 627781 - DNA, 20 bp, Artificial Sequence
  chemically synthesized
tgaaagctgcatattggtca

SEQ ID NO: 627782 - DNA, 20 bp, Artificial Sequence
  chemically synthesized
agttgtctcttcactctgtt

SEQ ID NO: 627783 - DNA, 20 bp, Artificial Sequence
  chemically synthesized
attgtttcctatgctgtaca

SEQ ID NO: 627784 - DNA, 20 bp, Artificial Sequence
  chemically synthesized
cctatgctgtacagaaggtt

SEQ ID NO: 627785 - DNA, 20 bp, Artificial Sequence
  chemically synthesized
ttatggtttgccgtagtaca

SEQ ID NO: 627786 - DNA, 20 bp, Artificial Sequence
  chemically synthesized
ccgtagtacaacttgtttaa

SEQ ID NO: 627787 - DNA, 20 bp, Artificial Sequence
  chemically synthesized
tttaattttgattttactgt

SEQ ID NO: 627788 - DNA, 20 bp, Artificial Sequence
  chemically synthesized
attctcgaaattggtcttgg

SEQ ID NO: 627789 - DNA, 20 bp, Artificial Sequence
  chemically synthesized
gcactttcttctaggaattt

SEQ ID NO: 627790 - DNA, 20 bp, Artificial Sequence
  chemically synthesized
cacaacaaaagtcagctaaa

SEQ ID NO: 627791 - DNA, 20 bp, Artificial Sequence
  chemically synthesized
tattctttagcatgtgtata

SEQ ID NO: 627792 - DNA, 20 bp, Artificial Sequence
  chemically synthesized
aggatattctctttaataaa

SEQ ID NO: 627793 - DNA, 20 bp, Artificial Sequence
  chemically synthesized
atttagttgaccatatatga

SEQ ID NO: 627794 - DNA, 20 bp, Artificial Sequence
  chemically synthesized
tctgttgcattggtctatat

SEQ ID NO: 627795 - DNA, 20 bp, Artificial Sequence
  chemically synthesized
tttatgccagtactatatta

SEQ ID NO: 627796 - DNA, 20 bp, Artificial Sequence
  chemically synthesized
tactatattattttgattac

SEQ ID NO: 627797 - DNA, 20 bp, Artificial Sequence
  chemically synthesized
cctgattttgaattatatga

SEQ ID NO: 627798 - DNA, 20 bp, Artificial Sequence
  chemically synthesized
aacattggaggtatcacact

SEQ ID NO: 627799 - DNA, 20 bp, Artificial Sequence
  chemically synthesized
aggaagtgtgatacctccaa

SEQ ID NO: 627800 - DNA, 20 bp, Artificial Sequence
  chemically synthesized
tccaatgttgcttatccttc

SEQ ID NO: 627801 - DNA, 20 bp, Artificial Sequence
  chemically synthesized
atgttgcttatccttctcaa

SEQ ID NO: 627802 - DNA, 20 bp, Artificial Sequence
  chemically synthesized
tttggctattctctttcttt

SEQ ID NO: 627803 - DNA, 20 bp, Artificial Sequence
  chemically synthesized
ttttgttgtttcatttgaat

SEQ ID NO: 627804 - DNA, 20 bp, Artificial Sequence
  chemically synthesized
aaaatgccaatagcattttt

SEQ ID NO: 627805 - DNA, 20 bp, Artificial Sequence
  chemically synthesized
gaggttgtgctgaatctgta

SEQ ID NO: 627806 - DNA, 20 bp, Artificial Sequence
  chemically synthesized
ccatgctactcaaagcaatt

SEQ ID NO: 627807 - DNA, 20 bp, Artificial Sequence
  chemically synthesized
tgttctgtgttcatggacta

SEQ ID NO: 627808 - DNA, 20 bp, Artificial Sequence
  chemically synthesized
ggcatgagccaccgtgcgtg

SEQ ID NO: 627809 - DNA, 20 bp, Artificial Sequence
  chemically synthesized
tgcctcggcctcacaaagtg

SEQ ID NO: 627810 - DNA, 20 bp, Artificial Sequence
  chemically synthesized
caggtgaatcaccttaggtg

SEQ ID NO: 627811 - DNA, 20 bp, Artificial Sequence
  chemically synthesized
ggtctcaaactcctcaccta

SEQ ID NO: 627812 - DNA, 20 bp, Artificial Sequence
  chemically synthesized
ttctgtatttttagtagaga

SEQ ID NO: 627813 - DNA, 20 bp, Artificial Sequence
  chemically synthesized
tgcctcagcctcccgagtag

SEQ ID NO: 627814 - DNA, 20 bp, Artificial Sequence
  chemically synthesized
tcgggaggctgaggcaggag

SEQ ID NO: 627815 - DNA, 20 bp, Artificial Sequence
  chemically synthesized
aacctccatcttccgggttc

SEQ ID NO: 627816 - DNA, 20 bp, Artificial Sequence
  chemically synthesized
aaaaaaaaaaaatctttaat

SEQ ID NO: 627817 - DNA, 20 bp, Artificial Sequence
  chemically synthesized
gaaaactacaaagcattgat

SEQ ID NO: 627818 - DNA, 20 bp, Artificial Sequence
  chemically synthesized
aaaatctttaatcaatgctt

SEQ ID NO: 627819 - DNA, 20 bp, Artificial Sequence
  chemically synthesized
atacagtgaaaactacaaag

SEQ ID NO: 627820 - DNA, 20 bp, Artificial Sequence
  chemically synthesized
cctgatgatactgtaaatga

SEQ ID NO: 627821 - DNA, 20 bp, Artificial Sequence
  chemically synthesized
tatccatgttgttgcaaatg

SEQ ID NO: 627822 - DNA, 20 bp, Artificial Sequence
  chemically synthesized
gtaatatttgtctttctgtg

SEQ ID NO: 627823 - DNA, 20 bp, Artificial Sequence
  chemically synthesized
tagataaaagaaataaattc

SEQ ID NO: 627824 - DNA, 20 bp, Artificial Sequence
  chemically synthesized
atatttcaaattgccagaag

SEQ ID NO: 627825 - DNA, 20 bp, Artificial Sequence
  chemically synthesized
gatgatggacatcctaatca

SEQ ID NO: 627826 - DNA, 20 bp, Artificial Sequence
  chemically synthesized
aatgtgtaatgatcgaatca

SEQ ID NO: 627827 - DNA, 20 bp, Artificial Sequence
  chemically synthesized
aaatcaataaaatgtttaga

SEQ ID NO: 627828 - DNA, 20 bp, Artificial Sequence
  chemically synthesized
aaagctaaatctaaacattt

SEQ ID NO: 627829 - DNA, 20 bp, Artificial Sequence
  chemically synthesized
aaaaggaaatcaataaaatg

SEQ ID NO: 627830 - DNA, 20 bp, Artificial Sequence
  chemically synthesized
ttttgaaaaggaaatcaata

SEQ ID NO: 627831 - DNA, 20 bp, Artificial Sequence
  chemically synthesized
ttccttttcaaaatgaaatc

SEQ ID NO: 627832 - DNA, 20 bp, Artificial Sequence
  chemically synthesized
ttttctctaaaaatgaaatc

SEQ ID NO: 627833 - DNA, 20 bp, Artificial Sequence
  chemically synthesized
aaatgctaccaatatttgta

SEQ ID NO: 627834 - DNA, 20 bp, Artificial Sequence
  chemically synthesized
tctagcaattttactgaatt

SEQ ID NO: 627835 - DNA, 20 bp, Artificial Sequence
  chemically synthesized
caaatttttaatgaaatcat

SEQ ID NO: 627836 - DNA, 20 bp, Artificial Sequence
  chemically synthesized
attctatatgtagaaagccc

SEQ ID NO: 627837 - DNA, 20 bp, Artificial Sequence
  chemically synthesized
aaattatctgtttgtagatg

SEQ ID NO: 627838 - DNA, 20 bp, Artificial Sequence
  chemically synthesized
ggaaaggaagaagtaaaatt

SEQ ID NO: 627839 - DNA, 20 bp, Artificial Sequence
  chemically synthesized
ctctaagatctggtacaatg

SEQ ID NO: 627840 - DNA, 20 bp, Artificial Sequence
  chemically synthesized
attgtaccagatcttagagg

SEQ ID NO: 627841 - DNA, 20 bp, Artificial Sequence
  chemically synthesized
taaccaacggggaaaaaatt

SEQ ID NO: 627842 - DNA, 20 bp, Artificial Sequence
  chemically synthesized
cgttggttacaatgttagct

SEQ ID NO: 627843 - DNA, 20 bp, Artificial Sequence
  chemically synthesized
cattctacacttattttgtt

SEQ ID NO: 627844 - DNA, 20 bp, Artificial Sequence
  chemically synthesized
atacatgttgaactttttca

SEQ ID NO: 627845 - DNA, 20 bp, Artificial Sequence
  chemically synthesized
catgtggttcttgtctttta

SEQ ID NO: 627846 - DNA, 20 bp, Artificial Sequence
  chemically synthesized
tccgtttatgtgatatatca

SEQ ID NO: 627847 - DNA, 20 bp, Artificial Sequence
  chemically synthesized
tttatgtgatatatcacatt

SEQ ID NO: 627848 - DNA, 20 bp, Artificial Sequence
  chemically synthesized
ggattatataccatgatcag

SEQ ID NO: 627849 - DNA, 20 bp, Artificial Sequence
  chemically synthesized
acaaattcaacagtacatca

SEQ ID NO: 627850 - DNA, 20 bp, Artificial Sequence
  chemically synthesized
tccttttgatgtactgttga

SEQ ID NO: 627851 - DNA, 20 bp, Artificial Sequence
  chemically synthesized
ttgttttgctagtattttat

SEQ ID NO: 627852 - DNA, 20 bp, Artificial Sequence
  chemically synthesized
cttttattgtggtatctttg

SEQ ID NO: 627853 - DNA, 20 bp, Artificial Sequence
  chemically synthesized
tttgcctggctttggtgcca

SEQ ID NO: 627854 - DNA, 20 bp, Artificial Sequence
  chemically synthesized
ggctttggtgccagtgtgat

SEQ ID NO: 627855 - DNA, 22 bp, Artificial Sequence
  chemically synthesized
cctacagtaacttgaggtttaa

SEQ ID NO: 627856 - DNA, 22 bp, Artificial Sequence
  chemically synthesized
aaacctcaagttactgtaggta

SEQ ID NO: 627857 - DNA, 22 bp, Artificial Sequence
  chemically synthesized
aacctcaagttactgtaggtaa

SEQ ID NO: 627858 - DNA, 22 bp, Artificial Sequence
  chemically synthesized
tgtacagaaaaggttacctaca

SEQ ID NO: 627859 - DNA, 22 bp, Artificial Sequence
  chemically synthesized
gtgtacagaaaaggttacctac

SEQ ID NO: 627860 - DNA, 22 bp, Artificial Sequence
  chemically synthesized
tgtgtacagaaaaggttaccta

SEQ ID NO: 627861 - DNA, 22 bp, Artificial Sequence
  chemically synthesized
ttgtgtacagaaaaggttacct

SEQ ID NO: 627862 - DNA, 22 bp, Artificial Sequence
  chemically synthesized
aagttactgtaggtaacctttt

SEQ ID NO: 627863 - DNA, 22 bp, Artificial Sequence
  chemically synthesized
ctgtaggtaaccttttctgtac

SEQ ID NO: 627864 - DNA, 22 bp, Artificial Sequence
  chemically synthesized
agagtagcttttgtgtacagaa

SEQ ID NO: 627865 - DNA, 22 bp, Artificial Sequence
  chemically synthesized
taggtaaccttttctgtacaca

SEQ ID NO: 627866 - DNA, 22 bp, Artificial Sequence
  chemically synthesized
gagagtagcttttgtgtacaga

SEQ ID NO: 627867 - DNA, 22 bp, Artificial Sequence
  chemically synthesized
tttgagagtagcttttgtgtac

SEQ ID NO: 627868 - DNA, 22 bp, Artificial Sequence
  chemically synthesized
gtttgagagtagcttttgtgta

SEQ ID NO: 627869 - DNA, 22 bp, Artificial Sequence
  chemically synthesized
ttctgtacacaaaagctactct

SEQ ID NO: 627870 - DNA, 22 bp, Artificial Sequence
  chemically synthesized
tctgtacacaaaagctactctc

SEQ ID NO: 627871 - DNA, 22 bp, Artificial Sequence
  chemically synthesized
ctgtacacaaaagctactctca

SEQ ID NO: 627872 - DNA, 22 bp, Artificial Sequence
  chemically synthesized
gggatgtttgtttgagagtagc

SEQ ID NO: 627873 - DNA, 22 bp, Artificial Sequence
  chemically synthesized
tgtacacaaaagctactctcaa

SEQ ID NO: 627874 - DNA, 22 bp, Artificial Sequence
  chemically synthesized
ggggatgtttgtttgagagtag

SEQ ID NO: 627875 - DNA, 22 bp, Artificial Sequence
  chemically synthesized
tacacaaaagctactctcaaac

SEQ ID NO: 627876 - DNA, 22 bp, Artificial Sequence
  chemically synthesized
ctctcaaacaaacatccccaaa

SEQ ID NO: 627877 - DNA, 22 bp, Artificial Sequence
  chemically synthesized
tcaaacaaacatccccaaactt

SEQ ID NO: 627878 - DNA, 22 bp, Artificial Sequence
  chemically synthesized
tgtgaatgtgtaaagtttgggg

SEQ ID NO: 627879 - DNA, 22 bp, Artificial Sequence
  chemically synthesized
aaacaaacatccccaaacttta

SEQ ID NO: 627880 - DNA, 22 bp, Artificial Sequence
  chemically synthesized
cataataaacaatattgtgtga

SEQ ID NO: 627881 - DNA, 22 bp, Artificial Sequence
  chemically synthesized
tacacattcacacaatattgtt

SEQ ID NO: 627882 - DNA, 22 bp, Artificial Sequence
  chemically synthesized
acacattcacacaatattgttt

SEQ ID NO: 627883 - DNA, 22 bp, Artificial Sequence
  chemically synthesized
cacattcacacaatattgttta

SEQ ID NO: 627884 - DNA, 22 bp, Artificial Sequence
  chemically synthesized
acacaatattgtttattatgga

SEQ ID NO: 627885 - DNA, 22 bp, Artificial Sequence
  chemically synthesized
tttattatggaatgttgggcat

SEQ ID NO: 627886 - DNA, 22 bp, Artificial Sequence
  chemically synthesized
attatggaatgttgggcatgct

SEQ ID NO: 627887 - DNA, 22 bp, Artificial Sequence
  chemically synthesized
ttatggaatgttgggcatgctg

SEQ ID NO: 627888 - DNA, 22 bp, Artificial Sequence
  chemically synthesized
tggaatgttgggcatgctgcca

SEQ ID NO: 627889 - DNA, 22 bp, Artificial Sequence
  chemically synthesized
acaacacaagagtggcagcatg

SEQ ID NO: 627890 - DNA, 22 bp, Artificial Sequence
  chemically synthesized
gctgacaacacaagagtggcag

SEQ ID NO: 627891 - DNA, 22 bp, Artificial Sequence
  chemically synthesized
agctgacaacacaagagtggca

SEQ ID NO: 627892 - DNA, 22 bp, Artificial Sequence
  chemically synthesized
ggcatgctgccactcttgtgtt

SEQ ID NO: 627893 - DNA, 22 bp, Artificial Sequence
  chemically synthesized
atggacttagctgacaacacaa

SEQ ID NO: 627894 - DNA, 22 bp, Artificial Sequence
  chemically synthesized
ccactcttgtgttgtcagctaa

SEQ ID NO: 627895 - DNA, 22 bp, Artificial Sequence
  chemically synthesized
tgatctcatggacttagctgac

SEQ ID NO: 627896 - DNA, 22 bp, Artificial Sequence
  chemically synthesized
ttgtgttgtcagctaagtccat

SEQ ID NO: 627897 - DNA, 22 bp, Artificial Sequence
  chemically synthesized
gtgttgtcagctaagtccatga

SEQ ID NO: 627898 - DNA, 22 bp, Artificial Sequence
  chemically synthesized
tgttgtcagctaagtccatgag

SEQ ID NO: 627899 - DNA, 22 bp, Artificial Sequence
  chemically synthesized
tcagctaagtccatgagatcac

SEQ ID NO: 627900 - DNA, 22 bp, Artificial Sequence
  chemically synthesized
cacgtcagtgtactgtgatctc

SEQ ID NO: 627901 - DNA, 22 bp, Artificial Sequence
  chemically synthesized
gcacgtcagtgtactgtgatct

SEQ ID NO: 627902 - DNA, 22 bp, Artificial Sequence
  chemically synthesized
agtccatgagatcacagtacac

SEQ ID NO: 627903 - DNA, 22 bp, Artificial Sequence
  chemically synthesized
aatgccccttgcacgtcagtgt

SEQ ID NO: 627904 - DNA, 22 bp, Artificial Sequence
  chemically synthesized
caatgccccttgcacgtcagtg

SEQ ID NO: 627905 - DNA, 22 bp, Artificial Sequence
  chemically synthesized
ttcaatgccccttgcacgtcag

SEQ ID NO: 627906 - DNA, 22 bp, Artificial Sequence
  chemically synthesized
taaatatgttcttcaatgcccc

SEQ ID NO: 627907 - DNA, 22 bp, Artificial Sequence
  chemically synthesized
acgtgcaaggggcattgaagaa

SEQ ID NO: 627908 - DNA, 22 bp, Artificial Sequence
  chemically synthesized
gagtaggaactataaatatgtt

SEQ ID NO: 627909 - DNA, 22 bp, Artificial Sequence
  chemically synthesized
aagaacatatttatagttccta

SEQ ID NO: 627910 - DNA, 22 bp, Artificial Sequence
  chemically synthesized
ccacagtagcaaagccattgga

SEQ ID NO: 627911 - DNA, 22 bp, Artificial Sequence
  chemically synthesized
atagttcctactccaatggctt

SEQ ID NO: 627912 - DNA, 22 bp, Artificial Sequence
  chemically synthesized
cccacagtagcaaagccattgg

SEQ ID NO: 627913 - DNA, 22 bp, Artificial Sequence
  chemically synthesized
tagttcctactccaatggcttt

SEQ ID NO: 627914 - DNA, 22 bp, Artificial Sequence
  chemically synthesized
tcccacagtagcaaagccattg

SEQ ID NO: 627915 - DNA, 22 bp, Artificial Sequence
  chemically synthesized
tttcccacagtagcaaagccat

SEQ ID NO: 627916 - DNA, 22 bp, Artificial Sequence
  chemically synthesized
ctactccaatggctttgctact

SEQ ID NO: 627917 - DNA, 22 bp, Artificial Sequence
  chemically synthesized
ctccaatggctttgctactgtg

SEQ ID NO: 627918 - DNA, 22 bp, Artificial Sequence
  chemically synthesized
caatggctttgctactgtggga

SEQ ID NO: 627919 - DNA, 22 bp, Artificial Sequence
  chemically synthesized
tgctactgtgggaaagaatttg

SEQ ID NO: 627920 - DNA, 22 bp, Artificial Sequence
  chemically synthesized
gctactgtgggaaagaatttga

SEQ ID NO: 627921 - DNA, 22 bp, Artificial Sequence
  chemically synthesized
ctactgtgggaaagaatttgat

SEQ ID NO: 627922 - DNA, 22 bp, Artificial Sequence
  chemically synthesized
ctgtgggaaagaatttgatttg

SEQ ID NO: 627923 - DNA, 22 bp, Artificial Sequence
  chemically synthesized
tgggaaagaatttgatttgtgt

SEQ ID NO: 627924 - DNA, 22 bp, Artificial Sequence
  chemically synthesized
agtgtaggaaggacacaaatca

SEQ ID NO: 627925 - DNA, 22 bp, Artificial Sequence
  chemically synthesized
aaattaagtgtaggaaggacac

SEQ ID NO: 627926 - DNA, 22 bp, Artificial Sequence
  chemically synthesized
caaattaagtgtaggaaggaca

SEQ ID NO: 627927 - DNA, 22 bp, Artificial Sequence
  chemically synthesized
ccttcaaattaagtgtaggaag

SEQ ID NO: 627928 - DNA, 22 bp, Artificial Sequence
  chemically synthesized
gccttcaaattaagtgtaggaa

SEQ ID NO: 627929 - DNA, 22 bp, Artificial Sequence
  chemically synthesized
gatttgtgtccttcctacactt

SEQ ID NO: 627930 - DNA, 22 bp, Artificial Sequence
  chemically synthesized
tgccttcaaattaagtgtagga

SEQ ID NO: 627931 - DNA, 22 bp, Artificial Sequence
  chemically synthesized
atttgtgtccttcctacactta

SEQ ID NO: 627932 - DNA, 22 bp, Artificial Sequence
  chemically synthesized
gtgtccttcctacacttaattt

SEQ ID NO: 627933 - DNA, 22 bp, Artificial Sequence
  chemically synthesized
tgtccttcctacacttaatttg

SEQ ID NO: 627934 - DNA, 22 bp, Artificial Sequence
  chemically synthesized
caaagactttgccttcaaatta

SEQ ID NO: 627935 - DNA, 22 bp, Artificial Sequence
  chemically synthesized
gcaaagactttgccttcaaatt

SEQ ID NO: 627936 - DNA, 22 bp, Artificial Sequence
  chemically synthesized
cctacacttaatttgaaggcaa

SEQ ID NO: 627937 - DNA, 22 bp, Artificial Sequence
  chemically synthesized
ctacacttaatttgaaggcaaa

SEQ ID NO: 627938 - DNA, 22 bp, Artificial Sequence
  chemically synthesized
cacttaatttgaaggcaaagtc

SEQ ID NO: 627939 - DNA, 22 bp, Artificial Sequence
  chemically synthesized
gcgcacttgcaaagactttgcc

SEQ ID NO: 627940 - DNA, 22 bp, Artificial Sequence
  chemically synthesized
aatttgaaggcaaagtctttgc

SEQ ID NO: 627941 - DNA, 22 bp, Artificial Sequence
  chemically synthesized
atttgaaggcaaagtctttgca

SEQ ID NO: 627942 - DNA, 22 bp, Artificial Sequence
  chemically synthesized
gaaggcaaagtctttgcaagtg

SEQ ID NO: 627943 - DNA, 22 bp, Artificial Sequence
  chemically synthesized
aaggcaaagtctttgcaagtgc

SEQ ID NO: 627944 - DNA, 22 bp, Artificial Sequence
  chemically synthesized
tgcaagtgcgccagtgcctgcc

SEQ ID NO: 627945 - DNA, 22 bp, Artificial Sequence
  chemically synthesized
gcaagtgcgccagtgcctgcct

SEQ ID NO: 627946 - DNA, 22 bp, Artificial Sequence
  chemically synthesized
caagtgcgccagtgcctgcctt

SEQ ID NO: 627947 - DNA, 22 bp, Artificial Sequence
  chemically synthesized
atggtggaatgaatacaaaggc

SEQ ID NO: 627948 - DNA, 22 bp, Artificial Sequence
  chemically synthesized
taatggtggaatgaatacaaag

SEQ ID NO: 627949 - DNA, 22 bp, Artificial Sequence
  chemically synthesized
taatgctctaatggtggaatga

SEQ ID NO: 627950 - DNA, 22 bp, Artificial Sequence
  chemically synthesized
gtaatgctctaatggtggaatg

SEQ ID NO: 627951 - DNA, 22 bp, Artificial Sequence
  chemically synthesized
cctttgtattcattccaccatt

SEQ ID NO: 627952 - DNA, 22 bp, Artificial Sequence
  chemically synthesized
aatttgtaatgctctaatggtg

SEQ ID NO: 627953 - DNA, 22 bp, Artificial Sequence
  chemically synthesized
tgtattcattccaccattagag

SEQ ID NO: 627954 - DNA, 22 bp, Artificial Sequence
  chemically synthesized
gtattcattccaccattagagc

SEQ ID NO: 627955 - DNA, 22 bp, Artificial Sequence
  chemically synthesized
tattcattccaccattagagca

SEQ ID NO: 627956 - DNA, 22 bp, Artificial Sequence
  chemically synthesized
cctgaatttgtaatgctctaat

SEQ ID NO: 627957 - DNA, 22 bp, Artificial Sequence
  chemically synthesized
ccctgaatttgtaatgctctaa

SEQ ID NO: 627958 - DNA, 22 bp, Artificial Sequence
  chemically synthesized
attccaccattagagcattaca

SEQ ID NO: 627959 - DNA, 22 bp, Artificial Sequence
  chemically synthesized
caccattagagcattacaaatt

SEQ ID NO: 627960 - DNA, 22 bp, Artificial Sequence
  chemically synthesized
cgatgggatttccctgaatttg

SEQ ID NO: 627961 - DNA, 22 bp, Artificial Sequence
  chemically synthesized
gagcattacaaattcagggaaa

SEQ ID NO: 627962 - DNA, 22 bp, Artificial Sequence
  chemically synthesized
tagagctgcgatgggatttccc

SEQ ID NO: 627963 - DNA, 22 bp, Artificial Sequence
  chemically synthesized
tgtagagctgcgatgggatttc

SEQ ID NO: 627964 - DNA, 22 bp, Artificial Sequence
  chemically synthesized
caaattcagggaaatcccatcg

SEQ ID NO: 627965 - DNA, 22 bp, Artificial Sequence
  chemically synthesized
agggaaatcccatcgcagctct

SEQ ID NO: 627966 - DNA, 22 bp, Artificial Sequence
  chemically synthesized
atggatgtgttctgtagagctg

SEQ ID NO: 627967 - DNA, 22 bp, Artificial Sequence
  chemically synthesized
tacagaacacatccattagtct

SEQ ID NO: 627968 - DNA, 22 bp, Artificial Sequence
  chemically synthesized
ggagaaagcaccaagactaatg

SEQ ID NO: 627969 - DNA, 22 bp, Artificial Sequence
  chemically synthesized
cagaacacatccattagtcttg

SEQ ID NO: 627970 - DNA, 22 bp, Artificial Sequence
  chemically synthesized
gggagaaagcaccaagactaat

SEQ ID NO: 627971 - DNA, 22 bp, Artificial Sequence
  chemically synthesized
tttgggagaaagcaccaagact

SEQ ID NO: 627972 - DNA, 22 bp, Artificial Sequence
  chemically synthesized
gtttgggagaaagcaccaagac

SEQ ID NO: 627973 - DNA, 22 bp, Artificial Sequence
  chemically synthesized
gtcttggtgctttctcccaaac

SEQ ID NO: 627974 - DNA, 22 bp, Artificial Sequence
  chemically synthesized
ggtgctttctcccaaacaaaca

SEQ ID NO: 627975 - DNA, 22 bp, Artificial Sequence
  chemically synthesized
gtgctttctcccaaacaaacac

SEQ ID NO: 627976 - DNA, 22 bp, Artificial Sequence
  chemically synthesized
tctcccaaacaaacacacattt

SEQ ID NO: 627977 - DNA, 22 bp, Artificial Sequence
  chemically synthesized
ctcccaaacaaacacacatttt

SEQ ID NO: 627978 - DNA, 22 bp, Artificial Sequence
  chemically synthesized
tcccaaacaaacacacattttg

SEQ ID NO: 627979 - DNA, 22 bp, Artificial Sequence
  chemically synthesized
tgcaccggcaagcaaaatgtgt

SEQ ID NO: 627980 - DNA, 22 bp, Artificial Sequence
  chemically synthesized
ccaaacaaacacacattttgct

SEQ ID NO: 627981 - DNA, 22 bp, Artificial Sequence
  chemically synthesized
gcacagattatgcaccggcaag

SEQ ID NO: 627982 - DNA, 22 bp, Artificial Sequence
  chemically synthesized
tgcttgccggtgcataatctgt

SEQ ID NO: 627983 - DNA, 22 bp, Artificial Sequence
  chemically synthesized
gcttgccggtgcataatctgtg

SEQ ID NO: 627984 - DNA, 22 bp, Artificial Sequence
  chemically synthesized
cttgccggtgcataatctgtgc

SEQ ID NO: 627985 - DNA, 22 bp, Artificial Sequence
  chemically synthesized
gccggtgcataatctgtgccag

SEQ ID NO: 627986 - DNA, 22 bp, Artificial Sequence
  chemically synthesized
aaatgaatcgagctggcacaga

SEQ ID NO: 627987 - DNA, 22 bp, Artificial Sequence
  chemically synthesized
ccggtgcataatctgtgccagc

SEQ ID NO: 627988 - DNA, 22 bp, Artificial Sequence
  chemically synthesized
aaaattaaaatgaatcgagctg

SEQ ID NO: 627989 - DNA, 22 bp, Artificial Sequence
  chemically synthesized
agttaaaaattaaaatgaatcg

SEQ ID NO: 627990 - DNA, 22 bp, Artificial Sequence
  chemically synthesized
tgccagctcgattcattttaat

SEQ ID NO: 627991 - DNA, 22 bp, Artificial Sequence
  chemically synthesized
attcagttaaaaattaaaatga

SEQ ID NO: 627992 - DNA, 22 bp, Artificial Sequence
  chemically synthesized
gattcattttaatttttaactg

SEQ ID NO: 627993 - DNA, 22 bp, Artificial Sequence
  chemically synthesized
attttaatttttaactgaatta

SEQ ID NO: 627994 - DNA, 22 bp, Artificial Sequence
  chemically synthesized
gaagagacagaattaattcagt

SEQ ID NO: 627995 - DNA, 22 bp, Artificial Sequence
  chemically synthesized
taatttttaactgaattaattc

SEQ ID NO: 627996 - DNA, 22 bp, Artificial Sequence
  chemically synthesized
aatttttaactgaattaattct

SEQ ID NO: 627997 - DNA, 22 bp, Artificial Sequence
  chemically synthesized
atttttaactgaattaattctg

SEQ ID NO: 627998 - DNA, 22 bp, Artificial Sequence
  chemically synthesized
ttaactgaattaattctgtctc

SEQ ID NO: 627999 - DNA, 22 bp, Artificial Sequence
  chemically synthesized
taactgaattaattctgtctct

SEQ ID NO: 628000 - DNA, 22 bp, Artificial Sequence
  chemically synthesized
gcacacactagaagagacagaa

SEQ ID NO: 628001 - DNA, 22 bp, Artificial Sequence
  chemically synthesized
aactgaattaattctgtctctt

SEQ ID NO: 628002 - DNA, 22 bp, Artificial Sequence
  chemically synthesized
ggcacacactagaagagacaga

SEQ ID NO: 628003 - DNA, 22 bp, Artificial Sequence
  chemically synthesized
actgaattaattctgtctcttc

SEQ ID NO: 628004 - DNA, 22 bp, Artificial Sequence
  chemically synthesized
aattaattctgtctcttctagt

SEQ ID NO: 628005 - DNA, 22 bp, Artificial Sequence
  chemically synthesized
catacttggcacacactagaag

SEQ ID NO: 628006 - DNA, 22 bp, Artificial Sequence
  chemically synthesized
attctgtctcttctagtgtgtg

SEQ ID NO: 628007 - DNA, 22 bp, Artificial Sequence
  chemically synthesized
cattccatacttggcacacact

SEQ ID NO: 628008 - DNA, 22 bp, Artificial Sequence
  chemically synthesized
ccattccatacttggcacacac

SEQ ID NO: 628009 - DNA, 22 bp, Artificial Sequence
  chemically synthesized
tgtctcttctagtgtgtgccaa

SEQ ID NO: 628010 - DNA, 22 bp, Artificial Sequence
  chemically synthesized
tccattccatacttggcacaca

SEQ ID NO: 628011 - DNA, 22 bp, Artificial Sequence
  chemically synthesized
tctcttctagtgtgtgccaagt

SEQ ID NO: 628012 - DNA, 22 bp, Artificial Sequence
  chemically synthesized
gttttccattccatacttggca

SEQ ID NO: 628013 - DNA, 22 bp, Artificial Sequence
  chemically synthesized
ggttttccattccatacttggc

SEQ ID NO: 628014 - DNA, 22 bp, Artificial Sequence
  chemically synthesized
ttctagtgtgtgccaagtatgg

SEQ ID NO: 628015 - DNA, 22 bp, Artificial Sequence
  chemically synthesized
ctagtgtgtgccaagtatggaa

SEQ ID NO: 628016 - DNA, 22 bp, Artificial Sequence
  chemically synthesized
tagtgtgtgccaagtatggaat

SEQ ID NO: 628017 - DNA, 22 bp, Artificial Sequence
  chemically synthesized
gtgtgtgccaagtatggaatgg

SEQ ID NO: 628018 - DNA, 22 bp, Artificial Sequence
  chemically synthesized
aggagggcatttggttttccat

SEQ ID NO: 628019 - DNA, 22 bp, Artificial Sequence
  chemically synthesized
tgaggagggcatttggttttcc

SEQ ID NO: 628020 - DNA, 22 bp, Artificial Sequence
  chemically synthesized
tgtgtggatgactctgaggagg

SEQ ID NO: 628021 - DNA, 22 bp, Artificial Sequence
  chemically synthesized
agacaactgtgtgtggatgact

SEQ ID NO: 628022 - DNA, 22 bp, Artificial Sequence
  chemically synthesized
ctcagagtcatccacacacagt

SEQ ID NO: 628023 - DNA, 22 bp, Artificial Sequence
  chemically synthesized
agagtcatccacacacagttgt

SEQ ID NO: 628024 - DNA, 22 bp, Artificial Sequence
  chemically synthesized
accacgtctaagacaactgtgt

SEQ ID NO: 628025 - DNA, 22 bp, Artificial Sequence
  chemically synthesized
caccacgtctaagacaactgtg

SEQ ID NO: 628026 - DNA, 22 bp, Artificial Sequence
  chemically synthesized
aatacttcaccacgtctaagac

SEQ ID NO: 628027 - DNA, 22 bp, Artificial Sequence
  chemically synthesized
caatacttcaccacgtctaaga

SEQ ID NO: 628028 - DNA, 22 bp, Artificial Sequence
  chemically synthesized
aggaatcttcaatacttcacca

SEQ ID NO: 628029 - DNA, 22 bp, Artificial Sequence
  chemically synthesized
tcttagacgtggtgaagtattg

SEQ ID NO: 628030 - DNA, 22 bp, Artificial Sequence
  chemically synthesized
agacgtggtgaagtattgaaga

SEQ ID NO: 628031 - DNA, 22 bp, Artificial Sequence
  chemically synthesized
gacgtggtgaagtattgaagat

SEQ ID NO: 628032 - DNA, 22 bp, Artificial Sequence
  chemically synthesized
aggaggtaactgaggaatcttc

SEQ ID NO: 628033 - DNA, 22 bp, Artificial Sequence
  chemically synthesized
aaggaggtaactgaggaatctt

SEQ ID NO: 628034 - DNA, 22 bp, Artificial Sequence
  chemically synthesized
gtgacacttaaggaggtaactg

SEQ ID NO: 628035 - DNA, 22 bp, Artificial Sequence
  chemically synthesized
ggtgacacttaaggaggtaact

SEQ ID NO: 628036 - DNA, 22 bp, Artificial Sequence
  chemically synthesized
tggtgacacttaaggaggtaac

SEQ ID NO: 628037 - DNA, 22 bp, Artificial Sequence
  chemically synthesized
aagattcctcagttacctcctt

SEQ ID NO: 628038 - DNA, 22 bp, Artificial Sequence
  chemically synthesized
ttttggtgacacttaaggaggt

SEQ ID NO: 628039 - DNA, 22 bp, Artificial Sequence
  chemically synthesized
gctgttttggtgacacttaagg

SEQ ID NO: 628040 - DNA, 22 bp, Artificial Sequence
  chemically synthesized
ctcagttacctccttaagtgtc

SEQ ID NO: 628041 - DNA, 22 bp, Artificial Sequence
  chemically synthesized
agttacctccttaagtgtcacc

SEQ ID NO: 628042 - DNA, 22 bp, Artificial Sequence
  chemically synthesized
cctccttaagtgtcaccaaaac

SEQ ID NO: 628043 - DNA, 22 bp, Artificial Sequence
  chemically synthesized
cttaagtgtcaccaaaacagcc

SEQ ID NO: 628044 - DNA, 22 bp, Artificial Sequence
  chemically synthesized
aaacacccagactggctgtttt

SEQ ID NO: 628045 - DNA, 22 bp, Artificial Sequence
  chemically synthesized
gaaacacccagactggctgttt

SEQ ID NO: 628046 - DNA, 22 bp, Artificial Sequence
  chemically synthesized
aagtgtcaccaaaacagccagt

SEQ ID NO: 628047 - DNA, 22 bp, Artificial Sequence
  chemically synthesized
agtgtcaccaaaacagccagtc

SEQ ID NO: 628048 - DNA, 22 bp, Artificial Sequence
  chemically synthesized
tttgaaacacccagactggctg

SEQ ID NO: 628049 - DNA, 22 bp, Artificial Sequence
  chemically synthesized
gtttgaaacacccagactggct

SEQ ID NO: 628050 - DNA, 22 bp, Artificial Sequence
  chemically synthesized
tgtttgaaacacccagactggc

SEQ ID NO: 628051 - DNA, 22 bp, Artificial Sequence
  chemically synthesized
cctttgtttgaaacacccagac

SEQ ID NO: 628052 - DNA, 22 bp, Artificial Sequence
  chemically synthesized
cccgaacctacctttgtttgaa

SEQ ID NO: 628053 - DNA, 22 bp, Artificial Sequence
  chemically synthesized
ggtgtttcaaacaaaggtaggt

SEQ ID NO: 628054 - DNA, 22 bp, Artificial Sequence
  chemically synthesized
ccaccattacccgaacctacct

SEQ ID NO: 628055 - DNA, 22 bp, Artificial Sequence
  chemically synthesized
cccaccattacccgaacctacc

SEQ ID NO: 628056 - DNA, 22 bp, Artificial Sequence
  chemically synthesized
caaacaaaggtaggttcgggta

SEQ ID NO: 628057 - DNA, 22 bp, Artificial Sequence
  chemically synthesized
aaacaaaggtaggttcgggtaa

SEQ ID NO: 628058 - DNA, 22 bp, Artificial Sequence
  chemically synthesized
tccttcccaccattacccgaac

SEQ ID NO: 628059 - DNA, 22 bp, Artificial Sequence
  chemically synthesized
atccttcccaccattacccgaa

SEQ ID NO: 628060 - DNA, 22 bp, Artificial Sequence
  chemically synthesized
gggtaatggtgggaaggataaa

SEQ ID NO: 628061 - DNA, 22 bp, Artificial Sequence
  chemically synthesized
aataaacaaatcatttatcctt

SEQ ID NO: 628062 - DNA, 22 bp, Artificial Sequence
  chemically synthesized
aaataaacaaatcatttatcct

SEQ ID NO: 628063 - DNA, 22 bp, Artificial Sequence
  chemically synthesized
tttaaataaacaaatcatttat

SEQ ID NO: 628064 - DNA, 22 bp, Artificial Sequence
  chemically synthesized
atcctatttaaataaacaaatc

SEQ ID NO: 628065 - DNA, 22 bp, Artificial Sequence
  chemically synthesized
catcctatttaaataaacaaat

SEQ ID NO: 628066 - DNA, 22 bp, Artificial Sequence
  chemically synthesized
tcatcctatttaaataaacaaa

SEQ ID NO: 628067 - DNA, 22 bp, Artificial Sequence
  chemically synthesized
gtttatttaaataggatgaaaa

SEQ ID NO: 628068 - DNA, 22 bp, Artificial Sequence
  chemically synthesized
tttatttaaataggatgaaaat

SEQ ID NO: 628069 - DNA, 22 bp, Artificial Sequence
  chemically synthesized
atttaaataggatgaaaatttt

SEQ ID NO: 628070 - DNA, 22 bp, Artificial Sequence
  chemically synthesized
tttaaataggatgaaaattttt

SEQ ID NO: 628071 - DNA, 22 bp, Artificial Sequence
  chemically synthesized
aaataggatgaaaatttttctt

SEQ ID NO: 628072 - DNA, 22 bp, Artificial Sequence
  chemically synthesized
aataggatgaaaatttttcttg

SEQ ID NO: 628073 - DNA, 22 bp, Artificial Sequence
  chemically synthesized
acatccacacataccaagaaaa

SEQ ID NO: 628074 - DNA, 22 bp, Artificial Sequence
  chemically synthesized
gacatccacacataccaagaaa

SEQ ID NO: 628075 - DNA, 22 bp, Artificial Sequence
  chemically synthesized
ccttgacatccacacataccaa

SEQ ID NO: 628076 - DNA, 22 bp, Artificial Sequence
  chemically synthesized
cccttgacatccacacatacca

SEQ ID NO: 628077 - DNA, 22 bp, Artificial Sequence
  chemically synthesized
ttcttggtatgtgtggatgtca

SEQ ID NO: 628078 - DNA, 22 bp, Artificial Sequence
  chemically synthesized
aaacacttcccttgacatccac

SEQ ID NO: 628079 - DNA, 22 bp, Artificial Sequence
  chemically synthesized
tcttggtatgtgtggatgtcaa

SEQ ID NO: 628080 - DNA, 22 bp, Artificial Sequence
  chemically synthesized
cttggtatgtgtggatgtcaag

SEQ ID NO: 628081 - DNA, 22 bp, Artificial Sequence
  chemically synthesized
ttggtatgtgtggatgtcaagg

SEQ ID NO: 628082 - DNA, 22 bp, Artificial Sequence
  chemically synthesized
ggtatgtgtggatgtcaaggga

SEQ ID NO: 628083 - DNA, 22 bp, Artificial Sequence
  chemically synthesized
gtatgtgtggatgtcaagggaa

SEQ ID NO: 628084 - DNA, 22 bp, Artificial Sequence
  chemically synthesized
ccacattgaaacacttcccttg

SEQ ID NO: 628085 - DNA, 22 bp, Artificial Sequence
  chemically synthesized
agtgactaccacattgaaacac

SEQ ID NO: 628086 - DNA, 22 bp, Artificial Sequence
  chemically synthesized
acctaagtgactaccacattga

SEQ ID NO: 628087 - DNA, 22 bp, Artificial Sequence
  chemically synthesized
caatgtggtagtcacttaggtc

SEQ ID NO: 628088 - DNA, 22 bp, Artificial Sequence
  chemically synthesized
aatgtggtagtcacttaggtca

SEQ ID NO: 628089 - DNA, 22 bp, Artificial Sequence
  chemically synthesized
aaagtagggtgatgatgctgac

SEQ ID NO: 628090 - DNA, 22 bp, Artificial Sequence
  chemically synthesized
gaaagtagggtgatgatgctga

SEQ ID NO: 628091 - DNA, 22 bp, Artificial Sequence
  chemically synthesized
tgaaagtagggtgatgatgctg

SEQ ID NO: 628092 - DNA, 22 bp, Artificial Sequence
  chemically synthesized
ttgaaagtagggtgatgatgct

SEQ ID NO: 628093 - DNA, 22 bp, Artificial Sequence
  chemically synthesized
tttgaaagtagggtgatgatgc

SEQ ID NO: 628094 - DNA, 22 bp, Artificial Sequence
  chemically synthesized
attttttgaaagtagggtgatg

SEQ ID NO: 628095 - DNA, 22 bp, Artificial Sequence
  chemically synthesized
aggtcagcatcatcaccctact

SEQ ID NO: 628096 - DNA, 22 bp, Artificial Sequence
  chemically synthesized
ggtcagcatcatcaccctactt

SEQ ID NO: 628097 - DNA, 22 bp, Artificial Sequence
  chemically synthesized
ctaattttttgaaagtagggtg

SEQ ID NO: 628098 - DNA, 22 bp, Artificial Sequence
  chemically synthesized
gctaattttttgaaagtagggt

SEQ ID NO: 628099 - DNA, 22 bp, Artificial Sequence
  chemically synthesized
tgaatcaatcacttgctaattt

SEQ ID NO: 628100 - DNA, 22 bp, Artificial Sequence
  chemically synthesized
ctgtgaatcaatcacttgctaa

SEQ ID NO: 628101 - DNA, 22 bp, Artificial Sequence
  chemically synthesized
ctttcaaaaaattagcaagtga

SEQ ID NO: 628102 - DNA, 22 bp, Artificial Sequence
  chemically synthesized
tgctgtgaatcaatcacttgct

SEQ ID NO: 628103 - DNA, 22 bp, Artificial Sequence
  chemically synthesized
tcaaaaaattagcaagtgattg

SEQ ID NO: 628104 - DNA, 22 bp, Artificial Sequence
  chemically synthesized
caaaaaattagcaagtgattga

SEQ ID NO: 628105 - DNA, 22 bp, Artificial Sequence
  chemically synthesized
aaaaaattagcaagtgattgat

SEQ ID NO: 628106 - DNA, 22 bp, Artificial Sequence
  chemically synthesized
gcaagtgattgattcacagcag

SEQ ID NO: 628107 - DNA, 22 bp, Artificial Sequence
  chemically synthesized
gtagatgtggcatctctgctgt

SEQ ID NO: 628108 - DNA, 22 bp, Artificial Sequence
  chemically synthesized
ttagtagatgtggcatctctgc

SEQ ID NO: 628109 - DNA, 22 bp, Artificial Sequence
  chemically synthesized
gttagtagatgtggcatctctg

SEQ ID NO: 628110 - DNA, 22 bp, Artificial Sequence
  chemically synthesized
attcacagcagagatgccacat

SEQ ID NO: 628111 - DNA, 22 bp, Artificial Sequence
  chemically synthesized
acagcagagatgccacatctac

SEQ ID NO: 628112 - DNA, 22 bp, Artificial Sequence
  chemically synthesized
gaaatgatgtttgttagtagat

SEQ ID NO: 628113 - DNA, 22 bp, Artificial Sequence
  chemically synthesized
attagaaatgatgtttgttagt

SEQ ID NO: 628114 - DNA, 22 bp, Artificial Sequence
  chemically synthesized
ctaacaaacatcatttctaatg

SEQ ID NO: 628115 - DNA, 22 bp, Artificial Sequence
  chemically synthesized
acaaacatcatttctaatgaga

SEQ ID NO: 628116 - DNA, 22 bp, Artificial Sequence
  chemically synthesized
ctaatgagatggatcatctcat

SEQ ID NO: 628117 - DNA, 22 bp, Artificial Sequence
  chemically synthesized
taatgagatggatcatctcatc

SEQ ID NO: 628118 - DNA, 22 bp, Artificial Sequence
  chemically synthesized
gaaataataggagatgagatga

SEQ ID NO: 628119 - DNA, 22 bp, Artificial Sequence
  chemically synthesized
ggaaataataggagatgagatg

SEQ ID NO: 628120 - DNA, 22 bp, Artificial Sequence
  chemically synthesized
atgagatggatcatctcatctc

SEQ ID NO: 628121 - DNA, 22 bp, Artificial Sequence
  chemically synthesized
tggaaataataggagatgagat

SEQ ID NO: 628122 - DNA, 22 bp, Artificial Sequence
  chemically synthesized
gtgattttggaaataataggag

SEQ ID NO: 628123 - DNA, 22 bp, Artificial Sequence
  chemically synthesized
tcctagtgattttggaaataat

SEQ ID NO: 628124 - DNA, 22 bp, Artificial Sequence
  chemically synthesized
atctcctattatttccaaaatc

SEQ ID NO: 628125 - DNA, 22 bp, Artificial Sequence
  chemically synthesized
ctattatttccaaaatcactag

SEQ ID NO: 628126 - DNA, 22 bp, Artificial Sequence
  chemically synthesized
ttatttccaaaatcactaggat

SEQ ID NO: 628127 - DNA, 22 bp, Artificial Sequence
  chemically synthesized
tttccaaaatcactaggatagg

SEQ ID NO: 628128 - DNA, 22 bp, Artificial Sequence
  chemically synthesized
ccaaaatcactaggataggctg

SEQ ID NO: 628129 - DNA, 22 bp, Artificial Sequence
  chemically synthesized
caaaatcactaggataggctgc

SEQ ID NO: 628130 - DNA, 22 bp, Artificial Sequence
  chemically synthesized
ggataggctgcacctggtggac

SEQ ID NO: 628131 - DNA, 22 bp, Artificial Sequence
  chemically synthesized
cacctggtggacttatgttatt

SEQ ID NO: 628132 - DNA, 22 bp, Artificial Sequence
  chemically synthesized
gtgagccaaaggaataacataa

SEQ ID NO: 628133 - DNA, 22 bp, Artificial Sequence
  chemically synthesized
gtggacttatgttattcctttg

SEQ ID NO: 628134 - DNA, 22 bp, Artificial Sequence
  chemically synthesized
agatactggtgagccaaaggaa

SEQ ID NO: 628135 - DNA, 22 bp, Artificial Sequence
  chemically synthesized
atgttattcctttggctcacca

SEQ ID NO: 628136 - DNA, 22 bp, Artificial Sequence
  chemically synthesized
tgttattcctttggctcaccag

SEQ ID NO: 628137 - DNA, 22 bp, Artificial Sequence
  chemically synthesized
ttcctttggctcaccagtatct

SEQ ID NO: 628138 - DNA, 22 bp, Artificial Sequence
  chemically synthesized
cccaacagtgttcagatactgg

SEQ ID NO: 628139 - DNA, 22 bp, Artificial Sequence
  chemically synthesized
ctttggctcaccagtatctgaa

SEQ ID NO: 628140 - DNA, 22 bp, Artificial Sequence
  chemically synthesized
tggctcaccagtatctgaacac

SEQ ID NO: 628141 - DNA, 22 bp, Artificial Sequence
  chemically synthesized
ggctcaccagtatctgaacact

SEQ ID NO: 628142 - DNA, 22 bp, Artificial Sequence
  chemically synthesized
gctcaccagtatctgaacactg

SEQ ID NO: 628143 - DNA, 22 bp, Artificial Sequence
  chemically synthesized
accagtatctgaacactgttgg

SEQ ID NO: 628144 - DNA, 22 bp, Artificial Sequence
  chemically synthesized
aacactgttggggaaccccgcc

SEQ ID NO: 628145 - DNA, 22 bp, Artificial Sequence
  chemically synthesized
atggatggggtgggcggggttc

SEQ ID NO: 628146 - DNA, 22 bp, Artificial Sequence
  chemically synthesized
ttggggaaccccgcccacccca

SEQ ID NO: 628147 - DNA, 22 bp, Artificial Sequence
  chemically synthesized
ccaaggttcatggatggggtgg

SEQ ID NO: 628148 - DNA, 22 bp, Artificial Sequence
  chemically synthesized
gggaaccccgcccaccccatcc

SEQ ID NO: 628149 - DNA, 22 bp, Artificial Sequence
  chemically synthesized
ttcccaaggttcatggatgggg

SEQ ID NO: 628150 - DNA, 22 bp, Artificial Sequence
  chemically synthesized
cctattcccaaggttcatggat

SEQ ID NO: 628151 - DNA, 22 bp, Artificial Sequence
  chemically synthesized
acctattcccaaggttcatgga

SEQ ID NO: 628152 - DNA, 22 bp, Artificial Sequence
  chemically synthesized
tacctattcccaaggttcatgg

SEQ ID NO: 628153 - DNA, 22 bp, Artificial Sequence
  chemically synthesized
tctttacctattcccaaggttc

SEQ ID NO: 628154 - DNA, 22 bp, Artificial Sequence
  chemically synthesized
tctatctttacctattcccaag

SEQ ID NO: 628155 - DNA, 22 bp, Artificial Sequence
  chemically synthesized
gggagaggctatctatctttac

SEQ ID NO: 628156 - DNA, 22 bp, Artificial Sequence
  chemically synthesized
agggagaggctatctatcttta

SEQ ID NO: 628157 - DNA, 22 bp, Artificial Sequence
  chemically synthesized
ttagggagaggctatctatctt

SEQ ID NO: 628158 - DNA, 22 bp, Artificial Sequence
  chemically synthesized
gggaataggtaaagatagatag

SEQ ID NO: 628159 - DNA, 22 bp, Artificial Sequence
  chemically synthesized
cttagggagaggctatctatct

SEQ ID NO: 628160 - DNA, 22 bp, Artificial Sequence
  chemically synthesized
ggaataggtaaagatagatagc

SEQ ID NO: 628161 - DNA, 22 bp, Artificial Sequence
  chemically synthesized
tccctaagaagtgctgacattg

SEQ ID NO: 628162 - DNA, 22 bp, Artificial Sequence
  chemically synthesized
agaaagtgggtagcaatgtcag

SEQ ID NO: 628163 - DNA, 22 bp, Artificial Sequence
  chemically synthesized
cctaagaagtgctgacattgct

SEQ ID NO: 628164 - DNA, 22 bp, Artificial Sequence
  chemically synthesized
agaagtgctgacattgctaccc

SEQ ID NO: 628165 - DNA, 22 bp, Artificial Sequence
  chemically synthesized
caaaggaagctgagaaagtggg

SEQ ID NO: 628166 - DNA, 22 bp, Artificial Sequence
  chemically synthesized
acattgctacccactttctcag

SEQ ID NO: 628167 - DNA, 22 bp, Artificial Sequence
  chemically synthesized
gctgcaaaggaagctgagaaag

SEQ ID NO: 628168 - DNA, 22 bp, Artificial Sequence
  chemically synthesized
ctacccactttctcagcttcct

SEQ ID NO: 628169 - DNA, 22 bp, Artificial Sequence
  chemically synthesized
ccctagctgcaaaggaagctga

SEQ ID NO: 628170 - DNA, 22 bp, Artificial Sequence
  chemically synthesized
gccctagctgcaaaggaagctg

SEQ ID NO: 628171 - DNA, 22 bp, Artificial Sequence
  chemically synthesized
cccactttctcagcttcctttg

SEQ ID NO: 628172 - DNA, 22 bp, Artificial Sequence
  chemically synthesized
ttgccctagctgcaaaggaagc

SEQ ID NO: 628173 - DNA, 22 bp, Artificial Sequence
  chemically synthesized
cttgccctagctgcaaaggaag

SEQ ID NO: 628174 - DNA, 22 bp, Artificial Sequence
  chemically synthesized
tttcttgccctagctgcaaagg

SEQ ID NO: 628175 - DNA, 22 bp, Artificial Sequence
  chemically synthesized
tgtttcttgccctagctgcaaa

SEQ ID NO: 628176 - DNA, 22 bp, Artificial Sequence
  chemically synthesized
tctcagcttcctttgcagctag

SEQ ID NO: 628177 - DNA, 22 bp, Artificial Sequence
  chemically synthesized
ctcagcttcctttgcagctagg

SEQ ID NO: 628178 - DNA, 22 bp, Artificial Sequence
  chemically synthesized
tcagcttcctttgcagctaggg

SEQ ID NO: 628179 - DNA, 22 bp, Artificial Sequence
  chemically synthesized
ctctgtttcttgccctagctgc

SEQ ID NO: 628180 - DNA, 22 bp, Artificial Sequence
  chemically synthesized
agcttcctttgcagctagggca

SEQ ID NO: 628181 - DNA, 22 bp, Artificial Sequence
  chemically synthesized
ccctgctctgtttcttgcccta

SEQ ID NO: 628182 - DNA, 22 bp, Artificial Sequence
  chemically synthesized
cctttgcagctagggcaagaaa

SEQ ID NO: 628183 - DNA, 22 bp, Artificial Sequence
  chemically synthesized
ctttgcagctagggcaagaaac

SEQ ID NO: 628184 - DNA, 22 bp, Artificial Sequence
  chemically synthesized
tgcagctagggcaagaaacaga

SEQ ID NO: 628185 - DNA, 22 bp, Artificial Sequence
  chemically synthesized
cccctgccctgctctgtttctt

SEQ ID NO: 628186 - DNA, 22 bp, Artificial Sequence
  chemically synthesized
gcagctagggcaagaaacagag

SEQ ID NO: 628187 - DNA, 22 bp, Artificial Sequence
  chemically synthesized
gcccctgccctgctctgtttct

SEQ ID NO: 628188 - DNA, 22 bp, Artificial Sequence
  chemically synthesized
cagctagggcaagaaacagagc

SEQ ID NO: 628189 - DNA, 22 bp, Artificial Sequence
  chemically synthesized
tgcccctgccctgctctgtttc

SEQ ID NO: 628190 - DNA, 22 bp, Artificial Sequence
  chemically synthesized
ctttgcccctgccctgctctgt

SEQ ID NO: 628191 - DNA, 22 bp, Artificial Sequence
  chemically synthesized
tcctttgcccctgccctgctct

SEQ ID NO: 628192 - DNA, 22 bp, Artificial Sequence
  chemically synthesized
gggcaagaaacagagcagggca

SEQ ID NO: 628193 - DNA, 22 bp, Artificial Sequence
  chemically synthesized
ccatagtcaaccaccaccatgg

SEQ ID NO: 628194 - DNA, 22 bp, Artificial Sequence
  chemically synthesized
accatagtcaaccaccaccatg

SEQ ID NO: 628195 - DNA, 22 bp, Artificial Sequence
  chemically synthesized
tccccatggtggtggttgacta

SEQ ID NO: 628196 - DNA, 22 bp, Artificial Sequence
  chemically synthesized
cccatggtggtggttgactatg

SEQ ID NO: 628197 - DNA, 22 bp, Artificial Sequence
  chemically synthesized
gggaagaagaatcccttaccat

SEQ ID NO: 628198 - DNA, 22 bp, Artificial Sequence
  chemically synthesized
tggggaagaagaatcccttacc

SEQ ID NO: 628199 - DNA, 22 bp, Artificial Sequence
  chemically synthesized
gttctggggaagaagaatccct

SEQ ID NO: 628200 - DNA, 22 bp, Artificial Sequence
  chemically synthesized
actatggtaagggattcttctt

SEQ ID NO: 628201 - DNA, 22 bp, Artificial Sequence
  chemically synthesized
tggtaagggattcttcttcccc

SEQ ID NO: 628202 - DNA, 22 bp, Artificial Sequence
  chemically synthesized
acaactggttctggggaagaag

SEQ ID NO: 628203 - DNA, 22 bp, Artificial Sequence
  chemically synthesized
aaatgatgtctcacaactggtt

SEQ ID NO: 628204 - DNA, 22 bp, Artificial Sequence
  chemically synthesized
ttcttccccagaaccagttgtg

SEQ ID NO: 628205 - DNA, 22 bp, Artificial Sequence
  chemically synthesized
cttccccagaaccagttgtgag

SEQ ID NO: 628206 - DNA, 22 bp, Artificial Sequence
  chemically synthesized
ttccccagaaccagttgtgaga

SEQ ID NO: 628207 - DNA, 22 bp, Artificial Sequence
  chemically synthesized
ccccagaaccagttgtgagaca

SEQ ID NO: 628208 - DNA, 22 bp, Artificial Sequence
  chemically synthesized
cccagaaccagttgtgagacat

SEQ ID NO: 628209 - DNA, 22 bp, Artificial Sequence
  chemically synthesized
tgagacatcattttaggtgtct

SEQ ID NO: 628210 - DNA, 22 bp, Artificial Sequence
  chemically synthesized
taggtgtctctttcttactact

SEQ ID NO: 628211 - DNA, 22 bp, Artificial Sequence
  chemically synthesized
aggtgtctctttcttactactc

SEQ ID NO: 628212 - DNA, 22 bp, Artificial Sequence
  chemically synthesized
ggtgtctctttcttactactca

SEQ ID NO: 628213 - DNA, 22 bp, Artificial Sequence
  chemically synthesized
agaggatgcatgagtgagtagt

SEQ ID NO: 628214 - DNA, 22 bp, Artificial Sequence
  chemically synthesized
tttcttactactcactcatgca

SEQ ID NO: 628215 - DNA, 22 bp, Artificial Sequence
  chemically synthesized
tcttactactcactcatgcatc

SEQ ID NO: 628216 - DNA, 22 bp, Artificial Sequence
  chemically synthesized
cttactactcactcatgcatcc

SEQ ID NO: 628217 - DNA, 22 bp, Artificial Sequence
  chemically synthesized
ttactactcactcatgcatcct

SEQ ID NO: 628218 - DNA, 22 bp, Artificial Sequence
  chemically synthesized
actactcactcatgcatcctct

SEQ ID NO: 628219 - DNA, 22 bp, Artificial Sequence
  chemically synthesized
ctactcactcatgcatcctctt

SEQ ID NO: 628220 - DNA, 22 bp, Artificial Sequence
  chemically synthesized
atgtcaccatctaagaggatgc

SEQ ID NO: 628221 - DNA, 22 bp, Artificial Sequence
  chemically synthesized
aatgtcaccatctaagaggatg

SEQ ID NO: 628222 - DNA, 22 bp, Artificial Sequence
  chemically synthesized
ctcactcatgcatcctcttaga

SEQ ID NO: 628223 - DNA, 22 bp, Artificial Sequence
  chemically synthesized
ttaatgtcaccatctaagagga

SEQ ID NO: 628224 - DNA, 22 bp, Artificial Sequence
  chemically synthesized
actcatgcatcctcttagatgg

SEQ ID NO: 628225 - DNA, 22 bp, Artificial Sequence
  chemically synthesized
ttcttaatgtcaccatctaaga

SEQ ID NO: 628226 - DNA, 22 bp, Artificial Sequence
  chemically synthesized
tattcttaatgtcaccatctaa

SEQ ID NO: 628227 - DNA, 22 bp, Artificial Sequence
  chemically synthesized
ctattcttaatgtcaccatcta

SEQ ID NO: 628228 - DNA, 22 bp, Artificial Sequence
  chemically synthesized
atgcatcctcttagatggtgac

SEQ ID NO: 628229 - DNA, 22 bp, Artificial Sequence
  chemically synthesized
atatcacttctattcttaatgt

SEQ ID NO: 628230 - DNA, 22 bp, Artificial Sequence
  chemically synthesized
catatcacttctattcttaatg

SEQ ID NO: 628231 - DNA, 22 bp, Artificial Sequence
  chemically synthesized
ttagatggtgacattaagaata

SEQ ID NO: 628232 - DNA, 22 bp, Artificial Sequence
  chemically synthesized
agatggtgacattaagaataga

SEQ ID NO: 628233 - DNA, 22 bp, Artificial Sequence
  chemically synthesized
gatggtgacattaagaatagaa

SEQ ID NO: 628234 - DNA, 22 bp, Artificial Sequence
  chemically synthesized
aagagaatttcatatcacttct

SEQ ID NO: 628235 - DNA, 22 bp, Artificial Sequence
  chemically synthesized
tcaagagaatttcatatcactt

SEQ ID NO: 628236 - DNA, 22 bp, Artificial Sequence
  chemically synthesized
ctcaagagaatttcatatcact

SEQ ID NO: 628237 - DNA, 22 bp, Artificial Sequence
  chemically synthesized
cttctcaagagaatttcatatc

SEQ ID NO: 628238 - DNA, 22 bp, Artificial Sequence
  chemically synthesized
agaatagaagtgatatgaaatt

SEQ ID NO: 628239 - DNA, 22 bp, Artificial Sequence
  chemically synthesized
gcttctcaagagaatttcatat

SEQ ID NO: 628240 - DNA, 22 bp, Artificial Sequence
  chemically synthesized
tgcttctcaagagaatttcata

SEQ ID NO: 628241 - DNA, 22 bp, Artificial Sequence
  chemically synthesized
atactttgcttctcaagagaat

SEQ ID NO: 628242 - DNA, 22 bp, Artificial Sequence
  chemically synthesized
cagttcatactttgcttctcaa

SEQ ID NO: 628243 - DNA, 22 bp, Artificial Sequence
  chemically synthesized
gcagttcatactttgcttctca

SEQ ID NO: 628244 - DNA, 22 bp, Artificial Sequence
  chemically synthesized
tcttgagaagcaaagtatgaac

SEQ ID NO: 628245 - DNA, 22 bp, Artificial Sequence
  chemically synthesized
agtcagtttgcagttcatactt

SEQ ID NO: 628246 - DNA, 22 bp, Artificial Sequence
  chemically synthesized
ttgagaagcaaagtatgaactg

SEQ ID NO: 628247 - DNA, 22 bp, Artificial Sequence
  chemically synthesized
gagaagcaaagtatgaactgca

SEQ ID NO: 628248 - DNA, 22 bp, Artificial Sequence
  chemically synthesized
attaagtcagtttgcagttcat

SEQ ID NO: 628249 - DNA, 22 bp, Artificial Sequence
  chemically synthesized
agaagcaaagtatgaactgcaa

SEQ ID NO: 628250 - DNA, 22 bp, Artificial Sequence
  chemically synthesized
ataatgacaagtatattaatta

SEQ ID NO: 628251 - DNA, 22 bp, Artificial Sequence
  chemically synthesized
aataatgacaagtatattaatt

SEQ ID NO: 628252 - DNA, 22 bp, Artificial Sequence
  chemically synthesized
caaactgacttaattaatatac

SEQ ID NO: 628253 - DNA, 22 bp, Artificial Sequence
  chemically synthesized
taataatgacaagtatattaat

SEQ ID NO: 628254 - DNA, 22 bp, Artificial Sequence
  chemically synthesized
ttttaataatgacaagtatatt

SEQ ID NO: 628255 - DNA, 22 bp, Artificial Sequence
  chemically synthesized
gttttaataatgacaagtatat

SEQ ID NO: 628256 - DNA, 22 bp, Artificial Sequence
  chemically synthesized
tgttttaataatgacaagtata

SEQ ID NO: 628257 - DNA, 22 bp, Artificial Sequence
  chemically synthesized
ttgttttaataatgacaagtat

SEQ ID NO: 628258 - DNA, 22 bp, Artificial Sequence
  chemically synthesized
acttaattaatatacttgtcat

SEQ ID NO: 628259 - DNA, 22 bp, Artificial Sequence
  chemically synthesized
tttgttttaataatgacaagta

SEQ ID NO: 628260 - DNA, 22 bp, Artificial Sequence
  chemically synthesized
aattaatatacttgtcattatt

SEQ ID NO: 628261 - DNA, 22 bp, Artificial Sequence
  chemically synthesized
attaatatacttgtcattatta

SEQ ID NO: 628262 - DNA, 22 bp, Artificial Sequence
  chemically synthesized
tgttttttgttttaataatgac

SEQ ID NO: 628263 - DNA, 22 bp, Artificial Sequence
  chemically synthesized
ttgtgttttttgttttaataat

SEQ ID NO: 628264 - DNA, 22 bp, Artificial Sequence
  chemically synthesized
atatacttgtcattattaaaac

SEQ ID NO: 628265 - DNA, 22 bp, Artificial Sequence
  chemically synthesized
gttgtgttttttgttttaataa

SEQ ID NO: 628266 - DNA, 22 bp, Artificial Sequence
  chemically synthesized
tttgttgtgttttttgttttaa

SEQ ID NO: 628267 - DNA, 22 bp, Artificial Sequence
  chemically synthesized
gtttgttgtgttttttgtttta

SEQ ID NO: 628268 - DNA, 22 bp, Artificial Sequence
  chemically synthesized
tttgtttgttgtgttttttgtt

SEQ ID NO: 628269 - DNA, 22 bp, Artificial Sequence
  chemically synthesized
gtcattattaaaacaaaaaaca

SEQ ID NO: 628270 - DNA, 22 bp, Artificial Sequence
  chemically synthesized
gtttgtttgttgtgttttttgt

SEQ ID NO: 628271 - DNA, 22 bp, Artificial Sequence
  chemically synthesized
tcattattaaaacaaaaaacac

SEQ ID NO: 628272 - DNA, 22 bp, Artificial Sequence
  chemically synthesized
ttaaaacaaaaaacacaacaaa

SEQ ID NO: 628273 - DNA, 22 bp, Artificial Sequence
  chemically synthesized
aaacaaaaaacacaacaaacaa

SEQ ID NO: 628274 - DNA, 22 bp, Artificial Sequence
  chemically synthesized
atagtcatagtgtttgtttgtt

SEQ ID NO: 628275 - DNA, 22 bp, Artificial Sequence
  chemically synthesized
attgatagtcatagtgtttgtt

SEQ ID NO: 628276 - DNA, 22 bp, Artificial Sequence
  chemically synthesized
attgattgatagtcatagtgtt

SEQ ID NO: 628277 - DNA, 22 bp, Artificial Sequence
  chemically synthesized
tgcagtgattgattgattgata

SEQ ID NO: 628278 - DNA, 22 bp, Artificial Sequence
  chemically synthesized
gtgcagtgattgattgattgat

SEQ ID NO: 628279 - DNA, 22 bp, Artificial Sequence
  chemically synthesized
tgtgcagtgattgattgattga

SEQ ID NO: 628280 - DNA, 22 bp, Artificial Sequence
  chemically synthesized
tgactatcaatcaatcaatcac

SEQ ID NO: 628281 - DNA, 22 bp, Artificial Sequence
  chemically synthesized
tcaatcaatcaatcactgcaca

SEQ ID NO: 628282 - DNA, 22 bp, Artificial Sequence
  chemically synthesized
ggagatgatacattttgtgcag

SEQ ID NO: 628283 - DNA, 22 bp, Artificial Sequence
  chemically synthesized
tagactgggagatgatacattt

SEQ ID NO: 628284 - DNA, 22 bp, Artificial Sequence
  chemically synthesized
gtagactgggagatgatacatt

SEQ ID NO: 628285 - DNA, 22 bp, Artificial Sequence
  chemically synthesized
cacaaaatgtatcatctcccag

SEQ ID NO: 628286 - DNA, 22 bp, Artificial Sequence
  chemically synthesized
gatcaaagggggtaagcatttg

SEQ ID NO: 628287 - DNA, 22 bp, Artificial Sequence
  chemically synthesized
ctggatcaaagggggtaagcat

SEQ ID NO: 628288 - DNA, 22 bp, Artificial Sequence
  chemically synthesized
ccagtctacaaatgcttacccc

SEQ ID NO: 628289 - DNA, 22 bp, Artificial Sequence
  chemically synthesized
caaatgcttaccccctttgatc

SEQ ID NO: 628290 - DNA, 22 bp, Artificial Sequence
  chemically synthesized
gaagtgagattgctggatcaaa

SEQ ID NO: 628291 - DNA, 22 bp, Artificial Sequence
  chemically synthesized
ctagaagtgagattgctggatc

SEQ ID NO: 628292 - DNA, 22 bp, Artificial Sequence
  chemically synthesized
cctagaagtgagattgctggat

SEQ ID NO: 628293 - DNA, 22 bp, Artificial Sequence
  chemically synthesized
accccctttgatccagcaatct

SEQ ID NO: 628294 - DNA, 22 bp, Artificial Sequence
  chemically synthesized
ccccctttgatccagcaatctc

SEQ ID NO: 628295 - DNA, 22 bp, Artificial Sequence
  chemically synthesized
tgatccagcaatctcacttcta

SEQ ID NO: 628296 - DNA, 22 bp, Artificial Sequence
  chemically synthesized
tgggatacttcctagaagtgag

SEQ ID NO: 628297 - DNA, 22 bp, Artificial Sequence
  chemically synthesized
gatccagcaatctcacttctag

SEQ ID NO: 628298 - DNA, 22 bp, Artificial Sequence
  chemically synthesized
atccagcaatctcacttctagg

SEQ ID NO: 628299 - DNA, 22 bp, Artificial Sequence
  chemically synthesized
acttctaggaagtatcccacag

SEQ ID NO: 628300 - DNA, 22 bp, Artificial Sequence
  chemically synthesized
ctaggaagtatcccacagattt

SEQ ID NO: 628301 - DNA, 22 bp, Artificial Sequence
  chemically synthesized
taggaagtatcccacagatttg

SEQ ID NO: 628302 - DNA, 22 bp, Artificial Sequence
  chemically synthesized
tgcataaacaaacaaatctgtg

SEQ ID NO: 628303 - DNA, 22 bp, Artificial Sequence
  chemically synthesized
gtgcataaacaaacaaatctgt

SEQ ID NO: 628304 - DNA, 22 bp, Artificial Sequence
  chemically synthesized
ggaagtatcccacagatttgtt

SEQ ID NO: 628305 - DNA, 22 bp, Artificial Sequence
  chemically synthesized
atttgtgcataaacaaacaaat

SEQ ID NO: 628306 - DNA, 22 bp, Artificial Sequence
  chemically synthesized
catttgtgcataaacaaacaaa

SEQ ID NO: 628307 - DNA, 22 bp, Artificial Sequence
  chemically synthesized
catcatttcatttgtgcataaa

SEQ ID NO: 628308 - DNA, 22 bp, Artificial Sequence
  chemically synthesized
attacatcatttcatttgtgca

SEQ ID NO: 628309 - DNA, 22 bp, Artificial Sequence
  chemically synthesized
tcattacatcatttcatttgtg

SEQ ID NO: 628310 - DNA, 22 bp, Artificial Sequence
  chemically synthesized
gtttgtttatgcacaaatgaaa

SEQ ID NO: 628311 - DNA, 22 bp, Artificial Sequence
  chemically synthesized
ctcattacatcatttcatttgt

SEQ ID NO: 628312 - DNA, 22 bp, Artificial Sequence
  chemically synthesized
tttgtttatgcacaaatgaaat

SEQ ID NO: 628313 - DNA, 22 bp, Artificial Sequence
  chemically synthesized
gtttatgcacaaatgaaatgat

SEQ ID NO: 628314 - DNA, 22 bp, Artificial Sequence
  chemically synthesized
tttatgcacaaatgaaatgatg

SEQ ID NO: 628315 - DNA, 22 bp, Artificial Sequence
  chemically synthesized
cacatttctcattacatcattt

SEQ ID NO: 628316 - DNA, 22 bp, Artificial Sequence
  chemically synthesized
atgcacaaatgaaatgatgtaa

SEQ ID NO: 628317 - DNA, 22 bp, Artificial Sequence
  chemically synthesized
tgcacaaatgaaatgatgtaat

SEQ ID NO: 628318 - DNA, 22 bp, Artificial Sequence
  chemically synthesized
taacaaacaatattgcacattt

SEQ ID NO: 628319 - DNA, 22 bp, Artificial Sequence
  chemically synthesized
ctataacaaacaatattgcaca

SEQ ID NO: 628320 - DNA, 22 bp, Artificial Sequence
  chemically synthesized
gctataacaaacaatattgcac

SEQ ID NO: 628321 - DNA, 22 bp, Artificial Sequence
  chemically synthesized
tgctataacaaacaatattgca

SEQ ID NO: 628322 - DNA, 22 bp, Artificial Sequence
  chemically synthesized
ttgctataacaaacaatattgc

SEQ ID NO: 628323 - DNA, 22 bp, Artificial Sequence
  chemically synthesized
ttttgctataacaaacaatatt

SEQ ID NO: 628324 - DNA, 22 bp, Artificial Sequence
  chemically synthesized
cttttgctataacaaacaatat

SEQ ID NO: 628325 - DNA, 22 bp, Artificial Sequence
  chemically synthesized
tcttttgctataacaaacaata

SEQ ID NO: 628326 - DNA, 22 bp, Artificial Sequence
  chemically synthesized
tcagtctttcttttgctataac

SEQ ID NO: 628327 - DNA, 22 bp, Artificial Sequence
  chemically synthesized
ttgtcagtctttcttttgctat

SEQ ID NO: 628328 - DNA, 22 bp, Artificial Sequence
  chemically synthesized
tttgttatagcaaaagaaagac

SEQ ID NO: 628329 - DNA, 22 bp, Artificial Sequence
  chemically synthesized
gttatagcaaaagaaagactga

SEQ ID NO: 628330 - DNA, 22 bp, Artificial Sequence
  chemically synthesized
ttatagcaaaagaaagactgac

SEQ ID NO: 628331 - DNA, 22 bp, Artificial Sequence
  chemically synthesized
tagcaaaagaaagactgacaac

SEQ ID NO: 628332 - DNA, 22 bp, Artificial Sequence
  chemically synthesized
gtgggatatgtagtctgttgtc

SEQ ID NO: 628333 - DNA, 22 bp, Artificial Sequence
  chemically synthesized
ggtgggatatgtagtctgttgt

SEQ ID NO: 628334 - DNA, 22 bp, Artificial Sequence
  chemically synthesized
tggtgggatatgtagtctgttg

SEQ ID NO: 628335 - DNA, 22 bp, Artificial Sequence
  chemically synthesized
cctttggtgggatatgtagtct

SEQ ID NO: 628336 - DNA, 22 bp, Artificial Sequence
  chemically synthesized
acaacagactacatatcccacc

SEQ ID NO: 628337 - DNA, 22 bp, Artificial Sequence
  chemically synthesized
agcagttccctttggtgggata

SEQ ID NO: 628338 - DNA, 22 bp, Artificial Sequence
  chemically synthesized
aagcagttccctttggtgggat

SEQ ID NO: 628339 - DNA, 22 bp, Artificial Sequence
  chemically synthesized
tttaagcagttccctttggtgg

SEQ ID NO: 628340 - DNA, 22 bp, Artificial Sequence
  chemically synthesized
atttaagcagttccctttggtg

SEQ ID NO: 628341 - DNA, 22 bp, Artificial Sequence
  chemically synthesized
tatttaagcagttccctttggt

SEQ ID NO: 628342 - DNA, 22 bp, Artificial Sequence
  chemically synthesized
catatcccaccaaagggaactg

SEQ ID NO: 628343 - DNA, 22 bp, Artificial Sequence
  chemically synthesized
ataggatattttatttaagcag

SEQ ID NO: 628344 - DNA, 22 bp, Artificial Sequence
  chemically synthesized
tatgttcataggatattttatt

SEQ ID NO: 628345 - DNA, 22 bp, Artificial Sequence
  chemically synthesized
attatatgttcataggatattt

SEQ ID NO: 628346 - DNA, 22 bp, Artificial Sequence
  chemically synthesized
cattatatgttcataggatatt

SEQ ID NO: 628347 - DNA, 22 bp, Artificial Sequence
  chemically synthesized
cttaaataaaatatcctatgaa

SEQ ID NO: 628348 - DNA, 22 bp, Artificial Sequence
  chemically synthesized
aaataaaatatcctatgaacat

SEQ ID NO: 628349 - DNA, 22 bp, Artificial Sequence
  chemically synthesized
aataaaatatcctatgaacata

SEQ ID NO: 628350 - DNA, 22 bp, Artificial Sequence
  chemically synthesized
tataatatttcattatatgttc

SEQ ID NO: 628351 - DNA, 22 bp, Artificial Sequence
  chemically synthesized
tagctgtataatatttcattat

SEQ ID NO: 628352 - DNA, 22 bp, Artificial Sequence
  chemically synthesized
atagctgtataatatttcatta

SEQ ID NO: 628353 - DNA, 22 bp, Artificial Sequence
  chemically synthesized
tatagctgtataatatttcatt

SEQ ID NO: 628354 - DNA, 22 bp, Artificial Sequence
  chemically synthesized
ttatagctgtataatatttcat

SEQ ID NO: 628355 - DNA, 22 bp, Artificial Sequence
  chemically synthesized
tttatagctgtataatatttca

SEQ ID NO: 628356 - DNA, 22 bp, Artificial Sequence
  chemically synthesized
tgaacatataatgaaatattat

SEQ ID NO: 628357 - DNA, 22 bp, Artificial Sequence
  chemically synthesized
ttttatagctgtataatatttc

SEQ ID NO: 628358 - DNA, 22 bp, Artificial Sequence
  chemically synthesized
ttttttatagctgtataatatt

SEQ ID NO: 628359 - DNA, 22 bp, Artificial Sequence
  chemically synthesized
attcttttttatagctgtataa

SEQ ID NO: 628360 - DNA, 22 bp, Artificial Sequence
  chemically synthesized
tcattcttttttatagctgtat

SEQ ID NO: 628361 - DNA, 22 bp, Artificial Sequence
  chemically synthesized
ctcattcttttttatagctgta

SEQ ID NO: 628362 - DNA, 22 bp, Artificial Sequence
  chemically synthesized
tctcattcttttttatagctgt

SEQ ID NO: 628363 - DNA, 22 bp, Artificial Sequence
  chemically synthesized
tacagctataaaaaagaatgag

SEQ ID NO: 628364 - DNA, 22 bp, Artificial Sequence
  chemically synthesized
aatatataaaatgctttctcat

SEQ ID NO: 628365 - DNA, 22 bp, Artificial Sequence
  chemically synthesized
aaatatataaaatgctttctca

SEQ ID NO: 628366 - DNA, 22 bp, Artificial Sequence
  chemically synthesized
taaaaaagaatgagaaagcatt

SEQ ID NO: 628367 - DNA, 22 bp, Artificial Sequence
  chemically synthesized
atttaaatatataaaatgcttt

SEQ ID NO: 628368 - DNA, 22 bp, Artificial Sequence
  chemically synthesized
catttaaatatataaaatgctt

SEQ ID NO: 628369 - DNA, 22 bp, Artificial Sequence
  chemically synthesized
tcatttaaatatataaaatgct

SEQ ID NO: 628370 - DNA, 22 bp, Artificial Sequence
  chemically synthesized
ttcatttaaatatataaaatgc

SEQ ID NO: 628371 - DNA, 22 bp, Artificial Sequence
  chemically synthesized
aagaaatcttttcatttaaata

SEQ ID NO: 628372 - DNA, 22 bp, Artificial Sequence
  chemically synthesized
tatatatttaaatgaaaagatt

SEQ ID NO: 628373 - DNA, 22 bp, Artificial Sequence
  chemically synthesized
atatatttaaatgaaaagattt

SEQ ID NO: 628374 - DNA, 22 bp, Artificial Sequence
  chemically synthesized
tatatttaaatgaaaagatttc

SEQ ID NO: 628375 - DNA, 22 bp, Artificial Sequence
  chemically synthesized
aatatggactcaagaaatcttt

SEQ ID NO: 628376 - DNA, 22 bp, Artificial Sequence
  chemically synthesized
aaatatggactcaagaaatctt

SEQ ID NO: 628377 - DNA, 22 bp, Artificial Sequence
  chemically synthesized
aaatgaaaagatttcttgagtc

SEQ ID NO: 628378 - DNA, 22 bp, Artificial Sequence
  chemically synthesized
aatttaaatatggactcaagaa

SEQ ID NO: 628379 - DNA, 22 bp, Artificial Sequence
  chemically synthesized
aatgaaaagatttcttgagtcc

SEQ ID NO: 628380 - DNA, 22 bp, Artificial Sequence
  chemically synthesized
aaatttaaatatggactcaaga

SEQ ID NO: 628381 - DNA, 22 bp, Artificial Sequence
  chemically synthesized
tttaaatttaaatatggactca

SEQ ID NO: 628382 - DNA, 22 bp, Artificial Sequence
  chemically synthesized
gtttaaatttaaatatggactc

SEQ ID NO: 628383 - DNA, 22 bp, Artificial Sequence
  chemically synthesized
tttgtttaaatttaaatatgga

SEQ ID NO: 628384 - DNA, 22 bp, Artificial Sequence
  chemically synthesized
gtttgtttaaatttaaatatgg

SEQ ID NO: 628385 - DNA, 22 bp, Artificial Sequence
  chemically synthesized
tttgtttgtttaaatttaaata

SEQ ID NO: 628386 - DNA, 22 bp, Artificial Sequence
  chemically synthesized
gtttgtttgtttaaatttaaat

SEQ ID NO: 628387 - DNA, 22 bp, Artificial Sequence
  chemically synthesized
cttgagtccatatttaaattta

SEQ ID NO: 628388 - DNA, 22 bp, Artificial Sequence
  chemically synthesized
ttgagtccatatttaaatttaa

SEQ ID NO: 628389 - DNA, 22 bp, Artificial Sequence
  chemically synthesized
cttgtttgtttgtttaaattta

SEQ ID NO: 628390 - DNA, 22 bp, Artificial Sequence
  chemically synthesized
gagtccatatttaaatttaaac

SEQ ID NO: 628391 - DNA, 22 bp, Artificial Sequence
  chemically synthesized
acttgtttgtttgtttaaattt

SEQ ID NO: 628392 - DNA, 22 bp, Artificial Sequence
  chemically synthesized
agtccatatttaaatttaaaca

SEQ ID NO: 628393 - DNA, 22 bp, Artificial Sequence
  chemically synthesized
tgcaccttacttgtttgtttgt

SEQ ID NO: 628394 - DNA, 22 bp, Artificial Sequence
  chemically synthesized
aaatttaaacaaacaaacaagt

SEQ ID NO: 628395 - DNA, 22 bp, Artificial Sequence
  chemically synthesized
aatttaaacaaacaaacaagta

SEQ ID NO: 628396 - DNA, 22 bp, Artificial Sequence
  chemically synthesized
aaacaaacaaacaagtaaggtg

SEQ ID NO: 628397 - DNA, 22 bp, Artificial Sequence
  chemically synthesized
cacccagttatgcaccttactt

SEQ ID NO: 628398 - DNA, 22 bp, Artificial Sequence
  chemically synthesized
aacaaacaaacaagtaaggtgc

SEQ ID NO: 628399 - DNA, 22 bp, Artificial Sequence
  chemically synthesized
tgcacccagttatgcaccttac

SEQ ID NO: 628400 - DNA, 22 bp, Artificial Sequence
  chemically synthesized
tctgcacccagttatgcacctt

SEQ ID NO: 628401 - DNA, 22 bp, Artificial Sequence
  chemically synthesized
ataggatatagcattctctgca

SEQ ID NO: 628402 - DNA, 22 bp, Artificial Sequence
  chemically synthesized
cataggatatagcattctctgc

SEQ ID NO: 628403 - DNA, 22 bp, Artificial Sequence
  chemically synthesized
tttcataggatatagcattctc

SEQ ID NO: 628404 - DNA, 22 bp, Artificial Sequence
  chemically synthesized
ttatttcataggatatagcatt

SEQ ID NO: 628405 - DNA, 22 bp, Artificial Sequence
  chemically synthesized
ggtgcagagaatgctatatcct

SEQ ID NO: 628406 - DNA, 22 bp, Artificial Sequence
  chemically synthesized
ttattatttcataggatatagc

SEQ ID NO: 628407 - DNA, 22 bp, Artificial Sequence
  chemically synthesized
ctattattatttcataggatat

SEQ ID NO: 628408 - DNA, 22 bp, Artificial Sequence
  chemically synthesized
cctattattatttcataggata

SEQ ID NO: 628409 - DNA, 22 bp, Artificial Sequence
  chemically synthesized
tcctattattatttcataggat

SEQ ID NO: 628410 - DNA, 22 bp, Artificial Sequence
  chemically synthesized
ttcctattattatttcatagga

SEQ ID NO: 628411 - DNA, 22 bp, Artificial Sequence
  chemically synthesized
tttcctattattatttcatagg

SEQ ID NO: 628412 - DNA, 22 bp, Artificial Sequence
  chemically synthesized
ttttcctattattatttcatag

SEQ ID NO: 628413 - DNA, 22 bp, Artificial Sequence
  chemically synthesized
tttttttcctattattatttca

SEQ ID NO: 628414 - DNA, 22 bp, Artificial Sequence
  chemically synthesized
atttttttcctattattatttc

SEQ ID NO: 628415 - DNA, 22 bp, Artificial Sequence
  chemically synthesized
tttatttttttcctattattat

SEQ ID NO: 628416 - DNA, 22 bp, Artificial Sequence
  chemically synthesized
tatcctatgaaataataatagg

SEQ ID NO: 628417 - DNA, 22 bp, Artificial Sequence
  chemically synthesized
ctatttatttttttcctattat

SEQ ID NO: 628418 - DNA, 22 bp, Artificial Sequence
  chemically synthesized
tgaaataataataggaaaaaaa

SEQ ID NO: 628419 - DNA, 22 bp, Artificial Sequence
  chemically synthesized
aaataatatatatgttcctatt

SEQ ID NO: 628420 - DNA, 22 bp, Artificial Sequence
  chemically synthesized
tataagcagttaaaataatata

SEQ ID NO: 628421 - DNA, 22 bp, Artificial Sequence
  chemically synthesized
ttatataagcagttaaaataat

SEQ ID NO: 628422 - DNA, 22 bp, Artificial Sequence
  chemically synthesized
attattatataagcagttaaaa

SEQ ID NO: 628423 - DNA, 22 bp, Artificial Sequence
  chemically synthesized
ttaattattatataagcagtta

SEQ ID NO: 628424 - DNA, 22 bp, Artificial Sequence
  chemically synthesized
attaattattatataagcagtt

SEQ ID NO: 628425 - DNA, 22 bp, Artificial Sequence
  chemically synthesized
tattaattattatataagcagt

SEQ ID NO: 628426 - DNA, 22 bp, Artificial Sequence
  chemically synthesized
tttattaattattatataagca

SEQ ID NO: 628427 - DNA, 22 bp, Artificial Sequence
  chemically synthesized
ctttattaattattatataagc

SEQ ID NO: 628428 - DNA, 22 bp, Artificial Sequence
  chemically synthesized
tctttattaattattatataag

SEQ ID NO: 628429 - DNA, 22 bp, Artificial Sequence
  chemically synthesized
ttttaactgcttatataataat

SEQ ID NO: 628430 - DNA, 22 bp, Artificial Sequence
  chemically synthesized
taactgcttatataataattaa

SEQ ID NO: 628431 - DNA, 22 bp, Artificial Sequence
  chemically synthesized
aactgcttatataataattaat

SEQ ID NO: 628432 - DNA, 22 bp, Artificial Sequence
  chemically synthesized
actgcttatataataattaata

SEQ ID NO: 628433 - DNA, 22 bp, Artificial Sequence
  chemically synthesized
cagagggtctttctttattaat

SEQ ID NO: 628434 - DNA, 22 bp, Artificial Sequence
  chemically synthesized
cttatataataattaataaaga

SEQ ID NO: 628435 - DNA, 22 bp, Artificial Sequence
  chemically synthesized
ccagagggtctttctttattaa

SEQ ID NO: 628436 - DNA, 22 bp, Artificial Sequence
  chemically synthesized
atataataattaataaagaaag

SEQ ID NO: 628437 - DNA, 22 bp, Artificial Sequence
  chemically synthesized
tataataattaataaagaaaga

SEQ ID NO: 628438 - DNA, 22 bp, Artificial Sequence
  chemically synthesized
gtcttccagagggtctttcttt

SEQ ID NO: 628439 - DNA, 22 bp, Artificial Sequence
  chemically synthesized
agtcttccagagggtctttctt

SEQ ID NO: 628440 - DNA, 22 bp, Artificial Sequence
  chemically synthesized
tttagtcttccagagggtcttt

SEQ ID NO: 628441 - DNA, 22 bp, Artificial Sequence
  chemically synthesized
atttagtcttccagagggtctt

SEQ ID NO: 628442 - DNA, 22 bp, Artificial Sequence
  chemically synthesized
ttatttagtcttccagagggtc

SEQ ID NO: 628443 - DNA, 22 bp, Artificial Sequence
  chemically synthesized
cttatttagtcttccagagggt

SEQ ID NO: 628444 - DNA, 22 bp, Artificial Sequence
  chemically synthesized
ataaagaaagaccctctggaag

SEQ ID NO: 628445 - DNA, 22 bp, Artificial Sequence
  chemically synthesized
atttcttatttagtcttccaga

SEQ ID NO: 628446 - DNA, 22 bp, Artificial Sequence
  chemically synthesized
ttaatttcttatttagtcttcc

SEQ ID NO: 628447 - DNA, 22 bp, Artificial Sequence
  chemically synthesized
tggaagactaaataagaaatta

SEQ ID NO: 628448 - DNA, 22 bp, Artificial Sequence
  chemically synthesized
gaagactaaataagaaattaat

SEQ ID NO: 628449 - DNA, 22 bp, Artificial Sequence
  chemically synthesized
tgagtagacattattaatttct

SEQ ID NO: 628450 - DNA, 22 bp, Artificial Sequence
  chemically synthesized
tatgagtagacattattaattt

SEQ ID NO: 628451 - DNA, 22 bp, Artificial Sequence
  chemically synthesized
ctctatgagtagacattattaa

SEQ ID NO: 628452 - DNA, 22 bp, Artificial Sequence
  chemically synthesized
aataagaaattaataatgtcta

SEQ ID NO: 628453 - DNA, 22 bp, Artificial Sequence
  chemically synthesized
attgctctatgagtagacatta

SEQ ID NO: 628454 - DNA, 22 bp, Artificial Sequence
  chemically synthesized
ataatgtctactcatagagcaa

SEQ ID NO: 628455 - DNA, 22 bp, Artificial Sequence
  chemically synthesized
ctcatagagcaatgaggatgat

SEQ ID NO: 628456 - DNA, 22 bp, Artificial Sequence
  chemically synthesized
ccccatatcaatcaatcatcct

SEQ ID NO: 628457 - DNA, 22 bp, Artificial Sequence
  chemically synthesized
atagagcaatgaggatgattga

SEQ ID NO: 628458 - DNA, 22 bp, Artificial Sequence
  chemically synthesized
cccccatatcaatcaatcatcc

SEQ ID NO: 628459 - DNA, 22 bp, Artificial Sequence
  chemically synthesized
ccccttcccccatatcaatcaa

SEQ ID NO: 628460 - DNA, 22 bp, Artificial Sequence
  chemically synthesized
actaccccttcccccatatcaa

SEQ ID NO: 628461 - DNA, 22 bp, Artificial Sequence
  chemically synthesized
ctaactaccccttcccccatat

SEQ ID NO: 628462 - DNA, 22 bp, Artificial Sequence
  chemically synthesized
attgatatgggggaaggggtag

SEQ ID NO: 628463 - DNA, 22 bp, Artificial Sequence
  chemically synthesized
atatgggggaaggggtagttag

SEQ ID NO: 628464 - DNA, 22 bp, Artificial Sequence
  chemically synthesized
taatccagaaagacagtgaaaa

SEQ ID NO: 628465 - DNA, 22 bp, Artificial Sequence
  chemically synthesized
ggagtgttttcactgtctttct

SEQ ID NO: 628466 - DNA, 22 bp, Artificial Sequence
  chemically synthesized
tcactgtctttctggattatag

SEQ ID NO: 628467 - DNA, 22 bp, Artificial Sequence
  chemically synthesized
cactgtctttctggattatagt

SEQ ID NO: 628468 - DNA, 22 bp, Artificial Sequence
  chemically synthesized
actgtctttctggattatagtt

SEQ ID NO: 628469 - DNA, 22 bp, Artificial Sequence
  chemically synthesized
tctttctggattatagtttttt

SEQ ID NO: 628470 - DNA, 22 bp, Artificial Sequence
  chemically synthesized
tctggattatagttttttactc

SEQ ID NO: 628471 - DNA, 22 bp, Artificial Sequence
  chemically synthesized
ctggattatagttttttactca

SEQ ID NO: 628472 - DNA, 22 bp, Artificial Sequence
  chemically synthesized
tggattatagttttttactcat

SEQ ID NO: 628473 - DNA, 22 bp, Artificial Sequence
  chemically synthesized
gattatagttttttactcatat

SEQ ID NO: 628474 - DNA, 22 bp, Artificial Sequence
  chemically synthesized
aataggtaatacatgcatatga

SEQ ID NO: 628475 - DNA, 22 bp, Artificial Sequence
  chemically synthesized
tagttttttactcatatgcatg

SEQ ID NO: 628476 - DNA, 22 bp, Artificial Sequence
  chemically synthesized
aaataggtaatacatgcatatg

SEQ ID NO: 628477 - DNA, 22 bp, Artificial Sequence
  chemically synthesized
taaataggtaatacatgcatat

SEQ ID NO: 628478 - DNA, 22 bp, Artificial Sequence
  chemically synthesized
ttaaataggtaatacatgcata

SEQ ID NO: 628479 - DNA, 22 bp, Artificial Sequence
  chemically synthesized
tttaaataggtaatacatgcat

SEQ ID NO: 628480 - DNA, 22 bp, Artificial Sequence
  chemically synthesized
tttactcatatgcatgtattac

SEQ ID NO: 628481 - DNA, 22 bp, Artificial Sequence
  chemically synthesized
ctttttaaataggtaatacatg

SEQ ID NO: 628482 - DNA, 22 bp, Artificial Sequence
  chemically synthesized
ttactcatatgcatgtattacc

SEQ ID NO: 628483 - DNA, 22 bp, Artificial Sequence
  chemically synthesized
actttttaaataggtaatacat

SEQ ID NO: 628484 - DNA, 22 bp, Artificial Sequence
  chemically synthesized
tactcatatgcatgtattacct

SEQ ID NO: 628485 - DNA, 22 bp, Artificial Sequence
  chemically synthesized
actcatatgcatgtattaccta

SEQ ID NO: 628486 - DNA, 22 bp, Artificial Sequence
  chemically synthesized
ctcatatgcatgtattacctat

SEQ ID NO: 628487 - DNA, 22 bp, Artificial Sequence
  chemically synthesized
cttactttttaaataggtaata

SEQ ID NO: 628488 - DNA, 22 bp, Artificial Sequence
  chemically synthesized
acttactttttaaataggtaat

SEQ ID NO: 628489 - DNA, 22 bp, Artificial Sequence
  chemically synthesized
atatgcatgtattacctattta

SEQ ID NO: 628490 - DNA, 22 bp, Artificial Sequence
  chemically synthesized
cttacttactttttaaataggt

SEQ ID NO: 628491 - DNA, 22 bp, Artificial Sequence
  chemically synthesized
acttacttactttttaaatagg

SEQ ID NO: 628492 - DNA, 22 bp, Artificial Sequence
  chemically synthesized
cttacttacttactttttaaat

SEQ ID NO: 628493 - DNA, 22 bp, Artificial Sequence
  chemically synthesized
ttacttacttacttacttttta

SEQ ID NO: 628494 - DNA, 22 bp, Artificial Sequence
  chemically synthesized
ttgttacttacttacttacttt

SEQ ID NO: 628495 - DNA, 22 bp, Artificial Sequence
  chemically synthesized
cctatttaaaaagtaagtaagt

SEQ ID NO: 628496 - DNA, 22 bp, Artificial Sequence
  chemically synthesized
gttgttgttacttacttactta

SEQ ID NO: 628497 - DNA, 22 bp, Artificial Sequence
  chemically synthesized
agttgttgttacttacttactt

SEQ ID NO: 628498 - DNA, 22 bp, Artificial Sequence
  chemically synthesized
tttaaaaagtaagtaagtaagt

SEQ ID NO: 628499 - DNA, 22 bp, Artificial Sequence
  chemically synthesized
atttagttgttgttacttactt

SEQ ID NO: 628500 - DNA, 22 bp, Artificial Sequence
  chemically synthesized
aaaaagtaagtaagtaagtaac

SEQ ID NO: 628501 - DNA, 22 bp, Artificial Sequence
  chemically synthesized
aatttagttgttgttacttact

SEQ ID NO: 628502 - DNA, 22 bp, Artificial Sequence
  chemically synthesized
aaaagtaagtaagtaagtaaca

SEQ ID NO: 628503 - DNA, 22 bp, Artificial Sequence
  chemically synthesized
taatttagttgttgttacttac

SEQ ID NO: 628504 - DNA, 22 bp, Artificial Sequence
  chemically synthesized
ttttaatttagttgttgttact

SEQ ID NO: 628505 - DNA, 22 bp, Artificial Sequence
  chemically synthesized
attttaatttagttgttgttac

SEQ ID NO: 628506 - DNA, 22 bp, Artificial Sequence
  chemically synthesized
tattttaatttagttgttgtta

SEQ ID NO: 628507 - DNA, 22 bp, Artificial Sequence
  chemically synthesized
ttattttaatttagttgttgtt

SEQ ID NO: 628508 - DNA, 22 bp, Artificial Sequence
  chemically synthesized
tttttattttaatttagttgtt

SEQ ID NO: 628509 - DNA, 22 bp, Artificial Sequence
  chemically synthesized
gtttttattttaatttagttgt

SEQ ID NO: 628510 - DNA, 22 bp, Artificial Sequence
  chemically synthesized
tgtttttattttaatttagttg

SEQ ID NO: 628511 - DNA, 22 bp, Artificial Sequence
  chemically synthesized
cagtactttgtttttattttaa

SEQ ID NO: 628512 - DNA, 22 bp, Artificial Sequence
  chemically synthesized
gactgcagtactttgtttttat

SEQ ID NO: 628513 - DNA, 22 bp, Artificial Sequence
  chemically synthesized
actggactgcagtactttgttt

SEQ ID NO: 628514 - DNA, 22 bp, Artificial Sequence
  chemically synthesized
aattaaaataaaaacaaagtac

SEQ ID NO: 628515 - DNA, 22 bp, Artificial Sequence
  chemically synthesized
aaataaaaacaaagtactgcag

SEQ ID NO: 628516 - DNA, 22 bp, Artificial Sequence
  chemically synthesized
caaaaaagtattgactggactg

SEQ ID NO: 628517 - DNA, 22 bp, Artificial Sequence
  chemically synthesized
tgttacaaaaaagtattgactg

SEQ ID NO: 628518 - DNA, 22 bp, Artificial Sequence
  chemically synthesized
cagtccagtcaatacttttttg

SEQ ID NO: 628519 - DNA, 22 bp, Artificial Sequence
  chemically synthesized
aataaagcacgcagttatgtta

SEQ ID NO: 628520 - DNA, 22 bp, Artificial Sequence
  chemically synthesized
ttttgtaacataactgcgtgct

SEQ ID NO: 628521 - DNA, 22 bp, Artificial Sequence
  chemically synthesized
tttgtaacataactgcgtgctt

SEQ ID NO: 628522 - DNA, 22 bp, Artificial Sequence
  chemically synthesized
tgtatctcaataaagcacgcag

SEQ ID NO: 628523 - DNA, 22 bp, Artificial Sequence
  chemically synthesized
ttgtaacataactgcgtgcttt

SEQ ID NO: 628524 - DNA, 22 bp, Artificial Sequence
  chemically synthesized
tgtaacataactgcgtgcttta

SEQ ID NO: 628525 - DNA, 22 bp, Artificial Sequence
  chemically synthesized
gtaacataactgcgtgctttat

SEQ ID NO: 628526 - DNA, 22 bp, Artificial Sequence
  chemically synthesized
ctgtgtatctcaataaagcacg

SEQ ID NO: 628527 - DNA, 22 bp, Artificial Sequence
  chemically synthesized
taacataactgcgtgctttatt

SEQ ID NO: 628528 - DNA, 22 bp, Artificial Sequence
  chemically synthesized
actgtgtatctcaataaagcac

SEQ ID NO: 628529 - DNA, 22 bp, Artificial Sequence
  chemically synthesized
tactgtgtatctcaataaagca

SEQ ID NO: 628530 - DNA, 22 bp, Artificial Sequence
  chemically synthesized
ctttactgtgtatctcaataaa

SEQ ID NO: 628531 - DNA, 22 bp, Artificial Sequence
  chemically synthesized
cgtgctttattgagatacacag

SEQ ID NO: 628532 - DNA, 22 bp, Artificial Sequence
  chemically synthesized
tagtactgctttactgtgtatc

SEQ ID NO: 628533 - DNA, 22 bp, Artificial Sequence
  chemically synthesized
tattatagtactgctttactgt

SEQ ID NO: 628534 - DNA, 22 bp, Artificial Sequence
  chemically synthesized
tattgagatacacagtaaagca

SEQ ID NO: 628535 - DNA, 22 bp, Artificial Sequence
  chemically synthesized
attgagatacacagtaaagcag

SEQ ID NO: 628536 - DNA, 22 bp, Artificial Sequence
  chemically synthesized
ttgagatacacagtaaagcagt

SEQ ID NO: 628537 - DNA, 22 bp, Artificial Sequence
  chemically synthesized
ttgtattatagtactgctttac

SEQ ID NO: 628538 - DNA, 22 bp, Artificial Sequence
  chemically synthesized
agatacacagtaaagcagtact

SEQ ID NO: 628539 - DNA, 22 bp, Artificial Sequence
  chemically synthesized
ctattgtattatagtactgctt

SEQ ID NO: 628540 - DNA, 22 bp, Artificial Sequence
  chemically synthesized
actattgtattatagtactgct

SEQ ID NO: 628541 - DNA, 22 bp, Artificial Sequence
  chemically synthesized
accaaatatatgccttactatt

SEQ ID NO: 628542 - DNA, 22 bp, Artificial Sequence
  chemically synthesized
caccaaatatatgccttactat

SEQ ID NO: 628543 - DNA, 22 bp, Artificial Sequence
  chemically synthesized
taatacaatagtaaggcatata

SEQ ID NO: 628544 - DNA, 22 bp, Artificial Sequence
  chemically synthesized
acaacatatcagacttcaccaa

SEQ ID NO: 628545 - DNA, 22 bp, Artificial Sequence
  chemically synthesized
cacaacatatcagacttcacca

SEQ ID NO: 628546 - DNA, 22 bp, Artificial Sequence
  chemically synthesized
tcacaacatatcagacttcacc

SEQ ID NO: 628547 - DNA, 22 bp, Artificial Sequence
  chemically synthesized
cattttcacaacatatcagact

SEQ ID NO: 628548 - DNA, 22 bp, Artificial Sequence
  chemically synthesized
ctgcattttcacaacatatcag

SEQ ID NO: 628549 - DNA, 22 bp, Artificial Sequence
  chemically synthesized
actgcattttcacaacatatca

SEQ ID NO: 628550 - DNA, 22 bp, Artificial Sequence
  chemically synthesized
tactgcattttcacaacatatc

SEQ ID NO: 628551 - DNA, 22 bp, Artificial Sequence
  chemically synthesized
ggtgaagtctgatatgttgtga

SEQ ID NO: 628552 - DNA, 22 bp, Artificial Sequence
  chemically synthesized
gtgaagtctgatatgttgtgaa

SEQ ID NO: 628553 - DNA, 22 bp, Artificial Sequence
  chemically synthesized
agttttactgcattttcacaac

SEQ ID NO: 628554 - DNA, 22 bp, Artificial Sequence
  chemically synthesized
cagttttactgcattttcacaa

SEQ ID NO: 628555 - DNA, 22 bp, Artificial Sequence
  chemically synthesized
aacttcagttttactgcatttt

SEQ ID NO: 628556 - DNA, 22 bp, Artificial Sequence
  chemically synthesized
aaacttcagttttactgcattt

SEQ ID NO: 628557 - DNA, 22 bp, Artificial Sequence
  chemically synthesized
atatgttgtgaaaatgcagtaa

SEQ ID NO: 628558 - DNA, 22 bp, Artificial Sequence
  chemically synthesized
taaacttcagttttactgcatt

SEQ ID NO: 628559 - DNA, 22 bp, Artificial Sequence
  chemically synthesized
ttaaacttcagttttactgcat

SEQ ID NO: 628560 - DNA, 22 bp, Artificial Sequence
  chemically synthesized
tttaaacttcagttttactgca

SEQ ID NO: 628561 - DNA, 22 bp, Artificial Sequence
  chemically synthesized
ttttaaacttcagttttactgc

SEQ ID NO: 628562 - DNA, 22 bp, Artificial Sequence
  chemically synthesized
tttttttaaacttcagttttac

SEQ ID NO: 628563 - DNA, 22 bp, Artificial Sequence
  chemically synthesized
tgaaaatgcagtaaaactgaag

SEQ ID NO: 628564 - DNA, 22 bp, Artificial Sequence
  chemically synthesized
cgaattatttttttaaacttca

SEQ ID NO: 628565 - DNA, 22 bp, Artificial Sequence
  chemically synthesized
acgaattatttttttaaacttc

SEQ ID NO: 628566 - DNA, 22 bp, Artificial Sequence
  chemically synthesized
taacatttacgaattatttttt

SEQ ID NO: 628567 - DNA, 22 bp, Artificial Sequence
  chemically synthesized
aagtttaaaaaaataattcgta

SEQ ID NO: 628568 - DNA, 22 bp, Artificial Sequence
  chemically synthesized
aaaaaaataattcgtaaatgtt

SEQ ID NO: 628569 - DNA, 22 bp, Artificial Sequence
  chemically synthesized
aaaaaataattcgtaaatgtta

SEQ ID NO: 628570 - DNA, 22 bp, Artificial Sequence
  chemically synthesized
acaccaacactgtaacatttac

SEQ ID NO: 628571 - DNA, 22 bp, Artificial Sequence
  chemically synthesized
aacaccaacactgtaacattta

SEQ ID NO: 628572 - DNA, 22 bp, Artificial Sequence
  chemically synthesized
taacaccaacactgtaacattt

SEQ ID NO: 628573 - DNA, 22 bp, Artificial Sequence
  chemically synthesized
tgttttaacaccaacactgtaa

SEQ ID NO: 628574 - DNA, 22 bp, Artificial Sequence
  chemically synthesized
gtaaatgttacagtgttggtgt

SEQ ID NO: 628575 - DNA, 22 bp, Artificial Sequence
  chemically synthesized
cagtgttggtgttaaaacacaa

SEQ ID NO: 628576 - DNA, 22 bp, Artificial Sequence
  chemically synthesized
agtatcataatatattgtgttt

SEQ ID NO: 628577 - DNA, 22 bp, Artificial Sequence
  chemically synthesized
gagtatcataatatattgtgtt

SEQ ID NO: 628578 - DNA, 22 bp, Artificial Sequence
  chemically synthesized
cttgagtatcataatatattgt

SEQ ID NO: 628579 - DNA, 22 bp, Artificial Sequence
  chemically synthesized
acttgagtatcataatatattg

SEQ ID NO: 628580 - DNA, 22 bp, Artificial Sequence
  chemically synthesized
gtgttaaaacacaatatattat

SEQ ID NO: 628581 - DNA, 22 bp, Artificial Sequence
  chemically synthesized
ttacttgagtatcataatatat

SEQ ID NO: 628582 - DNA, 22 bp, Artificial Sequence
  chemically synthesized
aaacacaatatattatgatact

SEQ ID NO: 628583 - DNA, 22 bp, Artificial Sequence
  chemically synthesized
agttcttacttgagtatcataa

SEQ ID NO: 628584 - DNA, 22 bp, Artificial Sequence
  chemically synthesized
aggtactgagttcttacttgag

SEQ ID NO: 628585 - DNA, 22 bp, Artificial Sequence
  chemically synthesized
caggtactgagttcttacttga

SEQ ID NO: 628586 - DNA, 22 bp, Artificial Sequence
  chemically synthesized
tcaggtactgagttcttacttg

SEQ ID NO: 628587 - DNA, 22 bp, Artificial Sequence
  chemically synthesized
ttttcaggtactgagttcttac

SEQ ID NO: 628588 - DNA, 22 bp, Artificial Sequence
  chemically synthesized
tgatactcaagtaagaactcag

SEQ ID NO: 628589 - DNA, 22 bp, Artificial Sequence
  chemically synthesized
tcattgttttcaggtactgagt

SEQ ID NO: 628590 - DNA, 22 bp, Artificial Sequence
  chemically synthesized
gtcattgttttcaggtactgag

SEQ ID NO: 628591 - DNA, 22 bp, Artificial Sequence
  chemically synthesized
tgtcattgttttcaggtactga

SEQ ID NO: 628592 - DNA, 22 bp, Artificial Sequence
  chemically synthesized
aagtaagaactcagtacctgaa

SEQ ID NO: 628593 - DNA, 22 bp, Artificial Sequence
  chemically synthesized
agtacctgaaaacaatgacaaa

SEQ ID NO: 628594 - DNA, 22 bp, Artificial Sequence
  chemically synthesized
aaaacaatgacaaaacatgcca

SEQ ID NO: 628595 - DNA, 22 bp, Artificial Sequence
  chemically synthesized
aagcataaacatcacatggcat

SEQ ID NO: 628596 - DNA, 22 bp, Artificial Sequence
  chemically synthesized
taaatcataatgtaactgaagc

SEQ ID NO: 628597 - DNA, 22 bp, Artificial Sequence
  chemically synthesized
aactgtaaatcataatgtaact

SEQ ID NO: 628598 - DNA, 22 bp, Artificial Sequence
  chemically synthesized
atgcttcagttacattatgatt

SEQ ID NO: 628599 - DNA, 22 bp, Artificial Sequence
  chemically synthesized
tgcttcagttacattatgattt

SEQ ID NO: 628600 - DNA, 22 bp, Artificial Sequence
  chemically synthesized
cagttacattatgatttacagt

SEQ ID NO: 628601 - DNA, 22 bp, Artificial Sequence
  chemically synthesized
agttacattatgatttacagtt

SEQ ID NO: 628602 - DNA, 22 bp, Artificial Sequence
  chemically synthesized
taaccaccaagtattaaactgt

SEQ ID NO: 628603 - DNA, 22 bp, Artificial Sequence
  chemically synthesized
cattatgatttacagtttaata

SEQ ID NO: 628604 - DNA, 22 bp, Artificial Sequence
  chemically synthesized
ataaccaccaagtattaaactg

SEQ ID NO: 628605 - DNA, 22 bp, Artificial Sequence
  chemically synthesized
tataaccaccaagtattaaact

SEQ ID NO: 628606 - DNA, 22 bp, Artificial Sequence
  chemically synthesized
tttataaccaccaagtattaaa

SEQ ID NO: 628607 - DNA, 22 bp, Artificial Sequence
  chemically synthesized
tgatttacagtttaatacttgg

SEQ ID NO: 628608 - DNA, 22 bp, Artificial Sequence
  chemically synthesized
tgttctttataaccaccaagta

SEQ ID NO: 628609 - DNA, 22 bp, Artificial Sequence
  chemically synthesized
acagtttaatacttggtggtta

SEQ ID NO: 628610 - DNA, 22 bp, Artificial Sequence
  chemically synthesized
cagtttaatacttggtggttat

SEQ ID NO: 628611 - DNA, 22 bp, Artificial Sequence
  chemically synthesized
gtgttgtgttctttataaccac

SEQ ID NO: 628612 - DNA, 22 bp, Artificial Sequence
  chemically synthesized
cgtgttgtgttctttataacca

SEQ ID NO: 628613 - DNA, 22 bp, Artificial Sequence
  chemically synthesized
aatacttggtggttataaagaa

SEQ ID NO: 628614 - DNA, 22 bp, Artificial Sequence
  chemically synthesized
tttcgtgttgtgttctttataa

SEQ ID NO: 628615 - DNA, 22 bp, Artificial Sequence
  chemically synthesized
atacttggtggttataaagaac

SEQ ID NO: 628616 - DNA, 22 bp, Artificial Sequence
  chemically synthesized
ggtggttataaagaacacaaca

SEQ ID NO: 628617 - DNA, 22 bp, Artificial Sequence
  chemically synthesized
gacattatttcgtgttgtgttc

SEQ ID NO: 628618 - DNA, 22 bp, Artificial Sequence
  chemically synthesized
gtggttataaagaacacaacac

SEQ ID NO: 628619 - DNA, 22 bp, Artificial Sequence
  chemically synthesized
ggacattatttcgtgttgtgtt

SEQ ID NO: 628620 - DNA, 22 bp, Artificial Sequence
  chemically synthesized
atttggacattatttcgtgttg

SEQ ID NO: 628621 - DNA, 22 bp, Artificial Sequence
  chemically synthesized
taaagaacacaacacgaaataa

SEQ ID NO: 628622 - DNA, 22 bp, Artificial Sequence
  chemically synthesized
agcataattaatttggacatta

SEQ ID NO: 628623 - DNA, 22 bp, Artificial Sequence
  chemically synthesized
aagcataattaatttggacatt

SEQ ID NO: 628624 - DNA, 22 bp, Artificial Sequence
  chemically synthesized
taagcataattaatttggacat

SEQ ID NO: 628625 - DNA, 22 bp, Artificial Sequence
  chemically synthesized
cattttaagcataattaatttg

SEQ ID NO: 628626 - DNA, 22 bp, Artificial Sequence
  chemically synthesized
ctgcattttaagcataattaat

SEQ ID NO: 628627 - DNA, 22 bp, Artificial Sequence
  chemically synthesized
ttgctgcattttaagcataatt

SEQ ID NO: 628628 - DNA, 22 bp, Artificial Sequence
  chemically synthesized
attgctgcattttaagcataat

SEQ ID NO: 628629 - DNA, 22 bp, Artificial Sequence
  chemically synthesized
tattgctgcattttaagcataa

SEQ ID NO: 628630 - DNA, 22 bp, Artificial Sequence
  chemically synthesized
agagctttattgctgcatttta

SEQ ID NO: 628631 - DNA, 22 bp, Artificial Sequence
  chemically synthesized
attatgcttaaaatgcagcaat

SEQ ID NO: 628632 - DNA, 22 bp, Artificial Sequence
  chemically synthesized
tgcttaaaatgcagcaataaag

SEQ ID NO: 628633 - DNA, 22 bp, Artificial Sequence
  chemically synthesized
aacaaaaattgagagctttatt

SEQ ID NO: 628634 - DNA, 22 bp, Artificial Sequence
  chemically synthesized
gaacaaaaattgagagctttat

SEQ ID NO: 628635 - DNA, 22 bp, Artificial Sequence
  chemically synthesized
aaaatgcagcaataaagctctc

SEQ ID NO: 628636 - DNA, 22 bp, Artificial Sequence
  chemically synthesized
aaatgcagcaataaagctctca

SEQ ID NO: 628637 - DNA, 22 bp, Artificial Sequence
  chemically synthesized
tcataatatttgaacaaaaatt

SEQ ID NO: 628638 - DNA, 22 bp, Artificial Sequence
  chemically synthesized
tcaatttttgttcaaatattat

SEQ ID NO: 628639 - DNA, 22 bp, Artificial Sequence
  chemically synthesized
gagtgagtctgtcataatattt

SEQ ID NO: 628640 - DNA, 22 bp, Artificial Sequence
  chemically synthesized
aatttttgttcaaatattatga

SEQ ID NO: 628641 - DNA, 22 bp, Artificial Sequence
  chemically synthesized
tggagtgagtctgtcataatat

SEQ ID NO: 628642 - DNA, 22 bp, Artificial Sequence
  chemically synthesized
ttgttcaaatattatgacagac

SEQ ID NO: 628643 - DNA, 22 bp, Artificial Sequence
  chemically synthesized
gctctggagtgagtctgtcata

SEQ ID NO: 628644 - DNA, 22 bp, Artificial Sequence
  chemically synthesized
tgttcaaatattatgacagact

SEQ ID NO: 628645 - DNA, 22 bp, Artificial Sequence
  chemically synthesized
gttcaaatattatgacagactc

SEQ ID NO: 628646 - DNA, 22 bp, Artificial Sequence
  chemically synthesized
ttcaaatattatgacagactca

SEQ ID NO: 628647 - DNA, 22 bp, Artificial Sequence
  chemically synthesized
aaatattatgacagactcactc

SEQ ID NO: 628648 - DNA, 22 bp, Artificial Sequence
  chemically synthesized
gacacattagctctggagtgag

SEQ ID NO: 628649 - DNA, 22 bp, Artificial Sequence
  chemically synthesized
agacacattagctctggagtga

SEQ ID NO: 628650 - DNA, 22 bp, Artificial Sequence
  chemically synthesized
tagacacattagctctggagtg

SEQ ID NO: 628651 - DNA, 22 bp, Artificial Sequence
  chemically synthesized
ttagacacattagctctggagt

SEQ ID NO: 628652 - DNA, 22 bp, Artificial Sequence
  chemically synthesized
tgacagactcactccagagcta

SEQ ID NO: 628653 - DNA, 22 bp, Artificial Sequence
  chemically synthesized
ttttagacacattagctctgga

SEQ ID NO: 628654 - DNA, 22 bp, Artificial Sequence
  chemically synthesized
cttttagacacattagctctgg

SEQ ID NO: 628655 - DNA, 22 bp, Artificial Sequence
  chemically synthesized
tcttttagacacattagctctg

SEQ ID NO: 628656 - DNA, 22 bp, Artificial Sequence
  chemically synthesized
ttcttttagacacattagctct

SEQ ID NO: 628657 - DNA, 22 bp, Artificial Sequence
  chemically synthesized
tttttcttttagacacattagc

SEQ ID NO: 628658 - DNA, 22 bp, Artificial Sequence
  chemically synthesized
gtttttcttttagacacattag

SEQ ID NO: 628659 - DNA, 22 bp, Artificial Sequence
  chemically synthesized
tgtttttcttttagacacatta

SEQ ID NO: 628660 - DNA, 22 bp, Artificial Sequence
  chemically synthesized
ttgtttttcttttagacacatt

SEQ ID NO: 628661 - DNA, 22 bp, Artificial Sequence
  chemically synthesized
actccagagctaatgtgtctaa

SEQ ID NO: 628662 - DNA, 22 bp, Artificial Sequence
  chemically synthesized
tttgtttttcttttagacacat

SEQ ID NO: 628663 - DNA, 22 bp, Artificial Sequence
  chemically synthesized
cagagctaatgtgtctaaaaga

SEQ ID NO: 628664 - DNA, 22 bp, Artificial Sequence
  chemically synthesized
atctttttgtttttcttttaga

SEQ ID NO: 628665 - DNA, 22 bp, Artificial Sequence
  chemically synthesized
aatctttttgtttttcttttag

SEQ ID NO: 628666 - DNA, 22 bp, Artificial Sequence
  chemically synthesized
taatctttttgtttttctttta

SEQ ID NO: 628667 - DNA, 22 bp, Artificial Sequence
  chemically synthesized
ttttaatctttttgtttttctt

SEQ ID NO: 628668 - DNA, 22 bp, Artificial Sequence
  chemically synthesized
gttttaatctttttgtttttct

SEQ ID NO: 628669 - DNA, 22 bp, Artificial Sequence
  chemically synthesized
atgtgtctaaaagaaaaacaaa

SEQ ID NO: 628670 - DNA, 22 bp, Artificial Sequence
  chemically synthesized
tgttttaatctttttgtttttc

SEQ ID NO: 628671 - DNA, 22 bp, Artificial Sequence
  chemically synthesized
aaagaaaaacaaaaagattaaa

SEQ ID NO: 628672 - DNA, 22 bp, Artificial Sequence
  chemically synthesized
aaacaaaattatttatgcactc

SEQ ID NO: 628673 - DNA, 22 bp, Artificial Sequence
  chemically synthesized
aaatcagaggtaaatagagtgc

SEQ ID NO: 628674 - DNA, 22 bp, Artificial Sequence
  chemically synthesized
taaaatcagaggtaaatagagt

SEQ ID NO: 628675 - DNA, 22 bp, Artificial Sequence
  chemically synthesized
attctaaaatcagaggtaaata

SEQ ID NO: 628676 - DNA, 22 bp, Artificial Sequence
  chemically synthesized
tttatgcactctatttacctct

SEQ ID NO: 628677 - DNA, 22 bp, Artificial Sequence
  chemically synthesized
cattctaaaatcagaggtaaat

SEQ ID NO: 628678 - DNA, 22 bp, Artificial Sequence
  chemically synthesized
atgcactctatttacctctgat

SEQ ID NO: 628679 - DNA, 22 bp, Artificial Sequence
  chemically synthesized
tgcactctatttacctctgatt

SEQ ID NO: 628680 - DNA, 22 bp, Artificial Sequence
  chemically synthesized
tatttacctctgattttagaat

SEQ ID NO: 628681 - DNA, 22 bp, Artificial Sequence
  chemically synthesized
tttacctctgattttagaatga

SEQ ID NO: 628682 - DNA, 22 bp, Artificial Sequence
  chemically synthesized
agtaagtaagtttcattctaaa

SEQ ID NO: 628683 - DNA, 22 bp, Artificial Sequence
  chemically synthesized
aagtaagtaagtttcattctaa

SEQ ID NO: 628684 - DNA, 22 bp, Artificial Sequence
  chemically synthesized
acctctgattttagaatgaaac

SEQ ID NO: 628685 - DNA, 22 bp, Artificial Sequence
  chemically synthesized
cctctgattttagaatgaaact

SEQ ID NO: 628686 - DNA, 22 bp, Artificial Sequence
  chemically synthesized
tgattttagaatgaaacttact

SEQ ID NO: 628687 - DNA, 22 bp, Artificial Sequence
  chemically synthesized
agaagtttaagtaagtaagttt

SEQ ID NO: 628688 - DNA, 22 bp, Artificial Sequence
  chemically synthesized
attttagaatgaaacttactta

SEQ ID NO: 628689 - DNA, 22 bp, Artificial Sequence
  chemically synthesized
ctaagaagtttaagtaagtaag

SEQ ID NO: 628690 - DNA, 22 bp, Artificial Sequence
  chemically synthesized
tagaatgaaacttacttactta

SEQ ID NO: 628691 - DNA, 22 bp, Artificial Sequence
  chemically synthesized
agaatgaaacttacttacttaa

SEQ ID NO: 628692 - DNA, 22 bp, Artificial Sequence
  chemically synthesized
gaatgaaacttacttacttaaa

SEQ ID NO: 628693 - DNA, 22 bp, Artificial Sequence
  chemically synthesized
catcctactaagaagtttaagt

SEQ ID NO: 628694 - DNA, 22 bp, Artificial Sequence
  chemically synthesized
acatcctactaagaagtttaag

SEQ ID NO: 628695 - DNA, 22 bp, Artificial Sequence
  chemically synthesized
tacatcctactaagaagtttaa

SEQ ID NO: 628696 - DNA, 22 bp, Artificial Sequence
  chemically synthesized
ctttacatcctactaagaagtt

SEQ ID NO: 628697 - DNA, 22 bp, Artificial Sequence
  chemically synthesized
acttacttaaacttcttagtag

SEQ ID NO: 628698 - DNA, 22 bp, Artificial Sequence
  chemically synthesized
cttacttaaacttcttagtagg

SEQ ID NO: 628699 - DNA, 22 bp, Artificial Sequence
  chemically synthesized
acttaaacttcttagtaggatg

SEQ ID NO: 628700 - DNA, 22 bp, Artificial Sequence
  chemically synthesized
cttaaacttcttagtaggatgt

SEQ ID NO: 628701 - DNA, 22 bp, Artificial Sequence
  chemically synthesized
aaacttcttagtaggatgtaaa

SEQ ID NO: 628702 - DNA, 22 bp, Artificial Sequence
  chemically synthesized
aacttcttagtaggatgtaaag

SEQ ID NO: 628703 - DNA, 22 bp, Artificial Sequence
  chemically synthesized
aaacaaggggttactttacatc

SEQ ID NO: 628704 - DNA, 22 bp, Artificial Sequence
  chemically synthesized
aaaacaaggggttactttacat

SEQ ID NO: 628705 - DNA, 22 bp, Artificial Sequence
  chemically synthesized
cttagtaggatgtaaagtaacc

SEQ ID NO: 628706 - DNA, 22 bp, Artificial Sequence
  chemically synthesized
ttagtaggatgtaaagtaaccc

SEQ ID NO: 628707 - DNA, 22 bp, Artificial Sequence
  chemically synthesized
agtaggatgtaaagtaacccct

SEQ ID NO: 628708 - DNA, 22 bp, Artificial Sequence
  chemically synthesized
agatttaaaacaaggggttact

SEQ ID NO: 628709 - DNA, 22 bp, Artificial Sequence
  chemically synthesized
gtaggatgtaaagtaacccctt

SEQ ID NO: 628710 - DNA, 22 bp, Artificial Sequence
  chemically synthesized
aaactcagatttaaaacaaggg

SEQ ID NO: 628711 - DNA, 22 bp, Artificial Sequence
  chemically synthesized
aaaactcagatttaaaacaagg

SEQ ID NO: 628712 - DNA, 22 bp, Artificial Sequence
  chemically synthesized
taaaactcagatttaaaacaag

SEQ ID NO: 628713 - DNA, 22 bp, Artificial Sequence
  chemically synthesized
ttaaaactcagatttaaaacaa

SEQ ID NO: 628714 - DNA, 22 bp, Artificial Sequence
  chemically synthesized
cccaaggatttttaaaactcag

SEQ ID NO: 628715 - DNA, 22 bp, Artificial Sequence
  chemically synthesized
acccaaggatttttaaaactca

SEQ ID NO: 628716 - DNA, 22 bp, Artificial Sequence
  chemically synthesized
tacccaaggatttttaaaactc

SEQ ID NO: 628717 - DNA, 22 bp, Artificial Sequence
  chemically synthesized
gttttaaatctgagttttaaaa

SEQ ID NO: 628718 - DNA, 22 bp, Artificial Sequence
  chemically synthesized
ttttaaatctgagttttaaaaa

SEQ ID NO: 628719 - DNA, 22 bp, Artificial Sequence
  chemically synthesized
tttacccaaggatttttaaaac

SEQ ID NO: 628720 - DNA, 22 bp, Artificial Sequence
  chemically synthesized
ctttacccaaggatttttaaaa

SEQ ID NO: 628721 - DNA, 22 bp, Artificial Sequence
  chemically synthesized
tctttacccaaggatttttaaa

SEQ ID NO: 628722 - DNA, 22 bp, Artificial Sequence
  chemically synthesized
taaatctgagttttaaaaatcc

SEQ ID NO: 628723 - DNA, 22 bp, Artificial Sequence
  chemically synthesized
ttctttacccaaggatttttaa

SEQ ID NO: 628724 - DNA, 22 bp, Artificial Sequence
  chemically synthesized
aaatctgagttttaaaaatcct

SEQ ID NO: 628725 - DNA, 22 bp, Artificial Sequence
  chemically synthesized
aatctgagttttaaaaatcctt

SEQ ID NO: 628726 - DNA, 22 bp, Artificial Sequence
  chemically synthesized
gaccttttctttacccaaggat

SEQ ID NO: 628727 - DNA, 22 bp, Artificial Sequence
  chemically synthesized
agttttaaaaatccttgggtaa

SEQ ID NO: 628728 - DNA, 22 bp, Artificial Sequence
  chemically synthesized
taaaaatccttgggtaaagaaa

SEQ ID NO: 628729 - DNA, 22 bp, Artificial Sequence
  chemically synthesized
aaaaatccttgggtaaagaaaa

SEQ ID NO: 628730 - DNA, 22 bp, Artificial Sequence
  chemically synthesized
aaaatccttgggtaaagaaaag

SEQ ID NO: 628731 - DNA, 22 bp, Artificial Sequence
  chemically synthesized
tgtgacgctggaccttttcttt

SEQ ID NO: 628732 - DNA, 22 bp, Artificial Sequence
  chemically synthesized
atgtgacgctggaccttttctt

SEQ ID NO: 628733 - DNA, 22 bp, Artificial Sequence
  chemically synthesized
tatgtgacgctggaccttttct

SEQ ID NO: 628734 - DNA, 22 bp, Artificial Sequence
  chemically synthesized
ctttatgtgacgctggaccttt

SEQ ID NO: 628735 - DNA, 22 bp, Artificial Sequence
  chemically synthesized
cctttatgtgacgctggacctt

SEQ ID NO: 628736 - DNA, 22 bp, Artificial Sequence
  chemically synthesized
tcctttatgtgacgctggacct

SEQ ID NO: 628737 - DNA, 22 bp, Artificial Sequence
  chemically synthesized
gggtaaagaaaaggtccagcgt

SEQ ID NO: 628738 - DNA, 22 bp, Artificial Sequence
  chemically synthesized
ttcctttatgtgacgctggacc

SEQ ID NO: 628739 - DNA, 22 bp, Artificial Sequence
  chemically synthesized
ggtaaagaaaaggtccagcgtc

SEQ ID NO: 628740 - DNA, 22 bp, Artificial Sequence
  chemically synthesized
tttcctttatgtgacgctggac

SEQ ID NO: 628741 - DNA, 22 bp, Artificial Sequence
  chemically synthesized
ttttcctttatgtgacgctgga

SEQ ID NO: 628742 - DNA, 22 bp, Artificial Sequence
  chemically synthesized
catttttttcctttatgtgacg

SEQ ID NO: 628743 - DNA, 22 bp, Artificial Sequence
  chemically synthesized
gcatttttttcctttatgtgac

SEQ ID NO: 628744 - DNA, 22 bp, Artificial Sequence
  chemically synthesized
tcttgcatttttttcctttatg

SEQ ID NO: 628745 - DNA, 22 bp, Artificial Sequence
  chemically synthesized
gtcttgcatttttttcctttat

SEQ ID NO: 628746 - DNA, 22 bp, Artificial Sequence
  chemically synthesized
tgtcttgcatttttttccttta

SEQ ID NO: 628747 - DNA, 22 bp, Artificial Sequence
  chemically synthesized
ttgtcttgcatttttttccttt

SEQ ID NO: 628748 - DNA, 22 bp, Artificial Sequence
  chemically synthesized
gtttttgtcttgcatttttttc

SEQ ID NO: 628749 - DNA, 22 bp, Artificial Sequence
  chemically synthesized
ggtttttgtcttgcattttttt

SEQ ID NO: 628750 - DNA, 22 bp, Artificial Sequence
  chemically synthesized
catgaagatttggtttttgtct

SEQ ID NO: 628751 - DNA, 22 bp, Artificial Sequence
  chemically synthesized
ccaaattacatgaagatttggt

SEQ ID NO: 628752 - DNA, 22 bp, Artificial Sequence
  chemically synthesized
aggtaacaaattaccaaattac

SEQ ID NO: 628753 - DNA, 22 bp, Artificial Sequence
  chemically synthesized
taaggtaacaaattaccaaatt

SEQ ID NO: 628754 - DNA, 22 bp, Artificial Sequence
  chemically synthesized
catgtaatttggtaatttgtta

SEQ ID NO: 628755 - DNA, 22 bp, Artificial Sequence
  chemically synthesized
atgtaatttggtaatttgttac

SEQ ID NO: 628756 - DNA, 22 bp, Artificial Sequence
  chemically synthesized
ggtaatttgttaccttagagct

SEQ ID NO: 628757 - DNA, 22 bp, Artificial Sequence
  chemically synthesized
gtaatttgttaccttagagctt

SEQ ID NO: 628758 - DNA, 22 bp, Artificial Sequence
  chemically synthesized
aaaagaaaacccaaagctctaa

SEQ ID NO: 628759 - DNA, 22 bp, Artificial Sequence
  chemically synthesized
caaaagaaaacccaaagctcta

SEQ ID NO: 628760 - DNA, 22 bp, Artificial Sequence
  chemically synthesized
tcaaaagaaaacccaaagctct

SEQ ID NO: 628761 - DNA, 22 bp, Artificial Sequence
  chemically synthesized
gttaccttagagctttgggttt

SEQ ID NO: 628762 - DNA, 22 bp, Artificial Sequence
  chemically synthesized
ttaccttagagctttgggtttt

SEQ ID NO: 628763 - DNA, 22 bp, Artificial Sequence
  chemically synthesized
ataattttcaaaagaaaaccca

SEQ ID NO: 628764 - DNA, 22 bp, Artificial Sequence
  chemically synthesized
ccttagagctttgggttttctt

SEQ ID NO: 628765 - DNA, 22 bp, Artificial Sequence
  chemically synthesized
cataattttcaaaagaaaaccc

SEQ ID NO: 628766 - DNA, 22 bp, Artificial Sequence
  chemically synthesized
cttcataattttcaaaagaaaa

SEQ ID NO: 628767 - DNA, 22 bp, Artificial Sequence
  chemically synthesized
agagctttgggttttcttttga

SEQ ID NO: 628768 - DNA, 22 bp, Artificial Sequence
  chemically synthesized
ccttcataattttcaaaagaaa

SEQ ID NO: 628769 - DNA, 22 bp, Artificial Sequence
  chemically synthesized
gagctttgggttttcttttgaa

SEQ ID NO: 628770 - DNA, 22 bp, Artificial Sequence
  chemically synthesized
tccttcataattttcaaaagaa

SEQ ID NO: 628771 - DNA, 22 bp, Artificial Sequence
  chemically synthesized
ttccttcataattttcaaaaga

SEQ ID NO: 628772 - DNA, 22 bp, Artificial Sequence
  chemically synthesized
tttccttcataattttcaaaag

SEQ ID NO: 628773 - DNA, 22 bp, Artificial Sequence
  chemically synthesized
tttttccttcataattttcaaa

SEQ ID NO: 628774 - DNA, 22 bp, Artificial Sequence
  chemically synthesized
ctttttccttcataattttcaa

SEQ ID NO: 628775 - DNA, 22 bp, Artificial Sequence
  chemically synthesized
tgggttttcttttgaaaattat

SEQ ID NO: 628776 - DNA, 22 bp, Artificial Sequence
  chemically synthesized
tctttttccttcataattttca

SEQ ID NO: 628777 - DNA, 22 bp, Artificial Sequence
  chemically synthesized
gggttttcttttgaaaattatg

SEQ ID NO: 628778 - DNA, 22 bp, Artificial Sequence
  chemically synthesized
ggttttcttttgaaaattatga

SEQ ID NO: 628779 - DNA, 22 bp, Artificial Sequence
  chemically synthesized
tttctttttccttcataatttt

SEQ ID NO: 628780 - DNA, 22 bp, Artificial Sequence
  chemically synthesized
tcttttgaaaattatgaaggaa

SEQ ID NO: 628781 - DNA, 22 bp, Artificial Sequence
  chemically synthesized
cttttgaaaattatgaaggaaa

SEQ ID NO: 628782 - DNA, 22 bp, Artificial Sequence
  chemically synthesized
taattctttctttttccttcat

SEQ ID NO: 628783 - DNA, 22 bp, Artificial Sequence
  chemically synthesized
ttttgaaaattatgaaggaaaa

SEQ ID NO: 628784 - DNA, 22 bp, Artificial Sequence
  chemically synthesized
ataattctttctttttccttca

SEQ ID NO: 628785 - DNA, 22 bp, Artificial Sequence
  chemically synthesized
tataattctttctttttccttc

SEQ ID NO: 628786 - DNA, 22 bp, Artificial Sequence
  chemically synthesized
ttgaaaattatgaaggaaaaag

SEQ ID NO: 628787 - DNA, 22 bp, Artificial Sequence
  chemically synthesized
tgaaaattatgaaggaaaaaga

SEQ ID NO: 628788 - DNA, 22 bp, Artificial Sequence
  chemically synthesized
gaaaattatgaaggaaaaagaa

SEQ ID NO: 628789 - DNA, 22 bp, Artificial Sequence
  chemically synthesized
ctttataattctttctttttcc

SEQ ID NO: 628790 - DNA, 22 bp, Artificial Sequence
  chemically synthesized
aaaattatgaaggaaaaagaaa

SEQ ID NO: 628791 - DNA, 22 bp, Artificial Sequence
  chemically synthesized
cctttataattctttctttttc

SEQ ID NO: 628792 - DNA, 22 bp, Artificial Sequence
  chemically synthesized
tcctttataattctttcttttt

SEQ ID NO: 628793 - DNA, 22 bp, Artificial Sequence
  chemically synthesized
ttcctttataattctttctttt

SEQ ID NO: 628794 - DNA, 22 bp, Artificial Sequence
  chemically synthesized
tttcctttataattctttcttt

SEQ ID NO: 628795 - DNA, 22 bp, Artificial Sequence
  chemically synthesized
tttttcctttataattctttct

SEQ ID NO: 628796 - DNA, 22 bp, Artificial Sequence
  chemically synthesized
ctttttcctttataattctttc

SEQ ID NO: 628797 - DNA, 22 bp, Artificial Sequence
  chemically synthesized
tgaaggaaaaagaaagaattat

SEQ ID NO: 628798 - DNA, 22 bp, Artificial Sequence
  chemically synthesized
tctttttcctttataattcttt

SEQ ID NO: 628799 - DNA, 22 bp, Artificial Sequence
  chemically synthesized
ttttctttttcctttataattc

SEQ ID NO: 628800 - DNA, 22 bp, Artificial Sequence
  chemically synthesized
cgttattttctttttcctttat

SEQ ID NO: 628801 - DNA, 22 bp, Artificial Sequence
  chemically synthesized
tccattgcgttattttcttttt

SEQ ID NO: 628802 - DNA, 22 bp, Artificial Sequence
  chemically synthesized
gtccattgcgttattttctttt

SEQ ID NO: 628803 - DNA, 22 bp, Artificial Sequence
  chemically synthesized
taaaggaaaaagaaaataacgc

SEQ ID NO: 628804 - DNA, 22 bp, Artificial Sequence
  chemically synthesized
accacttgtccattgcgttatt

SEQ ID NO: 628805 - DNA, 22 bp, Artificial Sequence
  chemically synthesized
caccacttgtccattgcgttat

SEQ ID NO: 628806 - DNA, 22 bp, Artificial Sequence
  chemically synthesized
acagcttcaccacttgtccatt

SEQ ID NO: 628807 - DNA, 22 bp, Artificial Sequence
  chemically synthesized
agttcacagcttcaccacttgt

SEQ ID NO: 628808 - DNA, 22 bp, Artificial Sequence
  chemically synthesized
tgcacacctgagttcacagctt

SEQ ID NO: 628809 - DNA, 22 bp, Artificial Sequence
  chemically synthesized
ataattgtgcacacctgagttc

SEQ ID NO: 628810 - DNA, 22 bp, Artificial Sequence
  chemically synthesized
ctgataattgtgcacacctgag

SEQ ID NO: 628811 - DNA, 22 bp, Artificial Sequence
  chemically synthesized
tgaactcaggtgtgcacaatta

SEQ ID NO: 628812 - DNA, 22 bp, Artificial Sequence
  chemically synthesized
gggtgttcctgataattgtgca

SEQ ID NO: 628813 - DNA, 22 bp, Artificial Sequence
  chemically synthesized
ggggtgttcctgataattgtgc

SEQ ID NO: 628814 - DNA, 22 bp, Artificial Sequence
  chemically synthesized
tggggtgttcctgataattgtg

SEQ ID NO: 628815 - DNA, 22 bp, Artificial Sequence
  chemically synthesized
gttttggggtgttcctgataat

SEQ ID NO: 628816 - DNA, 22 bp, Artificial Sequence
  chemically synthesized
aggtgtgcacaattatcaggaa

SEQ ID NO: 628817 - DNA, 22 bp, Artificial Sequence
  chemically synthesized
ggttttggggtgttcctgataa

SEQ ID NO: 628818 - DNA, 22 bp, Artificial Sequence
  chemically synthesized
tggttttggggtgttcctgata

SEQ ID NO: 628819 - DNA, 22 bp, Artificial Sequence
  chemically synthesized
actttggttttggggtgttcct

SEQ ID NO: 628820 - DNA, 22 bp, Artificial Sequence
  chemically synthesized
cctcactttggttttggggtgt

SEQ ID NO: 628821 - DNA, 22 bp, Artificial Sequence
  chemically synthesized
tacctcactttggttttggggt

SEQ ID NO: 628822 - DNA, 22 bp, Artificial Sequence
  chemically synthesized
ctacctcactttggttttgggg

SEQ ID NO: 628823 - DNA, 22 bp, Artificial Sequence
  chemically synthesized
tcaggaacaccccaaaaccaaa

SEQ ID NO: 628824 - DNA, 22 bp, Artificial Sequence
  chemically synthesized
tttctacctcactttggttttg

SEQ ID NO: 628825 - DNA, 22 bp, Artificial Sequence
  chemically synthesized
atgctatttctacctcactttg

SEQ ID NO: 628826 - DNA, 22 bp, Artificial Sequence
  chemically synthesized
tcatgctatttctacctcactt

SEQ ID NO: 628827 - DNA, 22 bp, Artificial Sequence
  chemically synthesized
ctcatgctatttctacctcact

SEQ ID NO: 628828 - DNA, 22 bp, Artificial Sequence
  chemically synthesized
acatcaaacacggcttctcatg

SEQ ID NO: 628829 - DNA, 22 bp, Artificial Sequence
  chemically synthesized
attaacatcaaacacggcttct

SEQ ID NO: 628830 - DNA, 22 bp, Artificial Sequence
  chemically synthesized
attaattaacatcaaacacggc

SEQ ID NO: 628831 - DNA, 22 bp, Artificial Sequence
  chemically synthesized
ataattaattaattaacatcaa

SEQ ID NO: 628832 - DNA, 22 bp, Artificial Sequence
  chemically synthesized
ttaataattaattaattaacat

SEQ ID NO: 628833 - DNA, 22 bp, Artificial Sequence
  chemically synthesized
tccattattaataattaattaa

SEQ ID NO: 628834 - DNA, 22 bp, Artificial Sequence
  chemically synthesized
gtccattattaataattaatta

SEQ ID NO: 628835 - DNA, 22 bp, Artificial Sequence
  chemically synthesized
tgtccattattaataattaatt

SEQ ID NO: 628836 - DNA, 22 bp, Artificial Sequence
  chemically synthesized
gatgttaattaattaattatta

SEQ ID NO: 628837 - DNA, 22 bp, Artificial Sequence
  chemically synthesized
atgttaattaattaattattaa

SEQ ID NO: 628838 - DNA, 22 bp, Artificial Sequence
  chemically synthesized
attaattaattattaataatgg

SEQ ID NO: 628839 - DNA, 22 bp, Artificial Sequence
  chemically synthesized
gagagtgggttttgtccattat

SEQ ID NO: 628840 - DNA, 22 bp, Artificial Sequence
  chemically synthesized
attaattattaataatggacaa

SEQ ID NO: 628841 - DNA, 22 bp, Artificial Sequence
  chemically synthesized
ggagagtgggttttgtccatta

SEQ ID NO: 628842 - DNA, 22 bp, Artificial Sequence
  chemically synthesized
tggagagtgggttttgtccatt

SEQ ID NO: 628843 - DNA, 22 bp, Artificial Sequence
  chemically synthesized
ttggagagtgggttttgtccat

SEQ ID NO: 628844 - DNA, 22 bp, Artificial Sequence
  chemically synthesized
attattaataatggacaaaacc

SEQ ID NO: 628845 - DNA, 22 bp, Artificial Sequence
  chemically synthesized
gcttttggagagtgggttttgt

SEQ ID NO: 628846 - DNA, 22 bp, Artificial Sequence
  chemically synthesized
ttaataatggacaaaacccact

SEQ ID NO: 628847 - DNA, 22 bp, Artificial Sequence
  chemically synthesized
ataatggacaaaacccactctc

SEQ ID NO: 628848 - DNA, 22 bp, Artificial Sequence
  chemically synthesized
acatcaagtgtaattagctttt

SEQ ID NO: 628849 - DNA, 22 bp, Artificial Sequence
  chemically synthesized
tccaaaagctaattacacttga

SEQ ID NO: 628850 - DNA, 22 bp, Artificial Sequence
  chemically synthesized
caaaagctaattacacttgatg

SEQ ID NO: 628851 - DNA, 22 bp, Artificial Sequence
  chemically synthesized
gagagtgggctgacatcaagtg

SEQ ID NO: 628852 - DNA, 22 bp, Artificial Sequence
  chemically synthesized
ggagagtgggctgacatcaagt

SEQ ID NO: 628853 - DNA, 22 bp, Artificial Sequence
  chemically synthesized
tggagagtgggctgacatcaag

SEQ ID NO: 628854 - DNA, 22 bp, Artificial Sequence
  chemically synthesized
ttggagagtgggctgacatcaa

SEQ ID NO: 628855 - DNA, 22 bp, Artificial Sequence
  chemically synthesized
gcttttggagagtgggctgaca

SEQ ID NO: 628856 - DNA, 22 bp, Artificial Sequence
  chemically synthesized
attacacttgatgtcagcccac

SEQ ID NO: 628857 - DNA, 22 bp, Artificial Sequence
  chemically synthesized
cacttgatgtcagcccactctc

SEQ ID NO: 628858 - DNA, 22 bp, Artificial Sequence
  chemically synthesized
gatgtcagcccactctccaaaa

SEQ ID NO: 628859 - DNA, 22 bp, Artificial Sequence
  chemically synthesized
atgtcagcccactctccaaaag

SEQ ID NO: 628860 - DNA, 22 bp, Artificial Sequence
  chemically synthesized
acatcaagtgtaattagctttt

SEQ ID NO: 628861 - DNA, 22 bp, Artificial Sequence
  chemically synthesized
tgacatcaagtgtaattagctt

SEQ ID NO: 628862 - DNA, 22 bp, Artificial Sequence
  chemically synthesized
cctctgacatcaagtgtaatta

SEQ ID NO: 628863 - DNA, 22 bp, Artificial Sequence
  chemically synthesized
tccaaaagctaattacacttga

SEQ ID NO: 628864 - DNA, 22 bp, Artificial Sequence
  chemically synthesized
ttacctctgacatcaagtgtaa

SEQ ID NO: 628865 - DNA, 22 bp, Artificial Sequence
  chemically synthesized
caaaagctaattacacttgatg

SEQ ID NO: 628866 - DNA, 22 bp, Artificial Sequence
  chemically synthesized
caaatctgttacctctgacatc

SEQ ID NO: 628867 - DNA, 22 bp, Artificial Sequence
  chemically synthesized
gcaaatctgttacctctgacat

SEQ ID NO: 628868 - DNA, 22 bp, Artificial Sequence
  chemically synthesized
tgcaaatctgttacctctgaca

SEQ ID NO: 628869 - DNA, 22 bp, Artificial Sequence
  chemically synthesized
attacacttgatgtcagaggta

SEQ ID NO: 628870 - DNA, 22 bp, Artificial Sequence
  chemically synthesized
cacttgatgtcagaggtaacag

SEQ ID NO: 628871 - DNA, 22 bp, Artificial Sequence
  chemically synthesized
taattttgcaaatctgttacct

SEQ ID NO: 628872 - DNA, 22 bp, Artificial Sequence
  chemically synthesized
gatgtcagaggtaacagatttg

SEQ ID NO: 628873 - DNA, 22 bp, Artificial Sequence
  chemically synthesized
atgtcagaggtaacagatttgc

SEQ ID NO: 628874 - DNA, 22 bp, Artificial Sequence
  chemically synthesized
aatagataccaccgtgtgacct

SEQ ID NO: 628875 - DNA, 22 bp, Artificial Sequence
  chemically synthesized
gcaaaattataggtcacacggt

SEQ ID NO: 628876 - DNA, 22 bp, Artificial Sequence
  chemically synthesized
caaaattataggtcacacggtg

SEQ ID NO: 628877 - DNA, 22 bp, Artificial Sequence
  chemically synthesized
attcaatagataccaccgtgtg

SEQ ID NO: 628878 - DNA, 22 bp, Artificial Sequence
  chemically synthesized
taggtcacacggtggtatctat

SEQ ID NO: 628879 - DNA, 22 bp, Artificial Sequence
  chemically synthesized
aatcattcattcaatagatacc

SEQ ID NO: 628880 - DNA, 22 bp, Artificial Sequence
  chemically synthesized
aaatcattcattcaatagatac

SEQ ID NO: 628881 - DNA, 22 bp, Artificial Sequence
  chemically synthesized
taaatcattcattcaatagata

SEQ ID NO: 628882 - DNA, 22 bp, Artificial Sequence
  chemically synthesized
ttaaatcattcattcaatagat

SEQ ID NO: 628883 - DNA, 22 bp, Artificial Sequence
  chemically synthesized
atttttaaatcattcattcaat

SEQ ID NO: 628884 - DNA, 22 bp, Artificial Sequence
  chemically synthesized
gatttttaaatcattcattcaa

SEQ ID NO: 628885 - DNA, 22 bp, Artificial Sequence
  chemically synthesized
tgatttttaaatcattcattca

SEQ ID NO: 628886 - DNA, 22 bp, Artificial Sequence
  chemically synthesized
ttgatttttaaatcattcattc

SEQ ID NO: 628887 - DNA, 22 bp, Artificial Sequence
  chemically synthesized
tttgatttttaaatcattcatt

SEQ ID NO: 628888 - DNA, 22 bp, Artificial Sequence
  chemically synthesized
tttttgatttttaaatcattca

SEQ ID NO: 628889 - DNA, 22 bp, Artificial Sequence
  chemically synthesized
ctttttgatttttaaatcattc

SEQ ID NO: 628890 - DNA, 22 bp, Artificial Sequence
  chemically synthesized
tttctttttgatttttaaatca

SEQ ID NO: 628891 - DNA, 22 bp, Artificial Sequence
  chemically synthesized
atttctttttgatttttaaatc

SEQ ID NO: 628892 - DNA, 22 bp, Artificial Sequence
  chemically synthesized
tatttctttttgatttttaaat

SEQ ID NO: 628893 - DNA, 22 bp, Artificial Sequence
  chemically synthesized
ttgaatgaatgatttaaaaatc

SEQ ID NO: 628894 - DNA, 22 bp, Artificial Sequence
  chemically synthesized
aatgaatgatttaaaaatcaaa

SEQ ID NO: 628895 - DNA, 22 bp, Artificial Sequence
  chemically synthesized
atgccattttatttctttttga

SEQ ID NO: 628896 - DNA, 22 bp, Artificial Sequence
  chemically synthesized
catgccattttatttctttttg

SEQ ID NO: 628897 - DNA, 22 bp, Artificial Sequence
  chemically synthesized
tcatgccattttatttcttttt

SEQ ID NO: 628898 - DNA, 22 bp, Artificial Sequence
  chemically synthesized
tttcatgccattttatttcttt

SEQ ID NO: 628899 - DNA, 22 bp, Artificial Sequence
  chemically synthesized
aaaaatcaaaaagaaataaaat

SEQ ID NO: 628900 - DNA, 22 bp, Artificial Sequence
  chemically synthesized
ctctttcatgccattttatttc

SEQ ID NO: 628901 - DNA, 22 bp, Artificial Sequence
  chemically synthesized
aaaatcaaaaagaaataaaatg

SEQ ID NO: 628902 - DNA, 22 bp, Artificial Sequence
  chemically synthesized
actctttcatgccattttattt

SEQ ID NO: 628903 - DNA, 22 bp, Artificial Sequence
  chemically synthesized
tactctttcatgccattttatt

SEQ ID NO: 628904 - DNA, 22 bp, Artificial Sequence
  chemically synthesized
gtaggaaaaagctttactcttt

SEQ ID NO: 628905 - DNA, 22 bp, Artificial Sequence
  chemically synthesized
aggactggtaggaaaaagcttt

SEQ ID NO: 628906 - DNA, 22 bp, Artificial Sequence
  chemically synthesized
aagaggaaaagctaaggactgg

SEQ ID NO: 628907 - DNA, 22 bp, Artificial Sequence
  chemically synthesized
tttcctaccagtccttagcttt

SEQ ID NO: 628908 - DNA, 22 bp, Artificial Sequence
  chemically synthesized
ttcctaccagtccttagctttt

SEQ ID NO: 628909 - DNA, 22 bp, Artificial Sequence
  chemically synthesized
tcctaccagtccttagcttttc

SEQ ID NO: 628910 - DNA, 22 bp, Artificial Sequence
  chemically synthesized
cctaccagtccttagcttttcc

SEQ ID NO: 628911 - DNA, 22 bp, Artificial Sequence
  chemically synthesized
ctaccagtccttagcttttcct

SEQ ID NO: 628912 - DNA, 22 bp, Artificial Sequence
  chemically synthesized
ccagtccttagcttttcctctt

SEQ ID NO: 628913 - DNA, 22 bp, Artificial Sequence
  chemically synthesized
aaaaaagaggagaaaagctcaa

SEQ ID NO: 628914 - DNA, 22 bp, Artificial Sequence
  chemically synthesized
agcttttcctcttgagcttttc

SEQ ID NO: 628915 - DNA, 22 bp, Artificial Sequence
  chemically synthesized
gcttttcctcttgagcttttct

SEQ ID NO: 628916 - DNA, 22 bp, Artificial Sequence
  chemically synthesized
ctcaaaaaagaggagaaaagct

SEQ ID NO: 628917 - DNA, 22 bp, Artificial Sequence
  chemically synthesized
ttcctcttgagcttttctcctc

SEQ ID NO: 628918 - DNA, 22 bp, Artificial Sequence
  chemically synthesized
tcctcttgagcttttctcctct

SEQ ID NO: 628919 - DNA, 22 bp, Artificial Sequence
  chemically synthesized
cctcttgagcttttctcctctt

SEQ ID NO: 628920 - DNA, 22 bp, Artificial Sequence
  chemically synthesized
ctcttgagcttttctcctcttt

SEQ ID NO: 628921 - DNA, 22 bp, Artificial Sequence
  chemically synthesized
ttgagcttttctcctctttttt

SEQ ID NO: 628922 - DNA, 22 bp, Artificial Sequence
  chemically synthesized
gagcttttctcctcttttttga

SEQ ID NO: 628923 - DNA, 22 bp, Artificial Sequence
  chemically synthesized
agcttttctcctcttttttgag

SEQ ID NO: 628924 - DNA, 22 bp, Artificial Sequence
  chemically synthesized
ttctcctcttttttgagcaatt

SEQ ID NO: 628925 - DNA, 22 bp, Artificial Sequence
  chemically synthesized
tctcctcttttttgagcaattt

SEQ ID NO: 628926 - DNA, 22 bp, Artificial Sequence
  chemically synthesized
ctcctcttttttgagcaatttt

SEQ ID NO: 628927 - DNA, 22 bp, Artificial Sequence
  chemically synthesized
tcctcttttttgagcaattttt

SEQ ID NO: 628928 - DNA, 22 bp, Artificial Sequence
  chemically synthesized
ctcttttttgagcaatttttgt

SEQ ID NO: 628929 - DNA, 22 bp, Artificial Sequence
  chemically synthesized
ttttttgagcaatttttgtttg

SEQ ID NO: 628930 - DNA, 22 bp, Artificial Sequence
  chemically synthesized
ttttgagcaatttttgtttgtt

SEQ ID NO: 628931 - DNA, 22 bp, Artificial Sequence
  chemically synthesized
aatatataaacaaacaaacaaa

SEQ ID NO: 628932 - DNA, 22 bp, Artificial Sequence
  chemically synthesized
tttgagcaatttttgtttgttt

SEQ ID NO: 628933 - DNA, 22 bp, Artificial Sequence
  chemically synthesized
ttgagcaatttttgtttgtttg

SEQ ID NO: 628934 - DNA, 22 bp, Artificial Sequence
  chemically synthesized
tgagcaatttttgtttgtttgt

SEQ ID NO: 628935 - DNA, 22 bp, Artificial Sequence
  chemically synthesized
gagcaatttttgtttgtttgtt

SEQ ID NO: 628936 - DNA, 22 bp, Artificial Sequence
  chemically synthesized
agcaatttttgtttgtttgttt

SEQ ID NO: 628937 - DNA, 22 bp, Artificial Sequence
  chemically synthesized
gacaggttaaatatataaacaa

SEQ ID NO: 628938 - DNA, 22 bp, Artificial Sequence
  chemically synthesized
ttgtttgtttgtttatatattt

SEQ ID NO: 628939 - DNA, 22 bp, Artificial Sequence
  chemically synthesized
tgtttgtttgtttatatattta

SEQ ID NO: 628940 - DNA, 22 bp, Artificial Sequence
  chemically synthesized
gtttgtttgtttatatatttaa

SEQ ID NO: 628941 - DNA, 22 bp, Artificial Sequence
  chemically synthesized
tttgtttgtttatatatttaac

SEQ ID NO: 628942 - DNA, 22 bp, Artificial Sequence
  chemically synthesized
gtggattagacaggttaaatat

SEQ ID NO: 628943 - DNA, 22 bp, Artificial Sequence
  chemically synthesized
ggtggattagacaggttaaata

SEQ ID NO: 628944 - DNA, 22 bp, Artificial Sequence
  chemically synthesized
gtttgtttatatatttaacctg

SEQ ID NO: 628945 - DNA, 22 bp, Artificial Sequence
  chemically synthesized
tttgtttatatatttaacctgt

SEQ ID NO: 628946 - DNA, 22 bp, Artificial Sequence
  chemically synthesized
ttggtggattagacaggttaaa

SEQ ID NO: 628947 - DNA, 22 bp, Artificial Sequence
  chemically synthesized
cttggtggattagacaggttaa

SEQ ID NO: 628948 - DNA, 22 bp, Artificial Sequence
  chemically synthesized
gtttatatatttaacctgtcta

SEQ ID NO: 628949 - DNA, 22 bp, Artificial Sequence
  chemically synthesized
tttatatatttaacctgtctaa

SEQ ID NO: 628950 - DNA, 22 bp, Artificial Sequence
  chemically synthesized
atatatttaacctgtctaatcc

SEQ ID NO: 628951 - DNA, 22 bp, Artificial Sequence
  chemically synthesized
tatatttaacctgtctaatcca

SEQ ID NO: 628952 - DNA, 22 bp, Artificial Sequence
  chemically synthesized
caaaaaaacccttcttggtgga

SEQ ID NO: 628953 - DNA, 22 bp, Artificial Sequence
  chemically synthesized
aacctgtctaatccaccaagaa

SEQ ID NO: 628954 - DNA, 22 bp, Artificial Sequence
  chemically synthesized
acctgtctaatccaccaagaag

SEQ ID NO: 628955 - DNA, 22 bp, Artificial Sequence
  chemically synthesized
tctaatccaccaagaagggttt

SEQ ID NO: 628956 - DNA, 22 bp, Artificial Sequence
  chemically synthesized
aaatgttacaaaaaaacccttc

SEQ ID NO: 628957 - DNA, 22 bp, Artificial Sequence
  chemically synthesized
atccaccaagaagggttttttt

SEQ ID NO: 628958 - DNA, 22 bp, Artificial Sequence
  chemically synthesized
attcaaatgttacaaaaaaacc

SEQ ID NO: 628959 - DNA, 22 bp, Artificial Sequence
  chemically synthesized
ttttgtaacatttgaatcaatt

SEQ ID NO: 628960 - DNA, 22 bp, Artificial Sequence
  chemically synthesized
tttgtaacatttgaatcaattt

SEQ ID NO: 628961 - DNA, 22 bp, Artificial Sequence
  chemically synthesized
ttgtaacatttgaatcaatttg

SEQ ID NO: 628962 - DNA, 22 bp, Artificial Sequence
  chemically synthesized
tgtaacatttgaatcaatttgc

SEQ ID NO: 628963 - DNA, 22 bp, Artificial Sequence
  chemically synthesized
gtaacatttgaatcaatttgcc

SEQ ID NO: 628964 - DNA, 22 bp, Artificial Sequence
  chemically synthesized
taacatttgaatcaatttgcct

SEQ ID NO: 628965 - DNA, 22 bp, Artificial Sequence
  chemically synthesized
taagtaagtaagaaagaaggca

SEQ ID NO: 628966 - DNA, 22 bp, Artificial Sequence
  chemically synthesized
gtaagtaagtaagaaagaaggc

SEQ ID NO: 628967 - DNA, 22 bp, Artificial Sequence
  chemically synthesized
gaatcaatttgccttctttctt

SEQ ID NO: 628968 - DNA, 22 bp, Artificial Sequence
  chemically synthesized
aatcaatttgccttctttctta

SEQ ID NO: 628969 - DNA, 22 bp, Artificial Sequence
  chemically synthesized
cacacaggtttgtaagtaagta

SEQ ID NO: 628970 - DNA, 22 bp, Artificial Sequence
  chemically synthesized
gccttctttcttacttacttac

SEQ ID NO: 628971 - DNA, 22 bp, Artificial Sequence
  chemically synthesized
ccttctttcttacttacttaca

SEQ ID NO: 628972 - DNA, 22 bp, Artificial Sequence
  chemically synthesized
ctttcttacttacttacaaacc

SEQ ID NO: 628973 - DNA, 22 bp, Artificial Sequence
  chemically synthesized
tttcttacttacttacaaacct

SEQ ID NO: 628974 - DNA, 22 bp, Artificial Sequence
  chemically synthesized
tcttacttacttacaaacctgt

SEQ ID NO: 628975 - DNA, 22 bp, Artificial Sequence
  chemically synthesized
cttacttacttacaaacctgtg

SEQ ID NO: 628976 - DNA, 22 bp, Artificial Sequence
  chemically synthesized
cgagtagttccacacaggtttg

SEQ ID NO: 628977 - DNA, 22 bp, Artificial Sequence
  chemically synthesized
ttacttacttacaaacctgtgt

SEQ ID NO: 628978 - DNA, 22 bp, Artificial Sequence
  chemically synthesized
tgcgagtagttccacacaggtt

SEQ ID NO: 628979 - DNA, 22 bp, Artificial Sequence
  chemically synthesized
acttacttacaaacctgtgtgg

SEQ ID NO: 628980 - DNA, 22 bp, Artificial Sequence
  chemically synthesized
cttacttacaaacctgtgtgga

SEQ ID NO: 628981 - DNA, 22 bp, Artificial Sequence
  chemically synthesized
tctgcgagtagttccacacagg

SEQ ID NO: 628982 - DNA, 22 bp, Artificial Sequence
  chemically synthesized
ctctgcgagtagttccacacag

SEQ ID NO: 628983 - DNA, 22 bp, Artificial Sequence
  chemically synthesized
acttacaaacctgtgtggaact

SEQ ID NO: 628984 - DNA, 22 bp, Artificial Sequence
  chemically synthesized
cttacaaacctgtgtggaacta

SEQ ID NO: 628985 - DNA, 22 bp, Artificial Sequence
  chemically synthesized
catttctctgcgagtagttcca

SEQ ID NO: 628986 - DNA, 22 bp, Artificial Sequence
  chemically synthesized
acaaacctgtgtggaactactc

SEQ ID NO: 628987 - DNA, 22 bp, Artificial Sequence
  chemically synthesized
gcatttctctgcgagtagttcc

SEQ ID NO: 628988 - DNA, 22 bp, Artificial Sequence
  chemically synthesized
caaacctgtgtggaactactcg

SEQ ID NO: 628989 - DNA, 22 bp, Artificial Sequence
  chemically synthesized
tgcatttctctgcgagtagttc

SEQ ID NO: 628990 - DNA, 22 bp, Artificial Sequence
  chemically synthesized
catcctttgcatttctctgcga

SEQ ID NO: 628991 - DNA, 22 bp, Artificial Sequence
  chemically synthesized
tgtggaactactcgcagagaaa

SEQ ID NO: 628992 - DNA, 22 bp, Artificial Sequence
  chemically synthesized
ccatcctttgcatttctctgcg

SEQ ID NO: 628993 - DNA, 22 bp, Artificial Sequence
  chemically synthesized
tgtttccatcctttgcatttct

SEQ ID NO: 628994 - DNA, 22 bp, Artificial Sequence
  chemically synthesized
ctcgcagagaaatgcaaaggat

SEQ ID NO: 628995 - DNA, 22 bp, Artificial Sequence
  chemically synthesized
gcagagaaatgcaaaggatgga

SEQ ID NO: 628996 - DNA, 22 bp, Artificial Sequence
  chemically synthesized
acaggtatcaacccagaagccc

SEQ ID NO: 628997 - DNA, 22 bp, Artificial Sequence
  chemically synthesized
tgatactgacaggtatcaaccc

SEQ ID NO: 628998 - DNA, 22 bp, Artificial Sequence
  chemically synthesized
gtgatactgacaggtatcaacc

SEQ ID NO: 628999 - DNA, 22 bp, Artificial Sequence
  chemically synthesized
atgggcttctgggttgatacct

SEQ ID NO: 629000 - DNA, 22 bp, Artificial Sequence
  chemically synthesized
ctgggttgatacctgtcagtat

SEQ ID NO: 629001 - DNA, 22 bp, Artificial Sequence
  chemically synthesized
tgggttgatacctgtcagtatc

SEQ ID NO: 629002 - DNA, 22 bp, Artificial Sequence
  chemically synthesized
ggttgatacctgtcagtatcac

SEQ ID NO: 629003 - DNA, 22 bp, Artificial Sequence
  chemically synthesized
atacctgtcagtatcacaaatg

SEQ ID NO: 629004 - DNA, 22 bp, Artificial Sequence
  chemically synthesized
tcagtatcacaaatgtgatggg

SEQ ID NO: 629005 - DNA, 22 bp, Artificial Sequence
  chemically synthesized
ggaaaaggtgtaaaacagtagc

SEQ ID NO: 629006 - DNA, 22 bp, Artificial Sequence
  chemically synthesized
gggaaaaggtgtaaaacagtag

SEQ ID NO: 629007 - DNA, 22 bp, Artificial Sequence
  chemically synthesized
tgggaaaaggtgtaaaacagta

SEQ ID NO: 629008 - DNA, 22 bp, Artificial Sequence
  chemically synthesized
ctgttttacaccttttcccaaa

SEQ ID NO: 629009 - DNA, 22 bp, Artificial Sequence
  chemically synthesized
aaataaataaactttgggaaaa

SEQ ID NO: 629010 - DNA, 22 bp, Artificial Sequence
  chemically synthesized
aaaataaataaactttgggaaa

SEQ ID NO: 629011 - DNA, 22 bp, Artificial Sequence
  chemically synthesized
ttttacaccttttcccaaagtt

SEQ ID NO: 629012 - DNA, 22 bp, Artificial Sequence
  chemically synthesized
tacaccttttcccaaagtttat

SEQ ID NO: 629013 - DNA, 22 bp, Artificial Sequence
  chemically synthesized
acaccttttcccaaagtttatt

SEQ ID NO: 629014 - DNA, 22 bp, Artificial Sequence
  chemically synthesized
caccttttcccaaagtttattt

SEQ ID NO: 629015 - DNA, 22 bp, Artificial Sequence
  chemically synthesized
ttcccaaagtttatttatttta

SEQ ID NO: 629016 - DNA, 22 bp, Artificial Sequence
  chemically synthesized
tcccaaagtttatttattttaa

SEQ ID NO: 629017 - DNA, 22 bp, Artificial Sequence
  chemically synthesized
cccaaagtttatttattttaaa

SEQ ID NO: 629018 - DNA, 22 bp, Artificial Sequence
  chemically synthesized
ccaaagtttatttattttaaat

SEQ ID NO: 629019 - DNA, 22 bp, Artificial Sequence
  chemically synthesized
aatgccacaagacataatttaa

SEQ ID NO: 629020 - DNA, 22 bp, Artificial Sequence
  chemically synthesized
aaatgccacaagacataattta

SEQ ID NO: 629021 - DNA, 22 bp, Artificial Sequence
  chemically synthesized
taaatgccacaagacataattt

SEQ ID NO: 629022 - DNA, 22 bp, Artificial Sequence
  chemically synthesized
ttaaatgccacaagacataatt

SEQ ID NO: 629023 - DNA, 22 bp, Artificial Sequence
  chemically synthesized
atttattttaaattatgtcttg

SEQ ID NO: 629024 - DNA, 22 bp, Artificial Sequence
  chemically synthesized
tttattttaaattatgtcttgt

SEQ ID NO: 629025 - DNA, 22 bp, Artificial Sequence
  chemically synthesized
attttaaattatgtcttgtggc

SEQ ID NO: 629026 - DNA, 22 bp, Artificial Sequence
  chemically synthesized
ttttaaattatgtcttgtggca

SEQ ID NO: 629027 - DNA, 22 bp, Artificial Sequence
  chemically synthesized
taaattatgtcttgtggcattt

SEQ ID NO: 629028 - DNA, 22 bp, Artificial Sequence
  chemically synthesized
aaattatgtcttgtggcattta

SEQ ID NO: 629029 - DNA, 22 bp, Artificial Sequence
  chemically synthesized
aattatgtcttgtggcatttaa

SEQ ID NO: 629030 - DNA, 22 bp, Artificial Sequence
  chemically synthesized
tgtcttgtggcatttaaaaact

SEQ ID NO: 629031 - DNA, 22 bp, Artificial Sequence
  chemically synthesized
tcccatgtgggatgagttttta

SEQ ID NO: 629032 - DNA, 22 bp, Artificial Sequence
  chemically synthesized
ttgtcccatgtgggatgagttt

SEQ ID NO: 629033 - DNA, 22 bp, Artificial Sequence
  chemically synthesized
gtggcatttaaaaactcatccc

SEQ ID NO: 629034 - DNA, 22 bp, Artificial Sequence
  chemically synthesized
attgtcccatgtgggatgagtt

SEQ ID NO: 629035 - DNA, 22 bp, Artificial Sequence
  chemically synthesized
tggcatttaaaaactcatccca

SEQ ID NO: 629036 - DNA, 22 bp, Artificial Sequence
  chemically synthesized
gatttattgtcccatgtgggat

SEQ ID NO: 629037 - DNA, 22 bp, Artificial Sequence
  chemically synthesized
agatttattgtcccatgtggga

SEQ ID NO: 629038 - DNA, 22 bp, Artificial Sequence
  chemically synthesized
tagatttattgtcccatgtggg

SEQ ID NO: 629039 - DNA, 22 bp, Artificial Sequence
  chemically synthesized
ttagatttattgtcccatgtgg

SEQ ID NO: 629040 - DNA, 22 bp, Artificial Sequence
  chemically synthesized
aaaaactcatcccacatgggac

SEQ ID NO: 629041 - DNA, 22 bp, Artificial Sequence
  chemically synthesized
tttagatttattgtcccatgtg

SEQ ID NO: 629042 - DNA, 22 bp, Artificial Sequence
  chemically synthesized
aaaactcatcccacatgggaca

SEQ ID NO: 629043 - DNA, 22 bp, Artificial Sequence
  chemically synthesized
ttttagatttattgtcccatgt

SEQ ID NO: 629044 - DNA, 22 bp, Artificial Sequence
  chemically synthesized
cttttttagatttattgtccca

SEQ ID NO: 629045 - DNA, 22 bp, Artificial Sequence
  chemically synthesized
ttgcttttttagatttattgtc

SEQ ID NO: 629046 - DNA, 22 bp, Artificial Sequence
  chemically synthesized
atcccacatgggacaataaatc

SEQ ID NO: 629047 - DNA, 22 bp, Artificial Sequence
  chemically synthesized
gttgcttttttagatttattgt

SEQ ID NO: 629048 - DNA, 22 bp, Artificial Sequence
  chemically synthesized
tgttgcttttttagatttattg

SEQ ID NO: 629049 - DNA, 22 bp, Artificial Sequence
  chemically synthesized
ttgttgcttttttagatttatt

SEQ ID NO: 629050 - DNA, 22 bp, Artificial Sequence
  chemically synthesized
gtttttgttgcttttttagatt

SEQ ID NO: 629051 - DNA, 22 bp, Artificial Sequence
  chemically synthesized
ggtttttgttgcttttttagat

SEQ ID NO: 629052 - DNA, 22 bp, Artificial Sequence
  chemically synthesized
ggtggtttggtttttgttgctt

SEQ ID NO: 629053 - DNA, 22 bp, Artificial Sequence
  chemically synthesized
aaaaagcaacaaaaaccaaacc

SEQ ID NO: 629054 - DNA, 22 bp, Artificial Sequence
  chemically synthesized
acagtcaaaaggaactgggtgg

SEQ ID NO: 629055 - DNA, 22 bp, Artificial Sequence
  chemically synthesized
tcacagtcaaaaggaactgggt

SEQ ID NO: 629056 - DNA, 22 bp, Artificial Sequence
  chemically synthesized
ctcacagtcaaaaggaactggg

SEQ ID NO: 629057 - DNA, 22 bp, Artificial Sequence
  chemically synthesized
ttctcacagtcaaaaggaactg

SEQ ID NO: 629058 - DNA, 22 bp, Artificial Sequence
  chemically synthesized
tgccctcttctcacagtcaaaa

SEQ ID NO: 629059 - DNA, 22 bp, Artificial Sequence
  chemically synthesized
ttatgccctcttctcacagtca

SEQ ID NO: 629060 - DNA, 22 bp, Artificial Sequence
  chemically synthesized
aattattatgccctcttctcac

SEQ ID NO: 629061 - DNA, 22 bp, Artificial Sequence
  chemically synthesized
cttttgactgtgagaagagggc

SEQ ID NO: 629062 - DNA, 22 bp, Artificial Sequence
  chemically synthesized
ttgactgtgagaagagggcata

SEQ ID NO: 629063 - DNA, 22 bp, Artificial Sequence
  chemically synthesized
caactaaattattatgccctct

SEQ ID NO: 629064 - DNA, 22 bp, Artificial Sequence
  chemically synthesized
tgactgtgagaagagggcataa

SEQ ID NO: 629065 - DNA, 22 bp, Artificial Sequence
  chemically synthesized
gactgtgagaagagggcataat

SEQ ID NO: 629066 - DNA, 22 bp, Artificial Sequence
  chemically synthesized
actgtgagaagagggcataata

SEQ ID NO: 629067 - DNA, 22 bp, Artificial Sequence
  chemically synthesized
taattacaactaaattattatg

SEQ ID NO: 629068 - DNA, 22 bp, Artificial Sequence
  chemically synthesized
tgagaagagggcataataattt

SEQ ID NO: 629069 - DNA, 22 bp, Artificial Sequence
  chemically synthesized
tgtaattacaactaaattatta

SEQ ID NO: 629070 - DNA, 22 bp, Artificial Sequence
  chemically synthesized
tctgtaattacaactaaattat

SEQ ID NO: 629071 - DNA, 22 bp, Artificial Sequence
  chemically synthesized
ataatacataaagttctctgta

SEQ ID NO: 629072 - DNA, 22 bp, Artificial Sequence
  chemically synthesized
agttgtaattacagagaacttt

SEQ ID NO: 629073 - DNA, 22 bp, Artificial Sequence
  chemically synthesized
ttcataatacataaagttctct

SEQ ID NO: 629074 - DNA, 22 bp, Artificial Sequence
  chemically synthesized
gttgtaattacagagaacttta

SEQ ID NO: 629075 - DNA, 22 bp, Artificial Sequence
  chemically synthesized
taattacagagaactttatgta

SEQ ID NO: 629076 - DNA, 22 bp, Artificial Sequence
  chemically synthesized
gatgattgttcataatacataa

SEQ ID NO: 629077 - DNA, 22 bp, Artificial Sequence
  chemically synthesized
cagagaactttatgtattatga

SEQ ID NO: 629078 - DNA, 22 bp, Artificial Sequence
  chemically synthesized
agtgaaggattggatgattgtt

SEQ ID NO: 629079 - DNA, 22 bp, Artificial Sequence
  chemically synthesized
tatgtattatgaacaatcatcc

SEQ ID NO: 629080 - DNA, 22 bp, Artificial Sequence
  chemically synthesized
aagtgaaggattggatgattgt

SEQ ID NO: 629081 - DNA, 22 bp, Artificial Sequence
  chemically synthesized
atgtattatgaacaatcatcca

SEQ ID NO: 629082 - DNA, 22 bp, Artificial Sequence
  chemically synthesized
taagtgaaggattggatgattg

SEQ ID NO: 629083 - DNA, 22 bp, Artificial Sequence
  chemically synthesized
tgtattatgaacaatcatccaa

SEQ ID NO: 629084 - DNA, 22 bp, Artificial Sequence
  chemically synthesized
tttaagtgaaggattggatgat

SEQ ID NO: 629085 - DNA, 22 bp, Artificial Sequence
  chemically synthesized
tgaacaatcatccaatccttca

SEQ ID NO: 629086 - DNA, 22 bp, Artificial Sequence
  chemically synthesized
tgaaggagtaggccactcttta

SEQ ID NO: 629087 - DNA, 22 bp, Artificial Sequence
  chemically synthesized
cacttaaagagtggcctactcc

SEQ ID NO: 629088 - DNA, 22 bp, Artificial Sequence
  chemically synthesized
acttaaagagtggcctactcct

SEQ ID NO: 629089 - DNA, 22 bp, Artificial Sequence
  chemically synthesized
aaagagtggcctactccttcac

SEQ ID NO: 629090 - DNA, 22 bp, Artificial Sequence
  chemically synthesized
aagagtggcctactccttcaca

SEQ ID NO: 629091 - DNA, 22 bp, Artificial Sequence
  chemically synthesized
ccagcccatccctgtgaaggag

SEQ ID NO: 629092 - DNA, 22 bp, Artificial Sequence
  chemically synthesized
tggattcccagcccatccctgt

SEQ ID NO: 629093 - DNA, 22 bp, Artificial Sequence
  chemically synthesized
ctccttcacagggatgggctgg

SEQ ID NO: 629094 - DNA, 22 bp, Artificial Sequence
  chemically synthesized
cttcacagggatgggctgggaa

SEQ ID NO: 629095 - DNA, 22 bp, Artificial Sequence
  chemically synthesized
gagggctatggattcccagccc

SEQ ID NO: 629096 - DNA, 22 bp, Artificial Sequence
  chemically synthesized
cacagggatgggctgggaatcc

SEQ ID NO: 629097 - DNA, 22 bp, Artificial Sequence
  chemically synthesized
acagggatgggctgggaatcca

SEQ ID NO: 629098 - DNA, 22 bp, Artificial Sequence
  chemically synthesized
ggaatccatagccctccagccc

SEQ ID NO: 629099 - DNA, 22 bp, Artificial Sequence
  chemically synthesized
ccaagcagtagcaggacgatga

SEQ ID NO: 629100 - DNA, 22 bp, Artificial Sequence
  chemically synthesized
cagccctatcatcgtcctgcta

SEQ ID NO: 629101 - DNA, 22 bp, Artificial Sequence
  chemically synthesized
actcccaagcagtagcaggacg

SEQ ID NO: 629102 - DNA, 22 bp, Artificial Sequence
  chemically synthesized
aactcccaagcagtagcaggac

SEQ ID NO: 629103 - DNA, 22 bp, Artificial Sequence
  chemically synthesized
taactcccaagcagtagcagga

SEQ ID NO: 629104 - DNA, 22 bp, Artificial Sequence
  chemically synthesized
ttaactcccaagcagtagcagg

SEQ ID NO: 629105 - DNA, 22 bp, Artificial Sequence
  chemically synthesized
tttaactcccaagcagtagcag

SEQ ID NO: 629106 - DNA, 22 bp, Artificial Sequence
  chemically synthesized
tcatcgtcctgctactgcttgg

SEQ ID NO: 629107 - DNA, 22 bp, Artificial Sequence
  chemically synthesized
ctactgcttgggagttaaaaaa

SEQ ID NO: 629108 - DNA, 22 bp, Artificial Sequence
  chemically synthesized
ctgcttgggagttaaaaaatac

SEQ ID NO: 629109 - DNA, 22 bp, Artificial Sequence
  chemically synthesized
tgaacatcagaaggtatttttt

SEQ ID NO: 629110 - DNA, 22 bp, Artificial Sequence
  chemically synthesized
gtgaacatcagaaggtattttt

SEQ ID NO: 629111 - DNA, 22 bp, Artificial Sequence
  chemically synthesized
cttgggagttaaaaaatacctt

SEQ ID NO: 629112 - DNA, 22 bp, Artificial Sequence
  chemically synthesized
gggagttaaaaaataccttctg

SEQ ID NO: 629113 - DNA, 22 bp, Artificial Sequence
  chemically synthesized
ggagttaaaaaataccttctga

SEQ ID NO: 629114 - DNA, 22 bp, Artificial Sequence
  chemically synthesized
accttgtgaacatcagaaggta

SEQ ID NO: 629115 - DNA, 22 bp, Artificial Sequence
  chemically synthesized
tgaccttgtgaacatcagaagg

SEQ ID NO: 629116 - DNA, 22 bp, Artificial Sequence
  chemically synthesized
aaaaataccttctgatgttcac

SEQ ID NO: 629117 - DNA, 22 bp, Artificial Sequence
  chemically synthesized
ctgatgttcacaaggtcagaat

SEQ ID NO: 629118 - DNA, 22 bp, Artificial Sequence
  chemically synthesized
tgatgttcacaaggtcagaata

SEQ ID NO: 629119 - DNA, 22 bp, Artificial Sequence
  chemically synthesized
atgttcacaaggtcagaatacc

SEQ ID NO: 629120 - DNA, 22 bp, Artificial Sequence
  chemically synthesized
acaaggtcagaataccttctga

SEQ ID NO: 629121 - DNA, 22 bp, Artificial Sequence
  chemically synthesized
agtggaaatcaatcagaaggta

SEQ ID NO: 629122 - DNA, 22 bp, Artificial Sequence
  chemically synthesized
cagtggaaatcaatcagaaggt

SEQ ID NO: 629123 - DNA, 22 bp, Artificial Sequence
  chemically synthesized
atgatgcttcagtggaaatcaa

SEQ ID NO: 629124 - DNA, 22 bp, Artificial Sequence
  chemically synthesized
aatgatgcttcagtggaaatca

SEQ ID NO: 629125 - DNA, 22 bp, Artificial Sequence
  chemically synthesized
gatttaatgatgcttcagtgga

SEQ ID NO: 629126 - DNA, 22 bp, Artificial Sequence
  chemically synthesized
agatttaatgatgcttcagtgg

SEQ ID NO: 629127 - DNA, 22 bp, Artificial Sequence
  chemically synthesized
ctgattgatttccactgaagca

SEQ ID NO: 629128 - DNA, 22 bp, Artificial Sequence
  chemically synthesized
tgattgatttccactgaagcat

SEQ ID NO: 629129 - DNA, 22 bp, Artificial Sequence
  chemically synthesized
attgatttccactgaagcatca

SEQ ID NO: 629130 - DNA, 22 bp, Artificial Sequence
  chemically synthesized
atttccactgaagcatcattaa

SEQ ID NO: 629131 - DNA, 22 bp, Artificial Sequence
  chemically synthesized
ccactgaagcatcattaaatct

SEQ ID NO: 629132 - DNA, 22 bp, Artificial Sequence
  chemically synthesized
cactgaagcatcattaaatcta

SEQ ID NO: 629133 - DNA, 22 bp, Artificial Sequence
  chemically synthesized
gcaatgccacgatttagattta

SEQ ID NO: 629134 - DNA, 22 bp, Artificial Sequence
  chemically synthesized
aagcatcattaaatctaaatcg

SEQ ID NO: 629135 - DNA, 22 bp, Artificial Sequence
  chemically synthesized
ctagcaatgccacgatttagat

SEQ ID NO: 629136 - DNA, 22 bp, Artificial Sequence
  chemically synthesized
ctgctagcaatgccacgattta

SEQ ID NO: 629137 - DNA, 22 bp, Artificial Sequence
  chemically synthesized
ctgctgctagcaatgccacgat

SEQ ID NO: 629138 - DNA, 22 bp, Artificial Sequence
  chemically synthesized
cctgctgctagcaatgccacga

SEQ ID NO: 629139 - DNA, 22 bp, Artificial Sequence
  chemically synthesized
aatctaaatcgtggcattgcta

SEQ ID NO: 629140 - DNA, 22 bp, Artificial Sequence
  chemically synthesized
agcttcctgctgctagcaatgc

SEQ ID NO: 629141 - DNA, 22 bp, Artificial Sequence
  chemically synthesized
aatcgtggcattgctagcagca

SEQ ID NO: 629142 - DNA, 22 bp, Artificial Sequence
  chemically synthesized
atacattcagcttcctgctgct

SEQ ID NO: 629143 - DNA, 22 bp, Artificial Sequence
  chemically synthesized
attgatacattcagcttcctgc

SEQ ID NO: 629144 - DNA, 22 bp, Artificial Sequence
  chemically synthesized
attgattgatacattcagcttc

SEQ ID NO: 629145 - DNA, 22 bp, Artificial Sequence
  chemically synthesized
ctagcagcaggaagctgaatgt

SEQ ID NO: 629146 - DNA, 22 bp, Artificial Sequence
  chemically synthesized
attgattgattgatacattcag

SEQ ID NO: 629147 - DNA, 22 bp, Artificial Sequence
  chemically synthesized
gcagcaggaagctgaatgtatc

SEQ ID NO: 629148 - DNA, 22 bp, Artificial Sequence
  chemically synthesized
attgattgattgattgatacat

SEQ ID NO: 629149 - DNA, 22 bp, Artificial Sequence
  chemically synthesized
gttgattgattgattgattgat

SEQ ID NO: 629150 - DNA, 22 bp, Artificial Sequence
  chemically synthesized
gttggttgattgattgattgat

SEQ ID NO: 629151 - DNA, 22 bp, Artificial Sequence
  chemically synthesized
aatgtatcaatcaatcaatcaa

SEQ ID NO: 629152 - DNA, 22 bp, Artificial Sequence
  chemically synthesized
tatcagagtgagtaatcggttg

SEQ ID NO: 629153 - DNA, 22 bp, Artificial Sequence
  chemically synthesized
ttatatcagagtgagtaatcgg

SEQ ID NO: 629154 - DNA, 22 bp, Artificial Sequence
  chemically synthesized
attatatcagagtgagtaatcg

SEQ ID NO: 629155 - DNA, 22 bp, Artificial Sequence
  chemically synthesized
ctcactctgatataataagtcc

SEQ ID NO: 629156 - DNA, 22 bp, Artificial Sequence
  chemically synthesized
actctgatataataagtcctgt

SEQ ID NO: 629157 - DNA, 22 bp, Artificial Sequence
  chemically synthesized
tgatataataagtcctgtgtat

SEQ ID NO: 629158 - DNA, 22 bp, Artificial Sequence
  chemically synthesized
atataataagtcctgtgtattc

SEQ ID NO: 629159 - DNA, 22 bp, Artificial Sequence
  chemically synthesized
aagggaacatgtgaatgaatac

SEQ ID NO: 629160 - DNA, 22 bp, Artificial Sequence
  chemically synthesized
aaagggaacatgtgaatgaata

SEQ ID NO: 629161 - DNA, 22 bp, Artificial Sequence
  chemically synthesized
taaagggaacatgtgaatgaat

SEQ ID NO: 629162 - DNA, 22 bp, Artificial Sequence
  chemically synthesized
ttaaagggaacatgtgaatgaa

SEQ ID NO: 629163 - DNA, 22 bp, Artificial Sequence
  chemically synthesized
tttaaagggaacatgtgaatga

SEQ ID NO: 629164 - DNA, 22 bp, Artificial Sequence
  chemically synthesized
ttttaaagggaacatgtgaatg

SEQ ID NO: 629165 - DNA, 22 bp, Artificial Sequence
  chemically synthesized
gatttttttaaagggaacatgt

SEQ ID NO: 629166 - DNA, 22 bp, Artificial Sequence
  chemically synthesized
tgtattcattcacatgttccct

SEQ ID NO: 629167 - DNA, 22 bp, Artificial Sequence
  chemically synthesized
attcacatgttccctttaaaaa

SEQ ID NO: 629168 - DNA, 22 bp, Artificial Sequence
  chemically synthesized
acatgttccctttaaaaaaatc

SEQ ID NO: 629169 - DNA, 22 bp, Artificial Sequence
  chemically synthesized
cctttaaaaaaatccaatactt

SEQ ID NO: 629170 - DNA, 22 bp, Artificial Sequence
  chemically synthesized
taaaaaaatccaatactttact

SEQ ID NO: 629171 - DNA, 22 bp, Artificial Sequence
  chemically synthesized
aaaaaaatccaatactttactt

SEQ ID NO: 629172 - DNA, 22 bp, Artificial Sequence
  chemically synthesized
acaacgaaagtaaagtaaagta

SEQ ID NO: 629173 - DNA, 22 bp, Artificial Sequence
  chemically synthesized
aaaaaatccaatactttacttt

SEQ ID NO: 629174 - DNA, 22 bp, Artificial Sequence
  chemically synthesized
cactgacaacgaaagtaaagta

SEQ ID NO: 629175 - DNA, 22 bp, Artificial Sequence
  chemically synthesized
ccactgacaacgaaagtaaagt

SEQ ID NO: 629176 - DNA, 22 bp, Artificial Sequence
  chemically synthesized
tccactgacaacgaaagtaaag

SEQ ID NO: 629177 - DNA, 22 bp, Artificial Sequence
  chemically synthesized
aacaactttccactgacaacga

SEQ ID NO: 629178 - DNA, 22 bp, Artificial Sequence
  chemically synthesized
aaacaactttccactgacaacg

SEQ ID NO: 629179 - DNA, 22 bp, Artificial Sequence
  chemically synthesized
tactttactttcgttgtcagtg

SEQ ID NO: 629180 - DNA, 22 bp, Artificial Sequence
  chemically synthesized
taaacaactttccactgacaac

SEQ ID NO: 629181 - DNA, 22 bp, Artificial Sequence
  chemically synthesized
actttactttcgttgtcagtgg

SEQ ID NO: 629182 - DNA, 22 bp, Artificial Sequence
  chemically synthesized
ctttactttcgttgtcagtgga

SEQ ID NO: 629183 - DNA, 22 bp, Artificial Sequence
  chemically synthesized
attttaaacaactttccactga

SEQ ID NO: 629184 - DNA, 22 bp, Artificial Sequence
  chemically synthesized
tactttcgttgtcagtggaaag

SEQ ID NO: 629185 - DNA, 22 bp, Artificial Sequence
  chemically synthesized
actttcgttgtcagtggaaagt

SEQ ID NO: 629186 - DNA, 22 bp, Artificial Sequence
  chemically synthesized
tcattttaaacaactttccact

SEQ ID NO: 629187 - DNA, 22 bp, Artificial Sequence
  chemically synthesized
ctttcgttgtcagtggaaagtt

SEQ ID NO: 629188 - DNA, 22 bp, Artificial Sequence
  chemically synthesized
ctcattttaaacaactttccac

SEQ ID NO: 629189 - DNA, 22 bp, Artificial Sequence
  chemically synthesized
tcgttgtcagtggaaagttgtt

SEQ ID NO: 629190 - DNA, 22 bp, Artificial Sequence
  chemically synthesized
cgttgtcagtggaaagttgttt

SEQ ID NO: 629191 - DNA, 22 bp, Artificial Sequence
  chemically synthesized
gttgtcagtggaaagttgttta

SEQ ID NO: 629192 - DNA, 22 bp, Artificial Sequence
  chemically synthesized
tcagtggaaagttgtttaaaat

SEQ ID NO: 629193 - DNA, 22 bp, Artificial Sequence
  chemically synthesized
cagatgtttctcattttaaaca

SEQ ID NO: 629194 - DNA, 22 bp, Artificial Sequence
  chemically synthesized
cagctccagatgtttctcattt

SEQ ID NO: 629195 - DNA, 22 bp, Artificial Sequence
  chemically synthesized
tctacagctccagatgtttctc

SEQ ID NO: 629196 - DNA, 22 bp, Artificial Sequence
  chemically synthesized
tttaaaatgagaaacatctgga

SEQ ID NO: 629197 - DNA, 22 bp, Artificial Sequence
  chemically synthesized
aaaatgagaaacatctggagct

SEQ ID NO: 629198 - DNA, 22 bp, Artificial Sequence
  chemically synthesized
aaatgagaaacatctggagctg

SEQ ID NO: 629199 - DNA, 22 bp, Artificial Sequence
  chemically synthesized
aaacattgtctacagctccaga

SEQ ID NO: 629200 - DNA, 22 bp, Artificial Sequence
  chemically synthesized
caccacactaaaacattgtcta

SEQ ID NO: 629201 - DNA, 22 bp, Artificial Sequence
  chemically synthesized
gagctgtagacaatgttttagt

SEQ ID NO: 629202 - DNA, 22 bp, Artificial Sequence
  chemically synthesized
tagacaatgttttagtgtggtg

SEQ ID NO: 629203 - DNA, 22 bp, Artificial Sequence
  chemically synthesized
tagtgtggtgtagtttcctcct

SEQ ID NO: 629204 - DNA, 22 bp, Artificial Sequence
  chemically synthesized
agtgtggtgtagtttcctcctg

SEQ ID NO: 629205 - DNA, 22 bp, Artificial Sequence
  chemically synthesized
gtgtggtgtagtttcctcctgg

SEQ ID NO: 629206 - DNA, 22 bp, Artificial Sequence
  chemically synthesized
ccggagccggaagccaggagga

SEQ ID NO: 629207 - DNA, 22 bp, Artificial Sequence
  chemically synthesized
cccggagccggaagccaggagg

SEQ ID NO: 629208 - DNA, 22 bp, Artificial Sequence
  chemically synthesized
tcccggagccggaagccaggag

SEQ ID NO: 629209 - DNA, 22 bp, Artificial Sequence
  chemically synthesized
ttcccggagccggaagccagga

SEQ ID NO: 629210 - DNA, 22 bp, Artificial Sequence
  chemically synthesized
cctcctggcttccggctccggg

SEQ ID NO: 629211 - DNA, 22 bp, Artificial Sequence
  chemically synthesized
gaatggatttttcccggagccg

SEQ ID NO: 629212 - DNA, 22 bp, Artificial Sequence
  chemically synthesized
ctcctggcttccggctccggga

SEQ ID NO: 629213 - DNA, 22 bp, Artificial Sequence
  chemically synthesized
ctggcttccggctccgggaaaa

SEQ ID NO: 629214 - DNA, 22 bp, Artificial Sequence
  chemically synthesized
gtctagaatggatttttcccgg

SEQ ID NO: 629215 - DNA, 22 bp, Artificial Sequence
  chemically synthesized
ggtctagaatggatttttcccg

SEQ ID NO: 629216 - DNA, 22 bp, Artificial Sequence
  chemically synthesized
gcttccggctccgggaaaaatc

SEQ ID NO: 629217 - DNA, 22 bp, Artificial Sequence
  chemically synthesized
cttggtctagaatggatttttc

SEQ ID NO: 629218 - DNA, 22 bp, Artificial Sequence
  chemically synthesized
ccggctccgggaaaaatccatt

SEQ ID NO: 629219 - DNA, 22 bp, Artificial Sequence
  chemically synthesized
cggctccgggaaaaatccattc

SEQ ID NO: 629220 - DNA, 22 bp, Artificial Sequence
  chemically synthesized
cctgcttggtctagaatggatt

SEQ ID NO: 629221 - DNA, 22 bp, Artificial Sequence
  chemically synthesized
acctgcttggtctagaatggat

SEQ ID NO: 629222 - DNA, 22 bp, Artificial Sequence
  chemically synthesized
cgggaaaaatccattctagacc

SEQ ID NO: 629223 - DNA, 22 bp, Artificial Sequence
  chemically synthesized
gtcagtcatccaggcttacctg

SEQ ID NO: 629224 - DNA, 22 bp, Artificial Sequence
  chemically synthesized
tagtcagtcatccaggcttacc

SEQ ID NO: 629225 - DNA, 22 bp, Artificial Sequence
  chemically synthesized
tagaccaagcaggtaagcctgg

SEQ ID NO: 629226 - DNA, 22 bp, Artificial Sequence
  chemically synthesized
ctagtcagtcatccaggcttac

SEQ ID NO: 629227 - DNA, 22 bp, Artificial Sequence
  chemically synthesized
gaccaagcaggtaagcctggat

SEQ ID NO: 629228 - DNA, 22 bp, Artificial Sequence
  chemically synthesized
cttctagtcagtcatccaggct

SEQ ID NO: 629229 - DNA, 22 bp, Artificial Sequence
  chemically synthesized
atagaaagaaattacttctagt

SEQ ID NO: 629230 - DNA, 22 bp, Artificial Sequence
  chemically synthesized
gatgactgactagaagtaattt

SEQ ID NO: 629231 - DNA, 22 bp, Artificial Sequence
  chemically synthesized
actagaagtaatttctttctat

SEQ ID NO: 629232 - DNA, 22 bp, Artificial Sequence
  chemically synthesized
atgtcacatcctaatagaaaga

SEQ ID NO: 629233 - DNA, 22 bp, Artificial Sequence
  chemically synthesized
gaagtaatttctttctattagg

SEQ ID NO: 629234 - DNA, 22 bp, Artificial Sequence
  chemically synthesized
aatgttcatgtcacatcctaat

SEQ ID NO: 629235 - DNA, 22 bp, Artificial Sequence
  chemically synthesized
aaatgttcatgtcacatcctaa

SEQ ID NO: 629236 - DNA, 22 bp, Artificial Sequence
  chemically synthesized
taaatgttcatgtcacatccta

SEQ ID NO: 629237 - DNA, 22 bp, Artificial Sequence
  chemically synthesized
ttaaatgttcatgtcacatcct

SEQ ID NO: 629238 - DNA, 22 bp, Artificial Sequence
  chemically synthesized
tttaaatgttcatgtcacatcc

SEQ ID NO: 629239 - DNA, 22 bp, Artificial Sequence
  chemically synthesized
ctttctattaggatgtgacatg

SEQ ID NO: 629240 - DNA, 22 bp, Artificial Sequence
  chemically synthesized
tttctattaggatgtgacatga

SEQ ID NO: 629241 - DNA, 22 bp, Artificial Sequence
  chemically synthesized
tctattaggatgtgacatgaac

SEQ ID NO: 629242 - DNA, 22 bp, Artificial Sequence
  chemically synthesized
cattttttaaatgttcatgtca

SEQ ID NO: 629243 - DNA, 22 bp, Artificial Sequence
  chemically synthesized
ctattaggatgtgacatgaaca

SEQ ID NO: 629244 - DNA, 22 bp, Artificial Sequence
  chemically synthesized
ccattttttaaatgttcatgtc

SEQ ID NO: 629245 - DNA, 22 bp, Artificial Sequence
  chemically synthesized
tattaggatgtgacatgaacat

SEQ ID NO: 629246 - DNA, 22 bp, Artificial Sequence
  chemically synthesized
tccattttttaaatgttcatgt

SEQ ID NO: 629247 - DNA, 22 bp, Artificial Sequence
  chemically synthesized
ttccattttttaaatgttcatg

SEQ ID NO: 629248 - DNA, 22 bp, Artificial Sequence
  chemically synthesized
ttaggatgtgacatgaacattt

SEQ ID NO: 629249 - DNA, 22 bp, Artificial Sequence
  chemically synthesized
tttccattttttaaatgttcat

SEQ ID NO: 629250 - DNA, 22 bp, Artificial Sequence
  chemically synthesized
ggatgtgacatgaacatttaaa

SEQ ID NO: 629251 - DNA, 22 bp, Artificial Sequence
  chemically synthesized
actttttccattttttaaatgt

SEQ ID NO: 629252 - DNA, 22 bp, Artificial Sequence
  chemically synthesized
tagactgactttttccattttt

SEQ ID NO: 629253 - DNA, 22 bp, Artificial Sequence
  chemically synthesized
tatagactgactttttccattt

SEQ ID NO: 629254 - DNA, 22 bp, Artificial Sequence
  chemically synthesized
ctatagactgactttttccatt

SEQ ID NO: 629255 - DNA, 22 bp, Artificial Sequence
  chemically synthesized
aaaaaatggaaaaagtcagtct

SEQ ID NO: 629256 - DNA, 22 bp, Artificial Sequence
  chemically synthesized
aaaaatggaaaaagtcagtcta

SEQ ID NO: 629257 - DNA, 22 bp, Artificial Sequence
  chemically synthesized
tatagataaagagatacgaatt

SEQ ID NO: 629258 - DNA, 22 bp, Artificial Sequence
  chemically synthesized
tagttatatagataaagagata

SEQ ID NO: 629259 - DNA, 22 bp, Artificial Sequence
  chemically synthesized
tagaaattcgtatctctttatc

SEQ ID NO: 629260 - DNA, 22 bp, Artificial Sequence
  chemically synthesized
gtatctctttatctatataact

SEQ ID NO: 629261 - DNA, 22 bp, Artificial Sequence
  chemically synthesized
taagtatataaatactatagtt

SEQ ID NO: 629262 - DNA, 22 bp, Artificial Sequence
  chemically synthesized
tttatctatataactatagtat

SEQ ID NO: 629263 - DNA, 22 bp, Artificial Sequence
  chemically synthesized
tatctatataactatagtattt

SEQ ID NO: 629264 - DNA, 22 bp, Artificial Sequence
  chemically synthesized
atctatataactatagtattta

SEQ ID NO: 629265 - DNA, 22 bp, Artificial Sequence
  chemically synthesized
tctatataactatagtatttat

SEQ ID NO: 629266 - DNA, 22 bp, Artificial Sequence
  chemically synthesized
tatgtctataagtatataaata

SEQ ID NO: 629267 - DNA, 22 bp, Artificial Sequence
  chemically synthesized
tataactatagtatttatatac

SEQ ID NO: 629268 - DNA, 22 bp, Artificial Sequence
  chemically synthesized
tagtatttatatacttatagac

SEQ ID NO: 629269 - DNA, 22 bp, Artificial Sequence
  chemically synthesized
atatatctatatgtctataagt

SEQ ID NO: 629270 - DNA, 22 bp, Artificial Sequence
  chemically synthesized
catatatctatatgtctataag

SEQ ID NO: 629271 - DNA, 22 bp, Artificial Sequence
  chemically synthesized
atttcatatatctatatgtcta

SEQ ID NO: 629272 - DNA, 22 bp, Artificial Sequence
  chemically synthesized
catttcatatatctatatgtct

SEQ ID NO: 629273 - DNA, 22 bp, Artificial Sequence
  chemically synthesized
tcatttcatatatctatatgtc

SEQ ID NO: 629274 - DNA, 22 bp, Artificial Sequence
  chemically synthesized
atatacttatagacatatagat

SEQ ID NO: 629275 - DNA, 22 bp, Artificial Sequence
  chemically synthesized
tatacttatagacatatagata

SEQ ID NO: 629276 - DNA, 22 bp, Artificial Sequence
  chemically synthesized
agttttcatttcatatatctat

SEQ ID NO: 629277 - DNA, 22 bp, Artificial Sequence
  chemically synthesized
gagttttcatttcatatatcta

SEQ ID NO: 629278 - DNA, 22 bp, Artificial Sequence
  chemically synthesized
atagacatatagatatatgaaa

SEQ ID NO: 629279 - DNA, 22 bp, Artificial Sequence
  chemically synthesized
tagacatatagatatatgaaat

SEQ ID NO: 629280 - DNA, 22 bp, Artificial Sequence
  chemically synthesized
agtggggcaggcttgagttttc

SEQ ID NO: 629281 - DNA, 22 bp, Artificial Sequence
  chemically synthesized
tcagctgagtggggcaggcttg

SEQ ID NO: 629282 - DNA, 22 bp, Artificial Sequence
  chemically synthesized
agaactgtcagctgagtggggc

SEQ ID NO: 629283 - DNA, 22 bp, Artificial Sequence
  chemically synthesized
gagaactgtcagctgagtgggg

SEQ ID NO: 629284 - DNA, 22 bp, Artificial Sequence
  chemically synthesized
atttgagaactgtcagctgagt

SEQ ID NO: 629285 - DNA, 22 bp, Artificial Sequence
  chemically synthesized
aagcctgccccactcagctgac

SEQ ID NO: 629286 - DNA, 22 bp, Artificial Sequence
  chemically synthesized
ctcatttgagaactgtcagctg

SEQ ID NO: 629287 - DNA, 22 bp, Artificial Sequence
  chemically synthesized
ccccactcagctgacagttctc

SEQ ID NO: 629288 - DNA, 22 bp, Artificial Sequence
  chemically synthesized
cacactgctcatttgagaactg

SEQ ID NO: 629289 - DNA, 22 bp, Artificial Sequence
  chemically synthesized
ctacacactgctcatttgagaa

SEQ ID NO: 629290 - DNA, 22 bp, Artificial Sequence
  chemically synthesized
agctgacagttctcaaatgagc

SEQ ID NO: 629291 - DNA, 22 bp, Artificial Sequence
  chemically synthesized
acagttctcaaatgagcagtgt

SEQ ID NO: 629292 - DNA, 22 bp, Artificial Sequence
  chemically synthesized
tcaaatgagcagtgtgtagtag

SEQ ID NO: 629293 - DNA, 22 bp, Artificial Sequence
  chemically synthesized
aaatgagcagtgtgtagtagtc

SEQ ID NO: 629294 - DNA, 22 bp, Artificial Sequence
  chemically synthesized
ccaccacaccaaatgactacta

SEQ ID NO: 629295 - DNA, 22 bp, Artificial Sequence
  chemically synthesized
taccaccacaccaaatgactac

SEQ ID NO: 629296 - DNA, 22 bp, Artificial Sequence
  chemically synthesized
ctctaccaccacaccaaatgac

SEQ ID NO: 629297 - DNA, 22 bp, Artificial Sequence
  chemically synthesized
cctctaccaccacaccaaatga

SEQ ID NO: 629298 - DNA, 22 bp, Artificial Sequence
  chemically synthesized
aagataagacttcctctaccac

SEQ ID NO: 629299 - DNA, 22 bp, Artificial Sequence
  chemically synthesized
ggtgtggtggtagaggaagtct

SEQ ID NO: 629300 - DNA, 22 bp, Artificial Sequence
  chemically synthesized
gtgtggtggtagaggaagtctt

SEQ ID NO: 629301 - DNA, 22 bp, Artificial Sequence
  chemically synthesized
catattaaagataagacttcct

SEQ ID NO: 629302 - DNA, 22 bp, Artificial Sequence
  chemically synthesized
gcatattaaagataagacttcc

SEQ ID NO: 629303 - DNA, 22 bp, Artificial Sequence
  chemically synthesized
tgcatattaaagataagacttc

SEQ ID NO: 629304 - DNA, 22 bp, Artificial Sequence
  chemically synthesized
ttgcatattaaagataagactt

SEQ ID NO: 629305 - DNA, 22 bp, Artificial Sequence
  chemically synthesized
tttgcatattaaagataagact

SEQ ID NO: 629306 - DNA, 22 bp, Artificial Sequence
  chemically synthesized
ttttgcatattaaagataagac

SEQ ID NO: 629307 - DNA, 22 bp, Artificial Sequence
  chemically synthesized
tttttgcatattaaagataaga

SEQ ID NO: 629308 - DNA, 22 bp, Artificial Sequence
  chemically synthesized
tttttttgcatattaaagataa

SEQ ID NO: 629309 - DNA, 22 bp, Artificial Sequence
  chemically synthesized
ctttttttgcatattaaagata

SEQ ID NO: 629310 - DNA, 22 bp, Artificial Sequence
  chemically synthesized
tctttttttgcatattaaagat

SEQ ID NO: 629311 - DNA, 22 bp, Artificial Sequence
  chemically synthesized
ttctttttttgcatattaaaga

SEQ ID NO: 629312 - DNA, 22 bp, Artificial Sequence
  chemically synthesized
tttctttttttgcatattaaag

SEQ ID NO: 629313 - DNA, 22 bp, Artificial Sequence
  chemically synthesized
atggctttttctttttttgcat

SEQ ID NO: 629314 - DNA, 22 bp, Artificial Sequence
  chemically synthesized
atctttaatatgcaaaaaaaga

SEQ ID NO: 629315 - DNA, 22 bp, Artificial Sequence
  chemically synthesized
tctttaatatgcaaaaaaagaa

SEQ ID NO: 629316 - DNA, 22 bp, Artificial Sequence
  chemically synthesized
taatatgcaaaaaaagaaaaag

SEQ ID NO: 629317 - DNA, 22 bp, Artificial Sequence
  chemically synthesized
aatatgcaaaaaaagaaaaagc

SEQ ID NO: 629318 - DNA, 22 bp, Artificial Sequence
  chemically synthesized
atatgcaaaaaaagaaaaagcc

SEQ ID NO: 629319 - DNA, 22 bp, Artificial Sequence
  chemically synthesized
gcgtgatatccatatgaaattc

SEQ ID NO: 629320 - DNA, 22 bp, Artificial Sequence
  chemically synthesized
ggcgtgatatccatatgaaatt

SEQ ID NO: 629321 - DNA, 22 bp, Artificial Sequence
  chemically synthesized
tggcgtgatatccatatgaaat

SEQ ID NO: 629322 - DNA, 22 bp, Artificial Sequence
  chemically synthesized
ttggcgtgatatccatatgaaa

SEQ ID NO: 629323 - DNA, 22 bp, Artificial Sequence
  chemically synthesized
catccttttggcgtgatatcca

SEQ ID NO: 629324 - DNA, 22 bp, Artificial Sequence
  chemically synthesized
gcatccttttggcgtgatatcc

SEQ ID NO: 629325 - DNA, 22 bp, Artificial Sequence
  chemically synthesized
tgcatccttttggcgtgatatc

SEQ ID NO: 629326 - DNA, 22 bp, Artificial Sequence
  chemically synthesized
ttttgcatccttttggcgtgat

SEQ ID NO: 629327 - DNA, 22 bp, Artificial Sequence
  chemically synthesized
catatggatatcacgccaaaag

SEQ ID NO: 629328 - DNA, 22 bp, Artificial Sequence
  chemically synthesized
atatggatatcacgccaaaagg

SEQ ID NO: 629329 - DNA, 22 bp, Artificial Sequence
  chemically synthesized
aggcagcgcattgttttgcatc

SEQ ID NO: 629330 - DNA, 22 bp, Artificial Sequence
  chemically synthesized
gaggcagcgcattgttttgcat

SEQ ID NO: 629331 - DNA, 22 bp, Artificial Sequence
  chemically synthesized
tgaggcagcgcattgttttgca

SEQ ID NO: 629332 - DNA, 22 bp, Artificial Sequence
  chemically synthesized
cctcaaagttttgtgtgtgtgt

SEQ ID NO: 629333 - DNA, 22 bp, Artificial Sequence
  chemically synthesized
aaagttttgtgtgtgtgtgtgt

SEQ ID NO: 629334 - DNA, 22 bp, Artificial Sequence
  chemically synthesized
tgtgtgtgtgtgtgtatgtgtg

SEQ ID NO: 629335 - DNA, 22 bp, Artificial Sequence
  chemically synthesized
gtgtgtgtgtgtgtatgtgtgt

SEQ ID NO: 629336 - DNA, 22 bp, Artificial Sequence
  chemically synthesized
tgtgtgtgtgtgtatgtgtgtg

SEQ ID NO: 629337 - DNA, 22 bp, Artificial Sequence
  chemically synthesized
aaaacaaaacaaacacacacac

SEQ ID NO: 629338 - DNA, 22 bp, Artificial Sequence
  chemically synthesized
taaaaacccctaaaaacaaaac

SEQ ID NO: 629339 - DNA, 22 bp, Artificial Sequence
  chemically synthesized
ataaaaacccctaaaaacaaaa

SEQ ID NO: 629340 - DNA, 22 bp, Artificial Sequence
  chemically synthesized
tttataaaaacccctaaaaaca

SEQ ID NO: 629341 - DNA, 22 bp, Artificial Sequence
  chemically synthesized
gttttgtttttaggggttttta

SEQ ID NO: 629342 - DNA, 22 bp, Artificial Sequence
  chemically synthesized
ttttgtttttaggggtttttat

SEQ ID NO: 629343 - DNA, 22 bp, Artificial Sequence
  chemically synthesized
tgtttttaggggtttttataaa

SEQ ID NO: 629344 - DNA, 22 bp, Artificial Sequence
  chemically synthesized
gtttttaggggtttttataaac

SEQ ID NO: 629345 - DNA, 22 bp, Artificial Sequence
  chemically synthesized
taaaaaaaagttgtttataaaa

SEQ ID NO: 629346 - DNA, 22 bp, Artificial Sequence
  chemically synthesized
tttttaggggtttttataaaca

SEQ ID NO: 629347 - DNA, 22 bp, Artificial Sequence
  chemically synthesized
ataaaaaaaagttgtttataaa

SEQ ID NO: 629348 - DNA, 22 bp, Artificial Sequence
  chemically synthesized
tataaaaaaaagttgtttataa

SEQ ID NO: 629349 - DNA, 22 bp, Artificial Sequence
  chemically synthesized
ttaggggtttttataaacaact

SEQ ID NO: 629350 - DNA, 22 bp, Artificial Sequence
  chemically synthesized
taggggtttttataaacaactt

SEQ ID NO: 629351 - DNA, 22 bp, Artificial Sequence
  chemically synthesized
aggggtttttataaacaacttt

SEQ ID NO: 629352 - DNA, 22 bp, Artificial Sequence
  chemically synthesized
ggggtttttataaacaactttt

SEQ ID NO: 629353 - DNA, 22 bp, Artificial Sequence
  chemically synthesized
aagtgtgctttataaaaaaaag

SEQ ID NO: 629354 - DNA, 22 bp, Artificial Sequence
  chemically synthesized
ttataaacaacttttttttata

SEQ ID NO: 629355 - DNA, 22 bp, Artificial Sequence
  chemically synthesized
tataaacaacttttttttataa

SEQ ID NO: 629356 - DNA, 22 bp, Artificial Sequence
  chemically synthesized
ataaacaacttttttttataaa

SEQ ID NO: 629357 - DNA, 22 bp, Artificial Sequence
  chemically synthesized
taaacaacttttttttataaag

SEQ ID NO: 629358 - DNA, 22 bp, Artificial Sequence
  chemically synthesized
taaactaaagtgtgctttataa

SEQ ID NO: 629359 - DNA, 22 bp, Artificial Sequence
  chemically synthesized
ttttttataaagcacactttag

SEQ ID NO: 629360 - DNA, 22 bp, Artificial Sequence
  chemically synthesized
tttttataaagcacactttagt

SEQ ID NO: 629361 - DNA, 22 bp, Artificial Sequence
  chemically synthesized
ttttataaagcacactttagtt

SEQ ID NO: 629362 - DNA, 22 bp, Artificial Sequence
  chemically synthesized
tttataaagcacactttagttt

SEQ ID NO: 629363 - DNA, 22 bp, Artificial Sequence
  chemically synthesized
ttataaagcacactttagttta

SEQ ID NO: 629364 - DNA, 22 bp, Artificial Sequence
  chemically synthesized
tataaagcacactttagtttac

SEQ ID NO: 629365 - DNA, 22 bp, Artificial Sequence
  chemically synthesized
taaagaaagattgtaaactaaa

SEQ ID NO: 629366 - DNA, 22 bp, Artificial Sequence
  chemically synthesized
ataaagcacactttagtttaca

SEQ ID NO: 629367 - DNA, 22 bp, Artificial Sequence
  chemically synthesized
taaagcacactttagtttacaa

SEQ ID NO: 629368 - DNA, 22 bp, Artificial Sequence
  chemically synthesized
taacagttataaagaaagattg

SEQ ID NO: 629369 - DNA, 22 bp, Artificial Sequence
  chemically synthesized
ataacagttataaagaaagatt

SEQ ID NO: 629370 - DNA, 22 bp, Artificial Sequence
  chemically synthesized
tagtttacaatctttctttata

SEQ ID NO: 629371 - DNA, 22 bp, Artificial Sequence
  chemically synthesized
agtttacaatctttctttataa

SEQ ID NO: 629372 - DNA, 22 bp, Artificial Sequence
  chemically synthesized
gtttacaatctttctttataac

SEQ ID NO: 629373 - DNA, 22 bp, Artificial Sequence
  chemically synthesized
aaaatttataacagttataaag

SEQ ID NO: 629374 - DNA, 22 bp, Artificial Sequence
  chemically synthesized
aaaaatttataacagttataaa

SEQ ID NO: 629375 - DNA, 22 bp, Artificial Sequence
  chemically synthesized
acaatctttctttataactgtt

SEQ ID NO: 629376 - DNA, 22 bp, Artificial Sequence
  chemically synthesized
caatctttctttataactgtta

SEQ ID NO: 629377 - DNA, 22 bp, Artificial Sequence
  chemically synthesized
tttaaaaatttataacagttat

SEQ ID NO: 629378 - DNA, 22 bp, Artificial Sequence
  chemically synthesized
ggttgtttaaaaatttataaca

SEQ ID NO: 629379 - DNA, 22 bp, Artificial Sequence
  chemically synthesized
gggttgtttaaaaatttataac

SEQ ID NO: 629380 - DNA, 22 bp, Artificial Sequence
  chemically synthesized
tctttataactgttataaattt

SEQ ID NO: 629381 - DNA, 22 bp, Artificial Sequence
  chemically synthesized
tgggttgtttaaaaatttataa

SEQ ID NO: 629382 - DNA, 22 bp, Artificial Sequence
  chemically synthesized
ctttataactgttataaatttt

SEQ ID NO: 629383 - DNA, 22 bp, Artificial Sequence
  chemically synthesized
tttataactgttataaattttt

SEQ ID NO: 629384 - DNA, 22 bp, Artificial Sequence
  chemically synthesized
tataactgttataaatttttaa

SEQ ID NO: 629385 - DNA, 22 bp, Artificial Sequence
  chemically synthesized
ataactgttataaatttttaaa

SEQ ID NO: 629386 - DNA, 22 bp, Artificial Sequence
  chemically synthesized
taactgttataaatttttaaac

SEQ ID NO: 629387 - DNA, 22 bp, Artificial Sequence
  chemically synthesized
ttataaatttttaaacaaccca

SEQ ID NO: 629388 - DNA, 22 bp, Artificial Sequence
  chemically synthesized
tatggaacgcattttgggttgt

SEQ ID NO: 629389 - DNA, 22 bp, Artificial Sequence
  chemically synthesized
taaatttttaaacaacccaaaa

SEQ ID NO: 629390 - DNA, 22 bp, Artificial Sequence
  chemically synthesized
atatggaacgcattttgggttg

SEQ ID NO: 629391 - DNA, 22 bp, Artificial Sequence
  chemically synthesized
tatatggaacgcattttgggtt

SEQ ID NO: 629392 - DNA, 22 bp, Artificial Sequence
  chemically synthesized
tttatatggaacgcattttggg

SEQ ID NO: 629393 - DNA, 22 bp, Artificial Sequence
  chemically synthesized
ctttatatggaacgcattttgg

SEQ ID NO: 629394 - DNA, 22 bp, Artificial Sequence
  chemically synthesized
ttaaacaacccaaaatgcgttc

SEQ ID NO: 629395 - DNA, 22 bp, Artificial Sequence
  chemically synthesized
taaacaacccaaaatgcgttcc

SEQ ID NO: 629396 - DNA, 22 bp, Artificial Sequence
  chemically synthesized
aaacaacccaaaatgcgttcca

SEQ ID NO: 629397 - DNA, 22 bp, Artificial Sequence
  chemically synthesized
aacaacccaaaatgcgttccat

SEQ ID NO: 629398 - DNA, 22 bp, Artificial Sequence
  chemically synthesized
ccatttctttatatggaacgca

SEQ ID NO: 629399 - DNA, 22 bp, Artificial Sequence
  chemically synthesized
gccatttctttatatggaacgc

SEQ ID NO: 629400 - DNA, 22 bp, Artificial Sequence
  chemically synthesized
aataacttgccatttctttata

SEQ ID NO: 629401 - DNA, 22 bp, Artificial Sequence
  chemically synthesized
atagctaaataacttgccattt

SEQ ID NO: 629402 - DNA, 22 bp, Artificial Sequence
  chemically synthesized
gatagctaaataacttgccatt

SEQ ID NO: 629403 - DNA, 22 bp, Artificial Sequence
  chemically synthesized
catataaagaaatggcaagtta

SEQ ID NO: 629404 - DNA, 22 bp, Artificial Sequence
  chemically synthesized
catgtaaaatcttgatagctaa

SEQ ID NO: 629405 - DNA, 22 bp, Artificial Sequence
  chemically synthesized
tttagctatcaagattttacat

SEQ ID NO: 629406 - DNA, 22 bp, Artificial Sequence
  chemically synthesized
taagaaaactacatgtaaaatc

SEQ ID NO: 629407 - DNA, 22 bp, Artificial Sequence
  chemically synthesized
agctatcaagattttacatgta

SEQ ID NO: 629408 - DNA, 22 bp, Artificial Sequence
  chemically synthesized
gctatcaagattttacatgtag

SEQ ID NO: 629409 - DNA, 22 bp, Artificial Sequence
  chemically synthesized
tcaagattttacatgtagtttt

SEQ ID NO: 629410 - DNA, 22 bp, Artificial Sequence
  chemically synthesized
tacaaaaaagttataagaaaac

SEQ ID NO: 629411 - DNA, 22 bp, Artificial Sequence
  chemically synthesized
tacatgtagttttcttataact

SEQ ID NO: 629412 - DNA, 22 bp, Artificial Sequence
  chemically synthesized
acatgtagttttcttataactt

SEQ ID NO: 629413 - DNA, 22 bp, Artificial Sequence
  chemically synthesized
catgtagttttcttataacttt

SEQ ID NO: 629414 - DNA, 22 bp, Artificial Sequence
  chemically synthesized
tgcaattgtacaaaaaagttat

SEQ ID NO: 629415 - DNA, 22 bp, Artificial Sequence
  chemically synthesized
tcttataacttttttgtacaat

SEQ ID NO: 629416 - DNA, 22 bp, Artificial Sequence
  chemically synthesized
cacgtctatgcaattgtacaaa

SEQ ID NO: 629417 - DNA, 22 bp, Artificial Sequence
  chemically synthesized
cttataacttttttgtacaatt

SEQ ID NO: 629418 - DNA, 22 bp, Artificial Sequence
  chemically synthesized
acacgtctatgcaattgtacaa

SEQ ID NO: 629419 - DNA, 22 bp, Artificial Sequence
  chemically synthesized
ttataacttttttgtacaattg

SEQ ID NO: 629420 - DNA, 22 bp, Artificial Sequence
  chemically synthesized
tacacgtctatgcaattgtaca

SEQ ID NO: 629421 - DNA, 22 bp, Artificial Sequence
  chemically synthesized
ataacttttttgtacaattgca

SEQ ID NO: 629422 - DNA, 22 bp, Artificial Sequence
  chemically synthesized
taacttttttgtacaattgcat

SEQ ID NO: 629423 - DNA, 22 bp, Artificial Sequence
  chemically synthesized
ttttgtacaattgcatagacgt

SEQ ID NO: 629424 - DNA, 22 bp, Artificial Sequence
  chemically synthesized
tttgtacaattgcatagacgtg

SEQ ID NO: 629425 - DNA, 22 bp, Artificial Sequence
  chemically synthesized
ttgtacaattgcatagacgtgt

SEQ ID NO: 629426 - DNA, 22 bp, Artificial Sequence
  chemically synthesized
tgtacaattgcatagacgtgta

SEQ ID NO: 629427 - DNA, 22 bp, Artificial Sequence
  chemically synthesized
gtacaattgcatagacgtgtaa

SEQ ID NO: 629428 - DNA, 22 bp, Artificial Sequence
  chemically synthesized
tacaattgcatagacgtgtaaa

SEQ ID NO: 629429 - DNA, 22 bp, Artificial Sequence
  chemically synthesized
acaatggcaggttttacacgtc

SEQ ID NO: 629430 - DNA, 22 bp, Artificial Sequence
  chemically synthesized
ttaacaatggcaggttttacac

SEQ ID NO: 629431 - DNA, 22 bp, Artificial Sequence
  chemically synthesized
gttaacaatggcaggttttaca

SEQ ID NO: 629432 - DNA, 22 bp, Artificial Sequence
  chemically synthesized
tgttaacaatggcaggttttac

SEQ ID NO: 629433 - DNA, 22 bp, Artificial Sequence
  chemically synthesized
catagacgtgtaaaacctgcca

SEQ ID NO: 629434 - DNA, 22 bp, Artificial Sequence
  chemically synthesized
ttttgttaacaatggcaggttt

SEQ ID NO: 629435 - DNA, 22 bp, Artificial Sequence
  chemically synthesized
ttgttttgttaacaatggcagg

SEQ ID NO: 629436 - DNA, 22 bp, Artificial Sequence
  chemically synthesized
ttattgttttgttaacaatggc

SEQ ID NO: 629437 - DNA, 22 bp, Artificial Sequence
  chemically synthesized
agtctgttattgttttgttaac

SEQ ID NO: 629438 - DNA, 22 bp, Artificial Sequence
  chemically synthesized
taagtctgttattgttttgtta

SEQ ID NO: 629439 - DNA, 22 bp, Artificial Sequence
  chemically synthesized
ctaagtctgttattgttttgtt

SEQ ID NO: 629440 - DNA, 22 bp, Artificial Sequence
  chemically synthesized
ccattgttaacaaaacaataac

SEQ ID NO: 629441 - DNA, 22 bp, Artificial Sequence
  chemically synthesized
agtagtttctaagtctgttatt

SEQ ID NO: 629442 - DNA, 22 bp, Artificial Sequence
  chemically synthesized
cagtagtttctaagtctgttat

SEQ ID NO: 629443 - DNA, 22 bp, Artificial Sequence
  chemically synthesized
ttaacaaaacaataacagactt

SEQ ID NO: 629444 - DNA, 22 bp, Artificial Sequence
  chemically synthesized
acaaaacaataacagacttaga

SEQ ID NO: 629445 - DNA, 22 bp, Artificial Sequence
  chemically synthesized
tagatttcagtagtttctaagt

SEQ ID NO: 629446 - DNA, 22 bp, Artificial Sequence
  chemically synthesized
tactgtagatttcagtagtttc

SEQ ID NO: 629447 - DNA, 22 bp, Artificial Sequence
  chemically synthesized
agaaactactgaaatctacagt

SEQ ID NO: 629448 - DNA, 22 bp, Artificial Sequence
  chemically synthesized
gaaactactgaaatctacagta

SEQ ID NO: 629449 - DNA, 22 bp, Artificial Sequence
  chemically synthesized
tgaagggtagtggtattatact

SEQ ID NO: 629450 - DNA, 22 bp, Artificial Sequence
  chemically synthesized
ctgaaatctacagtataatacc

SEQ ID NO: 629451 - DNA, 22 bp, Artificial Sequence
  chemically synthesized
gtgaagggtagtggtattatac

SEQ ID NO: 629452 - DNA, 22 bp, Artificial Sequence
  chemically synthesized
tgtgaagggtagtggtattata

SEQ ID NO: 629453 - DNA, 22 bp, Artificial Sequence
  chemically synthesized
ttgtgaagggtagtggtattat

SEQ ID NO: 629454 - DNA, 22 bp, Artificial Sequence
  chemically synthesized
aaatctacagtataataccact

SEQ ID NO: 629455 - DNA, 22 bp, Artificial Sequence
  chemically synthesized
tatttttgtgaagggtagtggt

SEQ ID NO: 629456 - DNA, 22 bp, Artificial Sequence
  chemically synthesized
cagtataataccactacccttc

SEQ ID NO: 629457 - DNA, 22 bp, Artificial Sequence
  chemically synthesized
caagaaataaatctatattttt

SEQ ID NO: 629458 - DNA, 22 bp, Artificial Sequence
  chemically synthesized
acaagaaataaatctatatttt

SEQ ID NO: 629459 - DNA, 22 bp, Artificial Sequence
  chemically synthesized
cccttcacaaaaatatagattt

SEQ ID NO: 629460 - DNA, 22 bp, Artificial Sequence
  chemically synthesized
cacaaaaatatagatttatttc

SEQ ID NO: 629461 - DNA, 22 bp, Artificial Sequence
  chemically synthesized
acaaaaatatagatttatttct

SEQ ID NO: 629462 - DNA, 22 bp, Artificial Sequence
  chemically synthesized
gacagtaagagtttacaagaaa

SEQ ID NO: 629463 - DNA, 22 bp, Artificial Sequence
  chemically synthesized
atttcttgtaaactcttactgt

SEQ ID NO: 629464 - DNA, 22 bp, Artificial Sequence
  chemically synthesized
tttcttgtaaactcttactgtc

SEQ ID NO: 629465 - DNA, 22 bp, Artificial Sequence
  chemically synthesized
cttgtaaactcttactgtctaa

SEQ ID NO: 629466 - DNA, 22 bp, Artificial Sequence
  chemically synthesized
ttgtaaactcttactgtctaat

SEQ ID NO: 629467 - DNA, 22 bp, Artificial Sequence
  chemically synthesized
gtaaactcttactgtctaatcc

SEQ ID NO: 629468 - DNA, 22 bp, Artificial Sequence
  chemically synthesized
atacaacaaagaggattagaca

SEQ ID NO: 629469 - DNA, 22 bp, Artificial Sequence
  chemically synthesized
taaactcttactgtctaatcct

SEQ ID NO: 629470 - DNA, 22 bp, Artificial Sequence
  chemically synthesized
ttactgtctaatcctctttgtt

SEQ ID NO: 629471 - DNA, 22 bp, Artificial Sequence
  chemically synthesized
taatattcatacaacaaagagg

SEQ ID NO: 629472 - DNA, 22 bp, Artificial Sequence
  chemically synthesized
ataatattcatacaacaaagag

SEQ ID NO: 629473 - DNA, 22 bp, Artificial Sequence
  chemically synthesized
actgtctaatcctctttgttgt

SEQ ID NO: 629474 - DNA, 22 bp, Artificial Sequence
  chemically synthesized
tataatattcatacaacaaaga

SEQ ID NO: 629475 - DNA, 22 bp, Artificial Sequence
  chemically synthesized
ctgtctaatcctctttgttgta

SEQ ID NO: 629476 - DNA, 22 bp, Artificial Sequence
  chemically synthesized
ttataatattcatacaacaaag

SEQ ID NO: 629477 - DNA, 22 bp, Artificial Sequence
  chemically synthesized
tctaatcctctttgttgtatga

SEQ ID NO: 629478 - DNA, 22 bp, Artificial Sequence
  chemically synthesized
atcctctttgttgtatgaatat

SEQ ID NO: 629479 - DNA, 22 bp, Artificial Sequence
  chemically synthesized
ccgcatggtttttataatattc

SEQ ID NO: 629480 - DNA, 22 bp, Artificial Sequence
  chemically synthesized
tttgttgtatgaatattataaa

SEQ ID NO: 629481 - DNA, 22 bp, Artificial Sequence
  chemically synthesized
tgttgtatgaatattataaaaa

SEQ ID NO: 629482 - DNA, 22 bp, Artificial Sequence
  chemically synthesized
attcccgcatggtttttataat

SEQ ID NO: 629483 - DNA, 22 bp, Artificial Sequence
  chemically synthesized
gttgtatgaatattataaaaac

SEQ ID NO: 629484 - DNA, 22 bp, Artificial Sequence
  chemically synthesized
ttgtatgaatattataaaaacc

SEQ ID NO: 629485 - DNA, 22 bp, Artificial Sequence
  chemically synthesized
ctgattcccgcatggtttttat

SEQ ID NO: 629486 - DNA, 22 bp, Artificial Sequence
  chemically synthesized
tatgaatattataaaaaccatg

SEQ ID NO: 629487 - DNA, 22 bp, Artificial Sequence
  chemically synthesized
caactcctgattcccgcatggt

SEQ ID NO: 629488 - DNA, 22 bp, Artificial Sequence
  chemically synthesized
acaactcctgattcccgcatgg

SEQ ID NO: 629489 - DNA, 22 bp, Artificial Sequence
  chemically synthesized
tacaactcctgattcccgcatg

SEQ ID NO: 629490 - DNA, 22 bp, Artificial Sequence
  chemically synthesized
taaaaaccatgcgggaatcagg

SEQ ID NO: 629491 - DNA, 22 bp, Artificial Sequence
  chemically synthesized
taaaacatttattctgctcctt

SEQ ID NO: 629492 - DNA, 22 bp, Artificial Sequence
  chemically synthesized
attctgctccttcttcatctgt

SEQ ID NO: 629493 - DNA, 22 bp, Artificial Sequence
  chemically synthesized
gtatcagtcatgacagatgaag

SEQ ID NO: 629494 - DNA, 22 bp, Artificial Sequence
  chemically synthesized
ttctgctccttcttcatctgtc

SEQ ID NO: 629495 - DNA, 22 bp, Artificial Sequence
  chemically synthesized
agtatcagtcatgacagatgaa

SEQ ID NO: 629496 - DNA, 22 bp, Artificial Sequence
  chemically synthesized
tgctccttcttcatctgtcatg

SEQ ID NO: 629497 - DNA, 22 bp, Artificial Sequence
  chemically synthesized
ctccttcttcatctgtcatgac

SEQ ID NO: 629498 - DNA, 22 bp, Artificial Sequence
  chemically synthesized
cttcttcatctgtcatgactga

SEQ ID NO: 629499 - DNA, 22 bp, Artificial Sequence
  chemically synthesized
cttcatctgtcatgactgatac

SEQ ID NO: 629500 - DNA, 22 bp, Artificial Sequence
  chemically synthesized
ttcatctgtcatgactgatact

SEQ ID NO: 629501 - DNA, 22 bp, Artificial Sequence
  chemically synthesized
catctgtcatgactgatactaa

SEQ ID NO: 629502 - DNA, 22 bp, Artificial Sequence
  chemically synthesized
atctgtcatgactgatactaag

SEQ ID NO: 629503 - DNA, 22 bp, Artificial Sequence
  chemically synthesized
tcatgactgatactaaggactc

SEQ ID NO: 629504 - DNA, 22 bp, Artificial Sequence
  chemically synthesized
ggcagagcgatggagtccttag

SEQ ID NO: 629505 - DNA, 22 bp, Artificial Sequence
  chemically synthesized
gggcagagcgatggagtcctta

SEQ ID NO: 629506 - DNA, 22 bp, Artificial Sequence
  chemically synthesized
atactaaggactccatcgctct

SEQ ID NO: 629507 - DNA, 22 bp, Artificial Sequence
  chemically synthesized
aggactccatcgctctgcccaa

SEQ ID NO: 629508 - DNA, 22 bp, Artificial Sequence
  chemically synthesized
cacatggcagatgatttgggca

SEQ ID NO: 629509 - DNA, 22 bp, Artificial Sequence
  chemically synthesized
ccacatggcagatgatttgggc

SEQ ID NO: 629510 - DNA, 22 bp, Artificial Sequence
  chemically synthesized
tccacatggcagatgatttggg

SEQ ID NO: 629511 - DNA, 22 bp, Artificial Sequence
  chemically synthesized
ttccacatggcagatgatttgg

SEQ ID NO: 629512 - DNA, 22 bp, Artificial Sequence
  chemically synthesized
catcgctctgcccaaatcatct

SEQ ID NO: 629513 - DNA, 22 bp, Artificial Sequence
  chemically synthesized
tgcccaaatcatctgccatgtg

SEQ ID NO: 629514 - DNA, 22 bp, Artificial Sequence
  chemically synthesized
cccaaatcatctgccatgtgga

SEQ ID NO: 629515 - DNA, 22 bp, Artificial Sequence
  chemically synthesized
caggacacaatgtaggaagtct

SEQ ID NO: 629516 - DNA, 22 bp, Artificial Sequence
  chemically synthesized
ccatgtggaaaagacttcctac

SEQ ID NO: 629517 - DNA, 22 bp, Artificial Sequence
  chemically synthesized
ccaggacacaatgtaggaagtc

SEQ ID NO: 629518 - DNA, 22 bp, Artificial Sequence
  chemically synthesized
tccaggacacaatgtaggaagt

SEQ ID NO: 629519 - DNA, 22 bp, Artificial Sequence
  chemically synthesized
ttttccaggacacaatgtagga

SEQ ID NO: 629520 - DNA, 22 bp, Artificial Sequence
  chemically synthesized
gttttccaggacacaatgtagg

SEQ ID NO: 629521 - DNA, 22 bp, Artificial Sequence
  chemically synthesized
tgttttccaggacacaatgtag

SEQ ID NO: 629522 - DNA, 22 bp, Artificial Sequence
  chemically synthesized
tttgttttccaggacacaatgt

SEQ ID NO: 629523 - DNA, 22 bp, Artificial Sequence
  chemically synthesized
tctttgttttccaggacacaat

SEQ ID NO: 629524 - DNA, 22 bp, Artificial Sequence
  chemically synthesized
ctctttgttttccaggacacaa

SEQ ID NO: 629525 - DNA, 22 bp, Artificial Sequence
  chemically synthesized
tctctttgttttccaggacaca

SEQ ID NO: 629526 - DNA, 22 bp, Artificial Sequence
  chemically synthesized
tttctctttgttttccaggaca

SEQ ID NO: 629527 - DNA, 22 bp, Artificial Sequence
  chemically synthesized
ctttctctttgttttccaggac

SEQ ID NO: 629528 - DNA, 22 bp, Artificial Sequence
  chemically synthesized
tctttctctttgttttccagga

SEQ ID NO: 629529 - DNA, 22 bp, Artificial Sequence
  chemically synthesized
cctacattgtgtcctggaaaac

SEQ ID NO: 629530 - DNA, 22 bp, Artificial Sequence
  chemically synthesized
ctacattgtgtcctggaaaaca

SEQ ID NO: 629531 - DNA, 22 bp, Artificial Sequence
  chemically synthesized
tctttctttctctttgttttcc

SEQ ID NO: 629532 - DNA, 22 bp, Artificial Sequence
  chemically synthesized
cattgtgtcctggaaaacaaag

SEQ ID NO: 629533 - DNA, 22 bp, Artificial Sequence
  chemically synthesized
tgtcctggaaaacaaagagaaa

SEQ ID NO: 629534 - DNA, 22 bp, Artificial Sequence
  chemically synthesized
taaagtctgtctttctttctct

SEQ ID NO: 629535 - DNA, 22 bp, Artificial Sequence
  chemically synthesized
gtaaagtctgtctttctttctc

SEQ ID NO: 629536 - DNA, 22 bp, Artificial Sequence
  chemically synthesized
tgtaaagtctgtctttctttct

SEQ ID NO: 629537 - DNA, 22 bp, Artificial Sequence
  chemically synthesized
ttgtaaagtctgtctttctttc

SEQ ID NO: 629538 - DNA, 22 bp, Artificial Sequence
  chemically synthesized
gaaaacaaagagaaagaaagac

SEQ ID NO: 629539 - DNA, 22 bp, Artificial Sequence
  chemically synthesized
caccttttgtaaagtctgtctt

SEQ ID NO: 629540 - DNA, 22 bp, Artificial Sequence
  chemically synthesized
tctgcaccttttgtaaagtctg

SEQ ID NO: 629541 - DNA, 22 bp, Artificial Sequence
  chemically synthesized
tctatctgcaccttttgtaaag

SEQ ID NO: 629542 - DNA, 22 bp, Artificial Sequence
  chemically synthesized
tacaaaaggtgcagatagatag

SEQ ID NO: 629543 - DNA, 22 bp, Artificial Sequence
  chemically synthesized
acaaaaggtgcagatagatagc

SEQ ID NO: 629544 - DNA, 22 bp, Artificial Sequence
  chemically synthesized
caaaaggtgcagatagatagca

SEQ ID NO: 629545 - DNA, 22 bp, Artificial Sequence
  chemically synthesized
ccaaatggcaaagaaacagagt

SEQ ID NO: 629546 - DNA, 22 bp, Artificial Sequence
  chemically synthesized
cccaaatggcaaagaaacagag

SEQ ID NO: 629547 - DNA, 22 bp, Artificial Sequence
  chemically synthesized
tgtttctttgccatttgggaaa

SEQ ID NO: 629548 - DNA, 22 bp, Artificial Sequence
  chemically synthesized
tttctttgccatttgggaaatc

SEQ ID NO: 629549 - DNA, 22 bp, Artificial Sequence
  chemically synthesized
ctttgccatttgggaaatcatt

SEQ ID NO: 629550 - DNA, 22 bp, Artificial Sequence
  chemically synthesized
tttgccatttgggaaatcattc

SEQ ID NO: 629551 - DNA, 22 bp, Artificial Sequence
  chemically synthesized
acccagaaatggggaatgattt

SEQ ID NO: 629552 - DNA, 22 bp, Artificial Sequence
  chemically synthesized
tgccatttgggaaatcattccc

SEQ ID NO: 629553 - DNA, 22 bp, Artificial Sequence
  chemically synthesized
cacccagaaatggggaatgatt

SEQ ID NO: 629554 - DNA, 22 bp, Artificial Sequence
  chemically synthesized
gccatttgggaaatcattcccc

SEQ ID NO: 629555 - DNA, 22 bp, Artificial Sequence
  chemically synthesized
ccatttgggaaatcattcccca

SEQ ID NO: 629556 - DNA, 22 bp, Artificial Sequence
  chemically synthesized
tcttcacccagaaatggggaat

SEQ ID NO: 629557 - DNA, 22 bp, Artificial Sequence
  chemically synthesized
gggaaatcattccccatttctg

SEQ ID NO: 629558 - DNA, 22 bp, Artificial Sequence
  chemically synthesized
ggaaatcattccccatttctgg

SEQ ID NO: 629559 - DNA, 22 bp, Artificial Sequence
  chemically synthesized
tgttgtcttcacccagaaatgg

SEQ ID NO: 629560 - DNA, 22 bp, Artificial Sequence
  chemically synthesized
tgtgttgtcttcacccagaaat

SEQ ID NO: 629561 - DNA, 22 bp, Artificial Sequence
  chemically synthesized
ctgtgttgtcttcacccagaaa

SEQ ID NO: 629562 - DNA, 22 bp, Artificial Sequence
  chemically synthesized
cccatttctgggtgaagacaac

SEQ ID NO: 629563 - DNA, 22 bp, Artificial Sequence
  chemically synthesized
gatgcagcttctgtgttgtctt

SEQ ID NO: 629564 - DNA, 22 bp, Artificial Sequence
  chemically synthesized
ctgggtgaagacaacacagaag

SEQ ID NO: 629565 - DNA, 22 bp, Artificial Sequence
  chemically synthesized
tgggtgaagacaacacagaagc

SEQ ID NO: 629566 - DNA, 22 bp, Artificial Sequence
  chemically synthesized
ggtgaagacaacacagaagctg

SEQ ID NO: 629567 - DNA, 22 bp, Artificial Sequence
  chemically synthesized
tgtacaccctcgatgcagcttc

SEQ ID NO: 629568 - DNA, 22 bp, Artificial Sequence
  chemically synthesized
ttgtgtacaccctcgatgcagc

SEQ ID NO: 629569 - DNA, 22 bp, Artificial Sequence
  chemically synthesized
gttgtgtacaccctcgatgcag

SEQ ID NO: 629570 - DNA, 22 bp, Artificial Sequence
  chemically synthesized
catcgagggtgtacacaacaag

SEQ ID NO: 629571 - DNA, 22 bp, Artificial Sequence
  chemically synthesized
gtgaaaaatcaaaccttgttgt

SEQ ID NO: 629572 - DNA, 22 bp, Artificial Sequence
  chemically synthesized
gaaactggtgaaaaatcaaacc

SEQ ID NO: 629573 - DNA, 22 bp, Artificial Sequence
  chemically synthesized
ctggaaactggtgaaaaatcaa

SEQ ID NO: 629574 - DNA, 22 bp, Artificial Sequence
  chemically synthesized
cctggaaactggtgaaaaatca

SEQ ID NO: 629575 - DNA, 22 bp, Artificial Sequence
  chemically synthesized
ttcctggaaactggtgaaaaat

SEQ ID NO: 629576 - DNA, 22 bp, Artificial Sequence
  chemically synthesized
cttcctggaaactggtgaaaaa

SEQ ID NO: 629577 - DNA, 22 bp, Artificial Sequence
  chemically synthesized
cttcttcctggaaactggtgaa

SEQ ID NO: 629578 - DNA, 22 bp, Artificial Sequence
  chemically synthesized
gcttcttcctggaaactggtga

SEQ ID NO: 629579 - DNA, 22 bp, Artificial Sequence
  chemically synthesized
tgcttcttcctggaaactggtg

SEQ ID NO: 629580 - DNA, 22 bp, Artificial Sequence
  chemically synthesized
gatttttcaccagtttccagga

SEQ ID NO: 629581 - DNA, 22 bp, Artificial Sequence
  chemically synthesized
atttttcaccagtttccaggaa

SEQ ID NO: 629582 - DNA, 22 bp, Artificial Sequence
  chemically synthesized
ataaggctttgcttcttcctgg

SEQ ID NO: 629583 - DNA, 22 bp, Artificial Sequence
  chemically synthesized
ttcaccagtttccaggaagaag

SEQ ID NO: 629584 - DNA, 22 bp, Artificial Sequence
  chemically synthesized
tcaccagtttccaggaagaagc

SEQ ID NO: 629585 - DNA, 22 bp, Artificial Sequence
  chemically synthesized
caccagtttccaggaagaagca

SEQ ID NO: 629586 - DNA, 22 bp, Artificial Sequence
  chemically synthesized
accagtttccaggaagaagcaa

SEQ ID NO: 629587 - DNA, 22 bp, Artificial Sequence
  chemically synthesized
attaataaggctttgcttcttc

SEQ ID NO: 629588 - DNA, 22 bp, Artificial Sequence
  chemically synthesized
cattaataaggctttgcttctt

SEQ ID NO: 629589 - DNA, 22 bp, Artificial Sequence
  chemically synthesized
ccaggaagaagcaaagccttat

SEQ ID NO: 629590 - DNA, 22 bp, Artificial Sequence
  chemically synthesized
caggaagaagcaaagccttatt

SEQ ID NO: 629591 - DNA, 22 bp, Artificial Sequence
  chemically synthesized
acaaacaacgtgtaatggcttc

SEQ ID NO: 629592 - DNA, 22 bp, Artificial Sequence
  chemically synthesized
attaatgaagccattacacgtt

SEQ ID NO: 629593 - DNA, 22 bp, Artificial Sequence
  chemically synthesized
atactaacaaacaacgtgtaat

SEQ ID NO: 629594 - DNA, 22 bp, Artificial Sequence
  chemically synthesized
ttaatgaagccattacacgttg

SEQ ID NO: 629595 - DNA, 22 bp, Artificial Sequence
  chemically synthesized
atgaagccattacacgttgttt

SEQ ID NO: 629596 - DNA, 22 bp, Artificial Sequence
  chemically synthesized
agctgatactaacaaacaacgt

SEQ ID NO: 629597 - DNA, 22 bp, Artificial Sequence
  chemically synthesized
cacgttgtttgttagtatcagc

SEQ ID NO: 629598 - DNA, 22 bp, Artificial Sequence
  chemically synthesized
atccaacattaagctgatacta

SEQ ID NO: 629599 - DNA, 22 bp, Artificial Sequence
  chemically synthesized
tttgttagtatcagcttaatgt

SEQ ID NO: 629600 - DNA, 22 bp, Artificial Sequence
  chemically synthesized
gttagtatcagcttaatgttgg

SEQ ID NO: 629601 - DNA, 22 bp, Artificial Sequence
  chemically synthesized
ttagtatcagcttaatgttgga

SEQ ID NO: 629602 - DNA, 22 bp, Artificial Sequence
  chemically synthesized
gtatcagcttaatgttggatca

SEQ ID NO: 629603 - DNA, 22 bp, Artificial Sequence
  chemically synthesized
catgtaaacaccagtagcctga

SEQ ID NO: 629604 - DNA, 22 bp, Artificial Sequence
  chemically synthesized
ccatgtaaacaccagtagcctg

SEQ ID NO: 629605 - DNA, 22 bp, Artificial Sequence
  chemically synthesized
tccatgtaaacaccagtagcct

SEQ ID NO: 629606 - DNA, 22 bp, Artificial Sequence
  chemically synthesized
aatgttggatcaggctactggt

SEQ ID NO: 629607 - DNA, 22 bp, Artificial Sequence
  chemically synthesized
ttccatgtaaacaccagtagcc

SEQ ID NO: 629608 - DNA, 22 bp, Artificial Sequence
  chemically synthesized
atgttggatcaggctactggtg

SEQ ID NO: 629609 - DNA, 22 bp, Artificial Sequence
  chemically synthesized
acatttttccatgtaaacacca

SEQ ID NO: 629610 - DNA, 22 bp, Artificial Sequence
  chemically synthesized
gatcaggctactggtgtttaca

SEQ ID NO: 629611 - DNA, 22 bp, Artificial Sequence
  chemically synthesized
gacatttttccatgtaaacacc

SEQ ID NO: 629612 - DNA, 22 bp, Artificial Sequence
  chemically synthesized
ctggtgtttacatggaaaaatg

SEQ ID NO: 629613 - DNA, 22 bp, Artificial Sequence
  chemically synthesized
aatgtagcttgacatttttcca

SEQ ID NO: 629614 - DNA, 22 bp, Artificial Sequence
  chemically synthesized
gtgtttacatggaaaaatgtca

SEQ ID NO: 629615 - DNA, 22 bp, Artificial Sequence
  chemically synthesized
ggaacctgaatgtagcttgaca

SEQ ID NO: 629616 - DNA, 22 bp, Artificial Sequence
  chemically synthesized
acatggaaaaatgtcaagctac

SEQ ID NO: 629617 - DNA, 22 bp, Artificial Sequence
  chemically synthesized
catggaaaaatgtcaagctaca

SEQ ID NO: 629618 - DNA, 22 bp, Artificial Sequence
  chemically synthesized
cattgggaacctgaatgtagct

SEQ ID NO: 629619 - DNA, 22 bp, Artificial Sequence
  chemically synthesized
acattgggaacctgaatgtagc

SEQ ID NO: 629620 - DNA, 22 bp, Artificial Sequence
  chemically synthesized
atatatatttacattgggaacc

SEQ ID NO: 629621 - DNA, 22 bp, Artificial Sequence
  chemically synthesized
gatatatatttacattgggaac

SEQ ID NO: 629622 - DNA, 22 bp, Artificial Sequence
  chemically synthesized
tgatatatatttacattgggaa

SEQ ID NO: 629623 - DNA, 22 bp, Artificial Sequence
  chemically synthesized
ttgatatatatttacattggga

SEQ ID NO: 629624 - DNA, 22 bp, Artificial Sequence
  chemically synthesized
ttttgatatatatttacattgg

SEQ ID NO: 629625 - DNA, 22 bp, Artificial Sequence
  chemically synthesized
cattcaggttcccaatgtaaat

SEQ ID NO: 629626 - DNA, 22 bp, Artificial Sequence
  chemically synthesized
aggttcccaatgtaaatatata

SEQ ID NO: 629627 - DNA, 22 bp, Artificial Sequence
  chemically synthesized
tggaattcttttgatatatatt

SEQ ID NO: 629628 - DNA, 22 bp, Artificial Sequence
  chemically synthesized
ccaatgtaaatatatatcaaaa

SEQ ID NO: 629629 - DNA, 22 bp, Artificial Sequence
  chemically synthesized
tctatggaattcttttgatata

SEQ ID NO: 629630 - DNA, 22 bp, Artificial Sequence
  chemically synthesized
atctatggaattcttttgatat

SEQ ID NO: 629631 - DNA, 22 bp, Artificial Sequence
  chemically synthesized
tgcttatctatggaattctttt

SEQ ID NO: 629632 - DNA, 22 bp, Artificial Sequence
  chemically synthesized
gtgcttatctatggaattcttt

SEQ ID NO: 629633 - DNA, 22 bp, Artificial Sequence
  chemically synthesized
atagaaatcttgtgcttatcta

SEQ ID NO: 629634 - DNA, 22 bp, Artificial Sequence
  chemically synthesized
tgatagaaatcttgtgcttatc

SEQ ID NO: 629635 - DNA, 22 bp, Artificial Sequence
  chemically synthesized
ttctgatagaaatcttgtgctt

SEQ ID NO: 629636 - DNA, 22 bp, Artificial Sequence
  chemically synthesized
ctgttctgatagaaatcttgtg

SEQ ID NO: 629637 - DNA, 22 bp, Artificial Sequence
  chemically synthesized
catagataagcacaagatttct

SEQ ID NO: 629638 - DNA, 22 bp, Artificial Sequence
  chemically synthesized
ctatcagaacaggaatattcca

SEQ ID NO: 629639 - DNA, 22 bp, Artificial Sequence
  chemically synthesized
tatcagaacaggaatattccat

SEQ ID NO: 629640 - DNA, 22 bp, Artificial Sequence
  chemically synthesized
tcagaacaggaatattccatga

SEQ ID NO: 629641 - DNA, 22 bp, Artificial Sequence
  chemically synthesized
atagccaaggtggaaaagatgt

SEQ ID NO: 629642 - DNA, 22 bp, Artificial Sequence
  chemically synthesized
catgatgggatacatcttttcc

SEQ ID NO: 629643 - DNA, 22 bp, Artificial Sequence
  chemically synthesized
ttccaccttggctatgagtgat

SEQ ID NO: 629644 - DNA, 22 bp, Artificial Sequence
  chemically synthesized
tccaccttggctatgagtgatt

SEQ ID NO: 629645 - DNA, 22 bp, Artificial Sequence
  chemically synthesized
ccaccttggctatgagtgattg

SEQ ID NO: 629646 - DNA, 22 bp, Artificial Sequence
  chemically synthesized
caccttggctatgagtgattga

SEQ ID NO: 629647 - DNA, 22 bp, Artificial Sequence
  chemically synthesized
ggctatgagtgattgattgatt

SEQ ID NO: 629648 - DNA, 22 bp, Artificial Sequence
  chemically synthesized
gctatgagtgattgattgatta

SEQ ID NO: 629649 - DNA, 22 bp, Artificial Sequence
  chemically synthesized
tgagtgattgattgattactta

SEQ ID NO: 629650 - DNA, 22 bp, Artificial Sequence
  chemically synthesized
atacaagtagagagtaagtaat

SEQ ID NO: 629651 - DNA, 22 bp, Artificial Sequence
  chemically synthesized
gttaatacaagtagagagtaag

SEQ ID NO: 629652 - DNA, 22 bp, Artificial Sequence
  chemically synthesized
attgattacttactctctactt

SEQ ID NO: 629653 - DNA, 22 bp, Artificial Sequence
  chemically synthesized
attacttactctctacttgtat

SEQ ID NO: 629654 - DNA, 22 bp, Artificial Sequence
  chemically synthesized
cttactctctacttgtattaac

SEQ ID NO: 629655 - DNA, 22 bp, Artificial Sequence
  chemically synthesized
actctctacttgtattaacgaa

SEQ ID NO: 629656 - DNA, 22 bp, Artificial Sequence
  chemically synthesized
ctctctacttgtattaacgaac

SEQ ID NO: 629657 - DNA, 22 bp, Artificial Sequence
  chemically synthesized
atagtaaaaaaaatgttcgtta

SEQ ID NO: 629658 - DNA, 22 bp, Artificial Sequence
  chemically synthesized
tctacttgtattaacgaacatt

SEQ ID NO: 629659 - DNA, 22 bp, Artificial Sequence
  chemically synthesized
tacttgtattaacgaacatttt

SEQ ID NO: 629660 - DNA, 22 bp, Artificial Sequence
  chemically synthesized
attgatagtaaaaaaaatgttc

SEQ ID NO: 629661 - DNA, 22 bp, Artificial Sequence
  chemically synthesized
cttgtattaacgaacatttttt

SEQ ID NO: 629662 - DNA, 22 bp, Artificial Sequence
  chemically synthesized
gattgatagtaaaaaaaatgtt

SEQ ID NO: 629663 - DNA, 22 bp, Artificial Sequence
  chemically synthesized
gtattaacgaacatttttttta

SEQ ID NO: 629664 - DNA, 22 bp, Artificial Sequence
  chemically synthesized
tattaacgaacattttttttac

SEQ ID NO: 629665 - DNA, 22 bp, Artificial Sequence
  chemically synthesized
acgaacattttttttactatca

SEQ ID NO: 629666 - DNA, 22 bp, Artificial Sequence
  chemically synthesized
tttttactatcaatcaaaccac

SEQ ID NO: 629667 - DNA, 22 bp, Artificial Sequence
  chemically synthesized
ttttactatcaatcaaaccacc

SEQ ID NO: 629668 - DNA, 22 bp, Artificial Sequence
  chemically synthesized
tttactatcaatcaaaccacca

SEQ ID NO: 629669 - DNA, 22 bp, Artificial Sequence
  chemically synthesized
tgaaggtggtgatggtggtttg

SEQ ID NO: 629670 - DNA, 22 bp, Artificial Sequence
  chemically synthesized
ttactatcaatcaaaccaccat

SEQ ID NO: 629671 - DNA, 22 bp, Artificial Sequence
  chemically synthesized
tactatcaatcaaaccaccatc

SEQ ID NO: 629672 - DNA, 22 bp, Artificial Sequence
  chemically synthesized
actatcaatcaaaccaccatca

SEQ ID NO: 629673 - DNA, 22 bp, Artificial Sequence
  chemically synthesized
ctatcaatcaaaccaccatcac

SEQ ID NO: 629674 - DNA, 22 bp, Artificial Sequence
  chemically synthesized
tcaatcaaaccaccatcaccac

SEQ ID NO: 629675 - DNA, 22 bp, Artificial Sequence
  chemically synthesized
gtgatggtagtggtagttgtga

SEQ ID NO: 629676 - DNA, 22 bp, Artificial Sequence
  chemically synthesized
ggtgctggtgatggtagtggta

SEQ ID NO: 629677 - DNA, 22 bp, Artificial Sequence
  chemically synthesized
cacaactaccactaccatcacc

SEQ ID NO: 629678 - DNA, 22 bp, Artificial Sequence
  chemically synthesized
acaactaccactaccatcacca

SEQ ID NO: 629679 - DNA, 22 bp, Artificial Sequence
  chemically synthesized
ccactaccatcaccagcaccca

SEQ ID NO: 629680 - DNA, 22 bp, Artificial Sequence
  chemically synthesized
ccatcaccagcacccaaccatc

SEQ ID NO: 629681 - DNA, 22 bp, Artificial Sequence
  chemically synthesized
gtgtggcggtgatggtggcagt

SEQ ID NO: 629682 - DNA, 22 bp, Artificial Sequence
  chemically synthesized
tcactgccaccatcaccgccac

SEQ ID NO: 629683 - DNA, 22 bp, Artificial Sequence
  chemically synthesized
aaatgaaaagttggtgtggcgg

SEQ ID NO: 629684 - DNA, 22 bp, Artificial Sequence
  chemically synthesized
gaaatgaaaagttggtgtggcg

SEQ ID NO: 629685 - DNA, 22 bp, Artificial Sequence
  chemically synthesized
tgaaatgaaaagttggtgtggc

SEQ ID NO: 629686 - DNA, 22 bp, Artificial Sequence
  chemically synthesized
ccaccatcaccgccacaccaac

SEQ ID NO: 629687 - DNA, 22 bp, Artificial Sequence
  chemically synthesized
aaacagctttgaaatgaaaagt

SEQ ID NO: 629688 - DNA, 22 bp, Artificial Sequence
  chemically synthesized
ttcatttcaaagctgtttcagg

SEQ ID NO: 629689 - DNA, 22 bp, Artificial Sequence
  chemically synthesized
tcatttcaaagctgtttcaggc

SEQ ID NO: 629690 - DNA, 22 bp, Artificial Sequence
  chemically synthesized
catttcaaagctgtttcaggct

SEQ ID NO: 629691 - DNA, 22 bp, Artificial Sequence
  chemically synthesized
atttcaaagctgtttcaggctg

SEQ ID NO: 629692 - DNA, 22 bp, Artificial Sequence
  chemically synthesized
agaagcaagccaacagcctgaa

SEQ ID NO: 629693 - DNA, 22 bp, Artificial Sequence
  chemically synthesized
caaagctgtttcaggctgttgg

SEQ ID NO: 629694 - DNA, 22 bp, Artificial Sequence
  chemically synthesized
aaagctgtttcaggctgttggc

SEQ ID NO: 629695 - DNA, 22 bp, Artificial Sequence
  chemically synthesized
tttcaggctgttggcttgcttc

SEQ ID NO: 629696 - DNA, 22 bp, Artificial Sequence
  chemically synthesized
caccatagcctcagaagcaagc

SEQ ID NO: 629697 - DNA, 22 bp, Artificial Sequence
  chemically synthesized
caggctgttggcttgcttctga

SEQ ID NO: 629698 - DNA, 22 bp, Artificial Sequence
  chemically synthesized
aggctgttggcttgcttctgag

SEQ ID NO: 629699 - DNA, 22 bp, Artificial Sequence
  chemically synthesized
ttggcttgcttctgaggctatg

SEQ ID NO: 629700 - DNA, 22 bp, Artificial Sequence
  chemically synthesized
gcttgcttctgaggctatggtg

SEQ ID NO: 629701 - DNA, 22 bp, Artificial Sequence
  chemically synthesized
gcttctgaggctatggtggagg

SEQ ID NO: 629702 - DNA, 22 bp, Artificial Sequence
  chemically synthesized
cttctgaggctatggtggaggt

SEQ ID NO: 629703 - DNA, 22 bp, Artificial Sequence
  chemically synthesized
ctgaggctatggtggaggtggc

SEQ ID NO: 629704 - DNA, 22 bp, Artificial Sequence
  chemically synthesized
tgaggctatggtggaggtggct

SEQ ID NO: 629705 - DNA, 22 bp, Artificial Sequence
  chemically synthesized
aggctatggtggaggtggctat

SEQ ID NO: 629706 - DNA, 22 bp, Artificial Sequence
  chemically synthesized
tggtggaggtggctattttctc

SEQ ID NO: 629707 - DNA, 22 bp, Artificial Sequence
  chemically synthesized
aacccaagtaaaagcagagaga

SEQ ID NO: 629708 - DNA, 22 bp, Artificial Sequence
  chemically synthesized
caacccaagtaaaagcagagag

SEQ ID NO: 629709 - DNA, 22 bp, Artificial Sequence
  chemically synthesized
tcaacccaagtaaaagcagaga

SEQ ID NO: 629710 - DNA, 22 bp, Artificial Sequence
  chemically synthesized
ttcaacccaagtaaaagcagag

SEQ ID NO: 629711 - DNA, 22 bp, Artificial Sequence
  chemically synthesized
tttttcaacccaagtaaaagca

SEQ ID NO: 629712 - DNA, 22 bp, Artificial Sequence
  chemically synthesized
ttttctctctgcttttacttgg

SEQ ID NO: 629713 - DNA, 22 bp, Artificial Sequence
  chemically synthesized
ttatttttcaacccaagtaaaa

SEQ ID NO: 629714 - DNA, 22 bp, Artificial Sequence
  chemically synthesized
tctctctgcttttacttgggtt

SEQ ID NO: 629715 - DNA, 22 bp, Artificial Sequence
  chemically synthesized
ttattatttttcaacccaagta

SEQ ID NO: 629716 - DNA, 22 bp, Artificial Sequence
  chemically synthesized
ctctctgcttttacttgggttg

SEQ ID NO: 629717 - DNA, 22 bp, Artificial Sequence
  chemically synthesized
tctctgcttttacttgggttga

SEQ ID NO: 629718 - DNA, 22 bp, Artificial Sequence
  chemically synthesized
ttattattatttttcaacccaa

SEQ ID NO: 629719 - DNA, 22 bp, Artificial Sequence
  chemically synthesized
tctgcttttacttgggttgaaa

SEQ ID NO: 629720 - DNA, 22 bp, Artificial Sequence
  chemically synthesized
attattattatttttcaaccca

SEQ ID NO: 629721 - DNA, 22 bp, Artificial Sequence
  chemically synthesized
tgcttttacttgggttgaaaaa

SEQ ID NO: 629722 - DNA, 22 bp, Artificial Sequence
  chemically synthesized
cttttacttgggttgaaaaata

SEQ ID NO: 629723 - DNA, 22 bp, Artificial Sequence
  chemically synthesized
ttacttgggttgaaaaataata

SEQ ID NO: 629724 - DNA, 22 bp, Artificial Sequence
  chemically synthesized
tacttgggttgaaaaataataa

SEQ ID NO: 629725 - DNA, 22 bp, Artificial Sequence
  chemically synthesized
aagagtttattattattatttt

SEQ ID NO: 629726 - DNA, 22 bp, Artificial Sequence
  chemically synthesized
acttgggttgaaaaataataat

SEQ ID NO: 629727 - DNA, 22 bp, Artificial Sequence
  chemically synthesized
cttgggttgaaaaataataata

SEQ ID NO: 629728 - DNA, 22 bp, Artificial Sequence
  chemically synthesized
gggttgaaaaataataataata

SEQ ID NO: 629729 - DNA, 22 bp, Artificial Sequence
  chemically synthesized
ggttgaaaaataataataataa

SEQ ID NO: 629730 - DNA, 22 bp, Artificial Sequence
  chemically synthesized
aaaaataataataataaactct

SEQ ID NO: 629731 - DNA, 22 bp, Artificial Sequence
  chemically synthesized
atagtgcaccaaaaggtcaatt

SEQ ID NO: 629732 - DNA, 22 bp, Artificial Sequence
  chemically synthesized
aaatgttaatagtgcaccaaaa

SEQ ID NO: 629733 - DNA, 22 bp, Artificial Sequence
  chemically synthesized
ttgaattgaccttttggtgcac

SEQ ID NO: 629734 - DNA, 22 bp, Artificial Sequence
  chemically synthesized
gaattgaccttttggtgcacta

SEQ ID NO: 629735 - DNA, 22 bp, Artificial Sequence
  chemically synthesized
aattgaccttttggtgcactat

SEQ ID NO: 629736 - DNA, 22 bp, Artificial Sequence
  chemically synthesized
attcaaatgttaatagtgcacc

SEQ ID NO: 629737 - DNA, 22 bp, Artificial Sequence
  chemically synthesized
ctaattcaaatgttaatagtgc

SEQ ID NO: 629738 - DNA, 22 bp, Artificial Sequence
  chemically synthesized
cctaattcaaatgttaatagtg

SEQ ID NO: 629739 - DNA, 22 bp, Artificial Sequence
  chemically synthesized
accttttggtgcactattaaca

SEQ ID NO: 629740 - DNA, 22 bp, Artificial Sequence
  chemically synthesized
ttggtgcactattaacatttga

SEQ ID NO: 629741 - DNA, 22 bp, Artificial Sequence
  chemically synthesized
aggtttcctaattcaaatgtta

SEQ ID NO: 629742 - DNA, 22 bp, Artificial Sequence
  chemically synthesized
tggtgcactattaacatttgaa

SEQ ID NO: 629743 - DNA, 22 bp, Artificial Sequence
  chemically synthesized
ggtgcactattaacatttgaat

SEQ ID NO: 629744 - DNA, 22 bp, Artificial Sequence
  chemically synthesized
tgaggtttcctaattcaaatgt

SEQ ID NO: 629745 - DNA, 22 bp, Artificial Sequence
  chemically synthesized
gtgcactattaacatttgaatt

SEQ ID NO: 629746 - DNA, 22 bp, Artificial Sequence
  chemically synthesized
ttctgaggtttcctaattcaaa

SEQ ID NO: 629747 - DNA, 22 bp, Artificial Sequence
  chemically synthesized
attctgaggtttcctaattcaa

SEQ ID NO: 629748 - DNA, 22 bp, Artificial Sequence
  chemically synthesized
tattctgaggtttcctaattca

SEQ ID NO: 629749 - DNA, 22 bp, Artificial Sequence
  chemically synthesized
ttattctgaggtttcctaattc

SEQ ID NO: 629750 - DNA, 22 bp, Artificial Sequence
  chemically synthesized
ttaacatttgaattaggaaacc

SEQ ID NO: 629751 - DNA, 22 bp, Artificial Sequence
  chemically synthesized
acatttgaattaggaaacctca

SEQ ID NO: 629752 - DNA, 22 bp, Artificial Sequence
  chemically synthesized
gaattaggaaacctcagaataa

SEQ ID NO: 629753 - DNA, 22 bp, Artificial Sequence
  chemically synthesized
aattaggaaacctcagaataaa

SEQ ID NO: 629754 - DNA, 22 bp, Artificial Sequence
  chemically synthesized
gaatgtaaagcaatttttattc

SEQ ID NO: 629755 - DNA, 22 bp, Artificial Sequence
  chemically synthesized
ggaatgtaaagcaatttttatt

SEQ ID NO: 629756 - DNA, 22 bp, Artificial Sequence
  chemically synthesized
ggaaacctcagaataaaaattg

SEQ ID NO: 629757 - DNA, 22 bp, Artificial Sequence
  chemically synthesized
gagtaatttggaatgtaaagca

SEQ ID NO: 629758 - DNA, 22 bp, Artificial Sequence
  chemically synthesized
agaataaaaattgctttacatt

SEQ ID NO: 629759 - DNA, 22 bp, Artificial Sequence
  chemically synthesized
gggtctagagtaatttggaatg

SEQ ID NO: 629760 - DNA, 22 bp, Artificial Sequence
  chemically synthesized
taattagggtctagagtaattt

SEQ ID NO: 629761 - DNA, 22 bp, Artificial Sequence
  chemically synthesized
ctttacattccaaattactcta

SEQ ID NO: 629762 - DNA, 22 bp, Artificial Sequence
  chemically synthesized
ataattagggtctagagtaatt

SEQ ID NO: 629763 - DNA, 22 bp, Artificial Sequence
  chemically synthesized
tacattccaaattactctagac

SEQ ID NO: 629764 - DNA, 22 bp, Artificial Sequence
  chemically synthesized
acattccaaattactctagacc

SEQ ID NO: 629765 - DNA, 22 bp, Artificial Sequence
  chemically synthesized
cattccaaattactctagaccc

SEQ ID NO: 629766 - DNA, 22 bp, Artificial Sequence
  chemically synthesized
caaattactctagaccctaatt

SEQ ID NO: 629767 - DNA, 22 bp, Artificial Sequence
  chemically synthesized
ctctagaccctaattataaggt

SEQ ID NO: 629768 - DNA, 22 bp, Artificial Sequence
  chemically synthesized
tagaccctaattataaggtgac

SEQ ID NO: 629769 - DNA, 22 bp, Artificial Sequence
  chemically synthesized
gaccctaattataaggtgaccc

SEQ ID NO: 629770 - DNA, 22 bp, Artificial Sequence
  chemically synthesized
attataaggtgacccacatgta

SEQ ID NO: 629771 - DNA, 22 bp, Artificial Sequence
  chemically synthesized
taaggtgacccacatgtattgt

SEQ ID NO: 629772 - DNA, 22 bp, Artificial Sequence
  chemically synthesized
acaaaatacccaaatgcataca

SEQ ID NO: 629773 - DNA, 22 bp, Artificial Sequence
  chemically synthesized
agatggattcacaaaataccca

SEQ ID NO: 629774 - DNA, 22 bp, Artificial Sequence
  chemically synthesized
taagatggattcacaaaatacc

SEQ ID NO: 629775 - DNA, 22 bp, Artificial Sequence
  chemically synthesized
tatgcatttgggtattttgtga

SEQ ID NO: 629776 - DNA, 22 bp, Artificial Sequence
  chemically synthesized
ggaggagctctaagatggattc

SEQ ID NO: 629777 - DNA, 22 bp, Artificial Sequence
  chemically synthesized
gggtattttgtgaatccatctt

SEQ ID NO: 629778 - DNA, 22 bp, Artificial Sequence
  chemically synthesized
aggaggagctctaagatggatt

SEQ ID NO: 629779 - DNA, 22 bp, Artificial Sequence
  chemically synthesized
ggtattttgtgaatccatctta

SEQ ID NO: 629780 - DNA, 22 bp, Artificial Sequence
  chemically synthesized
atttaggaggagctctaagatg

SEQ ID NO: 629781 - DNA, 22 bp, Artificial Sequence
  chemically synthesized
tgtgaatccatcttagagctcc

SEQ ID NO: 629782 - DNA, 22 bp, Artificial Sequence
  chemically synthesized
gtgaatccatcttagagctcct

SEQ ID NO: 629783 - DNA, 22 bp, Artificial Sequence
  chemically synthesized
tgaatccatcttagagctcctc

SEQ ID NO: 629784 - DNA, 22 bp, Artificial Sequence
  chemically synthesized
accctcatttaggaggagctct

SEQ ID NO: 629785 - DNA, 22 bp, Artificial Sequence
  chemically synthesized
tgatagttaaccctcatttagg

SEQ ID NO: 629786 - DNA, 22 bp, Artificial Sequence
  chemically synthesized
agagctcctcctaaatgagggt

SEQ ID NO: 629787 - DNA, 22 bp, Artificial Sequence
  chemically synthesized
ttgtgatagttaaccctcattt

SEQ ID NO: 629788 - DNA, 22 bp, Artificial Sequence
  chemically synthesized
gagctcctcctaaatgagggtt

SEQ ID NO: 629789 - DNA, 22 bp, Artificial Sequence
  chemically synthesized
ctcctaaatgagggttaactat

SEQ ID NO: 629790 - DNA, 22 bp, Artificial Sequence
  chemically synthesized
ctaaatgagggttaactatcac

SEQ ID NO: 629791 - DNA, 22 bp, Artificial Sequence
  chemically synthesized
gtaaaaggctattgtgatagtt

SEQ ID NO: 629792 - DNA, 22 bp, Artificial Sequence
  chemically synthesized
aatgagggttaactatcacaat

SEQ ID NO: 629793 - DNA, 22 bp, Artificial Sequence
  chemically synthesized
ttagtaaaaggctattgtgata

SEQ ID NO: 629794 - DNA, 22 bp, Artificial Sequence
  chemically synthesized
cattattagtaaaaggctattg

SEQ ID NO: 629795 - DNA, 22 bp, Artificial Sequence
  chemically synthesized
actatcacaatagccttttact

SEQ ID NO: 629796 - DNA, 22 bp, Artificial Sequence
  chemically synthesized
tcacaatagccttttactaata

SEQ ID NO: 629797 - DNA, 22 bp, Artificial Sequence
  chemically synthesized
ggtcgtgctgcattattagtaa

SEQ ID NO: 629798 - DNA, 22 bp, Artificial Sequence
  chemically synthesized
gtgctaggtcgtgctgcattat

SEQ ID NO: 629799 - DNA, 22 bp, Artificial Sequence
  chemically synthesized
ttactaataatgcagcacgacc

SEQ ID NO: 629800 - DNA, 22 bp, Artificial Sequence
  chemically synthesized
tactaataatgcagcacgacct

SEQ ID NO: 629801 - DNA, 22 bp, Artificial Sequence
  chemically synthesized
actaataatgcagcacgaccta

SEQ ID NO: 629802 - DNA, 22 bp, Artificial Sequence
  chemically synthesized
ggagattcgtgctaggtcgtgc

SEQ ID NO: 629803 - DNA, 22 bp, Artificial Sequence
  chemically synthesized
ctaataatgcagcacgacctag

SEQ ID NO: 629804 - DNA, 22 bp, Artificial Sequence
  chemically synthesized
ataatgcagcacgacctagcac

SEQ ID NO: 629805 - DNA, 22 bp, Artificial Sequence
  chemically synthesized
cgtgctgggagattcgtgctag

SEQ ID NO: 629806 - DNA, 22 bp, Artificial Sequence
  chemically synthesized
tccgtgctgggagattcgtgct

SEQ ID NO: 629807 - DNA, 22 bp, Artificial Sequence
  chemically synthesized
ctccgtgctgggagattcgtgc

SEQ ID NO: 629808 - DNA, 22 bp, Artificial Sequence
  chemically synthesized
tctccgtgctgggagattcgtg

SEQ ID NO: 629809 - DNA, 22 bp, Artificial Sequence
  chemically synthesized
ttctccgtgctgggagattcgt

SEQ ID NO: 629810 - DNA, 22 bp, Artificial Sequence
  chemically synthesized
tttctccgtgctgggagattcg

SEQ ID NO: 629811 - DNA, 22 bp, Artificial Sequence
  chemically synthesized
tttttctccgtgctgggagatt

SEQ ID NO: 629812 - DNA, 22 bp, Artificial Sequence
  chemically synthesized
ttctttttctccgtgctgggag

SEQ ID NO: 629813 - DNA, 22 bp, Artificial Sequence
  chemically synthesized
gcacgaatctcccagcacggag

SEQ ID NO: 629814 - DNA, 22 bp, Artificial Sequence
  chemically synthesized
tgctgttctttttctccgtgct

SEQ ID NO: 629815 - DNA, 22 bp, Artificial Sequence
  chemically synthesized
ccagcacggagaaaaagaacag

SEQ ID NO: 629816 - DNA, 22 bp, Artificial Sequence
  chemically synthesized
cgaagtacccagggacattgtg

SEQ ID NO: 629817 - DNA, 22 bp, Artificial Sequence
  chemically synthesized
ctacgaagtacccagggacatt

SEQ ID NO: 629818 - DNA, 22 bp, Artificial Sequence
  chemically synthesized
gctacgaagtacccagggacat

SEQ ID NO: 629819 - DNA, 22 bp, Artificial Sequence
  chemically synthesized
tgctacgaagtacccagggaca

SEQ ID NO: 629820 - DNA, 22 bp, Artificial Sequence
  chemically synthesized
aattttgctacgaagtacccag

SEQ ID NO: 629821 - DNA, 22 bp, Artificial Sequence
  chemically synthesized
aatctgaattttgctacgaagt

SEQ ID NO: 629822 - DNA, 22 bp, Artificial Sequence
  chemically synthesized
taaatctgaattttgctacgaa

SEQ ID NO: 629823 - DNA, 22 bp, Artificial Sequence
  chemically synthesized
ctctaaatctgaattttgctac

SEQ ID NO: 629824 - DNA, 22 bp, Artificial Sequence
  chemically synthesized
actctaaatctgaattttgcta

SEQ ID NO: 629825 - DNA, 22 bp, Artificial Sequence
  chemically synthesized
ggtacttcgtagcaaaattcag

SEQ ID NO: 629826 - DNA, 22 bp, Artificial Sequence
  chemically synthesized
tcttactctaaatctgaatttt

SEQ ID NO: 629827 - DNA, 22 bp, Artificial Sequence
  chemically synthesized
cgtagcaaaattcagatttaga

SEQ ID NO: 629828 - DNA, 22 bp, Artificial Sequence
  chemically synthesized
agattatcttactctaaatctg

SEQ ID NO: 629829 - DNA, 22 bp, Artificial Sequence
  chemically synthesized
gtagcaaaattcagatttagag

SEQ ID NO: 629830 - DNA, 22 bp, Artificial Sequence
  chemically synthesized
agatttagagtaagataatctg

SEQ ID NO: 629831 - DNA, 22 bp, Artificial Sequence
  chemically synthesized
agagtaagataatctgagactt

SEQ ID NO: 629832 - DNA, 22 bp, Artificial Sequence
  chemically synthesized
gagtaagataatctgagactta

SEQ ID NO: 629833 - DNA, 22 bp, Artificial Sequence
  chemically synthesized
agacttactttatggcttgcct

SEQ ID NO: 629834 - DNA, 22 bp, Artificial Sequence
  chemically synthesized
tgggacatagacgaaaaggcaa

SEQ ID NO: 629835 - DNA, 22 bp, Artificial Sequence
  chemically synthesized
actttatggcttgccttttcgt

SEQ ID NO: 629836 - DNA, 22 bp, Artificial Sequence
  chemically synthesized
ctttatggcttgccttttcgtc

SEQ ID NO: 629837 - DNA, 22 bp, Artificial Sequence
  chemically synthesized
tatggcttgccttttcgtctat

SEQ ID NO: 629838 - DNA, 22 bp, Artificial Sequence
  chemically synthesized
atggcttgccttttcgtctatg

SEQ ID NO: 629839 - DNA, 22 bp, Artificial Sequence
  chemically synthesized
tggcttgccttttcgtctatgt

SEQ ID NO: 629840 - DNA, 22 bp, Artificial Sequence
  chemically synthesized
gccttttcgtctatgtcccata

SEQ ID NO: 629841 - DNA, 22 bp, Artificial Sequence
  chemically synthesized
gccatgtaaaactatgggacat

SEQ ID NO: 629842 - DNA, 22 bp, Artificial Sequence
  chemically synthesized
ccttttcgtctatgtcccatag

SEQ ID NO: 629843 - DNA, 22 bp, Artificial Sequence
  chemically synthesized
ttcgtctatgtcccatagtttt

SEQ ID NO: 629844 - DNA, 22 bp, Artificial Sequence
  chemically synthesized
tcgtctatgtcccatagtttta

SEQ ID NO: 629845 - DNA, 22 bp, Artificial Sequence
  chemically synthesized
aaattagccatgtaaaactatg

SEQ ID NO: 629846 - DNA, 22 bp, Artificial Sequence
  chemically synthesized
cgtctatgtcccatagttttac

SEQ ID NO: 629847 - DNA, 22 bp, Artificial Sequence
  chemically synthesized
gtctatgtcccatagttttaca

SEQ ID NO: 629848 - DNA, 22 bp, Artificial Sequence
  chemically synthesized
tgtcccatagttttacatggct

SEQ ID NO: 629849 - DNA, 22 bp, Artificial Sequence
  chemically synthesized
ccaatgtgcaataattaaaatt

SEQ ID NO: 629850 - DNA, 22 bp, Artificial Sequence
  chemically synthesized
accaatgtgcaataattaaaat

SEQ ID NO: 629851 - DNA, 22 bp, Artificial Sequence
  chemically synthesized
tacatggctaattttaattatt

SEQ ID NO: 629852 - DNA, 22 bp, Artificial Sequence
  chemically synthesized
acatggctaattttaattattg

SEQ ID NO: 629853 - DNA, 22 bp, Artificial Sequence
  chemically synthesized
catggctaattttaattattgc

SEQ ID NO: 629854 - DNA, 22 bp, Artificial Sequence
  chemically synthesized
attttaattattgcacattggt

SEQ ID NO: 629855 - DNA, 22 bp, Artificial Sequence
  chemically synthesized
taattattgcacattggtaaat

SEQ ID NO: 629856 - DNA, 22 bp, Artificial Sequence
  chemically synthesized
aatagtggaaggatttaccaat

SEQ ID NO: 629857 - DNA, 22 bp, Artificial Sequence
  chemically synthesized
aattattgcacattggtaaatc

SEQ ID NO: 629858 - DNA, 22 bp, Artificial Sequence
  chemically synthesized
gaatagtggaaggatttaccaa

SEQ ID NO: 629859 - DNA, 22 bp, Artificial Sequence
  chemically synthesized
attattgcacattggtaaatcc

SEQ ID NO: 629860 - DNA, 22 bp, Artificial Sequence
  chemically synthesized
ttgcacattggtaaatccttcc

SEQ ID NO: 629861 - DNA, 22 bp, Artificial Sequence
  chemically synthesized
cacattggtaaatccttccact

SEQ ID NO: 629862 - DNA, 22 bp, Artificial Sequence
  chemically synthesized
caaagacaatacttgaatagtg

SEQ ID NO: 629863 - DNA, 22 bp, Artificial Sequence
  chemically synthesized
gtaaatccttccactattcaag

SEQ ID NO: 629864 - DNA, 22 bp, Artificial Sequence
  chemically synthesized
agttccaaagacaatacttgaa

SEQ ID NO: 629865 - DNA, 22 bp, Artificial Sequence
  chemically synthesized
cagttccaaagacaatacttga

SEQ ID NO: 629866 - DNA, 22 bp, Artificial Sequence
  chemically synthesized
ccactattcaagtattgtcttt

SEQ ID NO: 629867 - DNA, 22 bp, Artificial Sequence
  chemically synthesized
cactattcaagtattgtctttg

SEQ ID NO: 629868 - DNA, 22 bp, Artificial Sequence
  chemically synthesized
ttcaagtattgtctttggaact

SEQ ID NO: 629869 - DNA, 22 bp, Artificial Sequence
  chemically synthesized
gtaaagcatttcagttccaaag

SEQ ID NO: 629870 - DNA, 22 bp, Artificial Sequence
  chemically synthesized
aagtattgtctttggaactgaa

SEQ ID NO: 629871 - DNA, 22 bp, Artificial Sequence
  chemically synthesized
tctttggaactgaaatgcttta

SEQ ID NO: 629872 - DNA, 22 bp, Artificial Sequence
  chemically synthesized
tggaactgaaatgctttactag

SEQ ID NO: 629873 - DNA, 22 bp, Artificial Sequence
  chemically synthesized
ggaactgaaatgctttactagg

SEQ ID NO: 629874 - DNA, 22 bp, Artificial Sequence
  chemically synthesized
gaactgaaatgctttactaggc

SEQ ID NO: 629875 - DNA, 22 bp, Artificial Sequence
  chemically synthesized
aaatgctttactaggctattac

SEQ ID NO: 629876 - DNA, 22 bp, Artificial Sequence
  chemically synthesized
atacatggcaaggtagtaatag

SEQ ID NO: 629877 - DNA, 22 bp, Artificial Sequence
  chemically synthesized
tactaggctattactaccttgc

SEQ ID NO: 629878 - DNA, 22 bp, Artificial Sequence
  chemically synthesized
actaggctattactaccttgcc

SEQ ID NO: 629879 - DNA, 22 bp, Artificial Sequence
  chemically synthesized
ctaggctattactaccttgcca

SEQ ID NO: 629880 - DNA, 22 bp, Artificial Sequence
  chemically synthesized
taaagttgatacatggcaaggt

SEQ ID NO: 629881 - DNA, 22 bp, Artificial Sequence
  chemically synthesized
ggctattactaccttgccatgt

SEQ ID NO: 629882 - DNA, 22 bp, Artificial Sequence
  chemically synthesized
ttactaccttgccatgtatcaa

SEQ ID NO: 629883 - DNA, 22 bp, Artificial Sequence
  chemically synthesized
ctaccttgccatgtatcaactt

SEQ ID NO: 629884 - DNA, 22 bp, Artificial Sequence
  chemically synthesized
tgggaatctgtaaagttgatac

SEQ ID NO: 629885 - DNA, 22 bp, Artificial Sequence
  chemically synthesized
ccttgccatgtatcaactttac

SEQ ID NO: 629886 - DNA, 22 bp, Artificial Sequence
  chemically synthesized
ttatgggaatctgtaaagttga

SEQ ID NO: 629887 - DNA, 22 bp, Artificial Sequence
  chemically synthesized
gccatgtatcaactttacagat

SEQ ID NO: 629888 - DNA, 22 bp, Artificial Sequence
  chemically synthesized
ccatgtatcaactttacagatt

SEQ ID NO: 629889 - DNA, 22 bp, Artificial Sequence
  chemically synthesized
acaattattatgggaatctgta

SEQ ID NO: 629890 - DNA, 22 bp, Artificial Sequence
  chemically synthesized
aacaattattatgggaatctgt

SEQ ID NO: 629891 - DNA, 22 bp, Artificial Sequence
  chemically synthesized
taacaattattatgggaatctg

SEQ ID NO: 629892 - DNA, 22 bp, Artificial Sequence
  chemically synthesized
ttaacaattattatgggaatct

SEQ ID NO: 629893 - DNA, 22 bp, Artificial Sequence
  chemically synthesized
gtatttttaacaattattatgg

SEQ ID NO: 629894 - DNA, 22 bp, Artificial Sequence
  chemically synthesized
tacagattcccataataattgt

SEQ ID NO: 629895 - DNA, 22 bp, Artificial Sequence
  chemically synthesized
ttggtatttttaacaattatta

SEQ ID NO: 629896 - DNA, 22 bp, Artificial Sequence
  chemically synthesized
acagattcccataataattgtt

SEQ ID NO: 629897 - DNA, 22 bp, Artificial Sequence
  chemically synthesized
attggtatttttaacaattatt

SEQ ID NO: 629898 - DNA, 22 bp, Artificial Sequence
  chemically synthesized
cagattcccataataattgtta

SEQ ID NO: 629899 - DNA, 22 bp, Artificial Sequence
  chemically synthesized
tattggtatttttaacaattat

SEQ ID NO: 629900 - DNA, 22 bp, Artificial Sequence
  chemically synthesized
ttattggtatttttaacaatta

SEQ ID NO: 629901 - DNA, 22 bp, Artificial Sequence
  chemically synthesized
atttttattggtatttttaaca

SEQ ID NO: 629902 - DNA, 22 bp, Artificial Sequence
  chemically synthesized
aatttttattggtatttttaac

SEQ ID NO: 629903 - DNA, 22 bp, Artificial Sequence
  chemically synthesized
ccataataattgttaaaaatac

SEQ ID NO: 629904 - DNA, 22 bp, Artificial Sequence
  chemically synthesized
taatttttattggtatttttaa

SEQ ID NO: 629905 - DNA, 22 bp, Artificial Sequence
  chemically synthesized
ggatatctttaatttttattgg

SEQ ID NO: 629906 - DNA, 22 bp, Artificial Sequence
  chemically synthesized
ttaaaaataccaataaaaatta

SEQ ID NO: 629907 - DNA, 22 bp, Artificial Sequence
  chemically synthesized
ttgggatatctttaatttttat

SEQ ID NO: 629908 - DNA, 22 bp, Artificial Sequence
  chemically synthesized
attgggatatctttaattttta

SEQ ID NO: 629909 - DNA, 22 bp, Artificial Sequence
  chemically synthesized
tattgggatatctttaattttt

SEQ ID NO: 629910 - DNA, 22 bp, Artificial Sequence
  chemically synthesized
aaaataccaataaaaattaaag

SEQ ID NO: 629911 - DNA, 22 bp, Artificial Sequence
  chemically synthesized
ttattgggatatctttaatttt

SEQ ID NO: 629912 - DNA, 22 bp, Artificial Sequence
  chemically synthesized
atttttattgggatatctttaa

SEQ ID NO: 629913 - DNA, 22 bp, Artificial Sequence
  chemically synthesized
aatttttattgggatatcttta

SEQ ID NO: 629914 - DNA, 22 bp, Artificial Sequence
  chemically synthesized
taatttttattgggatatcttt

SEQ ID NO: 629915 - DNA, 22 bp, Artificial Sequence
  chemically synthesized
tagctttaatttttattgggat

SEQ ID NO: 629916 - DNA, 22 bp, Artificial Sequence
  chemically synthesized
gtctatagctttaatttttatt

SEQ ID NO: 629917 - DNA, 22 bp, Artificial Sequence
  chemically synthesized
aagatatcccaataaaaattaa

SEQ ID NO: 629918 - DNA, 22 bp, Artificial Sequence
  chemically synthesized
cctagtctatagctttaatttt

SEQ ID NO: 629919 - DNA, 22 bp, Artificial Sequence
  chemically synthesized
tccctagtctatagctttaatt

SEQ ID NO: 629920 - DNA, 22 bp, Artificial Sequence
  chemically synthesized
aaacaaaatactctccctagtc

SEQ ID NO: 629921 - DNA, 22 bp, Artificial Sequence
  chemically synthesized
aagctatagactagggagagta

SEQ ID NO: 629922 - DNA, 22 bp, Artificial Sequence
  chemically synthesized
tagactagggagagtattttgt

SEQ ID NO: 629923 - DNA, 22 bp, Artificial Sequence
  chemically synthesized
aaataaatattaaaacaaaata

SEQ ID NO: 629924 - DNA, 22 bp, Artificial Sequence
  chemically synthesized
gaaataaatattaaaacaaaat

SEQ ID NO: 629925 - DNA, 22 bp, Artificial Sequence
  chemically synthesized
ttgaaataaatattaaaacaaa

SEQ ID NO: 629926 - DNA, 22 bp, Artificial Sequence
  chemically synthesized
gggagagtattttgttttaata

SEQ ID NO: 629927 - DNA, 22 bp, Artificial Sequence
  chemically synthesized
tatctcttgaaataaatattaa

SEQ ID NO: 629928 - DNA, 22 bp, Artificial Sequence
  chemically synthesized
tgttttaatatttatttcaaga

SEQ ID NO: 629929 - DNA, 22 bp, Artificial Sequence
  chemically synthesized
gttttaatatttatttcaagag

SEQ ID NO: 629930 - DNA, 22 bp, Artificial Sequence
  chemically synthesized
ttttaatatttatttcaagaga

SEQ ID NO: 629931 - DNA, 22 bp, Artificial Sequence
  chemically synthesized
tagagaagctatatctcttgaa

SEQ ID NO: 629932 - DNA, 22 bp, Artificial Sequence
  chemically synthesized
gtagagaagctatatctcttga

SEQ ID NO: 629933 - DNA, 22 bp, Artificial Sequence
  chemically synthesized
taatatttatttcaagagatat

SEQ ID NO: 629934 - DNA, 22 bp, Artificial Sequence
  chemically synthesized
tgtagagaagctatatctcttg

SEQ ID NO: 629935 - DNA, 22 bp, Artificial Sequence
  chemically synthesized
aatatttatttcaagagatata

SEQ ID NO: 629936 - DNA, 22 bp, Artificial Sequence
  chemically synthesized
atatttatttcaagagatatag

SEQ ID NO: 629937 - DNA, 22 bp, Artificial Sequence
  chemically synthesized
attttgtagagaagctatatct

SEQ ID NO: 629938 - DNA, 22 bp, Artificial Sequence
  chemically synthesized
cattttgtagagaagctatatc

SEQ ID NO: 629939 - DNA, 22 bp, Artificial Sequence
  chemically synthesized
atttcaagagatatagcttctc

SEQ ID NO: 629940 - DNA, 22 bp, Artificial Sequence
  chemically synthesized
tttcaagagatatagcttctct

SEQ ID NO: 629941 - DNA, 22 bp, Artificial Sequence
  chemically synthesized
caagagatatagcttctctaca

SEQ ID NO: 629942 - DNA, 22 bp, Artificial Sequence
  chemically synthesized
aagagatatagcttctctacaa

SEQ ID NO: 629943 - DNA, 22 bp, Artificial Sequence
  chemically synthesized
cccgtgaatccgcttcattttg

SEQ ID NO: 629944 - DNA, 22 bp, Artificial Sequence
  chemically synthesized
ctctacaaaatgaagcggattc

SEQ ID NO: 629945 - DNA, 22 bp, Artificial Sequence
  chemically synthesized
tctacaaaatgaagcggattca

SEQ ID NO: 629946 - DNA, 22 bp, Artificial Sequence
  chemically synthesized
agtgcctgcccgtgaatccgct

SEQ ID NO: 629947 - DNA, 22 bp, Artificial Sequence
  chemically synthesized
aagtgcctgcccgtgaatccgc

SEQ ID NO: 629948 - DNA, 22 bp, Artificial Sequence
  chemically synthesized
tacaaaatgaagcggattcacg

SEQ ID NO: 629949 - DNA, 22 bp, Artificial Sequence
  chemically synthesized
caaaatgaagcggattcacggg

SEQ ID NO: 629950 - DNA, 22 bp, Artificial Sequence
  chemically synthesized
tttaagtgcctgcccgtgaatc

SEQ ID NO: 629951 - DNA, 22 bp, Artificial Sequence
  chemically synthesized
gtgccatcactgtttaagtgcc

SEQ ID NO: 629952 - DNA, 22 bp, Artificial Sequence
  chemically synthesized
acgggcaggcacttaaacagtg

SEQ ID NO: 629953 - DNA, 22 bp, Artificial Sequence
  chemically synthesized
atctggtgccatcactgtttaa

SEQ ID NO: 629954 - DNA, 22 bp, Artificial Sequence
  chemically synthesized
agttgatctggtgccatcactg

SEQ ID NO: 629955 - DNA, 22 bp, Artificial Sequence
  chemically synthesized
cagttgatctggtgccatcact

SEQ ID NO: 629956 - DNA, 22 bp, Artificial Sequence
  chemically synthesized
aaacagtgatggcaccagatca

SEQ ID NO: 629957 - DNA, 22 bp, Artificial Sequence
  chemically synthesized
aacagtgatggcaccagatcaa

SEQ ID NO: 629958 - DNA, 22 bp, Artificial Sequence
  chemically synthesized
ataagtaagtcttcagttgatc

SEQ ID NO: 629959 - DNA, 22 bp, Artificial Sequence
  chemically synthesized
aataagtaagtcttcagttgat

SEQ ID NO: 629960 - DNA, 22 bp, Artificial Sequence
  chemically synthesized
taataagtaagtcttcagttga

SEQ ID NO: 629961 - DNA, 22 bp, Artificial Sequence
  chemically synthesized
ttaataagtaagtcttcagttg

SEQ ID NO: 629962 - DNA, 22 bp, Artificial Sequence
  chemically synthesized
aacttttaataagtaagtcttc

SEQ ID NO: 629963 - DNA, 22 bp, Artificial Sequence
  chemically synthesized
aatgacattaaacttttaataa

SEQ ID NO: 629964 - DNA, 22 bp, Artificial Sequence
  chemically synthesized
aagacttacttattaaaagttt

SEQ ID NO: 629965 - DNA, 22 bp, Artificial Sequence
  chemically synthesized
acttattaaaagtttaatgtca

SEQ ID NO: 629966 - DNA, 22 bp, Artificial Sequence
  chemically synthesized
cttattaaaagtttaatgtcat

SEQ ID NO: 629967 - DNA, 22 bp, Artificial Sequence
  chemically synthesized
atagaaatgcctgaatgacatt

SEQ ID NO: 629968 - DNA, 22 bp, Artificial Sequence
  chemically synthesized
attaaaagtttaatgtcattca

SEQ ID NO: 629969 - DNA, 22 bp, Artificial Sequence
  chemically synthesized
aatagaaatgcctgaatgacat

SEQ ID NO: 629970 - DNA, 22 bp, Artificial Sequence
  chemically synthesized
ttaaaagtttaatgtcattcag

SEQ ID NO: 629971 - DNA, 22 bp, Artificial Sequence
  chemically synthesized
aaagtttaatgtcattcaggca

SEQ ID NO: 629972 - DNA, 22 bp, Artificial Sequence
  chemically synthesized
gtcaccttaatagaaatgcctg

SEQ ID NO: 629973 - DNA, 22 bp, Artificial Sequence
  chemically synthesized
ggtcaccttaatagaaatgcct

SEQ ID NO: 629974 - DNA, 22 bp, Artificial Sequence
  chemically synthesized
aatgtcattcaggcatttctat

SEQ ID NO: 629975 - DNA, 22 bp, Artificial Sequence
  chemically synthesized
atgtcattcaggcatttctatt

SEQ ID NO: 629976 - DNA, 22 bp, Artificial Sequence
  chemically synthesized
aggcatttctattaaggtgacc

SEQ ID NO: 629977 - DNA, 22 bp, Artificial Sequence
  chemically synthesized
ctattaaggtgaccaagtttgt

SEQ ID NO: 629978 - DNA, 22 bp, Artificial Sequence
  chemically synthesized
tattaaggtgaccaagtttgta

SEQ ID NO: 629979 - DNA, 22 bp, Artificial Sequence
  chemically synthesized
ttaaggtgaccaagtttgtata

SEQ ID NO: 629980 - DNA, 22 bp, Artificial Sequence
  chemically synthesized
aggtgaccaagtttgtatatct

SEQ ID NO: 629981 - DNA, 22 bp, Artificial Sequence
  chemically synthesized
ataaagcacaaaaagatagata

SEQ ID NO: 629982 - DNA, 22 bp, Artificial Sequence
  chemically synthesized
cactaataaagcacaaaaagat

SEQ ID NO: 629983 - DNA, 22 bp, Artificial Sequence
  chemically synthesized
gcactaataaagcacaaaaaga

SEQ ID NO: 629984 - DNA, 22 bp, Artificial Sequence
  chemically synthesized
tgcactaataaagcacaaaaag

SEQ ID NO: 629985 - DNA, 22 bp, Artificial Sequence
  chemically synthesized
gtatatctatctttttgtgctt

SEQ ID NO: 629986 - DNA, 22 bp, Artificial Sequence
  chemically synthesized
tttgcactaataaagcacaaaa

SEQ ID NO: 629987 - DNA, 22 bp, Artificial Sequence
  chemically synthesized
tatatctatctttttgtgcttt

SEQ ID NO: 629988 - DNA, 22 bp, Artificial Sequence
  chemically synthesized
tctttttgtgctttattagtgc

SEQ ID NO: 629989 - DNA, 22 bp, Artificial Sequence
  chemically synthesized
catgaaattctttgcactaata

SEQ ID NO: 629990 - DNA, 22 bp, Artificial Sequence
  chemically synthesized
tttgtgctttattagtgcaaag

SEQ ID NO: 629991 - DNA, 22 bp, Artificial Sequence
  chemically synthesized
ttgtgctttattagtgcaaaga

SEQ ID NO: 629992 - DNA, 22 bp, Artificial Sequence
  chemically synthesized
tgtgctttattagtgcaaagaa

SEQ ID NO: 629993 - DNA, 22 bp, Artificial Sequence
  chemically synthesized
gtgctttattagtgcaaagaat

SEQ ID NO: 629994 - DNA, 22 bp, Artificial Sequence
  chemically synthesized
atactccatgaaattctttgca

SEQ ID NO: 629995 - DNA, 22 bp, Artificial Sequence
  chemically synthesized
tgctttattagtgcaaagaatt

SEQ ID NO: 629996 - DNA, 22 bp, Artificial Sequence
  chemically synthesized
tattagtgcaaagaatttcatg

SEQ ID NO: 629997 - DNA, 22 bp, Artificial Sequence
  chemically synthesized
attagtgcaaagaatttcatgg

SEQ ID NO: 629998 - DNA, 22 bp, Artificial Sequence
  chemically synthesized
ttagtgcaaagaatttcatgga

SEQ ID NO: 629999 - DNA, 22 bp, Artificial Sequence
  chemically synthesized
gtgcaaagaatttcatggagta

SEQ ID NO: 630000 - DNA, 22 bp, Artificial Sequence
  chemically synthesized
aaatataattaatactccatga

SEQ ID NO: 630001 - DNA, 22 bp, Artificial Sequence
  chemically synthesized
taaaatataattaatactccat

SEQ ID NO: 630002 - DNA, 22 bp, Artificial Sequence
  chemically synthesized
ctaaaatataattaatactcca

SEQ ID NO: 630003 - DNA, 22 bp, Artificial Sequence
  chemically synthesized
tctaaaatataattaatactcc

SEQ ID NO: 630004 - DNA, 22 bp, Artificial Sequence
  chemically synthesized
catggagtattaattatatttt

SEQ ID NO: 630005 - DNA, 22 bp, Artificial Sequence
  chemically synthesized
atggagtattaattatatttta

SEQ ID NO: 630006 - DNA, 22 bp, Artificial Sequence
  chemically synthesized
attatattttagaaaatcactt

SEQ ID NO: 630007 - DNA, 22 bp, Artificial Sequence
  chemically synthesized
agccaaaatccaaagtgatttt

SEQ ID NO: 630008 - DNA, 22 bp, Artificial Sequence
  chemically synthesized
tattttagaaaatcactttgga

SEQ ID NO: 630009 - DNA, 22 bp, Artificial Sequence
  chemically synthesized
cagtctcagccaaaatccaaag

SEQ ID NO: 630010 - DNA, 22 bp, Artificial Sequence
  chemically synthesized
gcagtctcagccaaaatccaaa

SEQ ID NO: 630011 - DNA, 22 bp, Artificial Sequence
  chemically synthesized
tagaaaatcactttggattttg

SEQ ID NO: 630012 - DNA, 22 bp, Artificial Sequence
  chemically synthesized
agaaaatcactttggattttgg

SEQ ID NO: 630013 - DNA, 22 bp, Artificial Sequence
  chemically synthesized
gaaaatcactttggattttggc

SEQ ID NO: 630014 - DNA, 22 bp, Artificial Sequence
  chemically synthesized
tacttgcagtctcagccaaaat

SEQ ID NO: 630015 - DNA, 22 bp, Artificial Sequence
  chemically synthesized
atacttgcagtctcagccaaaa

SEQ ID NO: 630016 - DNA, 22 bp, Artificial Sequence
  chemically synthesized
tatacttgcagtctcagccaaa

SEQ ID NO: 630017 - DNA, 22 bp, Artificial Sequence
  chemically synthesized
ttatacttgcagtctcagccaa

SEQ ID NO: 630018 - DNA, 22 bp, Artificial Sequence
  chemically synthesized
tggattttggctgagactgcaa

SEQ ID NO: 630019 - DNA, 22 bp, Artificial Sequence
  chemically synthesized
ggattttggctgagactgcaag

SEQ ID NO: 630020 - DNA, 22 bp, Artificial Sequence
  chemically synthesized
gattttggctgagactgcaagt

SEQ ID NO: 630021 - DNA, 22 bp, Artificial Sequence
  chemically synthesized
aaaaatttttatacttgcagtc

SEQ ID NO: 630022 - DNA, 22 bp, Artificial Sequence
  chemically synthesized
ttaaaaaatttttatacttgca

SEQ ID NO: 630023 - DNA, 22 bp, Artificial Sequence
  chemically synthesized
gttaaaaaatttttatacttgc

SEQ ID NO: 630024 - DNA, 22 bp, Artificial Sequence
  chemically synthesized
tggctgagactgcaagtataaa

SEQ ID NO: 630025 - DNA, 22 bp, Artificial Sequence
  chemically synthesized
tgttaaaaaatttttatacttg

SEQ ID NO: 630026 - DNA, 22 bp, Artificial Sequence
  chemically synthesized
ggctgagactgcaagtataaaa

SEQ ID NO: 630027 - DNA, 22 bp, Artificial Sequence
  chemically synthesized
gctgagactgcaagtataaaaa

SEQ ID NO: 630028 - DNA, 22 bp, Artificial Sequence
  chemically synthesized
agactgcaagtataaaaatttt

SEQ ID NO: 630029 - DNA, 22 bp, Artificial Sequence
  chemically synthesized
catatgctttgttaaaaaattt

SEQ ID NO: 630030 - DNA, 22 bp, Artificial Sequence
  chemically synthesized
caagtataaaaattttttaaca

SEQ ID NO: 630031 - DNA, 22 bp, Artificial Sequence
  chemically synthesized
tgaatagttgcatatgctttgt

SEQ ID NO: 630032 - DNA, 22 bp, Artificial Sequence
  chemically synthesized
atgaatagttgcatatgctttg

SEQ ID NO: 630033 - DNA, 22 bp, Artificial Sequence
  chemically synthesized
tatgaatagttgcatatgcttt

SEQ ID NO: 630034 - DNA, 22 bp, Artificial Sequence
  chemically synthesized
tttaacaaagcatatgcaacta

SEQ ID NO: 630035 - DNA, 22 bp, Artificial Sequence
  chemically synthesized
ttaacaaagcatatgcaactat

SEQ ID NO: 630036 - DNA, 22 bp, Artificial Sequence
  chemically synthesized
taacaaagcatatgcaactatt

SEQ ID NO: 630037 - DNA, 22 bp, Artificial Sequence
  chemically synthesized
gcccactttatgaatagttgca

SEQ ID NO: 630038 - DNA, 22 bp, Artificial Sequence
  chemically synthesized
aacaaagcatatgcaactattc

SEQ ID NO: 630039 - DNA, 22 bp, Artificial Sequence
  chemically synthesized
acaaagcatatgcaactattca

SEQ ID NO: 630040 - DNA, 22 bp, Artificial Sequence
  chemically synthesized
ttggcccactttatgaatagtt

SEQ ID NO: 630041 - DNA, 22 bp, Artificial Sequence
  chemically synthesized
ccaaactattggcccactttat

SEQ ID NO: 630042 - DNA, 22 bp, Artificial Sequence
  chemically synthesized
agggctgccaaactattggccc

SEQ ID NO: 630043 - DNA, 22 bp, Artificial Sequence
  chemically synthesized
ttcataaagtgggccaatagtt

SEQ ID NO: 630044 - DNA, 22 bp, Artificial Sequence
  chemically synthesized
actgagggctgccaaactattg

SEQ ID NO: 630045 - DNA, 22 bp, Artificial Sequence
  chemically synthesized
ataaagtgggccaatagtttgg

SEQ ID NO: 630046 - DNA, 22 bp, Artificial Sequence
  chemically synthesized
cactgagggctgccaaactatt

SEQ ID NO: 630047 - DNA, 22 bp, Artificial Sequence
  chemically synthesized
ttcactgagggctgccaaacta

SEQ ID NO: 630048 - DNA, 22 bp, Artificial Sequence
  chemically synthesized
agttcttcactgagggctgcca

SEQ ID NO: 630049 - DNA, 22 bp, Artificial Sequence
  chemically synthesized
cagttcttcactgagggctgcc

SEQ ID NO: 630050 - DNA, 22 bp, Artificial Sequence
  chemically synthesized
ggcagccctcagtgaagaactg

SEQ ID NO: 630051 - DNA, 22 bp, Artificial Sequence
  chemically synthesized
gcagccctcagtgaagaactga

SEQ ID NO: 630052 - DNA, 22 bp, Artificial Sequence
  chemically synthesized
agtgaagaactgaaatcatttt

SEQ ID NO: 630053 - DNA, 22 bp, Artificial Sequence
  chemically synthesized
tggcacagaaagccaaaaatga

SEQ ID NO: 630054 - DNA, 22 bp, Artificial Sequence
  chemically synthesized
atggcacagaaagccaaaaatg

SEQ ID NO: 630055 - DNA, 22 bp, Artificial Sequence
  chemically synthesized
tatggcacagaaagccaaaaat

SEQ ID NO: 630056 - DNA, 22 bp, Artificial Sequence
  chemically synthesized
ttatggcacagaaagccaaaaa

SEQ ID NO: 630057 - DNA, 22 bp, Artificial Sequence
  chemically synthesized
aaatcatttttggctttctgtg

SEQ ID NO: 630058 - DNA, 22 bp, Artificial Sequence
  chemically synthesized
tggtttttatggcacagaaagc

SEQ ID NO: 630059 - DNA, 22 bp, Artificial Sequence
  chemically synthesized
ctgtggtttttatggcacagaa

SEQ ID NO: 630060 - DNA, 22 bp, Artificial Sequence
  chemically synthesized
cctgtggtttttatggcacaga

SEQ ID NO: 630061 - DNA, 22 bp, Artificial Sequence
  chemically synthesized
ttggctttctgtgccataaaaa

SEQ ID NO: 630062 - DNA, 22 bp, Artificial Sequence
  chemically synthesized
tggctttctgtgccataaaaac

SEQ ID NO: 630063 - DNA, 22 bp, Artificial Sequence
  chemically synthesized
ggctttctgtgccataaaaacc

SEQ ID NO: 630064 - DNA, 22 bp, Artificial Sequence
  chemically synthesized
gctttctgtgccataaaaacca

SEQ ID NO: 630065 - DNA, 22 bp, Artificial Sequence
  chemically synthesized
tgtcgtcttcctgtggttttta

SEQ ID NO: 630066 - DNA, 22 bp, Artificial Sequence
  chemically synthesized
tctgtgccataaaaaccacagg

SEQ ID NO: 630067 - DNA, 22 bp, Artificial Sequence
  chemically synthesized
ctgtgccataaaaaccacagga

SEQ ID NO: 630068 - DNA, 22 bp, Artificial Sequence
  chemically synthesized
tgtgccataaaaaccacaggaa

SEQ ID NO: 630069 - DNA, 22 bp, Artificial Sequence
  chemically synthesized
tgccataaaaaccacaggaaga

SEQ ID NO: 630070 - DNA, 22 bp, Artificial Sequence
  chemically synthesized
aggagcagcaaaggccccactg

SEQ ID NO: 630071 - DNA, 22 bp, Artificial Sequence
  chemically synthesized
taaggagcagcaaaggccccac

SEQ ID NO: 630072 - DNA, 22 bp, Artificial Sequence
  chemically synthesized
agctctaaggagcagcaaaggc

SEQ ID NO: 630073 - DNA, 22 bp, Artificial Sequence
  chemically synthesized
tgagctctaaggagcagcaaag

SEQ ID NO: 630074 - DNA, 22 bp, Artificial Sequence
  chemically synthesized
tactctgagctctaaggagcag

SEQ ID NO: 630075 - DNA, 22 bp, Artificial Sequence
  chemically synthesized
gtactctgagctctaaggagca

SEQ ID NO: 630076 - DNA, 22 bp, Artificial Sequence
  chemically synthesized
tatatttgtactctgagctcta

SEQ ID NO: 630077 - DNA, 22 bp, Artificial Sequence
  chemically synthesized
tgctgctccttagagctcagag

SEQ ID NO: 630078 - DNA, 22 bp, Artificial Sequence
  chemically synthesized
gctgctccttagagctcagagt

SEQ ID NO: 630079 - DNA, 22 bp, Artificial Sequence
  chemically synthesized
ctgctccttagagctcagagta

SEQ ID NO: 630080 - DNA, 22 bp, Artificial Sequence
  chemically synthesized
ctccttagagctcagagtacaa

SEQ ID NO: 630081 - DNA, 22 bp, Artificial Sequence
  chemically synthesized
cttagagctcagagtacaaata

SEQ ID NO: 630082 - DNA, 22 bp, Artificial Sequence
  chemically synthesized
agagctcagagtacaaatatat

SEQ ID NO: 630083 - DNA, 22 bp, Artificial Sequence
  chemically synthesized
atagcagcagttatatatttgt

SEQ ID NO: 630084 - DNA, 22 bp, Artificial Sequence
  chemically synthesized
gagctcagagtacaaatatata

SEQ ID NO: 630085 - DNA, 22 bp, Artificial Sequence
  chemically synthesized
gatagcagcagttatatatttg

SEQ ID NO: 630086 - DNA, 22 bp, Artificial Sequence
  chemically synthesized
agagtacaaatatataactgct

SEQ ID NO: 630087 - DNA, 22 bp, Artificial Sequence
  chemically synthesized
caacttgatagcagcagttata

SEQ ID NO: 630088 - DNA, 22 bp, Artificial Sequence
  chemically synthesized
ctgctatcaagttggagggctt

SEQ ID NO: 630089 - DNA, 22 bp, Artificial Sequence
  chemically synthesized
ctatcaagttggagggcttccc

SEQ ID NO: 630090 - DNA, 22 bp, Artificial Sequence
  chemically synthesized
tcaagttggagggcttcccctg

SEQ ID NO: 630091 - DNA, 22 bp, Artificial Sequence
  chemically synthesized
gacagccaaaaatagatacagg

SEQ ID NO: 630092 - DNA, 22 bp, Artificial Sequence
  chemically synthesized
gagggcttcccctgtatctatt

SEQ ID NO: 630093 - DNA, 22 bp, Artificial Sequence
  chemically synthesized
ctggacagccaaaaatagatac

SEQ ID NO: 630094 - DNA, 22 bp, Artificial Sequence
  chemically synthesized
cccctgtatctatttttggctg

SEQ ID NO: 630095 - DNA, 22 bp, Artificial Sequence
  chemically synthesized
ccctgtatctatttttggctgt

SEQ ID NO: 630096 - DNA, 22 bp, Artificial Sequence
  chemically synthesized
ccagggttgctggacagccaaa

SEQ ID NO: 630097 - DNA, 22 bp, Artificial Sequence
  chemically synthesized
cccagggttgctggacagccaa

SEQ ID NO: 630098 - DNA, 22 bp, Artificial Sequence
  chemically synthesized
tatctatttttggctgtccagc

SEQ ID NO: 630099 - DNA, 22 bp, Artificial Sequence
  chemically synthesized
tttttggctgtccagcaaccct

SEQ ID NO: 630100 - DNA, 22 bp, Artificial Sequence
  chemically synthesized
tgcagatttcccagggttgctg

SEQ ID NO: 630101 - DNA, 22 bp, Artificial Sequence
  chemically synthesized
ttggctgtccagcaaccctggg

SEQ ID NO: 630102 - DNA, 22 bp, Artificial Sequence
  chemically synthesized
tggctgtccagcaaccctggga

SEQ ID NO: 630103 - DNA, 22 bp, Artificial Sequence
  chemically synthesized
ggctgtccagcaaccctgggaa

SEQ ID NO: 630104 - DNA, 22 bp, Artificial Sequence
  chemically synthesized
gctgtccagcaaccctgggaaa

SEQ ID NO: 630105 - DNA, 22 bp, Artificial Sequence
  chemically synthesized
tccagcaaccctgggaaatctg

SEQ ID NO: 630106 - DNA, 22 bp, Artificial Sequence
  chemically synthesized
tgcatgaataattatgcagatt

SEQ ID NO: 630107 - DNA, 22 bp, Artificial Sequence
  chemically synthesized
atgcatgaataattatgcagat

SEQ ID NO: 630108 - DNA, 22 bp, Artificial Sequence
  chemically synthesized
aatttatgcatgaataattatg

SEQ ID NO: 630109 - DNA, 22 bp, Artificial Sequence
  chemically synthesized
caatttatgcatgaataattat

SEQ ID NO: 630110 - DNA, 22 bp, Artificial Sequence
  chemically synthesized
ggaaatctgcataattattcat

SEQ ID NO: 630111 - DNA, 22 bp, Artificial Sequence
  chemically synthesized
tcttcaatttatgcatgaataa

SEQ ID NO: 630112 - DNA, 22 bp, Artificial Sequence
  chemically synthesized
cataattattcatgcataaatt

SEQ ID NO: 630113 - DNA, 22 bp, Artificial Sequence
  chemically synthesized
gtccatctatcttcaatttatg

SEQ ID NO: 630114 - DNA, 22 bp, Artificial Sequence
  chemically synthesized
ttcatgcataaattgaagatag

SEQ ID NO: 630115 - DNA, 22 bp, Artificial Sequence
  chemically synthesized
gcagttagtccatctatcttca

SEQ ID NO: 630116 - DNA, 22 bp, Artificial Sequence
  chemically synthesized
atgcataaattgaagatagatg

SEQ ID NO: 630117 - DNA, 22 bp, Artificial Sequence
  chemically synthesized
aaaattggcagttagtccatct

SEQ ID NO: 630118 - DNA, 22 bp, Artificial Sequence
  chemically synthesized
aagatagatggactaactgcca

SEQ ID NO: 630119 - DNA, 22 bp, Artificial Sequence
  chemically synthesized
gtaattaaaaattggcagttag

SEQ ID NO: 630120 - DNA, 22 bp, Artificial Sequence
  chemically synthesized
actgccaatttttaattactag

SEQ ID NO: 630121 - DNA, 22 bp, Artificial Sequence
  chemically synthesized
accgtaaagatcgctagtaatt

SEQ ID NO: 630122 - DNA, 22 bp, Artificial Sequence
  chemically synthesized
ccaatttttaattactagcgat

SEQ ID NO: 630123 - DNA, 22 bp, Artificial Sequence
  chemically synthesized
ttaaccgtaaagatcgctagta

SEQ ID NO: 630124 - DNA, 22 bp, Artificial Sequence
  chemically synthesized
gttaaccgtaaagatcgctagt

SEQ ID NO: 630125 - DNA, 22 bp, Artificial Sequence
  chemically synthesized
tgttaaccgtaaagatcgctag

SEQ ID NO: 630126 - DNA, 22 bp, Artificial Sequence
  chemically synthesized
attttgttaaccgtaaagatcg

SEQ ID NO: 630127 - DNA, 22 bp, Artificial Sequence
  chemically synthesized
ttaattactagcgatctttacg

SEQ ID NO: 630128 - DNA, 22 bp, Artificial Sequence
  chemically synthesized
taattactagcgatctttacgg

SEQ ID NO: 630129 - DNA, 22 bp, Artificial Sequence
  chemically synthesized
aattactagcgatctttacggt

SEQ ID NO: 630130 - DNA, 22 bp, Artificial Sequence
  chemically synthesized
ctgattttgttaaccgtaaaga

SEQ ID NO: 630131 - DNA, 22 bp, Artificial Sequence
  chemically synthesized
attactagcgatctttacggtt

SEQ ID NO: 630132 - DNA, 22 bp, Artificial Sequence
  chemically synthesized
actgattttgttaaccgtaaag

SEQ ID NO: 630133 - DNA, 22 bp, Artificial Sequence
  chemically synthesized
tactgattttgttaaccgtaaa

SEQ ID NO: 630134 - DNA, 22 bp, Artificial Sequence
  chemically synthesized
ttactgattttgttaaccgtaa

SEQ ID NO: 630135 - DNA, 22 bp, Artificial Sequence
  chemically synthesized
ctagcgatctttacggttaaca

SEQ ID NO: 630136 - DNA, 22 bp, Artificial Sequence
  chemically synthesized
tttttactgattttgttaaccg

SEQ ID NO: 630137 - DNA, 22 bp, Artificial Sequence
  chemically synthesized
gtttttactgattttgttaacc

SEQ ID NO: 630138 - DNA, 22 bp, Artificial Sequence
  chemically synthesized
gcgatctttacggttaacaaaa

SEQ ID NO: 630139 - DNA, 22 bp, Artificial Sequence
  chemically synthesized
tgtttttactgattttgttaac

SEQ ID NO: 630140 - DNA, 22 bp, Artificial Sequence
  chemically synthesized
gactttgtttttactgattttg

SEQ ID NO: 630141 - DNA, 22 bp, Artificial Sequence
  chemically synthesized
tacggttaacaaaatcagtaaa

SEQ ID NO: 630142 - DNA, 22 bp, Artificial Sequence
  chemically synthesized
acggttaacaaaatcagtaaaa

SEQ ID NO: 630143 - DNA, 22 bp, Artificial Sequence
  chemically synthesized
cggttaacaaaatcagtaaaaa

SEQ ID NO: 630144 - DNA, 22 bp, Artificial Sequence
  chemically synthesized
acaaaatcagtaaaaacaaagt

SEQ ID NO: 630145 - DNA, 22 bp, Artificial Sequence
  chemically synthesized
taaaggtcctggactttgtttt

SEQ ID NO: 630146 - DNA, 22 bp, Artificial Sequence
  chemically synthesized
aggcaccatgttgtaaaggtcc

SEQ ID NO: 630147 - DNA, 22 bp, Artificial Sequence
  chemically synthesized
cattcaggcaccatgttgtaaa

SEQ ID NO: 630148 - DNA, 22 bp, Artificial Sequence
  chemically synthesized
gaattacattcaggcaccatgt

SEQ ID NO: 630149 - DNA, 22 bp, Artificial Sequence
  chemically synthesized
cgaattacattcaggcaccatg

SEQ ID NO: 630150 - DNA, 22 bp, Artificial Sequence
  chemically synthesized
tacaacatggtgcctgaatgta

SEQ ID NO: 630151 - DNA, 22 bp, Artificial Sequence
  chemically synthesized
acaacatggtgcctgaatgtaa

SEQ ID NO: 630152 - DNA, 22 bp, Artificial Sequence
  chemically synthesized
caacatggtgcctgaatgtaat

SEQ ID NO: 630153 - DNA, 22 bp, Artificial Sequence
  chemically synthesized
aatgtaattcgaagtatttctc

SEQ ID NO: 630154 - DNA, 22 bp, Artificial Sequence
  chemically synthesized
tagtcacatgtgggccatgaga

SEQ ID NO: 630155 - DNA, 22 bp, Artificial Sequence
  chemically synthesized
gaagtatttctcatggcccaca

SEQ ID NO: 630156 - DNA, 22 bp, Artificial Sequence
  chemically synthesized
catactatagtcacatgtgggc

SEQ ID NO: 630157 - DNA, 22 bp, Artificial Sequence
  chemically synthesized
ctcatggcccacatgtgactat

SEQ ID NO: 630158 - DNA, 22 bp, Artificial Sequence
  chemically synthesized
tcatggcccacatgtgactata

SEQ ID NO: 630159 - DNA, 22 bp, Artificial Sequence
  chemically synthesized
atggcccacatgtgactatagt

SEQ ID NO: 630160 - DNA, 22 bp, Artificial Sequence
  chemically synthesized
ggtggactacatactatagtca

SEQ ID NO: 630161 - DNA, 22 bp, Artificial Sequence
  chemically synthesized
ctaggtggactacatactatag

SEQ ID NO: 630162 - DNA, 22 bp, Artificial Sequence
  chemically synthesized
gctactaggtggactacatact

SEQ ID NO: 630163 - DNA, 22 bp, Artificial Sequence
  chemically synthesized
tagctactaggtggactacata

SEQ ID NO: 630164 - DNA, 22 bp, Artificial Sequence
  chemically synthesized
ctagctactaggtggactacat

SEQ ID NO: 630165 - DNA, 22 bp, Artificial Sequence
  chemically synthesized
tctagctactaggtggactaca

SEQ ID NO: 630166 - DNA, 22 bp, Artificial Sequence
  chemically synthesized
tagtatgtagtccacctagtag

SEQ ID NO: 630167 - DNA, 22 bp, Artificial Sequence
  chemically synthesized
taatatgttttctagctactag

SEQ ID NO: 630168 - DNA, 22 bp, Artificial Sequence
  chemically synthesized
gtaatatgttttctagctacta

SEQ ID NO: 630169 - DNA, 22 bp, Artificial Sequence
  chemically synthesized
tgtaatatgttttctagctact

SEQ ID NO: 630170 - DNA, 22 bp, Artificial Sequence
  chemically synthesized
atgttttgtaatatgttttcta

SEQ ID NO: 630171 - DNA, 22 bp, Artificial Sequence
  chemically synthesized
gttgatgttttgtaatatgttt

SEQ ID NO: 630172 - DNA, 22 bp, Artificial Sequence
  chemically synthesized
cgttgatgttttgtaatatgtt

SEQ ID NO: 630173 - DNA, 22 bp, Artificial Sequence
  chemically synthesized
tcgttgatgttttgtaatatgt

SEQ ID NO: 630174 - DNA, 22 bp, Artificial Sequence
  chemically synthesized
gtagctagaaaacatattacaa

SEQ ID NO: 630175 - DNA, 22 bp, Artificial Sequence
  chemically synthesized
ttcgttgatgttttgtaatatg

SEQ ID NO: 630176 - DNA, 22 bp, Artificial Sequence
  chemically synthesized
cccttttcgttgatgttttgta

SEQ ID NO: 630177 - DNA, 22 bp, Artificial Sequence
  chemically synthesized
gaaaacatattacaaaacatca

SEQ ID NO: 630178 - DNA, 22 bp, Artificial Sequence
  chemically synthesized
tccccttttcgttgatgttttg

SEQ ID NO: 630179 - DNA, 22 bp, Artificial Sequence
  chemically synthesized
ctccccttttcgttgatgtttt

SEQ ID NO: 630180 - DNA, 22 bp, Artificial Sequence
  chemically synthesized
tctccccttttcgttgatgttt

SEQ ID NO: 630181 - DNA, 22 bp, Artificial Sequence
  chemically synthesized
caaaacatcaacgaaaagggga

SEQ ID NO: 630182 - DNA, 22 bp, Artificial Sequence
  chemically synthesized
acaggaaaaaaaatgagttttc

SEQ ID NO: 630183 - DNA, 22 bp, Artificial Sequence
  chemically synthesized
tcgataagctgacaggaaaaaa

SEQ ID NO: 630184 - DNA, 22 bp, Artificial Sequence
  chemically synthesized
tgattatcgataagctgacagg

SEQ ID NO: 630185 - DNA, 22 bp, Artificial Sequence
  chemically synthesized
gtgattatcgataagctgacag

SEQ ID NO: 630186 - DNA, 22 bp, Artificial Sequence
  chemically synthesized
tgtgattatcgataagctgaca

SEQ ID NO: 630187 - DNA, 22 bp, Artificial Sequence
  chemically synthesized
attttttttcctgtcagcttat

SEQ ID NO: 630188 - DNA, 22 bp, Artificial Sequence
  chemically synthesized
tttttcctgtcagcttatcgat

SEQ ID NO: 630189 - DNA, 22 bp, Artificial Sequence
  chemically synthesized
ttttcctgtcagcttatcgata

SEQ ID NO: 630190 - DNA, 22 bp, Artificial Sequence
  chemically synthesized
tttcctgtcagcttatcgataa

SEQ ID NO: 630191 - DNA, 22 bp, Artificial Sequence
  chemically synthesized
ttcctgtcagcttatcgataat

SEQ ID NO: 630192 - DNA, 22 bp, Artificial Sequence
  chemically synthesized
tcctgtcagcttatcgataatc

SEQ ID NO: 630193 - DNA, 22 bp, Artificial Sequence
  chemically synthesized
cctgtcagcttatcgataatca

SEQ ID NO: 630194 - DNA, 22 bp, Artificial Sequence
  chemically synthesized
ctgtcagcttatcgataatcac

SEQ ID NO: 630195 - DNA, 22 bp, Artificial Sequence
  chemically synthesized
tcagcttatcgataatcacaaa

SEQ ID NO: 630196 - DNA, 22 bp, Artificial Sequence
  chemically synthesized
aaaagaaagacactttgtgatt

SEQ ID NO: 630197 - DNA, 22 bp, Artificial Sequence
  chemically synthesized
atcgataatcacaaagtgtctt

SEQ ID NO: 630198 - DNA, 22 bp, Artificial Sequence
  chemically synthesized
tcgataatcacaaagtgtcttt

SEQ ID NO: 630199 - DNA, 22 bp, Artificial Sequence
  chemically synthesized
gcacacagcctaaaaagaaaga

SEQ ID NO: 630200 - DNA, 22 bp, Artificial Sequence
  chemically synthesized
catcccctagcacacagcctaa

SEQ ID NO: 630201 - DNA, 22 bp, Artificial Sequence
  chemically synthesized
tctttttaggctgtgtgctagg

SEQ ID NO: 630202 - DNA, 22 bp, Artificial Sequence
  chemically synthesized
ccatctacatcccctagcacac

SEQ ID NO: 630203 - DNA, 22 bp, Artificial Sequence
  chemically synthesized
ctttttaggctgtgtgctaggg

SEQ ID NO: 630204 - DNA, 22 bp, Artificial Sequence
  chemically synthesized
tttttaggctgtgtgctagggg

SEQ ID NO: 630205 - DNA, 22 bp, Artificial Sequence
  chemically synthesized
tttaggctgtgtgctaggggat

SEQ ID NO: 630206 - DNA, 22 bp, Artificial Sequence
  chemically synthesized
ttaggctgtgtgctaggggatg

SEQ ID NO: 630207 - DNA, 22 bp, Artificial Sequence
  chemically synthesized
aactgccatctacatcccctag

SEQ ID NO: 630208 - DNA, 22 bp, Artificial Sequence
  chemically synthesized
taggctgtgtgctaggggatgt

SEQ ID NO: 630209 - DNA, 22 bp, Artificial Sequence
  chemically synthesized
gaactgccatctacatccccta

SEQ ID NO: 630210 - DNA, 22 bp, Artificial Sequence
  chemically synthesized
aggctgtgtgctaggggatgta

SEQ ID NO: 630211 - DNA, 22 bp, Artificial Sequence
  chemically synthesized
tgaactgccatctacatcccct

SEQ ID NO: 630212 - DNA, 22 bp, Artificial Sequence
  chemically synthesized
ggctgtgtgctaggggatgtag

SEQ ID NO: 630213 - DNA, 22 bp, Artificial Sequence
  chemically synthesized
tattttgaactgccatctacat

SEQ ID NO: 630214 - DNA, 22 bp, Artificial Sequence
  chemically synthesized
tgtgctaggggatgtagatggc

SEQ ID NO: 630215 - DNA, 22 bp, Artificial Sequence
  chemically synthesized
ttatattttgaactgccatcta

SEQ ID NO: 630216 - DNA, 22 bp, Artificial Sequence
  chemically synthesized
attatattttgaactgccatct

SEQ ID NO: 630217 - DNA, 22 bp, Artificial Sequence
  chemically synthesized
tattatattttgaactgccatc

SEQ ID NO: 630218 - DNA, 22 bp, Artificial Sequence
  chemically synthesized
ggggatgtagatggcagttcaa

SEQ ID NO: 630219 - DNA, 22 bp, Artificial Sequence
  chemically synthesized
ttttattatattttgaactgcc

SEQ ID NO: 630220 - DNA, 22 bp, Artificial Sequence
  chemically synthesized
gttttattatattttgaactgc

SEQ ID NO: 630221 - DNA, 22 bp, Artificial Sequence
  chemically synthesized
tttgttttattatattttgaac

SEQ ID NO: 630222 - DNA, 22 bp, Artificial Sequence
  chemically synthesized
atttgttttattatattttgaa

SEQ ID NO: 630223 - DNA, 22 bp, Artificial Sequence
  chemically synthesized
aaaatataataaaacaaataaa

SEQ ID NO: 630224 - DNA, 22 bp, Artificial Sequence
  chemically synthesized
tataatccataaatgcatttat

SEQ ID NO: 630225 - DNA, 22 bp, Artificial Sequence
  chemically synthesized
gctatataatccataaatgcat

SEQ ID NO: 630226 - DNA, 22 bp, Artificial Sequence
  chemically synthesized
ggctatataatccataaatgca

SEQ ID NO: 630227 - DNA, 22 bp, Artificial Sequence
  chemically synthesized
atggattatatagccaagtggt

SEQ ID NO: 630228 - DNA, 22 bp, Artificial Sequence
  chemically synthesized
tggattatatagccaagtggtg

SEQ ID NO: 630229 - DNA, 22 bp, Artificial Sequence
  chemically synthesized
aaggaagagaagcaccacttgg

SEQ ID NO: 630230 - DNA, 22 bp, Artificial Sequence
  chemically synthesized
caaggaagagaagcaccacttg

SEQ ID NO: 630231 - DNA, 22 bp, Artificial Sequence
  chemically synthesized
tatagccaagtggtgcttctct

SEQ ID NO: 630232 - DNA, 22 bp, Artificial Sequence
  chemically synthesized
aacaccatttcaaggaagagaa

SEQ ID NO: 630233 - DNA, 22 bp, Artificial Sequence
  chemically synthesized
gtaactgaacaccatttcaagg

SEQ ID NO: 630234 - DNA, 22 bp, Artificial Sequence
  chemically synthesized
cagttagtaactgaacaccatt

SEQ ID NO: 630235 - DNA, 22 bp, Artificial Sequence
  chemically synthesized
ctcttccttgaaatggtgttca

SEQ ID NO: 630236 - DNA, 22 bp, Artificial Sequence
  chemically synthesized
ccagttagtaactgaacaccat

SEQ ID NO: 630237 - DNA, 22 bp, Artificial Sequence
  chemically synthesized
tcttccttgaaatggtgttcag

SEQ ID NO: 630238 - DNA, 22 bp, Artificial Sequence
  chemically synthesized
ttccttgaaatggtgttcagtt

SEQ ID NO: 630239 - DNA, 22 bp, Artificial Sequence
  chemically synthesized
cttccagttagtaactgaacac

SEQ ID NO: 630240 - DNA, 22 bp, Artificial Sequence
  chemically synthesized
ccttccagttagtaactgaaca

SEQ ID NO: 630241 - DNA, 22 bp, Artificial Sequence
  chemically synthesized
ccttgaaatggtgttcagttac

SEQ ID NO: 630242 - DNA, 22 bp, Artificial Sequence
  chemically synthesized
tccttccagttagtaactgaac

SEQ ID NO: 630243 - DNA, 22 bp, Artificial Sequence
  chemically synthesized
cttgaaatggtgttcagttact

SEQ ID NO: 630244 - DNA, 22 bp, Artificial Sequence
  chemically synthesized
gaaatggtgttcagttactaac

SEQ ID NO: 630245 - DNA, 22 bp, Artificial Sequence
  chemically synthesized
aaatggtgttcagttactaact

SEQ ID NO: 630246 - DNA, 22 bp, Artificial Sequence
  chemically synthesized
aagaattttccttccagttagt

SEQ ID NO: 630247 - DNA, 22 bp, Artificial Sequence
  chemically synthesized
agttactaactggaaggaaaat

SEQ ID NO: 630248 - DNA, 22 bp, Artificial Sequence
  chemically synthesized
agagactcaagaattttccttc

SEQ ID NO: 630249 - DNA, 22 bp, Artificial Sequence
  chemically synthesized
gagagactcaagaattttcctt

SEQ ID NO: 630250 - DNA, 22 bp, Artificial Sequence
  chemically synthesized
ttgagagactcaagaattttcc

SEQ ID NO: 630251 - DNA, 22 bp, Artificial Sequence
  chemically synthesized
cttgagagactcaagaattttc

SEQ ID NO: 630252 - DNA, 22 bp, Artificial Sequence
  chemically synthesized
ctaactggaaggaaaattcttg

SEQ ID NO: 630253 - DNA, 22 bp, Artificial Sequence
  chemically synthesized
actggaaggaaaattcttgagt

SEQ ID NO: 630254 - DNA, 22 bp, Artificial Sequence
  chemically synthesized
tgcttcttgagagactcaagaa

SEQ ID NO: 630255 - DNA, 22 bp, Artificial Sequence
  chemically synthesized
atgcttcttgagagactcaaga

SEQ ID NO: 630256 - DNA, 22 bp, Artificial Sequence
  chemically synthesized
gaaggaaaattcttgagtctct

SEQ ID NO: 630257 - DNA, 22 bp, Artificial Sequence
  chemically synthesized
gaacttatgcttcttgagagac

SEQ ID NO: 630258 - DNA, 22 bp, Artificial Sequence
  chemically synthesized
ttgagtctctcaagaagcataa

SEQ ID NO: 630259 - DNA, 22 bp, Artificial Sequence
  chemically synthesized
gagtctctcaagaagcataagt

SEQ ID NO: 630260 - DNA, 22 bp, Artificial Sequence
  chemically synthesized
agtctctcaagaagcataagtt

SEQ ID NO: 630261 - DNA, 22 bp, Artificial Sequence
  chemically synthesized
tcaagaagcataagttctaggg

SEQ ID NO: 630262 - DNA, 22 bp, Artificial Sequence
  chemically synthesized
aatagcagatacccctagaact

SEQ ID NO: 630263 - DNA, 22 bp, Artificial Sequence
  chemically synthesized
aaatagcagatacccctagaac

SEQ ID NO: 630264 - DNA, 22 bp, Artificial Sequence
  chemically synthesized
aagaagcataagttctaggggt

SEQ ID NO: 630265 - DNA, 22 bp, Artificial Sequence
  chemically synthesized
taaatagcagatacccctagaa

SEQ ID NO: 630266 - DNA, 22 bp, Artificial Sequence
  chemically synthesized
gcaaatctttaaatagcagata

SEQ ID NO: 630267 - DNA, 22 bp, Artificial Sequence
  chemically synthesized
cctggcaaatctttaaatagca

SEQ ID NO: 630268 - DNA, 22 bp, Artificial Sequence
  chemically synthesized
ccctggcaaatctttaaatagc

SEQ ID NO: 630269 - DNA, 22 bp, Artificial Sequence
  chemically synthesized
taggggtatctgctatttaaag

SEQ ID NO: 630270 - DNA, 22 bp, Artificial Sequence
  chemically synthesized
tccctggcaaatctttaaatag

SEQ ID NO: 630271 - DNA, 22 bp, Artificial Sequence
  chemically synthesized
ggggtatctgctatttaaagat

SEQ ID NO: 630272 - DNA, 22 bp, Artificial Sequence
  chemically synthesized
ttttccctggcaaatctttaaa

SEQ ID NO: 630273 - DNA, 22 bp, Artificial Sequence
  chemically synthesized
ctatttaaagatttgccaggga

SEQ ID NO: 630274 - DNA, 22 bp, Artificial Sequence
  chemically synthesized
tttaaagatttgccagggaaaa

SEQ ID NO: 630275 - DNA, 22 bp, Artificial Sequence
  chemically synthesized
aaagatttgccagggaaaacag

SEQ ID NO: 630276 - DNA, 22 bp, Artificial Sequence
  chemically synthesized
agaataatgaacctgttttccc

SEQ ID NO: 630277 - DNA, 22 bp, Artificial Sequence
  chemically synthesized
aagatttgccagggaaaacagg

SEQ ID NO: 630278 - DNA, 22 bp, Artificial Sequence
  chemically synthesized
gccagggaaaacaggttcatta

SEQ ID NO: 630279 - DNA, 22 bp, Artificial Sequence
  chemically synthesized
ccagggaaaacaggttcattat

SEQ ID NO: 630280 - DNA, 22 bp, Artificial Sequence
  chemically synthesized
tcggagtgtgcatggcacatta

SEQ ID NO: 630281 - DNA, 22 bp, Artificial Sequence
  chemically synthesized
gtcggagtgtgcatggcacatt

SEQ ID NO: 630282 - DNA, 22 bp, Artificial Sequence
  chemically synthesized
tgtcggagtgtgcatggcacat

SEQ ID NO: 630283 - DNA, 22 bp, Artificial Sequence
  chemically synthesized
ttgtcggagtgtgcatggcaca

SEQ ID NO: 630284 - DNA, 22 bp, Artificial Sequence
  chemically synthesized
attattcttaatgtgccatgca

SEQ ID NO: 630285 - DNA, 22 bp, Artificial Sequence
  chemically synthesized
tttgtcggagtgtgcatggcac

SEQ ID NO: 630286 - DNA, 22 bp, Artificial Sequence
  chemically synthesized
ttcttaatgtgccatgcacact

SEQ ID NO: 630287 - DNA, 22 bp, Artificial Sequence
  chemically synthesized
ttaatgtgccatgcacactccg

SEQ ID NO: 630288 - DNA, 22 bp, Artificial Sequence
  chemically synthesized
aatgtgccatgcacactccgac

SEQ ID NO: 630289 - DNA, 22 bp, Artificial Sequence
  chemically synthesized
atgtgccatgcacactccgaca

SEQ ID NO: 630290 - DNA, 22 bp, Artificial Sequence
  chemically synthesized
aaggccacccaactttttgtcg

SEQ ID NO: 630291 - DNA, 22 bp, Artificial Sequence
  chemically synthesized
cgacaaaaagttgggtggcctt

SEQ ID NO: 630292 - DNA, 22 bp, Artificial Sequence
  chemically synthesized
ggtggcctttaaccggtttaca

SEQ ID NO: 630293 - DNA, 22 bp, Artificial Sequence
  chemically synthesized
tgaaaatgcagcagtgtaaacc

SEQ ID NO: 630294 - DNA, 22 bp, Artificial Sequence
  chemically synthesized
gtgaaaatgcagcagtgtaaac

SEQ ID NO: 630295 - DNA, 22 bp, Artificial Sequence
  chemically synthesized
taaccggtttacactgctgcat

SEQ ID NO: 630296 - DNA, 22 bp, Artificial Sequence
  chemically synthesized
aaccggtttacactgctgcatt

SEQ ID NO: 630297 - DNA, 22 bp, Artificial Sequence
  chemically synthesized
accggtttacactgctgcattt

SEQ ID NO: 630298 - DNA, 22 bp, Artificial Sequence
  chemically synthesized
acactgctgcattttcacaaat

SEQ ID NO: 630299 - DNA, 22 bp, Artificial Sequence
  chemically synthesized
cactgctgcattttcacaaatg

SEQ ID NO: 630300 - DNA, 22 bp, Artificial Sequence
  chemically synthesized
ctgcattttcacaaatgacctt

SEQ ID NO: 630301 - DNA, 22 bp, Artificial Sequence
  chemically synthesized
cattttcacaaatgaccttgtg

SEQ ID NO: 630302 - DNA, 22 bp, Artificial Sequence
  chemically synthesized
tagcacaaagatggccacaagg

SEQ ID NO: 630303 - DNA, 22 bp, Artificial Sequence
  chemically synthesized
atagcacaaagatggccacaag

SEQ ID NO: 630304 - DNA, 22 bp, Artificial Sequence
  chemically synthesized
tcacaaatgaccttgtggccat

SEQ ID NO: 630305 - DNA, 22 bp, Artificial Sequence
  chemically synthesized
tatagcacaaagatggccacaa

SEQ ID NO: 630306 - DNA, 22 bp, Artificial Sequence
  chemically synthesized
cacaaatgaccttgtggccatc

SEQ ID NO: 630307 - DNA, 22 bp, Artificial Sequence
  chemically synthesized
ttatagcacaaagatggccaca

SEQ ID NO: 630308 - DNA, 22 bp, Artificial Sequence
  chemically synthesized
acaaatgaccttgtggccatct

SEQ ID NO: 630309 - DNA, 22 bp, Artificial Sequence
  chemically synthesized
tttttatagcacaaagatggcc

SEQ ID NO: 630310 - DNA, 22 bp, Artificial Sequence
  chemically synthesized
atttttatagcacaaagatggc

SEQ ID NO: 630311 - DNA, 22 bp, Artificial Sequence
  chemically synthesized
tatttttatagcacaaagatgg

SEQ ID NO: 630312 - DNA, 22 bp, Artificial Sequence
  chemically synthesized
tttatttttatagcacaaagat

SEQ ID NO: 630313 - DNA, 22 bp, Artificial Sequence
  chemically synthesized
gtggccatctttgtgctataaa

SEQ ID NO: 630314 - DNA, 22 bp, Artificial Sequence
  chemically synthesized
tggccatctttgtgctataaaa

SEQ ID NO: 630315 - DNA, 22 bp, Artificial Sequence
  chemically synthesized
aaagttctttatttttatagca

SEQ ID NO: 630316 - DNA, 22 bp, Artificial Sequence
  chemically synthesized
taaaagttctttatttttatag

SEQ ID NO: 630317 - DNA, 22 bp, Artificial Sequence
  chemically synthesized
tgtgctataaaaataaagaact

SEQ ID NO: 630318 - DNA, 22 bp, Artificial Sequence
  chemically synthesized
gtgctataaaaataaagaactt

SEQ ID NO: 630319 - DNA, 22 bp, Artificial Sequence
  chemically synthesized
tgctataaaaataaagaacttt

SEQ ID NO: 630320 - DNA, 22 bp, Artificial Sequence
  chemically synthesized
taaaaataaagaacttttagag

SEQ ID NO: 630321 - DNA, 22 bp, Artificial Sequence
  chemically synthesized
ttagagtcacctcatcatctat

SEQ ID NO: 630322 - DNA, 22 bp, Artificial Sequence
  chemically synthesized
tagagtcacctcatcatctata

SEQ ID NO: 630323 - DNA, 22 bp, Artificial Sequence
  chemically synthesized
agagtcacctcatcatctatat

SEQ ID NO: 630324 - DNA, 22 bp, Artificial Sequence
  chemically synthesized
gagtcacctcatcatctatatt

SEQ ID NO: 630325 - DNA, 22 bp, Artificial Sequence
  chemically synthesized
gtgaagtaaccaaaggcataat

SEQ ID NO: 630326 - DNA, 22 bp, Artificial Sequence
  chemically synthesized
agtgaagtaaccaaaggcataa

SEQ ID NO: 630327 - DNA, 22 bp, Artificial Sequence
  chemically synthesized
atcatctatattatgcctttgg

SEQ ID NO: 630328 - DNA, 22 bp, Artificial Sequence
  chemically synthesized
tattatgcctttggttacttca

SEQ ID NO: 630329 - DNA, 22 bp, Artificial Sequence
  chemically synthesized
tgcctttggttacttcactaaa

SEQ ID NO: 630330 - DNA, 22 bp, Artificial Sequence
  chemically synthesized
gtaaagcaggtatttagtgaag

SEQ ID NO: 630331 - DNA, 22 bp, Artificial Sequence
  chemically synthesized
tggtaaagcaggtatttagtga

SEQ ID NO: 630332 - DNA, 22 bp, Artificial Sequence
  chemically synthesized
ttctggtaaagcaggtatttag

SEQ ID NO: 630333 - DNA, 22 bp, Artificial Sequence
  chemically synthesized
tggttacttcactaaatacctg

SEQ ID NO: 630334 - DNA, 22 bp, Artificial Sequence
  chemically synthesized
attctggtaaagcaggtattta

SEQ ID NO: 630335 - DNA, 22 bp, Artificial Sequence
  chemically synthesized
ggttacttcactaaatacctgc

SEQ ID NO: 630336 - DNA, 22 bp, Artificial Sequence
  chemically synthesized
gttacttcactaaatacctgct

SEQ ID NO: 630337 - DNA, 22 bp, Artificial Sequence
  chemically synthesized
tttattctggtaaagcaggtat

SEQ ID NO: 630338 - DNA, 22 bp, Artificial Sequence
  chemically synthesized
cttcactaaatacctgctttac

SEQ ID NO: 630339 - DNA, 22 bp, Artificial Sequence
  chemically synthesized
cactaaatacctgctttaccag

SEQ ID NO: 630340 - DNA, 22 bp, Artificial Sequence
  chemically synthesized
gaattatttattctggtaaagc

SEQ ID NO: 630341 - DNA, 22 bp, Artificial Sequence
  chemically synthesized
actaaatacctgctttaccaga

SEQ ID NO: 630342 - DNA, 22 bp, Artificial Sequence
  chemically synthesized
aatacctgctttaccagaataa

SEQ ID NO: 630343 - DNA, 22 bp, Artificial Sequence
  chemically synthesized
ctttaccagaataaataattct

SEQ ID NO: 630344 - DNA, 22 bp, Artificial Sequence
  chemically synthesized
catggaaagaaattagaattat

SEQ ID NO: 630345 - DNA, 22 bp, Artificial Sequence
  chemically synthesized
taccagaataaataattctaat

SEQ ID NO: 630346 - DNA, 22 bp, Artificial Sequence
  chemically synthesized
accagaataaataattctaatt

SEQ ID NO: 630347 - DNA, 22 bp, Artificial Sequence
  chemically synthesized
ccagaataaataattctaattt

SEQ ID NO: 630348 - DNA, 22 bp, Artificial Sequence
  chemically synthesized
atgaaaaactccatggaaagaa

SEQ ID NO: 630349 - DNA, 22 bp, Artificial Sequence
  chemically synthesized
gatctaatgaaaaactccatgg

SEQ ID NO: 630350 - DNA, 22 bp, Artificial Sequence
  chemically synthesized
taatttctttccatggagtttt

SEQ ID NO: 630351 - DNA, 22 bp, Artificial Sequence
  chemically synthesized
tggatctaatgaaaaactccat

SEQ ID NO: 630352 - DNA, 22 bp, Artificial Sequence
  chemically synthesized
ctggatctaatgaaaaactcca

SEQ ID NO: 630353 - DNA, 22 bp, Artificial Sequence
  chemically synthesized
atttctttccatggagtttttc

SEQ ID NO: 630354 - DNA, 22 bp, Artificial Sequence
  chemically synthesized
tctggatctaatgaaaaactcc

SEQ ID NO: 630355 - DNA, 22 bp, Artificial Sequence
  chemically synthesized
ttctggatctaatgaaaaactc

SEQ ID NO: 630356 - DNA, 22 bp, Artificial Sequence
  chemically synthesized
tttctggatctaatgaaaaact

SEQ ID NO: 630357 - DNA, 22 bp, Artificial Sequence
  chemically synthesized
ttttctggatctaatgaaaaac

SEQ ID NO: 630358 - DNA, 22 bp, Artificial Sequence
  chemically synthesized
ctttccatggagtttttcatta

SEQ ID NO: 630359 - DNA, 22 bp, Artificial Sequence
  chemically synthesized
tttccatggagtttttcattag

SEQ ID NO: 630360 - DNA, 22 bp, Artificial Sequence
  chemically synthesized
ttttttctggatctaatgaaaa

SEQ ID NO: 630361 - DNA, 22 bp, Artificial Sequence
  chemically synthesized
cttttttctggatctaatgaaa

SEQ ID NO: 630362 - DNA, 22 bp, Artificial Sequence
  chemically synthesized
tccatggagtttttcattagat

SEQ ID NO: 630363 - DNA, 22 bp, Artificial Sequence
  chemically synthesized
ccatggagtttttcattagatc

SEQ ID NO: 630364 - DNA, 22 bp, Artificial Sequence
  chemically synthesized
catggagtttttcattagatcc

SEQ ID NO: 630365 - DNA, 22 bp, Artificial Sequence
  chemically synthesized
acttcttttttctggatctaat

SEQ ID NO: 630366 - DNA, 22 bp, Artificial Sequence
  chemically synthesized
ttcattagatccagaaaaaaga

SEQ ID NO: 630367 - DNA, 22 bp, Artificial Sequence
  chemically synthesized
tcattagatccagaaaaaagaa

SEQ ID NO: 630368 - DNA, 22 bp, Artificial Sequence
  chemically synthesized
cattagatccagaaaaaagaag

SEQ ID NO: 630369 - DNA, 22 bp, Artificial Sequence
  chemically synthesized
attagatccagaaaaaagaagt

SEQ ID NO: 630370 - DNA, 22 bp, Artificial Sequence
  chemically synthesized
taaaaagagattgacttctttt

SEQ ID NO: 630371 - DNA, 22 bp, Artificial Sequence
  chemically synthesized
gtaaaaagagattgacttcttt

SEQ ID NO: 630372 - DNA, 22 bp, Artificial Sequence
  chemically synthesized
gatccagaaaaaagaagtcaat

SEQ ID NO: 630373 - DNA, 22 bp, Artificial Sequence
  chemically synthesized
gggcagtagtttgtaaaaagag

SEQ ID NO: 630374 - DNA, 22 bp, Artificial Sequence
  chemically synthesized
agggcagtagtttgtaaaaaga

SEQ ID NO: 630375 - DNA, 22 bp, Artificial Sequence
  chemically synthesized
tagggcagtagtttgtaaaaag

SEQ ID NO: 630376 - DNA, 22 bp, Artificial Sequence
  chemically synthesized
tttagggcagtagtttgtaaaa

SEQ ID NO: 630377 - DNA, 22 bp, Artificial Sequence
  chemically synthesized
tttttacaaactactgccctaa

SEQ ID NO: 630378 - DNA, 22 bp, Artificial Sequence
  chemically synthesized
aagtatgattctttagggcagt

SEQ ID NO: 630379 - DNA, 22 bp, Artificial Sequence
  chemically synthesized
tttacaaactactgccctaaag

SEQ ID NO: 630380 - DNA, 22 bp, Artificial Sequence
  chemically synthesized
ttacaaactactgccctaaaga

SEQ ID NO: 630381 - DNA, 22 bp, Artificial Sequence
  chemically synthesized
tacaaactactgccctaaagaa

SEQ ID NO: 630382 - DNA, 22 bp, Artificial Sequence
  chemically synthesized
acaaactactgccctaaagaat

SEQ ID NO: 630383 - DNA, 22 bp, Artificial Sequence
  chemically synthesized
caaactactgccctaaagaatc

SEQ ID NO: 630384 - DNA, 22 bp, Artificial Sequence
  chemically synthesized
caacggattaaagtatgattct

SEQ ID NO: 630385 - DNA, 22 bp, Artificial Sequence
  chemically synthesized
ctgccctaaagaatcatacttt

SEQ ID NO: 630386 - DNA, 22 bp, Artificial Sequence
  chemically synthesized
ccctaaagaatcatactttaat

SEQ ID NO: 630387 - DNA, 22 bp, Artificial Sequence
  chemically synthesized
cccctccaacggattaaagtat

SEQ ID NO: 630388 - DNA, 22 bp, Artificial Sequence
  chemically synthesized
acccctccaacggattaaagta

SEQ ID NO: 630389 - DNA, 22 bp, Artificial Sequence
  chemically synthesized
aagaatcatactttaatccgtt

SEQ ID NO: 630390 - DNA, 22 bp, Artificial Sequence
  chemically synthesized
taatccgttggaggggtaagac

SEQ ID NO: 630391 - DNA, 22 bp, Artificial Sequence
  chemically synthesized
aatccgttggaggggtaagact

SEQ ID NO: 630392 - DNA, 22 bp, Artificial Sequence
  chemically synthesized
atccgttggaggggtaagactg

SEQ ID NO: 630393 - DNA, 22 bp, Artificial Sequence
  chemically synthesized
tagtcatgtcacagtgcagtct

SEQ ID NO: 630394 - DNA, 22 bp, Artificial Sequence
  chemically synthesized
tatagtcatgtcacagtgcagt

SEQ ID NO: 630395 - DNA, 22 bp, Artificial Sequence
  chemically synthesized
ctatagtcatgtcacagtgcag

SEQ ID NO: 630396 - DNA, 22 bp, Artificial Sequence
  chemically synthesized
gaggggtaagactgcactgtga

SEQ ID NO: 630397 - DNA, 22 bp, Artificial Sequence
  chemically synthesized
tctatagtcatgtcacagtgca

SEQ ID NO: 630398 - DNA, 22 bp, Artificial Sequence
  chemically synthesized
ctttctatagtcatgtcacagt

SEQ ID NO: 630399 - DNA, 22 bp, Artificial Sequence
  chemically synthesized
cactgtgacatgactatagaaa

SEQ ID NO: 630400 - DNA, 22 bp, Artificial Sequence
  chemically synthesized
ggatacaaatctactttctata

SEQ ID NO: 630401 - DNA, 22 bp, Artificial Sequence
  chemically synthesized
tgacatgactatagaaagtaga

SEQ ID NO: 630402 - DNA, 22 bp, Artificial Sequence
  chemically synthesized
tagaaagtagatttgtatccta

SEQ ID NO: 630403 - DNA, 22 bp, Artificial Sequence
  chemically synthesized
cacacatggataatagaactag

SEQ ID NO: 630404 - DNA, 22 bp, Artificial Sequence
  chemically synthesized
acacacatggataatagaacta

SEQ ID NO: 630405 - DNA, 22 bp, Artificial Sequence
  chemically synthesized
ccttacacacatggataataga

SEQ ID NO: 630406 - DNA, 22 bp, Artificial Sequence
  chemically synthesized
gtatcctagttctattatccat

SEQ ID NO: 630407 - DNA, 22 bp, Artificial Sequence
  chemically synthesized
tgccttacacacatggataata

SEQ ID NO: 630408 - DNA, 22 bp, Artificial Sequence
  chemically synthesized
tatcctagttctattatccatg

SEQ ID NO: 630409 - DNA, 22 bp, Artificial Sequence
  chemically synthesized
gttctattatccatgtgtgtaa

SEQ ID NO: 630410 - DNA, 22 bp, Artificial Sequence
  chemically synthesized
ccgaatgctctgccttacacac

SEQ ID NO: 630411 - DNA, 22 bp, Artificial Sequence
  chemically synthesized
tattatccatgtgtgtaaggca

SEQ ID NO: 630412 - DNA, 22 bp, Artificial Sequence
  chemically synthesized
ttatccatgtgtgtaaggcaga

SEQ ID NO: 630413 - DNA, 22 bp, Artificial Sequence
  chemically synthesized
tccatgtgtgtaaggcagagca

SEQ ID NO: 630414 - DNA, 22 bp, Artificial Sequence
  chemically synthesized
atgacctcccgaatgctctgcc

SEQ ID NO: 630415 - DNA, 22 bp, Artificial Sequence
  chemically synthesized
tcaggtaacattaatgacctcc

SEQ ID NO: 630416 - DNA, 22 bp, Artificial Sequence
  chemically synthesized
gaaaaatctgtcaggtaacatt

SEQ ID NO: 630417 - DNA, 22 bp, Artificial Sequence
  chemically synthesized
gggaggtcattaatgttacctg

SEQ ID NO: 630418 - DNA, 22 bp, Artificial Sequence
  chemically synthesized
agaaaaatctgtcaggtaacat

SEQ ID NO: 630419 - DNA, 22 bp, Artificial Sequence
  chemically synthesized
tagaaaaatctgtcaggtaaca

SEQ ID NO: 630420 - DNA, 22 bp, Artificial Sequence
  chemically synthesized
actttagaaaaatctgtcaggt

SEQ ID NO: 630421 - DNA, 22 bp, Artificial Sequence
  chemically synthesized
gactttagaaaaatctgtcagg

SEQ ID NO: 630422 - DNA, 22 bp, Artificial Sequence
  chemically synthesized
tgactttagaaaaatctgtcag

SEQ ID NO: 630423 - DNA, 22 bp, Artificial Sequence
  chemically synthesized
atgttacctgacagatttttct

SEQ ID NO: 630424 - DNA, 22 bp, Artificial Sequence
  chemically synthesized
taattttgactttagaaaaatc

SEQ ID NO: 630425 - DNA, 22 bp, Artificial Sequence
  chemically synthesized
cctgacagatttttctaaagtc

SEQ ID NO: 630426 - DNA, 22 bp, Artificial Sequence
  chemically synthesized
acagatttttctaaagtcaaaa

SEQ ID NO: 630427 - DNA, 22 bp, Artificial Sequence
  chemically synthesized
atagtatgagattgtaattttg

SEQ ID NO: 630428 - DNA, 22 bp, Artificial Sequence
  chemically synthesized
catagtatgagattgtaatttt

SEQ ID NO: 630429 - DNA, 22 bp, Artificial Sequence
  chemically synthesized
ttctaaagtcaaaattacaatc

SEQ ID NO: 630430 - DNA, 22 bp, Artificial Sequence
  chemically synthesized
tctaaagtcaaaattacaatct

SEQ ID NO: 630431 - DNA, 22 bp, Artificial Sequence
  chemically synthesized
ctaaagtcaaaattacaatctc

SEQ ID NO: 630432 - DNA, 22 bp, Artificial Sequence
  chemically synthesized
taaagtcaaaattacaatctca

SEQ ID NO: 630433 - DNA, 22 bp, Artificial Sequence
  chemically synthesized
atacttcatagtatgagattgt

SEQ ID NO: 630434 - DNA, 22 bp, Artificial Sequence
  chemically synthesized
aagtcaaaattacaatctcata

SEQ ID NO: 630435 - DNA, 22 bp, Artificial Sequence
  chemically synthesized
tcatacttcatagtatgagatt

SEQ ID NO: 630436 - DNA, 22 bp, Artificial Sequence
  chemically synthesized
agtacctctcatacttcatagt

SEQ ID NO: 630437 - DNA, 22 bp, Artificial Sequence
  chemically synthesized
cagtacctctcatacttcatag

SEQ ID NO: 630438 - DNA, 22 bp, Artificial Sequence
  chemically synthesized
tcagtacctctcatacttcata

SEQ ID NO: 630439 - DNA, 22 bp, Artificial Sequence
  chemically synthesized
caatctcatactatgaagtatg

SEQ ID NO: 630440 - DNA, 22 bp, Artificial Sequence
  chemically synthesized
ttcagtacctctcatacttcat

SEQ ID NO: 630441 - DNA, 22 bp, Artificial Sequence
  chemically synthesized
cttttcagtacctctcatactt

SEQ ID NO: 630442 - DNA, 22 bp, Artificial Sequence
  chemically synthesized
atactatgaagtatgagaggta

SEQ ID NO: 630443 - DNA, 22 bp, Artificial Sequence
  chemically synthesized
gctgcttttcagtacctctcat

SEQ ID NO: 630444 - DNA, 22 bp, Artificial Sequence
  chemically synthesized
tgaagtatgagaggtactgaaa

SEQ ID NO: 630445 - DNA, 22 bp, Artificial Sequence
  chemically synthesized
aatcctggctgcttttcagtac

SEQ ID NO: 630446 - DNA, 22 bp, Artificial Sequence
  chemically synthesized
caaatgcctgaatcctggctgc

SEQ ID NO: 630447 - DNA, 22 bp, Artificial Sequence
  chemically synthesized
aaaagcagccaggattcaggca

SEQ ID NO: 630448 - DNA, 22 bp, Artificial Sequence
  chemically synthesized
aaggtgattgcaaatgcctgaa

SEQ ID NO: 630449 - DNA, 22 bp, Artificial Sequence
  chemically synthesized
tgcctgaaggtgattgcaaatg

SEQ ID NO: 630450 - DNA, 22 bp, Artificial Sequence
  chemically synthesized
gtgcctgaaggtgattgcaaat

SEQ ID NO: 630451 - DNA, 22 bp, Artificial Sequence
  chemically synthesized
tcaccttgtgcctgaaggtgat

SEQ ID NO: 630452 - DNA, 22 bp, Artificial Sequence
  chemically synthesized
aggcatttgcaatcaccttcag

SEQ ID NO: 630453 - DNA, 22 bp, Artificial Sequence
  chemically synthesized
tgtcaccttgtgcctgaaggtg

SEQ ID NO: 630454 - DNA, 22 bp, Artificial Sequence
  chemically synthesized
ctgtcaccttgtgcctgaaggt

SEQ ID NO: 630455 - DNA, 22 bp, Artificial Sequence
  chemically synthesized
tctgtcaccttgtgcctgaagg

SEQ ID NO: 630456 - DNA, 22 bp, Artificial Sequence
  chemically synthesized
gcaatcaccttcaggcacaagg

SEQ ID NO: 630457 - DNA, 22 bp, Artificial Sequence
  chemically synthesized
caatcaccttcaggcacaaggt

SEQ ID NO: 630458 - DNA, 22 bp, Artificial Sequence
  chemically synthesized
tagacatagttttctgtcacct

SEQ ID NO: 630459 - DNA, 22 bp, Artificial Sequence
  chemically synthesized
tatagacatagttttctgtcac

SEQ ID NO: 630460 - DNA, 22 bp, Artificial Sequence
  chemically synthesized
ctatagacatagttttctgtca

SEQ ID NO: 630461 - DNA, 22 bp, Artificial Sequence
  chemically synthesized
caggcacaaggtgacagaaaac

SEQ ID NO: 630462 - DNA, 22 bp, Artificial Sequence
  chemically synthesized
tctatagacatagttttctgtc

SEQ ID NO: 630463 - DNA, 22 bp, Artificial Sequence
  chemically synthesized
aggcacaaggtgacagaaaact

SEQ ID NO: 630464 - DNA, 22 bp, Artificial Sequence
  chemically synthesized
aatcaatactttctatagacat

SEQ ID NO: 630465 - DNA, 22 bp, Artificial Sequence
  chemically synthesized
agaatggattaaatcaatactt

SEQ ID NO: 630466 - DNA, 22 bp, Artificial Sequence
  chemically synthesized
aagaatggattaaatcaatact

SEQ ID NO: 630467 - DNA, 22 bp, Artificial Sequence
  chemically synthesized
tgtctatagaaagtattgattt

SEQ ID NO: 630468 - DNA, 22 bp, Artificial Sequence
  chemically synthesized
tagaaagtattgatttaatcca

SEQ ID NO: 630469 - DNA, 22 bp, Artificial Sequence
  chemically synthesized
aataatccttaagaatggatta

SEQ ID NO: 630470 - DNA, 22 bp, Artificial Sequence
  chemically synthesized
tgttcaataatccttaagaatg

SEQ ID NO: 630471 - DNA, 22 bp, Artificial Sequence
  chemically synthesized
gtgttcaataatccttaagaat

SEQ ID NO: 630472 - DNA, 22 bp, Artificial Sequence
  chemically synthesized
tgtgttcaataatccttaagaa

SEQ ID NO: 630473 - DNA, 22 bp, Artificial Sequence
  chemically synthesized
atttaatccattcttaaggatt

SEQ ID NO: 630474 - DNA, 22 bp, Artificial Sequence
  chemically synthesized
aatccattcttaaggattattg

SEQ ID NO: 630475 - DNA, 22 bp, Artificial Sequence
  chemically synthesized
atccattcttaaggattattga

SEQ ID NO: 630476 - DNA, 22 bp, Artificial Sequence
  chemically synthesized
ttaaggattattgaacacaaag

SEQ ID NO: 630477 - DNA, 22 bp, Artificial Sequence
  chemically synthesized
aaggcatagtgcctttgtgttc

SEQ ID NO: 630478 - DNA, 22 bp, Artificial Sequence
  chemically synthesized
aaggattattgaacacaaaggc

SEQ ID NO: 630479 - DNA, 22 bp, Artificial Sequence
  chemically synthesized
aggattattgaacacaaaggca

SEQ ID NO: 630480 - DNA, 22 bp, Artificial Sequence
  chemically synthesized
atgttcaaggcatagtgccttt

SEQ ID NO: 630481 - DNA, 22 bp, Artificial Sequence
  chemically synthesized
ttgaacacaaaggcactatgcc

SEQ ID NO: 630482 - DNA, 22 bp, Artificial Sequence
  chemically synthesized
ccctaatgttcaaggcatagtg

SEQ ID NO: 630483 - DNA, 22 bp, Artificial Sequence
  chemically synthesized
aacacaaaggcactatgccttg

SEQ ID NO: 630484 - DNA, 22 bp, Artificial Sequence
  chemically synthesized
aaaaacatacaactgccctaat

SEQ ID NO: 630485 - DNA, 22 bp, Artificial Sequence
  chemically synthesized
gaaaaacatacaactgccctaa

SEQ ID NO: 630486 - DNA, 22 bp, Artificial Sequence
  chemically synthesized
tgccttgaacattagggcagtt

SEQ ID NO: 630487 - DNA, 22 bp, Artificial Sequence
  chemically synthesized
gaacattagggcagttgtatgt

SEQ ID NO: 630488 - DNA, 22 bp, Artificial Sequence
  chemically synthesized
aacattagggcagttgtatgtt

SEQ ID NO: 630489 - DNA, 22 bp, Artificial Sequence
  chemically synthesized
gcgccaacttgaaaaacataca

SEQ ID NO: 630490 - DNA, 22 bp, Artificial Sequence
  chemically synthesized
gggcagttgtatgtttttcaag

SEQ ID NO: 630491 - DNA, 22 bp, Artificial Sequence
  chemically synthesized
cagttagcgccaacttgaaaaa

SEQ ID NO: 630492 - DNA, 22 bp, Artificial Sequence
  chemically synthesized
tatgtttttcaagttggcgcta

SEQ ID NO: 630493 - DNA, 22 bp, Artificial Sequence
  chemically synthesized
aatgtgttgcagttagcgccaa

SEQ ID NO: 630494 - DNA, 22 bp, Artificial Sequence
  chemically synthesized
ttcaagttggcgctaactgcaa

SEQ ID NO: 630495 - DNA, 22 bp, Artificial Sequence
  chemically synthesized
tcaagttggcgctaactgcaac

SEQ ID NO: 630496 - DNA, 22 bp, Artificial Sequence
  chemically synthesized
caagttggcgctaactgcaaca

SEQ ID NO: 630497 - DNA, 22 bp, Artificial Sequence
  chemically synthesized
aagttggcgctaactgcaacac

SEQ ID NO: 630498 - DNA, 22 bp, Artificial Sequence
  chemically synthesized
gcgctaactgcaacacatttag

SEQ ID NO: 630499 - DNA, 22 bp, Artificial Sequence
  chemically synthesized
actgcaacacatttagtctcac

SEQ ID NO: 630500 - DNA, 22 bp, Artificial Sequence
  chemically synthesized
aggcagtggtgacgtgtgagac

SEQ ID NO: 630501 - DNA, 22 bp, Artificial Sequence
  chemically synthesized
caacacatttagtctcacacgt

SEQ ID NO: 630502 - DNA, 22 bp, Artificial Sequence
  chemically synthesized
cctcaggcagtggtgacgtgtg

SEQ ID NO: 630503 - DNA, 22 bp, Artificial Sequence
  chemically synthesized
agtctcacacgtcaccactgcc

SEQ ID NO: 630504 - DNA, 22 bp, Artificial Sequence
  chemically synthesized
gtctcacacgtcaccactgcct

SEQ ID NO: 630505 - DNA, 22 bp, Artificial Sequence
  chemically synthesized
acacgtcaccactgcctgaggg

SEQ ID NO: 630506 - DNA, 22 bp, Artificial Sequence
  chemically synthesized
tggaaaacaattccctcaggca

SEQ ID NO: 630507 - DNA, 22 bp, Artificial Sequence
  chemically synthesized
caatcgctgtggaaaacaattc

SEQ ID NO: 630508 - DNA, 22 bp, Artificial Sequence
  chemically synthesized
cctgagggaattgttttccaca

SEQ ID NO: 630509 - DNA, 22 bp, Artificial Sequence
  chemically synthesized
aattccaatcgctgtggaaaac

SEQ ID NO: 630510 - DNA, 22 bp, Artificial Sequence
  chemically synthesized
agggaattgttttccacagcga

SEQ ID NO: 630511 - DNA, 22 bp, Artificial Sequence
  chemically synthesized
ccagaaagtctcaattccaatc

SEQ ID NO: 630512 - DNA, 22 bp, Artificial Sequence
  chemically synthesized
ttttccacagcgattggaattg

SEQ ID NO: 630513 - DNA, 22 bp, Artificial Sequence
  chemically synthesized
gccagaaagtctcaattccaat

SEQ ID NO: 630514 - DNA, 22 bp, Artificial Sequence
  chemically synthesized
tgccagaaagtctcaattccaa

SEQ ID NO: 630515 - DNA, 22 bp, Artificial Sequence
  chemically synthesized
tccacagcgattggaattgaga

SEQ ID NO: 630516 - DNA, 22 bp, Artificial Sequence
  chemically synthesized
ccacagcgattggaattgagac

SEQ ID NO: 630517 - DNA, 22 bp, Artificial Sequence
  chemically synthesized
cacagcgattggaattgagact

SEQ ID NO: 630518 - DNA, 22 bp, Artificial Sequence
  chemically synthesized
gatctttgccagaaagtctcaa

SEQ ID NO: 630519 - DNA, 22 bp, Artificial Sequence
  chemically synthesized
ggatctttgccagaaagtctca

SEQ ID NO: 630520 - DNA, 22 bp, Artificial Sequence
  chemically synthesized
aggtcttggatctttgccagaa

SEQ ID NO: 630521 - DNA, 22 bp, Artificial Sequence
  chemically synthesized
gaattgagactttctggcaaag

SEQ ID NO: 630522 - DNA, 22 bp, Artificial Sequence
  chemically synthesized
ttgaggtcttggatctttgcca

SEQ ID NO: 630523 - DNA, 22 bp, Artificial Sequence
  chemically synthesized
ctattgaggtcttggatctttg

SEQ ID NO: 630524 - DNA, 22 bp, Artificial Sequence
  chemically synthesized
agactttctggcaaagatccaa

SEQ ID NO: 630525 - DNA, 22 bp, Artificial Sequence
  chemically synthesized
tctggcaaagatccaagacctc

SEQ ID NO: 630526 - DNA, 22 bp, Artificial Sequence
  chemically synthesized
ctggcaaagatccaagacctca

SEQ ID NO: 630527 - DNA, 22 bp, Artificial Sequence
  chemically synthesized
tggcaaagatccaagacctcaa

SEQ ID NO: 630528 - DNA, 22 bp, Artificial Sequence
  chemically synthesized
gcaaagatccaagacctcaata

SEQ ID NO: 630529 - DNA, 22 bp, Artificial Sequence
  chemically synthesized
aaaaatagagcaccagattgct

SEQ ID NO: 630530 - DNA, 22 bp, Artificial Sequence
  chemically synthesized
aaaaaatagagcaccagattgc

SEQ ID NO: 630531 - DNA, 22 bp, Artificial Sequence
  chemically synthesized
taaaaaatagagcaccagattg

SEQ ID NO: 630532 - DNA, 22 bp, Artificial Sequence
  chemically synthesized
ttaaaaaatagagcaccagatt

SEQ ID NO: 630533 - DNA, 22 bp, Artificial Sequence
  chemically synthesized
tatttttaaaaaatagagcacc

SEQ ID NO: 630534 - DNA, 22 bp, Artificial Sequence
  chemically synthesized
aatagcaatctggtgctctatt

SEQ ID NO: 630535 - DNA, 22 bp, Artificial Sequence
  chemically synthesized
ggaattgtatttttaaaaaata

SEQ ID NO: 630536 - DNA, 22 bp, Artificial Sequence
  chemically synthesized
gggaattgtatttttaaaaaat

SEQ ID NO: 630537 - DNA, 22 bp, Artificial Sequence
  chemically synthesized
tttgggaattgtatttttaaaa

SEQ ID NO: 630538 - DNA, 22 bp, Artificial Sequence
  chemically synthesized
atttgggaattgtatttttaaa

SEQ ID NO: 630539 - DNA, 22 bp, Artificial Sequence
  chemically synthesized
gtgctctattttttaaaaatac

SEQ ID NO: 630540 - DNA, 22 bp, Artificial Sequence
  chemically synthesized
tattttttaaaaatacaattcc

SEQ ID NO: 630541 - DNA, 22 bp, Artificial Sequence
  chemically synthesized
acaatttatttgggaattgtat

SEQ ID NO: 630542 - DNA, 22 bp, Artificial Sequence
  chemically synthesized
ttttttaaaaatacaattccca

SEQ ID NO: 630543 - DNA, 22 bp, Artificial Sequence
  chemically synthesized
tttaaaaatacaattcccaaat

SEQ ID NO: 630544 - DNA, 22 bp, Artificial Sequence
  chemically synthesized
ttaaaaatacaattcccaaata

SEQ ID NO: 630545 - DNA, 22 bp, Artificial Sequence
  chemically synthesized
taaaaatacaattcccaaataa

SEQ ID NO: 630546 - DNA, 22 bp, Artificial Sequence
  chemically synthesized
aatgctaacaatttatttggga

SEQ ID NO: 630547 - DNA, 22 bp, Artificial Sequence
  chemically synthesized
aaaaatacaattcccaaataaa

SEQ ID NO: 630548 - DNA, 22 bp, Artificial Sequence
  chemically synthesized
aaaatacaattcccaaataaat

SEQ ID NO: 630549 - DNA, 22 bp, Artificial Sequence
  chemically synthesized
gacaactgaatgctaacaattt

SEQ ID NO: 630550 - DNA, 22 bp, Artificial Sequence
  chemically synthesized
ggacaactgaatgctaacaatt

SEQ ID NO: 630551 - DNA, 22 bp, Artificial Sequence
  chemically synthesized
tggacaactgaatgctaacaat

SEQ ID NO: 630552 - DNA, 22 bp, Artificial Sequence
  chemically synthesized
ctttggacaactgaatgctaac

SEQ ID NO: 630553 - DNA, 22 bp, Artificial Sequence
  chemically synthesized
ccaaataaattgttagcattca

SEQ ID NO: 630554 - DNA, 22 bp, Artificial Sequence
  chemically synthesized
cctttggacaactgaatgctaa

SEQ ID NO: 630555 - DNA, 22 bp, Artificial Sequence
  chemically synthesized
tcctttggacaactgaatgcta

SEQ ID NO: 630556 - DNA, 22 bp, Artificial Sequence
  chemically synthesized
cggctttcctttggacaactga

SEQ ID NO: 630557 - DNA, 22 bp, Artificial Sequence
  chemically synthesized
ttagcattcagttgtccaaagg

SEQ ID NO: 630558 - DNA, 22 bp, Artificial Sequence
  chemically synthesized
gcattcagttgtccaaaggaaa

SEQ ID NO: 630559 - DNA, 22 bp, Artificial Sequence
  chemically synthesized
tagtattccggctttcctttgg

SEQ ID NO: 630560 - DNA, 22 bp, Artificial Sequence
  chemically synthesized
cctgtagtattccggctttcct

SEQ ID NO: 630561 - DNA, 22 bp, Artificial Sequence
  chemically synthesized
ccctgtagtattccggctttcc

SEQ ID NO: 630562 - DNA, 22 bp, Artificial Sequence
  chemically synthesized
agttgtccaaaggaaagccgga

SEQ ID NO: 630563 - DNA, 22 bp, Artificial Sequence
  chemically synthesized
tccaaaggaaagccggaatact

SEQ ID NO: 630564 - DNA, 22 bp, Artificial Sequence
  chemically synthesized
tagagaagaaaagataagcaaa

SEQ ID NO: 630565 - DNA, 22 bp, Artificial Sequence
  chemically synthesized
cagggaaatttgcttatctttt

SEQ ID NO: 630566 - DNA, 22 bp, Artificial Sequence
  chemically synthesized
aattatagagaagaaaagataa

SEQ ID NO: 630567 - DNA, 22 bp, Artificial Sequence
  chemically synthesized
agagattaaattatagagaaga

SEQ ID NO: 630568 - DNA, 22 bp, Artificial Sequence
  chemically synthesized
cagagattaaattatagagaag

SEQ ID NO: 630569 - DNA, 22 bp, Artificial Sequence
  chemically synthesized
gcttatcttttcttctctataa

SEQ ID NO: 630570 - DNA, 22 bp, Artificial Sequence
  chemically synthesized
tcagagattaaattatagagaa

SEQ ID NO: 630571 - DNA, 22 bp, Artificial Sequence
  chemically synthesized
cttatcttttcttctctataat

SEQ ID NO: 630572 - DNA, 22 bp, Artificial Sequence
  chemically synthesized
ttcagagattaaattatagaga

SEQ ID NO: 630573 - DNA, 22 bp, Artificial Sequence
  chemically synthesized
tttcagagattaaattatagag

SEQ ID NO: 630574 - DNA, 22 bp, Artificial Sequence
  chemically synthesized
ttttcagagattaaattataga

SEQ ID NO: 630575 - DNA, 22 bp, Artificial Sequence
  chemically synthesized
atcttttcttctctataattta

SEQ ID NO: 630576 - DNA, 22 bp, Artificial Sequence
  chemically synthesized
tcttttcttctctataatttaa

SEQ ID NO: 630577 - DNA, 22 bp, Artificial Sequence
  chemically synthesized
ttcttctctataatttaatctc

SEQ ID NO: 630578 - DNA, 22 bp, Artificial Sequence
  chemically synthesized
tcttctctataatttaatctct

SEQ ID NO: 630579 - DNA, 22 bp, Artificial Sequence
  chemically synthesized
cttctctataatttaatctctg

SEQ ID NO: 630580 - DNA, 22 bp, Artificial Sequence
  chemically synthesized
ttctctataatttaatctctga

SEQ ID NO: 630581 - DNA, 22 bp, Artificial Sequence
  chemically synthesized
ctctataatttaatctctgaaa

SEQ ID NO: 630582 - DNA, 22 bp, Artificial Sequence
  chemically synthesized
tctataatttaatctctgaaaa

SEQ ID NO: 630583 - DNA, 22 bp, Artificial Sequence
  chemically synthesized
tataatttaatctctgaaaaaa

SEQ ID NO: 630584 - DNA, 22 bp, Artificial Sequence
  chemically synthesized
taatttaatctctgaaaaaaat

SEQ ID NO: 630585 - DNA, 22 bp, Artificial Sequence
  chemically synthesized
aatctctgaaaaaaatctgctt

SEQ ID NO: 630586 - DNA, 22 bp, Artificial Sequence
  chemically synthesized
atctctgaaaaaaatctgcttt

SEQ ID NO: 630587 - DNA, 22 bp, Artificial Sequence
  chemically synthesized
tgaaaaaaatctgctttacgta

SEQ ID NO: 630588 - DNA, 22 bp, Artificial Sequence
  chemically synthesized
aaaaaaatctgctttacgtaca

SEQ ID NO: 630589 - DNA, 22 bp, Artificial Sequence
  chemically synthesized
tgaaaatatcccaaatgtacgt

SEQ ID NO: 630590 - DNA, 22 bp, Artificial Sequence
  chemically synthesized
atgctatgaaaatatcccaaat

SEQ ID NO: 630591 - DNA, 22 bp, Artificial Sequence
  chemically synthesized
aatgctatgaaaatatcccaaa

SEQ ID NO: 630592 - DNA, 22 bp, Artificial Sequence
  chemically synthesized
ctttacgtacatttgggatatt

SEQ ID NO: 630593 - DNA, 22 bp, Artificial Sequence
  chemically synthesized
taatgctatgaaaatatcccaa

SEQ ID NO: 630594 - DNA, 22 bp, Artificial Sequence
  chemically synthesized
ttaatgctatgaaaatatccca

SEQ ID NO: 630595 - DNA, 22 bp, Artificial Sequence
  chemically synthesized
tttaatgctatgaaaatatccc

SEQ ID NO: 630596 - DNA, 22 bp, Artificial Sequence
  chemically synthesized
tacgtacatttgggatattttc

SEQ ID NO: 630597 - DNA, 22 bp, Artificial Sequence
  chemically synthesized
ttttaatgctatgaaaatatcc

SEQ ID NO: 630598 - DNA, 22 bp, Artificial Sequence
  chemically synthesized
acgtacatttgggatattttca

SEQ ID NO: 630599 - DNA, 22 bp, Artificial Sequence
  chemically synthesized
cgtacatttgggatattttcat

SEQ ID NO: 630600 - DNA, 22 bp, Artificial Sequence
  chemically synthesized
gggatattttcatagcattaaa

SEQ ID NO: 630601 - DNA, 22 bp, Artificial Sequence
  chemically synthesized
ggatattttcatagcattaaaa

SEQ ID NO: 630602 - DNA, 22 bp, Artificial Sequence
  chemically synthesized
tcatagcattaaaaaaggtcat

SEQ ID NO: 630603 - DNA, 22 bp, Artificial Sequence
  chemically synthesized
catagcattaaaaaaggtcatt

SEQ ID NO: 630604 - DNA, 22 bp, Artificial Sequence
  chemically synthesized
atagcattaaaaaaggtcatta

SEQ ID NO: 630605 - DNA, 22 bp, Artificial Sequence
  chemically synthesized
aaaaaggtcattattgttttga

SEQ ID NO: 630606 - DNA, 22 bp, Artificial Sequence
  chemically synthesized
cagaagccaaagaatcaaaaca

SEQ ID NO: 630607 - DNA, 22 bp, Artificial Sequence
  chemically synthesized
ccagaagccaaagaatcaaaac

SEQ ID NO: 630608 - DNA, 22 bp, Artificial Sequence
  chemically synthesized
ttgttttgattctttggcttct

SEQ ID NO: 630609 - DNA, 22 bp, Artificial Sequence
  chemically synthesized
agacaagtttccagaagccaaa

SEQ ID NO: 630610 - DNA, 22 bp, Artificial Sequence
  chemically synthesized
ttttgattctttggcttctgga

SEQ ID NO: 630611 - DNA, 22 bp, Artificial Sequence
  chemically synthesized
tgattctttggcttctggaaac

SEQ ID NO: 630612 - DNA, 22 bp, Artificial Sequence
  chemically synthesized
gattctttggcttctggaaact

SEQ ID NO: 630613 - DNA, 22 bp, Artificial Sequence
  chemically synthesized
attctttggcttctggaaactt

SEQ ID NO: 630614 - DNA, 22 bp, Artificial Sequence
  chemically synthesized
tttggcttctggaaacttgtct

SEQ ID NO: 630615 - DNA, 22 bp, Artificial Sequence
  chemically synthesized
tggcttctggaaacttgtctga

SEQ ID NO: 630616 - DNA, 22 bp, Artificial Sequence
  chemically synthesized
ggcttctggaaacttgtctgaa

SEQ ID NO: 630617 - DNA, 22 bp, Artificial Sequence
  chemically synthesized
aggtgtatggtgttcagacaag

SEQ ID NO: 630618 - DNA, 22 bp, Artificial Sequence
  chemically synthesized
gcttctggaaacttgtctgaac

SEQ ID NO: 630619 - DNA, 22 bp, Artificial Sequence
  chemically synthesized
cctgaggtgtatggtgttcaga

SEQ ID NO: 630620 - DNA, 22 bp, Artificial Sequence
  chemically synthesized
ctggaaacttgtctgaacacca

SEQ ID NO: 630621 - DNA, 22 bp, Artificial Sequence
  chemically synthesized
tggaaacttgtctgaacaccat

SEQ ID NO: 630622 - DNA, 22 bp, Artificial Sequence
  chemically synthesized
gaaacttgtctgaacaccatac

SEQ ID NO: 630623 - DNA, 22 bp, Artificial Sequence
  chemically synthesized
actacctgaggtgtatggtgtt

SEQ ID NO: 630624 - DNA, 22 bp, Artificial Sequence
  chemically synthesized
gactacctgaggtgtatggtgt

SEQ ID NO: 630625 - DNA, 22 bp, Artificial Sequence
  chemically synthesized
gtctgaacaccatacacctcag

SEQ ID NO: 630626 - DNA, 22 bp, Artificial Sequence
  chemically synthesized
tctgaacaccatacacctcagg

SEQ ID NO: 630627 - DNA, 22 bp, Artificial Sequence
  chemically synthesized
cagacttgactacctgaggtgt

SEQ ID NO: 630628 - DNA, 22 bp, Artificial Sequence
  chemically synthesized
gcagacttgactacctgaggtg

SEQ ID NO: 630629 - DNA, 22 bp, Artificial Sequence
  chemically synthesized
aacaccatacacctcaggtagt

SEQ ID NO: 630630 - DNA, 22 bp, Artificial Sequence
  chemically synthesized
tataggcatttgcagacttgac

SEQ ID NO: 630631 - DNA, 22 bp, Artificial Sequence
  chemically synthesized
aagttatataggcatttgcaga

SEQ ID NO: 630632 - DNA, 22 bp, Artificial Sequence
  chemically synthesized
aggtagtcaagtctgcaaatgc

SEQ ID NO: 630633 - DNA, 22 bp, Artificial Sequence
  chemically synthesized
gcacatgtaattgaagttatat

SEQ ID NO: 630634 - DNA, 22 bp, Artificial Sequence
  chemically synthesized
caaatgcctatataacttcaat

SEQ ID NO: 630635 - DNA, 22 bp, Artificial Sequence
  chemically synthesized
agaaaaggctagcacatgtaat

SEQ ID NO: 630636 - DNA, 22 bp, Artificial Sequence
  chemically synthesized
cagaaaaggctagcacatgtaa

SEQ ID NO: 630637 - DNA, 22 bp, Artificial Sequence
  chemically synthesized
tataacttcaattacatgtgct

SEQ ID NO: 630638 - DNA, 22 bp, Artificial Sequence
  chemically synthesized
caattacatgtgctagcctttt

SEQ ID NO: 630639 - DNA, 22 bp, Artificial Sequence
  chemically synthesized
aattacatgtgctagccttttc

SEQ ID NO: 630640 - DNA, 22 bp, Artificial Sequence
  chemically synthesized
acaaatgaatttcagaaaaggc

SEQ ID NO: 630641 - DNA, 22 bp, Artificial Sequence
  chemically synthesized
catgtgctagccttttctgaaa

SEQ ID NO: 630642 - DNA, 22 bp, Artificial Sequence
  chemically synthesized
actcacaaatgaatttcagaaa

SEQ ID NO: 630643 - DNA, 22 bp, Artificial Sequence
  chemically synthesized
cactcacaaatgaatttcagaa

SEQ ID NO: 630644 - DNA, 22 bp, Artificial Sequence
  chemically synthesized
gccttttctgaaattcatttgt

SEQ ID NO: 630645 - DNA, 22 bp, Artificial Sequence
  chemically synthesized
aacatgtttcactcacaaatga

SEQ ID NO: 630646 - DNA, 22 bp, Artificial Sequence
  chemically synthesized
aaacatgtttcactcacaaatg

SEQ ID NO: 630647 - DNA, 22 bp, Artificial Sequence
  chemically synthesized
ttctgaaattcatttgtgagtg

SEQ ID NO: 630648 - DNA, 22 bp, Artificial Sequence
  chemically synthesized
tctgaaattcatttgtgagtga

SEQ ID NO: 630649 - DNA, 22 bp, Artificial Sequence
  chemically synthesized
ctgaaattcatttgtgagtgaa

SEQ ID NO: 630650 - DNA, 22 bp, Artificial Sequence
  chemically synthesized
tgaaattcatttgtgagtgaaa

SEQ ID NO: 630651 - DNA, 22 bp, Artificial Sequence
  chemically synthesized
aaattcatttgtgagtgaaaca

SEQ ID NO: 630652 - DNA, 22 bp, Artificial Sequence
  chemically synthesized
accaccttaaacatgtttcact

SEQ ID NO: 630653 - DNA, 22 bp, Artificial Sequence
  chemically synthesized
gaccaccttaaacatgtttcac

SEQ ID NO: 630654 - DNA, 22 bp, Artificial Sequence
  chemically synthesized
tgaccaccttaaacatgtttca

SEQ ID NO: 630655 - DNA, 22 bp, Artificial Sequence
  chemically synthesized
atttgtgagtgaaacatgttta

SEQ ID NO: 630656 - DNA, 22 bp, Artificial Sequence
  chemically synthesized
gtgagtgaaacatgtttaaggt

SEQ ID NO: 630657 - DNA, 22 bp, Artificial Sequence
  chemically synthesized
tgagtgaaacatgtttaaggtg

SEQ ID NO: 630658 - DNA, 22 bp, Artificial Sequence
  chemically synthesized
tagaaaaatgcaccataatttt

SEQ ID NO: 630659 - DNA, 22 bp, Artificial Sequence
  chemically synthesized
gtagaaaaatgcaccataattt

SEQ ID NO: 630660 - DNA, 22 bp, Artificial Sequence
  chemically synthesized
tgtagaaaaatgcaccataatt

SEQ ID NO: 630661 - DNA, 22 bp, Artificial Sequence
  chemically synthesized
aaggtggtcaaaattatggtgc

SEQ ID NO: 630662 - DNA, 22 bp, Artificial Sequence
  chemically synthesized
ttgtagaaaaatgcaccataat

SEQ ID NO: 630663 - DNA, 22 bp, Artificial Sequence
  chemically synthesized
aggtggtcaaaattatggtgca

SEQ ID NO: 630664 - DNA, 22 bp, Artificial Sequence
  chemically synthesized
tttgtagaaaaatgcaccataa

SEQ ID NO: 630665 - DNA, 22 bp, Artificial Sequence
  chemically synthesized
actttttgtagaaaaatgcacc

SEQ ID NO: 630666 - DNA, 22 bp, Artificial Sequence
  chemically synthesized
aactttttgtagaaaaatgcac

SEQ ID NO: 630667 - DNA, 22 bp, Artificial Sequence
  chemically synthesized
taactttttgtagaaaaatgca

SEQ ID NO: 630668 - DNA, 22 bp, Artificial Sequence
  chemically synthesized
attttaactttttgtagaaaaa

SEQ ID NO: 630669 - DNA, 22 bp, Artificial Sequence
  chemically synthesized
ttcattttaactttttgtagaa

SEQ ID NO: 630670 - DNA, 22 bp, Artificial Sequence
  chemically synthesized
attcattttaactttttgtaga

SEQ ID NO: 630671 - DNA, 22 bp, Artificial Sequence
  chemically synthesized
tggtgcatttttctacaaaaag

SEQ ID NO: 630672 - DNA, 22 bp, Artificial Sequence
  chemically synthesized
aaatttattcattttaactttt

SEQ ID NO: 630673 - DNA, 22 bp, Artificial Sequence
  chemically synthesized
aaaatttattcattttaacttt

SEQ ID NO: 630674 - DNA, 22 bp, Artificial Sequence
  chemically synthesized
ttctacaaaaagttaaaatgaa

SEQ ID NO: 630675 - DNA, 22 bp, Artificial Sequence
  chemically synthesized
tctacaaaaagttaaaatgaat

SEQ ID NO: 630676 - DNA, 22 bp, Artificial Sequence
  chemically synthesized
ctacaaaaagttaaaatgaata

SEQ ID NO: 630677 - DNA, 22 bp, Artificial Sequence
  chemically synthesized
tacaaaaagttaaaatgaataa

SEQ ID NO: 630678 - DNA, 22 bp, Artificial Sequence
  chemically synthesized
caaaaagttaaaatgaataaat

SEQ ID NO: 630679 - DNA, 22 bp, Artificial Sequence
  chemically synthesized
tggtaagtgccccttaaaattt

SEQ ID NO: 630680 - DNA, 22 bp, Artificial Sequence
  chemically synthesized
atggtaagtgccccttaaaatt

SEQ ID NO: 630681 - DNA, 22 bp, Artificial Sequence
  chemically synthesized
ttatggtaagtgccccttaaaa

SEQ ID NO: 630682 - DNA, 22 bp, Artificial Sequence
  chemically synthesized
aaatgaataaattttaaggggc

SEQ ID NO: 630683 - DNA, 22 bp, Artificial Sequence
  chemically synthesized
attcttatggtaagtgcccctt

SEQ ID NO: 630684 - DNA, 22 bp, Artificial Sequence
  chemically synthesized
ggttcattcttatggtaagtgc

SEQ ID NO: 630685 - DNA, 22 bp, Artificial Sequence
  chemically synthesized
gggttcattcttatggtaagtg

SEQ ID NO: 630686 - DNA, 22 bp, Artificial Sequence
  chemically synthesized
ttgggttcattcttatggtaag

SEQ ID NO: 630687 - DNA, 22 bp, Artificial Sequence
  chemically synthesized
cttgggttcattcttatggtaa

SEQ ID NO: 630688 - DNA, 22 bp, Artificial Sequence
  chemically synthesized
taaggggcacttaccataagaa

SEQ ID NO: 630689 - DNA, 22 bp, Artificial Sequence
  chemically synthesized
aaggggcacttaccataagaat

SEQ ID NO: 630690 - DNA, 22 bp, Artificial Sequence
  chemically synthesized
aggggcacttaccataagaatg

SEQ ID NO: 630691 - DNA, 22 bp, Artificial Sequence
  chemically synthesized
gtatgtgagacttcttgggttc

SEQ ID NO: 630692 - DNA, 22 bp, Artificial Sequence
  chemically synthesized
accataagaatgaacccaagaa

SEQ ID NO: 630693 - DNA, 22 bp, Artificial Sequence
  chemically synthesized
cgtatgtgagacttcttgggtt

SEQ ID NO: 630694 - DNA, 22 bp, Artificial Sequence
  chemically synthesized
ccataagaatgaacccaagaag

SEQ ID NO: 630695 - DNA, 22 bp, Artificial Sequence
  chemically synthesized
atgtacttcgtatgtgagactt

SEQ ID NO: 630696 - DNA, 22 bp, Artificial Sequence
  chemically synthesized
gttcatgtacttcgtatgtgag

SEQ ID NO: 630697 - DNA, 22 bp, Artificial Sequence
  chemically synthesized
cctggttcatgtacttcgtatg

SEQ ID NO: 630698 - DNA, 22 bp, Artificial Sequence
  chemically synthesized
gcctggttcatgtacttcgtat

SEQ ID NO: 630699 - DNA, 22 bp, Artificial Sequence
  chemically synthesized
acggtttgcctggttcatgtac

SEQ ID NO: 630700 - DNA, 22 bp, Artificial Sequence
  chemically synthesized
acatacgaagtacatgaaccag

SEQ ID NO: 630701 - DNA, 22 bp, Artificial Sequence
  chemically synthesized
aatgcccctgacggtttgcctg

SEQ ID NO: 630702 - DNA, 22 bp, Artificial Sequence
  chemically synthesized
gtgaagcattgaatgcccctga

SEQ ID NO: 630703 - DNA, 22 bp, Artificial Sequence
  chemically synthesized
ggtgaagcattgaatgcccctg

SEQ ID NO: 630704 - DNA, 22 bp, Artificial Sequence
  chemically synthesized
acttggtgaagcattgaatgcc

SEQ ID NO: 630705 - DNA, 22 bp, Artificial Sequence
  chemically synthesized
aggaaacctgacttggtgaagc

SEQ ID NO: 630706 - DNA, 22 bp, Artificial Sequence
  chemically synthesized
aatgcttcaccaagtcaggttt

SEQ ID NO: 630707 - DNA, 22 bp, Artificial Sequence
  chemically synthesized
ggaggagaaattgaggaaacct

SEQ ID NO: 630708 - DNA, 22 bp, Artificial Sequence
  chemically synthesized
caccaagtcaggtttcctcaat

SEQ ID NO: 630709 - DNA, 22 bp, Artificial Sequence
  chemically synthesized
accaagtcaggtttcctcaatt

SEQ ID NO: 630710 - DNA, 22 bp, Artificial Sequence
  chemically synthesized
cctcaatttctcctcccagcct

SEQ ID NO: 630711 - DNA, 22 bp, Artificial Sequence
  chemically synthesized
ctcaatttctcctcccagccta

SEQ ID NO: 630712 - DNA, 22 bp, Artificial Sequence
  chemically synthesized
aatttctcctcccagcctacca

SEQ ID NO: 630713 - DNA, 22 bp, Artificial Sequence
  chemically synthesized
ctcctcccagcctaccattccc

SEQ ID NO: 630714 - DNA, 22 bp, Artificial Sequence
  chemically synthesized
tcctcccagcctaccattccct

SEQ ID NO: 630715 - DNA, 22 bp, Artificial Sequence
  chemically synthesized
ctcccagcctaccattccctcc

SEQ ID NO: 630716 - DNA, 22 bp, Artificial Sequence
  chemically synthesized
ggcagtggggccagggagggaa

SEQ ID NO: 630717 - DNA, 22 bp, Artificial Sequence
  chemically synthesized
ccagcctaccattccctccctg

SEQ ID NO: 630718 - DNA, 22 bp, Artificial Sequence
  chemically synthesized
gggcagtggggccagggaggga

SEQ ID NO: 630719 - DNA, 22 bp, Artificial Sequence
  chemically synthesized
tgggcagtggggccagggaggg

SEQ ID NO: 630720 - DNA, 22 bp, Artificial Sequence
  chemically synthesized
ccattccctccctggccccact

SEQ ID NO: 630721 - DNA, 22 bp, Artificial Sequence
  chemically synthesized
caaggctttgggcagtggggcc

SEQ ID NO: 630722 - DNA, 22 bp, Artificial Sequence
  chemically synthesized
ccaaggctttgggcagtggggc

SEQ ID NO: 630723 - DNA, 22 bp, Artificial Sequence
  chemically synthesized
cttccaaggctttgggcagtgg

SEQ ID NO: 630724 - DNA, 22 bp, Artificial Sequence
  chemically synthesized
cctccctggccccactgcccaa

SEQ ID NO: 630725 - DNA, 22 bp, Artificial Sequence
  chemically synthesized
cctggccccactgcccaaagcc

SEQ ID NO: 630726 - DNA, 22 bp, Artificial Sequence
  chemically synthesized
gccccactgcccaaagccttgg

SEQ ID NO: 630727 - DNA, 22 bp, Artificial Sequence
  chemically synthesized
tgccagtgcctccttccaaggc

SEQ ID NO: 630728 - DNA, 22 bp, Artificial Sequence
  chemically synthesized
cccaaagccttggaaggaggca

SEQ ID NO: 630729 - DNA, 22 bp, Artificial Sequence
  chemically synthesized
agtgtgtctgtgccagtgcctc

SEQ ID NO: 630730 - DNA, 22 bp, Artificial Sequence
  chemically synthesized
cagtgtgtctgtgccagtgcct

SEQ ID NO: 630731 - DNA, 22 bp, Artificial Sequence
  chemically synthesized
ttcagtgtgtctgtgccagtgc

SEQ ID NO: 630732 - DNA, 22 bp, Artificial Sequence
  chemically synthesized
ggaaggaggcactggcacagac

SEQ ID NO: 630733 - DNA, 22 bp, Artificial Sequence
  chemically synthesized
gaaggaggcactggcacagaca

SEQ ID NO: 630734 - DNA, 22 bp, Artificial Sequence
  chemically synthesized
atgattcttcagtgtgtctgtg

SEQ ID NO: 630735 - DNA, 22 bp, Artificial Sequence
  chemically synthesized
aatgattcttcagtgtgtctgt

SEQ ID NO: 630736 - DNA, 22 bp, Artificial Sequence
  chemically synthesized
atcaatttaatgattcttcagt

SEQ ID NO: 630737 - DNA, 22 bp, Artificial Sequence
  chemically synthesized
gcacagacacactgaagaatca

SEQ ID NO: 630738 - DNA, 22 bp, Artificial Sequence
  chemically synthesized
aagaatcattaaattgattaga

SEQ ID NO: 630739 - DNA, 22 bp, Artificial Sequence
  chemically synthesized
ccaacatcatgccatacaagtc

SEQ ID NO: 630740 - DNA, 22 bp, Artificial Sequence
  chemically synthesized
tgccaacatcatgccatacaag

SEQ ID NO: 630741 - DNA, 22 bp, Artificial Sequence
  chemically synthesized
aattgattagacttgtatggca

SEQ ID NO: 630742 - DNA, 22 bp, Artificial Sequence
  chemically synthesized
attagacttgtatggcatgatg

SEQ ID NO: 630743 - DNA, 22 bp, Artificial Sequence
  chemically synthesized
gacttgtatggcatgatgttgg

SEQ ID NO: 630744 - DNA, 22 bp, Artificial Sequence
  chemically synthesized
gtatggcatgatgttggcagag

SEQ ID NO: 630745 - DNA, 22 bp, Artificial Sequence
  chemically synthesized
tatggcatgatgttggcagagt

SEQ ID NO: 630746 - DNA, 22 bp, Artificial Sequence
  chemically synthesized
aacacaggagtcgtaatgaaaa

SEQ ID NO: 630747 - DNA, 22 bp, Artificial Sequence
  chemically synthesized
aaacacaggagtcgtaatgaaa

SEQ ID NO: 630748 - DNA, 22 bp, Artificial Sequence
  chemically synthesized
atttaaacacaggagtcgtaat

SEQ ID NO: 630749 - DNA, 22 bp, Artificial Sequence
  chemically synthesized
gcagagttttcattacgactcc

SEQ ID NO: 630750 - DNA, 22 bp, Artificial Sequence
  chemically synthesized
attcatttaaacacaggagtcg

SEQ ID NO: 630751 - DNA, 22 bp, Artificial Sequence
  chemically synthesized
tcattacgactcctgtgtttaa

SEQ ID NO: 630752 - DNA, 22 bp, Artificial Sequence
  chemically synthesized
cattacgactcctgtgtttaaa

SEQ ID NO: 630753 - DNA, 22 bp, Artificial Sequence
  chemically synthesized
attacgactcctgtgtttaaat

SEQ ID NO: 630754 - DNA, 22 bp, Artificial Sequence
  chemically synthesized
cgactcctgtgtttaaatgaat

SEQ ID NO: 630755 - DNA, 22 bp, Artificial Sequence
  chemically synthesized
gagagaccactgattcatttaa

SEQ ID NO: 630756 - DNA, 22 bp, Artificial Sequence
  chemically synthesized
ctgtgtttaaatgaatcagtgg

SEQ ID NO: 630757 - DNA, 22 bp, Artificial Sequence
  chemically synthesized
tgtttaaatgaatcagtggtct

SEQ ID NO: 630758 - DNA, 22 bp, Artificial Sequence
  chemically synthesized
aaatgaatcagtggtctctcca

SEQ ID NO: 630759 - DNA, 22 bp, Artificial Sequence
  chemically synthesized
aatgaatcagtggtctctccag

SEQ ID NO: 630760 - DNA, 22 bp, Artificial Sequence
  chemically synthesized
gcaacaggatggactggagaga

SEQ ID NO: 630761 - DNA, 22 bp, Artificial Sequence
  chemically synthesized
agcaacaggatggactggagag

SEQ ID NO: 630762 - DNA, 22 bp, Artificial Sequence
  chemically synthesized
cttagcaacaggatggactgga

SEQ ID NO: 630763 - DNA, 22 bp, Artificial Sequence
  chemically synthesized
gattccttagcaacaggatgga

SEQ ID NO: 630764 - DNA, 22 bp, Artificial Sequence
  chemically synthesized
tggattccttagcaacaggatg

SEQ ID NO: 630765 - DNA, 22 bp, Artificial Sequence
  chemically synthesized
tccagtccatcctgttgctaag

SEQ ID NO: 630766 - DNA, 22 bp, Artificial Sequence
  chemically synthesized
cagtccatcctgttgctaagga

SEQ ID NO: 630767 - DNA, 22 bp, Artificial Sequence
  chemically synthesized
aatgagaagattctggattcct

SEQ ID NO: 630768 - DNA, 22 bp, Artificial Sequence
  chemically synthesized
aaatgagaagattctggattcc

SEQ ID NO: 630769 - DNA, 22 bp, Artificial Sequence
  chemically synthesized
ttaaatgagaagattctggatt

SEQ ID NO: 630770 - DNA, 22 bp, Artificial Sequence
  chemically synthesized
cttaaatgagaagattctggat

SEQ ID NO: 630771 - DNA, 22 bp, Artificial Sequence
  chemically synthesized
ttgctaaggaatccagaatctt

SEQ ID NO: 630772 - DNA, 22 bp, Artificial Sequence
  chemically synthesized
ctaaggaatccagaatcttctc

SEQ ID NO: 630773 - DNA, 22 bp, Artificial Sequence
  chemically synthesized
aggaatccagaatcttctcatt

SEQ ID NO: 630774 - DNA, 22 bp, Artificial Sequence
  chemically synthesized
gatgggtggagagtccttctta

SEQ ID NO: 630775 - DNA, 22 bp, Artificial Sequence
  chemically synthesized
ctcatttaagaaggactctcca

SEQ ID NO: 630776 - DNA, 22 bp, Artificial Sequence
  chemically synthesized
tcatttaagaaggactctccac

SEQ ID NO: 630777 - DNA, 22 bp, Artificial Sequence
  chemically synthesized
atttaagaaggactctccaccc

SEQ ID NO: 630778 - DNA, 22 bp, Artificial Sequence
  chemically synthesized
ggagacaggctggatgggtgga

SEQ ID NO: 630779 - DNA, 22 bp, Artificial Sequence
  chemically synthesized
aagaaggactctccacccatcc

SEQ ID NO: 630780 - DNA, 22 bp, Artificial Sequence
  chemically synthesized
agaaggactctccacccatcca

SEQ ID NO: 630781 - DNA, 22 bp, Artificial Sequence
  chemically synthesized
tgggagacaggctggatgggtg

SEQ ID NO: 630782 - DNA, 22 bp, Artificial Sequence
  chemically synthesized
tccacccatccagcctgtctcc

SEQ ID NO: 630783 - DNA, 22 bp, Artificial Sequence
  chemically synthesized
cacccatccagcctgtctccca

SEQ ID NO: 630784 - DNA, 22 bp, Artificial Sequence
  chemically synthesized
ccatgggatgacagtgttctgg

SEQ ID NO: 630785 - DNA, 22 bp, Artificial Sequence
  chemically synthesized
tcccatgggatgacagtgttct

SEQ ID NO: 630786 - DNA, 22 bp, Artificial Sequence
  chemically synthesized
tctcccagaacactgtcatccc

SEQ ID NO: 630787 - DNA, 22 bp, Artificial Sequence
  chemically synthesized
ccagaacactgtcatcccatgg

SEQ ID NO: 630788 - DNA, 22 bp, Artificial Sequence
  chemically synthesized
tcatcccatgggagagctttcc

SEQ ID NO: 630789 - DNA, 22 bp, Artificial Sequence
  chemically synthesized
aaggaggagagaaggaaagctc

SEQ ID NO: 630790 - DNA, 22 bp, Artificial Sequence
  chemically synthesized
atctgaaggaggagagaaggaa

SEQ ID NO: 630791 - DNA, 22 bp, Artificial Sequence
  chemically synthesized
aatctgaaggaggagagaagga

SEQ ID NO: 630792 - DNA, 22 bp, Artificial Sequence
  chemically synthesized
ccaagaatttaatctgaaggag

SEQ ID NO: 630793 - DNA, 22 bp, Artificial Sequence
  chemically synthesized
accaagaatttaatctgaagga

SEQ ID NO: 630794 - DNA, 22 bp, Artificial Sequence
  chemically synthesized
tccttctctcctccttcagatt

SEQ ID NO: 630795 - DNA, 22 bp, Artificial Sequence
  chemically synthesized
taccaagaatttaatctgaagg

SEQ ID NO: 630796 - DNA, 22 bp, Artificial Sequence
  chemically synthesized
ccttctctcctccttcagatta

SEQ ID NO: 630797 - DNA, 22 bp, Artificial Sequence
  chemically synthesized
cttctctcctccttcagattaa

SEQ ID NO: 630798 - DNA, 22 bp, Artificial Sequence
  chemically synthesized
tctttaccaagaatttaatctg

SEQ ID NO: 630799 - DNA, 22 bp, Artificial Sequence
  chemically synthesized
ctctcctccttcagattaaatt

SEQ ID NO: 630800 - DNA, 22 bp, Artificial Sequence
  chemically synthesized
tctcctccttcagattaaattc

SEQ ID NO: 630801 - DNA, 22 bp, Artificial Sequence
  chemically synthesized
tcctccttcagattaaattctt

SEQ ID NO: 630802 - DNA, 22 bp, Artificial Sequence
  chemically synthesized
ctccttcagattaaattcttgg

SEQ ID NO: 630803 - DNA, 22 bp, Artificial Sequence
  chemically synthesized
cttcagattaaattcttggtaa

SEQ ID NO: 630804 - DNA, 22 bp, Artificial Sequence
  chemically synthesized
cagattaaattcttggtaaaga

SEQ ID NO: 630805 - DNA, 22 bp, Artificial Sequence
  chemically synthesized
agattaaattcttggtaaagac

SEQ ID NO: 630806 - DNA, 22 bp, Artificial Sequence
  chemically synthesized
aattcttggtaaagacaacctt

SEQ ID NO: 630807 - DNA, 22 bp, Artificial Sequence
  chemically synthesized
ttggtaaagacaaccttgattt

SEQ ID NO: 630808 - DNA, 22 bp, Artificial Sequence
  chemically synthesized
acagcccaagtaaaatcaaggt

SEQ ID NO: 630809 - DNA, 22 bp, Artificial Sequence
  chemically synthesized
ggtaaagacaaccttgatttta

SEQ ID NO: 630810 - DNA, 22 bp, Artificial Sequence
  chemically synthesized
gtaaagacaaccttgattttac

SEQ ID NO: 630811 - DNA, 22 bp, Artificial Sequence
  chemically synthesized
actgacagcccaagtaaaatca

SEQ ID NO: 630812 - DNA, 22 bp, Artificial Sequence
  chemically synthesized
gattttacttgggctgtcagtt

SEQ ID NO: 630813 - DNA, 22 bp, Artificial Sequence
  chemically synthesized
attttacttgggctgtcagtta

SEQ ID NO: 630814 - DNA, 22 bp, Artificial Sequence
  chemically synthesized
gatgacaaagtgttaactgaca

SEQ ID NO: 630815 - DNA, 22 bp, Artificial Sequence
  chemically synthesized
tacttgggctgtcagttaacac

SEQ ID NO: 630816 - DNA, 22 bp, Artificial Sequence
  chemically synthesized
ttggatgacaaagtgttaactg

SEQ ID NO: 630817 - DNA, 22 bp, Artificial Sequence
  chemically synthesized
acttgggctgtcagttaacact

SEQ ID NO: 630818 - DNA, 22 bp, Artificial Sequence
  chemically synthesized
cttgggctgtcagttaacactt

SEQ ID NO: 630819 - DNA, 22 bp, Artificial Sequence
  chemically synthesized
gggctgtcagttaacactttgt

SEQ ID NO: 630820 - DNA, 22 bp, Artificial Sequence
  chemically synthesized
ggctgtcagttaacactttgtc

SEQ ID NO: 630821 - DNA, 22 bp, Artificial Sequence
  chemically synthesized
agtgactgttggatgacaaagt

SEQ ID NO: 630822 - DNA, 22 bp, Artificial Sequence
  chemically synthesized
tcagttaacactttgtcatcca

SEQ ID NO: 630823 - DNA, 22 bp, Artificial Sequence
  chemically synthesized
attaagtgactgttggatgaca

SEQ ID NO: 630824 - DNA, 22 bp, Artificial Sequence
  chemically synthesized
cctaattaagtgactgttggat

SEQ ID NO: 630825 - DNA, 22 bp, Artificial Sequence
  chemically synthesized
acactttgtcatccaacagtca

SEQ ID NO: 630826 - DNA, 22 bp, Artificial Sequence
  chemically synthesized
tgtcatccaacagtcacttaat

SEQ ID NO: 630827 - DNA, 22 bp, Artificial Sequence
  chemically synthesized
gtcatccaacagtcacttaatt

SEQ ID NO: 630828 - DNA, 22 bp, Artificial Sequence
  chemically synthesized
tcatccaacagtcacttaatta

SEQ ID NO: 630829 - DNA, 22 bp, Artificial Sequence
  chemically synthesized
aatatcgaattacctaattaag

SEQ ID NO: 630830 - DNA, 22 bp, Artificial Sequence
  chemically synthesized
tctgaatatcgaattacctaat

SEQ ID NO: 630831 - DNA, 22 bp, Artificial Sequence
  chemically synthesized
aattaggtaattcgatattcag

SEQ ID NO: 630832 - DNA, 22 bp, Artificial Sequence
  chemically synthesized
attaggtaattcgatattcaga

SEQ ID NO: 630833 - DNA, 22 bp, Artificial Sequence
  chemically synthesized
caccaggaatattgtctgaata

SEQ ID NO: 630834 - DNA, 22 bp, Artificial Sequence
  chemically synthesized
ggtaattcgatattcagacaat

SEQ ID NO: 630835 - DNA, 22 bp, Artificial Sequence
  chemically synthesized
ttccaccaggaatattgtctga

SEQ ID NO: 630836 - DNA, 22 bp, Artificial Sequence
  chemically synthesized
ctattccaccaggaatattgtc

SEQ ID NO: 630837 - DNA, 22 bp, Artificial Sequence
  chemically synthesized
ctcctattccaccaggaatatt

SEQ ID NO: 630838 - DNA, 22 bp, Artificial Sequence
  chemically synthesized
gatattcagacaatattcctgg

SEQ ID NO: 630839 - DNA, 22 bp, Artificial Sequence
  chemically synthesized
actcctattccaccaggaatat

SEQ ID NO: 630840 - DNA, 22 bp, Artificial Sequence
  chemically synthesized
ttactcctattccaccaggaat

SEQ ID NO: 630841 - DNA, 22 bp, Artificial Sequence
  chemically synthesized
cttactcctattccaccaggaa

SEQ ID NO: 630842 - DNA, 22 bp, Artificial Sequence
  chemically synthesized
agacaatattcctggtggaata

SEQ ID NO: 630843 - DNA, 22 bp, Artificial Sequence
  chemically synthesized
ctggtggaataggagtaagaag

SEQ ID NO: 630844 - DNA, 22 bp, Artificial Sequence
  chemically synthesized
cggtgaaagatgcttcttactc

SEQ ID NO: 630845 - DNA, 22 bp, Artificial Sequence
  chemically synthesized
acggtgaaagatgcttcttact

SEQ ID NO: 630846 - DNA, 22 bp, Artificial Sequence
  chemically synthesized
tacggtgaaagatgcttcttac

SEQ ID NO: 630847 - DNA, 22 bp, Artificial Sequence
  chemically synthesized
gtggaataggagtaagaagcat

SEQ ID NO: 630848 - DNA, 22 bp, Artificial Sequence
  chemically synthesized
aggttttacggtgaaagatgct

SEQ ID NO: 630849 - DNA, 22 bp, Artificial Sequence
  chemically synthesized
caggttttacggtgaaagatgc

SEQ ID NO: 630850 - DNA, 22 bp, Artificial Sequence
  chemically synthesized
aatgtggtttcaggttttacgg

SEQ ID NO: 630851 - DNA, 22 bp, Artificial Sequence
  chemically synthesized
tcactgaatgtggtttcaggtt

SEQ ID NO: 630852 - DNA, 22 bp, Artificial Sequence
  chemically synthesized
atcactgaatgtggtttcaggt

SEQ ID NO: 630853 - DNA, 22 bp, Artificial Sequence
  chemically synthesized
tcaccgtaaaacctgaaaccac

SEQ ID NO: 630854 - DNA, 22 bp, Artificial Sequence
  chemically synthesized
caccgtaaaacctgaaaccaca

SEQ ID NO: 630855 - DNA, 22 bp, Artificial Sequence
  chemically synthesized
accgtaaaacctgaaaccacat

SEQ ID NO: 630856 - DNA, 22 bp, Artificial Sequence
  chemically synthesized
aaaccacattcagtgataagac

SEQ ID NO: 630857 - DNA, 22 bp, Artificial Sequence
  chemically synthesized
aaagggatagggtgcagtctta

SEQ ID NO: 630858 - DNA, 22 bp, Artificial Sequence
  chemically synthesized
agtgataagactgcaccctatc

SEQ ID NO: 630859 - DNA, 22 bp, Artificial Sequence
  chemically synthesized
tgggttgaaagggatagggtgc

SEQ ID NO: 630860 - DNA, 22 bp, Artificial Sequence
  chemically synthesized
atgggttgaaagggatagggtg

SEQ ID NO: 630861 - DNA, 22 bp, Artificial Sequence
  chemically synthesized
tttatgggttgaaagggatagg

SEQ ID NO: 630862 - DNA, 22 bp, Artificial Sequence
  chemically synthesized
caccctatccctttcaacccat

SEQ ID NO: 630863 - DNA, 22 bp, Artificial Sequence
  chemically synthesized
aaatgcctatttatgggttgaa

SEQ ID NO: 630864 - DNA, 22 bp, Artificial Sequence
  chemically synthesized
aaaatgcctatttatgggttga

SEQ ID NO: 630865 - DNA, 22 bp, Artificial Sequence
  chemically synthesized
taaaatgcctatttatgggttg

SEQ ID NO: 630866 - DNA, 22 bp, Artificial Sequence
  chemically synthesized
ttaaaatgcctatttatgggtt

SEQ ID NO: 630867 - DNA, 22 bp, Artificial Sequence
  chemically synthesized
tccctttcaacccataaatagg

SEQ ID NO: 630868 - DNA, 22 bp, Artificial Sequence
  chemically synthesized
agaggtttttaaaatgcctatt

SEQ ID NO: 630869 - DNA, 22 bp, Artificial Sequence
  chemically synthesized
gagaggtttttaaaatgcctat

SEQ ID NO: 630870 - DNA, 22 bp, Artificial Sequence
  chemically synthesized
tcaacccataaataggcatttt

SEQ ID NO: 630871 - DNA, 22 bp, Artificial Sequence
  chemically synthesized
tgagaggtttttaaaatgccta

SEQ ID NO: 630872 - DNA, 22 bp, Artificial Sequence
  chemically synthesized
caacccataaataggcatttta

SEQ ID NO: 630873 - DNA, 22 bp, Artificial Sequence
  chemically synthesized
aacccataaataggcattttaa

SEQ ID NO: 630874 - DNA, 22 bp, Artificial Sequence
  chemically synthesized
gagttttgagaggtttttaaaa

SEQ ID NO: 630875 - DNA, 22 bp, Artificial Sequence
  chemically synthesized
aatattggagttttgagaggtt

SEQ ID NO: 630876 - DNA, 22 bp, Artificial Sequence
  chemically synthesized
taaaaacctctcaaaactccaa

SEQ ID NO: 630877 - DNA, 22 bp, Artificial Sequence
  chemically synthesized
aaaaattaaatattggagtttt

SEQ ID NO: 630878 - DNA, 22 bp, Artificial Sequence
  chemically synthesized
aaaaacctctcaaaactccaat

SEQ ID NO: 630879 - DNA, 22 bp, Artificial Sequence
  chemically synthesized
aaaacctctcaaaactccaata

SEQ ID NO: 630880 - DNA, 22 bp, Artificial Sequence
  chemically synthesized
gattaaaaaattaaatattgga

SEQ ID NO: 630881 - DNA, 22 bp, Artificial Sequence
  chemically synthesized
tcaaaactccaatatttaattt

SEQ ID NO: 630882 - DNA, 22 bp, Artificial Sequence
  chemically synthesized
aaaactccaatatttaattttt

SEQ ID NO: 630883 - DNA, 22 bp, Artificial Sequence
  chemically synthesized
caatatttaattttttaatcga

SEQ ID NO: 630884 - DNA, 22 bp, Artificial Sequence
  chemically synthesized
aattttttaatcgaattggtta

SEQ ID NO: 630885 - DNA, 22 bp, Artificial Sequence
  chemically synthesized
attttttaatcgaattggttat

SEQ ID NO: 630886 - DNA, 22 bp, Artificial Sequence
  chemically synthesized
aagccacacagaacaataacca

SEQ ID NO: 630887 - DNA, 22 bp, Artificial Sequence
  chemically synthesized
tttaatcgaattggttattgtt

SEQ ID NO: 630888 - DNA, 22 bp, Artificial Sequence
  chemically synthesized
gaagccacacagaacaataacc

SEQ ID NO: 630889 - DNA, 22 bp, Artificial Sequence
  chemically synthesized
ttaatcgaattggttattgttc

SEQ ID NO: 630890 - DNA, 22 bp, Artificial Sequence
  chemically synthesized
taatcgaattggttattgttct

SEQ ID NO: 630891 - DNA, 22 bp, Artificial Sequence
  chemically synthesized
aatcgaattggttattgttctg

SEQ ID NO: 630892 - DNA, 22 bp, Artificial Sequence
  chemically synthesized
atcgaattggttattgttctgt

SEQ ID NO: 630893 - DNA, 22 bp, Artificial Sequence
  chemically synthesized
gtatttgaagccacacagaaca

SEQ ID NO: 630894 - DNA, 22 bp, Artificial Sequence
  chemically synthesized
ggtatttgaagccacacagaac

SEQ ID NO: 630895 - DNA, 22 bp, Artificial Sequence
  chemically synthesized
tttggtatttgaagccacacag

SEQ ID NO: 630896 - DNA, 22 bp, Artificial Sequence
  chemically synthesized
atttggtatttgaagccacaca

SEQ ID NO: 630897 - DNA, 22 bp, Artificial Sequence
  chemically synthesized
tatttggtatttgaagccacac

SEQ ID NO: 630898 - DNA, 22 bp, Artificial Sequence
  chemically synthesized
gttattgttctgtgtggcttca

SEQ ID NO: 630899 - DNA, 22 bp, Artificial Sequence
  chemically synthesized
ttatttggtatttgaagccaca

SEQ ID NO: 630900 - DNA, 22 bp, Artificial Sequence
  chemically synthesized
tttatttggtatttgaagccac

SEQ ID NO: 630901 - DNA, 22 bp, Artificial Sequence
  chemically synthesized
ttttatttggtatttgaagcca

SEQ ID NO: 630902 - DNA, 22 bp, Artificial Sequence
  chemically synthesized
ttgttctgtgtggcttcaaata

SEQ ID NO: 630903 - DNA, 22 bp, Artificial Sequence
  chemically synthesized
ttctgtgtggcttcaaatacca

SEQ ID NO: 630904 - DNA, 22 bp, Artificial Sequence
  chemically synthesized
tgtgtggcttcaaataccaaat

SEQ ID NO: 630905 - DNA, 22 bp, Artificial Sequence
  chemically synthesized
tgtggcttcaaataccaaataa

SEQ ID NO: 630906 - DNA, 22 bp, Artificial Sequence
  chemically synthesized
agaagatgatcttttttatttg

SEQ ID NO: 630907 - DNA, 22 bp, Artificial Sequence
  chemically synthesized
cagaagatgatcttttttattt

SEQ ID NO: 630908 - DNA, 22 bp, Artificial Sequence
  chemically synthesized
caaataccaaataaaaaagatc

SEQ ID NO: 630909 - DNA, 22 bp, Artificial Sequence
  chemically synthesized
aaataccaaataaaaaagatca

SEQ ID NO: 630910 - DNA, 22 bp, Artificial Sequence
  chemically synthesized
aacgtacccttcagaagatgat

SEQ ID NO: 630911 - DNA, 22 bp, Artificial Sequence
  chemically synthesized
catcatctcaacgtacccttca

SEQ ID NO: 630912 - DNA, 22 bp, Artificial Sequence
  chemically synthesized
acatcatctcaacgtacccttc

SEQ ID NO: 630913 - DNA, 22 bp, Artificial Sequence
  chemically synthesized
aaaggcttacatcatctcaacg

SEQ ID NO: 630914 - DNA, 22 bp, Artificial Sequence
  chemically synthesized
gaaaggcttacatcatctcaac

SEQ ID NO: 630915 - DNA, 22 bp, Artificial Sequence
  chemically synthesized
ctgaagggtacgttgagatgat

SEQ ID NO: 630916 - DNA, 22 bp, Artificial Sequence
  chemically synthesized
tgaagggtacgttgagatgatg

SEQ ID NO: 630917 - DNA, 22 bp, Artificial Sequence
  chemically synthesized
aagggtacgttgagatgatgta

SEQ ID NO: 630918 - DNA, 22 bp, Artificial Sequence
  chemically synthesized
atttgaaaggcttacatcatct

SEQ ID NO: 630919 - DNA, 22 bp, Artificial Sequence
  chemically synthesized
tcatttgaaaggcttacatcat

SEQ ID NO: 630920 - DNA, 22 bp, Artificial Sequence
  chemically synthesized
actctcatttgaaaggcttaca

SEQ ID NO: 630921 - DNA, 22 bp, Artificial Sequence
  chemically synthesized
aactctcatttgaaaggcttac

SEQ ID NO: 630922 - DNA, 22 bp, Artificial Sequence
  chemically synthesized
ttaactctcatttgaaaggctt

SEQ ID NO: 630923 - DNA, 22 bp, Artificial Sequence
  chemically synthesized
agatgatgtaagcctttcaaat

SEQ ID NO: 630924 - DNA, 22 bp, Artificial Sequence
  chemically synthesized
cagacccacactcttaactctc

SEQ ID NO: 630925 - DNA, 22 bp, Artificial Sequence
  chemically synthesized
gctccagacccacactcttaac

SEQ ID NO: 630926 - DNA, 22 bp, Artificial Sequence
  chemically synthesized
tcaaatgagagttaagagtgtg

SEQ ID NO: 630927 - DNA, 22 bp, Artificial Sequence
  chemically synthesized
caaatgagagttaagagtgtgg

SEQ ID NO: 630928 - DNA, 22 bp, Artificial Sequence
  chemically synthesized
aaatgagagttaagagtgtggg

SEQ ID NO: 630929 - DNA, 22 bp, Artificial Sequence
  chemically synthesized
gatccaggcagtctggctccag

SEQ ID NO: 630930 - DNA, 22 bp, Artificial Sequence
  chemically synthesized
agagtgtgggtctggagccaga

SEQ ID NO: 630931 - DNA, 22 bp, Artificial Sequence
  chemically synthesized
ggatccaggcagtctggctcca

SEQ ID NO: 630932 - DNA, 22 bp, Artificial Sequence
  chemically synthesized
gagccagactgcctggatccaa

SEQ ID NO: 630933 - DNA, 22 bp, Artificial Sequence
  chemically synthesized
cctggatccaaatccttggctc

SEQ ID NO: 630934 - DNA, 22 bp, Artificial Sequence
  chemically synthesized
gatccaaatccttggctctgtc

SEQ ID NO: 630935 - DNA, 22 bp, Artificial Sequence
  chemically synthesized
ggctctgtcacctgggacacac

SEQ ID NO: 630936 - DNA, 22 bp, Artificial Sequence
  chemically synthesized
gctctgtcacctgggacacact

SEQ ID NO: 630937 - DNA, 22 bp, Artificial Sequence
  chemically synthesized
tgtcacctgggacacactgctt

SEQ ID NO: 630938 - DNA, 22 bp, Artificial Sequence
  chemically synthesized
tcacctgggacacactgcttac

SEQ ID NO: 630939 - DNA, 22 bp, Artificial Sequence
  chemically synthesized
agtcaatgagagagtaagcagt

SEQ ID NO: 630940 - DNA, 22 bp, Artificial Sequence
  chemically synthesized
ggacacactgcttactctctca

SEQ ID NO: 630941 - DNA, 22 bp, Artificial Sequence
  chemically synthesized
cagataaggagactgagtcaat

SEQ ID NO: 630942 - DNA, 22 bp, Artificial Sequence
  chemically synthesized
cttactctctcattgactcagt

SEQ ID NO: 630943 - DNA, 22 bp, Artificial Sequence
  chemically synthesized
acagataaggagactgagtcaa

SEQ ID NO: 630944 - DNA, 22 bp, Artificial Sequence
  chemically synthesized
tacagataaggagactgagtca

SEQ ID NO: 630945 - DNA, 22 bp, Artificial Sequence
  chemically synthesized
actctctcattgactcagtctc

SEQ ID NO: 630946 - DNA, 22 bp, Artificial Sequence
  chemically synthesized
ctctctcattgactcagtctcc

SEQ ID NO: 630947 - DNA, 22 bp, Artificial Sequence
  chemically synthesized
tctcattgactcagtctcctta

SEQ ID NO: 630948 - DNA, 22 bp, Artificial Sequence
  chemically synthesized
tcattgactcagtctccttatc

SEQ ID NO: 630949 - DNA, 22 bp, Artificial Sequence
  chemically synthesized
accccgttttacagataaggag

SEQ ID NO: 630950 - DNA, 22 bp, Artificial Sequence
  chemically synthesized
attgactcagtctccttatctg

SEQ ID NO: 630951 - DNA, 22 bp, Artificial Sequence
  chemically synthesized
ttaaccccgttttacagataag

SEQ ID NO: 630952 - DNA, 22 bp, Artificial Sequence
  chemically synthesized
attaaccccgttttacagataa

SEQ ID NO: 630953 - DNA, 22 bp, Artificial Sequence
  chemically synthesized
actcagtctccttatctgtaaa

SEQ ID NO: 630954 - DNA, 22 bp, Artificial Sequence
  chemically synthesized
ttattaaccccgttttacagat

SEQ ID NO: 630955 - DNA, 22 bp, Artificial Sequence
  chemically synthesized
agtctccttatctgtaaaacgg

SEQ ID NO: 630956 - DNA, 22 bp, Artificial Sequence
  chemically synthesized
cttatctgtaaaacggggttaa

SEQ ID NO: 630957 - DNA, 22 bp, Artificial Sequence
  chemically synthesized
atctgtaaaacggggttaataa

SEQ ID NO: 630958 - DNA, 22 bp, Artificial Sequence
  chemically synthesized
tctgtaaaacggggttaataag

SEQ ID NO: 630959 - DNA, 22 bp, Artificial Sequence
  chemically synthesized
tgaggtaggtactcttattaac

SEQ ID NO: 630960 - DNA, 22 bp, Artificial Sequence
  chemically synthesized
taaaacggggttaataagagta

SEQ ID NO: 630961 - DNA, 22 bp, Artificial Sequence
  chemically synthesized
atgacaaacctgtgaggtaggt

SEQ ID NO: 630962 - DNA, 22 bp, Artificial Sequence
  chemically synthesized
catgacaaacctgtgaggtagg

SEQ ID NO: 630963 - DNA, 22 bp, Artificial Sequence
  chemically synthesized
ataagagtacctacctcacagg

SEQ ID NO: 630964 - DNA, 22 bp, Artificial Sequence
  chemically synthesized
atcatgtcatcttcatgacaaa

SEQ ID NO: 630965 - DNA, 22 bp, Artificial Sequence
  chemically synthesized
catcatgtcatcttcatgacaa

SEQ ID NO: 630966 - DNA, 22 bp, Artificial Sequence
  chemically synthesized
tcatcatgtcatcttcatgaca

SEQ ID NO: 630967 - DNA, 22 bp, Artificial Sequence
  chemically synthesized
cctcacaggtttgtcatgaaga

SEQ ID NO: 630968 - DNA, 22 bp, Artificial Sequence
  chemically synthesized
ttcatcatgtcatcttcatgac

SEQ ID NO: 630969 - DNA, 22 bp, Artificial Sequence
  chemically synthesized
tttcatcatgtcatcttcatga

SEQ ID NO: 630970 - DNA, 22 bp, Artificial Sequence
  chemically synthesized
acaggtttgtcatgaagatgac

SEQ ID NO: 630971 - DNA, 22 bp, Artificial Sequence
  chemically synthesized
ccatctttttcatcatgtcatc

SEQ ID NO: 630972 - DNA, 22 bp, Artificial Sequence
  chemically synthesized
gccatctttttcatcatgtcat

SEQ ID NO: 630973 - DNA, 22 bp, Artificial Sequence
  chemically synthesized
gtcatgaagatgacatgatgaa

SEQ ID NO: 630974 - DNA, 22 bp, Artificial Sequence
  chemically synthesized
tcatgaagatgacatgatgaaa

SEQ ID NO: 630975 - DNA, 22 bp, Artificial Sequence
  chemically synthesized
agcacttgccatctttttcatc

SEQ ID NO: 630976 - DNA, 22 bp, Artificial Sequence
  chemically synthesized
tcagcacttgccatctttttca

SEQ ID NO: 630977 - DNA, 22 bp, Artificial Sequence
  chemically synthesized
ttctcagcacttgccatctttt

SEQ ID NO: 630978 - DNA, 22 bp, Artificial Sequence
  chemically synthesized
tgtgccaagcattgttctcagc

SEQ ID NO: 630979 - DNA, 22 bp, Artificial Sequence
  chemically synthesized
ctgtgtgccaagcattgttctc

SEQ ID NO: 630980 - DNA, 22 bp, Artificial Sequence
  chemically synthesized
actgtgtgccaagcattgttct

SEQ ID NO: 630981 - DNA, 22 bp, Artificial Sequence
  chemically synthesized
agcacttactgtgtgccaagca

SEQ ID NO: 630982 - DNA, 22 bp, Artificial Sequence
  chemically synthesized
gagcacttactgtgtgccaagc

SEQ ID NO: 630983 - DNA, 22 bp, Artificial Sequence
  chemically synthesized
tgagcacttactgtgtgccaag

SEQ ID NO: 630984 - DNA, 22 bp, Artificial Sequence
  chemically synthesized
ttgagcacttactgtgtgccaa

SEQ ID NO: 630985 - DNA, 22 bp, Artificial Sequence
  chemically synthesized
tttgagcacttactgtgtgcca

SEQ ID NO: 630986 - DNA, 22 bp, Artificial Sequence
  chemically synthesized
agaacaatgcttggcacacagt

SEQ ID NO: 630987 - DNA, 22 bp, Artificial Sequence
  chemically synthesized
gcgaacattttttgagcactta

SEQ ID NO: 630988 - DNA, 22 bp, Artificial Sequence
  chemically synthesized
agcgaacattttttgagcactt

SEQ ID NO: 630989 - DNA, 22 bp, Artificial Sequence
  chemically synthesized
tagcgaacattttttgagcact

SEQ ID NO: 630990 - DNA, 22 bp, Artificial Sequence
  chemically synthesized
ggcacacagtaagtgctcaaaa

SEQ ID NO: 630991 - DNA, 22 bp, Artificial Sequence
  chemically synthesized
gcacacagtaagtgctcaaaaa

SEQ ID NO: 630992 - DNA, 22 bp, Artificial Sequence
  chemically synthesized
ccattttagcgaacattttttg

SEQ ID NO: 630993 - DNA, 22 bp, Artificial Sequence
  chemically synthesized
tcccattttagcgaacattttt

SEQ ID NO: 630994 - DNA, 22 bp, Artificial Sequence
  chemically synthesized
tctcccattttagcgaacattt

SEQ ID NO: 630995 - DNA, 22 bp, Artificial Sequence
  chemically synthesized
ctctcccattttagcgaacatt

SEQ ID NO: 630996 - DNA, 22 bp, Artificial Sequence
  chemically synthesized
tctctcccattttagcgaacat

SEQ ID NO: 630997 - DNA, 22 bp, Artificial Sequence
  chemically synthesized
tttctctcccattttagcgaac

SEQ ID NO: 630998 - DNA, 22 bp, Artificial Sequence
  chemically synthesized
aaaaaatgttcgctaaaatggg

SEQ ID NO: 630999 - DNA, 22 bp, Artificial Sequence
  chemically synthesized
cgctctttctctcccattttag

SEQ ID NO: 631000 - DNA, 22 bp, Artificial Sequence
  chemically synthesized
ctacgctctttctctcccattt

SEQ ID NO: 631001 - DNA, 22 bp, Artificial Sequence
  chemically synthesized
gttcctacgctctttctctccc

SEQ ID NO: 631002 - DNA, 22 bp, Artificial Sequence
  chemically synthesized
ggttcctacgctctttctctcc

SEQ ID NO: 631003 - DNA, 22 bp, Artificial Sequence
  chemically synthesized
ttggttcctacgctctttctct

SEQ ID NO: 631004 - DNA, 22 bp, Artificial Sequence
  chemically synthesized
gctaaaatgggagagaaagagc

SEQ ID NO: 631005 - DNA, 22 bp, Artificial Sequence
  chemically synthesized
cttggttcctacgctctttctc

SEQ ID NO: 631006 - DNA, 22 bp, Artificial Sequence
  chemically synthesized
tcttggttcctacgctctttct

SEQ ID NO: 631007 - DNA, 22 bp, Artificial Sequence
  chemically synthesized
ttcttggttcctacgctctttc

SEQ ID NO: 631008 - DNA, 22 bp, Artificial Sequence
  chemically synthesized
tttcttggttcctacgctcttt

SEQ ID NO: 631009 - DNA, 22 bp, Artificial Sequence
  chemically synthesized
aaatgggagagaaagagcgtag

SEQ ID NO: 631010 - DNA, 22 bp, Artificial Sequence
  chemically synthesized
ttttcttggttcctacgctctt

SEQ ID NO: 631011 - DNA, 22 bp, Artificial Sequence
  chemically synthesized
cttttttcttggttcctacgct

SEQ ID NO: 631012 - DNA, 22 bp, Artificial Sequence
  chemically synthesized
ccttttttcttggttcctacgc

SEQ ID NO: 631013 - DNA, 22 bp, Artificial Sequence
  chemically synthesized
tttccttttttcttggttccta

SEQ ID NO: 631014 - DNA, 22 bp, Artificial Sequence
  chemically synthesized
gtttccttttttcttggttcct

SEQ ID NO: 631015 - DNA, 22 bp, Artificial Sequence
  chemically synthesized
tgtttccttttttcttggttcc

SEQ ID NO: 631016 - DNA, 22 bp, Artificial Sequence
  chemically synthesized
ttgtttccttttttcttggttc

SEQ ID NO: 631017 - DNA, 22 bp, Artificial Sequence
  chemically synthesized
cttttgtttccttttttcttgg

SEQ ID NO: 631018 - DNA, 22 bp, Artificial Sequence
  chemically synthesized
gcttttgtttccttttttcttg

SEQ ID NO: 631019 - DNA, 22 bp, Artificial Sequence
  chemically synthesized
tgcttttgtttccttttttctt

SEQ ID NO: 631020 - DNA, 22 bp, Artificial Sequence
  chemically synthesized
attttgcttttgtttccttttt

SEQ ID NO: 631021 - DNA, 22 bp, Artificial Sequence
  chemically synthesized
cattttgcttttgtttcctttt

SEQ ID NO: 631022 - DNA, 22 bp, Artificial Sequence
  chemically synthesized
ggatgacttcattttgcttttg

SEQ ID NO: 631023 - DNA, 22 bp, Artificial Sequence
  chemically synthesized
tgggatgacttcattttgcttt

SEQ ID NO: 631024 - DNA, 22 bp, Artificial Sequence
  chemically synthesized
ctgggatgacttcattttgctt

SEQ ID NO: 631025 - DNA, 22 bp, Artificial Sequence
  chemically synthesized
ttctgggatgacttcattttgc

SEQ ID NO: 631026 - DNA, 22 bp, Artificial Sequence
  chemically synthesized
ttcttctgggatgacttcattt

SEQ ID NO: 631027 - DNA, 22 bp, Artificial Sequence
  chemically synthesized
attcttctgggatgacttcatt

SEQ ID NO: 631028 - DNA, 22 bp, Artificial Sequence
  chemically synthesized
tattcttctgggatgacttcat

SEQ ID NO: 631029 - DNA, 22 bp, Artificial Sequence
  chemically synthesized
ttattcttctgggatgacttca

SEQ ID NO: 631030 - DNA, 22 bp, Artificial Sequence
  chemically synthesized
gtttttattcttctgggatgac

SEQ ID NO: 631031 - DNA, 22 bp, Artificial Sequence
  chemically synthesized
agtttttattcttctgggatga

SEQ ID NO: 631032 - DNA, 22 bp, Artificial Sequence
  chemically synthesized
ccagcgcccttagtttttattc

SEQ ID NO: 631033 - DNA, 22 bp, Artificial Sequence
  chemically synthesized
tgccagcgcccttagtttttat

SEQ ID NO: 631034 - DNA, 22 bp, Artificial Sequence
  chemically synthesized
ctgccagcgcccttagttttta

SEQ ID NO: 631035 - DNA, 22 bp, Artificial Sequence
  chemically synthesized
tctgccagcgcccttagttttt

SEQ ID NO: 631036 - DNA, 22 bp, Artificial Sequence
  chemically synthesized
gcattttctgccagcgccctta

SEQ ID NO: 631037 - DNA, 22 bp, Artificial Sequence
  chemically synthesized
agcattttctgccagcgccctt

SEQ ID NO: 631038 - DNA, 22 bp, Artificial Sequence
  chemically synthesized
caggaccttagcattttctgcc

SEQ ID NO: 631039 - DNA, 22 bp, Artificial Sequence
  chemically synthesized
ccaggaccttagcattttctgc

SEQ ID NO: 631040 - DNA, 22 bp, Artificial Sequence
  chemically synthesized
agggcgctggcagaaaatgcta

SEQ ID NO: 631041 - DNA, 22 bp, Artificial Sequence
  chemically synthesized
cacttccaggaccttagcattt

SEQ ID NO: 631042 - DNA, 22 bp, Artificial Sequence
  chemically synthesized
ccacttccaggaccttagcatt

SEQ ID NO: 631043 - DNA, 22 bp, Artificial Sequence
  chemically synthesized
ttccacttccaggaccttagca

SEQ ID NO: 631044 - DNA, 22 bp, Artificial Sequence
  chemically synthesized
cttccacttccaggaccttagc

SEQ ID NO: 631045 - DNA, 22 bp, Artificial Sequence
  chemically synthesized
tcttccacttccaggaccttag

SEQ ID NO: 631046 - DNA, 22 bp, Artificial Sequence
  chemically synthesized
gcagaaaatgctaaggtcctgg

SEQ ID NO: 631047 - DNA, 22 bp, Artificial Sequence
  chemically synthesized
aggtcctggaagtggaagaaag

SEQ ID NO: 631048 - DNA, 22 bp, Artificial Sequence
  chemically synthesized
atgagtcataaagctttcttcc

SEQ ID NO: 631049 - DNA, 22 bp, Artificial Sequence
  chemically synthesized
gaagtggaagaaagctttatga

SEQ ID NO: 631050 - DNA, 22 bp, Artificial Sequence
  chemically synthesized
aacataactgatgagtcataaa

SEQ ID NO: 631051 - DNA, 22 bp, Artificial Sequence
  chemically synthesized
gaacataactgatgagtcataa

SEQ ID NO: 631052 - DNA, 22 bp, Artificial Sequence
  chemically synthesized
gccttgaacataactgatgagt

SEQ ID NO: 631053 - DNA, 22 bp, Artificial Sequence
  chemically synthesized
agccttgaacataactgatgag

SEQ ID NO: 631054 - DNA, 22 bp, Artificial Sequence
  chemically synthesized
tatgactcatcagttatgttca

SEQ ID NO: 631055 - DNA, 22 bp, Artificial Sequence
  chemically synthesized
atgactcatcagttatgttcaa

SEQ ID NO: 631056 - DNA, 22 bp, Artificial Sequence
  chemically synthesized
tgactcatcagttatgttcaag

SEQ ID NO: 631057 - DNA, 22 bp, Artificial Sequence
  chemically synthesized
aaaataaatttagccttgaaca

SEQ ID NO: 631058 - DNA, 22 bp, Artificial Sequence
  chemically synthesized
caaaataaatttagccttgaac

SEQ ID NO: 631059 - DNA, 22 bp, Artificial Sequence
  chemically synthesized
atcagttatgttcaaggctaaa

SEQ ID NO: 631060 - DNA, 22 bp, Artificial Sequence
  chemically synthesized
acaaaatcttcaaaataaattt

SEQ ID NO: 631061 - DNA, 22 bp, Artificial Sequence
  chemically synthesized
tgttcaaggctaaatttatttt

SEQ ID NO: 631062 - DNA, 22 bp, Artificial Sequence
  chemically synthesized
aaggctaaatttattttgaaga

SEQ ID NO: 631063 - DNA, 22 bp, Artificial Sequence
  chemically synthesized
caacactaacaaaatcttcaaa

SEQ ID NO: 631064 - DNA, 22 bp, Artificial Sequence
  chemically synthesized
gcaacactaacaaaatcttcaa

SEQ ID NO: 631065 - DNA, 22 bp, Artificial Sequence
  chemically synthesized
aatttattttgaagattttgtt

SEQ ID NO: 631066 - DNA, 22 bp, Artificial Sequence
  chemically synthesized
ccatttgcaacactaacaaaat

SEQ ID NO: 631067 - DNA, 22 bp, Artificial Sequence
  chemically synthesized
attttgaagattttgttagtgt

SEQ ID NO: 631068 - DNA, 22 bp, Artificial Sequence
  chemically synthesized
ttgccatttgcaacactaacaa

SEQ ID NO: 631069 - DNA, 22 bp, Artificial Sequence
  chemically synthesized
ttttgaagattttgttagtgtt

SEQ ID NO: 631070 - DNA, 22 bp, Artificial Sequence
  chemically synthesized
tgaagattttgttagtgttgca

SEQ ID NO: 631071 - DNA, 22 bp, Artificial Sequence
  chemically synthesized
gaagattttgttagtgttgcaa

SEQ ID NO: 631072 - DNA, 22 bp, Artificial Sequence
  chemically synthesized
aagattttgttagtgttgcaaa

SEQ ID NO: 631073 - DNA, 22 bp, Artificial Sequence
  chemically synthesized
atcatctgttgccatttgcaac

SEQ ID NO: 631074 - DNA, 22 bp, Artificial Sequence
  chemically synthesized
tgttagtgttgcaaatggcaac

SEQ ID NO: 631075 - DNA, 22 bp, Artificial Sequence
  chemically synthesized
gttagtgttgcaaatggcaaca

SEQ ID NO: 631076 - DNA, 22 bp, Artificial Sequence
  chemically synthesized
ccgttcatcatctgttgccatt

SEQ ID NO: 631077 - DNA, 22 bp, Artificial Sequence
  chemically synthesized
ttagtgttgcaaatggcaacag

SEQ ID NO: 631078 - DNA, 22 bp, Artificial Sequence
  chemically synthesized
gtgttgcaaatggcaacagatg

SEQ ID NO: 631079 - DNA, 22 bp, Artificial Sequence
  chemically synthesized
gaatcctgccgttcatcatctg

SEQ ID NO: 631080 - DNA, 22 bp, Artificial Sequence
  chemically synthesized
caaatggcaacagatgatgaac

SEQ ID NO: 631081 - DNA, 22 bp, Artificial Sequence
  chemically synthesized
ggttggaatcctgccgttcatc

SEQ ID NO: 631082 - DNA, 22 bp, Artificial Sequence
  chemically synthesized
tagtccctaggttggaatcctg

SEQ ID NO: 631083 - DNA, 22 bp, Artificial Sequence
  chemically synthesized
gtagtccctaggttggaatcct

SEQ ID NO: 631084 - DNA, 22 bp, Artificial Sequence
  chemically synthesized
tgtagtccctaggttggaatcc

SEQ ID NO: 631085 - DNA, 22 bp, Artificial Sequence
  chemically synthesized
aaatggcaatcctttgtagtcc

SEQ ID NO: 631086 - DNA, 22 bp, Artificial Sequence
  chemically synthesized
aaaatggcaatcctttgtagtc

SEQ ID NO: 631087 - DNA, 22 bp, Artificial Sequence
  chemically synthesized
taaaatggcaatcctttgtagt

SEQ ID NO: 631088 - DNA, 22 bp, Artificial Sequence
  chemically synthesized
caacctagggactacaaaggat

SEQ ID NO: 631089 - DNA, 22 bp, Artificial Sequence
  chemically synthesized
tttaaaatggcaatcctttgta

SEQ ID NO: 631090 - DNA, 22 bp, Artificial Sequence
  chemically synthesized
gggactacaaaggattgccatt

SEQ ID NO: 631091 - DNA, 22 bp, Artificial Sequence
  chemically synthesized
caaaggattgccattttaaaga

SEQ ID NO: 631092 - DNA, 22 bp, Artificial Sequence
  chemically synthesized
ggagcaagaatctctttaaaat

SEQ ID NO: 631093 - DNA, 22 bp, Artificial Sequence
  chemically synthesized
gggttgggagcaagaatctctt

SEQ ID NO: 631094 - DNA, 22 bp, Artificial Sequence
  chemically synthesized
ccattttaaagagattcttgct

SEQ ID NO: 631095 - DNA, 22 bp, Artificial Sequence
  chemically synthesized
taaagagattcttgctcccaac

SEQ ID NO: 631096 - DNA, 22 bp, Artificial Sequence
  chemically synthesized
aaagagattcttgctcccaacc

SEQ ID NO: 631097 - DNA, 22 bp, Artificial Sequence
  chemically synthesized
aagagattcttgctcccaaccc

SEQ ID NO: 631098 - DNA, 22 bp, Artificial Sequence
  chemically synthesized
ttgctcccaaccccagtcttgt

SEQ ID NO: 631099 - DNA, 22 bp, Artificial Sequence
  chemically synthesized
gctcccaaccccagtcttgtcg

SEQ ID NO: 631100 - DNA, 22 bp, Artificial Sequence
  chemically synthesized
tcatcaccatgacgacaagact

SEQ ID NO: 631101 - DNA, 22 bp, Artificial Sequence
  chemically synthesized
ctcccaaccccagtcttgtcgt

SEQ ID NO: 631102 - DNA, 22 bp, Artificial Sequence
  chemically synthesized
ccaaccccagtcttgtcgtcat

SEQ ID NO: 631103 - DNA, 22 bp, Artificial Sequence
  chemically synthesized
ccgttgtcatcaccatgacgac

SEQ ID NO: 631104 - DNA, 22 bp, Artificial Sequence
  chemically synthesized
attgccgttgtcatcaccatga

SEQ ID NO: 631105 - DNA, 22 bp, Artificial Sequence
  chemically synthesized
gtcgtcatggtgatgacaacgg

SEQ ID NO: 631106 - DNA, 22 bp, Artificial Sequence
  chemically synthesized
aaatgttcattgccgttgtcat

SEQ ID NO: 631107 - DNA, 22 bp, Artificial Sequence
  chemically synthesized
tcgtcatggtgatgacaacggc

SEQ ID NO: 631108 - DNA, 22 bp, Artificial Sequence
  chemically synthesized
ctcaaatgttcattgccgttgt

SEQ ID NO: 631109 - DNA, 22 bp, Artificial Sequence
  chemically synthesized
atgaggaacattcctcaaatgt

SEQ ID NO: 631110 - DNA, 22 bp, Artificial Sequence
  chemically synthesized
cagctcatgaggaacattcctc

SEQ ID NO: 631111 - DNA, 22 bp, Artificial Sequence
  chemically synthesized
gcagctcatgaggaacattcct

SEQ ID NO: 631112 - DNA, 22 bp, Artificial Sequence
  chemically synthesized
cacttgcagctcatgaggaaca

SEQ ID NO: 631113 - DNA, 22 bp, Artificial Sequence
  chemically synthesized
tccacttgcagctcatgaggaa

SEQ ID NO: 631114 - DNA, 22 bp, Artificial Sequence
  chemically synthesized
gaggaatgttcctcatgagctg

SEQ ID NO: 631115 - DNA, 22 bp, Artificial Sequence
  chemically synthesized
aggaatgttcctcatgagctgc

SEQ ID NO: 631116 - DNA, 22 bp, Artificial Sequence
  chemically synthesized
ctcatgagctgcaagtggagag

SEQ ID NO: 631117 - DNA, 22 bp, Artificial Sequence
  chemically synthesized
atgagctgcaagtggagaggtg

SEQ ID NO: 631118 - DNA, 22 bp, Artificial Sequence
  chemically synthesized
caagtggagaggtgactaccat

SEQ ID NO: 631119 - DNA, 22 bp, Artificial Sequence
  chemically synthesized
tgtcatcatgtaaggatggtag

SEQ ID NO: 631120 - DNA, 22 bp, Artificial Sequence
  chemically synthesized
cacattgtgtcatcatgtaagg

SEQ ID NO: 631121 - DNA, 22 bp, Artificial Sequence
  chemically synthesized
ccatccttacatgatgacacaa

SEQ ID NO: 631122 - DNA, 22 bp, Artificial Sequence
  chemically synthesized
acatgatgacacaatgtgtaat

SEQ ID NO: 631123 - DNA, 22 bp, Artificial Sequence
  chemically synthesized
catgatgacacaatgtgtaata

SEQ ID NO: 631124 - DNA, 22 bp, Artificial Sequence
  chemically synthesized
tgtgtgtgcacgcgcatgtgtg

SEQ ID NO: 631125 - DNA, 22 bp, Artificial Sequence
  chemically synthesized
tgtaagaattgtgtgtgtgcac

SEQ ID NO: 631126 - DNA, 22 bp, Artificial Sequence
  chemically synthesized
gtgtaagaattgtgtgtgtgca

SEQ ID NO: 631127 - DNA, 22 bp, Artificial Sequence
  chemically synthesized
gcgtttgtgtaagaattgtgtg

SEQ ID NO: 631128 - DNA, 22 bp, Artificial Sequence
  chemically synthesized
ggcgtttgtgtaagaattgtgt

SEQ ID NO: 631129 - DNA, 22 bp, Artificial Sequence
  chemically synthesized
tgtttggcgtttgtgtaagaat

SEQ ID NO: 631130 - DNA, 22 bp, Artificial Sequence
  chemically synthesized
atgtttggcgtttgtgtaagaa

SEQ ID NO: 631131 - DNA, 22 bp, Artificial Sequence
  chemically synthesized
tatgtttggcgtttgtgtaaga

SEQ ID NO: 631132 - DNA, 22 bp, Artificial Sequence
  chemically synthesized
ttatgtttggcgtttgtgtaag

SEQ ID NO: 631133 - DNA, 22 bp, Artificial Sequence
  chemically synthesized
tttatgtttggcgtttgtgtaa

SEQ ID NO: 631134 - DNA, 22 bp, Artificial Sequence
  chemically synthesized
ctttttatgtttggcgtttgtg

SEQ ID NO: 631135 - DNA, 22 bp, Artificial Sequence
  chemically synthesized
atcctgctttttatgtttggcg

SEQ ID NO: 631136 - DNA, 22 bp, Artificial Sequence
  chemically synthesized
ttacacaaacgccaaacataaa

SEQ ID NO: 631137 - DNA, 22 bp, Artificial Sequence
  chemically synthesized
tctcatcctgctttttatgttt

SEQ ID NO: 631138 - DNA, 22 bp, Artificial Sequence
  chemically synthesized
acacaaacgccaaacataaaaa

SEQ ID NO: 631139 - DNA, 22 bp, Artificial Sequence
  chemically synthesized
cacaaacgccaaacataaaaag

SEQ ID NO: 631140 - DNA, 22 bp, Artificial Sequence
  chemically synthesized
tctgtctcatcctgctttttat

SEQ ID NO: 631141 - DNA, 22 bp, Artificial Sequence
  chemically synthesized
tgtctgtctcatcctgcttttt

SEQ ID NO: 631142 - DNA, 22 bp, Artificial Sequence
  chemically synthesized
ctgtctgtctcatcctgctttt

SEQ ID NO: 631143 - DNA, 22 bp, Artificial Sequence
  chemically synthesized
acggccatggcttctgtctgtc

SEQ ID NO: 631144 - DNA, 22 bp, Artificial Sequence
  chemically synthesized
aggctcacggccatggcttctg

SEQ ID NO: 631145 - DNA, 22 bp, Artificial Sequence
  chemically synthesized
gtgagattcaggctcacggcca

SEQ ID NO: 631146 - DNA, 22 bp, Artificial Sequence
  chemically synthesized
gaaagccaatgagagaggttag

SEQ ID NO: 631147 - DNA, 22 bp, Artificial Sequence
  chemically synthesized
aatctcactaacctctctcatt

SEQ ID NO: 631148 - DNA, 22 bp, Artificial Sequence
  chemically synthesized
actaacctctctcattggcttt

SEQ ID NO: 631149 - DNA, 22 bp, Artificial Sequence
  chemically synthesized
acctctctcattggctttccag

SEQ ID NO: 631150 - DNA, 22 bp, Artificial Sequence
  chemically synthesized
aaggaagaaatacccctggaaa

SEQ ID NO: 631151 - DNA, 22 bp, Artificial Sequence
  chemically synthesized
tctcattggctttccaggggta

SEQ ID NO: 631152 - DNA, 22 bp, Artificial Sequence
  chemically synthesized
ttaaaggaagaaatacccctgg

SEQ ID NO: 631153 - DNA, 22 bp, Artificial Sequence
  chemically synthesized
tcattggctttccaggggtatt

SEQ ID NO: 631154 - DNA, 22 bp, Artificial Sequence
  chemically synthesized
attggctttccaggggtatttc

SEQ ID NO: 631155 - DNA, 22 bp, Artificial Sequence
  chemically synthesized
ttattaaaggaagaaatacccc

SEQ ID NO: 631156 - DNA, 22 bp, Artificial Sequence
  chemically synthesized
tattattaaaggaagaaatacc

SEQ ID NO: 631157 - DNA, 22 bp, Artificial Sequence
  chemically synthesized
gctttccaggggtatttcttcc

SEQ ID NO: 631158 - DNA, 22 bp, Artificial Sequence
  chemically synthesized
tctattattaaaggaagaaata

SEQ ID NO: 631159 - DNA, 22 bp, Artificial Sequence
  chemically synthesized
tctctattattaaaggaagaaa

SEQ ID NO: 631160 - DNA, 22 bp, Artificial Sequence
  chemically synthesized
tccaggggtatttcttccttta

SEQ ID NO: 631161 - DNA, 22 bp, Artificial Sequence
  chemically synthesized
ccaggggtatttcttcctttaa

SEQ ID NO: 631162 - DNA, 22 bp, Artificial Sequence
  chemically synthesized
ctctctctattattaaaggaag

SEQ ID NO: 631163 - DNA, 22 bp, Artificial Sequence
  chemically synthesized
caggggtatttcttcctttaat

SEQ ID NO: 631164 - DNA, 22 bp, Artificial Sequence
  chemically synthesized
cctctctctattattaaaggaa

SEQ ID NO: 631165 - DNA, 22 bp, Artificial Sequence
  chemically synthesized
ttcctctctctattattaaagg

SEQ ID NO: 631166 - DNA, 22 bp, Artificial Sequence
  chemically synthesized
cctcttcctctctctattatta

SEQ ID NO: 631167 - DNA, 22 bp, Artificial Sequence
  chemically synthesized
tgcctcttcctctctctattat

SEQ ID NO: 631168 - DNA, 22 bp, Artificial Sequence
  chemically synthesized
cttcctttaataatagagagag

SEQ ID NO: 631169 - DNA, 22 bp, Artificial Sequence
  chemically synthesized
ttcctttaataatagagagagg

SEQ ID NO: 631170 - DNA, 22 bp, Artificial Sequence
  chemically synthesized
cctttaataatagagagaggaa

SEQ ID NO: 631171 - DNA, 22 bp, Artificial Sequence
  chemically synthesized
ctttaataatagagagaggaag

SEQ ID NO: 631172 - DNA, 22 bp, Artificial Sequence
  chemically synthesized
atatctctgcctcttcctctct

SEQ ID NO: 631173 - DNA, 22 bp, Artificial Sequence
  chemically synthesized
tgatatctctgcctcttcctct

SEQ ID NO: 631174 - DNA, 22 bp, Artificial Sequence
  chemically synthesized
taataatagagagaggaagagg

SEQ ID NO: 631175 - DNA, 22 bp, Artificial Sequence
  chemically synthesized
ctgatatctctgcctcttcctc

SEQ ID NO: 631176 - DNA, 22 bp, Artificial Sequence
  chemically synthesized
aataatagagagaggaagaggc

SEQ ID NO: 631177 - DNA, 22 bp, Artificial Sequence
  chemically synthesized
tctgatatctctgcctcttcct

SEQ ID NO: 631178 - DNA, 22 bp, Artificial Sequence
  chemically synthesized
ataatagagagaggaagaggca

SEQ ID NO: 631179 - DNA, 22 bp, Artificial Sequence
  chemically synthesized
cctttctgatatctctgcctct

SEQ ID NO: 631180 - DNA, 22 bp, Artificial Sequence
  chemically synthesized
ccctttctgatatctctgcctc

SEQ ID NO: 631181 - DNA, 22 bp, Artificial Sequence
  chemically synthesized
tccctttctgatatctctgcct

SEQ ID NO: 631182 - DNA, 22 bp, Artificial Sequence
  chemically synthesized
ttccctttctgatatctctgcc

SEQ ID NO: 631183 - DNA, 22 bp, Artificial Sequence
  chemically synthesized
tttccctttctgatatctctgc

SEQ ID NO: 631184 - DNA, 22 bp, Artificial Sequence
  chemically synthesized
ttttccctttctgatatctctg

SEQ ID NO: 631185 - DNA, 22 bp, Artificial Sequence
  chemically synthesized
tttttccctttctgatatctct

SEQ ID NO: 631186 - DNA, 22 bp, Artificial Sequence
  chemically synthesized
tgcatgttttttttccctttct

SEQ ID NO: 631187 - DNA, 22 bp, Artificial Sequence
  chemically synthesized
atgcatgttttttttccctttc

SEQ ID NO: 631188 - DNA, 22 bp, Artificial Sequence
  chemically synthesized
tatatttatgcatgtttttttt

SEQ ID NO: 631189 - DNA, 22 bp, Artificial Sequence
  chemically synthesized
gtatgaaattgtatatttatgc

SEQ ID NO: 631190 - DNA, 22 bp, Artificial Sequence
  chemically synthesized
gtaaaagaagcaaattggtatg

SEQ ID NO: 631191 - DNA, 22 bp, Artificial Sequence
  chemically synthesized
ggtaaaagaagcaaattggtat

SEQ ID NO: 631192 - DNA, 22 bp, Artificial Sequence
  chemically synthesized
tttggtaaaagaagcaaattgg

SEQ ID NO: 631193 - DNA, 22 bp, Artificial Sequence
  chemically synthesized
gtttggtaaaagaagcaaattg

SEQ ID NO: 631194 - DNA, 22 bp, Artificial Sequence
  chemically synthesized
cataccaatttgcttcttttac

SEQ ID NO: 631195 - DNA, 22 bp, Artificial Sequence
  chemically synthesized
aacatttgtttggtaaaagaag

SEQ ID NO: 631196 - DNA, 22 bp, Artificial Sequence
  chemically synthesized
ataccaatttgcttcttttacc

SEQ ID NO: 631197 - DNA, 22 bp, Artificial Sequence
  chemically synthesized
gcttcttttaccaaacaaatgt

SEQ ID NO: 631198 - DNA, 22 bp, Artificial Sequence
  chemically synthesized
cttcttttaccaaacaaatgtt

SEQ ID NO: 631199 - DNA, 22 bp, Artificial Sequence
  chemically synthesized
cttttaccaaacaaatgttgag

SEQ ID NO: 631200 - DNA, 22 bp, Artificial Sequence
  chemically synthesized
ttttaccaaacaaatgttgaga

SEQ ID NO: 631201 - DNA, 22 bp, Artificial Sequence
  chemically synthesized
ttaccaaacaaatgttgagatg

SEQ ID NO: 631202 - DNA, 22 bp, Artificial Sequence
  chemically synthesized
taccaaacaaatgttgagatga

SEQ ID NO: 631203 - DNA, 22 bp, Artificial Sequence
  chemically synthesized
accaaacaaatgttgagatgac

SEQ ID NO: 631204 - DNA, 22 bp, Artificial Sequence
  chemically synthesized
ccaaacaaatgttgagatgacc

SEQ ID NO: 631205 - DNA, 22 bp, Artificial Sequence
  chemically synthesized
cagcagagaataaatggtcatc

SEQ ID NO: 631206 - DNA, 22 bp, Artificial Sequence
  chemically synthesized
ccagcagagaataaatggtcat

SEQ ID NO: 631207 - DNA, 22 bp, Artificial Sequence
  chemically synthesized
tccagcagagaataaatggtca

SEQ ID NO: 631208 - DNA, 22 bp, Artificial Sequence
  chemically synthesized
ttccagcagagaataaatggtc

SEQ ID NO: 631209 - DNA, 22 bp, Artificial Sequence
  chemically synthesized
tttccagcagagaataaatggt

SEQ ID NO: 631210 - DNA, 22 bp, Artificial Sequence
  chemically synthesized
ttttccagcagagaataaatgg

SEQ ID NO: 631211 - DNA, 22 bp, Artificial Sequence
  chemically synthesized
tttttccagcagagaataaatg

SEQ ID NO: 631212 - DNA, 22 bp, Artificial Sequence
  chemically synthesized
ttttttccagcagagaataaat

SEQ ID NO: 631213 - DNA, 22 bp, Artificial Sequence
  chemically synthesized
tttttttccagcagagaataaa

SEQ ID NO: 631214 - DNA, 22 bp, Artificial Sequence
  chemically synthesized
ttttttttccagcagagaataa

SEQ ID NO: 631215 - DNA, 22 bp, Artificial Sequence
  chemically synthesized
tttttttttccagcagagaata

SEQ ID NO: 631216 - DNA, 22 bp, Artificial Sequence
  chemically synthesized
agatgaccatttattctctgct

SEQ ID NO: 631217 - DNA, 22 bp, Artificial Sequence
  chemically synthesized
ttttttttttccagcagagaat

SEQ ID NO: 631218 - DNA, 22 bp, Artificial Sequence
  chemically synthesized
tttttttttttccagcagagaa

SEQ ID NO: 631219 - DNA, 22 bp, Artificial Sequence
  chemically synthesized
ttttttttttttccagcagaga

SEQ ID NO: 631220 - DNA, 22 bp, Artificial Sequence
  chemically synthesized
tttttttttttttccagcagag

SEQ ID NO: 631221 - DNA, 22 bp, Artificial Sequence
  chemically synthesized
ttttttttttttttccagcaga

SEQ ID NO: 631222 - DNA, 22 bp, Artificial Sequence
  chemically synthesized
tttttttttttttttccagcag

SEQ ID NO: 631223 - DNA, 22 bp, Artificial Sequence
  chemically synthesized
ttttttttttttttttccagca

SEQ ID NO: 631224 - DNA, 22 bp, Artificial Sequence
  chemically synthesized
tttttttttttttttttccagc

SEQ ID NO: 631225 - DNA, 22 bp, Artificial Sequence
  chemically synthesized
ttttttttttttttttttccag

SEQ ID NO: 631226 - DNA, 22 bp, Artificial Sequence
  chemically synthesized
tttttttttttttttttttttc

SEQ ID NO: 631227 - DNA, 22 bp, Artificial Sequence
  chemically synthesized
attctctgctggaaaaaaaaaa

SEQ ID NO: 631228 - DNA, 22 bp, Artificial Sequence
  chemically synthesized
ttctctgctggaaaaaaaaaaa

SEQ ID NO: 631229 - DNA, 22 bp, Artificial Sequence
  chemically synthesized
tgtttttttttttttttttttt

SEQ ID NO: 631230 - DNA, 22 bp, Artificial Sequence
  chemically synthesized
ctgttttttttttttttttttt

SEQ ID NO: 631231 - DNA, 22 bp, Artificial Sequence
  chemically synthesized
tctgctggaaaaaaaaaaaaaa

SEQ ID NO: 631232 - DNA, 22 bp, Artificial Sequence
  chemically synthesized
tttctgtttttttttttttttt

SEQ ID NO: 631233 - DNA, 22 bp, Artificial Sequence
  chemically synthesized
tgctggaaaaaaaaaaaaaaaa

SEQ ID NO: 631234 - DNA, 22 bp, Artificial Sequence
  chemically synthesized
gtttctgttttttttttttttt

SEQ ID NO: 631235 - DNA, 22 bp, Artificial Sequence
  chemically synthesized
tgtttctgtttttttttttttt

SEQ ID NO: 631236 - DNA, 22 bp, Artificial Sequence
  chemically synthesized
ctggaaaaaaaaaaaaaaaaaa

SEQ ID NO: 631237 - DNA, 22 bp, Artificial Sequence
  chemically synthesized
ttgtttctgttttttttttttt

SEQ ID NO: 631238 - DNA, 22 bp, Artificial Sequence
  chemically synthesized
tttgtttctgtttttttttttt

SEQ ID NO: 631239 - DNA, 22 bp, Artificial Sequence
  chemically synthesized
gaaaaaaaaaaaaaaaaaaaaa

SEQ ID NO: 631240 - DNA, 22 bp, Artificial Sequence
  chemically synthesized
ggttttttgtttctgttttttt

SEQ ID NO: 631241 - DNA, 22 bp, Artificial Sequence
  chemically synthesized
gggttttttgtttctgtttttt

SEQ ID NO: 631242 - DNA, 22 bp, Artificial Sequence
  chemically synthesized
tgggttttttgtttctgttttt

SEQ ID NO: 631243 - DNA, 22 bp, Artificial Sequence
  chemically synthesized
ttgggttttttgtttctgtttt

SEQ ID NO: 631244 - DNA, 22 bp, Artificial Sequence
  chemically synthesized
gatgtgtcttttgggttttttg

SEQ ID NO: 631245 - DNA, 22 bp, Artificial Sequence
  chemically synthesized
actagatgtgtcttttgggttt

SEQ ID NO: 631246 - DNA, 22 bp, Artificial Sequence
  chemically synthesized
gactagatgtgtcttttgggtt

SEQ ID NO: 631247 - DNA, 22 bp, Artificial Sequence
  chemically synthesized
tttgactagatgtgtcttttgg

SEQ ID NO: 631248 - DNA, 22 bp, Artificial Sequence
  chemically synthesized
agtgtatgtaaaggttatttga

SEQ ID NO: 631249 - DNA, 22 bp, Artificial Sequence
  chemically synthesized
aagtgtatgtaaaggttatttg

SEQ ID NO: 631250 - DNA, 22 bp, Artificial Sequence
  chemically synthesized
atcttaagtgtatgtaaaggtt

SEQ ID NO: 631251 - DNA, 22 bp, Artificial Sequence
  chemically synthesized
gtcaaataacctttacatacac

SEQ ID NO: 631252 - DNA, 22 bp, Artificial Sequence
  chemically synthesized
cactgatcttaagtgtatgtaa

SEQ ID NO: 631253 - DNA, 22 bp, Artificial Sequence
  chemically synthesized
acactgatcttaagtgtatgta

SEQ ID NO: 631254 - DNA, 22 bp, Artificial Sequence
  chemically synthesized
tttacactgatcttaagtgtat

SEQ ID NO: 631255 - DNA, 22 bp, Artificial Sequence
  chemically synthesized
tctgtttacactgatcttaagt

SEQ ID NO: 631256 - DNA, 22 bp, Artificial Sequence
  chemically synthesized
tacatacacttaagatcagtgt

SEQ ID NO: 631257 - DNA, 22 bp, Artificial Sequence
  chemically synthesized
acatacacttaagatcagtgta

SEQ ID NO: 631258 - DNA, 22 bp, Artificial Sequence
  chemically synthesized
catacacttaagatcagtgtaa

SEQ ID NO: 631259 - DNA, 22 bp, Artificial Sequence
  chemically synthesized
gatcatgttatctgtttacact

SEQ ID NO: 631260 - DNA, 22 bp, Artificial Sequence
  chemically synthesized
tggatcatgttatctgtttaca

SEQ ID NO: 631261 - DNA, 22 bp, Artificial Sequence
  chemically synthesized
ctggatcatgttatctgtttac

SEQ ID NO: 631262 - DNA, 22 bp, Artificial Sequence
  chemically synthesized
aagatcagtgtaaacagataac

SEQ ID NO: 631263 - DNA, 22 bp, Artificial Sequence
  chemically synthesized
agatcagtgtaaacagataaca

SEQ ID NO: 631264 - DNA, 22 bp, Artificial Sequence
  chemically synthesized
caaatgacgtcttctggatcat

SEQ ID NO: 631265 - DNA, 22 bp, Artificial Sequence
  chemically synthesized
acaaatgacgtcttctggatca

SEQ ID NO: 631266 - DNA, 22 bp, Artificial Sequence
  chemically synthesized
tacaaatgacgtcttctggatc

SEQ ID NO: 631267 - DNA, 22 bp, Artificial Sequence
  chemically synthesized
tggattttacaaatgacgtctt

SEQ ID NO: 631268 - DNA, 22 bp, Artificial Sequence
  chemically synthesized
tatggattttacaaatgacgtc

SEQ ID NO: 631269 - DNA, 22 bp, Artificial Sequence
  chemically synthesized
atgcgtgaactctatggatttt

SEQ ID NO: 631270 - DNA, 22 bp, Artificial Sequence
  chemically synthesized
aatgcgtgaactctatggattt

SEQ ID NO: 631271 - DNA, 22 bp, Artificial Sequence
  chemically synthesized
gtaaaatccatagagttcacgc

SEQ ID NO: 631272 - DNA, 22 bp, Artificial Sequence
  chemically synthesized
atccagtttaatgcgtgaactc

SEQ ID NO: 631273 - DNA, 22 bp, Artificial Sequence
  chemically synthesized
taaaatccatagagttcacgca

SEQ ID NO: 631274 - DNA, 22 bp, Artificial Sequence
  chemically synthesized
catccagtttaatgcgtgaact

SEQ ID NO: 631275 - DNA, 22 bp, Artificial Sequence
  chemically synthesized
tcatccagtttaatgcgtgaac

SEQ ID NO: 631276 - DNA, 22 bp, Artificial Sequence
  chemically synthesized
tgccagttttcatccagtttaa

SEQ ID NO: 631277 - DNA, 22 bp, Artificial Sequence
  chemically synthesized
tgtgccagttttcatccagttt

SEQ ID NO: 631278 - DNA, 22 bp, Artificial Sequence
  chemically synthesized
ttctgtgccagttttcatccag

SEQ ID NO: 631279 - DNA, 22 bp, Artificial Sequence
  chemically synthesized
acgcattaaactggatgaaaac

SEQ ID NO: 631280 - DNA, 22 bp, Artificial Sequence
  chemically synthesized
tattctgtgccagttttcatcc

SEQ ID NO: 631281 - DNA, 22 bp, Artificial Sequence
  chemically synthesized
ctattctgtgccagttttcatc

SEQ ID NO: 631282 - DNA, 22 bp, Artificial Sequence
  chemically synthesized
aactggatgaaaactggcacag

SEQ ID NO: 631283 - DNA, 22 bp, Artificial Sequence
  chemically synthesized
tcagatttctattctgtgccag

SEQ ID NO: 631284 - DNA, 22 bp, Artificial Sequence
  chemically synthesized
gtcagatttctattctgtgcca

SEQ ID NO: 631285 - DNA, 22 bp, Artificial Sequence
  chemically synthesized
gatgaaaactggcacagaatag

SEQ ID NO: 631286 - DNA, 22 bp, Artificial Sequence
  chemically synthesized
gcacagaatagaaatctgacaa

SEQ ID NO: 631287 - DNA, 22 bp, Artificial Sequence
  chemically synthesized
aaaacaatgcccaatttgtcag

SEQ ID NO: 631288 - DNA, 22 bp, Artificial Sequence
  chemically synthesized
gaaaacaatgcccaatttgtca

SEQ ID NO: 631289 - DNA, 22 bp, Artificial Sequence
  chemically synthesized
tccttgaaaacaatgcccaatt

SEQ ID NO: 631290 - DNA, 22 bp, Artificial Sequence
  chemically synthesized
agttgtccttgaaaacaatgcc

SEQ ID NO: 631291 - DNA, 22 bp, Artificial Sequence
  chemically synthesized
gagttgtccttgaaaacaatgc

SEQ ID NO: 631292 - DNA, 22 bp, Artificial Sequence
  chemically synthesized
acaaattgggcattgttttcaa

SEQ ID NO: 631293 - DNA, 22 bp, Artificial Sequence
  chemically synthesized
agtttgagttgtccttgaaaac

SEQ ID NO: 631294 - DNA, 22 bp, Artificial Sequence
  chemically synthesized
ggcattgttttcaaggacaact

SEQ ID NO: 631295 - DNA, 22 bp, Artificial Sequence
  chemically synthesized
acattaagtttgagttgtcctt

SEQ ID NO: 631296 - DNA, 22 bp, Artificial Sequence
  chemically synthesized
aacattaagtttgagttgtcct

SEQ ID NO: 631297 - DNA, 22 bp, Artificial Sequence
  chemically synthesized
taacattaagtttgagttgtcc

SEQ ID NO: 631298 - DNA, 22 bp, Artificial Sequence
  chemically synthesized
ttaacattaagtttgagttgtc

SEQ ID NO: 631299 - DNA, 22 bp, Artificial Sequence
  chemically synthesized
tttaacattaagtttgagttgt

SEQ ID NO: 631300 - DNA, 22 bp, Artificial Sequence
  chemically synthesized
ttttaacattaagtttgagttg

SEQ ID NO: 631301 - DNA, 22 bp, Artificial Sequence
  chemically synthesized
tttttaacattaagtttgagtt

SEQ ID NO: 631302 - DNA, 22 bp, Artificial Sequence
  chemically synthesized
ttttcaaggacaactcaaactt

SEQ ID NO: 631303 - DNA, 22 bp, Artificial Sequence
  chemically synthesized
tcaaggacaactcaaacttaat

SEQ ID NO: 631304 - DNA, 22 bp, Artificial Sequence
  chemically synthesized
caaggacaactcaaacttaatg

SEQ ID NO: 631305 - DNA, 22 bp, Artificial Sequence
  chemically synthesized
aaggacaactcaaacttaatgt

SEQ ID NO: 631306 - DNA, 22 bp, Artificial Sequence
  chemically synthesized
agactttttttaacattaagtt

SEQ ID NO: 631307 - DNA, 22 bp, Artificial Sequence
  chemically synthesized
tgagactttttttaacattaag

SEQ ID NO: 631308 - DNA, 22 bp, Artificial Sequence
  chemically synthesized
aaacttaatgttaaaaaaagtc

SEQ ID NO: 631309 - DNA, 22 bp, Artificial Sequence
  chemically synthesized
aatgttaaaaaaagtctcagaa

SEQ ID NO: 631310 - DNA, 22 bp, Artificial Sequence
  chemically synthesized
atgttaaaaaaagtctcagaat

SEQ ID NO: 631311 - DNA, 22 bp, Artificial Sequence
  chemically synthesized
tcaagagtgaagagattctgag

SEQ ID NO: 631312 - DNA, 22 bp, Artificial Sequence
  chemically synthesized
aaaaaagtctcagaatctcttc

SEQ ID NO: 631313 - DNA, 22 bp, Artificial Sequence
  chemically synthesized
attgtcaagagtgaagagattc

SEQ ID NO: 631314 - DNA, 22 bp, Artificial Sequence
  chemically synthesized
aatgtgctgattgtcaagagtg

SEQ ID NO: 631315 - DNA, 22 bp, Artificial Sequence
  chemically synthesized
caatgtgctgattgtcaagagt

SEQ ID NO: 631316 - DNA, 22 bp, Artificial Sequence
  chemically synthesized
agaatctcttcactcttgacaa

SEQ ID NO: 631317 - DNA, 22 bp, Artificial Sequence
  chemically synthesized
tgtttcaatgtgctgattgtca

SEQ ID NO: 631318 - DNA, 22 bp, Artificial Sequence
  chemically synthesized
atgtttcaatgtgctgattgtc

SEQ ID NO: 631319 - DNA, 22 bp, Artificial Sequence
  chemically synthesized
ttcactcttgacaatcagcaca

SEQ ID NO: 631320 - DNA, 22 bp, Artificial Sequence
  chemically synthesized
tttatgtttcaatgtgctgatt

SEQ ID NO: 631321 - DNA, 22 bp, Artificial Sequence
  chemically synthesized
cactcttgacaatcagcacatt

SEQ ID NO: 631322 - DNA, 22 bp, Artificial Sequence
  chemically synthesized
actcttgacaatcagcacattg

SEQ ID NO: 631323 - DNA, 22 bp, Artificial Sequence
  chemically synthesized
ctgtttatgtttcaatgtgctg

SEQ ID NO: 631324 - DNA, 22 bp, Artificial Sequence
  chemically synthesized
ttgacaatcagcacattgaaac

SEQ ID NO: 631325 - DNA, 22 bp, Artificial Sequence
  chemically synthesized
gacaatcagcacattgaaacat

SEQ ID NO: 631326 - DNA, 22 bp, Artificial Sequence
  chemically synthesized
acaatcagcacattgaaacata

SEQ ID NO: 631327 - DNA, 22 bp, Artificial Sequence
  chemically synthesized
ggcacacagagtcaactactgt

SEQ ID NO: 631328 - DNA, 22 bp, Artificial Sequence
  chemically synthesized
gggcacacagagtcaactactg

SEQ ID NO: 631329 - DNA, 22 bp, Artificial Sequence
  chemically synthesized
tgggcacacagagtcaactact

SEQ ID NO: 631330 - DNA, 22 bp, Artificial Sequence
  chemically synthesized
aaacataaacagtagttgactc

SEQ ID NO: 631331 - DNA, 22 bp, Artificial Sequence
  chemically synthesized
atgtgcagactttgggcacaca

SEQ ID NO: 631332 - DNA, 22 bp, Artificial Sequence
  chemically synthesized
gatgtgcagactttgggcacac

SEQ ID NO: 631333 - DNA, 22 bp, Artificial Sequence
  chemically synthesized
catttgatgtgcagactttggg

SEQ ID NO: 631334 - DNA, 22 bp, Artificial Sequence
  chemically synthesized
gcatttgatgtgcagactttgg

SEQ ID NO: 631335 - DNA, 22 bp, Artificial Sequence
  chemically synthesized
actctgtgtgcccaaagtctgc

SEQ ID NO: 631336 - DNA, 22 bp, Artificial Sequence
  chemically synthesized
ccttgcatttgatgtgcagact

SEQ ID NO: 631337 - DNA, 22 bp, Artificial Sequence
  chemically synthesized
tgtgtgcccaaagtctgcacat

SEQ ID NO: 631338 - DNA, 22 bp, Artificial Sequence
  chemically synthesized
taccttgcatttgatgtgcaga

SEQ ID NO: 631339 - DNA, 22 bp, Artificial Sequence
  chemically synthesized
tgtgcccaaagtctgcacatca

SEQ ID NO: 631340 - DNA, 22 bp, Artificial Sequence
  chemically synthesized
tgtcgggttctaccttgcattt

SEQ ID NO: 631341 - DNA, 22 bp, Artificial Sequence
  chemically synthesized
tatgtcgggttctaccttgcat

SEQ ID NO: 631342 - DNA, 22 bp, Artificial Sequence
  chemically synthesized
cacatcaaatgcaaggtagaac

SEQ ID NO: 631343 - DNA, 22 bp, Artificial Sequence
  chemically synthesized
ccaagaggatggagtccagcct

SEQ ID NO: 631344 - DNA, 22 bp, Artificial Sequence
  chemically synthesized
tcccaagaggatggagtccagc

SEQ ID NO: 631345 - DNA, 22 bp, Artificial Sequence
  chemically synthesized
gactccatcctcttgggagaat

SEQ ID NO: 631346 - DNA, 22 bp, Artificial Sequence
  chemically synthesized
tcagatagaacaaattctccca

SEQ ID NO: 631347 - DNA, 22 bp, Artificial Sequence
  chemically synthesized
tatcagatagaacaaattctcc

SEQ ID NO: 631348 - DNA, 22 bp, Artificial Sequence
  chemically synthesized
ctatcagatagaacaaattctc

SEQ ID NO: 631349 - DNA, 22 bp, Artificial Sequence
  chemically synthesized
catcctcttgggagaatttgtt

SEQ ID NO: 631350 - DNA, 22 bp, Artificial Sequence
  chemically synthesized
agcttctatcagatagaacaaa

SEQ ID NO: 631351 - DNA, 22 bp, Artificial Sequence
  chemically synthesized
ttgggagaatttgttctatctg

SEQ ID NO: 631352 - DNA, 22 bp, Artificial Sequence
  chemically synthesized
gggagaatttgttctatctgat

SEQ ID NO: 631353 - DNA, 22 bp, Artificial Sequence
  chemically synthesized
ggagaatttgttctatctgata

SEQ ID NO: 631354 - DNA, 22 bp, Artificial Sequence
  chemically synthesized
gttctatctgatagaagctgag

SEQ ID NO: 631355 - DNA, 22 bp, Artificial Sequence
  chemically synthesized
atcatggaaatgctcagcttct

SEQ ID NO: 631356 - DNA, 22 bp, Artificial Sequence
  chemically synthesized
ttctatctgatagaagctgagc

SEQ ID NO: 631357 - DNA, 22 bp, Artificial Sequence
  chemically synthesized
catcatggaaatgctcagcttc

SEQ ID NO: 631358 - DNA, 22 bp, Artificial Sequence
  chemically synthesized
tatctgatagaagctgagcatt

SEQ ID NO: 631359 - DNA, 22 bp, Artificial Sequence
  chemically synthesized
tctgatagaagctgagcatttc

SEQ ID NO: 631360 - DNA, 22 bp, Artificial Sequence
  chemically synthesized
caatttcatcatggaaatgctc

SEQ ID NO: 631361 - DNA, 22 bp, Artificial Sequence
  chemically synthesized
atagaagctgagcatttccatg

SEQ ID NO: 631362 - DNA, 22 bp, Artificial Sequence
  chemically synthesized
aaatgcctccaatttcatcatg

SEQ ID NO: 631363 - DNA, 22 bp, Artificial Sequence
  chemically synthesized
tcaaatgcctccaatttcatca

SEQ ID NO: 631364 - DNA, 22 bp, Artificial Sequence
  chemically synthesized
ctcaaatgcctccaatttcatc

SEQ ID NO: 631365 - DNA, 22 bp, Artificial Sequence
  chemically synthesized
agcatttccatgatgaaattgg

SEQ ID NO: 631366 - DNA, 22 bp, Artificial Sequence
  chemically synthesized
tctcaaatgcctccaatttcat

SEQ ID NO: 631367 - DNA, 22 bp, Artificial Sequence
  chemically synthesized
ttttctcaaatgcctccaattt

SEQ ID NO: 631368 - DNA, 22 bp, Artificial Sequence
  chemically synthesized
tgttttctcaaatgcctccaat

SEQ ID NO: 631369 - DNA, 22 bp, Artificial Sequence
  chemically synthesized
ctgttttctcaaatgcctccaa

SEQ ID NO: 631370 - DNA, 22 bp, Artificial Sequence
  chemically synthesized
ccatgatgaaattggaggcatt

SEQ ID NO: 631371 - DNA, 22 bp, Artificial Sequence
  chemically synthesized
tctgttttctcaaatgcctcca

SEQ ID NO: 631372 - DNA, 22 bp, Artificial Sequence
  chemically synthesized
catgatgaaattggaggcattt

SEQ ID NO: 631373 - DNA, 22 bp, Artificial Sequence
  chemically synthesized
tttctgttttctcaaatgcctc

SEQ ID NO: 631374 - DNA, 22 bp, Artificial Sequence
  chemically synthesized
ttctttctgttttctcaaatgc

SEQ ID NO: 631375 - DNA, 22 bp, Artificial Sequence
  chemically synthesized
atctgttctttctgttttctca

SEQ ID NO: 631376 - DNA, 22 bp, Artificial Sequence
  chemically synthesized
gaggcatttgagaaaacagaaa

SEQ ID NO: 631377 - DNA, 22 bp, Artificial Sequence
  chemically synthesized
ccctcatctgttctttctgttt

SEQ ID NO: 631378 - DNA, 22 bp, Artificial Sequence
  chemically synthesized
cccctcatctgttctttctgtt

SEQ ID NO: 631379 - DNA, 22 bp, Artificial Sequence
  chemically synthesized
ttcccctcatctgttctttctg

SEQ ID NO: 631380 - DNA, 22 bp, Artificial Sequence
  chemically synthesized
cctcttcccctcatctgttctt

SEQ ID NO: 631381 - DNA, 22 bp, Artificial Sequence
  chemically synthesized
gagaaaacagaaagaacagatg

SEQ ID NO: 631382 - DNA, 22 bp, Artificial Sequence
  chemically synthesized
acctcttcccctcatctgttct

SEQ ID NO: 631383 - DNA, 22 bp, Artificial Sequence
  chemically synthesized
agaaaacagaaagaacagatga

SEQ ID NO: 631384 - DNA, 22 bp, Artificial Sequence
  chemically synthesized
ggacttacctcttcccctcatc

SEQ ID NO: 631385 - DNA, 22 bp, Artificial Sequence
  chemically synthesized
ctgggacttacctcttcccctc

SEQ ID NO: 631386 - DNA, 22 bp, Artificial Sequence
  chemically synthesized
cccattactgggacttacctct

SEQ ID NO: 631387 - DNA, 22 bp, Artificial Sequence
  chemically synthesized
gcccattactgggacttacctc

SEQ ID NO: 631388 - DNA, 22 bp, Artificial Sequence
  chemically synthesized
tggcttgcccattactgggact

SEQ ID NO: 631389 - DNA, 22 bp, Artificial Sequence
  chemically synthesized
tgtggcttgcccattactggga

SEQ ID NO: 631390 - DNA, 22 bp, Artificial Sequence
  chemically synthesized
gctctgtggcttgcccattact

SEQ ID NO: 631391 - DNA, 22 bp, Artificial Sequence
  chemically synthesized
gatctggctctgtggcttgccc

SEQ ID NO: 631392 - DNA, 22 bp, Artificial Sequence
  chemically synthesized
ctggatctggctctgtggcttg

SEQ ID NO: 631393 - DNA, 22 bp, Artificial Sequence
  chemically synthesized
attcctggatctggctctgtgg

SEQ ID NO: 631394 - DNA, 22 bp, Artificial Sequence
  chemically synthesized
gggaggaagtggaaagctcatt

SEQ ID NO: 631395 - DNA, 22 bp, Artificial Sequence
  chemically synthesized
aattggggaggaagtggaaagc

SEQ ID NO: 631396 - DNA, 22 bp, Artificial Sequence
  chemically synthesized
ctgaattggggaggaagtggaa

SEQ ID NO: 631397 - DNA, 22 bp, Artificial Sequence
  chemically synthesized
gctgaattggggaggaagtgga

SEQ ID NO: 631398 - DNA, 22 bp, Artificial Sequence
  chemically synthesized
atatttgctgaattggggagga

SEQ ID NO: 631399 - DNA, 22 bp, Artificial Sequence
  chemically synthesized
ctgatatttgctgaattgggga

SEQ ID NO: 631400 - DNA, 22 bp, Artificial Sequence
  chemically synthesized
tccacttcctccccaattcagc

SEQ ID NO: 631401 - DNA, 22 bp, Artificial Sequence
  chemically synthesized
ccacttcctccccaattcagca

SEQ ID NO: 631402 - DNA, 22 bp, Artificial Sequence
  chemically synthesized
cacttcctccccaattcagcaa

SEQ ID NO: 631403 - DNA, 22 bp, Artificial Sequence
  chemically synthesized
gtaaggctcctgatatttgctg

SEQ ID NO: 631404 - DNA, 22 bp, Artificial Sequence
  chemically synthesized
cctccccaattcagcaaatatc

SEQ ID NO: 631405 - DNA, 22 bp, Artificial Sequence
  chemically synthesized
ctccccaattcagcaaatatca

SEQ ID NO: 631406 - DNA, 22 bp, Artificial Sequence
  chemically synthesized
cctcgtaaggctcctgatattt

SEQ ID NO: 631407 - DNA, 22 bp, Artificial Sequence
  chemically synthesized
cccaattcagcaaatatcagga

SEQ ID NO: 631408 - DNA, 22 bp, Artificial Sequence
  chemically synthesized
gccattgcctcgtaaggctcct

SEQ ID NO: 631409 - DNA, 22 bp, Artificial Sequence
  chemically synthesized
agccattgcctcgtaaggctcc

SEQ ID NO: 631410 - DNA, 22 bp, Artificial Sequence
  chemically synthesized
agcaaatatcaggagccttacg

SEQ ID NO: 631411 - DNA, 22 bp, Artificial Sequence
  chemically synthesized
tagccattgcctcgtaaggctc

SEQ ID NO: 631412 - DNA, 22 bp, Artificial Sequence
  chemically synthesized
acgaggcaatggctaaagaccc

SEQ ID NO: 631413 - DNA, 22 bp, Artificial Sequence
  chemically synthesized
cgaggcaatggctaaagaccca

SEQ ID NO: 631414 - DNA, 22 bp, Artificial Sequence
  chemically synthesized
tgaatcaaggccagtgggtctt

SEQ ID NO: 631415 - DNA, 22 bp, Artificial Sequence
  chemically synthesized
aagacccactggccttgattca

SEQ ID NO: 631416 - DNA, 22 bp, Artificial Sequence
  chemically synthesized
gccttgattcatagattcctac

SEQ ID NO: 631417 - DNA, 22 bp, Artificial Sequence
  chemically synthesized
gattcatagattcctacatctg

SEQ ID NO: 631418 - DNA, 22 bp, Artificial Sequence
  chemically synthesized
attcatagattcctacatctgt

SEQ ID NO: 631419 - DNA, 22 bp, Artificial Sequence
  chemically synthesized
atagattcctacatctgtatgc

SEQ ID NO: 631420 - DNA, 22 bp, Artificial Sequence
  chemically synthesized
aaatacaaataaatgcatacag

SEQ ID NO: 631421 - DNA, 22 bp, Artificial Sequence
  chemically synthesized
gaaatacaaataaatgcataca

SEQ ID NO: 631422 - DNA, 22 bp, Artificial Sequence
  chemically synthesized
tgaaatacaaataaatgcatac

SEQ ID NO: 631423 - DNA, 22 bp, Artificial Sequence
  chemically synthesized
ttgaaatacaaataaatgcata

SEQ ID NO: 631424 - DNA, 22 bp, Artificial Sequence
  chemically synthesized
ctacatctgtatgcatttattt

SEQ ID NO: 631425 - DNA, 22 bp, Artificial Sequence
  chemically synthesized
cttttgaaatacaaataaatgc

SEQ ID NO: 631426 - DNA, 22 bp, Artificial Sequence
  chemically synthesized
catctgtatgcatttatttgta

SEQ ID NO: 631427 - DNA, 22 bp, Artificial Sequence
  chemically synthesized
tatgcatttatttgtatttcaa

SEQ ID NO: 631428 - DNA, 22 bp, Artificial Sequence
  chemically synthesized
atcagagtctacttttgaaata

SEQ ID NO: 631429 - DNA, 22 bp, Artificial Sequence
  chemically synthesized
tcatcagagtctacttttgaaa

SEQ ID NO: 631430 - DNA, 22 bp, Artificial Sequence
  chemically synthesized
ctcatcagagtctacttttgaa

SEQ ID NO: 631431 - DNA, 22 bp, Artificial Sequence
  chemically synthesized
tctcatcagagtctacttttga

SEQ ID NO: 631432 - DNA, 22 bp, Artificial Sequence
  chemically synthesized
atttgtatttcaaaagtagact

SEQ ID NO: 631433 - DNA, 22 bp, Artificial Sequence
  chemically synthesized
tttgtatttcaaaagtagactc

SEQ ID NO: 631434 - DNA, 22 bp, Artificial Sequence
  chemically synthesized
gtatttcaaaagtagactctga

SEQ ID NO: 631435 - DNA, 22 bp, Artificial Sequence
  chemically synthesized
tatttcaaaagtagactctgat

SEQ ID NO: 631436 - DNA, 22 bp, Artificial Sequence
  chemically synthesized
caaaagtagactctgatgagaa

SEQ ID NO: 631437 - DNA, 22 bp, Artificial Sequence
  chemically synthesized
tcatagaacactttctcatcag

SEQ ID NO: 631438 - DNA, 22 bp, Artificial Sequence
  chemically synthesized
aaaagtagactctgatgagaaa

SEQ ID NO: 631439 - DNA, 22 bp, Artificial Sequence
  chemically synthesized
atcatagaacactttctcatca

SEQ ID NO: 631440 - DNA, 22 bp, Artificial Sequence
  chemically synthesized
tgacttatcatagaacactttc

SEQ ID NO: 631441 - DNA, 22 bp, Artificial Sequence
  chemically synthesized
tgatgagaaagtgttctatgat

SEQ ID NO: 631442 - DNA, 22 bp, Artificial Sequence
  chemically synthesized
atgagaaagtgttctatgataa

SEQ ID NO: 631443 - DNA, 22 bp, Artificial Sequence
  chemically synthesized
tccaattatgacttatcataga

SEQ ID NO: 631444 - DNA, 22 bp, Artificial Sequence
  chemically synthesized
tgtccaattatgacttatcata

SEQ ID NO: 631445 - DNA, 22 bp, Artificial Sequence
  chemically synthesized
ctgtccaattatgacttatcat

SEQ ID NO: 631446 - DNA, 22 bp, Artificial Sequence
  chemically synthesized
tctgtccaattatgacttatca

SEQ ID NO: 631447 - DNA, 22 bp, Artificial Sequence
  chemically synthesized
ttctgtccaattatgacttatc

SEQ ID NO: 631448 - DNA, 22 bp, Artificial Sequence
  chemically synthesized
cttttctgtccaattatgactt

SEQ ID NO: 631449 - DNA, 22 bp, Artificial Sequence
  chemically synthesized
tatgataagtcataattggaca

SEQ ID NO: 631450 - DNA, 22 bp, Artificial Sequence
  chemically synthesized
tgataagtcataattggacaga

SEQ ID NO: 631451 - DNA, 22 bp, Artificial Sequence
  chemically synthesized
acatgtatggacagaagtccct

SEQ ID NO: 631452 - DNA, 22 bp, Artificial Sequence
  chemically synthesized
gacagaaaagtagggacttctg

SEQ ID NO: 631453 - DNA, 22 bp, Artificial Sequence
  chemically synthesized
ttgacatgtatggacagaagtc

SEQ ID NO: 631454 - DNA, 22 bp, Artificial Sequence
  chemically synthesized
ctgtccatacatgtcaatagcc

SEQ ID NO: 631455 - DNA, 22 bp, Artificial Sequence
  chemically synthesized
tgtccatacatgtcaatagcct

SEQ ID NO: 631456 - DNA, 22 bp, Artificial Sequence
  chemically synthesized
catgcccaagacaggctattga

SEQ ID NO: 631457 - DNA, 22 bp, Artificial Sequence
  chemically synthesized
tccatacatgtcaatagcctgt

SEQ ID NO: 631458 - DNA, 22 bp, Artificial Sequence
  chemically synthesized
aaggaaattgcatgcccaagac

SEQ ID NO: 631459 - DNA, 22 bp, Artificial Sequence
  chemically synthesized
aaaggaaattgcatgcccaaga

SEQ ID NO: 631460 - DNA, 22 bp, Artificial Sequence
  chemically synthesized
taaaggaaattgcatgcccaag

SEQ ID NO: 631461 - DNA, 22 bp, Artificial Sequence
  chemically synthesized
tcttgggcatgcaatttccttt

SEQ ID NO: 631462 - DNA, 22 bp, Artificial Sequence
  chemically synthesized
aaaaccaagattttaaaggaaa

SEQ ID NO: 631463 - DNA, 22 bp, Artificial Sequence
  chemically synthesized
gaaaaccaagattttaaaggaa

SEQ ID NO: 631464 - DNA, 22 bp, Artificial Sequence
  chemically synthesized
gggcatgcaatttcctttaaaa

SEQ ID NO: 631465 - DNA, 22 bp, Artificial Sequence
  chemically synthesized
ggcatgcaatttcctttaaaat

SEQ ID NO: 631466 - DNA, 22 bp, Artificial Sequence
  chemically synthesized
aaacagtttgaaaaccaagatt

SEQ ID NO: 631467 - DNA, 22 bp, Artificial Sequence
  chemically synthesized
cctttaaaatcttggttttcaa

SEQ ID NO: 631468 - DNA, 22 bp, Artificial Sequence
  chemically synthesized
ctttaaaatcttggttttcaaa

SEQ ID NO: 631469 - DNA, 22 bp, Artificial Sequence
  chemically synthesized
tagttaaaacagtttgaaaacc

SEQ ID NO: 631470 - DNA, 22 bp, Artificial Sequence
  chemically synthesized
taaaatcttggttttcaaactg

SEQ ID NO: 631471 - DNA, 22 bp, Artificial Sequence
  chemically synthesized
ctatagttaaaacagtttgaaa

SEQ ID NO: 631472 - DNA, 22 bp, Artificial Sequence
  chemically synthesized
aaaatcttggttttcaaactgt

SEQ ID NO: 631473 - DNA, 22 bp, Artificial Sequence
  chemically synthesized
aaatcttggttttcaaactgtt

SEQ ID NO: 631474 - DNA, 22 bp, Artificial Sequence
  chemically synthesized
ggttttcaaactgttttaacta

SEQ ID NO: 631475 - DNA, 22 bp, Artificial Sequence
  chemically synthesized
gttttcaaactgttttaactat

SEQ ID NO: 631476 - DNA, 22 bp, Artificial Sequence
  chemically synthesized
tcaaactgttttaactatagca

SEQ ID NO: 631477 - DNA, 22 bp, Artificial Sequence
  chemically synthesized
caaactgttttaactatagcaa

SEQ ID NO: 631478 - DNA, 22 bp, Artificial Sequence
  chemically synthesized
ggagatgtcccattgctatagt

SEQ ID NO: 631479 - DNA, 22 bp, Artificial Sequence
  chemically synthesized
aaactgttttaactatagcaat

SEQ ID NO: 631480 - DNA, 22 bp, Artificial Sequence
  chemically synthesized
aggagatgtcccattgctatag

SEQ ID NO: 631481 - DNA, 22 bp, Artificial Sequence
  chemically synthesized
taggagatgtcccattgctata

SEQ ID NO: 631482 - DNA, 22 bp, Artificial Sequence
  chemically synthesized
ttttaggagatgtcccattgct

SEQ ID NO: 631483 - DNA, 22 bp, Artificial Sequence
  chemically synthesized
ttttaactatagcaatgggaca

SEQ ID NO: 631484 - DNA, 22 bp, Artificial Sequence
  chemically synthesized
taactatagcaatgggacatct

SEQ ID NO: 631485 - DNA, 22 bp, Artificial Sequence
  chemically synthesized
aactatagcaatgggacatctc

SEQ ID NO: 631486 - DNA, 22 bp, Artificial Sequence
  chemically synthesized
actatagcaatgggacatctcc

SEQ ID NO: 631487 - DNA, 22 bp, Artificial Sequence
  chemically synthesized
tagcaatgggacatctcctaaa

SEQ ID NO: 631488 - DNA, 22 bp, Artificial Sequence
  chemically synthesized
catataagattgttttaggaga

SEQ ID NO: 631489 - DNA, 22 bp, Artificial Sequence
  chemically synthesized
gaattccatataagattgtttt

SEQ ID NO: 631490 - DNA, 22 bp, Artificial Sequence
  chemically synthesized
aaaatattggaattccatataa

SEQ ID NO: 631491 - DNA, 22 bp, Artificial Sequence
  chemically synthesized
ctaaaacaatcttatatggaat

SEQ ID NO: 631492 - DNA, 22 bp, Artificial Sequence
  chemically synthesized
ctcaaaatattggaattccata

SEQ ID NO: 631493 - DNA, 22 bp, Artificial Sequence
  chemically synthesized
aaacaatcttatatggaattcc

SEQ ID NO: 631494 - DNA, 22 bp, Artificial Sequence
  chemically synthesized
aactgctcaaaatattggaatt

SEQ ID NO: 631495 - DNA, 22 bp, Artificial Sequence
  chemically synthesized
gaactgctcaaaatattggaat

SEQ ID NO: 631496 - DNA, 22 bp, Artificial Sequence
  chemically synthesized
tgaactgctcaaaatattggaa

SEQ ID NO: 631497 - DNA, 22 bp, Artificial Sequence
  chemically synthesized
ctttgaactgctcaaaatattg

SEQ ID NO: 631498 - DNA, 22 bp, Artificial Sequence
  chemically synthesized
atatggaattccaatattttga

SEQ ID NO: 631499 - DNA, 22 bp, Artificial Sequence
  chemically synthesized
tatggaattccaatattttgag

SEQ ID NO: 631500 - DNA, 22 bp, Artificial Sequence
  chemically synthesized
tgctttgaactgctcaaaatat

SEQ ID NO: 631501 - DNA, 22 bp, Artificial Sequence
  chemically synthesized
acagctctgctttgaactgctc

SEQ ID NO: 631502 - DNA, 22 bp, Artificial Sequence
  chemically synthesized
tcacagctctgctttgaactgc

SEQ ID NO: 631503 - DNA, 22 bp, Artificial Sequence
  chemically synthesized
caatattttgagcagttcaaag

SEQ ID NO: 631504 - DNA, 22 bp, Artificial Sequence
  chemically synthesized
tgagcagttcaaagcagagctg

SEQ ID NO: 631505 - DNA, 22 bp, Artificial Sequence
  chemically synthesized
gagcagttcaaagcagagctgt

SEQ ID NO: 631506 - DNA, 22 bp, Artificial Sequence
  chemically synthesized
agcagttcaaagcagagctgtg

SEQ ID NO: 631507 - DNA, 22 bp, Artificial Sequence
  chemically synthesized
tacaggatctctcacagctctg

SEQ ID NO: 631508 - DNA, 22 bp, Artificial Sequence
  chemically synthesized
aaagcagagctgtgagagatcc

SEQ ID NO: 631509 - DNA, 22 bp, Artificial Sequence
  chemically synthesized
tgagagatcctgtacagcatct

SEQ ID NO: 631510 - DNA, 22 bp, Artificial Sequence
  chemically synthesized
tacagcatctccctttcccctc

SEQ ID NO: 631511 - DNA, 22 bp, Artificial Sequence
  chemically synthesized
agaatgatgggtggaggggaaa

SEQ ID NO: 631512 - DNA, 22 bp, Artificial Sequence
  chemically synthesized
gagccactgagaatgatgggtg

SEQ ID NO: 631513 - DNA, 22 bp, Artificial Sequence
  chemically synthesized
cctttcccctccacccatcatt

SEQ ID NO: 631514 - DNA, 22 bp, Artificial Sequence
  chemically synthesized
ggagccactgagaatgatgggt

SEQ ID NO: 631515 - DNA, 22 bp, Artificial Sequence
  chemically synthesized
ttggagccactgagaatgatgg

SEQ ID NO: 631516 - DNA, 22 bp, Artificial Sequence
  chemically synthesized
cttggagccactgagaatgatg

SEQ ID NO: 631517 - DNA, 22 bp, Artificial Sequence
  chemically synthesized
tcccctccacccatcattctca

SEQ ID NO: 631518 - DNA, 22 bp, Artificial Sequence
  chemically synthesized
cccctccacccatcattctcag

SEQ ID NO: 631519 - DNA, 22 bp, Artificial Sequence
  chemically synthesized
ccctccacccatcattctcagt

SEQ ID NO: 631520 - DNA, 22 bp, Artificial Sequence
  chemically synthesized
gtcttcttggagccactgagaa

SEQ ID NO: 631521 - DNA, 22 bp, Artificial Sequence
  chemically synthesized
agtcttcttggagccactgaga

SEQ ID NO: 631522 - DNA, 22 bp, Artificial Sequence
  chemically synthesized
tagtcttcttggagccactgag

SEQ ID NO: 631523 - DNA, 22 bp, Artificial Sequence
  chemically synthesized
cacccatcattctcagtggctc

SEQ ID NO: 631524 - DNA, 22 bp, Artificial Sequence
  chemically synthesized
ttagtcttcttggagccactga

SEQ ID NO: 631525 - DNA, 22 bp, Artificial Sequence
  chemically synthesized
agggagtttttagtcttcttgg

SEQ ID NO: 631526 - DNA, 22 bp, Artificial Sequence
  chemically synthesized
cagggagtttttagtcttcttg

SEQ ID NO: 631527 - DNA, 22 bp, Artificial Sequence
  chemically synthesized
tcagtggctccaagaagactaa

SEQ ID NO: 631528 - DNA, 22 bp, Artificial Sequence
  chemically synthesized
tttcagggagtttttagtcttc

SEQ ID NO: 631529 - DNA, 22 bp, Artificial Sequence
  chemically synthesized
agtggctccaagaagactaaaa

SEQ ID NO: 631530 - DNA, 22 bp, Artificial Sequence
  chemically synthesized
aaattgtttcagggagttttta

SEQ ID NO: 631531 - DNA, 22 bp, Artificial Sequence
  chemically synthesized
tcaaattgtttcagggagtttt

SEQ ID NO: 631532 - DNA, 22 bp, Artificial Sequence
  chemically synthesized
caagaagactaaaaactccctg

SEQ ID NO: 631533 - DNA, 22 bp, Artificial Sequence
  chemically synthesized
gtagttctcaaattgtttcagg

SEQ ID NO: 631534 - DNA, 22 bp, Artificial Sequence
  chemically synthesized
aaaactccctgaaacaatttga

SEQ ID NO: 631535 - DNA, 22 bp, Artificial Sequence
  chemically synthesized
cagactagtagttctcaaattg

SEQ ID NO: 631536 - DNA, 22 bp, Artificial Sequence
  chemically synthesized
attccagactagtagttctcaa

SEQ ID NO: 631537 - DNA, 22 bp, Artificial Sequence
  chemically synthesized
cctgaaacaatttgagaactac

SEQ ID NO: 631538 - DNA, 22 bp, Artificial Sequence
  chemically synthesized
cattccagactagtagttctca

SEQ ID NO: 631539 - DNA, 22 bp, Artificial Sequence
  chemically synthesized
ttcattccagactagtagttct

SEQ ID NO: 631540 - DNA, 22 bp, Artificial Sequence
  chemically synthesized
aaacaatttgagaactactagt

SEQ ID NO: 631541 - DNA, 22 bp, Artificial Sequence
  chemically synthesized
catacctcttcattccagacta

SEQ ID NO: 631542 - DNA, 22 bp, Artificial Sequence
  chemically synthesized
gagaactactagtctggaatga

SEQ ID NO: 631543 - DNA, 22 bp, Artificial Sequence
  chemically synthesized
agaactactagtctggaatgaa

SEQ ID NO: 631544 - DNA, 22 bp, Artificial Sequence
  chemically synthesized
ctagtctggaatgaagaggtat

SEQ ID NO: 631545 - DNA, 22 bp, Artificial Sequence
  chemically synthesized
gtgtcgtagctccatacctctt

SEQ ID NO: 631546 - DNA, 22 bp, Artificial Sequence
  chemically synthesized
gtctggaatgaagaggtatgga

SEQ ID NO: 631547 - DNA, 22 bp, Artificial Sequence
  chemically synthesized
ttggtgtcgtagctccatacct

SEQ ID NO: 631548 - DNA, 22 bp, Artificial Sequence
  chemically synthesized
tattggtgtcgtagctccatac

SEQ ID NO: 631549 - DNA, 22 bp, Artificial Sequence
  chemically synthesized
ctattggtgtcgtagctccata

SEQ ID NO: 631550 - DNA, 22 bp, Artificial Sequence
  chemically synthesized
gaatgaagaggtatggagctac

SEQ ID NO: 631551 - DNA, 22 bp, Artificial Sequence
  chemically synthesized
aaaggtttctattggtgtcgta

SEQ ID NO: 631552 - DNA, 22 bp, Artificial Sequence
  chemically synthesized
gaaaggtttctattggtgtcgt

SEQ ID NO: 631553 - DNA, 22 bp, Artificial Sequence
  chemically synthesized
tgaaaggtttctattggtgtcg

SEQ ID NO: 631554 - DNA, 22 bp, Artificial Sequence
  chemically synthesized
agtgagttttgaaaggtttcta

SEQ ID NO: 631555 - DNA, 22 bp, Artificial Sequence
  chemically synthesized
gagtgagttttgaaaggtttct

SEQ ID NO: 631556 - DNA, 22 bp, Artificial Sequence
  chemically synthesized
cgacaccaatagaaacctttca

SEQ ID NO: 631557 - DNA, 22 bp, Artificial Sequence
  chemically synthesized
accttgagtgagttttgaaagg

SEQ ID NO: 631558 - DNA, 22 bp, Artificial Sequence
  chemically synthesized
aaccctaaccttgagtgagttt

SEQ ID NO: 631559 - DNA, 22 bp, Artificial Sequence
  chemically synthesized
gaaccctaaccttgagtgagtt

SEQ ID NO: 631560 - DNA, 22 bp, Artificial Sequence
  chemically synthesized
tgaaccctaaccttgagtgagt

SEQ ID NO: 631561 - DNA, 22 bp, Artificial Sequence
  chemically synthesized
tcaaaactcactcaaggttagg

SEQ ID NO: 631562 - DNA, 22 bp, Artificial Sequence
  chemically synthesized
gaagttttgaaccctaaccttg

SEQ ID NO: 631563 - DNA, 22 bp, Artificial Sequence
  chemically synthesized
caaaactcactcaaggttaggg

SEQ ID NO: 631564 - DNA, 22 bp, Artificial Sequence
  chemically synthesized
aaaactcactcaaggttagggt

SEQ ID NO: 631565 - DNA, 22 bp, Artificial Sequence
  chemically synthesized
actcaaggttagggttcaaaac

SEQ ID NO: 631566 - DNA, 22 bp, Artificial Sequence
  chemically synthesized
aatgtatactagaagttttgaa

SEQ ID NO: 631567 - DNA, 22 bp, Artificial Sequence
  chemically synthesized
aaatgtatactagaagttttga

SEQ ID NO: 631568 - DNA, 22 bp, Artificial Sequence
  chemically synthesized
aaggttagggttcaaaacttct

SEQ ID NO: 631569 - DNA, 22 bp, Artificial Sequence
  chemically synthesized
tccttaaatgtatactagaagt

SEQ ID NO: 631570 - DNA, 22 bp, Artificial Sequence
  chemically synthesized
gggttcaaaacttctagtatac

SEQ ID NO: 631571 - DNA, 22 bp, Artificial Sequence
  chemically synthesized
gaaactatccttaaatgtatac

SEQ ID NO: 631572 - DNA, 22 bp, Artificial Sequence
  chemically synthesized
agaaactatccttaaatgtata

SEQ ID NO: 631573 - DNA, 22 bp, Artificial Sequence
  chemically synthesized
aaaacttctagtatacatttaa

SEQ ID NO: 631574 - DNA, 22 bp, Artificial Sequence
  chemically synthesized
ctagtatacatttaaggatagt

SEQ ID NO: 631575 - DNA, 22 bp, Artificial Sequence
  chemically synthesized
tagtatacatttaaggatagtt

SEQ ID NO: 631576 - DNA, 22 bp, Artificial Sequence
  chemically synthesized
gtatacatttaaggatagtttc

SEQ ID NO: 631577 - DNA, 22 bp, Artificial Sequence
  chemically synthesized
aaggatagtttctaagtttttc

SEQ ID NO: 631578 - DNA, 22 bp, Artificial Sequence
  chemically synthesized
aggatagtttctaagtttttct

SEQ ID NO: 631579 - DNA, 22 bp, Artificial Sequence
  chemically synthesized
ctaagtttttcttccctctctc

SEQ ID NO: 631580 - DNA, 22 bp, Artificial Sequence
  chemically synthesized
taagtttttcttccctctctcc

SEQ ID NO: 631581 - DNA, 22 bp, Artificial Sequence
  chemically synthesized
agtttttcttccctctctcctt

SEQ ID NO: 631582 - DNA, 22 bp, Artificial Sequence
  chemically synthesized
ttcttccctctctccttctctt

SEQ ID NO: 631583 - DNA, 22 bp, Artificial Sequence
  chemically synthesized
tcttccctctctccttctcttt

SEQ ID NO: 631584 - DNA, 22 bp, Artificial Sequence
  chemically synthesized
cttccctctctccttctctttc

SEQ ID NO: 631585 - DNA, 22 bp, Artificial Sequence
  chemically synthesized
ttccctctctccttctctttct

SEQ ID NO: 631586 - DNA, 22 bp, Artificial Sequence
  chemically synthesized
ccctctctccttctctttcttc

SEQ ID NO: 631587 - DNA, 22 bp, Artificial Sequence
  chemically synthesized
cctctctccttctctttcttcc

SEQ ID NO: 631588 - DNA, 22 bp, Artificial Sequence
  chemically synthesized
tctccttctctttcttccctcc

SEQ ID NO: 631589 - DNA, 22 bp, Artificial Sequence
  chemically synthesized
tccttctctttcttccctccct

SEQ ID NO: 631590 - DNA, 22 bp, Artificial Sequence
  chemically synthesized
cttctctttcttccctcccttt

SEQ ID NO: 631591 - DNA, 22 bp, Artificial Sequence
  chemically synthesized
ctctttcttccctccctttctc

SEQ ID NO: 631592 - DNA, 22 bp, Artificial Sequence
  chemically synthesized
tctttcttccctccctttctcc

SEQ ID NO: 631593 - DNA, 22 bp, Artificial Sequence
  chemically synthesized
tttcttccctccctttctcctt

SEQ ID NO: 631594 - DNA, 22 bp, Artificial Sequence
  chemically synthesized
tcttccctccctttctccttct

SEQ ID NO: 631595 - DNA, 22 bp, Artificial Sequence
  chemically synthesized
cttccctccctttctccttctc

SEQ ID NO: 631596 - DNA, 22 bp, Artificial Sequence
  chemically synthesized
ttccctccctttctccttctct

SEQ ID NO: 631597 - DNA, 22 bp, Artificial Sequence
  chemically synthesized
ccctccctttctccttctctcc

SEQ ID NO: 631598 - DNA, 22 bp, Artificial Sequence
  chemically synthesized
cctccctttctccttctctccc

SEQ ID NO: 631599 - DNA, 22 bp, Artificial Sequence
  chemically synthesized
cctttctccttctctcccttcc

SEQ ID NO: 631600 - DNA, 22 bp, Artificial Sequence
  chemically synthesized
agaaggaagagaggaagggaga

SEQ ID NO: 631601 - DNA, 22 bp, Artificial Sequence
  chemically synthesized
tctccttctctcccttcctctc

SEQ ID NO: 631602 - DNA, 22 bp, Artificial Sequence
  chemically synthesized
ctccttctctcccttcctctct

SEQ ID NO: 631603 - DNA, 22 bp, Artificial Sequence
  chemically synthesized
tccttctctcccttcctctctt

SEQ ID NO: 631604 - DNA, 22 bp, Artificial Sequence
  chemically synthesized
cttctctcccttcctctcttcc

SEQ ID NO: 631605 - DNA, 22 bp, Artificial Sequence
  chemically synthesized
ctctcccttcctctcttccttc

SEQ ID NO: 631606 - DNA, 22 bp, Artificial Sequence
  chemically synthesized
tctcccttcctctcttccttct

SEQ ID NO: 631607 - DNA, 22 bp, Artificial Sequence
  chemically synthesized
tcccttcctctcttccttctga

SEQ ID NO: 631608 - DNA, 22 bp, Artificial Sequence
  chemically synthesized
ccttcctctcttccttctgaat

SEQ ID NO: 631609 - DNA, 22 bp, Artificial Sequence
  chemically synthesized
agtcatgtaggaaattcagaag

SEQ ID NO: 631610 - DNA, 22 bp, Artificial Sequence
  chemically synthesized
cctctcttccttctgaatttcc

SEQ ID NO: 631611 - DNA, 22 bp, Artificial Sequence
  chemically synthesized
ctctcttccttctgaatttcct

SEQ ID NO: 631612 - DNA, 22 bp, Artificial Sequence
  chemically synthesized
tcttccttctgaatttcctaca

SEQ ID NO: 631613 - DNA, 22 bp, Artificial Sequence
  chemically synthesized
ttccttctgaatttcctacatg

SEQ ID NO: 631614 - DNA, 22 bp, Artificial Sequence
  chemically synthesized
ccttctgaatttcctacatgac

SEQ ID NO: 631615 - DNA, 22 bp, Artificial Sequence
  chemically synthesized
agaaatcgctgagtcatgtagg

SEQ ID NO: 631616 - DNA, 22 bp, Artificial Sequence
  chemically synthesized
cttctgaatttcctacatgact

SEQ ID NO: 631617 - DNA, 22 bp, Artificial Sequence
  chemically synthesized
ctaagaaatcgctgagtcatgt

SEQ ID NO: 631618 - DNA, 22 bp, Artificial Sequence
  chemically synthesized
ctgaatttcctacatgactcag

SEQ ID NO: 631619 - DNA, 22 bp, Artificial Sequence
  chemically synthesized
tgaatttcctacatgactcagc

SEQ ID NO: 631620 - DNA, 22 bp, Artificial Sequence
  chemically synthesized
aatttcctacatgactcagcga

SEQ ID NO: 631621 - DNA, 22 bp, Artificial Sequence
  chemically synthesized
atactcctaagaaatcgctgag

SEQ ID NO: 631622 - DNA, 22 bp, Artificial Sequence
  chemically synthesized
cctacatgactcagcgatttct

SEQ ID NO: 631623 - DNA, 22 bp, Artificial Sequence
  chemically synthesized
ctacatgactcagcgatttctt

SEQ ID NO: 631624 - DNA, 22 bp, Artificial Sequence
  chemically synthesized
catgactcagcgatttcttagg

SEQ ID NO: 631625 - DNA, 22 bp, Artificial Sequence
  chemically synthesized
aaaatctgatactcctaagaaa

SEQ ID NO: 631626 - DNA, 22 bp, Artificial Sequence
  chemically synthesized
agcgatttcttaggagtatcag

SEQ ID NO: 631627 - DNA, 22 bp, Artificial Sequence
  chemically synthesized
cgtggtcaagctgaaaatctga

SEQ ID NO: 631628 - DNA, 22 bp, Artificial Sequence
  chemically synthesized
acgtggtcaagctgaaaatctg

SEQ ID NO: 631629 - DNA, 22 bp, Artificial Sequence
  chemically synthesized
cttaggagtatcagattttcag

SEQ ID NO: 631630 - DNA, 22 bp, Artificial Sequence
  chemically synthesized
ttaggagtatcagattttcagc

SEQ ID NO: 631631 - DNA, 22 bp, Artificial Sequence
  chemically synthesized
aggagtatcagattttcagctt

SEQ ID NO: 631632 - DNA, 22 bp, Artificial Sequence
  chemically synthesized
ggagtatcagattttcagcttg

SEQ ID NO: 631633 - DNA, 22 bp, Artificial Sequence
  chemically synthesized
gcccttacgtggtcaagctgaa

SEQ ID NO: 631634 - DNA, 22 bp, Artificial Sequence
  chemically synthesized
aatacctggcccttacgtggtc

SEQ ID NO: 631635 - DNA, 22 bp, Artificial Sequence
  chemically synthesized
aaatacctggcccttacgtggt

SEQ ID NO: 631636 - DNA, 22 bp, Artificial Sequence
  chemically synthesized
tcagcttgaccacgtaagggcc

SEQ ID NO: 631637 - DNA, 22 bp, Artificial Sequence
  chemically synthesized
cagcttgaccacgtaagggcca

SEQ ID NO: 631638 - DNA, 22 bp, Artificial Sequence
  chemically synthesized
agcttgaccacgtaagggccag

SEQ ID NO: 631639 - DNA, 22 bp, Artificial Sequence
  chemically synthesized
gaccacgtaagggccaggtatt

SEQ ID NO: 631640 - DNA, 22 bp, Artificial Sequence
  chemically synthesized
aggagcatcttaaatacctggc

SEQ ID NO: 631641 - DNA, 22 bp, Artificial Sequence
  chemically synthesized
accacgtaagggccaggtattt

SEQ ID NO: 631642 - DNA, 22 bp, Artificial Sequence
  chemically synthesized
gaggagcatcttaaatacctgg

SEQ ID NO: 631643 - DNA, 22 bp, Artificial Sequence
  chemically synthesized
gcttgaggagcatcttaaatac

SEQ ID NO: 631644 - DNA, 22 bp, Artificial Sequence
  chemically synthesized
cctggcttgaggagcatcttaa

SEQ ID NO: 631645 - DNA, 22 bp, Artificial Sequence
  chemically synthesized
ccctggcttgaggagcatctta

SEQ ID NO: 631646 - DNA, 22 bp, Artificial Sequence
  chemically synthesized
tccctggcttgaggagcatctt

SEQ ID NO: 631647 - DNA, 22 bp, Artificial Sequence
  chemically synthesized
ttccctggcttgaggagcatct

SEQ ID NO: 631648 - DNA, 22 bp, Artificial Sequence
  chemically synthesized
ttttccctggcttgaggagcat

SEQ ID NO: 631649 - DNA, 22 bp, Artificial Sequence
  chemically synthesized
cctcttttccctggcttgagga

SEQ ID NO: 631650 - DNA, 22 bp, Artificial Sequence
  chemically synthesized
tccctcttttccctggcttgag

SEQ ID NO: 631651 - DNA, 22 bp, Artificial Sequence
  chemically synthesized
ctccctcttttccctggcttga

SEQ ID NO: 631652 - DNA, 22 bp, Artificial Sequence
  chemically synthesized
tctccctcttttccctggcttg

SEQ ID NO: 631653 - DNA, 22 bp, Artificial Sequence
  chemically synthesized
aagatgctcctcaagccaggga

SEQ ID NO: 631654 - DNA, 22 bp, Artificial Sequence
  chemically synthesized
ttctccctcttttccctggctt

SEQ ID NO: 631655 - DNA, 22 bp, Artificial Sequence
  chemically synthesized
agatgctcctcaagccagggaa

SEQ ID NO: 631656 - DNA, 22 bp, Artificial Sequence
  chemically synthesized
ctcaagccagggaaaagaggga

SEQ ID NO: 631657 - DNA, 22 bp, Artificial Sequence
  chemically synthesized
gtacccatttttctccctcttt

SEQ ID NO: 631658 - DNA, 22 bp, Artificial Sequence
  chemically synthesized
aagccagggaaaagagggagaa

SEQ ID NO: 631659 - DNA, 22 bp, Artificial Sequence
  chemically synthesized
aggagctagtacccatttttct

SEQ ID NO: 631660 - DNA, 22 bp, Artificial Sequence
  chemically synthesized
gtgacacccacagctgaggagc

SEQ ID NO: 631661 - DNA, 22 bp, Artificial Sequence
  chemically synthesized
ccactagtgacacccacagctg

SEQ ID NO: 631662 - DNA, 22 bp, Artificial Sequence
  chemically synthesized
gctcctcagctgtgggtgtcac

SEQ ID NO: 631663 - DNA, 22 bp, Artificial Sequence
  chemically synthesized
ctcagctgtgggtgtcactagt

SEQ ID NO: 631664 - DNA, 22 bp, Artificial Sequence
  chemically synthesized
gtatggatctcccactagtgac

SEQ ID NO: 631665 - DNA, 22 bp, Artificial Sequence
  chemically synthesized
ggtatggatctcccactagtga

SEQ ID NO: 631666 - DNA, 22 bp, Artificial Sequence
  chemically synthesized
agctgtgggtgtcactagtggg

SEQ ID NO: 631667 - DNA, 22 bp, Artificial Sequence
  chemically synthesized
tgggtgtcactagtgggagatc

SEQ ID NO: 631668 - DNA, 22 bp, Artificial Sequence
  chemically synthesized
gtgggagatccataccaaatga

SEQ ID NO: 631669 - DNA, 22 bp, Artificial Sequence
  chemically synthesized
cccaaatgatgggaacatcatt

SEQ ID NO: 631670 - DNA, 22 bp, Artificial Sequence
  chemically synthesized
ctccccaaatgatgggaacatc

SEQ ID NO: 631671 - DNA, 22 bp, Artificial Sequence
  chemically synthesized
tcctccccaaatgatgggaaca

SEQ ID NO: 631672 - DNA, 22 bp, Artificial Sequence
  chemically synthesized
ccatcatttggggaggagaaca

SEQ ID NO: 631673 - DNA, 22 bp, Artificial Sequence
  chemically synthesized
agccatcaaggaaagaatgatg

SEQ ID NO: 631674 - DNA, 22 bp, Artificial Sequence
  chemically synthesized
ggggaggagaacatcattcttt

SEQ ID NO: 631675 - DNA, 22 bp, Artificial Sequence
  chemically synthesized
cagccatcaaggaaagaatgat

SEQ ID NO: 631676 - DNA, 22 bp, Artificial Sequence
  chemically synthesized
gggaggagaacatcattctttc

SEQ ID NO: 631677 - DNA, 22 bp, Artificial Sequence
  chemically synthesized
ggatttcagccatcaaggaaag

SEQ ID NO: 631678 - DNA, 22 bp, Artificial Sequence
  chemically synthesized
atactgggatttcagccatcaa

SEQ ID NO: 631679 - DNA, 22 bp, Artificial Sequence
  chemically synthesized
tttccttgatggctgaaatccc

SEQ ID NO: 631680 - DNA, 22 bp, Artificial Sequence
  chemically synthesized
tccttgatggctgaaatcccag

SEQ ID NO: 631681 - DNA, 22 bp, Artificial Sequence
  chemically synthesized
ccttgatggctgaaatcccagt

SEQ ID NO: 631682 - DNA, 22 bp, Artificial Sequence
  chemically synthesized
cttgatggctgaaatcccagta

SEQ ID NO: 631683 - DNA, 22 bp, Artificial Sequence
  chemically synthesized
gatggctgaaatcccagtatga

SEQ ID NO: 631684 - DNA, 22 bp, Artificial Sequence
  chemically synthesized
atggctgaaatcccagtatgaa

SEQ ID NO: 631685 - DNA, 22 bp, Artificial Sequence
  chemically synthesized
aaatcccagtatgaatcactca

SEQ ID NO: 631686 - DNA, 22 bp, Artificial Sequence
  chemically synthesized
aaggaatcaaaaagaaggggtg

SEQ ID NO: 631687 - DNA, 22 bp, Artificial Sequence
  chemically synthesized
ctaaaggaatcaaaaagaaggg

SEQ ID NO: 631688 - DNA, 22 bp, Artificial Sequence
  chemically synthesized
gctaaaggaatcaaaaagaagg

SEQ ID NO: 631689 - DNA, 22 bp, Artificial Sequence
  chemically synthesized
accccttctttttgattccttt

SEQ ID NO: 631690 - DNA, 22 bp, Artificial Sequence
  chemically synthesized
aaaaaaccttgctaaaggaatc

SEQ ID NO: 631691 - DNA, 22 bp, Artificial Sequence
  chemically synthesized
aaaaaaaccttgctaaaggaat

SEQ ID NO: 631692 - DNA, 22 bp, Artificial Sequence
  chemically synthesized
taaaaaaaccttgctaaaggaa

SEQ ID NO: 631693 - DNA, 22 bp, Artificial Sequence
  chemically synthesized
ttaaaaaaaccttgctaaagga

SEQ ID NO: 631694 - DNA, 22 bp, Artificial Sequence
  chemically synthesized
tttaaaaaaaccttgctaaagg

SEQ ID NO: 631695 - DNA, 22 bp, Artificial Sequence
  chemically synthesized
ttttaaaaaaaccttgctaaag

SEQ ID NO: 631696 - DNA, 22 bp, Artificial Sequence
  chemically synthesized
ctttttgattcctttagcaagg

SEQ ID NO: 631697 - DNA, 22 bp, Artificial Sequence
  chemically synthesized
tttttgattcctttagcaaggt

SEQ ID NO: 631698 - DNA, 22 bp, Artificial Sequence
  chemically synthesized
tttgattcctttagcaaggttt

SEQ ID NO: 631699 - DNA, 22 bp, Artificial Sequence
  chemically synthesized
ttgattcctttagcaaggtttt

SEQ ID NO: 631700 - DNA, 22 bp, Artificial Sequence
  chemically synthesized
tgattcctttagcaaggttttt

SEQ ID NO: 631701 - DNA, 22 bp, Artificial Sequence
  chemically synthesized
gattcctttagcaaggtttttt

SEQ ID NO: 631702 - DNA, 22 bp, Artificial Sequence
  chemically synthesized
attcctttagcaaggttttttt

SEQ ID NO: 631703 - DNA, 22 bp, Artificial Sequence
  chemically synthesized
ctttagcaaggtttttttaaaa

SEQ ID NO: 631704 - DNA, 22 bp, Artificial Sequence
  chemically synthesized
tagcaaggtttttttaaaaaag

SEQ ID NO: 631705 - DNA, 22 bp, Artificial Sequence
  chemically synthesized
agcaaggtttttttaaaaaagt

SEQ ID NO: 631706 - DNA, 22 bp, Artificial Sequence
  chemically synthesized
gcaaggtttttttaaaaaagta

SEQ ID NO: 631707 - DNA, 22 bp, Artificial Sequence
  chemically synthesized
tgaaacataaagatactttttt

SEQ ID NO: 631708 - DNA, 22 bp, Artificial Sequence
  chemically synthesized
ttttaaaaaagtatctttatgt

SEQ ID NO: 631709 - DNA, 22 bp, Artificial Sequence
  chemically synthesized
tttaaaaaagtatctttatgtt

SEQ ID NO: 631710 - DNA, 22 bp, Artificial Sequence
  chemically synthesized
ttaaaaaagtatctttatgttt

SEQ ID NO: 631711 - DNA, 22 bp, Artificial Sequence
  chemically synthesized
taaaaaagtatctttatgtttc

SEQ ID NO: 631712 - DNA, 22 bp, Artificial Sequence
  chemically synthesized
aaaaaagtatctttatgtttca

SEQ ID NO: 631713 - DNA, 22 bp, Artificial Sequence
  chemically synthesized
aaaaagtatctttatgtttcat

SEQ ID NO: 631714 - DNA, 22 bp, Artificial Sequence
  chemically synthesized
ccaccagacagtattatgaaac

SEQ ID NO: 631715 - DNA, 22 bp, Artificial Sequence
  chemically synthesized
tgccaccagacagtattatgaa

SEQ ID NO: 631716 - DNA, 22 bp, Artificial Sequence
  chemically synthesized
attctgccaccagacagtatta

SEQ ID NO: 631717 - DNA, 22 bp, Artificial Sequence
  chemically synthesized
tatgtttcataatactgtctgg

SEQ ID NO: 631718 - DNA, 22 bp, Artificial Sequence
  chemically synthesized
atgtttcataatactgtctggt

SEQ ID NO: 631719 - DNA, 22 bp, Artificial Sequence
  chemically synthesized
tgtttcataatactgtctggtg

SEQ ID NO: 631720 - DNA, 22 bp, Artificial Sequence
  chemically synthesized
cataatactgtctggtggcaga

SEQ ID NO: 631721 - DNA, 22 bp, Artificial Sequence
  chemically synthesized
ataatactgtctggtggcagaa

SEQ ID NO: 631722 - DNA, 22 bp, Artificial Sequence
  chemically synthesized
caggggaagggaattaattctg

SEQ ID NO: 631723 - DNA, 22 bp, Artificial Sequence
  chemically synthesized
acaggggaagggaattaattct

SEQ ID NO: 631724 - DNA, 22 bp, Artificial Sequence
  chemically synthesized
tctggtggcagaattaattccc

SEQ ID NO: 631725 - DNA, 22 bp, Artificial Sequence
  chemically synthesized
gtggcagaattaattcccttcc

SEQ ID NO: 631726 - DNA, 22 bp, Artificial Sequence
  chemically synthesized
tagtcttacaggggaagggaat

SEQ ID NO: 631727 - DNA, 22 bp, Artificial Sequence
  chemically synthesized
atagtcttacaggggaagggaa

SEQ ID NO: 631728 - DNA, 22 bp, Artificial Sequence
  chemically synthesized
aagaggcttatagtcttacagg

SEQ ID NO: 631729 - DNA, 22 bp, Artificial Sequence
  chemically synthesized
attcccttcccctgtaagacta

SEQ ID NO: 631730 - DNA, 22 bp, Artificial Sequence
  chemically synthesized
ccttcccctgtaagactataag

SEQ ID NO: 631731 - DNA, 22 bp, Artificial Sequence
  chemically synthesized
cccctgtaagactataagcctc

SEQ ID NO: 631732 - DNA, 22 bp, Artificial Sequence
  chemically synthesized
ccctgtaagactataagcctct

SEQ ID NO: 631733 - DNA, 22 bp, Artificial Sequence
  chemically synthesized
taagactataagcctcttgagg

SEQ ID NO: 631734 - DNA, 22 bp, Artificial Sequence
  chemically synthesized
taagcctcttgaggacggggtc

SEQ ID NO: 631735 - DNA, 22 bp, Artificial Sequence
  chemically synthesized
ttgaggacggggtccacatgtt

SEQ ID NO: 631736 - DNA, 22 bp, Artificial Sequence
  chemically synthesized
gaggacggggtccacatgttgc

SEQ ID NO: 631737 - DNA, 22 bp, Artificial Sequence
  chemically synthesized
aggacggggtccacatgttgct

SEQ ID NO: 631738 - DNA, 22 bp, Artificial Sequence
  chemically synthesized
ggcatagagaggtggatgagca

SEQ ID NO: 631739 - DNA, 22 bp, Artificial Sequence
  chemically synthesized
ctcatccacctctctatgccca

SEQ ID NO: 631740 - DNA, 22 bp, Artificial Sequence
  chemically synthesized
atccacctctctatgcccaatg

SEQ ID NO: 631741 - DNA, 22 bp, Artificial Sequence
  chemically synthesized
tctatgcccaatgccctgtacc

SEQ ID NO: 631742 - DNA, 22 bp, Artificial Sequence
  chemically synthesized
tatgcccaatgccctgtaccgt

SEQ ID NO: 631743 - DNA, 22 bp, Artificial Sequence
  chemically synthesized
tgcccaatgccctgtaccgtat

SEQ ID NO: 631744 - DNA, 22 bp, Artificial Sequence
  chemically synthesized
tcaaataccaaaagtgtgtata

SEQ ID NO: 631745 - DNA, 22 bp, Artificial Sequence
  chemically synthesized
atcaaataccaaaagtgtgtat

SEQ ID NO: 631746 - DNA, 22 bp, Artificial Sequence
  chemically synthesized
taccgtatatacacacttttgg

SEQ ID NO: 631747 - DNA, 22 bp, Artificial Sequence
  chemically synthesized
agccagtatttatcaaatacca

SEQ ID NO: 631748 - DNA, 22 bp, Artificial Sequence
  chemically synthesized
cagccagtatttatcaaatacc

SEQ ID NO: 631749 - DNA, 22 bp, Artificial Sequence
  chemically synthesized
acttcagccagtatttatcaaa

SEQ ID NO: 631750 - DNA, 22 bp, Artificial Sequence
  chemically synthesized
ttggtatttgataaatactggc

SEQ ID NO: 631751 - DNA, 22 bp, Artificial Sequence
  chemically synthesized
tggtatttgataaatactggct

SEQ ID NO: 631752 - DNA, 22 bp, Artificial Sequence
  chemically synthesized
ccaattcacttcagccagtatt

SEQ ID NO: 631753 - DNA, 22 bp, Artificial Sequence
  chemically synthesized
ggtatttgataaatactggctg

SEQ ID NO: 631754 - DNA, 22 bp, Artificial Sequence
  chemically synthesized
accaattcacttcagccagtat

SEQ ID NO: 631755 - DNA, 22 bp, Artificial Sequence
  chemically synthesized
gtatttgataaatactggctga

SEQ ID NO: 631756 - DNA, 22 bp, Artificial Sequence
  chemically synthesized
taccaattcacttcagccagta

SEQ ID NO: 631757 - DNA, 22 bp, Artificial Sequence
  chemically synthesized
ctttaccaattcacttcagcca

SEQ ID NO: 631758 - DNA, 22 bp, Artificial Sequence
  chemically synthesized
gataaatactggctgaagtgaa

SEQ ID NO: 631759 - DNA, 22 bp, Artificial Sequence
  chemically synthesized
ctactttaccaattcacttcag

SEQ ID NO: 631760 - DNA, 22 bp, Artificial Sequence
  chemically synthesized
ataaatactggctgaagtgaat

SEQ ID NO: 631761 - DNA, 22 bp, Artificial Sequence
  chemically synthesized
gctgaagtgaattggtaaagta

SEQ ID NO: 631762 - DNA, 22 bp, Artificial Sequence
  chemically synthesized
aagtgaattggtaaagtagtag

SEQ ID NO: 631763 - DNA, 22 bp, Artificial Sequence
  chemically synthesized
gtcatgacccaactactacttt

SEQ ID NO: 631764 - DNA, 22 bp, Artificial Sequence
  chemically synthesized
ggtcatgacccaactactactt

SEQ ID NO: 631765 - DNA, 22 bp, Artificial Sequence
  chemically synthesized
ttggtcatgacccaactactac

SEQ ID NO: 631766 - DNA, 22 bp, Artificial Sequence
  chemically synthesized
ctcttggtcatgacccaactac

SEQ ID NO: 631767 - DNA, 22 bp, Artificial Sequence
  chemically synthesized
gtaaagtagtagttgggtcatg

SEQ ID NO: 631768 - DNA, 22 bp, Artificial Sequence
  chemically synthesized
taacacagaaggactcctcttg

SEQ ID NO: 631769 - DNA, 22 bp, Artificial Sequence
  chemically synthesized
ataacacagaaggactcctctt

SEQ ID NO: 631770 - DNA, 22 bp, Artificial Sequence
  chemically synthesized
ggtcatgaccaagaggagtcct

SEQ ID NO: 631771 - DNA, 22 bp, Artificial Sequence
  chemically synthesized
cttataacacagaaggactcct

SEQ ID NO: 631772 - DNA, 22 bp, Artificial Sequence
  chemically synthesized
ctgtgttataagtaacttgccc

SEQ ID NO: 631773 - DNA, 22 bp, Artificial Sequence
  chemically synthesized
tgtgttataagtaacttgccct

SEQ ID NO: 631774 - DNA, 22 bp, Artificial Sequence
  chemically synthesized
tgttataagtaacttgcccttc

SEQ ID NO: 631775 - DNA, 22 bp, Artificial Sequence
  chemically synthesized
aagtgtgccagtgaagggcaag

SEQ ID NO: 631776 - DNA, 22 bp, Artificial Sequence
  chemically synthesized
taagtaacttgcccttcactgg

SEQ ID NO: 631777 - DNA, 22 bp, Artificial Sequence
  chemically synthesized
gcatccaaactaaagtgtgcca

SEQ ID NO: 631778 - DNA, 22 bp, Artificial Sequence
  chemically synthesized
ggcatccaaactaaagtgtgcc

SEQ ID NO: 631779 - DNA, 22 bp, Artificial Sequence
  chemically synthesized
tggcatccaaactaaagtgtgc

SEQ ID NO: 631780 - DNA, 22 bp, Artificial Sequence
  chemically synthesized
gcccttcactggcacactttag

SEQ ID NO: 631781 - DNA, 22 bp, Artificial Sequence
  chemically synthesized
cccttcactggcacactttagt

SEQ ID NO: 631782 - DNA, 22 bp, Artificial Sequence
  chemically synthesized
cactggcacactttagtttgga

SEQ ID NO: 631783 - DNA, 22 bp, Artificial Sequence
  chemically synthesized
actggcacactttagtttggat

SEQ ID NO: 631784 - DNA, 22 bp, Artificial Sequence
  chemically synthesized
cccacctttggcatccaaacta

SEQ ID NO: 631785 - DNA, 22 bp, Artificial Sequence
  chemically synthesized
gcacactttagtttggatgcca

SEQ ID NO: 631786 - DNA, 22 bp, Artificial Sequence
  chemically synthesized
tagtttggatgccaaaggtggg

SEQ ID NO: 631787 - DNA, 22 bp, Artificial Sequence
  chemically synthesized
agtttggatgccaaaggtgggt

SEQ ID NO: 631788 - DNA, 22 bp, Artificial Sequence
  chemically synthesized
gtttggatgccaaaggtgggta

SEQ ID NO: 631789 - DNA, 22 bp, Artificial Sequence
  chemically synthesized
catgccgaaacaagttacccac

SEQ ID NO: 631790 - DNA, 22 bp, Artificial Sequence
  chemically synthesized
ggatgccaaaggtgggtaactt

SEQ ID NO: 631791 - DNA, 22 bp, Artificial Sequence
  chemically synthesized
gatgccaaaggtgggtaacttg

SEQ ID NO: 631792 - DNA, 22 bp, Artificial Sequence
  chemically synthesized
gaccaaagttacatgccgaaac

SEQ ID NO: 631793 - DNA, 22 bp, Artificial Sequence
  chemically synthesized
aaaactagaccaaagttacatg

SEQ ID NO: 631794 - DNA, 22 bp, Artificial Sequence
  chemically synthesized
caaaactagaccaaagttacat

SEQ ID NO: 631795 - DNA, 22 bp, Artificial Sequence
  chemically synthesized
tcaaaactagaccaaagttaca

SEQ ID NO: 631796 - DNA, 22 bp, Artificial Sequence
  chemically synthesized
gtttcggcatgtaactttggtc

SEQ ID NO: 631797 - DNA, 22 bp, Artificial Sequence
  chemically synthesized
tttcggcatgtaactttggtct

SEQ ID NO: 631798 - DNA, 22 bp, Artificial Sequence
  chemically synthesized
aagttttcaaaactagaccaaa

SEQ ID NO: 631799 - DNA, 22 bp, Artificial Sequence
  chemically synthesized
cggcatgtaactttggtctagt

SEQ ID NO: 631800 - DNA, 22 bp, Artificial Sequence
  chemically synthesized
ggcatgtaactttggtctagtt

SEQ ID NO: 631801 - DNA, 22 bp, Artificial Sequence
  chemically synthesized
aagatctcaagttttcaaaact

SEQ ID NO: 631802 - DNA, 22 bp, Artificial Sequence
  chemically synthesized
ctaaagatctcaagttttcaaa

SEQ ID NO: 631803 - DNA, 22 bp, Artificial Sequence
  chemically synthesized
cctaaagatctcaagttttcaa

SEQ ID NO: 631804 - DNA, 22 bp, Artificial Sequence
  chemically synthesized
tggtctagttttgaaaacttga

SEQ ID NO: 631805 - DNA, 22 bp, Artificial Sequence
  chemically synthesized
ggtctagttttgaaaacttgag

SEQ ID NO: 631806 - DNA, 22 bp, Artificial Sequence
  chemically synthesized
gtctagttttgaaaacttgaga

SEQ ID NO: 631807 - DNA, 22 bp, Artificial Sequence
  chemically synthesized
tccttcctaaagatctcaagtt

SEQ ID NO: 631808 - DNA, 22 bp, Artificial Sequence
  chemically synthesized
gttttgaaaacttgagatcttt

SEQ ID NO: 631809 - DNA, 22 bp, Artificial Sequence
  chemically synthesized
tgaaaacttgagatctttagga

SEQ ID NO: 631810 - DNA, 22 bp, Artificial Sequence
  chemically synthesized
gaaaacttgagatctttaggaa

SEQ ID NO: 631811 - DNA, 22 bp, Artificial Sequence
  chemically synthesized
acaacactgtccttcctaaaga

SEQ ID NO: 631812 - DNA, 22 bp, Artificial Sequence
  chemically synthesized
aaaacttgagatctttaggaag

SEQ ID NO: 631813 - DNA, 22 bp, Artificial Sequence
  chemically synthesized
taacaacactgtccttcctaaa

SEQ ID NO: 631814 - DNA, 22 bp, Artificial Sequence
  chemically synthesized
ctaacaacactgtccttcctaa

SEQ ID NO: 631815 - DNA, 22 bp, Artificial Sequence
  chemically synthesized
tctaacaacactgtccttccta

SEQ ID NO: 631816 - DNA, 22 bp, Artificial Sequence
  chemically synthesized
gagatctttaggaaggacagtg

SEQ ID NO: 631817 - DNA, 22 bp, Artificial Sequence
  chemically synthesized
agatctttaggaaggacagtgt

SEQ ID NO: 631818 - DNA, 22 bp, Artificial Sequence
  chemically synthesized
taggaaggacagtgttgttaga

SEQ ID NO: 631819 - DNA, 22 bp, Artificial Sequence
  chemically synthesized
aggaaggacagtgttgttagaa

SEQ ID NO: 631820 - DNA, 22 bp, Artificial Sequence
  chemically synthesized
aatcacatggctttctaacaac

SEQ ID NO: 631821 - DNA, 22 bp, Artificial Sequence
  chemically synthesized
ggaaggacagtgttgttagaaa

SEQ ID NO: 631822 - DNA, 22 bp, Artificial Sequence
  chemically synthesized
taaatcacatggctttctaaca

SEQ ID NO: 631823 - DNA, 22 bp, Artificial Sequence
  chemically synthesized
cattctaaatcacatggctttc

SEQ ID NO: 631824 - DNA, 22 bp, Artificial Sequence
  chemically synthesized
ttagaaagccatgtgatttaga

SEQ ID NO: 631825 - DNA, 22 bp, Artificial Sequence
  chemically synthesized
gaaagccatgtgatttagaatg

SEQ ID NO: 631826 - DNA, 22 bp, Artificial Sequence
  chemically synthesized
aagtacataaccataattacat

SEQ ID NO: 631827 - DNA, 22 bp, Artificial Sequence
  chemically synthesized
tgaagtacataaccataattac

SEQ ID NO: 631828 - DNA, 22 bp, Artificial Sequence
  chemically synthesized
cattctgaagtacataaccata

SEQ ID NO: 631829 - DNA, 22 bp, Artificial Sequence
  chemically synthesized
agaatgtaattatggttatgta

SEQ ID NO: 631830 - DNA, 22 bp, Artificial Sequence
  chemically synthesized
gaatgtaattatggttatgtac

SEQ ID NO: 631831 - DNA, 22 bp, Artificial Sequence
  chemically synthesized
tggttatgtacttcagaatgta

SEQ ID NO: 631832 - DNA, 22 bp, Artificial Sequence
  chemically synthesized
aaagaatcatcgttacattctg

SEQ ID NO: 631833 - DNA, 22 bp, Artificial Sequence
  chemically synthesized
tgtacttcagaatgtaacgatg

SEQ ID NO: 631834 - DNA, 22 bp, Artificial Sequence
  chemically synthesized
agcattcaaagaatcatcgtta

SEQ ID NO: 631835 - DNA, 22 bp, Artificial Sequence
  chemically synthesized
cagaatgtaacgatgattcttt

SEQ ID NO: 631836 - DNA, 22 bp, Artificial Sequence
  chemically synthesized
agaatgtaacgatgattctttg

SEQ ID NO: 631837 - DNA, 22 bp, Artificial Sequence
  chemically synthesized
aagatatgtatcattaagcatt

SEQ ID NO: 631838 - DNA, 22 bp, Artificial Sequence
  chemically synthesized
ctaaagatatgtatcattaagc

SEQ ID NO: 631839 - DNA, 22 bp, Artificial Sequence
  chemically synthesized
tttgaatgcttaatgatacata

SEQ ID NO: 631840 - DNA, 22 bp, Artificial Sequence
  chemically synthesized
tgaatgcttaatgatacatatc

SEQ ID NO: 631841 - DNA, 22 bp, Artificial Sequence
  chemically synthesized
gaatgcttaatgatacatatct

SEQ ID NO: 631842 - DNA, 22 bp, Artificial Sequence
  chemically synthesized
aatgcttaatgatacatatctt

SEQ ID NO: 631843 - DNA, 22 bp, Artificial Sequence
  chemically synthesized
gtgtagaattactaaagatatg

SEQ ID NO: 631844 - DNA, 22 bp, Artificial Sequence
  chemically synthesized
agtgtagaattactaaagatat

SEQ ID NO: 631845 - DNA, 22 bp, Artificial Sequence
  chemically synthesized
aatgatacatatctttagtaat

SEQ ID NO: 631846 - DNA, 22 bp, Artificial Sequence
  chemically synthesized
atgatacatatctttagtaatt

SEQ ID NO: 631847 - DNA, 22 bp, Artificial Sequence
  chemically synthesized
aatatggcttagtgtagaatta

SEQ ID NO: 631848 - DNA, 22 bp, Artificial Sequence
  chemically synthesized
tgaatatggcttagtgtagaat

SEQ ID NO: 631849 - DNA, 22 bp, Artificial Sequence
  chemically synthesized
agttctgaatatggcttagtgt

SEQ ID NO: 631850 - DNA, 22 bp, Artificial Sequence
  chemically synthesized
tagtaattctacactaagccat

SEQ ID NO: 631851 - DNA, 22 bp, Artificial Sequence
  chemically synthesized
agtaattctacactaagccata

SEQ ID NO: 631852 - DNA, 22 bp, Artificial Sequence
  chemically synthesized
gtaattctacactaagccatat

SEQ ID NO: 631853 - DNA, 22 bp, Artificial Sequence
  chemically synthesized
ataactgagttctgaatatggc

SEQ ID NO: 631854 - DNA, 22 bp, Artificial Sequence
  chemically synthesized
tacactaagccatattcagaac

SEQ ID NO: 631855 - DNA, 22 bp, Artificial Sequence
  chemically synthesized
cactaagccatattcagaactc

SEQ ID NO: 631856 - DNA, 22 bp, Artificial Sequence
  chemically synthesized
agccatattcagaactcagtta

SEQ ID NO: 631857 - DNA, 22 bp, Artificial Sequence
  chemically synthesized
agaaataatcaattgataactg

SEQ ID NO: 631858 - DNA, 22 bp, Artificial Sequence
  chemically synthesized
agaactcagttatcaattgatt

SEQ ID NO: 631859 - DNA, 22 bp, Artificial Sequence
  chemically synthesized
catattaagaaataatcaattg

SEQ ID NO: 631860 - DNA, 22 bp, Artificial Sequence
  chemically synthesized
ctacatattaagaaataatcaa

SEQ ID NO: 631861 - DNA, 22 bp, Artificial Sequence
  chemically synthesized
agttatcaattgattatttctt

SEQ ID NO: 631862 - DNA, 22 bp, Artificial Sequence
  chemically synthesized
ctgctacatattaagaaataat

SEQ ID NO: 631863 - DNA, 22 bp, Artificial Sequence
  chemically synthesized
gctgctacatattaagaaataa

SEQ ID NO: 631864 - DNA, 22 bp, Artificial Sequence
  chemically synthesized
tcaattgattatttcttaatat

SEQ ID NO: 631865 - DNA, 22 bp, Artificial Sequence
  chemically synthesized
attatttcttaatatgtagcag

SEQ ID NO: 631866 - DNA, 22 bp, Artificial Sequence
  chemically synthesized
tttcttaatatgtagcagcaaa

SEQ ID NO: 631867 - DNA, 22 bp, Artificial Sequence
  chemically synthesized
cttaatatgtagcagcaaatga

SEQ ID NO: 631868 - DNA, 22 bp, Artificial Sequence
  chemically synthesized
ttaatatgtagcagcaaatgac

SEQ ID NO: 631869 - DNA, 22 bp, Artificial Sequence
  chemically synthesized
gaacataacacaagtcatttgc

SEQ ID NO: 631870 - DNA, 22 bp, Artificial Sequence
  chemically synthesized
aatatgtagcagcaaatgactt

SEQ ID NO: 631871 - DNA, 22 bp, Artificial Sequence
  chemically synthesized
atatgtagcagcaaatgacttg

SEQ ID NO: 631872 - DNA, 22 bp, Artificial Sequence
  chemically synthesized
aagaaggatctggaacataaca

SEQ ID NO: 631873 - DNA, 22 bp, Artificial Sequence
  chemically synthesized
tgaagaaggatctggaacataa

SEQ ID NO: 631874 - DNA, 22 bp, Artificial Sequence
  chemically synthesized
ctgaagaaggatctggaacata

SEQ ID NO: 631875 - DNA, 22 bp, Artificial Sequence
  chemically synthesized
gtgttatgttccagatccttct

SEQ ID NO: 631876 - DNA, 22 bp, Artificial Sequence
  chemically synthesized
tgttatgttccagatccttctt

SEQ ID NO: 631877 - DNA, 22 bp, Artificial Sequence
  chemically synthesized
tgttccagatccttcttcagaa

SEQ ID NO: 631878 - DNA, 22 bp, Artificial Sequence
  chemically synthesized
ataaaatatggtttctgaagaa

SEQ ID NO: 631879 - DNA, 22 bp, Artificial Sequence
  chemically synthesized
cataaaatatggtttctgaaga

SEQ ID NO: 631880 - DNA, 22 bp, Artificial Sequence
  chemically synthesized
tcataaaatatggtttctgaag

SEQ ID NO: 631881 - DNA, 22 bp, Artificial Sequence
  chemically synthesized
cagatccttcttcagaaaccat

SEQ ID NO: 631882 - DNA, 22 bp, Artificial Sequence
  chemically synthesized
cttcagaaaccatattttatga

SEQ ID NO: 631883 - DNA, 22 bp, Artificial Sequence
  chemically synthesized
ggaggtccattttcataaaata

SEQ ID NO: 631884 - DNA, 22 bp, Artificial Sequence
  chemically synthesized
ttcagaaaccatattttatgaa

SEQ ID NO: 631885 - DNA, 22 bp, Artificial Sequence
  chemically synthesized
tgggaggtccattttcataaaa

SEQ ID NO: 631886 - DNA, 22 bp, Artificial Sequence
  chemically synthesized
cagaaaccatattttatgaaaa

SEQ ID NO: 631887 - DNA, 22 bp, Artificial Sequence
  chemically synthesized
agaaaccatattttatgaaaat

SEQ ID NO: 631888 - DNA, 22 bp, Artificial Sequence
  chemically synthesized
gctctgggaggtccattttcat

SEQ ID NO: 631889 - DNA, 22 bp, Artificial Sequence
  chemically synthesized
ggctctgggaggtccattttca

SEQ ID NO: 631890 - DNA, 22 bp, Artificial Sequence
  chemically synthesized
gcttggctctgggaggtccatt

SEQ ID NO: 631891 - DNA, 22 bp, Artificial Sequence
  chemically synthesized
tatgaaaatggacctcccagag

SEQ ID NO: 631892 - DNA, 22 bp, Artificial Sequence
  chemically synthesized
gagttagcttggctctgggagg

SEQ ID NO: 631893 - DNA, 22 bp, Artificial Sequence
  chemically synthesized
atgaaaatggacctcccagagc

SEQ ID NO: 631894 - DNA, 22 bp, Artificial Sequence
  chemically synthesized
tgaaaatggacctcccagagcc

SEQ ID NO: 631895 - DNA, 22 bp, Artificial Sequence
  chemically synthesized
gaagagattagagttagcttgg

SEQ ID NO: 631896 - DNA, 22 bp, Artificial Sequence
  chemically synthesized
agaagagattagagttagcttg

SEQ ID NO: 631897 - DNA, 22 bp, Artificial Sequence
  chemically synthesized
tagaagagattagagttagctt

SEQ ID NO: 631898 - DNA, 22 bp, Artificial Sequence
  chemically synthesized
ccagagccaagctaactctaat

SEQ ID NO: 631899 - DNA, 22 bp, Artificial Sequence
  chemically synthesized
actctaatctcttctaaaatcc

SEQ ID NO: 631900 - DNA, 22 bp, Artificial Sequence
  chemically synthesized
taatctcttctaaaatcctccc

SEQ ID NO: 631901 - DNA, 22 bp, Artificial Sequence
  chemically synthesized
atctcttctaaaatcctccctc

SEQ ID NO: 631902 - DNA, 22 bp, Artificial Sequence
  chemically synthesized
ttctaaaatcctccctcatcac

SEQ ID NO: 631903 - DNA, 22 bp, Artificial Sequence
  chemically synthesized
ctaaaatcctccctcatcactt

SEQ ID NO: 631904 - DNA, 22 bp, Artificial Sequence
  chemically synthesized
taaaatcctccctcatcacttg

SEQ ID NO: 631905 - DNA, 22 bp, Artificial Sequence
  chemically synthesized
aaatcctccctcatcacttggg

SEQ ID NO: 631906 - DNA, 22 bp, Artificial Sequence
  chemically synthesized
atgagtacgtggggacccaagt

SEQ ID NO: 631907 - DNA, 22 bp, Artificial Sequence
  chemically synthesized
cctcatcacttgggtccccacg

SEQ ID NO: 631908 - DNA, 22 bp, Artificial Sequence
  chemically synthesized
atcacttgggtccccacgtact

SEQ ID NO: 631909 - DNA, 22 bp, Artificial Sequence
  chemically synthesized
taatgtgttaatgagtacgtgg

SEQ ID NO: 631910 - DNA, 22 bp, Artificial Sequence
  chemically synthesized
gtaatgtgttaatgagtacgtg

SEQ ID NO: 631911 - DNA, 22 bp, Artificial Sequence
  chemically synthesized
tgtaatgtgttaatgagtacgt

SEQ ID NO: 631912 - DNA, 22 bp, Artificial Sequence
  chemically synthesized
ttgtaatgtgttaatgagtacg

SEQ ID NO: 631913 - DNA, 22 bp, Artificial Sequence
  chemically synthesized
gggtccccacgtactcattaac

SEQ ID NO: 631914 - DNA, 22 bp, Artificial Sequence
  chemically synthesized
cttttgtaatgtgttaatgagt

SEQ ID NO: 631915 - DNA, 22 bp, Artificial Sequence
  chemically synthesized
ggtccccacgtactcattaaca

SEQ ID NO: 631916 - DNA, 22 bp, Artificial Sequence
  chemically synthesized
ccttttgtaatgtgttaatgag

SEQ ID NO: 631917 - DNA, 22 bp, Artificial Sequence
  chemically synthesized
attaacacattacaaaaggaag

SEQ ID NO: 631918 - DNA, 22 bp, Artificial Sequence
  chemically synthesized
acacattacaaaaggaaggtcc

SEQ ID NO: 631919 - DNA, 22 bp, Artificial Sequence
  chemically synthesized
aagtgaaaaaaaggaccttcct

SEQ ID NO: 631920 - DNA, 22 bp, Artificial Sequence
  chemically synthesized
taaagtgaaaaaaaggaccttc

SEQ ID NO: 631921 - DNA, 22 bp, Artificial Sequence
  chemically synthesized
ctaaagtgaaaaaaaggacctt

SEQ ID NO: 631922 - DNA, 22 bp, Artificial Sequence
  chemically synthesized
tctaaagtgaaaaaaaggacct

SEQ ID NO: 631923 - DNA, 22 bp, Artificial Sequence
  chemically synthesized
ttctaaagtgaaaaaaaggacc

SEQ ID NO: 631924 - DNA, 22 bp, Artificial Sequence
  chemically synthesized
tttctaaagtgaaaaaaaggac

SEQ ID NO: 631925 - DNA, 22 bp, Artificial Sequence
  chemically synthesized
caaaaggaaggtcctttttttc

SEQ ID NO: 631926 - DNA, 22 bp, Artificial Sequence
  chemically synthesized
actttttctaaagtgaaaaaaa

SEQ ID NO: 631927 - DNA, 22 bp, Artificial Sequence
  chemically synthesized
aactttttctaaagtgaaaaaa

SEQ ID NO: 631928 - DNA, 22 bp, Artificial Sequence
  chemically synthesized
taactttttctaaagtgaaaaa

SEQ ID NO: 631929 - DNA, 22 bp, Artificial Sequence
  chemically synthesized
ttaactttttctaaagtgaaaa

SEQ ID NO: 631930 - DNA, 22 bp, Artificial Sequence
  chemically synthesized
tttttaactttttctaaagtga

SEQ ID NO: 631931 - DNA, 22 bp, Artificial Sequence
  chemically synthesized
gtttttaactttttctaaagtg

SEQ ID NO: 631932 - DNA, 22 bp, Artificial Sequence
  chemically synthesized
tttttcactttagaaaaagtta

SEQ ID NO: 631933 - DNA, 22 bp, Artificial Sequence
  chemically synthesized
ttttcactttagaaaaagttaa

SEQ ID NO: 631934 - DNA, 22 bp, Artificial Sequence
  chemically synthesized
tttcactttagaaaaagttaaa

SEQ ID NO: 631935 - DNA, 22 bp, Artificial Sequence
  chemically synthesized
ttcactttagaaaaagttaaaa

SEQ ID NO: 631936 - DNA, 22 bp, Artificial Sequence
  chemically synthesized
tcactttagaaaaagttaaaaa

SEQ ID NO: 631937 - DNA, 22 bp, Artificial Sequence
  chemically synthesized
cactttagaaaaagttaaaaac

SEQ ID NO: 631938 - DNA, 22 bp, Artificial Sequence
  chemically synthesized
actttagaaaaagttaaaaaca

SEQ ID NO: 631939 - DNA, 22 bp, Artificial Sequence
  chemically synthesized
tagaaaaagttaaaaacaaatg

SEQ ID NO: 631940 - DNA, 22 bp, Artificial Sequence
  chemically synthesized
agaaaaagttaaaaacaaatga

SEQ ID NO: 631941 - DNA, 22 bp, Artificial Sequence
  chemically synthesized
cagtagaaaatatcatttgttt

SEQ ID NO: 631942 - DNA, 22 bp, Artificial Sequence
  chemically synthesized
gaaaaagttaaaaacaaatgat

SEQ ID NO: 631943 - DNA, 22 bp, Artificial Sequence
  chemically synthesized
acagtagaaaatatcatttgtt

SEQ ID NO: 631944 - DNA, 22 bp, Artificial Sequence
  chemically synthesized
tacagtagaaaatatcatttgt

SEQ ID NO: 631945 - DNA, 22 bp, Artificial Sequence
  chemically synthesized
ttacagtagaaaatatcatttg

SEQ ID NO: 631946 - DNA, 22 bp, Artificial Sequence
  chemically synthesized
gtccttttacagtagaaaatat

SEQ ID NO: 631947 - DNA, 22 bp, Artificial Sequence
  chemically synthesized
aaaacaaatgatattttctact

SEQ ID NO: 631948 - DNA, 22 bp, Artificial Sequence
  chemically synthesized
tcagcgtagaactagtcctttt

SEQ ID NO: 631949 - DNA, 22 bp, Artificial Sequence
  chemically synthesized
gtcagcgtagaactagtccttt

SEQ ID NO: 631950 - DNA, 22 bp, Artificial Sequence
  chemically synthesized
tgtcagcgtagaactagtcctt

SEQ ID NO: 631951 - DNA, 22 bp, Artificial Sequence
  chemically synthesized
tctactgtaaaaggactagttc

SEQ ID NO: 631952 - DNA, 22 bp, Artificial Sequence
  chemically synthesized
ctactgtaaaaggactagttct

SEQ ID NO: 631953 - DNA, 22 bp, Artificial Sequence
  chemically synthesized
ttttgtcagcgtagaactagtc

SEQ ID NO: 631954 - DNA, 22 bp, Artificial Sequence
  chemically synthesized
tactgtaaaaggactagttcta

SEQ ID NO: 631955 - DNA, 22 bp, Artificial Sequence
  chemically synthesized
tgttttgtcagcgtagaactag

SEQ ID NO: 631956 - DNA, 22 bp, Artificial Sequence
  chemically synthesized
ctgtaaaaggactagttctacg

SEQ ID NO: 631957 - DNA, 22 bp, Artificial Sequence
  chemically synthesized
taaaaggactagttctacgctg

SEQ ID NO: 631958 - DNA, 22 bp, Artificial Sequence
  chemically synthesized
gttctacgctgacaaaacagag

SEQ ID NO: 631959 - DNA, 22 bp, Artificial Sequence
  chemically synthesized
taatcaagtagcctctgttttg

SEQ ID NO: 631960 - DNA, 22 bp, Artificial Sequence
  chemically synthesized
tacgctgacaaaacagaggcta

SEQ ID NO: 631961 - DNA, 22 bp, Artificial Sequence
  chemically synthesized
cgctgacaaaacagaggctact

SEQ ID NO: 631962 - DNA, 22 bp, Artificial Sequence
  chemically synthesized
aaaatgttgtaatcaagtagcc

SEQ ID NO: 631963 - DNA, 22 bp, Artificial Sequence
  chemically synthesized
aaaaatgttgtaatcaagtagc

SEQ ID NO: 631964 - DNA, 22 bp, Artificial Sequence
  chemically synthesized
acaaaacagaggctacttgatt

SEQ ID NO: 631965 - DNA, 22 bp, Artificial Sequence
  chemically synthesized
taaaaatgttgtaatcaagtag

SEQ ID NO: 631966 - DNA, 22 bp, Artificial Sequence
  chemically synthesized
ttaaaaatgttgtaatcaagta

SEQ ID NO: 631967 - DNA, 22 bp, Artificial Sequence
  chemically synthesized
cttgattacaacatttttaaaa

SEQ ID NO: 631968 - DNA, 22 bp, Artificial Sequence
  chemically synthesized
tcggtcaagaacttttaaaaat

SEQ ID NO: 631969 - DNA, 22 bp, Artificial Sequence
  chemically synthesized
atcggtcaagaacttttaaaaa

SEQ ID NO: 631970 - DNA, 22 bp, Artificial Sequence
  chemically synthesized
gattacaacatttttaaaagtt

SEQ ID NO: 631971 - DNA, 22 bp, Artificial Sequence
  chemically synthesized
attacaacatttttaaaagttc

SEQ ID NO: 631972 - DNA, 22 bp, Artificial Sequence
  chemically synthesized
tttatcggtcaagaacttttaa

SEQ ID NO: 631973 - DNA, 22 bp, Artificial Sequence
  chemically synthesized
atttatcggtcaagaactttta

SEQ ID NO: 631974 - DNA, 22 bp, Artificial Sequence
  chemically synthesized
tatttatcggtcaagaactttt

SEQ ID NO: 631975 - DNA, 22 bp, Artificial Sequence
  chemically synthesized
caacatttttaaaagttcttga

SEQ ID NO: 631976 - DNA, 22 bp, Artificial Sequence
  chemically synthesized
aaactttatttatcggtcaaga

SEQ ID NO: 631977 - DNA, 22 bp, Artificial Sequence
  chemically synthesized
ttaaaagttcttgaccgataaa

SEQ ID NO: 631978 - DNA, 22 bp, Artificial Sequence
  chemically synthesized
taaaagttcttgaccgataaat

SEQ ID NO: 631979 - DNA, 22 bp, Artificial Sequence
  chemically synthesized
aaaagttcttgaccgataaata

SEQ ID NO: 631980 - DNA, 22 bp, Artificial Sequence
  chemically synthesized
aaagttcttgaccgataaataa

SEQ ID NO: 631981 - DNA, 22 bp, Artificial Sequence
  chemically synthesized
ttgaccgataaataaagtttca

SEQ ID NO: 631982 - DNA, 22 bp, Artificial Sequence
  chemically synthesized
gaccgataaataaagtttcaga

SEQ ID NO: 631983 - DNA, 22 bp, Artificial Sequence
  chemically synthesized
accgataaataaagtttcagat

SEQ ID NO: 631984 - DNA, 22 bp, Artificial Sequence
  chemically synthesized
gaaaatgaaacatatctgaaac

SEQ ID NO: 631985 - DNA, 22 bp, Artificial Sequence
  chemically synthesized
agaaaatgaaacatatctgaaa

SEQ ID NO: 631986 - DNA, 22 bp, Artificial Sequence
  chemically synthesized
cagatatgtttcattttctaaa

SEQ ID NO: 631987 - DNA, 22 bp, Artificial Sequence
  chemically synthesized
agatatgtttcattttctaaac

SEQ ID NO: 631988 - DNA, 22 bp, Artificial Sequence
  chemically synthesized
caaaaaaaaataaatgtttaga

SEQ ID NO: 631989 - DNA, 22 bp, Artificial Sequence
  chemically synthesized
ccaaaaaaaaataaatgtttag

SEQ ID NO: 631990 - DNA, 22 bp, Artificial Sequence
  chemically synthesized
atttccaaaaaaaaataaatgt

SEQ ID NO: 631991 - DNA, 22 bp, Artificial Sequence
  chemically synthesized
cattttctaaacatttattttt

SEQ ID NO: 631992 - DNA, 22 bp, Artificial Sequence
  chemically synthesized
attttctaaacatttatttttt

SEQ ID NO: 631993 - DNA, 22 bp, Artificial Sequence
  chemically synthesized
tctaaacatttatttttttttg

SEQ ID NO: 631994 - DNA, 22 bp, Artificial Sequence
  chemically synthesized
ctaaacatttatttttttttgg

SEQ ID NO: 631995 - DNA, 22 bp, Artificial Sequence
  chemically synthesized
taaacatttatttttttttgga

SEQ ID NO: 631996 - DNA, 22 bp, Artificial Sequence
  chemically synthesized
cagaaactcatttccaaaaaaa

SEQ ID NO: 631997 - DNA, 22 bp, Artificial Sequence
  chemically synthesized
aacatttatttttttttggaaa

SEQ ID NO: 631998 - DNA, 22 bp, Artificial Sequence
  chemically synthesized
aaggtctacagaaactcatttc

SEQ ID NO: 631999 - DNA, 22 bp, Artificial Sequence
  chemically synthesized
atttttttttggaaatgagttt

SEQ ID NO: 632000 - DNA, 22 bp, Artificial Sequence
  chemically synthesized
tttttttttggaaatgagtttc

SEQ ID NO: 632001 - DNA, 22 bp, Artificial Sequence
  chemically synthesized
ttttttggaaatgagtttctgt

SEQ ID NO: 632002 - DNA, 22 bp, Artificial Sequence
  chemically synthesized
tttttggaaatgagtttctgta

SEQ ID NO: 632003 - DNA, 22 bp, Artificial Sequence
  chemically synthesized
taactgaaggtctacagaaact

SEQ ID NO: 632004 - DNA, 22 bp, Artificial Sequence
  chemically synthesized
ttttggaaatgagtttctgtag

SEQ ID NO: 632005 - DNA, 22 bp, Artificial Sequence
  chemically synthesized
tttggaaatgagtttctgtaga

SEQ ID NO: 632006 - DNA, 22 bp, Artificial Sequence
  chemically synthesized
ttggaaatgagtttctgtagac

SEQ ID NO: 632007 - DNA, 22 bp, Artificial Sequence
  chemically synthesized
tggaaatgagtttctgtagacc

SEQ ID NO: 632008 - DNA, 22 bp, Artificial Sequence
  chemically synthesized
ggaaatgagtttctgtagacct

SEQ ID NO: 632009 - DNA, 22 bp, Artificial Sequence
  chemically synthesized
gaaatgagtttctgtagacctt

SEQ ID NO: 632010 - DNA, 22 bp, Artificial Sequence
  chemically synthesized
ccagatggacactgtaactgaa

SEQ ID NO: 632011 - DNA, 22 bp, Artificial Sequence
  chemically synthesized
ctgtagaccttcagttacagtg

SEQ ID NO: 632012 - DNA, 22 bp, Artificial Sequence
  chemically synthesized
tgtagaccttcagttacagtgt

SEQ ID NO: 632013 - DNA, 22 bp, Artificial Sequence
  chemically synthesized
tagaccttcagttacagtgtcc

SEQ ID NO: 632014 - DNA, 22 bp, Artificial Sequence
  chemically synthesized
cagttacagtgtccatctggca

SEQ ID NO: 632015 - DNA, 22 bp, Artificial Sequence
  chemically synthesized
agttacagtgtccatctggcaa

SEQ ID NO: 632016 - DNA, 22 bp, Artificial Sequence
  chemically synthesized
acaacacatcacattgccagat

SEQ ID NO: 632017 - DNA, 22 bp, Artificial Sequence
  chemically synthesized
ctgacaacacatcacattgcca

SEQ ID NO: 632018 - DNA, 22 bp, Artificial Sequence
  chemically synthesized
cagtgtccatctggcaatgtga

SEQ ID NO: 632019 - DNA, 22 bp, Artificial Sequence
  chemically synthesized
cctgacaacacatcacattgcc

SEQ ID NO: 632020 - DNA, 22 bp, Artificial Sequence
  chemically synthesized
atttcctgacaacacatcacat

SEQ ID NO: 632021 - DNA, 22 bp, Artificial Sequence
  chemically synthesized
attcatttcctgacaacacatc

SEQ ID NO: 632022 - DNA, 22 bp, Artificial Sequence
  chemically synthesized
gattcatttcctgacaacacat

SEQ ID NO: 632023 - DNA, 22 bp, Artificial Sequence
  chemically synthesized
gcaatgtgatgtgttgtcagga

SEQ ID NO: 632024 - DNA, 22 bp, Artificial Sequence
  chemically synthesized
tcttgattcatttcctgacaac

SEQ ID NO: 632025 - DNA, 22 bp, Artificial Sequence
  chemically synthesized
gtcttgattcatttcctgacaa

SEQ ID NO: 632026 - DNA, 22 bp, Artificial Sequence
  chemically synthesized
tgtcttgattcatttcctgaca

SEQ ID NO: 632027 - DNA, 22 bp, Artificial Sequence
  chemically synthesized
ttgtcttgattcatttcctgac

SEQ ID NO: 632028 - DNA, 22 bp, Artificial Sequence
  chemically synthesized
ccttttgtcttgattcatttcc

SEQ ID NO: 632029 - DNA, 22 bp, Artificial Sequence
  chemically synthesized
cccttttgtcttgattcatttc

SEQ ID NO: 632030 - DNA, 22 bp, Artificial Sequence
  chemically synthesized
tcaggaaatgaatcaagacaaa

SEQ ID NO: 632031 - DNA, 22 bp, Artificial Sequence
  chemically synthesized
ccccagcacacttcccttttgt

SEQ ID NO: 632032 - DNA, 22 bp, Artificial Sequence
  chemically synthesized
aggactgccccagcacacttcc

SEQ ID NO: 632033 - DNA, 22 bp, Artificial Sequence
  chemically synthesized
gactcaggactgccccagcaca

SEQ ID NO: 632034 - DNA, 22 bp, Artificial Sequence
  chemically synthesized
agactcaggactgccccagcac

SEQ ID NO: 632035 - DNA, 22 bp, Artificial Sequence
  chemically synthesized
tttagactcaggactgccccag

SEQ ID NO: 632036 - DNA, 22 bp, Artificial Sequence
  chemically synthesized
atttagactcaggactgcccca

SEQ ID NO: 632037 - DNA, 22 bp, Artificial Sequence
  chemically synthesized
tatttagactcaggactgcccc

SEQ ID NO: 632038 - DNA, 22 bp, Artificial Sequence
  chemically synthesized
accaagccctttatttagactc

SEQ ID NO: 632039 - DNA, 22 bp, Artificial Sequence
  chemically synthesized
gggcagtcctgagtctaaataa

SEQ ID NO: 632040 - DNA, 22 bp, Artificial Sequence
  chemically synthesized
gggacctgaccaagccctttat

SEQ ID NO: 632041 - DNA, 22 bp, Artificial Sequence
  chemically synthesized
tcgggacctgaccaagcccttt

SEQ ID NO: 632042 - DNA, 22 bp, Artificial Sequence
  chemically synthesized
ctcgggacctgaccaagccctt

SEQ ID NO: 632043 - DNA, 22 bp, Artificial Sequence
  chemically synthesized
agtctaaataaagggcttggtc

SEQ ID NO: 632044 - DNA, 22 bp, Artificial Sequence
  chemically synthesized
gacttctcgggacctgaccaag

SEQ ID NO: 632045 - DNA, 22 bp, Artificial Sequence
  chemically synthesized
aataaagggcttggtcaggtcc

SEQ ID NO: 632046 - DNA, 22 bp, Artificial Sequence
  chemically synthesized
ggtcaggtcccgagaagtctaa

SEQ ID NO: 632047 - DNA, 22 bp, Artificial Sequence
  chemically synthesized
gtcaggtcccgagaagtctaat

SEQ ID NO: 632048 - DNA, 22 bp, Artificial Sequence
  chemically synthesized
tagtgcccgaggaaattagact

SEQ ID NO: 632049 - DNA, 22 bp, Artificial Sequence
  chemically synthesized
atagtgcccgaggaaattagac

SEQ ID NO: 632050 - DNA, 22 bp, Artificial Sequence
  chemically synthesized
tatagtgcccgaggaaattaga

SEQ ID NO: 632051 - DNA, 22 bp, Artificial Sequence
  chemically synthesized
atttcctcgggcactataaaat

SEQ ID NO: 632052 - DNA, 22 bp, Artificial Sequence
  chemically synthesized
caatcaataatgtcaattttat

SEQ ID NO: 632053 - DNA, 22 bp, Artificial Sequence
  chemically synthesized
cctcgggcactataaaattgac

SEQ ID NO: 632054 - DNA, 22 bp, Artificial Sequence
  chemically synthesized
ctcgggcactataaaattgaca

SEQ ID NO: 632055 - DNA, 22 bp, Artificial Sequence
  chemically synthesized
gggcactataaaattgacatta

SEQ ID NO: 632056 - DNA, 22 bp, Artificial Sequence
  chemically synthesized
taaaattgacattattgattgt

SEQ ID NO: 632057 - DNA, 22 bp, Artificial Sequence
  chemically synthesized
aaataatgaattacaatcaata

SEQ ID NO: 632058 - DNA, 22 bp, Artificial Sequence
  chemically synthesized
taaaataatgaattacaatcaa

SEQ ID NO: 632059 - DNA, 22 bp, Artificial Sequence
  chemically synthesized
acattattgattgtaattcatt

SEQ ID NO: 632060 - DNA, 22 bp, Artificial Sequence
  chemically synthesized
caactctaaaataatgaattac

SEQ ID NO: 632061 - DNA, 22 bp, Artificial Sequence
  chemically synthesized
ttgattgtaattcattatttta

SEQ ID NO: 632062 - DNA, 22 bp, Artificial Sequence
  chemically synthesized
caattccaactctaaaataatg

SEQ ID NO: 632063 - DNA, 22 bp, Artificial Sequence
  chemically synthesized
attgtaattcattattttagag

SEQ ID NO: 632064 - DNA, 22 bp, Artificial Sequence
  chemically synthesized
tcctgcaattccaactctaaaa

SEQ ID NO: 632065 - DNA, 22 bp, Artificial Sequence
  chemically synthesized
taattcattattttagagttgg

SEQ ID NO: 632066 - DNA, 22 bp, Artificial Sequence
  chemically synthesized
attattttagagttggaattgc

SEQ ID NO: 632067 - DNA, 22 bp, Artificial Sequence
  chemically synthesized
ttttagagttggaattgcagga

SEQ ID NO: 632068 - DNA, 22 bp, Artificial Sequence
  chemically synthesized
tagagttggaattgcaggacag

SEQ ID NO: 632069 - DNA, 22 bp, Artificial Sequence
  chemically synthesized
agagttggaattgcaggacagt

SEQ ID NO: 632070 - DNA, 22 bp, Artificial Sequence
  chemically synthesized
gagttggaattgcaggacagta

SEQ ID NO: 632071 - DNA, 22 bp, Artificial Sequence
  chemically synthesized
aaagcacccagaaacagtactg

SEQ ID NO: 632072 - DNA, 22 bp, Artificial Sequence
  chemically synthesized
gaattgcaggacagtactgttt

SEQ ID NO: 632073 - DNA, 22 bp, Artificial Sequence
  chemically synthesized
caggacagtactgtttctgggt

SEQ ID NO: 632074 - DNA, 22 bp, Artificial Sequence
  chemically synthesized
atataaaagaggctaaaagcac

SEQ ID NO: 632075 - DNA, 22 bp, Artificial Sequence
  chemically synthesized
tttctgggtgcttttagcctct

SEQ ID NO: 632076 - DNA, 22 bp, Artificial Sequence
  chemically synthesized
ctgggtgcttttagcctctttt

SEQ ID NO: 632077 - DNA, 22 bp, Artificial Sequence
  chemically synthesized
tgggtgcttttagcctctttta

SEQ ID NO: 632078 - DNA, 22 bp, Artificial Sequence
  chemically synthesized
ggtgcttttagcctcttttata

SEQ ID NO: 632079 - DNA, 22 bp, Artificial Sequence
  chemically synthesized
aatagtcagtgaattaatataa

SEQ ID NO: 632080 - DNA, 22 bp, Artificial Sequence
  chemically synthesized
aaatagtcagtgaattaatata

SEQ ID NO: 632081 - DNA, 22 bp, Artificial Sequence
  chemically synthesized
ttagcctcttttatattaattc

SEQ ID NO: 632082 - DNA, 22 bp, Artificial Sequence
  chemically synthesized
taaatagtcagtgaattaatat

SEQ ID NO: 632083 - DNA, 22 bp, Artificial Sequence
  chemically synthesized
tagcctcttttatattaattca

SEQ ID NO: 632084 - DNA, 22 bp, Artificial Sequence
  chemically synthesized
agcctcttttatattaattcac

SEQ ID NO: 632085 - DNA, 22 bp, Artificial Sequence
  chemically synthesized
gcctcttttatattaattcact

SEQ ID NO: 632086 - DNA, 22 bp, Artificial Sequence
  chemically synthesized
agtattttaaatagtcagtgaa

SEQ ID NO: 632087 - DNA, 22 bp, Artificial Sequence
  chemically synthesized
ttttatattaattcactgacta

SEQ ID NO: 632088 - DNA, 22 bp, Artificial Sequence
  chemically synthesized
aagtattttaaatagtcagtga

SEQ ID NO: 632089 - DNA, 22 bp, Artificial Sequence
  chemically synthesized
ttatattaattcactgactatt

SEQ ID NO: 632090 - DNA, 22 bp, Artificial Sequence
  chemically synthesized
tatattaattcactgactattt

SEQ ID NO: 632091 - DNA, 22 bp, Artificial Sequence
  chemically synthesized
cttaagtattttaaatagtcag

SEQ ID NO: 632092 - DNA, 22 bp, Artificial Sequence
  chemically synthesized
atattaattcactgactattta

SEQ ID NO: 632093 - DNA, 22 bp, Artificial Sequence
  chemically synthesized
ccttaagtattttaaatagtca

SEQ ID NO: 632094 - DNA, 22 bp, Artificial Sequence
  chemically synthesized
tattaattcactgactatttaa

SEQ ID NO: 632095 - DNA, 22 bp, Artificial Sequence
  chemically synthesized
ttccttaagtattttaaatagt

SEQ ID NO: 632096 - DNA, 22 bp, Artificial Sequence
  chemically synthesized
ttcttccttaagtattttaaat

SEQ ID NO: 632097 - DNA, 22 bp, Artificial Sequence
  chemically synthesized
attcactgactatttaaaatac

SEQ ID NO: 632098 - DNA, 22 bp, Artificial Sequence
  chemically synthesized
attcttccttaagtattttaaa

SEQ ID NO: 632099 - DNA, 22 bp, Artificial Sequence
  chemically synthesized
actgactatttaaaatacttaa

SEQ ID NO: 632100 - DNA, 22 bp, Artificial Sequence
  chemically synthesized
actatttaaaatacttaaggaa

SEQ ID NO: 632101 - DNA, 22 bp, Artificial Sequence
  chemically synthesized
aaaagggacttattcttcctta

SEQ ID NO: 632102 - DNA, 22 bp, Artificial Sequence
  chemically synthesized
tttaaaatacttaaggaagaat

SEQ ID NO: 632103 - DNA, 22 bp, Artificial Sequence
  chemically synthesized
aaaatacttaaggaagaataag

SEQ ID NO: 632104 - DNA, 22 bp, Artificial Sequence
  chemically synthesized
aaatacttaaggaagaataagt

SEQ ID NO: 632105 - DNA, 22 bp, Artificial Sequence
  chemically synthesized
aaggaagaataagtcccttttt

SEQ ID NO: 632106 - DNA, 22 bp, Artificial Sequence
  chemically synthesized
aggaagaataagtcccttttta

SEQ ID NO: 632107 - DNA, 22 bp, Artificial Sequence
  chemically synthesized
taaaataacagaaatcctaaaa

SEQ ID NO: 632108 - DNA, 22 bp, Artificial Sequence
  chemically synthesized
ataaaataacagaaatcctaaa

SEQ ID NO: 632109 - DNA, 22 bp, Artificial Sequence
  chemically synthesized
acttataaaataacagaaatcc

SEQ ID NO: 632110 - DNA, 22 bp, Artificial Sequence
  chemically synthesized
gacttataaaataacagaaatc

SEQ ID NO: 632111 - DNA, 22 bp, Artificial Sequence
  chemically synthesized
tgacttataaaataacagaaat

SEQ ID NO: 632112 - DNA, 22 bp, Artificial Sequence
  chemically synthesized
ttgacttataaaataacagaaa

SEQ ID NO: 632113 - DNA, 22 bp, Artificial Sequence
  chemically synthesized
tttgacttataaaataacagaa

SEQ ID NO: 632114 - DNA, 22 bp, Artificial Sequence
  chemically synthesized
ttttgacttataaaataacaga

SEQ ID NO: 632115 - DNA, 22 bp, Artificial Sequence
  chemically synthesized
tttaggatttctgttattttat

SEQ ID NO: 632116 - DNA, 22 bp, Artificial Sequence
  chemically synthesized
ttaggatttctgttattttata

SEQ ID NO: 632117 - DNA, 22 bp, Artificial Sequence
  chemically synthesized
taggatttctgttattttataa

SEQ ID NO: 632118 - DNA, 22 bp, Artificial Sequence
  chemically synthesized
aatttttttgacttataaaata

SEQ ID NO: 632119 - DNA, 22 bp, Artificial Sequence
  chemically synthesized
aggatttctgttattttataag

SEQ ID NO: 632120 - DNA, 22 bp, Artificial Sequence
  chemically synthesized
gaatttttttgacttataaaat

SEQ ID NO: 632121 - DNA, 22 bp, Artificial Sequence
  chemically synthesized
ggatttctgttattttataagt

SEQ ID NO: 632122 - DNA, 22 bp, Artificial Sequence
  chemically synthesized
ctgttattttataagtcaaaaa

SEQ ID NO: 632123 - DNA, 22 bp, Artificial Sequence
  chemically synthesized
tgttattttataagtcaaaaaa

SEQ ID NO: 632124 - DNA, 22 bp, Artificial Sequence
  chemically synthesized
ttattttataagtcaaaaaaat

SEQ ID NO: 632125 - DNA, 22 bp, Artificial Sequence
  chemically synthesized
ttttataagtcaaaaaaattca

SEQ ID NO: 632126 - DNA, 22 bp, Artificial Sequence
  chemically synthesized
caagtgtggccatttgaatttt

SEQ ID NO: 632127 - DNA, 22 bp, Artificial Sequence
  chemically synthesized
tataagtcaaaaaaattcaaat

SEQ ID NO: 632128 - DNA, 22 bp, Artificial Sequence
  chemically synthesized
ataagtcaaaaaaattcaaatg

SEQ ID NO: 632129 - DNA, 22 bp, Artificial Sequence
  chemically synthesized
taagtcaaaaaaattcaaatgg

SEQ ID NO: 632130 - DNA, 22 bp, Artificial Sequence
  chemically synthesized
accaaagagcctgcaagtgtgg

SEQ ID NO: 632131 - DNA, 22 bp, Artificial Sequence
  chemically synthesized
aaatggccacacttgcaggctc

SEQ ID NO: 632132 - DNA, 22 bp, Artificial Sequence
  chemically synthesized
atattcaccaaagagcctgcaa

SEQ ID NO: 632133 - DNA, 22 bp, Artificial Sequence
  chemically synthesized
tattcatattcaccaaagagcc

SEQ ID NO: 632134 - DNA, 22 bp, Artificial Sequence
  chemically synthesized
atattcatattcaccaaagagc

SEQ ID NO: 632135 - DNA, 22 bp, Artificial Sequence
  chemically synthesized
tagatttatattcatattcacc

SEQ ID NO: 632136 - DNA, 22 bp, Artificial Sequence
  chemically synthesized
gcaggctctttggtgaatatga

SEQ ID NO: 632137 - DNA, 22 bp, Artificial Sequence
  chemically synthesized
atagatttatattcatattcac

SEQ ID NO: 632138 - DNA, 22 bp, Artificial Sequence
  chemically synthesized
caggctctttggtgaatatgaa

SEQ ID NO: 632139 - DNA, 22 bp, Artificial Sequence
  chemically synthesized
atttatagatttatattcatat

SEQ ID NO: 632140 - DNA, 22 bp, Artificial Sequence
  chemically synthesized
tttggtgaatatgaatataaat

SEQ ID NO: 632141 - DNA, 22 bp, Artificial Sequence
  chemically synthesized
aattgatttatagatttatatt

SEQ ID NO: 632142 - DNA, 22 bp, Artificial Sequence
  chemically synthesized
tggtgaatatgaatataaatct

SEQ ID NO: 632143 - DNA, 22 bp, Artificial Sequence
  chemically synthesized
ggtgaatatgaatataaatcta

SEQ ID NO: 632144 - DNA, 22 bp, Artificial Sequence
  chemically synthesized
gtgaatatgaatataaatctat

SEQ ID NO: 632145 - DNA, 22 bp, Artificial Sequence
  chemically synthesized
aaattgaattgatttatagatt

SEQ ID NO: 632146 - DNA, 22 bp, Artificial Sequence
  chemically synthesized
agctgaaattgaattgatttat

SEQ ID NO: 632147 - DNA, 22 bp, Artificial Sequence
  chemically synthesized
ttgagctgaaattgaattgatt

SEQ ID NO: 632148 - DNA, 22 bp, Artificial Sequence
  chemically synthesized
taaatcaattcaatttcagctc

SEQ ID NO: 632149 - DNA, 22 bp, Artificial Sequence
  chemically synthesized
aacaagattattgagctgaaat

SEQ ID NO: 632150 - DNA, 22 bp, Artificial Sequence
  chemically synthesized
agctgaacaagattattgagct

SEQ ID NO: 632151 - DNA, 22 bp, Artificial Sequence
  chemically synthesized
cagctgaacaagattattgagc

SEQ ID NO: 632152 - DNA, 22 bp, Artificial Sequence
  chemically synthesized
tcagctgaacaagattattgag

SEQ ID NO: 632153 - DNA, 22 bp, Artificial Sequence
  chemically synthesized
aatttcagctcaataatcttgt

SEQ ID NO: 632154 - DNA, 22 bp, Artificial Sequence
  chemically synthesized
atcaactttcagctgaacaaga

SEQ ID NO: 632155 - DNA, 22 bp, Artificial Sequence
  chemically synthesized
cagctcaataatcttgttcagc

SEQ ID NO: 632156 - DNA, 22 bp, Artificial Sequence
  chemically synthesized
agctcaataatcttgttcagct

SEQ ID NO: 632157 - DNA, 22 bp, Artificial Sequence
  chemically synthesized
tgctgatcaactttcagctgaa

SEQ ID NO: 632158 - DNA, 22 bp, Artificial Sequence
  chemically synthesized
aataatcttgttcagctgaaag

SEQ ID NO: 632159 - DNA, 22 bp, Artificial Sequence
  chemically synthesized
tgtgctgatcaactttcagctg

SEQ ID NO: 632160 - DNA, 22 bp, Artificial Sequence
  chemically synthesized
ctgtgctgatcaactttcagct

SEQ ID NO: 632161 - DNA, 22 bp, Artificial Sequence
  chemically synthesized
gttcagctgaaagttgatcagc

SEQ ID NO: 632162 - DNA, 22 bp, Artificial Sequence
  chemically synthesized
ttcagctgaaagttgatcagca

SEQ ID NO: 632163 - DNA, 22 bp, Artificial Sequence
  chemically synthesized
agctgaaagttgatcagcacag

SEQ ID NO: 632164 - DNA, 22 bp, Artificial Sequence
  chemically synthesized
aaagttgatcagcacagaagcc

SEQ ID NO: 632165 - DNA, 22 bp, Artificial Sequence
  chemically synthesized
catgtatagagtcacaggcttc

SEQ ID NO: 632166 - DNA, 22 bp, Artificial Sequence
  chemically synthesized
atcagcacagaagcctgtgact

SEQ ID NO: 632167 - DNA, 22 bp, Artificial Sequence
  chemically synthesized
attacatgtatagagtcacagg

SEQ ID NO: 632168 - DNA, 22 bp, Artificial Sequence
  chemically synthesized
actcattacatgtatagagtca

SEQ ID NO: 632169 - DNA, 22 bp, Artificial Sequence
  chemically synthesized
tgactcattacatgtatagagt

SEQ ID NO: 632170 - DNA, 22 bp, Artificial Sequence
  chemically synthesized
tccattctgactcattacatgt

SEQ ID NO: 632171 - DNA, 22 bp, Artificial Sequence
  chemically synthesized
tgactctatacatgtaatgagt

SEQ ID NO: 632172 - DNA, 22 bp, Artificial Sequence
  chemically synthesized
gttgtccattctgactcattac

SEQ ID NO: 632173 - DNA, 22 bp, Artificial Sequence
  chemically synthesized
cgttgtccattctgactcatta

SEQ ID NO: 632174 - DNA, 22 bp, Artificial Sequence
  chemically synthesized
tttcgttgtccattctgactca

SEQ ID NO: 632175 - DNA, 22 bp, Artificial Sequence
  chemically synthesized
tatacatgtaatgagtcagaat

SEQ ID NO: 632176 - DNA, 22 bp, Artificial Sequence
  chemically synthesized
tacatgtaatgagtcagaatgg

SEQ ID NO: 632177 - DNA, 22 bp, Artificial Sequence
  chemically synthesized
ttatttcgttgtccattctgac

SEQ ID NO: 632178 - DNA, 22 bp, Artificial Sequence
  chemically synthesized
cgctattatttcgttgtccatt

SEQ ID NO: 632179 - DNA, 22 bp, Artificial Sequence
  chemically synthesized
acgctattatttcgttgtccat

SEQ ID NO: 632180 - DNA, 22 bp, Artificial Sequence
  chemically synthesized
tacgctattatttcgttgtcca

SEQ ID NO: 632181 - DNA, 22 bp, Artificial Sequence
  chemically synthesized
ctttacgctattatttcgttgt

SEQ ID NO: 632182 - DNA, 22 bp, Artificial Sequence
  chemically synthesized
ccaatccctgctttacgctatt

SEQ ID NO: 632183 - DNA, 22 bp, Artificial Sequence
  chemically synthesized
gccaatccctgctttacgctat

SEQ ID NO: 632184 - DNA, 22 bp, Artificial Sequence
  chemically synthesized
tggggaaaatttgccaatccct

SEQ ID NO: 632185 - DNA, 22 bp, Artificial Sequence
  chemically synthesized
atggggaaaatttgccaatccc

SEQ ID NO: 632186 - DNA, 22 bp, Artificial Sequence
  chemically synthesized
tatggggaaaatttgccaatcc

SEQ ID NO: 632187 - DNA, 22 bp, Artificial Sequence
  chemically synthesized
gccctttatggggaaaatttgc

SEQ ID NO: 632188 - DNA, 22 bp, Artificial Sequence
  chemically synthesized
tctggccctttatggggaaaat

SEQ ID NO: 632189 - DNA, 22 bp, Artificial Sequence
  chemically synthesized
ctatctggccctttatggggaa

SEQ ID NO: 632190 - DNA, 22 bp, Artificial Sequence
  chemically synthesized
actatctggccctttatgggga

SEQ ID NO: 632191 - DNA, 22 bp, Artificial Sequence
  chemically synthesized
gcaaattttccccataaagggc

SEQ ID NO: 632192 - DNA, 22 bp, Artificial Sequence
  chemically synthesized
aaatatttactatctggccctt

SEQ ID NO: 632193 - DNA, 22 bp, Artificial Sequence
  chemically synthesized
tccccataaagggccagatagt

SEQ ID NO: 632194 - DNA, 22 bp, Artificial Sequence
  chemically synthesized
ccccataaagggccagatagta

SEQ ID NO: 632195 - DNA, 22 bp, Artificial Sequence
  chemically synthesized
cccataaagggccagatagtaa

SEQ ID NO: 632196 - DNA, 22 bp, Artificial Sequence
  chemically synthesized
caaagcctgaaatatttactat

SEQ ID NO: 632197 - DNA, 22 bp, Artificial Sequence
  chemically synthesized
gcaaagcctgaaatatttacta

SEQ ID NO: 632198 - DNA, 22 bp, Artificial Sequence
  chemically synthesized
gtccagagaccgtgggcttgca

SEQ ID NO: 632199 - DNA, 22 bp, Artificial Sequence
  chemically synthesized
caggctttgcaagcccacggtc

SEQ ID NO: 632200 - DNA, 22 bp, Artificial Sequence
  chemically synthesized
aggctttgcaagcccacggtct

SEQ ID NO: 632201 - DNA, 22 bp, Artificial Sequence
  chemically synthesized
aatagctggtccagagaccgtg

SEQ ID NO: 632202 - DNA, 22 bp, Artificial Sequence
  chemically synthesized
tgcaagcccacggtctctggac

SEQ ID NO: 632203 - DNA, 22 bp, Artificial Sequence
  chemically synthesized
gcaagcccacggtctctggacc

SEQ ID NO: 632204 - DNA, 22 bp, Artificial Sequence
  chemically synthesized
caagcccacggtctctggacca

SEQ ID NO: 632205 - DNA, 22 bp, Artificial Sequence
  chemically synthesized
cagcagtgctgaatagctggtc

SEQ ID NO: 632206 - DNA, 22 bp, Artificial Sequence
  chemically synthesized
tggaccagctattcagcactgc

SEQ ID NO: 632207 - DNA, 22 bp, Artificial Sequence
  chemically synthesized
gaccagctattcagcactgctg

SEQ ID NO: 632208 - DNA, 22 bp, Artificial Sequence
  chemically synthesized
ccagggcagagtagttgcagca

SEQ ID NO: 632209 - DNA, 22 bp, Artificial Sequence
  chemically synthesized
ttcagcactgctgcaactactc

SEQ ID NO: 632210 - DNA, 22 bp, Artificial Sequence
  chemically synthesized
attaccagggcagagtagttgc

SEQ ID NO: 632211 - DNA, 22 bp, Artificial Sequence
  chemically synthesized
tcattaccagggcagagtagtt

SEQ ID NO: 632212 - DNA, 22 bp, Artificial Sequence
  chemically synthesized
agcactgctgcaactactctgc

SEQ ID NO: 632213 - DNA, 22 bp, Artificial Sequence
  chemically synthesized
ctcattaccagggcagagtagt

SEQ ID NO: 632214 - DNA, 22 bp, Artificial Sequence
  chemically synthesized
tctcattaccagggcagagtag

SEQ ID NO: 632215 - DNA, 22 bp, Artificial Sequence
  chemically synthesized
ctttctcattaccagggcagag

SEQ ID NO: 632216 - DNA, 22 bp, Artificial Sequence
  chemically synthesized
ctgcaactactctgccctggta

SEQ ID NO: 632217 - DNA, 22 bp, Artificial Sequence
  chemically synthesized
caactactctgccctggtaatg

SEQ ID NO: 632218 - DNA, 22 bp, Artificial Sequence
  chemically synthesized
tagttgctttctcattaccagg

SEQ ID NO: 632219 - DNA, 22 bp, Artificial Sequence
  chemically synthesized
cctatagttgctttctcattac

SEQ ID NO: 632220 - DNA, 22 bp, Artificial Sequence
  chemically synthesized
ctctgccctggtaatgagaaag

SEQ ID NO: 632221 - DNA, 22 bp, Artificial Sequence
  chemically synthesized
tgccctggtaatgagaaagcaa

SEQ ID NO: 632222 - DNA, 22 bp, Artificial Sequence
  chemically synthesized
ccctggtaatgagaaagcaact

SEQ ID NO: 632223 - DNA, 22 bp, Artificial Sequence
  chemically synthesized
catgttgcctatagttgctttc

SEQ ID NO: 632224 - DNA, 22 bp, Artificial Sequence
  chemically synthesized
acatgttgcctatagttgcttt

SEQ ID NO: 632225 - DNA, 22 bp, Artificial Sequence
  chemically synthesized
gtaatgagaaagcaactatagg

SEQ ID NO: 632226 - DNA, 22 bp, Artificial Sequence
  chemically synthesized
atttacatgttgcctatagttg

SEQ ID NO: 632227 - DNA, 22 bp, Artificial Sequence
  chemically synthesized
taggcaacatgtaaatgaatgg

SEQ ID NO: 632228 - DNA, 22 bp, Artificial Sequence
  chemically synthesized
gaacacagccatacccattcat

SEQ ID NO: 632229 - DNA, 22 bp, Artificial Sequence
  chemically synthesized
ttggaacacagccatacccatt

SEQ ID NO: 632230 - DNA, 22 bp, Artificial Sequence
  chemically synthesized
attggaacacagccatacccat

SEQ ID NO: 632231 - DNA, 22 bp, Artificial Sequence
  chemically synthesized
tattggaacacagccataccca

SEQ ID NO: 632232 - DNA, 22 bp, Artificial Sequence
  chemically synthesized
taaagctttattggaacacagc

SEQ ID NO: 632233 - DNA, 22 bp, Artificial Sequence
  chemically synthesized
ataaagctttattggaacacag

SEQ ID NO: 632234 - DNA, 22 bp, Artificial Sequence
  chemically synthesized
tataaagctttattggaacaca

SEQ ID NO: 632235 - DNA, 22 bp, Artificial Sequence
  chemically synthesized
ttataaagctttattggaacac

SEQ ID NO: 632236 - DNA, 22 bp, Artificial Sequence
  chemically synthesized
tttttataaagctttattggaa

SEQ ID NO: 632237 - DNA, 22 bp, Artificial Sequence
  chemically synthesized
tgttccaataaagctttataaa

SEQ ID NO: 632238 - DNA, 22 bp, Artificial Sequence
  chemically synthesized
gcccaatacctgtttttataaa

SEQ ID NO: 632239 - DNA, 22 bp, Artificial Sequence
  chemically synthesized
caataaagctttataaaaacag

SEQ ID NO: 632240 - DNA, 22 bp, Artificial Sequence
  chemically synthesized
tataaaaacaggtattgggcca

SEQ ID NO: 632241 - DNA, 22 bp, Artificial Sequence
  chemically synthesized
ataaaaacaggtattgggccag

SEQ ID NO: 632242 - DNA, 22 bp, Artificial Sequence
  chemically synthesized
taaaaacaggtattgggccaga

SEQ ID NO: 632243 - DNA, 22 bp, Artificial Sequence
  chemically synthesized
catacagcccaaatgccaaatc

SEQ ID NO: 632244 - DNA, 22 bp, Artificial Sequence
  chemically synthesized
ggccagatttggcatttgggct

SEQ ID NO: 632245 - DNA, 22 bp, Artificial Sequence
  chemically synthesized
gcaaactacatacagcccaaat

SEQ ID NO: 632246 - DNA, 22 bp, Artificial Sequence
  chemically synthesized
ggcatttgggctgtatgtagtt

SEQ ID NO: 632247 - DNA, 22 bp, Artificial Sequence
  chemically synthesized
gcatttgggctgtatgtagttt

SEQ ID NO: 632248 - DNA, 22 bp, Artificial Sequence
  chemically synthesized
atccaggactagcaaactacat

SEQ ID NO: 632249 - DNA, 22 bp, Artificial Sequence
  chemically synthesized
aatccaggactagcaaactaca

SEQ ID NO: 632250 - DNA, 22 bp, Artificial Sequence
  chemically synthesized
taatccaggactagcaaactac

SEQ ID NO: 632251 - DNA, 22 bp, Artificial Sequence
  chemically synthesized
gggctgtatgtagtttgctagt

SEQ ID NO: 632252 - DNA, 22 bp, Artificial Sequence
  chemically synthesized
ggctgtatgtagtttgctagtc

SEQ ID NO: 632253 - DNA, 22 bp, Artificial Sequence
  chemically synthesized
tccctttaatccaggactagca

SEQ ID NO: 632254 - DNA, 22 bp, Artificial Sequence
  chemically synthesized
tatgtagtttgctagtcctgga

SEQ ID NO: 632255 - DNA, 22 bp, Artificial Sequence
  chemically synthesized
agcggttatccctttaatccag

SEQ ID NO: 632256 - DNA, 22 bp, Artificial Sequence
  chemically synthesized
gagcggttatccctttaatcca

SEQ ID NO: 632257 - DNA, 22 bp, Artificial Sequence
  chemically synthesized
gctagtcctggattaaagggat

SEQ ID NO: 632258 - DNA, 22 bp, Artificial Sequence
  chemically synthesized
ctagtcctggattaaagggata

SEQ ID NO: 632259 - DNA, 22 bp, Artificial Sequence
  chemically synthesized
gtcctggattaaagggataacc

SEQ ID NO: 632260 - DNA, 22 bp, Artificial Sequence
  chemically synthesized
ccacaaaggatttgagcggtta

SEQ ID NO: 632261 - DNA, 22 bp, Artificial Sequence
  chemically synthesized
gattaaagggataaccgctcaa

SEQ ID NO: 632262 - DNA, 22 bp, Artificial Sequence
  chemically synthesized
aagggataaccgctcaaatcct

SEQ ID NO: 632263 - DNA, 22 bp, Artificial Sequence
  chemically synthesized
tatgctcccacaaaggatttga

SEQ ID NO: 632264 - DNA, 22 bp, Artificial Sequence
  chemically synthesized
ctgtatgctcccacaaaggatt

SEQ ID NO: 632265 - DNA, 22 bp, Artificial Sequence
  chemically synthesized
cctgtatgctcccacaaaggat

SEQ ID NO: 632266 - DNA, 22 bp, Artificial Sequence
  chemically synthesized
tttcctgtatgctcccacaaag

SEQ ID NO: 632267 - DNA, 22 bp, Artificial Sequence
  chemically synthesized
tgtttcctgtatgctcccacaa

SEQ ID NO: 632268 - DNA, 22 bp, Artificial Sequence
  chemically synthesized
aaatcctttgtgggagcataca

SEQ ID NO: 632269 - DNA, 22 bp, Artificial Sequence
  chemically synthesized
aggcaccattctgtttcctgta

SEQ ID NO: 632270 - DNA, 22 bp, Artificial Sequence
  chemically synthesized
caggcaccattctgtttcctgt

SEQ ID NO: 632271 - DNA, 22 bp, Artificial Sequence
  chemically synthesized
tgtgggagcatacaggaaacag

SEQ ID NO: 632272 - DNA, 22 bp, Artificial Sequence
  chemically synthesized
tcaggcaccattctgtttcctg

SEQ ID NO: 632273 - DNA, 22 bp, Artificial Sequence
  chemically synthesized
gtgggagcatacaggaaacaga

SEQ ID NO: 632274 - DNA, 22 bp, Artificial Sequence
  chemically synthesized
ttcaggcaccattctgtttcct

SEQ ID NO: 632275 - DNA, 22 bp, Artificial Sequence
  chemically synthesized
tgggagcatacaggaaacagaa

SEQ ID NO: 632276 - DNA, 22 bp, Artificial Sequence
  chemically synthesized
tttcaggcaccattctgtttcc

SEQ ID NO: 632277 - DNA, 22 bp, Artificial Sequence
  chemically synthesized
aaaaagggcacaccatatttct

SEQ ID NO: 632278 - DNA, 22 bp, Artificial Sequence
  chemically synthesized
tggaagagcaacataaagaaca

SEQ ID NO: 632279 - DNA, 22 bp, Artificial Sequence
  chemically synthesized
ctatctgcctttgttctttatg

SEQ ID NO: 632280 - DNA, 22 bp, Artificial Sequence
  chemically synthesized
atggaagagcaacataaagaac

SEQ ID NO: 632281 - DNA, 22 bp, Artificial Sequence
  chemically synthesized
tatctgcctttgttctttatgt

SEQ ID NO: 632282 - DNA, 22 bp, Artificial Sequence
  chemically synthesized
tatggaagagcaacataaagaa

SEQ ID NO: 632283 - DNA, 22 bp, Artificial Sequence
  chemically synthesized
ttatggaagagcaacataaaga

SEQ ID NO: 632284 - DNA, 22 bp, Artificial Sequence
  chemically synthesized
tctgcctttgttctttatgttg

SEQ ID NO: 632285 - DNA, 22 bp, Artificial Sequence
  chemically synthesized
ttttatggaagagcaacataaa

SEQ ID NO: 632286 - DNA, 22 bp, Artificial Sequence
  chemically synthesized
cctttgttctttatgttgctct

SEQ ID NO: 632287 - DNA, 22 bp, Artificial Sequence
  chemically synthesized
tggttcttttatggaagagcaa

SEQ ID NO: 632288 - DNA, 22 bp, Artificial Sequence
  chemically synthesized
tgttctttatgttgctcttcca

SEQ ID NO: 632289 - DNA, 22 bp, Artificial Sequence
  chemically synthesized
gttctttatgttgctcttccat

SEQ ID NO: 632290 - DNA, 22 bp, Artificial Sequence
  chemically synthesized
tgtggttcttttatggaagagc

SEQ ID NO: 632291 - DNA, 22 bp, Artificial Sequence
  chemically synthesized
ttctttatgttgctcttccata

SEQ ID NO: 632292 - DNA, 22 bp, Artificial Sequence
  chemically synthesized
ttctgtggttcttttatggaag

SEQ ID NO: 632293 - DNA, 22 bp, Artificial Sequence
  chemically synthesized
tttatgttgctcttccataaaa

SEQ ID NO: 632294 - DNA, 22 bp, Artificial Sequence
  chemically synthesized
attctgtggttcttttatggaa

SEQ ID NO: 632295 - DNA, 22 bp, Artificial Sequence
  chemically synthesized
tatgttgctcttccataaaaga

SEQ ID NO: 632296 - DNA, 22 bp, Artificial Sequence
  chemically synthesized
atgttgctcttccataaaagaa

SEQ ID NO: 632297 - DNA, 22 bp, Artificial Sequence
  chemically synthesized
tgttgctcttccataaaagaac

SEQ ID NO: 632298 - DNA, 22 bp, Artificial Sequence
  chemically synthesized
aaatcttattctgtggttcttt

SEQ ID NO: 632299 - DNA, 22 bp, Artificial Sequence
  chemically synthesized
ctcttccataaaagaaccacag

SEQ ID NO: 632300 - DNA, 22 bp, Artificial Sequence
  chemically synthesized
ttccataaaagaaccacagaat

SEQ ID NO: 632301 - DNA, 22 bp, Artificial Sequence
  chemically synthesized
aaattaaaatcttattctgtgg

SEQ ID NO: 632302 - DNA, 22 bp, Artificial Sequence
  chemically synthesized
ccataaaagaaccacagaataa

SEQ ID NO: 632303 - DNA, 22 bp, Artificial Sequence
  chemically synthesized
aaaattaaaatcttattctgtg

SEQ ID NO: 632304 - DNA, 22 bp, Artificial Sequence
  chemically synthesized
cataaaagaaccacagaataag

SEQ ID NO: 632305 - DNA, 22 bp, Artificial Sequence
  chemically synthesized
taaaattaaaatcttattctgt

SEQ ID NO: 632306 - DNA, 22 bp, Artificial Sequence
  chemically synthesized
ttaaaattaaaatcttattctg

SEQ ID NO: 632307 - DNA, 22 bp, Artificial Sequence
  chemically synthesized
ccgtcttttaaaattaaaatct

SEQ ID NO: 632308 - DNA, 22 bp, Artificial Sequence
  chemically synthesized
taaaacctaccgtcttttaaaa

SEQ ID NO: 632309 - DNA, 22 bp, Artificial Sequence
  chemically synthesized
gtaaaacctaccgtcttttaaa

SEQ ID NO: 632310 - DNA, 22 bp, Artificial Sequence
  chemically synthesized
tgtaaaacctaccgtcttttaa

SEQ ID NO: 632311 - DNA, 22 bp, Artificial Sequence
  chemically synthesized
taattttaaaagacggtaggtt

SEQ ID NO: 632312 - DNA, 22 bp, Artificial Sequence
  chemically synthesized
aattttaaaagacggtaggttt

SEQ ID NO: 632313 - DNA, 22 bp, Artificial Sequence
  chemically synthesized
attttaaaagacggtaggtttt

SEQ ID NO: 632314 - DNA, 22 bp, Artificial Sequence
  chemically synthesized
taaaagacggtaggttttacaa

SEQ ID NO: 632315 - DNA, 22 bp, Artificial Sequence
  chemically synthesized
aaaagacggtaggttttacaaa

SEQ ID NO: 632316 - DNA, 22 bp, Artificial Sequence
  chemically synthesized
aaagacggtaggttttacaaag

SEQ ID NO: 632317 - DNA, 22 bp, Artificial Sequence
  chemically synthesized
ccaacccaacagctttgtaaaa

SEQ ID NO: 632318 - DNA, 22 bp, Artificial Sequence
  chemically synthesized
aattaccaacccaacagctttg

SEQ ID NO: 632319 - DNA, 22 bp, Artificial Sequence
  chemically synthesized
tacaaagctgttgggttggtaa

SEQ ID NO: 632320 - DNA, 22 bp, Artificial Sequence
  chemically synthesized
acaaagctgttgggttggtaat

SEQ ID NO: 632321 - DNA, 22 bp, Artificial Sequence
  chemically synthesized
caaagctgttgggttggtaatt

SEQ ID NO: 632322 - DNA, 22 bp, Artificial Sequence
  chemically synthesized
tcaaatacccctaaattaccaa

SEQ ID NO: 632323 - DNA, 22 bp, Artificial Sequence
  chemically synthesized
tatcaaatacccctaaattacc

SEQ ID NO: 632324 - DNA, 22 bp, Artificial Sequence
  chemically synthesized
ttgggttggtaatttaggggta

SEQ ID NO: 632325 - DNA, 22 bp, Artificial Sequence
  chemically synthesized
ggttggtaatttaggggtattt

SEQ ID NO: 632326 - DNA, 22 bp, Artificial Sequence
  chemically synthesized
gtaatttaggggtatttgatag

SEQ ID NO: 632327 - DNA, 22 bp, Artificial Sequence
  chemically synthesized
aggggtatttgatagaatgtac

SEQ ID NO: 632328 - DNA, 22 bp, Artificial Sequence
  chemically synthesized
aaataagcccgcgtacattcta

SEQ ID NO: 632329 - DNA, 22 bp, Artificial Sequence
  chemically synthesized
ggggtatttgatagaatgtacg

SEQ ID NO: 632330 - DNA, 22 bp, Artificial Sequence
  chemically synthesized
tcaaataagcccgcgtacattc

SEQ ID NO: 632331 - DNA, 22 bp, Artificial Sequence
  chemically synthesized
gatagaatgtacgcgggcttat

SEQ ID NO: 632332 - DNA, 22 bp, Artificial Sequence
  chemically synthesized
atagaatgtacgcgggcttatt

SEQ ID NO: 632333 - DNA, 22 bp, Artificial Sequence
  chemically synthesized
ataccatcccctctcaaataag

SEQ ID NO: 632334 - DNA, 22 bp, Artificial Sequence
  chemically synthesized
cataccatcccctctcaaataa

SEQ ID NO: 632335 - DNA, 22 bp, Artificial Sequence
  chemically synthesized
tcataccatcccctctcaaata

SEQ ID NO: 632336 - DNA, 22 bp, Artificial Sequence
  chemically synthesized
ttcataccatcccctctcaaat

SEQ ID NO: 632337 - DNA, 22 bp, Artificial Sequence
  chemically synthesized
tttcataccatcccctctcaaa

SEQ ID NO: 632338 - DNA, 22 bp, Artificial Sequence
  chemically synthesized
ttttcataccatcccctctcaa

SEQ ID NO: 632339 - DNA, 22 bp, Artificial Sequence
  chemically synthesized
tttttcataccatcccctctca

SEQ ID NO: 632340 - DNA, 22 bp, Artificial Sequence
  chemically synthesized
tttttttcataccatcccctct

SEQ ID NO: 632341 - DNA, 22 bp, Artificial Sequence
  chemically synthesized
atttgagaggggatggtatgaa

SEQ ID NO: 632342 - DNA, 22 bp, Artificial Sequence
  chemically synthesized
tttgagaggggatggtatgaaa

SEQ ID NO: 632343 - DNA, 22 bp, Artificial Sequence
  chemically synthesized
gagaggggatggtatgaaaaaa

SEQ ID NO: 632344 - DNA, 22 bp, Artificial Sequence
  chemically synthesized
agaggggatggtatgaaaaaaa

SEQ ID NO: 632345 - DNA, 22 bp, Artificial Sequence
  chemically synthesized
caccagcccatgccatcctctt

SEQ ID NO: 632346 - DNA, 22 bp, Artificial Sequence
  chemically synthesized
tctccaccagcccatgccatcc

SEQ ID NO: 632347 - DNA, 22 bp, Artificial Sequence
  chemically synthesized
tgccacattatctccaccagcc

SEQ ID NO: 632348 - DNA, 22 bp, Artificial Sequence
  chemically synthesized
acctgtgccacattatctccac

SEQ ID NO: 632349 - DNA, 22 bp, Artificial Sequence
  chemically synthesized
ctgacctgtgccacattatctc

SEQ ID NO: 632350 - DNA, 22 bp, Artificial Sequence
  chemically synthesized
cctactgacctgtgccacatta

SEQ ID NO: 632351 - DNA, 22 bp, Artificial Sequence
  chemically synthesized
gcctactgacctgtgccacatt

SEQ ID NO: 632352 - DNA, 22 bp, Artificial Sequence
  chemically synthesized
ttgcctactgacctgtgccaca

SEQ ID NO: 632353 - DNA, 22 bp, Artificial Sequence
  chemically synthesized
gtggagataatgtggcacaggt

SEQ ID NO: 632354 - DNA, 22 bp, Artificial Sequence
  chemically synthesized
tacaatctcttgcctactgacc

SEQ ID NO: 632355 - DNA, 22 bp, Artificial Sequence
  chemically synthesized
cctgtacaatctcttgcctact

SEQ ID NO: 632356 - DNA, 22 bp, Artificial Sequence
  chemically synthesized
ctacctgtacaatctcttgcct

SEQ ID NO: 632357 - DNA, 22 bp, Artificial Sequence
  chemically synthesized
tgctacctgtacaatctcttgc

SEQ ID NO: 632358 - DNA, 22 bp, Artificial Sequence
  chemically synthesized
ctgctacctgtacaatctcttg

SEQ ID NO: 632359 - DNA, 22 bp, Artificial Sequence
  chemically synthesized
tttctgctacctgtacaatctc

SEQ ID NO: 632360 - DNA, 22 bp, Artificial Sequence
  chemically synthesized
ctatttctgctacctgtacaat

SEQ ID NO: 632361 - DNA, 22 bp, Artificial Sequence
  chemically synthesized
gcagtgctactatttctgctac

SEQ ID NO: 632362 - DNA, 22 bp, Artificial Sequence
  chemically synthesized
tacaggtagcagaaatagtagc

SEQ ID NO: 632363 - DNA, 22 bp, Artificial Sequence
  chemically synthesized
atgcagtaaaacaatccagaaa

SEQ ID NO: 632364 - DNA, 22 bp, Artificial Sequence
  chemically synthesized
aatgcagtaaaacaatccagaa

SEQ ID NO: 632365 - DNA, 22 bp, Artificial Sequence
  chemically synthesized
ttaatgcagtaaaacaatccag

SEQ ID NO: 632366 - DNA, 22 bp, Artificial Sequence
  chemically synthesized
ctaactgctttctggattgttt

SEQ ID NO: 632367 - DNA, 22 bp, Artificial Sequence
  chemically synthesized
actgctttctggattgttttac

SEQ ID NO: 632368 - DNA, 22 bp, Artificial Sequence
  chemically synthesized
ctttctggattgttttactgca

SEQ ID NO: 632369 - DNA, 22 bp, Artificial Sequence
  chemically synthesized
tctggattgttttactgcatta

SEQ ID NO: 632370 - DNA, 22 bp, Artificial Sequence
  chemically synthesized
ctggattgttttactgcattaa

SEQ ID NO: 632371 - DNA, 22 bp, Artificial Sequence
  chemically synthesized
tggattgttttactgcattaag

SEQ ID NO: 632372 - DNA, 22 bp, Artificial Sequence
  chemically synthesized
gattgttttactgcattaagag

SEQ ID NO: 632373 - DNA, 22 bp, Artificial Sequence
  chemically synthesized
ttttactgcattaagagcttat

SEQ ID NO: 632374 - DNA, 22 bp, Artificial Sequence
  chemically synthesized
tactgcattaagagcttatctt

SEQ ID NO: 632375 - DNA, 22 bp, Artificial Sequence
  chemically synthesized
actgcattaagagcttatcttg

SEQ ID NO: 632376 - DNA, 22 bp, Artificial Sequence
  chemically synthesized
ctgcattaagagcttatcttgg

SEQ ID NO: 632377 - DNA, 22 bp, Artificial Sequence
  chemically synthesized
cattaagagcttatcttggctc

SEQ ID NO: 632378 - DNA, 22 bp, Artificial Sequence
  chemically synthesized
agagcttatcttggctcctatt

SEQ ID NO: 632379 - DNA, 22 bp, Artificial Sequence
  chemically synthesized
tatagatgaatgaataatagga

SEQ ID NO: 632380 - DNA, 22 bp, Artificial Sequence
  chemically synthesized
atatagatgaatgaataatagg

SEQ ID NO: 632381 - DNA, 22 bp, Artificial Sequence
  chemically synthesized
tatatagatgaatgaataatag

SEQ ID NO: 632382 - DNA, 22 bp, Artificial Sequence
  chemically synthesized
atcttggctcctattattcatt

SEQ ID NO: 632383 - DNA, 22 bp, Artificial Sequence
  chemically synthesized
tcttggctcctattattcattc

SEQ ID NO: 632384 - DNA, 22 bp, Artificial Sequence
  chemically synthesized
ggctcctattattcattcatct

SEQ ID NO: 632385 - DNA, 22 bp, Artificial Sequence
  chemically synthesized
gctcctattattcattcatcta

SEQ ID NO: 632386 - DNA, 22 bp, Artificial Sequence
  chemically synthesized
ctattattcattcatctatata

SEQ ID NO: 632387 - DNA, 22 bp, Artificial Sequence
  chemically synthesized
ttattcattcatctatataaag

SEQ ID NO: 632388 - DNA, 22 bp, Artificial Sequence
  chemically synthesized
aaatgtggtaccactttatata

SEQ ID NO: 632389 - DNA, 22 bp, Artificial Sequence
  chemically synthesized
ttcattcatctatataaagtgg

SEQ ID NO: 632390 - DNA, 22 bp, Artificial Sequence
  chemically synthesized
taaaatgtggtaccactttata

SEQ ID NO: 632391 - DNA, 22 bp, Artificial Sequence
  chemically synthesized
tctaaaatgtggtaccacttta

SEQ ID NO: 632392 - DNA, 22 bp, Artificial Sequence
  chemically synthesized
attcatctatataaagtggtac

SEQ ID NO: 632393 - DNA, 22 bp, Artificial Sequence
  chemically synthesized
atctatataaagtggtaccaca

SEQ ID NO: 632394 - DNA, 22 bp, Artificial Sequence
  chemically synthesized
ggctctctaaaatgtggtacca

SEQ ID NO: 632395 - DNA, 22 bp, Artificial Sequence
  chemically synthesized
tataaagtggtaccacatttta

SEQ ID NO: 632396 - DNA, 22 bp, Artificial Sequence
  chemically synthesized
gtcagtagtatggtattaggct

SEQ ID NO: 632397 - DNA, 22 bp, Artificial Sequence
  chemically synthesized
ctagtcagtagtatggtattag

SEQ ID NO: 632398 - DNA, 22 bp, Artificial Sequence
  chemically synthesized
tcctagtcagtagtatggtatt

SEQ ID NO: 632399 - DNA, 22 bp, Artificial Sequence
  chemically synthesized
tagagagcctaataccatacta

SEQ ID NO: 632400 - DNA, 22 bp, Artificial Sequence
  chemically synthesized
agagagcctaataccatactac

SEQ ID NO: 632401 - DNA, 22 bp, Artificial Sequence
  chemically synthesized
gagagcctaataccatactact

SEQ ID NO: 632402 - DNA, 22 bp, Artificial Sequence
  chemically synthesized
ataccatactactgactaggag

SEQ ID NO: 632403 - DNA, 22 bp, Artificial Sequence
  chemically synthesized
atgaaagaaacgctctcctagt

SEQ ID NO: 632404 - DNA, 22 bp, Artificial Sequence
  chemically synthesized
ctgactaggagagcgtttcttt

SEQ ID NO: 632405 - DNA, 22 bp, Artificial Sequence
  chemically synthesized
actaggagagcgtttctttcat

SEQ ID NO: 632406 - DNA, 22 bp, Artificial Sequence
  chemically synthesized
tatgtatgtgcattgatgaaag

SEQ ID NO: 632407 - DNA, 22 bp, Artificial Sequence
  chemically synthesized
ggagagcgtttctttcatcaat

SEQ ID NO: 632408 - DNA, 22 bp, Artificial Sequence
  chemically synthesized
atatgtatgtgcattgatgaaa

SEQ ID NO: 632409 - DNA, 22 bp, Artificial Sequence
  chemically synthesized
tatatgtatgtgcattgatgaa

SEQ ID NO: 632410 - DNA, 22 bp, Artificial Sequence
  chemically synthesized
ttatatgtatgtgcattgatga

SEQ ID NO: 632411 - DNA, 22 bp, Artificial Sequence
  chemically synthesized
ctttcatcaatgcacatacata

SEQ ID NO: 632412 - DNA, 22 bp, Artificial Sequence
  chemically synthesized
tttcatcaatgcacatacatat

SEQ ID NO: 632413 - DNA, 22 bp, Artificial Sequence
  chemically synthesized
tcatcaatgcacatacatataa

SEQ ID NO: 632414 - DNA, 22 bp, Artificial Sequence
  chemically synthesized
acaaagatatttttatatgtat

SEQ ID NO: 632415 - DNA, 22 bp, Artificial Sequence
  chemically synthesized
catcaatgcacatacatataaa

SEQ ID NO: 632416 - DNA, 22 bp, Artificial Sequence
  chemically synthesized
atcaatgcacatacatataaaa

SEQ ID NO: 632417 - DNA, 22 bp, Artificial Sequence
  chemically synthesized
gcagactaacaaagatattttt

SEQ ID NO: 632418 - DNA, 22 bp, Artificial Sequence
  chemically synthesized
agcagactaacaaagatatttt

SEQ ID NO: 632419 - DNA, 22 bp, Artificial Sequence
  chemically synthesized
atcatttagcagactaacaaag

SEQ ID NO: 632420 - DNA, 22 bp, Artificial Sequence
  chemically synthesized
tgatcatttagcagactaacaa

SEQ ID NO: 632421 - DNA, 22 bp, Artificial Sequence
  chemically synthesized
tccataagtctctgatcattta

SEQ ID NO: 632422 - DNA, 22 bp, Artificial Sequence
  chemically synthesized
tgttagtctgctaaatgatcag

SEQ ID NO: 632423 - DNA, 22 bp, Artificial Sequence
  chemically synthesized
gtccataagtctctgatcattt

SEQ ID NO: 632424 - DNA, 22 bp, Artificial Sequence
  chemically synthesized
gttagtctgctaaatgatcaga

SEQ ID NO: 632425 - DNA, 22 bp, Artificial Sequence
  chemically synthesized
ttagtctgctaaatgatcagag

SEQ ID NO: 632426 - DNA, 22 bp, Artificial Sequence
  chemically synthesized
gtctgctaaatgatcagagact

SEQ ID NO: 632427 - DNA, 22 bp, Artificial Sequence
  chemically synthesized
agtgatttgtccataagtctct

SEQ ID NO: 632428 - DNA, 22 bp, Artificial Sequence
  chemically synthesized
ctaaatgatcagagacttatgg

SEQ ID NO: 632429 - DNA, 22 bp, Artificial Sequence
  chemically synthesized
aatgatcagagacttatggaca

SEQ ID NO: 632430 - DNA, 22 bp, Artificial Sequence
  chemically synthesized
aaaaataaccccattaagtgat

SEQ ID NO: 632431 - DNA, 22 bp, Artificial Sequence
  chemically synthesized
aaaaaataaccccattaagtga

SEQ ID NO: 632432 - DNA, 22 bp, Artificial Sequence
  chemically synthesized
atggacaaatcacttaatgggg

SEQ ID NO: 632433 - DNA, 22 bp, Artificial Sequence
  chemically synthesized
tggacaaatcacttaatggggt

SEQ ID NO: 632434 - DNA, 22 bp, Artificial Sequence
  chemically synthesized
aatggggttattttttaaatta

SEQ ID NO: 632435 - DNA, 22 bp, Artificial Sequence
  chemically synthesized
atggggttattttttaaattac

SEQ ID NO: 632436 - DNA, 22 bp, Artificial Sequence
  chemically synthesized
catgggtacaataaacaaacgt

SEQ ID NO: 632437 - DNA, 22 bp, Artificial Sequence
  chemically synthesized
ttttttaaattacgtttgttta

SEQ ID NO: 632438 - DNA, 22 bp, Artificial Sequence
  chemically synthesized
tttaaattacgtttgtttattg

SEQ ID NO: 632439 - DNA, 22 bp, Artificial Sequence
  chemically synthesized
ttaaattacgtttgtttattgt

SEQ ID NO: 632440 - DNA, 22 bp, Artificial Sequence
  chemically synthesized
taaattacgtttgtttattgta

SEQ ID NO: 632441 - DNA, 22 bp, Artificial Sequence
  chemically synthesized
aaattacgtttgtttattgtac

SEQ ID NO: 632442 - DNA, 22 bp, Artificial Sequence
  chemically synthesized
aattacgtttgtttattgtacc

SEQ ID NO: 632443 - DNA, 22 bp, Artificial Sequence
  chemically synthesized
taggaaaactacatgggtacaa

SEQ ID NO: 632444 - DNA, 22 bp, Artificial Sequence
  chemically synthesized
cgtttgtttattgtacccatgt

SEQ ID NO: 632445 - DNA, 22 bp, Artificial Sequence
  chemically synthesized
tataggaaaactacatgggtac

SEQ ID NO: 632446 - DNA, 22 bp, Artificial Sequence
  chemically synthesized
gtttattgtacccatgtagttt

SEQ ID NO: 632447 - DNA, 22 bp, Artificial Sequence
  chemically synthesized
tttattgtacccatgtagtttt

SEQ ID NO: 632448 - DNA, 22 bp, Artificial Sequence
  chemically synthesized
ccattctataggaaaactacat

SEQ ID NO: 632449 - DNA, 22 bp, Artificial Sequence
  chemically synthesized
tgccattctataggaaaactac

SEQ ID NO: 632450 - DNA, 22 bp, Artificial Sequence
  chemically synthesized
attgtacccatgtagttttcct

SEQ ID NO: 632451 - DNA, 22 bp, Artificial Sequence
  chemically synthesized
ttgtacccatgtagttttccta

SEQ ID NO: 632452 - DNA, 22 bp, Artificial Sequence
  chemically synthesized
tacccatgtagttttcctatag

SEQ ID NO: 632453 - DNA, 22 bp, Artificial Sequence
  chemically synthesized
aagctctgccattctataggaa

SEQ ID NO: 632454 - DNA, 22 bp, Artificial Sequence
  chemically synthesized
taaagctctgccattctatagg

SEQ ID NO: 632455 - DNA, 22 bp, Artificial Sequence
  chemically synthesized
tctaaagctctgccattctata

SEQ ID NO: 632456 - DNA, 22 bp, Artificial Sequence
  chemically synthesized
tcctatagaatggcagagcttt

SEQ ID NO: 632457 - DNA, 22 bp, Artificial Sequence
  chemically synthesized
cctatagaatggcagagcttta

SEQ ID NO: 632458 - DNA, 22 bp, Artificial Sequence
  chemically synthesized
taaggtactctctaaagctctg

SEQ ID NO: 632459 - DNA, 22 bp, Artificial Sequence
  chemically synthesized
ctatagaatggcagagctttag

SEQ ID NO: 632460 - DNA, 22 bp, Artificial Sequence
  chemically synthesized
ctataaggtactctctaaagct

SEQ ID NO: 632461 - DNA, 22 bp, Artificial Sequence
  chemically synthesized
tagaatggcagagctttagaga

SEQ ID NO: 632462 - DNA, 22 bp, Artificial Sequence
  chemically synthesized
actataaggtactctctaaagc

SEQ ID NO: 632463 - DNA, 22 bp, Artificial Sequence
  chemically synthesized
tactataaggtactctctaaag

SEQ ID NO: 632464 - DNA, 22 bp, Artificial Sequence
  chemically synthesized
ctttactataaggtactctcta

SEQ ID NO: 632465 - DNA, 22 bp, Artificial Sequence
  chemically synthesized
tctactttactataaggtactc

SEQ ID NO: 632466 - DNA, 22 bp, Artificial Sequence
  chemically synthesized
tagagagtaccttatagtaaag

SEQ ID NO: 632467 - DNA, 22 bp, Artificial Sequence
  chemically synthesized
agagagtaccttatagtaaagt

SEQ ID NO: 632468 - DNA, 22 bp, Artificial Sequence
  chemically synthesized
gagagtaccttatagtaaagta

SEQ ID NO: 632469 - DNA, 22 bp, Artificial Sequence
  chemically synthesized
tagtgtaataagtcattatcta

SEQ ID NO: 632470 - DNA, 22 bp, Artificial Sequence
  chemically synthesized
atagtaaagtagataatgactt

SEQ ID NO: 632471 - DNA, 22 bp, Artificial Sequence
  chemically synthesized
tagtaaagtagataatgactta

SEQ ID NO: 632472 - DNA, 22 bp, Artificial Sequence
  chemically synthesized
aattatagtgtaataagtcatt

SEQ ID NO: 632473 - DNA, 22 bp, Artificial Sequence
  chemically synthesized
attacactataattcaatttct

SEQ ID NO: 632474 - DNA, 22 bp, Artificial Sequence
  chemically synthesized
ttacactataattcaatttcta

SEQ ID NO: 632475 - DNA, 22 bp, Artificial Sequence
  chemically synthesized
taagtatatgtgtagaaattga

SEQ ID NO: 632476 - DNA, 22 bp, Artificial Sequence
  chemically synthesized
gtaagtatatgtgtagaaattg

SEQ ID NO: 632477 - DNA, 22 bp, Artificial Sequence
  chemically synthesized
tgtaagtatatgtgtagaaatt

SEQ ID NO: 632478 - DNA, 22 bp, Artificial Sequence
  chemically synthesized
cactataattcaatttctacac

SEQ ID NO: 632479 - DNA, 22 bp, Artificial Sequence
  chemically synthesized
ctttgtaagtatatgtgtagaa

SEQ ID NO: 632480 - DNA, 22 bp, Artificial Sequence
  chemically synthesized
cctttgtaagtatatgtgtaga

SEQ ID NO: 632481 - DNA, 22 bp, Artificial Sequence
  chemically synthesized
taattcaatttctacacatata

SEQ ID NO: 632482 - DNA, 22 bp, Artificial Sequence
  chemically synthesized
ttcctttgtaagtatatgtgta

SEQ ID NO: 632483 - DNA, 22 bp, Artificial Sequence
  chemically synthesized
atctcttcctttgtaagtatat

SEQ ID NO: 632484 - DNA, 22 bp, Artificial Sequence
  chemically synthesized
aatttctacacatatacttaca

SEQ ID NO: 632485 - DNA, 22 bp, Artificial Sequence
  chemically synthesized
taatctcttcctttgtaagtat

SEQ ID NO: 632486 - DNA, 22 bp, Artificial Sequence
  chemically synthesized
ctacacatatacttacaaagga

SEQ ID NO: 632487 - DNA, 22 bp, Artificial Sequence
  chemically synthesized
tctctaatctcttcctttgtaa

SEQ ID NO: 632488 - DNA, 22 bp, Artificial Sequence
  chemically synthesized
tacacatatacttacaaaggaa

SEQ ID NO: 632489 - DNA, 22 bp, Artificial Sequence
  chemically synthesized
cacatatacttacaaaggaaga

SEQ ID NO: 632490 - DNA, 22 bp, Artificial Sequence
  chemically synthesized
tctatctctaatctcttccttt

SEQ ID NO: 632491 - DNA, 22 bp, Artificial Sequence
  chemically synthesized
atctgtctatctctaatctctt

SEQ ID NO: 632492 - DNA, 22 bp, Artificial Sequence
  chemically synthesized
tctaatctgtctatctctaatc

SEQ ID NO: 632493 - DNA, 22 bp, Artificial Sequence
  chemically synthesized
acaaaggaagagattagagata

SEQ ID NO: 632494 - DNA, 22 bp, Artificial Sequence
  chemically synthesized
caaaggaagagattagagatag

SEQ ID NO: 632495 - DNA, 22 bp, Artificial Sequence
  chemically synthesized
tatctaatctgtctatctctaa

SEQ ID NO: 632496 - DNA, 22 bp, Artificial Sequence
  chemically synthesized
ctatctaatctgtctatctcta

SEQ ID NO: 632497 - DNA, 22 bp, Artificial Sequence
  chemically synthesized
gccaatttctatctaatctgtc

SEQ ID NO: 632498 - DNA, 22 bp, Artificial Sequence
  chemically synthesized
gagatagacagattagatagaa

SEQ ID NO: 632499 - DNA, 22 bp, Artificial Sequence
  chemically synthesized
aatattagccaatttctatcta

SEQ ID NO: 632500 - DNA, 22 bp, Artificial Sequence
  chemically synthesized
aacactgaatattagccaattt

SEQ ID NO: 632501 - DNA, 22 bp, Artificial Sequence
  chemically synthesized
gaacactgaatattagccaatt

SEQ ID NO: 632502 - DNA, 22 bp, Artificial Sequence
  chemically synthesized
gatagaaattggctaatattca

SEQ ID NO: 632503 - DNA, 22 bp, Artificial Sequence
  chemically synthesized
agtgtatatttgaacactgaat

SEQ ID NO: 632504 - DNA, 22 bp, Artificial Sequence
  chemically synthesized
gctaatattcagtgttcaaata

SEQ ID NO: 632505 - DNA, 22 bp, Artificial Sequence
  chemically synthesized
agtggctcagtgtatatttgaa

SEQ ID NO: 632506 - DNA, 22 bp, Artificial Sequence
  chemically synthesized
gagtggctcagtgtatatttga

SEQ ID NO: 632507 - DNA, 22 bp, Artificial Sequence
  chemically synthesized
atattcagtgttcaaatataca

SEQ ID NO: 632508 - DNA, 22 bp, Artificial Sequence
  chemically synthesized
agtgttcaaatatacactgagc

SEQ ID NO: 632509 - DNA, 22 bp, Artificial Sequence
  chemically synthesized
ggagatttgagtggctcagtgt

SEQ ID NO: 632510 - DNA, 22 bp, Artificial Sequence
  chemically synthesized
gggagatttgagtggctcagtg

SEQ ID NO: 632511 - DNA, 22 bp, Artificial Sequence
  chemically synthesized
aaatatacactgagccactcaa

SEQ ID NO: 632512 - DNA, 22 bp, Artificial Sequence
  chemically synthesized
acaaacacttgggagatttgag

SEQ ID NO: 632513 - DNA, 22 bp, Artificial Sequence
  chemically synthesized
ttcacaaacacttgggagattt

SEQ ID NO: 632514 - DNA, 22 bp, Artificial Sequence
  chemically synthesized
agccactcaaatctcccaagtg

SEQ ID NO: 632515 - DNA, 22 bp, Artificial Sequence
  chemically synthesized
gttgttcacaaacacttgggag

SEQ ID NO: 632516 - DNA, 22 bp, Artificial Sequence
  chemically synthesized
agttgttcacaaacacttggga

SEQ ID NO: 632517 - DNA, 22 bp, Artificial Sequence
  chemically synthesized
aaatctcccaagtgtttgtgaa

SEQ ID NO: 632518 - DNA, 22 bp, Artificial Sequence
  chemically synthesized
gatatacttagttgttcacaaa

SEQ ID NO: 632519 - DNA, 22 bp, Artificial Sequence
  chemically synthesized
tagatatacttagttgttcaca

SEQ ID NO: 632520 - DNA, 22 bp, Artificial Sequence
  chemically synthesized
ccaagtgtttgtgaacaactaa

SEQ ID NO: 632521 - DNA, 22 bp, Artificial Sequence
  chemically synthesized
gtctctagatatacttagttgt

SEQ ID NO: 632522 - DNA, 22 bp, Artificial Sequence
  chemically synthesized
gttggtctctagatatacttag

SEQ ID NO: 632523 - DNA, 22 bp, Artificial Sequence
  chemically synthesized
tggttggtctctagatatactt

SEQ ID NO: 632524 - DNA, 22 bp, Artificial Sequence
  chemically synthesized
ctggttggtctctagatatact

SEQ ID NO: 632525 - DNA, 22 bp, Artificial Sequence
  chemically synthesized
gtgaacaactaagtatatctag

SEQ ID NO: 632526 - DNA, 22 bp, Artificial Sequence
  chemically synthesized
tctggttggtctctagatatac

SEQ ID NO: 632527 - DNA, 22 bp, Artificial Sequence
  chemically synthesized
tgaacaactaagtatatctaga

SEQ ID NO: 632528 - DNA, 22 bp, Artificial Sequence
  chemically synthesized
tatctttctggttggtctctag

SEQ ID NO: 632529 - DNA, 22 bp, Artificial Sequence
  chemically synthesized
agtatatctagagaccaaccag

SEQ ID NO: 632530 - DNA, 22 bp, Artificial Sequence
  chemically synthesized
tgattatatctttctggttggt

SEQ ID NO: 632531 - DNA, 22 bp, Artificial Sequence
  chemically synthesized
gtgattatatctttctggttgg

SEQ ID NO: 632532 - DNA, 22 bp, Artificial Sequence
  chemically synthesized
tgtgattatatctttctggttg

SEQ ID NO: 632533 - DNA, 22 bp, Artificial Sequence
  chemically synthesized
agctttgtgattatatctttct

SEQ ID NO: 632534 - DNA, 22 bp, Artificial Sequence
  chemically synthesized
gagaccaaccagaaagatataa

SEQ ID NO: 632535 - DNA, 22 bp, Artificial Sequence
  chemically synthesized
aagatatgaatgtgtaaacatt

SEQ ID NO: 632536 - DNA, 22 bp, Artificial Sequence
  chemically synthesized
aatgtttacacattcatatctt

SEQ ID NO: 632537 - DNA, 22 bp, Artificial Sequence
  chemically synthesized
acacattcatatcttgaatatg

SEQ ID NO: 632538 - DNA, 22 bp, Artificial Sequence
  chemically synthesized
cacattcatatcttgaatatgc

SEQ ID NO: 632539 - DNA, 22 bp, Artificial Sequence
  chemically synthesized
atatcttgaatatgctcctgct

SEQ ID NO: 632540 - DNA, 22 bp, Artificial Sequence
  chemically synthesized
cataataggcaatataagcagg

SEQ ID NO: 632541 - DNA, 22 bp, Artificial Sequence
  chemically synthesized
gaatatgctcctgcttatattg

SEQ ID NO: 632542 - DNA, 22 bp, Artificial Sequence
  chemically synthesized
aatatgctcctgcttatattgc

SEQ ID NO: 632543 - DNA, 22 bp, Artificial Sequence
  chemically synthesized
tcctgcataataggcaatataa

SEQ ID NO: 632544 - DNA, 22 bp, Artificial Sequence
  chemically synthesized
ctgcttatattgcctattatgc

SEQ ID NO: 632545 - DNA, 22 bp, Artificial Sequence
  chemically synthesized
cttatattgcctattatgcagg

SEQ ID NO: 632546 - DNA, 22 bp, Artificial Sequence
  chemically synthesized
atattgcctattatgcaggata

SEQ ID NO: 632547 - DNA, 22 bp, Artificial Sequence
  chemically synthesized
tattgcctattatgcaggatag

SEQ ID NO: 632548 - DNA, 22 bp, Artificial Sequence
  chemically synthesized
cctattatgcaggatagtgttg

SEQ ID NO: 632549 - DNA, 22 bp, Artificial Sequence
  chemically synthesized
ttatgcaggatagtgttggcca

SEQ ID NO: 632550 - DNA, 22 bp, Artificial Sequence
  chemically synthesized
gtgataaaccgatggccaacac

SEQ ID NO: 632551 - DNA, 22 bp, Artificial Sequence
  chemically synthesized
agtgataaaccgatggccaaca

SEQ ID NO: 632552 - DNA, 22 bp, Artificial Sequence
  chemically synthesized
tgcaggatagtgttggccatcg

SEQ ID NO: 632553 - DNA, 22 bp, Artificial Sequence
  chemically synthesized
catttagtgataaaccgatggc

SEQ ID NO: 632554 - DNA, 22 bp, Artificial Sequence
  chemically synthesized
tccatttagtgataaaccgatg

SEQ ID NO: 632555 - DNA, 22 bp, Artificial Sequence
  chemically synthesized
ctccatttagtgataaaccgat

SEQ ID NO: 632556 - DNA, 22 bp, Artificial Sequence
  chemically synthesized
gccatcggtttatcactaaatg

SEQ ID NO: 632557 - DNA, 22 bp, Artificial Sequence
  chemically synthesized
ataaatgagtggcatgcttctc

SEQ ID NO: 632558 - DNA, 22 bp, Artificial Sequence
  chemically synthesized
atcactaaatggagaagcatgc

SEQ ID NO: 632559 - DNA, 22 bp, Artificial Sequence
  chemically synthesized
tcactaaatggagaagcatgcc

SEQ ID NO: 632560 - DNA, 22 bp, Artificial Sequence
  chemically synthesized
aatggagaagcatgccactcat

SEQ ID NO: 632561 - DNA, 22 bp, Artificial Sequence
  chemically synthesized
tcaaaattaataaatgagtggc

SEQ ID NO: 632562 - DNA, 22 bp, Artificial Sequence
  chemically synthesized
ttatcaaaattaataaatgagt

SEQ ID NO: 632563 - DNA, 22 bp, Artificial Sequence
  chemically synthesized
aactgttatcaaaattaataaa

SEQ ID NO: 632564 - DNA, 22 bp, Artificial Sequence
  chemically synthesized
ctaaactgttatcaaaattaat

SEQ ID NO: 632565 - DNA, 22 bp, Artificial Sequence
  chemically synthesized
gctaaactgttatcaaaattaa

SEQ ID NO: 632566 - DNA, 22 bp, Artificial Sequence
  chemically synthesized
tgctaaactgttatcaaaatta

SEQ ID NO: 632567 - DNA, 22 bp, Artificial Sequence
  chemically synthesized
atttattaattttgataacagt

SEQ ID NO: 632568 - DNA, 22 bp, Artificial Sequence
  chemically synthesized
atggctttgctaaactgttatc

SEQ ID NO: 632569 - DNA, 22 bp, Artificial Sequence
  chemically synthesized
aatggctttgctaaactgttat

SEQ ID NO: 632570 - DNA, 22 bp, Artificial Sequence
  chemically synthesized
attaattttgataacagtttag

SEQ ID NO: 632571 - DNA, 22 bp, Artificial Sequence
  chemically synthesized
ttaattttgataacagtttagc

SEQ ID NO: 632572 - DNA, 22 bp, Artificial Sequence
  chemically synthesized
tcttaatggctttgctaaactg

SEQ ID NO: 632573 - DNA, 22 bp, Artificial Sequence
  chemically synthesized
atcttaatggctttgctaaact

SEQ ID NO: 632574 - DNA, 22 bp, Artificial Sequence
  chemically synthesized
attttgataacagtttagcaaa

SEQ ID NO: 632575 - DNA, 22 bp, Artificial Sequence
  chemically synthesized
tgataacagtttagcaaagcca

SEQ ID NO: 632576 - DNA, 22 bp, Artificial Sequence
  chemically synthesized
atcttatcttaatggctttgct

SEQ ID NO: 632577 - DNA, 22 bp, Artificial Sequence
  chemically synthesized
gataacagtttagcaaagccat

SEQ ID NO: 632578 - DNA, 22 bp, Artificial Sequence
  chemically synthesized
ataacagtttagcaaagccatt

SEQ ID NO: 632579 - DNA, 22 bp, Artificial Sequence
  chemically synthesized
taatcttatcttaatggctttg

SEQ ID NO: 632580 - DNA, 22 bp, Artificial Sequence
  chemically synthesized
ctaatcttatcttaatggcttt

SEQ ID NO: 632581 - DNA, 22 bp, Artificial Sequence
  chemically synthesized
ggcttctaatcttatcttaatg

SEQ ID NO: 632582 - DNA, 22 bp, Artificial Sequence
  chemically synthesized
agcaaagccattaagataagat

SEQ ID NO: 632583 - DNA, 22 bp, Artificial Sequence
  chemically synthesized
gcaaagccattaagataagatt

SEQ ID NO: 632584 - DNA, 22 bp, Artificial Sequence
  chemically synthesized
agttaggcttctaatcttatct

SEQ ID NO: 632585 - DNA, 22 bp, Artificial Sequence
  chemically synthesized
agcaggttaagttaggcttcta

SEQ ID NO: 632586 - DNA, 22 bp, Artificial Sequence
  chemically synthesized
agataagattagaagcctaact

SEQ ID NO: 632587 - DNA, 22 bp, Artificial Sequence
  chemically synthesized
tggccattcagcaggttaagtt

SEQ ID NO: 632588 - DNA, 22 bp, Artificial Sequence
  chemically synthesized
atggccattcagcaggttaagt

SEQ ID NO: 632589 - DNA, 22 bp, Artificial Sequence
  chemically synthesized
tttatggccattcagcaggtta

SEQ ID NO: 632590 - DNA, 22 bp, Artificial Sequence
  chemically synthesized
gaagcctaacttaacctgctga

SEQ ID NO: 632591 - DNA, 22 bp, Artificial Sequence
  chemically synthesized
atttatggccattcagcaggtt

SEQ ID NO: 632592 - DNA, 22 bp, Artificial Sequence
  chemically synthesized
acttaacctgctgaatggccat

SEQ ID NO: 632593 - DNA, 22 bp, Artificial Sequence
  chemically synthesized
aacctgctgaatggccataaat

SEQ ID NO: 632594 - DNA, 22 bp, Artificial Sequence
  chemically synthesized
acctgctgaatggccataaata

SEQ ID NO: 632595 - DNA, 22 bp, Artificial Sequence
  chemically synthesized
ctgaatggccataaataaggca

SEQ ID NO: 632596 - DNA, 22 bp, Artificial Sequence
  chemically synthesized
aatggccataaataaggcactt

SEQ ID NO: 632597 - DNA, 22 bp, Artificial Sequence
  chemically synthesized
gaagccaagaaaagtcaagtgc

SEQ ID NO: 632598 - DNA, 22 bp, Artificial Sequence
  chemically synthesized
acaaagagtacctggaagccaa

SEQ ID NO: 632599 - DNA, 22 bp, Artificial Sequence
  chemically synthesized
cacaaagagtacctggaagcca

SEQ ID NO: 632600 - DNA, 22 bp, Artificial Sequence
  chemically synthesized
tcacaaagagtacctggaagcc

SEQ ID NO: 632601 - DNA, 22 bp, Artificial Sequence
  chemically synthesized
gacttttcttggcttccaggta

SEQ ID NO: 632602 - DNA, 22 bp, Artificial Sequence
  chemically synthesized
acttttcttggcttccaggtac

SEQ ID NO: 632603 - DNA, 22 bp, Artificial Sequence
  chemically synthesized
ttttcacaaagagtacctggaa

SEQ ID NO: 632604 - DNA, 22 bp, Artificial Sequence
  chemically synthesized
attttcacaaagagtacctgga

SEQ ID NO: 632605 - DNA, 22 bp, Artificial Sequence
  chemically synthesized
tattttcacaaagagtacctgg

SEQ ID NO: 632606 - DNA, 22 bp, Artificial Sequence
  chemically synthesized
ttattttcacaaagagtacctg

SEQ ID NO: 632607 - DNA, 22 bp, Artificial Sequence
  chemically synthesized
ttcttggcttccaggtactctt

SEQ ID NO: 632608 - DNA, 22 bp, Artificial Sequence
  chemically synthesized
tcttggcttccaggtactcttt

SEQ ID NO: 632609 - DNA, 22 bp, Artificial Sequence
  chemically synthesized
cttggcttccaggtactctttg

SEQ ID NO: 632610 - DNA, 22 bp, Artificial Sequence
  chemically synthesized
ttggcttccaggtactctttgt

SEQ ID NO: 632611 - DNA, 22 bp, Artificial Sequence
  chemically synthesized
tcttttattttcacaaagagta

SEQ ID NO: 632612 - DNA, 22 bp, Artificial Sequence
  chemically synthesized
atcttttattttcacaaagagt

SEQ ID NO: 632613 - DNA, 22 bp, Artificial Sequence
  chemically synthesized
ggcttccaggtactctttgtga

SEQ ID NO: 632614 - DNA, 22 bp, Artificial Sequence
  chemically synthesized
tatcttttattttcacaaagag

SEQ ID NO: 632615 - DNA, 22 bp, Artificial Sequence
  chemically synthesized
gcttccaggtactctttgtgaa

SEQ ID NO: 632616 - DNA, 22 bp, Artificial Sequence
  chemically synthesized
tttatcttttattttcacaaag

SEQ ID NO: 632617 - DNA, 22 bp, Artificial Sequence
  chemically synthesized
ctttatcttttattttcacaaa

SEQ ID NO: 632618 - DNA, 22 bp, Artificial Sequence
  chemically synthesized
tctttatcttttattttcacaa

SEQ ID NO: 632619 - DNA, 22 bp, Artificial Sequence
  chemically synthesized
ccaggtactctttgtgaaaata

SEQ ID NO: 632620 - DNA, 22 bp, Artificial Sequence
  chemically synthesized
caggtactctttgtgaaaataa

SEQ ID NO: 632621 - DNA, 22 bp, Artificial Sequence
  chemically synthesized
acctttctttatcttttatttt

SEQ ID NO: 632622 - DNA, 22 bp, Artificial Sequence
  chemically synthesized
tttgtgaaaataaaagataaag

SEQ ID NO: 632623 - DNA, 22 bp, Artificial Sequence
  chemically synthesized
tgtgaaaataaaagataaagaa

SEQ ID NO: 632624 - DNA, 22 bp, Artificial Sequence
  chemically synthesized
gtgaaaataaaagataaagaaa

SEQ ID NO: 632625 - DNA, 22 bp, Artificial Sequence
  chemically synthesized
tgaaaataaaagataaagaaag

SEQ ID NO: 632626 - DNA, 22 bp, Artificial Sequence
  chemically synthesized
aaggtgtcagctaacctttctt

SEQ ID NO: 632627 - DNA, 22 bp, Artificial Sequence
  chemically synthesized
gtcctgaaggtgtcagctaacc

SEQ ID NO: 632628 - DNA, 22 bp, Artificial Sequence
  chemically synthesized
ccacagagttggtcctgaaggt

SEQ ID NO: 632629 - DNA, 22 bp, Artificial Sequence
  chemically synthesized
gccacagagttggtcctgaagg

SEQ ID NO: 632630 - DNA, 22 bp, Artificial Sequence
  chemically synthesized
gctgacaccttcaggaccaact

SEQ ID NO: 632631 - DNA, 22 bp, Artificial Sequence
  chemically synthesized
ccccttgccacagagttggtcc

SEQ ID NO: 632632 - DNA, 22 bp, Artificial Sequence
  chemically synthesized
acaccttcaggaccaactctgt

SEQ ID NO: 632633 - DNA, 22 bp, Artificial Sequence
  chemically synthesized
ttgccccttgccacagagttgg

SEQ ID NO: 632634 - DNA, 22 bp, Artificial Sequence
  chemically synthesized
tgttgccccttgccacagagtt

SEQ ID NO: 632635 - DNA, 22 bp, Artificial Sequence
  chemically synthesized
ctgttgccccttgccacagagt

SEQ ID NO: 632636 - DNA, 22 bp, Artificial Sequence
  chemically synthesized
tctgttgccccttgccacagag

SEQ ID NO: 632637 - DNA, 22 bp, Artificial Sequence
  chemically synthesized
ttctgttgccccttgccacaga

SEQ ID NO: 632638 - DNA, 22 bp, Artificial Sequence
  chemically synthesized
caggaccaactctgtggcaagg

SEQ ID NO: 632639 - DNA, 22 bp, Artificial Sequence
  chemically synthesized
aggaccaactctgtggcaaggg

SEQ ID NO: 632640 - DNA, 22 bp, Artificial Sequence
  chemically synthesized
caacttttctgttgccccttgc

SEQ ID NO: 632641 - DNA, 22 bp, Artificial Sequence
  chemically synthesized
acaacttttctgttgccccttg

SEQ ID NO: 632642 - DNA, 22 bp, Artificial Sequence
  chemically synthesized
aaatttacaacttttctgttgc

SEQ ID NO: 632643 - DNA, 22 bp, Artificial Sequence
  chemically synthesized
tgtggcaaggggcaacagaaaa

SEQ ID NO: 632644 - DNA, 22 bp, Artificial Sequence
  chemically synthesized
tggcaaggggcaacagaaaagt

SEQ ID NO: 632645 - DNA, 22 bp, Artificial Sequence
  chemically synthesized
tgtacctcaaatttacaacttt

SEQ ID NO: 632646 - DNA, 22 bp, Artificial Sequence
  chemically synthesized
ttatgtacctcaaatttacaac

SEQ ID NO: 632647 - DNA, 22 bp, Artificial Sequence
  chemically synthesized
taaatttgaggtacataatagc

SEQ ID NO: 632648 - DNA, 22 bp, Artificial Sequence
  chemically synthesized
gaggtacataatagcttaccta

SEQ ID NO: 632649 - DNA, 22 bp, Artificial Sequence
  chemically synthesized
aggtacataatagcttacctat

SEQ ID NO: 632650 - DNA, 22 bp, Artificial Sequence
  chemically synthesized
ataaacataaagtatatagata

SEQ ID NO: 632651 - DNA, 22 bp, Artificial Sequence
  chemically synthesized
cataaacataaagtatatagat

SEQ ID NO: 632652 - DNA, 22 bp, Artificial Sequence
  chemically synthesized
ttcataaacataaagtatatag

SEQ ID NO: 632653 - DNA, 22 bp, Artificial Sequence
  chemically synthesized
tgctcttcataaacataaagta

SEQ ID NO: 632654 - DNA, 22 bp, Artificial Sequence
  chemically synthesized
acctatctatatactttatgtt

SEQ ID NO: 632655 - DNA, 22 bp, Artificial Sequence
  chemically synthesized
atgctcttcataaacataaagt

SEQ ID NO: 632656 - DNA, 22 bp, Artificial Sequence
  chemically synthesized
cctatctatatactttatgttt

SEQ ID NO: 632657 - DNA, 22 bp, Artificial Sequence
  chemically synthesized
tctatatactttatgtttatga

SEQ ID NO: 632658 - DNA, 22 bp, Artificial Sequence
  chemically synthesized
aaaaacttatgctcttcataaa

SEQ ID NO: 632659 - DNA, 22 bp, Artificial Sequence
  chemically synthesized
tatactttatgtttatgaagag

SEQ ID NO: 632660 - DNA, 22 bp, Artificial Sequence
  chemically synthesized
aaaaaacttatgctcttcataa

SEQ ID NO: 632661 - DNA, 22 bp, Artificial Sequence
  chemically synthesized
taaaaaacttatgctcttcata

SEQ ID NO: 632662 - DNA, 22 bp, Artificial Sequence
  chemically synthesized
ttaaaaaacttatgctcttcat

SEQ ID NO: 632663 - DNA, 22 bp, Artificial Sequence
  chemically synthesized
tatgtttatgaagagcataagt

SEQ ID NO: 632664 - DNA, 22 bp, Artificial Sequence
  chemically synthesized
atgtttatgaagagcataagtt

SEQ ID NO: 632665 - DNA, 22 bp, Artificial Sequence
  chemically synthesized
tgtttatgaagagcataagttt

SEQ ID NO: 632666 - DNA, 22 bp, Artificial Sequence
  chemically synthesized
atgaagagcataagttttttaa

SEQ ID NO: 632667 - DNA, 22 bp, Artificial Sequence
  chemically synthesized
tgaagagcataagttttttaaa

SEQ ID NO: 632668 - DNA, 22 bp, Artificial Sequence
  chemically synthesized
cccacagaggaaaagccgtttt

SEQ ID NO: 632669 - DNA, 22 bp, Artificial Sequence
  chemically synthesized
tttaaaaacggcttttcctctg

SEQ ID NO: 632670 - DNA, 22 bp, Artificial Sequence
  chemically synthesized
gataattgcccacagaggaaaa

SEQ ID NO: 632671 - DNA, 22 bp, Artificial Sequence
  chemically synthesized
ttaaaaacggcttttcctctgt

SEQ ID NO: 632672 - DNA, 22 bp, Artificial Sequence
  chemically synthesized
taaaaacggcttttcctctgtg

SEQ ID NO: 632673 - DNA, 22 bp, Artificial Sequence
  chemically synthesized
aaaaacggcttttcctctgtgg

SEQ ID NO: 632674 - DNA, 22 bp, Artificial Sequence
  chemically synthesized
ctagataattgcccacagagga

SEQ ID NO: 632675 - DNA, 22 bp, Artificial Sequence
  chemically synthesized
aaaacggcttttcctctgtggg

SEQ ID NO: 632676 - DNA, 22 bp, Artificial Sequence
  chemically synthesized
accctgctagataattgcccac

SEQ ID NO: 632677 - DNA, 22 bp, Artificial Sequence
  chemically synthesized
aaccctgctagataattgccca

SEQ ID NO: 632678 - DNA, 22 bp, Artificial Sequence
  chemically synthesized
cttaaccctgctagataattgc

SEQ ID NO: 632679 - DNA, 22 bp, Artificial Sequence
  chemically synthesized
ttcctctgtgggcaattatcta

SEQ ID NO: 632680 - DNA, 22 bp, Artificial Sequence
  chemically synthesized
acttaaccctgctagataattg

SEQ ID NO: 632681 - DNA, 22 bp, Artificial Sequence
  chemically synthesized
tcctctgtgggcaattatctag

SEQ ID NO: 632682 - DNA, 22 bp, Artificial Sequence
  chemically synthesized
cctctgtgggcaattatctagc

SEQ ID NO: 632683 - DNA, 22 bp, Artificial Sequence
  chemically synthesized
ctctgtgggcaattatctagca

SEQ ID NO: 632684 - DNA, 22 bp, Artificial Sequence
  chemically synthesized
tgtgggcaattatctagcaggg

SEQ ID NO: 632685 - DNA, 22 bp, Artificial Sequence
  chemically synthesized
tgggcaattatctagcagggtt

SEQ ID NO: 632686 - DNA, 22 bp, Artificial Sequence
  chemically synthesized
tctagcagggttaagtaaacca

SEQ ID NO: 632687 - DNA, 22 bp, Artificial Sequence
  chemically synthesized
aataccaccgcgtggtttactt

SEQ ID NO: 632688 - DNA, 22 bp, Artificial Sequence
  chemically synthesized
ttaaataccaccgcgtggttta

SEQ ID NO: 632689 - DNA, 22 bp, Artificial Sequence
  chemically synthesized
gcagggttaagtaaaccacgcg

SEQ ID NO: 632690 - DNA, 22 bp, Artificial Sequence
  chemically synthesized
agtaaaccacgcggtggtattt

SEQ ID NO: 632691 - DNA, 22 bp, Artificial Sequence
  chemically synthesized
gtggaaatgtgctattaaatac

SEQ ID NO: 632692 - DNA, 22 bp, Artificial Sequence
  chemically synthesized
agtggaaatgtgctattaaata

SEQ ID NO: 632693 - DNA, 22 bp, Artificial Sequence
  chemically synthesized
acatttagtggaaatgtgctat

SEQ ID NO: 632694 - DNA, 22 bp, Artificial Sequence
  chemically synthesized
aatagcacatttccactaaatg

SEQ ID NO: 632695 - DNA, 22 bp, Artificial Sequence
  chemically synthesized
atagcacatttccactaaatgt

SEQ ID NO: 632696 - DNA, 22 bp, Artificial Sequence
  chemically synthesized
ccactaaatgtcagacctctgg

SEQ ID NO: 632697 - DNA, 22 bp, Artificial Sequence
  chemically synthesized
cactaaatgtcagacctctggc

SEQ ID NO: 632698 - DNA, 22 bp, Artificial Sequence
  chemically synthesized
aaaacagatgtgagagccagag

SEQ ID NO: 632699 - DNA, 22 bp, Artificial Sequence
  chemically synthesized
aatgtcagacctctggctctca

SEQ ID NO: 632700 - DNA, 22 bp, Artificial Sequence
  chemically synthesized
agtaactcaaaacagatgtgag

SEQ ID NO: 632701 - DNA, 22 bp, Artificial Sequence
  chemically synthesized
gagtaactcaaaacagatgtga

SEQ ID NO: 632702 - DNA, 22 bp, Artificial Sequence
  chemically synthesized
tttgagtaactcaaaacagatg

SEQ ID NO: 632703 - DNA, 22 bp, Artificial Sequence
  chemically synthesized
tggctctcacatctgttttgag

SEQ ID NO: 632704 - DNA, 22 bp, Artificial Sequence
  chemically synthesized
gctctcacatctgttttgagtt

SEQ ID NO: 632705 - DNA, 22 bp, Artificial Sequence
  chemically synthesized
gacagctgtttgagtaactcaa

SEQ ID NO: 632706 - DNA, 22 bp, Artificial Sequence
  chemically synthesized
tcacatctgttttgagttactc

SEQ ID NO: 632707 - DNA, 22 bp, Artificial Sequence
  chemically synthesized
ggacagctgtttgagtaactca

SEQ ID NO: 632708 - DNA, 22 bp, Artificial Sequence
  chemically synthesized
tggacagctgtttgagtaactc

SEQ ID NO: 632709 - DNA, 22 bp, Artificial Sequence
  chemically synthesized
acatctgttttgagttactcaa

SEQ ID NO: 632710 - DNA, 22 bp, Artificial Sequence
  chemically synthesized
ttttggacagctgtttgagtaa

SEQ ID NO: 632711 - DNA, 22 bp, Artificial Sequence
  chemically synthesized
ttttgagttactcaaacagctg

SEQ ID NO: 632712 - DNA, 22 bp, Artificial Sequence
  chemically synthesized
cagctgttttggacagctgttt

SEQ ID NO: 632713 - DNA, 22 bp, Artificial Sequence
  chemically synthesized
tgagttactcaaacagctgtcc

SEQ ID NO: 632714 - DNA, 22 bp, Artificial Sequence
  chemically synthesized
gagttactcaaacagctgtcca

SEQ ID NO: 632715 - DNA, 22 bp, Artificial Sequence
  chemically synthesized
ctacagctgttttggacagctg

SEQ ID NO: 632716 - DNA, 22 bp, Artificial Sequence
  chemically synthesized
agttactcaaacagctgtccaa

SEQ ID NO: 632717 - DNA, 22 bp, Artificial Sequence
  chemically synthesized
ctcaaacagctgtccaaaacag

SEQ ID NO: 632718 - DNA, 22 bp, Artificial Sequence
  chemically synthesized
atgattgctacagctgttttgg

SEQ ID NO: 632719 - DNA, 22 bp, Artificial Sequence
  chemically synthesized
aaacagctgtccaaaacagctg

SEQ ID NO: 632720 - DNA, 22 bp, Artificial Sequence
  chemically synthesized
tccaaaacagctgtagcaatca

SEQ ID NO: 632721 - DNA, 22 bp, Artificial Sequence
  chemically synthesized
caaaaaacaaagttcatgattg

SEQ ID NO: 632722 - DNA, 22 bp, Artificial Sequence
  chemically synthesized
tgttacaaaaaacaaagttcat

SEQ ID NO: 632723 - DNA, 22 bp, Artificial Sequence
  chemically synthesized
ttgtgttacaaaaaacaaagtt

SEQ ID NO: 632724 - DNA, 22 bp, Artificial Sequence
  chemically synthesized
tagcaatcatgaactttgtttt

SEQ ID NO: 632725 - DNA, 22 bp, Artificial Sequence
  chemically synthesized
attgttgtgttacaaaaaacaa

SEQ ID NO: 632726 - DNA, 22 bp, Artificial Sequence
  chemically synthesized
tcattgttgtgttacaaaaaac

SEQ ID NO: 632727 - DNA, 22 bp, Artificial Sequence
  chemically synthesized
tgttttttgtaacacaacaatg

SEQ ID NO: 632728 - DNA, 22 bp, Artificial Sequence
  chemically synthesized
gttttttgtaacacaacaatga

SEQ ID NO: 632729 - DNA, 22 bp, Artificial Sequence
  chemically synthesized
ccatccatgttctcattgttgt

SEQ ID NO: 632730 - DNA, 22 bp, Artificial Sequence
  chemically synthesized
ttttttgtaacacaacaatgag

SEQ ID NO: 632731 - DNA, 22 bp, Artificial Sequence
  chemically synthesized
tttgtaacacaacaatgagaac

SEQ ID NO: 632732 - DNA, 22 bp, Artificial Sequence
  chemically synthesized
ttgtaacacaacaatgagaaca

SEQ ID NO: 632733 - DNA, 22 bp, Artificial Sequence
  chemically synthesized
tgtaacacaacaatgagaacat

SEQ ID NO: 632734 - DNA, 22 bp, Artificial Sequence
  chemically synthesized
acactaccatccatgttctcat

SEQ ID NO: 632735 - DNA, 22 bp, Artificial Sequence
  chemically synthesized
gtaacacaacaatgagaacatg

SEQ ID NO: 632736 - DNA, 22 bp, Artificial Sequence
  chemically synthesized
taacacaacaatgagaacatgg

SEQ ID NO: 632737 - DNA, 22 bp, Artificial Sequence
  chemically synthesized
taacactaccatccatgttctc

SEQ ID NO: 632738 - DNA, 22 bp, Artificial Sequence
  chemically synthesized
ttctaacactaccatccatgtt

SEQ ID NO: 632739 - DNA, 22 bp, Artificial Sequence
  chemically synthesized
attctaacactaccatccatgt

SEQ ID NO: 632740 - DNA, 22 bp, Artificial Sequence
  chemically synthesized
tattctaacactaccatccatg

SEQ ID NO: 632741 - DNA, 22 bp, Artificial Sequence
  chemically synthesized
tagttttattctaacactacca

SEQ ID NO: 632742 - DNA, 22 bp, Artificial Sequence
  chemically synthesized
atagttttattctaacactacc

SEQ ID NO: 632743 - DNA, 22 bp, Artificial Sequence
  chemically synthesized
tatagttttattctaacactac

SEQ ID NO: 632744 - DNA, 22 bp, Artificial Sequence
  chemically synthesized
agagacctttatagttttattc

SEQ ID NO: 632745 - DNA, 22 bp, Artificial Sequence
  chemically synthesized
atgtctcagagacctttatagt

SEQ ID NO: 632746 - DNA, 22 bp, Artificial Sequence
  chemically synthesized
ctaatgtctcagagacctttat

SEQ ID NO: 632747 - DNA, 22 bp, Artificial Sequence
  chemically synthesized
gaataaaactataaaggtctct

SEQ ID NO: 632748 - DNA, 22 bp, Artificial Sequence
  chemically synthesized
ccaagacgttgctaatgtctca

SEQ ID NO: 632749 - DNA, 22 bp, Artificial Sequence
  chemically synthesized
taaaggtctctgagacattagc

SEQ ID NO: 632750 - DNA, 22 bp, Artificial Sequence
  chemically synthesized
tgccaagacgttgctaatgtct

SEQ ID NO: 632751 - DNA, 22 bp, Artificial Sequence
  chemically synthesized
ctgccaagacgttgctaatgtc

SEQ ID NO: 632752 - DNA, 22 bp, Artificial Sequence
  chemically synthesized
tgagacattagcaacgtcttgg

SEQ ID NO: 632753 - DNA, 22 bp, Artificial Sequence
  chemically synthesized
agacattagcaacgtcttggca

SEQ ID NO: 632754 - DNA, 22 bp, Artificial Sequence
  chemically synthesized
ccgtggaagtttctgccaagac

SEQ ID NO: 632755 - DNA, 22 bp, Artificial Sequence
  chemically synthesized
gccgtggaagtttctgccaaga

SEQ ID NO: 632756 - DNA, 22 bp, Artificial Sequence
  chemically synthesized
tgccgtggaagtttctgccaag

SEQ ID NO: 632757 - DNA, 22 bp, Artificial Sequence
  chemically synthesized
ttgccgtggaagtttctgccaa

SEQ ID NO: 632758 - DNA, 22 bp, Artificial Sequence
  chemically synthesized
gcaacgtcttggcagaaacttc

SEQ ID NO: 632759 - DNA, 22 bp, Artificial Sequence
  chemically synthesized
agatttttgccgtggaagtttc

SEQ ID NO: 632760 - DNA, 22 bp, Artificial Sequence
  chemically synthesized
gagatttttgccgtggaagttt

SEQ ID NO: 632761 - DNA, 22 bp, Artificial Sequence
  chemically synthesized
tgagatttttgccgtggaagtt

SEQ ID NO: 632762 - DNA, 22 bp, Artificial Sequence
  chemically synthesized
aattttgagatttttgccgtgg

SEQ ID NO: 632763 - DNA, 22 bp, Artificial Sequence
  chemically synthesized
ggcagaaacttccacggcaaaa

SEQ ID NO: 632764 - DNA, 22 bp, Artificial Sequence
  chemically synthesized
aaattttgagatttttgccgtg

SEQ ID NO: 632765 - DNA, 22 bp, Artificial Sequence
  chemically synthesized
gcagaaacttccacggcaaaaa

SEQ ID NO: 632766 - DNA, 22 bp, Artificial Sequence
  chemically synthesized
aaaaaaatttaaattttgagat

SEQ ID NO: 632767 - DNA, 22 bp, Artificial Sequence
  chemically synthesized
ccacggcaaaaatctcaaaatt

SEQ ID NO: 632768 - DNA, 22 bp, Artificial Sequence
  chemically synthesized
caaaaaaatttaaattttgaga

SEQ ID NO: 632769 - DNA, 22 bp, Artificial Sequence
  chemically synthesized
cacggcaaaaatctcaaaattt

SEQ ID NO: 632770 - DNA, 22 bp, Artificial Sequence
  chemically synthesized
tcaaaaaaatttaaattttgag

SEQ ID NO: 632771 - DNA, 22 bp, Artificial Sequence
  chemically synthesized
tctttcaaaaaaatttaaattt

SEQ ID NO: 632772 - DNA, 22 bp, Artificial Sequence
  chemically synthesized
aattatctttcaaaaaaattta

SEQ ID NO: 632773 - DNA, 22 bp, Artificial Sequence
  chemically synthesized
gttgaattatctttcaaaaaaa

SEQ ID NO: 632774 - DNA, 22 bp, Artificial Sequence
  chemically synthesized
aaaatttaaatttttttgaaag

SEQ ID NO: 632775 - DNA, 22 bp, Artificial Sequence
  chemically synthesized
cctggttgaattatctttcaaa

SEQ ID NO: 632776 - DNA, 22 bp, Artificial Sequence
  chemically synthesized
gcctggttgaattatctttcaa

SEQ ID NO: 632777 - DNA, 22 bp, Artificial Sequence
  chemically synthesized
ttgcctggttgaattatctttc

SEQ ID NO: 632778 - DNA, 22 bp, Artificial Sequence
  chemically synthesized
cttgcctggttgaattatcttt

SEQ ID NO: 632779 - DNA, 22 bp, Artificial Sequence
  chemically synthesized
aaatttttttgaaagataattc

SEQ ID NO: 632780 - DNA, 22 bp, Artificial Sequence
  chemically synthesized
tcttgcctggttgaattatctt

SEQ ID NO: 632781 - DNA, 22 bp, Artificial Sequence
  chemically synthesized
aatttttttgaaagataattca

SEQ ID NO: 632782 - DNA, 22 bp, Artificial Sequence
  chemically synthesized
ttcttgcctggttgaattatct

SEQ ID NO: 632783 - DNA, 22 bp, Artificial Sequence
  chemically synthesized
ttttgaaagataattcaaccag

SEQ ID NO: 632784 - DNA, 22 bp, Artificial Sequence
  chemically synthesized
agtttttcttgcctggttgaat

SEQ ID NO: 632785 - DNA, 22 bp, Artificial Sequence
  chemically synthesized
tttgaaagataattcaaccagg

SEQ ID NO: 632786 - DNA, 22 bp, Artificial Sequence
  chemically synthesized
ttgaaagataattcaaccaggc

SEQ ID NO: 632787 - DNA, 22 bp, Artificial Sequence
  chemically synthesized
tgaaagataattcaaccaggca

SEQ ID NO: 632788 - DNA, 22 bp, Artificial Sequence
  chemically synthesized
gaaagataattcaaccaggcaa

SEQ ID NO: 632789 - DNA, 22 bp, Artificial Sequence
  chemically synthesized
aaagataattcaaccaggcaag

SEQ ID NO: 632790 - DNA, 22 bp, Artificial Sequence
  chemically synthesized
tgtgatctcagtttttcttgcc

SEQ ID NO: 632791 - DNA, 22 bp, Artificial Sequence
  chemically synthesized
atctatgtgatctcagtttttc

SEQ ID NO: 632792 - DNA, 22 bp, Artificial Sequence
  chemically synthesized
aaccaggcaagaaaaactgaga

SEQ ID NO: 632793 - DNA, 22 bp, Artificial Sequence
  chemically synthesized
aaaatactaatctatgtgatct

SEQ ID NO: 632794 - DNA, 22 bp, Artificial Sequence
  chemically synthesized
aaaaatactaatctatgtgatc

SEQ ID NO: 632795 - DNA, 22 bp, Artificial Sequence
  chemically synthesized
agatcacatagattagtatttt

SEQ ID NO: 632796 - DNA, 22 bp, Artificial Sequence
  chemically synthesized
aaccagtggtttaaaaatacta

SEQ ID NO: 632797 - DNA, 22 bp, Artificial Sequence
  chemically synthesized
tgaaccagtggtttaaaaatac

SEQ ID NO: 632798 - DNA, 22 bp, Artificial Sequence
  chemically synthesized
ctgaaccagtggtttaaaaata

SEQ ID NO: 632799 - DNA, 22 bp, Artificial Sequence
  chemically synthesized
tctgaaccagtggtttaaaaat

SEQ ID NO: 632800 - DNA, 22 bp, Artificial Sequence
  chemically synthesized
aatggattttctgaaccagtgg

SEQ ID NO: 632801 - DNA, 22 bp, Artificial Sequence
  chemically synthesized
gtatttttaaaccactggttca

SEQ ID NO: 632802 - DNA, 22 bp, Artificial Sequence
  chemically synthesized
ttaaaccactggttcagaaaat

SEQ ID NO: 632803 - DNA, 22 bp, Artificial Sequence
  chemically synthesized
taaaccactggttcagaaaatc

SEQ ID NO: 632804 - DNA, 22 bp, Artificial Sequence
  chemically synthesized
aaaccactggttcagaaaatcc

SEQ ID NO: 632805 - DNA, 22 bp, Artificial Sequence
  chemically synthesized
aaccactggttcagaaaatcca

SEQ ID NO: 632806 - DNA, 22 bp, Artificial Sequence
  chemically synthesized
caacccactaaatggattttct

SEQ ID NO: 632807 - DNA, 22 bp, Artificial Sequence
  chemically synthesized
gttgcaacccactaaatggatt

SEQ ID NO: 632808 - DNA, 22 bp, Artificial Sequence
  chemically synthesized
gttcagaaaatccatttagtgg

SEQ ID NO: 632809 - DNA, 22 bp, Artificial Sequence
  chemically synthesized
agaaaatccatttagtgggttg

SEQ ID NO: 632810 - DNA, 22 bp, Artificial Sequence
  chemically synthesized
aaaacaaaatgctggttgcaac

SEQ ID NO: 632811 - DNA, 22 bp, Artificial Sequence
  chemically synthesized
aaaaacaaaatgctggttgcaa

SEQ ID NO: 632812 - DNA, 22 bp, Artificial Sequence
  chemically synthesized
tttaaaaacaaaatgctggttg

SEQ ID NO: 632813 - DNA, 22 bp, Artificial Sequence
  chemically synthesized
atttaaaaacaaaatgctggtt

SEQ ID NO: 632814 - DNA, 22 bp, Artificial Sequence
  chemically synthesized
agtgggttgcaaccagcatttt

SEQ ID NO: 632815 - DNA, 22 bp, Artificial Sequence
  chemically synthesized
gtgggttgcaaccagcattttg

SEQ ID NO: 632816 - DNA, 22 bp, Artificial Sequence
  chemically synthesized
tttatttaaaaacaaaatgctg

SEQ ID NO: 632817 - DNA, 22 bp, Artificial Sequence
  chemically synthesized
atttatttaaaaacaaaatgct

SEQ ID NO: 632818 - DNA, 22 bp, Artificial Sequence
  chemically synthesized
tatttatttaaaaacaaaatgc

SEQ ID NO: 632819 - DNA, 22 bp, Artificial Sequence
  chemically synthesized
ttttatttatttaaaaacaaaa

SEQ ID NO: 632820 - DNA, 22 bp, Artificial Sequence
  chemically synthesized
tattttatttatttaaaaacaa

SEQ ID NO: 632821 - DNA, 22 bp, Artificial Sequence
  chemically synthesized
caaccagcattttgtttttaaa

SEQ ID NO: 632822 - DNA, 22 bp, Artificial Sequence
  chemically synthesized
ctattttatttatttaaaaaca

SEQ ID NO: 632823 - DNA, 22 bp, Artificial Sequence
  chemically synthesized
tctattttatttatttaaaaac

SEQ ID NO: 632824 - DNA, 22 bp, Artificial Sequence
  chemically synthesized
ttctattttatttatttaaaaa

SEQ ID NO: 632825 - DNA, 22 bp, Artificial Sequence
  chemically synthesized
tttttctattttatttatttaa

SEQ ID NO: 632826 - DNA, 22 bp, Artificial Sequence
  chemically synthesized
tgtttttaaataaataaaatag

SEQ ID NO: 632827 - DNA, 22 bp, Artificial Sequence
  chemically synthesized
gtttttaaataaataaaataga

SEQ ID NO: 632828 - DNA, 22 bp, Artificial Sequence
  chemically synthesized
tttttaaataaataaaatagaa

SEQ ID NO: 632829 - DNA, 22 bp, Artificial Sequence
  chemically synthesized
ttaaataaataaaatagaaaaa

SEQ ID NO: 632830 - DNA, 22 bp, Artificial Sequence
  chemically synthesized
taaataaataaaatagaaaaac

SEQ ID NO: 632831 - DNA, 22 bp, Artificial Sequence
  chemically synthesized
aaataaataaaatagaaaaaca

SEQ ID NO: 632832 - DNA, 22 bp, Artificial Sequence
  chemically synthesized
aataaataaaatagaaaaacag

SEQ ID NO: 632833 - DNA, 22 bp, Artificial Sequence
  chemically synthesized
catacagtgcatgctgtttttc

SEQ ID NO: 632834 - DNA, 22 bp, Artificial Sequence
  chemically synthesized
catactacatacagtgcatgct

SEQ ID NO: 632835 - DNA, 22 bp, Artificial Sequence
  chemically synthesized
ccatactacatacagtgcatgc

SEQ ID NO: 632836 - DNA, 22 bp, Artificial Sequence
  chemically synthesized
atcaagtgatgccttccatact

SEQ ID NO: 632837 - DNA, 22 bp, Artificial Sequence
  chemically synthesized
catcaagtgatgccttccatac

SEQ ID NO: 632838 - DNA, 22 bp, Artificial Sequence
  chemically synthesized
tatgtagtatggaaggcatcac

SEQ ID NO: 632839 - DNA, 22 bp, Artificial Sequence
  chemically synthesized
gatgaaacttttgtttctgatc

SEQ ID NO: 632840 - DNA, 22 bp, Artificial Sequence
  chemically synthesized
atgaaacttttgtttctgatct

SEQ ID NO: 632841 - DNA, 22 bp, Artificial Sequence
  chemically synthesized
cagtgtcatatgcatacaaaga

SEQ ID NO: 632842 - DNA, 22 bp, Artificial Sequence
  chemically synthesized
acagtgtcatatgcatacaaag

SEQ ID NO: 632843 - DNA, 22 bp, Artificial Sequence
  chemically synthesized
ttgtttctgatctttgtatgca

SEQ ID NO: 632844 - DNA, 22 bp, Artificial Sequence
  chemically synthesized
tgtttctgatctttgtatgcat

SEQ ID NO: 632845 - DNA, 22 bp, Artificial Sequence
  chemically synthesized
gtttctgatctttgtatgcata

SEQ ID NO: 632846 - DNA, 22 bp, Artificial Sequence
  chemically synthesized
tttctgatctttgtatgcatat

SEQ ID NO: 632847 - DNA, 22 bp, Artificial Sequence
  chemically synthesized
ctgatctttgtatgcatatgac

SEQ ID NO: 632848 - DNA, 22 bp, Artificial Sequence
  chemically synthesized
tgatctttgtatgcatatgaca

SEQ ID NO: 632849 - DNA, 22 bp, Artificial Sequence
  chemically synthesized
atctttgtatgcatatgacact

SEQ ID NO: 632850 - DNA, 22 bp, Artificial Sequence
  chemically synthesized
tgtatgcatatgacactgtaaa

SEQ ID NO: 632851 - DNA, 22 bp, Artificial Sequence
  chemically synthesized
gtatgcatatgacactgtaaat

SEQ ID NO: 632852 - DNA, 22 bp, Artificial Sequence
  chemically synthesized
tatgcatatgacactgtaaatg

SEQ ID NO: 632853 - DNA, 22 bp, Artificial Sequence
  chemically synthesized
taaatgtgtgtgtgtacatatg

SEQ ID NO: 632854 - DNA, 22 bp, Artificial Sequence
  chemically synthesized
tgtacacacatgtatatataca

SEQ ID NO: 632855 - DNA, 22 bp, Artificial Sequence
  chemically synthesized
atgtacacacatgtatatatac

SEQ ID NO: 632856 - DNA, 22 bp, Artificial Sequence
  chemically synthesized
tacatgtgtttatgtacacaca

SEQ ID NO: 632857 - DNA, 22 bp, Artificial Sequence
  chemically synthesized
gggtaaagatataaaataaatt

SEQ ID NO: 632858 - DNA, 22 bp, Artificial Sequence
  chemically synthesized
catcacaaactggggtaaagat

SEQ ID NO: 632859 - DNA, 22 bp, Artificial Sequence
  chemically synthesized
acatcacaaactggggtaaaga

SEQ ID NO: 632860 - DNA, 22 bp, Artificial Sequence
  chemically synthesized
tacatcacaaactggggtaaag

SEQ ID NO: 632861 - DNA, 22 bp, Artificial Sequence
  chemically synthesized
attttatatctttaccccagtt

SEQ ID NO: 632862 - DNA, 22 bp, Artificial Sequence
  chemically synthesized
ttttatatctttaccccagttt

SEQ ID NO: 632863 - DNA, 22 bp, Artificial Sequence
  chemically synthesized
tatatctttaccccagtttgtg

SEQ ID NO: 632864 - DNA, 22 bp, Artificial Sequence
  chemically synthesized
atatctttaccccagtttgtga

SEQ ID NO: 632865 - DNA, 22 bp, Artificial Sequence
  chemically synthesized
tatctttaccccagtttgtgat

SEQ ID NO: 632866 - DNA, 22 bp, Artificial Sequence
  chemically synthesized
taccccagtttgtgatgtaaaa

SEQ ID NO: 632867 - DNA, 22 bp, Artificial Sequence
  chemically synthesized
accccagtttgtgatgtaaaat

SEQ ID NO: 632868 - DNA, 22 bp, Artificial Sequence
  chemically synthesized
ccccagtttgtgatgtaaaatg

SEQ ID NO: 632869 - DNA, 22 bp, Artificial Sequence
  chemically synthesized
tccatatcagaggaacatttta

SEQ ID NO: 632870 - DNA, 22 bp, Artificial Sequence
  chemically synthesized
gtgatgtaaaatgttcctctga

SEQ ID NO: 632871 - DNA, 22 bp, Artificial Sequence
  chemically synthesized
tgatgtaaaatgttcctctgat

SEQ ID NO: 632872 - DNA, 22 bp, Artificial Sequence
  chemically synthesized
atggttatccatatcagaggaa

SEQ ID NO: 632873 - DNA, 22 bp, Artificial Sequence
  chemically synthesized
gatggttatccatatcagagga

SEQ ID NO: 632874 - DNA, 22 bp, Artificial Sequence
  chemically synthesized
tgatggttatccatatcagagg

SEQ ID NO: 632875 - DNA, 22 bp, Artificial Sequence
  chemically synthesized
ttttgatggttatccatatcag

SEQ ID NO: 632876 - DNA, 22 bp, Artificial Sequence
  chemically synthesized
tgttttgatggttatccatatc

SEQ ID NO: 632877 - DNA, 22 bp, Artificial Sequence
  chemically synthesized
actctgttttgatggttatcca

SEQ ID NO: 632878 - DNA, 22 bp, Artificial Sequence
  chemically synthesized
tgactctgttttgatggttatc

SEQ ID NO: 632879 - DNA, 22 bp, Artificial Sequence
  chemically synthesized
ctgactctgttttgatggttat

SEQ ID NO: 632880 - DNA, 22 bp, Artificial Sequence
  chemically synthesized
ctctgatatggataaccatcaa

SEQ ID NO: 632881 - DNA, 22 bp, Artificial Sequence
  chemically synthesized
tgatatggataaccatcaaaac

SEQ ID NO: 632882 - DNA, 22 bp, Artificial Sequence
  chemically synthesized
atatggataaccatcaaaacag

SEQ ID NO: 632883 - DNA, 22 bp, Artificial Sequence
  chemically synthesized
acatccaggacagtgatttctg

SEQ ID NO: 632884 - DNA, 22 bp, Artificial Sequence
  chemically synthesized
gacatccaggacagtgatttct

SEQ ID NO: 632885 - DNA, 22 bp, Artificial Sequence
  chemically synthesized
tgacatccaggacagtgatttc

SEQ ID NO: 632886 - DNA, 22 bp, Artificial Sequence
  chemically synthesized
ttgacatccaggacagtgattt

SEQ ID NO: 632887 - DNA, 22 bp, Artificial Sequence
  chemically synthesized
acacttttgacatccaggacag

SEQ ID NO: 632888 - DNA, 22 bp, Artificial Sequence
  chemically synthesized
aacacttttgacatccaggaca

SEQ ID NO: 632889 - DNA, 22 bp, Artificial Sequence
  chemically synthesized
taacacttttgacatccaggac

SEQ ID NO: 632890 - DNA, 22 bp, Artificial Sequence
  chemically synthesized
aaaggtcattttaacacttttg

SEQ ID NO: 632891 - DNA, 22 bp, Artificial Sequence
  chemically synthesized
gaaaggtcattttaacactttt

SEQ ID NO: 632892 - DNA, 22 bp, Artificial Sequence
  chemically synthesized
tcctggatgtcaaaagtgttaa

SEQ ID NO: 632893 - DNA, 22 bp, Artificial Sequence
  chemically synthesized
gatgtcaaaagtgttaaaatga

SEQ ID NO: 632894 - DNA, 22 bp, Artificial Sequence
  chemically synthesized
aaatggaagagccttgaaaggt

SEQ ID NO: 632895 - DNA, 22 bp, Artificial Sequence
  chemically synthesized
caaatggaagagccttgaaagg

SEQ ID NO: 632896 - DNA, 22 bp, Artificial Sequence
  chemically synthesized
tcaaatggaagagccttgaaag

SEQ ID NO: 632897 - DNA, 22 bp, Artificial Sequence
  chemically synthesized
aaatgacctttcaaggctcttc

SEQ ID NO: 632898 - DNA, 22 bp, Artificial Sequence
  chemically synthesized
caaagtctttcaaatggaagag

SEQ ID NO: 632899 - DNA, 22 bp, Artificial Sequence
  chemically synthesized
tcaaggctcttccatttgaaag

SEQ ID NO: 632900 - DNA, 22 bp, Artificial Sequence
  chemically synthesized
ggattacaaagtctttcaaatg

SEQ ID NO: 632901 - DNA, 22 bp, Artificial Sequence
  chemically synthesized
caaggctcttccatttgaaaga

SEQ ID NO: 632902 - DNA, 22 bp, Artificial Sequence
  chemically synthesized
gggattacaaagtctttcaaat

SEQ ID NO: 632903 - DNA, 22 bp, Artificial Sequence
  chemically synthesized
aaggctcttccatttgaaagac

SEQ ID NO: 632904 - DNA, 22 bp, Artificial Sequence
  chemically synthesized
acatcttgggattacaaagtct

SEQ ID NO: 632905 - DNA, 22 bp, Artificial Sequence
  chemically synthesized
ttccatttgaaagactttgtaa

SEQ ID NO: 632906 - DNA, 22 bp, Artificial Sequence
  chemically synthesized
aacatcttgggattacaaagtc

SEQ ID NO: 632907 - DNA, 22 bp, Artificial Sequence
  chemically synthesized
ccatttgaaagactttgtaatc

SEQ ID NO: 632908 - DNA, 22 bp, Artificial Sequence
  chemically synthesized
catttgaaagactttgtaatcc

SEQ ID NO: 632909 - DNA, 22 bp, Artificial Sequence
  chemically synthesized
gaaagactttgtaatcccaaga

SEQ ID NO: 632910 - DNA, 22 bp, Artificial Sequence
  chemically synthesized
agaatcttaacatcttgggatt

SEQ ID NO: 632911 - DNA, 22 bp, Artificial Sequence
  chemically synthesized
aaagactttgtaatcccaagat

SEQ ID NO: 632912 - DNA, 22 bp, Artificial Sequence
  chemically synthesized
gagaatcttaacatcttgggat

SEQ ID NO: 632913 - DNA, 22 bp, Artificial Sequence
  chemically synthesized
ttgagaatcttaacatcttggg

SEQ ID NO: 632914 - DNA, 22 bp, Artificial Sequence
  chemically synthesized
tgtaatcccaagatgttaagat

SEQ ID NO: 632915 - DNA, 22 bp, Artificial Sequence
  chemically synthesized
gtaatcccaagatgttaagatt

SEQ ID NO: 632916 - DNA, 22 bp, Artificial Sequence
  chemically synthesized
taatcccaagatgttaagattc

SEQ ID NO: 632917 - DNA, 22 bp, Artificial Sequence
  chemically synthesized
agcagaaattcttgagaatctt

SEQ ID NO: 632918 - DNA, 22 bp, Artificial Sequence
  chemically synthesized
atattaagcagaaattcttgag

SEQ ID NO: 632919 - DNA, 22 bp, Artificial Sequence
  chemically synthesized
agctgatattaagcagaaattc

SEQ ID NO: 632920 - DNA, 22 bp, Artificial Sequence
  chemically synthesized
agattctcaagaatttctgctt

SEQ ID NO: 632921 - DNA, 22 bp, Artificial Sequence
  chemically synthesized
tcaagaatttctgcttaatatc

SEQ ID NO: 632922 - DNA, 22 bp, Artificial Sequence
  chemically synthesized
aagaatttctgcttaatatcag

SEQ ID NO: 632923 - DNA, 22 bp, Artificial Sequence
  chemically synthesized
gtagatgtgttcagctgatatt

SEQ ID NO: 632924 - DNA, 22 bp, Artificial Sequence
  chemically synthesized
ctgcttaatatcagctgaacac

SEQ ID NO: 632925 - DNA, 22 bp, Artificial Sequence
  chemically synthesized
tgcttaatatcagctgaacaca

SEQ ID NO: 632926 - DNA, 22 bp, Artificial Sequence
  chemically synthesized
ccagttggtagatgtgttcagc

SEQ ID NO: 632927 - DNA, 22 bp, Artificial Sequence
  chemically synthesized
accagttggtagatgtgttcag

SEQ ID NO: 632928 - DNA, 22 bp, Artificial Sequence
  chemically synthesized
cttaatatcagctgaacacatc

SEQ ID NO: 632929 - DNA, 22 bp, Artificial Sequence
  chemically synthesized
aatatcagctgaacacatctac

SEQ ID NO: 632930 - DNA, 22 bp, Artificial Sequence
  chemically synthesized
atatcagctgaacacatctacc

SEQ ID NO: 632931 - DNA, 22 bp, Artificial Sequence
  chemically synthesized
gcgggaacatcttaccagttgg

SEQ ID NO: 632932 - DNA, 22 bp, Artificial Sequence
  chemically synthesized
ggcgggaacatcttaccagttg

SEQ ID NO: 632933 - DNA, 22 bp, Artificial Sequence
  chemically synthesized
aacacatctaccaactggtaag

SEQ ID NO: 632934 - DNA, 22 bp, Artificial Sequence
  chemically synthesized
ccaactggtaagatgttcccgc

SEQ ID NO: 632935 - DNA, 22 bp, Artificial Sequence
  chemically synthesized
gtaagatgttcccgccaaactt

SEQ ID NO: 632936 - DNA, 22 bp, Artificial Sequence
  chemically synthesized
ccgccaaacttgacggtatatg

SEQ ID NO: 632937 - DNA, 22 bp, Artificial Sequence
  chemically synthesized
gacggtatatgtgtgtgtacac

SEQ ID NO: 632938 - DNA, 22 bp, Artificial Sequence
  chemically synthesized
acggtatatgtgtgtgtacaca

SEQ ID NO: 632939 - DNA, 22 bp, Artificial Sequence
  chemically synthesized
aaaaatggcatatgtgtgtgta

SEQ ID NO: 632940 - DNA, 22 bp, Artificial Sequence
  chemically synthesized
gaaaaatggcatatgtgtgtgt

SEQ ID NO: 632941 - DNA, 22 bp, Artificial Sequence
  chemically synthesized
tgaaaaatggcatatgtgtgtg

SEQ ID NO: 632942 - DNA, 22 bp, Artificial Sequence
  chemically synthesized
attttgaaaaatggcatatgtg

SEQ ID NO: 632943 - DNA, 22 bp, Artificial Sequence
  chemically synthesized
aattttgaaaaatggcatatgt

SEQ ID NO: 632944 - DNA, 22 bp, Artificial Sequence
  chemically synthesized
taattttgaaaaatggcatatg

SEQ ID NO: 632945 - DNA, 22 bp, Artificial Sequence
  chemically synthesized
ttaattttgaaaaatggcatat

SEQ ID NO: 632946 - DNA, 22 bp, Artificial Sequence
  chemically synthesized
tttaattttgaaaaatggcata

SEQ ID NO: 632947 - DNA, 22 bp, Artificial Sequence
  chemically synthesized
ttttttaattttgaaaaatggc

SEQ ID NO: 632948 - DNA, 22 bp, Artificial Sequence
  chemically synthesized
gttttttaattttgaaaaatgg

SEQ ID NO: 632949 - DNA, 22 bp, Artificial Sequence
  chemically synthesized
tgttttttaattttgaaaaatg

SEQ ID NO: 632950 - DNA, 22 bp, Artificial Sequence
  chemically synthesized
ttgttttttaattttgaaaaat

SEQ ID NO: 632951 - DNA, 22 bp, Artificial Sequence
  chemically synthesized
aaagcacttttgttttttaatt

SEQ ID NO: 632952 - DNA, 22 bp, Artificial Sequence
  chemically synthesized
caactaaaagcacttttgtttt

SEQ ID NO: 632953 - DNA, 22 bp, Artificial Sequence
  chemically synthesized
ttcaaaattaaaaaacaaaagt

SEQ ID NO: 632954 - DNA, 22 bp, Artificial Sequence
  chemically synthesized
ccaactaaaagcacttttgttt

SEQ ID NO: 632955 - DNA, 22 bp, Artificial Sequence
  chemically synthesized
tcaaaattaaaaaacaaaagtg

SEQ ID NO: 632956 - DNA, 22 bp, Artificial Sequence
  chemically synthesized
tccaactaaaagcacttttgtt

SEQ ID NO: 632957 - DNA, 22 bp, Artificial Sequence
  chemically synthesized
caaaattaaaaaacaaaagtgc

SEQ ID NO: 632958 - DNA, 22 bp, Artificial Sequence
  chemically synthesized
aaaattaaaaaacaaaagtgct

SEQ ID NO: 632959 - DNA, 22 bp, Artificial Sequence
  chemically synthesized
tttccaactaaaagcacttttg

SEQ ID NO: 632960 - DNA, 22 bp, Artificial Sequence
  chemically synthesized
ctttccaactaaaagcactttt

SEQ ID NO: 632961 - DNA, 22 bp, Artificial Sequence
  chemically synthesized
tctttccaactaaaagcacttt

SEQ ID NO: 632962 - DNA, 22 bp, Artificial Sequence
  chemically synthesized
aaaaacaaaagtgcttttagtt

SEQ ID NO: 632963 - DNA, 22 bp, Artificial Sequence
  chemically synthesized
gatgctttctttccaactaaaa

SEQ ID NO: 632964 - DNA, 22 bp, Artificial Sequence
  chemically synthesized
ggatgctttctttccaactaaa

SEQ ID NO: 632965 - DNA, 22 bp, Artificial Sequence
  chemically synthesized
tggatgctttctttccaactaa

SEQ ID NO: 632966 - DNA, 22 bp, Artificial Sequence
  chemically synthesized
ttggatgctttctttccaacta

SEQ ID NO: 632967 - DNA, 22 bp, Artificial Sequence
  chemically synthesized
ttagttggaaagaaagcatcca

SEQ ID NO: 632968 - DNA, 22 bp, Artificial Sequence
  chemically synthesized
tagttggaaagaaagcatccaa

SEQ ID NO: 632969 - DNA, 22 bp, Artificial Sequence
  chemically synthesized
agttggaaagaaagcatccaaa

SEQ ID NO: 632970 - DNA, 22 bp, Artificial Sequence
  chemically synthesized
aaaaaagtggtttttggatgct

SEQ ID NO: 632971 - DNA, 22 bp, Artificial Sequence
  chemically synthesized
gttggaaagaaagcatccaaaa

SEQ ID NO: 632972 - DNA, 22 bp, Artificial Sequence
  chemically synthesized
gaaagaaagcatccaaaaacca

SEQ ID NO: 632973 - DNA, 22 bp, Artificial Sequence
  chemically synthesized
atgcactcaaaaaagtggtttt

SEQ ID NO: 632974 - DNA, 22 bp, Artificial Sequence
  chemically synthesized
ttgatgcactcaaaaaagtggt

SEQ ID NO: 632975 - DNA, 22 bp, Artificial Sequence
  chemically synthesized
attattgatgcactcaaaaaag

SEQ ID NO: 632976 - DNA, 22 bp, Artificial Sequence
  chemically synthesized
ggctaattattgatgcactcaa

SEQ ID NO: 632977 - DNA, 22 bp, Artificial Sequence
  chemically synthesized
taaaaattaggctaattattga

SEQ ID NO: 632978 - DNA, 22 bp, Artificial Sequence
  chemically synthesized
ttttgagtgcatcaataattag

SEQ ID NO: 632979 - DNA, 22 bp, Artificial Sequence
  chemically synthesized
tttgagtgcatcaataattagc

SEQ ID NO: 632980 - DNA, 22 bp, Artificial Sequence
  chemically synthesized
ttgagtgcatcaataattagcc

SEQ ID NO: 632981 - DNA, 22 bp, Artificial Sequence
  chemically synthesized
ttgtaaaaattaggctaattat

SEQ ID NO: 632982 - DNA, 22 bp, Artificial Sequence
  chemically synthesized
tgagtgcatcaataattagcct

SEQ ID NO: 632983 - DNA, 22 bp, Artificial Sequence
  chemically synthesized
gagtgcatcaataattagccta

SEQ ID NO: 632984 - DNA, 22 bp, Artificial Sequence
  chemically synthesized
agtgcatcaataattagcctaa

SEQ ID NO: 632985 - DNA, 22 bp, Artificial Sequence
  chemically synthesized
attattgtaaaaattaggctaa

SEQ ID NO: 632986 - DNA, 22 bp, Artificial Sequence
  chemically synthesized
cattattgtaaaaattaggcta

SEQ ID NO: 632987 - DNA, 22 bp, Artificial Sequence
  chemically synthesized
gcctaatttttacaataatgaa

SEQ ID NO: 632988 - DNA, 22 bp, Artificial Sequence
  chemically synthesized
aagtggataaaaagtttcatta

SEQ ID NO: 632989 - DNA, 22 bp, Artificial Sequence
  chemically synthesized
atttttacaataatgaaacttt

SEQ ID NO: 632990 - DNA, 22 bp, Artificial Sequence
  chemically synthesized
ttacaataatgaaactttttat

SEQ ID NO: 632991 - DNA, 22 bp, Artificial Sequence
  chemically synthesized
tacaataatgaaactttttatc

SEQ ID NO: 632992 - DNA, 22 bp, Artificial Sequence
  chemically synthesized
acaataatgaaactttttatcc

SEQ ID NO: 632993 - DNA, 22 bp, Artificial Sequence
  chemically synthesized
caataatgaaactttttatcca

SEQ ID NO: 632994 - DNA, 22 bp, Artificial Sequence
  chemically synthesized
cccaaattcaagtggataaaaa

SEQ ID NO: 632995 - DNA, 22 bp, Artificial Sequence
  chemically synthesized
tccccaaattcaagtggataaa

SEQ ID NO: 632996 - DNA, 22 bp, Artificial Sequence
  chemically synthesized
ctccccaaattcaagtggataa

SEQ ID NO: 632997 - DNA, 22 bp, Artificial Sequence
  chemically synthesized
tctccccaaattcaagtggata

SEQ ID NO: 632998 - DNA, 22 bp, Artificial Sequence
  chemically synthesized
ttctccccaaattcaagtggat

SEQ ID NO: 632999 - DNA, 22 bp, Artificial Sequence
  chemically synthesized
tttctccccaaattcaagtgga

SEQ ID NO: 633000 - DNA, 22 bp, Artificial Sequence
  chemically synthesized
tttatccacttgaatttgggga

SEQ ID NO: 633001 - DNA, 22 bp, Artificial Sequence
  chemically synthesized
caggcctttttctccccaaatt

SEQ ID NO: 633002 - DNA, 22 bp, Artificial Sequence
  chemically synthesized
ttatccacttgaatttggggag

SEQ ID NO: 633003 - DNA, 22 bp, Artificial Sequence
  chemically synthesized
acaggcctttttctccccaaat

SEQ ID NO: 633004 - DNA, 22 bp, Artificial Sequence
  chemically synthesized
tatccacttgaatttggggaga

SEQ ID NO: 633005 - DNA, 22 bp, Artificial Sequence
  chemically synthesized
atccacttgaatttggggagaa

SEQ ID NO: 633006 - DNA, 22 bp, Artificial Sequence
  chemically synthesized
ttacaggcctttttctccccaa

SEQ ID NO: 633007 - DNA, 22 bp, Artificial Sequence
  chemically synthesized
tccacttgaatttggggagaaa

SEQ ID NO: 633008 - DNA, 22 bp, Artificial Sequence
  chemically synthesized
cttacaggcctttttctcccca

SEQ ID NO: 633009 - DNA, 22 bp, Artificial Sequence
  chemically synthesized
tcttacaggcctttttctcccc

SEQ ID NO: 633010 - DNA, 22 bp, Artificial Sequence
  chemically synthesized
gaatttggggagaaaaaggcct

SEQ ID NO: 633011 - DNA, 22 bp, Artificial Sequence
  chemically synthesized
aggctttcttacaggccttttt

SEQ ID NO: 633012 - DNA, 22 bp, Artificial Sequence
  chemically synthesized
aatttggggagaaaaaggcctg

SEQ ID NO: 633013 - DNA, 22 bp, Artificial Sequence
  chemically synthesized
actcaggctttcttacaggcct

SEQ ID NO: 633014 - DNA, 22 bp, Artificial Sequence
  chemically synthesized
ggggagaaaaaggcctgtaaga

SEQ ID NO: 633015 - DNA, 22 bp, Artificial Sequence
  chemically synthesized
gggagaaaaaggcctgtaagaa

SEQ ID NO: 633016 - DNA, 22 bp, Artificial Sequence
  chemically synthesized
agctaactcaggctttcttaca

SEQ ID NO: 633017 - DNA, 22 bp, Artificial Sequence
  chemically synthesized
cagctaactcaggctttcttac

SEQ ID NO: 633018 - DNA, 22 bp, Artificial Sequence
  chemically synthesized
tcagctaactcaggctttctta

SEQ ID NO: 633019 - DNA, 22 bp, Artificial Sequence
  chemically synthesized
ctttcagctaactcaggctttc

SEQ ID NO: 633020 - DNA, 22 bp, Artificial Sequence
  chemically synthesized
ctactttcagctaactcaggct

SEQ ID NO: 633021 - DNA, 22 bp, Artificial Sequence
  chemically synthesized
gctactttcagctaactcaggc

SEQ ID NO: 633022 - DNA, 22 bp, Artificial Sequence
  chemically synthesized
tgctactttcagctaactcagg

SEQ ID NO: 633023 - DNA, 22 bp, Artificial Sequence
  chemically synthesized
taagaaagcctgagttagctga

SEQ ID NO: 633024 - DNA, 22 bp, Artificial Sequence
  chemically synthesized
acgttttgctactttcagctaa

SEQ ID NO: 633025 - DNA, 22 bp, Artificial Sequence
  chemically synthesized
ctcacgttttgctactttcagc

SEQ ID NO: 633026 - DNA, 22 bp, Artificial Sequence
  chemically synthesized
cctcacgttttgctactttcag

SEQ ID NO: 633027 - DNA, 22 bp, Artificial Sequence
  chemically synthesized
agttagctgaaagtagcaaaac

SEQ ID NO: 633028 - DNA, 22 bp, Artificial Sequence
  chemically synthesized
gcatttcctcacgttttgctac

SEQ ID NO: 633029 - DNA, 22 bp, Artificial Sequence
  chemically synthesized
ggcatttcctcacgttttgcta

SEQ ID NO: 633030 - DNA, 22 bp, Artificial Sequence
  chemically synthesized
gctgaaagtagcaaaacgtgag

SEQ ID NO: 633031 - DNA, 22 bp, Artificial Sequence
  chemically synthesized
aaagtagcaaaacgtgaggaaa

SEQ ID NO: 633032 - DNA, 22 bp, Artificial Sequence
  chemically synthesized
taataccatgatcttggcattt

SEQ ID NO: 633033 - DNA, 22 bp, Artificial Sequence
  chemically synthesized
tgtaataccatgatcttggcat

SEQ ID NO: 633034 - DNA, 22 bp, Artificial Sequence
  chemically synthesized
tcattctgtaataccatgatct

SEQ ID NO: 633035 - DNA, 22 bp, Artificial Sequence
  chemically synthesized
gcctatcattctgtaataccat

SEQ ID NO: 633036 - DNA, 22 bp, Artificial Sequence
  chemically synthesized
gaaaatctggcctatcattctg

SEQ ID NO: 633037 - DNA, 22 bp, Artificial Sequence
  chemically synthesized
aggtattggaaaatctggccta

SEQ ID NO: 633038 - DNA, 22 bp, Artificial Sequence
  chemically synthesized
cagaatgataggccagattttc

SEQ ID NO: 633039 - DNA, 22 bp, Artificial Sequence
  chemically synthesized
tccaataccttagctactctct

SEQ ID NO: 633040 - DNA, 22 bp, Artificial Sequence
  chemically synthesized
ccaataccttagctactctctt

SEQ ID NO: 633041 - DNA, 22 bp, Artificial Sequence
  chemically synthesized
caataccttagctactctcttg

SEQ ID NO: 633042 - DNA, 22 bp, Artificial Sequence
  chemically synthesized
aatacacaaaaaacacaagaga

SEQ ID NO: 633043 - DNA, 22 bp, Artificial Sequence
  chemically synthesized
agctactctcttgtgttttttg

SEQ ID NO: 633044 - DNA, 22 bp, Artificial Sequence
  chemically synthesized
gctactctcttgtgttttttgt

SEQ ID NO: 633045 - DNA, 22 bp, Artificial Sequence
  chemically synthesized
ctctcttgtgttttttgtgtat

SEQ ID NO: 633046 - DNA, 22 bp, Artificial Sequence
  chemically synthesized
tcttgtgttttttgtgtattta

SEQ ID NO: 633047 - DNA, 22 bp, Artificial Sequence
  chemically synthesized
ttgtgttttttgtgtatttaat

SEQ ID NO: 633048 - DNA, 22 bp, Artificial Sequence
  chemically synthesized
aaaaacaaaacaattaaataca

SEQ ID NO: 633049 - DNA, 22 bp, Artificial Sequence
  chemically synthesized
aaaaaacaaaacaattaaatac

SEQ ID NO: 633050 - DNA, 22 bp, Artificial Sequence
  chemically synthesized
gtgttttttgtgtatttaattg

SEQ ID NO: 633051 - DNA, 22 bp, Artificial Sequence
  chemically synthesized
tgttttttgtgtatttaattgt

SEQ ID NO: 633052 - DNA, 22 bp, Artificial Sequence
  chemically synthesized
ttaaaaaacaaaacaattaaat

SEQ ID NO: 633053 - DNA, 22 bp, Artificial Sequence
  chemically synthesized
tttgtgtatttaattgttttgt

SEQ ID NO: 633054 - DNA, 22 bp, Artificial Sequence
  chemically synthesized
ttgtgtatttaattgttttgtt

SEQ ID NO: 633055 - DNA, 22 bp, Artificial Sequence
  chemically synthesized
acattcttaaaaaacaaaacaa

SEQ ID NO: 633056 - DNA, 22 bp, Artificial Sequence
  chemically synthesized
tgtgtatttaattgttttgttt

SEQ ID NO: 633057 - DNA, 22 bp, Artificial Sequence
  chemically synthesized
gtgtatttaattgttttgtttt

SEQ ID NO: 633058 - DNA, 22 bp, Artificial Sequence
  chemically synthesized
tgtatttaattgttttgttttt

SEQ ID NO: 633059 - DNA, 22 bp, Artificial Sequence
  chemically synthesized
aattgttttgttttttaagaat

SEQ ID NO: 633060 - DNA, 22 bp, Artificial Sequence
  chemically synthesized
attgttttgttttttaagaatg

SEQ ID NO: 633061 - DNA, 22 bp, Artificial Sequence
  chemically synthesized
agaaaataaattcacattctta

SEQ ID NO: 633062 - DNA, 22 bp, Artificial Sequence
  chemically synthesized
ttttgttttttaagaatgtgaa

SEQ ID NO: 633063 - DNA, 22 bp, Artificial Sequence
  chemically synthesized
tgttttttaagaatgtgaattt

SEQ ID NO: 633064 - DNA, 22 bp, Artificial Sequence
  chemically synthesized
gttttttaagaatgtgaattta

SEQ ID NO: 633065 - DNA, 22 bp, Artificial Sequence
  chemically synthesized
ttttttaagaatgtgaatttat

SEQ ID NO: 633066 - DNA, 22 bp, Artificial Sequence
  chemically synthesized
tggcctgagaaaataaattcac

SEQ ID NO: 633067 - DNA, 22 bp, Artificial Sequence
  chemically synthesized
gtggcctgagaaaataaattca

SEQ ID NO: 633068 - DNA, 22 bp, Artificial Sequence
  chemically synthesized
tttaagaatgtgaatttatttt

SEQ ID NO: 633069 - DNA, 22 bp, Artificial Sequence
  chemically synthesized
ttaagaatgtgaatttattttc

SEQ ID NO: 633070 - DNA, 22 bp, Artificial Sequence
  chemically synthesized
taagaatgtgaatttattttct

SEQ ID NO: 633071 - DNA, 22 bp, Artificial Sequence
  chemically synthesized
aagaatgtgaatttattttctc

SEQ ID NO: 633072 - DNA, 22 bp, Artificial Sequence
  chemically synthesized
agaatgtgaatttattttctca

SEQ ID NO: 633073 - DNA, 22 bp, Artificial Sequence
  chemically synthesized
agtggtacccttgtggcctgag

SEQ ID NO: 633074 - DNA, 22 bp, Artificial Sequence
  chemically synthesized
ctcagtggtacccttgtggcct

SEQ ID NO: 633075 - DNA, 22 bp, Artificial Sequence
  chemically synthesized
actcagtggtacccttgtggcc

SEQ ID NO: 633076 - DNA, 22 bp, Artificial Sequence
  chemically synthesized
attttctcaggccacaagggta

SEQ ID NO: 633077 - DNA, 22 bp, Artificial Sequence
  chemically synthesized
ttttctcaggccacaagggtac

SEQ ID NO: 633078 - DNA, 22 bp, Artificial Sequence
  chemically synthesized
cggcttactcagtggtaccctt

SEQ ID NO: 633079 - DNA, 22 bp, Artificial Sequence
  chemically synthesized
tctcaggccacaagggtaccac

SEQ ID NO: 633080 - DNA, 22 bp, Artificial Sequence
  chemically synthesized
ctcaggccacaagggtaccact

SEQ ID NO: 633081 - DNA, 22 bp, Artificial Sequence
  chemically synthesized
tcaggccacaagggtaccactg

SEQ ID NO: 633082 - DNA, 22 bp, Artificial Sequence
  chemically synthesized
aggccacaagggtaccactgag

SEQ ID NO: 633083 - DNA, 22 bp, Artificial Sequence
  chemically synthesized
agttccggcttactcagtggta

SEQ ID NO: 633084 - DNA, 22 bp, Artificial Sequence
  chemically synthesized
aagttccggcttactcagtggt

SEQ ID NO: 633085 - DNA, 22 bp, Artificial Sequence
  chemically synthesized
acttaagttccggcttactcag

SEQ ID NO: 633086 - DNA, 22 bp, Artificial Sequence
  chemically synthesized
cattaacttaagttccggctta

SEQ ID NO: 633087 - DNA, 22 bp, Artificial Sequence
  chemically synthesized
agtaagccggaacttaagttaa

SEQ ID NO: 633088 - DNA, 22 bp, Artificial Sequence
  chemically synthesized
tccgataccaattccattaact

SEQ ID NO: 633089 - DNA, 22 bp, Artificial Sequence
  chemically synthesized
gtccgataccaattccattaac

SEQ ID NO: 633090 - DNA, 22 bp, Artificial Sequence
  chemically synthesized
aagttaatggaattggtatcgg

SEQ ID NO: 633091 - DNA, 22 bp, Artificial Sequence
  chemically synthesized
agttaatggaattggtatcgga

SEQ ID NO: 633092 - DNA, 22 bp, Artificial Sequence
  chemically synthesized
atggaattggtatcggacaagg

SEQ ID NO: 633093 - DNA, 22 bp, Artificial Sequence
  chemically synthesized
aaatgtgggagaaggaagcctt

SEQ ID NO: 633094 - DNA, 22 bp, Artificial Sequence
  chemically synthesized
tcaaatgtgggagaaggaagcc

SEQ ID NO: 633095 - DNA, 22 bp, Artificial Sequence
  chemically synthesized
gtatcggacaaggcttccttct

SEQ ID NO: 633096 - DNA, 22 bp, Artificial Sequence
  chemically synthesized
agttctcaaatgtgggagaagg

SEQ ID NO: 633097 - DNA, 22 bp, Artificial Sequence
  chemically synthesized
aagttctcaaatgtgggagaag

SEQ ID NO: 633098 - DNA, 22 bp, Artificial Sequence
  chemically synthesized
atttaagttctcaaatgtggga

SEQ ID NO: 633099 - DNA, 22 bp, Artificial Sequence
  chemically synthesized
ccttctcccacatttgagaact

SEQ ID NO: 633100 - DNA, 22 bp, Artificial Sequence
  chemically synthesized
agggctgatttaagttctcaaa

SEQ ID NO: 633101 - DNA, 22 bp, Artificial Sequence
  chemically synthesized
cttctcccacatttgagaactt

SEQ ID NO: 633102 - DNA, 22 bp, Artificial Sequence
  chemically synthesized
aagggctgatttaagttctcaa

SEQ ID NO: 633103 - DNA, 22 bp, Artificial Sequence
  chemically synthesized
ctcccacatttgagaacttaaa

SEQ ID NO: 633104 - DNA, 22 bp, Artificial Sequence
  chemically synthesized
tcccacatttgagaacttaaat

SEQ ID NO: 633105 - DNA, 22 bp, Artificial Sequence
  chemically synthesized
ccacatttgagaacttaaatca

SEQ ID NO: 633106 - DNA, 22 bp, Artificial Sequence
  chemically synthesized
aggccttaagggctgatttaag

SEQ ID NO: 633107 - DNA, 22 bp, Artificial Sequence
  chemically synthesized
caggccttaagggctgatttaa

SEQ ID NO: 633108 - DNA, 22 bp, Artificial Sequence
  chemically synthesized
gagaacttaaatcagcccttaa

SEQ ID NO: 633109 - DNA, 22 bp, Artificial Sequence
  chemically synthesized
agaacttaaatcagcccttaag

SEQ ID NO: 633110 - DNA, 22 bp, Artificial Sequence
  chemically synthesized
cggaagaatttcaggccttaag

SEQ ID NO: 633111 - DNA, 22 bp, Artificial Sequence
  chemically synthesized
acggaagaatttcaggccttaa

SEQ ID NO: 633112 - DNA, 22 bp, Artificial Sequence
  chemically synthesized
aaatcagcccttaaggcctgaa

SEQ ID NO: 633113 - DNA, 22 bp, Artificial Sequence
  chemically synthesized
aatcagcccttaaggcctgaaa

SEQ ID NO: 633114 - DNA, 22 bp, Artificial Sequence
  chemically synthesized
gtgcttacggaagaatttcagg

SEQ ID NO: 633115 - DNA, 22 bp, Artificial Sequence
  chemically synthesized
aattagtgcttacggaagaatt

SEQ ID NO: 633116 - DNA, 22 bp, Artificial Sequence
  chemically synthesized
aaggcctgaaattcttccgtaa

SEQ ID NO: 633117 - DNA, 22 bp, Artificial Sequence
  chemically synthesized
ctaaattagtgcttacggaaga

SEQ ID NO: 633118 - DNA, 22 bp, Artificial Sequence
  chemically synthesized
aggcctgaaattcttccgtaag

SEQ ID NO: 633119 - DNA, 22 bp, Artificial Sequence
  chemically synthesized
actaaattagtgcttacggaag

SEQ ID NO: 633120 - DNA, 22 bp, Artificial Sequence
  chemically synthesized
aaattcttccgtaagcactaat

SEQ ID NO: 633121 - DNA, 22 bp, Artificial Sequence
  chemically synthesized
gatagtgtttactaaattagtg

SEQ ID NO: 633122 - DNA, 22 bp, Artificial Sequence
  chemically synthesized
ttccgtaagcactaatttagta

SEQ ID NO: 633123 - DNA, 22 bp, Artificial Sequence
  chemically synthesized
ccgtaagcactaatttagtaaa

SEQ ID NO: 633124 - DNA, 22 bp, Artificial Sequence
  chemically synthesized
cgtaagcactaatttagtaaac

SEQ ID NO: 633125 - DNA, 22 bp, Artificial Sequence
  chemically synthesized
aggccacctggatagtgtttac

SEQ ID NO: 633126 - DNA, 22 bp, Artificial Sequence
  chemically synthesized
aattcaggccacctggatagtg

SEQ ID NO: 633127 - DNA, 22 bp, Artificial Sequence
  chemically synthesized
atttagtaaacactatccaggt

SEQ ID NO: 633128 - DNA, 22 bp, Artificial Sequence
  chemically synthesized
agtaaacactatccaggtggcc

SEQ ID NO: 633129 - DNA, 22 bp, Artificial Sequence
  chemically synthesized
gtaaacactatccaggtggcct

SEQ ID NO: 633130 - DNA, 22 bp, Artificial Sequence
  chemically synthesized
ggaaactcaattcaggccacct

SEQ ID NO: 633131 - DNA, 22 bp, Artificial Sequence
  chemically synthesized
gggaaactcaattcaggccacc

SEQ ID NO: 633132 - DNA, 22 bp, Artificial Sequence
  chemically synthesized
tccaggtggcctgaattgagtt

SEQ ID NO: 633133 - DNA, 22 bp, Artificial Sequence
  chemically synthesized
tatggaaacttgggaaactcaa

SEQ ID NO: 633134 - DNA, 22 bp, Artificial Sequence
  chemically synthesized
gtatggaaacttgggaaactca

SEQ ID NO: 633135 - DNA, 22 bp, Artificial Sequence
  chemically synthesized
cttgtatggaaacttgggaaac

SEQ ID NO: 633136 - DNA, 22 bp, Artificial Sequence
  chemically synthesized
acttgtatggaaacttgggaaa

SEQ ID NO: 633137 - DNA, 22 bp, Artificial Sequence
  chemically synthesized
cttacttgtatggaaacttggg

SEQ ID NO: 633138 - DNA, 22 bp, Artificial Sequence
  chemically synthesized
acttacttgtatggaaacttgg

SEQ ID NO: 633139 - DNA, 22 bp, Artificial Sequence
  chemically synthesized
aattgagtttcccaagtttcca

SEQ ID NO: 633140 - DNA, 22 bp, Artificial Sequence
  chemically synthesized
atttacttacttgtatggaaac

SEQ ID NO: 633141 - DNA, 22 bp, Artificial Sequence
  chemically synthesized
agtttcccaagtttccatacaa

SEQ ID NO: 633142 - DNA, 22 bp, Artificial Sequence
  chemically synthesized
atgttgatttacttacttgtat

SEQ ID NO: 633143 - DNA, 22 bp, Artificial Sequence
  chemically synthesized
cccaagtttccatacaagtaag

SEQ ID NO: 633144 - DNA, 22 bp, Artificial Sequence
  chemically synthesized
ccaagtttccatacaagtaagt

SEQ ID NO: 633145 - DNA, 22 bp, Artificial Sequence
  chemically synthesized
tgatgttgatttacttacttgt

SEQ ID NO: 633146 - DNA, 22 bp, Artificial Sequence
  chemically synthesized
ccatacaagtaagtaaatcaac

SEQ ID NO: 633147 - DNA, 22 bp, Artificial Sequence
  chemically synthesized
catacaagtaagtaaatcaaca

SEQ ID NO: 633148 - DNA, 22 bp, Artificial Sequence
  chemically synthesized
gcagtcagtatctctgatgttg

SEQ ID NO: 633149 - DNA, 22 bp, Artificial Sequence
  chemically synthesized
agcagtcagtatctctgatgtt

SEQ ID NO: 633150 - DNA, 22 bp, Artificial Sequence
  chemically synthesized
atatggtatttagcagtcagta

SEQ ID NO: 633151 - DNA, 22 bp, Artificial Sequence
  chemically synthesized
tgatatggtatttagcagtcag

SEQ ID NO: 633152 - DNA, 22 bp, Artificial Sequence
  chemically synthesized
ctctgatatggtatttagcagt

SEQ ID NO: 633153 - DNA, 22 bp, Artificial Sequence
  chemically synthesized
actgctaaataccatatcagag

SEQ ID NO: 633154 - DNA, 22 bp, Artificial Sequence
  chemically synthesized
ctaaataccatatcagaggagg

SEQ ID NO: 633155 - DNA, 22 bp, Artificial Sequence
  chemically synthesized
aataccatatcagaggaggtat

SEQ ID NO: 633156 - DNA, 22 bp, Artificial Sequence
  chemically synthesized
gaagacaagaaatatacctcct

SEQ ID NO: 633157 - DNA, 22 bp, Artificial Sequence
  chemically synthesized
ctggaagacaagaaatatacct

SEQ ID NO: 633158 - DNA, 22 bp, Artificial Sequence
  chemically synthesized
cctggaagacaagaaatatacc

SEQ ID NO: 633159 - DNA, 22 bp, Artificial Sequence
  chemically synthesized
cttgtcttccaggaagcttcta

SEQ ID NO: 633160 - DNA, 22 bp, Artificial Sequence
  chemically synthesized
ttgtcttccaggaagcttctac

SEQ ID NO: 633161 - DNA, 22 bp, Artificial Sequence
  chemically synthesized
gtcttccaggaagcttctacac

SEQ ID NO: 633162 - DNA, 22 bp, Artificial Sequence
  chemically synthesized
gataccacatgggtgtagaagc

SEQ ID NO: 633163 - DNA, 22 bp, Artificial Sequence
  chemically synthesized
tcttccaggaagcttctacacc

SEQ ID NO: 633164 - DNA, 22 bp, Artificial Sequence
  chemically synthesized
ccaggaagcttctacacccatg

SEQ ID NO: 633165 - DNA, 22 bp, Artificial Sequence
  chemically synthesized
caggaagcttctacacccatgt

SEQ ID NO: 633166 - DNA, 22 bp, Artificial Sequence
  chemically synthesized
aagctagataccacatgggtgt

SEQ ID NO: 633167 - DNA, 22 bp, Artificial Sequence
  chemically synthesized
aaagctagataccacatgggtg

SEQ ID NO: 633168 - DNA, 22 bp, Artificial Sequence
  chemically synthesized
gagtccttaaagctagatacca

SEQ ID NO: 633169 - DNA, 22 bp, Artificial Sequence
  chemically synthesized
ctacacccatgtggtatctagc

SEQ ID NO: 633170 - DNA, 22 bp, Artificial Sequence
  chemically synthesized
agagtccttaaagctagatacc

SEQ ID NO: 633171 - DNA, 22 bp, Artificial Sequence
  chemically synthesized
tacacccatgtggtatctagct

SEQ ID NO: 633172 - DNA, 22 bp, Artificial Sequence
  chemically synthesized
tagagtccttaaagctagatac

SEQ ID NO: 633173 - DNA, 22 bp, Artificial Sequence
  chemically synthesized
ttagagtccttaaagctagata

SEQ ID NO: 633174 - DNA, 22 bp, Artificial Sequence
  chemically synthesized
cacccatgtggtatctagcttt

SEQ ID NO: 633175 - DNA, 22 bp, Artificial Sequence
  chemically synthesized
tgtcccgcttttagagtcctta

SEQ ID NO: 633176 - DNA, 22 bp, Artificial Sequence
  chemically synthesized
cctgtgtcccgcttttagagtc

SEQ ID NO: 633177 - DNA, 22 bp, Artificial Sequence
  chemically synthesized
gctttaaggactctaaaagcgg

SEQ ID NO: 633178 - DNA, 22 bp, Artificial Sequence
  chemically synthesized
taaggactctaaaagcgggaca

SEQ ID NO: 633179 - DNA, 22 bp, Artificial Sequence
  chemically synthesized
aaggactctaaaagcgggacac

SEQ ID NO: 633180 - DNA, 22 bp, Artificial Sequence
  chemically synthesized
caccatctccctgtgtcccgct

SEQ ID NO: 633181 - DNA, 22 bp, Artificial Sequence
  chemically synthesized
aggactctaaaagcgggacaca

SEQ ID NO: 633182 - DNA, 22 bp, Artificial Sequence
  chemically synthesized
gcaccatctccctgtgtcccgc

SEQ ID NO: 633183 - DNA, 22 bp, Artificial Sequence
  chemically synthesized
tgcaccatctccctgtgtcccg

SEQ ID NO: 633184 - DNA, 22 bp, Artificial Sequence
  chemically synthesized
taaaagcgggacacagggagat

SEQ ID NO: 633185 - DNA, 22 bp, Artificial Sequence
  chemically synthesized
aaagcgggacacagggagatgg

SEQ ID NO: 633186 - DNA, 22 bp, Artificial Sequence
  chemically synthesized
taaggtgaaatcctttgcacca

SEQ ID NO: 633187 - DNA, 22 bp, Artificial Sequence
  chemically synthesized
gctgtaaggtgaaatcctttgc

SEQ ID NO: 633188 - DNA, 22 bp, Artificial Sequence
  chemically synthesized
attagctgtaaggtgaaatcct

SEQ ID NO: 633189 - DNA, 22 bp, Artificial Sequence
  chemically synthesized
gtccaccctaattagctgtaag

SEQ ID NO: 633190 - DNA, 22 bp, Artificial Sequence
  chemically synthesized
tggtccaccctaattagctgta

SEQ ID NO: 633191 - DNA, 22 bp, Artificial Sequence
  chemically synthesized
ctggtccaccctaattagctgt

SEQ ID NO: 633192 - DNA, 22 bp, Artificial Sequence
  chemically synthesized
agtttctggtccaccctaatta

SEQ ID NO: 633193 - DNA, 22 bp, Artificial Sequence
  chemically synthesized
caccttacagctaattagggtg

SEQ ID NO: 633194 - DNA, 22 bp, Artificial Sequence
  chemically synthesized
accttacagctaattagggtgg

SEQ ID NO: 633195 - DNA, 22 bp, Artificial Sequence
  chemically synthesized
tacctgagtttctggtccaccc

SEQ ID NO: 633196 - DNA, 22 bp, Artificial Sequence
  chemically synthesized
acagctaattagggtggaccag

SEQ ID NO: 633197 - DNA, 22 bp, Artificial Sequence
  chemically synthesized
gtacctgagtttctggtccacc

SEQ ID NO: 633198 - DNA, 22 bp, Artificial Sequence
  chemically synthesized
cagctaattagggtggaccaga

SEQ ID NO: 633199 - DNA, 22 bp, Artificial Sequence
  chemically synthesized
tgtacctgagtttctggtccac

SEQ ID NO: 633200 - DNA, 22 bp, Artificial Sequence
  chemically synthesized
ttgtacctgagtttctggtcca

SEQ ID NO: 633201 - DNA, 22 bp, Artificial Sequence
  chemically synthesized
tttgtacctgagtttctggtcc

SEQ ID NO: 633202 - DNA, 22 bp, Artificial Sequence
  chemically synthesized
ctttttgtacctgagtttctgg

SEQ ID NO: 633203 - DNA, 22 bp, Artificial Sequence
  chemically synthesized
attagggtggaccagaaactca

SEQ ID NO: 633204 - DNA, 22 bp, Artificial Sequence
  chemically synthesized
gggtggaccagaaactcaggta

SEQ ID NO: 633205 - DNA, 22 bp, Artificial Sequence
  chemically synthesized
gactcctttttgtacctgagtt

SEQ ID NO: 633206 - DNA, 22 bp, Artificial Sequence
  chemically synthesized
ctagactcctttttgtacctga

SEQ ID NO: 633207 - DNA, 22 bp, Artificial Sequence
  chemically synthesized
cctagactcctttttgtacctg

SEQ ID NO: 633208 - DNA, 22 bp, Artificial Sequence
  chemically synthesized
acttcctagactcctttttgta

SEQ ID NO: 633209 - DNA, 22 bp, Artificial Sequence
  chemically synthesized
gacttcctagactcctttttgt

SEQ ID NO: 633210 - DNA, 22 bp, Artificial Sequence
  chemically synthesized
aggtacaaaaaggagtctagga

SEQ ID NO: 633211 - DNA, 22 bp, Artificial Sequence
  chemically synthesized
ataggcagccttgacttcctag

SEQ ID NO: 633212 - DNA, 22 bp, Artificial Sequence
  chemically synthesized
cataggcagccttgacttccta

SEQ ID NO: 633213 - DNA, 22 bp, Artificial Sequence
  chemically synthesized
ttcataggcagccttgacttcc

SEQ ID NO: 633214 - DNA, 22 bp, Artificial Sequence
  chemically synthesized
cttcataggcagccttgacttc

SEQ ID NO: 633215 - DNA, 22 bp, Artificial Sequence
  chemically synthesized
cttcttcataggcagccttgac

SEQ ID NO: 633216 - DNA, 22 bp, Artificial Sequence
  chemically synthesized
tgcttcttcataggcagccttg

SEQ ID NO: 633217 - DNA, 22 bp, Artificial Sequence
  chemically synthesized
ggaagtcaaggctgcctatgaa

SEQ ID NO: 633218 - DNA, 22 bp, Artificial Sequence
  chemically synthesized
atgactctgcttcttcataggc

SEQ ID NO: 633219 - DNA, 22 bp, Artificial Sequence
  chemically synthesized
cagcaaggctcatgactctgct

SEQ ID NO: 633220 - DNA, 22 bp, Artificial Sequence
  chemically synthesized
cctatgaagaagcagagtcatg

SEQ ID NO: 633221 - DNA, 22 bp, Artificial Sequence
  chemically synthesized
tgaagaagcagagtcatgagcc

SEQ ID NO: 633222 - DNA, 22 bp, Artificial Sequence
  chemically synthesized
gtagagaagaagctacagcaag

SEQ ID NO: 633223 - DNA, 22 bp, Artificial Sequence
  chemically synthesized
aacaagaggttagtagagaaga

SEQ ID NO: 633224 - DNA, 22 bp, Artificial Sequence
  chemically synthesized
gctgtagcttcttctctactaa

SEQ ID NO: 633225 - DNA, 22 bp, Artificial Sequence
  chemically synthesized
ctgtagcttcttctctactaac

SEQ ID NO: 633226 - DNA, 22 bp, Artificial Sequence
  chemically synthesized
tagcttcttctctactaacctc

SEQ ID NO: 633227 - DNA, 22 bp, Artificial Sequence
  chemically synthesized
cacatctaaacaagaggttagt

SEQ ID NO: 633228 - DNA, 22 bp, Artificial Sequence
  chemically synthesized
ccacatctaaacaagaggttag

SEQ ID NO: 633229 - DNA, 22 bp, Artificial Sequence
  chemically synthesized
ttccacatctaaacaagaggtt

SEQ ID NO: 633230 - DNA, 22 bp, Artificial Sequence
  chemically synthesized
cttccacatctaaacaagaggt

SEQ ID NO: 633231 - DNA, 22 bp, Artificial Sequence
  chemically synthesized
cttctctactaacctcttgttt

SEQ ID NO: 633232 - DNA, 22 bp, Artificial Sequence
  chemically synthesized
ttctctactaacctcttgttta

SEQ ID NO: 633233 - DNA, 22 bp, Artificial Sequence
  chemically synthesized
ctctactaacctcttgtttaga

SEQ ID NO: 633234 - DNA, 22 bp, Artificial Sequence
  chemically synthesized
tctactaacctcttgtttagat

SEQ ID NO: 633235 - DNA, 22 bp, Artificial Sequence
  chemically synthesized
tactaacctcttgtttagatgt

SEQ ID NO: 633236 - DNA, 22 bp, Artificial Sequence
  chemically synthesized
ggcatttcttccacatctaaac

SEQ ID NO: 633237 - DNA, 22 bp, Artificial Sequence
  chemically synthesized
ctaacctcttgtttagatgtgg

SEQ ID NO: 633238 - DNA, 22 bp, Artificial Sequence
  chemically synthesized
acctcttgtttagatgtggaag

SEQ ID NO: 633239 - DNA, 22 bp, Artificial Sequence
  chemically synthesized
gcaccctgggcatttcttccac

SEQ ID NO: 633240 - DNA, 22 bp, Artificial Sequence
  chemically synthesized
ttgtttagatgtggaagaaatg

SEQ ID NO: 633241 - DNA, 22 bp, Artificial Sequence
  chemically synthesized
ttggcaccctgggcatttcttc

SEQ ID NO: 633242 - DNA, 22 bp, Artificial Sequence
  chemically synthesized
gtttagatgtggaagaaatgcc

SEQ ID NO: 633243 - DNA, 22 bp, Artificial Sequence
  chemically synthesized
tttagatgtggaagaaatgccc

SEQ ID NO: 633244 - DNA, 22 bp, Artificial Sequence
  chemically synthesized
agatgtggaagaaatgcccagg

SEQ ID NO: 633245 - DNA, 22 bp, Artificial Sequence
  chemically synthesized
ccctgttggcaccctgggcatt

SEQ ID NO: 633246 - DNA, 22 bp, Artificial Sequence
  chemically synthesized
gatgtggaagaaatgcccaggg

SEQ ID NO: 633247 - DNA, 22 bp, Artificial Sequence
  chemically synthesized
gctgccctgttggcaccctggg

SEQ ID NO: 633248 - DNA, 22 bp, Artificial Sequence
  chemically synthesized
ctggctgccctgttggcaccct

SEQ ID NO: 633249 - DNA, 22 bp, Artificial Sequence
  chemically synthesized
gaaagttgctggctgccctgtt

SEQ ID NO: 633250 - DNA, 22 bp, Artificial Sequence
  chemically synthesized
tggaaagttgctggctgccctg

SEQ ID NO: 633251 - DNA, 22 bp, Artificial Sequence
  chemically synthesized
ctctggaaagttgctggctgcc

SEQ ID NO: 633252 - DNA, 22 bp, Artificial Sequence
  chemically synthesized
cctgctctggaaagttgctggc

SEQ ID NO: 633253 - DNA, 22 bp, Artificial Sequence
  chemically synthesized
acctgctctggaaagttgctgg

SEQ ID NO: 633254 - DNA, 22 bp, Artificial Sequence
  chemically synthesized
cttacctgctctggaaagttgc

SEQ ID NO: 633255 - DNA, 22 bp, Artificial Sequence
  chemically synthesized
gcttacctgctctggaaagttg

SEQ ID NO: 633256 - DNA, 22 bp, Artificial Sequence
  chemically synthesized
gcagcttgcttacctgctctgg

SEQ ID NO: 633257 - DNA, 22 bp, Artificial Sequence
  chemically synthesized
aactggcagcttgcttacctgc

SEQ ID NO: 633258 - DNA, 22 bp, Artificial Sequence
  chemically synthesized
gaactggcagcttgcttacctg

SEQ ID NO: 633259 - DNA, 22 bp, Artificial Sequence
  chemically synthesized
tccagagcaggtaagcaagctg

SEQ ID NO: 633260 - DNA, 22 bp, Artificial Sequence
  chemically synthesized
ccagagcaggtaagcaagctgc

SEQ ID NO: 633261 - DNA, 22 bp, Artificial Sequence
  chemically synthesized
cagagcaggtaagcaagctgcc

SEQ ID NO: 633262 - DNA, 22 bp, Artificial Sequence
  chemically synthesized
gccccttgaactggcagcttgc

SEQ ID NO: 633263 - DNA, 22 bp, Artificial Sequence
  chemically synthesized
tatgatcctggccccttgaact

SEQ ID NO: 633264 - DNA, 22 bp, Artificial Sequence
  chemically synthesized
ctgtatgatcctggccccttga

SEQ ID NO: 633265 - DNA, 22 bp, Artificial Sequence
  chemically synthesized
attactgtatgatcctggcccc

SEQ ID NO: 633266 - DNA, 22 bp, Artificial Sequence
  chemically synthesized
ccagttcaaggggccaggatca

SEQ ID NO: 633267 - DNA, 22 bp, Artificial Sequence
  chemically synthesized
aaggggccaggatcatacagta

SEQ ID NO: 633268 - DNA, 22 bp, Artificial Sequence
  chemically synthesized
aaatcacagtacaatcattgat

SEQ ID NO: 633269 - DNA, 22 bp, Artificial Sequence
  chemically synthesized
caaagaaattcaaatcacagta

SEQ ID NO: 633270 - DNA, 22 bp, Artificial Sequence
  chemically synthesized
tactgtgatttgaatttctttg

SEQ ID NO: 633271 - DNA, 22 bp, Artificial Sequence
  chemically synthesized
cagatacagaactccaaagaaa

SEQ ID NO: 633272 - DNA, 22 bp, Artificial Sequence
  chemically synthesized
tgatttgaatttctttggagtt

SEQ ID NO: 633273 - DNA, 22 bp, Artificial Sequence
  chemically synthesized
gaatttctttggagttctgtat

SEQ ID NO: 633274 - DNA, 22 bp, Artificial Sequence
  chemically synthesized
aatttctttggagttctgtatc

SEQ ID NO: 633275 - DNA, 22 bp, Artificial Sequence
  chemically synthesized
tggtcaattgcagatacagaac

SEQ ID NO: 633276 - DNA, 22 bp, Artificial Sequence
  chemically synthesized
atggtcaattgcagatacagaa

SEQ ID NO: 633277 - DNA, 22 bp, Artificial Sequence
  chemically synthesized
ctttggagttctgtatctgcaa

SEQ ID NO: 633278 - DNA, 22 bp, Artificial Sequence
  chemically synthesized
tttggagttctgtatctgcaat

SEQ ID NO: 633279 - DNA, 22 bp, Artificial Sequence
  chemically synthesized
tggagttctgtatctgcaattg

SEQ ID NO: 633280 - DNA, 22 bp, Artificial Sequence
  chemically synthesized
ggagttctgtatctgcaattga

SEQ ID NO: 633281 - DNA, 22 bp, Artificial Sequence
  chemically synthesized
gagttctgtatctgcaattgac

SEQ ID NO: 633282 - DNA, 22 bp, Artificial Sequence
  chemically synthesized
aaggtacttatggtcaattgca

SEQ ID NO: 633283 - DNA, 22 bp, Artificial Sequence
  chemically synthesized
caaggtacttatggtcaattgc

SEQ ID NO: 633284 - DNA, 22 bp, Artificial Sequence
  chemically synthesized
ccttcaaggtacttatggtcaa

SEQ ID NO: 633285 - DNA, 22 bp, Artificial Sequence
  chemically synthesized
tgtatctgcaattgaccataag

SEQ ID NO: 633286 - DNA, 22 bp, Artificial Sequence
  chemically synthesized
gccttcaaggtacttatggtca

SEQ ID NO: 633287 - DNA, 22 bp, Artificial Sequence
  chemically synthesized
tatctgcaattgaccataagta

SEQ ID NO: 633288 - DNA, 22 bp, Artificial Sequence
  chemically synthesized
cttgccttcaaggtacttatgg

SEQ ID NO: 633289 - DNA, 22 bp, Artificial Sequence
  chemically synthesized
caattgaccataagtaccttga

SEQ ID NO: 633290 - DNA, 22 bp, Artificial Sequence
  chemically synthesized
accataagtaccttgaaggcaa

SEQ ID NO: 633291 - DNA, 22 bp, Artificial Sequence
  chemically synthesized
gaaggcaaggaatttgtcattt

SEQ ID NO: 633292 - DNA, 22 bp, Artificial Sequence
  chemically synthesized
aaggcaaggaatttgtcatttc

SEQ ID NO: 633293 - DNA, 22 bp, Artificial Sequence
  chemically synthesized
gtcatttcttctttccatccct

SEQ ID NO: 633294 - DNA, 22 bp, Artificial Sequence
  chemically synthesized
tcatttcttctttccatcccta

SEQ ID NO: 633295 - DNA, 22 bp, Artificial Sequence
  chemically synthesized
cgtaccagtggaggtagtaggg

SEQ ID NO: 633296 - DNA, 22 bp, Artificial Sequence
  chemically synthesized
cttctttccatccctactacct

SEQ ID NO: 633297 - DNA, 22 bp, Artificial Sequence
  chemically synthesized
ttctttccatccctactacctc

SEQ ID NO: 633298 - DNA, 22 bp, Artificial Sequence
  chemically synthesized
ctacgtaccagtggaggtagta

SEQ ID NO: 633299 - DNA, 22 bp, Artificial Sequence
  chemically synthesized
ctttccatccctactacctcca

SEQ ID NO: 633300 - DNA, 22 bp, Artificial Sequence
  chemically synthesized
tttccatccctactacctccac

SEQ ID NO: 633301 - DNA, 22 bp, Artificial Sequence
  chemically synthesized
tccatccctactacctccactg

SEQ ID NO: 633302 - DNA, 22 bp, Artificial Sequence
  chemically synthesized
ccatccctactacctccactgg

SEQ ID NO: 633303 - DNA, 22 bp, Artificial Sequence
  chemically synthesized
catccctactacctccactggt

SEQ ID NO: 633304 - DNA, 22 bp, Artificial Sequence
  chemically synthesized
gcacctactacgtaccagtgga

SEQ ID NO: 633305 - DNA, 22 bp, Artificial Sequence
  chemically synthesized
ctagcacctactacgtaccagt

SEQ ID NO: 633306 - DNA, 22 bp, Artificial Sequence
  chemically synthesized
actagcacctactacgtaccag

SEQ ID NO: 633307 - DNA, 22 bp, Artificial Sequence
  chemically synthesized
tactagcacctactacgtacca

SEQ ID NO: 633308 - DNA, 22 bp, Artificial Sequence
  chemically synthesized
ttactagcacctactacgtacc

SEQ ID NO: 633309 - DNA, 22 bp, Artificial Sequence
  chemically synthesized
ctacctccactggtacgtagta

SEQ ID NO: 633310 - DNA, 22 bp, Artificial Sequence
  chemically synthesized
cttttactagcacctactacgt

SEQ ID NO: 633311 - DNA, 22 bp, Artificial Sequence
  chemically synthesized
cctccactggtacgtagtaggt

SEQ ID NO: 633312 - DNA, 22 bp, Artificial Sequence
  chemically synthesized
gcttttactagcacctactacg

SEQ ID NO: 633313 - DNA, 22 bp, Artificial Sequence
  chemically synthesized
cttgcttttactagcacctact

SEQ ID NO: 633314 - DNA, 22 bp, Artificial Sequence
  chemically synthesized
cactggtacgtagtaggtgcta

SEQ ID NO: 633315 - DNA, 22 bp, Artificial Sequence
  chemically synthesized
tcctgcttgcttttactagcac

SEQ ID NO: 633316 - DNA, 22 bp, Artificial Sequence
  chemically synthesized
gtacgtagtaggtgctagtaaa

SEQ ID NO: 633317 - DNA, 22 bp, Artificial Sequence
  chemically synthesized
gtcctgcttgcttttactagca

SEQ ID NO: 633318 - DNA, 22 bp, Artificial Sequence
  chemically synthesized
tgtcctgcttgcttttactagc

SEQ ID NO: 633319 - DNA, 22 bp, Artificial Sequence
  chemically synthesized
ctttgtcctgcttgcttttact

SEQ ID NO: 633320 - DNA, 22 bp, Artificial Sequence
  chemically synthesized
attactttgtcctgcttgcttt

SEQ ID NO: 633321 - DNA, 22 bp, Artificial Sequence
  chemically synthesized
ctcattactttgtcctgcttgc

SEQ ID NO: 633322 - DNA, 22 bp, Artificial Sequence
  chemically synthesized
gtaaaagcaagcaggacaaagt

SEQ ID NO: 633323 - DNA, 22 bp, Artificial Sequence
  chemically synthesized
acgtgtctcctcattactttgt

SEQ ID NO: 633324 - DNA, 22 bp, Artificial Sequence
  chemically synthesized
cacgtgtctcctcattactttg

SEQ ID NO: 633325 - DNA, 22 bp, Artificial Sequence
  chemically synthesized
tcacgtgtctcctcattacttt

SEQ ID NO: 633326 - DNA, 22 bp, Artificial Sequence
  chemically synthesized
acagaatcaggtgctttcacgt

SEQ ID NO: 633327 - DNA, 22 bp, Artificial Sequence
  chemically synthesized
gacagaatcaggtgctttcacg

SEQ ID NO: 633328 - DNA, 22 bp, Artificial Sequence
  chemically synthesized
attctgtcaagcctgtgtatga

SEQ ID NO: 633329 - DNA, 22 bp, Artificial Sequence
  chemically synthesized
ataatgagaagatcatacacag

SEQ ID NO: 633330 - DNA, 22 bp, Artificial Sequence
  chemically synthesized
tgtcaagcctgtgtatgatctt

SEQ ID NO: 633331 - DNA, 22 bp, Artificial Sequence
  chemically synthesized
tcaagcctgtgtatgatcttct

SEQ ID NO: 633332 - DNA, 22 bp, Artificial Sequence
  chemically synthesized
gatgtcataattcataatgaga

SEQ ID NO: 633333 - DNA, 22 bp, Artificial Sequence
  chemically synthesized
tgtatgatcttctcattatgaa

SEQ ID NO: 633334 - DNA, 22 bp, Artificial Sequence
  chemically synthesized
tagatgtcataattcataatga

SEQ ID NO: 633335 - DNA, 22 bp, Artificial Sequence
  chemically synthesized
ctagatgtcataattcataatg

SEQ ID NO: 633336 - DNA, 22 bp, Artificial Sequence
  chemically synthesized
ttctagatgtcataattcataa

SEQ ID NO: 633337 - DNA, 22 bp, Artificial Sequence
  chemically synthesized
cttctagatgtcataattcata

SEQ ID NO: 633338 - DNA, 22 bp, Artificial Sequence
  chemically synthesized
cttcttctagatgtcataattc

SEQ ID NO: 633339 - DNA, 22 bp, Artificial Sequence
  chemically synthesized
ctcattatgaattatgacatct

SEQ ID NO: 633340 - DNA, 22 bp, Artificial Sequence
  chemically synthesized
tcattatgaattatgacatcta

SEQ ID NO: 633341 - DNA, 22 bp, Artificial Sequence
  chemically synthesized
attatgaattatgacatctaga

SEQ ID NO: 633342 - DNA, 22 bp, Artificial Sequence
  chemically synthesized
ggtatctccttcttctagatgt

SEQ ID NO: 633343 - DNA, 22 bp, Artificial Sequence
  chemically synthesized
aggtatctccttcttctagatg

SEQ ID NO: 633344 - DNA, 22 bp, Artificial Sequence
  chemically synthesized
tgaattatgacatctagaagaa

SEQ ID NO: 633345 - DNA, 22 bp, Artificial Sequence
  chemically synthesized
tcttaggtatctccttcttcta

SEQ ID NO: 633346 - DNA, 22 bp, Artificial Sequence
  chemically synthesized
actatcttaggtatctccttct

SEQ ID NO: 633347 - DNA, 22 bp, Artificial Sequence
  chemically synthesized
tgacatctagaagaaggagata

SEQ ID NO: 633348 - DNA, 22 bp, Artificial Sequence
  chemically synthesized
tgactatcttaggtatctcctt

SEQ ID NO: 633349 - DNA, 22 bp, Artificial Sequence
  chemically synthesized
gaagaaggagatacctaagata

SEQ ID NO: 633350 - DNA, 22 bp, Artificial Sequence
  chemically synthesized
agatagtcagaatggggatgcg

SEQ ID NO: 633351 - DNA, 22 bp, Artificial Sequence
  chemically synthesized
cacatcccccaccgccacccgc

SEQ ID NO: 633352 - DNA, 22 bp, Artificial Sequence
  chemically synthesized
cacccacctccacatcccccac

SEQ ID NO: 633353 - DNA, 22 bp, Artificial Sequence
  chemically synthesized
ccacccacctccacatccccca

SEQ ID NO: 633354 - DNA, 22 bp, Artificial Sequence
  chemically synthesized
tcttccacccacctccacatcc

SEQ ID NO: 633355 - DNA, 22 bp, Artificial Sequence
  chemically synthesized
tctgtcttccacccacctccac

SEQ ID NO: 633356 - DNA, 22 bp, Artificial Sequence
  chemically synthesized
atctgtcttccacccacctcca

SEQ ID NO: 633357 - DNA, 22 bp, Artificial Sequence
  chemically synthesized
acagataaaaatcttatctgtc

SEQ ID NO: 633358 - DNA, 22 bp, Artificial Sequence
  chemically synthesized
aacagataaaaatcttatctgt

SEQ ID NO: 633359 - DNA, 22 bp, Artificial Sequence
  chemically synthesized
taacagataaaaatcttatctg

SEQ ID NO: 633360 - DNA, 22 bp, Artificial Sequence
  chemically synthesized
aagtgatgattttaacagataa

SEQ ID NO: 633361 - DNA, 22 bp, Artificial Sequence
  chemically synthesized
agcgccactgaagtgatgattt

SEQ ID NO: 633362 - DNA, 22 bp, Artificial Sequence
  chemically synthesized
ttatctgttaaaatcatcactt

SEQ ID NO: 633363 - DNA, 22 bp, Artificial Sequence
  chemically synthesized
tatctgttaaaatcatcacttc

SEQ ID NO: 633364 - DNA, 22 bp, Artificial Sequence
  chemically synthesized
ctgagcgccactgaagtgatga

SEQ ID NO: 633365 - DNA, 22 bp, Artificial Sequence
  chemically synthesized
atctgttaaaatcatcacttca

SEQ ID NO: 633366 - DNA, 22 bp, Artificial Sequence
  chemically synthesized
tctgttaaaatcatcacttcag

SEQ ID NO: 633367 - DNA, 22 bp, Artificial Sequence
  chemically synthesized
actgctgagcgccactgaagtg

SEQ ID NO: 633368 - DNA, 22 bp, Artificial Sequence
  chemically synthesized
cactgctgagcgccactgaagt

SEQ ID NO: 633369 - DNA, 22 bp, Artificial Sequence
  chemically synthesized
ttaaaatcatcacttcagtggc

SEQ ID NO: 633370 - DNA, 22 bp, Artificial Sequence
  chemically synthesized
tcactgctgagcgccactgaag

SEQ ID NO: 633371 - DNA, 22 bp, Artificial Sequence
  chemically synthesized
ttcactgctgagcgccactgaa

SEQ ID NO: 633372 - DNA, 22 bp, Artificial Sequence
  chemically synthesized
aaatcatcacttcagtggcgct

SEQ ID NO: 633373 - DNA, 22 bp, Artificial Sequence
  chemically synthesized
caccagccatcttttcactgct

SEQ ID NO: 633374 - DNA, 22 bp, Artificial Sequence
  chemically synthesized
cagtggcgctcagcagtgaaaa

SEQ ID NO: 633375 - DNA, 22 bp, Artificial Sequence
  chemically synthesized
agtggcgctcagcagtgaaaag

SEQ ID NO: 633376 - DNA, 22 bp, Artificial Sequence
  chemically synthesized
aatgtctgcaccagccatcttt

SEQ ID NO: 633377 - DNA, 22 bp, Artificial Sequence
  chemically synthesized
aaatgtctgcaccagccatctt

SEQ ID NO: 633378 - DNA, 22 bp, Artificial Sequence
  chemically synthesized
taaatgtctgcaccagccatct

SEQ ID NO: 633379 - DNA, 22 bp, Artificial Sequence
  chemically synthesized
agcagtgaaaagatggctggtg

SEQ ID NO: 633380 - DNA, 22 bp, Artificial Sequence
  chemically synthesized
attttaaatgtctgcaccagcc

SEQ ID NO: 633381 - DNA, 22 bp, Artificial Sequence
  chemically synthesized
gtgcagacatttaaaattagct

SEQ ID NO: 633382 - DNA, 22 bp, Artificial Sequence
  chemically synthesized
aggaaccgtcaggggaagctaa

SEQ ID NO: 633383 - DNA, 22 bp, Artificial Sequence
  chemically synthesized
ctaaggaaccgtcaggggaagc

SEQ ID NO: 633384 - DNA, 22 bp, Artificial Sequence
  chemically synthesized
aaaattagcttcccctgacggt

SEQ ID NO: 633385 - DNA, 22 bp, Artificial Sequence
  chemically synthesized
aaattagcttcccctgacggtt

SEQ ID NO: 633386 - DNA, 22 bp, Artificial Sequence
  chemically synthesized
gtagagcgttgctaaggaaccg

SEQ ID NO: 633387 - DNA, 22 bp, Artificial Sequence
  chemically synthesized
gcttcccctgacggttccttag

SEQ ID NO: 633388 - DNA, 22 bp, Artificial Sequence
  chemically synthesized
tggtagagcgttgctaaggaac

SEQ ID NO: 633389 - DNA, 22 bp, Artificial Sequence
  chemically synthesized
cccctgacggttccttagcaac

SEQ ID NO: 633390 - DNA, 22 bp, Artificial Sequence
  chemically synthesized
ccctgacggttccttagcaacg

SEQ ID NO: 633391 - DNA, 22 bp, Artificial Sequence
  chemically synthesized
acggttccttagcaacgctcta

SEQ ID NO: 633392 - DNA, 22 bp, Artificial Sequence
  chemically synthesized
aaagcaataatgttctggtaga

SEQ ID NO: 633393 - DNA, 22 bp, Artificial Sequence
  chemically synthesized
cttagcaacgctctaccagaac

SEQ ID NO: 633394 - DNA, 22 bp, Artificial Sequence
  chemically synthesized
agcaacgctctaccagaacatt

SEQ ID NO: 633395 - DNA, 22 bp, Artificial Sequence
  chemically synthesized
gcaacgctctaccagaacatta

SEQ ID NO: 633396 - DNA, 22 bp, Artificial Sequence
  chemically synthesized
taccagaacattattgctttta

SEQ ID NO: 633397 - DNA, 22 bp, Artificial Sequence
  chemically synthesized
tgcagtgcacattaaaagcaat

SEQ ID NO: 633398 - DNA, 22 bp, Artificial Sequence
  chemically synthesized
ccagaacattattgcttttaat

SEQ ID NO: 633399 - DNA, 22 bp, Artificial Sequence
  chemically synthesized
ttgcttttaatgtgcactgcac

SEQ ID NO: 633400 - DNA, 22 bp, Artificial Sequence
  chemically synthesized
cttttaatgtgcactgcacaac

SEQ ID NO: 633401 - DNA, 22 bp, Artificial Sequence
  chemically synthesized
atgtgcaagtaaacgttgtgca

SEQ ID NO: 633402 - DNA, 22 bp, Artificial Sequence
  chemically synthesized
ttaatgtgcactgcacaacgtt

SEQ ID NO: 633403 - DNA, 22 bp, Artificial Sequence
  chemically synthesized
gatgtgcaagtaaacgttgtgc

SEQ ID NO: 633404 - DNA, 22 bp, Artificial Sequence
  chemically synthesized
taatgtgcactgcacaacgttt

SEQ ID NO: 633405 - DNA, 22 bp, Artificial Sequence
  chemically synthesized
aatgtgcactgcacaacgttta

SEQ ID NO: 633406 - DNA, 22 bp, Artificial Sequence
  chemically synthesized
atgtgcactgcacaacgtttac

SEQ ID NO: 633407 - DNA, 22 bp, Artificial Sequence
  chemically synthesized
tttgatgtgcaagtaaacgttg

SEQ ID NO: 633408 - DNA, 22 bp, Artificial Sequence
  chemically synthesized
gctatttgatgtgcaagtaaac

SEQ ID NO: 633409 - DNA, 22 bp, Artificial Sequence
  chemically synthesized
ctagctatttgatgtgcaagta

SEQ ID NO: 633410 - DNA, 22 bp, Artificial Sequence
  chemically synthesized
cctagctatttgatgtgcaagt

SEQ ID NO: 633411 - DNA, 22 bp, Artificial Sequence
  chemically synthesized
cacaacgtttacttgcacatca

SEQ ID NO: 633412 - DNA, 22 bp, Artificial Sequence
  chemically synthesized
acttgcacatcaaatagctagg

SEQ ID NO: 633413 - DNA, 22 bp, Artificial Sequence
  chemically synthesized
cttgcacatcaaatagctagga

SEQ ID NO: 633414 - DNA, 22 bp, Artificial Sequence
  chemically synthesized
acaatggccatttcctagctat

SEQ ID NO: 633415 - DNA, 22 bp, Artificial Sequence
  chemically synthesized
gcacatcaaatagctaggaaat

SEQ ID NO: 633416 - DNA, 22 bp, Artificial Sequence
  chemically synthesized
cacatcaaatagctaggaaatg

SEQ ID NO: 633417 - DNA, 22 bp, Artificial Sequence
  chemically synthesized
agtgtcagttaacaatggccat

SEQ ID NO: 633418 - DNA, 22 bp, Artificial Sequence
  chemically synthesized
ttcagtgtcagttaacaatggc

SEQ ID NO: 633419 - DNA, 22 bp, Artificial Sequence
  chemically synthesized
gttcagtgtcagttaacaatgg

SEQ ID NO: 633420 - DNA, 22 bp, Artificial Sequence
  chemically synthesized
tgttcagtgtcagttaacaatg

SEQ ID NO: 633421 - DNA, 22 bp, Artificial Sequence
  chemically synthesized
ttgttcagtgtcagttaacaat

SEQ ID NO: 633422 - DNA, 22 bp, Artificial Sequence
  chemically synthesized
tttgttcagtgtcagttaacaa

SEQ ID NO: 633423 - DNA, 22 bp, Artificial Sequence
  chemically synthesized
ggaaatggccattgttaactga

SEQ ID NO: 633424 - DNA, 22 bp, Artificial Sequence
  chemically synthesized
tctttttgttcagtgtcagtta

SEQ ID NO: 633425 - DNA, 22 bp, Artificial Sequence
  chemically synthesized
ctatctttttgttcagtgtcag

SEQ ID NO: 633426 - DNA, 22 bp, Artificial Sequence
  chemically synthesized
cctatctttttgttcagtgtca

SEQ ID NO: 633427 - DNA, 22 bp, Artificial Sequence
  chemically synthesized
tcctatctttttgttcagtgtc

SEQ ID NO: 633428 - DNA, 22 bp, Artificial Sequence
  chemically synthesized
ttcctatctttttgttcagtgt

SEQ ID NO: 633429 - DNA, 22 bp, Artificial Sequence
  chemically synthesized
ttaactgacactgaacaaaaag

SEQ ID NO: 633430 - DNA, 22 bp, Artificial Sequence
  chemically synthesized
actgacactgaacaaaaagata

SEQ ID NO: 633431 - DNA, 22 bp, Artificial Sequence
  chemically synthesized
acactgaacaaaaagataggaa

SEQ ID NO: 633432 - DNA, 22 bp, Artificial Sequence
  chemically synthesized
agtagtgtgtttttcctatctt

SEQ ID NO: 633433 - DNA, 22 bp, Artificial Sequence
  chemically synthesized
aacaaaaagataggaaaaacac

SEQ ID NO: 633434 - DNA, 22 bp, Artificial Sequence
  chemically synthesized
cataagggcaatgaggagggtg

SEQ ID NO: 633435 - DNA, 22 bp, Artificial Sequence
  chemically synthesized
tccataagggcaatgaggaggg

SEQ ID NO: 633436 - DNA, 22 bp, Artificial Sequence
  chemically synthesized
ctcaatacaccctcctcattgc

SEQ ID NO: 633437 - DNA, 22 bp, Artificial Sequence
  chemically synthesized
ctctccataagggcaatgagga

SEQ ID NO: 633438 - DNA, 22 bp, Artificial Sequence
  chemically synthesized
aatacaccctcctcattgccct

SEQ ID NO: 633439 - DNA, 22 bp, Artificial Sequence
  chemically synthesized
ttcctctccataagggcaatga

SEQ ID NO: 633440 - DNA, 22 bp, Artificial Sequence
  chemically synthesized
gttcctctccataagggcaatg

SEQ ID NO: 633441 - DNA, 22 bp, Artificial Sequence
  chemically synthesized
tttgttcctctccataagggca

SEQ ID NO: 633442 - DNA, 22 bp, Artificial Sequence
  chemically synthesized
ggctgtttgttcctctccataa

SEQ ID NO: 633443 - DNA, 22 bp, Artificial Sequence
  chemically synthesized
ctcattgcccttatggagagga

SEQ ID NO: 633444 - DNA, 22 bp, Artificial Sequence
  chemically synthesized
attgcccttatggagaggaaca

SEQ ID NO: 633445 - DNA, 22 bp, Artificial Sequence
  chemically synthesized
cccttatggagaggaacaaaca

SEQ ID NO: 633446 - DNA, 22 bp, Artificial Sequence
  chemically synthesized
atggagaggaacaaacagccca

SEQ ID NO: 633447 - DNA, 22 bp, Artificial Sequence
  chemically synthesized
tggagaggaacaaacagcccag

SEQ ID NO: 633448 - DNA, 22 bp, Artificial Sequence
  chemically synthesized
ggagggacgggcagcaggaaat

SEQ ID NO: 633449 - DNA, 22 bp, Artificial Sequence
  chemically synthesized
atgggtagcctgggagggacgg

SEQ ID NO: 633450 - DNA, 22 bp, Artificial Sequence
  chemically synthesized
taatgggtagcctgggagggac

SEQ ID NO: 633451 - DNA, 22 bp, Artificial Sequence
  chemically synthesized
cctgctgcccgtccctcccagg

SEQ ID NO: 633452 - DNA, 22 bp, Artificial Sequence
  chemically synthesized
ctgctgcccgtccctcccaggc

SEQ ID NO: 633453 - DNA, 22 bp, Artificial Sequence
  chemically synthesized
ctgcccgtccctcccaggctac

SEQ ID NO: 633454 - DNA, 22 bp, Artificial Sequence
  chemically synthesized
gcacctctaatgggtagcctgg

SEQ ID NO: 633455 - DNA, 22 bp, Artificial Sequence
  chemically synthesized
cccgtccctcccaggctaccca

SEQ ID NO: 633456 - DNA, 22 bp, Artificial Sequence
  chemically synthesized
ccaggctacccattagaggtgc

SEQ ID NO: 633457 - DNA, 22 bp, Artificial Sequence
  chemically synthesized
tggccagtgattggcacctcta

SEQ ID NO: 633458 - DNA, 22 bp, Artificial Sequence
  chemically synthesized
gtggccagtgattggcacctct

SEQ ID NO: 633459 - DNA, 22 bp, Artificial Sequence
  chemically synthesized
tgtggccagtgattggcacctc

SEQ ID NO: 633460 - DNA, 22 bp, Artificial Sequence
  chemically synthesized
cccattagaggtgccaatcact

SEQ ID NO: 633461 - DNA, 22 bp, Artificial Sequence
  chemically synthesized
gaggtgccaatcactggccaca

SEQ ID NO: 633462 - DNA, 22 bp, Artificial Sequence
  chemically synthesized
gccacaaagccttgtgttttct

SEQ ID NO: 633463 - DNA, 22 bp, Artificial Sequence
  chemically synthesized
gagaaacaaaagggagaaaaca

SEQ ID NO: 633464 - DNA, 22 bp, Artificial Sequence
  chemically synthesized
gtgttttctcccttttgtttct

SEQ ID NO: 633465 - DNA, 22 bp, Artificial Sequence
  chemically synthesized
tgttttctcccttttgtttctc

SEQ ID NO: 633466 - DNA, 22 bp, Artificial Sequence
  chemically synthesized
tctcccttttgtttctctaggc

SEQ ID NO: 633467 - DNA, 22 bp, Artificial Sequence
  chemically synthesized
ctcccttttgtttctctaggct

SEQ ID NO: 633468 - DNA, 22 bp, Artificial Sequence
  chemically synthesized
tcccttttgtttctctaggctt

SEQ ID NO: 633469 - DNA, 22 bp, Artificial Sequence
  chemically synthesized
ccttttgtttctctaggctttt

SEQ ID NO: 633470 - DNA, 22 bp, Artificial Sequence
  chemically synthesized
tgatcaaatagaagaaaagcct

SEQ ID NO: 633471 - DNA, 22 bp, Artificial Sequence
  chemically synthesized
ttgtttctctaggcttttcttc

SEQ ID NO: 633472 - DNA, 22 bp, Artificial Sequence
  chemically synthesized
tgtttctctaggcttttcttct

SEQ ID NO: 633473 - DNA, 22 bp, Artificial Sequence
  chemically synthesized
gtttctctaggcttttcttcta

SEQ ID NO: 633474 - DNA, 22 bp, Artificial Sequence
  chemically synthesized
tttctctaggcttttcttctat

SEQ ID NO: 633475 - DNA, 22 bp, Artificial Sequence
  chemically synthesized
ctctaggcttttcttctatttg

SEQ ID NO: 633476 - DNA, 22 bp, Artificial Sequence
  chemically synthesized
tctaggcttttcttctatttga

SEQ ID NO: 633477 - DNA, 22 bp, Artificial Sequence
  chemically synthesized
taggcttttcttctatttgatc

SEQ ID NO: 633478 - DNA, 22 bp, Artificial Sequence
  chemically synthesized
ggcttttcttctatttgatcac

SEQ ID NO: 633479 - DNA, 22 bp, Artificial Sequence
  chemically synthesized
ttcttctatttgatcacaggtg

SEQ ID NO: 633480 - DNA, 22 bp, Artificial Sequence
  chemically synthesized
tcttctatttgatcacaggtga

SEQ ID NO: 633481 - DNA, 22 bp, Artificial Sequence
  chemically synthesized
cttctatttgatcacaggtgac

SEQ ID NO: 633482 - DNA, 22 bp, Artificial Sequence
  chemically synthesized
ttctatttgatcacaggtgact

SEQ ID NO: 633483 - DNA, 22 bp, Artificial Sequence
  chemically synthesized
ctatttgatcacaggtgactgc

SEQ ID NO: 633484 - DNA, 22 bp, Artificial Sequence
  chemically synthesized
tatttgatcacaggtgactgcc

SEQ ID NO: 633485 - DNA, 22 bp, Artificial Sequence
  chemically synthesized
tttgatcacaggtgactgccac

SEQ ID NO: 633486 - DNA, 22 bp, Artificial Sequence
  chemically synthesized
gatcacaggtgactgccaccat

SEQ ID NO: 633487 - DNA, 22 bp, Artificial Sequence
  chemically synthesized
atcacaggtgactgccaccatc

SEQ ID NO: 633488 - DNA, 22 bp, Artificial Sequence
  chemically synthesized
aacgaataaaaaggatggtggc

SEQ ID NO: 633489 - DNA, 22 bp, Artificial Sequence
  chemically synthesized
caacgaataaaaaggatggtgg

SEQ ID NO: 633490 - DNA, 22 bp, Artificial Sequence
  chemically synthesized
cttcaacgaataaaaaggatgg

SEQ ID NO: 633491 - DNA, 22 bp, Artificial Sequence
  chemically synthesized
ccttcaacgaataaaaaggatg

SEQ ID NO: 633492 - DNA, 22 bp, Artificial Sequence
  chemically synthesized
gccttccttcaacgaataaaaa

SEQ ID NO: 633493 - DNA, 22 bp, Artificial Sequence
  chemically synthesized
tcgccttccttcaacgaataaa

SEQ ID NO: 633494 - DNA, 22 bp, Artificial Sequence
  chemically synthesized
ccaccatcctttttattcgttg

SEQ ID NO: 633495 - DNA, 22 bp, Artificial Sequence
  chemically synthesized
tctcgccttccttcaacgaata

SEQ ID NO: 633496 - DNA, 22 bp, Artificial Sequence
  chemically synthesized
tttattcgttgaaggaaggcga

SEQ ID NO: 633497 - DNA, 22 bp, Artificial Sequence
  chemically synthesized
ttattcgttgaaggaaggcgag

SEQ ID NO: 633498 - DNA, 22 bp, Artificial Sequence
  chemically synthesized
tattcgttgaaggaaggcgaga

SEQ ID NO: 633499 - DNA, 22 bp, Artificial Sequence
  chemically synthesized
attcgttgaaggaaggcgagag

SEQ ID NO: 633500 - DNA, 22 bp, Artificial Sequence
  chemically synthesized
ttcgttgaaggaaggcgagaga

SEQ ID NO: 633501 - DNA, 22 bp, Artificial Sequence
  chemically synthesized
gttgaaggaaggcgagagagtg

SEQ ID NO: 633502 - DNA, 22 bp, Artificial Sequence
  chemically synthesized
acataaaacaaagtcactctct

SEQ ID NO: 633503 - DNA, 22 bp, Artificial Sequence
  chemically synthesized
aaggaaggcgagagagtgactt

SEQ ID NO: 633504 - DNA, 22 bp, Artificial Sequence
  chemically synthesized
ccctcacataaaacaaagtcac

SEQ ID NO: 633505 - DNA, 22 bp, Artificial Sequence
  chemically synthesized
ttgccctcacataaaacaaagt

SEQ ID NO: 633506 - DNA, 22 bp, Artificial Sequence
  chemically synthesized
attgccctcacataaaacaaag

SEQ ID NO: 633507 - DNA, 22 bp, Artificial Sequence
  chemically synthesized
gtttattgccctcacataaaac

SEQ ID NO: 633508 - DNA, 22 bp, Artificial Sequence
  chemically synthesized
ggtttattgccctcacataaaa

SEQ ID NO: 633509 - DNA, 22 bp, Artificial Sequence
  chemically synthesized
tttggtttattgccctcacata

SEQ ID NO: 633510 - DNA, 22 bp, Artificial Sequence
  chemically synthesized
atttggtttattgccctcacat

SEQ ID NO: 633511 - DNA, 22 bp, Artificial Sequence
  chemically synthesized
tgttttatgtgagggcaataaa

SEQ ID NO: 633512 - DNA, 22 bp, Artificial Sequence
  chemically synthesized
gttttatgtgagggcaataaac

SEQ ID NO: 633513 - DNA, 22 bp, Artificial Sequence
  chemically synthesized
ttttatgtgagggcaataaacc

SEQ ID NO: 633514 - DNA, 22 bp, Artificial Sequence
  chemically synthesized
ggggcatttatttggtttattg

SEQ ID NO: 633515 - DNA, 22 bp, Artificial Sequence
  chemically synthesized
tatgtgagggcaataaaccaaa

SEQ ID NO: 633516 - DNA, 22 bp, Artificial Sequence
  chemically synthesized
tgggggcatttatttggtttat

SEQ ID NO: 633517 - DNA, 22 bp, Artificial Sequence
  chemically synthesized
atgtgagggcaataaaccaaat

SEQ ID NO: 633518 - DNA, 22 bp, Artificial Sequence
  chemically synthesized
ctgggggcatttatttggttta

SEQ ID NO: 633519 - DNA, 22 bp, Artificial Sequence
  chemically synthesized
tgtgagggcaataaaccaaata

SEQ ID NO: 633520 - DNA, 22 bp, Artificial Sequence
  chemically synthesized
gtttctgggggcatttatttgg

SEQ ID NO: 633521 - DNA, 22 bp, Artificial Sequence
  chemically synthesized
ttcgtttctgggggcatttatt

SEQ ID NO: 633522 - DNA, 22 bp, Artificial Sequence
  chemically synthesized
ctgttcgtttctgggggcattt

SEQ ID NO: 633523 - DNA, 22 bp, Artificial Sequence
  chemically synthesized
ctactgttcgtttctgggggca

SEQ ID NO: 633524 - DNA, 22 bp, Artificial Sequence
  chemically synthesized
ctgctactgttcgtttctgggg

SEQ ID NO: 633525 - DNA, 22 bp, Artificial Sequence
  chemically synthesized
gctgctactgttcgtttctggg

SEQ ID NO: 633526 - DNA, 22 bp, Artificial Sequence
  chemically synthesized
tgctgctactgttcgtttctgg

SEQ ID NO: 633527 - DNA, 22 bp, Artificial Sequence
  chemically synthesized
atccaagatgatgttttgctgc

SEQ ID NO: 633528 - DNA, 22 bp, Artificial Sequence
  chemically synthesized
catccaagatgatgttttgctg

SEQ ID NO: 633529 - DNA, 22 bp, Artificial Sequence
  chemically synthesized
cttcatccaagatgatgttttg

SEQ ID NO: 633530 - DNA, 22 bp, Artificial Sequence
  chemically synthesized
gcttcatccaagatgatgtttt

SEQ ID NO: 633531 - DNA, 22 bp, Artificial Sequence
  chemically synthesized
agatgtcttgcttcatccaaga

SEQ ID NO: 633532 - DNA, 22 bp, Artificial Sequence
  chemically synthesized
cagatgtcttgcttcatccaag

SEQ ID NO: 633533 - DNA, 22 bp, Artificial Sequence
  chemically synthesized
catgagcttcagatgtcttgct

SEQ ID NO: 633534 - DNA, 22 bp, Artificial Sequence
  chemically synthesized
gcatgagcttcagatgtcttgc

SEQ ID NO: 633535 - DNA, 22 bp, Artificial Sequence
  chemically synthesized
gcttgcatgagcttcagatgtc

SEQ ID NO: 633536 - DNA, 22 bp, Artificial Sequence
  chemically synthesized
ggatgaagcaagacatctgaag

SEQ ID NO: 633537 - DNA, 22 bp, Artificial Sequence
  chemically synthesized
gatgaagcaagacatctgaagc

SEQ ID NO: 633538 - DNA, 22 bp, Artificial Sequence
  chemically synthesized
ccactggcttgcatgagcttca

SEQ ID NO: 633539 - DNA, 22 bp, Artificial Sequence
  chemically synthesized
cccactggcttgcatgagcttc

SEQ ID NO: 633540 - DNA, 22 bp, Artificial Sequence
  chemically synthesized
tcccactggcttgcatgagctt

SEQ ID NO: 633541 - DNA, 22 bp, Artificial Sequence
  chemically synthesized
cagaattttcccactggcttgc

SEQ ID NO: 633542 - DNA, 22 bp, Artificial Sequence
  chemically synthesized
aagctcatgcaagccagtggga

SEQ ID NO: 633543 - DNA, 22 bp, Artificial Sequence
  chemically synthesized
ccctgcagaattttcccactgg

SEQ ID NO: 633544 - DNA, 22 bp, Artificial Sequence
  chemically synthesized
accctgcagaattttcccactg

SEQ ID NO: 633545 - DNA, 22 bp, Artificial Sequence
  chemically synthesized
taccctgcagaattttcccact

SEQ ID NO: 633546 - DNA, 22 bp, Artificial Sequence
  chemically synthesized
atgcaagccagtgggaaaattc

SEQ ID NO: 633547 - DNA, 22 bp, Artificial Sequence
  chemically synthesized
cccccatacaaaaacagcattt

SEQ ID NO: 633548 - DNA, 22 bp, Artificial Sequence
  chemically synthesized
acccccatacaaaaacagcatt

SEQ ID NO: 633549 - DNA, 22 bp, Artificial Sequence
  chemically synthesized
tacccccatacaaaaacagcat

SEQ ID NO: 633550 - DNA, 22 bp, Artificial Sequence
  chemically synthesized
tgcagggtaaaatgctgttttt

SEQ ID NO: 633551 - DNA, 22 bp, Artificial Sequence
  chemically synthesized
cagggtaaaatgctgtttttgt

SEQ ID NO: 633552 - DNA, 22 bp, Artificial Sequence
  chemically synthesized
cgtattttacccccatacaaaa

SEQ ID NO: 633553 - DNA, 22 bp, Artificial Sequence
  chemically synthesized
gcgtattttacccccatacaaa

SEQ ID NO: 633554 - DNA, 22 bp, Artificial Sequence
  chemically synthesized
gccttgcgtattttacccccat

SEQ ID NO: 633555 - DNA, 22 bp, Artificial Sequence
  chemically synthesized
ggccttgcgtattttaccccca

SEQ ID NO: 633556 - DNA, 22 bp, Artificial Sequence
  chemically synthesized
tggccttgcgtattttaccccc

SEQ ID NO: 633557 - DNA, 22 bp, Artificial Sequence
  chemically synthesized
tttttgtatgggggtaaaatac

SEQ ID NO: 633558 - DNA, 22 bp, Artificial Sequence
  chemically synthesized
ttgtatgggggtaaaatacgca

SEQ ID NO: 633559 - DNA, 22 bp, Artificial Sequence
  chemically synthesized
tgtatgggggtaaaatacgcaa

SEQ ID NO: 633560 - DNA, 22 bp, Artificial Sequence
  chemically synthesized
atcactttggccttgcgtattt

SEQ ID NO: 633561 - DNA, 22 bp, Artificial Sequence
  chemically synthesized
gtatgggggtaaaatacgcaag

SEQ ID NO: 633562 - DNA, 22 bp, Artificial Sequence
  chemically synthesized
catcactttggccttgcgtatt

SEQ ID NO: 633563 - DNA, 22 bp, Artificial Sequence
  chemically synthesized
tatgggggtaaaatacgcaagg

SEQ ID NO: 633564 - DNA, 22 bp, Artificial Sequence
  chemically synthesized
ttcatcactttggccttgcgta

SEQ ID NO: 633565 - DNA, 22 bp, Artificial Sequence
  chemically synthesized
cttcatcactttggccttgcgt

SEQ ID NO: 633566 - DNA, 22 bp, Artificial Sequence
  chemically synthesized
tcttcatcactttggccttgcg

SEQ ID NO: 633567 - DNA, 22 bp, Artificial Sequence
  chemically synthesized
ttcttcatcactttggccttgc

SEQ ID NO: 633568 - DNA, 22 bp, Artificial Sequence
  chemically synthesized
tttcttcatcactttggccttg

SEQ ID NO: 633569 - DNA, 22 bp, Artificial Sequence
  chemically synthesized
tttttcttcatcactttggcct

SEQ ID NO: 633570 - DNA, 22 bp, Artificial Sequence
  chemically synthesized
ctttttcttcatcactttggcc

SEQ ID NO: 633571 - DNA, 22 bp, Artificial Sequence
  chemically synthesized
tctttttcttcatcactttggc

SEQ ID NO: 633572 - DNA, 22 bp, Artificial Sequence
  chemically synthesized
ttctttttcttcatcactttgg

SEQ ID NO: 633573 - DNA, 22 bp, Artificial Sequence
  chemically synthesized
atatttttctttttcttcatca

SEQ ID NO: 633574 - DNA, 22 bp, Artificial Sequence
  chemically synthesized
gcaaagaaagacattaatattt

SEQ ID NO: 633575 - DNA, 22 bp, Artificial Sequence
  chemically synthesized
agcaaagaaagacattaatatt

SEQ ID NO: 633576 - DNA, 22 bp, Artificial Sequence
  chemically synthesized
atgtctttctttgctaagcctg

SEQ ID NO: 633577 - DNA, 22 bp, Artificial Sequence
  chemically synthesized
gatagaggaaatacaggcttag

SEQ ID NO: 633578 - DNA, 22 bp, Artificial Sequence
  chemically synthesized
cgatagaggaaatacaggctta

SEQ ID NO: 633579 - DNA, 22 bp, Artificial Sequence
  chemically synthesized
cttcgatagaggaaatacaggc

SEQ ID NO: 633580 - DNA, 22 bp, Artificial Sequence
  chemically synthesized
acttcgatagaggaaatacagg

SEQ ID NO: 633581 - DNA, 22 bp, Artificial Sequence
  chemically synthesized
tctttgctaagcctgtatttcc

SEQ ID NO: 633582 - DNA, 22 bp, Artificial Sequence
  chemically synthesized
tacttcgatagaggaaatacag

SEQ ID NO: 633583 - DNA, 22 bp, Artificial Sequence
  chemically synthesized
ctttgctaagcctgtatttcct

SEQ ID NO: 633584 - DNA, 22 bp, Artificial Sequence
  chemically synthesized
ttacttcgatagaggaaataca

SEQ ID NO: 633585 - DNA, 22 bp, Artificial Sequence
  chemically synthesized
tttgctaagcctgtatttcctc

SEQ ID NO: 633586 - DNA, 22 bp, Artificial Sequence
  chemically synthesized
tttacttcgatagaggaaatac

SEQ ID NO: 633587 - DNA, 22 bp, Artificial Sequence
  chemically synthesized
tgctaagcctgtatttcctcta

SEQ ID NO: 633588 - DNA, 22 bp, Artificial Sequence
  chemically synthesized
gctaagcctgtatttcctctat

SEQ ID NO: 633589 - DNA, 22 bp, Artificial Sequence
  chemically synthesized
ttttttacttcgatagaggaaa

SEQ ID NO: 633590 - DNA, 22 bp, Artificial Sequence
  chemically synthesized
ctaagcctgtatttcctctatc

SEQ ID NO: 633591 - DNA, 22 bp, Artificial Sequence
  chemically synthesized
agcctgtatttcctctatcgaa

SEQ ID NO: 633592 - DNA, 22 bp, Artificial Sequence
  chemically synthesized
gttattttttacttcgatagag

SEQ ID NO: 633593 - DNA, 22 bp, Artificial Sequence
  chemically synthesized
tatttcctctatcgaagtaaaa

SEQ ID NO: 633594 - DNA, 22 bp, Artificial Sequence
  chemically synthesized
cctctatcgaagtaaaaaataa

SEQ ID NO: 633595 - DNA, 22 bp, Artificial Sequence
  chemically synthesized
ctctatcgaagtaaaaaataac

SEQ ID NO: 633596 - DNA, 22 bp, Artificial Sequence
  chemically synthesized
atagagtagttggttatttttt

SEQ ID NO: 633597 - DNA, 22 bp, Artificial Sequence
  chemically synthesized
catagagtagttggttattttt

SEQ ID NO: 633598 - DNA, 22 bp, Artificial Sequence
  chemically synthesized
tatcgaagtaaaaaataaccaa

SEQ ID NO: 633599 - DNA, 22 bp, Artificial Sequence
  chemically synthesized
tcgaagtaaaaaataaccaact

SEQ ID NO: 633600 - DNA, 22 bp, Artificial Sequence
  chemically synthesized
aatcttcatagagtagttggtt

SEQ ID NO: 633601 - DNA, 22 bp, Artificial Sequence
  chemically synthesized
aatatagggacaattaaatctt

SEQ ID NO: 633602 - DNA, 22 bp, Artificial Sequence
  chemically synthesized
aaatatagggacaattaaatct

SEQ ID NO: 633603 - DNA, 22 bp, Artificial Sequence
  chemically synthesized
ctctatgaagatttaattgtcc

SEQ ID NO: 633604 - DNA, 22 bp, Artificial Sequence
  chemically synthesized
tatgaagatttaattgtcccta

SEQ ID NO: 633605 - DNA, 22 bp, Artificial Sequence
  chemically synthesized
catcatttaaatatagggacaa

SEQ ID NO: 633606 - DNA, 22 bp, Artificial Sequence
  chemically synthesized
tgaagatttaattgtccctata

SEQ ID NO: 633607 - DNA, 22 bp, Artificial Sequence
  chemically synthesized
ctccatcatttaaatataggga

SEQ ID NO: 633608 - DNA, 22 bp, Artificial Sequence
  chemically synthesized
actccatcatttaaatataggg

SEQ ID NO: 633609 - DNA, 22 bp, Artificial Sequence
  chemically synthesized
aattgtccctatatttaaatga

SEQ ID NO: 633610 - DNA, 22 bp, Artificial Sequence
  chemically synthesized
tatcttactccatcatttaaat

SEQ ID NO: 633611 - DNA, 22 bp, Artificial Sequence
  chemically synthesized
attgtccctatatttaaatgat

SEQ ID NO: 633612 - DNA, 22 bp, Artificial Sequence
  chemically synthesized
tccctatatttaaatgatggag

SEQ ID NO: 633613 - DNA, 22 bp, Artificial Sequence
  chemically synthesized
aaaattgtatcttactccatca

SEQ ID NO: 633614 - DNA, 22 bp, Artificial Sequence
  chemically synthesized
aaaaattgtatcttactccatc

SEQ ID NO: 633615 - DNA, 22 bp, Artificial Sequence
  chemically synthesized
tatttaaatgatggagtaagat

SEQ ID NO: 633616 - DNA, 22 bp, Artificial Sequence
  chemically synthesized
tatttaaaaattgtatcttact

SEQ ID NO: 633617 - DNA, 22 bp, Artificial Sequence
  chemically synthesized
atatttaaaaattgtatcttac

SEQ ID NO: 633618 - DNA, 22 bp, Artificial Sequence
  chemically synthesized
tatatttaaaaattgtatctta

SEQ ID NO: 633619 - DNA, 22 bp, Artificial Sequence
  chemically synthesized
aaatgatggagtaagatacaat

SEQ ID NO: 633620 - DNA, 22 bp, Artificial Sequence
  chemically synthesized
aatgatggagtaagatacaatt

SEQ ID NO: 633621 - DNA, 22 bp, Artificial Sequence
  chemically synthesized
atgccctttatatttaaaaatt

SEQ ID NO: 633622 - DNA, 22 bp, Artificial Sequence
  chemically synthesized
ccatctgatgccctttatattt

SEQ ID NO: 633623 - DNA, 22 bp, Artificial Sequence
  chemically synthesized
gccatctgatgccctttatatt

SEQ ID NO: 633624 - DNA, 22 bp, Artificial Sequence
  chemically synthesized
acttgccatctgatgcccttta

SEQ ID NO: 633625 - DNA, 22 bp, Artificial Sequence
  chemically synthesized
tgacttgccatctgatgccctt

SEQ ID NO: 633626 - DNA, 22 bp, Artificial Sequence
  chemically synthesized
ttaaatataaagggcatcagat

SEQ ID NO: 633627 - DNA, 22 bp, Artificial Sequence
  chemically synthesized
taaatataaagggcatcagatg

SEQ ID NO: 633628 - DNA, 22 bp, Artificial Sequence
  chemically synthesized
aaatataaagggcatcagatgg

SEQ ID NO: 633629 - DNA, 22 bp, Artificial Sequence
  chemically synthesized
aatataaagggcatcagatggc

SEQ ID NO: 633630 - DNA, 22 bp, Artificial Sequence
  chemically synthesized
gtagtggtagagattctgactt

SEQ ID NO: 633631 - DNA, 22 bp, Artificial Sequence
  chemically synthesized
attggtagtggtagagattctg

SEQ ID NO: 633632 - DNA, 22 bp, Artificial Sequence
  chemically synthesized
ctgattggtagtggtagagatt

SEQ ID NO: 633633 - DNA, 22 bp, Artificial Sequence
  chemically synthesized
gaacaatgcctactgattggta

SEQ ID NO: 633634 - DNA, 22 bp, Artificial Sequence
  chemically synthesized
taccactaccaatcagtaggca

SEQ ID NO: 633635 - DNA, 22 bp, Artificial Sequence
  chemically synthesized
ccactaccaatcagtaggcatt

SEQ ID NO: 633636 - DNA, 22 bp, Artificial Sequence
  chemically synthesized
cagcaaggcctagaacaatgcc

SEQ ID NO: 633637 - DNA, 22 bp, Artificial Sequence
  chemically synthesized
ccaatcagtaggcattgttcta

SEQ ID NO: 633638 - DNA, 22 bp, Artificial Sequence
  chemically synthesized
cgtgctacagcaaggcctagaa

SEQ ID NO: 633639 - DNA, 22 bp, Artificial Sequence
  chemically synthesized
ctacgtgctacagcaaggccta

SEQ ID NO: 633640 - DNA, 22 bp, Artificial Sequence
  chemically synthesized
ttctaggccttgctgtagcacg

SEQ ID NO: 633641 - DNA, 22 bp, Artificial Sequence
  chemically synthesized
taggccttgctgtagcacgtag

SEQ ID NO: 633642 - DNA, 22 bp, Artificial Sequence
  chemically synthesized
ggccttgctgtagcacgtagta

SEQ ID NO: 633643 - DNA, 22 bp, Artificial Sequence
  chemically synthesized
ccagggacatatggctactacg

SEQ ID NO: 633644 - DNA, 22 bp, Artificial Sequence
  chemically synthesized
gccagggacatatggctactac

SEQ ID NO: 633645 - DNA, 22 bp, Artificial Sequence
  chemically synthesized
tgccagggacatatggctacta

SEQ ID NO: 633646 - DNA, 22 bp, Artificial Sequence
  chemically synthesized
gctgtagcacgtagtagccata

SEQ ID NO: 633647 - DNA, 22 bp, Artificial Sequence
  chemically synthesized
ctgtagcacgtagtagccatat

SEQ ID NO: 633648 - DNA, 22 bp, Artificial Sequence
  chemically synthesized
tagcacgtagtagccatatgtc

SEQ ID NO: 633649 - DNA, 22 bp, Artificial Sequence
  chemically synthesized
atagtgcctttgccagggacat

SEQ ID NO: 633650 - DNA, 22 bp, Artificial Sequence
  chemically synthesized
atgccctgatagtgcctttgcc

SEQ ID NO: 633651 - DNA, 22 bp, Artificial Sequence
  chemically synthesized
gcaaaggcactatcagggcatt

SEQ ID NO: 633652 - DNA, 22 bp, Artificial Sequence
  chemically synthesized
cagatgaggaaattaatgccct

SEQ ID NO: 633653 - DNA, 22 bp, Artificial Sequence
  chemically synthesized
acagatgaggaaattaatgccc

SEQ ID NO: 633654 - DNA, 22 bp, Artificial Sequence
  chemically synthesized
tacagatgaggaaattaatgcc

SEQ ID NO: 633655 - DNA, 22 bp, Artificial Sequence
  chemically synthesized
ttacagatgaggaaattaatgc

SEQ ID NO: 633656 - DNA, 22 bp, Artificial Sequence
  chemically synthesized
tcagggcattaatttcctcatc

SEQ ID NO: 633657 - DNA, 22 bp, Artificial Sequence
  chemically synthesized
tgtgacttttacagatgaggaa

SEQ ID NO: 633658 - DNA, 22 bp, Artificial Sequence
  chemically synthesized
ttatgtgacttttacagatgag

SEQ ID NO: 633659 - DNA, 22 bp, Artificial Sequence
  chemically synthesized
atttcctcatctgtaaaagtca

SEQ ID NO: 633660 - DNA, 22 bp, Artificial Sequence
  chemically synthesized
cctcatctgtaaaagtcacata

SEQ ID NO: 633661 - DNA, 22 bp, Artificial Sequence
  chemically synthesized
aagagcaattattatgtgactt

SEQ ID NO: 633662 - DNA, 22 bp, Artificial Sequence
  chemically synthesized
ctcatctgtaaaagtcacataa

SEQ ID NO: 633663 - DNA, 22 bp, Artificial Sequence
  chemically synthesized
ctgaagagcaattattatgtga

SEQ ID NO: 633664 - DNA, 22 bp, Artificial Sequence
  chemically synthesized
atctgtaaaagtcacataataa

SEQ ID NO: 633665 - DNA, 22 bp, Artificial Sequence
  chemically synthesized
actgaagagcaattattatgtg

SEQ ID NO: 633666 - DNA, 22 bp, Artificial Sequence
  chemically synthesized
tactgaagagcaattattatgt

SEQ ID NO: 633667 - DNA, 22 bp, Artificial Sequence
  chemically synthesized
taaaagtcacataataattgct

SEQ ID NO: 633668 - DNA, 22 bp, Artificial Sequence
  chemically synthesized
tgaggtgccctttactgaagag

SEQ ID NO: 633669 - DNA, 22 bp, Artificial Sequence
  chemically synthesized
attatgaggtgccctttactga

SEQ ID NO: 633670 - DNA, 22 bp, Artificial Sequence
  chemically synthesized
ctcttcagtaaagggcacctca

SEQ ID NO: 633671 - DNA, 22 bp, Artificial Sequence
  chemically synthesized
aagagttaattatgaggtgccc

SEQ ID NO: 633672 - DNA, 22 bp, Artificial Sequence
  chemically synthesized
ttcagtaaagggcacctcataa

SEQ ID NO: 633673 - DNA, 22 bp, Artificial Sequence
  chemically synthesized
cagtaaagggcacctcataatt

SEQ ID NO: 633674 - DNA, 22 bp, Artificial Sequence
  chemically synthesized
gtctgaagagttaattatgagg

SEQ ID NO: 633675 - DNA, 22 bp, Artificial Sequence
  chemically synthesized
agtaaagggcacctcataatta

SEQ ID NO: 633676 - DNA, 22 bp, Artificial Sequence
  chemically synthesized
acacattagtctgaagagttaa

SEQ ID NO: 633677 - DNA, 22 bp, Artificial Sequence
  chemically synthesized
cacacattagtctgaagagtta

SEQ ID NO: 633678 - DNA, 22 bp, Artificial Sequence
  chemically synthesized
cttcacacattagtctgaagag

SEQ ID NO: 633679 - DNA, 22 bp, Artificial Sequence
  chemically synthesized
gcttcacacattagtctgaaga

SEQ ID NO: 633680 - DNA, 22 bp, Artificial Sequence
  chemically synthesized
ataattaactcttcagactaat

SEQ ID NO: 633681 - DNA, 22 bp, Artificial Sequence
  chemically synthesized
cttgcttcacacattagtctga

SEQ ID NO: 633682 - DNA, 22 bp, Artificial Sequence
  chemically synthesized
acttgcttcacacattagtctg

SEQ ID NO: 633683 - DNA, 22 bp, Artificial Sequence
  chemically synthesized
tacttgcttcacacattagtct

SEQ ID NO: 633684 - DNA, 22 bp, Artificial Sequence
  chemically synthesized
actcttcagactaatgtgtgaa

SEQ ID NO: 633685 - DNA, 22 bp, Artificial Sequence
  chemically synthesized
ttcagactaatgtgtgaagcaa

SEQ ID NO: 633686 - DNA, 22 bp, Artificial Sequence
  chemically synthesized
tcaagtattttacttgcttcac

SEQ ID NO: 633687 - DNA, 22 bp, Artificial Sequence
  chemically synthesized
cagactaatgtgtgaagcaagt

SEQ ID NO: 633688 - DNA, 22 bp, Artificial Sequence
  chemically synthesized
gtcaagtattttacttgcttca

SEQ ID NO: 633689 - DNA, 22 bp, Artificial Sequence
  chemically synthesized
agactaatgtgtgaagcaagta

SEQ ID NO: 633690 - DNA, 22 bp, Artificial Sequence
  chemically synthesized
tttgtcaagtattttacttgct

SEQ ID NO: 633691 - DNA, 22 bp, Artificial Sequence
  chemically synthesized
tatttgtcaagtattttacttg

SEQ ID NO: 633692 - DNA, 22 bp, Artificial Sequence
  chemically synthesized
atgtgtgaagcaagtaaaatac

SEQ ID NO: 633693 - DNA, 22 bp, Artificial Sequence
  chemically synthesized
caaaaataagaataccaccctc

SEQ ID NO: 633694 - DNA, 22 bp, Artificial Sequence
  chemically synthesized
ccaaaaataagaataccaccct

SEQ ID NO: 633695 - DNA, 22 bp, Artificial Sequence
  chemically synthesized
gacaaatagagggtggtattct

SEQ ID NO: 633696 - DNA, 22 bp, Artificial Sequence
  chemically synthesized
acaaatagagggtggtattctt

SEQ ID NO: 633697 - DNA, 22 bp, Artificial Sequence
  chemically synthesized
ttatttttggaaacatgttgcc

SEQ ID NO: 633698 - DNA, 22 bp, Artificial Sequence
  chemically synthesized
aaatacccgtgagggcaacatg

SEQ ID NO: 633699 - DNA, 22 bp, Artificial Sequence
  chemically synthesized
atttttggaaacatgttgccct

SEQ ID NO: 633700 - DNA, 22 bp, Artificial Sequence
  chemically synthesized
tttttggaaacatgttgccctc

SEQ ID NO: 633701 - DNA, 22 bp, Artificial Sequence
  chemically synthesized
ttggaaacatgttgccctcacg

SEQ ID NO: 633702 - DNA, 22 bp, Artificial Sequence
  chemically synthesized
aattcaaatacccgtgagggca

SEQ ID NO: 633703 - DNA, 22 bp, Artificial Sequence
  chemically synthesized
tggaaacatgttgccctcacgg

SEQ ID NO: 633704 - DNA, 22 bp, Artificial Sequence
  chemically synthesized
ggaaacatgttgccctcacggg

SEQ ID NO: 633705 - DNA, 22 bp, Artificial Sequence
  chemically synthesized
tgaattcaaatacccgtgaggg

SEQ ID NO: 633706 - DNA, 22 bp, Artificial Sequence
  chemically synthesized
gaaacatgttgccctcacgggt

SEQ ID NO: 633707 - DNA, 22 bp, Artificial Sequence
  chemically synthesized
gagtactctgaattcaaatacc

SEQ ID NO: 633708 - DNA, 22 bp, Artificial Sequence
  chemically synthesized
agagtactctgaattcaaatac

SEQ ID NO: 633709 - DNA, 22 bp, Artificial Sequence
  chemically synthesized
ccctcacgggtatttgaattca

SEQ ID NO: 633710 - DNA, 22 bp, Artificial Sequence
  chemically synthesized
tggtttagagtactctgaattc

SEQ ID NO: 633711 - DNA, 22 bp, Artificial Sequence
  chemically synthesized
gtggtttagagtactctgaatt

SEQ ID NO: 633712 - DNA, 22 bp, Artificial Sequence
  chemically synthesized
acgggtatttgaattcagagta

SEQ ID NO: 633713 - DNA, 22 bp, Artificial Sequence
  chemically synthesized
gaattcagagtactctaaacca

SEQ ID NO: 633714 - DNA, 22 bp, Artificial Sequence
  chemically synthesized
agtgtgaatttgtggtttagag

SEQ ID NO: 633715 - DNA, 22 bp, Artificial Sequence
  chemically synthesized
aattcagagtactctaaaccac

SEQ ID NO: 633716 - DNA, 22 bp, Artificial Sequence
  chemically synthesized
aagtgtgaatttgtggtttaga

SEQ ID NO: 633717 - DNA, 22 bp, Artificial Sequence
  chemically synthesized
taagtgtgaatttgtggtttag

SEQ ID NO: 633718 - DNA, 22 bp, Artificial Sequence
  chemically synthesized
ttaagtgtgaatttgtggttta

SEQ ID NO: 633719 - DNA, 22 bp, Artificial Sequence
  chemically synthesized
agagtactctaaaccacaaatt

SEQ ID NO: 633720 - DNA, 22 bp, Artificial Sequence
  chemically synthesized
atttttaagtgtgaatttgtgg

SEQ ID NO: 633721 - DNA, 22 bp, Artificial Sequence
  chemically synthesized
gatttttaagtgtgaatttgtg

SEQ ID NO: 633722 - DNA, 22 bp, Artificial Sequence
  chemically synthesized
taaaccacaaattcacacttaa

SEQ ID NO: 633723 - DNA, 22 bp, Artificial Sequence
  chemically synthesized
aaccacaaattcacacttaaaa

SEQ ID NO: 633724 - DNA, 22 bp, Artificial Sequence
  chemically synthesized
ggtccatggtgaaaagatttga

SEQ ID NO: 633725 - DNA, 22 bp, Artificial Sequence
  chemically synthesized
acacttaaaaatcaaatctttt

SEQ ID NO: 633726 - DNA, 22 bp, Artificial Sequence
  chemically synthesized
gggtccatggtgaaaagatttg

SEQ ID NO: 633727 - DNA, 22 bp, Artificial Sequence
  chemically synthesized
aaaaatcaaatcttttcaccat

SEQ ID NO: 633728 - DNA, 22 bp, Artificial Sequence
  chemically synthesized
aaaatcaaatcttttcaccatg

SEQ ID NO: 633729 - DNA, 22 bp, Artificial Sequence
  chemically synthesized
ttcaccatggacccaaattgcc

SEQ ID NO: 633730 - DNA, 22 bp, Artificial Sequence
  chemically synthesized
tcaccatggacccaaattgcca

SEQ ID NO: 633731 - DNA, 22 bp, Artificial Sequence
  chemically synthesized
caccatggacccaaattgccat

SEQ ID NO: 633732 - DNA, 22 bp, Artificial Sequence
  chemically synthesized
accatggacccaaattgccatt

SEQ ID NO: 633733 - DNA, 22 bp, Artificial Sequence
  chemically synthesized
catatggaagccaacacgcagt

SEQ ID NO: 633734 - DNA, 22 bp, Artificial Sequence
  chemically synthesized
ccatatggaagccaacacgcag

SEQ ID NO: 633735 - DNA, 22 bp, Artificial Sequence
  chemically synthesized
ccattctgatactgcgtgttgg

SEQ ID NO: 633736 - DNA, 22 bp, Artificial Sequence
  chemically synthesized
tccatatggaagccaacacgca

SEQ ID NO: 633737 - DNA, 22 bp, Artificial Sequence
  chemically synthesized
tgatactgcgtgttggcttcca

SEQ ID NO: 633738 - DNA, 22 bp, Artificial Sequence
  chemically synthesized
atactgcgtgttggcttccata

SEQ ID NO: 633739 - DNA, 22 bp, Artificial Sequence
  chemically synthesized
gtgtgtgtattttccatatgga

SEQ ID NO: 633740 - DNA, 22 bp, Artificial Sequence
  chemically synthesized
cgtgttggcttccatatggaaa

SEQ ID NO: 633741 - DNA, 22 bp, Artificial Sequence
  chemically synthesized
cccaactggtgtgtgtattttc

SEQ ID NO: 633742 - DNA, 22 bp, Artificial Sequence
  chemically synthesized
gcttccatatggaaaatacaca

SEQ ID NO: 633743 - DNA, 22 bp, Artificial Sequence
  chemically synthesized
cctacccaactggtgtgtgtat

SEQ ID NO: 633744 - DNA, 22 bp, Artificial Sequence
  chemically synthesized
ccatatggaaaatacacacacc

SEQ ID NO: 633745 - DNA, 22 bp, Artificial Sequence
  chemically synthesized
ccctacccaactggtgtgtgta

SEQ ID NO: 633746 - DNA, 22 bp, Artificial Sequence
  chemically synthesized
catatggaaaatacacacacca

SEQ ID NO: 633747 - DNA, 22 bp, Artificial Sequence
  chemically synthesized
gcttccctacccaactggtgtg

SEQ ID NO: 633748 - DNA, 22 bp, Artificial Sequence
  chemically synthesized
ggatcaggccactcgcttccct

SEQ ID NO: 633749 - DNA, 22 bp, Artificial Sequence
  chemically synthesized
ctgggatcaggccactcgcttc

SEQ ID NO: 633750 - DNA, 22 bp, Artificial Sequence
  chemically synthesized
gctgggatcaggccactcgctt

SEQ ID NO: 633751 - DNA, 22 bp, Artificial Sequence
  chemically synthesized
ggtagggaagcgagtggcctga

SEQ ID NO: 633752 - DNA, 22 bp, Artificial Sequence
  chemically synthesized
agatttgctgggatcaggccac

SEQ ID NO: 633753 - DNA, 22 bp, Artificial Sequence
  chemically synthesized
gaagggactcagatttgctggg

SEQ ID NO: 633754 - DNA, 22 bp, Artificial Sequence
  chemically synthesized
caatacctagaagggactcaga

SEQ ID NO: 633755 - DNA, 22 bp, Artificial Sequence
  chemically synthesized
atcccagcaaatctgagtccct

SEQ ID NO: 633756 - DNA, 22 bp, Artificial Sequence
  chemically synthesized
aagaggtaagctccaataccta

SEQ ID NO: 633757 - DNA, 22 bp, Artificial Sequence
  chemically synthesized
agtcccttctaggtattggagc

SEQ ID NO: 633758 - DNA, 22 bp, Artificial Sequence
  chemically synthesized
gttcaagaggtaagctccaata

SEQ ID NO: 633759 - DNA, 22 bp, Artificial Sequence
  chemically synthesized
cctagttcaagaggtaagctcc

SEQ ID NO: 633760 - DNA, 22 bp, Artificial Sequence
  chemically synthesized
ccctagttcaagaggtaagctc

SEQ ID NO: 633761 - DNA, 22 bp, Artificial Sequence
  chemically synthesized
ctaggtattggagcttacctct

SEQ ID NO: 633762 - DNA, 22 bp, Artificial Sequence
  chemically synthesized
taggtattggagcttacctctt

SEQ ID NO: 633763 - DNA, 22 bp, Artificial Sequence
  chemically synthesized
cttccctagttcaagaggtaag

SEQ ID NO: 633764 - DNA, 22 bp, Artificial Sequence
  chemically synthesized
ggtattggagcttacctcttga

SEQ ID NO: 633765 - DNA, 22 bp, Artificial Sequence
  chemically synthesized
aacaactccttccctagttcaa

SEQ ID NO: 633766 - DNA, 22 bp, Artificial Sequence
  chemically synthesized
gagcttacctcttgaactaggg

SEQ ID NO: 633767 - DNA, 22 bp, Artificial Sequence
  chemically synthesized
acctcttgaactagggaaggag

SEQ ID NO: 633768 - DNA, 22 bp, Artificial Sequence
  chemically synthesized
cctcttgaactagggaaggagt

SEQ ID NO: 633769 - DNA, 22 bp, Artificial Sequence
  chemically synthesized
ttgaactagggaaggagttgtt

SEQ ID NO: 633770 - DNA, 22 bp, Artificial Sequence
  chemically synthesized
gaactagggaaggagttgttga

SEQ ID NO: 633771 - DNA, 22 bp, Artificial Sequence
  chemically synthesized
aactagggaaggagttgttgag

SEQ ID NO: 633772 - DNA, 22 bp, Artificial Sequence
  chemically synthesized
gggaaggagttgttgagttgct

SEQ ID NO: 633773 - DNA, 22 bp, Artificial Sequence
  chemically synthesized
gaggaggtgatggagcaactca

SEQ ID NO: 633774 - DNA, 22 bp, Artificial Sequence
  chemically synthesized
ttgagttgctccatcacctcct

SEQ ID NO: 633775 - DNA, 22 bp, Artificial Sequence
  chemically synthesized
agttgctccatcacctcctcta

SEQ ID NO: 633776 - DNA, 22 bp, Artificial Sequence
  chemically synthesized
ctccatcacctcctctaaccct

SEQ ID NO: 633777 - DNA, 22 bp, Artificial Sequence
  chemically synthesized
catcacctcctctaaccctgtg

SEQ ID NO: 633778 - DNA, 22 bp, Artificial Sequence
  chemically synthesized
cccaggacacaagcacagggtt

SEQ ID NO: 633779 - DNA, 22 bp, Artificial Sequence
  chemically synthesized
agtcctccccaggacacaagca

SEQ ID NO: 633780 - DNA, 22 bp, Artificial Sequence
  chemically synthesized
ctctaaccctgtgcttgtgtcc

SEQ ID NO: 633781 - DNA, 22 bp, Artificial Sequence
  chemically synthesized
tcagtcctccccaggacacaag

SEQ ID NO: 633782 - DNA, 22 bp, Artificial Sequence
  chemically synthesized
ctcagtcctccccaggacacaa

SEQ ID NO: 633783 - DNA, 22 bp, Artificial Sequence
  chemically synthesized
taaccctgtgcttgtgtcctgg

SEQ ID NO: 633784 - DNA, 22 bp, Artificial Sequence
  chemically synthesized
accctgtgcttgtgtcctgggg

SEQ ID NO: 633785 - DNA, 22 bp, Artificial Sequence
  chemically synthesized
tgcttgtgtcctggggaggact

SEQ ID NO: 633786 - DNA, 22 bp, Artificial Sequence
  chemically synthesized
gtgtcctggggaggactgagaa

SEQ ID NO: 633787 - DNA, 22 bp, Artificial Sequence
  chemically synthesized
tgtcctggggaggactgagaag

SEQ ID NO: 633788 - DNA, 22 bp, Artificial Sequence
  chemically synthesized
aggtgaggaagatcttctcagt

SEQ ID NO: 633789 - DNA, 22 bp, Artificial Sequence
  chemically synthesized
ttaaggtgaggaagatcttctc

SEQ ID NO: 633790 - DNA, 22 bp, Artificial Sequence
  chemically synthesized
attaaggtgaggaagatcttct

SEQ ID NO: 633791 - DNA, 22 bp, Artificial Sequence
  chemically synthesized
tattaaggtgaggaagatcttc

SEQ ID NO: 633792 - DNA, 22 bp, Artificial Sequence
  chemically synthesized
gggaggactgagaagatcttcc

SEQ ID NO: 633793 - DNA, 22 bp, Artificial Sequence
  chemically synthesized
ttattaaggtgaggaagatctt

SEQ ID NO: 633794 - DNA, 22 bp, Artificial Sequence
  chemically synthesized
cttttattaaggtgaggaagat

SEQ ID NO: 633795 - DNA, 22 bp, Artificial Sequence
  chemically synthesized
gcttttattaaggtgaggaaga

SEQ ID NO: 633796 - DNA, 22 bp, Artificial Sequence
  chemically synthesized
tgcttttattaaggtgaggaag

SEQ ID NO: 633797 - DNA, 22 bp, Artificial Sequence
  chemically synthesized
ttgcttttattaaggtgaggaa

SEQ ID NO: 633798 - DNA, 22 bp, Artificial Sequence
  chemically synthesized
tttttgcttttattaaggtgag

SEQ ID NO: 633799 - DNA, 22 bp, Artificial Sequence
  chemically synthesized
agaagatcttcctcaccttaat

SEQ ID NO: 633800 - DNA, 22 bp, Artificial Sequence
  chemically synthesized
gtttttgcttttattaaggtga

SEQ ID NO: 633801 - DNA, 22 bp, Artificial Sequence
  chemically synthesized
tttgtttttgcttttattaagg

SEQ ID NO: 633802 - DNA, 22 bp, Artificial Sequence
  chemically synthesized
cattatttgtttttgcttttat

SEQ ID NO: 633803 - DNA, 22 bp, Artificial Sequence
  chemically synthesized
ccattatttgtttttgctttta

SEQ ID NO: 633804 - DNA, 22 bp, Artificial Sequence
  chemically synthesized
cctcaccttaataaaagcaaaa

SEQ ID NO: 633805 - DNA, 22 bp, Artificial Sequence
  chemically synthesized
tccattatttgtttttgctttt

SEQ ID NO: 633806 - DNA, 22 bp, Artificial Sequence
  chemically synthesized
ctcaccttaataaaagcaaaaa

SEQ ID NO: 633807 - DNA, 22 bp, Artificial Sequence
  chemically synthesized
accttaataaaagcaaaaacaa

SEQ ID NO: 633808 - DNA, 22 bp, Artificial Sequence
  chemically synthesized
aataaaagcaaaaacaaataat

SEQ ID NO: 633809 - DNA, 22 bp, Artificial Sequence
  chemically synthesized
ataaaagcaaaaacaaataatg

SEQ ID NO: 633810 - DNA, 22 bp, Artificial Sequence
  chemically synthesized
taaatgtaattttccattattt

SEQ ID NO: 633811 - DNA, 22 bp, Artificial Sequence
  chemically synthesized
tataaatgtaattttccattat

SEQ ID NO: 633812 - DNA, 22 bp, Artificial Sequence
  chemically synthesized
ctataaatgtaattttccatta

SEQ ID NO: 633813 - DNA, 22 bp, Artificial Sequence
  chemically synthesized
tctataaatgtaattttccatt

SEQ ID NO: 633814 - DNA, 22 bp, Artificial Sequence
  chemically synthesized
ttttctataaatgtaattttcc

SEQ ID NO: 633815 - DNA, 22 bp, Artificial Sequence
  chemically synthesized
atatctgttttctataaatgta

SEQ ID NO: 633816 - DNA, 22 bp, Artificial Sequence
  chemically synthesized
aatatctgttttctataaatgt

SEQ ID NO: 633817 - DNA, 22 bp, Artificial Sequence
  chemically synthesized
taatatctgttttctataaatg

SEQ ID NO: 633818 - DNA, 22 bp, Artificial Sequence
  chemically synthesized
catttatagaaaacagatatta

SEQ ID NO: 633819 - DNA, 22 bp, Artificial Sequence
  chemically synthesized
atagaaaacagatattaaaggg

SEQ ID NO: 633820 - DNA, 22 bp, Artificial Sequence
  chemically synthesized
tagaaaacagatattaaagggc

SEQ ID NO: 633821 - DNA, 22 bp, Artificial Sequence
  chemically synthesized
aaaatgtaatcatggcccttta

SEQ ID NO: 633822 - DNA, 22 bp, Artificial Sequence
  chemically synthesized
taatggtgttaaaaatgtaatc

SEQ ID NO: 633823 - DNA, 22 bp, Artificial Sequence
  chemically synthesized
ataatggtgttaaaaatgtaat

SEQ ID NO: 633824 - DNA, 22 bp, Artificial Sequence
  chemically synthesized
aagggccatgattacattttta

SEQ ID NO: 633825 - DNA, 22 bp, Artificial Sequence
  chemically synthesized
catttttaacaccattataaat

SEQ ID NO: 633826 - DNA, 22 bp, Artificial Sequence
  chemically synthesized
tgagcaagtgaaatgaatttat

SEQ ID NO: 633827 - DNA, 22 bp, Artificial Sequence
  chemically synthesized
ttaacaccattataaattcatt

SEQ ID NO: 633828 - DNA, 22 bp, Artificial Sequence
  chemically synthesized
atgagcaagtgaaatgaattta

SEQ ID NO: 633829 - DNA, 22 bp, Artificial Sequence
  chemically synthesized
taacaccattataaattcattt

SEQ ID NO: 633830 - DNA, 22 bp, Artificial Sequence
  chemically synthesized
aacaccattataaattcatttc

SEQ ID NO: 633831 - DNA, 22 bp, Artificial Sequence
  chemically synthesized
acaccattataaattcatttca

SEQ ID NO: 633832 - DNA, 22 bp, Artificial Sequence
  chemically synthesized
tttatgagcaagtgaaatgaat

SEQ ID NO: 633833 - DNA, 22 bp, Artificial Sequence
  chemically synthesized
ttatttatgagcaagtgaaatg

SEQ ID NO: 633834 - DNA, 22 bp, Artificial Sequence
  chemically synthesized
gttatttatgagcaagtgaaat

SEQ ID NO: 633835 - DNA, 22 bp, Artificial Sequence
  chemically synthesized
tgttatttatgagcaagtgaaa

SEQ ID NO: 633836 - DNA, 22 bp, Artificial Sequence
  chemically synthesized
tttgttatttatgagcaagtga

SEQ ID NO: 633837 - DNA, 22 bp, Artificial Sequence
  chemically synthesized
ctttgttatttatgagcaagtg

SEQ ID NO: 633838 - DNA, 22 bp, Artificial Sequence
  chemically synthesized
taaattcatttcacttgctcat

SEQ ID NO: 633839 - DNA, 22 bp, Artificial Sequence
  chemically synthesized
tctttgttatttatgagcaagt

SEQ ID NO: 633840 - DNA, 22 bp, Artificial Sequence
  chemically synthesized
atttcacttgctcataaataac

SEQ ID NO: 633841 - DNA, 22 bp, Artificial Sequence
  chemically synthesized
agggttttctttgttatttatg

SEQ ID NO: 633842 - DNA, 22 bp, Artificial Sequence
  chemically synthesized
gagggttttctttgttatttat

SEQ ID NO: 633843 - DNA, 22 bp, Artificial Sequence
  chemically synthesized
cacttgctcataaataacaaag

SEQ ID NO: 633844 - DNA, 22 bp, Artificial Sequence
  chemically synthesized
acttgctcataaataacaaaga

SEQ ID NO: 633845 - DNA, 22 bp, Artificial Sequence
  chemically synthesized
agcttgagggttttctttgtta

SEQ ID NO: 633846 - DNA, 22 bp, Artificial Sequence
  chemically synthesized
gctcataaataacaaagaaaac

SEQ ID NO: 633847 - DNA, 22 bp, Artificial Sequence
  chemically synthesized
ttaagcttgagggttttctttg

SEQ ID NO: 633848 - DNA, 22 bp, Artificial Sequence
  chemically synthesized
ctcataaataacaaagaaaacc

SEQ ID NO: 633849 - DNA, 22 bp, Artificial Sequence
  chemically synthesized
ataaataacaaagaaaaccctc

SEQ ID NO: 633850 - DNA, 22 bp, Artificial Sequence
  chemically synthesized
attattaagcttgagggttttc

SEQ ID NO: 633851 - DNA, 22 bp, Artificial Sequence
  chemically synthesized
ctcattattaagcttgagggtt

SEQ ID NO: 633852 - DNA, 22 bp, Artificial Sequence
  chemically synthesized
cctcattattaagcttgagggt

SEQ ID NO: 633853 - DNA, 22 bp, Artificial Sequence
  chemically synthesized
cttcctcattattaagcttgag

SEQ ID NO: 633854 - DNA, 22 bp, Artificial Sequence
  chemically synthesized
aagaattacttcctcattatta

SEQ ID NO: 633855 - DNA, 22 bp, Artificial Sequence
  chemically synthesized
aaagaattacttcctcattatt

SEQ ID NO: 633856 - DNA, 22 bp, Artificial Sequence
  chemically synthesized
taaagaattacttcctcattat

SEQ ID NO: 633857 - DNA, 22 bp, Artificial Sequence
  chemically synthesized
cctttaaagaattacttcctca

SEQ ID NO: 633858 - DNA, 22 bp, Artificial Sequence
  chemically synthesized
aagcttaataatgaggaagtaa

SEQ ID NO: 633859 - DNA, 22 bp, Artificial Sequence
  chemically synthesized
ccctttaaagaattacttcctc

SEQ ID NO: 633860 - DNA, 22 bp, Artificial Sequence
  chemically synthesized
ttccctttaaagaattacttcc

SEQ ID NO: 633861 - DNA, 22 bp, Artificial Sequence
  chemically synthesized
cttccctttaaagaattacttc

SEQ ID NO: 633862 - DNA, 22 bp, Artificial Sequence
  chemically synthesized
ttcttccctttaaagaattact

SEQ ID NO: 633863 - DNA, 22 bp, Artificial Sequence
  chemically synthesized
aataatgaggaagtaattcttt

SEQ ID NO: 633864 - DNA, 22 bp, Artificial Sequence
  chemically synthesized
cttcttccctttaaagaattac

SEQ ID NO: 633865 - DNA, 22 bp, Artificial Sequence
  chemically synthesized
ataatgaggaagtaattcttta

SEQ ID NO: 633866 - DNA, 22 bp, Artificial Sequence
  chemically synthesized
tatggatttcttcttcccttta

SEQ ID NO: 633867 - DNA, 22 bp, Artificial Sequence
  chemically synthesized
ctgtatggatttcttcttccct

SEQ ID NO: 633868 - DNA, 22 bp, Artificial Sequence
  chemically synthesized
tttaaagggaagaagaaatcca

SEQ ID NO: 633869 - DNA, 22 bp, Artificial Sequence
  chemically synthesized
taaagggaagaagaaatccata

SEQ ID NO: 633870 - DNA, 22 bp, Artificial Sequence
  chemically synthesized
aaagggaagaagaaatccatac

SEQ ID NO: 633871 - DNA, 22 bp, Artificial Sequence
  chemically synthesized
aagggaagaagaaatccataca

SEQ ID NO: 633872 - DNA, 22 bp, Artificial Sequence
  chemically synthesized
caagggtaatgatatagataaa

SEQ ID NO: 633873 - DNA, 22 bp, Artificial Sequence
  chemically synthesized
tccaagggtaatgatatagata

SEQ ID NO: 633874 - DNA, 22 bp, Artificial Sequence
  chemically synthesized
ctccaagggtaatgatatagat

SEQ ID NO: 633875 - DNA, 22 bp, Artificial Sequence
  chemically synthesized
tctccaagggtaatgatataga

SEQ ID NO: 633876 - DNA, 22 bp, Artificial Sequence
  chemically synthesized
ttctccaagggtaatgatatag

SEQ ID NO: 633877 - DNA, 22 bp, Artificial Sequence
  chemically synthesized
tttctccaagggtaatgatata

SEQ ID NO: 633878 - DNA, 22 bp, Artificial Sequence
  chemically synthesized
ttttctccaagggtaatgatat

SEQ ID NO: 633879 - DNA, 22 bp, Artificial Sequence
  chemically synthesized
tttttctccaagggtaatgata

SEQ ID NO: 633880 - DNA, 22 bp, Artificial Sequence
  chemically synthesized
ttttttctccaagggtaatgat

SEQ ID NO: 633881 - DNA, 22 bp, Artificial Sequence
  chemically synthesized
atctatatcattacccttggag

SEQ ID NO: 633882 - DNA, 22 bp, Artificial Sequence
  chemically synthesized
tctatatcattacccttggaga

SEQ ID NO: 633883 - DNA, 22 bp, Artificial Sequence
  chemically synthesized
tatcattacccttggagaaaaa

SEQ ID NO: 633884 - DNA, 22 bp, Artificial Sequence
  chemically synthesized
cccttggagaaaaaaaaactgt

SEQ ID NO: 633885 - DNA, 22 bp, Artificial Sequence
  chemically synthesized
ggagaaaaaaaaactgtatatc

SEQ ID NO: 633886 - DNA, 22 bp, Artificial Sequence
  chemically synthesized
gagaaaaaaaaactgtatatct

SEQ ID NO: 633887 - DNA, 22 bp, Artificial Sequence
  chemically synthesized
aaaaaaaaaaaaaaaaaaagat

SEQ ID NO: 633888 - DNA, 22 bp, Artificial Sequence
  chemically synthesized
catctcaaaaaaaaaaaaaaaa

SEQ ID NO: 633889 - DNA, 22 bp, Artificial Sequence
  chemically synthesized
tatatctttttttttttttttt

SEQ ID NO: 633890 - DNA, 22 bp, Artificial Sequence
  chemically synthesized
tttttttttttttttttgagat

SEQ ID NO: 633891 - DNA, 22 bp, Artificial Sequence
  chemically synthesized
ttttttttttttttttgagatg

SEQ ID NO: 633892 - DNA, 22 bp, Artificial Sequence
  chemically synthesized
tttttttttttttttgagatgg

SEQ ID NO: 633893 - DNA, 22 bp, Artificial Sequence
  chemically synthesized
ttttttttttttttgagatgga

SEQ ID NO: 633894 - DNA, 22 bp, Artificial Sequence
  chemically synthesized
tttttttttttttgagatggag

SEQ ID NO: 633895 - DNA, 22 bp, Artificial Sequence
  chemically synthesized
ttttttttttttgagatggagt

SEQ ID NO: 633896 - DNA, 22 bp, Artificial Sequence
  chemically synthesized
tttttttttttgagatggagtc

SEQ ID NO: 633897 - DNA, 22 bp, Artificial Sequence
  chemically synthesized
ttttttttttgagatggagtct

SEQ ID NO: 633898 - DNA, 22 bp, Artificial Sequence
  chemically synthesized
ggtgacagagcaagactccatc

SEQ ID NO: 633899 - DNA, 22 bp, Artificial Sequence
  chemically synthesized
tttttttttgagatggagtctt

SEQ ID NO: 633900 - DNA, 22 bp, Artificial Sequence
  chemically synthesized
ttttttttgagatggagtcttg

SEQ ID NO: 633901 - DNA, 22 bp, Artificial Sequence
  chemically synthesized
tttttttgagatggagtcttgc

SEQ ID NO: 633902 - DNA, 22 bp, Artificial Sequence
  chemically synthesized
ttttttgagatggagtcttgct

SEQ ID NO: 633903 - DNA, 22 bp, Artificial Sequence
  chemically synthesized
tttttgagatggagtcttgctc

SEQ ID NO: 633904 - DNA, 22 bp, Artificial Sequence
  chemically synthesized
ttttgagatggagtcttgctct

SEQ ID NO: 633905 - DNA, 22 bp, Artificial Sequence
  chemically synthesized
tttgagatggagtcttgctctg

SEQ ID NO: 633906 - DNA, 22 bp, Artificial Sequence
  chemically synthesized
cagcctgggtgacagagcaaga

SEQ ID NO: 633907 - DNA, 22 bp, Artificial Sequence
  chemically synthesized
ttgagatggagtcttgctctgt

SEQ ID NO: 633908 - DNA, 22 bp, Artificial Sequence
  chemically synthesized
tgagatggagtcttgctctgtc

SEQ ID NO: 633909 - DNA, 22 bp, Artificial Sequence
  chemically synthesized
gagatggagtcttgctctgtca

SEQ ID NO: 633910 - DNA, 22 bp, Artificial Sequence
  chemically synthesized
agatggagtcttgctctgtcac

SEQ ID NO: 633911 - DNA, 22 bp, Artificial Sequence
  chemically synthesized
cactccagcctgggtgacagag

SEQ ID NO: 633912 - DNA, 22 bp, Artificial Sequence
  chemically synthesized
gctctgtcacccaggctggagt

SEQ ID NO: 633913 - DNA, 22 bp, Artificial Sequence
  chemically synthesized
ctctgtcacccaggctggagtg

SEQ ID NO: 633914 - DNA, 22 bp, Artificial Sequence
  chemically synthesized
tgtcacccaggctggagtgcag

SEQ ID NO: 633915 - DNA, 22 bp, Artificial Sequence
  chemically synthesized
tcacccaggctggagtgcagtg

SEQ ID NO: 633916 - DNA, 22 bp, Artificial Sequence
  chemically synthesized
cagtgagccaagatcgtgccac

SEQ ID NO: 633917 - DNA, 22 bp, Artificial Sequence
  chemically synthesized
gagtgcagtggcacgatcttgg

SEQ ID NO: 633918 - DNA, 22 bp, Artificial Sequence
  chemically synthesized
ggaggcggaggttgcagtgagc

SEQ ID NO: 633919 - DNA, 22 bp, Artificial Sequence
  chemically synthesized
aacctgggaggcggaggttgca

SEQ ID NO: 633920 - DNA, 22 bp, Artificial Sequence
  chemically synthesized
gaacctgggaggcggaggttgc

SEQ ID NO: 633921 - DNA, 22 bp, Artificial Sequence
  chemically synthesized
ggctcactgcaacctccgcctc

SEQ ID NO: 633922 - DNA, 22 bp, Artificial Sequence
  chemically synthesized
gctcactgcaacctccgcctcc

SEQ ID NO: 633923 - DNA, 22 bp, Artificial Sequence
  chemically synthesized
actgcaacctccgcctcccagg

SEQ ID NO: 633924 - DNA, 22 bp, Artificial Sequence
  chemically synthesized
caacctccgcctcccaggttca

SEQ ID NO: 633925 - DNA, 22 bp, Artificial Sequence
  chemically synthesized
aggcagaagaatcgtttgaacc

SEQ ID NO: 633926 - DNA, 22 bp, Artificial Sequence
  chemically synthesized
cgcctcccaggttcaaacgatt

SEQ ID NO: 633927 - DNA, 22 bp, Artificial Sequence
  chemically synthesized
ccaggttcaaacgattcttctg

SEQ ID NO: 633928 - DNA, 22 bp, Artificial Sequence
  chemically synthesized
gggaggctgaggcagaagaatc

SEQ ID NO: 633929 - DNA, 22 bp, Artificial Sequence
  chemically synthesized
ctcgggaggctgaggcagaaga

SEQ ID NO: 633930 - DNA, 22 bp, Artificial Sequence
  chemically synthesized
aaacgattcttctgcctcagcc

SEQ ID NO: 633931 - DNA, 22 bp, Artificial Sequence
  chemically synthesized
tagtcccagctactcgggaggc

SEQ ID NO: 633932 - DNA, 22 bp, Artificial Sequence
  chemically synthesized
ttctgcctcagcctcccgagta

SEQ ID NO: 633933 - DNA, 22 bp, Artificial Sequence
  chemically synthesized
ctgcctcagcctcccgagtagc

SEQ ID NO: 633934 - DNA, 22 bp, Artificial Sequence
  chemically synthesized
tgcctcagcctcccgagtagct

SEQ ID NO: 633935 - DNA, 22 bp, Artificial Sequence
  chemically synthesized
cctcagcctcccgagtagctgg

SEQ ID NO: 633936 - DNA, 22 bp, Artificial Sequence
  chemically synthesized
agcctcccgagtagctgggact

SEQ ID NO: 633937 - DNA, 22 bp, Artificial Sequence
  chemically synthesized
gcgcatgcctgtagtcccagct

SEQ ID NO: 633938 - DNA, 22 bp, Artificial Sequence
  chemically synthesized
ccgagtagctgggactacaggc

SEQ ID NO: 633939 - DNA, 22 bp, Artificial Sequence
  chemically synthesized
gacgtgttggcgcatgcctgta

SEQ ID NO: 633940 - DNA, 22 bp, Artificial Sequence
  chemically synthesized
gctggacgtgttggcgcatgcc

SEQ ID NO: 633941 - DNA, 22 bp, Artificial Sequence
  chemically synthesized
ggactacaggcatgcgccaaca

SEQ ID NO: 633942 - DNA, 22 bp, Artificial Sequence
  chemically synthesized
caggcatgcgccaacacgtcca

SEQ ID NO: 633943 - DNA, 22 bp, Artificial Sequence
  chemically synthesized
aaaatacaaaaattagctggac

SEQ ID NO: 633944 - DNA, 22 bp, Artificial Sequence
  chemically synthesized
ctaaaaatacaaaaattagctg

SEQ ID NO: 633945 - DNA, 22 bp, Artificial Sequence
  chemically synthesized
tactaaaaatacaaaaattagc

SEQ ID NO: 633946 - DNA, 22 bp, Artificial Sequence
  chemically synthesized
tctctactaaaaatacaaaaat

SEQ ID NO: 633947 - DNA, 22 bp, Artificial Sequence
  chemically synthesized
atttttgtatttttagtagaga

SEQ ID NO: 633948 - DNA, 22 bp, Artificial Sequence
  chemically synthesized
ttgtatttttagtagagacagg

SEQ ID NO: 633949 - DNA, 22 bp, Artificial Sequence
  chemically synthesized
tgtatttttagtagagacaggg

SEQ ID NO: 633950 - DNA, 22 bp, Artificial Sequence
  chemically synthesized
gtatttttagtagagacagggt

SEQ ID NO: 633951 - DNA, 22 bp, Artificial Sequence
  chemically synthesized
tatttttagtagagacagggtt

SEQ ID NO: 633952 - DNA, 22 bp, Artificial Sequence
  chemically synthesized
gccaatatggtgaaaccctgtc

SEQ ID NO: 633953 - DNA, 22 bp, Artificial Sequence
  chemically synthesized
ttagtagagacagggtttcacc

SEQ ID NO: 633954 - DNA, 22 bp, Artificial Sequence
  chemically synthesized
tagtagagacagggtttcacca

SEQ ID NO: 633955 - DNA, 22 bp, Artificial Sequence
  chemically synthesized
agtagagacagggtttcaccat

SEQ ID NO: 633956 - DNA, 22 bp, Artificial Sequence
  chemically synthesized
gtagagacagggtttcaccata

SEQ ID NO: 633957 - DNA, 22 bp, Artificial Sequence
  chemically synthesized
gagaccagcctggccaatatgg

SEQ ID NO: 633958 - DNA, 22 bp, Artificial Sequence
  chemically synthesized
caccatattggccaggctggtc

SEQ ID NO: 633959 - DNA, 22 bp, Artificial Sequence
  chemically synthesized
accatattggccaggctggtct

SEQ ID NO: 633960 - DNA, 22 bp, Artificial Sequence
  chemically synthesized
gccaggctggtctcgaactcct

SEQ ID NO: 633961 - DNA, 22 bp, Artificial Sequence
  chemically synthesized
gtctcgaactcctgacctcatg

SEQ ID NO: 633962 - DNA, 22 bp, Artificial Sequence
  chemically synthesized
aggtgggcagatcatgaggtca

SEQ ID NO: 633963 - DNA, 22 bp, Artificial Sequence
  chemically synthesized
gaactcctgacctcatgatctg

SEQ ID NO: 633964 - DNA, 22 bp, Artificial Sequence
  chemically synthesized
ggaggctgaggtgggcagatca

SEQ ID NO: 633965 - DNA, 22 bp, Artificial Sequence
  chemically synthesized
gggaggctgaggtgggcagatc

SEQ ID NO: 633966 - DNA, 22 bp, Artificial Sequence
  chemically synthesized
tgggaggctgaggtgggcagat

SEQ ID NO: 633967 - DNA, 22 bp, Artificial Sequence
  chemically synthesized
ctgacctcatgatctgcccacc

SEQ ID NO: 633968 - DNA, 22 bp, Artificial Sequence
  chemically synthesized
acctcatgatctgcccacctca

SEQ ID NO: 633969 - DNA, 22 bp, Artificial Sequence
  chemically synthesized
atgatctgcccacctcagcctc

SEQ ID NO: 633970 - DNA, 22 bp, Artificial Sequence
  chemically synthesized
taatcccagcactttgggaggc

SEQ ID NO: 633971 - DNA, 22 bp, Artificial Sequence
  chemically synthesized
cccacctcagcctcccaaagtg

SEQ ID NO: 633972 - DNA, 22 bp, Artificial Sequence
  chemically synthesized
acgcctgtaatcccagcacttt

SEQ ID NO: 633973 - DNA, 22 bp, Artificial Sequence
  chemically synthesized
agcctcccaaagtgctgggatt

SEQ ID NO: 633974 - DNA, 22 bp, Artificial Sequence
  chemically synthesized
gctcacgcctgtaatcccagca

SEQ ID NO: 633975 - DNA, 22 bp, Artificial Sequence
  chemically synthesized
ccaaagtgctgggattacaggc

SEQ ID NO: 633976 - DNA, 22 bp, Artificial Sequence
  chemically synthesized
ggcgtgttggctcacgcctgta

SEQ ID NO: 633977 - DNA, 22 bp, Artificial Sequence
  chemically synthesized
ggattacaggcgtgagccaaca

SEQ ID NO: 633978 - DNA, 22 bp, Artificial Sequence
  chemically synthesized
caggcgtgagccaacacgccca

SEQ ID NO: 633979 - DNA, 22 bp, Artificial Sequence
  chemically synthesized
aaaagatacgcagtaggctggg

SEQ ID NO: 633980 - DNA, 22 bp, Artificial Sequence
  chemically synthesized
aaaaagatacgcagtaggctgg

SEQ ID NO: 633981 - DNA, 22 bp, Artificial Sequence
  chemically synthesized
taaaaagatacgcagtaggctg

SEQ ID NO: 633982 - DNA, 22 bp, Artificial Sequence
  chemically synthesized
ttaaaaagatacgcagtaggct

SEQ ID NO: 633983 - DNA, 22 bp, Artificial Sequence
  chemically synthesized
gtcaacttttaaaaagatacgc

SEQ ID NO: 633984 - DNA, 22 bp, Artificial Sequence
  chemically synthesized
aagtaactagtcaacttttaaa

SEQ ID NO: 633985 - DNA, 22 bp, Artificial Sequence
  chemically synthesized
ctgcgtatctttttaaaagttg

SEQ ID NO: 633986 - DNA, 22 bp, Artificial Sequence
  chemically synthesized
caagtaactagtcaacttttaa

SEQ ID NO: 633987 - DNA, 22 bp, Artificial Sequence
  chemically synthesized
cgtatctttttaaaagttgact

SEQ ID NO: 633988 - DNA, 22 bp, Artificial Sequence
  chemically synthesized
tttaaaagttgactagttactt

SEQ ID NO: 633989 - DNA, 22 bp, Artificial Sequence
  chemically synthesized
ttaaaagttgactagttacttg

SEQ ID NO: 633990 - DNA, 22 bp, Artificial Sequence
  chemically synthesized
taaaagttgactagttacttga

SEQ ID NO: 633991 - DNA, 22 bp, Artificial Sequence
  chemically synthesized
aaaagttgactagttacttgaa

SEQ ID NO: 633992 - DNA, 22 bp, Artificial Sequence
  chemically synthesized
aaagttgactagttacttgaaa

SEQ ID NO: 633993 - DNA, 22 bp, Artificial Sequence
  chemically synthesized
tgtgcggggcacatttcaagta

SEQ ID NO: 633994 - DNA, 22 bp, Artificial Sequence
  chemically synthesized
tatgtgcggggcacatttcaag

SEQ ID NO: 633995 - DNA, 22 bp, Artificial Sequence
  chemically synthesized
ctatgtgcggggcacatttcaa

SEQ ID NO: 633996 - DNA, 22 bp, Artificial Sequence
  chemically synthesized
actagttacttgaaatgtgccc

SEQ ID NO: 633997 - DNA, 22 bp, Artificial Sequence
  chemically synthesized
tcatttctatgtgcggggcaca

SEQ ID NO: 633998 - DNA, 22 bp, Artificial Sequence
  chemically synthesized
gttacttgaaatgtgccccgca

SEQ ID NO: 633999 - DNA, 22 bp, Artificial Sequence
  chemically synthesized
atcatttctatgtgcggggcac

SEQ ID NO: 634000 - DNA, 22 bp, Artificial Sequence
  chemically synthesized
cttgaaatgtgccccgcacata

SEQ ID NO: 634001 - DNA, 22 bp, Artificial Sequence
  chemically synthesized
gaaatgtgccccgcacatagaa

SEQ ID NO: 634002 - DNA, 22 bp, Artificial Sequence
  chemically synthesized
aaatgtgccccgcacatagaaa

SEQ ID NO: 634003 - DNA, 22 bp, Artificial Sequence
  chemically synthesized
atgtatttatcatttctatgtg

SEQ ID NO: 634004 - DNA, 22 bp, Artificial Sequence
  chemically synthesized
tctcatgtatttatcatttcta

SEQ ID NO: 634005 - DNA, 22 bp, Artificial Sequence
  chemically synthesized
attatctcatgtatttatcatt

SEQ ID NO: 634006 - DNA, 22 bp, Artificial Sequence
  chemically synthesized
gagtattcattatctcatgtat

SEQ ID NO: 634007 - DNA, 22 bp, Artificial Sequence
  chemically synthesized
agagtattcattatctcatgta

SEQ ID NO: 634008 - DNA, 22 bp, Artificial Sequence
  chemically synthesized
atgatcaagtcagggtatttag

SEQ ID NO: 634009 - DNA, 22 bp, Artificial Sequence
  chemically synthesized
taaataccctgacttgatcatt

SEQ ID NO: 634010 - DNA, 22 bp, Artificial Sequence
  chemically synthesized
aataccctgacttgatcattaa

SEQ ID NO: 634011 - DNA, 22 bp, Artificial Sequence
  chemically synthesized
catacacagaatgtgttaatga

SEQ ID NO: 634012 - DNA, 22 bp, Artificial Sequence
  chemically synthesized
ttgcatacacagaatgtgttaa

SEQ ID NO: 634013 - DNA, 22 bp, Artificial Sequence
  chemically synthesized
gttgcatacacagaatgtgtta

SEQ ID NO: 634014 - DNA, 22 bp, Artificial Sequence
  chemically synthesized
tgttgcatacacagaatgtgtt

SEQ ID NO: 634015 - DNA, 22 bp, Artificial Sequence
  chemically synthesized
acttgatcattaacacattctg

SEQ ID NO: 634016 - DNA, 22 bp, Artificial Sequence
  chemically synthesized
gatcattaacacattctgtgta

SEQ ID NO: 634017 - DNA, 22 bp, Artificial Sequence
  chemically synthesized
atcattaacacattctgtgtat

SEQ ID NO: 634018 - DNA, 22 bp, Artificial Sequence
  chemically synthesized
atattttgttgcatacacagaa

SEQ ID NO: 634019 - DNA, 22 bp, Artificial Sequence
  chemically synthesized
gatattttgttgcatacacaga

SEQ ID NO: 634020 - DNA, 22 bp, Artificial Sequence
  chemically synthesized
acacattctgtgtatgcaacaa

SEQ ID NO: 634021 - DNA, 22 bp, Artificial Sequence
  chemically synthesized
tggagtgcatttgatattttgt

SEQ ID NO: 634022 - DNA, 22 bp, Artificial Sequence
  chemically synthesized
atggagtgcatttgatattttg

SEQ ID NO: 634023 - DNA, 22 bp, Artificial Sequence
  chemically synthesized
tgtgtatgcaacaaaatatcaa

SEQ ID NO: 634024 - DNA, 22 bp, Artificial Sequence
  chemically synthesized
tgtatgcaacaaaatatcaaat

SEQ ID NO: 634025 - DNA, 22 bp, Artificial Sequence
  chemically synthesized
tacatatttatggagtgcattt

SEQ ID NO: 634026 - DNA, 22 bp, Artificial Sequence
  chemically synthesized
gtacatatttatggagtgcatt

SEQ ID NO: 634027 - DNA, 22 bp, Artificial Sequence
  chemically synthesized
tagtataatatttgtacatatt

SEQ ID NO: 634028 - DNA, 22 bp, Artificial Sequence
  chemically synthesized
ctgtagtataatatttgtacat

SEQ ID NO: 634029 - DNA, 22 bp, Artificial Sequence
  chemically synthesized
actgtagtataatatttgtaca

SEQ ID NO: 634030 - DNA, 22 bp, Artificial Sequence
  chemically synthesized
tactgtagtataatatttgtac

SEQ ID NO: 634031 - DNA, 22 bp, Artificial Sequence
  chemically synthesized
ttactgtagtataatatttgta

SEQ ID NO: 634032 - DNA, 22 bp, Artificial Sequence
  chemically synthesized
tttactgtagtataatatttgt

SEQ ID NO: 634033 - DNA, 22 bp, Artificial Sequence
  chemically synthesized
cataaatatgtacaaatattat

SEQ ID NO: 634034 - DNA, 22 bp, Artificial Sequence
  chemically synthesized
ttttttactgtagtataatatt

SEQ ID NO: 634035 - DNA, 22 bp, Artificial Sequence
  chemically synthesized
tactacagtaaaaaacaggctg

SEQ ID NO: 634036 - DNA, 22 bp, Artificial Sequence
  chemically synthesized
cagtaaaaaacaggctgggtgc

SEQ ID NO: 634037 - DNA, 22 bp, Artificial Sequence
  chemically synthesized
caggcatgagcgaccgcaccca

SEQ ID NO: 634038 - DNA, 22 bp, Artificial Sequence
  chemically synthesized
ggattacaggcatgagcgaccg

SEQ ID NO: 634039 - DNA, 22 bp, Artificial Sequence
  chemically synthesized
ggtgcggtcgctcatgcctgta

SEQ ID NO: 634040 - DNA, 22 bp, Artificial Sequence
  chemically synthesized
ccaaagggctgggattacaggc

SEQ ID NO: 634041 - DNA, 22 bp, Artificial Sequence
  chemically synthesized
cccaaagggctgggattacagg

SEQ ID NO: 634042 - DNA, 22 bp, Artificial Sequence
  chemically synthesized
ggcttcccaaagggctgggatt

SEQ ID NO: 634043 - DNA, 22 bp, Artificial Sequence
  chemically synthesized
atgcctgtaatcccagcccttt

SEQ ID NO: 634044 - DNA, 22 bp, Artificial Sequence
  chemically synthesized
ccacctcggcttcccaaagggc

SEQ ID NO: 634045 - DNA, 22 bp, Artificial Sequence
  chemically synthesized
taatcccagccctttgggaagc

SEQ ID NO: 634046 - DNA, 22 bp, Artificial Sequence
  chemically synthesized
gcagcaaacaatcctcccacct

SEQ ID NO: 634047 - DNA, 22 bp, Artificial Sequence
  chemically synthesized
tgggaagccgaggtgggaggat

SEQ ID NO: 634048 - DNA, 22 bp, Artificial Sequence
  chemically synthesized
gggaagccgaggtgggaggatt

SEQ ID NO: 634049 - DNA, 22 bp, Artificial Sequence
  chemically synthesized
ctggcagcaaacaatcctccca

SEQ ID NO: 634050 - DNA, 22 bp, Artificial Sequence
  chemically synthesized
ggaagccgaggtgggaggattg

SEQ ID NO: 634051 - DNA, 22 bp, Artificial Sequence
  chemically synthesized
aaattcctggcagcaaacaatc

SEQ ID NO: 634052 - DNA, 22 bp, Artificial Sequence
  chemically synthesized
tcaaattcctggcagcaaacaa

SEQ ID NO: 634053 - DNA, 22 bp, Artificial Sequence
  chemically synthesized
ctctcaaattcctggcagcaaa

SEQ ID NO: 634054 - DNA, 22 bp, Artificial Sequence
  chemically synthesized
cccaagctgctctcaaattcct

SEQ ID NO: 634055 - DNA, 22 bp, Artificial Sequence
  chemically synthesized
tttgctgccaggaatttgagag

SEQ ID NO: 634056 - DNA, 22 bp, Artificial Sequence
  chemically synthesized
tgttgcccaagctgctctcaaa

SEQ ID NO: 634057 - DNA, 22 bp, Artificial Sequence
  chemically synthesized
gctgccaggaatttgagagcag

SEQ ID NO: 634058 - DNA, 22 bp, Artificial Sequence
  chemically synthesized
ctgccaggaatttgagagcagc

SEQ ID NO: 634059 - DNA, 22 bp, Artificial Sequence
  chemically synthesized
actatgttgcccaagctgctct

SEQ ID NO: 634060 - DNA, 22 bp, Artificial Sequence
  chemically synthesized
ccaggaatttgagagcagcttg

SEQ ID NO: 634061 - DNA, 22 bp, Artificial Sequence
  chemically synthesized
gagagcagcttgggcaacatag

SEQ ID NO: 634062 - DNA, 22 bp, Artificial Sequence
  chemically synthesized
agagcagcttgggcaacatagt

SEQ ID NO: 634063 - DNA, 22 bp, Artificial Sequence
  chemically synthesized
aatagagacagggtctcactat

SEQ ID NO: 634064 - DNA, 22 bp, Artificial Sequence
  chemically synthesized
aaatagagacagggtctcacta

SEQ ID NO: 634065 - DNA, 22 bp, Artificial Sequence
  chemically synthesized
taaatagagacagggtctcact

SEQ ID NO: 634066 - DNA, 22 bp, Artificial Sequence
  chemically synthesized
ttaaatagagacagggtctcac

SEQ ID NO: 634067 - DNA, 22 bp, Artificial Sequence
  chemically synthesized
gggcaacatagtgagaccctgt

SEQ ID NO: 634068 - DNA, 22 bp, Artificial Sequence
  chemically synthesized
ggcaacatagtgagaccctgtc

SEQ ID NO: 634069 - DNA, 22 bp, Artificial Sequence
  chemically synthesized
tttttaaatagagacagggtct

SEQ ID NO: 634070 - DNA, 22 bp, Artificial Sequence
  chemically synthesized
gtttttaaatagagacagggtc

SEQ ID NO: 634071 - DNA, 22 bp, Artificial Sequence
  chemically synthesized
tgtttttaaatagagacagggt

SEQ ID NO: 634072 - DNA, 22 bp, Artificial Sequence
  chemically synthesized
ttgtttttaaatagagacaggg

SEQ ID NO: 634073 - DNA, 22 bp, Artificial Sequence
  chemically synthesized
tttgtttttaaatagagacagg

SEQ ID NO: 634074 - DNA, 22 bp, Artificial Sequence
  chemically synthesized
ttttgtttttaaatagagacag

SEQ ID NO: 634075 - DNA, 22 bp, Artificial Sequence
  chemically synthesized
tttttttgtttttaaatagaga

SEQ ID NO: 634076 - DNA, 22 bp, Artificial Sequence
  chemically synthesized
gtttttttgtttttaaatagag

SEQ ID NO: 634077 - DNA, 22 bp, Artificial Sequence
  chemically synthesized
tgtttttttgtttttaaataga

SEQ ID NO: 634078 - DNA, 22 bp, Artificial Sequence
  chemically synthesized
ttgtttttttgtttttaaatag

SEQ ID NO: 634079 - DNA, 22 bp, Artificial Sequence
  chemically synthesized
tttgtttttttgtttttaaata

SEQ ID NO: 634080 - DNA, 22 bp, Artificial Sequence
  chemically synthesized
ttttgtttttttgtttttaaat

SEQ ID NO: 634081 - DNA, 22 bp, Artificial Sequence
  chemically synthesized
tttttttgtttttttgttttta

SEQ ID NO: 634082 - DNA, 22 bp, Artificial Sequence
  chemically synthesized
gtttttttgtttttttgttttt

SEQ ID NO: 634083 - DNA, 22 bp, Artificial Sequence
  chemically synthesized
tgtttttttgtttttttgtttt

SEQ ID NO: 634084 - DNA, 22 bp, Artificial Sequence
  chemically synthesized
ttgtttttttgtttttttgttt

SEQ ID NO: 634085 - DNA, 22 bp, Artificial Sequence
  chemically synthesized
tctctatttaaaaacaaaaaaa

SEQ ID NO: 634086 - DNA, 22 bp, Artificial Sequence
  chemically synthesized
tttgtttttttgtttttttgtt

SEQ ID NO: 634087 - DNA, 22 bp, Artificial Sequence
  chemically synthesized
ttttttgtttttttgttttttt

SEQ ID NO: 634088 - DNA, 22 bp, Artificial Sequence
  chemically synthesized
tatttaaaaacaaaaaaacaaa

SEQ ID NO: 634089 - DNA, 22 bp, Artificial Sequence
  chemically synthesized
attttttgtttttttgtttttt

SEQ ID NO: 634090 - DNA, 22 bp, Artificial Sequence
  chemically synthesized
tttaaaaacaaaaaaacaaaaa

SEQ ID NO: 634091 - DNA, 22 bp, Artificial Sequence
  chemically synthesized
aaaaacaaaaaaacaaaaaaac

SEQ ID NO: 634092 - DNA, 22 bp, Artificial Sequence
  chemically synthesized
aatttattttttgtttttttgt

SEQ ID NO: 634093 - DNA, 22 bp, Artificial Sequence
  chemically synthesized
aaaacaaaaaaacaaaaaaaca

SEQ ID NO: 634094 - DNA, 22 bp, Artificial Sequence
  chemically synthesized
aaatttattttttgtttttttg

SEQ ID NO: 634095 - DNA, 22 bp, Artificial Sequence
  chemically synthesized
taaatttattttttgttttttt

SEQ ID NO: 634096 - DNA, 22 bp, Artificial Sequence
  chemically synthesized
ttaaatttattttttgtttttt

SEQ ID NO: 634097 - DNA, 22 bp, Artificial Sequence
  chemically synthesized
acttttaaatttattttttgtt

SEQ ID NO: 634098 - DNA, 22 bp, Artificial Sequence
  chemically synthesized
aacttttaaatttattttttgt

SEQ ID NO: 634099 - DNA, 22 bp, Artificial Sequence
  chemically synthesized
taacttttaaatttattttttg

SEQ ID NO: 634100 - DNA, 22 bp, Artificial Sequence
  chemically synthesized
ttaacttttaaatttatttttt

SEQ ID NO: 634101 - DNA, 22 bp, Artificial Sequence
  chemically synthesized
tttaacttttaaatttattttt

SEQ ID NO: 634102 - DNA, 22 bp, Artificial Sequence
  chemically synthesized
tttttaacttttaaatttattt

SEQ ID NO: 634103 - DNA, 22 bp, Artificial Sequence
  chemically synthesized
ttctttttaacttttaaattta

SEQ ID NO: 634104 - DNA, 22 bp, Artificial Sequence
  chemically synthesized
attctttttaacttttaaattt

SEQ ID NO: 634105 - DNA, 22 bp, Artificial Sequence
  chemically synthesized
tattctttttaacttttaaatt

SEQ ID NO: 634106 - DNA, 22 bp, Artificial Sequence
  chemically synthesized
ttattctttttaacttttaaat

SEQ ID NO: 634107 - DNA, 22 bp, Artificial Sequence
  chemically synthesized
ttttattctttttaacttttaa

SEQ ID NO: 634108 - DNA, 22 bp, Artificial Sequence
  chemically synthesized
cttttattctttttaactttta

SEQ ID NO: 634109 - DNA, 22 bp, Artificial Sequence
  chemically synthesized
tcttttattctttttaactttt

SEQ ID NO: 634110 - DNA, 22 bp, Artificial Sequence
  chemically synthesized
ttcttttattctttttaacttt

SEQ ID NO: 634111 - DNA, 22 bp, Artificial Sequence
  chemically synthesized
tttcttttattctttttaactt

SEQ ID NO: 634112 - DNA, 22 bp, Artificial Sequence
  chemically synthesized
actttttcttttattcttttta

SEQ ID NO: 634113 - DNA, 22 bp, Artificial Sequence
  chemically synthesized
aattgactttttcttttattct

SEQ ID NO: 634114 - DNA, 22 bp, Artificial Sequence
  chemically synthesized
aaaagttaaaaagaataaaaga

SEQ ID NO: 634115 - DNA, 22 bp, Artificial Sequence
  chemically synthesized
caattgactttttcttttattc

SEQ ID NO: 634116 - DNA, 22 bp, Artificial Sequence
  chemically synthesized
aaagttaaaaagaataaaagaa

SEQ ID NO: 634117 - DNA, 22 bp, Artificial Sequence
  chemically synthesized
tcaattgactttttcttttatt

SEQ ID NO: 634118 - DNA, 22 bp, Artificial Sequence
  chemically synthesized
ttcaattgactttttcttttat

SEQ ID NO: 634119 - DNA, 22 bp, Artificial Sequence
  chemically synthesized
tttcaattgactttttctttta

SEQ ID NO: 634120 - DNA, 22 bp, Artificial Sequence
  chemically synthesized
cctttttcaattgactttttct

SEQ ID NO: 634121 - DNA, 22 bp, Artificial Sequence
  chemically synthesized
aaaagaataaaagaaaaagtca

SEQ ID NO: 634122 - DNA, 22 bp, Artificial Sequence
  chemically synthesized
acctttttcaattgactttttc

SEQ ID NO: 634123 - DNA, 22 bp, Artificial Sequence
  chemically synthesized
tacctttttcaattgacttttt

SEQ ID NO: 634124 - DNA, 22 bp, Artificial Sequence
  chemically synthesized
tcagttttacctttttcaattg

SEQ ID NO: 634125 - DNA, 22 bp, Artificial Sequence
  chemically synthesized
gtcagttttacctttttcaatt

SEQ ID NO: 634126 - DNA, 22 bp, Artificial Sequence
  chemically synthesized
aaaaaggtaaaactgacaagct

SEQ ID NO: 634127 - DNA, 22 bp, Artificial Sequence
  chemically synthesized
tgaatggggcacaaaagagagc

SEQ ID NO: 634128 - DNA, 22 bp, Artificial Sequence
  chemically synthesized
gtgaatggggcacaaaagagag

SEQ ID NO: 634129 - DNA, 22 bp, Artificial Sequence
  chemically synthesized
acatttgtgaatggggcacaaa

SEQ ID NO: 634130 - DNA, 22 bp, Artificial Sequence
  chemically synthesized
acaagctctcttttgtgcccca

SEQ ID NO: 634131 - DNA, 22 bp, Artificial Sequence
  chemically synthesized
cacatttgtgaatggggcacaa

SEQ ID NO: 634132 - DNA, 22 bp, Artificial Sequence
  chemically synthesized
tcttttgtgccccattcacaaa

SEQ ID NO: 634133 - DNA, 22 bp, Artificial Sequence
  chemically synthesized
ttttgtgccccattcacaaatg

SEQ ID NO: 634134 - DNA, 22 bp, Artificial Sequence
  chemically synthesized
ttgtgccccattcacaaatgtg

SEQ ID NO: 634135 - DNA, 22 bp, Artificial Sequence
  chemically synthesized
tgtgccccattcacaaatgtga

SEQ ID NO: 634136 - DNA, 22 bp, Artificial Sequence
  chemically synthesized
gtgccccattcacaaatgtgaa

SEQ ID NO: 634137 - DNA, 22 bp, Artificial Sequence
  chemically synthesized
tgccccattcacaaatgtgaaa

SEQ ID NO: 634138 - DNA, 22 bp, Artificial Sequence
  chemically synthesized
catagaacaaagtttcacattt

SEQ ID NO: 634139 - DNA, 22 bp, Artificial Sequence
  chemically synthesized
ttacatagaacaaagtttcaca

SEQ ID NO: 634140 - DNA, 22 bp, Artificial Sequence
  chemically synthesized
attacatagaacaaagtttcac

SEQ ID NO: 634141 - DNA, 22 bp, Artificial Sequence
  chemically synthesized
tattacatagaacaaagtttca

SEQ ID NO: 634142 - DNA, 22 bp, Artificial Sequence
  chemically synthesized
ttttattacatagaacaaagtt

SEQ ID NO: 634143 - DNA, 22 bp, Artificial Sequence
  chemically synthesized
attttattacatagaacaaagt

SEQ ID NO: 634144 - DNA, 22 bp, Artificial Sequence
  chemically synthesized
acaaatgtgaaactttgttcta

SEQ ID NO: 634145 - DNA, 22 bp, Artificial Sequence
  chemically synthesized
tgttctatgtaataaaataagt

SEQ ID NO: 634146 - DNA, 22 bp, Artificial Sequence
  chemically synthesized
gttctatgtaataaaataagta

SEQ ID NO: 634147 - DNA, 22 bp, Artificial Sequence
  chemically synthesized
ttctatgtaataaaataagtat

SEQ ID NO: 634148 - DNA, 22 bp, Artificial Sequence
  chemically synthesized
caagtgtgcagtaatacttatt

SEQ ID NO: 634149 - DNA, 22 bp, Artificial Sequence
  chemically synthesized
tatgtaataaaataagtattac

SEQ ID NO: 634150 - DNA, 22 bp, Artificial Sequence
  chemically synthesized
tgtaataaaataagtattactg

SEQ ID NO: 634151 - DNA, 22 bp, Artificial Sequence
  chemically synthesized
aggagacagcactgcaagtgtg

SEQ ID NO: 634152 - DNA, 22 bp, Artificial Sequence
  chemically synthesized
tgttgaggagacagcactgcaa

SEQ ID NO: 634153 - DNA, 22 bp, Artificial Sequence
  chemically synthesized
gtgttgaggagacagcactgca

SEQ ID NO: 634154 - DNA, 22 bp, Artificial Sequence
  chemically synthesized
tgtgttgaggagacagcactgc

SEQ ID NO: 634155 - DNA, 22 bp, Artificial Sequence
  chemically synthesized
ttgtgttgaggagacagcactg

SEQ ID NO: 634156 - DNA, 22 bp, Artificial Sequence
  chemically synthesized
ctgcacacttgcagtgctgtct

SEQ ID NO: 634157 - DNA, 22 bp, Artificial Sequence
  chemically synthesized
ttttgtgttgaggagacagcac

SEQ ID NO: 634158 - DNA, 22 bp, Artificial Sequence
  chemically synthesized
cacacttgcagtgctgtctcct

SEQ ID NO: 634159 - DNA, 22 bp, Artificial Sequence
  chemically synthesized
ctcttttgtgttgaggagacag

SEQ ID NO: 634160 - DNA, 22 bp, Artificial Sequence
  chemically synthesized
actcttttgtgttgaggagaca

SEQ ID NO: 634161 - DNA, 22 bp, Artificial Sequence
  chemically synthesized
ttactcttttgtgttgaggaga

SEQ ID NO: 634162 - DNA, 22 bp, Artificial Sequence
  chemically synthesized
gcagtgctgtctcctcaacaca

SEQ ID NO: 634163 - DNA, 22 bp, Artificial Sequence
  chemically synthesized
cagtgctgtctcctcaacacaa

SEQ ID NO: 634164 - DNA, 22 bp, Artificial Sequence
  chemically synthesized
aattcttactcttttgtgttga

SEQ ID NO: 634165 - DNA, 22 bp, Artificial Sequence
  chemically synthesized
tctcctcaacacaaaagagtaa

SEQ ID NO: 634166 - DNA, 22 bp, Artificial Sequence
  chemically synthesized
caaagtgttcaattcttactct

SEQ ID NO: 634167 - DNA, 22 bp, Artificial Sequence
  chemically synthesized
ctcaacacaaaagagtaagaat

SEQ ID NO: 634168 - DNA, 22 bp, Artificial Sequence
  chemically synthesized
aacacaaaagagtaagaattga

SEQ ID NO: 634169 - DNA, 22 bp, Artificial Sequence
  chemically synthesized
atgaagtgactgcaaagtgttc

SEQ ID NO: 634170 - DNA, 22 bp, Artificial Sequence
  chemically synthesized
catgaagtgactgcaaagtgtt

SEQ ID NO: 634171 - DNA, 22 bp, Artificial Sequence
  chemically synthesized
ccttcatgaagtgactgcaaag

SEQ ID NO: 634172 - DNA, 22 bp, Artificial Sequence
  chemically synthesized
accttcatgaagtgactgcaaa

SEQ ID NO: 634173 - DNA, 22 bp, Artificial Sequence
  chemically synthesized
ttaccttcatgaagtgactgca

SEQ ID NO: 634174 - DNA, 22 bp, Artificial Sequence
  chemically synthesized
cttaccttcatgaagtgactgc

SEQ ID NO: 634175 - DNA, 22 bp, Artificial Sequence
  chemically synthesized
aacactttgcagtcacttcatg

SEQ ID NO: 634176 - DNA, 22 bp, Artificial Sequence
  chemically synthesized
ccttcttaccttcatgaagtga

SEQ ID NO: 634177 - DNA, 22 bp, Artificial Sequence
  chemically synthesized
aactcccttcttaccttcatga

SEQ ID NO: 634178 - DNA, 22 bp, Artificial Sequence
  chemically synthesized
tgcagtcacttcatgaaggtaa

SEQ ID NO: 634179 - DNA, 22 bp, Artificial Sequence
  chemically synthesized
gcagtcacttcatgaaggtaag

SEQ ID NO: 634180 - DNA, 22 bp, Artificial Sequence
  chemically synthesized
cagtcacttcatgaaggtaaga

SEQ ID NO: 634181 - DNA, 22 bp, Artificial Sequence
  chemically synthesized
agtgtctcaactcccttcttac

SEQ ID NO: 634182 - DNA, 22 bp, Artificial Sequence
  chemically synthesized
catgaaggtaagaagggagttg

SEQ ID NO: 634183 - DNA, 22 bp, Artificial Sequence
  chemically synthesized
atgaaggtaagaagggagttga

SEQ ID NO: 634184 - DNA, 22 bp, Artificial Sequence
  chemically synthesized
agacactgaggtctttttttca

SEQ ID NO: 634185 - DNA, 22 bp, Artificial Sequence
  chemically synthesized
aatgtcaaaacaaagagtgaaa

SEQ ID NO: 634186 - DNA, 22 bp, Artificial Sequence
  chemically synthesized
aggtctttttttcactctttgt

SEQ ID NO: 634187 - DNA, 22 bp, Artificial Sequence
  chemically synthesized
gttaaatgtcaaaacaaagagt

SEQ ID NO: 634188 - DNA, 22 bp, Artificial Sequence
  chemically synthesized
ggttaaatgtcaaaacaaagag

SEQ ID NO: 634189 - DNA, 22 bp, Artificial Sequence
  chemically synthesized
tggttaaatgtcaaaacaaaga

SEQ ID NO: 634190 - DNA, 22 bp, Artificial Sequence
  chemically synthesized
ttggttaaatgtcaaaacaaag

SEQ ID NO: 634191 - DNA, 22 bp, Artificial Sequence
  chemically synthesized
tttttcactctttgttttgaca

SEQ ID NO: 634192 - DNA, 22 bp, Artificial Sequence
  chemically synthesized
ttttcactctttgttttgacat

SEQ ID NO: 634193 - DNA, 22 bp, Artificial Sequence
  chemically synthesized
tttcactctttgttttgacatt

SEQ ID NO: 634194 - DNA, 22 bp, Artificial Sequence
  chemically synthesized
tatttttggttaaatgtcaaaa

SEQ ID NO: 634195 - DNA, 22 bp, Artificial Sequence
  chemically synthesized
ttcactctttgttttgacattt

SEQ ID NO: 634196 - DNA, 22 bp, Artificial Sequence
  chemically synthesized
gtatttttggttaaatgtcaaa

SEQ ID NO: 634197 - DNA, 22 bp, Artificial Sequence
  chemically synthesized
tcactctttgttttgacattta

SEQ ID NO: 634198 - DNA, 22 bp, Artificial Sequence
  chemically synthesized
cactctttgttttgacatttaa

SEQ ID NO: 634199 - DNA, 22 bp, Artificial Sequence
  chemically synthesized
actctttgttttgacatttaac

SEQ ID NO: 634200 - DNA, 22 bp, Artificial Sequence
  chemically synthesized
gtttgtatttttggttaaatgt

SEQ ID NO: 634201 - DNA, 22 bp, Artificial Sequence
  chemically synthesized
cgtttgtatttttggttaaatg

SEQ ID NO: 634202 - DNA, 22 bp, Artificial Sequence
  chemically synthesized
tttgttttgacatttaaccaaa

SEQ ID NO: 634203 - DNA, 22 bp, Artificial Sequence
  chemically synthesized
tgttttgacatttaaccaaaaa

SEQ ID NO: 634204 - DNA, 22 bp, Artificial Sequence
  chemically synthesized
gttttgacatttaaccaaaaat

SEQ ID NO: 634205 - DNA, 22 bp, Artificial Sequence
  chemically synthesized
agtttcgtttgtatttttggtt

SEQ ID NO: 634206 - DNA, 22 bp, Artificial Sequence
  chemically synthesized
ttttgacatttaaccaaaaata

SEQ ID NO: 634207 - DNA, 22 bp, Artificial Sequence
  chemically synthesized
gagtttcgtttgtatttttggt

SEQ ID NO: 634208 - DNA, 22 bp, Artificial Sequence
  chemically synthesized
tgacatttaaccaaaaatacaa

SEQ ID NO: 634209 - DNA, 22 bp, Artificial Sequence
  chemically synthesized
gacatttaaccaaaaatacaaa

SEQ ID NO: 634210 - DNA, 22 bp, Artificial Sequence
  chemically synthesized
acatttaaccaaaaatacaaac

SEQ ID NO: 634211 - DNA, 22 bp, Artificial Sequence
  chemically synthesized
aaggtacttgagtttcgtttgt

SEQ ID NO: 634212 - DNA, 22 bp, Artificial Sequence
  chemically synthesized
aaaggtacttgagtttcgtttg

SEQ ID NO: 634213 - DNA, 22 bp, Artificial Sequence
  chemically synthesized
aaccaaaaatacaaacgaaact

SEQ ID NO: 634214 - DNA, 22 bp, Artificial Sequence
  chemically synthesized
accaaaaatacaaacgaaactc

SEQ ID NO: 634215 - DNA, 22 bp, Artificial Sequence
  chemically synthesized
gagtttaaaggtacttgagttt

SEQ ID NO: 634216 - DNA, 22 bp, Artificial Sequence
  chemically synthesized
cattggagtttaaaggtacttg

SEQ ID NO: 634217 - DNA, 22 bp, Artificial Sequence
  chemically synthesized
ttacattggagtttaaaggtac

SEQ ID NO: 634218 - DNA, 22 bp, Artificial Sequence
  chemically synthesized
tattacattggagtttaaaggt

SEQ ID NO: 634219 - DNA, 22 bp, Artificial Sequence
  chemically synthesized
ctattacattggagtttaaagg

SEQ ID NO: 634220 - DNA, 22 bp, Artificial Sequence
  chemically synthesized
tttctattacattggagtttaa

SEQ ID NO: 634221 - DNA, 22 bp, Artificial Sequence
  chemically synthesized
atttctattacattggagttta

SEQ ID NO: 634222 - DNA, 22 bp, Artificial Sequence
  chemically synthesized
tatttctattacattggagttt

SEQ ID NO: 634223 - DNA, 22 bp, Artificial Sequence
  chemically synthesized
ttatttctattacattggagtt

SEQ ID NO: 634224 - DNA, 22 bp, Artificial Sequence
  chemically synthesized
aagtacctttaaactccaatgt

SEQ ID NO: 634225 - DNA, 22 bp, Artificial Sequence
  chemically synthesized
tttttatttctattacattgga

SEQ ID NO: 634226 - DNA, 22 bp, Artificial Sequence
  chemically synthesized
taaactccaatgtaatagaaat

SEQ ID NO: 634227 - DNA, 22 bp, Artificial Sequence
  chemically synthesized
aaactccaatgtaatagaaata

SEQ ID NO: 634228 - DNA, 22 bp, Artificial Sequence
  chemically synthesized
aactccaatgtaatagaaataa

SEQ ID NO: 634229 - DNA, 22 bp, Artificial Sequence
  chemically synthesized
caatgtaatagaaataaaaata

SEQ ID NO: 634230 - DNA, 22 bp, Artificial Sequence
  chemically synthesized
tataggatatatactattttta

SEQ ID NO: 634231 - DNA, 22 bp, Artificial Sequence
  chemically synthesized
cctatataggatatatactatt

SEQ ID NO: 634232 - DNA, 22 bp, Artificial Sequence
  chemically synthesized
attacctatataggatatatac

SEQ ID NO: 634233 - DNA, 22 bp, Artificial Sequence
  chemically synthesized
cattacctatataggatatata

SEQ ID NO: 634234 - DNA, 22 bp, Artificial Sequence
  chemically synthesized
atatttcattacctatatagga

SEQ ID NO: 634235 - DNA, 22 bp, Artificial Sequence
  chemically synthesized
gaatattcatatttcattacct

SEQ ID NO: 634236 - DNA, 22 bp, Artificial Sequence
  chemically synthesized
agaatattcatatttcattacc

SEQ ID NO: 634237 - DNA, 22 bp, Artificial Sequence
  chemically synthesized
tagaatattcatatttcattac

SEQ ID NO: 634238 - DNA, 22 bp, Artificial Sequence
  chemically synthesized
ttagaatattcatatttcatta

SEQ ID NO: 634239 - DNA, 22 bp, Artificial Sequence
  chemically synthesized
tataggtaatgaaatatgaata

SEQ ID NO: 634240 - DNA, 22 bp, Artificial Sequence
  chemically synthesized
cagtttttagaatattcatatt

SEQ ID NO: 634241 - DNA, 22 bp, Artificial Sequence
  chemically synthesized
caatatatgccatatctacagt

SEQ ID NO: 634242 - DNA, 22 bp, Artificial Sequence
  chemically synthesized
tccaatatatgccatatctaca

SEQ ID NO: 634243 - DNA, 22 bp, Artificial Sequence
  chemically synthesized
taaaaactgtagatatggcata

SEQ ID NO: 634244 - DNA, 22 bp, Artificial Sequence
  chemically synthesized
aaaactgtagatatggcatata

SEQ ID NO: 634245 - DNA, 22 bp, Artificial Sequence
  chemically synthesized
tagatatggcatatattggaga

SEQ ID NO: 634246 - DNA, 22 bp, Artificial Sequence
  chemically synthesized
gagagttatggtcctttcctct

SEQ ID NO: 634247 - DNA, 22 bp, Artificial Sequence
  chemically synthesized
tggtcctttcctctgttacttg

SEQ ID NO: 634248 - DNA, 22 bp, Artificial Sequence
  chemically synthesized
tgataaagtagtcccaagtaac

SEQ ID NO: 634249 - DNA, 22 bp, Artificial Sequence
  chemically synthesized
tcctctgttacttgggactact

SEQ ID NO: 634250 - DNA, 22 bp, Artificial Sequence
  chemically synthesized
cctctgttacttgggactactt

SEQ ID NO: 634251 - DNA, 22 bp, Artificial Sequence
  chemically synthesized
ctctgttacttgggactacttt

SEQ ID NO: 634252 - DNA, 22 bp, Artificial Sequence
  chemically synthesized
tgttacttgggactactttatc

SEQ ID NO: 634253 - DNA, 22 bp, Artificial Sequence
  chemically synthesized
ttacttgggactactttatcat

SEQ ID NO: 634254 - DNA, 22 bp, Artificial Sequence
  chemically synthesized
cttgggactactttatcataat

SEQ ID NO: 634255 - DNA, 22 bp, Artificial Sequence
  chemically synthesized
gggactactttatcataattat

SEQ ID NO: 634256 - DNA, 22 bp, Artificial Sequence
  chemically synthesized
ggactactttatcataattatg

SEQ ID NO: 634257 - DNA, 22 bp, Artificial Sequence
  chemically synthesized
taaaacccaaaacataattatg

SEQ ID NO: 634258 - DNA, 22 bp, Artificial Sequence
  chemically synthesized
ataaaacccaaaacataattat

SEQ ID NO: 634259 - DNA, 22 bp, Artificial Sequence
  chemically synthesized
tataaaacccaaaacataatta

SEQ ID NO: 634260 - DNA, 22 bp, Artificial Sequence
  chemically synthesized
tttataaaacccaaaacataat

SEQ ID NO: 634261 - DNA, 22 bp, Artificial Sequence
  chemically synthesized
ctttataaaacccaaaacataa

SEQ ID NO: 634262 - DNA, 22 bp, Artificial Sequence
  chemically synthesized
ctttatcataattatgttttgg

SEQ ID NO: 634263 - DNA, 22 bp, Artificial Sequence
  chemically synthesized
tatcataattatgttttgggtt

SEQ ID NO: 634264 - DNA, 22 bp, Artificial Sequence
  chemically synthesized
atcataattatgttttgggttt

SEQ ID NO: 634265 - DNA, 22 bp, Artificial Sequence
  chemically synthesized
tcataattatgttttgggtttt

SEQ ID NO: 634266 - DNA, 22 bp, Artificial Sequence
  chemically synthesized
taatgtcttctttataaaaccc

SEQ ID NO: 634267 - DNA, 22 bp, Artificial Sequence
  chemically synthesized
gtaatgtcttctttataaaacc

SEQ ID NO: 634268 - DNA, 22 bp, Artificial Sequence
  chemically synthesized
tgttttgggttttataaagaag

SEQ ID NO: 634269 - DNA, 22 bp, Artificial Sequence
  chemically synthesized
tgggttttataaagaagacatt

SEQ ID NO: 634270 - DNA, 22 bp, Artificial Sequence
  chemically synthesized
gggttttataaagaagacatta

SEQ ID NO: 634271 - DNA, 22 bp, Artificial Sequence
  chemically synthesized
ggttttataaagaagacattac

SEQ ID NO: 634272 - DNA, 22 bp, Artificial Sequence
  chemically synthesized
tataaagaagacattacaaaca

SEQ ID NO: 634273 - DNA, 22 bp, Artificial Sequence
  chemically synthesized
ataaagaagacattacaaacat

SEQ ID NO: 634274 - DNA, 22 bp, Artificial Sequence
  chemically synthesized
taaagaagacattacaaacatt

SEQ ID NO: 634275 - DNA, 22 bp, Artificial Sequence
  chemically synthesized
acataaacagtcaaaatgtttg

SEQ ID NO: 634276 - DNA, 22 bp, Artificial Sequence
  chemically synthesized
ctcacataaacagtcaaaatgt

SEQ ID NO: 634277 - DNA, 22 bp, Artificial Sequence
  chemically synthesized
tcctcacataaacagtcaaaat

SEQ ID NO: 634278 - DNA, 22 bp, Artificial Sequence
  chemically synthesized
tctcctcacataaacagtcaaa

SEQ ID NO: 634279 - DNA, 22 bp, Artificial Sequence
  chemically synthesized
caaacattttgactgtttatgt

SEQ ID NO: 634280 - DNA, 22 bp, Artificial Sequence
  chemically synthesized
cagatcatcattctctcctcac

SEQ ID NO: 634281 - DNA, 22 bp, Artificial Sequence
  chemically synthesized
tgactgtttatgtgaggagaga

SEQ ID NO: 634282 - DNA, 22 bp, Artificial Sequence
  chemically synthesized
ccagatcatcattctctcctca

SEQ ID NO: 634283 - DNA, 22 bp, Artificial Sequence
  chemically synthesized
gactgtttatgtgaggagagaa

SEQ ID NO: 634284 - DNA, 22 bp, Artificial Sequence
  chemically synthesized
actgtttatgtgaggagagaat

SEQ ID NO: 634285 - DNA, 22 bp, Artificial Sequence
  chemically synthesized
cttccagatcatcattctctcc

SEQ ID NO: 634286 - DNA, 22 bp, Artificial Sequence
  chemically synthesized
gcttccagatcatcattctctc

SEQ ID NO: 634287 - DNA, 22 bp, Artificial Sequence
  chemically synthesized
tgcttccagatcatcattctct

SEQ ID NO: 634288 - DNA, 22 bp, Artificial Sequence
  chemically synthesized
tttatgtgaggagagaatgatg

SEQ ID NO: 634289 - DNA, 22 bp, Artificial Sequence
  chemically synthesized
tttgcttccagatcatcattct

SEQ ID NO: 634290 - DNA, 22 bp, Artificial Sequence
  chemically synthesized
ctttgcttccagatcatcattc

SEQ ID NO: 634291 - DNA, 22 bp, Artificial Sequence
  chemically synthesized
atgtgaggagagaatgatgatc

SEQ ID NO: 634292 - DNA, 22 bp, Artificial Sequence
  chemically synthesized
tgtgaggagagaatgatgatct

SEQ ID NO: 634293 - DNA, 22 bp, Artificial Sequence
  chemically synthesized
gaagcaaagaaacctatggatg

SEQ ID NO: 634294 - DNA, 22 bp, Artificial Sequence
  chemically synthesized
ccagtgaatatcatccatccat

SEQ ID NO: 634295 - DNA, 22 bp, Artificial Sequence
  chemically synthesized
cattcccagtgaatatcatcca

SEQ ID NO: 634296 - DNA, 22 bp, Artificial Sequence
  chemically synthesized
ccattcccagtgaatatcatcc

SEQ ID NO: 634297 - DNA, 22 bp, Artificial Sequence
  chemically synthesized
tggatggatgatattcactggg

SEQ ID NO: 634298 - DNA, 22 bp, Artificial Sequence
  chemically synthesized
caaggagatttccattcccagt

SEQ ID NO: 634299 - DNA, 22 bp, Artificial Sequence
  chemically synthesized
acaaaatctacaaggagatttc

SEQ ID NO: 634300 - DNA, 22 bp, Artificial Sequence
  chemically synthesized
actgggaatggaaatctccttg

SEQ ID NO: 634301 - DNA, 22 bp, Artificial Sequence
  chemically synthesized
ggaatggaaatctccttgtaga

SEQ ID NO: 634302 - DNA, 22 bp, Artificial Sequence
  chemically synthesized
cttgtagattttgtgaatctgt

SEQ ID NO: 634303 - DNA, 22 bp, Artificial Sequence
  chemically synthesized
gtagattttgtgaatctgtgtc

SEQ ID NO: 634304 - DNA, 22 bp, Artificial Sequence
  chemically synthesized
tagattttgtgaatctgtgtct

SEQ ID NO: 634305 - DNA, 22 bp, Artificial Sequence
  chemically synthesized
tgtgaatctgtgtctgtattgt

SEQ ID NO: 634306 - DNA, 22 bp, Artificial Sequence
  chemically synthesized
acacatgaacaaacaatacaga

SEQ ID NO: 634307 - DNA, 22 bp, Artificial Sequence
  chemically synthesized
gtgaatctgtgtctgtattgtt

SEQ ID NO: 634308 - DNA, 22 bp, Artificial Sequence
  chemically synthesized
aacacatgaacaaacaatacag

SEQ ID NO: 634309 - DNA, 22 bp, Artificial Sequence
  chemically synthesized
tgaatctgtgtctgtattgttt

SEQ ID NO: 634310 - DNA, 22 bp, Artificial Sequence
  chemically synthesized
taacacatgaacaaacaataca

SEQ ID NO: 634311 - DNA, 22 bp, Artificial Sequence
  chemically synthesized
tttaacacatgaacaaacaata

SEQ ID NO: 634312 - DNA, 22 bp, Artificial Sequence
  chemically synthesized
ctttaacacatgaacaaacaat

SEQ ID NO: 634313 - DNA, 22 bp, Artificial Sequence
  chemically synthesized
tgtctgtattgtttgttcatgt

SEQ ID NO: 634314 - DNA, 22 bp, Artificial Sequence
  chemically synthesized
aagtgtatttctttaacacatg

SEQ ID NO: 634315 - DNA, 22 bp, Artificial Sequence
  chemically synthesized
tattgtttgttcatgtgttaaa

SEQ ID NO: 634316 - DNA, 22 bp, Artificial Sequence
  chemically synthesized
gaagtgtatttctttaacacat

SEQ ID NO: 634317 - DNA, 22 bp, Artificial Sequence
  chemically synthesized
tttgaagtgtatttctttaaca

SEQ ID NO: 634318 - DNA, 22 bp, Artificial Sequence
  chemically synthesized
tttgttcatgtgttaaagaaat

SEQ ID NO: 634319 - DNA, 22 bp, Artificial Sequence
  chemically synthesized
gttcatgtgttaaagaaataca

SEQ ID NO: 634320 - DNA, 22 bp, Artificial Sequence
  chemically synthesized
ttcatgtgttaaagaaatacac

SEQ ID NO: 634321 - DNA, 22 bp, Artificial Sequence
  chemically synthesized
atgtgttaaagaaatacacttc

SEQ ID NO: 634322 - DNA, 22 bp, Artificial Sequence
  chemically synthesized
caaatgctgtttgaagtgtatt

SEQ ID NO: 634323 - DNA, 22 bp, Artificial Sequence
  chemically synthesized
gcaaatgctgtttgaagtgtat

SEQ ID NO: 634324 - DNA, 22 bp, Artificial Sequence
  chemically synthesized
acttgcaaatgctgtttgaagt

SEQ ID NO: 634325 - DNA, 22 bp, Artificial Sequence
  chemically synthesized
aacttgcaaatgctgtttgaag

SEQ ID NO: 634326 - DNA, 22 bp, Artificial Sequence
  chemically synthesized
taacttgcaaatgctgtttgaa

SEQ ID NO: 634327 - DNA, 22 bp, Artificial Sequence
  chemically synthesized
aagaaatacacttcaaacagca

SEQ ID NO: 634328 - DNA, 22 bp, Artificial Sequence
  chemically synthesized
cctttaacttgcaaatgctgtt

SEQ ID NO: 634329 - DNA, 22 bp, Artificial Sequence
  chemically synthesized
ccctttaacttgcaaatgctgt

SEQ ID NO: 634330 - DNA, 22 bp, Artificial Sequence
  chemically synthesized
agaaatttccctttaacttgca

SEQ ID NO: 634331 - DNA, 22 bp, Artificial Sequence
  chemically synthesized
caaacagcatttgcaagttaaa

SEQ ID NO: 634332 - DNA, 22 bp, Artificial Sequence
  chemically synthesized
aaacagcatttgcaagttaaag

SEQ ID NO: 634333 - DNA, 22 bp, Artificial Sequence
  chemically synthesized
cacctaagaaatttccctttaa

SEQ ID NO: 634334 - DNA, 22 bp, Artificial Sequence
  chemically synthesized
gcacctaagaaatttcccttta

SEQ ID NO: 634335 - DNA, 22 bp, Artificial Sequence
  chemically synthesized
tttgcacctaagaaatttccct

SEQ ID NO: 634336 - DNA, 22 bp, Artificial Sequence
  chemically synthesized
gtttgcacctaagaaatttccc

SEQ ID NO: 634337 - DNA, 22 bp, Artificial Sequence
  chemically synthesized
tgtttgcacctaagaaatttcc

SEQ ID NO: 634338 - DNA, 22 bp, Artificial Sequence
  chemically synthesized
gcaagttaaagggaaatttctt

SEQ ID NO: 634339 - DNA, 22 bp, Artificial Sequence
  chemically synthesized
caagttaaagggaaatttctta

SEQ ID NO: 634340 - DNA, 22 bp, Artificial Sequence
  chemically synthesized
attttgtttgcacctaagaaat

SEQ ID NO: 634341 - DNA, 22 bp, Artificial Sequence
  chemically synthesized
aattttgtttgcacctaagaaa

SEQ ID NO: 634342 - DNA, 22 bp, Artificial Sequence
  chemically synthesized
aagggaaatttcttaggtgcaa

SEQ ID NO: 634343 - DNA, 22 bp, Artificial Sequence
  chemically synthesized
aagtttaattttgtttgcacct

SEQ ID NO: 634344 - DNA, 22 bp, Artificial Sequence
  chemically synthesized
aaagtttaattttgtttgcacc

SEQ ID NO: 634345 - DNA, 22 bp, Artificial Sequence
  chemically synthesized
taaagtttaattttgtttgcac

SEQ ID NO: 634346 - DNA, 22 bp, Artificial Sequence
  chemically synthesized
cttaggtgcaaacaaaattaaa

SEQ ID NO: 634347 - DNA, 22 bp, Artificial Sequence
  chemically synthesized
ttaggtgcaaacaaaattaaac

SEQ ID NO: 634348 - DNA, 22 bp, Artificial Sequence
  chemically synthesized
aggtgcaaacaaaattaaactt

SEQ ID NO: 634349 - DNA, 22 bp, Artificial Sequence
  chemically synthesized
aaaggacctttaaagtttaatt

SEQ ID NO: 634350 - DNA, 22 bp, Artificial Sequence
  chemically synthesized
ggtgcaaacaaaattaaacttt

SEQ ID NO: 634351 - DNA, 22 bp, Artificial Sequence
  chemically synthesized
caaaggacctttaaagtttaat

SEQ ID NO: 634352 - DNA, 22 bp, Artificial Sequence
  chemically synthesized
gtttcaaaggacctttaaagtt

SEQ ID NO: 634353 - DNA, 22 bp, Artificial Sequence
  chemically synthesized
tgaaaagttagtttcaaaggac

SEQ ID NO: 634354 - DNA, 22 bp, Artificial Sequence
  chemically synthesized
aactttaaaggtcctttgaaac

SEQ ID NO: 634355 - DNA, 22 bp, Artificial Sequence
  chemically synthesized
taaaggtcctttgaaactaact

SEQ ID NO: 634356 - DNA, 22 bp, Artificial Sequence
  chemically synthesized
tatattatgaaaagttagtttc

SEQ ID NO: 634357 - DNA, 22 bp, Artificial Sequence
  chemically synthesized
aaaggtcctttgaaactaactt

SEQ ID NO: 634358 - DNA, 22 bp, Artificial Sequence
  chemically synthesized
aaggtcctttgaaactaacttt

SEQ ID NO: 634359 - DNA, 22 bp, Artificial Sequence
  chemically synthesized
gaagattgtatattatgaaaag

SEQ ID NO: 634360 - DNA, 22 bp, Artificial Sequence
  chemically synthesized
tgaaactaacttttcataatat

SEQ ID NO: 634361 - DNA, 22 bp, Artificial Sequence
  chemically synthesized
ttggaagattgtatattatgaa

SEQ ID NO: 634362 - DNA, 22 bp, Artificial Sequence
  chemically synthesized
gaaactaacttttcataatata

SEQ ID NO: 634363 - DNA, 22 bp, Artificial Sequence
  chemically synthesized
aaactaacttttcataatatac

SEQ ID NO: 634364 - DNA, 22 bp, Artificial Sequence
  chemically synthesized
actattggaagattgtatatta

SEQ ID NO: 634365 - DNA, 22 bp, Artificial Sequence
  chemically synthesized
cactattggaagattgtatatt

SEQ ID NO: 634366 - DNA, 22 bp, Artificial Sequence
  chemically synthesized
tcactattggaagattgtatat

SEQ ID NO: 634367 - DNA, 22 bp, Artificial Sequence
  chemically synthesized
acttttcataatatacaatctt

SEQ ID NO: 634368 - DNA, 22 bp, Artificial Sequence
  chemically synthesized
ttttcactattggaagattgta

SEQ ID NO: 634369 - DNA, 22 bp, Artificial Sequence
  chemically synthesized
ttcataatatacaatcttccaa

SEQ ID NO: 634370 - DNA, 22 bp, Artificial Sequence
  chemically synthesized
tcataatatacaatcttccaat

SEQ ID NO: 634371 - DNA, 22 bp, Artificial Sequence
  chemically synthesized
cataatatacaatcttccaata

SEQ ID NO: 634372 - DNA, 22 bp, Artificial Sequence
  chemically synthesized
ataatatacaatcttccaatag

SEQ ID NO: 634373 - DNA, 22 bp, Artificial Sequence
  chemically synthesized
aatagaagttattttcactatt

SEQ ID NO: 634374 - DNA, 22 bp, Artificial Sequence
  chemically synthesized
gaatagaagttattttcactat

SEQ ID NO: 634375 - DNA, 22 bp, Artificial Sequence
  chemically synthesized
ccaatagtgaaaataacttcta

SEQ ID NO: 634376 - DNA, 22 bp, Artificial Sequence
  chemically synthesized
caatagtgaaaataacttctat

SEQ ID NO: 634377 - DNA, 22 bp, Artificial Sequence
  chemically synthesized
ctattcaagctctgtttgtttt

SEQ ID NO: 634378 - DNA, 22 bp, Artificial Sequence
  chemically synthesized
tattcaagctctgtttgttttg

SEQ ID NO: 634379 - DNA, 22 bp, Artificial Sequence
  chemically synthesized
ttcaagctctgtttgttttgca

SEQ ID NO: 634380 - DNA, 22 bp, Artificial Sequence
  chemically synthesized
aagctctgtttgttttgcacat

SEQ ID NO: 634381 - DNA, 22 bp, Artificial Sequence
  chemically synthesized
gatggaagtgacaatgtgcaaa

SEQ ID NO: 634382 - DNA, 22 bp, Artificial Sequence
  chemically synthesized
agatggaagtgacaatgtgcaa

SEQ ID NO: 634383 - DNA, 22 bp, Artificial Sequence
  chemically synthesized
tagatggaagtgacaatgtgca

SEQ ID NO: 634384 - DNA, 22 bp, Artificial Sequence
  chemically synthesized
tgtttgttttgcacattgtcac

SEQ ID NO: 634385 - DNA, 22 bp, Artificial Sequence
  chemically synthesized
ttttagatggaagtgacaatgt

SEQ ID NO: 634386 - DNA, 22 bp, Artificial Sequence
  chemically synthesized
gttttagatggaagtgacaatg

SEQ ID NO: 634387 - DNA, 22 bp, Artificial Sequence
  chemically synthesized
tttgttttgcacattgtcactt

SEQ ID NO: 634388 - DNA, 22 bp, Artificial Sequence
  chemically synthesized
gttttgcacattgtcacttcca

SEQ ID NO: 634389 - DNA, 22 bp, Artificial Sequence
  chemically synthesized
ttttgcacattgtcacttccat

SEQ ID NO: 634390 - DNA, 22 bp, Artificial Sequence
  chemically synthesized
tgcacattgtcacttccatcta

SEQ ID NO: 634391 - DNA, 22 bp, Artificial Sequence
  chemically synthesized
gcacattgtcacttccatctaa

SEQ ID NO: 634392 - DNA, 22 bp, Artificial Sequence
  chemically synthesized
cacattgtcacttccatctaaa

SEQ ID NO: 634393 - DNA, 22 bp, Artificial Sequence
  chemically synthesized
aagcaaggtcttgttttagatg

SEQ ID NO: 634394 - DNA, 22 bp, Artificial Sequence
  chemically synthesized
ctaaagcaaggtcttgttttag

SEQ ID NO: 634395 - DNA, 22 bp, Artificial Sequence
  chemically synthesized
gctaaagcaaggtcttgtttta

SEQ ID NO: 634396 - DNA, 22 bp, Artificial Sequence
  chemically synthesized
tcacttccatctaaaacaagac

SEQ ID NO: 634397 - DNA, 22 bp, Artificial Sequence
  chemically synthesized
acttgctaaagcaaggtcttgt

SEQ ID NO: 634398 - DNA, 22 bp, Artificial Sequence
  chemically synthesized
ccatctaaaacaagaccttgct

SEQ ID NO: 634399 - DNA, 22 bp, Artificial Sequence
  chemically synthesized
catctaaaacaagaccttgctt

SEQ ID NO: 634400 - DNA, 22 bp, Artificial Sequence
  chemically synthesized
tggttgacttgctaaagcaagg

SEQ ID NO: 634401 - DNA, 22 bp, Artificial Sequence
  chemically synthesized
aaacaagaccttgctttagcaa

SEQ ID NO: 634402 - DNA, 22 bp, Artificial Sequence
  chemically synthesized
attatggttgacttgctaaagc

SEQ ID NO: 634403 - DNA, 22 bp, Artificial Sequence
  chemically synthesized
agttcattatggttgacttgct

SEQ ID NO: 634404 - DNA, 22 bp, Artificial Sequence
  chemically synthesized
attaagttcattatggttgact

SEQ ID NO: 634405 - DNA, 22 bp, Artificial Sequence
  chemically synthesized
gctttagcaagtcaaccataat

SEQ ID NO: 634406 - DNA, 22 bp, Artificial Sequence
  chemically synthesized
ctttagcaagtcaaccataatg

SEQ ID NO: 634407 - DNA, 22 bp, Artificial Sequence
  chemically synthesized
tccctaattaagttcattatgg

SEQ ID NO: 634408 - DNA, 22 bp, Artificial Sequence
  chemically synthesized
tagcaagtcaaccataatgaac

SEQ ID NO: 634409 - DNA, 22 bp, Artificial Sequence
  chemically synthesized
agcaagtcaaccataatgaact

SEQ ID NO: 634410 - DNA, 22 bp, Artificial Sequence
  chemically synthesized
gcaagtcaaccataatgaactt

SEQ ID NO: 634411 - DNA, 22 bp, Artificial Sequence
  chemically synthesized
aggttgtccctaattaagttca

SEQ ID NO: 634412 - DNA, 22 bp, Artificial Sequence
  chemically synthesized
aattagggacaacctcaggttt

SEQ ID NO: 634413 - DNA, 22 bp, Artificial Sequence
  chemically synthesized
caagtcagatgtaaacctgagg

SEQ ID NO: 634414 - DNA, 22 bp, Artificial Sequence
  chemically synthesized
attagggacaacctcaggttta

SEQ ID NO: 634415 - DNA, 22 bp, Artificial Sequence
  chemically synthesized
gggacaacctcaggtttacatc

SEQ ID NO: 634416 - DNA, 22 bp, Artificial Sequence
  chemically synthesized
cgaagcagttccaagtcagatg

SEQ ID NO: 634417 - DNA, 22 bp, Artificial Sequence
  chemically synthesized
ccgaagcagttccaagtcagat

SEQ ID NO: 634418 - DNA, 22 bp, Artificial Sequence
  chemically synthesized
aggtttacatctgacttggaac

SEQ ID NO: 634419 - DNA, 22 bp, Artificial Sequence
  chemically synthesized
gcttccgaagcagttccaagtc

SEQ ID NO: 634420 - DNA, 22 bp, Artificial Sequence
  chemically synthesized
acatctgacttggaactgcttc

SEQ ID NO: 634421 - DNA, 22 bp, Artificial Sequence
  chemically synthesized
catctgacttggaactgcttcg

SEQ ID NO: 634422 - DNA, 22 bp, Artificial Sequence
  chemically synthesized
gtcactggcttccgaagcagtt

SEQ ID NO: 634423 - DNA, 22 bp, Artificial Sequence
  chemically synthesized
agtcactggcttccgaagcagt

SEQ ID NO: 634424 - DNA, 22 bp, Artificial Sequence
  chemically synthesized
acttggaactgcttcggaagcc

SEQ ID NO: 634425 - DNA, 22 bp, Artificial Sequence
  chemically synthesized
agtcatttagtcactggcttcc

SEQ ID NO: 634426 - DNA, 22 bp, Artificial Sequence
  chemically synthesized
ggaactgcttcggaagccagtg

SEQ ID NO: 634427 - DNA, 22 bp, Artificial Sequence
  chemically synthesized
aagtcatttagtcactggcttc

SEQ ID NO: 634428 - DNA, 22 bp, Artificial Sequence
  chemically synthesized
gaactgcttcggaagccagtga

SEQ ID NO: 634429 - DNA, 22 bp, Artificial Sequence
  chemically synthesized
cttcggaagccagtgactaaat

SEQ ID NO: 634430 - DNA, 22 bp, Artificial Sequence
  chemically synthesized
cggaagccagtgactaaatgac

SEQ ID NO: 634431 - DNA, 22 bp, Artificial Sequence
  chemically synthesized
ggaagccagtgactaaatgact

SEQ ID NO: 634432 - DNA, 22 bp, Artificial Sequence
  chemically synthesized
aatgacttaaatatgcttctca

SEQ ID NO: 634433 - DNA, 22 bp, Artificial Sequence
  chemically synthesized
aaatatgcttctcattcccttt

SEQ ID NO: 634434 - DNA, 22 bp, Artificial Sequence
  chemically synthesized
aatatgcttctcattccctttg

SEQ ID NO: 634435 - DNA, 22 bp, Artificial Sequence
  chemically synthesized
ctcattccctttggtctatgcc

SEQ ID NO: 634436 - DNA, 22 bp, Artificial Sequence
  chemically synthesized
tcattccctttggtctatgcca

SEQ ID NO: 634437 - DNA, 22 bp, Artificial Sequence
  chemically synthesized
attccctttggtctatgccact

SEQ ID NO: 634438 - DNA, 22 bp, Artificial Sequence
  chemically synthesized
cctttggtctatgccacttgga

SEQ ID NO: 634439 - DNA, 22 bp, Artificial Sequence
  chemically synthesized
atcaaacatgaaaatccaagtg

SEQ ID NO: 634440 - DNA, 22 bp, Artificial Sequence
  chemically synthesized
tggtctatgccacttggatttt

SEQ ID NO: 634441 - DNA, 22 bp, Artificial Sequence
  chemically synthesized
taatcaaacatgaaaatccaag

SEQ ID NO: 634442 - DNA, 22 bp, Artificial Sequence
  chemically synthesized
ggtctatgccacttggattttc

SEQ ID NO: 634443 - DNA, 22 bp, Artificial Sequence
  chemically synthesized
gtctatgccacttggattttca

SEQ ID NO: 634444 - DNA, 22 bp, Artificial Sequence
  chemically synthesized
tgccacttggattttcatgttt

SEQ ID NO: 634445 - DNA, 22 bp, Artificial Sequence
  chemically synthesized
ggattttcatgtttgattagaa

SEQ ID NO: 634446 - DNA, 22 bp, Artificial Sequence
  chemically synthesized
gattttcatgtttgattagaat

SEQ ID NO: 634447 - DNA, 22 bp, Artificial Sequence
  chemically synthesized
tcatgtttgattagaatcctgc

SEQ ID NO: 634448 - DNA, 22 bp, Artificial Sequence
  chemically synthesized
catgtttgattagaatcctgca

SEQ ID NO: 634449 - DNA, 22 bp, Artificial Sequence
  chemically synthesized
atgtttgattagaatcctgcat

SEQ ID NO: 634450 - DNA, 22 bp, Artificial Sequence
  chemically synthesized
gattagaatcctgcatttattc

SEQ ID NO: 634451 - DNA, 22 bp, Artificial Sequence
  chemically synthesized
attagaatcctgcatttattcc

SEQ ID NO: 634452 - DNA, 22 bp, Artificial Sequence
  chemically synthesized
aaaaaaaaaaaaggaataaatg

SEQ ID NO: 634453 - DNA, 22 bp, Artificial Sequence
  chemically synthesized
ttaaaaaaaaaaaaaggaataa

SEQ ID NO: 634454 - DNA, 22 bp, Artificial Sequence
  chemically synthesized
gaatcctgcatttattcctttt

SEQ ID NO: 634455 - DNA, 22 bp, Artificial Sequence
  chemically synthesized
ctgttaaaaaaaaaaaaaggaa

SEQ ID NO: 634456 - DNA, 22 bp, Artificial Sequence
  chemically synthesized
tgctgttaaaaaaaaaaaaagg

SEQ ID NO: 634457 - DNA, 22 bp, Artificial Sequence
  chemically synthesized
ctgctgttaaaaaaaaaaaaag

SEQ ID NO: 634458 - DNA, 22 bp, Artificial Sequence
  chemically synthesized
catttattcctttttttttttt

SEQ ID NO: 634459 - DNA, 22 bp, Artificial Sequence
  chemically synthesized
gcttctgctgttaaaaaaaaaa

SEQ ID NO: 634460 - DNA, 22 bp, Artificial Sequence
  chemically synthesized
agcttctgctgttaaaaaaaaa

SEQ ID NO: 634461 - DNA, 22 bp, Artificial Sequence
  chemically synthesized
tagcttctgctgttaaaaaaaa

SEQ ID NO: 634462 - DNA, 22 bp, Artificial Sequence
  chemically synthesized
ttagcttctgctgttaaaaaaa

SEQ ID NO: 634463 - DNA, 22 bp, Artificial Sequence
  chemically synthesized
attcctttttttttttttaaca

SEQ ID NO: 634464 - DNA, 22 bp, Artificial Sequence
  chemically synthesized
ttcctttttttttttttaacag

SEQ ID NO: 634465 - DNA, 22 bp, Artificial Sequence
  chemically synthesized
ttttagcttctgctgttaaaaa

SEQ ID NO: 634466 - DNA, 22 bp, Artificial Sequence
  chemically synthesized
ctttttttttttttaacagcag

SEQ ID NO: 634467 - DNA, 22 bp, Artificial Sequence
  chemically synthesized
tttttttttttaacagcagaag

SEQ ID NO: 634468 - DNA, 22 bp, Artificial Sequence
  chemically synthesized
ttttttttttaacagcagaagc

SEQ ID NO: 634469 - DNA, 22 bp, Artificial Sequence
  chemically synthesized
tttttttttaacagcagaagct

SEQ ID NO: 634470 - DNA, 22 bp, Artificial Sequence
  chemically synthesized
ttttttttaacagcagaagcta

SEQ ID NO: 634471 - DNA, 22 bp, Artificial Sequence
  chemically synthesized
tttttttaacagcagaagctaa

SEQ ID NO: 634472 - DNA, 22 bp, Artificial Sequence
  chemically synthesized
gcaatgattcttttagcttctg

SEQ ID NO: 634473 - DNA, 22 bp, Artificial Sequence
  chemically synthesized
ttttttaacagcagaagctaaa

SEQ ID NO: 634474 - DNA, 22 bp, Artificial Sequence
  chemically synthesized
tttttaacagcagaagctaaaa

SEQ ID NO: 634475 - DNA, 22 bp, Artificial Sequence
  chemically synthesized
ttttaacagcagaagctaaaag

SEQ ID NO: 634476 - DNA, 22 bp, Artificial Sequence
  chemically synthesized
tttaacagcagaagctaaaaga

SEQ ID NO: 634477 - DNA, 22 bp, Artificial Sequence
  chemically synthesized
ttaacagcagaagctaaaagaa

SEQ ID NO: 634478 - DNA, 22 bp, Artificial Sequence
  chemically synthesized
taacagcagaagctaaaagaat

SEQ ID NO: 634479 - DNA, 22 bp, Artificial Sequence
  chemically synthesized
gcattggcaatgattcttttag

SEQ ID NO: 634480 - DNA, 22 bp, Artificial Sequence
  chemically synthesized
aacagcagaagctaaaagaatc

SEQ ID NO: 634481 - DNA, 22 bp, Artificial Sequence
  chemically synthesized
acagcagaagctaaaagaatca

SEQ ID NO: 634482 - DNA, 22 bp, Artificial Sequence
  chemically synthesized
atggttagcattggcaatgatt

SEQ ID NO: 634483 - DNA, 22 bp, Artificial Sequence
  chemically synthesized
aatggttagcattggcaatgat

SEQ ID NO: 634484 - DNA, 22 bp, Artificial Sequence
  chemically synthesized
tcttaatggttagcattggcaa

SEQ ID NO: 634485 - DNA, 22 bp, Artificial Sequence
  chemically synthesized
gtcttaatggttagcattggca

SEQ ID NO: 634486 - DNA, 22 bp, Artificial Sequence
  chemically synthesized
tgtcttaatggttagcattggc

SEQ ID NO: 634487 - DNA, 22 bp, Artificial Sequence
  chemically synthesized
aaagaatcattgccaatgctaa

SEQ ID NO: 634488 - DNA, 22 bp, Artificial Sequence
  chemically synthesized
gaatatgattttgtcttaatgg

SEQ ID NO: 634489 - DNA, 22 bp, Artificial Sequence
  chemically synthesized
ccaatgctaaccattaagacaa

SEQ ID NO: 634490 - DNA, 22 bp, Artificial Sequence
  chemically synthesized
accattaagacaaaatcatatt

SEQ ID NO: 634491 - DNA, 22 bp, Artificial Sequence
  chemically synthesized
acatccacctagaatatgattt

SEQ ID NO: 634492 - DNA, 22 bp, Artificial Sequence
  chemically synthesized
agacaaaatcatattctaggtg

SEQ ID NO: 634493 - DNA, 22 bp, Artificial Sequence
  chemically synthesized
ataaaaatatgaagcctcacat

SEQ ID NO: 634494 - DNA, 22 bp, Artificial Sequence
  chemically synthesized
taataaaaatatgaagcctcac

SEQ ID NO: 634495 - DNA, 22 bp, Artificial Sequence
  chemically synthesized
taggtggatgtgaggcttcata

SEQ ID NO: 634496 - DNA, 22 bp, Artificial Sequence
  chemically synthesized
ggtggatgtgaggcttcatatt

SEQ ID NO: 634497 - DNA, 22 bp, Artificial Sequence
  chemically synthesized
cattctaataaaaatatgaagc

SEQ ID NO: 634498 - DNA, 22 bp, Artificial Sequence
  chemically synthesized
tccctccattctaataaaaata

SEQ ID NO: 634499 - DNA, 22 bp, Artificial Sequence
  chemically synthesized
atccctccattctaataaaaat

SEQ ID NO: 634500 - DNA, 22 bp, Artificial Sequence
  chemically synthesized
ttatccctccattctaataaaa

SEQ ID NO: 634501 - DNA, 22 bp, Artificial Sequence
  chemically synthesized
cgttcttatccctccattctaa

SEQ ID NO: 634502 - DNA, 22 bp, Artificial Sequence
  chemically synthesized
acgttcttatccctccattcta

SEQ ID NO: 634503 - DNA, 22 bp, Artificial Sequence
  chemically synthesized
catatttttattagaatggagg

SEQ ID NO: 634504 - DNA, 22 bp, Artificial Sequence
  chemically synthesized
atatttttattagaatggaggg

SEQ ID NO: 634505 - DNA, 22 bp, Artificial Sequence
  chemically synthesized
ccttacgttcttatccctccat

SEQ ID NO: 634506 - DNA, 22 bp, Artificial Sequence
  chemically synthesized
ttattagaatggagggataaga

SEQ ID NO: 634507 - DNA, 22 bp, Artificial Sequence
  chemically synthesized
tctaccttacgttcttatccct

SEQ ID NO: 634508 - DNA, 22 bp, Artificial Sequence
  chemically synthesized
tattagaatggagggataagaa

SEQ ID NO: 634509 - DNA, 22 bp, Artificial Sequence
  chemically synthesized
atctaccttacgttcttatccc

SEQ ID NO: 634510 - DNA, 22 bp, Artificial Sequence
  chemically synthesized
attagaatggagggataagaac

SEQ ID NO: 634511 - DNA, 22 bp, Artificial Sequence
  chemically synthesized
tatctaccttacgttcttatcc

SEQ ID NO: 634512 - DNA, 22 bp, Artificial Sequence
  chemically synthesized
ttagaatggagggataagaacg

SEQ ID NO: 634513 - DNA, 22 bp, Artificial Sequence
  chemically synthesized
ttatctaccttacgttcttatc

SEQ ID NO: 634514 - DNA, 22 bp, Artificial Sequence
  chemically synthesized
tttatctaccttacgttcttat

SEQ ID NO: 634515 - DNA, 22 bp, Artificial Sequence
  chemically synthesized
gaatggagggataagaacgtaa

SEQ ID NO: 634516 - DNA, 22 bp, Artificial Sequence
  chemically synthesized
aggctttttatctaccttacgt

SEQ ID NO: 634517 - DNA, 22 bp, Artificial Sequence
  chemically synthesized
atgtagtctgaggctttttatc

SEQ ID NO: 634518 - DNA, 22 bp, Artificial Sequence
  chemically synthesized
ccaggagactcatgtagtctga

SEQ ID NO: 634519 - DNA, 22 bp, Artificial Sequence
  chemically synthesized
tggtatgttaccaggagactca

SEQ ID NO: 634520 - DNA, 22 bp, Artificial Sequence
  chemically synthesized
ctgtggtatgttaccaggagac

SEQ ID NO: 634521 - DNA, 22 bp, Artificial Sequence
  chemically synthesized
agactacatgagtctcctggta

SEQ ID NO: 634522 - DNA, 22 bp, Artificial Sequence
  chemically synthesized
cctgtggtatgttaccaggaga

SEQ ID NO: 634523 - DNA, 22 bp, Artificial Sequence
  chemically synthesized
catgagtctcctggtaacatac

SEQ ID NO: 634524 - DNA, 22 bp, Artificial Sequence
  chemically synthesized
caaagaggtttcctgtggtatg

SEQ ID NO: 634525 - DNA, 22 bp, Artificial Sequence
  chemically synthesized
ctggtaacataccacaggaaac

SEQ ID NO: 634526 - DNA, 22 bp, Artificial Sequence
  chemically synthesized
atattgcaaagaggtttcctgt

SEQ ID NO: 634527 - DNA, 22 bp, Artificial Sequence
  chemically synthesized
aatattgcaaagaggtttcctg

SEQ ID NO: 634528 - DNA, 22 bp, Artificial Sequence
  chemically synthesized
gtaacataccacaggaaacctc

SEQ ID NO: 634529 - DNA, 22 bp, Artificial Sequence
  chemically synthesized
tacttaatattgcaaagaggtt

SEQ ID NO: 634530 - DNA, 22 bp, Artificial Sequence
  chemically synthesized
ctgtacttaatattgcaaagag

SEQ ID NO: 634531 - DNA, 22 bp, Artificial Sequence
  chemically synthesized
cctgtacttaatattgcaaaga

SEQ ID NO: 634532 - DNA, 22 bp, Artificial Sequence
  chemically synthesized
agcacccatttcctgtacttaa

SEQ ID NO: 634533 - DNA, 22 bp, Artificial Sequence
  chemically synthesized
cagcacccatttcctgtactta

SEQ ID NO: 634534 - DNA, 22 bp, Artificial Sequence
  chemically synthesized
tttgcaatattaagtacaggaa

SEQ ID NO: 634535 - DNA, 22 bp, Artificial Sequence
  chemically synthesized
ttcagcacccatttcctgtact

SEQ ID NO: 634536 - DNA, 22 bp, Artificial Sequence
  chemically synthesized
tgcaatattaagtacaggaaat

SEQ ID NO: 634537 - DNA, 22 bp, Artificial Sequence
  chemically synthesized
gcaatattaagtacaggaaatg

SEQ ID NO: 634538 - DNA, 22 bp, Artificial Sequence
  chemically synthesized
caatattaagtacaggaaatgg

SEQ ID NO: 634539 - DNA, 22 bp, Artificial Sequence
  chemically synthesized
attcttcagcacccatttcctg

SEQ ID NO: 634540 - DNA, 22 bp, Artificial Sequence
  chemically synthesized
aattcttcagcacccatttcct

SEQ ID NO: 634541 - DNA, 22 bp, Artificial Sequence
  chemically synthesized
agtacaggaaatgggtgctgaa

SEQ ID NO: 634542 - DNA, 22 bp, Artificial Sequence
  chemically synthesized
tgaccttaattcttcagcaccc

SEQ ID NO: 634543 - DNA, 22 bp, Artificial Sequence
  chemically synthesized
gtgaccttaattcttcagcacc

SEQ ID NO: 634544 - DNA, 22 bp, Artificial Sequence
  chemically synthesized
tgtgaccttaattcttcagcac

SEQ ID NO: 634545 - DNA, 22 bp, Artificial Sequence
  chemically synthesized
ctttgtgaccttaattcttcag

SEQ ID NO: 634546 - DNA, 22 bp, Artificial Sequence
  chemically synthesized
tgctttgtgaccttaattcttc

SEQ ID NO: 634547 - DNA, 22 bp, Artificial Sequence
  chemically synthesized
ctgctttgtgaccttaattctt

SEQ ID NO: 634548 - DNA, 22 bp, Artificial Sequence
  chemically synthesized
tctgctttgtgaccttaattct

SEQ ID NO: 634549 - DNA, 22 bp, Artificial Sequence
  chemically synthesized
ttctgctttgtgaccttaattc

SEQ ID NO: 634550 - DNA, 22 bp, Artificial Sequence
  chemically synthesized
cttttctgctttgtgaccttaa

SEQ ID NO: 634551 - DNA, 22 bp, Artificial Sequence
  chemically synthesized
ttccttttctgctttgtgacct

SEQ ID NO: 634552 - DNA, 22 bp, Artificial Sequence
  chemically synthesized
aagaattaaggtcacaaagcag

SEQ ID NO: 634553 - DNA, 22 bp, Artificial Sequence
  chemically synthesized
taactattccttttctgctttg

SEQ ID NO: 634554 - DNA, 22 bp, Artificial Sequence
  chemically synthesized
gtaactattccttttctgcttt

SEQ ID NO: 634555 - DNA, 22 bp, Artificial Sequence
  chemically synthesized
aggtcacaaagcagaaaaggaa

SEQ ID NO: 634556 - DNA, 22 bp, Artificial Sequence
  chemically synthesized
caaactctctctctcctctttc

SEQ ID NO: 634557 - DNA, 22 bp, Artificial Sequence
  chemically synthesized
tctctctcctctttctctctct

SEQ ID NO: 634558 - DNA, 22 bp, Artificial Sequence
  chemically synthesized
tctctcctctttctctctctct

SEQ ID NO: 634559 - DNA, 22 bp, Artificial Sequence
  chemically synthesized
tctcctctttctctctctcttc

SEQ ID NO: 634560 - DNA, 22 bp, Artificial Sequence
  chemically synthesized
tcctctttctctctctcttcct

SEQ ID NO: 634561 - DNA, 22 bp, Artificial Sequence
  chemically synthesized
ctctttctctctctcttcctcc

SEQ ID NO: 634562 - DNA, 22 bp, Artificial Sequence
  chemically synthesized
tttctctctctcttcctccccc

SEQ ID NO: 634563 - DNA, 22 bp, Artificial Sequence
  chemically synthesized
tctctctctcttcctcccccct

SEQ ID NO: 634564 - DNA, 22 bp, Artificial Sequence
  chemically synthesized
ctctctctcttcctcccccctc

SEQ ID NO: 634565 - DNA, 22 bp, Artificial Sequence
  chemically synthesized
tctctctcttcctcccccctca

SEQ ID NO: 634566 - DNA, 22 bp, Artificial Sequence
  chemically synthesized
tctctcttcctcccccctcaca

SEQ ID NO: 634567 - DNA, 22 bp, Artificial Sequence
  chemically synthesized
tctcttcctcccccctcacaca

SEQ ID NO: 634568 - DNA, 22 bp, Artificial Sequence
  chemically synthesized
tcttcctcccccctcacacaca

SEQ ID NO: 634569 - DNA, 22 bp, Artificial Sequence
  chemically synthesized
agcaaatagtgcatgtgtgtga

SEQ ID NO: 634570 - DNA, 22 bp, Artificial Sequence
  chemically synthesized
ttcctcccccctcacacacatg

SEQ ID NO: 634571 - DNA, 22 bp, Artificial Sequence
  chemically synthesized
aagcaaatagtgcatgtgtgtg

SEQ ID NO: 634572 - DNA, 22 bp, Artificial Sequence
  chemically synthesized
cctcccccctcacacacatgca

SEQ ID NO: 634573 - DNA, 22 bp, Artificial Sequence
  chemically synthesized
ctcccccctcacacacatgcac

SEQ ID NO: 634574 - DNA, 22 bp, Artificial Sequence
  chemically synthesized
ccccctcacacacatgcactat

SEQ ID NO: 634575 - DNA, 22 bp, Artificial Sequence
  chemically synthesized
acacacatgcactatttgctta

SEQ ID NO: 634576 - DNA, 22 bp, Artificial Sequence
  chemically synthesized
aaggcataaacttaagcaaata

SEQ ID NO: 634577 - DNA, 22 bp, Artificial Sequence
  chemically synthesized
taaaggcataaacttaagcaaa

SEQ ID NO: 634578 - DNA, 22 bp, Artificial Sequence
  chemically synthesized
ctaaaggcataaacttaagcaa

SEQ ID NO: 634579 - DNA, 22 bp, Artificial Sequence
  chemically synthesized
tctaaaggcataaacttaagca

SEQ ID NO: 634580 - DNA, 22 bp, Artificial Sequence
  chemically synthesized
ttctaaaggcataaacttaagc

SEQ ID NO: 634581 - DNA, 22 bp, Artificial Sequence
  chemically synthesized
tttctaaaggcataaacttaag

SEQ ID NO: 634582 - DNA, 22 bp, Artificial Sequence
  chemically synthesized
tttttctaaaggcataaactta

SEQ ID NO: 634583 - DNA, 22 bp, Artificial Sequence
  chemically synthesized
ctttttctaaaggcataaactt

SEQ ID NO: 634584 - DNA, 22 bp, Artificial Sequence
  chemically synthesized
acttctttttctaaaggcataa

SEQ ID NO: 634585 - DNA, 22 bp, Artificial Sequence
  chemically synthesized
tttgcttaagtttatgccttta

SEQ ID NO: 634586 - DNA, 22 bp, Artificial Sequence
  chemically synthesized
cacttctttttctaaaggcata

SEQ ID NO: 634587 - DNA, 22 bp, Artificial Sequence
  chemically synthesized
gcttaagtttatgcctttagaa

SEQ ID NO: 634588 - DNA, 22 bp, Artificial Sequence
  chemically synthesized
cttaagtttatgcctttagaaa

SEQ ID NO: 634589 - DNA, 22 bp, Artificial Sequence
  chemically synthesized
aagtttatgcctttagaaaaag

SEQ ID NO: 634590 - DNA, 22 bp, Artificial Sequence
  chemically synthesized
agtttatgcctttagaaaaaga

SEQ ID NO: 634591 - DNA, 22 bp, Artificial Sequence
  chemically synthesized
atgcctttagaaaaagaagtga

SEQ ID NO: 634592 - DNA, 22 bp, Artificial Sequence
  chemically synthesized
tgcctttagaaaaagaagtgaa

SEQ ID NO: 634593 - DNA, 22 bp, Artificial Sequence
  chemically synthesized
aaaatagtgaatttcacttctt

SEQ ID NO: 634594 - DNA, 22 bp, Artificial Sequence
  chemically synthesized
tagaaaaagaagtgaaattcac

SEQ ID NO: 634595 - DNA, 22 bp, Artificial Sequence
  chemically synthesized
agaaaaagaagtgaaattcact

SEQ ID NO: 634596 - DNA, 22 bp, Artificial Sequence
  chemically synthesized
gaaaaagaagtgaaattcacta

SEQ ID NO: 634597 - DNA, 22 bp, Artificial Sequence
  chemically synthesized
aaaccgcaagaaaaatgaaact

SEQ ID NO: 634598 - DNA, 22 bp, Artificial Sequence
  chemically synthesized
aaaaccgcaagaaaaatgaaac

SEQ ID NO: 634599 - DNA, 22 bp, Artificial Sequence
  chemically synthesized
actatttttagtttcatttttc

SEQ ID NO: 634600 - DNA, 22 bp, Artificial Sequence
  chemically synthesized
tttttagtttcatttttcttgc

SEQ ID NO: 634601 - DNA, 22 bp, Artificial Sequence
  chemically synthesized
ttagtttcatttttcttgcggt

SEQ ID NO: 634602 - DNA, 22 bp, Artificial Sequence
  chemically synthesized
tagtttcatttttcttgcggtt

SEQ ID NO: 634603 - DNA, 22 bp, Artificial Sequence
  chemically synthesized
agtttcatttttcttgcggttt

SEQ ID NO: 634604 - DNA, 22 bp, Artificial Sequence
  chemically synthesized
gtttcatttttcttgcggtttt

SEQ ID NO: 634605 - DNA, 22 bp, Artificial Sequence
  chemically synthesized
catttttcttgcggttttaaac

SEQ ID NO: 634606 - DNA, 22 bp, Artificial Sequence
  chemically synthesized
atttttcttgcggttttaaact

SEQ ID NO: 634607 - DNA, 22 bp, Artificial Sequence
  chemically synthesized
accagataatggtagtttaaaa

SEQ ID NO: 634608 - DNA, 22 bp, Artificial Sequence
  chemically synthesized
caccagataatggtagtttaaa

SEQ ID NO: 634609 - DNA, 22 bp, Artificial Sequence
  chemically synthesized
ttcttgcggttttaaactacca

SEQ ID NO: 634610 - DNA, 22 bp, Artificial Sequence
  chemically synthesized
tcttgcggttttaaactaccat

SEQ ID NO: 634611 - DNA, 22 bp, Artificial Sequence
  chemically synthesized
cttgcggttttaaactaccatt

SEQ ID NO: 634612 - DNA, 22 bp, Artificial Sequence
  chemically synthesized
ttgcggttttaaactaccatta

SEQ ID NO: 634613 - DNA, 22 bp, Artificial Sequence
  chemically synthesized
atcttcaccagataatggtagt

SEQ ID NO: 634614 - DNA, 22 bp, Artificial Sequence
  chemically synthesized
catcttcaccagataatggtag

SEQ ID NO: 634615 - DNA, 22 bp, Artificial Sequence
  chemically synthesized
gcggttttaaactaccattatc

SEQ ID NO: 634616 - DNA, 22 bp, Artificial Sequence
  chemically synthesized
cggttttaaactaccattatct

SEQ ID NO: 634617 - DNA, 22 bp, Artificial Sequence
  chemically synthesized
atttcatcttcaccagataatg

SEQ ID NO: 634618 - DNA, 22 bp, Artificial Sequence
  chemically synthesized
taaactaccattatctggtgaa

SEQ ID NO: 634619 - DNA, 22 bp, Artificial Sequence
  chemically synthesized
attcatttcatcttcaccagat

SEQ ID NO: 634620 - DNA, 22 bp, Artificial Sequence
  chemically synthesized
aaactaccattatctggtgaag

SEQ ID NO: 634621 - DNA, 22 bp, Artificial Sequence
  chemically synthesized
cattcatttcatcttcaccaga

SEQ ID NO: 634622 - DNA, 22 bp, Artificial Sequence
  chemically synthesized
aactaccattatctggtgaaga

SEQ ID NO: 634623 - DNA, 22 bp, Artificial Sequence
  chemically synthesized
ccattatctggtgaagatgaaa

SEQ ID NO: 634624 - DNA, 22 bp, Artificial Sequence
  chemically synthesized
gtagtatttcattcatttcatc

SEQ ID NO: 634625 - DNA, 22 bp, Artificial Sequence
  chemically synthesized
ggtagtatttcattcatttcat

SEQ ID NO: 634626 - DNA, 22 bp, Artificial Sequence
  chemically synthesized
tctggtgaagatgaaatgaatg

SEQ ID NO: 634627 - DNA, 22 bp, Artificial Sequence
  chemically synthesized
ttggtagtatttcattcatttc

SEQ ID NO: 634628 - DNA, 22 bp, Artificial Sequence
  chemically synthesized
gtgaagatgaaatgaatgaaat

SEQ ID NO: 634629 - DNA, 22 bp, Artificial Sequence
  chemically synthesized
atcctcttggtagtatttcatt

SEQ ID NO: 634630 - DNA, 22 bp, Artificial Sequence
  chemically synthesized
gatcctcttggtagtatttcat

SEQ ID NO: 634631 - DNA, 22 bp, Artificial Sequence
  chemically synthesized
tcaggatcttgatcctcttggt

SEQ ID NO: 634632 - DNA, 22 bp, Artificial Sequence
  chemically synthesized
cagttgtcaggatcttgatcct

SEQ ID NO: 634633 - DNA, 22 bp, Artificial Sequence
  chemically synthesized
ccaagaggatcaagatcctgac

SEQ ID NO: 634634 - DNA, 22 bp, Artificial Sequence
  chemically synthesized
acaactgcagggctgattacat

SEQ ID NO: 634635 - DNA, 22 bp, Artificial Sequence
  chemically synthesized
cagggctgattacatctctctg

SEQ ID NO: 634636 - DNA, 22 bp, Artificial Sequence
  chemically synthesized
catcagtaatgaaacagagaga

SEQ ID NO: 634637 - DNA, 22 bp, Artificial Sequence
  chemically synthesized
gcatcagtaatgaaacagagag

SEQ ID NO: 634638 - DNA, 22 bp, Artificial Sequence
  chemically synthesized
attacatctctctgtttcatta

SEQ ID NO: 634639 - DNA, 22 bp, Artificial Sequence
  chemically synthesized
catctctctgtttcattactga

SEQ ID NO: 634640 - DNA, 22 bp, Artificial Sequence
  chemically synthesized
cgcaaaaatttgcatcagtaat

SEQ ID NO: 634641 - DNA, 22 bp, Artificial Sequence
  chemically synthesized
tctgtttcattactgatgcaaa

SEQ ID NO: 634642 - DNA, 22 bp, Artificial Sequence
  chemically synthesized
tgtttcattactgatgcaaatt

SEQ ID NO: 634643 - DNA, 22 bp, Artificial Sequence
  chemically synthesized
ccagttccgcaaaaatttgcat

SEQ ID NO: 634644 - DNA, 22 bp, Artificial Sequence
  chemically synthesized
tttcattactgatgcaaatttt

SEQ ID NO: 634645 - DNA, 22 bp, Artificial Sequence
  chemically synthesized
cccagttccgcaaaaatttgca

SEQ ID NO: 634646 - DNA, 22 bp, Artificial Sequence
  chemically synthesized
cattactgatgcaaatttttgc

SEQ ID NO: 634647 - DNA, 22 bp, Artificial Sequence
  chemically synthesized
attactgatgcaaatttttgcg

SEQ ID NO: 634648 - DNA, 22 bp, Artificial Sequence
  chemically synthesized
atgtttcccagttccgcaaaaa

SEQ ID NO: 634649 - DNA, 22 bp, Artificial Sequence
  chemically synthesized
ctgatgcaaatttttgcggaac

SEQ ID NO: 634650 - DNA, 22 bp, Artificial Sequence
  chemically synthesized
atgcaaatttttgcggaactgg

SEQ ID NO: 634651 - DNA, 22 bp, Artificial Sequence
  chemically synthesized
aaaatgcctcatgtttcccagt

SEQ ID NO: 634652 - DNA, 22 bp, Artificial Sequence
  chemically synthesized
ttgcggaactgggaaacatgag

SEQ ID NO: 634653 - DNA, 22 bp, Artificial Sequence
  chemically synthesized
tgcggaactgggaaacatgagg

SEQ ID NO: 634654 - DNA, 22 bp, Artificial Sequence
  chemically synthesized
ccattaaaaatgcctcatgttt

SEQ ID NO: 634655 - DNA, 22 bp, Artificial Sequence
  chemically synthesized
gcggaactgggaaacatgaggc

SEQ ID NO: 634656 - DNA, 22 bp, Artificial Sequence
  chemically synthesized
cggaactgggaaacatgaggca

SEQ ID NO: 634657 - DNA, 22 bp, Artificial Sequence
  chemically synthesized
ctgccattaaaaatgcctcatg

SEQ ID NO: 634658 - DNA, 22 bp, Artificial Sequence
  chemically synthesized
actgccattaaaaatgcctcat

SEQ ID NO: 634659 - DNA, 22 bp, Artificial Sequence
  chemically synthesized
ggaaacatgaggcatttttaat

SEQ ID NO: 634660 - DNA, 22 bp, Artificial Sequence
  chemically synthesized
aagtggacttactgccattaaa

SEQ ID NO: 634661 - DNA, 22 bp, Artificial Sequence
  chemically synthesized
tcactgaagtggacttactgcc

SEQ ID NO: 634662 - DNA, 22 bp, Artificial Sequence
  chemically synthesized
ttaatggcagtaagtccacttc

SEQ ID NO: 634663 - DNA, 22 bp, Artificial Sequence
  chemically synthesized
taatggcagtaagtccacttca

SEQ ID NO: 634664 - DNA, 22 bp, Artificial Sequence
  chemically synthesized
aatggcagtaagtccacttcag

SEQ ID NO: 634665 - DNA, 22 bp, Artificial Sequence
  chemically synthesized
atggcagtaagtccacttcagt

SEQ ID NO: 634666 - DNA, 22 bp, Artificial Sequence
  chemically synthesized
agtgaggcatactgtcactgaa

SEQ ID NO: 634667 - DNA, 22 bp, Artificial Sequence
  chemically synthesized
ttcagtgaggcatactgtcact

SEQ ID NO: 634668 - DNA, 22 bp, Artificial Sequence
  chemically synthesized
attcagtgaggcatactgtcac

SEQ ID NO: 634669 - DNA, 22 bp, Artificial Sequence
  chemically synthesized
atttattcagtgaggcatactg

SEQ ID NO: 634670 - DNA, 22 bp, Artificial Sequence
  chemically synthesized
tgatttattcagtgaggcatac

SEQ ID NO: 634671 - DNA, 22 bp, Artificial Sequence
  chemically synthesized
cagtgacagtatgcctcactga

SEQ ID NO: 634672 - DNA, 22 bp, Artificial Sequence
  chemically synthesized
gttctgatttattcagtgaggc

SEQ ID NO: 634673 - DNA, 22 bp, Artificial Sequence
  chemically synthesized
agtgacagtatgcctcactgaa

SEQ ID NO: 634674 - DNA, 22 bp, Artificial Sequence
  chemically synthesized
ggttctgatttattcagtgagg

SEQ ID NO: 634675 - DNA, 22 bp, Artificial Sequence
  chemically synthesized
ttggttctgatttattcagtga

SEQ ID NO: 634676 - DNA, 22 bp, Artificial Sequence
  chemically synthesized
tcttggttctgatttattcagt

SEQ ID NO: 634677 - DNA, 22 bp, Artificial Sequence
  chemically synthesized
atgatgttctcttggttctgat

SEQ ID NO: 634678 - DNA, 22 bp, Artificial Sequence
  chemically synthesized
actgaataaatcagaaccaaga

SEQ ID NO: 634679 - DNA, 22 bp, Artificial Sequence
  chemically synthesized
aataaatcagaaccaagagaac

SEQ ID NO: 634680 - DNA, 22 bp, Artificial Sequence
  chemically synthesized
atgagcgtcgttcatgatgttc

SEQ ID NO: 634681 - DNA, 22 bp, Artificial Sequence
  chemically synthesized
acatcgatgttcatgagcgtcg

SEQ ID NO: 634682 - DNA, 22 bp, Artificial Sequence
  chemically synthesized
tcagaaatattaacatcgatgt

SEQ ID NO: 634683 - DNA, 22 bp, Artificial Sequence
  chemically synthesized
aactgtcagaaatattaacatc

SEQ ID NO: 634684 - DNA, 22 bp, Artificial Sequence
  chemically synthesized
atgaacatcgatgttaatattt

SEQ ID NO: 634685 - DNA, 22 bp, Artificial Sequence
  chemically synthesized
caatatgatgtaattaaactgt

SEQ ID NO: 634686 - DNA, 22 bp, Artificial Sequence
  chemically synthesized
atatttctgacagtttaattac

SEQ ID NO: 634687 - DNA, 22 bp, Artificial Sequence
  chemically synthesized
gagctccaatatgatgtaatta

SEQ ID NO: 634688 - DNA, 22 bp, Artificial Sequence
  chemically synthesized
ctgacagtttaattacatcata

SEQ ID NO: 634689 - DNA, 22 bp, Artificial Sequence
  chemically synthesized
ctagagctccaatatgatgtaa

SEQ ID NO: 634690 - DNA, 22 bp, Artificial Sequence
  chemically synthesized
tgacagtttaattacatcatat

SEQ ID NO: 634691 - DNA, 22 bp, Artificial Sequence
  chemically synthesized
acagtttaattacatcatattg

SEQ ID NO: 634692 - DNA, 22 bp, Artificial Sequence
  chemically synthesized
agttcctagagctccaatatga

SEQ ID NO: 634693 - DNA, 22 bp, Artificial Sequence
  chemically synthesized
aattacatcatattggagctct

SEQ ID NO: 634694 - DNA, 22 bp, Artificial Sequence
  chemically synthesized
attacatcatattggagctcta

SEQ ID NO: 634695 - DNA, 22 bp, Artificial Sequence
  chemically synthesized
catcatattggagctctaggaa

SEQ ID NO: 634696 - DNA, 22 bp, Artificial Sequence
  chemically synthesized
acacagtacaattgagttccta

SEQ ID NO: 634697 - DNA, 22 bp, Artificial Sequence
  chemically synthesized
aacacagtacaattgagttcct

SEQ ID NO: 634698 - DNA, 22 bp, Artificial Sequence
  chemically synthesized
taacacagtacaattgagttcc

SEQ ID NO: 634699 - DNA, 22 bp, Artificial Sequence
  chemically synthesized
gagctctaggaactcaattgta

SEQ ID NO: 634700 - DNA, 22 bp, Artificial Sequence
  chemically synthesized
aattttaacacagtacaattga

SEQ ID NO: 634701 - DNA, 22 bp, Artificial Sequence
  chemically synthesized
taggaactcaattgtactgtgt

SEQ ID NO: 634702 - DNA, 22 bp, Artificial Sequence
  chemically synthesized
tacctgaattttaacacagtac

SEQ ID NO: 634703 - DNA, 22 bp, Artificial Sequence
  chemically synthesized
ggaactcaattgtactgtgtta

SEQ ID NO: 634704 - DNA, 22 bp, Artificial Sequence
  chemically synthesized
aactgtacctgaattttaacac

SEQ ID NO: 634705 - DNA, 22 bp, Artificial Sequence
  chemically synthesized
aattgtactgtgttaaaattca

SEQ ID NO: 634706 - DNA, 22 bp, Artificial Sequence
  chemically synthesized
attgaactgtacctgaatttta

SEQ ID NO: 634707 - DNA, 22 bp, Artificial Sequence
  chemically synthesized
cattgaactgtacctgaatttt

SEQ ID NO: 634708 - DNA, 22 bp, Artificial Sequence
  chemically synthesized
tactgtgttaaaattcaggtac

SEQ ID NO: 634709 - DNA, 22 bp, Artificial Sequence
  chemically synthesized
tgttaaaattcaggtacagttc

SEQ ID NO: 634710 - DNA, 22 bp, Artificial Sequence
  chemically synthesized
aaattcaggtacagttcaatga

SEQ ID NO: 634711 - DNA, 22 bp, Artificial Sequence
  chemically synthesized
aggtacagttcaatgaagtgac

SEQ ID NO: 634712 - DNA, 22 bp, Artificial Sequence
  chemically synthesized
aggaacaggaatgccagtcact

SEQ ID NO: 634713 - DNA, 22 bp, Artificial Sequence
  chemically synthesized
aatgaagtgactggcattcctg

SEQ ID NO: 634714 - DNA, 22 bp, Artificial Sequence
  chemically synthesized
aaataattcaggaacaggaatg

SEQ ID NO: 634715 - DNA, 22 bp, Artificial Sequence
  chemically synthesized
gaaataattcaggaacaggaat

SEQ ID NO: 634716 - DNA, 22 bp, Artificial Sequence
  chemically synthesized
tgaaataattcaggaacaggaa

SEQ ID NO: 634717 - DNA, 22 bp, Artificial Sequence
  chemically synthesized
atctttgaaataattcaggaac

SEQ ID NO: 634718 - DNA, 22 bp, Artificial Sequence
  chemically synthesized
gatctttgaaataattcaggaa

SEQ ID NO: 634719 - DNA, 22 bp, Artificial Sequence
  chemically synthesized
gcattcctgttcctgaattatt

SEQ ID NO: 634720 - DNA, 22 bp, Artificial Sequence
  chemically synthesized
taatttgatctttgaaataatt

SEQ ID NO: 634721 - DNA, 22 bp, Artificial Sequence
  chemically synthesized
ataatttgatctttgaaataat

SEQ ID NO: 634722 - DNA, 22 bp, Artificial Sequence
  chemically synthesized
tataatttgatctttgaaataa

SEQ ID NO: 634723 - DNA, 22 bp, Artificial Sequence
  chemically synthesized
ctgttcctgaattatttcaaag

SEQ ID NO: 634724 - DNA, 22 bp, Artificial Sequence
  chemically synthesized
ttcctgaattatttcaaagatc

SEQ ID NO: 634725 - DNA, 22 bp, Artificial Sequence
  chemically synthesized
tactttataatttgatctttga

SEQ ID NO: 634726 - DNA, 22 bp, Artificial Sequence
  chemically synthesized
atactttataatttgatctttg

SEQ ID NO: 634727 - DNA, 22 bp, Artificial Sequence
  chemically synthesized
ctgaattatttcaaagatcaaa

SEQ ID NO: 634728 - DNA, 22 bp, Artificial Sequence
  chemically synthesized
aattatttcaaagatcaaatta

SEQ ID NO: 634729 - DNA, 22 bp, Artificial Sequence
  chemically synthesized
ggtttatactttataatttgat

SEQ ID NO: 634730 - DNA, 22 bp, Artificial Sequence
  chemically synthesized
tttcaaagatcaaattataaag

SEQ ID NO: 634731 - DNA, 22 bp, Artificial Sequence
  chemically synthesized
caaagatcaaattataaagtat

SEQ ID NO: 634732 - DNA, 22 bp, Artificial Sequence
  chemically synthesized
aaagatcaaattataaagtata

SEQ ID NO: 634733 - DNA, 22 bp, Artificial Sequence
  chemically synthesized
acatcattaggtttatacttta

SEQ ID NO: 634734 - DNA, 22 bp, Artificial Sequence
  chemically synthesized
gctgacatcattaggtttatac

SEQ ID NO: 634735 - DNA, 22 bp, Artificial Sequence
  chemically synthesized
ggctgacatcattaggtttata

SEQ ID NO: 634736 - DNA, 22 bp, Artificial Sequence
  chemically synthesized
taaagtataaacctaatgatgt

SEQ ID NO: 634737 - DNA, 22 bp, Artificial Sequence
  chemically synthesized
gaaaaataaacttggctgacat

SEQ ID NO: 634738 - DNA, 22 bp, Artificial Sequence
  chemically synthesized
tctggaaaaataaacttggctg

SEQ ID NO: 634739 - DNA, 22 bp, Artificial Sequence
  chemically synthesized
atctggaaaaataaacttggct

SEQ ID NO: 634740 - DNA, 22 bp, Artificial Sequence
  chemically synthesized
atgatgtcagccaagtttattt

SEQ ID NO: 634741 - DNA, 22 bp, Artificial Sequence
  chemically synthesized
acagagagtttatctggaaaaa

SEQ ID NO: 634742 - DNA, 22 bp, Artificial Sequence
  chemically synthesized
aagactcacagagagtttatct

SEQ ID NO: 634743 - DNA, 22 bp, Artificial Sequence
  chemically synthesized
atttttccagataaactctctg

SEQ ID NO: 634744 - DNA, 22 bp, Artificial Sequence
  chemically synthesized
tttttccagataaactctctgt

SEQ ID NO: 634745 - DNA, 22 bp, Artificial Sequence
  chemically synthesized
atattaaagactcacagagagt

SEQ ID NO: 634746 - DNA, 22 bp, Artificial Sequence
  chemically synthesized
ttccagataaactctctgtgag

SEQ ID NO: 634747 - DNA, 22 bp, Artificial Sequence
  chemically synthesized
tccagataaactctctgtgagt

SEQ ID NO: 634748 - DNA, 22 bp, Artificial Sequence
  chemically synthesized
ccagataaactctctgtgagtc

SEQ ID NO: 634749 - DNA, 22 bp, Artificial Sequence
  chemically synthesized
cagataaactctctgtgagtct

SEQ ID NO: 634750 - DNA, 22 bp, Artificial Sequence
  chemically synthesized
gacactcatattaaagactcac

SEQ ID NO: 634751 - DNA, 22 bp, Artificial Sequence
  chemically synthesized
ggacactcatattaaagactca

SEQ ID NO: 634752 - DNA, 22 bp, Artificial Sequence
  chemically synthesized
tacttggacactcatattaaag

SEQ ID NO: 634753 - DNA, 22 bp, Artificial Sequence
  chemically synthesized
tctgtgagtctttaatatgagt

SEQ ID NO: 634754 - DNA, 22 bp, Artificial Sequence
  chemically synthesized
tgtgagtctttaatatgagtgt

SEQ ID NO: 634755 - DNA, 22 bp, Artificial Sequence
  chemically synthesized
tattatacttggacactcatat

SEQ ID NO: 634756 - DNA, 22 bp, Artificial Sequence
  chemically synthesized
gtattatacttggacactcata

SEQ ID NO: 634757 - DNA, 22 bp, Artificial Sequence
  chemically synthesized
tgagtctttaatatgagtgtcc

SEQ ID NO: 634758 - DNA, 22 bp, Artificial Sequence
  chemically synthesized
catttgtattatacttggacac

SEQ ID NO: 634759 - DNA, 22 bp, Artificial Sequence
  chemically synthesized
acatttgtattatacttggaca

SEQ ID NO: 634760 - DNA, 22 bp, Artificial Sequence
  chemically synthesized
tacatttgtattatacttggac

SEQ ID NO: 634761 - DNA, 22 bp, Artificial Sequence
  chemically synthesized
taatatgagtgtccaagtataa

SEQ ID NO: 634762 - DNA, 22 bp, Artificial Sequence
  chemically synthesized
aatatgagtgtccaagtataat

SEQ ID NO: 634763 - DNA, 22 bp, Artificial Sequence
  chemically synthesized
atatgagtgtccaagtataata

SEQ ID NO: 634764 - DNA, 22 bp, Artificial Sequence
  chemically synthesized
aagcaaagaagccaattttaca

SEQ ID NO: 634765 - DNA, 22 bp, Artificial Sequence
  chemically synthesized
cattaaagcaaagaagccaatt

SEQ ID NO: 634766 - DNA, 22 bp, Artificial Sequence
  chemically synthesized
ccattaaagcaaagaagccaat

SEQ ID NO: 634767 - DNA, 22 bp, Artificial Sequence
  chemically synthesized
tccattaaagcaaagaagccaa

SEQ ID NO: 634768 - DNA, 22 bp, Artificial Sequence
  chemically synthesized
aaagttttccattaaagcaaag

SEQ ID NO: 634769 - DNA, 22 bp, Artificial Sequence
  chemically synthesized
aaaagttttccattaaagcaaa

SEQ ID NO: 634770 - DNA, 22 bp, Artificial Sequence
  chemically synthesized
ccttaaaagttttccattaaag

SEQ ID NO: 634771 - DNA, 22 bp, Artificial Sequence
  chemically synthesized
gcttctttgctttaatggaaaa

SEQ ID NO: 634772 - DNA, 22 bp, Artificial Sequence
  chemically synthesized
tcactgccttaaaagttttcca

SEQ ID NO: 634773 - DNA, 22 bp, Artificial Sequence
  chemically synthesized
ctttgctttaatggaaaacttt

SEQ ID NO: 634774 - DNA, 22 bp, Artificial Sequence
  chemically synthesized
tttgctttaatggaaaactttt

SEQ ID NO: 634775 - DNA, 22 bp, Artificial Sequence
  chemically synthesized
tgctttaatggaaaacttttaa

SEQ ID NO: 634776 - DNA, 22 bp, Artificial Sequence
  chemically synthesized
gctttaatggaaaacttttaag

SEQ ID NO: 634777 - DNA, 22 bp, Artificial Sequence
  chemically synthesized
ctttaatggaaaacttttaagg

SEQ ID NO: 634778 - DNA, 22 bp, Artificial Sequence
  chemically synthesized
taatggaaaacttttaaggcag

SEQ ID NO: 634779 - DNA, 22 bp, Artificial Sequence
  chemically synthesized
aatggaaaacttttaaggcagt

SEQ ID NO: 634780 - DNA, 22 bp, Artificial Sequence
  chemically synthesized
atggaaaacttttaaggcagtg

SEQ ID NO: 634781 - DNA, 22 bp, Artificial Sequence
  chemically synthesized
aatggatacaattatcactgcc

SEQ ID NO: 634782 - DNA, 22 bp, Artificial Sequence
  chemically synthesized
ttaaggcagtgataattgtatc

SEQ ID NO: 634783 - DNA, 22 bp, Artificial Sequence
  chemically synthesized
taaggcagtgataattgtatcc

SEQ ID NO: 634784 - DNA, 22 bp, Artificial Sequence
  chemically synthesized
aaggcagtgataattgtatcca

SEQ ID NO: 634785 - DNA, 22 bp, Artificial Sequence
  chemically synthesized
aggcagtgataattgtatccat

SEQ ID NO: 634786 - DNA, 22 bp, Artificial Sequence
  chemically synthesized
aaaaaaatgtctgaatggatac

SEQ ID NO: 634787 - DNA, 22 bp, Artificial Sequence
  chemically synthesized
tatccattcagacatttttttg

SEQ ID NO: 634788 - DNA, 22 bp, Artificial Sequence
  chemically synthesized
gaatgtaataggcactcaaaaa

SEQ ID NO: 634789 - DNA, 22 bp, Artificial Sequence
  chemically synthesized
cctagaatgtaataggcactca

SEQ ID NO: 634790 - DNA, 22 bp, Artificial Sequence
  chemically synthesized
agacatttttttgagtgcctat

SEQ ID NO: 634791 - DNA, 22 bp, Artificial Sequence
  chemically synthesized
tactacctagaatgtaataggc

SEQ ID NO: 634792 - DNA, 22 bp, Artificial Sequence
  chemically synthesized
atactacctagaatgtaatagg

SEQ ID NO: 634793 - DNA, 22 bp, Artificial Sequence
  chemically synthesized
tatactacctagaatgtaatag

SEQ ID NO: 634794 - DNA, 22 bp, Artificial Sequence
  chemically synthesized
ttatactacctagaatgtaata

SEQ ID NO: 634795 - DNA, 22 bp, Artificial Sequence
  chemically synthesized
ttttgagtgcctattacattct

SEQ ID NO: 634796 - DNA, 22 bp, Artificial Sequence
  chemically synthesized
tttgagtgcctattacattcta

SEQ ID NO: 634797 - DNA, 22 bp, Artificial Sequence
  chemically synthesized
ttgagtgcctattacattctag

SEQ ID NO: 634798 - DNA, 22 bp, Artificial Sequence
  chemically synthesized
tttttatactacctagaatgta

SEQ ID NO: 634799 - DNA, 22 bp, Artificial Sequence
  chemically synthesized
tgagtgcctattacattctagg

SEQ ID NO: 634800 - DNA, 22 bp, Artificial Sequence
  chemically synthesized
gtttttatactacctagaatgt

SEQ ID NO: 634801 - DNA, 22 bp, Artificial Sequence
  chemically synthesized
gagtgcctattacattctaggt

SEQ ID NO: 634802 - DNA, 22 bp, Artificial Sequence
  chemically synthesized
agtgcctattacattctaggta

SEQ ID NO: 634803 - DNA, 22 bp, Artificial Sequence
  chemically synthesized
cttgtttttatactacctagaa

SEQ ID NO: 634804 - DNA, 22 bp, Artificial Sequence
  chemically synthesized
tacttgtttttatactacctag

SEQ ID NO: 634805 - DNA, 22 bp, Artificial Sequence
  chemically synthesized
ttacattctaggtagtataaaa

SEQ ID NO: 634806 - DNA, 22 bp, Artificial Sequence
  chemically synthesized
tactctacttgtttttatacta

SEQ ID NO: 634807 - DNA, 22 bp, Artificial Sequence
  chemically synthesized
cattctaggtagtataaaaaca

SEQ ID NO: 634808 - DNA, 22 bp, Artificial Sequence
  chemically synthesized
taggtagtataaaaacaagtag

SEQ ID NO: 634809 - DNA, 22 bp, Artificial Sequence
  chemically synthesized
ggtagtataaaaacaagtagag

SEQ ID NO: 634810 - DNA, 22 bp, Artificial Sequence
  chemically synthesized
gttttcttcttttctccatatt

SEQ ID NO: 634811 - DNA, 22 bp, Artificial Sequence
  chemically synthesized
agaaatcatgaaaatatggaga

SEQ ID NO: 634812 - DNA, 22 bp, Artificial Sequence
  chemically synthesized
ttttcttcttttctccatattt

SEQ ID NO: 634813 - DNA, 22 bp, Artificial Sequence
  chemically synthesized
gagaaatcatgaaaatatggag

SEQ ID NO: 634814 - DNA, 22 bp, Artificial Sequence
  chemically synthesized
tcttcttttctccatattttca

SEQ ID NO: 634815 - DNA, 22 bp, Artificial Sequence
  chemically synthesized
cttcttttctccatattttcat

SEQ ID NO: 634816 - DNA, 22 bp, Artificial Sequence
  chemically synthesized
ttcttttctccatattttcatg

SEQ ID NO: 634817 - DNA, 22 bp, Artificial Sequence
  chemically synthesized
cttttctccatattttcatgat

SEQ ID NO: 634818 - DNA, 22 bp, Artificial Sequence
  chemically synthesized
ttttctccatattttcatgatt

SEQ ID NO: 634819 - DNA, 22 bp, Artificial Sequence
  chemically synthesized
ttctccatattttcatgatttc

SEQ ID NO: 634820 - DNA, 22 bp, Artificial Sequence
  chemically synthesized
aaaccatcttgagaaatcatga

SEQ ID NO: 634821 - DNA, 22 bp, Artificial Sequence
  chemically synthesized
tctccatattttcatgatttct

SEQ ID NO: 634822 - DNA, 22 bp, Artificial Sequence
  chemically synthesized
ctccatattttcatgatttctc

SEQ ID NO: 634823 - DNA, 22 bp, Artificial Sequence
  chemically synthesized
tccatattttcatgatttctca

SEQ ID NO: 634824 - DNA, 22 bp, Artificial Sequence
  chemically synthesized
catattttcatgatttctcaag

SEQ ID NO: 634825 - DNA, 22 bp, Artificial Sequence
  chemically synthesized
tcatgatttctcaagatggttt

SEQ ID NO: 634826 - DNA, 22 bp, Artificial Sequence
  chemically synthesized
catgatttctcaagatggtttt

SEQ ID NO: 634827 - DNA, 22 bp, Artificial Sequence
  chemically synthesized
atgatttctcaagatggtttta

SEQ ID NO: 634828 - DNA, 22 bp, Artificial Sequence
  chemically synthesized
ctcaagatggttttaatgcatt

SEQ ID NO: 634829 - DNA, 22 bp, Artificial Sequence
  chemically synthesized
tcaagatggttttaatgcattg

SEQ ID NO: 634830 - DNA, 22 bp, Artificial Sequence
  chemically synthesized
aagatggttttaatgcattgct

SEQ ID NO: 634831 - DNA, 22 bp, Artificial Sequence
  chemically synthesized
taatgcattgctttttttctct

SEQ ID NO: 634832 - DNA, 22 bp, Artificial Sequence
  chemically synthesized
aatgcattgctttttttctctt

SEQ ID NO: 634833 - DNA, 22 bp, Artificial Sequence
  chemically synthesized
atgcattgctttttttctcttt

SEQ ID NO: 634834 - DNA, 22 bp, Artificial Sequence
  chemically synthesized
aaaaaaaaagaaaaagagaaaa

SEQ ID NO: 634835 - DNA, 22 bp, Artificial Sequence
  chemically synthesized
catctcaaaaaaaaagaaaaag

SEQ ID NO: 634836 - DNA, 22 bp, Artificial Sequence
  chemically synthesized
ctttttttctctttttcttttt

SEQ ID NO: 634837 - DNA, 22 bp, Artificial Sequence
  chemically synthesized
tttttctctttttctttttttt

SEQ ID NO: 634838 - DNA, 22 bp, Artificial Sequence
  chemically synthesized
ttttctctttttcttttttttt

SEQ ID NO: 634839 - DNA, 22 bp, Artificial Sequence
  chemically synthesized
tttctctttttctttttttttg

SEQ ID NO: 634840 - DNA, 22 bp, Artificial Sequence
  chemically synthesized
ttctctttttctttttttttga

SEQ ID NO: 634841 - DNA, 22 bp, Artificial Sequence
  chemically synthesized
tctctttttctttttttttgag

SEQ ID NO: 634842 - DNA, 22 bp, Artificial Sequence
  chemically synthesized
ctctttttctttttttttgaga

SEQ ID NO: 634843 - DNA, 22 bp, Artificial Sequence
  chemically synthesized
tctttttctttttttttgagat

SEQ ID NO: 634844 - DNA, 22 bp, Artificial Sequence
  chemically synthesized
tttttctttttttttgagatgg

SEQ ID NO: 634845 - DNA, 22 bp, Artificial Sequence
  chemically synthesized
tttctttttttttgagatggag

SEQ ID NO: 634846 - DNA, 22 bp, Artificial Sequence
  chemically synthesized
ttctttttttttgagatggagt

SEQ ID NO: 634847 - DNA, 22 bp, Artificial Sequence
  chemically synthesized
tctttttttttgagatggagtc

SEQ ID NO: 634848 - DNA, 22 bp, Artificial Sequence
  chemically synthesized
ctttttttttgagatggagtct

SEQ ID NO: 634849 - DNA, 22 bp, Artificial Sequence
  chemically synthesized
ggtgacagagcaagactccatc

SEQ ID NO: 634850 - DNA, 22 bp, Artificial Sequence
  chemically synthesized
tttttttttgagatggagtctt

SEQ ID NO: 634851 - DNA, 22 bp, Artificial Sequence
  chemically synthesized
tttttttgagatggagtcttgc

SEQ ID NO: 634852 - DNA, 22 bp, Artificial Sequence
  chemically synthesized
ttttttgagatggagtcttgct

SEQ ID NO: 634853 - DNA, 22 bp, Artificial Sequence
  chemically synthesized
tttttgagatggagtcttgctc

SEQ ID NO: 634854 - DNA, 22 bp, Artificial Sequence
  chemically synthesized
ttttgagatggagtcttgctct

SEQ ID NO: 634855 - DNA, 22 bp, Artificial Sequence
  chemically synthesized
tttgagatggagtcttgctctg

SEQ ID NO: 634856 - DNA, 22 bp, Artificial Sequence
  chemically synthesized
cagcctgggtgacagagcaaga

SEQ ID NO: 634857 - DNA, 22 bp, Artificial Sequence
  chemically synthesized
ttgagatggagtcttgctctgt

SEQ ID NO: 634858 - DNA, 22 bp, Artificial Sequence
  chemically synthesized
tgagatggagtcttgctctgtc

SEQ ID NO: 634859 - DNA, 22 bp, Artificial Sequence
  chemically synthesized
gagatggagtcttgctctgtca

SEQ ID NO: 634860 - DNA, 22 bp, Artificial Sequence
  chemically synthesized
agatggagtcttgctctgtcac

SEQ ID NO: 634861 - DNA, 22 bp, Artificial Sequence
  chemically synthesized
cactccagcctgggtgacagag

SEQ ID NO: 634862 - DNA, 22 bp, Artificial Sequence
  chemically synthesized
caccactgcactccagcctggg

SEQ ID NO: 634863 - DNA, 22 bp, Artificial Sequence
  chemically synthesized
gctctgtcacccaggctggagt

SEQ ID NO: 634864 - DNA, 22 bp, Artificial Sequence
  chemically synthesized
ctctgtcacccaggctggagtg

SEQ ID NO: 634865 - DNA, 22 bp, Artificial Sequence
  chemically synthesized
tgtcacccaggctggagtgcag

SEQ ID NO: 634866 - DNA, 22 bp, Artificial Sequence
  chemically synthesized
tcacccaggctggagtgcagtg

SEQ ID NO: 634867 - DNA, 22 bp, Artificial Sequence
  chemically synthesized
gccgagattccaccactgcact

SEQ ID NO: 634868 - DNA, 22 bp, Artificial Sequence
  chemically synthesized
cagctagccgagattccaccac

SEQ ID NO: 634869 - DNA, 22 bp, Artificial Sequence
  chemically synthesized
gagtgcagtggtggaatctcgg

SEQ ID NO: 634870 - DNA, 22 bp, Artificial Sequence
  chemically synthesized
aacccggaaggcagaggttgca

SEQ ID NO: 634871 - DNA, 22 bp, Artificial Sequence
  chemically synthesized
gaacccggaaggcagaggttgc

SEQ ID NO: 634872 - DNA, 22 bp, Artificial Sequence
  chemically synthesized
ggctagctgcaacctctgcctt

SEQ ID NO: 634873 - DNA, 22 bp, Artificial Sequence
  chemically synthesized
gctgcaacctctgccttccggg

SEQ ID NO: 634874 - DNA, 22 bp, Artificial Sequence
  chemically synthesized
caacctctgccttccgggttca

SEQ ID NO: 634875 - DNA, 22 bp, Artificial Sequence
  chemically synthesized
aggcaggagaatcacttgaacc

SEQ ID NO: 634876 - DNA, 22 bp, Artificial Sequence
  chemically synthesized
tgccttccgggttcaagtgatt

SEQ ID NO: 634877 - DNA, 22 bp, Artificial Sequence
  chemically synthesized
ccttccgggttcaagtgattct

SEQ ID NO: 634878 - DNA, 22 bp, Artificial Sequence
  chemically synthesized
ccgggttcaagtgattctcctg

SEQ ID NO: 634879 - DNA, 22 bp, Artificial Sequence
  chemically synthesized
aggaggctgaggcaggagaatc

SEQ ID NO: 634880 - DNA, 22 bp, Artificial Sequence
  chemically synthesized
cgggttcaagtgattctcctgc

SEQ ID NO: 634881 - DNA, 22 bp, Artificial Sequence
  chemically synthesized
ctcaggaggctgaggcaggaga

SEQ ID NO: 634882 - DNA, 22 bp, Artificial Sequence
  chemically synthesized
aagtgattctcctgcctcagcc

SEQ ID NO: 634883 - DNA, 22 bp, Artificial Sequence
  chemically synthesized
tagtcccagctactcaggaggc

SEQ ID NO: 634884 - DNA, 22 bp, Artificial Sequence
  chemically synthesized
tcctgcctcagcctcctgagta

SEQ ID NO: 634885 - DNA, 22 bp, Artificial Sequence
  chemically synthesized
ctgcctcagcctcctgagtagc

SEQ ID NO: 634886 - DNA, 22 bp, Artificial Sequence
  chemically synthesized
cctcagcctcctgagtagctgg

SEQ ID NO: 634887 - DNA, 22 bp, Artificial Sequence
  chemically synthesized
agcctcctgagtagctgggact

SEQ ID NO: 634888 - DNA, 22 bp, Artificial Sequence
  chemically synthesized
ctgagtagctgggactacaggc

SEQ ID NO: 634889 - DNA, 22 bp, Artificial Sequence
  chemically synthesized
agtagctgggactacaggcgcg

SEQ ID NO: 634890 - DNA, 22 bp, Artificial Sequence
  chemically synthesized
gccaggcgtggtggcacgcgcc

SEQ ID NO: 634891 - DNA, 22 bp, Artificial Sequence
  chemically synthesized
ggactacaggcgcgtgccacca

SEQ ID NO: 634892 - DNA, 22 bp, Artificial Sequence
  chemically synthesized
caggcgcgtgccaccacgcctg

SEQ ID NO: 634893 - DNA, 22 bp, Artificial Sequence
  chemically synthesized
aaaaatataaaaaattagccag

SEQ ID NO: 634894 - DNA, 22 bp, Artificial Sequence
  chemically synthesized
ctaaaaaatataaaaaattagc

SEQ ID NO: 634895 - DNA, 22 bp, Artificial Sequence
  chemically synthesized
tactaaaaaatataaaaaatta

SEQ ID NO: 634896 - DNA, 22 bp, Artificial Sequence
  chemically synthesized
tctctactaaaaaatataaaaa

SEQ ID NO: 634897 - DNA, 22 bp, Artificial Sequence
  chemically synthesized
gctaattttttatattttttag

SEQ ID NO: 634898 - DNA, 22 bp, Artificial Sequence
  chemically synthesized
attttttatattttttagtaga

SEQ ID NO: 634899 - DNA, 22 bp, Artificial Sequence
  chemically synthesized
tttatattttttagtagagaca

SEQ ID NO: 634900 - DNA, 22 bp, Artificial Sequence
  chemically synthesized
ttatattttttagtagagacag

SEQ ID NO: 634901 - DNA, 22 bp, Artificial Sequence
  chemically synthesized
tatattttttagtagagacagg

SEQ ID NO: 634902 - DNA, 22 bp, Artificial Sequence
  chemically synthesized
acacggtgaaaccctgtctcta

SEQ ID NO: 634903 - DNA, 22 bp, Artificial Sequence
  chemically synthesized
atattttttagtagagacaggg

SEQ ID NO: 634904 - DNA, 22 bp, Artificial Sequence
  chemically synthesized
tattttttagtagagacagggt

SEQ ID NO: 634905 - DNA, 22 bp, Artificial Sequence
  chemically synthesized
gctaacacggtgaaaccctgtc

SEQ ID NO: 634906 - DNA, 22 bp, Artificial Sequence
  chemically synthesized
tggctaacacggtgaaaccctg

SEQ ID NO: 634907 - DNA, 22 bp, Artificial Sequence
  chemically synthesized
tttagtagagacagggtttcac

SEQ ID NO: 634908 - DNA, 22 bp, Artificial Sequence
  chemically synthesized
ttagtagagacagggtttcacc

SEQ ID NO: 634909 - DNA, 22 bp, Artificial Sequence
  chemically synthesized
tagtagagacagggtttcaccg

SEQ ID NO: 634910 - DNA, 22 bp, Artificial Sequence
  chemically synthesized
ttctggctaacacggtgaaacc

SEQ ID NO: 634911 - DNA, 22 bp, Artificial Sequence
  chemically synthesized
agtagagacagggtttcaccgt

SEQ ID NO: 634912 - DNA, 22 bp, Artificial Sequence
  chemically synthesized
gtagagacagggtttcaccgtg

SEQ ID NO: 634913 - DNA, 22 bp, Artificial Sequence
  chemically synthesized
agactattctggctaacacggt

SEQ ID NO: 634914 - DNA, 22 bp, Artificial Sequence
  chemically synthesized
caccgtgttagccagaatagtc

SEQ ID NO: 634915 - DNA, 22 bp, Artificial Sequence
  chemically synthesized
accgtgttagccagaatagtct

SEQ ID NO: 634916 - DNA, 22 bp, Artificial Sequence
  chemically synthesized
gccagaatagtctcaatctcct

SEQ ID NO: 634917 - DNA, 22 bp, Artificial Sequence
  chemically synthesized
aatctcctgacctcgtgatcca

SEQ ID NO: 634918 - DNA, 22 bp, Artificial Sequence
  chemically synthesized
ggaggccgaggcaggtggatca

SEQ ID NO: 634919 - DNA, 22 bp, Artificial Sequence
  chemically synthesized
gggaggccgaggcaggtggatc

SEQ ID NO: 634920 - DNA, 22 bp, Artificial Sequence
  chemically synthesized
tgggaggccgaggcaggtggat

SEQ ID NO: 634921 - DNA, 22 bp, Artificial Sequence
  chemically synthesized
ctgacctcgtgatccacctgcc

SEQ ID NO: 634922 - DNA, 22 bp, Artificial Sequence
  chemically synthesized
acctcgtgatccacctgcctcg

SEQ ID NO: 634923 - DNA, 22 bp, Artificial Sequence
  chemically synthesized
gtgatccacctgcctcggcctc

SEQ ID NO: 634924 - DNA, 22 bp, Artificial Sequence
  chemically synthesized
taatcccagcactttgggaggc

SEQ ID NO: 634925 - DNA, 22 bp, Artificial Sequence
  chemically synthesized
cctcggcctcccaaagtgctgg

SEQ ID NO: 634926 - DNA, 22 bp, Artificial Sequence
  chemically synthesized
acgcctgtaatcccagcacttt

SEQ ID NO: 634927 - DNA, 22 bp, Artificial Sequence
  chemically synthesized
ggcctcccaaagtgctgggatt

SEQ ID NO: 634928 - DNA, 22 bp, Artificial Sequence
  chemically synthesized
ccaaagtgctgggattacaggc

SEQ ID NO: 634929 - DNA, 22 bp, Artificial Sequence
  chemically synthesized
ggcgtggtggctcacgcctgta

SEQ ID NO: 634930 - DNA, 22 bp, Artificial Sequence
  chemically synthesized
ggattacaggcgtgagccacca

SEQ ID NO: 634931 - DNA, 22 bp, Artificial Sequence
  chemically synthesized
caggcgtgagccaccacgccca

SEQ ID NO: 634932 - DNA, 22 bp, Artificial Sequence
  chemically synthesized
aaaagagatgagcctgggcgtg

SEQ ID NO: 634933 - DNA, 22 bp, Artificial Sequence
  chemically synthesized
aaaaagagatgagcctgggcgt

SEQ ID NO: 634934 - DNA, 22 bp, Artificial Sequence
  chemically synthesized
ttaaaaagagatgagcctgggc

SEQ ID NO: 634935 - DNA, 22 bp, Artificial Sequence
  chemically synthesized
gattcttaaaaagagatgagcc

SEQ ID NO: 634936 - DNA, 22 bp, Artificial Sequence
  chemically synthesized
cgattcttaaaaagagatgagc

SEQ ID NO: 634937 - DNA, 22 bp, Artificial Sequence
  chemically synthesized
atttcgattcttaaaaagagat

SEQ ID NO: 634938 - DNA, 22 bp, Artificial Sequence
  chemically synthesized
atctctttttaagaatcgaaat

SEQ ID NO: 634939 - DNA, 22 bp, Artificial Sequence
  chemically synthesized
tttttaagaatcgaaatcagac

SEQ ID NO: 634940 - DNA, 22 bp, Artificial Sequence
  chemically synthesized
tttaagaatcgaaatcagacat

SEQ ID NO: 634941 - DNA, 22 bp, Artificial Sequence
  chemically synthesized
ttaagaatcgaaatcagacatc

SEQ ID NO: 634942 - DNA, 22 bp, Artificial Sequence
  chemically synthesized
atgcacatatgtgatgtctgat

SEQ ID NO: 634943 - DNA, 22 bp, Artificial Sequence
  chemically synthesized
taagaatcgaaatcagacatca

SEQ ID NO: 634944 - DNA, 22 bp, Artificial Sequence
  chemically synthesized
aagaatcgaaatcagacatcac

SEQ ID NO: 634945 - DNA, 22 bp, Artificial Sequence
  chemically synthesized
agaatcgaaatcagacatcaca

SEQ ID NO: 634946 - DNA, 22 bp, Artificial Sequence
  chemically synthesized
ctcatgcacatatgtgatgtct

SEQ ID NO: 634947 - DNA, 22 bp, Artificial Sequence
  chemically synthesized
tactcatgcacatatgtgatgt

SEQ ID NO: 634948 - DNA, 22 bp, Artificial Sequence
  chemically synthesized
ctactcatgcacatatgtgatg

SEQ ID NO: 634949 - DNA, 22 bp, Artificial Sequence
  chemically synthesized
acttctactcatgcacatatgt

SEQ ID NO: 634950 - DNA, 22 bp, Artificial Sequence
  chemically synthesized
attcacttctactcatgcacat

SEQ ID NO: 634951 - DNA, 22 bp, Artificial Sequence
  chemically synthesized
aatgagttgattcacttctact

SEQ ID NO: 634952 - DNA, 22 bp, Artificial Sequence
  chemically synthesized
caatgagttgattcacttctac

SEQ ID NO: 634953 - DNA, 22 bp, Artificial Sequence
  chemically synthesized
tcaatgagttgattcacttcta

SEQ ID NO: 634954 - DNA, 22 bp, Artificial Sequence
  chemically synthesized
ttcaatgagttgattcacttct

SEQ ID NO: 634955 - DNA, 22 bp, Artificial Sequence
  chemically synthesized
agcatttttcaatgagttgatt

SEQ ID NO: 634956 - DNA, 22 bp, Artificial Sequence
  chemically synthesized
ggcattaagcatttttcaatga

SEQ ID NO: 634957 - DNA, 22 bp, Artificial Sequence
  chemically synthesized
attgaaaaatgcttaatgccta

SEQ ID NO: 634958 - DNA, 22 bp, Artificial Sequence
  chemically synthesized
acacagaaaatattaggcatta

SEQ ID NO: 634959 - DNA, 22 bp, Artificial Sequence
  chemically synthesized
tgacacagaaaatattaggcat

SEQ ID NO: 634960 - DNA, 22 bp, Artificial Sequence
  chemically synthesized
aaaaatgcttaatgcctaatat

SEQ ID NO: 634961 - DNA, 22 bp, Artificial Sequence
  chemically synthesized
caatatattctgacacagaaaa

SEQ ID NO: 634962 - DNA, 22 bp, Artificial Sequence
  chemically synthesized
aatgcctaatattttctgtgtc

SEQ ID NO: 634963 - DNA, 22 bp, Artificial Sequence
  chemically synthesized
acaatatattctgacacagaaa

SEQ ID NO: 634964 - DNA, 22 bp, Artificial Sequence
  chemically synthesized
atgcctaatattttctgtgtca

SEQ ID NO: 634965 - DNA, 22 bp, Artificial Sequence
  chemically synthesized
tacaatatattctgacacagaa

SEQ ID NO: 634966 - DNA, 22 bp, Artificial Sequence
  chemically synthesized
ttacaatatattctgacacaga

SEQ ID NO: 634967 - DNA, 22 bp, Artificial Sequence
  chemically synthesized
acttttacaatatattctgaca

SEQ ID NO: 634968 - DNA, 22 bp, Artificial Sequence
  chemically synthesized
aacttttacaatatattctgac

SEQ ID NO: 634969 - DNA, 22 bp, Artificial Sequence
  chemically synthesized
atattttctgtgtcagaatata

SEQ ID NO: 634970 - DNA, 22 bp, Artificial Sequence
  chemically synthesized
taacttttacaatatattctga

SEQ ID NO: 634971 - DNA, 22 bp, Artificial Sequence
  chemically synthesized
ttttaacttttacaatatattc

SEQ ID NO: 634972 - DNA, 22 bp, Artificial Sequence
  chemically synthesized
tctgtgtcagaatatattgtaa

SEQ ID NO: 634973 - DNA, 22 bp, Artificial Sequence
  chemically synthesized
ctgtgtcagaatatattgtaaa

SEQ ID NO: 634974 - DNA, 22 bp, Artificial Sequence
  chemically synthesized
gctgttttaacttttacaatat

SEQ ID NO: 634975 - DNA, 22 bp, Artificial Sequence
  chemically synthesized
tgtgtcagaatatattgtaaaa

SEQ ID NO: 634976 - DNA, 22 bp, Artificial Sequence
  chemically synthesized
agctgttttaacttttacaata

SEQ ID NO: 634977 - DNA, 22 bp, Artificial Sequence
  chemically synthesized
tgtcagaatatattgtaaaagt

SEQ ID NO: 634978 - DNA, 22 bp, Artificial Sequence
  chemically synthesized
atttagctgttttaacttttac

SEQ ID NO: 634979 - DNA, 22 bp, Artificial Sequence
  chemically synthesized
catttagctgttttaactttta

SEQ ID NO: 634980 - DNA, 22 bp, Artificial Sequence
  chemically synthesized
aggtttcatttagctgttttaa

SEQ ID NO: 634981 - DNA, 22 bp, Artificial Sequence
  chemically synthesized
caggtttcatttagctgtttta

SEQ ID NO: 634982 - DNA, 22 bp, Artificial Sequence
  chemically synthesized
acttcaggtttcatttagctgt

SEQ ID NO: 634983 - DNA, 22 bp, Artificial Sequence
  chemically synthesized
taaaagttaaaacagctaaatg

SEQ ID NO: 634984 - DNA, 22 bp, Artificial Sequence
  chemically synthesized
aacttcaggtttcatttagctg

SEQ ID NO: 634985 - DNA, 22 bp, Artificial Sequence
  chemically synthesized
taacttcaggtttcatttagct

SEQ ID NO: 634986 - DNA, 22 bp, Artificial Sequence
  chemically synthesized
ctttaacttcaggtttcattta

SEQ ID NO: 634987 - DNA, 22 bp, Artificial Sequence
  chemically synthesized
aaacagctaaatgaaacctgaa

SEQ ID NO: 634988 - DNA, 22 bp, Artificial Sequence
  chemically synthesized
caatggtattactttaacttca

SEQ ID NO: 634989 - DNA, 22 bp, Artificial Sequence
  chemically synthesized
aatgaaacctgaagttaaagta

SEQ ID NO: 634990 - DNA, 22 bp, Artificial Sequence
  chemically synthesized
gtatcaaatattacaatggtat

SEQ ID NO: 634991 - DNA, 22 bp, Artificial Sequence
  chemically synthesized
aagttaaagtaataccattgta

SEQ ID NO: 634992 - DNA, 22 bp, Artificial Sequence
  chemically synthesized
ggttagtatcaaatattacaat

SEQ ID NO: 634993 - DNA, 22 bp, Artificial Sequence
  chemically synthesized
aagtaataccattgtaatattt

SEQ ID NO: 634994 - DNA, 22 bp, Artificial Sequence
  chemically synthesized
aaaatctgggttagtatcaaat

SEQ ID NO: 634995 - DNA, 22 bp, Artificial Sequence
  chemically synthesized
aaaaatctgggttagtatcaaa

SEQ ID NO: 634996 - DNA, 22 bp, Artificial Sequence
  chemically synthesized
taaaaatctgggttagtatcaa

SEQ ID NO: 634997 - DNA, 22 bp, Artificial Sequence
  chemically synthesized
taatatttgatactaacccaga

SEQ ID NO: 634998 - DNA, 22 bp, Artificial Sequence
  chemically synthesized
aaaggcattttaaaaatctggg

SEQ ID NO: 634999 - DNA, 22 bp, Artificial Sequence
  chemically synthesized
aaaaggcattttaaaaatctgg

SEQ ID NO: 635000 - DNA, 22 bp, Artificial Sequence
  chemically synthesized
taaaaggcattttaaaaatctg

SEQ ID NO: 635001 - DNA, 22 bp, Artificial Sequence
  chemically synthesized
ttaaaaggcattttaaaaatct

SEQ ID NO: 635002 - DNA, 22 bp, Artificial Sequence
  chemically synthesized
gatactaacccagatttttaaa

SEQ ID NO: 635003 - DNA, 22 bp, Artificial Sequence
  chemically synthesized
atactaacccagatttttaaaa

SEQ ID NO: 635004 - DNA, 22 bp, Artificial Sequence
  chemically synthesized
tggtttttaaaaggcattttaa

SEQ ID NO: 635005 - DNA, 22 bp, Artificial Sequence
  chemically synthesized
gtggtttttaaaaggcatttta

SEQ ID NO: 635006 - DNA, 22 bp, Artificial Sequence
  chemically synthesized
acccagatttttaaaatgcctt

SEQ ID NO: 635007 - DNA, 22 bp, Artificial Sequence
  chemically synthesized
tgtggtttttaaaaggcatttt

SEQ ID NO: 635008 - DNA, 22 bp, Artificial Sequence
  chemically synthesized
ttgtggtttttaaaaggcattt

SEQ ID NO: 635009 - DNA, 22 bp, Artificial Sequence
  chemically synthesized
aacttttgtggtttttaaaagg

SEQ ID NO: 635010 - DNA, 22 bp, Artificial Sequence
  chemically synthesized
aaacttttgtggtttttaaaag

SEQ ID NO: 635011 - DNA, 22 bp, Artificial Sequence
  chemically synthesized
taaacttttgtggtttttaaaa

SEQ ID NO: 635012 - DNA, 22 bp, Artificial Sequence
  chemically synthesized
ttaaacttttgtggtttttaaa

SEQ ID NO: 635013 - DNA, 22 bp, Artificial Sequence
  chemically synthesized
ttaaaatgccttttaaaaacca

SEQ ID NO: 635014 - DNA, 22 bp, Artificial Sequence
  chemically synthesized
taaaatgccttttaaaaaccac

SEQ ID NO: 635015 - DNA, 22 bp, Artificial Sequence
  chemically synthesized
aaaatgccttttaaaaaccaca

SEQ ID NO: 635016 - DNA, 22 bp, Artificial Sequence
  chemically synthesized
tttttaaacttttgtggttttt

SEQ ID NO: 635017 - DNA, 22 bp, Artificial Sequence
  chemically synthesized
aaatgccttttaaaaaccacaa

SEQ ID NO: 635018 - DNA, 22 bp, Artificial Sequence
  chemically synthesized
ctgtttttaaacttttgtggtt

SEQ ID NO: 635019 - DNA, 22 bp, Artificial Sequence
  chemically synthesized
actgtttttaaacttttgtggt

SEQ ID NO: 635020 - DNA, 22 bp, Artificial Sequence
  chemically synthesized
ttaaaaaccacaaaagtttaaa

SEQ ID NO: 635021 - DNA, 22 bp, Artificial Sequence
  chemically synthesized
taaaaaccacaaaagtttaaaa

SEQ ID NO: 635022 - DNA, 22 bp, Artificial Sequence
  chemically synthesized
aaaaaccacaaaagtttaaaaa

SEQ ID NO: 635023 - DNA, 22 bp, Artificial Sequence
  chemically synthesized
aaaaccacaaaagtttaaaaac

SEQ ID NO: 635024 - DNA, 22 bp, Artificial Sequence
  chemically synthesized
aataaataaatgaatcttactg

SEQ ID NO: 635025 - DNA, 22 bp, Artificial Sequence
  chemically synthesized
gaataaataaatgaatcttact

SEQ ID NO: 635026 - DNA, 22 bp, Artificial Sequence
  chemically synthesized
aaaaacagtaagattcatttat

SEQ ID NO: 635027 - DNA, 22 bp, Artificial Sequence
  chemically synthesized
aaaacagtaagattcatttatt

SEQ ID NO: 635028 - DNA, 22 bp, Artificial Sequence
  chemically synthesized
ataaatatttgaataaataaat

SEQ ID NO: 635029 - DNA, 22 bp, Artificial Sequence
  chemically synthesized
aataaatatttgaataaataaa

SEQ ID NO: 635030 - DNA, 22 bp, Artificial Sequence
  chemically synthesized
taataaatatttgaataaataa

SEQ ID NO: 635031 - DNA, 22 bp, Artificial Sequence
  chemically synthesized
gattttaataaatatttgaata

SEQ ID NO: 635032 - DNA, 22 bp, Artificial Sequence
  chemically synthesized
atttatttattcaaatatttat

SEQ ID NO: 635033 - DNA, 22 bp, Artificial Sequence
  chemically synthesized
atttattcaaatatttattaaa

SEQ ID NO: 635034 - DNA, 22 bp, Artificial Sequence
  chemically synthesized
tttattcaaatatttattaaaa

SEQ ID NO: 635035 - DNA, 22 bp, Artificial Sequence
  chemically synthesized
attcaaatatttattaaaatcc

SEQ ID NO: 635036 - DNA, 22 bp, Artificial Sequence
  chemically synthesized
gcatatatagttggattttaat

SEQ ID NO: 635037 - DNA, 22 bp, Artificial Sequence
  chemically synthesized
ttcaaatatttattaaaatcca

SEQ ID NO: 635038 - DNA, 22 bp, Artificial Sequence
  chemically synthesized
aaatatttattaaaatccaact

SEQ ID NO: 635039 - DNA, 22 bp, Artificial Sequence
  chemically synthesized
aacagtgcctggcatatatagt

SEQ ID NO: 635040 - DNA, 22 bp, Artificial Sequence
  chemically synthesized
attaaaatccaactatatatgc

SEQ ID NO: 635041 - DNA, 22 bp, Artificial Sequence
  chemically synthesized
gaacagtgcctggcatatatag

SEQ ID NO: 635042 - DNA, 22 bp, Artificial Sequence
  chemically synthesized
ttaaaatccaactatatatgcc

SEQ ID NO: 635043 - DNA, 22 bp, Artificial Sequence
  chemically synthesized
aaatccaactatatatgccagg

SEQ ID NO: 635044 - DNA, 22 bp, Artificial Sequence
  chemically synthesized
aaccatttgaacagtgcctggc

SEQ ID NO: 635045 - DNA, 22 bp, Artificial Sequence
  chemically synthesized
ttcaaccatttgaacagtgcct

SEQ ID NO: 635046 - DNA, 22 bp, Artificial Sequence
  chemically synthesized
tatatgccaggcactgttcaaa

SEQ ID NO: 635047 - DNA, 22 bp, Artificial Sequence
  chemically synthesized
ttcaaatggttgaacagtgcct

SEQ ID NO: 635048 - DNA, 22 bp, Artificial Sequence
  chemically synthesized
aaatggttgaacagtgcctggc

SEQ ID NO: 635049 - DNA, 22 bp, Artificial Sequence
  chemically synthesized
agtgaacaatatgccaggcact

SEQ ID NO: 635050 - DNA, 22 bp, Artificial Sequence
  chemically synthesized
cagtgaacaatatgccaggcac

SEQ ID NO: 635051 - DNA, 22 bp, Artificial Sequence
  chemically synthesized
tatcttcagtgaacaatatgcc

SEQ ID NO: 635052 - DNA, 22 bp, Artificial Sequence
  chemically synthesized
aacagtgcctggcatattgttc

SEQ ID NO: 635053 - DNA, 22 bp, Artificial Sequence
  chemically synthesized
ctatatcttcagtgaacaatat

SEQ ID NO: 635054 - DNA, 22 bp, Artificial Sequence
  chemically synthesized
ttgctatatcttcagtgaacaa

SEQ ID NO: 635055 - DNA, 22 bp, Artificial Sequence
  chemically synthesized
attgctatatcttcagtgaaca

SEQ ID NO: 635056 - DNA, 22 bp, Artificial Sequence
  chemically synthesized
cttattgctatatcttcagtga

SEQ ID NO: 635057 - DNA, 22 bp, Artificial Sequence
  chemically synthesized
gcttattgctatatcttcagtg

SEQ ID NO: 635058 - DNA, 22 bp, Artificial Sequence
  chemically synthesized
gcatattgttcactgaagatat

SEQ ID NO: 635059 - DNA, 22 bp, Artificial Sequence
  chemically synthesized
tttgcttattgctatatcttca

SEQ ID NO: 635060 - DNA, 22 bp, Artificial Sequence
  chemically synthesized
gtttgcttattgctatatcttc

SEQ ID NO: 635061 - DNA, 22 bp, Artificial Sequence
  chemically synthesized
ttcactgaagatatagcaataa

SEQ ID NO: 635062 - DNA, 22 bp, Artificial Sequence
  chemically synthesized
actgaagatatagcaataagca

SEQ ID NO: 635063 - DNA, 22 bp, Artificial Sequence
  chemically synthesized
aagatatagcaataagcaaaca

SEQ ID NO: 635064 - DNA, 22 bp, Artificial Sequence
  chemically synthesized
acagagagagtgtgtgggtggg

SEQ ID NO: 635065 - DNA, 22 bp, Artificial Sequence
  chemically synthesized
cacagagagagtgtgtgggtgg

SEQ ID NO: 635066 - DNA, 22 bp, Artificial Sequence
  chemically synthesized
tgaatgcgagtttcacagagag

SEQ ID NO: 635067 - DNA, 22 bp, Artificial Sequence
  chemically synthesized
atgaatgcgagtttcacagaga

SEQ ID NO: 635068 - DNA, 22 bp, Artificial Sequence
  chemically synthesized
cttatgaatgcgagtttcacag

SEQ ID NO: 635069 - DNA, 22 bp, Artificial Sequence
  chemically synthesized
tgtgcctccttatgaatgcgag

SEQ ID NO: 635070 - DNA, 22 bp, Artificial Sequence
  chemically synthesized
tctctgtgaaactcgcattcat

SEQ ID NO: 635071 - DNA, 22 bp, Artificial Sequence
  chemically synthesized
tctgtgaaactcgcattcataa

SEQ ID NO: 635072 - DNA, 22 bp, Artificial Sequence
  chemically synthesized
tgtgaaactcgcattcataagg

SEQ ID NO: 635073 - DNA, 22 bp, Artificial Sequence
  chemically synthesized
agcctgtgtgcctccttatgaa

SEQ ID NO: 635074 - DNA, 22 bp, Artificial Sequence
  chemically synthesized
tgaaactcgcattcataaggag

SEQ ID NO: 635075 - DNA, 22 bp, Artificial Sequence
  chemically synthesized
ttaagcctgtgtgcctccttat

SEQ ID NO: 635076 - DNA, 22 bp, Artificial Sequence
  chemically synthesized
gttaagcctgtgtgcctcctta

SEQ ID NO: 635077 - DNA, 22 bp, Artificial Sequence
  chemically synthesized
cttgttaagcctgtgtgcctcc

SEQ ID NO: 635078 - DNA, 22 bp, Artificial Sequence
  chemically synthesized
acttgttaagcctgtgtgcctc

SEQ ID NO: 635079 - DNA, 22 bp, Artificial Sequence
  chemically synthesized
gcattcataaggaggcacacag

SEQ ID NO: 635080 - DNA, 22 bp, Artificial Sequence
  chemically synthesized
tttacttgttaagcctgtgtgc

SEQ ID NO: 635081 - DNA, 22 bp, Artificial Sequence
  chemically synthesized
atttacttgttaagcctgtgtg

SEQ ID NO: 635082 - DNA, 22 bp, Artificial Sequence
  chemically synthesized
ataaggaggcacacaggcttaa

SEQ ID NO: 635083 - DNA, 22 bp, Artificial Sequence
  chemically synthesized
cttatttacttgttaagcctgt

SEQ ID NO: 635084 - DNA, 22 bp, Artificial Sequence
  chemically synthesized
acttatttacttgttaagcctg

SEQ ID NO: 635085 - DNA, 22 bp, Artificial Sequence
  chemically synthesized
tatagtttacttatttacttgt

SEQ ID NO: 635086 - DNA, 22 bp, Artificial Sequence
  chemically synthesized
aagatacctatatagtttactt

SEQ ID NO: 635087 - DNA, 22 bp, Artificial Sequence
  chemically synthesized
aacaagtaaataagtaaactat

SEQ ID NO: 635088 - DNA, 22 bp, Artificial Sequence
  chemically synthesized
acaagtaaataagtaaactata

SEQ ID NO: 635089 - DNA, 22 bp, Artificial Sequence
  chemically synthesized
atcaccactcaagatacctata

SEQ ID NO: 635090 - DNA, 22 bp, Artificial Sequence
  chemically synthesized
agagtgttcatcaccactcaag

SEQ ID NO: 635091 - DNA, 22 bp, Artificial Sequence
  chemically synthesized
tataggtatcttgagtggtgat

SEQ ID NO: 635092 - DNA, 22 bp, Artificial Sequence
  chemically synthesized
ctcagagtgttcatcaccactc

SEQ ID NO: 635093 - DNA, 22 bp, Artificial Sequence
  chemically synthesized
tcctcagagtgttcatcaccac

SEQ ID NO: 635094 - DNA, 22 bp, Artificial Sequence
  chemically synthesized
gccctctcctcagagtgttcat

SEQ ID NO: 635095 - DNA, 22 bp, Artificial Sequence
  chemically synthesized
ctagccctctcctcagagtgtt

SEQ ID NO: 635096 - DNA, 22 bp, Artificial Sequence
  chemically synthesized
gagtggtgatgaacactctgag

SEQ ID NO: 635097 - DNA, 22 bp, Artificial Sequence
  chemically synthesized
gctagccctctcctcagagtgt

SEQ ID NO: 635098 - DNA, 22 bp, Artificial Sequence
  chemically synthesized
agtggtgatgaacactctgagg

SEQ ID NO: 635099 - DNA, 22 bp, Artificial Sequence
  chemically synthesized
tcccttgctagccctctcctca

SEQ ID NO: 635100 - DNA, 22 bp, Artificial Sequence
  chemically synthesized
attgtcccttgctagccctctc

SEQ ID NO: 635101 - DNA, 22 bp, Artificial Sequence
  chemically synthesized
tcattgtcccttgctagccctc

SEQ ID NO: 635102 - DNA, 22 bp, Artificial Sequence
  chemically synthesized
tgaggagagggctagcaaggga

SEQ ID NO: 635103 - DNA, 22 bp, Artificial Sequence
  chemically synthesized
atgactctcattgtcccttgct

SEQ ID NO: 635104 - DNA, 22 bp, Artificial Sequence
  chemically synthesized
aggagagggctagcaagggaca

SEQ ID NO: 635105 - DNA, 22 bp, Artificial Sequence
  chemically synthesized
tgatgactctcattgtcccttg

SEQ ID NO: 635106 - DNA, 22 bp, Artificial Sequence
  chemically synthesized
ctgatgactctcattgtccctt

SEQ ID NO: 635107 - DNA, 22 bp, Artificial Sequence
  chemically synthesized
tctgatgactctcattgtccct

SEQ ID NO: 635108 - DNA, 22 bp, Artificial Sequence
  chemically synthesized
cactttctgatgactctcattg

SEQ ID NO: 635109 - DNA, 22 bp, Artificial Sequence
  chemically synthesized
gcaagggacaatgagagtcatc

SEQ ID NO: 635110 - DNA, 22 bp, Artificial Sequence
  chemically synthesized
caagactccactttctgatgac

SEQ ID NO: 635111 - DNA, 22 bp, Artificial Sequence
  chemically synthesized
ccaagactccactttctgatga

SEQ ID NO: 635112 - DNA, 22 bp, Artificial Sequence
  chemically synthesized
atcaatgaggacttccaagact

SEQ ID NO: 635113 - DNA, 22 bp, Artificial Sequence
  chemically synthesized
catctcatcaatgaggacttcc

SEQ ID NO: 635114 - DNA, 22 bp, Artificial Sequence
  chemically synthesized
aactgcatctcatcaatgagga

SEQ ID NO: 635115 - DNA, 22 bp, Artificial Sequence
  chemically synthesized
ctcaactgcatctcatcaatga

SEQ ID NO: 635116 - DNA, 22 bp, Artificial Sequence
  chemically synthesized
gctcaactgcatctcatcaatg

SEQ ID NO: 635117 - DNA, 22 bp, Artificial Sequence
  chemically synthesized
tgctcaactgcatctcatcaat

SEQ ID NO: 635118 - DNA, 22 bp, Artificial Sequence
  chemically synthesized
ttgctcaactgcatctcatcaa

SEQ ID NO: 635119 - DNA, 22 bp, Artificial Sequence
  chemically synthesized
ggaagtcctcattgatgagatg

SEQ ID NO: 635120 - DNA, 22 bp, Artificial Sequence
  chemically synthesized
gaagtcctcattgatgagatgc

SEQ ID NO: 635121 - DNA, 22 bp, Artificial Sequence
  chemically synthesized
aagcttttgctcaactgcatct

SEQ ID NO: 635122 - DNA, 22 bp, Artificial Sequence
  chemically synthesized
aaagcttttgctcaactgcatc

SEQ ID NO: 635123 - DNA, 22 bp, Artificial Sequence
  chemically synthesized
ttaaagcttttgctcaactgca

SEQ ID NO: 635124 - DNA, 22 bp, Artificial Sequence
  chemically synthesized
attgatgagatgcagttgagca

SEQ ID NO: 635125 - DNA, 22 bp, Artificial Sequence
  chemically synthesized
atgagatgcagttgagcaaaag

SEQ ID NO: 635126 - DNA, 22 bp, Artificial Sequence
  chemically synthesized
cagttcttaaagcttttgctca

SEQ ID NO: 635127 - DNA, 22 bp, Artificial Sequence
  chemically synthesized
ataccctccagttcttaaagct

SEQ ID NO: 635128 - DNA, 22 bp, Artificial Sequence
  chemically synthesized
agcaaaagctttaagaactgga

SEQ ID NO: 635129 - DNA, 22 bp, Artificial Sequence
  chemically synthesized
tgcaactcataccctccagttc

SEQ ID NO: 635130 - DNA, 22 bp, Artificial Sequence
  chemically synthesized
gtgcaactcataccctccagtt

SEQ ID NO: 635131 - DNA, 22 bp, Artificial Sequence
  chemically synthesized
taagaactggagggtatgagtt

SEQ ID NO: 635132 - DNA, 22 bp, Artificial Sequence
  chemically synthesized
aaatacttgtgcaactcatacc

SEQ ID NO: 635133 - DNA, 22 bp, Artificial Sequence
  chemically synthesized
aagaactggagggtatgagttg

SEQ ID NO: 635134 - DNA, 22 bp, Artificial Sequence
  chemically synthesized
agaactggagggtatgagttgc

SEQ ID NO: 635135 - DNA, 22 bp, Artificial Sequence
  chemically synthesized
cctcaaatacttgtgcaactca

SEQ ID NO: 635136 - DNA, 22 bp, Artificial Sequence
  chemically synthesized
ccctcaaatacttgtgcaactc

SEQ ID NO: 635137 - DNA, 22 bp, Artificial Sequence
  chemically synthesized
tccctcaaatacttgtgcaact

SEQ ID NO: 635138 - DNA, 22 bp, Artificial Sequence
  chemically synthesized
ttccctcaaatacttgtgcaac

SEQ ID NO: 635139 - DNA, 22 bp, Artificial Sequence
  chemically synthesized
gagggtatgagttgcacaagta

SEQ ID NO: 635140 - DNA, 22 bp, Artificial Sequence
  chemically synthesized
gagcacttttccctcaaatact

SEQ ID NO: 635141 - DNA, 22 bp, Artificial Sequence
  chemically synthesized
tctggagcacttttccctcaaa

SEQ ID NO: 635142 - DNA, 22 bp, Artificial Sequence
  chemically synthesized
tgtctggagcacttttccctca

SEQ ID NO: 635143 - DNA, 22 bp, Artificial Sequence
  chemically synthesized
ctgtctggagcacttttccctc

SEQ ID NO: 635144 - DNA, 22 bp, Artificial Sequence
  chemically synthesized
cacaagtatttgagggaaaagt

SEQ ID NO: 635145 - DNA, 22 bp, Artificial Sequence
  chemically synthesized
ccaatccttctgtctggagcac

SEQ ID NO: 635146 - DNA, 22 bp, Artificial Sequence
  chemically synthesized
gccaatccttctgtctggagca

SEQ ID NO: 635147 - DNA, 22 bp, Artificial Sequence
  chemically synthesized
gagggaaaagtgctccagacag

SEQ ID NO: 635148 - DNA, 22 bp, Artificial Sequence
  chemically synthesized
agggaaaagtgctccagacaga

SEQ ID NO: 635149 - DNA, 22 bp, Artificial Sequence
  chemically synthesized
catttgccaatccttctgtctg

SEQ ID NO: 635150 - DNA, 22 bp, Artificial Sequence
  chemically synthesized
gcatttgccaatccttctgtct

SEQ ID NO: 635151 - DNA, 22 bp, Artificial Sequence
  chemically synthesized
tgcatttgccaatccttctgtc

SEQ ID NO: 635152 - DNA, 22 bp, Artificial Sequence
  chemically synthesized
agagtctttgcatttgccaatc

SEQ ID NO: 635153 - DNA, 22 bp, Artificial Sequence
  chemically synthesized
cagacagaaggattggcaaatg

SEQ ID NO: 635154 - DNA, 22 bp, Artificial Sequence
  chemically synthesized
tcagagtctttgcatttgccaa

SEQ ID NO: 635155 - DNA, 22 bp, Artificial Sequence
  chemically synthesized
ctctcagagtctttgcatttgc

SEQ ID NO: 635156 - DNA, 22 bp, Artificial Sequence
  chemically synthesized
tcctctcagagtctttgcattt

SEQ ID NO: 635157 - DNA, 22 bp, Artificial Sequence
  chemically synthesized
gcaaatgcaaagactctgagag

SEQ ID NO: 635158 - DNA, 22 bp, Artificial Sequence
  chemically synthesized
aggaagccagtcacactctcct

SEQ ID NO: 635159 - DNA, 22 bp, Artificial Sequence
  chemically synthesized
gaggaagccagtcacactctcc

SEQ ID NO: 635160 - DNA, 22 bp, Artificial Sequence
  chemically synthesized
tgcttgaggaagccagtcacac

SEQ ID NO: 635161 - DNA, 22 bp, Artificial Sequence
  chemically synthesized
tgagaggagagtgtgactggct

SEQ ID NO: 635162 - DNA, 22 bp, Artificial Sequence
  chemically synthesized
ctgtgcttgaggaagccagtca

SEQ ID NO: 635163 - DNA, 22 bp, Artificial Sequence
  chemically synthesized
agaggagagtgtgactggcttc

SEQ ID NO: 635164 - DNA, 22 bp, Artificial Sequence
  chemically synthesized
gctgtgcttgaggaagccagtc

SEQ ID NO: 635165 - DNA, 22 bp, Artificial Sequence
  chemically synthesized
ttgctgtgcttgaggaagccag

SEQ ID NO: 635166 - DNA, 22 bp, Artificial Sequence
  chemically synthesized
cttgctgtgcttgaggaagcca

SEQ ID NO: 635167 - DNA, 22 bp, Artificial Sequence
  chemically synthesized
gacttcttgctgtgcttgagga

SEQ ID NO: 635168 - DNA, 22 bp, Artificial Sequence
  chemically synthesized
cattagacttcttgctgtgctt

SEQ ID NO: 635169 - DNA, 22 bp, Artificial Sequence
  chemically synthesized
gcttcctcaagcacagcaagaa

SEQ ID NO: 635170 - DNA, 22 bp, Artificial Sequence
  chemically synthesized
tctacattagacttcttgctgt

SEQ ID NO: 635171 - DNA, 22 bp, Artificial Sequence
  chemically synthesized
atctacattagacttcttgctg

SEQ ID NO: 635172 - DNA, 22 bp, Artificial Sequence
  chemically synthesized
tatctacattagacttcttgct

SEQ ID NO: 635173 - DNA, 22 bp, Artificial Sequence
  chemically synthesized
cctcaagcacagcaagaagtct

SEQ ID NO: 635174 - DNA, 22 bp, Artificial Sequence
  chemically synthesized
ctcaagcacagcaagaagtcta

SEQ ID NO: 635175 - DNA, 22 bp, Artificial Sequence
  chemically synthesized
ctttatctacattagacttctt

SEQ ID NO: 635176 - DNA, 22 bp, Artificial Sequence
  chemically synthesized
tgctttatctacattagacttc

SEQ ID NO: 635177 - DNA, 22 bp, Artificial Sequence
  chemically synthesized
aagcacagcaagaagtctaatg

SEQ ID NO: 635178 - DNA, 22 bp, Artificial Sequence
  chemically synthesized
actctgctttatctacattaga

SEQ ID NO: 635179 - DNA, 22 bp, Artificial Sequence
  chemically synthesized
ttcactctgctttatctacatt

SEQ ID NO: 635180 - DNA, 22 bp, Artificial Sequence
  chemically synthesized
gttcactctgctttatctacat

SEQ ID NO: 635181 - DNA, 22 bp, Artificial Sequence
  chemically synthesized
ttgttcactctgctttatctac

SEQ ID NO: 635182 - DNA, 22 bp, Artificial Sequence
  chemically synthesized
ccagctcttgttcactctgctt

SEQ ID NO: 635183 - DNA, 22 bp, Artificial Sequence
  chemically synthesized
cccagctcttgttcactctgct

SEQ ID NO: 635184 - DNA, 22 bp, Artificial Sequence
  chemically synthesized
tcccagctcttgttcactctgc

SEQ ID NO: 635185 - DNA, 22 bp, Artificial Sequence
  chemically synthesized
atgtagataaagcagagtgaac

SEQ ID NO: 635186 - DNA, 22 bp, Artificial Sequence
  chemically synthesized
ttttcccagctcttgttcactc

SEQ ID NO: 635187 - DNA, 22 bp, Artificial Sequence
  chemically synthesized
ggaaaacagtacttccctggcc

SEQ ID NO: 635188 - DNA, 22 bp, Artificial Sequence
  chemically synthesized
tgtggccaaatccgaatcccca

SEQ ID NO: 635189 - DNA, 22 bp, Artificial Sequence
  chemically synthesized
ccctggcctggggattcggatt

SEQ ID NO: 635190 - DNA, 22 bp, Artificial Sequence
  chemically synthesized
cctggcctggggattcggattt

SEQ ID NO: 635191 - DNA, 22 bp, Artificial Sequence
  chemically synthesized
gcctggggattcggatttggcc

SEQ ID NO: 635192 - DNA, 22 bp, Artificial Sequence
  chemically synthesized
caaagcaggttatgtggccaaa

SEQ ID NO: 635193 - DNA, 22 bp, Artificial Sequence
  chemically synthesized
ccaaagcaggttatgtggccaa

SEQ ID NO: 635194 - DNA, 22 bp, Artificial Sequence
  chemically synthesized
gggattcggatttggccacata

SEQ ID NO: 635195 - DNA, 22 bp, Artificial Sequence
  chemically synthesized
tccaaagcaggttatgtggcca

SEQ ID NO: 635196 - DNA, 22 bp, Artificial Sequence
  chemically synthesized
cattttccaaagcaggttatgt

SEQ ID NO: 635197 - DNA, 22 bp, Artificial Sequence
  chemically synthesized
ggatttggccacataacctgct

SEQ ID NO: 635198 - DNA, 22 bp, Artificial Sequence
  chemically synthesized
cattccattttccaaagcaggt

SEQ ID NO: 635199 - DNA, 22 bp, Artificial Sequence
  chemically synthesized
acattccattttccaaagcagg

SEQ ID NO: 635200 - DNA, 22 bp, Artificial Sequence
  chemically synthesized
ggccacataacctgctttggaa

SEQ ID NO: 635201 - DNA, 22 bp, Artificial Sequence
  chemically synthesized
gccacataacctgctttggaaa

SEQ ID NO: 635202 - DNA, 22 bp, Artificial Sequence
  chemically synthesized
tcatgcccgcttacattccatt

SEQ ID NO: 635203 - DNA, 22 bp, Artificial Sequence
  chemically synthesized
gtcatgcccgcttacattccat

SEQ ID NO: 635204 - DNA, 22 bp, Artificial Sequence
  chemically synthesized
tgtcatgcccgcttacattcca

SEQ ID NO: 635205 - DNA, 22 bp, Artificial Sequence
  chemically synthesized
ttgtcatgcccgcttacattcc

SEQ ID NO: 635206 - DNA, 22 bp, Artificial Sequence
  chemically synthesized
ctttggaaaatggaatgtaagc

SEQ ID NO: 635207 - DNA, 22 bp, Artificial Sequence
  chemically synthesized
cttttgtcatgcccgcttacat

SEQ ID NO: 635208 - DNA, 22 bp, Artificial Sequence
  chemically synthesized
tggaaaatggaatgtaagcggg

SEQ ID NO: 635209 - DNA, 22 bp, Artificial Sequence
  chemically synthesized
ggaaaatggaatgtaagcgggc

SEQ ID NO: 635210 - DNA, 22 bp, Artificial Sequence
  chemically synthesized
tacttttgtcatgcccgcttac

SEQ ID NO: 635211 - DNA, 22 bp, Artificial Sequence
  chemically synthesized
gaaaatggaatgtaagcgggca

SEQ ID NO: 635212 - DNA, 22 bp, Artificial Sequence
  chemically synthesized
agcctctacttttgtcatgccc

SEQ ID NO: 635213 - DNA, 22 bp, Artificial Sequence
  chemically synthesized
taagcctctacttttgtcatgc

SEQ ID NO: 635214 - DNA, 22 bp, Artificial Sequence
  chemically synthesized
agaatgtctttgactggttggg

SEQ ID NO: 635215 - DNA, 22 bp, Artificial Sequence
  chemically synthesized
gaatgtctttgactggttgggg

SEQ ID NO: 635216 - DNA, 22 bp, Artificial Sequence
  chemically synthesized
tgactggttggggttgcccgct

SEQ ID NO: 635217 - DNA, 22 bp, Artificial Sequence
  chemically synthesized
gactggttggggttgcccgctt

SEQ ID NO: 635218 - DNA, 22 bp, Artificial Sequence
  chemically synthesized
actggttggggttgcccgcttg

SEQ ID NO: 635219 - DNA, 22 bp, Artificial Sequence
  chemically synthesized
tgcacataaacacaagcgggca

SEQ ID NO: 635220 - DNA, 22 bp, Artificial Sequence
  chemically synthesized
gtgcacataaacacaagcgggc

SEQ ID NO: 635221 - DNA, 22 bp, Artificial Sequence
  chemically synthesized
ttgtgcacataaacacaagcgg

SEQ ID NO: 635222 - DNA, 22 bp, Artificial Sequence
  chemically synthesized
gttggggttgcccgcttgtgtt

SEQ ID NO: 635223 - DNA, 22 bp, Artificial Sequence
  chemically synthesized
cttgtgcacataaacacaagcg

SEQ ID NO: 635224 - DNA, 22 bp, Artificial Sequence
  chemically synthesized
gggttgcccgcttgtgtttatg

SEQ ID NO: 635225 - DNA, 22 bp, Artificial Sequence
  chemically synthesized
cccgcttgtgtttatgtgcaca

SEQ ID NO: 635226 - DNA, 22 bp, Artificial Sequence
  chemically synthesized
ggccatatgcttcttgtgcaca

SEQ ID NO: 635227 - DNA, 22 bp, Artificial Sequence
  chemically synthesized
cctgggccatatgcttcttgtg

SEQ ID NO: 635228 - DNA, 22 bp, Artificial Sequence
  chemically synthesized
gtgtttatgtgcacaagaagca

SEQ ID NO: 635229 - DNA, 22 bp, Artificial Sequence
  chemically synthesized
tgtttatgtgcacaagaagcat

SEQ ID NO: 635230 - DNA, 22 bp, Artificial Sequence
  chemically synthesized
atgtgcacaagaagcatatggc

SEQ ID NO: 635231 - DNA, 22 bp, Artificial Sequence
  chemically synthesized
tgtgcacaagaagcatatggcc

SEQ ID NO: 635232 - DNA, 22 bp, Artificial Sequence
  chemically synthesized
gcaagctacctgggccatatgc

SEQ ID NO: 635233 - DNA, 22 bp, Artificial Sequence
  chemically synthesized
ggctagcaagctacctgggcca

SEQ ID NO: 635234 - DNA, 22 bp, Artificial Sequence
  chemically synthesized
gggctagcaagctacctgggcc

SEQ ID NO: 635235 - DNA, 22 bp, Artificial Sequence
  chemically synthesized
ttgggctagcaagctacctggg

SEQ ID NO: 635236 - DNA, 22 bp, Artificial Sequence
  chemically synthesized
cttgggctagcaagctacctgg

SEQ ID NO: 635237 - DNA, 22 bp, Artificial Sequence
  chemically synthesized
atccttcttgggctagcaagct

SEQ ID NO: 635238 - DNA, 22 bp, Artificial Sequence
  chemically synthesized
tcatccttcttgggctagcaag

SEQ ID NO: 635239 - DNA, 22 bp, Artificial Sequence
  chemically synthesized
aacatgtctctcatccttcttg

SEQ ID NO: 635240 - DNA, 22 bp, Artificial Sequence
  chemically synthesized
ttcaacatgtctctcatccttc

SEQ ID NO: 635241 - DNA, 22 bp, Artificial Sequence
  chemically synthesized
gctagcccaagaaggatgagag

SEQ ID NO: 635242 - DNA, 22 bp, Artificial Sequence
  chemically synthesized
ctagcccaagaaggatgagaga

SEQ ID NO: 635243 - DNA, 22 bp, Artificial Sequence
  chemically synthesized
gcccaagaaggatgagagacat

SEQ ID NO: 635244 - DNA, 22 bp, Artificial Sequence
  chemically synthesized
aggtctgttcaacatgtctctc

SEQ ID NO: 635245 - DNA, 22 bp, Artificial Sequence
  chemically synthesized
ggttcaggtctgttcaacatgt

SEQ ID NO: 635246 - DNA, 22 bp, Artificial Sequence
  chemically synthesized
gggttcaggtctgttcaacatg

SEQ ID NO: 635247 - DNA, 22 bp, Artificial Sequence
  chemically synthesized
tggtttgggttcaggtctgttc

SEQ ID NO: 635248 - DNA, 22 bp, Artificial Sequence
  chemically synthesized
acaccaagttgtggtttgggtt

SEQ ID NO: 635249 - DNA, 22 bp, Artificial Sequence
  chemically synthesized
gacaccaagttgtggtttgggt

SEQ ID NO: 635250 - DNA, 22 bp, Artificial Sequence
  chemically synthesized
aacagacctgaacccaaaccac

SEQ ID NO: 635251 - DNA, 22 bp, Artificial Sequence
  chemically synthesized
gacttgacaccaagttgtggtt

SEQ ID NO: 635252 - DNA, 22 bp, Artificial Sequence
  chemically synthesized
aacccaaaccacaacttggtgt

SEQ ID NO: 635253 - DNA, 22 bp, Artificial Sequence
  chemically synthesized
gcaatcagctggacttgacacc

SEQ ID NO: 635254 - DNA, 22 bp, Artificial Sequence
  chemically synthesized
ctggcaatcagctggacttgac

SEQ ID NO: 635255 - DNA, 22 bp, Artificial Sequence
  chemically synthesized
gctggcaatcagctggacttga

SEQ ID NO: 635256 - DNA, 22 bp, Artificial Sequence
  chemically synthesized
tgctggcaatcagctggacttg

SEQ ID NO: 635257 - DNA, 22 bp, Artificial Sequence
  chemically synthesized
ttgctggcaatcagctggactt

SEQ ID NO: 635258 - DNA, 22 bp, Artificial Sequence
  chemically synthesized
aacttttgctggcaatcagctg

SEQ ID NO: 635259 - DNA, 22 bp, Artificial Sequence
  chemically synthesized
ggtgtcaagtccagctgattgc

SEQ ID NO: 635260 - DNA, 22 bp, Artificial Sequence
  chemically synthesized
gtgtcaagtccagctgattgcc

SEQ ID NO: 635261 - DNA, 22 bp, Artificial Sequence
  chemically synthesized
gctgaacttttgctggcaatca

SEQ ID NO: 635262 - DNA, 22 bp, Artificial Sequence
  chemically synthesized
ggctgaacttttgctggcaatc

SEQ ID NO: 635263 - DNA, 22 bp, Artificial Sequence
  chemically synthesized
tttggctgaacttttgctggca

SEQ ID NO: 635264 - DNA, 22 bp, Artificial Sequence
  chemically synthesized
ttgtttggctgaacttttgctg

SEQ ID NO: 635265 - DNA, 22 bp, Artificial Sequence
  chemically synthesized
attgccagcaaaagttcagcca

SEQ ID NO: 635266 - DNA, 22 bp, Artificial Sequence
  chemically synthesized
acgcatctgttgtttggctgaa

SEQ ID NO: 635267 - DNA, 22 bp, Artificial Sequence
  chemically synthesized
ccagcaaaagttcagccaaaca

SEQ ID NO: 635268 - DNA, 22 bp, Artificial Sequence
  chemically synthesized
attcacgcatctgttgtttggc

SEQ ID NO: 635269 - DNA, 22 bp, Artificial Sequence
  chemically synthesized
tcattcacgcatctgttgtttg

SEQ ID NO: 635270 - DNA, 22 bp, Artificial Sequence
  chemically synthesized
ctcattcacgcatctgttgttt

SEQ ID NO: 635271 - DNA, 22 bp, Artificial Sequence
  chemically synthesized
catatttctcattcacgcatct

SEQ ID NO: 635272 - DNA, 22 bp, Artificial Sequence
  chemically synthesized
agccaaacaacagatgcgtgaa

SEQ ID NO: 635273 - DNA, 22 bp, Artificial Sequence
  chemically synthesized
aagttgcatatttctcattcac

SEQ ID NO: 635274 - DNA, 22 bp, Artificial Sequence
  chemically synthesized
tcaagttgcatatttctcattc

SEQ ID NO: 635275 - DNA, 22 bp, Artificial Sequence
  chemically synthesized
cataacaaataaccacaaaatt

SEQ ID NO: 635276 - DNA, 22 bp, Artificial Sequence
  chemically synthesized
ctgcataacaaataaccacaaa

SEQ ID NO: 635277 - DNA, 22 bp, Artificial Sequence
  chemically synthesized
ttgctgcataacaaataaccac

SEQ ID NO: 635278 - DNA, 22 bp, Artificial Sequence
  chemically synthesized
gagaattttgtggttatttgtt

SEQ ID NO: 635279 - DNA, 22 bp, Artificial Sequence
  chemically synthesized
agaattttgtggttatttgtta

SEQ ID NO: 635280 - DNA, 22 bp, Artificial Sequence
  chemically synthesized
tgtggttatttgttatgcagca

SEQ ID NO: 635281 - DNA, 22 bp, Artificial Sequence
  chemically synthesized
gtggttatttgttatgcagcaa

SEQ ID NO: 635282 - DNA, 22 bp, Artificial Sequence
  chemically synthesized
tggttatttgttatgcagcaac

SEQ ID NO: 635283 - DNA, 22 bp, Artificial Sequence
  chemically synthesized
tttgttatgcagcaacagctga

SEQ ID NO: 635284 - DNA, 22 bp, Artificial Sequence
  chemically synthesized
gttatgcagcaacagctgactg

SEQ ID NO: 635285 - DNA, 22 bp, Artificial Sequence
  chemically synthesized
ttatgcagcaacagctgactga

SEQ ID NO: 635286 - DNA, 22 bp, Artificial Sequence
  chemically synthesized
tgcagcaacagctgactgatac

SEQ ID NO: 635287 - DNA, 22 bp, Artificial Sequence
  chemically synthesized
atgcccataatagtgtatcagt

SEQ ID NO: 635288 - DNA, 22 bp, Artificial Sequence
  chemically synthesized
catgcccataatagtgtatcag

SEQ ID NO: 635289 - DNA, 22 bp, Artificial Sequence
  chemically synthesized
tttcatgcccataatagtgtat

SEQ ID NO: 635290 - DNA, 22 bp, Artificial Sequence
  chemically synthesized
gtttcatgcccataatagtgta

SEQ ID NO: 635291 - DNA, 22 bp, Artificial Sequence
  chemically synthesized
gcttgtttcatgcccataatag

SEQ ID NO: 635292 - DNA, 22 bp, Artificial Sequence
  chemically synthesized
actgatacactattatgggcat

SEQ ID NO: 635293 - DNA, 22 bp, Artificial Sequence
  chemically synthesized
tatctggcttgtttcatgccca

SEQ ID NO: 635294 - DNA, 22 bp, Artificial Sequence
  chemically synthesized
atacactattatgggcatgaaa

SEQ ID NO: 635295 - DNA, 22 bp, Artificial Sequence
  chemically synthesized
ttatgggcatgaaacaagccag

SEQ ID NO: 635296 - DNA, 22 bp, Artificial Sequence
  chemically synthesized
tgggcatgaaacaagccagata

SEQ ID NO: 635297 - DNA, 22 bp, Artificial Sequence
  chemically synthesized
gacaagccataaatattatatc

SEQ ID NO: 635298 - DNA, 22 bp, Artificial Sequence
  chemically synthesized
catagtgtatgattagacaagc

SEQ ID NO: 635299 - DNA, 22 bp, Artificial Sequence
  chemically synthesized
tagctacatagtgtatgattag

SEQ ID NO: 635300 - DNA, 22 bp, Artificial Sequence
  chemically synthesized
atggcttgtctaatcatacact

SEQ ID NO: 635301 - DNA, 22 bp, Artificial Sequence
  chemically synthesized
tggcttgtctaatcatacacta

SEQ ID NO: 635302 - DNA, 22 bp, Artificial Sequence
  chemically synthesized
tgttgtagctacatagtgtatg

SEQ ID NO: 635303 - DNA, 22 bp, Artificial Sequence
  chemically synthesized
ttatgttgtagctacatagtgt

SEQ ID NO: 635304 - DNA, 22 bp, Artificial Sequence
  chemically synthesized
gtctaatcatacactatgtagc

SEQ ID NO: 635305 - DNA, 22 bp, Artificial Sequence
  chemically synthesized
tctaatcatacactatgtagct

SEQ ID NO: 635306 - DNA, 22 bp, Artificial Sequence
  chemically synthesized
atcatacactatgtagctacaa

SEQ ID NO: 635307 - DNA, 22 bp, Artificial Sequence
  chemically synthesized
atacacctattatgttgtagct

SEQ ID NO: 635308 - DNA, 22 bp, Artificial Sequence
  chemically synthesized
tgtagctacaacataataggtg

SEQ ID NO: 635309 - DNA, 22 bp, Artificial Sequence
  chemically synthesized
caacataataggtgtattaatc

SEQ ID NO: 635310 - DNA, 22 bp, Artificial Sequence
  chemically synthesized
tagcagtgtgaaaatggattaa

SEQ ID NO: 635311 - DNA, 22 bp, Artificial Sequence
  chemically synthesized
tatagcagtgtgaaaatggatt

SEQ ID NO: 635312 - DNA, 22 bp, Artificial Sequence
  chemically synthesized
aggtagtatctctatagcagtg

SEQ ID NO: 635313 - DNA, 22 bp, Artificial Sequence
  chemically synthesized
atccattttcacactgctatag

SEQ ID NO: 635314 - DNA, 22 bp, Artificial Sequence
  chemically synthesized
tcacactgctatagagatacta

SEQ ID NO: 635315 - DNA, 22 bp, Artificial Sequence
  chemically synthesized
cccagtctcaggtagtatctct

SEQ ID NO: 635316 - DNA, 22 bp, Artificial Sequence
  chemically synthesized
cacactgctatagagatactac

SEQ ID NO: 635317 - DNA, 22 bp, Artificial Sequence
  chemically synthesized
acactgctatagagatactacc

SEQ ID NO: 635318 - DNA, 22 bp, Artificial Sequence
  chemically synthesized
taaattacccagtctcaggtag

SEQ ID NO: 635319 - DNA, 22 bp, Artificial Sequence
  chemically synthesized
ctatagagatactacctgagac

SEQ ID NO: 635320 - DNA, 22 bp, Artificial Sequence
  chemically synthesized
ataaattacccagtctcaggta

SEQ ID NO: 635321 - DNA, 22 bp, Artificial Sequence
  chemically synthesized
tataaattacccagtctcaggt

SEQ ID NO: 635322 - DNA, 22 bp, Artificial Sequence
  chemically synthesized
tagagatactacctgagactgg

SEQ ID NO: 635323 - DNA, 22 bp, Artificial Sequence
  chemically synthesized
ctttataaattacccagtctca

SEQ ID NO: 635324 - DNA, 22 bp, Artificial Sequence
  chemically synthesized
cctttataaattacccagtctc

SEQ ID NO: 635325 - DNA, 22 bp, Artificial Sequence
  chemically synthesized
tcctttataaattacccagtct

SEQ ID NO: 635326 - DNA, 22 bp, Artificial Sequence
  chemically synthesized
tttcctttataaattacccagt

SEQ ID NO: 635327 - DNA, 22 bp, Artificial Sequence
  chemically synthesized
cctgagactgggtaatttataa

SEQ ID NO: 635328 - DNA, 22 bp, Artificial Sequence
  chemically synthesized
aacctctttcctttataaatta

SEQ ID NO: 635329 - DNA, 22 bp, Artificial Sequence
  chemically synthesized
agactgggtaatttataaagga

SEQ ID NO: 635330 - DNA, 22 bp, Artificial Sequence
  chemically synthesized
ggtaatttataaaggaaagagg

SEQ ID NO: 635331 - DNA, 22 bp, Artificial Sequence
  chemically synthesized
tgagtcaattaaacctctttcc

SEQ ID NO: 635332 - DNA, 22 bp, Artificial Sequence
  chemically synthesized
gaactgtgagtcaattaaacct

SEQ ID NO: 635333 - DNA, 22 bp, Artificial Sequence
  chemically synthesized
ataaaggaaagaggtttaattg

SEQ ID NO: 635334 - DNA, 22 bp, Artificial Sequence
  chemically synthesized
taaaggaaagaggtttaattga

SEQ ID NO: 635335 - DNA, 22 bp, Artificial Sequence
  chemically synthesized
acgcatctggaactgtgagtca

SEQ ID NO: 635336 - DNA, 22 bp, Artificial Sequence
  chemically synthesized
ctcacgcatctggaactgtgag

SEQ ID NO: 635337 - DNA, 22 bp, Artificial Sequence
  chemically synthesized
aattgactcacagttccagatg

SEQ ID NO: 635338 - DNA, 22 bp, Artificial Sequence
  chemically synthesized
attgactcacagttccagatgc

SEQ ID NO: 635339 - DNA, 22 bp, Artificial Sequence
  chemically synthesized
aggcctcctcacgcatctggaa

SEQ ID NO: 635340 - DNA, 22 bp, Artificial Sequence
  chemically synthesized
ctgaggcctcctcacgcatctg

SEQ ID NO: 635341 - DNA, 22 bp, Artificial Sequence
  chemically synthesized
actcacagttccagatgcgtga

SEQ ID NO: 635342 - DNA, 22 bp, Artificial Sequence
  chemically synthesized
acagttccagatgcgtgaggag

SEQ ID NO: 635343 - DNA, 22 bp, Artificial Sequence
  chemically synthesized
cagatgcgtgaggaggcctcag

SEQ ID NO: 635344 - DNA, 22 bp, Artificial Sequence
  chemically synthesized
taatcatgaggcctcctgaggc

SEQ ID NO: 635345 - DNA, 22 bp, Artificial Sequence
  chemically synthesized
ataatcatgaggcctcctgagg

SEQ ID NO: 635346 - DNA, 22 bp, Artificial Sequence
  chemically synthesized
aacttataatcatgaggcctcc

SEQ ID NO: 635347 - DNA, 22 bp, Artificial Sequence
  chemically synthesized
taaacttataatcatgaggcct

SEQ ID NO: 635348 - DNA, 22 bp, Artificial Sequence
  chemically synthesized
aggaggcctcatgattataagt

SEQ ID NO: 635349 - DNA, 22 bp, Artificial Sequence
  chemically synthesized
caccatgattctaaacttataa

SEQ ID NO: 635350 - DNA, 22 bp, Artificial Sequence
  chemically synthesized
ccaccatgattctaaacttata

SEQ ID NO: 635351 - DNA, 22 bp, Artificial Sequence
  chemically synthesized
ccttccaccatgattctaaact

SEQ ID NO: 635352 - DNA, 22 bp, Artificial Sequence
  chemically synthesized
gccttccaccatgattctaaac

SEQ ID NO: 635353 - DNA, 22 bp, Artificial Sequence
  chemically synthesized
tgccttccaccatgattctaaa

SEQ ID NO: 635354 - DNA, 22 bp, Artificial Sequence
  chemically synthesized
atgattataagtttagaatcat

SEQ ID NO: 635355 - DNA, 22 bp, Artificial Sequence
  chemically synthesized
ccctttgccttccaccatgatt

SEQ ID NO: 635356 - DNA, 22 bp, Artificial Sequence
  chemically synthesized
cccctttgccttccaccatgat

SEQ ID NO: 635357 - DNA, 22 bp, Artificial Sequence
  chemically synthesized
taagtttagaatcatggtggaa

SEQ ID NO: 635358 - DNA, 22 bp, Artificial Sequence
  chemically synthesized
cttcccctttgccttccaccat

SEQ ID NO: 635359 - DNA, 22 bp, Artificial Sequence
  chemically synthesized
gcttcccctttgccttccacca

SEQ ID NO: 635360 - DNA, 22 bp, Artificial Sequence
  chemically synthesized
agaatcatggtggaaggcaaag

SEQ ID NO: 635361 - DNA, 22 bp, Artificial Sequence
  chemically synthesized
gaatcatggtggaaggcaaagg

SEQ ID NO: 635362 - DNA, 22 bp, Artificial Sequence
  chemically synthesized
ccatgtaagaggtgccttgctt

SEQ ID NO: 635363 - DNA, 22 bp, Artificial Sequence
  chemically synthesized
ctgccatgtaagaggtgccttg

SEQ ID NO: 635364 - DNA, 22 bp, Artificial Sequence
  chemically synthesized
ctgctgccatgtaagaggtgcc

SEQ ID NO: 635365 - DNA, 22 bp, Artificial Sequence
  chemically synthesized
tcctgctgccatgtaagaggtg

SEQ ID NO: 635366 - DNA, 22 bp, Artificial Sequence
  chemically synthesized
tctcctgctgccatgtaagagg

SEQ ID NO: 635367 - DNA, 22 bp, Artificial Sequence
  chemically synthesized
tctctcctgctgccatgtaaga

SEQ ID NO: 635368 - DNA, 22 bp, Artificial Sequence
  chemically synthesized
tctctctcctgctgccatgtaa

SEQ ID NO: 635369 - DNA, 22 bp, Artificial Sequence
  chemically synthesized
tctctctctcctgctgccatgt

SEQ ID NO: 635370 - DNA, 22 bp, Artificial Sequence
  chemically synthesized
tctctctctctcctgctgccat

SEQ ID NO: 635371 - DNA, 22 bp, Artificial Sequence
  chemically synthesized
tctctctctctctcctgctgcc

SEQ ID NO: 635372 - DNA, 22 bp, Artificial Sequence
  chemically synthesized
tctctctctctctctcctgctg

SEQ ID NO: 635373 - DNA, 22 bp, Artificial Sequence
  chemically synthesized
tctctctctctctctctcctgc

SEQ ID NO: 635374 - DNA, 22 bp, Artificial Sequence
  chemically synthesized
ttacatggcagcaggagagaga

SEQ ID NO: 635375 - DNA, 22 bp, Artificial Sequence
  chemically synthesized
tctctctctctctctctctcct

SEQ ID NO: 635376 - DNA, 22 bp, Artificial Sequence
  chemically synthesized
acatggcagcaggagagagaga

SEQ ID NO: 635377 - DNA, 22 bp, Artificial Sequence
  chemically synthesized
tctctctctctctctctctctc

SEQ ID NO: 635378 - DNA, 22 bp, Artificial Sequence
  chemically synthesized
catggcagcaggagagagagag

SEQ ID NO: 635379 - DNA, 22 bp, Artificial Sequence
  chemically synthesized
tctctctctctctctctctctc

SEQ ID NO: 635380 - DNA, 22 bp, Artificial Sequence
  chemically synthesized
tctctctctctctctctctctc

SEQ ID NO: 635381 - DNA, 22 bp, Artificial Sequence
  chemically synthesized
tctctctctctctctctctctc

SEQ ID NO: 635382 - DNA, 22 bp, Artificial Sequence
  chemically synthesized
tctctctctctctctctctctc

SEQ ID NO: 635383 - DNA, 22 bp, Artificial Sequence
  chemically synthesized
tctctctctctctctctctctc

SEQ ID NO: 635384 - DNA, 22 bp, Artificial Sequence
  chemically synthesized
tctctctctctctctctctctc

SEQ ID NO: 635385 - DNA, 22 bp, Artificial Sequence
  chemically synthesized
tctctctctctctctctctctc

SEQ ID NO: 635386 - DNA, 22 bp, Artificial Sequence
  chemically synthesized
tctctctctctctctctctctc

SEQ ID NO: 635387 - DNA, 22 bp, Artificial Sequence
  chemically synthesized
tctctctctctctctctctctc

SEQ ID NO: 635388 - DNA, 22 bp, Artificial Sequence
  chemically synthesized
tctctctctctctctctctctc

SEQ ID NO: 635389 - DNA, 22 bp, Artificial Sequence
  chemically synthesized
tctctctctctctctctctctc

SEQ ID NO: 635390 - DNA, 22 bp, Artificial Sequence
  chemically synthesized
tctctctctctctctctctctc

SEQ ID NO: 635391 - DNA, 22 bp, Artificial Sequence
  chemically synthesized
tctctctctctctctctctctc

SEQ ID NO: 635392 - DNA, 22 bp, Artificial Sequence
  chemically synthesized
tctctctctctctctctctctc

SEQ ID NO: 635393 - DNA, 22 bp, Artificial Sequence
  chemically synthesized
tctctctctctctctctctctc

SEQ ID NO: 635394 - DNA, 22 bp, Artificial Sequence
  chemically synthesized
tctctctctctctctctctctc

SEQ ID NO: 635395 - DNA, 22 bp, Artificial Sequence
  chemically synthesized
tctctctctctctctctctctc

SEQ ID NO: 635396 - DNA, 22 bp, Artificial Sequence
  chemically synthesized
tctctctctctctctctctctc

SEQ ID NO: 635397 - DNA, 22 bp, Artificial Sequence
  chemically synthesized
tctctctctctctctctctctc

SEQ ID NO: 635398 - DNA, 22 bp, Artificial Sequence
  chemically synthesized
tctctctctctctctctctctc

SEQ ID NO: 635399 - DNA, 22 bp, Artificial Sequence
  chemically synthesized
ctctctctctctctctctctct

SEQ ID NO: 635400 - DNA, 22 bp, Artificial Sequence
  chemically synthesized
ccccttctctctctctctctct

SEQ ID NO: 635401 - DNA, 22 bp, Artificial Sequence
  chemically synthesized
cccccttctctctctctctctc

SEQ ID NO: 635402 - DNA, 22 bp, Artificial Sequence
  chemically synthesized
aagtgtgtggcacttccccctt

SEQ ID NO: 635403 - DNA, 22 bp, Artificial Sequence
  chemically synthesized
aaagtgtgtggcacttccccct

SEQ ID NO: 635404 - DNA, 22 bp, Artificial Sequence
  chemically synthesized
taaagtgtgtggcacttccccc

SEQ ID NO: 635405 - DNA, 22 bp, Artificial Sequence
  chemically synthesized
ttaaagtgtgtggcacttcccc

SEQ ID NO: 635406 - DNA, 22 bp, Artificial Sequence
  chemically synthesized
atggtttttaaagtgtgtggca

SEQ ID NO: 635407 - DNA, 22 bp, Artificial Sequence
  chemically synthesized
aggagagctgatggtttttaaa

SEQ ID NO: 635408 - DNA, 22 bp, Artificial Sequence
  chemically synthesized
tcaggagagctgatggttttta

SEQ ID NO: 635409 - DNA, 22 bp, Artificial Sequence
  chemically synthesized
taaaaaccatcagctctcctga

SEQ ID NO: 635410 - DNA, 22 bp, Artificial Sequence
  chemically synthesized
aaaaaccatcagctctcctgag

SEQ ID NO: 635411 - DNA, 22 bp, Artificial Sequence
  chemically synthesized
aaaaccatcagctctcctgaga

SEQ ID NO: 635412 - DNA, 22 bp, Artificial Sequence
  chemically synthesized
gtgatagtgagtgagttctcag

SEQ ID NO: 635413 - DNA, 22 bp, Artificial Sequence
  chemically synthesized
tcgtgatagtgagtgagttctc

SEQ ID NO: 635414 - DNA, 22 bp, Artificial Sequence
  chemically synthesized
ttctcgtgatagtgagtgagtt

SEQ ID NO: 635415 - DNA, 22 bp, Artificial Sequence
  chemically synthesized
tcctgagaactcactcactatc

SEQ ID NO: 635416 - DNA, 22 bp, Artificial Sequence
  chemically synthesized
ctgagaactcactcactatcac

SEQ ID NO: 635417 - DNA, 22 bp, Artificial Sequence
  chemically synthesized
agaactcactcactatcacgag

SEQ ID NO: 635418 - DNA, 22 bp, Artificial Sequence
  chemically synthesized
ccccatgctgttctcgtgatag

SEQ ID NO: 635419 - DNA, 22 bp, Artificial Sequence
  chemically synthesized
cccccatgctgttctcgtgata

SEQ ID NO: 635420 - DNA, 22 bp, Artificial Sequence
  chemically synthesized
tcccccatgctgttctcgtgat

SEQ ID NO: 635421 - DNA, 22 bp, Artificial Sequence
  chemically synthesized
actcactatcacgagaacagca

SEQ ID NO: 635422 - DNA, 22 bp, Artificial Sequence
  chemically synthesized
actatcacgagaacagcatggg

SEQ ID NO: 635423 - DNA, 22 bp, Artificial Sequence
  chemically synthesized
tcacgagaacagcatgggggaa

SEQ ID NO: 635424 - DNA, 22 bp, Artificial Sequence
  chemically synthesized
gatcatgaagaagttttccccc

SEQ ID NO: 635425 - DNA, 22 bp, Artificial Sequence
  chemically synthesized
atgggaggtgactggatcatga

SEQ ID NO: 635426 - DNA, 22 bp, Artificial Sequence
  chemically synthesized
cttcatgatccagtcacctccc

SEQ ID NO: 635427 - DNA, 22 bp, Artificial Sequence
  chemically synthesized
ttcatgatccagtcacctccca

SEQ ID NO: 635428 - DNA, 22 bp, Artificial Sequence
  chemically synthesized
catgatccagtcacctcccatc

SEQ ID NO: 635429 - DNA, 22 bp, Artificial Sequence
  chemically synthesized
atgatccagtcacctcccatca

SEQ ID NO: 635430 - DNA, 22 bp, Artificial Sequence
  chemically synthesized
taatccccacgtgtcaggggag

SEQ ID NO: 635431 - DNA, 22 bp, Artificial Sequence
  chemically synthesized
ccatcaggtccctcccctgaca

SEQ ID NO: 635432 - DNA, 22 bp, Artificial Sequence
  chemically synthesized
aaattgtaatccccacgtgtca

SEQ ID NO: 635433 - DNA, 22 bp, Artificial Sequence
  chemically synthesized
atctcaaattgtaatccccacg

SEQ ID NO: 635434 - DNA, 22 bp, Artificial Sequence
  chemically synthesized
ccctgacacgtggggattacaa

SEQ ID NO: 635435 - DNA, 22 bp, Artificial Sequence
  chemically synthesized
aatctcatctcaaattgtaatc

SEQ ID NO: 635436 - DNA, 22 bp, Artificial Sequence
  chemically synthesized
acacgtggggattacaatttga

SEQ ID NO: 635437 - DNA, 22 bp, Artificial Sequence
  chemically synthesized
ccacctaaatctcatctcaaat

SEQ ID NO: 635438 - DNA, 22 bp, Artificial Sequence
  chemically synthesized
tgttcccacctaaatctcatct

SEQ ID NO: 635439 - DNA, 22 bp, Artificial Sequence
  chemically synthesized
tgtgttcccacctaaatctcat

SEQ ID NO: 635440 - DNA, 22 bp, Artificial Sequence
  chemically synthesized
caatttgagatgagatttaggt

SEQ ID NO: 635441 - DNA, 22 bp, Artificial Sequence
  chemically synthesized
gctctgtgttcccacctaaatc

SEQ ID NO: 635442 - DNA, 22 bp, Artificial Sequence
  chemically synthesized
ggctctgtgttcccacctaaat

SEQ ID NO: 635443 - DNA, 22 bp, Artificial Sequence
  chemically synthesized
gagatgagatttaggtgggaac

SEQ ID NO: 635444 - DNA, 22 bp, Artificial Sequence
  chemically synthesized
agatgagatttaggtgggaaca

SEQ ID NO: 635445 - DNA, 22 bp, Artificial Sequence
  chemically synthesized
atatggtttggctctgtgttcc

SEQ ID NO: 635446 - DNA, 22 bp, Artificial Sequence
  chemically synthesized
ttaatatggtttggctctgtgt

SEQ ID NO: 635447 - DNA, 22 bp, Artificial Sequence
  chemically synthesized
aggtgggaacacagagccaaac

SEQ ID NO: 635448 - DNA, 22 bp, Artificial Sequence
  chemically synthesized
cctattaatatggtttggctct

SEQ ID NO: 635449 - DNA, 22 bp, Artificial Sequence
  chemically synthesized
ggtgggaacacagagccaaacc

SEQ ID NO: 635450 - DNA, 22 bp, Artificial Sequence
  chemically synthesized
aggttgcctattaatatggttt

SEQ ID NO: 635451 - DNA, 22 bp, Artificial Sequence
  chemically synthesized
gaggttgcctattaatatggtt

SEQ ID NO: 635452 - DNA, 22 bp, Artificial Sequence
  chemically synthesized
tgaggttgcctattaatatggt

SEQ ID NO: 635453 - DNA, 22 bp, Artificial Sequence
  chemically synthesized
gagtcagaaatattttgaggtt

SEQ ID NO: 635454 - DNA, 22 bp, Artificial Sequence
  chemically synthesized
ttagagtcagaaatattttgag

SEQ ID NO: 635455 - DNA, 22 bp, Artificial Sequence
  chemically synthesized
ataggcaacctcaaaatatttc

SEQ ID NO: 635456 - DNA, 22 bp, Artificial Sequence
  chemically synthesized
ttgttagagtcagaaatatttt

SEQ ID NO: 635457 - DNA, 22 bp, Artificial Sequence
  chemically synthesized
aaaatatttctgactctaacaa

SEQ ID NO: 635458 - DNA, 22 bp, Artificial Sequence
  chemically synthesized
tgatgacaggtattattgttag

SEQ ID NO: 635459 - DNA, 22 bp, Artificial Sequence
  chemically synthesized
gtgatgacaggtattattgtta

SEQ ID NO: 635460 - DNA, 22 bp, Artificial Sequence
  chemically synthesized
ctgactctaacaataatacctg

SEQ ID NO: 635461 - DNA, 22 bp, Artificial Sequence
  chemically synthesized
tgactctaacaataatacctgt

SEQ ID NO: 635462 - DNA, 22 bp, Artificial Sequence
  chemically synthesized
actctaacaataatacctgtca

SEQ ID NO: 635463 - DNA, 22 bp, Artificial Sequence
  chemically synthesized
taacaataatacctgtcatcac

SEQ ID NO: 635464 - DNA, 22 bp, Artificial Sequence
  chemically synthesized
acaataatacctgtcatcacaa

SEQ ID NO: 635465 - DNA, 22 bp, Artificial Sequence
  chemically synthesized
gtgatgaggggcttgtgatgac

SEQ ID NO: 635466 - DNA, 22 bp, Artificial Sequence
  chemically synthesized
ggtgatgaggggcttgtgatga

SEQ ID NO: 635467 - DNA, 22 bp, Artificial Sequence
  chemically synthesized
tggtgatgaggggcttgtgatg

SEQ ID NO: 635468 - DNA, 22 bp, Artificial Sequence
  chemically synthesized
ttggtgatgaggggcttgtgat

SEQ ID NO: 635469 - DNA, 22 bp, Artificial Sequence
  chemically synthesized
tttttggtgatgaggggcttgt

SEQ ID NO: 635470 - DNA, 22 bp, Artificial Sequence
  chemically synthesized
gtttttggtgatgaggggcttg

SEQ ID NO: 635471 - DNA, 22 bp, Artificial Sequence
  chemically synthesized
tgtttttggtgatgaggggctt

SEQ ID NO: 635472 - DNA, 22 bp, Artificial Sequence
  chemically synthesized
ttgtttttggtgatgaggggct

SEQ ID NO: 635473 - DNA, 22 bp, Artificial Sequence
  chemically synthesized
tcatcacaagcccctcatcacc

SEQ ID NO: 635474 - DNA, 22 bp, Artificial Sequence
  chemically synthesized
atcaccaaaaacaaaaacacct

SEQ ID NO: 635475 - DNA, 22 bp, Artificial Sequence
  chemically synthesized
aataagtgaaaaaagtgaaaag

SEQ ID NO: 635476 - DNA, 22 bp, Artificial Sequence
  chemically synthesized
ttgaataagtgaaaaaagtgaa

SEQ ID NO: 635477 - DNA, 22 bp, Artificial Sequence
  chemically synthesized
gttgaataagtgaaaaaagtga

SEQ ID NO: 635478 - DNA, 22 bp, Artificial Sequence
  chemically synthesized
ttgttgaataagtgaaaaaagt

SEQ ID NO: 635479 - DNA, 22 bp, Artificial Sequence
  chemically synthesized
cttgttgaataagtgaaaaaag

SEQ ID NO: 635480 - DNA, 22 bp, Artificial Sequence
  chemically synthesized
tcttgttgaataagtgaaaaaa

SEQ ID NO: 635481 - DNA, 22 bp, Artificial Sequence
  chemically synthesized
ttcacttttttcacttattcaa

SEQ ID NO: 635482 - DNA, 22 bp, Artificial Sequence
  chemically synthesized
agtattttcttgttgaataagt

SEQ ID NO: 635483 - DNA, 22 bp, Artificial Sequence
  chemically synthesized
tcacttttttcacttattcaac

SEQ ID NO: 635484 - DNA, 22 bp, Artificial Sequence
  chemically synthesized
cacttttttcacttattcaaca

SEQ ID NO: 635485 - DNA, 22 bp, Artificial Sequence
  chemically synthesized
acttttttcacttattcaacaa

SEQ ID NO: 635486 - DNA, 22 bp, Artificial Sequence
  chemically synthesized
gaactcagtattttcttgttga

SEQ ID NO: 635487 - DNA, 22 bp, Artificial Sequence
  chemically synthesized
ttttcacttattcaacaagaaa

SEQ ID NO: 635488 - DNA, 22 bp, Artificial Sequence
  chemically synthesized
tttcacttattcaacaagaaaa

SEQ ID NO: 635489 - DNA, 22 bp, Artificial Sequence
  chemically synthesized
ttcacttattcaacaagaaaat

SEQ ID NO: 635490 - DNA, 22 bp, Artificial Sequence
  chemically synthesized
tcacttattcaacaagaaaata

SEQ ID NO: 635491 - DNA, 22 bp, Artificial Sequence
  chemically synthesized
cacttattcaacaagaaaatac

SEQ ID NO: 635492 - DNA, 22 bp, Artificial Sequence
  chemically synthesized
acttattcaacaagaaaatact

SEQ ID NO: 635493 - DNA, 22 bp, Artificial Sequence
  chemically synthesized
attcaacaagaaaatactgagt

SEQ ID NO: 635494 - DNA, 22 bp, Artificial Sequence
  chemically synthesized
ttcaacaagaaaatactgagtt

SEQ ID NO: 635495 - DNA, 22 bp, Artificial Sequence
  chemically synthesized
gtgtgcaactggaactcagtat

SEQ ID NO: 635496 - DNA, 22 bp, Artificial Sequence
  chemically synthesized
tagtgtgcaactggaactcagt

SEQ ID NO: 635497 - DNA, 22 bp, Artificial Sequence
  chemically synthesized
aacaagaaaatactgagttcca

SEQ ID NO: 635498 - DNA, 22 bp, Artificial Sequence
  chemically synthesized
tgcaggtctctagtgtgcaact

SEQ ID NO: 635499 - DNA, 22 bp, Artificial Sequence
  chemically synthesized
agttccagttgcacactagaga

SEQ ID NO: 635500 - DNA, 22 bp, Artificial Sequence
  chemically synthesized
cagttgcacactagagacctgc

SEQ ID NO: 635501 - DNA, 22 bp, Artificial Sequence
  chemically synthesized
cacactagagacctgcacagcc

SEQ ID NO: 635502 - DNA, 22 bp, Artificial Sequence
  chemically synthesized
tgaagtagggataagggctgtg

SEQ ID NO: 635503 - DNA, 22 bp, Artificial Sequence
  chemically synthesized
gagacctgcacagcccttatcc

SEQ ID NO: 635504 - DNA, 22 bp, Artificial Sequence
  chemically synthesized
cacagcccttatccctacttca

SEQ ID NO: 635505 - DNA, 22 bp, Artificial Sequence
  chemically synthesized
agcaggcaatgaatctgtgaag

SEQ ID NO: 635506 - DNA, 22 bp, Artificial Sequence
  chemically synthesized
gagcaggcaatgaatctgtgaa

SEQ ID NO: 635507 - DNA, 22 bp, Artificial Sequence
  chemically synthesized
tttgagcaggcaatgaatctgt

SEQ ID NO: 635508 - DNA, 22 bp, Artificial Sequence
  chemically synthesized
atccctacttcacagattcatt

SEQ ID NO: 635509 - DNA, 22 bp, Artificial Sequence
  chemically synthesized
tccctacttcacagattcattg

SEQ ID NO: 635510 - DNA, 22 bp, Artificial Sequence
  chemically synthesized
cttcacagattcattgcctgct

SEQ ID NO: 635511 - DNA, 22 bp, Artificial Sequence
  chemically synthesized
cacagattcattgcctgctcaa

SEQ ID NO: 635512 - DNA, 22 bp, Artificial Sequence
  chemically synthesized
gcaatatgctatttgagcaggc

SEQ ID NO: 635513 - DNA, 22 bp, Artificial Sequence
  chemically synthesized
acagattcattgcctgctcaaa

SEQ ID NO: 635514 - DNA, 22 bp, Artificial Sequence
  chemically synthesized
attgcctgctcaaatagcatat

SEQ ID NO: 635515 - DNA, 22 bp, Artificial Sequence
  chemically synthesized
cctgctcaaatagcatattgct

SEQ ID NO: 635516 - DNA, 22 bp, Artificial Sequence
  chemically synthesized
ctcaaatagcatattgctagtc

SEQ ID NO: 635517 - DNA, 22 bp, Artificial Sequence
  chemically synthesized
aaatcccccaaagactagcaat

SEQ ID NO: 635518 - DNA, 22 bp, Artificial Sequence
  chemically synthesized
aaaatcccccaaagactagcaa

SEQ ID NO: 635519 - DNA, 22 bp, Artificial Sequence
  chemically synthesized
aaatagcatattgctagtcttt

SEQ ID NO: 635520 - DNA, 22 bp, Artificial Sequence
  chemically synthesized
agtttaaaatcccccaaagact

SEQ ID NO: 635521 - DNA, 22 bp, Artificial Sequence
  chemically synthesized
ctagtctttgggggattttaaa

SEQ ID NO: 635522 - DNA, 22 bp, Artificial Sequence
  chemically synthesized
ccatcaactaagtttaaaatcc

SEQ ID NO: 635523 - DNA, 22 bp, Artificial Sequence
  chemically synthesized
gtctttgggggattttaaactt

SEQ ID NO: 635524 - DNA, 22 bp, Artificial Sequence
  chemically synthesized
tgggggattttaaacttagttg

SEQ ID NO: 635525 - DNA, 22 bp, Artificial Sequence
  chemically synthesized
aagcattgccatcaactaagtt

SEQ ID NO: 635526 - DNA, 22 bp, Artificial Sequence
  chemically synthesized
gggggattttaaacttagttga

SEQ ID NO: 635527 - DNA, 22 bp, Artificial Sequence
  chemically synthesized
ggggattttaaacttagttgat

SEQ ID NO: 635528 - DNA, 22 bp, Artificial Sequence
  chemically synthesized
agtgttaaagcattgccatcaa

SEQ ID NO: 635529 - DNA, 22 bp, Artificial Sequence
  chemically synthesized
aagtgttaaagcattgccatca

SEQ ID NO: 635530 - DNA, 22 bp, Artificial Sequence
  chemically synthesized
taaacttagttgatggcaatgc

SEQ ID NO: 635531 - DNA, 22 bp, Artificial Sequence
  chemically synthesized
aaacttagttgatggcaatgct

SEQ ID NO: 635532 - DNA, 22 bp, Artificial Sequence
  chemically synthesized
aacttagttgatggcaatgctt

SEQ ID NO: 635533 - DNA, 22 bp, Artificial Sequence
  chemically synthesized
agttgatggcaatgctttaaca

SEQ ID NO: 635534 - DNA, 22 bp, Artificial Sequence
  chemically synthesized
gttgatggcaatgctttaacac

SEQ ID NO: 635535 - DNA, 22 bp, Artificial Sequence
  chemically synthesized
atggcaatgctttaacacttaa

SEQ ID NO: 635536 - DNA, 22 bp, Artificial Sequence
  chemically synthesized
gagtagagtcaagtttaagtgt

SEQ ID NO: 635537 - DNA, 22 bp, Artificial Sequence
  chemically synthesized
ggagtagagtcaagtttaagtg

SEQ ID NO: 635538 - DNA, 22 bp, Artificial Sequence
  chemically synthesized
taacacttaaacttgactctac

SEQ ID NO: 635539 - DNA, 22 bp, Artificial Sequence
  chemically synthesized
aacacttaaacttgactctact

SEQ ID NO: 635540 - DNA, 22 bp, Artificial Sequence
  chemically synthesized
acacttaaacttgactctactc

SEQ ID NO: 635541 - DNA, 22 bp, Artificial Sequence
  chemically synthesized
tggaaatcaccttggagtagag

SEQ ID NO: 635542 - DNA, 22 bp, Artificial Sequence
  chemically synthesized
gtggaaatcaccttggagtaga

SEQ ID NO: 635543 - DNA, 22 bp, Artificial Sequence
  chemically synthesized
aaacttgactctactccaaggt

SEQ ID NO: 635544 - DNA, 22 bp, Artificial Sequence
  chemically synthesized
aacttgactctactccaaggtg

SEQ ID NO: 635545 - DNA, 22 bp, Artificial Sequence
  chemically synthesized
gactctactccaaggtgatttc

SEQ ID NO: 635546 - DNA, 22 bp, Artificial Sequence
  chemically synthesized
tgcatgtttgtggaaatcacct

SEQ ID NO: 635547 - DNA, 22 bp, Artificial Sequence
  chemically synthesized
actctactccaaggtgatttcc

SEQ ID NO: 635548 - DNA, 22 bp, Artificial Sequence
  chemically synthesized
atgcatgtttgtggaaatcacc

SEQ ID NO: 635549 - DNA, 22 bp, Artificial Sequence
  chemically synthesized
tttatgcatgtttgtggaaatc

SEQ ID NO: 635550 - DNA, 22 bp, Artificial Sequence
  chemically synthesized
tactccaaggtgatttccacaa

SEQ ID NO: 635551 - DNA, 22 bp, Artificial Sequence
  chemically synthesized
ctccaaggtgatttccacaaac

SEQ ID NO: 635552 - DNA, 22 bp, Artificial Sequence
  chemically synthesized
ttatttatgcatgtttgtggaa

SEQ ID NO: 635553 - DNA, 22 bp, Artificial Sequence
  chemically synthesized
caaggtgatttccacaaacatg

SEQ ID NO: 635554 - DNA, 22 bp, Artificial Sequence
  chemically synthesized
acatctattatttatgcatgtt

SEQ ID NO: 635555 - DNA, 22 bp, Artificial Sequence
  chemically synthesized
ccacaaacatgcataaataata

SEQ ID NO: 635556 - DNA, 22 bp, Artificial Sequence
  chemically synthesized
cacaaacatgcataaataatag

SEQ ID NO: 635557 - DNA, 22 bp, Artificial Sequence
  chemically synthesized
accacatccacactgacatcta

SEQ ID NO: 635558 - DNA, 22 bp, Artificial Sequence
  chemically synthesized
caccacatccacactgacatct

SEQ ID NO: 635559 - DNA, 22 bp, Artificial Sequence
  chemically synthesized
tcaccacatccacactgacatc

SEQ ID NO: 635560 - DNA, 22 bp, Artificial Sequence
  chemically synthesized
ttttcaccacatccacactgac

SEQ ID NO: 635561 - DNA, 22 bp, Artificial Sequence
  chemically synthesized
tgttttcaccacatccacactg

SEQ ID NO: 635562 - DNA, 22 bp, Artificial Sequence
  chemically synthesized
ccaccagcagtgtaaaagtgtt

SEQ ID NO: 635563 - DNA, 22 bp, Artificial Sequence
  chemically synthesized
cattcccaccagcagtgtaaaa

SEQ ID NO: 635564 - DNA, 22 bp, Artificial Sequence
  chemically synthesized
acattcccaccagcagtgtaaa

SEQ ID NO: 635565 - DNA, 22 bp, Artificial Sequence
  chemically synthesized
gtttacattcccaccagcagtg

SEQ ID NO: 635566 - DNA, 22 bp, Artificial Sequence
  chemically synthesized
tcctagtttacattcccaccag

SEQ ID NO: 635567 - DNA, 22 bp, Artificial Sequence
  chemically synthesized
ttacactgctggtgggaatgta

SEQ ID NO: 635568 - DNA, 22 bp, Artificial Sequence
  chemically synthesized
tacactgctggtgggaatgtaa

SEQ ID NO: 635569 - DNA, 22 bp, Artificial Sequence
  chemically synthesized
acactgctggtgggaatgtaaa

SEQ ID NO: 635570 - DNA, 22 bp, Artificial Sequence
  chemically synthesized
cactgctggtgggaatgtaaac

SEQ ID NO: 635571 - DNA, 22 bp, Artificial Sequence
  chemically synthesized
catagtggttgtcctagtttac

SEQ ID NO: 635572 - DNA, 22 bp, Artificial Sequence
  chemically synthesized
ctggtgggaatgtaaactagga

SEQ ID NO: 635573 - DNA, 22 bp, Artificial Sequence
  chemically synthesized
ccatagtggttgtcctagttta

SEQ ID NO: 635574 - DNA, 22 bp, Artificial Sequence
  chemically synthesized
tccatagtggttgtcctagttt

SEQ ID NO: 635575 - DNA, 22 bp, Artificial Sequence
  chemically synthesized
gtgggaatgtaaactaggacaa

SEQ ID NO: 635576 - DNA, 22 bp, Artificial Sequence
  chemically synthesized
catagtgttttccatagtggtt

SEQ ID NO: 635577 - DNA, 22 bp, Artificial Sequence
  chemically synthesized
ggacaaccactatggaaaacac

SEQ ID NO: 635578 - DNA, 22 bp, Artificial Sequence
  chemically synthesized
aggagcctccatagtgttttcc

SEQ ID NO: 635579 - DNA, 22 bp, Artificial Sequence
  chemically synthesized
aaggagcctccatagtgttttc

SEQ ID NO: 635580 - DNA, 22 bp, Artificial Sequence
  chemically synthesized
taaggagcctccatagtgtttt

SEQ ID NO: 635581 - DNA, 22 bp, Artificial Sequence
  chemically synthesized
tttaaggagcctccatagtgtt

SEQ ID NO: 635582 - DNA, 22 bp, Artificial Sequence
  chemically synthesized
gttctttaaggagcctccatag

SEQ ID NO: 635583 - DNA, 22 bp, Artificial Sequence
  chemically synthesized
agttctttaaggagcctccata

SEQ ID NO: 635584 - DNA, 22 bp, Artificial Sequence
  chemically synthesized
tagttctttaaggagcctccat

SEQ ID NO: 635585 - DNA, 22 bp, Artificial Sequence
  chemically synthesized
tggaaaacactatggaggctcc

SEQ ID NO: 635586 - DNA, 22 bp, Artificial Sequence
  chemically synthesized
cattttagttctttaaggagcc

SEQ ID NO: 635587 - DNA, 22 bp, Artificial Sequence
  chemically synthesized
tacattttagttctttaaggag

SEQ ID NO: 635588 - DNA, 22 bp, Artificial Sequence
  chemically synthesized
tggaggctccttaaagaactaa

SEQ ID NO: 635589 - DNA, 22 bp, Artificial Sequence
  chemically synthesized
cttaaagaactaaaatgtagaa

SEQ ID NO: 635590 - DNA, 22 bp, Artificial Sequence
  chemically synthesized
gatcaaatggtagttctacatt

SEQ ID NO: 635591 - DNA, 22 bp, Artificial Sequence
  chemically synthesized
aaagaactaaaatgtagaacta

SEQ ID NO: 635592 - DNA, 22 bp, Artificial Sequence
  chemically synthesized
aagaactaaaatgtagaactac

SEQ ID NO: 635593 - DNA, 22 bp, Artificial Sequence
  chemically synthesized
ctggatcaaatggtagttctac

SEQ ID NO: 635594 - DNA, 22 bp, Artificial Sequence
  chemically synthesized
aaatgtagaactaccatttgat

SEQ ID NO: 635595 - DNA, 22 bp, Artificial Sequence
  chemically synthesized
ccatttgatccagcagtcccac

SEQ ID NO: 635596 - DNA, 22 bp, Artificial Sequence
  chemically synthesized
ggtagatatccagtagtgggac

SEQ ID NO: 635597 - DNA, 22 bp, Artificial Sequence
  chemically synthesized
gggtagatatccagtagtggga

SEQ ID NO: 635598 - DNA, 22 bp, Artificial Sequence
  chemically synthesized
tgggtagatatccagtagtggg

SEQ ID NO: 635599 - DNA, 22 bp, Artificial Sequence
  chemically synthesized
gatccagcagtcccactactgg

SEQ ID NO: 635600 - DNA, 22 bp, Artificial Sequence
  chemically synthesized
atccagcagtcccactactgga

SEQ ID NO: 635601 - DNA, 22 bp, Artificial Sequence
  chemically synthesized
ctttgggtagatatccagtagt

SEQ ID NO: 635602 - DNA, 22 bp, Artificial Sequence
  chemically synthesized
cctttgggtagatatccagtag

SEQ ID NO: 635603 - DNA, 22 bp, Artificial Sequence
  chemically synthesized
tcctttgggtagatatccagta

SEQ ID NO: 635604 - DNA, 22 bp, Artificial Sequence
  chemically synthesized
ctttcctttgggtagatatcca

SEQ ID NO: 635605 - DNA, 22 bp, Artificial Sequence
  chemically synthesized
cctttcctttgggtagatatcc

SEQ ID NO: 635606 - DNA, 22 bp, Artificial Sequence
  chemically synthesized
ctggatatctacccaaaggaaa

SEQ ID NO: 635607 - DNA, 22 bp, Artificial Sequence
  chemically synthesized
acataatgacttcctttccttt

SEQ ID NO: 635608 - DNA, 22 bp, Artificial Sequence
  chemically synthesized
gatatctacccaaaggaaagga

SEQ ID NO: 635609 - DNA, 22 bp, Artificial Sequence
  chemically synthesized
cacataatgacttcctttcctt

SEQ ID NO: 635610 - DNA, 22 bp, Artificial Sequence
  chemically synthesized
tcacataatgacttcctttcct

SEQ ID NO: 635611 - DNA, 22 bp, Artificial Sequence
  chemically synthesized
ttcacataatgacttcctttcc

SEQ ID NO: 635612 - DNA, 22 bp, Artificial Sequence
  chemically synthesized
cccaaaggaaaggaagtcatta

SEQ ID NO: 635613 - DNA, 22 bp, Artificial Sequence
  chemically synthesized
gtatgcaagtatatttttcaca

SEQ ID NO: 635614 - DNA, 22 bp, Artificial Sequence
  chemically synthesized
ggtatgcaagtatatttttcac

SEQ ID NO: 635615 - DNA, 22 bp, Artificial Sequence
  chemically synthesized
taatcttggtatgcaagtatat

SEQ ID NO: 635616 - DNA, 22 bp, Artificial Sequence
  chemically synthesized
ctataatcttggtatgcaagta

SEQ ID NO: 635617 - DNA, 22 bp, Artificial Sequence
  chemically synthesized
tgtgaaaaatatacttgcatac

SEQ ID NO: 635618 - DNA, 22 bp, Artificial Sequence
  chemically synthesized
cgctgctataatcttggtatgc

SEQ ID NO: 635619 - DNA, 22 bp, Artificial Sequence
  chemically synthesized
tgaattgcgctgctataatctt

SEQ ID NO: 635620 - DNA, 22 bp, Artificial Sequence
  chemically synthesized
gcataccaagattatagcagcg

SEQ ID NO: 635621 - DNA, 22 bp, Artificial Sequence
  chemically synthesized
cataccaagattatagcagcgc

SEQ ID NO: 635622 - DNA, 22 bp, Artificial Sequence
  chemically synthesized
caattatgaattgcgctgctat

SEQ ID NO: 635623 - DNA, 22 bp, Artificial Sequence
  chemically synthesized
tgcaattatgaattgcgctgct

SEQ ID NO: 635624 - DNA, 22 bp, Artificial Sequence
  chemically synthesized
ctgcaattatgaattgcgctgc

SEQ ID NO: 635625 - DNA, 22 bp, Artificial Sequence
  chemically synthesized
cgtatttctgcaattatgaatt

SEQ ID NO: 635626 - DNA, 22 bp, Artificial Sequence
  chemically synthesized
tagcagcgcaattcataattgc

SEQ ID NO: 635627 - DNA, 22 bp, Artificial Sequence
  chemically synthesized
gttccgtatttctgcaattatg

SEQ ID NO: 635628 - DNA, 22 bp, Artificial Sequence
  chemically synthesized
agctagttccgtatttctgcaa

SEQ ID NO: 635629 - DNA, 22 bp, Artificial Sequence
  chemically synthesized
aagctagttccgtatttctgca

SEQ ID NO: 635630 - DNA, 22 bp, Artificial Sequence
  chemically synthesized
ataattgcagaaatacggaact

SEQ ID NO: 635631 - DNA, 22 bp, Artificial Sequence
  chemically synthesized
atgggcatttaagctagttccg

SEQ ID NO: 635632 - DNA, 22 bp, Artificial Sequence
  chemically synthesized
cagaaatacggaactagcttaa

SEQ ID NO: 635633 - DNA, 22 bp, Artificial Sequence
  chemically synthesized
gttgatgggcatttaagctagt

SEQ ID NO: 635634 - DNA, 22 bp, Artificial Sequence
  chemically synthesized
gttggttgatgggcatttaagc

SEQ ID NO: 635635 - DNA, 22 bp, Artificial Sequence
  chemically synthesized
tccactcgttggttgatgggca

SEQ ID NO: 635636 - DNA, 22 bp, Artificial Sequence
  chemically synthesized
atccactcgttggttgatgggc

SEQ ID NO: 635637 - DNA, 22 bp, Artificial Sequence
  chemically synthesized
tatccactcgttggttgatggg

SEQ ID NO: 635638 - DNA, 22 bp, Artificial Sequence
  chemically synthesized
tttatccactcgttggttgatg

SEQ ID NO: 635639 - DNA, 22 bp, Artificial Sequence
  chemically synthesized
gcttaaatgcccatcaaccaac

SEQ ID NO: 635640 - DNA, 22 bp, Artificial Sequence
  chemically synthesized
ctttatccactcgttggttgat

SEQ ID NO: 635641 - DNA, 22 bp, Artificial Sequence
  chemically synthesized
tctttatccactcgttggttga

SEQ ID NO: 635642 - DNA, 22 bp, Artificial Sequence
  chemically synthesized
aaatgcccatcaaccaacgagt

SEQ ID NO: 635643 - DNA, 22 bp, Artificial Sequence
  chemically synthesized
aatgcccatcaaccaacgagtg

SEQ ID NO: 635644 - DNA, 22 bp, Artificial Sequence
  chemically synthesized
cattttctttatccactcgttg

SEQ ID NO: 635645 - DNA, 22 bp, Artificial Sequence
  chemically synthesized
atatacacacacacacacacac

SEQ ID NO: 635646 - DNA, 22 bp, Artificial Sequence
  chemically synthesized
tatacacacacacacacacaca

SEQ ID NO: 635647 - DNA, 22 bp, Artificial Sequence
  chemically synthesized
catggcgtgtgtgtgtgtgtgt

SEQ ID NO: 635648 - DNA, 22 bp, Artificial Sequence
  chemically synthesized
atattccatggcgtgtgtgtgt

SEQ ID NO: 635649 - DNA, 22 bp, Artificial Sequence
  chemically synthesized
atgactaatattccatggcgtg

SEQ ID NO: 635650 - DNA, 22 bp, Artificial Sequence
  chemically synthesized
catgactaatattccatggcgt

SEQ ID NO: 635651 - DNA, 22 bp, Artificial Sequence
  chemically synthesized
tcatgactaatattccatggcg

SEQ ID NO: 635652 - DNA, 22 bp, Artificial Sequence
  chemically synthesized
ctttcatgactaatattccatg

SEQ ID NO: 635653 - DNA, 22 bp, Artificial Sequence
  chemically synthesized
attcctttcatgactaatattc

SEQ ID NO: 635654 - DNA, 22 bp, Artificial Sequence
  chemically synthesized
cattcctttcatgactaatatt

SEQ ID NO: 635655 - DNA, 22 bp, Artificial Sequence
  chemically synthesized
tttcattcctttcatgactaat

SEQ ID NO: 635656 - DNA, 22 bp, Artificial Sequence
  chemically synthesized
tgaatgccattatttcattcct

SEQ ID NO: 635657 - DNA, 22 bp, Artificial Sequence
  chemically synthesized
ctgtgaatgccattatttcatt

SEQ ID NO: 635658 - DNA, 22 bp, Artificial Sequence
  chemically synthesized
gtcatgaaaggaatgaaataat

SEQ ID NO: 635659 - DNA, 22 bp, Artificial Sequence
  chemically synthesized
catccaggttgctgtgaatgcc

SEQ ID NO: 635660 - DNA, 22 bp, Artificial Sequence
  chemically synthesized
caactccatccaggttgctgtg

SEQ ID NO: 635661 - DNA, 22 bp, Artificial Sequence
  chemically synthesized
acagcaacctggatggagttgg

SEQ ID NO: 635662 - DNA, 22 bp, Artificial Sequence
  chemically synthesized
gagtaatggtctccaactccat

SEQ ID NO: 635663 - DNA, 22 bp, Artificial Sequence
  chemically synthesized
agagtaatggtctccaactcca

SEQ ID NO: 635664 - DNA, 22 bp, Artificial Sequence
  chemically synthesized
cttagagtaatggtctccaact

SEQ ID NO: 635665 - DNA, 22 bp, Artificial Sequence
  chemically synthesized
acttagagtaatggtctccaac

SEQ ID NO: 635666 - DNA, 22 bp, Artificial Sequence
  chemically synthesized
tacttagagtaatggtctccaa

SEQ ID NO: 635667 - DNA, 22 bp, Artificial Sequence
  chemically synthesized
ctttacttagagtaatggtctc

SEQ ID NO: 635668 - DNA, 22 bp, Artificial Sequence
  chemically synthesized
gatggagttggagaccattact

SEQ ID NO: 635669 - DNA, 22 bp, Artificial Sequence
  chemically synthesized
agttactttacttagagtaatg

SEQ ID NO: 635670 - DNA, 22 bp, Artificial Sequence
  chemically synthesized
ctgagttactttacttagagta

SEQ ID NO: 635671 - DNA, 22 bp, Artificial Sequence
  chemically synthesized
ttcctgagttactttacttaga

SEQ ID NO: 635672 - DNA, 22 bp, Artificial Sequence
  chemically synthesized
gagaccattactctaagtaaag

SEQ ID NO: 635673 - DNA, 22 bp, Artificial Sequence
  chemically synthesized
tctattcctgagttactttact

SEQ ID NO: 635674 - DNA, 22 bp, Artificial Sequence
  chemically synthesized
gttgtctattcctgagttactt

SEQ ID NO: 635675 - DNA, 22 bp, Artificial Sequence
  chemically synthesized
ggttgtctattcctgagttact

SEQ ID NO: 635676 - DNA, 22 bp, Artificial Sequence
  chemically synthesized
ctctaagtaaagtaactcagga

SEQ ID NO: 635677 - DNA, 22 bp, Artificial Sequence
  chemically synthesized
taagtaaagtaactcaggaata

SEQ ID NO: 635678 - DNA, 22 bp, Artificial Sequence
  chemically synthesized
agtaaagtaactcaggaataga

SEQ ID NO: 635679 - DNA, 22 bp, Artificial Sequence
  chemically synthesized
aggaatagacaaccaaacattg

SEQ ID NO: 635680 - DNA, 22 bp, Artificial Sequence
  chemically synthesized
taagtgagaaagtacaatgttt

SEQ ID NO: 635681 - DNA, 22 bp, Artificial Sequence
  chemically synthesized
ataagtgagaaagtacaatgtt

SEQ ID NO: 635682 - DNA, 22 bp, Artificial Sequence
  chemically synthesized
ccacttataagtgagaaagtac

SEQ ID NO: 635683 - DNA, 22 bp, Artificial Sequence
  chemically synthesized
gctcccacttataagtgagaaa

SEQ ID NO: 635684 - DNA, 22 bp, Artificial Sequence
  chemically synthesized
agctcccacttataagtgagaa

SEQ ID NO: 635685 - DNA, 22 bp, Artificial Sequence
  chemically synthesized
tactttctcacttataagtggg

SEQ ID NO: 635686 - DNA, 22 bp, Artificial Sequence
  chemically synthesized
tctcacttataagtgggagcta

SEQ ID NO: 635687 - DNA, 22 bp, Artificial Sequence
  chemically synthesized
ctcacttataagtgggagctaa

SEQ ID NO: 635688 - DNA, 22 bp, Artificial Sequence
  chemically synthesized
catccgcatagcttagctccca

SEQ ID NO: 635689 - DNA, 22 bp, Artificial Sequence
  chemically synthesized
tcacttataagtgggagctaag

SEQ ID NO: 635690 - DNA, 22 bp, Artificial Sequence
  chemically synthesized
gcatccgcatagcttagctccc

SEQ ID NO: 635691 - DNA, 22 bp, Artificial Sequence
  chemically synthesized
tgcatccgcatagcttagctcc

SEQ ID NO: 635692 - DNA, 22 bp, Artificial Sequence
  chemically synthesized
acttataagtgggagctaagct

SEQ ID NO: 635693 - DNA, 22 bp, Artificial Sequence
  chemically synthesized
ataagtgggagctaagctatgc

SEQ ID NO: 635694 - DNA, 22 bp, Artificial Sequence
  chemically synthesized
taagtgggagctaagctatgcg

SEQ ID NO: 635695 - DNA, 22 bp, Artificial Sequence
  chemically synthesized
atgcctttgcatccgcatagct

SEQ ID NO: 635696 - DNA, 22 bp, Artificial Sequence
  chemically synthesized
tcatgcctttgcatccgcatag

SEQ ID NO: 635697 - DNA, 22 bp, Artificial Sequence
  chemically synthesized
agctatgcggatgcaaaggcat

SEQ ID NO: 635698 - DNA, 22 bp, Artificial Sequence
  chemically synthesized
tgcggatgcaaaggcatgagaa

SEQ ID NO: 635699 - DNA, 22 bp, Artificial Sequence
  chemically synthesized
cccccaagtccccagagtccat

SEQ ID NO: 635700 - DNA, 22 bp, Artificial Sequence
  chemically synthesized
ccccccaagtccccagagtcca

SEQ ID NO: 635701 - DNA, 22 bp, Artificial Sequence
  chemically synthesized
ccacccttccccccaagtcccc

SEQ ID NO: 635702 - DNA, 22 bp, Artificial Sequence
  chemically synthesized
acccccctcccacccttccccc

SEQ ID NO: 635703 - DNA, 22 bp, Artificial Sequence
  chemically synthesized
cacccccctcccacccttcccc

SEQ ID NO: 635704 - DNA, 22 bp, Artificial Sequence
  chemically synthesized
tggggacttggggggaagggtg

SEQ ID NO: 635705 - DNA, 22 bp, Artificial Sequence
  chemically synthesized
gggacttggggggaagggtggg

SEQ ID NO: 635706 - DNA, 22 bp, Artificial Sequence
  chemically synthesized
tccttcacccccctcccaccct

SEQ ID NO: 635707 - DNA, 22 bp, Artificial Sequence
  chemically synthesized
atccttcacccccctcccaccc

SEQ ID NO: 635708 - DNA, 22 bp, Artificial Sequence
  chemically synthesized
tatccttcacccccctcccacc

SEQ ID NO: 635709 - DNA, 22 bp, Artificial Sequence
  chemically synthesized
ttatccttcacccccctcccac

SEQ ID NO: 635710 - DNA, 22 bp, Artificial Sequence
  chemically synthesized
ggggggaagggtgggagggggg

SEQ ID NO: 635711 - DNA, 22 bp, Artificial Sequence
  chemically synthesized
gggggaagggtgggaggggggt

SEQ ID NO: 635712 - DNA, 22 bp, Artificial Sequence
  chemically synthesized
tacccaacgtgtagtcttttat

SEQ ID NO: 635713 - DNA, 22 bp, Artificial Sequence
  chemically synthesized
agcagtgtacactgtacccaac

SEQ ID NO: 635714 - DNA, 22 bp, Artificial Sequence
  chemically synthesized
cacgttgggtacagtgtacact

SEQ ID NO: 635715 - DNA, 22 bp, Artificial Sequence
  chemically synthesized
ggtacagtgtacactgctcagg

SEQ ID NO: 635716 - DNA, 22 bp, Artificial Sequence
  chemically synthesized
ggtgcatccatcacctgagcag

SEQ ID NO: 635717 - DNA, 22 bp, Artificial Sequence
  chemically synthesized
gggtgcatccatcacctgagca

SEQ ID NO: 635718 - DNA, 22 bp, Artificial Sequence
  chemically synthesized
acatttgggtgcatccatcacc

SEQ ID NO: 635719 - DNA, 22 bp, Artificial Sequence
  chemically synthesized
tgacatttgggtgcatccatca

SEQ ID NO: 635720 - DNA, 22 bp, Artificial Sequence
  chemically synthesized
ctgacatttgggtgcatccatc

SEQ ID NO: 635721 - DNA, 22 bp, Artificial Sequence
  chemically synthesized
ctcaggtgatggatgcacccaa

SEQ ID NO: 635722 - DNA, 22 bp, Artificial Sequence
  chemically synthesized
aggtgatggatgcacccaaatg

SEQ ID NO: 635723 - DNA, 22 bp, Artificial Sequence
  chemically synthesized
ggtggtgatttctgacatttgg

SEQ ID NO: 635724 - DNA, 22 bp, Artificial Sequence
  chemically synthesized
cggtggtgatttctgacatttg

SEQ ID NO: 635725 - DNA, 22 bp, Artificial Sequence
  chemically synthesized
ttcggtggtgatttctgacatt

SEQ ID NO: 635726 - DNA, 22 bp, Artificial Sequence
  chemically synthesized
catgaataagttcttcggtggt

SEQ ID NO: 635727 - DNA, 22 bp, Artificial Sequence
  chemically synthesized
gttacatgaataagttcttcgg

SEQ ID NO: 635728 - DNA, 22 bp, Artificial Sequence
  chemically synthesized
ggttacatgaataagttcttcg

SEQ ID NO: 635729 - DNA, 22 bp, Artificial Sequence
  chemically synthesized
agggaacccaggtggtgtttgg

SEQ ID NO: 635730 - DNA, 22 bp, Artificial Sequence
  chemically synthesized
cagggaacccaggtggtgtttg

SEQ ID NO: 635731 - DNA, 22 bp, Artificial Sequence
  chemically synthesized
attcatgtaaccaaacaccacc

SEQ ID NO: 635732 - DNA, 22 bp, Artificial Sequence
  chemically synthesized
tcagggaacccaggtggtgttt

SEQ ID NO: 635733 - DNA, 22 bp, Artificial Sequence
  chemically synthesized
ttcatgtaaccaaacaccacct

SEQ ID NO: 635734 - DNA, 22 bp, Artificial Sequence
  chemically synthesized
atgtaaccaaacaccacctggg

SEQ ID NO: 635735 - DNA, 22 bp, Artificial Sequence
  chemically synthesized
agtagttttcagggaacccagg

SEQ ID NO: 635736 - DNA, 22 bp, Artificial Sequence
  chemically synthesized
cagtagttttcagggaacccag

SEQ ID NO: 635737 - DNA, 22 bp, Artificial Sequence
  chemically synthesized
tttcagtagttttcagggaacc

SEQ ID NO: 635738 - DNA, 22 bp, Artificial Sequence
  chemically synthesized
ttatttcagtagttttcaggga

SEQ ID NO: 635739 - DNA, 22 bp, Artificial Sequence
  chemically synthesized
attatttcagtagttttcaggg

SEQ ID NO: 635740 - DNA, 22 bp, Artificial Sequence
  chemically synthesized
tattatttcagtagttttcagg

SEQ ID NO: 635741 - DNA, 22 bp, Artificial Sequence
  chemically synthesized
ttattatttcagtagttttcag

SEQ ID NO: 635742 - DNA, 22 bp, Artificial Sequence
  chemically synthesized
tttattatttcagtagttttca

SEQ ID NO: 635743 - DNA, 22 bp, Artificial Sequence
  chemically synthesized
tttttattatttcagtagtttt

SEQ ID NO: 635744 - DNA, 22 bp, Artificial Sequence
  chemically synthesized
tctttttattatttcagtagtt

SEQ ID NO: 635745 - DNA, 22 bp, Artificial Sequence
  chemically synthesized
ggttccctgaaaactactgaaa

SEQ ID NO: 635746 - DNA, 22 bp, Artificial Sequence
  chemically synthesized
ctctttttattatttcagtagt

SEQ ID NO: 635747 - DNA, 22 bp, Artificial Sequence
  chemically synthesized
tctctttttattatttcagtag

SEQ ID NO: 635748 - DNA, 22 bp, Artificial Sequence
  chemically synthesized
ttctctttttattatttcagta

SEQ ID NO: 635749 - DNA, 22 bp, Artificial Sequence
  chemically synthesized
cctgaaaactactgaaataata

SEQ ID NO: 635750 - DNA, 22 bp, Artificial Sequence
  chemically synthesized
tttttctctttttattatttca

SEQ ID NO: 635751 - DNA, 22 bp, Artificial Sequence
  chemically synthesized
aaaactactgaaataataaaaa

SEQ ID NO: 635752 - DNA, 22 bp, Artificial Sequence
  chemically synthesized
ctgaaataataaaaagagaaaa

SEQ ID NO: 635753 - DNA, 22 bp, Artificial Sequence
  chemically synthesized
aaataataaaaagagaaaaata

SEQ ID NO: 635754 - DNA, 22 bp, Artificial Sequence
  chemically synthesized
ataatccaaaaaacattatttt

SEQ ID NO: 635755 - DNA, 22 bp, Artificial Sequence
  chemically synthesized
tttggattattagctatttggt

SEQ ID NO: 635756 - DNA, 22 bp, Artificial Sequence
  chemically synthesized
ttggattattagctatttggtc

SEQ ID NO: 635757 - DNA, 22 bp, Artificial Sequence
  chemically synthesized
tggattattagctatttggtct

SEQ ID NO: 635758 - DNA, 22 bp, Artificial Sequence
  chemically synthesized
ggattattagctatttggtctt

SEQ ID NO: 635759 - DNA, 22 bp, Artificial Sequence
  chemically synthesized
gattattagctatttggtcttc

SEQ ID NO: 635760 - DNA, 22 bp, Artificial Sequence
  chemically synthesized
ttagctatttggtcttcctggc

SEQ ID NO: 635761 - DNA, 22 bp, Artificial Sequence
  chemically synthesized
gctatttggtcttcctggcttg

SEQ ID NO: 635762 - DNA, 22 bp, Artificial Sequence
  chemically synthesized
gaccacaatcagacaagccagg

SEQ ID NO: 635763 - DNA, 22 bp, Artificial Sequence
  chemically synthesized
ggaccacaatcagacaagccag

SEQ ID NO: 635764 - DNA, 22 bp, Artificial Sequence
  chemically synthesized
tttggtcttcctggcttgtctg

SEQ ID NO: 635765 - DNA, 22 bp, Artificial Sequence
  chemically synthesized
tttggaccacaatcagacaagc

SEQ ID NO: 635766 - DNA, 22 bp, Artificial Sequence
  chemically synthesized
atttggaccacaatcagacaag

SEQ ID NO: 635767 - DNA, 22 bp, Artificial Sequence
  chemically synthesized
ggtcttcctggcttgtctgatt

SEQ ID NO: 635768 - DNA, 22 bp, Artificial Sequence
  chemically synthesized
gtcttcctggcttgtctgattg

SEQ ID NO: 635769 - DNA, 22 bp, Artificial Sequence
  chemically synthesized
cctggcttgtctgattgtggtc

SEQ ID NO: 635770 - DNA, 22 bp, Artificial Sequence
  chemically synthesized
ctggcttgtctgattgtggtcc

SEQ ID NO: 635771 - DNA, 22 bp, Artificial Sequence
  chemically synthesized
agtgatttatttggaccacaat

SEQ ID NO: 635772 - DNA, 22 bp, Artificial Sequence
  chemically synthesized
cagtgatttatttggaccacaa

SEQ ID NO: 635773 - DNA, 22 bp, Artificial Sequence
  chemically synthesized
gcttgtctgattgtggtccaaa

SEQ ID NO: 635774 - DNA, 22 bp, Artificial Sequence
  chemically synthesized
gtctgattgtggtccaaataaa

SEQ ID NO: 635775 - DNA, 22 bp, Artificial Sequence
  chemically synthesized
tctgattgtggtccaaataaat

SEQ ID NO: 635776 - DNA, 22 bp, Artificial Sequence
  chemically synthesized
aaaaatgtttcagtgatttatt

SEQ ID NO: 635777 - DNA, 22 bp, Artificial Sequence
  chemically synthesized
attgtggtccaaataaatcact

SEQ ID NO: 635778 - DNA, 22 bp, Artificial Sequence
  chemically synthesized
aaaaaatgtttcagtgatttat

SEQ ID NO: 635779 - DNA, 22 bp, Artificial Sequence
  chemically synthesized
taaaaaatgtttcagtgattta

SEQ ID NO: 635780 - DNA, 22 bp, Artificial Sequence
  chemically synthesized
tggtccaaataaatcactgaaa

SEQ ID NO: 635781 - DNA, 22 bp, Artificial Sequence
  chemically synthesized
ttttaaaaaatgtttcagtgat

SEQ ID NO: 635782 - DNA, 22 bp, Artificial Sequence
  chemically synthesized
attttaaaaaatgtttcagtga

SEQ ID NO: 635783 - DNA, 22 bp, Artificial Sequence
  chemically synthesized
cttattttaaaaaatgtttcag

SEQ ID NO: 635784 - DNA, 22 bp, Artificial Sequence
  chemically synthesized
ccttattttaaaaaatgtttca

SEQ ID NO: 635785 - DNA, 22 bp, Artificial Sequence
  chemically synthesized
tccttattttaaaaaatgtttc

SEQ ID NO: 635786 - DNA, 22 bp, Artificial Sequence
  chemically synthesized
tgtctttccttattttaaaaaa

SEQ ID NO: 635787 - DNA, 22 bp, Artificial Sequence
  chemically synthesized
actatgtctttccttattttaa

SEQ ID NO: 635788 - DNA, 22 bp, Artificial Sequence
  chemically synthesized
gactatgtctttccttatttta

SEQ ID NO: 635789 - DNA, 22 bp, Artificial Sequence
  chemically synthesized
tgactatgtctttccttatttt

SEQ ID NO: 635790 - DNA, 22 bp, Artificial Sequence
  chemically synthesized
aaacattttttaaaataaggaa

SEQ ID NO: 635791 - DNA, 22 bp, Artificial Sequence
  chemically synthesized
actttgactatgtctttcctta

SEQ ID NO: 635792 - DNA, 22 bp, Artificial Sequence
  chemically synthesized
aactttgactatgtctttcctt

SEQ ID NO: 635793 - DNA, 22 bp, Artificial Sequence
  chemically synthesized
tttaactttgactatgtctttc

SEQ ID NO: 635794 - DNA, 22 bp, Artificial Sequence
  chemically synthesized
tttaaaataaggaaagacatag

SEQ ID NO: 635795 - DNA, 22 bp, Artificial Sequence
  chemically synthesized
ttaaaataaggaaagacatagt

SEQ ID NO: 635796 - DNA, 22 bp, Artificial Sequence
  chemically synthesized
taaaataaggaaagacatagtc

SEQ ID NO: 635797 - DNA, 22 bp, Artificial Sequence
  chemically synthesized
aaaataaggaaagacatagtca

SEQ ID NO: 635798 - DNA, 22 bp, Artificial Sequence
  chemically synthesized
aaataaggaaagacatagtcaa

SEQ ID NO: 635799 - DNA, 22 bp, Artificial Sequence
  chemically synthesized
tatcacggtactatttaacttt

SEQ ID NO: 635800 - DNA, 22 bp, Artificial Sequence
  chemically synthesized
ctatatcacggtactatttaac

SEQ ID NO: 635801 - DNA, 22 bp, Artificial Sequence
  chemically synthesized
gctatatcacggtactatttaa

SEQ ID NO: 635802 - DNA, 22 bp, Artificial Sequence
  chemically synthesized
tgctatatcacggtactattta

SEQ ID NO: 635803 - DNA, 22 bp, Artificial Sequence
  chemically synthesized
tcatattttgctatatcacggt

SEQ ID NO: 635804 - DNA, 22 bp, Artificial Sequence
  chemically synthesized
aatagtaccgtgatatagcaaa

SEQ ID NO: 635805 - DNA, 22 bp, Artificial Sequence
  chemically synthesized
aaggagactatcatattttgct

SEQ ID NO: 635806 - DNA, 22 bp, Artificial Sequence
  chemically synthesized
agcagtgattaaaggagactat

SEQ ID NO: 635807 - DNA, 22 bp, Artificial Sequence
  chemically synthesized
cagcagtgattaaaggagacta

SEQ ID NO: 635808 - DNA, 22 bp, Artificial Sequence
  chemically synthesized
acttcagcagtgattaaaggag

SEQ ID NO: 635809 - DNA, 22 bp, Artificial Sequence
  chemically synthesized
cacttcagcagtgattaaagga

SEQ ID NO: 635810 - DNA, 22 bp, Artificial Sequence
  chemically synthesized
ttcacttcagcagtgattaaag

SEQ ID NO: 635811 - DNA, 22 bp, Artificial Sequence
  chemically synthesized
cttcacttcagcagtgattaaa

SEQ ID NO: 635812 - DNA, 22 bp, Artificial Sequence
  chemically synthesized
tcttcacttcagcagtgattaa

SEQ ID NO: 635813 - DNA, 22 bp, Artificial Sequence
  chemically synthesized
ttcttcacttcagcagtgatta

SEQ ID NO: 635814 - DNA, 22 bp, Artificial Sequence
  chemically synthesized
tttcttcacttcagcagtgatt

SEQ ID NO: 635815 - DNA, 22 bp, Artificial Sequence
  chemically synthesized
ttttcttcacttcagcagtgat

SEQ ID NO: 635816 - DNA, 22 bp, Artificial Sequence
  chemically synthesized
ttttttcttcacttcagcagtg

SEQ ID NO: 635817 - DNA, 22 bp, Artificial Sequence
  chemically synthesized
cttttttcttcacttcagcagt

SEQ ID NO: 635818 - DNA, 22 bp, Artificial Sequence
  chemically synthesized
ctttaatcactgctgaagtgaa

SEQ ID NO: 635819 - DNA, 22 bp, Artificial Sequence
  chemically synthesized
taatcactgctgaagtgaagaa

SEQ ID NO: 635820 - DNA, 22 bp, Artificial Sequence
  chemically synthesized
aatcactgctgaagtgaagaaa

SEQ ID NO: 635821 - DNA, 22 bp, Artificial Sequence
  chemically synthesized
atcactgctgaagtgaagaaaa

SEQ ID NO: 635822 - DNA, 22 bp, Artificial Sequence
  chemically synthesized
agtcatcccacttcttttttct

SEQ ID NO: 635823 - DNA, 22 bp, Artificial Sequence
  chemically synthesized
ctgaagtgaagaaaaaagaagt

SEQ ID NO: 635824 - DNA, 22 bp, Artificial Sequence
  chemically synthesized
aattgagtcatcccacttcttt

SEQ ID NO: 635825 - DNA, 22 bp, Artificial Sequence
  chemically synthesized
aagtgaagaaaaaagaagtggg

SEQ ID NO: 635826 - DNA, 22 bp, Artificial Sequence
  chemically synthesized
ggattaaattgagtcatcccac

SEQ ID NO: 635827 - DNA, 22 bp, Artificial Sequence
  chemically synthesized
tcggattaaattgagtcatccc

SEQ ID NO: 635828 - DNA, 22 bp, Artificial Sequence
  chemically synthesized
ctcggattaaattgagtcatcc

SEQ ID NO: 635829 - DNA, 22 bp, Artificial Sequence
  chemically synthesized
tctcggattaaattgagtcatc

SEQ ID NO: 635830 - DNA, 22 bp, Artificial Sequence
  chemically synthesized
ttctcggattaaattgagtcat

SEQ ID NO: 635831 - DNA, 22 bp, Artificial Sequence
  chemically synthesized
tttctcggattaaattgagtca

SEQ ID NO: 635832 - DNA, 22 bp, Artificial Sequence
  chemically synthesized
ttttctcggattaaattgagtc

SEQ ID NO: 635833 - DNA, 22 bp, Artificial Sequence
  chemically synthesized
ttttttctcggattaaattgag

SEQ ID NO: 635834 - DNA, 22 bp, Artificial Sequence
  chemically synthesized
cttttttctcggattaaattga

SEQ ID NO: 635835 - DNA, 22 bp, Artificial Sequence
  chemically synthesized
tcttttttctcggattaaattg

SEQ ID NO: 635836 - DNA, 22 bp, Artificial Sequence
  chemically synthesized
ttcttttttctcggattaaatt

SEQ ID NO: 635837 - DNA, 22 bp, Artificial Sequence
  chemically synthesized
cttttcttttttctcggattaa

SEQ ID NO: 635838 - DNA, 22 bp, Artificial Sequence
  chemically synthesized
aatttaatccgagaaaaaagaa

SEQ ID NO: 635839 - DNA, 22 bp, Artificial Sequence
  chemically synthesized
aatccgagaaaaaagaaaagga

SEQ ID NO: 635840 - DNA, 22 bp, Artificial Sequence
  chemically synthesized
atccgagaaaaaagaaaaggaa

SEQ ID NO: 635841 - DNA, 22 bp, Artificial Sequence
  chemically synthesized
ccatggcaaagcattccttttc

SEQ ID NO: 635842 - DNA, 22 bp, Artificial Sequence
  chemically synthesized
gccatggcaaagcattcctttt

SEQ ID NO: 635843 - DNA, 22 bp, Artificial Sequence
  chemically synthesized
aagaatatcttgccatggcaaa

SEQ ID NO: 635844 - DNA, 22 bp, Artificial Sequence
  chemically synthesized
agaagactgaagaatatcttgc

SEQ ID NO: 635845 - DNA, 22 bp, Artificial Sequence
  chemically synthesized
cagaagactgaagaatatcttg

SEQ ID NO: 635846 - DNA, 22 bp, Artificial Sequence
  chemically synthesized
tgccatggcaagatattcttca

SEQ ID NO: 635847 - DNA, 22 bp, Artificial Sequence
  chemically synthesized
gccatggcaagatattcttcag

SEQ ID NO: 635848 - DNA, 22 bp, Artificial Sequence
  chemically synthesized
tatttcagaagactgaagaata

SEQ ID NO: 635849 - DNA, 22 bp, Artificial Sequence
  chemically synthesized
ccatggcaagatattcttcagt

SEQ ID NO: 635850 - DNA, 22 bp, Artificial Sequence
  chemically synthesized
aaaccatcgttatatttcagaa

SEQ ID NO: 635851 - DNA, 22 bp, Artificial Sequence
  chemically synthesized
ttcagtcttctgaaatataacg

SEQ ID NO: 635852 - DNA, 22 bp, Artificial Sequence
  chemically synthesized
cagtcttctgaaatataacgat

SEQ ID NO: 635853 - DNA, 22 bp, Artificial Sequence
  chemically synthesized
agtcttctgaaatataacgatg

SEQ ID NO: 635854 - DNA, 22 bp, Artificial Sequence
  chemically synthesized
ctgaaatataacgatggtttca

SEQ ID NO: 635855 - DNA, 22 bp, Artificial Sequence
  chemically synthesized
aagaaagggatctgaaaccatc

SEQ ID NO: 635856 - DNA, 22 bp, Artificial Sequence
  chemically synthesized
tgaaatataacgatggtttcag

SEQ ID NO: 635857 - DNA, 22 bp, Artificial Sequence
  chemically synthesized
caagaaagggatctgaaaccat

SEQ ID NO: 635858 - DNA, 22 bp, Artificial Sequence
  chemically synthesized
aaatataacgatggtttcagat

SEQ ID NO: 635859 - DNA, 22 bp, Artificial Sequence
  chemically synthesized
ccttcaagaaagggatctgaaa

SEQ ID NO: 635860 - DNA, 22 bp, Artificial Sequence
  chemically synthesized
cccttcaagaaagggatctgaa

SEQ ID NO: 635861 - DNA, 22 bp, Artificial Sequence
  chemically synthesized
cagatccctttcttgaagggaa

SEQ ID NO: 635862 - DNA, 22 bp, Artificial Sequence
  chemically synthesized
agatccctttcttgaagggaag

SEQ ID NO: 635863 - DNA, 22 bp, Artificial Sequence
  chemically synthesized
tcttgaagggaagatatcccat

SEQ ID NO: 635864 - DNA, 22 bp, Artificial Sequence
  chemically synthesized
cttgaagggaagatatcccatc

SEQ ID NO: 635865 - DNA, 22 bp, Artificial Sequence
  chemically synthesized
ttgaagggaagatatcccatct

SEQ ID NO: 635866 - DNA, 22 bp, Artificial Sequence
  chemically synthesized
gaagggaagatatcccatctga

SEQ ID NO: 635867 - DNA, 22 bp, Artificial Sequence
  chemically synthesized
aagggaagatatcccatctgac

SEQ ID NO: 635868 - DNA, 22 bp, Artificial Sequence
  chemically synthesized
aatcaaagggaagtgagtcaga

SEQ ID NO: 635869 - DNA, 22 bp, Artificial Sequence
  chemically synthesized
gaatcaaagggaagtgagtcag

SEQ ID NO: 635870 - DNA, 22 bp, Artificial Sequence
  chemically synthesized
tcagcgtttgaatcaaagggaa

SEQ ID NO: 635871 - DNA, 22 bp, Artificial Sequence
  chemically synthesized
actcacttccctttgattcaaa

SEQ ID NO: 635872 - DNA, 22 bp, Artificial Sequence
  chemically synthesized
acttccctttgattcaaacgct

SEQ ID NO: 635873 - DNA, 22 bp, Artificial Sequence
  chemically synthesized
ccctttgattcaaacgctgata

SEQ ID NO: 635874 - DNA, 22 bp, Artificial Sequence
  chemically synthesized
cctttgattcaaacgctgataa

SEQ ID NO: 635875 - DNA, 22 bp, Artificial Sequence
  chemically synthesized
agcagatagaaccattatcagc

SEQ ID NO: 635876 - DNA, 22 bp, Artificial Sequence
  chemically synthesized
aagcagatagaaccattatcag

SEQ ID NO: 635877 - DNA, 22 bp, Artificial Sequence
  chemically synthesized
tgattcaaacgctgataatggt

SEQ ID NO: 635878 - DNA, 22 bp, Artificial Sequence
  chemically synthesized
taagcagatagaaccattatca

SEQ ID NO: 635879 - DNA, 22 bp, Artificial Sequence
  chemically synthesized
gattcaaacgctgataatggtt

SEQ ID NO: 635880 - DNA, 22 bp, Artificial Sequence
  chemically synthesized
ttaagcagatagaaccattatc

SEQ ID NO: 635881 - DNA, 22 bp, Artificial Sequence
  chemically synthesized
attcaaacgctgataatggttc

SEQ ID NO: 635882 - DNA, 22 bp, Artificial Sequence
  chemically synthesized
tttaagcagatagaaccattat

SEQ ID NO: 635883 - DNA, 22 bp, Artificial Sequence
  chemically synthesized
aaacgctgataatggttctatc

SEQ ID NO: 635884 - DNA, 22 bp, Artificial Sequence
  chemically synthesized
aaatcactttttaagcagatag

SEQ ID NO: 635885 - DNA, 22 bp, Artificial Sequence
  chemically synthesized
ataatggttctatctgcttaaa

SEQ ID NO: 635886 - DNA, 22 bp, Artificial Sequence
  chemically synthesized
gctaaaatcactttttaagcag

SEQ ID NO: 635887 - DNA, 22 bp, Artificial Sequence
  chemically synthesized
tggctaaaatcactttttaagc

SEQ ID NO: 635888 - DNA, 22 bp, Artificial Sequence
  chemically synthesized
tatctgcttaaaaagtgatttt

SEQ ID NO: 635889 - DNA, 22 bp, Artificial Sequence
  chemically synthesized
tctgcttaaaaagtgattttag

SEQ ID NO: 635890 - DNA, 22 bp, Artificial Sequence
  chemically synthesized
cgtaggttctggctaaaatcac

SEQ ID NO: 635891 - DNA, 22 bp, Artificial Sequence
  chemically synthesized
cttaaaaagtgattttagccag

SEQ ID NO: 635892 - DNA, 22 bp, Artificial Sequence
  chemically synthesized
aaaaagtgattttagccagaac

SEQ ID NO: 635893 - DNA, 22 bp, Artificial Sequence
  chemically synthesized
aaaagtgattttagccagaacc

SEQ ID NO: 635894 - DNA, 22 bp, Artificial Sequence
  chemically synthesized
cataggctgcgtaggttctggc

SEQ ID NO: 635895 - DNA, 22 bp, Artificial Sequence
  chemically synthesized
tgcataggctgcgtaggttctg

SEQ ID NO: 635896 - DNA, 22 bp, Artificial Sequence
  chemically synthesized
ttctgcataggctgcgtaggtt

SEQ ID NO: 635897 - DNA, 22 bp, Artificial Sequence
  chemically synthesized
tagccagaacctacgcagccta

SEQ ID NO: 635898 - DNA, 22 bp, Artificial Sequence
  chemically synthesized
agccagaacctacgcagcctat

SEQ ID NO: 635899 - DNA, 22 bp, Artificial Sequence
  chemically synthesized
tgtctattctgcataggctgcg

SEQ ID NO: 635900 - DNA, 22 bp, Artificial Sequence
  chemically synthesized
gccagaacctacgcagcctatg

SEQ ID NO: 635901 - DNA, 22 bp, Artificial Sequence
  chemically synthesized
gtgtctattctgcataggctgc

SEQ ID NO: 635902 - DNA, 22 bp, Artificial Sequence
  chemically synthesized
ttgtgtctattctgcataggct

SEQ ID NO: 635903 - DNA, 22 bp, Artificial Sequence
  chemically synthesized
cgcagcctatgcagaatagaca

SEQ ID NO: 635904 - DNA, 22 bp, Artificial Sequence
  chemically synthesized
tgcagaatagacacaagaatta

SEQ ID NO: 635905 - DNA, 22 bp, Artificial Sequence
  chemically synthesized
agacaaaaacacaggagtaatt

SEQ ID NO: 635906 - DNA, 22 bp, Artificial Sequence
  chemically synthesized
gattcagacaaaaacacaggag

SEQ ID NO: 635907 - DNA, 22 bp, Artificial Sequence
  chemically synthesized
agattcagacaaaaacacagga

SEQ ID NO: 635908 - DNA, 22 bp, Artificial Sequence
  chemically synthesized
tttagattcagacaaaaacaca

SEQ ID NO: 635909 - DNA, 22 bp, Artificial Sequence
  chemically synthesized
gtttagattcagacaaaaacac

SEQ ID NO: 635910 - DNA, 22 bp, Artificial Sequence
  chemically synthesized
ctcctgtgtttttgtctgaatc

SEQ ID NO: 635911 - DNA, 22 bp, Artificial Sequence
  chemically synthesized
ctgtgtttttgtctgaatctaa

SEQ ID NO: 635912 - DNA, 22 bp, Artificial Sequence
  chemically synthesized
tgtttttgtctgaatctaaaca

SEQ ID NO: 635913 - DNA, 22 bp, Artificial Sequence
  chemically synthesized
ttgtctgaatctaaacaaatta

SEQ ID NO: 635914 - DNA, 22 bp, Artificial Sequence
  chemically synthesized
tgtctgaatctaaacaaattat

SEQ ID NO: 635915 - DNA, 22 bp, Artificial Sequence
  chemically synthesized
gtctgaatctaaacaaattatt

SEQ ID NO: 635916 - DNA, 22 bp, Artificial Sequence
  chemically synthesized
aaaaaaagagaaaataatttgt

SEQ ID NO: 635917 - DNA, 22 bp, Artificial Sequence
  chemically synthesized
tctgaatctaaacaaattattt

SEQ ID NO: 635918 - DNA, 22 bp, Artificial Sequence
  chemically synthesized
aaaaaaaagagaaaataatttg

SEQ ID NO: 635919 - DNA, 22 bp, Artificial Sequence
  chemically synthesized
taaaaaaaagagaaaataattt

SEQ ID NO: 635920 - DNA, 22 bp, Artificial Sequence
  chemically synthesized
ttaaaaaaaagagaaaataatt

SEQ ID NO: 635921 - DNA, 22 bp, Artificial Sequence
  chemically synthesized
tttaaaaaaaagagaaaataat

SEQ ID NO: 635922 - DNA, 22 bp, Artificial Sequence
  chemically synthesized
aatctaaacaaattattttctc

SEQ ID NO: 635923 - DNA, 22 bp, Artificial Sequence
  chemically synthesized
ctttttaaaaaaaagagaaaat

SEQ ID NO: 635924 - DNA, 22 bp, Artificial Sequence
  chemically synthesized
aacaaattattttctctttttt

SEQ ID NO: 635925 - DNA, 22 bp, Artificial Sequence
  chemically synthesized
tacacagctcctttttaaaaaa

SEQ ID NO: 635926 - DNA, 22 bp, Artificial Sequence
  chemically synthesized
gtacacagctcctttttaaaaa

SEQ ID NO: 635927 - DNA, 22 bp, Artificial Sequence
  chemically synthesized
ttttctcttttttttaaaaagg

SEQ ID NO: 635928 - DNA, 22 bp, Artificial Sequence
  chemically synthesized
ttgtacacagctcctttttaaa

SEQ ID NO: 635929 - DNA, 22 bp, Artificial Sequence
  chemically synthesized
cttgtacacagctcctttttaa

SEQ ID NO: 635930 - DNA, 22 bp, Artificial Sequence
  chemically synthesized
tctcttttttttaaaaaggagc

SEQ ID NO: 635931 - DNA, 22 bp, Artificial Sequence
  chemically synthesized
ctcttttttttaaaaaggagct

SEQ ID NO: 635932 - DNA, 22 bp, Artificial Sequence
  chemically synthesized
tcttttttttaaaaaggagctg

SEQ ID NO: 635933 - DNA, 22 bp, Artificial Sequence
  chemically synthesized
ttttttttaaaaaggagctgtg

SEQ ID NO: 635934 - DNA, 22 bp, Artificial Sequence
  chemically synthesized
ttttttaaaaaggagctgtgta

SEQ ID NO: 635935 - DNA, 22 bp, Artificial Sequence
  chemically synthesized
tttttaaaaaggagctgtgtac

SEQ ID NO: 635936 - DNA, 22 bp, Artificial Sequence
  chemically synthesized
ttttaaaaaggagctgtgtaca

SEQ ID NO: 635937 - DNA, 22 bp, Artificial Sequence
  chemically synthesized
tttaaaaaggagctgtgtacaa

SEQ ID NO: 635938 - DNA, 22 bp, Artificial Sequence
  chemically synthesized
ttaaaaaggagctgtgtacaag

SEQ ID NO: 635939 - DNA, 22 bp, Artificial Sequence
  chemically synthesized
taaaaaggagctgtgtacaaga

SEQ ID NO: 635940 - DNA, 22 bp, Artificial Sequence
  chemically synthesized
aaaaaggagctgtgtacaagaa

SEQ ID NO: 635941 - DNA, 22 bp, Artificial Sequence
  chemically synthesized
aaaaggagctgtgtacaagaaa

SEQ ID NO: 635942 - DNA, 22 bp, Artificial Sequence
  chemically synthesized
tgagaaaaaataatttcttgta

SEQ ID NO: 635943 - DNA, 22 bp, Artificial Sequence
  chemically synthesized
atgagaaaaaataatttcttgt

SEQ ID NO: 635944 - DNA, 22 bp, Artificial Sequence
  chemically synthesized
tatgagaaaaaataatttcttg

SEQ ID NO: 635945 - DNA, 22 bp, Artificial Sequence
  chemically synthesized
tgtacaagaaattattttttct

SEQ ID NO: 635946 - DNA, 22 bp, Artificial Sequence
  chemically synthesized
atacacagccccctttatgaga

SEQ ID NO: 635947 - DNA, 22 bp, Artificial Sequence
  chemically synthesized
ttcatacacagccccctttatg

SEQ ID NO: 635948 - DNA, 22 bp, Artificial Sequence
  chemically synthesized
gttcatacacagccccctttat

SEQ ID NO: 635949 - DNA, 22 bp, Artificial Sequence
  chemically synthesized
ttttttctcataaagggggctg

SEQ ID NO: 635950 - DNA, 22 bp, Artificial Sequence
  chemically synthesized
tttctcataaagggggctgtgt

SEQ ID NO: 635951 - DNA, 22 bp, Artificial Sequence
  chemically synthesized
ttctcataaagggggctgtgta

SEQ ID NO: 635952 - DNA, 22 bp, Artificial Sequence
  chemically synthesized
tctcataaagggggctgtgtat

SEQ ID NO: 635953 - DNA, 22 bp, Artificial Sequence
  chemically synthesized
ctcataaagggggctgtgtatg

SEQ ID NO: 635954 - DNA, 22 bp, Artificial Sequence
  chemically synthesized
tcataaagggggctgtgtatga

SEQ ID NO: 635955 - DNA, 22 bp, Artificial Sequence
  chemically synthesized
ataaagggggctgtgtatgaac

SEQ ID NO: 635956 - DNA, 22 bp, Artificial Sequence
  chemically synthesized
gtgggcgtatttgttcatacac

SEQ ID NO: 635957 - DNA, 22 bp, Artificial Sequence
  chemically synthesized
tgtatgaacaaatacgcccacc

SEQ ID NO: 635958 - DNA, 22 bp, Artificial Sequence
  chemically synthesized
aaatccaaagaaaaatgttggt

SEQ ID NO: 635959 - DNA, 22 bp, Artificial Sequence
  chemically synthesized
gttaaaatccaaagaaaaatgt

SEQ ID NO: 635960 - DNA, 22 bp, Artificial Sequence
  chemically synthesized
ttctttggattttaaccagttt

SEQ ID NO: 635961 - DNA, 22 bp, Artificial Sequence
  chemically synthesized
tctttggattttaaccagtttc

SEQ ID NO: 635962 - DNA, 22 bp, Artificial Sequence
  chemically synthesized
ctttggattttaaccagtttcc

SEQ ID NO: 635963 - DNA, 22 bp, Artificial Sequence
  chemically synthesized
tttggattttaaccagtttccg

SEQ ID NO: 635964 - DNA, 22 bp, Artificial Sequence
  chemically synthesized
tggattttaaccagtttccgac

SEQ ID NO: 635965 - DNA, 22 bp, Artificial Sequence
  chemically synthesized
ggattttaaccagtttccgact

SEQ ID NO: 635966 - DNA, 22 bp, Artificial Sequence
  chemically synthesized
gattttaaccagtttccgactt

SEQ ID NO: 635967 - DNA, 22 bp, Artificial Sequence
  chemically synthesized
agataataacacatcaagtcgg

SEQ ID NO: 635968 - DNA, 22 bp, Artificial Sequence
  chemically synthesized
taaccagtttccgacttgatgt

SEQ ID NO: 635969 - DNA, 22 bp, Artificial Sequence
  chemically synthesized
aaccagtttccgacttgatgtg

SEQ ID NO: 635970 - DNA, 22 bp, Artificial Sequence
  chemically synthesized
accagtttccgacttgatgtgt

SEQ ID NO: 635971 - DNA, 22 bp, Artificial Sequence
  chemically synthesized
ccgacttgatgtgttattatct

SEQ ID NO: 635972 - DNA, 22 bp, Artificial Sequence
  chemically synthesized
cgacttgatgtgttattatctt

SEQ ID NO: 635973 - DNA, 22 bp, Artificial Sequence
  chemically synthesized
gatgtgttattatcttagtact

SEQ ID NO: 635974 - DNA, 22 bp, Artificial Sequence
  chemically synthesized
atgtgttattatcttagtactt

SEQ ID NO: 635975 - DNA, 22 bp, Artificial Sequence
  chemically synthesized
ttatcttagtacttgtgtattt

SEQ ID NO: 635976 - DNA, 22 bp, Artificial Sequence
  chemically synthesized
gagaaaggcaggaaatacacaa

SEQ ID NO: 635977 - DNA, 22 bp, Artificial Sequence
  chemically synthesized
tcttagtacttgtgtatttcct

SEQ ID NO: 635978 - DNA, 22 bp, Artificial Sequence
  chemically synthesized
agtacttgtgtatttcctgcct

SEQ ID NO: 635979 - DNA, 22 bp, Artificial Sequence
  chemically synthesized
gtacttgtgtatttcctgcctt

SEQ ID NO: 635980 - DNA, 22 bp, Artificial Sequence
  chemically synthesized
aaaaatactggagaaaggcagg

SEQ ID NO: 635981 - DNA, 22 bp, Artificial Sequence
  chemically synthesized
taaaaaatactggagaaaggca

SEQ ID NO: 635982 - DNA, 22 bp, Artificial Sequence
  chemically synthesized
ctaaaaaatactggagaaaggc

SEQ ID NO: 635983 - DNA, 22 bp, Artificial Sequence
  chemically synthesized
gtgtatttcctgcctttctcca

SEQ ID NO: 635984 - DNA, 22 bp, Artificial Sequence
  chemically synthesized
tgtatttcctgcctttctccag

SEQ ID NO: 635985 - DNA, 22 bp, Artificial Sequence
  chemically synthesized
ttctaaaaaatactggagaaag

SEQ ID NO: 635986 - DNA, 22 bp, Artificial Sequence
  chemically synthesized
cttctaaaaaatactggagaaa

SEQ ID NO: 635987 - DNA, 22 bp, Artificial Sequence
  chemically synthesized
tcttctaaaaaatactggagaa

SEQ ID NO: 635988 - DNA, 22 bp, Artificial Sequence
  chemically synthesized
ttcttctaaaaaatactggaga

SEQ ID NO: 635989 - DNA, 22 bp, Artificial Sequence
  chemically synthesized
tttcttctaaaaaatactggag

SEQ ID NO: 635990 - DNA, 22 bp, Artificial Sequence
  chemically synthesized
cctgcctttctccagtattttt

SEQ ID NO: 635991 - DNA, 22 bp, Artificial Sequence
  chemically synthesized
ctgcctttctccagtatttttt

SEQ ID NO: 635992 - DNA, 22 bp, Artificial Sequence
  chemically synthesized
cctttctccagtattttttaga

SEQ ID NO: 635993 - DNA, 22 bp, Artificial Sequence
  chemically synthesized
tctccagtattttttagaagaa

SEQ ID NO: 635994 - DNA, 22 bp, Artificial Sequence
  chemically synthesized
ctccagtattttttagaagaaa

SEQ ID NO: 635995 - DNA, 22 bp, Artificial Sequence
  chemically synthesized
tccagtattttttagaagaaaa

SEQ ID NO: 635996 - DNA, 22 bp, Artificial Sequence
  chemically synthesized
cagtattttttagaagaaaaag

SEQ ID NO: 635997 - DNA, 22 bp, Artificial Sequence
  chemically synthesized
gatacatcagtgtgctttttct

SEQ ID NO: 635998 - DNA, 22 bp, Artificial Sequence
  chemically synthesized
tttagaagaaaaagcacactga

SEQ ID NO: 635999 - DNA, 22 bp, Artificial Sequence
  chemically synthesized
ttagaagaaaaagcacactgat

SEQ ID NO: 636000 - DNA, 22 bp, Artificial Sequence
  chemically synthesized
ggtattggatacatcagtgtgc

SEQ ID NO: 636001 - DNA, 22 bp, Artificial Sequence
  chemically synthesized
tagaagaaaaagcacactgatg

SEQ ID NO: 636002 - DNA, 22 bp, Artificial Sequence
  chemically synthesized
agaagaaaaagcacactgatgt

SEQ ID NO: 636003 - DNA, 22 bp, Artificial Sequence
  chemically synthesized
gaagaaaaagcacactgatgta

SEQ ID NO: 636004 - DNA, 22 bp, Artificial Sequence
  chemically synthesized
tagccaaatgttgggtattgga

SEQ ID NO: 636005 - DNA, 22 bp, Artificial Sequence
  chemically synthesized
attgtagccaaatgttgggtat

SEQ ID NO: 636006 - DNA, 22 bp, Artificial Sequence
  chemically synthesized
atgtatccaatacccaacattt

SEQ ID NO: 636007 - DNA, 22 bp, Artificial Sequence
  chemically synthesized
tatcatatggaaaaaaattaat

SEQ ID NO: 636008 - DNA, 22 bp, Artificial Sequence
  chemically synthesized
ggctacaattaatttttttcca

SEQ ID NO: 636009 - DNA, 22 bp, Artificial Sequence
  chemically synthesized
gctacaattaatttttttccat

SEQ ID NO: 636010 - DNA, 22 bp, Artificial Sequence
  chemically synthesized
caattaatttttttccatatga

SEQ ID NO: 636011 - DNA, 22 bp, Artificial Sequence
  chemically synthesized
aaagcatcggtcctatatcata

SEQ ID NO: 636012 - DNA, 22 bp, Artificial Sequence
  chemically synthesized
atttttttccatatgatatagg

SEQ ID NO: 636013 - DNA, 22 bp, Artificial Sequence
  chemically synthesized
ttttccatatgatataggaccg

SEQ ID NO: 636014 - DNA, 22 bp, Artificial Sequence
  chemically synthesized
tttccatatgatataggaccga

SEQ ID NO: 636015 - DNA, 22 bp, Artificial Sequence
  chemically synthesized
ttccatatgatataggaccgat

SEQ ID NO: 636016 - DNA, 22 bp, Artificial Sequence
  chemically synthesized
tccatatgatataggaccgatg

SEQ ID NO: 636017 - DNA, 22 bp, Artificial Sequence
  chemically synthesized
ccatatgatataggaccgatgc

SEQ ID NO: 636018 - DNA, 22 bp, Artificial Sequence
  chemically synthesized
catatgatataggaccgatgct

SEQ ID NO: 636019 - DNA, 22 bp, Artificial Sequence
  chemically synthesized
tgtgtgaaattgaaagcatcgg

SEQ ID NO: 636020 - DNA, 22 bp, Artificial Sequence
  chemically synthesized
atgtgtgaaattgaaagcatcg

SEQ ID NO: 636021 - DNA, 22 bp, Artificial Sequence
  chemically synthesized
cacacagaatttatgtgtgaaa

SEQ ID NO: 636022 - DNA, 22 bp, Artificial Sequence
  chemically synthesized
tcaatttcacacataaattctg

SEQ ID NO: 636023 - DNA, 22 bp, Artificial Sequence
  chemically synthesized
caatttcacacataaattctgt

SEQ ID NO: 636024 - DNA, 22 bp, Artificial Sequence
  chemically synthesized
aaggtgttacacacagaattta

SEQ ID NO: 636025 - DNA, 22 bp, Artificial Sequence
  chemically synthesized
aatttcacacataaattctgtg

SEQ ID NO: 636026 - DNA, 22 bp, Artificial Sequence
  chemically synthesized
cacacataaattctgtgtgtaa

SEQ ID NO: 636027 - DNA, 22 bp, Artificial Sequence
  chemically synthesized
acacataaattctgtgtgtaac

SEQ ID NO: 636028 - DNA, 22 bp, Artificial Sequence
  chemically synthesized
tacaccataatatgttaaaggt

SEQ ID NO: 636029 - DNA, 22 bp, Artificial Sequence
  chemically synthesized
tgtgtgtaacacctttaacata

SEQ ID NO: 636030 - DNA, 22 bp, Artificial Sequence
  chemically synthesized
tgtgtaacacctttaacatatt

SEQ ID NO: 636031 - DNA, 22 bp, Artificial Sequence
  chemically synthesized
taacatattatggtgtacaatg

SEQ ID NO: 636032 - DNA, 22 bp, Artificial Sequence
  chemically synthesized
aacatattatggtgtacaatgt

SEQ ID NO: 636033 - DNA, 22 bp, Artificial Sequence
  chemically synthesized
acatattatggtgtacaatgtt

SEQ ID NO: 636034 - DNA, 22 bp, Artificial Sequence
  chemically synthesized
ataatcagcaacaacattgtac

SEQ ID NO: 636035 - DNA, 22 bp, Artificial Sequence
  chemically synthesized
tggtgtacaatgttgttgctga

SEQ ID NO: 636036 - DNA, 22 bp, Artificial Sequence
  chemically synthesized
atcagctaataatcagcaacaa

SEQ ID NO: 636037 - DNA, 22 bp, Artificial Sequence
  chemically synthesized
acaactgatcagctaataatca

SEQ ID NO: 636038 - DNA, 22 bp, Artificial Sequence
  chemically synthesized
ttgctgattattagctgatcag

SEQ ID NO: 636039 - DNA, 22 bp, Artificial Sequence
  chemically synthesized
accaccattcacaactgatcag

SEQ ID NO: 636040 - DNA, 22 bp, Artificial Sequence
  chemically synthesized
ctgattattagctgatcagttg

SEQ ID NO: 636041 - DNA, 22 bp, Artificial Sequence
  chemically synthesized
caccaccattcacaactgatca

SEQ ID NO: 636042 - DNA, 22 bp, Artificial Sequence
  chemically synthesized
tcaccaccattcacaactgatc

SEQ ID NO: 636043 - DNA, 22 bp, Artificial Sequence
  chemically synthesized
attattagctgatcagttgtga

SEQ ID NO: 636044 - DNA, 22 bp, Artificial Sequence
  chemically synthesized
ttagctgatcagttgtgaatgg

SEQ ID NO: 636045 - DNA, 22 bp, Artificial Sequence
  chemically synthesized
agtatctttcaccaccattcac

SEQ ID NO: 636046 - DNA, 22 bp, Artificial Sequence
  chemically synthesized
gctgatcagttgtgaatggtgg

SEQ ID NO: 636047 - DNA, 22 bp, Artificial Sequence
  chemically synthesized
cagtatctttcaccaccattca

SEQ ID NO: 636048 - DNA, 22 bp, Artificial Sequence
  chemically synthesized
atcagttgtgaatggtggtgaa

SEQ ID NO: 636049 - DNA, 22 bp, Artificial Sequence
  chemically synthesized
gtttcagtatctttcaccacca

SEQ ID NO: 636050 - DNA, 22 bp, Artificial Sequence
  chemically synthesized
ctagtttcagtatctttcacca

SEQ ID NO: 636051 - DNA, 22 bp, Artificial Sequence
  chemically synthesized
gctactagtttcagtatctttc

SEQ ID NO: 636052 - DNA, 22 bp, Artificial Sequence
  chemically synthesized
tgaatggtggtgaaagatactg

SEQ ID NO: 636053 - DNA, 22 bp, Artificial Sequence
  chemically synthesized
agctactagtttcagtatcttt

SEQ ID NO: 636054 - DNA, 22 bp, Artificial Sequence
  chemically synthesized
ggaaatttagctactagtttca

SEQ ID NO: 636055 - DNA, 22 bp, Artificial Sequence
  chemically synthesized
aggaaatttagctactagtttc

SEQ ID NO: 636056 - DNA, 22 bp, Artificial Sequence
  chemically synthesized
aaactagtagctaaatttccta

SEQ ID NO: 636057 - DNA, 22 bp, Artificial Sequence
  chemically synthesized
gtagctaaatttcctaaacgtg

SEQ ID NO: 636058 - DNA, 22 bp, Artificial Sequence
  chemically synthesized
aatttcctaaacgtgtgggctg

SEQ ID NO: 636059 - DNA, 22 bp, Artificial Sequence
  chemically synthesized
tgtacacatggaacagcccaca

SEQ ID NO: 636060 - DNA, 22 bp, Artificial Sequence
  chemically synthesized
gtgtacacatggaacagcccac

SEQ ID NO: 636061 - DNA, 22 bp, Artificial Sequence
  chemically synthesized
ttgtgtacacatggaacagccc

SEQ ID NO: 636062 - DNA, 22 bp, Artificial Sequence
  chemically synthesized
cctaaacgtgtgggctgttcca

SEQ ID NO: 636063 - DNA, 22 bp, Artificial Sequence
  chemically synthesized
ctaaacgtgtgggctgttccat

SEQ ID NO: 636064 - DNA, 22 bp, Artificial Sequence
  chemically synthesized
aacgtgtgggctgttccatgtg

SEQ ID NO: 636065 - DNA, 22 bp, Artificial Sequence
  chemically synthesized
ttccatgtgtacacaagaatgt

SEQ ID NO: 636066 - DNA, 22 bp, Artificial Sequence
  chemically synthesized
catgtgtacacaagaatgtatt

SEQ ID NO: 636067 - DNA, 22 bp, Artificial Sequence
  chemically synthesized
gaaatcaagcataatacattct

SEQ ID NO: 636068 - DNA, 22 bp, Artificial Sequence
  chemically synthesized
agaaatcaagcataatacattc

SEQ ID NO: 636069 - DNA, 22 bp, Artificial Sequence
  chemically synthesized
tagaaatcaagcataatacatt

SEQ ID NO: 636070 - DNA, 22 bp, Artificial Sequence
  chemically synthesized
atattttagaaatcaagcataa

SEQ ID NO: 636071 - DNA, 22 bp, Artificial Sequence
  chemically synthesized
agttaatattttagaaatcaag

SEQ ID NO: 636072 - DNA, 22 bp, Artificial Sequence
  chemically synthesized
ttgagttaatattttagaaatc

SEQ ID NO: 636073 - DNA, 22 bp, Artificial Sequence
  chemically synthesized
gttgagttaatattttagaaat

SEQ ID NO: 636074 - DNA, 22 bp, Artificial Sequence
  chemically synthesized
tgcttgatttctaaaatattaa

SEQ ID NO: 636075 - DNA, 22 bp, Artificial Sequence
  chemically synthesized
gatttctaaaatattaactcaa

SEQ ID NO: 636076 - DNA, 22 bp, Artificial Sequence
  chemically synthesized
atttctaaaatattaactcaac

SEQ ID NO: 636077 - DNA, 22 bp, Artificial Sequence
  chemically synthesized
ctaaaatattaactcaacaagc

SEQ ID NO: 636078 - DNA, 22 bp, Artificial Sequence
  chemically synthesized
taaaatattaactcaacaagca

SEQ ID NO: 636079 - DNA, 22 bp, Artificial Sequence
  chemically synthesized
aaatattaactcaacaagcact

SEQ ID NO: 636080 - DNA, 22 bp, Artificial Sequence
  chemically synthesized
tgcaacaaacaatcagtaaagt

SEQ ID NO: 636081 - DNA, 22 bp, Artificial Sequence
  chemically synthesized
actcaacaagcactttactgat

SEQ ID NO: 636082 - DNA, 22 bp, Artificial Sequence
  chemically synthesized
tgtgcaacaaacaatcagtaaa

SEQ ID NO: 636083 - DNA, 22 bp, Artificial Sequence
  chemically synthesized
aacaagcactttactgattgtt

SEQ ID NO: 636084 - DNA, 22 bp, Artificial Sequence
  chemically synthesized
tatgaggatactctgtgcaaca

SEQ ID NO: 636085 - DNA, 22 bp, Artificial Sequence
  chemically synthesized
tactgattgtttgttgcacaga

SEQ ID NO: 636086 - DNA, 22 bp, Artificial Sequence
  chemically synthesized
actgattgtttgttgcacagag

SEQ ID NO: 636087 - DNA, 22 bp, Artificial Sequence
  chemically synthesized
ctgattgtttgttgcacagagt

SEQ ID NO: 636088 - DNA, 22 bp, Artificial Sequence
  chemically synthesized
ctgtatgaggatactctgtgca

SEQ ID NO: 636089 - DNA, 22 bp, Artificial Sequence
  chemically synthesized
attgtttgttgcacagagtatc

SEQ ID NO: 636090 - DNA, 22 bp, Artificial Sequence
  chemically synthesized
tcgttactgtatgaggatactc

SEQ ID NO: 636091 - DNA, 22 bp, Artificial Sequence
  chemically synthesized
tttgttgcacagagtatcctca

SEQ ID NO: 636092 - DNA, 22 bp, Artificial Sequence
  chemically synthesized
gttgcacagagtatcctcatac

SEQ ID NO: 636093 - DNA, 22 bp, Artificial Sequence
  chemically synthesized
attgtcgttactgtatgaggat

SEQ ID NO: 636094 - DNA, 22 bp, Artificial Sequence
  chemically synthesized
ttgcacagagtatcctcataca

SEQ ID NO: 636095 - DNA, 22 bp, Artificial Sequence
  chemically synthesized
ctcattgtcgttactgtatgag

SEQ ID NO: 636096 - DNA, 22 bp, Artificial Sequence
  chemically synthesized
cacagagtatcctcatacagta

SEQ ID NO: 636097 - DNA, 22 bp, Artificial Sequence
  chemically synthesized
gctcattgtcgttactgtatga

SEQ ID NO: 636098 - DNA, 22 bp, Artificial Sequence
  chemically synthesized
atacagtaacgacaatgagcaa

SEQ ID NO: 636099 - DNA, 22 bp, Artificial Sequence
  chemically synthesized
aggacaggatgtaagtcttgct

SEQ ID NO: 636100 - DNA, 22 bp, Artificial Sequence
  chemically synthesized
aaggacaggatgtaagtcttgc

SEQ ID NO: 636101 - DNA, 22 bp, Artificial Sequence
  chemically synthesized
cttaaggacaggatgtaagtct

SEQ ID NO: 636102 - DNA, 22 bp, Artificial Sequence
  chemically synthesized
agctccttaaggacaggatgta

SEQ ID NO: 636103 - DNA, 22 bp, Artificial Sequence
  chemically synthesized
aagctccttaaggacaggatgt

SEQ ID NO: 636104 - DNA, 22 bp, Artificial Sequence
  chemically synthesized
gaacttaagctccttaaggaca

SEQ ID NO: 636105 - DNA, 22 bp, Artificial Sequence
  chemically synthesized
cctagaacttaagctccttaag

SEQ ID NO: 636106 - DNA, 22 bp, Artificial Sequence
  chemically synthesized
acatcctgtccttaaggagctt

SEQ ID NO: 636107 - DNA, 22 bp, Artificial Sequence
  chemically synthesized
catcctgtccttaaggagctta

SEQ ID NO: 636108 - DNA, 22 bp, Artificial Sequence
  chemically synthesized
caactccctagaacttaagctc

SEQ ID NO: 636109 - DNA, 22 bp, Artificial Sequence
  chemically synthesized
tccttaaggagcttaagttcta

SEQ ID NO: 636110 - DNA, 22 bp, Artificial Sequence
  chemically synthesized
cctacaactccctagaacttaa

SEQ ID NO: 636111 - DNA, 22 bp, Artificial Sequence
  chemically synthesized
tgcctacaactccctagaactt

SEQ ID NO: 636112 - DNA, 22 bp, Artificial Sequence
  chemically synthesized
ctgcctacaactccctagaact

SEQ ID NO: 636113 - DNA, 22 bp, Artificial Sequence
  chemically synthesized
aaggagcttaagttctagggag

SEQ ID NO: 636114 - DNA, 22 bp, Artificial Sequence
  chemically synthesized
ttctgcctacaactccctagaa

SEQ ID NO: 636115 - DNA, 22 bp, Artificial Sequence
  chemically synthesized
aggagcttaagttctagggagt

SEQ ID NO: 636116 - DNA, 22 bp, Artificial Sequence
  chemically synthesized
cttctgcctacaactccctaga

SEQ ID NO: 636117 - DNA, 22 bp, Artificial Sequence
  chemically synthesized
tcttctgcctacaactccctag

SEQ ID NO: 636118 - DNA, 22 bp, Artificial Sequence
  chemically synthesized
tttcttctgcctacaactccct

SEQ ID NO: 636119 - DNA, 22 bp, Artificial Sequence
  chemically synthesized
ctttcttctgcctacaactccc

SEQ ID NO: 636120 - DNA, 22 bp, Artificial Sequence
  chemically synthesized
aagttctagggagttgtaggca

SEQ ID NO: 636121 - DNA, 22 bp, Artificial Sequence
  chemically synthesized
agttctagggagttgtaggcag

SEQ ID NO: 636122 - DNA, 22 bp, Artificial Sequence
  chemically synthesized
gtacttctttcttctgcctaca

SEQ ID NO: 636123 - DNA, 22 bp, Artificial Sequence
  chemically synthesized
ctagtacttctttcttctgcct

SEQ ID NO: 636124 - DNA, 22 bp, Artificial Sequence
  chemically synthesized
tagggagttgtaggcagaagaa

SEQ ID NO: 636125 - DNA, 22 bp, Artificial Sequence
  chemically synthesized
gggagttgtaggcagaagaaag

SEQ ID NO: 636126 - DNA, 22 bp, Artificial Sequence
  chemically synthesized
agccagttactagtacttcttt

SEQ ID NO: 636127 - DNA, 22 bp, Artificial Sequence
  chemically synthesized
cagccagttactagtacttctt

SEQ ID NO: 636128 - DNA, 22 bp, Artificial Sequence
  chemically synthesized
taggcagaagaaagaagtacta

SEQ ID NO: 636129 - DNA, 22 bp, Artificial Sequence
  chemically synthesized
tcagccagttactagtacttct

SEQ ID NO: 636130 - DNA, 22 bp, Artificial Sequence
  chemically synthesized
gtaactggctgaaaacatggct

SEQ ID NO: 636131 - DNA, 22 bp, Artificial Sequence
  chemically synthesized
gctgaaaacatggctgggtgtg

SEQ ID NO: 636132 - DNA, 22 bp, Artificial Sequence
  chemically synthesized
aaggcatgagccaccacaccca

SEQ ID NO: 636133 - DNA, 22 bp, Artificial Sequence
  chemically synthesized
aaaacatggctgggtgtggtgg

SEQ ID NO: 636134 - DNA, 22 bp, Artificial Sequence
  chemically synthesized
ggattaaaggcatgagccacca

SEQ ID NO: 636135 - DNA, 22 bp, Artificial Sequence
  chemically synthesized
ggtgtggtggctcatgccttta

SEQ ID NO: 636136 - DNA, 22 bp, Artificial Sequence
  chemically synthesized
ccaaagtgctgggattaaaggc

SEQ ID NO: 636137 - DNA, 22 bp, Artificial Sequence
  chemically synthesized
agcctcccaaagtgctgggatt

SEQ ID NO: 636138 - DNA, 22 bp, Artificial Sequence
  chemically synthesized
atgcctttaatcccagcacttt

SEQ ID NO: 636139 - DNA, 22 bp, Artificial Sequence
  chemically synthesized
taatcccagcactttgggaggc

SEQ ID NO: 636140 - DNA, 22 bp, Artificial Sequence
  chemically synthesized
aatcccagcactttgggaggct

SEQ ID NO: 636141 - DNA, 22 bp, Artificial Sequence
  chemically synthesized
atcccagcactttgggaggctg

SEQ ID NO: 636142 - DNA, 22 bp, Artificial Sequence
  chemically synthesized
aagcaatccacccgcctcagcc

SEQ ID NO: 636143 - DNA, 22 bp, Artificial Sequence
  chemically synthesized
tgggaggctgaggcgggtggat

SEQ ID NO: 636144 - DNA, 22 bp, Artificial Sequence
  chemically synthesized
gggaggctgaggcgggtggatt

SEQ ID NO: 636145 - DNA, 22 bp, Artificial Sequence
  chemically synthesized
ccaacctcaagcaatccacccg

SEQ ID NO: 636146 - DNA, 22 bp, Artificial Sequence
  chemically synthesized
ggaggctgaggcgggtggattg

SEQ ID NO: 636147 - DNA, 22 bp, Artificial Sequence
  chemically synthesized
aactcccaacctcaagcaatcc

SEQ ID NO: 636148 - DNA, 22 bp, Artificial Sequence
  chemically synthesized
gaactcccaacctcaagcaatc

SEQ ID NO: 636149 - DNA, 22 bp, Artificial Sequence
  chemically synthesized
ttgaactcccaacctcaagcaa

SEQ ID NO: 636150 - DNA, 22 bp, Artificial Sequence
  chemically synthesized
aggcgggtggattgcttgaggt

SEQ ID NO: 636151 - DNA, 22 bp, Artificial Sequence
  chemically synthesized
ttcttgaactcccaacctcaag

SEQ ID NO: 636152 - DNA, 22 bp, Artificial Sequence
  chemically synthesized
gccaggctgttcttgaactccc

SEQ ID NO: 636153 - DNA, 22 bp, Artificial Sequence
  chemically synthesized
cttgaggttgggagttcaagaa

SEQ ID NO: 636154 - DNA, 22 bp, Artificial Sequence
  chemically synthesized
gaggttgggagttcaagaacag

SEQ ID NO: 636155 - DNA, 22 bp, Artificial Sequence
  chemically synthesized
aggttgggagttcaagaacagc

SEQ ID NO: 636156 - DNA, 22 bp, Artificial Sequence
  chemically synthesized
accatgttggccaggctgttct

SEQ ID NO: 636157 - DNA, 22 bp, Artificial Sequence
  chemically synthesized
caccatgttggccaggctgttc

SEQ ID NO: 636158 - DNA, 22 bp, Artificial Sequence
  chemically synthesized
ggagttcaagaacagcctggcc

SEQ ID NO: 636159 - DNA, 22 bp, Artificial Sequence
  chemically synthesized
aagaacagcctggccaacatgg

SEQ ID NO: 636160 - DNA, 22 bp, Artificial Sequence
  chemically synthesized
gtagagacagggtttcaccatg

SEQ ID NO: 636161 - DNA, 22 bp, Artificial Sequence
  chemically synthesized
agtagagacagggtttcaccat

SEQ ID NO: 636162 - DNA, 22 bp, Artificial Sequence
  chemically synthesized
tagtagagacagggtttcacca

SEQ ID NO: 636163 - DNA, 22 bp, Artificial Sequence
  chemically synthesized
ttagtagagacagggtttcacc

SEQ ID NO: 636164 - DNA, 22 bp, Artificial Sequence
  chemically synthesized
gccaacatggtgaaaccctgtc

SEQ ID NO: 636165 - DNA, 22 bp, Artificial Sequence
  chemically synthesized
tatttttagtagagacagggtt

SEQ ID NO: 636166 - DNA, 22 bp, Artificial Sequence
  chemically synthesized
gtatttttagtagagacagggt

SEQ ID NO: 636167 - DNA, 22 bp, Artificial Sequence
  chemically synthesized
ttgtatttttagtagagacagg

SEQ ID NO: 636168 - DNA, 22 bp, Artificial Sequence
  chemically synthesized
cttgtatttttagtagagacag

SEQ ID NO: 636169 - DNA, 22 bp, Artificial Sequence
  chemically synthesized
tcttgtatttttagtagagaca

SEQ ID NO: 636170 - DNA, 22 bp, Artificial Sequence
  chemically synthesized
ttcttgtatttttagtagagac

SEQ ID NO: 636171 - DNA, 22 bp, Artificial Sequence
  chemically synthesized
tttcttgtatttttagtagaga

SEQ ID NO: 636172 - DNA, 22 bp, Artificial Sequence
  chemically synthesized
ctttttcttgtatttttagtag

SEQ ID NO: 636173 - DNA, 22 bp, Artificial Sequence
  chemically synthesized
gctactttttcttgtattttta

SEQ ID NO: 636174 - DNA, 22 bp, Artificial Sequence
  chemically synthesized
tctctactaaaaatacaagaaa

SEQ ID NO: 636175 - DNA, 22 bp, Artificial Sequence
  chemically synthesized
tactaaaaatacaagaaaaagt

SEQ ID NO: 636176 - DNA, 22 bp, Artificial Sequence
  chemically synthesized
ctaaaaatacaagaaaaagtag

SEQ ID NO: 636177 - DNA, 22 bp, Artificial Sequence
  chemically synthesized
gccaccatgcctggctactttt

SEQ ID NO: 636178 - DNA, 22 bp, Artificial Sequence
  chemically synthesized
aaaatacaagaaaaagtagcca

SEQ ID NO: 636179 - DNA, 22 bp, Artificial Sequence
  chemically synthesized
caggctcgccaccatgcctggc

SEQ ID NO: 636180 - DNA, 22 bp, Artificial Sequence
  chemically synthesized
ggattacaggctcgccaccatg

SEQ ID NO: 636181 - DNA, 22 bp, Artificial Sequence
  chemically synthesized
agtagctgggattacaggctcg

SEQ ID NO: 636182 - DNA, 22 bp, Artificial Sequence
  chemically synthesized
ctgagtagctgggattacaggc

SEQ ID NO: 636183 - DNA, 22 bp, Artificial Sequence
  chemically synthesized
accctcctgagtagctgggatt

SEQ ID NO: 636184 - DNA, 22 bp, Artificial Sequence
  chemically synthesized
cctcaccctcctgagtagctgg

SEQ ID NO: 636185 - DNA, 22 bp, Artificial Sequence
  chemically synthesized
ctgcctcaccctcctgagtagc

SEQ ID NO: 636186 - DNA, 22 bp, Artificial Sequence
  chemically synthesized
tcctgcctcaccctcctgagta

SEQ ID NO: 636187 - DNA, 22 bp, Artificial Sequence
  chemically synthesized
taatcccagctactcaggaggg

SEQ ID NO: 636188 - DNA, 22 bp, Artificial Sequence
  chemically synthesized
aagcgattctcctgcctcaccc

SEQ ID NO: 636189 - DNA, 22 bp, Artificial Sequence
  chemically synthesized
ctcaggagggtgaggcaggaga

SEQ ID NO: 636190 - DNA, 22 bp, Artificial Sequence
  chemically synthesized
ggttcaagcgattctcctgcct

SEQ ID NO: 636191 - DNA, 22 bp, Artificial Sequence
  chemically synthesized
aggagggtgaggcaggagaatc

SEQ ID NO: 636192 - DNA, 22 bp, Artificial Sequence
  chemically synthesized
ctgggttcaagcgattctcctg

SEQ ID NO: 636193 - DNA, 22 bp, Artificial Sequence
  chemically synthesized
cacctcctgggttcaagcgatt

SEQ ID NO: 636194 - DNA, 22 bp, Artificial Sequence
  chemically synthesized
caacctccacctcctgggttca

SEQ ID NO: 636195 - DNA, 22 bp, Artificial Sequence
  chemically synthesized
attgcaacctccacctcctggg

SEQ ID NO: 636196 - DNA, 22 bp, Artificial Sequence
  chemically synthesized
agctcattgcaacctccacctc

SEQ ID NO: 636197 - DNA, 22 bp, Artificial Sequence
  chemically synthesized
gaacccaggaggtggaggttgc

SEQ ID NO: 636198 - DNA, 22 bp, Artificial Sequence
  chemically synthesized
aacccaggaggtggaggttgca

SEQ ID NO: 636199 - DNA, 22 bp, Artificial Sequence
  chemically synthesized
gagtgcagtggtgcgatctcag

SEQ ID NO: 636200 - DNA, 22 bp, Artificial Sequence
  chemically synthesized
caatgagctgagatcgcaccac

SEQ ID NO: 636201 - DNA, 22 bp, Artificial Sequence
  chemically synthesized
cccaggctggagtgcagtggtg

SEQ ID NO: 636202 - DNA, 22 bp, Artificial Sequence
  chemically synthesized
ttgcccaggctggagtgcagtg

SEQ ID NO: 636203 - DNA, 22 bp, Artificial Sequence
  chemically synthesized
attgcccaggctggagtgcagt

SEQ ID NO: 636204 - DNA, 22 bp, Artificial Sequence
  chemically synthesized
tattgcccaggctggagtgcag

SEQ ID NO: 636205 - DNA, 22 bp, Artificial Sequence
  chemically synthesized
agatcgcaccactgcactccag

SEQ ID NO: 636206 - DNA, 22 bp, Artificial Sequence
  chemically synthesized
gctttattgcccaggctggagt

SEQ ID NO: 636207 - DNA, 22 bp, Artificial Sequence
  chemically synthesized
cactccagcctgggcaataaag

SEQ ID NO: 636208 - DNA, 22 bp, Artificial Sequence
  chemically synthesized
cagcctgggcaataaagcgaga

SEQ ID NO: 636209 - DNA, 22 bp, Artificial Sequence
  chemically synthesized
tgtgagacggagtctcgcttta

SEQ ID NO: 636210 - DNA, 22 bp, Artificial Sequence
  chemically synthesized
gtgtgagacggagtctcgcttt

SEQ ID NO: 636211 - DNA, 22 bp, Artificial Sequence
  chemically synthesized
tgtgtgagacggagtctcgctt

SEQ ID NO: 636212 - DNA, 22 bp, Artificial Sequence
  chemically synthesized
ttgtgtgagacggagtctcgct

SEQ ID NO: 636213 - DNA, 22 bp, Artificial Sequence
  chemically synthesized
ttttgtgtgagacggagtctcg

SEQ ID NO: 636214 - DNA, 22 bp, Artificial Sequence
  chemically synthesized
cttttgtgtgagacggagtctc

SEQ ID NO: 636215 - DNA, 22 bp, Artificial Sequence
  chemically synthesized
ggcaataaagcgagactccgtc

SEQ ID NO: 636216 - DNA, 22 bp, Artificial Sequence
  chemically synthesized
tttcttttgtgtgagacggagt

SEQ ID NO: 636217 - DNA, 22 bp, Artificial Sequence
  chemically synthesized
ttgtttcttttgtgtgagacgg

SEQ ID NO: 636218 - DNA, 22 bp, Artificial Sequence
  chemically synthesized
ttgttgtttcttttgtgtgaga

SEQ ID NO: 636219 - DNA, 22 bp, Artificial Sequence
  chemically synthesized
ttgttgttgtttcttttgtgtg

SEQ ID NO: 636220 - DNA, 22 bp, Artificial Sequence
  chemically synthesized
ttgttgttgttgtttcttttgt

SEQ ID NO: 636221 - DNA, 22 bp, Artificial Sequence
  chemically synthesized
ttgttgttgttgttgtttcttt

SEQ ID NO: 636222 - DNA, 22 bp, Artificial Sequence
  chemically synthesized
cgtctcacacaaaagaaacaac

SEQ ID NO: 636223 - DNA, 22 bp, Artificial Sequence
  chemically synthesized
ttgttgttgttgttgttgtttc

SEQ ID NO: 636224 - DNA, 22 bp, Artificial Sequence
  chemically synthesized
ttgttgttgttgttgttgttgt

SEQ ID NO: 636225 - DNA, 22 bp, Artificial Sequence
  chemically synthesized
acacaaaagaaacaacaacaac

SEQ ID NO: 636226 - DNA, 22 bp, Artificial Sequence
  chemically synthesized
ttgttgttgttgttgttgttgt

SEQ ID NO: 636227 - DNA, 22 bp, Artificial Sequence
  chemically synthesized
ttgttgttgttgttgttgttgt

SEQ ID NO: 636228 - DNA, 22 bp, Artificial Sequence
  chemically synthesized
ttgttgttgttgttgttgttgt

SEQ ID NO: 636229 - DNA, 22 bp, Artificial Sequence
  chemically synthesized
gttgttgttgttgttgttgttg

SEQ ID NO: 636230 - DNA, 22 bp, Artificial Sequence
  chemically synthesized
tgttgttgttgttgttgttgtt

SEQ ID NO: 636231 - DNA, 22 bp, Artificial Sequence
  chemically synthesized
gttttgttgttgttgttgttgt

SEQ ID NO: 636232 - DNA, 22 bp, Artificial Sequence
  chemically synthesized
tggttttgttgttgttgttgtt

SEQ ID NO: 636233 - DNA, 22 bp, Artificial Sequence
  chemically synthesized
tatcattctggttttgttgttg

SEQ ID NO: 636234 - DNA, 22 bp, Artificial Sequence
  chemically synthesized
atcatgcattatatcattctgg

SEQ ID NO: 636235 - DNA, 22 bp, Artificial Sequence
  chemically synthesized
aatcatgcattatatcattctg

SEQ ID NO: 636236 - DNA, 22 bp, Artificial Sequence
  chemically synthesized
gaacttaatcatgcattatatc

SEQ ID NO: 636237 - DNA, 22 bp, Artificial Sequence
  chemically synthesized
ggaacttaatcatgcattatat

SEQ ID NO: 636238 - DNA, 22 bp, Artificial Sequence
  chemically synthesized
tggaacttaatcatgcattata

SEQ ID NO: 636239 - DNA, 22 bp, Artificial Sequence
  chemically synthesized
ttggaacttaatcatgcattat

SEQ ID NO: 636240 - DNA, 22 bp, Artificial Sequence
  chemically synthesized
ttttggaacttaatcatgcatt

SEQ ID NO: 636241 - DNA, 22 bp, Artificial Sequence
  chemically synthesized
cttttggaacttaatcatgcat

SEQ ID NO: 636242 - DNA, 22 bp, Artificial Sequence
  chemically synthesized
tcttttggaacttaatcatgca

SEQ ID NO: 636243 - DNA, 22 bp, Artificial Sequence
  chemically synthesized
agtgagttttcttttggaactt

SEQ ID NO: 636244 - DNA, 22 bp, Artificial Sequence
  chemically synthesized
actcagtgagttttcttttgga

SEQ ID NO: 636245 - DNA, 22 bp, Artificial Sequence
  chemically synthesized
cactcagtgagttttcttttgg

SEQ ID NO: 636246 - DNA, 22 bp, Artificial Sequence
  chemically synthesized
tcactcagtgagttttcttttg

SEQ ID NO: 636247 - DNA, 22 bp, Artificial Sequence
  chemically synthesized
ttcactcagtgagttttctttt

SEQ ID NO: 636248 - DNA, 22 bp, Artificial Sequence
  chemically synthesized
ttttcactcagtgagttttctt

SEQ ID NO: 636249 - DNA, 22 bp, Artificial Sequence
  chemically synthesized
cttttcactcagtgagttttct

SEQ ID NO: 636250 - DNA, 22 bp, Artificial Sequence
  chemically synthesized
tcttttcactcagtgagttttc

SEQ ID NO: 636251 - DNA, 22 bp, Artificial Sequence
  chemically synthesized
agttccaaaagaaaactcactg

SEQ ID NO: 636252 - DNA, 22 bp, Artificial Sequence
  chemically synthesized
caaaagaaaactcactgagtga

SEQ ID NO: 636253 - DNA, 22 bp, Artificial Sequence
  chemically synthesized
aaatatagcatcctttcttttc

SEQ ID NO: 636254 - DNA, 22 bp, Artificial Sequence
  chemically synthesized
actgagtgaaaagaaaggatgc

SEQ ID NO: 636255 - DNA, 22 bp, Artificial Sequence
  chemically synthesized
acctgaaatatagcatcctttc

SEQ ID NO: 636256 - DNA, 22 bp, Artificial Sequence
  chemically synthesized
aacctgaaatatagcatccttt

SEQ ID NO: 636257 - DNA, 22 bp, Artificial Sequence
  chemically synthesized
ttaacctgaaatatagcatcct

SEQ ID NO: 636258 - DNA, 22 bp, Artificial Sequence
  chemically synthesized
agtgaaaagaaaggatgctata

SEQ ID NO: 636259 - DNA, 22 bp, Artificial Sequence
  chemically synthesized
tgttcttaacctgaaatatagc

SEQ ID NO: 636260 - DNA, 22 bp, Artificial Sequence
  chemically synthesized
agtacattatgttcttaacctg

SEQ ID NO: 636261 - DNA, 22 bp, Artificial Sequence
  chemically synthesized
gagtacattatgttcttaacct

SEQ ID NO: 636262 - DNA, 22 bp, Artificial Sequence
  chemically synthesized
gccttgagtacattatgttctt

SEQ ID NO: 636263 - DNA, 22 bp, Artificial Sequence
  chemically synthesized
tatttcaggttaagaacataat

SEQ ID NO: 636264 - DNA, 22 bp, Artificial Sequence
  chemically synthesized
ggccttgagtacattatgttct

SEQ ID NO: 636265 - DNA, 22 bp, Artificial Sequence
  chemically synthesized
tggccttgagtacattatgttc

SEQ ID NO: 636266 - DNA, 22 bp, Artificial Sequence
  chemically synthesized
tttggccttgagtacattatgt

SEQ ID NO: 636267 - DNA, 22 bp, Artificial Sequence
  chemically synthesized
caggttaagaacataatgtact

SEQ ID NO: 636268 - DNA, 22 bp, Artificial Sequence
  chemically synthesized
aggttaagaacataatgtactc

SEQ ID NO: 636269 - DNA, 22 bp, Artificial Sequence
  chemically synthesized
agaacataatgtactcaaggcc

SEQ ID NO: 636270 - DNA, 22 bp, Artificial Sequence
  chemically synthesized
acaacagaataaatgtgctctt

SEQ ID NO: 636271 - DNA, 22 bp, Artificial Sequence
  chemically synthesized
gacaacagaataaatgtgctct

SEQ ID NO: 636272 - DNA, 22 bp, Artificial Sequence
  chemically synthesized
tttgacaacagaataaatgtgc

SEQ ID NO: 636273 - DNA, 22 bp, Artificial Sequence
  chemically synthesized
aaggccaaagagcacatttatt

SEQ ID NO: 636274 - DNA, 22 bp, Artificial Sequence
  chemically synthesized
tgtttgacaacagaataaatgt

SEQ ID NO: 636275 - DNA, 22 bp, Artificial Sequence
  chemically synthesized
ctgtttgacaacagaataaatg

SEQ ID NO: 636276 - DNA, 22 bp, Artificial Sequence
  chemically synthesized
tgccttctgtttgacaacagaa

SEQ ID NO: 636277 - DNA, 22 bp, Artificial Sequence
  chemically synthesized
atgccttctgtttgacaacaga

SEQ ID NO: 636278 - DNA, 22 bp, Artificial Sequence
  chemically synthesized
tatgccttctgtttgacaacag

SEQ ID NO: 636279 - DNA, 22 bp, Artificial Sequence
  chemically synthesized
agcattttatgccttctgtttg

SEQ ID NO: 636280 - DNA, 22 bp, Artificial Sequence
  chemically synthesized
aagcattttatgccttctgttt

SEQ ID NO: 636281 - DNA, 22 bp, Artificial Sequence
  chemically synthesized
attctgttgtcaaacagaaggc

SEQ ID NO: 636282 - DNA, 22 bp, Artificial Sequence
  chemically synthesized
taagcattttatgccttctgtt

SEQ ID NO: 636283 - DNA, 22 bp, Artificial Sequence
  chemically synthesized
ttctgttgtcaaacagaaggca

SEQ ID NO: 636284 - DNA, 22 bp, Artificial Sequence
  chemically synthesized
tttaagcattttatgccttctg

SEQ ID NO: 636285 - DNA, 22 bp, Artificial Sequence
  chemically synthesized
tgttgtcaaacagaaggcataa

SEQ ID NO: 636286 - DNA, 22 bp, Artificial Sequence
  chemically synthesized
ttgtcaaacagaaggcataaaa

SEQ ID NO: 636287 - DNA, 22 bp, Artificial Sequence
  chemically synthesized
ccctctttaagcattttatgcc

SEQ ID NO: 636288 - DNA, 22 bp, Artificial Sequence
  chemically synthesized
tcaaacagaaggcataaaatgc

SEQ ID NO: 636289 - DNA, 22 bp, Artificial Sequence
  chemically synthesized
ttcccctctttaagcattttat

SEQ ID NO: 636290 - DNA, 22 bp, Artificial Sequence
  chemically synthesized
tatcatattattcccctcttta

SEQ ID NO: 636291 - DNA, 22 bp, Artificial Sequence
  chemically synthesized
aaattatatcatattattcccc

SEQ ID NO: 636292 - DNA, 22 bp, Artificial Sequence
  chemically synthesized
ccattcaaattatatcatatta

SEQ ID NO: 636293 - DNA, 22 bp, Artificial Sequence
  chemically synthesized
aaagaggggaataatatgatat

SEQ ID NO: 636294 - DNA, 22 bp, Artificial Sequence
  chemically synthesized
aagaggggaataatatgatata

SEQ ID NO: 636295 - DNA, 22 bp, Artificial Sequence
  chemically synthesized
taccattcaaattatatcatat

SEQ ID NO: 636296 - DNA, 22 bp, Artificial Sequence
  chemically synthesized
ctaccattcaaattatatcata

SEQ ID NO: 636297 - DNA, 22 bp, Artificial Sequence
  chemically synthesized
ttctaccattcaaattatatca

SEQ ID NO: 636298 - DNA, 22 bp, Artificial Sequence
  chemically synthesized
ctcttctaccattcaaattata

SEQ ID NO: 636299 - DNA, 22 bp, Artificial Sequence
  chemically synthesized
agttcctcttctaccattcaaa

SEQ ID NO: 636300 - DNA, 22 bp, Artificial Sequence
  chemically synthesized
cagttcctcttctaccattcaa

SEQ ID NO: 636301 - DNA, 22 bp, Artificial Sequence
  chemically synthesized
cagaaacttcagttcctcttct

SEQ ID NO: 636302 - DNA, 22 bp, Artificial Sequence
  chemically synthesized
ccagaaacttcagttcctcttc

SEQ ID NO: 636303 - DNA, 22 bp, Artificial Sequence
  chemically synthesized
gaatggtagaagaggaactgaa

SEQ ID NO: 636304 - DNA, 22 bp, Artificial Sequence
  chemically synthesized
tcttccagaaacttcagttcct

SEQ ID NO: 636305 - DNA, 22 bp, Artificial Sequence
  chemically synthesized
aatggtagaagaggaactgaag

SEQ ID NO: 636306 - DNA, 22 bp, Artificial Sequence
  chemically synthesized
agctatcttccagaaacttcag

SEQ ID NO: 636307 - DNA, 22 bp, Artificial Sequence
  chemically synthesized
taagctatcttccagaaacttc

SEQ ID NO: 636308 - DNA, 22 bp, Artificial Sequence
  chemically synthesized
ctaagctatcttccagaaactt

SEQ ID NO: 636309 - DNA, 22 bp, Artificial Sequence
  chemically synthesized
tctaagctatcttccagaaact

SEQ ID NO: 636310 - DNA, 22 bp, Artificial Sequence
  chemically synthesized
cctttctaagctatcttccaga

SEQ ID NO: 636311 - DNA, 22 bp, Artificial Sequence
  chemically synthesized
tccctttctaagctatcttcca

SEQ ID NO: 636312 - DNA, 22 bp, Artificial Sequence
  chemically synthesized
tctccctttctaagctatcttc

SEQ ID NO: 636313 - DNA, 22 bp, Artificial Sequence
  chemically synthesized
aagtttctggaagatagcttag

SEQ ID NO: 636314 - DNA, 22 bp, Artificial Sequence
  chemically synthesized
gtctctctccctttctaagcta

SEQ ID NO: 636315 - DNA, 22 bp, Artificial Sequence
  chemically synthesized
ggtctctctccctttctaagct

SEQ ID NO: 636316 - DNA, 22 bp, Artificial Sequence
  chemically synthesized
tggtctctctccctttctaagc

SEQ ID NO: 636317 - DNA, 22 bp, Artificial Sequence
  chemically synthesized
ctggaagatagcttagaaaggg

SEQ ID NO: 636318 - DNA, 22 bp, Artificial Sequence
  chemically synthesized
tggaagatagcttagaaaggga

SEQ ID NO: 636319 - DNA, 22 bp, Artificial Sequence
  chemically synthesized
cctttggtctctctccctttct

SEQ ID NO: 636320 - DNA, 22 bp, Artificial Sequence
  chemically synthesized
gaagatagcttagaaagggaga

SEQ ID NO: 636321 - DNA, 22 bp, Artificial Sequence
  chemically synthesized
tgcctttggtctctctcccttt

SEQ ID NO: 636322 - DNA, 22 bp, Artificial Sequence
  chemically synthesized
ctctgcctttggtctctctccc

SEQ ID NO: 636323 - DNA, 22 bp, Artificial Sequence
  chemically synthesized
gttcctctgcctttggtctctc

SEQ ID NO: 636324 - DNA, 22 bp, Artificial Sequence
  chemically synthesized
agaaagggagagagaccaaagg

SEQ ID NO: 636325 - DNA, 22 bp, Artificial Sequence
  chemically synthesized
gaaagggagagagaccaaaggc

SEQ ID NO: 636326 - DNA, 22 bp, Artificial Sequence
  chemically synthesized
attggttcctctgcctttggtc

SEQ ID NO: 636327 - DNA, 22 bp, Artificial Sequence
  chemically synthesized
ctaattggttcctctgcctttg

SEQ ID NO: 636328 - DNA, 22 bp, Artificial Sequence
  chemically synthesized
cctaattggttcctctgccttt

SEQ ID NO: 636329 - DNA, 22 bp, Artificial Sequence
  chemically synthesized
tcctaattggttcctctgcctt

SEQ ID NO: 636330 - DNA, 22 bp, Artificial Sequence
  chemically synthesized
aacagacaatatgaatactttc

SEQ ID NO: 636331 - DNA, 22 bp, Artificial Sequence
  chemically synthesized
cctgaacagacaatatgaatac

SEQ ID NO: 636332 - DNA, 22 bp, Artificial Sequence
  chemically synthesized
ggaaagtattcatattgtctgt

SEQ ID NO: 636333 - DNA, 22 bp, Artificial Sequence
  chemically synthesized
atcatgtgttacctgaacagac

SEQ ID NO: 636334 - DNA, 22 bp, Artificial Sequence
  chemically synthesized
gccctcatcatgtgttacctga

SEQ ID NO: 636335 - DNA, 22 bp, Artificial Sequence
  chemically synthesized
atattgtctgttcaggtaacac

SEQ ID NO: 636336 - DNA, 22 bp, Artificial Sequence
  chemically synthesized
agccctcatcatgtgttacctg

SEQ ID NO: 636337 - DNA, 22 bp, Artificial Sequence
  chemically synthesized
tctgttcaggtaacacatgatg

SEQ ID NO: 636338 - DNA, 22 bp, Artificial Sequence
  chemically synthesized
cccaaatttagccctcatcatg

SEQ ID NO: 636339 - DNA, 22 bp, Artificial Sequence
  chemically synthesized
ttcaggtaacacatgatgaggg

SEQ ID NO: 636340 - DNA, 22 bp, Artificial Sequence
  chemically synthesized
tgcccaaatttagccctcatca

SEQ ID NO: 636341 - DNA, 22 bp, Artificial Sequence
  chemically synthesized
ctgcccaaatttagccctcatc

SEQ ID NO: 636342 - DNA, 22 bp, Artificial Sequence
  chemically synthesized
aggtaacacatgatgagggcta

SEQ ID NO: 636343 - DNA, 22 bp, Artificial Sequence
  chemically synthesized
cttctgcccaaatttagccctc

SEQ ID NO: 636344 - DNA, 22 bp, Artificial Sequence
  chemically synthesized
agctacttctgcccaaatttag

SEQ ID NO: 636345 - DNA, 22 bp, Artificial Sequence
  chemically synthesized
aattcagctacttctgcccaaa

SEQ ID NO: 636346 - DNA, 22 bp, Artificial Sequence
  chemically synthesized
caattcagctacttctgcccaa

SEQ ID NO: 636347 - DNA, 22 bp, Artificial Sequence
  chemically synthesized
ttcaattcagctacttctgccc

SEQ ID NO: 636348 - DNA, 22 bp, Artificial Sequence
  chemically synthesized
aatttgggcagaagtagctgaa

SEQ ID NO: 636349 - DNA, 22 bp, Artificial Sequence
  chemically synthesized
gggcagaagtagctgaattgaa

SEQ ID NO: 636350 - DNA, 22 bp, Artificial Sequence
  chemically synthesized
ggcagaagtagctgaattgaag

SEQ ID NO: 636351 - DNA, 22 bp, Artificial Sequence
  chemically synthesized
tgaaaaagagcaaaattcttca

SEQ ID NO: 636352 - DNA, 22 bp, Artificial Sequence
  chemically synthesized
atgaaaaagagcaaaattcttc

SEQ ID NO: 636353 - DNA, 22 bp, Artificial Sequence
  chemically synthesized
cttatgaaaaagagcaaaattc

SEQ ID NO: 636354 - DNA, 22 bp, Artificial Sequence
  chemically synthesized
ctacttatgaaaaagagcaaaa

SEQ ID NO: 636355 - DNA, 22 bp, Artificial Sequence
  chemically synthesized
gctacttatgaaaaagagcaaa

SEQ ID NO: 636356 - DNA, 22 bp, Artificial Sequence
  chemically synthesized
aattgaagaattttgctctttt

SEQ ID NO: 636357 - DNA, 22 bp, Artificial Sequence
  chemically synthesized
tgctacttatgaaaaagagcaa

SEQ ID NO: 636358 - DNA, 22 bp, Artificial Sequence
  chemically synthesized
aagaattttgctctttttcata

SEQ ID NO: 636359 - DNA, 22 bp, Artificial Sequence
  chemically synthesized
tgctctttttcataagtagcaa

SEQ ID NO: 636360 - DNA, 22 bp, Artificial Sequence
  chemically synthesized
gctctttttcataagtagcaaa

SEQ ID NO: 636361 - DNA, 22 bp, Artificial Sequence
  chemically synthesized
ctctttttcataagtagcaaaa

SEQ ID NO: 636362 - DNA, 22 bp, Artificial Sequence
  chemically synthesized
tttttcataagtagcaaaacac

SEQ ID NO: 636363 - DNA, 22 bp, Artificial Sequence
  chemically synthesized
tttcataagtagcaaaacacac

SEQ ID NO: 636364 - DNA, 22 bp, Artificial Sequence
  chemically synthesized
ttcataagtagcaaaacacact

SEQ ID NO: 636365 - DNA, 22 bp, Artificial Sequence
  chemically synthesized
tcataagtagcaaaacacactg

SEQ ID NO: 636366 - DNA, 22 bp, Artificial Sequence
  chemically synthesized
cataagtagcaaaacacactga

SEQ ID NO: 636367 - DNA, 22 bp, Artificial Sequence
  chemically synthesized
ataagtagcaaaacacactgac

SEQ ID NO: 636368 - DNA, 22 bp, Artificial Sequence
  chemically synthesized
caccaccatcaatccagtcacc

SEQ ID NO: 636369 - DNA, 22 bp, Artificial Sequence
  chemically synthesized
tgttccaccaccatcaatccag

SEQ ID NO: 636370 - DNA, 22 bp, Artificial Sequence
  chemically synthesized
accttggtgactggattgatgg

SEQ ID NO: 636371 - DNA, 22 bp, Artificial Sequence
  chemically synthesized
gctatgttccaccaccatcaat

SEQ ID NO: 636372 - DNA, 22 bp, Artificial Sequence
  chemically synthesized
agctatgttccaccaccatcaa

SEQ ID NO: 636373 - DNA, 22 bp, Artificial Sequence
  chemically synthesized
ggtgactggattgatggtggtg

SEQ ID NO: 636374 - DNA, 22 bp, Artificial Sequence
  chemically synthesized
gtgactggattgatggtggtgg

SEQ ID NO: 636375 - DNA, 22 bp, Artificial Sequence
  chemically synthesized
cttagctatgttccaccaccat

SEQ ID NO: 636376 - DNA, 22 bp, Artificial Sequence
  chemically synthesized
ccttagctatgttccaccacca

SEQ ID NO: 636377 - DNA, 22 bp, Artificial Sequence
  chemically synthesized
ccttccttagctatgttccacc

SEQ ID NO: 636378 - DNA, 22 bp, Artificial Sequence
  chemically synthesized
gattgatggtggtggaacatag

SEQ ID NO: 636379 - DNA, 22 bp, Artificial Sequence
  chemically synthesized
cctgccttccttagctatgttc

SEQ ID NO: 636380 - DNA, 22 bp, Artificial Sequence
  chemically synthesized
acctgccttccttagctatgtt

SEQ ID NO: 636381 - DNA, 22 bp, Artificial Sequence
  chemically synthesized
tacctgccttccttagctatgt

SEQ ID NO: 636382 - DNA, 22 bp, Artificial Sequence
  chemically synthesized
atggtggtggaacatagctaag

SEQ ID NO: 636383 - DNA, 22 bp, Artificial Sequence
  chemically synthesized
ctttacctgccttccttagcta

SEQ ID NO: 636384 - DNA, 22 bp, Artificial Sequence
  chemically synthesized
cctttacctgccttccttagct

SEQ ID NO: 636385 - DNA, 22 bp, Artificial Sequence
  chemically synthesized
ttcctttacctgccttccttag

SEQ ID NO: 636386 - DNA, 22 bp, Artificial Sequence
  chemically synthesized
cttcctttacctgccttcctta

SEQ ID NO: 636387 - DNA, 22 bp, Artificial Sequence
  chemically synthesized
ccccttcttcctttacctgcct

SEQ ID NO: 636388 - DNA, 22 bp, Artificial Sequence
  chemically synthesized
taccccttcttcctttacctgc

SEQ ID NO: 636389 - DNA, 22 bp, Artificial Sequence
  chemically synthesized
ctaccccttcttcctttacctg

SEQ ID NO: 636390 - DNA, 22 bp, Artificial Sequence
  chemically synthesized
tctaccccttcttcctttacct

SEQ ID NO: 636391 - DNA, 22 bp, Artificial Sequence
  chemically synthesized
aggaaggcaggtaaaggaagaa

SEQ ID NO: 636392 - DNA, 22 bp, Artificial Sequence
  chemically synthesized
tacaaagtcattttctacccct

SEQ ID NO: 636393 - DNA, 22 bp, Artificial Sequence
  chemically synthesized
ccaatctatacaaagtcatttt

SEQ ID NO: 636394 - DNA, 22 bp, Artificial Sequence
  chemically synthesized
cccaatctatacaaagtcattt

SEQ ID NO: 636395 - DNA, 22 bp, Artificial Sequence
  chemically synthesized
caatttcccaatctatacaaag

SEQ ID NO: 636396 - DNA, 22 bp, Artificial Sequence
  chemically synthesized
ccaatttcccaatctatacaaa

SEQ ID NO: 636397 - DNA, 22 bp, Artificial Sequence
  chemically synthesized
ttccaatttcccaatctataca

SEQ ID NO: 636398 - DNA, 22 bp, Artificial Sequence
  chemically synthesized
gagcatctcttccaatttccca

SEQ ID NO: 636399 - DNA, 22 bp, Artificial Sequence
  chemically synthesized
ggagcatctcttccaatttccc

SEQ ID NO: 636400 - DNA, 22 bp, Artificial Sequence
  chemically synthesized
tggagcatctcttccaatttcc

SEQ ID NO: 636401 - DNA, 22 bp, Artificial Sequence
  chemically synthesized
tgtatagattgggaaattggaa

SEQ ID NO: 636402 - DNA, 22 bp, Artificial Sequence
  chemically synthesized
gtatagattgggaaattggaag

SEQ ID NO: 636403 - DNA, 22 bp, Artificial Sequence
  chemically synthesized
tatagattgggaaattggaaga

SEQ ID NO: 636404 - DNA, 22 bp, Artificial Sequence
  chemically synthesized
ggaaattggaagagatgctcca

SEQ ID NO: 636405 - DNA, 22 bp, Artificial Sequence
  chemically synthesized
aaatcatgatcaacctttggag

SEQ ID NO: 636406 - DNA, 22 bp, Artificial Sequence
  chemically synthesized
gaagagatgctccaaaggttga

SEQ ID NO: 636407 - DNA, 22 bp, Artificial Sequence
  chemically synthesized
atctgaaatcatgatcaacctt

SEQ ID NO: 636408 - DNA, 22 bp, Artificial Sequence
  chemically synthesized
caaaggttgatcatgatttcag

SEQ ID NO: 636409 - DNA, 22 bp, Artificial Sequence
  chemically synthesized
atcatgatttcagattaggcta

SEQ ID NO: 636410 - DNA, 22 bp, Artificial Sequence
  chemically synthesized
taaataaaaatatagcctaatc

SEQ ID NO: 636411 - DNA, 22 bp, Artificial Sequence
  chemically synthesized
cagattaggctatatttttatt

SEQ ID NO: 636412 - DNA, 22 bp, Artificial Sequence
  chemically synthesized
gataaaattataaataaaaata

SEQ ID NO: 636413 - DNA, 22 bp, Artificial Sequence
  chemically synthesized
agattaggctatatttttattt

SEQ ID NO: 636414 - DNA, 22 bp, Artificial Sequence
  chemically synthesized
tggataaaattataaataaaaa

SEQ ID NO: 636415 - DNA, 22 bp, Artificial Sequence
  chemically synthesized
ctggataaaattataaataaaa

SEQ ID NO: 636416 - DNA, 22 bp, Artificial Sequence
  chemically synthesized
ggctatatttttatttataatt

SEQ ID NO: 636417 - DNA, 22 bp, Artificial Sequence
  chemically synthesized
agcatcttctggataaaattat

SEQ ID NO: 636418 - DNA, 22 bp, Artificial Sequence
  chemically synthesized
tatttttatttataattttatc

SEQ ID NO: 636419 - DNA, 22 bp, Artificial Sequence
  chemically synthesized
ttatttataattttatccagaa

SEQ ID NO: 636420 - DNA, 22 bp, Artificial Sequence
  chemically synthesized
tatttataattttatccagaag

SEQ ID NO: 636421 - DNA, 22 bp, Artificial Sequence
  chemically synthesized
ccacctgagcatcttctggata

SEQ ID NO: 636422 - DNA, 22 bp, Artificial Sequence
  chemically synthesized
atttataattttatccagaaga

SEQ ID NO: 636423 - DNA, 22 bp, Artificial Sequence
  chemically synthesized
tttataattttatccagaagat

SEQ ID NO: 636424 - DNA, 22 bp, Artificial Sequence
  chemically synthesized
ataattttatccagaagatgct

SEQ ID NO: 636425 - DNA, 22 bp, Artificial Sequence
  chemically synthesized
taattttatccagaagatgctc

SEQ ID NO: 636426 - DNA, 22 bp, Artificial Sequence
  chemically synthesized
tatccagaagatgctcaggtgg

SEQ ID NO: 636427 - DNA, 22 bp, Artificial Sequence
  chemically synthesized
atccagaagatgctcaggtggg

SEQ ID NO: 636428 - DNA, 22 bp, Artificial Sequence
  chemically synthesized
cagcccagacctcccacctgag

SEQ ID NO: 636429 - DNA, 22 bp, Artificial Sequence
  chemically synthesized
tccagaagatgctcaggtggga

SEQ ID NO: 636430 - DNA, 22 bp, Artificial Sequence
  chemically synthesized
ccagcccagacctcccacctga

SEQ ID NO: 636431 - DNA, 22 bp, Artificial Sequence
  chemically synthesized
agtcaagatttccagcccagac

SEQ ID NO: 636432 - DNA, 22 bp, Artificial Sequence
  chemically synthesized
aagtcaagatttccagcccaga

SEQ ID NO: 636433 - DNA, 22 bp, Artificial Sequence
  chemically synthesized
aggtgggaggtctgggctggaa

SEQ ID NO: 636434 - DNA, 22 bp, Artificial Sequence
  chemically synthesized
ttaagtcaagatttccagccca

SEQ ID NO: 636435 - DNA, 22 bp, Artificial Sequence
  chemically synthesized
acaactcttaagtcaagatttc

SEQ ID NO: 636436 - DNA, 22 bp, Artificial Sequence
  chemically synthesized
tgctgacaactcttaagtcaag

SEQ ID NO: 636437 - DNA, 22 bp, Artificial Sequence
  chemically synthesized
ggctggaaatcttgacttaaga

SEQ ID NO: 636438 - DNA, 22 bp, Artificial Sequence
  chemically synthesized
ctatgctgacaactcttaagtc

SEQ ID NO: 636439 - DNA, 22 bp, Artificial Sequence
  chemically synthesized
tgctatgctgacaactcttaag

SEQ ID NO: 636440 - DNA, 22 bp, Artificial Sequence
  chemically synthesized
ctgctatgctgacaactcttaa

SEQ ID NO: 636441 - DNA, 22 bp, Artificial Sequence
  chemically synthesized
gaaatcttgacttaagagttgt

SEQ ID NO: 636442 - DNA, 22 bp, Artificial Sequence
  chemically synthesized
gcttctgctatgctgacaactc

SEQ ID NO: 636443 - DNA, 22 bp, Artificial Sequence
  chemically synthesized
ggcttctgctatgctgacaact

SEQ ID NO: 636444 - DNA, 22 bp, Artificial Sequence
  chemically synthesized
tggcttctgctatgctgacaac

SEQ ID NO: 636445 - DNA, 22 bp, Artificial Sequence
  chemically synthesized
gacttaagagttgtcagcatag

SEQ ID NO: 636446 - DNA, 22 bp, Artificial Sequence
  chemically synthesized
acttaagagttgtcagcatagc

SEQ ID NO: 636447 - DNA, 22 bp, Artificial Sequence
  chemically synthesized
catactttggcttctgctatgc

SEQ ID NO: 636448 - DNA, 22 bp, Artificial Sequence
  chemically synthesized
aagagttgtcagcatagcagaa

SEQ ID NO: 636449 - DNA, 22 bp, Artificial Sequence
  chemically synthesized
ccatactttggcttctgctatg

SEQ ID NO: 636450 - DNA, 22 bp, Artificial Sequence
  chemically synthesized
agagttgtcagcatagcagaag

SEQ ID NO: 636451 - DNA, 22 bp, Artificial Sequence
  chemically synthesized
cttccatactttggcttctgct

SEQ ID NO: 636452 - DNA, 22 bp, Artificial Sequence
  chemically synthesized
tcagcatagcagaagccaaagt

SEQ ID NO: 636453 - DNA, 22 bp, Artificial Sequence
  chemically synthesized
ggcgctccttccatactttggc

SEQ ID NO: 636454 - DNA, 22 bp, Artificial Sequence
  chemically synthesized
cctgggcgctccttccatactt

SEQ ID NO: 636455 - DNA, 22 bp, Artificial Sequence
  chemically synthesized
tccctgggcgctccttccatac

SEQ ID NO: 636456 - DNA, 22 bp, Artificial Sequence
  chemically synthesized
actctccctgggcgctccttcc

SEQ ID NO: 636457 - DNA, 22 bp, Artificial Sequence
  chemically synthesized
cactctccctgggcgctccttc

SEQ ID NO: 636458 - DNA, 22 bp, Artificial Sequence
  chemically synthesized
ttcactctccctgggcgctcct

SEQ ID NO: 636459 - DNA, 22 bp, Artificial Sequence
  chemically synthesized
accgttcttcactctccctggg

SEQ ID NO: 636460 - DNA, 22 bp, Artificial Sequence
  chemically synthesized
caccgttcttcactctccctgg

SEQ ID NO: 636461 - DNA, 22 bp, Artificial Sequence
  chemically synthesized
catccccttcaccgttcttcac

SEQ ID NO: 636462 - DNA, 22 bp, Artificial Sequence
  chemically synthesized
tccatccccttcaccgttcttc

SEQ ID NO: 636463 - DNA, 22 bp, Artificial Sequence
  chemically synthesized
aagattctccatccccttcacc

SEQ ID NO: 636464 - DNA, 22 bp, Artificial Sequence
  chemically synthesized
ctcaagattctccatccccttc

SEQ ID NO: 636465 - DNA, 22 bp, Artificial Sequence
  chemically synthesized
cctcaagattctccatcccctt

SEQ ID NO: 636466 - DNA, 22 bp, Artificial Sequence
  chemically synthesized
tcctcaagattctccatcccct

SEQ ID NO: 636467 - DNA, 22 bp, Artificial Sequence
  chemically synthesized
agtacatcacatcaaggttttc

SEQ ID NO: 636468 - DNA, 22 bp, Artificial Sequence
  chemically synthesized
gaggaaaaccttgatgtgatgt

SEQ ID NO: 636469 - DNA, 22 bp, Artificial Sequence
  chemically synthesized
aggaaaaccttgatgtgatgta

SEQ ID NO: 636470 - DNA, 22 bp, Artificial Sequence
  chemically synthesized
gatgtgatgtactgaggatacc

SEQ ID NO: 636471 - DNA, 22 bp, Artificial Sequence
  chemically synthesized
ccatataggtaaggtatcctca

SEQ ID NO: 636472 - DNA, 22 bp, Artificial Sequence
  chemically synthesized
atgtgatgtactgaggatacct

SEQ ID NO: 636473 - DNA, 22 bp, Artificial Sequence
  chemically synthesized
tgccagattaccatataggtaa

SEQ ID NO: 636474 - DNA, 22 bp, Artificial Sequence
  chemically synthesized
atgccagattaccatataggta

SEQ ID NO: 636475 - DNA, 22 bp, Artificial Sequence
  chemically synthesized
tatgccagattaccatataggt

SEQ ID NO: 636476 - DNA, 22 bp, Artificial Sequence
  chemically synthesized
aggataccttacctatatggta

SEQ ID NO: 636477 - DNA, 22 bp, Artificial Sequence
  chemically synthesized
aatgttttatgccagattacca

SEQ ID NO: 636478 - DNA, 22 bp, Artificial Sequence
  chemically synthesized
acctatatggtaatctggcata

SEQ ID NO: 636479 - DNA, 22 bp, Artificial Sequence
  chemically synthesized
cctatatggtaatctggcataa

SEQ ID NO: 636480 - DNA, 22 bp, Artificial Sequence
  chemically synthesized
gggttaaatgttttatgccaga

SEQ ID NO: 636481 - DNA, 22 bp, Artificial Sequence
  chemically synthesized
tatggtaatctggcataaaaca

SEQ ID NO: 636482 - DNA, 22 bp, Artificial Sequence
  chemically synthesized
ggttcgggttaaatgttttatg

SEQ ID NO: 636483 - DNA, 22 bp, Artificial Sequence
  chemically synthesized
gcataaaacatttaacccgaac

SEQ ID NO: 636484 - DNA, 22 bp, Artificial Sequence
  chemically synthesized
tatccaagtgattgggttcggg

SEQ ID NO: 636485 - DNA, 22 bp, Artificial Sequence
  chemically synthesized
gtatccaagtgattgggttcgg

SEQ ID NO: 636486 - DNA, 22 bp, Artificial Sequence
  chemically synthesized
cttgtatccaagtgattgggtt

SEQ ID NO: 636487 - DNA, 22 bp, Artificial Sequence
  chemically synthesized
tctgcttgtatccaagtgattg

SEQ ID NO: 636488 - DNA, 22 bp, Artificial Sequence
  chemically synthesized
gtctgcttgtatccaagtgatt

SEQ ID NO: 636489 - DNA, 22 bp, Artificial Sequence
  chemically synthesized
aacccgaacccaatcacttgga

SEQ ID NO: 636490 - DNA, 22 bp, Artificial Sequence
  chemically synthesized
acccgaacccaatcacttggat

SEQ ID NO: 636491 - DNA, 22 bp, Artificial Sequence
  chemically synthesized
aatttgtctgcttgtatccaag

SEQ ID NO: 636492 - DNA, 22 bp, Artificial Sequence
  chemically synthesized
gaatttgtctgcttgtatccaa

SEQ ID NO: 636493 - DNA, 22 bp, Artificial Sequence
  chemically synthesized
ggatacaagcagacaaattcaa

SEQ ID NO: 636494 - DNA, 22 bp, Artificial Sequence
  chemically synthesized
gatacaagcagacaaattcaaa

SEQ ID NO: 636495 - DNA, 22 bp, Artificial Sequence
  chemically synthesized
tagaatgtcccccaatttgaat

SEQ ID NO: 636496 - DNA, 22 bp, Artificial Sequence
  chemically synthesized
gtagaatgtcccccaatttgaa

SEQ ID NO: 636497 - DNA, 22 bp, Artificial Sequence
  chemically synthesized
tgtagaatgtcccccaatttga

SEQ ID NO: 636498 - DNA, 22 bp, Artificial Sequence
  chemically synthesized
gatgttttgtagaatgtccccc

SEQ ID NO: 636499 - DNA, 22 bp, Artificial Sequence
  chemically synthesized
aaattgggggacattctacaaa

SEQ ID NO: 636500 - DNA, 22 bp, Artificial Sequence
  chemically synthesized
ggggacattctacaaaacatct

SEQ ID NO: 636501 - DNA, 22 bp, Artificial Sequence
  chemically synthesized
gaagaggtcgggctagatgttt

SEQ ID NO: 636502 - DNA, 22 bp, Artificial Sequence
  chemically synthesized
tacaaaacatctagcccgacct

SEQ ID NO: 636503 - DNA, 22 bp, Artificial Sequence
  chemically synthesized
atatattagaagaggtcgggct

SEQ ID NO: 636504 - DNA, 22 bp, Artificial Sequence
  chemically synthesized
caaaacatctagcccgacctct

SEQ ID NO: 636505 - DNA, 22 bp, Artificial Sequence
  chemically synthesized
atgacattgatatattagaaga

SEQ ID NO: 636506 - DNA, 22 bp, Artificial Sequence
  chemically synthesized
catgacattgatatattagaag

SEQ ID NO: 636507 - DNA, 22 bp, Artificial Sequence
  chemically synthesized
tcatgacattgatatattagaa

SEQ ID NO: 636508 - DNA, 22 bp, Artificial Sequence
  chemically synthesized
gcccgacctcttctaatatatc

SEQ ID NO: 636509 - DNA, 22 bp, Artificial Sequence
  chemically synthesized
aatctttcatgacattgatata

SEQ ID NO: 636510 - DNA, 22 bp, Artificial Sequence
  chemically synthesized
aaatctttcatgacattgatat

SEQ ID NO: 636511 - DNA, 22 bp, Artificial Sequence
  chemically synthesized
taaatctttcatgacattgata

SEQ ID NO: 636512 - DNA, 22 bp, Artificial Sequence
  chemically synthesized
tttaaatctttcatgacattga

SEQ ID NO: 636513 - DNA, 22 bp, Artificial Sequence
  chemically synthesized
ttctaatatatcaatgtcatga

SEQ ID NO: 636514 - DNA, 22 bp, Artificial Sequence
  chemically synthesized
ctaatatatcaatgtcatgaaa

SEQ ID NO: 636515 - DNA, 22 bp, Artificial Sequence
  chemically synthesized
taatatatcaatgtcatgaaag

SEQ ID NO: 636516 - DNA, 22 bp, Artificial Sequence
  chemically synthesized
atatatcaatgtcatgaaagat

SEQ ID NO: 636517 - DNA, 22 bp, Artificial Sequence
  chemically synthesized
ccagcctctttaaatctttcat

SEQ ID NO: 636518 - DNA, 22 bp, Artificial Sequence
  chemically synthesized
cccagcctctttaaatctttca

SEQ ID NO: 636519 - DNA, 22 bp, Artificial Sequence
  chemically synthesized
tcccagcctctttaaatctttc

SEQ ID NO: 636520 - DNA, 22 bp, Artificial Sequence
  chemically synthesized
aagcactttcccagcctcttta

SEQ ID NO: 636521 - DNA, 22 bp, Artificial Sequence
  chemically synthesized
atctgaagcactttcccagcct

SEQ ID NO: 636522 - DNA, 22 bp, Artificial Sequence
  chemically synthesized
aatctgaagcactttcccagcc

SEQ ID NO: 636523 - DNA, 22 bp, Artificial Sequence
  chemically synthesized
taatctgaagcactttcccagc

SEQ ID NO: 636524 - DNA, 22 bp, Artificial Sequence
  chemically synthesized
ctttaatctgaagcactttccc

SEQ ID NO: 636525 - DNA, 22 bp, Artificial Sequence
  chemically synthesized
aaagaggctgggaaagtgcttc

SEQ ID NO: 636526 - DNA, 22 bp, Artificial Sequence
  chemically synthesized
aagaggctgggaaagtgcttca

SEQ ID NO: 636527 - DNA, 22 bp, Artificial Sequence
  chemically synthesized
tagtctcctttaatctgaagca

SEQ ID NO: 636528 - DNA, 22 bp, Artificial Sequence
  chemically synthesized
ggaaagtgcttcagattaaagg

SEQ ID NO: 636529 - DNA, 22 bp, Artificial Sequence
  chemically synthesized
cagattaaaggagactacaggg

SEQ ID NO: 636530 - DNA, 22 bp, Artificial Sequence
  chemically synthesized
agattaaaggagactacaggga

SEQ ID NO: 636531 - DNA, 22 bp, Artificial Sequence
  chemically synthesized
aggatcagtgatgtccctgtag

SEQ ID NO: 636532 - DNA, 22 bp, Artificial Sequence
  chemically synthesized
aaggagactacagggacatcac

SEQ ID NO: 636533 - DNA, 22 bp, Artificial Sequence
  chemically synthesized
cattcaggatcagtgatgtccc

SEQ ID NO: 636534 - DNA, 22 bp, Artificial Sequence
  chemically synthesized
acattcaggatcagtgatgtcc

SEQ ID NO: 636535 - DNA, 22 bp, Artificial Sequence
  chemically synthesized
tacattcaggatcagtgatgtc

SEQ ID NO: 636536 - DNA, 22 bp, Artificial Sequence
  chemically synthesized
cagggacatcactgatcctgaa

SEQ ID NO: 636537 - DNA, 22 bp, Artificial Sequence
  chemically synthesized
atagcgatattttacattcagg

SEQ ID NO: 636538 - DNA, 22 bp, Artificial Sequence
  chemically synthesized
catagcgatattttacattcag

SEQ ID NO: 636539 - DNA, 22 bp, Artificial Sequence
  chemically synthesized
ttcatagcgatattttacattc

SEQ ID NO: 636540 - DNA, 22 bp, Artificial Sequence
  chemically synthesized
atattcttcatagcgatatttt

SEQ ID NO: 636541 - DNA, 22 bp, Artificial Sequence
  chemically synthesized
atcctgaatgtaaaatatcgct

SEQ ID NO: 636542 - DNA, 22 bp, Artificial Sequence
  chemically synthesized
aatgtaaaatatcgctatgaag

SEQ ID NO: 636543 - DNA, 22 bp, Artificial Sequence
  chemically synthesized
ccaattaatattcttcatagcg

SEQ ID NO: 636544 - DNA, 22 bp, Artificial Sequence
  chemically synthesized
tgccaattaatattcttcatag

SEQ ID NO: 636545 - DNA, 22 bp, Artificial Sequence
  chemically synthesized
caattctgccaattaatattct

SEQ ID NO: 636546 - DNA, 22 bp, Artificial Sequence
  chemically synthesized
tgaagaatattaattggcagaa

SEQ ID NO: 636547 - DNA, 22 bp, Artificial Sequence
  chemically synthesized
aaatacctccaattctgccaat

SEQ ID NO: 636548 - DNA, 22 bp, Artificial Sequence
  chemically synthesized
aattcaaatacctccaattctg

SEQ ID NO: 636549 - DNA, 22 bp, Artificial Sequence
  chemically synthesized
aaattcaaatacctccaattct

SEQ ID NO: 636550 - DNA, 22 bp, Artificial Sequence
  chemically synthesized
attggcagaattggaggtattt

SEQ ID NO: 636551 - DNA, 22 bp, Artificial Sequence
  chemically synthesized
gcagaattggaggtatttgaat

SEQ ID NO: 636552 - DNA, 22 bp, Artificial Sequence
  chemically synthesized
tataatgtagaatttaaattca

SEQ ID NO: 636553 - DNA, 22 bp, Artificial Sequence
  chemically synthesized
ttatataatgtagaatttaaat

SEQ ID NO: 636554 - DNA, 22 bp, Artificial Sequence
  chemically synthesized
gaggtatttgaatttaaattct

SEQ ID NO: 636555 - DNA, 22 bp, Artificial Sequence
  chemically synthesized
gaatttaaattctacattatat

SEQ ID NO: 636556 - DNA, 22 bp, Artificial Sequence
  chemically synthesized
aatttaaattctacattatata

SEQ ID NO: 636557 - DNA, 22 bp, Artificial Sequence
  chemically synthesized
aaattctacattatataacagt

SEQ ID NO: 636558 - DNA, 22 bp, Artificial Sequence
  chemically synthesized
aaaaagaacaatactgttatat

SEQ ID NO: 636559 - DNA, 22 bp, Artificial Sequence
  chemically synthesized
aattctacattatataacagta

SEQ ID NO: 636560 - DNA, 22 bp, Artificial Sequence
  chemically synthesized
tacattatataacagtattgtt

SEQ ID NO: 636561 - DNA, 22 bp, Artificial Sequence
  chemically synthesized
cattatataacagtattgttct

SEQ ID NO: 636562 - DNA, 22 bp, Artificial Sequence
  chemically synthesized
tcatgctcaaaaagaacaatac

SEQ ID NO: 636563 - DNA, 22 bp, Artificial Sequence
  chemically synthesized
tataacagtattgttctttttg

SEQ ID NO: 636564 - DNA, 22 bp, Artificial Sequence
  chemically synthesized
cataagcacaattatcatgctc

SEQ ID NO: 636565 - DNA, 22 bp, Artificial Sequence
  chemically synthesized
gcataagcacaattatcatgct

SEQ ID NO: 636566 - DNA, 22 bp, Artificial Sequence
  chemically synthesized
ttgcataagcacaattatcatg

SEQ ID NO: 636567 - DNA, 22 bp, Artificial Sequence
  chemically synthesized
ttctttttgagcatgataattg

SEQ ID NO: 636568 - DNA, 22 bp, Artificial Sequence
  chemically synthesized
tttttgagcatgataattgtgc

SEQ ID NO: 636569 - DNA, 22 bp, Artificial Sequence
  chemically synthesized
tttgagcatgataattgtgctt

SEQ ID NO: 636570 - DNA, 22 bp, Artificial Sequence
  chemically synthesized
ttgagcatgataattgtgctta

SEQ ID NO: 636571 - DNA, 22 bp, Artificial Sequence
  chemically synthesized
tgagcatgataattgtgcttat

SEQ ID NO: 636572 - DNA, 22 bp, Artificial Sequence
  chemically synthesized
gagcatgataattgtgcttatg

SEQ ID NO: 636573 - DNA, 22 bp, Artificial Sequence
  chemically synthesized
agcatgataattgtgcttatgc

SEQ ID NO: 636574 - DNA, 22 bp, Artificial Sequence
  chemically synthesized
aaatgaaagatattcttgcata

SEQ ID NO: 636575 - DNA, 22 bp, Artificial Sequence
  chemically synthesized
taaaatgaaagatattcttgca

SEQ ID NO: 636576 - DNA, 22 bp, Artificial Sequence
  chemically synthesized
ctaaaatgaaagatattcttgc

SEQ ID NO: 636577 - DNA, 22 bp, Artificial Sequence
  chemically synthesized
tgcttatgcaagaatatctttc

SEQ ID NO: 636578 - DNA, 22 bp, Artificial Sequence
  chemically synthesized
atgcaagaatatctttcatttt

SEQ ID NO: 636579 - DNA, 22 bp, Artificial Sequence
  chemically synthesized
tgcaagaatatctttcatttta

SEQ ID NO: 636580 - DNA, 22 bp, Artificial Sequence
  chemically synthesized
aacacgtgccttctaaaatgaa

SEQ ID NO: 636581 - DNA, 22 bp, Artificial Sequence
  chemically synthesized
gaacacgtgccttctaaaatga

SEQ ID NO: 636582 - DNA, 22 bp, Artificial Sequence
  chemically synthesized
aacacttgaacacgtgccttct

SEQ ID NO: 636583 - DNA, 22 bp, Artificial Sequence
  chemically synthesized
tcattttagaaggcacgtgttc

SEQ ID NO: 636584 - DNA, 22 bp, Artificial Sequence
  chemically synthesized
cattttagaaggcacgtgttca

SEQ ID NO: 636585 - DNA, 22 bp, Artificial Sequence
  chemically synthesized
attttagaaggcacgtgttcaa

SEQ ID NO: 636586 - DNA, 22 bp, Artificial Sequence
  chemically synthesized
acccctaaacacttgaacacgt

SEQ ID NO: 636587 - DNA, 22 bp, Artificial Sequence
  chemically synthesized
cacccctaaacacttgaacacg

SEQ ID NO: 636588 - DNA, 22 bp, Artificial Sequence
  chemically synthesized
tagaaggcacgtgttcaagtgt

SEQ ID NO: 636589 - DNA, 22 bp, Artificial Sequence
  chemically synthesized
agaaggcacgtgttcaagtgtt

SEQ ID NO: 636590 - DNA, 22 bp, Artificial Sequence
  chemically synthesized
gaaggcacgtgttcaagtgttt

SEQ ID NO: 636591 - DNA, 22 bp, Artificial Sequence
  chemically synthesized
atacataacacttcacccctaa

SEQ ID NO: 636592 - DNA, 22 bp, Artificial Sequence
  chemically synthesized
catacataacacttcaccccta

SEQ ID NO: 636593 - DNA, 22 bp, Artificial Sequence
  chemically synthesized
aagtgtttaggggtgaagtgtt

SEQ ID NO: 636594 - DNA, 22 bp, Artificial Sequence
  chemically synthesized
ggtttcatacataacacttcac

SEQ ID NO: 636595 - DNA, 22 bp, Artificial Sequence
  chemically synthesized
aggggtgaagtgttatgtatga

SEQ ID NO: 636596 - DNA, 22 bp, Artificial Sequence
  chemically synthesized
aatggttaggtttcatacataa

SEQ ID NO: 636597 - DNA, 22 bp, Artificial Sequence
  chemically synthesized
ggggtgaagtgttatgtatgaa

SEQ ID NO: 636598 - DNA, 22 bp, Artificial Sequence
  chemically synthesized
atccactcaatggttaggtttc

SEQ ID NO: 636599 - DNA, 22 bp, Artificial Sequence
  chemically synthesized
actgatccactcaatggttagg

SEQ ID NO: 636600 - DNA, 22 bp, Artificial Sequence
  chemically synthesized
cactgatccactcaatggttag

SEQ ID NO: 636601 - DNA, 22 bp, Artificial Sequence
  chemically synthesized
tcactgatccactcaatggtta

SEQ ID NO: 636602 - DNA, 22 bp, Artificial Sequence
  chemically synthesized
tgtatgaaacctaaccattgag

SEQ ID NO: 636603 - DNA, 22 bp, Artificial Sequence
  chemically synthesized
ttcactgatccactcaatggtt

SEQ ID NO: 636604 - DNA, 22 bp, Artificial Sequence
  chemically synthesized
tttcactgatccactcaatggt

SEQ ID NO: 636605 - DNA, 22 bp, Artificial Sequence
  chemically synthesized
ttttcactgatccactcaatgg

SEQ ID NO: 636606 - DNA, 22 bp, Artificial Sequence
  chemically synthesized
tttttcactgatccactcaatg

SEQ ID NO: 636607 - DNA, 22 bp, Artificial Sequence
  chemically synthesized
ttttttcactgatccactcaat

SEQ ID NO: 636608 - DNA, 22 bp, Artificial Sequence
  chemically synthesized
tggatttttttttcactgatcc

SEQ ID NO: 636609 - DNA, 22 bp, Artificial Sequence
  chemically synthesized
gtggatttttttttcactgatc

SEQ ID NO: 636610 - DNA, 22 bp, Artificial Sequence
  chemically synthesized
accattgagtggatcagtgaaa

SEQ ID NO: 636611 - DNA, 22 bp, Artificial Sequence
  chemically synthesized
agtggatcagtgaaaaaaaaat

SEQ ID NO: 636612 - DNA, 22 bp, Artificial Sequence
  chemically synthesized
atgcgtgtatatagtttgtgga

SEQ ID NO: 636613 - DNA, 22 bp, Artificial Sequence
  chemically synthesized
atcatattcatgcgtgtatata

SEQ ID NO: 636614 - DNA, 22 bp, Artificial Sequence
  chemically synthesized
aatcatattcatgcgtgtatat

SEQ ID NO: 636615 - DNA, 22 bp, Artificial Sequence
  chemically synthesized
tgtgcatatttaatcatattca

SEQ ID NO: 636616 - DNA, 22 bp, Artificial Sequence
  chemically synthesized
atgtgcatatttaatcatattc

SEQ ID NO: 636617 - DNA, 22 bp, Artificial Sequence
  chemically synthesized
tatacacgcatgaatatgatta

SEQ ID NO: 636618 - DNA, 22 bp, Artificial Sequence
  chemically synthesized
tatgtgcatatttaatcatatt

SEQ ID NO: 636619 - DNA, 22 bp, Artificial Sequence
  chemically synthesized
tattttatgtgcatatttaatc

SEQ ID NO: 636620 - DNA, 22 bp, Artificial Sequence
  chemically synthesized
atattttatgtgcatatttaat

SEQ ID NO: 636621 - DNA, 22 bp, Artificial Sequence
  chemically synthesized
tatatgtttatattttatgtgc

SEQ ID NO: 636622 - DNA, 22 bp, Artificial Sequence
  chemically synthesized
aatatgcacataaaatataaac

SEQ ID NO: 636623 - DNA, 22 bp, Artificial Sequence
  chemically synthesized
tatactgtatatgtttatattt

SEQ ID NO: 636624 - DNA, 22 bp, Artificial Sequence
  chemically synthesized
atatactgtatatgtttatatt

SEQ ID NO: 636625 - DNA, 22 bp, Artificial Sequence
  chemically synthesized
tatatactgtatatgtttatat

SEQ ID NO: 636626 - DNA, 22 bp, Artificial Sequence
  chemically synthesized
ttatatactgtatatgtttata

SEQ ID NO: 636627 - DNA, 22 bp, Artificial Sequence
  chemically synthesized
acatatttttatatactgtata

SEQ ID NO: 636628 - DNA, 22 bp, Artificial Sequence
  chemically synthesized
tatgttaacatatttttatata

SEQ ID NO: 636629 - DNA, 22 bp, Artificial Sequence
  chemically synthesized
acatgtatatctgtatgttaac

SEQ ID NO: 636630 - DNA, 22 bp, Artificial Sequence
  chemically synthesized
gattaacatgtatatctgtatg

SEQ ID NO: 636631 - DNA, 22 bp, Artificial Sequence
  chemically synthesized
agattaacatgtatatctgtat

SEQ ID NO: 636632 - DNA, 22 bp, Artificial Sequence
  chemically synthesized
catatatttagattaacatgta

SEQ ID NO: 636633 - DNA, 22 bp, Artificial Sequence
  chemically synthesized
acatacagatatacatgttaat

SEQ ID NO: 636634 - DNA, 22 bp, Artificial Sequence
  chemically synthesized
aatggattgcatatatttagat

SEQ ID NO: 636635 - DNA, 22 bp, Artificial Sequence
  chemically synthesized
ttaaatggattgcatatattta

SEQ ID NO: 636636 - DNA, 22 bp, Artificial Sequence
  chemically synthesized
atgtgttgttaaatggattgca

SEQ ID NO: 636637 - DNA, 22 bp, Artificial Sequence
  chemically synthesized
atctaaatatatgcaatccatt

SEQ ID NO: 636638 - DNA, 22 bp, Artificial Sequence
  chemically synthesized
cattcatgtgttgttaaatgga

SEQ ID NO: 636639 - DNA, 22 bp, Artificial Sequence
  chemically synthesized
aatatatgcaatccatttaaca

SEQ ID NO: 636640 - DNA, 22 bp, Artificial Sequence
  chemically synthesized
acattcatgtgttgttaaatgg

SEQ ID NO: 636641 - DNA, 22 bp, Artificial Sequence
  chemically synthesized
tacattcatgtgttgttaaatg

SEQ ID NO: 636642 - DNA, 22 bp, Artificial Sequence
  chemically synthesized
ttacattcatgtgttgttaaat

SEQ ID NO: 636643 - DNA, 22 bp, Artificial Sequence
  chemically synthesized
tgtacttttacattcatgtgtt

SEQ ID NO: 636644 - DNA, 22 bp, Artificial Sequence
  chemically synthesized
atgtacttttacattcatgtgt

SEQ ID NO: 636645 - DNA, 22 bp, Artificial Sequence
  chemically synthesized
tttatgtacttttacattcatg

SEQ ID NO: 636646 - DNA, 22 bp, Artificial Sequence
  chemically synthesized
atttatgtacttttacattcat

SEQ ID NO: 636647 - DNA, 22 bp, Artificial Sequence
  chemically synthesized
tttatttatgtacttttacatt

SEQ ID NO: 636648 - DNA, 22 bp, Artificial Sequence
  chemically synthesized
aacaacacatgaatgtaaaagt

SEQ ID NO: 636649 - DNA, 22 bp, Artificial Sequence
  chemically synthesized
acaacacatgaatgtaaaagta

SEQ ID NO: 636650 - DNA, 22 bp, Artificial Sequence
  chemically synthesized
tagctatttatttatgtacttt

SEQ ID NO: 636651 - DNA, 22 bp, Artificial Sequence
  chemically synthesized
atagctatttatttatgtactt

SEQ ID NO: 636652 - DNA, 22 bp, Artificial Sequence
  chemically synthesized
tatagctatttatttatgtact

SEQ ID NO: 636653 - DNA, 22 bp, Artificial Sequence
  chemically synthesized
ctttatagctatttatttatgt

SEQ ID NO: 636654 - DNA, 22 bp, Artificial Sequence
  chemically synthesized
gctttatagctatttatttatg

SEQ ID NO: 636655 - DNA, 22 bp, Artificial Sequence
  chemically synthesized
ccacatttgctttatagctatt

SEQ ID NO: 636656 - DNA, 22 bp, Artificial Sequence
  chemically synthesized
gccacatttgctttatagctat

SEQ ID NO: 636657 - DNA, 22 bp, Artificial Sequence
  chemically synthesized
aacagtttgccacatttgcttt

SEQ ID NO: 636658 - DNA, 22 bp, Artificial Sequence
  chemically synthesized
attcaacagtttgccacatttg

SEQ ID NO: 636659 - DNA, 22 bp, Artificial Sequence
  chemically synthesized
caattaattcaacagtttgcca

SEQ ID NO: 636660 - DNA, 22 bp, Artificial Sequence
  chemically synthesized
taaagcaaatgtggcaaactgt

SEQ ID NO: 636661 - DNA, 22 bp, Artificial Sequence
  chemically synthesized
tggcaaaactgcaattaattca

SEQ ID NO: 636662 - DNA, 22 bp, Artificial Sequence
  chemically synthesized
atggcaaaactgcaattaattc

SEQ ID NO: 636663 - DNA, 22 bp, Artificial Sequence
  chemically synthesized
aaacttatggcaaaactgcaat

SEQ ID NO: 636664 - DNA, 22 bp, Artificial Sequence
  chemically synthesized
caaacttatggcaaaactgcaa

SEQ ID NO: 636665 - DNA, 22 bp, Artificial Sequence
  chemically synthesized
ttgaattaattgcagttttgcc

SEQ ID NO: 636666 - DNA, 22 bp, Artificial Sequence
  chemically synthesized
aattaattgcagttttgccata

SEQ ID NO: 636667 - DNA, 22 bp, Artificial Sequence
  chemically synthesized
gaacaatttcaaacttatggca

SEQ ID NO: 636668 - DNA, 22 bp, Artificial Sequence
  chemically synthesized
agaacaatttcaaacttatggc

SEQ ID NO: 636669 - DNA, 22 bp, Artificial Sequence
  chemically synthesized
attgcagttttgccataagttt

SEQ ID NO: 636670 - DNA, 22 bp, Artificial Sequence
  chemically synthesized
tttagaacaatttcaaacttat

SEQ ID NO: 636671 - DNA, 22 bp, Artificial Sequence
  chemically synthesized
atttagaacaatttcaaactta

SEQ ID NO: 636672 - DNA, 22 bp, Artificial Sequence
  chemically synthesized
cagttttgccataagtttgaaa

SEQ ID NO: 636673 - DNA, 22 bp, Artificial Sequence
  chemically synthesized
tatttagaacaatttcaaactt

SEQ ID NO: 636674 - DNA, 22 bp, Artificial Sequence
  chemically synthesized
ttatttagaacaatttcaaact

SEQ ID NO: 636675 - DNA, 22 bp, Artificial Sequence
  chemically synthesized
tttatttagaacaatttcaaac

SEQ ID NO: 636676 - DNA, 22 bp, Artificial Sequence
  chemically synthesized
tgccataagtttgaaattgttc

SEQ ID NO: 636677 - DNA, 22 bp, Artificial Sequence
  chemically synthesized
gctttttatttagaacaatttc

SEQ ID NO: 636678 - DNA, 22 bp, Artificial Sequence
  chemically synthesized
gccataagtttgaaattgttct

SEQ ID NO: 636679 - DNA, 22 bp, Artificial Sequence
  chemically synthesized
ccataagtttgaaattgttcta

SEQ ID NO: 636680 - DNA, 22 bp, Artificial Sequence
  chemically synthesized
cctagctttttatttagaacaa

SEQ ID NO: 636681 - DNA, 22 bp, Artificial Sequence
  chemically synthesized
gaaattgttctaaataaaaagc

SEQ ID NO: 636682 - DNA, 22 bp, Artificial Sequence
  chemically synthesized
aaattgttctaaataaaaagct

SEQ ID NO: 636683 - DNA, 22 bp, Artificial Sequence
  chemically synthesized
tgacataatggctccctagctt

SEQ ID NO: 636684 - DNA, 22 bp, Artificial Sequence
  chemically synthesized
ttctaaataaaaagctagggag

SEQ ID NO: 636685 - DNA, 22 bp, Artificial Sequence
  chemically synthesized
atgacataatggctccctagct

SEQ ID NO: 636686 - DNA, 22 bp, Artificial Sequence
  chemically synthesized
taaataaaaagctagggagcca

SEQ ID NO: 636687 - DNA, 22 bp, Artificial Sequence
  chemically synthesized
aataaaaagctagggagccatt

SEQ ID NO: 636688 - DNA, 22 bp, Artificial Sequence
  chemically synthesized
aggtttatgacataatggctcc

SEQ ID NO: 636689 - DNA, 22 bp, Artificial Sequence
  chemically synthesized
gaggtttatgacataatggctc

SEQ ID NO: 636690 - DNA, 22 bp, Artificial Sequence
  chemically synthesized
gggagccattatgtcataaacc

SEQ ID NO: 636691 - DNA, 22 bp, Artificial Sequence
  chemically synthesized
tcatgtacatttgaggtttatg

SEQ ID NO: 636692 - DNA, 22 bp, Artificial Sequence
  chemically synthesized
atcatgtacatttgaggtttat

SEQ ID NO: 636693 - DNA, 22 bp, Artificial Sequence
  chemically synthesized
tgtcataaacctcaaatgtaca

SEQ ID NO: 636694 - DNA, 22 bp, Artificial Sequence
  chemically synthesized
aaaaatttatcatgtacatttg

SEQ ID NO: 636695 - DNA, 22 bp, Artificial Sequence
  chemically synthesized
aaaaaatttatcatgtacattt

SEQ ID NO: 636696 - DNA, 22 bp, Artificial Sequence
  chemically synthesized
taaaaaatttatcatgtacatt

SEQ ID NO: 636697 - DNA, 22 bp, Artificial Sequence
  chemically synthesized
ttaaaaaatttatcatgtacat

SEQ ID NO: 636698 - DNA, 22 bp, Artificial Sequence
  chemically synthesized
tttaaaaaatttatcatgtaca

SEQ ID NO: 636699 - DNA, 22 bp, Artificial Sequence
  chemically synthesized
ctttttaaaaaatttatcatgt

SEQ ID NO: 636700 - DNA, 22 bp, Artificial Sequence
  chemically synthesized
gctttttaaaaaatttatcatg

SEQ ID NO: 636701 - DNA, 22 bp, Artificial Sequence
  chemically synthesized
tgctttttaaaaaatttatcat

SEQ ID NO: 636702 - DNA, 22 bp, Artificial Sequence
  chemically synthesized
ctttgctttttaaaaaatttat

SEQ ID NO: 636703 - DNA, 22 bp, Artificial Sequence
  chemically synthesized
aaatgtacatgataaatttttt

SEQ ID NO: 636704 - DNA, 22 bp, Artificial Sequence
  chemically synthesized
ttcctttgctttttaaaaaatt

SEQ ID NO: 636705 - DNA, 22 bp, Artificial Sequence
  chemically synthesized
aactgttcctttgctttttaaa

SEQ ID NO: 636706 - DNA, 22 bp, Artificial Sequence
  chemically synthesized
aaaattaaactgttcctttgct

SEQ ID NO: 636707 - DNA, 22 bp, Artificial Sequence
  chemically synthesized
aaaaattaaactgttcctttgc

SEQ ID NO: 636708 - DNA, 22 bp, Artificial Sequence
  chemically synthesized
tttaaaaagcaaaggaacagtt

SEQ ID NO: 636709 - DNA, 22 bp, Artificial Sequence
  chemically synthesized
atttaaaaattaaactgttcct

SEQ ID NO: 636710 - DNA, 22 bp, Artificial Sequence
  chemically synthesized
ttaaaaagcaaaggaacagttt

SEQ ID NO: 636711 - DNA, 22 bp, Artificial Sequence
  chemically synthesized
taaaaagcaaaggaacagttta

SEQ ID NO: 636712 - DNA, 22 bp, Artificial Sequence
  chemically synthesized
aaaaagcaaaggaacagtttaa

SEQ ID NO: 636713 - DNA, 22 bp, Artificial Sequence
  chemically synthesized
ttgatttaaaaattaaactgtt

SEQ ID NO: 636714 - DNA, 22 bp, Artificial Sequence
  chemically synthesized
aaaagcaaaggaacagtttaat

SEQ ID NO: 636715 - DNA, 22 bp, Artificial Sequence
  chemically synthesized
attgatttaaaaattaaactgt

SEQ ID NO: 636716 - DNA, 22 bp, Artificial Sequence
  chemically synthesized
tattgatttaaaaattaaactg

SEQ ID NO: 636717 - DNA, 22 bp, Artificial Sequence
  chemically synthesized
tattttattgatttaaaaatta

SEQ ID NO: 636718 - DNA, 22 bp, Artificial Sequence
  chemically synthesized
atattttattgatttaaaaatt

SEQ ID NO: 636719 - DNA, 22 bp, Artificial Sequence
  chemically synthesized
tatattttattgatttaaaaat

SEQ ID NO: 636720 - DNA, 22 bp, Artificial Sequence
  chemically synthesized
aagcattttatattttattgat

SEQ ID NO: 636721 - DNA, 22 bp, Artificial Sequence
  chemically synthesized
gaagcattttatattttattga

SEQ ID NO: 636722 - DNA, 22 bp, Artificial Sequence
  chemically synthesized
tgaagcattttatattttattg

SEQ ID NO: 636723 - DNA, 22 bp, Artificial Sequence
  chemically synthesized
aatttttaaatcaataaaatat

SEQ ID NO: 636724 - DNA, 22 bp, Artificial Sequence
  chemically synthesized
ttgaagcattttatattttatt

SEQ ID NO: 636725 - DNA, 22 bp, Artificial Sequence
  chemically synthesized
atttttaaatcaataaaatata

SEQ ID NO: 636726 - DNA, 22 bp, Artificial Sequence
  chemically synthesized
tttgaagcattttatattttat

SEQ ID NO: 636727 - DNA, 22 bp, Artificial Sequence
  chemically synthesized
ttttttgaagcattttatattt

SEQ ID NO: 636728 - DNA, 22 bp, Artificial Sequence
  chemically synthesized
ttaaatcaataaaatataaaat

SEQ ID NO: 636729 - DNA, 22 bp, Artificial Sequence
  chemically synthesized
taaatcaataaaatataaaatg

SEQ ID NO: 636730 - DNA, 22 bp, Artificial Sequence
  chemically synthesized
aaatcaataaaatataaaatgc

SEQ ID NO: 636731 - DNA, 22 bp, Artificial Sequence
  chemically synthesized
ctgttttttgaagcattttata

SEQ ID NO: 636732 - DNA, 22 bp, Artificial Sequence
  chemically synthesized
aatcaataaaatataaaatgct

SEQ ID NO: 636733 - DNA, 22 bp, Artificial Sequence
  chemically synthesized
caccagattactgttttttgaa

SEQ ID NO: 636734 - DNA, 22 bp, Artificial Sequence
  chemically synthesized
ccaccagattactgttttttga

SEQ ID NO: 636735 - DNA, 22 bp, Artificial Sequence
  chemically synthesized
tccaccagattactgttttttg

SEQ ID NO: 636736 - DNA, 22 bp, Artificial Sequence
  chemically synthesized
actttccaccagattactgttt

SEQ ID NO: 636737 - DNA, 22 bp, Artificial Sequence
  chemically synthesized
ctaactttccaccagattactg

SEQ ID NO: 636738 - DNA, 22 bp, Artificial Sequence
  chemically synthesized
caaaaaacagtaatctggtgga

SEQ ID NO: 636739 - DNA, 22 bp, Artificial Sequence
  chemically synthesized
aaaaaacagtaatctggtggaa

SEQ ID NO: 636740 - DNA, 22 bp, Artificial Sequence
  chemically synthesized
atgactcctaactttccaccag

SEQ ID NO: 636741 - DNA, 22 bp, Artificial Sequence
  chemically synthesized
tgatgactcctaactttccacc

SEQ ID NO: 636742 - DNA, 22 bp, Artificial Sequence
  chemically synthesized
tctctgatgactcctaactttc

SEQ ID NO: 636743 - DNA, 22 bp, Artificial Sequence
  chemically synthesized
atctctgatgactcctaacttt

SEQ ID NO: 636744 - DNA, 22 bp, Artificial Sequence
  chemically synthesized
cttatctctgatgactcctaac

SEQ ID NO: 636745 - DNA, 22 bp, Artificial Sequence
  chemically synthesized
gtggaaagttaggagtcatcag

SEQ ID NO: 636746 - DNA, 22 bp, Artificial Sequence
  chemically synthesized
ggagtcatcagagataaggagt

SEQ ID NO: 636747 - DNA, 22 bp, Artificial Sequence
  chemically synthesized
tgatgtccagacaactccttat

SEQ ID NO: 636748 - DNA, 22 bp, Artificial Sequence
  chemically synthesized
catatacaaatctgtgatgtcc

SEQ ID NO: 636749 - DNA, 22 bp, Artificial Sequence
  chemically synthesized
atgggctccatatacaaatctg

SEQ ID NO: 636750 - DNA, 22 bp, Artificial Sequence
  chemically synthesized
tctggacatcacagatttgtat

SEQ ID NO: 636751 - DNA, 22 bp, Artificial Sequence
  chemically synthesized
tcatgggctccatatacaaatc

SEQ ID NO: 636752 - DNA, 22 bp, Artificial Sequence
  chemically synthesized
gacatcacagatttgtatatgg

SEQ ID NO: 636753 - DNA, 22 bp, Artificial Sequence
  chemically synthesized
gctctcatgggctccatataca

SEQ ID NO: 636754 - DNA, 22 bp, Artificial Sequence
  chemically synthesized
ttggctctcatgggctccatat

SEQ ID NO: 636755 - DNA, 22 bp, Artificial Sequence
  chemically synthesized
tcccctattggctctcatgggc

SEQ ID NO: 636756 - DNA, 22 bp, Artificial Sequence
  chemically synthesized
atcccctattggctctcatggg

SEQ ID NO: 636757 - DNA, 22 bp, Artificial Sequence
  chemically synthesized
gtatatggagcccatgagagcc

SEQ ID NO: 636758 - DNA, 22 bp, Artificial Sequence
  chemically synthesized
tatatggagcccatgagagcca

SEQ ID NO: 636759 - DNA, 22 bp, Artificial Sequence
  chemically synthesized
acaatgtttatcccctattggc

SEQ ID NO: 636760 - DNA, 22 bp, Artificial Sequence
  chemically synthesized
gaggaagcaaatacagaacaaa

SEQ ID NO: 636761 - DNA, 22 bp, Artificial Sequence
  chemically synthesized
ttaattgctattttgttctgta

SEQ ID NO: 636762 - DNA, 22 bp, Artificial Sequence
  chemically synthesized
ttggaggaagcaaatacagaac

SEQ ID NO: 636763 - DNA, 22 bp, Artificial Sequence
  chemically synthesized
attgctattttgttctgtattt

SEQ ID NO: 636764 - DNA, 22 bp, Artificial Sequence
  chemically synthesized
tattggaggaagcaaatacaga

SEQ ID NO: 636765 - DNA, 22 bp, Artificial Sequence
  chemically synthesized
ctattttgttctgtatttgctt

SEQ ID NO: 636766 - DNA, 22 bp, Artificial Sequence
  chemically synthesized
ttttgttctgtatttgcttcct

SEQ ID NO: 636767 - DNA, 22 bp, Artificial Sequence
  chemically synthesized
tgttctgtatttgcttcctcca

SEQ ID NO: 636768 - DNA, 22 bp, Artificial Sequence
  chemically synthesized
gttctgtatttgcttcctccaa

SEQ ID NO: 636769 - DNA, 22 bp, Artificial Sequence
  chemically synthesized
ttctgtatttgcttcctccaat

SEQ ID NO: 636770 - DNA, 22 bp, Artificial Sequence
  chemically synthesized
tgtatttgcttcctccaataga

SEQ ID NO: 636771 - DNA, 22 bp, Artificial Sequence
  chemically synthesized
atgaaacgtacattctattgga

SEQ ID NO: 636772 - DNA, 22 bp, Artificial Sequence
  chemically synthesized
tatttgcttcctccaatagaat

SEQ ID NO: 636773 - DNA, 22 bp, Artificial Sequence
  chemically synthesized
gcttcctccaatagaatgtacg

SEQ ID NO: 636774 - DNA, 22 bp, Artificial Sequence
  chemically synthesized
cttcctccaatagaatgtacgt

SEQ ID NO: 636775 - DNA, 22 bp, Artificial Sequence
  chemically synthesized
cctccaatagaatgtacgtttc

SEQ ID NO: 636776 - DNA, 22 bp, Artificial Sequence
  chemically synthesized
ctccaatagaatgtacgtttca

SEQ ID NO: 636777 - DNA, 22 bp, Artificial Sequence
  chemically synthesized
agacaatgtgctaatgaaacgt

SEQ ID NO: 636778 - DNA, 22 bp, Artificial Sequence
  chemically synthesized
caatagaatgtacgtttcatta

SEQ ID NO: 636779 - DNA, 22 bp, Artificial Sequence
  chemically synthesized
ctgagacaatgtgctaatgaaa

SEQ ID NO: 636780 - DNA, 22 bp, Artificial Sequence
  chemically synthesized
actgagacaatgtgctaatgaa

SEQ ID NO: 636781 - DNA, 22 bp, Artificial Sequence
  chemically synthesized
ttactgagacaatgtgctaatg

SEQ ID NO: 636782 - DNA, 22 bp, Artificial Sequence
  chemically synthesized
tacagttcttactgagacaatg

SEQ ID NO: 636783 - DNA, 22 bp, Artificial Sequence
  chemically synthesized
tgtacagttcttactgagacaa

SEQ ID NO: 636784 - DNA, 22 bp, Artificial Sequence
  chemically synthesized
cattagcacattgtctcagtaa

SEQ ID NO: 636785 - DNA, 22 bp, Artificial Sequence
  chemically synthesized
attagcacattgtctcagtaag

SEQ ID NO: 636786 - DNA, 22 bp, Artificial Sequence
  chemically synthesized
tattctgtacagttcttactga

SEQ ID NO: 636787 - DNA, 22 bp, Artificial Sequence
  chemically synthesized
gtattctgtacagttcttactg

SEQ ID NO: 636788 - DNA, 22 bp, Artificial Sequence
  chemically synthesized
gcacattgtctcagtaagaact

SEQ ID NO: 636789 - DNA, 22 bp, Artificial Sequence
  chemically synthesized
tctcagtaagaactgtacagaa

SEQ ID NO: 636790 - DNA, 22 bp, Artificial Sequence
  chemically synthesized
tgtaccatttgtattctgtaca

SEQ ID NO: 636791 - DNA, 22 bp, Artificial Sequence
  chemically synthesized
tatgtaccatttgtattctgta

SEQ ID NO: 636792 - DNA, 22 bp, Artificial Sequence
  chemically synthesized
agtaagaactgtacagaataca

SEQ ID NO: 636793 - DNA, 22 bp, Artificial Sequence
  chemically synthesized
agtctctatgtaccatttgtat

SEQ ID NO: 636794 - DNA, 22 bp, Artificial Sequence
  chemically synthesized
tacagaatacaaatggtacata

SEQ ID NO: 636795 - DNA, 22 bp, Artificial Sequence
  chemically synthesized
tcactgagtctctatgtaccat

SEQ ID NO: 636796 - DNA, 22 bp, Artificial Sequence
  chemically synthesized
atcactgagtctctatgtacca

SEQ ID NO: 636797 - DNA, 22 bp, Artificial Sequence
  chemically synthesized
aagccatgaaatacttatcact

SEQ ID NO: 636798 - DNA, 22 bp, Artificial Sequence
  chemically synthesized
ctcaagccatgaaatacttatc

SEQ ID NO: 636799 - DNA, 22 bp, Artificial Sequence
  chemically synthesized
cctcaagccatgaaatacttat

SEQ ID NO: 636800 - DNA, 22 bp, Artificial Sequence
  chemically synthesized
agtgataagtatttcatggctt

SEQ ID NO: 636801 - DNA, 22 bp, Artificial Sequence
  chemically synthesized
aagagtcaacatatttcctcaa

SEQ ID NO: 636802 - DNA, 22 bp, Artificial Sequence
  chemically synthesized
catggcttgaggaaatatgttg

SEQ ID NO: 636803 - DNA, 22 bp, Artificial Sequence
  chemically synthesized
atggcttgaggaaatatgttga

SEQ ID NO: 636804 - DNA, 22 bp, Artificial Sequence
  chemically synthesized
ggtgatgtgtctaaagagtcaa

SEQ ID NO: 636805 - DNA, 22 bp, Artificial Sequence
  chemically synthesized
gaggaaatatgttgactcttta

SEQ ID NO: 636806 - DNA, 22 bp, Artificial Sequence
  chemically synthesized
aggaaatatgttgactctttag

SEQ ID NO: 636807 - DNA, 22 bp, Artificial Sequence
  chemically synthesized
actctttagacacatcacctaa

SEQ ID NO: 636808 - DNA, 22 bp, Artificial Sequence
  chemically synthesized
tttagacacatcacctaatatg

SEQ ID NO: 636809 - DNA, 22 bp, Artificial Sequence
  chemically synthesized
tagacacatcacctaatatgac

SEQ ID NO: 636810 - DNA, 22 bp, Artificial Sequence
  chemically synthesized
agacacatcacctaatatgact

SEQ ID NO: 636811 - DNA, 22 bp, Artificial Sequence
  chemically synthesized
gacacatcacctaatatgactt

SEQ ID NO: 636812 - DNA, 22 bp, Artificial Sequence
  chemically synthesized
agtgaaacatgagacaagtcat

SEQ ID NO: 636813 - DNA, 22 bp, Artificial Sequence
  chemically synthesized
aagtgaaacatgagacaagtca

SEQ ID NO: 636814 - DNA, 22 bp, Artificial Sequence
  chemically synthesized
taagtgaaacatgagacaagtc

SEQ ID NO: 636815 - DNA, 22 bp, Artificial Sequence
  chemically synthesized
ttaagtgaaacatgagacaagt

SEQ ID NO: 636816 - DNA, 22 bp, Artificial Sequence
  chemically synthesized
ttttaagtgaaacatgagacaa

SEQ ID NO: 636817 - DNA, 22 bp, Artificial Sequence
  chemically synthesized
cttttaagtgaaacatgagaca

SEQ ID NO: 636818 - DNA, 22 bp, Artificial Sequence
  chemically synthesized
tcttttaagtgaaacatgagac

SEQ ID NO: 636819 - DNA, 22 bp, Artificial Sequence
  chemically synthesized
atatgacttgtctcatgtttca

SEQ ID NO: 636820 - DNA, 22 bp, Artificial Sequence
  chemically synthesized
attttcttttaagtgaaacatg

SEQ ID NO: 636821 - DNA, 22 bp, Artificial Sequence
  chemically synthesized
gtctcatgtttcacttaaaaga

SEQ ID NO: 636822 - DNA, 22 bp, Artificial Sequence
  chemically synthesized
tctcatgtttcacttaaaagaa

SEQ ID NO: 636823 - DNA, 22 bp, Artificial Sequence
  chemically synthesized
atgtttcacttaaaagaaaatc

SEQ ID NO: 636824 - DNA, 22 bp, Artificial Sequence
  chemically synthesized
cacttaaaagaaaatcagtcat

SEQ ID NO: 636825 - DNA, 22 bp, Artificial Sequence
  chemically synthesized
acttaaaagaaaatcagtcatc

SEQ ID NO: 636826 - DNA, 22 bp, Artificial Sequence
  chemically synthesized
aatatgcaaccccgatgactga

SEQ ID NO: 636827 - DNA, 22 bp, Artificial Sequence
  chemically synthesized
aaatatgcaaccccgatgactg

SEQ ID NO: 636828 - DNA, 22 bp, Artificial Sequence
  chemically synthesized
taaatatgcaaccccgatgact

SEQ ID NO: 636829 - DNA, 22 bp, Artificial Sequence
  chemically synthesized
aaaagaaaatcagtcatcgggg

SEQ ID NO: 636830 - DNA, 22 bp, Artificial Sequence
  chemically synthesized
aaagaaaatcagtcatcggggt

SEQ ID NO: 636831 - DNA, 22 bp, Artificial Sequence
  chemically synthesized
tttaaatatgcaaccccgatga

SEQ ID NO: 636832 - DNA, 22 bp, Artificial Sequence
  chemically synthesized
cattctttaaatatgcaacccc

SEQ ID NO: 636833 - DNA, 22 bp, Artificial Sequence
  chemically synthesized
gatagagctgcattctttaaat

SEQ ID NO: 636834 - DNA, 22 bp, Artificial Sequence
  chemically synthesized
tggatagagctgcattctttaa

SEQ ID NO: 636835 - DNA, 22 bp, Artificial Sequence
  chemically synthesized
catatttaaagaatgcagctct

SEQ ID NO: 636836 - DNA, 22 bp, Artificial Sequence
  chemically synthesized
aaccacattctggatagagctg

SEQ ID NO: 636837 - DNA, 22 bp, Artificial Sequence
  chemically synthesized
ctgaaccacattctggatagag

SEQ ID NO: 636838 - DNA, 22 bp, Artificial Sequence
  chemically synthesized
aaagaatgcagctctatccaga

SEQ ID NO: 636839 - DNA, 22 bp, Artificial Sequence
  chemically synthesized
aagaatgcagctctatccagaa

SEQ ID NO: 636840 - DNA, 22 bp, Artificial Sequence
  chemically synthesized
ggatctgctgaaccacattctg

SEQ ID NO: 636841 - DNA, 22 bp, Artificial Sequence
  chemically synthesized
tatccagaatgtggttcagcag

SEQ ID NO: 636842 - DNA, 22 bp, Artificial Sequence
  chemically synthesized
tccagaatgtggttcagcagat

SEQ ID NO: 636843 - DNA, 22 bp, Artificial Sequence
  chemically synthesized
agatacaaggctgggatctgct

SEQ ID NO: 636844 - DNA, 22 bp, Artificial Sequence
  chemically synthesized
gagatacaaggctgggatctgc

SEQ ID NO: 636845 - DNA, 22 bp, Artificial Sequence
  chemically synthesized
aaggtttgagatacaaggctgg

SEQ ID NO: 636846 - DNA, 22 bp, Artificial Sequence
  chemically synthesized
gaaggtttgagatacaaggctg

SEQ ID NO: 636847 - DNA, 22 bp, Artificial Sequence
  chemically synthesized
tgaaggtttgagatacaaggct

SEQ ID NO: 636848 - DNA, 22 bp, Artificial Sequence
  chemically synthesized
agcagatcccagccttgtatct

SEQ ID NO: 636849 - DNA, 22 bp, Artificial Sequence
  chemically synthesized
ggctttgaaggtttgagataca

SEQ ID NO: 636850 - DNA, 22 bp, Artificial Sequence
  chemically synthesized
gggctttgaaggtttgagatac

SEQ ID NO: 636851 - DNA, 22 bp, Artificial Sequence
  chemically synthesized
gtatctcaaaccttcaaagccc

SEQ ID NO: 636852 - DNA, 22 bp, Artificial Sequence
  chemically synthesized
tatctcaaaccttcaaagccca

SEQ ID NO: 636853 - DNA, 22 bp, Artificial Sequence
  chemically synthesized
aaaccttcaaagcccaagtata

SEQ ID NO: 636854 - DNA, 22 bp, Artificial Sequence
  chemically synthesized
aataaatgcagtgtatatactt

SEQ ID NO: 636855 - DNA, 22 bp, Artificial Sequence
  chemically synthesized
aaataaatgcagtgtatatact

SEQ ID NO: 636856 - DNA, 22 bp, Artificial Sequence
  chemically synthesized
caaagcccaagtatatacactg

SEQ ID NO: 636857 - DNA, 22 bp, Artificial Sequence
  chemically synthesized
aaagcccaagtatatacactgc

SEQ ID NO: 636858 - DNA, 22 bp, Artificial Sequence
  chemically synthesized
aaggatgcacacaggtgtttaa

SEQ ID NO: 636859 - DNA, 22 bp, Artificial Sequence
  chemically synthesized
gaaggatgcacacaggtgttta

SEQ ID NO: 636860 - DNA, 22 bp, Artificial Sequence
  chemically synthesized
ttgaaggatgcacacaggtgtt

SEQ ID NO: 636861 - DNA, 22 bp, Artificial Sequence
  chemically synthesized
cttgaaggatgcacacaggtgt

SEQ ID NO: 636862 - DNA, 22 bp, Artificial Sequence
  chemically synthesized
catttatttaaacacctgtgtg

SEQ ID NO: 636863 - DNA, 22 bp, Artificial Sequence
  chemically synthesized
atttaaacacctgtgtgcatcc

SEQ ID NO: 636864 - DNA, 22 bp, Artificial Sequence
  chemically synthesized
tttaaacacctgtgtgcatcct

SEQ ID NO: 636865 - DNA, 22 bp, Artificial Sequence
  chemically synthesized
ccgtcttcttgaaggatgcaca

SEQ ID NO: 636866 - DNA, 22 bp, Artificial Sequence
  chemically synthesized
accgtcttcttgaaggatgcac

SEQ ID NO: 636867 - DNA, 22 bp, Artificial Sequence
  chemically synthesized
aaacacctgtgtgcatccttca

SEQ ID NO: 636868 - DNA, 22 bp, Artificial Sequence
  chemically synthesized
aacacctgtgtgcatccttcaa

SEQ ID NO: 636869 - DNA, 22 bp, Artificial Sequence
  chemically synthesized
tgtgcatccttcaagaagacgg

SEQ ID NO: 636870 - DNA, 22 bp, Artificial Sequence
  chemically synthesized
aaaaggaaaaaagccttaccgt

SEQ ID NO: 636871 - DNA, 22 bp, Artificial Sequence
  chemically synthesized
aaaaaggaaaaaagccttaccg

SEQ ID NO: 636872 - DNA, 22 bp, Artificial Sequence
  chemically synthesized
caagaagacggtaaggcttttt

SEQ ID NO: 636873 - DNA, 22 bp, Artificial Sequence
  chemically synthesized
atttaaaaaggaaaaaagcctt

SEQ ID NO: 636874 - DNA, 22 bp, Artificial Sequence
  chemically synthesized
aagaagacggtaaggctttttt

SEQ ID NO: 636875 - DNA, 22 bp, Artificial Sequence
  chemically synthesized
catttaaaaaggaaaaaagcct

SEQ ID NO: 636876 - DNA, 22 bp, Artificial Sequence
  chemically synthesized
acttcatttaaaaaggaaaaaa

SEQ ID NO: 636877 - DNA, 22 bp, Artificial Sequence
  chemically synthesized
cataagctaacttcatttaaaa

SEQ ID NO: 636878 - DNA, 22 bp, Artificial Sequence
  chemically synthesized
ttttcctttttaaatgaagtta

SEQ ID NO: 636879 - DNA, 22 bp, Artificial Sequence
  chemically synthesized
tttcctttttaaatgaagttag

SEQ ID NO: 636880 - DNA, 22 bp, Artificial Sequence
  chemically synthesized
ttcctttttaaatgaagttagc

SEQ ID NO: 636881 - DNA, 22 bp, Artificial Sequence
  chemically synthesized
tcctttttaaatgaagttagct

SEQ ID NO: 636882 - DNA, 22 bp, Artificial Sequence
  chemically synthesized
cctttttaaatgaagttagctt

SEQ ID NO: 636883 - DNA, 22 bp, Artificial Sequence
  chemically synthesized
ctttttaaatgaagttagctta

SEQ ID NO: 636884 - DNA, 22 bp, Artificial Sequence
  chemically synthesized
tttaaatgaagttagcttatgc

SEQ ID NO: 636885 - DNA, 22 bp, Artificial Sequence
  chemically synthesized
ttaaatgaagttagcttatgca

SEQ ID NO: 636886 - DNA, 22 bp, Artificial Sequence
  chemically synthesized
taaatgaagttagcttatgcag

SEQ ID NO: 636887 - DNA, 22 bp, Artificial Sequence
  chemically synthesized
aaatgaagttagcttatgcagt

SEQ ID NO: 636888 - DNA, 22 bp, Artificial Sequence
  chemically synthesized
aatgaagttagcttatgcagtt

SEQ ID NO: 636889 - DNA, 22 bp, Artificial Sequence
  chemically synthesized
gcttatgcagttcgatatggtt

SEQ ID NO: 636890 - DNA, 22 bp, Artificial Sequence
  chemically synthesized
atgcagttcgatatggtttggt

SEQ ID NO: 636891 - DNA, 22 bp, Artificial Sequence
  chemically synthesized
tgcagttcgatatggtttggtt

SEQ ID NO: 636892 - DNA, 22 bp, Artificial Sequence
  chemically synthesized
gatggggacacagaaccaaacc

SEQ ID NO: 636893 - DNA, 22 bp, Artificial Sequence
  chemically synthesized
ggatggggacacagaaccaaac

SEQ ID NO: 636894 - DNA, 22 bp, Artificial Sequence
  chemically synthesized
gatatggtttggttctgtgtcc

SEQ ID NO: 636895 - DNA, 22 bp, Artificial Sequence
  chemically synthesized
aacatgagatttggatggggac

SEQ ID NO: 636896 - DNA, 22 bp, Artificial Sequence
  chemically synthesized
ggttctgtgtccccatccaaat

SEQ ID NO: 636897 - DNA, 22 bp, Artificial Sequence
  chemically synthesized
gttctgtgtccccatccaaatc

SEQ ID NO: 636898 - DNA, 22 bp, Artificial Sequence
  chemically synthesized
caattcaacatgagatttggat

SEQ ID NO: 636899 - DNA, 22 bp, Artificial Sequence
  chemically synthesized
tgtgtccccatccaaatctcat

SEQ ID NO: 636900 - DNA, 22 bp, Artificial Sequence
  chemically synthesized
tgtccccatccaaatctcatgt

SEQ ID NO: 636901 - DNA, 22 bp, Artificial Sequence
  chemically synthesized
ccgcagcacatggggattacaa

SEQ ID NO: 636902 - DNA, 22 bp, Artificial Sequence
  chemically synthesized
atgttgaattgtaatccccatg

SEQ ID NO: 636903 - DNA, 22 bp, Artificial Sequence
  chemically synthesized
aattgtaatccccatgtgctgc

SEQ ID NO: 636904 - DNA, 22 bp, Artificial Sequence
  chemically synthesized
ccaccggacccctcccgcagca

SEQ ID NO: 636905 - DNA, 22 bp, Artificial Sequence
  chemically synthesized
taatccccatgtgctgcgggag

SEQ ID NO: 636906 - DNA, 22 bp, Artificial Sequence
  chemically synthesized
cgggaggggtccggtgggaggt

SEQ ID NO: 636907 - DNA, 22 bp, Artificial Sequence
  chemically synthesized
gatcatggcggcggtttccccc

SEQ ID NO: 636908 - DNA, 22 bp, Artificial Sequence
  chemically synthesized
tcatgagaacagcatgggggaa

SEQ ID NO: 636909 - DNA, 22 bp, Artificial Sequence
  chemically synthesized
actatcatgagaacagcatggg

SEQ ID NO: 636910 - DNA, 22 bp, Artificial Sequence
  chemically synthesized
tgcgaactcactatcatgagaa

SEQ ID NO: 636911 - DNA, 22 bp, Artificial Sequence
  chemically synthesized
cccccatgctgttctcatgata

SEQ ID NO: 636912 - DNA, 22 bp, Artificial Sequence
  chemically synthesized
atgcgaactcactatcatgaga

SEQ ID NO: 636913 - DNA, 22 bp, Artificial Sequence
  chemically synthesized
ccccatgctgttctcatgatag

SEQ ID NO: 636914 - DNA, 22 bp, Artificial Sequence
  chemically synthesized
ttctcatgatagtgagttcgca

SEQ ID NO: 636915 - DNA, 22 bp, Artificial Sequence
  chemically synthesized
tcatgatagtgagttcgcataa

SEQ ID NO: 636916 - DNA, 22 bp, Artificial Sequence
  chemically synthesized
aaccatcagatcttatgcgaac

SEQ ID NO: 636917 - DNA, 22 bp, Artificial Sequence
  chemically synthesized
aaaccatcagatcttatgcgaa

SEQ ID NO: 636918 - DNA, 22 bp, Artificial Sequence
  chemically synthesized
atgatagtgagttcgcataaga

SEQ ID NO: 636919 - DNA, 22 bp, Artificial Sequence
  chemically synthesized
taaaccatcagatcttatgcga

SEQ ID NO: 636920 - DNA, 22 bp, Artificial Sequence
  chemically synthesized
ttaaaccatcagatcttatgcg

SEQ ID NO: 636921 - DNA, 22 bp, Artificial Sequence
  chemically synthesized
ccacacttttaaaccatcagat

SEQ ID NO: 636922 - DNA, 22 bp, Artificial Sequence
  chemically synthesized
gcataagatctgatggtttaaa

SEQ ID NO: 636923 - DNA, 22 bp, Artificial Sequence
  chemically synthesized
atggtttaaaagtgtggcagtt

SEQ ID NO: 636924 - DNA, 22 bp, Artificial Sequence
  chemically synthesized
aaaagtgtggcagttctcccct

SEQ ID NO: 636925 - DNA, 22 bp, Artificial Sequence
  chemically synthesized
aaagtgtggcagttctcccctc

SEQ ID NO: 636926 - DNA, 22 bp, Artificial Sequence
  chemically synthesized
catagcggcaggagagagaaag

SEQ ID NO: 636927 - DNA, 22 bp, Artificial Sequence
  chemically synthesized
tcccctcgctttctctctcctg

SEQ ID NO: 636928 - DNA, 22 bp, Artificial Sequence
  chemically synthesized
ccctcgctttctctctcctgcc

SEQ ID NO: 636929 - DNA, 22 bp, Artificial Sequence
  chemically synthesized
gctttctctctcctgccgctat

SEQ ID NO: 636930 - DNA, 22 bp, Artificial Sequence
  chemically synthesized
tctctctcctgccgctatgtag

SEQ ID NO: 636931 - DNA, 22 bp, Artificial Sequence
  chemically synthesized
ctctctcctgccgctatgtagc

SEQ ID NO: 636932 - DNA, 22 bp, Artificial Sequence
  chemically synthesized
tctctcctgccgctatgtagca

SEQ ID NO: 636933 - DNA, 22 bp, Artificial Sequence
  chemically synthesized
tctcctgccgctatgtagcaca

SEQ ID NO: 636934 - DNA, 22 bp, Artificial Sequence
  chemically synthesized
tcctgccgctatgtagcacatg

SEQ ID NO: 636935 - DNA, 22 bp, Artificial Sequence
  chemically synthesized
ctgccgctatgtagcacatgcc

SEQ ID NO: 636936 - DNA, 22 bp, Artificial Sequence
  chemically synthesized
ccgctatgtagcacatgccttg

SEQ ID NO: 636937 - DNA, 22 bp, Artificial Sequence
  chemically synthesized
tgtagcacatgccttgcttccc

SEQ ID NO: 636938 - DNA, 22 bp, Artificial Sequence
  chemically synthesized
caatcatgggggaaggtgaagg

SEQ ID NO: 636939 - DNA, 22 bp, Artificial Sequence
  chemically synthesized
acaatcatgggggaaggtgaag

SEQ ID NO: 636940 - DNA, 22 bp, Artificial Sequence
  chemically synthesized
gcttccccttcaccttccccca

SEQ ID NO: 636941 - DNA, 22 bp, Artificial Sequence
  chemically synthesized
cttccccttcaccttcccccat

SEQ ID NO: 636942 - DNA, 22 bp, Artificial Sequence
  chemically synthesized
ccccttcaccttcccccatgat

SEQ ID NO: 636943 - DNA, 22 bp, Artificial Sequence
  chemically synthesized
aggaaacttacaatcatggggg

SEQ ID NO: 636944 - DNA, 22 bp, Artificial Sequence
  chemically synthesized
cccttcaccttcccccatgatt

SEQ ID NO: 636945 - DNA, 22 bp, Artificial Sequence
  chemically synthesized
caccttcccccatgattgtaag

SEQ ID NO: 636946 - DNA, 22 bp, Artificial Sequence
  chemically synthesized
accttcccccatgattgtaagt

SEQ ID NO: 636947 - DNA, 22 bp, Artificial Sequence
  chemically synthesized
gggaggcctcaggaaacttaca

SEQ ID NO: 636948 - DNA, 22 bp, Artificial Sequence
  chemically synthesized
cccccatgattgtaagtttcct

SEQ ID NO: 636949 - DNA, 22 bp, Artificial Sequence
  chemically synthesized
ccccatgattgtaagtttcctg

SEQ ID NO: 636950 - DNA, 22 bp, Artificial Sequence
  chemically synthesized
cacaaggctggggaggcctcag

SEQ ID NO: 636951 - DNA, 22 bp, Artificial Sequence
  chemically synthesized
taagtttcctgaggcctcccca

SEQ ID NO: 636952 - DNA, 22 bp, Artificial Sequence
  chemically synthesized
agttccacaaggctggggaggc

SEQ ID NO: 636953 - DNA, 22 bp, Artificial Sequence
  chemically synthesized
actcagttccacaaggctgggg

SEQ ID NO: 636954 - DNA, 22 bp, Artificial Sequence
  chemically synthesized
cctgaggcctccccagccttgt

SEQ ID NO: 636955 - DNA, 22 bp, Artificial Sequence
  chemically synthesized
ctgaggcctccccagccttgtg

SEQ ID NO: 636956 - DNA, 22 bp, Artificial Sequence
  chemically synthesized
ttgactcagttccacaaggctg

SEQ ID NO: 636957 - DNA, 22 bp, Artificial Sequence
  chemically synthesized
attgactcagttccacaaggct

SEQ ID NO: 636958 - DNA, 22 bp, Artificial Sequence
  chemically synthesized
aggcctccccagccttgtggaa

SEQ ID NO: 636959 - DNA, 22 bp, Artificial Sequence
  chemically synthesized
cccagccttgtggaactgagtc

SEQ ID NO: 636960 - DNA, 22 bp, Artificial Sequence
  chemically synthesized
tgaagaaagaggtttattgact

SEQ ID NO: 636961 - DNA, 22 bp, Artificial Sequence
  chemically synthesized
atgaagaaagaggtttattgac

SEQ ID NO: 636962 - DNA, 22 bp, Artificial Sequence
  chemically synthesized
gtggaactgagtcaataaacct

SEQ ID NO: 636963 - DNA, 22 bp, Artificial Sequence
  chemically synthesized
tggaactgagtcaataaacctc

SEQ ID NO: 636964 - DNA, 22 bp, Artificial Sequence
  chemically synthesized
ggtaatttatgaagaaagaggt

SEQ ID NO: 636965 - DNA, 22 bp, Artificial Sequence
  chemically synthesized
agtcaataaacctctttcttca

SEQ ID NO: 636966 - DNA, 22 bp, Artificial Sequence
  chemically synthesized
agactgggtaatttatgaagaa

SEQ ID NO: 636967 - DNA, 22 bp, Artificial Sequence
  chemically synthesized
cctgagactgggtaatttatga

SEQ ID NO: 636968 - DNA, 22 bp, Artificial Sequence
  chemically synthesized
tttcttcataaattacccagtc

SEQ ID NO: 636969 - DNA, 22 bp, Artificial Sequence
  chemically synthesized
tcttcataaattacccagtctc

SEQ ID NO: 636970 - DNA, 22 bp, Artificial Sequence
  chemically synthesized
cttcataaattacccagtctca

SEQ ID NO: 636971 - DNA, 22 bp, Artificial Sequence
  chemically synthesized
taaagaactacctgagactggg

SEQ ID NO: 636972 - DNA, 22 bp, Artificial Sequence
  chemically synthesized
ttcataaattacccagtctcag

SEQ ID NO: 636973 - DNA, 22 bp, Artificial Sequence
  chemically synthesized
cataaattacccagtctcaggt

SEQ ID NO: 636974 - DNA, 22 bp, Artificial Sequence
  chemically synthesized
ctataaagaactacctgagact

SEQ ID NO: 636975 - DNA, 22 bp, Artificial Sequence
  chemically synthesized
ataaattacccagtctcaggta

SEQ ID NO: 636976 - DNA, 22 bp, Artificial Sequence
  chemically synthesized
acactgctataaagaactacct

SEQ ID NO: 636977 - DNA, 22 bp, Artificial Sequence
  chemically synthesized
cacactgctataaagaactacc

SEQ ID NO: 636978 - DNA, 22 bp, Artificial Sequence
  chemically synthesized
tcacactgctataaagaactac

SEQ ID NO: 636979 - DNA, 22 bp, Artificial Sequence
  chemically synthesized
cccagtctcaggtagttcttta

SEQ ID NO: 636980 - DNA, 22 bp, Artificial Sequence
  chemically synthesized
ttttcacactgctataaagaac

SEQ ID NO: 636981 - DNA, 22 bp, Artificial Sequence
  chemically synthesized
atctgttttcacactgctataa

SEQ ID NO: 636982 - DNA, 22 bp, Artificial Sequence
  chemically synthesized
aggtagttctttatagcagtgt

SEQ ID NO: 636983 - DNA, 22 bp, Artificial Sequence
  chemically synthesized
tgtattaatctgttttcacact

SEQ ID NO: 636984 - DNA, 22 bp, Artificial Sequence
  chemically synthesized
tttatagcagtgtgaaaacaga

SEQ ID NO: 636985 - DNA, 22 bp, Artificial Sequence
  chemically synthesized
aactgtgtattaatctgttttc

SEQ ID NO: 636986 - DNA, 22 bp, Artificial Sequence
  chemically synthesized
tatagcagtgtgaaaacagatt

SEQ ID NO: 636987 - DNA, 22 bp, Artificial Sequence
  chemically synthesized
gaactgtgtattaatctgtttt

SEQ ID NO: 636988 - DNA, 22 bp, Artificial Sequence
  chemically synthesized
atagcagtgtgaaaacagatta

SEQ ID NO: 636989 - DNA, 22 bp, Artificial Sequence
  chemically synthesized
tagcagtgtgaaaacagattaa

SEQ ID NO: 636990 - DNA, 22 bp, Artificial Sequence
  chemically synthesized
ttgaactgtgtattaatctgtt

SEQ ID NO: 636991 - DNA, 22 bp, Artificial Sequence
  chemically synthesized
cttgaactgtgtattaatctgt

SEQ ID NO: 636992 - DNA, 22 bp, Artificial Sequence
  chemically synthesized
tcttgaactgtgtattaatctg

SEQ ID NO: 636993 - DNA, 22 bp, Artificial Sequence
  chemically synthesized
ttcttgaactgtgtattaatct

SEQ ID NO: 636994 - DNA, 22 bp, Artificial Sequence
  chemically synthesized
tttcttgaactgtgtattaatc

SEQ ID NO: 636995 - DNA, 22 bp, Artificial Sequence
  chemically synthesized
aagggtactttttcttgaactg

SEQ ID NO: 636996 - DNA, 22 bp, Artificial Sequence
  chemically synthesized
aattcaagggtactttttcttg

SEQ ID NO: 636997 - DNA, 22 bp, Artificial Sequence
  chemically synthesized
atacacagttcaagaaaaagta

SEQ ID NO: 636998 - DNA, 22 bp, Artificial Sequence
  chemically synthesized
aagaaaaagtacccttgaattc

SEQ ID NO: 636999 - DNA, 22 bp, Artificial Sequence
  chemically synthesized
aaagaaaagactgaattcaagg

SEQ ID NO: 637000 - DNA, 22 bp, Artificial Sequence
  chemically synthesized
tgaaagaaaagactgaattcaa

SEQ ID NO: 637001 - DNA, 22 bp, Artificial Sequence
  chemically synthesized
tcctctgaaagaaaagactgaa

SEQ ID NO: 637002 - DNA, 22 bp, Artificial Sequence
  chemically synthesized
gtcctctgaaagaaaagactga

SEQ ID NO: 637003 - DNA, 22 bp, Artificial Sequence
  chemically synthesized
aatttgtcctctgaaagaaaag

SEQ ID NO: 637004 - DNA, 22 bp, Artificial Sequence
  chemically synthesized
gaattcagtcttttctttcaga

SEQ ID NO: 637005 - DNA, 22 bp, Artificial Sequence
  chemically synthesized
aattcagtcttttctttcagag

SEQ ID NO: 637006 - DNA, 22 bp, Artificial Sequence
  chemically synthesized
tgttaaatttgtcctctgaaag

SEQ ID NO: 637007 - DNA, 22 bp, Artificial Sequence
  chemically synthesized
agtcttttctttcagaggacaa

SEQ ID NO: 637008 - DNA, 22 bp, Artificial Sequence
  chemically synthesized
ttctttcagaggacaaatttaa

SEQ ID NO: 637009 - DNA, 22 bp, Artificial Sequence
  chemically synthesized
tctttcagaggacaaatttaac

SEQ ID NO: 637010 - DNA, 22 bp, Artificial Sequence
  chemically synthesized
ctttcagaggacaaatttaaca

SEQ ID NO: 637011 - DNA, 22 bp, Artificial Sequence
  chemically synthesized
tttcagaggacaaatttaacac

SEQ ID NO: 637012 - DNA, 22 bp, Artificial Sequence
  chemically synthesized
tcagaggacaaatttaacacag

SEQ ID NO: 637013 - DNA, 22 bp, Artificial Sequence
  chemically synthesized
cagaggacaaatttaacacagc

SEQ ID NO: 637014 - DNA, 22 bp, Artificial Sequence
  chemically synthesized
agaggacaaatttaacacagct

SEQ ID NO: 637015 - DNA, 22 bp, Artificial Sequence
  chemically synthesized
gcataaaatggataagctgtgt

SEQ ID NO: 637016 - DNA, 22 bp, Artificial Sequence
  chemically synthesized
ctggcataaaatggataagctg

SEQ ID NO: 637017 - DNA, 22 bp, Artificial Sequence
  chemically synthesized
gctggcataaaatggataagct

SEQ ID NO: 637018 - DNA, 22 bp, Artificial Sequence
  chemically synthesized
aacacagcttatccattttatg

SEQ ID NO: 637019 - DNA, 22 bp, Artificial Sequence
  chemically synthesized
acacagcttatccattttatgc

SEQ ID NO: 637020 - DNA, 22 bp, Artificial Sequence
  chemically synthesized
agagataacttgctggcataaa

SEQ ID NO: 637021 - DNA, 22 bp, Artificial Sequence
  chemically synthesized
agctaagagataacttgctggc

SEQ ID NO: 637022 - DNA, 22 bp, Artificial Sequence
  chemically synthesized
atccattttatgccagcaagtt

SEQ ID NO: 637023 - DNA, 22 bp, Artificial Sequence
  chemically synthesized
tccattttatgccagcaagtta

SEQ ID NO: 637024 - DNA, 22 bp, Artificial Sequence
  chemically synthesized
tatgccagcaagttatctctta

SEQ ID NO: 637025 - DNA, 22 bp, Artificial Sequence
  chemically synthesized
caatggctaagctaagagataa

SEQ ID NO: 637026 - DNA, 22 bp, Artificial Sequence
  chemically synthesized
atgccagcaagttatctcttag

SEQ ID NO: 637027 - DNA, 22 bp, Artificial Sequence
  chemically synthesized
tgccagcaagttatctcttagc

SEQ ID NO: 637028 - DNA, 22 bp, Artificial Sequence
  chemically synthesized
tattccaatggctaagctaaga

SEQ ID NO: 637029 - DNA, 22 bp, Artificial Sequence
  chemically synthesized
tctcttagcttagccattggaa

SEQ ID NO: 637030 - DNA, 22 bp, Artificial Sequence
  chemically synthesized
ttagcttagccattggaatata

SEQ ID NO: 637031 - DNA, 22 bp, Artificial Sequence
  chemically synthesized
agcttagccattggaatatagc

SEQ ID NO: 637032 - DNA, 22 bp, Artificial Sequence
  chemically synthesized
gcttagccattggaatatagca

SEQ ID NO: 637033 - DNA, 22 bp, Artificial Sequence
  chemically synthesized
agccattggaatatagcacttt

SEQ ID NO: 637034 - DNA, 22 bp, Artificial Sequence
  chemically synthesized
aataccaggacaaaagtgctat

SEQ ID NO: 637035 - DNA, 22 bp, Artificial Sequence
  chemically synthesized
gccattggaatatagcactttt

SEQ ID NO: 637036 - DNA, 22 bp, Artificial Sequence
  chemically synthesized
gaatatagcacttttgtcctgg

SEQ ID NO: 637037 - DNA, 22 bp, Artificial Sequence
  chemically synthesized
aaaagatcatggtagaactgaa

SEQ ID NO: 637038 - DNA, 22 bp, Artificial Sequence
  chemically synthesized
ttgtcctggtattcagttctac

SEQ ID NO: 637039 - DNA, 22 bp, Artificial Sequence
  chemically synthesized
tgtcctggtattcagttctacc

SEQ ID NO: 637040 - DNA, 22 bp, Artificial Sequence
  chemically synthesized
gtcctggtattcagttctacca

SEQ ID NO: 637041 - DNA, 22 bp, Artificial Sequence
  chemically synthesized
tcctggtattcagttctaccat

SEQ ID NO: 637042 - DNA, 22 bp, Artificial Sequence
  chemically synthesized
tggagctaaaaagatcatggta

SEQ ID NO: 637043 - DNA, 22 bp, Artificial Sequence
  chemically synthesized
gtattcagttctaccatgatct

SEQ ID NO: 637044 - DNA, 22 bp, Artificial Sequence
  chemically synthesized
agttctaccatgatctttttag

SEQ ID NO: 637045 - DNA, 22 bp, Artificial Sequence
  chemically synthesized
atgatctgtggagctaaaaaga

SEQ ID NO: 637046 - DNA, 22 bp, Artificial Sequence
  chemically synthesized
taccatgatctttttagctcca

SEQ ID NO: 637047 - DNA, 22 bp, Artificial Sequence
  chemically synthesized
ccatgatctttttagctccaca

SEQ ID NO: 637048 - DNA, 22 bp, Artificial Sequence
  chemically synthesized
ggatgtggtcctgatgatctgt

SEQ ID NO: 637049 - DNA, 22 bp, Artificial Sequence
  chemically synthesized
tttagctccacagatcatcagg

SEQ ID NO: 637050 - DNA, 22 bp, Artificial Sequence
  chemically synthesized
ttagctccacagatcatcagga

SEQ ID NO: 637051 - DNA, 22 bp, Artificial Sequence
  chemically synthesized
tagctccacagatcatcaggac

SEQ ID NO: 637052 - DNA, 22 bp, Artificial Sequence
  chemically synthesized
agctccacagatcatcaggacc

SEQ ID NO: 637053 - DNA, 22 bp, Artificial Sequence
  chemically synthesized
gctccacagatcatcaggacca

SEQ ID NO: 637054 - DNA, 22 bp, Artificial Sequence
  chemically synthesized
cacagatcatcaggaccacatc

SEQ ID NO: 637055 - DNA, 22 bp, Artificial Sequence
  chemically synthesized
aagtgcacattaggatgtggtc

SEQ ID NO: 637056 - DNA, 22 bp, Artificial Sequence
  chemically synthesized
aaattaaagtgcacattaggat

SEQ ID NO: 637057 - DNA, 22 bp, Artificial Sequence
  chemically synthesized
aagcactcaaattaaagtgcac

SEQ ID NO: 637058 - DNA, 22 bp, Artificial Sequence
  chemically synthesized
gttaaagcactcaaattaaagt

SEQ ID NO: 637059 - DNA, 22 bp, Artificial Sequence
  chemically synthesized
atgtgcactttaatttgagtgc

SEQ ID NO: 637060 - DNA, 22 bp, Artificial Sequence
  chemically synthesized
taatttgagtgctttaacgagt

SEQ ID NO: 637061 - DNA, 22 bp, Artificial Sequence
  chemically synthesized
aatttgagtgctttaacgagta

SEQ ID NO: 637062 - DNA, 22 bp, Artificial Sequence
  chemically synthesized
atttgagtgctttaacgagtat

SEQ ID NO: 637063 - DNA, 22 bp, Artificial Sequence
  chemically synthesized
gagtgctttaacgagtatgctg

SEQ ID NO: 637064 - DNA, 22 bp, Artificial Sequence
  chemically synthesized
agtgctttaacgagtatgctgc

SEQ ID NO: 637065 - DNA, 22 bp, Artificial Sequence
  chemically synthesized
acaatggcgaataggcagcata

SEQ ID NO: 637066 - DNA, 22 bp, Artificial Sequence
  chemically synthesized
taacgagtatgctgcctattcg

SEQ ID NO: 637067 - DNA, 22 bp, Artificial Sequence
  chemically synthesized
aacgagtatgctgcctattcgc

SEQ ID NO: 637068 - DNA, 22 bp, Artificial Sequence
  chemically synthesized
acgagtatgctgcctattcgcc

SEQ ID NO: 637069 - DNA, 22 bp, Artificial Sequence
  chemically synthesized
ggtcgttgacaatggcgaatag

SEQ ID NO: 637070 - DNA, 22 bp, Artificial Sequence
  chemically synthesized
aggtcgttgacaatggcgaata

SEQ ID NO: 637071 - DNA, 22 bp, Artificial Sequence
  chemically synthesized
tttaggtcgttgacaatggcga

SEQ ID NO: 637072 - DNA, 22 bp, Artificial Sequence
  chemically synthesized
cctattcgccattgtcaacgac

SEQ ID NO: 637073 - DNA, 22 bp, Artificial Sequence
  chemically synthesized
ataattatttaggtcgttgaca

SEQ ID NO: 637074 - DNA, 22 bp, Artificial Sequence
  chemically synthesized
ttcgccattgtcaacgacctaa

SEQ ID NO: 637075 - DNA, 22 bp, Artificial Sequence
  chemically synthesized
gccattgtcaacgacctaaata

SEQ ID NO: 637076 - DNA, 22 bp, Artificial Sequence
  chemically synthesized
gaagcattaataattatttagg

SEQ ID NO: 637077 - DNA, 22 bp, Artificial Sequence
  chemically synthesized
agaagcattaataattatttag

SEQ ID NO: 637078 - DNA, 22 bp, Artificial Sequence
  chemically synthesized
tcaacgacctaaataattatta

SEQ ID NO: 637079 - DNA, 22 bp, Artificial Sequence
  chemically synthesized
ggtgcttagaagcattaataat

SEQ ID NO: 637080 - DNA, 22 bp, Artificial Sequence
  chemically synthesized
aataattattaatgcttctaag

SEQ ID NO: 637081 - DNA, 22 bp, Artificial Sequence
  chemically synthesized
agagccctgggtgcttagaagc

SEQ ID NO: 637082 - DNA, 22 bp, Artificial Sequence
  chemically synthesized
ttaatgcttctaagcacccagg

SEQ ID NO: 637083 - DNA, 22 bp, Artificial Sequence
  chemically synthesized
atgcttctaagcacccagggct

SEQ ID NO: 637084 - DNA, 22 bp, Artificial Sequence
  chemically synthesized
gtggtcagattcagagccctgg

SEQ ID NO: 637085 - DNA, 22 bp, Artificial Sequence
  chemically synthesized
agtggtcagattcagagccctg

SEQ ID NO: 637086 - DNA, 22 bp, Artificial Sequence
  chemically synthesized
tagtggtcagattcagagccct

SEQ ID NO: 637087 - DNA, 22 bp, Artificial Sequence
  chemically synthesized
ctaagcacccagggctctgaat

SEQ ID NO: 637088 - DNA, 22 bp, Artificial Sequence
  chemically synthesized
taagcacccagggctctgaatc

SEQ ID NO: 637089 - DNA, 22 bp, Artificial Sequence
  chemically synthesized
agcacccagggctctgaatctg

SEQ ID NO: 637090 - DNA, 22 bp, Artificial Sequence
  chemically synthesized
catattttagtggtcagattca

SEQ ID NO: 637091 - DNA, 22 bp, Artificial Sequence
  chemically synthesized
agttacatattttagtggtcag

SEQ ID NO: 637092 - DNA, 22 bp, Artificial Sequence
  chemically synthesized
tgaatctgaccactaaaatatg

SEQ ID NO: 637093 - DNA, 22 bp, Artificial Sequence
  chemically synthesized
aatctgaccactaaaatatgta

SEQ ID NO: 637094 - DNA, 22 bp, Artificial Sequence
  chemically synthesized
accactaaaatatgtaacttag

SEQ ID NO: 637095 - DNA, 22 bp, Artificial Sequence
  chemically synthesized
aaatatgtaacttagtttcata

SEQ ID NO: 637096 - DNA, 22 bp, Artificial Sequence
  chemically synthesized
agtaagtaaagcatatgaaact

SEQ ID NO: 637097 - DNA, 22 bp, Artificial Sequence
  chemically synthesized
aagtaagtaaagcatatgaaac

SEQ ID NO: 637098 - DNA, 22 bp, Artificial Sequence
  chemically synthesized
taagtaagtaaagcatatgaaa

SEQ ID NO: 637099 - DNA, 22 bp, Artificial Sequence
  chemically synthesized
ttaagtaagtaaagcatatgaa

SEQ ID NO: 637100 - DNA, 22 bp, Artificial Sequence
  chemically synthesized
tttaagtaagtaaagcatatga

SEQ ID NO: 637101 - DNA, 22 bp, Artificial Sequence
  chemically synthesized
ttttaagtaagtaaagcatatg

SEQ ID NO: 637102 - DNA, 22 bp, Artificial Sequence
  chemically synthesized
ccccttttttaagtaagtaaag

SEQ ID NO: 637103 - DNA, 22 bp, Artificial Sequence
  chemically synthesized
agtttcatatgctttacttact

SEQ ID NO: 637104 - DNA, 22 bp, Artificial Sequence
  chemically synthesized
cccccttttttaagtaagtaaa

SEQ ID NO: 637105 - DNA, 22 bp, Artificial Sequence
  chemically synthesized
gtttcatatgctttacttactt

SEQ ID NO: 637106 - DNA, 22 bp, Artificial Sequence
  chemically synthesized
tcccccttttttaagtaagtaa

SEQ ID NO: 637107 - DNA, 22 bp, Artificial Sequence
  chemically synthesized
catatgctttacttacttaaaa

SEQ ID NO: 637108 - DNA, 22 bp, Artificial Sequence
  chemically synthesized
atatgctttacttacttaaaaa

SEQ ID NO: 637109 - DNA, 22 bp, Artificial Sequence
  chemically synthesized
aggattttcccccttttttaag

SEQ ID NO: 637110 - DNA, 22 bp, Artificial Sequence
  chemically synthesized
caggattttcccccttttttaa

SEQ ID NO: 637111 - DNA, 22 bp, Artificial Sequence
  chemically synthesized
cttcaggattttcccccttttt

SEQ ID NO: 637112 - DNA, 22 bp, Artificial Sequence
  chemically synthesized
tacttacttaaaaaagggggaa

SEQ ID NO: 637113 - DNA, 22 bp, Artificial Sequence
  chemically synthesized
tacttcaggattttcccccttt

SEQ ID NO: 637114 - DNA, 22 bp, Artificial Sequence
  chemically synthesized
acttacttaaaaaagggggaaa

SEQ ID NO: 637115 - DNA, 22 bp, Artificial Sequence
  chemically synthesized
ctacttcaggattttccccctt

SEQ ID NO: 637116 - DNA, 22 bp, Artificial Sequence
  chemically synthesized
cttacttaaaaaagggggaaaa

SEQ ID NO: 637117 - DNA, 22 bp, Artificial Sequence
  chemically synthesized
tctacttcaggattttccccct

SEQ ID NO: 637118 - DNA, 22 bp, Artificial Sequence
  chemically synthesized
ttctacttcaggattttccccc

SEQ ID NO: 637119 - DNA, 22 bp, Artificial Sequence
  chemically synthesized
tttctacttcaggattttcccc

SEQ ID NO: 637120 - DNA, 22 bp, Artificial Sequence
  chemically synthesized
acttaaaaaagggggaaaatcc

SEQ ID NO: 637121 - DNA, 22 bp, Artificial Sequence
  chemically synthesized
ttttctacttcaggattttccc

SEQ ID NO: 637122 - DNA, 22 bp, Artificial Sequence
  chemically synthesized
cttaaaaaagggggaaaatcct

SEQ ID NO: 637123 - DNA, 22 bp, Artificial Sequence
  chemically synthesized
tttttttctacttcaggatttt

SEQ ID NO: 637124 - DNA, 22 bp, Artificial Sequence
  chemically synthesized
aaaaaagggggaaaatcctgaa

SEQ ID NO: 637125 - DNA, 22 bp, Artificial Sequence
  chemically synthesized
atttttttctacttcaggattt

SEQ ID NO: 637126 - DNA, 22 bp, Artificial Sequence
  chemically synthesized
aaaaagggggaaaatcctgaag

SEQ ID NO: 637127 - DNA, 22 bp, Artificial Sequence
  chemically synthesized
ttatttttttctacttcaggat

SEQ ID NO: 637128 - DNA, 22 bp, Artificial Sequence
  chemically synthesized
gtacctcttatttttttctact

SEQ ID NO: 637129 - DNA, 22 bp, Artificial Sequence
  chemically synthesized
agtacctcttatttttttctac

SEQ ID NO: 637130 - DNA, 22 bp, Artificial Sequence
  chemically synthesized
tagtacctcttatttttttcta

SEQ ID NO: 637131 - DNA, 22 bp, Artificial Sequence
  chemically synthesized
agctttagtacctcttattttt

SEQ ID NO: 637132 - DNA, 22 bp, Artificial Sequence
  chemically synthesized
aagtagaaaaaaataagaggta

SEQ ID NO: 637133 - DNA, 22 bp, Artificial Sequence
  chemically synthesized
aaaacaactgagctttagtacc

SEQ ID NO: 637134 - DNA, 22 bp, Artificial Sequence
  chemically synthesized
tgaaaacaactgagctttagta

SEQ ID NO: 637135 - DNA, 22 bp, Artificial Sequence
  chemically synthesized
taaattctgaaaacaactgagc

SEQ ID NO: 637136 - DNA, 22 bp, Artificial Sequence
  chemically synthesized
caaagtctgtaaattctgaaaa

SEQ ID NO: 637137 - DNA, 22 bp, Artificial Sequence
  chemically synthesized
aagctcagttgttttcagaatt

SEQ ID NO: 637138 - DNA, 22 bp, Artificial Sequence
  chemically synthesized
gcaaagtctgtaaattctgaaa

SEQ ID NO: 637139 - DNA, 22 bp, Artificial Sequence
  chemically synthesized
agttgttttcagaatttacaga

SEQ ID NO: 637140 - DNA, 22 bp, Artificial Sequence
  chemically synthesized
tatgcatttgcaaagtctgtaa

SEQ ID NO: 637141 - DNA, 22 bp, Artificial Sequence
  chemically synthesized
ttttcagaatttacagactttg

SEQ ID NO: 637142 - DNA, 22 bp, Artificial Sequence
  chemically synthesized
tcagaatttacagactttgcaa

SEQ ID NO: 637143 - DNA, 22 bp, Artificial Sequence
  chemically synthesized
cagaatttacagactttgcaaa

SEQ ID NO: 637144 - DNA, 22 bp, Artificial Sequence
  chemically synthesized
agaatttacagactttgcaaat

SEQ ID NO: 637145 - DNA, 22 bp, Artificial Sequence
  chemically synthesized
acagactttgcaaatgcataca

SEQ ID NO: 637146 - DNA, 22 bp, Artificial Sequence
  chemically synthesized
cagactttgcaaatgcatacag

SEQ ID NO: 637147 - DNA, 22 bp, Artificial Sequence
  chemically synthesized
catgaaaaacaactgtatgcat

SEQ ID NO: 637148 - DNA, 22 bp, Artificial Sequence
  chemically synthesized
tgcaaatgcatacagttgtttt

SEQ ID NO: 637149 - DNA, 22 bp, Artificial Sequence
  chemically synthesized
gcaaatgcatacagttgttttt

SEQ ID NO: 637150 - DNA, 22 bp, Artificial Sequence
  chemically synthesized
caaatgcatacagttgtttttc

SEQ ID NO: 637151 - DNA, 22 bp, Artificial Sequence
  chemically synthesized
taaatgacaacacactacatga

SEQ ID NO: 637152 - DNA, 22 bp, Artificial Sequence
  chemically synthesized
ggattgtaaatgacaacacact

SEQ ID NO: 637153 - DNA, 22 bp, Artificial Sequence
  chemically synthesized
tttttcatgtagtgtgttgtca

SEQ ID NO: 637154 - DNA, 22 bp, Artificial Sequence
  chemically synthesized
ttgggattgtaaatgacaacac

SEQ ID NO: 637155 - DNA, 22 bp, Artificial Sequence
  chemically synthesized
ttcatgtagtgtgttgtcattt

SEQ ID NO: 637156 - DNA, 22 bp, Artificial Sequence
  chemically synthesized
tcatgtagtgtgttgtcattta

SEQ ID NO: 637157 - DNA, 22 bp, Artificial Sequence
  chemically synthesized
catgtagtgtgttgtcatttac

SEQ ID NO: 637158 - DNA, 22 bp, Artificial Sequence
  chemically synthesized
atgtagtgtgttgtcatttaca

SEQ ID NO: 637159 - DNA, 22 bp, Artificial Sequence
  chemically synthesized
ataaactgttgggattgtaaat

SEQ ID NO: 637160 - DNA, 22 bp, Artificial Sequence
  chemically synthesized
tcatttacaatcccaacagttt

SEQ ID NO: 637161 - DNA, 22 bp, Artificial Sequence
  chemically synthesized
aatatagctaataaactgttgg

SEQ ID NO: 637162 - DNA, 22 bp, Artificial Sequence
  chemically synthesized
acaatcccaacagtttattagc

SEQ ID NO: 637163 - DNA, 22 bp, Artificial Sequence
  chemically synthesized
caatcccaacagtttattagct

SEQ ID NO: 637164 - DNA, 22 bp, Artificial Sequence
  chemically synthesized
agatctgaatatagctaataaa

SEQ ID NO: 637165 - DNA, 22 bp, Artificial Sequence
  chemically synthesized
cacctgagatctgaatatagct

SEQ ID NO: 637166 - DNA, 22 bp, Artificial Sequence
  chemically synthesized
cctccacctgagatctgaatat

SEQ ID NO: 637167 - DNA, 22 bp, Artificial Sequence
  chemically synthesized
tctccctccacctgagatctga

SEQ ID NO: 637168 - DNA, 22 bp, Artificial Sequence
  chemically synthesized
attagctatattcagatctcag

SEQ ID NO: 637169 - DNA, 22 bp, Artificial Sequence
  chemically synthesized
ttagctatattcagatctcagg

SEQ ID NO: 637170 - DNA, 22 bp, Artificial Sequence
  chemically synthesized
gctatattcagatctcaggtgg

SEQ ID NO: 637171 - DNA, 22 bp, Artificial Sequence
  chemically synthesized
tattcagatctcaggtggaggg

SEQ ID NO: 637172 - DNA, 22 bp, Artificial Sequence
  chemically synthesized
tgtcagattatctccctccacc

SEQ ID NO: 637173 - DNA, 22 bp, Artificial Sequence
  chemically synthesized
tgtgtcagattatctccctcca

SEQ ID NO: 637174 - DNA, 22 bp, Artificial Sequence
  chemically synthesized
agatctcaggtggagggagata

SEQ ID NO: 637175 - DNA, 22 bp, Artificial Sequence
  chemically synthesized
aggtggagggagataatctgac

SEQ ID NO: 637176 - DNA, 22 bp, Artificial Sequence
  chemically synthesized
aggcaatctctgtgtcagatta

SEQ ID NO: 637177 - DNA, 22 bp, Artificial Sequence
  chemically synthesized
aaggcaatctctgtgtcagatt

SEQ ID NO: 637178 - DNA, 22 bp, Artificial Sequence
  chemically synthesized
catgatttaaggcaatctctgt

SEQ ID NO: 637179 - DNA, 22 bp, Artificial Sequence
  chemically synthesized
cacctccatgatttaaggcaat

SEQ ID NO: 637180 - DNA, 22 bp, Artificial Sequence
  chemically synthesized
ctacacctccatgatttaaggc

SEQ ID NO: 637181 - DNA, 22 bp, Artificial Sequence
  chemically synthesized
acacagagattgccttaaatca

SEQ ID NO: 637182 - DNA, 22 bp, Artificial Sequence
  chemically synthesized
actacacctccatgatttaagg

SEQ ID NO: 637183 - DNA, 22 bp, Artificial Sequence
  chemically synthesized
aatttactacacctccatgatt

SEQ ID NO: 637184 - DNA, 22 bp, Artificial Sequence
  chemically synthesized
ctgaatttactacacctccatg

SEQ ID NO: 637185 - DNA, 22 bp, Artificial Sequence
  chemically synthesized
cctgaatttactacacctccat

SEQ ID NO: 637186 - DNA, 22 bp, Artificial Sequence
  chemically synthesized
tcctgaatttactacacctcca

SEQ ID NO: 637187 - DNA, 22 bp, Artificial Sequence
  chemically synthesized
ccttaaatcatggaggtgtagt

SEQ ID NO: 637188 - DNA, 22 bp, Artificial Sequence
  chemically synthesized
ttttcctgaatttactacacct

SEQ ID NO: 637189 - DNA, 22 bp, Artificial Sequence
  chemically synthesized
aaatcatggaggtgtagtaaat

SEQ ID NO: 637190 - DNA, 22 bp, Artificial Sequence
  chemically synthesized
aatcatggaggtgtagtaaatt

SEQ ID NO: 637191 - DNA, 22 bp, Artificial Sequence
  chemically synthesized
aggttattttcctgaatttact

SEQ ID NO: 637192 - DNA, 22 bp, Artificial Sequence
  chemically synthesized
gaggttattttcctgaatttac

SEQ ID NO: 637193 - DNA, 22 bp, Artificial Sequence
  chemically synthesized
aggaaaataacctcaaacatat

SEQ ID NO: 637194 - DNA, 22 bp, Artificial Sequence
  chemically synthesized
agaaggaaaaggatatgtttga

SEQ ID NO: 637195 - DNA, 22 bp, Artificial Sequence
  chemically synthesized
gagaaggaaaaggatatgtttg

SEQ ID NO: 637196 - DNA, 22 bp, Artificial Sequence
  chemically synthesized
tgagaaggaaaaggatatgttt

SEQ ID NO: 637197 - DNA, 22 bp, Artificial Sequence
  chemically synthesized
ttgagaaggaaaaggatatgtt

SEQ ID NO: 637198 - DNA, 22 bp, Artificial Sequence
  chemically synthesized
tttgagaaggaaaaggatatgt

SEQ ID NO: 637199 - DNA, 22 bp, Artificial Sequence
  chemically synthesized
ttttgagaaggaaaaggatatg

SEQ ID NO: 637200 - DNA, 22 bp, Artificial Sequence
  chemically synthesized
atttttttgagaaggaaaagga

SEQ ID NO: 637201 - DNA, 22 bp, Artificial Sequence
  chemically synthesized
gatttttttgagaaggaaaagg

SEQ ID NO: 637202 - DNA, 22 bp, Artificial Sequence
  chemically synthesized
tgatttttttgagaaggaaaag

SEQ ID NO: 637203 - DNA, 22 bp, Artificial Sequence
  chemically synthesized
aaacatatccttttccttctca

SEQ ID NO: 637204 - DNA, 22 bp, Artificial Sequence
  chemically synthesized
ttccttctcaaaaaaatcaaaa

SEQ ID NO: 637205 - DNA, 22 bp, Artificial Sequence
  chemically synthesized
tccttctcaaaaaaatcaaaac

SEQ ID NO: 637206 - DNA, 22 bp, Artificial Sequence
  chemically synthesized
taggaaagccaggttttgattt

SEQ ID NO: 637207 - DNA, 22 bp, Artificial Sequence
  chemically synthesized
ccttctcaaaaaaatcaaaacc

SEQ ID NO: 637208 - DNA, 22 bp, Artificial Sequence
  chemically synthesized
gtaggaaagccaggttttgatt

SEQ ID NO: 637209 - DNA, 22 bp, Artificial Sequence
  chemically synthesized
cttctcaaaaaaatcaaaacct

SEQ ID NO: 637210 - DNA, 22 bp, Artificial Sequence
  chemically synthesized
ctcaaaaaaatcaaaacctggc

SEQ ID NO: 637211 - DNA, 22 bp, Artificial Sequence
  chemically synthesized
tcaaaaaaatcaaaacctggct

SEQ ID NO: 637212 - DNA, 22 bp, Artificial Sequence
  chemically synthesized
aaaaaaatcaaaacctggcttt

SEQ ID NO: 637213 - DNA, 22 bp, Artificial Sequence
  chemically synthesized
gagaagccaaatcttgtaggaa

SEQ ID NO: 637214 - DNA, 22 bp, Artificial Sequence
  chemically synthesized
tggagaagccaaatcttgtagg

SEQ ID NO: 637215 - DNA, 22 bp, Artificial Sequence
  chemically synthesized
ctctggagaagccaaatcttgt

SEQ ID NO: 637216 - DNA, 22 bp, Artificial Sequence
  chemically synthesized
gctttcctacaagatttggctt

SEQ ID NO: 637217 - DNA, 22 bp, Artificial Sequence
  chemically synthesized
tcctacaagatttggcttctcc

SEQ ID NO: 637218 - DNA, 22 bp, Artificial Sequence
  chemically synthesized
cctacaagatttggcttctcca

SEQ ID NO: 637219 - DNA, 22 bp, Artificial Sequence
  chemically synthesized
ctacaagatttggcttctccag

SEQ ID NO: 637220 - DNA, 22 bp, Artificial Sequence
  chemically synthesized
caagatttggcttctccagagg

SEQ ID NO: 637221 - DNA, 22 bp, Artificial Sequence
  chemically synthesized
ggcttctccagaggaggatgtg

SEQ ID NO: 637222 - DNA, 22 bp, Artificial Sequence
  chemically synthesized
gcttctccagaggaggatgtgc

SEQ ID NO: 637223 - DNA, 22 bp, Artificial Sequence
  chemically synthesized
gagcagtgggaagaggcacatc

SEQ ID NO: 637224 - DNA, 22 bp, Artificial Sequence
  chemically synthesized
ctccagaggaggatgtgcctct

SEQ ID NO: 637225 - DNA, 22 bp, Artificial Sequence
  chemically synthesized
tccagaggaggatgtgcctctt

SEQ ID NO: 637226 - DNA, 22 bp, Artificial Sequence
  chemically synthesized
cagaggaggatgtgcctcttcc

SEQ ID NO: 637227 - DNA, 22 bp, Artificial Sequence
  chemically synthesized
aagaacctggagcagtgggaag

SEQ ID NO: 637228 - DNA, 22 bp, Artificial Sequence
  chemically synthesized
ttcccactgctccaggttcttg

SEQ ID NO: 637229 - DNA, 22 bp, Artificial Sequence
  chemically synthesized
cccactgctccaggttcttgaa

SEQ ID NO: 637230 - DNA, 22 bp, Artificial Sequence
  chemically synthesized
ccactgctccaggttcttgaac

SEQ ID NO: 637231 - DNA, 22 bp, Artificial Sequence
  chemically synthesized
aaataaatgtgatgaagttcaa

SEQ ID NO: 637232 - DNA, 22 bp, Artificial Sequence
  chemically synthesized
ctccaggttcttgaacttcatc

SEQ ID NO: 637233 - DNA, 22 bp, Artificial Sequence
  chemically synthesized
caggttcttgaacttcatcaca

SEQ ID NO: 637234 - DNA, 22 bp, Artificial Sequence
  chemically synthesized
ttgaacttcatcacatttattt

SEQ ID NO: 637235 - DNA, 22 bp, Artificial Sequence
  chemically synthesized
gaacttcatcacatttatttca

SEQ ID NO: 637236 - DNA, 22 bp, Artificial Sequence
  chemically synthesized
aacttcatcacatttatttcaa

SEQ ID NO: 637237 - DNA, 22 bp, Artificial Sequence
  chemically synthesized
catcacatttatttcaactacc

SEQ ID NO: 637238 - DNA, 22 bp, Artificial Sequence
  chemically synthesized
atcacatttatttcaactaccc

SEQ ID NO: 637239 - DNA, 22 bp, Artificial Sequence
  chemically synthesized
aggaaagagacagggtagttga

SEQ ID NO: 637240 - DNA, 22 bp, Artificial Sequence
  chemically synthesized
tgaggaaagagacagggtagtt

SEQ ID NO: 637241 - DNA, 22 bp, Artificial Sequence
  chemically synthesized
ctgaggaaagagacagggtagt

SEQ ID NO: 637242 - DNA, 22 bp, Artificial Sequence
  chemically synthesized
atttcaactaccctgtctcttt

SEQ ID NO: 637243 - DNA, 22 bp, Artificial Sequence
  chemically synthesized
tttcaactaccctgtctctttc

SEQ ID NO: 637244 - DNA, 22 bp, Artificial Sequence
  chemically synthesized
caactaccctgtctctttcctc

SEQ ID NO: 637245 - DNA, 22 bp, Artificial Sequence
  chemically synthesized
aactaccctgtctctttcctca

SEQ ID NO: 637246 - DNA, 22 bp, Artificial Sequence
  chemically synthesized
aggagatgaacatttctgagga

SEQ ID NO: 637247 - DNA, 22 bp, Artificial Sequence
  chemically synthesized
ccctgtctctttcctcagaaat

SEQ ID NO: 637248 - DNA, 22 bp, Artificial Sequence
  chemically synthesized
tgaggagatgaacatttctgag

SEQ ID NO: 637249 - DNA, 22 bp, Artificial Sequence
  chemically synthesized
tctctttcctcagaaatgttca

SEQ ID NO: 637250 - DNA, 22 bp, Artificial Sequence
  chemically synthesized
tttcctcagaaatgttcatctc

SEQ ID NO: 637251 - DNA, 22 bp, Artificial Sequence
  chemically synthesized
tcctcagaaatgttcatctcct

SEQ ID NO: 637252 - DNA, 22 bp, Artificial Sequence
  chemically synthesized
cctcagaaatgttcatctcctc

SEQ ID NO: 637253 - DNA, 22 bp, Artificial Sequence
  chemically synthesized
ctcagaaatgttcatctcctca

SEQ ID NO: 637254 - DNA, 22 bp, Artificial Sequence
  chemically synthesized
agaaatgttcatctcctcagag

SEQ ID NO: 637255 - DNA, 22 bp, Artificial Sequence
  chemically synthesized
aagaagatggacgagggctctg

SEQ ID NO: 637256 - DNA, 22 bp, Artificial Sequence
  chemically synthesized
atctcctcagagccctcgtcca

SEQ ID NO: 637257 - DNA, 22 bp, Artificial Sequence
  chemically synthesized
ctcagagccctcgtccatcttc

SEQ ID NO: 637258 - DNA, 22 bp, Artificial Sequence
  chemically synthesized
agagccctcgtccatcttcttc

SEQ ID NO: 637259 - DNA, 22 bp, Artificial Sequence
  chemically synthesized
gtccatcttcttcaacatcttt

SEQ ID NO: 637260 - DNA, 22 bp, Artificial Sequence
  chemically synthesized
cttcaacatcttttccatcctg

SEQ ID NO: 637261 - DNA, 22 bp, Artificial Sequence
  chemically synthesized
ttcaacatcttttccatcctga

SEQ ID NO: 637262 - DNA, 22 bp, Artificial Sequence
  chemically synthesized
caacatcttttccatcctgatc

SEQ ID NO: 637263 - DNA, 22 bp, Artificial Sequence
  chemically synthesized
acgacagtggtagatcaggatg

SEQ ID NO: 637264 - DNA, 22 bp, Artificial Sequence
  chemically synthesized
aacatcttttccatcctgatct

SEQ ID NO: 637265 - DNA, 22 bp, Artificial Sequence
  chemically synthesized
ttccatcctgatctaccactgt

SEQ ID NO: 637266 - DNA, 22 bp, Artificial Sequence
  chemically synthesized
tccatcctgatctaccactgtc

SEQ ID NO: 637267 - DNA, 22 bp, Artificial Sequence
  chemically synthesized
ccatcctgatctaccactgtcg

SEQ ID NO: 637268 - DNA, 22 bp, Artificial Sequence
  chemically synthesized
catcctgatctaccactgtcgt

SEQ ID NO: 637269 - DNA, 22 bp, Artificial Sequence
  chemically synthesized
atctaccactgtcgtcaggatc

SEQ ID NO: 637270 - DNA, 22 bp, Artificial Sequence
  chemically synthesized
ccactgtcgtcaggatctggac

SEQ ID NO: 637271 - DNA, 22 bp, Artificial Sequence
  chemically synthesized
tcagcagaggggtgaggtccag

SEQ ID NO: 637272 - DNA, 22 bp, Artificial Sequence
  chemically synthesized
atcagcagaggggtgaggtcca

SEQ ID NO: 637273 - DNA, 22 bp, Artificial Sequence
  chemically synthesized
tcgtcaggatctggacctcacc

SEQ ID NO: 637274 - DNA, 22 bp, Artificial Sequence
  chemically synthesized
agcttatcagcagaggggtgag

SEQ ID NO: 637275 - DNA, 22 bp, Artificial Sequence
  chemically synthesized
ctgagcttatcagcagaggggt

SEQ ID NO: 637276 - DNA, 22 bp, Artificial Sequence
  chemically synthesized
gacctcacccctctgctgataa

SEQ ID NO: 637277 - DNA, 22 bp, Artificial Sequence
  chemically synthesized
acccctctgctgataagctcag

SEQ ID NO: 637278 - DNA, 22 bp, Artificial Sequence
  chemically synthesized
atgagaccaacgttgctgagct

SEQ ID NO: 637279 - DNA, 22 bp, Artificial Sequence
  chemically synthesized
tgctgataagctcagcaacgtt

SEQ ID NO: 637280 - DNA, 22 bp, Artificial Sequence
  chemically synthesized
ctgataagctcagcaacgttgg

SEQ ID NO: 637281 - DNA, 22 bp, Artificial Sequence
  chemically synthesized
ataagctcagcaacgttggtct

SEQ ID NO: 637282 - DNA, 22 bp, Artificial Sequence
  chemically synthesized
atggagttgatgagaccaacgt

SEQ ID NO: 637283 - DNA, 22 bp, Artificial Sequence
  chemically synthesized
agcaacgttggtctcatcaact

SEQ ID NO: 637284 - DNA, 22 bp, Artificial Sequence
  chemically synthesized
gtctcatcaactccatgaactg

SEQ ID NO: 637285 - DNA, 22 bp, Artificial Sequence
  chemically synthesized
aggggtagggagtacagttcat

SEQ ID NO: 637286 - DNA, 22 bp, Artificial Sequence
  chemically synthesized
atcaactccatgaactgtactc

SEQ ID NO: 637287 - DNA, 22 bp, Artificial Sequence
  chemically synthesized
gagatcactgaggggtagggag

SEQ ID NO: 637288 - DNA, 22 bp, Artificial Sequence
  chemically synthesized
catgaactgtactccctacccc

SEQ ID NO: 637289 - DNA, 22 bp, Artificial Sequence
  chemically synthesized
ggagatcactgaggggtaggga

SEQ ID NO: 637290 - DNA, 22 bp, Artificial Sequence
  chemically synthesized
cttggagatcactgaggggtag

SEQ ID NO: 637291 - DNA, 22 bp, Artificial Sequence
  chemically synthesized
acttggagatcactgaggggta

SEQ ID NO: 637292 - DNA, 22 bp, Artificial Sequence
  chemically synthesized
tacttggagatcactgaggggt

SEQ ID NO: 637293 - DNA, 22 bp, Artificial Sequence
  chemically synthesized
tactccctacccctcagtgatc

SEQ ID NO: 637294 - DNA, 22 bp, Artificial Sequence
  chemically synthesized
aagattttacttggagatcact

SEQ ID NO: 637295 - DNA, 22 bp, Artificial Sequence
  chemically synthesized
cctacccctcagtgatctccaa

SEQ ID NO: 637296 - DNA, 22 bp, Artificial Sequence
  chemically synthesized
ctgaagattttacttggagatc

SEQ ID NO: 637297 - DNA, 22 bp, Artificial Sequence
  chemically synthesized
cccctcagtgatctccaagtaa

SEQ ID NO: 637298 - DNA, 22 bp, Artificial Sequence
  chemically synthesized
agtgatctccaagtaaaatctt

SEQ ID NO: 637299 - DNA, 22 bp, Artificial Sequence
  chemically synthesized
ccagcgagctgctgaagatttt

SEQ ID NO: 637300 - DNA, 22 bp, Artificial Sequence
  chemically synthesized
caagtaaaatcttcagcagctc

SEQ ID NO: 637301 - DNA, 22 bp, Artificial Sequence
  chemically synthesized
acatggtgcctcccagcgagct

SEQ ID NO: 637302 - DNA, 22 bp, Artificial Sequence
  chemically synthesized
catctaacatggtgcctcccag

SEQ ID NO: 637303 - DNA, 22 bp, Artificial Sequence
  chemically synthesized
cagcagctcgctgggaggcacc

SEQ ID NO: 637304 - DNA, 22 bp, Artificial Sequence
  chemically synthesized
tacatctaacatggtgcctccc

SEQ ID NO: 637305 - DNA, 22 bp, Artificial Sequence
  chemically synthesized
agcagctcgctgggaggcacca

SEQ ID NO: 637306 - DNA, 22 bp, Artificial Sequence
  chemically synthesized
ctacatctaacatggtgcctcc

SEQ ID NO: 637307 - DNA, 22 bp, Artificial Sequence
  chemically synthesized
gctgggaggcaccatgttagat

SEQ ID NO: 637308 - DNA, 22 bp, Artificial Sequence
  chemically synthesized
aagcaatttctacatctaacat

SEQ ID NO: 637309 - DNA, 22 bp, Artificial Sequence
  chemically synthesized
caagcaatttctacatctaaca

SEQ ID NO: 637310 - DNA, 22 bp, Artificial Sequence
  chemically synthesized
tcaagcaatttctacatctaac

SEQ ID NO: 637311 - DNA, 22 bp, Artificial Sequence
  chemically synthesized
ggaggcaccatgttagatgtag

SEQ ID NO: 637312 - DNA, 22 bp, Artificial Sequence
  chemically synthesized
gatgtagaaattgcttgaaagt

SEQ ID NO: 637313 - DNA, 22 bp, Artificial Sequence
  chemically synthesized
gatatcatggaagtaaaatact

SEQ ID NO: 637314 - DNA, 22 bp, Artificial Sequence
  chemically synthesized
cttgaaagtattttacttccat

SEQ ID NO: 637315 - DNA, 22 bp, Artificial Sequence
  chemically synthesized
aaaagttggatatcatggaagt

SEQ ID NO: 637316 - DNA, 22 bp, Artificial Sequence
  chemically synthesized
gaaagtattttacttccatgat

SEQ ID NO: 637317 - DNA, 22 bp, Artificial Sequence
  chemically synthesized
aaagtattttacttccatgata

SEQ ID NO: 637318 - DNA, 22 bp, Artificial Sequence
  chemically synthesized
tacttccatgatatccaacttt

SEQ ID NO: 637319 - DNA, 22 bp, Artificial Sequence
  chemically synthesized
acttccatgatatccaactttt

SEQ ID NO: 637320 - DNA, 22 bp, Artificial Sequence
  chemically synthesized
cttccatgatatccaacttttg

SEQ ID NO: 637321 - DNA, 22 bp, Artificial Sequence
  chemically synthesized
ccatgatatccaacttttgaat

SEQ ID NO: 637322 - DNA, 22 bp, Artificial Sequence
  chemically synthesized
catgatatccaacttttgaatt

SEQ ID NO: 637323 - DNA, 22 bp, Artificial Sequence
  chemically synthesized
gagatcacagtcgggaaaattc

SEQ ID NO: 637324 - DNA, 22 bp, Artificial Sequence
  chemically synthesized
ggagatcacagtcgggaaaatt

SEQ ID NO: 637325 - DNA, 22 bp, Artificial Sequence
  chemically synthesized
ttgaattttcccgactgtgatc

SEQ ID NO: 637326 - DNA, 22 bp, Artificial Sequence
  chemically synthesized
tgaattttcccgactgtgatct

SEQ ID NO: 637327 - DNA, 22 bp, Artificial Sequence
  chemically synthesized
gaattttcccgactgtgatctc

SEQ ID NO: 637328 - DNA, 22 bp, Artificial Sequence
  chemically synthesized
aattttcccgactgtgatctcc

SEQ ID NO: 637329 - DNA, 22 bp, Artificial Sequence
  chemically synthesized
tggcgaaaaatttggagatcac

SEQ ID NO: 637330 - DNA, 22 bp, Artificial Sequence
  chemically synthesized
atggcgaaaaatttggagatca

SEQ ID NO: 637331 - DNA, 22 bp, Artificial Sequence
  chemically synthesized
tatggcgaaaaatttggagatc

SEQ ID NO: 637332 - DNA, 22 bp, Artificial Sequence
  chemically synthesized
tcccgactgtgatctccaaatt

SEQ ID NO: 637333 - DNA, 22 bp, Artificial Sequence
  chemically synthesized
cccgactgtgatctccaaattt

SEQ ID NO: 637334 - DNA, 22 bp, Artificial Sequence
  chemically synthesized
ccgactgtgatctccaaatttt

SEQ ID NO: 637335 - DNA, 22 bp, Artificial Sequence
  chemically synthesized
tgatctccaaatttttcgccat

SEQ ID NO: 637336 - DNA, 22 bp, Artificial Sequence
  chemically synthesized
caaatttttcgccataaaactc

SEQ ID NO: 637337 - DNA, 22 bp, Artificial Sequence
  chemically synthesized
ttcgccataaaactcacccaca

SEQ ID NO: 637338 - DNA, 22 bp, Artificial Sequence
  chemically synthesized
tcgccataaaactcacccacac

SEQ ID NO: 637339 - DNA, 22 bp, Artificial Sequence
  chemically synthesized
cgccataaaactcacccacacc

SEQ ID NO: 637340 - DNA, 22 bp, Artificial Sequence
  chemically synthesized
gccataaaactcacccacaccc

SEQ ID NO: 637341 - DNA, 22 bp, Artificial Sequence
  chemically synthesized
acccacacccctgacttttcct

SEQ ID NO: 637342 - DNA, 22 bp, Artificial Sequence
  chemically synthesized
accaaaatggataggacagaaa

SEQ ID NO: 637343 - DNA, 22 bp, Artificial Sequence
  chemically synthesized
aaccaaaatggataggacagaa

SEQ ID NO: 637344 - DNA, 22 bp, Artificial Sequence
  chemically synthesized
acttttcctttctgtcctatcc

SEQ ID NO: 637345 - DNA, 22 bp, Artificial Sequence
  chemically synthesized
ttcctttctgtcctatccattt

SEQ ID NO: 637346 - DNA, 22 bp, Artificial Sequence
  chemically synthesized
tcctttctgtcctatccatttt

SEQ ID NO: 637347 - DNA, 22 bp, Artificial Sequence
  chemically synthesized
cctttctgtcctatccattttg

SEQ ID NO: 637348 - DNA, 22 bp, Artificial Sequence
  chemically synthesized
ctttctgtcctatccattttgg

SEQ ID NO: 637349 - DNA, 22 bp, Artificial Sequence
  chemically synthesized
tctgtcctatccattttggtta

SEQ ID NO: 637350 - DNA, 22 bp, Artificial Sequence
  chemically synthesized
ctgtcctatccattttggttaa

SEQ ID NO: 637351 - DNA, 22 bp, Artificial Sequence
  chemically synthesized
tgtcctatccattttggttaag

SEQ ID NO: 637352 - DNA, 22 bp, Artificial Sequence
  chemically synthesized
tcctatccattttggttaaggc

SEQ ID NO: 637353 - DNA, 22 bp, Artificial Sequence
  chemically synthesized
tccattttggttaaggcacttt

SEQ ID NO: 637354 - DNA, 22 bp, Artificial Sequence
  chemically synthesized
tggttaaggcactttgcctccc

SEQ ID NO: 637355 - DNA, 22 bp, Artificial Sequence
  chemically synthesized
ggttaaggcactttgcctccct

SEQ ID NO: 637356 - DNA, 22 bp, Artificial Sequence
  chemically synthesized
gttaaggcactttgcctccctt

SEQ ID NO: 637357 - DNA, 22 bp, Artificial Sequence
  chemically synthesized
catgagggtagaataaagggag

SEQ ID NO: 637358 - DNA, 22 bp, Artificial Sequence
  chemically synthesized
aggcactttgcctccctttatt

SEQ ID NO: 637359 - DNA, 22 bp, Artificial Sequence
  chemically synthesized
ccatgagggtagaataaaggga

SEQ ID NO: 637360 - DNA, 22 bp, Artificial Sequence
  chemically synthesized
ttccatgagggtagaataaagg

SEQ ID NO: 637361 - DNA, 22 bp, Artificial Sequence
  chemically synthesized
agctcttccatgagggtagaat

SEQ ID NO: 637362 - DNA, 22 bp, Artificial Sequence
  chemically synthesized
tgcctccctttattctaccctc

SEQ ID NO: 637363 - DNA, 22 bp, Artificial Sequence
  chemically synthesized
gagctcttccatgagggtagaa

SEQ ID NO: 637364 - DNA, 22 bp, Artificial Sequence
  chemically synthesized
gcctccctttattctaccctca

SEQ ID NO: 637365 - DNA, 22 bp, Artificial Sequence
  chemically synthesized
cctccctttattctaccctcat

SEQ ID NO: 637366 - DNA, 22 bp, Artificial Sequence
  chemically synthesized
cctttattctaccctcatggaa

SEQ ID NO: 637367 - DNA, 22 bp, Artificial Sequence
  chemically synthesized
atacttgagctcttccatgagg

SEQ ID NO: 637368 - DNA, 22 bp, Artificial Sequence
  chemically synthesized
catacttgagctcttccatgag

SEQ ID NO: 637369 - DNA, 22 bp, Artificial Sequence
  chemically synthesized
tattctaccctcatggaagagc

SEQ ID NO: 637370 - DNA, 22 bp, Artificial Sequence
  chemically synthesized
attctaccctcatggaagagct

SEQ ID NO: 637371 - DNA, 22 bp, Artificial Sequence
  chemically synthesized
atttcatacttgagctcttcca

SEQ ID NO: 637372 - DNA, 22 bp, Artificial Sequence
  chemically synthesized
ttctaccctcatggaagagctc

SEQ ID NO: 637373 - DNA, 22 bp, Artificial Sequence
  chemically synthesized
taccctcatggaagagctcaag

SEQ ID NO: 637374 - DNA, 22 bp, Artificial Sequence
  chemically synthesized
ccctcatggaagagctcaagta

SEQ ID NO: 637375 - DNA, 22 bp, Artificial Sequence
  chemically synthesized
aggaattcatttcatacttgag

SEQ ID NO: 637376 - DNA, 22 bp, Artificial Sequence
  chemically synthesized
atggaagagctcaagtatgaaa

SEQ ID NO: 637377 - DNA, 22 bp, Artificial Sequence
  chemically synthesized
aagtatgaaatgaattcctgaa

SEQ ID NO: 637378 - DNA, 22 bp, Artificial Sequence
  chemically synthesized
atatgatgatgtgttcaggaat

SEQ ID NO: 637379 - DNA, 22 bp, Artificial Sequence
  chemically synthesized
cctgatatgatgatgtgttcag

SEQ ID NO: 637380 - DNA, 22 bp, Artificial Sequence
  chemically synthesized
ttgcctgatatgatgatgtgtt

SEQ ID NO: 637381 - DNA, 22 bp, Artificial Sequence
  chemically synthesized
tattgcctgatatgatgatgtg

SEQ ID NO: 637382 - DNA, 22 bp, Artificial Sequence
  chemically synthesized
cagctctattgcctgatatgat

SEQ ID NO: 637383 - DNA, 22 bp, Artificial Sequence
  chemically synthesized
ctgaacacatcatcatatcagg

SEQ ID NO: 637384 - DNA, 22 bp, Artificial Sequence
  chemically synthesized
acagctctattgcctgatatga

SEQ ID NO: 637385 - DNA, 22 bp, Artificial Sequence
  chemically synthesized
aacacatcatcatatcaggcaa

SEQ ID NO: 637386 - DNA, 22 bp, Artificial Sequence
  chemically synthesized
catacacttacagctctattgc

SEQ ID NO: 637387 - DNA, 22 bp, Artificial Sequence
  chemically synthesized
attccatacacttacagctcta

SEQ ID NO: 637388 - DNA, 22 bp, Artificial Sequence
  chemically synthesized
gattccatacacttacagctct

SEQ ID NO: 637389 - DNA, 22 bp, Artificial Sequence
  chemically synthesized
cttgattccatacacttacagc

SEQ ID NO: 637390 - DNA, 22 bp, Artificial Sequence
  chemically synthesized
tgactccttgattccatacact

SEQ ID NO: 637391 - DNA, 22 bp, Artificial Sequence
  chemically synthesized
taagtgtatggaatcaaggagt

SEQ ID NO: 637392 - DNA, 22 bp, Artificial Sequence
  chemically synthesized
acagaatagaaaagacctgtga

SEQ ID NO: 637393 - DNA, 22 bp, Artificial Sequence
  chemically synthesized
cctcacagaatagaaaagacct

SEQ ID NO: 637394 - DNA, 22 bp, Artificial Sequence
  chemically synthesized
acctcacagaatagaaaagacc

SEQ ID NO: 637395 - DNA, 22 bp, Artificial Sequence
  chemically synthesized
aaatcttacctcacagaataga

SEQ ID NO: 637396 - DNA, 22 bp, Artificial Sequence
  chemically synthesized
tcaaatcttacctcacagaata

SEQ ID NO: 637397 - DNA, 22 bp, Artificial Sequence
  chemically synthesized
gtcctctcaaatcttacctcac

SEQ ID NO: 637398 - DNA, 22 bp, Artificial Sequence
  chemically synthesized
ggtcctctcaaatcttacctca

SEQ ID NO: 637399 - DNA, 22 bp, Artificial Sequence
  chemically synthesized
ttctattctgtgaggtaagatt

SEQ ID NO: 637400 - DNA, 22 bp, Artificial Sequence
  chemically synthesized
tctattctgtgaggtaagattt

SEQ ID NO: 637401 - DNA, 22 bp, Artificial Sequence
  chemically synthesized
ctattctgtgaggtaagatttg

SEQ ID NO: 637402 - DNA, 22 bp, Artificial Sequence
  chemically synthesized
tattctgtgaggtaagatttga

SEQ ID NO: 637403 - DNA, 22 bp, Artificial Sequence
  chemically synthesized
ttctgtgaggtaagatttgaga

SEQ ID NO: 637404 - DNA, 22 bp, Artificial Sequence
  chemically synthesized
tatacttggtcctctcaaatct

SEQ ID NO: 637405 - DNA, 22 bp, Artificial Sequence
  chemically synthesized
tgtgaggtaagatttgagagga

SEQ ID NO: 637406 - DNA, 22 bp, Artificial Sequence
  chemically synthesized
gttatatacttggtcctctcaa

SEQ ID NO: 637407 - DNA, 22 bp, Artificial Sequence
  chemically synthesized
tgaggtaagatttgagaggacc

SEQ ID NO: 637408 - DNA, 22 bp, Artificial Sequence
  chemically synthesized
aactggttatatacttggtcct

SEQ ID NO: 637409 - DNA, 22 bp, Artificial Sequence
  chemically synthesized
ggacctaaactggttatatact

SEQ ID NO: 637410 - DNA, 22 bp, Artificial Sequence
  chemically synthesized
gagaggaccaagtatataacca

SEQ ID NO: 637411 - DNA, 22 bp, Artificial Sequence
  chemically synthesized
agaggaccaagtatataaccag

SEQ ID NO: 637412 - DNA, 22 bp, Artificial Sequence
  chemically synthesized
cctgggacctaaactggttata

SEQ ID NO: 637413 - DNA, 22 bp, Artificial Sequence
  chemically synthesized
ccctgggacctaaactggttat

SEQ ID NO: 637414 - DNA, 22 bp, Artificial Sequence
  chemically synthesized
tccctgggacctaaactggtta

SEQ ID NO: 637415 - DNA, 22 bp, Artificial Sequence
  chemically synthesized
ttccctgggacctaaactggtt

SEQ ID NO: 637416 - DNA, 22 bp, Artificial Sequence
  chemically synthesized
cttttccctgggacctaaactg

SEQ ID NO: 637417 - DNA, 22 bp, Artificial Sequence
  chemically synthesized
acttttccctgggacctaaact

SEQ ID NO: 637418 - DNA, 22 bp, Artificial Sequence
  chemically synthesized
cttacttttccctgggacctaa

SEQ ID NO: 637419 - DNA, 22 bp, Artificial Sequence
  chemically synthesized
tccttacttttccctgggacct

SEQ ID NO: 637420 - DNA, 22 bp, Artificial Sequence
  chemically synthesized
tctccttacttttccctgggac

SEQ ID NO: 637421 - DNA, 22 bp, Artificial Sequence
  chemically synthesized
catcctctctccttacttttcc

SEQ ID NO: 637422 - DNA, 22 bp, Artificial Sequence
  chemically synthesized
aggtcccagggaaaagtaagga

SEQ ID NO: 637423 - DNA, 22 bp, Artificial Sequence
  chemically synthesized
ggtcccagggaaaagtaaggag

SEQ ID NO: 637424 - DNA, 22 bp, Artificial Sequence
  chemically synthesized
taaaggcccagtaggagtcagc

SEQ ID NO: 637425 - DNA, 22 bp, Artificial Sequence
  chemically synthesized
tgtaaaggcccagtaggagtca

SEQ ID NO: 637426 - DNA, 22 bp, Artificial Sequence
  chemically synthesized
tctgtaaaggcccagtaggagt

SEQ ID NO: 637427 - DNA, 22 bp, Artificial Sequence
  chemically synthesized
ctctgtaaaggcccagtaggag

SEQ ID NO: 637428 - DNA, 22 bp, Artificial Sequence
  chemically synthesized
tctctgtaaaggcccagtagga

SEQ ID NO: 637429 - DNA, 22 bp, Artificial Sequence
  chemically synthesized
tttctctgtaaaggcccagtag

SEQ ID NO: 637430 - DNA, 22 bp, Artificial Sequence
  chemically synthesized
tctttctctgtaaaggcccagt

SEQ ID NO: 637431 - DNA, 22 bp, Artificial Sequence
  chemically synthesized
ctctttctctgtaaaggcccag

SEQ ID NO: 637432 - DNA, 22 bp, Artificial Sequence
  chemically synthesized
atttctctttctctgtaaaggc

SEQ ID NO: 637433 - DNA, 22 bp, Artificial Sequence
  chemically synthesized
actcctactgggcctttacaga

SEQ ID NO: 637434 - DNA, 22 bp, Artificial Sequence
  chemically synthesized
ctcatttctctttctctgtaaa

SEQ ID NO: 637435 - DNA, 22 bp, Artificial Sequence
  chemically synthesized
cctcatttctctttctctgtaa

SEQ ID NO: 637436 - DNA, 22 bp, Artificial Sequence
  chemically synthesized
ctactgggcctttacagagaaa

SEQ ID NO: 637437 - DNA, 22 bp, Artificial Sequence
  chemically synthesized
ctgggcctttacagagaaagag

SEQ ID NO: 637438 - DNA, 22 bp, Artificial Sequence
  chemically synthesized
ggcctttacagagaaagagaaa

SEQ ID NO: 637439 - DNA, 22 bp, Artificial Sequence
  chemically synthesized
gtcccccttcctcatttctctt

SEQ ID NO: 637440 - DNA, 22 bp, Artificial Sequence
  chemically synthesized
ggtcccccttcctcatttctct

SEQ ID NO: 637441 - DNA, 22 bp, Artificial Sequence
  chemically synthesized
tacagagaaagagaaatgagga

SEQ ID NO: 637442 - DNA, 22 bp, Artificial Sequence
  chemically synthesized
acagagaaagagaaatgaggaa

SEQ ID NO: 637443 - DNA, 22 bp, Artificial Sequence
  chemically synthesized
cagagaaagagaaatgaggaag

SEQ ID NO: 637444 - DNA, 22 bp, Artificial Sequence
  chemically synthesized
tgaaggccacaaatacttggtc

SEQ ID NO: 637445 - DNA, 22 bp, Artificial Sequence
  chemically synthesized
atgaaggccacaaatacttggt

SEQ ID NO: 637446 - DNA, 22 bp, Artificial Sequence
  chemically synthesized
tatgaaggccacaaatacttgg

SEQ ID NO: 637447 - DNA, 22 bp, Artificial Sequence
  chemically synthesized
gacaatagagggttttatgaag

SEQ ID NO: 637448 - DNA, 22 bp, Artificial Sequence
  chemically synthesized
gctagacaatagagggttttat

SEQ ID NO: 637449 - DNA, 22 bp, Artificial Sequence
  chemically synthesized
gtggccttcataaaaccctcta

SEQ ID NO: 637450 - DNA, 22 bp, Artificial Sequence
  chemically synthesized
tggccttcataaaaccctctat

SEQ ID NO: 637451 - DNA, 22 bp, Artificial Sequence
  chemically synthesized
tgtctggctagacaatagaggg

SEQ ID NO: 637452 - DNA, 22 bp, Artificial Sequence
  chemically synthesized
ctgtgtctggctagacaataga

SEQ ID NO: 637453 - DNA, 22 bp, Artificial Sequence
  chemically synthesized
cataaaaccctctattgtctag

SEQ ID NO: 637454 - DNA, 22 bp, Artificial Sequence
  chemically synthesized
ataaaaccctctattgtctagc

SEQ ID NO: 637455 - DNA, 22 bp, Artificial Sequence
  chemically synthesized
ctgctgtgtctggctagacaat

SEQ ID NO: 637456 - DNA, 22 bp, Artificial Sequence
  chemically synthesized
cctgctgtgtctggctagacaa

SEQ ID NO: 637457 - DNA, 22 bp, Artificial Sequence
  chemically synthesized
tcctgctgtgtctggctagaca

SEQ ID NO: 637458 - DNA, 22 bp, Artificial Sequence
  chemically synthesized
ttcctgctgtgtctggctagac

SEQ ID NO: 637459 - DNA, 22 bp, Artificial Sequence
  chemically synthesized
gtttttcctgctgtgtctggct

SEQ ID NO: 637460 - DNA, 22 bp, Artificial Sequence
  chemically synthesized
tattgtctagccagacacagca

SEQ ID NO: 637461 - DNA, 22 bp, Artificial Sequence
  chemically synthesized
attggtttttcctgctgtgtct

SEQ ID NO: 637462 - DNA, 22 bp, Artificial Sequence
  chemically synthesized
ttgtctagccagacacagcagg

SEQ ID NO: 637463 - DNA, 22 bp, Artificial Sequence
  chemically synthesized
ctcattggtttttcctgctgtg

SEQ ID NO: 637464 - DNA, 22 bp, Artificial Sequence
  chemically synthesized
tctagccagacacagcaggaaa

SEQ ID NO: 637465 - DNA, 22 bp, Artificial Sequence
  chemically synthesized
gccagacacagcaggaaaaacc

SEQ ID NO: 637466 - DNA, 22 bp, Artificial Sequence
  chemically synthesized
gccagctgctcattggtttttc

SEQ ID NO: 637467 - DNA, 22 bp, Artificial Sequence
  chemically synthesized
ctagccagctgctcattggttt

SEQ ID NO: 637468 - DNA, 22 bp, Artificial Sequence
  chemically synthesized
ggacaggggttcctagccagct

SEQ ID NO: 637469 - DNA, 22 bp, Artificial Sequence
  chemically synthesized
gctaggaacccctgtcctagcc

SEQ ID NO: 637470 - DNA, 22 bp, Artificial Sequence
  chemically synthesized
cagtggtaatgaatggctagga

SEQ ID NO: 637471 - DNA, 22 bp, Artificial Sequence
  chemically synthesized
acagtggtaatgaatggctagg

SEQ ID NO: 637472 - DNA, 22 bp, Artificial Sequence
  chemically synthesized
ggaacccctgtcctagccattc

SEQ ID NO: 637473 - DNA, 22 bp, Artificial Sequence
  chemically synthesized
tacagtggtaatgaatggctag

SEQ ID NO: 637474 - DNA, 22 bp, Artificial Sequence
  chemically synthesized
tcctagccattcattaccactg

SEQ ID NO: 637475 - DNA, 22 bp, Artificial Sequence
  chemically synthesized
gccattcattaccactgtaaaa

SEQ ID NO: 637476 - DNA, 22 bp, Artificial Sequence
  chemically synthesized
attaccactgtaaaatgcccta

SEQ ID NO: 637477 - DNA, 22 bp, Artificial Sequence
  chemically synthesized
ccactgtaaaatgccctactct

SEQ ID NO: 637478 - DNA, 22 bp, Artificial Sequence
  chemically synthesized
taaaatgccctactcttgtttt

SEQ ID NO: 637479 - DNA, 22 bp, Artificial Sequence
  chemically synthesized
ctcttgttttgacctttgatca

SEQ ID NO: 637480 - DNA, 22 bp, Artificial Sequence
  chemically synthesized
atgaggcataaatgatcaaagg

SEQ ID NO: 637481 - DNA, 22 bp, Artificial Sequence
  chemically synthesized
ttgttttgacctttgatcattt

SEQ ID NO: 637482 - DNA, 22 bp, Artificial Sequence
  chemically synthesized
gttttgacctttgatcatttat

SEQ ID NO: 637483 - DNA, 22 bp, Artificial Sequence
  chemically synthesized
ttttgacctttgatcatttatg

SEQ ID NO: 637484 - DNA, 22 bp, Artificial Sequence
  chemically synthesized
tgacctttgatcatttatgcct

SEQ ID NO: 637485 - DNA, 22 bp, Artificial Sequence
  chemically synthesized
gacctttgatcatttatgcctc

SEQ ID NO: 637486 - DNA, 22 bp, Artificial Sequence
  chemically synthesized
acctttgatcatttatgcctca

SEQ ID NO: 637487 - DNA, 22 bp, Artificial Sequence
  chemically synthesized
agaaaggtggagctgatgaggc

SEQ ID NO: 637488 - DNA, 22 bp, Artificial Sequence
  chemically synthesized
tgatcatttatgcctcatcagc

SEQ ID NO: 637489 - DNA, 22 bp, Artificial Sequence
  chemically synthesized
gatcatttatgcctcatcagct

SEQ ID NO: 637490 - DNA, 22 bp, Artificial Sequence
  chemically synthesized
taagaaaggtggagctgatgag

SEQ ID NO: 637491 - DNA, 22 bp, Artificial Sequence
  chemically synthesized
atcatttatgcctcatcagctc

SEQ ID NO: 637492 - DNA, 22 bp, Artificial Sequence
  chemically synthesized
ggttctaagaaaggtggagctg

SEQ ID NO: 637493 - DNA, 22 bp, Artificial Sequence
  chemically synthesized
atgcctcatcagctccaccttt

SEQ ID NO: 637494 - DNA, 22 bp, Artificial Sequence
  chemically synthesized
tgcctcatcagctccacctttc

SEQ ID NO: 637495 - DNA, 22 bp, Artificial Sequence
  chemically synthesized
ggactaggttctaagaaaggtg

SEQ ID NO: 637496 - DNA, 22 bp, Artificial Sequence
  chemically synthesized
atcagctccacctttcttagaa

SEQ ID NO: 637497 - DNA, 22 bp, Artificial Sequence
  chemically synthesized
cctaggactaggttctaagaaa

SEQ ID NO: 637498 - DNA, 22 bp, Artificial Sequence
  chemically synthesized
tgcctaggactaggttctaaga

SEQ ID NO: 637499 - DNA, 22 bp, Artificial Sequence
  chemically synthesized
tctgcctaggactaggttctaa

SEQ ID NO: 637500 - DNA, 22 bp, Artificial Sequence
  chemically synthesized
cacctttcttagaacctagtcc

SEQ ID NO: 637501 - DNA, 22 bp, Artificial Sequence
  chemically synthesized
gcaatgttctctgcctaggact

SEQ ID NO: 637502 - DNA, 22 bp, Artificial Sequence
  chemically synthesized
tcttagaacctagtcctaggca

SEQ ID NO: 637503 - DNA, 22 bp, Artificial Sequence
  chemically synthesized
agcaatgttctctgcctaggac

SEQ ID NO: 637504 - DNA, 22 bp, Artificial Sequence
  chemically synthesized
cttagaacctagtcctaggcag

SEQ ID NO: 637505 - DNA, 22 bp, Artificial Sequence
  chemically synthesized
ttagaacctagtcctaggcaga

SEQ ID NO: 637506 - DNA, 22 bp, Artificial Sequence
  chemically synthesized
ttagcaatgttctctgcctagg

SEQ ID NO: 637507 - DNA, 22 bp, Artificial Sequence
  chemically synthesized
agaacctagtcctaggcagaga

SEQ ID NO: 637508 - DNA, 22 bp, Artificial Sequence
  chemically synthesized
gaacctagtcctaggcagagaa

SEQ ID NO: 637509 - DNA, 22 bp, Artificial Sequence
  chemically synthesized
attcttagcaatgttctctgcc

SEQ ID NO: 637510 - DNA, 22 bp, Artificial Sequence
  chemically synthesized
tcattcttagcaatgttctctg

SEQ ID NO: 637511 - DNA, 22 bp, Artificial Sequence
  chemically synthesized
ttctcattcttagcaatgttct

SEQ ID NO: 637512 - DNA, 22 bp, Artificial Sequence
  chemically synthesized
gtcctaggcagagaacattgct

SEQ ID NO: 637513 - DNA, 22 bp, Artificial Sequence
  chemically synthesized
tgttctcattcttagcaatgtt

SEQ ID NO: 637514 - DNA, 22 bp, Artificial Sequence
  chemically synthesized
ggcagagaacattgctaagaat

SEQ ID NO: 637515 - DNA, 22 bp, Artificial Sequence
  chemically synthesized
ctaagaatgagaacagaacatg

SEQ ID NO: 637516 - DNA, 22 bp, Artificial Sequence
  chemically synthesized
aggaaatggtccacatgttctg

SEQ ID NO: 637517 - DNA, 22 bp, Artificial Sequence
  chemically synthesized
agaatgagaacagaacatgtgg

SEQ ID NO: 637518 - DNA, 22 bp, Artificial Sequence
  chemically synthesized
ttgaggaaatggtccacatgtt

SEQ ID NO: 637519 - DNA, 22 bp, Artificial Sequence
  chemically synthesized
gttgaggaaatggtccacatgt

SEQ ID NO: 637520 - DNA, 22 bp, Artificial Sequence
  chemically synthesized
gatgaatttgttgaggaaatgg

SEQ ID NO: 637521 - DNA, 22 bp, Artificial Sequence
  chemically synthesized
ggcaaaagttggatgaatttgt

SEQ ID NO: 637522 - DNA, 22 bp, Artificial Sequence
  chemically synthesized
aggcaaaagttggatgaatttg

SEQ ID NO: 637523 - DNA, 22 bp, Artificial Sequence
  chemically synthesized
cctcaacaaattcatccaactt

SEQ ID NO: 637524 - DNA, 22 bp, Artificial Sequence
  chemically synthesized
ctcaacaaattcatccaacttt

SEQ ID NO: 637525 - DNA, 22 bp, Artificial Sequence
  chemically synthesized
aacaaattcatccaacttttgc

SEQ ID NO: 637526 - DNA, 22 bp, Artificial Sequence
  chemically synthesized
atccaacttttgcctaaggctt

SEQ ID NO: 637527 - DNA, 22 bp, Artificial Sequence
  chemically synthesized
ccaagtaagaaggaagccttag

SEQ ID NO: 637528 - DNA, 22 bp, Artificial Sequence
  chemically synthesized
ttgcctaaggcttccttcttac

SEQ ID NO: 637529 - DNA, 22 bp, Artificial Sequence
  chemically synthesized
aaacattaccaagtaagaagga

SEQ ID NO: 637530 - DNA, 22 bp, Artificial Sequence
  chemically synthesized
tgcctaaggcttccttcttact

SEQ ID NO: 637531 - DNA, 22 bp, Artificial Sequence
  chemically synthesized
gaaacattaccaagtaagaagg

SEQ ID NO: 637532 - DNA, 22 bp, Artificial Sequence
  chemically synthesized
gcctaaggcttccttcttactt

SEQ ID NO: 637533 - DNA, 22 bp, Artificial Sequence
  chemically synthesized
tgaaacattaccaagtaagaag

SEQ ID NO: 637534 - DNA, 22 bp, Artificial Sequence
  chemically synthesized
cctaaggcttccttcttacttg

SEQ ID NO: 637535 - DNA, 22 bp, Artificial Sequence
  chemically synthesized
aggcttccttcttacttggtaa

SEQ ID NO: 637536 - DNA, 22 bp, Artificial Sequence
  chemically synthesized
ccttcttacttggtaatgtttc

SEQ ID NO: 637537 - DNA, 22 bp, Artificial Sequence
  chemically synthesized
cttcttacttggtaatgtttca

SEQ ID NO: 637538 - DNA, 22 bp, Artificial Sequence
  chemically synthesized
cttacttggtaatgtttcaaaa

SEQ ID NO: 637539 - DNA, 22 bp, Artificial Sequence
  chemically synthesized
ttacttggtaatgtttcaaaat

SEQ ID NO: 637540 - DNA, 22 bp, Artificial Sequence
  chemically synthesized
acttggtaatgtttcaaaattg

SEQ ID NO: 637541 - DNA, 22 bp, Artificial Sequence
  chemically synthesized
cttggtaatgtttcaaaattgt

SEQ ID NO: 637542 - DNA, 22 bp, Artificial Sequence
  chemically synthesized
aggaaagtgaagacaattttga

SEQ ID NO: 637543 - DNA, 22 bp, Artificial Sequence
  chemically synthesized
ggtaatgtttcaaaattgtctt

SEQ ID NO: 637544 - DNA, 22 bp, Artificial Sequence
  chemically synthesized
gtaatgtttcaaaattgtcttc

SEQ ID NO: 637545 - DNA, 22 bp, Artificial Sequence
  chemically synthesized
caaaattgtcttcactttcctt

SEQ ID NO: 637546 - DNA, 22 bp, Artificial Sequence
  chemically synthesized
aaaattgtcttcactttcctta

SEQ ID NO: 637547 - DNA, 22 bp, Artificial Sequence
  chemically synthesized
aaatgaatgaggattaaggaaa

SEQ ID NO: 637548 - DNA, 22 bp, Artificial Sequence
  chemically synthesized
aaaatgaatgaggattaaggaa

SEQ ID NO: 637549 - DNA, 22 bp, Artificial Sequence
  chemically synthesized
tcttcactttccttaatcctca

SEQ ID NO: 637550 - DNA, 22 bp, Artificial Sequence
  chemically synthesized
cactttccttaatcctcattca

SEQ ID NO: 637551 - DNA, 22 bp, Artificial Sequence
  chemically synthesized
actttccttaatcctcattcat

SEQ ID NO: 637552 - DNA, 22 bp, Artificial Sequence
  chemically synthesized
ggtaatcttaaaatgaatgagg

SEQ ID NO: 637553 - DNA, 22 bp, Artificial Sequence
  chemically synthesized
tccttaatcctcattcatttta

SEQ ID NO: 637554 - DNA, 22 bp, Artificial Sequence
  chemically synthesized
ccttaatcctcattcattttaa

SEQ ID NO: 637555 - DNA, 22 bp, Artificial Sequence
  chemically synthesized
cttaatcctcattcattttaag

SEQ ID NO: 637556 - DNA, 22 bp, Artificial Sequence
  chemically synthesized
aatcctcattcattttaagatt

SEQ ID NO: 637557 - DNA, 22 bp, Artificial Sequence
  chemically synthesized
atcctcattcattttaagatta

SEQ ID NO: 637558 - DNA, 22 bp, Artificial Sequence
  chemically synthesized
attcattttaagattacctagt

SEQ ID NO: 637559 - DNA, 22 bp, Artificial Sequence
  chemically synthesized
aatgaaatgaaagactaggtaa

SEQ ID NO: 637560 - DNA, 22 bp, Artificial Sequence
  chemically synthesized
caatgaaatgaaagactaggta

SEQ ID NO: 637561 - DNA, 22 bp, Artificial Sequence
  chemically synthesized
attttaagattacctagtcttt

SEQ ID NO: 637562 - DNA, 22 bp, Artificial Sequence
  chemically synthesized
tttcaatgaaatgaaagactag

SEQ ID NO: 637563 - DNA, 22 bp, Artificial Sequence
  chemically synthesized
tgtttcaatgaaatgaaagact

SEQ ID NO: 637564 - DNA, 22 bp, Artificial Sequence
  chemically synthesized
taagattacctagtctttcatt

SEQ ID NO: 637565 - DNA, 22 bp, Artificial Sequence
  chemically synthesized
ctgtttcaatgaaatgaaagac

SEQ ID NO: 637566 - DNA, 22 bp, Artificial Sequence
  chemically synthesized
aagattacctagtctttcattt

SEQ ID NO: 637567 - DNA, 22 bp, Artificial Sequence
  chemically synthesized
agattacctagtctttcatttc

SEQ ID NO: 637568 - DNA, 22 bp, Artificial Sequence
  chemically synthesized
cctagtctttcatttcattgaa

SEQ ID NO: 637569 - DNA, 22 bp, Artificial Sequence
  chemically synthesized
gtctttcatttcattgaaacag

SEQ ID NO: 637570 - DNA, 22 bp, Artificial Sequence
  chemically synthesized
tcatttcattgaaacagaagtt

SEQ ID NO: 637571 - DNA, 22 bp, Artificial Sequence
  chemically synthesized
catttcattgaaacagaagttt

SEQ ID NO: 637572 - DNA, 22 bp, Artificial Sequence
  chemically synthesized
atttcattgaaacagaagtttt

SEQ ID NO: 637573 - DNA, 22 bp, Artificial Sequence
  chemically synthesized
cattgaaacagaagttttccac

SEQ ID NO: 637574 - DNA, 22 bp, Artificial Sequence
  chemically synthesized
attgaaacagaagttttccacc

SEQ ID NO: 637575 - DNA, 22 bp, Artificial Sequence
  chemically synthesized
aaacagaagttttccaccttcc

SEQ ID NO: 637576 - DNA, 22 bp, Artificial Sequence
  chemically synthesized
ggccaagagaagggaaggtgga

SEQ ID NO: 637577 - DNA, 22 bp, Artificial Sequence
  chemically synthesized
aggccaagagaagggaaggtgg

SEQ ID NO: 637578 - DNA, 22 bp, Artificial Sequence
  chemically synthesized
taggccaagagaagggaaggtg

SEQ ID NO: 637579 - DNA, 22 bp, Artificial Sequence
  chemically synthesized
tccaccttcccttctcttggcc

SEQ ID NO: 637580 - DNA, 22 bp, Artificial Sequence
  chemically synthesized
ccaccttcccttctcttggcct

SEQ ID NO: 637581 - DNA, 22 bp, Artificial Sequence
  chemically synthesized
agaaaccattttaggccaagag

SEQ ID NO: 637582 - DNA, 22 bp, Artificial Sequence
  chemically synthesized
caccttcccttctcttggccta

SEQ ID NO: 637583 - DNA, 22 bp, Artificial Sequence
  chemically synthesized
gagaaaccattttaggccaaga

SEQ ID NO: 637584 - DNA, 22 bp, Artificial Sequence
  chemically synthesized
tgagaaaccattttaggccaag

SEQ ID NO: 637585 - DNA, 22 bp, Artificial Sequence
  chemically synthesized
cccttctcttggcctaaaatgg

SEQ ID NO: 637586 - DNA, 22 bp, Artificial Sequence
  chemically synthesized
ccttctcttggcctaaaatggt

SEQ ID NO: 637587 - DNA, 22 bp, Artificial Sequence
  chemically synthesized
ggtaattttgagaaaccatttt

SEQ ID NO: 637588 - DNA, 22 bp, Artificial Sequence
  chemically synthesized
ctcttggcctaaaatggtttct

SEQ ID NO: 637589 - DNA, 22 bp, Artificial Sequence
  chemically synthesized
tcttggcctaaaatggtttctc

SEQ ID NO: 637590 - DNA, 22 bp, Artificial Sequence
  chemically synthesized
ttggcctaaaatggtttctcaa

SEQ ID NO: 637591 - DNA, 22 bp, Artificial Sequence
  chemically synthesized
ggcctaaaatggtttctcaaaa

SEQ ID NO: 637592 - DNA, 22 bp, Artificial Sequence
  chemically synthesized
gcctaaaatggtttctcaaaat

SEQ ID NO: 637593 - DNA, 22 bp, Artificial Sequence
  chemically synthesized
taaatgcattgggtaattttga

SEQ ID NO: 637594 - DNA, 22 bp, Artificial Sequence
  chemically synthesized
aaatggtttctcaaaattaccc

SEQ ID NO: 637595 - DNA, 22 bp, Artificial Sequence
  chemically synthesized
ggtcactataaatgcattgggt

SEQ ID NO: 637596 - DNA, 22 bp, Artificial Sequence
  chemically synthesized
ctcaaaattacccaatgcattt

SEQ ID NO: 637597 - DNA, 22 bp, Artificial Sequence
  chemically synthesized
tcaaaattacccaatgcattta

SEQ ID NO: 637598 - DNA, 22 bp, Artificial Sequence
  chemically synthesized
aaaattacccaatgcatttata

SEQ ID NO: 637599 - DNA, 22 bp, Artificial Sequence
  chemically synthesized
cccaatgcatttatagtgaccc

SEQ ID NO: 637600 - DNA, 22 bp, Artificial Sequence
  chemically synthesized
aaataaatcacagtccattggg

SEQ ID NO: 637601 - DNA, 22 bp, Artificial Sequence
  chemically synthesized
atagtgacccaatggactgtga

SEQ ID NO: 637602 - DNA, 22 bp, Artificial Sequence
  chemically synthesized
tagtgacccaatggactgtgat

SEQ ID NO: 637603 - DNA, 22 bp, Artificial Sequence
  chemically synthesized
aatggaaattaaaataaatcac

SEQ ID NO: 637604 - DNA, 22 bp, Artificial Sequence
  chemically synthesized
aagagagctcaatggaaattaa

SEQ ID NO: 637605 - DNA, 22 bp, Artificial Sequence
  chemically synthesized
tgatttattttaatttccattg

SEQ ID NO: 637606 - DNA, 22 bp, Artificial Sequence
  chemically synthesized
attttaatttccattgagctct

SEQ ID NO: 637607 - DNA, 22 bp, Artificial Sequence
  chemically synthesized
ttttaatttccattgagctctc

SEQ ID NO: 637608 - DNA, 22 bp, Artificial Sequence
  chemically synthesized
taatttccattgagctctcttt

SEQ ID NO: 637609 - DNA, 22 bp, Artificial Sequence
  chemically synthesized
aatttccattgagctctcttta

SEQ ID NO: 637610 - DNA, 22 bp, Artificial Sequence
  chemically synthesized
atttccattgagctctctttag

SEQ ID NO: 637611 - DNA, 22 bp, Artificial Sequence
  chemically synthesized
ccattgagctctctttagcatt

SEQ ID NO: 637612 - DNA, 22 bp, Artificial Sequence
  chemically synthesized
cattgagctctctttagcattt

SEQ ID NO: 637613 - DNA, 22 bp, Artificial Sequence
  chemically synthesized
agctctctttagcatttcacct

SEQ ID NO: 637614 - DNA, 22 bp, Artificial Sequence
  chemically synthesized
tctttagcatttcacctttttg

SEQ ID NO: 637615 - DNA, 22 bp, Artificial Sequence
  chemically synthesized
aaggaagatgtgacaaaaaggt

SEQ ID NO: 637616 - DNA, 22 bp, Artificial Sequence
  chemically synthesized
tttagcatttcacctttttgtc

SEQ ID NO: 637617 - DNA, 22 bp, Artificial Sequence
  chemically synthesized
tagcatttcacctttttgtcac

SEQ ID NO: 637618 - DNA, 22 bp, Artificial Sequence
  chemically synthesized
agcatttcacctttttgtcaca

SEQ ID NO: 637619 - DNA, 22 bp, Artificial Sequence
  chemically synthesized
gcatttcacctttttgtcacat

SEQ ID NO: 637620 - DNA, 22 bp, Artificial Sequence
  chemically synthesized
cacctttttgtcacatcttcct

SEQ ID NO: 637621 - DNA, 22 bp, Artificial Sequence
  chemically synthesized
acctttttgtcacatcttcctt

SEQ ID NO: 637622 - DNA, 22 bp, Artificial Sequence
  chemically synthesized
tttgtcacatcttccttgaacc

SEQ ID NO: 637623 - DNA, 22 bp, Artificial Sequence
  chemically synthesized
ttgtcacatcttccttgaacct

SEQ ID NO: 637624 - DNA, 22 bp, Artificial Sequence
  chemically synthesized
tgtcacatcttccttgaacctc

SEQ ID NO: 637625 - DNA, 22 bp, Artificial Sequence
  chemically synthesized
gtcacatcttccttgaacctcc

SEQ ID NO: 637626 - DNA, 22 bp, Artificial Sequence
  chemically synthesized
tcacatcttccttgaacctccc

SEQ ID NO: 637627 - DNA, 22 bp, Artificial Sequence
  chemically synthesized
ccttgaacctccctacttatcc

SEQ ID NO: 637628 - DNA, 22 bp, Artificial Sequence
  chemically synthesized
cttgaacctccctacttatcca

SEQ ID NO: 637629 - DNA, 22 bp, Artificial Sequence
  chemically synthesized
gaacctccctacttatccatcc

SEQ ID NO: 637630 - DNA, 22 bp, Artificial Sequence
  chemically synthesized
aacctccctacttatccatcct

SEQ ID NO: 637631 - DNA, 22 bp, Artificial Sequence
  chemically synthesized
ggtaatgggatagtaaaggatg

SEQ ID NO: 637632 - DNA, 22 bp, Artificial Sequence
  chemically synthesized
gggtaatgggatagtaaaggat

SEQ ID NO: 637633 - DNA, 22 bp, Artificial Sequence
  chemically synthesized
cctacttatccatcctttacta

SEQ ID NO: 637634 - DNA, 22 bp, Artificial Sequence
  chemically synthesized
cttatccatcctttactatccc

SEQ ID NO: 637635 - DNA, 22 bp, Artificial Sequence
  chemically synthesized
catttgggtaatgggatagtaa

SEQ ID NO: 637636 - DNA, 22 bp, Artificial Sequence
  chemically synthesized
atccatcctttactatcccatt

SEQ ID NO: 637637 - DNA, 22 bp, Artificial Sequence
  chemically synthesized
tccatcctttactatcccatta

SEQ ID NO: 637638 - DNA, 22 bp, Artificial Sequence
  chemically synthesized
gaaaagacctccatttgggtaa

SEQ ID NO: 637639 - DNA, 22 bp, Artificial Sequence
  chemically synthesized
ggaaaagacctccatttgggta

SEQ ID NO: 637640 - DNA, 22 bp, Artificial Sequence
  chemically synthesized
tactatcccattacccaaatgg

SEQ ID NO: 637641 - DNA, 22 bp, Artificial Sequence
  chemically synthesized
actatcccattacccaaatgga

SEQ ID NO: 637642 - DNA, 22 bp, Artificial Sequence
  chemically synthesized
ctatcccattacccaaatggag

SEQ ID NO: 637643 - DNA, 22 bp, Artificial Sequence
  chemically synthesized
tcccattacccaaatggaggtc

SEQ ID NO: 637644 - DNA, 22 bp, Artificial Sequence
  chemically synthesized
gatccagtgccttggaaaagac

SEQ ID NO: 637645 - DNA, 22 bp, Artificial Sequence
  chemically synthesized
cccaaatggaggtcttttccaa

SEQ ID NO: 637646 - DNA, 22 bp, Artificial Sequence
  chemically synthesized
cgatccagtgccttggaaaaga

SEQ ID NO: 637647 - DNA, 22 bp, Artificial Sequence
  chemically synthesized
taacacaggtgcttcgatccag

SEQ ID NO: 637648 - DNA, 22 bp, Artificial Sequence
  chemically synthesized
ttccaaggcactggatcgaagc

SEQ ID NO: 637649 - DNA, 22 bp, Artificial Sequence
  chemically synthesized
tccaaggcactggatcgaagca

SEQ ID NO: 637650 - DNA, 22 bp, Artificial Sequence
  chemically synthesized
ccaaggcactggatcgaagcac

SEQ ID NO: 637651 - DNA, 22 bp, Artificial Sequence
  chemically synthesized
caaggcactggatcgaagcacc

SEQ ID NO: 637652 - DNA, 22 bp, Artificial Sequence
  chemically synthesized
taaaatctataacacaggtgct

SEQ ID NO: 637653 - DNA, 22 bp, Artificial Sequence
  chemically synthesized
gatcgaagcacctgtgttatag

SEQ ID NO: 637654 - DNA, 22 bp, Artificial Sequence
  chemically synthesized
tgttatagattttatagatttc

SEQ ID NO: 637655 - DNA, 22 bp, Artificial Sequence
  chemically synthesized
aagggtgtgagatgagaaatct

SEQ ID NO: 637656 - DNA, 22 bp, Artificial Sequence
  chemically synthesized
tagattttatagatttctcatc

SEQ ID NO: 637657 - DNA, 22 bp, Artificial Sequence
  chemically synthesized
ctgaagggtgtgagatgagaaa

SEQ ID NO: 637658 - DNA, 22 bp, Artificial Sequence
  chemically synthesized
attgctgaagggtgtgagatga

SEQ ID NO: 637659 - DNA, 22 bp, Artificial Sequence
  chemically synthesized
tatagatttctcatctcacacc

SEQ ID NO: 637660 - DNA, 22 bp, Artificial Sequence
  chemically synthesized
atagatttctcatctcacaccc

SEQ ID NO: 637661 - DNA, 22 bp, Artificial Sequence
  chemically synthesized
tagatttctcatctcacaccct

SEQ ID NO: 637662 - DNA, 22 bp, Artificial Sequence
  chemically synthesized
atagaattgattgctgaagggt

SEQ ID NO: 637663 - DNA, 22 bp, Artificial Sequence
  chemically synthesized
catagaattgattgctgaaggg

SEQ ID NO: 637664 - DNA, 22 bp, Artificial Sequence
  chemically synthesized
ctcatctcacacccttcagcaa

SEQ ID NO: 637665 - DNA, 22 bp, Artificial Sequence
  chemically synthesized
tcatctcacacccttcagcaat

SEQ ID NO: 637666 - DNA, 22 bp, Artificial Sequence
  chemically synthesized
atctcacacccttcagcaatca

SEQ ID NO: 637667 - DNA, 22 bp, Artificial Sequence
  chemically synthesized
acacccttcagcaatcaattct

SEQ ID NO: 637668 - DNA, 22 bp, Artificial Sequence
  chemically synthesized
agaatgagtttcatagaattga

SEQ ID NO: 637669 - DNA, 22 bp, Artificial Sequence
  chemically synthesized
gagaatgagtttcatagaattg

SEQ ID NO: 637670 - DNA, 22 bp, Artificial Sequence
  chemically synthesized
cagcaatcaattctatgaaact

SEQ ID NO: 637671 - DNA, 22 bp, Artificial Sequence
  chemically synthesized
agcaatcaattctatgaaactc

SEQ ID NO: 637672 - DNA, 22 bp, Artificial Sequence
  chemically synthesized
gagagatttgagaatgagtttc

SEQ ID NO: 637673 - DNA, 22 bp, Artificial Sequence
  chemically synthesized
tatgaaactcattctcaaatct

SEQ ID NO: 637674 - DNA, 22 bp, Artificial Sequence
  chemically synthesized
tgaaactcattctcaaatctct

SEQ ID NO: 637675 - DNA, 22 bp, Artificial Sequence
  chemically synthesized
aagtaagtgggcaaactggaga

SEQ ID NO: 637676 - DNA, 22 bp, Artificial Sequence
  chemically synthesized
attctcaaatctctccagtttg

SEQ ID NO: 637677 - DNA, 22 bp, Artificial Sequence
  chemically synthesized
gaagtaagtgggcaaactggag

SEQ ID NO: 637678 - DNA, 22 bp, Artificial Sequence
  chemically synthesized
tcaaatctctccagtttgccca

SEQ ID NO: 637679 - DNA, 22 bp, Artificial Sequence
  chemically synthesized
tacttgaagtaagtgggcaaac

SEQ ID NO: 637680 - DNA, 22 bp, Artificial Sequence
  chemically synthesized
aaatctctccagtttgcccact

SEQ ID NO: 637681 - DNA, 22 bp, Artificial Sequence
  chemically synthesized
tccagtttgcccacttacttca

SEQ ID NO: 637682 - DNA, 22 bp, Artificial Sequence
  chemically synthesized
cagtttgcccacttacttcaag

SEQ ID NO: 637683 - DNA, 22 bp, Artificial Sequence
  chemically synthesized
agatacagatctatacttgaag

SEQ ID NO: 637684 - DNA, 22 bp, Artificial Sequence
  chemically synthesized
gcccacttacttcaagtataga

SEQ ID NO: 637685 - DNA, 22 bp, Artificial Sequence
  chemically synthesized
cccacttacttcaagtatagat

SEQ ID NO: 637686 - DNA, 22 bp, Artificial Sequence
  chemically synthesized
acttcaagtatagatctgtatc

SEQ ID NO: 637687 - DNA, 22 bp, Artificial Sequence
  chemically synthesized
cttcaagtatagatctgtatct

SEQ ID NO: 637688 - DNA, 22 bp, Artificial Sequence
  chemically synthesized
caagtatagatctgtatcttaa

SEQ ID NO: 637689 - DNA, 22 bp, Artificial Sequence
  chemically synthesized
aagtatagatctgtatcttaat

SEQ ID NO: 637690 - DNA, 22 bp, Artificial Sequence
  chemically synthesized
agtcatgtcccaaaagaaatta

SEQ ID NO: 637691 - DNA, 22 bp, Artificial Sequence
  chemically synthesized
taagtcatgtcccaaaagaaat

SEQ ID NO: 637692 - DNA, 22 bp, Artificial Sequence
  chemically synthesized
ctaagtcatgtcccaaaagaaa

SEQ ID NO: 637693 - DNA, 22 bp, Artificial Sequence
  chemically synthesized
tatcttaatttcttttgggaca

SEQ ID NO: 637694 - DNA, 22 bp, Artificial Sequence
  chemically synthesized
acaggtcttctaagtcatgtcc

SEQ ID NO: 637695 - DNA, 22 bp, Artificial Sequence
  chemically synthesized
aatttcttttgggacatgactt

SEQ ID NO: 637696 - DNA, 22 bp, Artificial Sequence
  chemically synthesized
atttcttttgggacatgactta

SEQ ID NO: 637697 - DNA, 22 bp, Artificial Sequence
  chemically synthesized
cttttgggacatgacttagaag

SEQ ID NO: 637698 - DNA, 22 bp, Artificial Sequence
  chemically synthesized
ttttgggacatgacttagaaga

SEQ ID NO: 637699 - DNA, 22 bp, Artificial Sequence
  chemically synthesized
agaaattgacaggtcttctaag

SEQ ID NO: 637700 - DNA, 22 bp, Artificial Sequence
  chemically synthesized
ttgggacatgacttagaagacc

SEQ ID NO: 637701 - DNA, 22 bp, Artificial Sequence
  chemically synthesized
gagaaattgacaggtcttctaa

SEQ ID NO: 637702 - DNA, 22 bp, Artificial Sequence
  chemically synthesized
tgggacatgacttagaagacct

SEQ ID NO: 637703 - DNA, 22 bp, Artificial Sequence
  chemically synthesized
gggacatgacttagaagacctg

SEQ ID NO: 637704 - DNA, 22 bp, Artificial Sequence
  chemically synthesized
ggacatgacttagaagacctgt

SEQ ID NO: 637705 - DNA, 22 bp, Artificial Sequence
  chemically synthesized
agaagacctgtcaatttctcaa

SEQ ID NO: 637706 - DNA, 22 bp, Artificial Sequence
  chemically synthesized
gaagacctgtcaatttctcaaa

SEQ ID NO: 637707 - DNA, 22 bp, Artificial Sequence
  chemically synthesized
tggacataatgtgtttgagaaa

SEQ ID NO: 637708 - DNA, 22 bp, Artificial Sequence
  chemically synthesized
attgtggacataatgtgtttga

SEQ ID NO: 637709 - DNA, 22 bp, Artificial Sequence
  chemically synthesized
tgattgtggacataatgtgttt

SEQ ID NO: 637710 - DNA, 22 bp, Artificial Sequence
  chemically synthesized
ctgattgtggacataatgtgtt

SEQ ID NO: 637711 - DNA, 22 bp, Artificial Sequence
  chemically synthesized
tcaatttctcaaacacattatg

SEQ ID NO: 637712 - DNA, 22 bp, Artificial Sequence
  chemically synthesized
ctcaaacacattatgtccacaa

SEQ ID NO: 637713 - DNA, 22 bp, Artificial Sequence
  chemically synthesized
tcaaacacattatgtccacaat

SEQ ID NO: 637714 - DNA, 22 bp, Artificial Sequence
  chemically synthesized
aaacacattatgtccacaatca

SEQ ID NO: 637715 - DNA, 22 bp, Artificial Sequence
  chemically synthesized
gaagaagatagtgaaacttctg

SEQ ID NO: 637716 - DNA, 22 bp, Artificial Sequence
  chemically synthesized
tgtccacaatcagaagtttcac

SEQ ID NO: 637717 - DNA, 22 bp, Artificial Sequence
  chemically synthesized
gttggaagaagatagtgaaact

SEQ ID NO: 637718 - DNA, 22 bp, Artificial Sequence
  chemically synthesized
ggttggaagaagatagtgaaac

SEQ ID NO: 637719 - DNA, 22 bp, Artificial Sequence
  chemically synthesized
cactatcttcttccaaccaaat

SEQ ID NO: 637720 - DNA, 22 bp, Artificial Sequence
  chemically synthesized
actatcttcttccaaccaaatc

SEQ ID NO: 637721 - DNA, 22 bp, Artificial Sequence
  chemically synthesized
tcttcttccaaccaaatcctct

SEQ ID NO: 637722 - DNA, 22 bp, Artificial Sequence
  chemically synthesized
cttccaaccaaatcctctccct

SEQ ID NO: 637723 - DNA, 22 bp, Artificial Sequence
  chemically synthesized
ttccaaccaaatcctctccctt

SEQ ID NO: 637724 - DNA, 22 bp, Artificial Sequence
  chemically synthesized
ccaaccaaatcctctcccttca

SEQ ID NO: 637725 - DNA, 22 bp, Artificial Sequence
  chemically synthesized
taagaagaggaatgaagggaga

SEQ ID NO: 637726 - DNA, 22 bp, Artificial Sequence
  chemically synthesized
caaccaaatcctctcccttcat

SEQ ID NO: 637727 - DNA, 22 bp, Artificial Sequence
  chemically synthesized
agtgcaaattgtaagaagagga

SEQ ID NO: 637728 - DNA, 22 bp, Artificial Sequence
  chemically synthesized
tcccttcattcctcttcttaca

SEQ ID NO: 637729 - DNA, 22 bp, Artificial Sequence
  chemically synthesized
ccttcattcctcttcttacaat

SEQ ID NO: 637730 - DNA, 22 bp, Artificial Sequence
  chemically synthesized
gggactgagtgcaaattgtaag

SEQ ID NO: 637731 - DNA, 22 bp, Artificial Sequence
  chemically synthesized
cattcctcttcttacaatttgc

SEQ ID NO: 637732 - DNA, 22 bp, Artificial Sequence
  chemically synthesized
attcctcttcttacaatttgca

SEQ ID NO: 637733 - DNA, 22 bp, Artificial Sequence
  chemically synthesized
ctcttcttacaatttgcactca

SEQ ID NO: 637734 - DNA, 22 bp, Artificial Sequence
  chemically synthesized
ttcttacaatttgcactcagtc

SEQ ID NO: 637735 - DNA, 22 bp, Artificial Sequence
  chemically synthesized
ccagggtctggggactgagtgc

SEQ ID NO: 637736 - DNA, 22 bp, Artificial Sequence
  chemically synthesized
cttacaatttgcactcagtccc

SEQ ID NO: 637737 - DNA, 22 bp, Artificial Sequence
  chemically synthesized
ttacaatttgcactcagtcccc

SEQ ID NO: 637738 - DNA, 22 bp, Artificial Sequence
  chemically synthesized
acaatttgcactcagtccccag

SEQ ID NO: 637739 - DNA, 22 bp, Artificial Sequence
  chemically synthesized
caatttgcactcagtccccaga

SEQ ID NO: 637740 - DNA, 22 bp, Artificial Sequence
  chemically synthesized
gcactcagtccccagaccctgg

SEQ ID NO: 637741 - DNA, 22 bp, Artificial Sequence
  chemically synthesized
cactcagtccccagaccctggg

SEQ ID NO: 637742 - DNA, 22 bp, Artificial Sequence
  chemically synthesized
agtccccagaccctgggaactc

SEQ ID NO: 637743 - DNA, 22 bp, Artificial Sequence
  chemically synthesized
aaaaaaaaaaaaaaaaaataga

SEQ ID NO: 637744 - DNA, 22 bp, Artificial Sequence
  chemically synthesized
tgtctcaaaaaaaaaaaaaaaa

SEQ ID NO: 637745 - DNA, 22 bp, Artificial Sequence
  chemically synthesized
ggaactctattttttttttttt

SEQ ID NO: 637746 - DNA, 22 bp, Artificial Sequence
  chemically synthesized
tattttttttttttttttttga

SEQ ID NO: 637747 - DNA, 22 bp, Artificial Sequence
  chemically synthesized
ttttttttttttttttttgaga

SEQ ID NO: 637748 - DNA, 22 bp, Artificial Sequence
  chemically synthesized
tttttttttttttttgagacac

SEQ ID NO: 637749 - DNA, 22 bp, Artificial Sequence
  chemically synthesized
ttttttttttttttgagacaca

SEQ ID NO: 637750 - DNA, 22 bp, Artificial Sequence
  chemically synthesized
tttttttttttttgagacacag

SEQ ID NO: 637751 - DNA, 22 bp, Artificial Sequence
  chemically synthesized
ttttttttttttgagacacagt

SEQ ID NO: 637752 - DNA, 22 bp, Artificial Sequence
  chemically synthesized
tttttttttttgagacacagtc

SEQ ID NO: 637753 - DNA, 22 bp, Artificial Sequence
  chemically synthesized
ttttttttttgagacacagtct

SEQ ID NO: 637754 - DNA, 22 bp, Artificial Sequence
  chemically synthesized
ggcgacagagcaagactgtgtc

SEQ ID NO: 637755 - DNA, 22 bp, Artificial Sequence
  chemically synthesized
tttttttttgagacacagtctt

SEQ ID NO: 637756 - DNA, 22 bp, Artificial Sequence
  chemically synthesized
ttttttttgagacacagtcttg

SEQ ID NO: 637757 - DNA, 22 bp, Artificial Sequence
  chemically synthesized
tttttttgagacacagtcttgc

SEQ ID NO: 637758 - DNA, 22 bp, Artificial Sequence
  chemically synthesized
ttttttgagacacagtcttgct

SEQ ID NO: 637759 - DNA, 22 bp, Artificial Sequence
  chemically synthesized
tttttgagacacagtcttgctc

SEQ ID NO: 637760 - DNA, 22 bp, Artificial Sequence
  chemically synthesized
ttttgagacacagtcttgctct

SEQ ID NO: 637761 - DNA, 22 bp, Artificial Sequence
  chemically synthesized
tttgagacacagtcttgctctg

SEQ ID NO: 637762 - DNA, 22 bp, Artificial Sequence
  chemically synthesized
cagcctgggcgacagagcaaga

SEQ ID NO: 637763 - DNA, 22 bp, Artificial Sequence
  chemically synthesized
ttgagacacagtcttgctctgt

SEQ ID NO: 637764 - DNA, 22 bp, Artificial Sequence
  chemically synthesized
tgagacacagtcttgctctgtc

SEQ ID NO: 637765 - DNA, 22 bp, Artificial Sequence
  chemically synthesized
gagacacagtcttgctctgtcg

SEQ ID NO: 637766 - DNA, 22 bp, Artificial Sequence
  chemically synthesized
agacacagtcttgctctgtcgc

SEQ ID NO: 637767 - DNA, 22 bp, Artificial Sequence
  chemically synthesized
cactccagcctgggcgacagag

SEQ ID NO: 637768 - DNA, 22 bp, Artificial Sequence
  chemically synthesized
gctctgtcgcccaggctggagt

SEQ ID NO: 637769 - DNA, 22 bp, Artificial Sequence
  chemically synthesized
ctctgtcgcccaggctggagtg

SEQ ID NO: 637770 - DNA, 22 bp, Artificial Sequence
  chemically synthesized
tgtcgcccaggctggagtgcaa

SEQ ID NO: 637771 - DNA, 22 bp, Artificial Sequence
  chemically synthesized
tcgcccaggctggagtgcaatg

SEQ ID NO: 637772 - DNA, 22 bp, Artificial Sequence
  chemically synthesized
cagtgagccaagatggcaccat

SEQ ID NO: 637773 - DNA, 22 bp, Artificial Sequence
  chemically synthesized
gagtgcaatggtgccatcttgg

SEQ ID NO: 637774 - DNA, 22 bp, Artificial Sequence
  chemically synthesized
agcccaggaggcggaggttgca

SEQ ID NO: 637775 - DNA, 22 bp, Artificial Sequence
  chemically synthesized
gagcccaggaggcggaggttgc

SEQ ID NO: 637776 - DNA, 22 bp, Artificial Sequence
  chemically synthesized
ggctcactgcaacctccgcctc

SEQ ID NO: 637777 - DNA, 22 bp, Artificial Sequence
  chemically synthesized
gctcactgcaacctccgcctcc

SEQ ID NO: 637778 - DNA, 22 bp, Artificial Sequence
  chemically synthesized
actgcaacctccgcctcctggg

SEQ ID NO: 637779 - DNA, 22 bp, Artificial Sequence
  chemically synthesized
caacctccgcctcctgggctca

SEQ ID NO: 637780 - DNA, 22 bp, Artificial Sequence
  chemically synthesized
cgcctcctgggctcaagcgatt

SEQ ID NO: 637781 - DNA, 22 bp, Artificial Sequence
  chemically synthesized
ctgggctcaagcgattctcctg

SEQ ID NO: 637782 - DNA, 22 bp, Artificial Sequence
  chemically synthesized
gggaggatgaggcaggagaatc

SEQ ID NO: 637783 - DNA, 22 bp, Artificial Sequence
  chemically synthesized
ggctcaagcgattctcctgcct

SEQ ID NO: 637784 - DNA, 22 bp, Artificial Sequence
  chemically synthesized
ctcgggaggatgaggcaggaga

SEQ ID NO: 637785 - DNA, 22 bp, Artificial Sequence
  chemically synthesized
aagcgattctcctgcctcatcc

SEQ ID NO: 637786 - DNA, 22 bp, Artificial Sequence
  chemically synthesized
tagtcccagctactcgggagga

SEQ ID NO: 637787 - DNA, 22 bp, Artificial Sequence
  chemically synthesized
tcctgcctcatcctcccgagta

SEQ ID NO: 637788 - DNA, 22 bp, Artificial Sequence
  chemically synthesized
ctgcctcatcctcccgagtagc

SEQ ID NO: 637789 - DNA, 22 bp, Artificial Sequence
  chemically synthesized
cctcatcctcccgagtagctgg

SEQ ID NO: 637790 - DNA, 22 bp, Artificial Sequence
  chemically synthesized
atcctcccgagtagctgggact

SEQ ID NO: 637791 - DNA, 22 bp, Artificial Sequence
  chemically synthesized
ccgagtagctgggactataggc

SEQ ID NO: 637792 - DNA, 22 bp, Artificial Sequence
  chemically synthesized
gccaggcatggtggtgggcgcc

SEQ ID NO: 637793 - DNA, 22 bp, Artificial Sequence
  chemically synthesized
ggactataggcgcccaccacca

SEQ ID NO: 637794 - DNA, 22 bp, Artificial Sequence
  chemically synthesized
taggcgcccaccaccatgcctg

SEQ ID NO: 637795 - DNA, 22 bp, Artificial Sequence
  chemically synthesized
aaaatagaaaaattagccaggc

SEQ ID NO: 637796 - DNA, 22 bp, Artificial Sequence
  chemically synthesized
ctaaaaatagaaaaattagcca

SEQ ID NO: 637797 - DNA, 22 bp, Artificial Sequence
  chemically synthesized
tactaaaaatagaaaaattagc

SEQ ID NO: 637798 - DNA, 22 bp, Artificial Sequence
  chemically synthesized
tctctactaaaaatagaaaaat

SEQ ID NO: 637799 - DNA, 22 bp, Artificial Sequence
  chemically synthesized
gctaatttttctatttttagta

SEQ ID NO: 637800 - DNA, 22 bp, Artificial Sequence
  chemically synthesized
atttttctatttttagtagaga

SEQ ID NO: 637801 - DNA, 22 bp, Artificial Sequence
  chemically synthesized
ttctatttttagtagagacagg

SEQ ID NO: 637802 - DNA, 22 bp, Artificial Sequence
  chemically synthesized
tctatttttagtagagacaggg

SEQ ID NO: 637803 - DNA, 22 bp, Artificial Sequence
  chemically synthesized
ctatttttagtagagacagggt

SEQ ID NO: 637804 - DNA, 22 bp, Artificial Sequence
  chemically synthesized
tatttttagtagagacagggtt

SEQ ID NO: 637805 - DNA, 22 bp, Artificial Sequence
  chemically synthesized
tttttagtagagacagggtttc

SEQ ID NO: 637806 - DNA, 22 bp, Artificial Sequence
  chemically synthesized
ttagtagagacagggtttcacc

SEQ ID NO: 637807 - DNA, 22 bp, Artificial Sequence
  chemically synthesized
tagtagagacagggtttcacca

SEQ ID NO: 637808 - DNA, 22 bp, Artificial Sequence
  chemically synthesized
agtagagacagggtttcaccat

SEQ ID NO: 637809 - DNA, 22 bp, Artificial Sequence
  chemically synthesized
gtagagacagggtttcaccata

SEQ ID NO: 637810 - DNA, 22 bp, Artificial Sequence
  chemically synthesized
aagaccagcccggccaatatgg

SEQ ID NO: 637811 - DNA, 22 bp, Artificial Sequence
  chemically synthesized
ggagttgaagaccagcccggcc

SEQ ID NO: 637812 - DNA, 22 bp, Artificial Sequence
  chemically synthesized
caccatattggccgggctggtc

SEQ ID NO: 637813 - DNA, 22 bp, Artificial Sequence
  chemically synthesized
accatattggccgggctggtct

SEQ ID NO: 637814 - DNA, 22 bp, Artificial Sequence
  chemically synthesized
gccgggctggtcttcaactcct

SEQ ID NO: 637815 - DNA, 22 bp, Artificial Sequence
  chemically synthesized
gtcttcaactcctaaccttgtg

SEQ ID NO: 637816 - DNA, 22 bp, Artificial Sequence
  chemically synthesized
caactcctaaccttgtgatccg

SEQ ID NO: 637817 - DNA, 22 bp, Artificial Sequence
  chemically synthesized
aactcctaaccttgtgatccgc

SEQ ID NO: 637818 - DNA, 22 bp, Artificial Sequence
  chemically synthesized
ggagggtgaggtgggcggatca

SEQ ID NO: 637819 - DNA, 22 bp, Artificial Sequence
  chemically synthesized
gggagggtgaggtgggcggatc

SEQ ID NO: 637820 - DNA, 22 bp, Artificial Sequence
  chemically synthesized
tgggagggtgaggtgggcggat

SEQ ID NO: 637821 - DNA, 22 bp, Artificial Sequence
  chemically synthesized
ctaaccttgtgatccgcccacc

SEQ ID NO: 637822 - DNA, 22 bp, Artificial Sequence
  chemically synthesized
accttgtgatccgcccacctca

SEQ ID NO: 637823 - DNA, 22 bp, Artificial Sequence
  chemically synthesized
gtgatccgcccacctcaccctc

SEQ ID NO: 637824 - DNA, 22 bp, Artificial Sequence
  chemically synthesized
tgatccgcccacctcaccctcc

SEQ ID NO: 637825 - DNA, 22 bp, Artificial Sequence
  chemically synthesized
taatcccagcactttgggaggg

SEQ ID NO: 637826 - DNA, 22 bp, Artificial Sequence
  chemically synthesized
acgcctgtaatcccagcacttt

SEQ ID NO: 637827 - DNA, 22 bp, Artificial Sequence
  chemically synthesized
accctcccaaagtgctgggatt

SEQ ID NO: 637828 - DNA, 22 bp, Artificial Sequence
  chemically synthesized
ccaaagtgctgggattacaggc

SEQ ID NO: 637829 - DNA, 22 bp, Artificial Sequence
  chemically synthesized
ggcgtggaggctcacgcctgta

SEQ ID NO: 637830 - DNA, 22 bp, Artificial Sequence
  chemically synthesized
ggattacaggcgtgagcctcca

SEQ ID NO: 637831 - DNA, 22 bp, Artificial Sequence
  chemically synthesized
ccagggggctgggcgtggaggc

SEQ ID NO: 637832 - DNA, 22 bp, Artificial Sequence
  chemically synthesized
gccagggggctgggcgtggagg

SEQ ID NO: 637833 - DNA, 22 bp, Artificial Sequence
  chemically synthesized
caggcgtgagcctccacgccca

SEQ ID NO: 637834 - DNA, 22 bp, Artificial Sequence
  chemically synthesized
taaaaatagacttgccaggggg

SEQ ID NO: 637835 - DNA, 22 bp, Artificial Sequence
  chemically synthesized
tataaaaatagacttgccaggg

SEQ ID NO: 637836 - DNA, 22 bp, Artificial Sequence
  chemically synthesized
cacgcccagccccctggcaagt

SEQ ID NO: 637837 - DNA, 22 bp, Artificial Sequence
  chemically synthesized
ttctataaaaatagacttgcca

SEQ ID NO: 637838 - DNA, 22 bp, Artificial Sequence
  chemically synthesized
tgagactattctataaaaatag

SEQ ID NO: 637839 - DNA, 22 bp, Artificial Sequence
  chemically synthesized
gcaagtctatttttatagaata

SEQ ID NO: 637840 - DNA, 22 bp, Artificial Sequence
  chemically synthesized
tttttatagaatagtctcacag

SEQ ID NO: 637841 - DNA, 22 bp, Artificial Sequence
  chemically synthesized
ttatagaatagtctcacagtcc

SEQ ID NO: 637842 - DNA, 22 bp, Artificial Sequence
  chemically synthesized
tatagaatagtctcacagtcct

SEQ ID NO: 637843 - DNA, 22 bp, Artificial Sequence
  chemically synthesized
atagaatagtctcacagtcctc

SEQ ID NO: 637844 - DNA, 22 bp, Artificial Sequence
  chemically synthesized
tagaatagtctcacagtcctct

SEQ ID NO: 637845 - DNA, 22 bp, Artificial Sequence
  chemically synthesized
agagatgtgggaggagaggact

SEQ ID NO: 637846 - DNA, 22 bp, Artificial Sequence
  chemically synthesized
gagagatgtgggaggagaggac

SEQ ID NO: 637847 - DNA, 22 bp, Artificial Sequence
  chemically synthesized
cacttgagagatgtgggaggag

SEQ ID NO: 637848 - DNA, 22 bp, Artificial Sequence
  chemically synthesized
acagtcctctcctcccacatct

SEQ ID NO: 637849 - DNA, 22 bp, Artificial Sequence
  chemically synthesized
agggcctgcacttgagagatgt

SEQ ID NO: 637850 - DNA, 22 bp, Artificial Sequence
  chemically synthesized
tgagggcctgcacttgagagat

SEQ ID NO: 637851 - DNA, 22 bp, Artificial Sequence
  chemically synthesized
tcctcccacatctctcaagtgc

SEQ ID NO: 637852 - DNA, 22 bp, Artificial Sequence
  chemically synthesized
ctcccacatctctcaagtgcag

SEQ ID NO: 637853 - DNA, 22 bp, Artificial Sequence
  chemically synthesized
ccacatctctcaagtgcaggcc

SEQ ID NO: 637854 - DNA, 22 bp, Artificial Sequence
  chemically synthesized
gtgagttctgagggcctgcact

SEQ ID NO: 637855 - DNA, 22 bp, Artificial Sequence
  chemically synthesized
tcaagtgcaggccctcagaact

SEQ ID NO: 637856 - DNA, 22 bp, Artificial Sequence
  chemically synthesized
aagtgcaggccctcagaactca

SEQ ID NO: 637857 - DNA, 22 bp, Artificial Sequence
  chemically synthesized
ccaaggccaagattggtgagtt

SEQ ID NO: 637858 - DNA, 22 bp, Artificial Sequence
  chemically synthesized
agaactcaccaatcttggcctt

SEQ ID NO: 637859 - DNA, 22 bp, Artificial Sequence
  chemically synthesized
ggaggcaattgccaaggccaag

SEQ ID NO: 637860 - DNA, 22 bp, Artificial Sequence
  chemically synthesized
accaatcttggccttggcaatt

SEQ ID NO: 637861 - DNA, 22 bp, Artificial Sequence
  chemically synthesized
ggccttggcaattgcctcctaa

SEQ ID NO: 637862 - DNA, 22 bp, Artificial Sequence
  chemically synthesized
gccttggcaattgcctcctaac

SEQ ID NO: 637863 - DNA, 22 bp, Artificial Sequence
  chemically synthesized
ggcaattgcctcctaactggtc

SEQ ID NO: 637864 - DNA, 22 bp, Artificial Sequence
  chemically synthesized
tataggtgagaagaccagttag

SEQ ID NO: 637865 - DNA, 22 bp, Artificial Sequence
  chemically synthesized
gcaattgcctcctaactggtct

SEQ ID NO: 637866 - DNA, 22 bp, Artificial Sequence
  chemically synthesized
gtataggtgagaagaccagtta

SEQ ID NO: 637867 - DNA, 22 bp, Artificial Sequence
  chemically synthesized
cctcctaactggtcttctcacc

SEQ ID NO: 637868 - DNA, 22 bp, Artificial Sequence
  chemically synthesized
ctaactggtcttctcacctata

SEQ ID NO: 637869 - DNA, 22 bp, Artificial Sequence
  chemically synthesized
actggtcttctcacctatacaa

SEQ ID NO: 637870 - DNA, 22 bp, Artificial Sequence
  chemically synthesized
gcccacagaaaacttgtatagg

SEQ ID NO: 637871 - DNA, 22 bp, Artificial Sequence
  chemically synthesized
gtcttctcacctatacaagttt

SEQ ID NO: 637872 - DNA, 22 bp, Artificial Sequence
  chemically synthesized
tctggcccacagaaaacttgta

SEQ ID NO: 637873 - DNA, 22 bp, Artificial Sequence
  chemically synthesized
tatctggcccacagaaaacttg

SEQ ID NO: 637874 - DNA, 22 bp, Artificial Sequence
  chemically synthesized
ctcacctatacaagttttctgt

SEQ ID NO: 637875 - DNA, 22 bp, Artificial Sequence
  chemically synthesized
tcacctatacaagttttctgtg

SEQ ID NO: 637876 - DNA, 22 bp, Artificial Sequence
  chemically synthesized
acctatacaagttttctgtggg

SEQ ID NO: 637877 - DNA, 22 bp, Artificial Sequence
  chemically synthesized
gcagctctatctggcccacaga

SEQ ID NO: 637878 - DNA, 22 bp, Artificial Sequence
  chemically synthesized
tggcagctctatctggcccaca

SEQ ID NO: 637879 - DNA, 22 bp, Artificial Sequence
  chemically synthesized
tacaagttttctgtgggccaga

SEQ ID NO: 637880 - DNA, 22 bp, Artificial Sequence
  chemically synthesized
tctgtgggccagatagagctgc

SEQ ID NO: 637881 - DNA, 22 bp, Artificial Sequence
  chemically synthesized
ctgtgggccagatagagctgcc

SEQ ID NO: 637882 - DNA, 22 bp, Artificial Sequence
  chemically synthesized
tgtgggccagatagagctgcca

SEQ ID NO: 637883 - DNA, 22 bp, Artificial Sequence
  chemically synthesized
aaaaggtgtattctggcagctc

SEQ ID NO: 637884 - DNA, 22 bp, Artificial Sequence
  chemically synthesized
tgggccagatagagctgccaga

SEQ ID NO: 637885 - DNA, 22 bp, Artificial Sequence
  chemically synthesized
taaaaaggtgtattctggcagc

SEQ ID NO: 637886 - DNA, 22 bp, Artificial Sequence
  chemically synthesized
aaaagaaaattctaaaaaggtg

SEQ ID NO: 637887 - DNA, 22 bp, Artificial Sequence
  chemically synthesized
ccagaatacacctttttagaat

SEQ ID NO: 637888 - DNA, 22 bp, Artificial Sequence
  chemically synthesized
tttagaattttctttttagact

SEQ ID NO: 637889 - DNA, 22 bp, Artificial Sequence
  chemically synthesized
ttagaattttctttttagactt

SEQ ID NO: 637890 - DNA, 22 bp, Artificial Sequence
  chemically synthesized
tagaattttctttttagacttt

SEQ ID NO: 637891 - DNA, 22 bp, Artificial Sequence
  chemically synthesized
agaattttctttttagactttt

SEQ ID NO: 637892 - DNA, 22 bp, Artificial Sequence
  chemically synthesized
gaattttctttttagacttttt

SEQ ID NO: 637893 - DNA, 22 bp, Artificial Sequence
  chemically synthesized
tctttttagacttttttcgcct

SEQ ID NO: 637894 - DNA, 22 bp, Artificial Sequence
  chemically synthesized
ctttttagacttttttcgcctg

SEQ ID NO: 637895 - DNA, 22 bp, Artificial Sequence
  chemically synthesized
aaaatcatataccaggcgaaaa

SEQ ID NO: 637896 - DNA, 22 bp, Artificial Sequence
  chemically synthesized
tttttagacttttttcgcctgg

SEQ ID NO: 637897 - DNA, 22 bp, Artificial Sequence
  chemically synthesized
tttagacttttttcgcctggta

SEQ ID NO: 637898 - DNA, 22 bp, Artificial Sequence
  chemically synthesized
ttagacttttttcgcctggtat

SEQ ID NO: 637899 - DNA, 22 bp, Artificial Sequence
  chemically synthesized
tagacttttttcgcctggtata

SEQ ID NO: 637900 - DNA, 22 bp, Artificial Sequence
  chemically synthesized
agacttttttcgcctggtatat

SEQ ID NO: 637901 - DNA, 22 bp, Artificial Sequence
  chemically synthesized
gacttttttcgcctggtatatg

SEQ ID NO: 637902 - DNA, 22 bp, Artificial Sequence
  chemically synthesized
ttttcgcctggtatatgatttt

SEQ ID NO: 637903 - DNA, 22 bp, Artificial Sequence
  chemically synthesized
tttcgcctggtatatgattttc

SEQ ID NO: 637904 - DNA, 22 bp, Artificial Sequence
  chemically synthesized
ttcgcctggtatatgattttca

SEQ ID NO: 637905 - DNA, 22 bp, Artificial Sequence
  chemically synthesized
tcgcctggtatatgattttcag

SEQ ID NO: 637906 - DNA, 22 bp, Artificial Sequence
  chemically synthesized
cgcctggtatatgattttcagt

SEQ ID NO: 637907 - DNA, 22 bp, Artificial Sequence
  chemically synthesized
gcctggtatatgattttcagtg

SEQ ID NO: 637908 - DNA, 22 bp, Artificial Sequence
  chemically synthesized
gtatcagggagccactgaaaat

SEQ ID NO: 637909 - DNA, 22 bp, Artificial Sequence
  chemically synthesized
ggtatcagggagccactgaaaa

SEQ ID NO: 637910 - DNA, 22 bp, Artificial Sequence
  chemically synthesized
gtatatgattttcagtggctcc

SEQ ID NO: 637911 - DNA, 22 bp, Artificial Sequence
  chemically synthesized
atcttggtatcagggagccact

SEQ ID NO: 637912 - DNA, 22 bp, Artificial Sequence
  chemically synthesized
actcatcttggtatcagggagc

SEQ ID NO: 637913 - DNA, 22 bp, Artificial Sequence
  chemically synthesized
gactcatcttggtatcagggag

SEQ ID NO: 637914 - DNA, 22 bp, Artificial Sequence
  chemically synthesized
tcagtggctccctgataccaag

SEQ ID NO: 637915 - DNA, 22 bp, Artificial Sequence
  chemically synthesized
cagtggctccctgataccaaga

SEQ ID NO: 637916 - DNA, 22 bp, Artificial Sequence
  chemically synthesized
agtggctccctgataccaagat

SEQ ID NO: 637917 - DNA, 22 bp, Artificial Sequence
  chemically synthesized
gccgtaagtgtttgactcatct

SEQ ID NO: 637918 - DNA, 22 bp, Artificial Sequence
  chemically synthesized
ggccgtaagtgtttgactcatc

SEQ ID NO: 637919 - DNA, 22 bp, Artificial Sequence
  chemically synthesized
cctgataccaagatgagtcaaa

SEQ ID NO: 637920 - DNA, 22 bp, Artificial Sequence
  chemically synthesized
ataccaagatgagtcaaacact

SEQ ID NO: 637921 - DNA, 22 bp, Artificial Sequence
  chemically synthesized
cagggacatgaatatttggccg

SEQ ID NO: 637922 - DNA, 22 bp, Artificial Sequence
  chemically synthesized
acggccaaatattcatgtccct

SEQ ID NO: 637923 - DNA, 22 bp, Artificial Sequence
  chemically synthesized
cggccaaatattcatgtccctg

SEQ ID NO: 637924 - DNA, 22 bp, Artificial Sequence
  chemically synthesized
aagaaaggtagagtcgtattac

SEQ ID NO: 637925 - DNA, 22 bp, Artificial Sequence
  chemically synthesized
atgtccctgtaatacgactcta

SEQ ID NO: 637926 - DNA, 22 bp, Artificial Sequence
  chemically synthesized
tctgaagaaaggtagagtcgta

SEQ ID NO: 637927 - DNA, 22 bp, Artificial Sequence
  chemically synthesized
ttgtctgaagaaaggtagagtc

SEQ ID NO: 637928 - DNA, 22 bp, Artificial Sequence
  chemically synthesized
gttgtctgaagaaaggtagagt

SEQ ID NO: 637929 - DNA, 22 bp, Artificial Sequence
  chemically synthesized
tgttgtctgaagaaaggtagag

SEQ ID NO: 637930 - DNA, 22 bp, Artificial Sequence
  chemically synthesized
taatacgactctacctttcttc

SEQ ID NO: 637931 - DNA, 22 bp, Artificial Sequence
  chemically synthesized
agattttgttgtctgaagaaag

SEQ ID NO: 637932 - DNA, 22 bp, Artificial Sequence
  chemically synthesized
tcagattttgttgtctgaagaa

SEQ ID NO: 637933 - DNA, 22 bp, Artificial Sequence
  chemically synthesized
ctctcagattttgttgtctgaa

SEQ ID NO: 637934 - DNA, 22 bp, Artificial Sequence
  chemically synthesized
tacctttcttcagacaacaaaa

SEQ ID NO: 637935 - DNA, 22 bp, Artificial Sequence
  chemically synthesized
gctactctcagattttgttgtc

SEQ ID NO: 637936 - DNA, 22 bp, Artificial Sequence
  chemically synthesized
cctttcttcagacaacaaaatc

SEQ ID NO: 637937 - DNA, 22 bp, Artificial Sequence
  chemically synthesized
tcttcagacaacaaaatctgag

SEQ ID NO: 637938 - DNA, 22 bp, Artificial Sequence
  chemically synthesized
cttcagacaacaaaatctgaga

SEQ ID NO: 637939 - DNA, 22 bp, Artificial Sequence
  chemically synthesized
ttcagacaacaaaatctgagag

SEQ ID NO: 637940 - DNA, 22 bp, Artificial Sequence
  chemically synthesized
cagacaacaaaatctgagagta

SEQ ID NO: 637941 - DNA, 22 bp, Artificial Sequence
  chemically synthesized
agacaacaaaatctgagagtag

SEQ ID NO: 637942 - DNA, 22 bp, Artificial Sequence
  chemically synthesized
catgggtaagtgtcctagctac

SEQ ID NO: 637943 - DNA, 22 bp, Artificial Sequence
  chemically synthesized
ggactccatgggtaagtgtcct

SEQ ID NO: 637944 - DNA, 22 bp, Artificial Sequence
  chemically synthesized
cggactccatgggtaagtgtcc

SEQ ID NO: 637945 - DNA, 22 bp, Artificial Sequence
  chemically synthesized
agagtagctaggacacttaccc

SEQ ID NO: 637946 - DNA, 22 bp, Artificial Sequence
  chemically synthesized
ggacacttacccatggagtccg

SEQ ID NO: 637947 - DNA, 22 bp, Artificial Sequence
  chemically synthesized
gcagtcaaacttcggactccat

SEQ ID NO: 637948 - DNA, 22 bp, Artificial Sequence
  chemically synthesized
acccatggagtccgaagtttga

SEQ ID NO: 637949 - DNA, 22 bp, Artificial Sequence
  chemically synthesized
cccatggagtccgaagtttgac

SEQ ID NO: 637950 - DNA, 22 bp, Artificial Sequence
  chemically synthesized
cgagtggttggcagtcaaactt

SEQ ID NO: 637951 - DNA, 22 bp, Artificial Sequence
  chemically synthesized
ctccgagtggttggcagtcaaa

SEQ ID NO: 637952 - DNA, 22 bp, Artificial Sequence
  chemically synthesized
tgctgctccgagtggttggcag

SEQ ID NO: 637953 - DNA, 22 bp, Artificial Sequence
  chemically synthesized
gactgccaaccactcggagcag

SEQ ID NO: 637954 - DNA, 22 bp, Artificial Sequence
  chemically synthesized
actgccaaccactcggagcagc

SEQ ID NO: 637955 - DNA, 22 bp, Artificial Sequence
  chemically synthesized
ccaaccactcggagcagcatag

SEQ ID NO: 637956 - DNA, 22 bp, Artificial Sequence
  chemically synthesized
ggagcagcataggctgactgct

SEQ ID NO: 637957 - DNA, 22 bp, Artificial Sequence
  chemically synthesized
cagaggtccgacagcagtcagc

SEQ ID NO: 637958 - DNA, 22 bp, Artificial Sequence
  chemically synthesized
tacagaggtccgacagcagtca

SEQ ID NO: 637959 - DNA, 22 bp, Artificial Sequence
  chemically synthesized
tctacagaggtccgacagcagt

SEQ ID NO: 637960 - DNA, 22 bp, Artificial Sequence
  chemically synthesized
cctctctacagaggtccgacag

SEQ ID NO: 637961 - DNA, 22 bp, Artificial Sequence
  chemically synthesized
tacctctctacagaggtccgac

SEQ ID NO: 637962 - DNA, 22 bp, Artificial Sequence
  chemically synthesized
ctacctctctacagaggtccga

SEQ ID NO: 637963 - DNA, 22 bp, Artificial Sequence
  chemically synthesized
cttctacctctctacagaggtc

SEQ ID NO: 637964 - DNA, 22 bp, Artificial Sequence
  chemically synthesized
actgctgtcggacctctgtaga

SEQ ID NO: 637965 - DNA, 22 bp, Artificial Sequence
  chemically synthesized
tccttctacctctctacagagg

SEQ ID NO: 637966 - DNA, 22 bp, Artificial Sequence
  chemically synthesized
ctgtcggacctctgtagagagg

SEQ ID NO: 637967 - DNA, 22 bp, Artificial Sequence
  chemically synthesized
tcggacctctgtagagaggtag

SEQ ID NO: 637968 - DNA, 22 bp, Artificial Sequence
  chemically synthesized
tgtagagaggtagaaggagagg

SEQ ID NO: 637969 - DNA, 22 bp, Artificial Sequence
  chemically synthesized
tagagaggtagaaggagaggac

SEQ ID NO: 637970 - DNA, 22 bp, Artificial Sequence
  chemically synthesized
gccccaggcagaggccaaagtg

SEQ ID NO: 637971 - DNA, 22 bp, Artificial Sequence
  chemically synthesized
agccccaggcagaggccaaagt

SEQ ID NO: 637972 - DNA, 22 bp, Artificial Sequence
  chemically synthesized
tgccattcactttggcctctgc

SEQ ID NO: 637973 - DNA, 22 bp, Artificial Sequence
  chemically synthesized
gatgacttagccccaggcagag

SEQ ID NO: 637974 - DNA, 22 bp, Artificial Sequence
  chemically synthesized
ggatgacttagccccaggcaga

SEQ ID NO: 637975 - DNA, 22 bp, Artificial Sequence
  chemically synthesized
tggatgacttagccccaggcag

SEQ ID NO: 637976 - DNA, 22 bp, Artificial Sequence
  chemically synthesized
ttggatgacttagccccaggca

SEQ ID NO: 637977 - DNA, 22 bp, Artificial Sequence
  chemically synthesized
actttggcctctgcctggggct

SEQ ID NO: 637978 - DNA, 22 bp, Artificial Sequence
  chemically synthesized
ttttggatgacttagccccagg

SEQ ID NO: 637979 - DNA, 22 bp, Artificial Sequence
  chemically synthesized
cttttggatgacttagccccag

SEQ ID NO: 637980 - DNA, 22 bp, Artificial Sequence
  chemically synthesized
tcttttggatgacttagcccca

SEQ ID NO: 637981 - DNA, 22 bp, Artificial Sequence
  chemically synthesized
tggcctctgcctggggctaagt

SEQ ID NO: 637982 - DNA, 22 bp, Artificial Sequence
  chemically synthesized
ggcctctgcctggggctaagtc

SEQ ID NO: 637983 - DNA, 22 bp, Artificial Sequence
  chemically synthesized
gcctctgcctggggctaagtca

SEQ ID NO: 637984 - DNA, 22 bp, Artificial Sequence
  chemically synthesized
ttttcttttggatgacttagcc

SEQ ID NO: 637985 - DNA, 22 bp, Artificial Sequence
  chemically synthesized
tgttttcttttggatgacttag

SEQ ID NO: 637986 - DNA, 22 bp, Artificial Sequence
  chemically synthesized
tgcctggggctaagtcatccaa

SEQ ID NO: 637987 - DNA, 22 bp, Artificial Sequence
  chemically synthesized
cctggggctaagtcatccaaaa

SEQ ID NO: 637988 - DNA, 22 bp, Artificial Sequence
  chemically synthesized
gggctaagtcatccaaaagaaa

SEQ ID NO: 637989 - DNA, 22 bp, Artificial Sequence
  chemically synthesized
tgaaaagtaattctgttttctt

SEQ ID NO: 637990 - DNA, 22 bp, Artificial Sequence
  chemically synthesized
agtcatccaaaagaaaacagaa

SEQ ID NO: 637991 - DNA, 22 bp, Artificial Sequence
  chemically synthesized
ttatgaaaagtaattctgtttt

SEQ ID NO: 637992 - DNA, 22 bp, Artificial Sequence
  chemically synthesized
attatgaaaagtaattctgttt

SEQ ID NO: 637993 - DNA, 22 bp, Artificial Sequence
  chemically synthesized
tatgtttattatgaaaagtaat

SEQ ID NO: 637994 - DNA, 22 bp, Artificial Sequence
  chemically synthesized
gtatgtttattatgaaaagtaa

SEQ ID NO: 637995 - DNA, 22 bp, Artificial Sequence
  chemically synthesized
tacatttgtatgtttattatga

SEQ ID NO: 637996 - DNA, 22 bp, Artificial Sequence
  chemically synthesized
atacatttgtatgtttattatg

SEQ ID NO: 637997 - DNA, 22 bp, Artificial Sequence
  chemically synthesized
aaatttatacatttgtatgttt

SEQ ID NO: 637998 - DNA, 22 bp, Artificial Sequence
  chemically synthesized
cttttcataataaacatacaaa

SEQ ID NO: 637999 - DNA, 22 bp, Artificial Sequence
  chemically synthesized
gaaatttatacatttgtatgtt

SEQ ID NO: 638000 - DNA, 22 bp, Artificial Sequence
  chemically synthesized
tgaaatttatacatttgtatgt

SEQ ID NO: 638001 - DNA, 22 bp, Artificial Sequence
  chemically synthesized
ttcataataaacatacaaatgt

SEQ ID NO: 638002 - DNA, 22 bp, Artificial Sequence
  chemically synthesized
tcataataaacatacaaatgta

SEQ ID NO: 638003 - DNA, 22 bp, Artificial Sequence
  chemically synthesized
cataataaacatacaaatgtat

SEQ ID NO: 638004 - DNA, 22 bp, Artificial Sequence
  chemically synthesized
ataataaacatacaaatgtata

SEQ ID NO: 638005 - DNA, 22 bp, Artificial Sequence
  chemically synthesized
agtgtgtatcatattttgaaat

SEQ ID NO: 638006 - DNA, 22 bp, Artificial Sequence
  chemically synthesized
tgagtcctgagtgtgtatcata

SEQ ID NO: 638007 - DNA, 22 bp, Artificial Sequence
  chemically synthesized
atgagtcctgagtgtgtatcat

SEQ ID NO: 638008 - DNA, 22 bp, Artificial Sequence
  chemically synthesized
caaaatatgatacacactcagg

SEQ ID NO: 638009 - DNA, 22 bp, Artificial Sequence
  chemically synthesized
aaaatatgatacacactcagga

SEQ ID NO: 638010 - DNA, 22 bp, Artificial Sequence
  chemically synthesized
aagtaggaagggtcaaaattta

SEQ ID NO: 638011 - DNA, 22 bp, Artificial Sequence
  chemically synthesized
taaagtaggaagggtcaaaatt

SEQ ID NO: 638012 - DNA, 22 bp, Artificial Sequence
  chemically synthesized
ctaaagtaggaagggtcaaaat

SEQ ID NO: 638013 - DNA, 22 bp, Artificial Sequence
  chemically synthesized
aggactcataaattttgaccct

SEQ ID NO: 638014 - DNA, 22 bp, Artificial Sequence
  chemically synthesized
ataaattttgacccttcctact

SEQ ID NO: 638015 - DNA, 22 bp, Artificial Sequence
  chemically synthesized
ggagggcttctaaagtaggaag

SEQ ID NO: 638016 - DNA, 22 bp, Artificial Sequence
  chemically synthesized
gggagggcttctaaagtaggaa

SEQ ID NO: 638017 - DNA, 22 bp, Artificial Sequence
  chemically synthesized
tgggagggcttctaaagtagga

SEQ ID NO: 638018 - DNA, 22 bp, Artificial Sequence
  chemically synthesized
tgacccttcctactttagaagc

SEQ ID NO: 638019 - DNA, 22 bp, Artificial Sequence
  chemically synthesized
gacccttcctactttagaagcc

SEQ ID NO: 638020 - DNA, 22 bp, Artificial Sequence
  chemically synthesized
acccttcctactttagaagccc

SEQ ID NO: 638021 - DNA, 22 bp, Artificial Sequence
  chemically synthesized
aacaatctttgggagggcttct

SEQ ID NO: 638022 - DNA, 22 bp, Artificial Sequence
  chemically synthesized
cctactttagaagccctcccaa

SEQ ID NO: 638023 - DNA, 22 bp, Artificial Sequence
  chemically synthesized
ctactttagaagccctcccaaa

SEQ ID NO: 638024 - DNA, 22 bp, Artificial Sequence
  chemically synthesized
ctttagaagccctcccaaagat

SEQ ID NO: 638025 - DNA, 22 bp, Artificial Sequence
  chemically synthesized
tagaagccctcccaaagattgt

SEQ ID NO: 638026 - DNA, 22 bp, Artificial Sequence
  chemically synthesized
agaagccctcccaaagattgtt

SEQ ID NO: 638027 - DNA, 22 bp, Artificial Sequence
  chemically synthesized
gaagccctcccaaagattgttt

SEQ ID NO: 638028 - DNA, 22 bp, Artificial Sequence
  chemically synthesized
ccaaagattgtttaatttggga

SEQ ID NO: 638029 - DNA, 22 bp, Artificial Sequence
  chemically synthesized
tatcaacagtgaaatatcccaa

SEQ ID NO: 638030 - DNA, 22 bp, Artificial Sequence
  chemically synthesized
tttaatttgggatatttcactg

SEQ ID NO: 638031 - DNA, 22 bp, Artificial Sequence
  chemically synthesized
tggattatatcaacagtgaaat

SEQ ID NO: 638032 - DNA, 22 bp, Artificial Sequence
  chemically synthesized
aatttgggatatttcactgttg

SEQ ID NO: 638033 - DNA, 22 bp, Artificial Sequence
  chemically synthesized
tatggattatatcaacagtgaa

SEQ ID NO: 638034 - DNA, 22 bp, Artificial Sequence
  chemically synthesized
atttgggatatttcactgttga

SEQ ID NO: 638035 - DNA, 22 bp, Artificial Sequence
  chemically synthesized
ctatggattatatcaacagtga

SEQ ID NO: 638036 - DNA, 22 bp, Artificial Sequence
  chemically synthesized
gggatatttcactgttgatata

SEQ ID NO: 638037 - DNA, 22 bp, Artificial Sequence
  chemically synthesized
ggatatttcactgttgatataa

SEQ ID NO: 638038 - DNA, 22 bp, Artificial Sequence
  chemically synthesized
cactgttgatataatccataga

SEQ ID NO: 638039 - DNA, 22 bp, Artificial Sequence
  chemically synthesized
actgttgatataatccatagaa

SEQ ID NO: 638040 - DNA, 22 bp, Artificial Sequence
  chemically synthesized
agatacaaagacagtttctatg

SEQ ID NO: 638041 - DNA, 22 bp, Artificial Sequence
  chemically synthesized
ttgatataatccatagaaactg

SEQ ID NO: 638042 - DNA, 22 bp, Artificial Sequence
  chemically synthesized
atataatccatagaaactgtct

SEQ ID NO: 638043 - DNA, 22 bp, Artificial Sequence
  chemically synthesized
taagggagcacaattcagatac

SEQ ID NO: 638044 - DNA, 22 bp, Artificial Sequence
  chemically synthesized
ataagggagcacaattcagata

SEQ ID NO: 638045 - DNA, 22 bp, Artificial Sequence
  chemically synthesized
tctttgtatctgaattgtgctc

SEQ ID NO: 638046 - DNA, 22 bp, Artificial Sequence
  chemically synthesized
aaatttataagggagcacaatt

SEQ ID NO: 638047 - DNA, 22 bp, Artificial Sequence
  chemically synthesized
tcaaatttataagggagcacaa

SEQ ID NO: 638048 - DNA, 22 bp, Artificial Sequence
  chemically synthesized
ctcaaatttataagggagcaca

SEQ ID NO: 638049 - DNA, 22 bp, Artificial Sequence
  chemically synthesized
tgtatctgaattgtgctccctt

SEQ ID NO: 638050 - DNA, 22 bp, Artificial Sequence
  chemically synthesized
tctcaaatttataagggagcac

SEQ ID NO: 638051 - DNA, 22 bp, Artificial Sequence
  chemically synthesized
gtatctgaattgtgctccctta

SEQ ID NO: 638052 - DNA, 22 bp, Artificial Sequence
  chemically synthesized
ttctcaaatttataagggagca

SEQ ID NO: 638053 - DNA, 22 bp, Artificial Sequence
  chemically synthesized
tatctgaattgtgctcccttat

SEQ ID NO: 638054 - DNA, 22 bp, Artificial Sequence
  chemically synthesized
tttctcaaatttataagggagc

SEQ ID NO: 638055 - DNA, 22 bp, Artificial Sequence
  chemically synthesized
ttttctcaaatttataagggag

SEQ ID NO: 638056 - DNA, 22 bp, Artificial Sequence
  chemically synthesized
atttttttctcaaatttataag

SEQ ID NO: 638057 - DNA, 22 bp, Artificial Sequence
  chemically synthesized
aattgtgctcccttataaattt

SEQ ID NO: 638058 - DNA, 22 bp, Artificial Sequence
  chemically synthesized
tgatttttttctcaaatttata

SEQ ID NO: 638059 - DNA, 22 bp, Artificial Sequence
  chemically synthesized
tgctcccttataaatttgagaa

SEQ ID NO: 638060 - DNA, 22 bp, Artificial Sequence
  chemically synthesized
ccttataaatttgagaaaaaaa

SEQ ID NO: 638061 - DNA, 22 bp, Artificial Sequence
  chemically synthesized
cagtgtagctctgatttttttc

SEQ ID NO: 638062 - DNA, 22 bp, Artificial Sequence
  chemically synthesized
ataaatttgagaaaaaaatcag

SEQ ID NO: 638063 - DNA, 22 bp, Artificial Sequence
  chemically synthesized
taaatttgagaaaaaaatcaga

SEQ ID NO: 638064 - DNA, 22 bp, Artificial Sequence
  chemically synthesized
attccagtgtagctctgatttt

SEQ ID NO: 638065 - DNA, 22 bp, Artificial Sequence
  chemically synthesized
gagaaaaaaatcagagctacac

SEQ ID NO: 638066 - DNA, 22 bp, Artificial Sequence
  chemically synthesized
agaaaaaaatcagagctacact

SEQ ID NO: 638067 - DNA, 22 bp, Artificial Sequence
  chemically synthesized
atgtaatgatgtatagtctcat

SEQ ID NO: 638068 - DNA, 22 bp, Artificial Sequence
  chemically synthesized
aatgtaatgatgtatagtctca

SEQ ID NO: 638069 - DNA, 22 bp, Artificial Sequence
  chemically synthesized
tttaatgtaatgatgtatagtc

SEQ ID NO: 638070 - DNA, 22 bp, Artificial Sequence
  chemically synthesized
cactggaatgagactatacatc

SEQ ID NO: 638071 - DNA, 22 bp, Artificial Sequence
  chemically synthesized
gaatgagactatacatcattac

SEQ ID NO: 638072 - DNA, 22 bp, Artificial Sequence
  chemically synthesized
cagttatttaatgtaatgatgt

SEQ ID NO: 638073 - DNA, 22 bp, Artificial Sequence
  chemically synthesized
ccagttatttaatgtaatgatg

SEQ ID NO: 638074 - DNA, 22 bp, Artificial Sequence
  chemically synthesized
aatcttccagttatttaatgta

SEQ ID NO: 638075 - DNA, 22 bp, Artificial Sequence
  chemically synthesized
taaatcttccagttatttaatg

SEQ ID NO: 638076 - DNA, 22 bp, Artificial Sequence
  chemically synthesized
ctaaatcttccagttatttaat

SEQ ID NO: 638077 - DNA, 22 bp, Artificial Sequence
  chemically synthesized
tacatcattacattaaataact

SEQ ID NO: 638078 - DNA, 22 bp, Artificial Sequence
  chemically synthesized
cattaaataactggaagattta

SEQ ID NO: 638079 - DNA, 22 bp, Artificial Sequence
  chemically synthesized
acacatgaccttctaaatcttc

SEQ ID NO: 638080 - DNA, 22 bp, Artificial Sequence
  chemically synthesized
aataactggaagatttagaagg

SEQ ID NO: 638081 - DNA, 22 bp, Artificial Sequence
  chemically synthesized
atcattcacacatgaccttcta

SEQ ID NO: 638082 - DNA, 22 bp, Artificial Sequence
  chemically synthesized
gaagatttagaaggtcatgtgt

SEQ ID NO: 638083 - DNA, 22 bp, Artificial Sequence
  chemically synthesized
acatagtctcatcattcacaca

SEQ ID NO: 638084 - DNA, 22 bp, Artificial Sequence
  chemically synthesized
agaaggtcatgtgtgaatgatg

SEQ ID NO: 638085 - DNA, 22 bp, Artificial Sequence
  chemically synthesized
gaaggtcatgtgtgaatgatga

SEQ ID NO: 638086 - DNA, 22 bp, Artificial Sequence
  chemically synthesized
agatctcacatagtctcatcat

SEQ ID NO: 638087 - DNA, 22 bp, Artificial Sequence
  chemically synthesized
gagatctcacatagtctcatca

SEQ ID NO: 638088 - DNA, 22 bp, Artificial Sequence
  chemically synthesized
tgagatctcacatagtctcatc

SEQ ID NO: 638089 - DNA, 22 bp, Artificial Sequence
  chemically synthesized
cagttttgagatctcacatagt

SEQ ID NO: 638090 - DNA, 22 bp, Artificial Sequence
  chemically synthesized
cattacagttttgagatctcac

SEQ ID NO: 638091 - DNA, 22 bp, Artificial Sequence
  chemically synthesized
ccattacagttttgagatctca

SEQ ID NO: 638092 - DNA, 22 bp, Artificial Sequence
  chemically synthesized
tgtgagatctcaaaactgtaat

SEQ ID NO: 638093 - DNA, 22 bp, Artificial Sequence
  chemically synthesized
acaaagatatgaatcttccatt

SEQ ID NO: 638094 - DNA, 22 bp, Artificial Sequence
  chemically synthesized
cacaaagatatgaatcttccat

SEQ ID NO: 638095 - DNA, 22 bp, Artificial Sequence
  chemically synthesized
aaaactgtaatggaagattcat

SEQ ID NO: 638096 - DNA, 22 bp, Artificial Sequence
  chemically synthesized
atacttcacaaagatatgaatc

SEQ ID NO: 638097 - DNA, 22 bp, Artificial Sequence
  chemically synthesized
aatacttcacaaagatatgaat

SEQ ID NO: 638098 - DNA, 22 bp, Artificial Sequence
  chemically synthesized
taatggaagattcatatctttg

SEQ ID NO: 638099 - DNA, 22 bp, Artificial Sequence
  chemically synthesized
cttaatacttcacaaagatatg

SEQ ID NO: 638100 - DNA, 22 bp, Artificial Sequence
  chemically synthesized
ttacttaatacttcacaaagat

SEQ ID NO: 638101 - DNA, 22 bp, Artificial Sequence
  chemically synthesized
gttacttaatacttcacaaaga

SEQ ID NO: 638102 - DNA, 22 bp, Artificial Sequence
  chemically synthesized
tcttgttacttaatacttcaca

SEQ ID NO: 638103 - DNA, 22 bp, Artificial Sequence
  chemically synthesized
tatcttgttacttaatacttca

SEQ ID NO: 638104 - DNA, 22 bp, Artificial Sequence
  chemically synthesized
tctatcttgttacttaatactt

SEQ ID NO: 638105 - DNA, 22 bp, Artificial Sequence
  chemically synthesized
atatctttgtgaagtattaagt

SEQ ID NO: 638106 - DNA, 22 bp, Artificial Sequence
  chemically synthesized
tctctatcttgttacttaatac

SEQ ID NO: 638107 - DNA, 22 bp, Artificial Sequence
  chemically synthesized
tgttctctctatcttgttactt

SEQ ID NO: 638108 - DNA, 22 bp, Artificial Sequence
  chemically synthesized
tgtgaagtattaagtaacaaga

SEQ ID NO: 638109 - DNA, 22 bp, Artificial Sequence
  chemically synthesized
gtgaagtattaagtaacaagat

SEQ ID NO: 638110 - DNA, 22 bp, Artificial Sequence
  chemically synthesized
tgaagtattaagtaacaagata

SEQ ID NO: 638111 - DNA, 22 bp, Artificial Sequence
  chemically synthesized
aattatgttctctctatcttgt

SEQ ID NO: 638112 - DNA, 22 bp, Artificial Sequence
  chemically synthesized
caattatgttctctctatcttg

SEQ ID NO: 638113 - DNA, 22 bp, Artificial Sequence
  chemically synthesized
tcaattatgttctctctatctt

SEQ ID NO: 638114 - DNA, 22 bp, Artificial Sequence
  chemically synthesized
ttcaattatgttctctctatct

SEQ ID NO: 638115 - DNA, 22 bp, Artificial Sequence
  chemically synthesized
agtaacaagatagagagaacat

SEQ ID NO: 638116 - DNA, 22 bp, Artificial Sequence
  chemically synthesized
aatttttcaattatgttctctc

SEQ ID NO: 638117 - DNA, 22 bp, Artificial Sequence
  chemically synthesized
aaatttttcaattatgttctct

SEQ ID NO: 638118 - DNA, 22 bp, Artificial Sequence
  chemically synthesized
taaatttttcaattatgttctc

SEQ ID NO: 638119 - DNA, 22 bp, Artificial Sequence
  chemically synthesized
ggaattttaaatttttcaatta

SEQ ID NO: 638120 - DNA, 22 bp, Artificial Sequence
  chemically synthesized
tgggaattttaaatttttcaat

SEQ ID NO: 638121 - DNA, 22 bp, Artificial Sequence
  chemically synthesized
ctgggaattttaaatttttcaa

SEQ ID NO: 638122 - DNA, 22 bp, Artificial Sequence
  chemically synthesized
tctgggaattttaaatttttca

SEQ ID NO: 638123 - DNA, 22 bp, Artificial Sequence
  chemically synthesized
gctttctgggaattttaaattt

SEQ ID NO: 638124 - DNA, 22 bp, Artificial Sequence
  chemically synthesized
tggctttctgggaattttaaat

SEQ ID NO: 638125 - DNA, 22 bp, Artificial Sequence
  chemically synthesized
aaaaatttaaaattcccagaaa

SEQ ID NO: 638126 - DNA, 22 bp, Artificial Sequence
  chemically synthesized
gacatagttctggctttctggg

SEQ ID NO: 638127 - DNA, 22 bp, Artificial Sequence
  chemically synthesized
cctggacatagttctggctttc

SEQ ID NO: 638128 - DNA, 22 bp, Artificial Sequence
  chemically synthesized
aaaattcccagaaagccagaac

SEQ ID NO: 638129 - DNA, 22 bp, Artificial Sequence
  chemically synthesized
aaattcccagaaagccagaact

SEQ ID NO: 638130 - DNA, 22 bp, Artificial Sequence
  chemically synthesized
ccagaaagccagaactatgtcc

SEQ ID NO: 638131 - DNA, 22 bp, Artificial Sequence
  chemically synthesized
taagaggacctacctggacata

SEQ ID NO: 638132 - DNA, 22 bp, Artificial Sequence
  chemically synthesized
cattgtaagaggacctacctgg

SEQ ID NO: 638133 - DNA, 22 bp, Artificial Sequence
  chemically synthesized
tgtccaggtaggtcctcttaca

SEQ ID NO: 638134 - DNA, 22 bp, Artificial Sequence
  chemically synthesized
gcaagatactgcattgtaagag

SEQ ID NO: 638135 - DNA, 22 bp, Artificial Sequence
  chemically synthesized
catcgaaaacctagcaagatac

SEQ ID NO: 638136 - DNA, 22 bp, Artificial Sequence
  chemically synthesized
ttacaatgcagtatcttgctag

SEQ ID NO: 638137 - DNA, 22 bp, Artificial Sequence
  chemically synthesized
acaatgcagtatcttgctaggt

SEQ ID NO: 638138 - DNA, 22 bp, Artificial Sequence
  chemically synthesized
caatgcagtatcttgctaggtt

SEQ ID NO: 638139 - DNA, 22 bp, Artificial Sequence
  chemically synthesized
agcctccatcgaaaacctagca

SEQ ID NO: 638140 - DNA, 22 bp, Artificial Sequence
  chemically synthesized
aagcctccatcgaaaacctagc

SEQ ID NO: 638141 - DNA, 22 bp, Artificial Sequence
  chemically synthesized
taagcctccatcgaaaacctag

SEQ ID NO: 638142 - DNA, 22 bp, Artificial Sequence
  chemically synthesized
tttaagcctccatcgaaaacct

SEQ ID NO: 638143 - DNA, 22 bp, Artificial Sequence
  chemically synthesized
gctaggttttcgatggaggctt

SEQ ID NO: 638144 - DNA, 22 bp, Artificial Sequence
  chemically synthesized
ctaggttttcgatggaggctta

SEQ ID NO: 638145 - DNA, 22 bp, Artificial Sequence
  chemically synthesized
acacatagttctttaagcctcc

SEQ ID NO: 638146 - DNA, 22 bp, Artificial Sequence
  chemically synthesized
ggttttcgatggaggcttaaag

SEQ ID NO: 638147 - DNA, 22 bp, Artificial Sequence
  chemically synthesized
tcgatggaggcttaaagaacta

SEQ ID NO: 638148 - DNA, 22 bp, Artificial Sequence
  chemically synthesized
atccctaacacatagttcttta

SEQ ID NO: 638149 - DNA, 22 bp, Artificial Sequence
  chemically synthesized
cgatggaggcttaaagaactat

SEQ ID NO: 638150 - DNA, 22 bp, Artificial Sequence
  chemically synthesized
gatggaggcttaaagaactatg

SEQ ID NO: 638151 - DNA, 22 bp, Artificial Sequence
  chemically synthesized
ctaatccctaacacatagttct

SEQ ID NO: 638152 - DNA, 22 bp, Artificial Sequence
  chemically synthesized
tcctaatccctaacacatagtt

SEQ ID NO: 638153 - DNA, 22 bp, Artificial Sequence
  chemically synthesized
ctcctaatccctaacacatagt

SEQ ID NO: 638154 - DNA, 22 bp, Artificial Sequence
  chemically synthesized
tctcctaatccctaacacatag

SEQ ID NO: 638155 - DNA, 22 bp, Artificial Sequence
  chemically synthesized
ttctcctaatccctaacacata

SEQ ID NO: 638156 - DNA, 22 bp, Artificial Sequence
  chemically synthesized
tttctcctaatccctaacacat

SEQ ID NO: 638157 - DNA, 22 bp, Artificial Sequence
  chemically synthesized
ttttctcctaatccctaacaca

SEQ ID NO: 638158 - DNA, 22 bp, Artificial Sequence
  chemically synthesized
tttttctcctaatccctaacac

SEQ ID NO: 638159 - DNA, 22 bp, Artificial Sequence
  chemically synthesized
aaagaactatgtgttagggatt

SEQ ID NO: 638160 - DNA, 22 bp, Artificial Sequence
  chemically synthesized
aagaactatgtgttagggatta

SEQ ID NO: 638161 - DNA, 22 bp, Artificial Sequence
  chemically synthesized
tgttttttttctcctaatccct

SEQ ID NO: 638162 - DNA, 22 bp, Artificial Sequence
  chemically synthesized
gtgttttttttctcctaatccc

SEQ ID NO: 638163 - DNA, 22 bp, Artificial Sequence
  chemically synthesized
tgtgttttttttctcctaatcc

SEQ ID NO: 638164 - DNA, 22 bp, Artificial Sequence
  chemically synthesized
tgtgttagggattaggagaaaa

SEQ ID NO: 638165 - DNA, 22 bp, Artificial Sequence
  chemically synthesized
gtatacctttgtgttttttttc

SEQ ID NO: 638166 - DNA, 22 bp, Artificial Sequence
  chemically synthesized
gggattaggagaaaaaaaacac

SEQ ID NO: 638167 - DNA, 22 bp, Artificial Sequence
  chemically synthesized
tggtatacctttgtgttttttt

SEQ ID NO: 638168 - DNA, 22 bp, Artificial Sequence
  chemically synthesized
ctggtatacctttgtgtttttt

SEQ ID NO: 638169 - DNA, 22 bp, Artificial Sequence
  chemically synthesized
tctggtatacctttgtgttttt

SEQ ID NO: 638170 - DNA, 22 bp, Artificial Sequence
  chemically synthesized
ggagaaaaaaaacacaaaggta

SEQ ID NO: 638171 - DNA, 22 bp, Artificial Sequence
  chemically synthesized
tattttctggtatacctttgtg

SEQ ID NO: 638172 - DNA, 22 bp, Artificial Sequence
  chemically synthesized
gttatattttctggtatacctt

SEQ ID NO: 638173 - DNA, 22 bp, Artificial Sequence
  chemically synthesized
caattagttatattttctggta

SEQ ID NO: 638174 - DNA, 22 bp, Artificial Sequence
  chemically synthesized
acaattagttatattttctggt

SEQ ID NO: 638175 - DNA, 22 bp, Artificial Sequence
  chemically synthesized
atttacaattagttatattttc

SEQ ID NO: 638176 - DNA, 22 bp, Artificial Sequence
  chemically synthesized
catttacaattagttatatttt

SEQ ID NO: 638177 - DNA, 22 bp, Artificial Sequence
  chemically synthesized
tttcatttacaattagttatat

SEQ ID NO: 638178 - DNA, 22 bp, Artificial Sequence
  chemically synthesized
aaatggaactatttcatttaca

SEQ ID NO: 638179 - DNA, 22 bp, Artificial Sequence
  chemically synthesized
gaaatggaactatttcatttac

SEQ ID NO: 638180 - DNA, 22 bp, Artificial Sequence
  chemically synthesized
ttgaaatggaactatttcattt

SEQ ID NO: 638181 - DNA, 22 bp, Artificial Sequence
  chemically synthesized
cttgaaatggaactatttcatt

SEQ ID NO: 638182 - DNA, 22 bp, Artificial Sequence
  chemically synthesized
acttcttgaaatggaactattt

SEQ ID NO: 638183 - DNA, 22 bp, Artificial Sequence
  chemically synthesized
cacttcttgaaatggaactatt

SEQ ID NO: 638184 - DNA, 22 bp, Artificial Sequence
  chemically synthesized
attgtaaatgaaatagttccat

SEQ ID NO: 638185 - DNA, 22 bp, Artificial Sequence
  chemically synthesized
taaatgaaatagttccatttca

SEQ ID NO: 638186 - DNA, 22 bp, Artificial Sequence
  chemically synthesized
aaagtgaatatttcacttcttg

SEQ ID NO: 638187 - DNA, 22 bp, Artificial Sequence
  chemically synthesized
taaaagtgaatatttcacttct

SEQ ID NO: 638188 - DNA, 22 bp, Artificial Sequence
  chemically synthesized
tctaaaagtgaatatttcactt

SEQ ID NO: 638189 - DNA, 22 bp, Artificial Sequence
  chemically synthesized
catttcaagaagtgaaatattc

SEQ ID NO: 638190 - DNA, 22 bp, Artificial Sequence
  chemically synthesized
gttctctaaaagtgaatatttc

SEQ ID NO: 638191 - DNA, 22 bp, Artificial Sequence
  chemically synthesized
caagaagtgaaatattcacttt

SEQ ID NO: 638192 - DNA, 22 bp, Artificial Sequence
  chemically synthesized
aagaagtgaaatattcactttt

SEQ ID NO: 638193 - DNA, 22 bp, Artificial Sequence
  chemically synthesized
cactagttctctaaaagtgaat

SEQ ID NO: 638194 - DNA, 22 bp, Artificial Sequence
  chemically synthesized
ccactagttctctaaaagtgaa

SEQ ID NO: 638195 - DNA, 22 bp, Artificial Sequence
  chemically synthesized
aaggtttccactagttctctaa

SEQ ID NO: 638196 - DNA, 22 bp, Artificial Sequence
  chemically synthesized
acttttagagaactagtggaaa

SEQ ID NO: 638197 - DNA, 22 bp, Artificial Sequence
  chemically synthesized
ttagagaactagtggaaacctt

SEQ ID NO: 638198 - DNA, 22 bp, Artificial Sequence
  chemically synthesized
tagagaactagtggaaaccttt

SEQ ID NO: 638199 - DNA, 22 bp, Artificial Sequence
  chemically synthesized
agagaactagtggaaaccttta

SEQ ID NO: 638200 - DNA, 22 bp, Artificial Sequence
  chemically synthesized
gagaactagtggaaacctttag

SEQ ID NO: 638201 - DNA, 22 bp, Artificial Sequence
  chemically synthesized
gggaaaaaaacgcctaaaggtt

SEQ ID NO: 638202 - DNA, 22 bp, Artificial Sequence
  chemically synthesized
ggggaaaaaaacgcctaaaggt

SEQ ID NO: 638203 - DNA, 22 bp, Artificial Sequence
  chemically synthesized
gtggaaacctttaggcgttttt

SEQ ID NO: 638204 - DNA, 22 bp, Artificial Sequence
  chemically synthesized
aaatacatcttggggaaaaaaa

SEQ ID NO: 638205 - DNA, 22 bp, Artificial Sequence
  chemically synthesized
gaaatacatcttggggaaaaaa

SEQ ID NO: 638206 - DNA, 22 bp, Artificial Sequence
  chemically synthesized
taggcgtttttttccccaagat

SEQ ID NO: 638207 - DNA, 22 bp, Artificial Sequence
  chemically synthesized
aggcgtttttttccccaagatg

SEQ ID NO: 638208 - DNA, 22 bp, Artificial Sequence
  chemically synthesized
ggcgtttttttccccaagatgt

SEQ ID NO: 638209 - DNA, 22 bp, Artificial Sequence
  chemically synthesized
accaatttgaaatacatcttgg

SEQ ID NO: 638210 - DNA, 22 bp, Artificial Sequence
  chemically synthesized
gaccaatttgaaatacatcttg

SEQ ID NO: 638211 - DNA, 22 bp, Artificial Sequence
  chemically synthesized
ttgaccaatttgaaatacatct

SEQ ID NO: 638212 - DNA, 22 bp, Artificial Sequence
  chemically synthesized
cttgaccaatttgaaatacatc

SEQ ID NO: 638213 - DNA, 22 bp, Artificial Sequence
  chemically synthesized
tcttgaccaatttgaaatacat

SEQ ID NO: 638214 - DNA, 22 bp, Artificial Sequence
  chemically synthesized
ttttccccaagatgtatttcaa

SEQ ID NO: 638215 - DNA, 22 bp, Artificial Sequence
  chemically synthesized
ttcttgaccaatttgaaataca

SEQ ID NO: 638216 - DNA, 22 bp, Artificial Sequence
  chemically synthesized
tttccccaagatgtatttcaaa

SEQ ID NO: 638217 - DNA, 22 bp, Artificial Sequence
  chemically synthesized
tttcttgaccaatttgaaatac

SEQ ID NO: 638218 - DNA, 22 bp, Artificial Sequence
  chemically synthesized
ttccccaagatgtatttcaaat

SEQ ID NO: 638219 - DNA, 22 bp, Artificial Sequence
  chemically synthesized
tccccaagatgtatttcaaatt

SEQ ID NO: 638220 - DNA, 22 bp, Artificial Sequence
  chemically synthesized
ccccaagatgtatttcaaattg

SEQ ID NO: 638221 - DNA, 22 bp, Artificial Sequence
  chemically synthesized
cccaagatgtatttcaaattgg

SEQ ID NO: 638222 - DNA, 22 bp, Artificial Sequence
  chemically synthesized
ccaaaatggttttttcttgacc

SEQ ID NO: 638223 - DNA, 22 bp, Artificial Sequence
  chemically synthesized
ctaccaaaatggttttttcttg

SEQ ID NO: 638224 - DNA, 22 bp, Artificial Sequence
  chemically synthesized
cctaccaaaatggttttttctt

SEQ ID NO: 638225 - DNA, 22 bp, Artificial Sequence
  chemically synthesized
caaattggtcaagaaaaaacca

SEQ ID NO: 638226 - DNA, 22 bp, Artificial Sequence
  chemically synthesized
aaattggtcaagaaaaaaccat

SEQ ID NO: 638227 - DNA, 22 bp, Artificial Sequence
  chemically synthesized
tttcctaccaaaatggtttttt

SEQ ID NO: 638228 - DNA, 22 bp, Artificial Sequence
  chemically synthesized
gtcaagaaaaaaccattttggt

SEQ ID NO: 638229 - DNA, 22 bp, Artificial Sequence
  chemically synthesized
tccaatattgtttcctaccaaa

SEQ ID NO: 638230 - DNA, 22 bp, Artificial Sequence
  chemically synthesized
gtccaatattgtttcctaccaa

SEQ ID NO: 638231 - DNA, 22 bp, Artificial Sequence
  chemically synthesized
tatttgtccaatattgtttcct

SEQ ID NO: 638232 - DNA, 22 bp, Artificial Sequence
  chemically synthesized
gtatttgtccaatattgtttcc

SEQ ID NO: 638233 - DNA, 22 bp, Artificial Sequence
  chemically synthesized
tgtatttgtccaatattgtttc

SEQ ID NO: 638234 - DNA, 22 bp, Artificial Sequence
  chemically synthesized
ttgtatttgtccaatattgttt

SEQ ID NO: 638235 - DNA, 22 bp, Artificial Sequence
  chemically synthesized
tttgtatttgtccaatattgtt

SEQ ID NO: 638236 - DNA, 22 bp, Artificial Sequence
  chemically synthesized
ttttgtatttgtccaatattgt

SEQ ID NO: 638237 - DNA, 22 bp, Artificial Sequence
  chemically synthesized
tggtaggaaacaatattggaca

SEQ ID NO: 638238 - DNA, 22 bp, Artificial Sequence
  chemically synthesized
ggtaggaaacaatattggacaa

SEQ ID NO: 638239 - DNA, 22 bp, Artificial Sequence
  chemically synthesized
gtaggaaacaatattggacaaa

SEQ ID NO: 638240 - DNA, 22 bp, Artificial Sequence
  chemically synthesized
gtgtgtcttttttgtatttgtc

SEQ ID NO: 638241 - DNA, 22 bp, Artificial Sequence
  chemically synthesized
gacaaatacaaaaaagacacac

SEQ ID NO: 638242 - DNA, 22 bp, Artificial Sequence
  chemically synthesized
gtttttctatctcctctacttc

SEQ ID NO: 638243 - DNA, 22 bp, Artificial Sequence
  chemically synthesized
ttctatctcctctacttctatc

SEQ ID NO: 638244 - DNA, 22 bp, Artificial Sequence
  chemically synthesized
tctatctcctctacttctatcc

SEQ ID NO: 638245 - DNA, 22 bp, Artificial Sequence
  chemically synthesized
ctatctcctctacttctatcct

SEQ ID NO: 638246 - DNA, 22 bp, Artificial Sequence
  chemically synthesized
tatctcctctacttctatcctt

SEQ ID NO: 638247 - DNA, 22 bp, Artificial Sequence
  chemically synthesized
tctcctctacttctatcctttg

SEQ ID NO: 638248 - DNA, 22 bp, Artificial Sequence
  chemically synthesized
caaagtgatagtatcaaaggat

SEQ ID NO: 638249 - DNA, 22 bp, Artificial Sequence
  chemically synthesized
ctctacttctatcctttgatac

SEQ ID NO: 638250 - DNA, 22 bp, Artificial Sequence
  chemically synthesized
tacttctatcctttgatactat

SEQ ID NO: 638251 - DNA, 22 bp, Artificial Sequence
  chemically synthesized
cttctatcctttgatactatca

SEQ ID NO: 638252 - DNA, 22 bp, Artificial Sequence
  chemically synthesized
ctatcctttgatactatcactt

SEQ ID NO: 638253 - DNA, 22 bp, Artificial Sequence
  chemically synthesized
tatcctttgatactatcacttt

SEQ ID NO: 638254 - DNA, 22 bp, Artificial Sequence
  chemically synthesized
gtatgtgcctgcaaagtgatag

SEQ ID NO: 638255 - DNA, 22 bp, Artificial Sequence
  chemically synthesized
ggtatgtgcctgcaaagtgata

SEQ ID NO: 638256 - DNA, 22 bp, Artificial Sequence
  chemically synthesized
tcctttgatactatcactttgc

SEQ ID NO: 638257 - DNA, 22 bp, Artificial Sequence
  chemically synthesized
tgatactatcactttgcaggca

SEQ ID NO: 638258 - DNA, 22 bp, Artificial Sequence
  chemically synthesized
gatactatcactttgcaggcac

SEQ ID NO: 638259 - DNA, 22 bp, Artificial Sequence
  chemically synthesized
agtgcttggtatgtgcctgcaa

SEQ ID NO: 638260 - DNA, 22 bp, Artificial Sequence
  chemically synthesized
atactatcactttgcaggcaca

SEQ ID NO: 638261 - DNA, 22 bp, Artificial Sequence
  chemically synthesized
aagtgcttggtatgtgcctgca

SEQ ID NO: 638262 - DNA, 22 bp, Artificial Sequence
  chemically synthesized
ttaagtgcttggtatgtgcctg

SEQ ID NO: 638263 - DNA, 22 bp, Artificial Sequence
  chemically synthesized
tcactttgcaggcacataccaa

SEQ ID NO: 638264 - DNA, 22 bp, Artificial Sequence
  chemically synthesized
tgcaggcacataccaagcactt

SEQ ID NO: 638265 - DNA, 22 bp, Artificial Sequence
  chemically synthesized
gcaggcacataccaagcactta

SEQ ID NO: 638266 - DNA, 22 bp, Artificial Sequence
  chemically synthesized
caggcacataccaagcacttaa

SEQ ID NO: 638267 - DNA, 22 bp, Artificial Sequence
  chemically synthesized
taggtgcaacaagcatcaattc

SEQ ID NO: 638268 - DNA, 22 bp, Artificial Sequence
  chemically synthesized
ataggtgcaacaagcatcaatt

SEQ ID NO: 638269 - DNA, 22 bp, Artificial Sequence
  chemically synthesized
tataggtgcaacaagcatcaat

SEQ ID NO: 638270 - DNA, 22 bp, Artificial Sequence
  chemically synthesized
ttataggtgcaacaagcatcaa

SEQ ID NO: 638271 - DNA, 22 bp, Artificial Sequence
  chemically synthesized
tttataggtgcaacaagcatca

SEQ ID NO: 638272 - DNA, 22 bp, Artificial Sequence
  chemically synthesized
aagaattgatgcttgttgcacc

SEQ ID NO: 638273 - DNA, 22 bp, Artificial Sequence
  chemically synthesized
agaattgatgcttgttgcacct

SEQ ID NO: 638274 - DNA, 22 bp, Artificial Sequence
  chemically synthesized
agagagcactttttataggtgc

SEQ ID NO: 638275 - DNA, 22 bp, Artificial Sequence
  chemically synthesized
atgcttgttgcacctataaaaa

SEQ ID NO: 638276 - DNA, 22 bp, Artificial Sequence
  chemically synthesized
aacctcagagagcactttttat

SEQ ID NO: 638277 - DNA, 22 bp, Artificial Sequence
  chemically synthesized
gttgcacctataaaaagtgctc

SEQ ID NO: 638278 - DNA, 22 bp, Artificial Sequence
  chemically synthesized
ttgcacctataaaaagtgctct

SEQ ID NO: 638279 - DNA, 22 bp, Artificial Sequence
  chemically synthesized
cacctataaaaagtgctctctg

SEQ ID NO: 638280 - DNA, 22 bp, Artificial Sequence
  chemically synthesized
aacaaaactaaacctcagagag

SEQ ID NO: 638281 - DNA, 22 bp, Artificial Sequence
  chemically synthesized
aaacaaaactaaacctcagaga

SEQ ID NO: 638282 - DNA, 22 bp, Artificial Sequence
  chemically synthesized
taaaaagtgctctctgaggttt

SEQ ID NO: 638283 - DNA, 22 bp, Artificial Sequence
  chemically synthesized
ttaaacaaaactaaacctcaga

SEQ ID NO: 638284 - DNA, 22 bp, Artificial Sequence
  chemically synthesized
cctcttaaacaaaactaaacct

SEQ ID NO: 638285 - DNA, 22 bp, Artificial Sequence
  chemically synthesized
ccctcttaaacaaaactaaacc

SEQ ID NO: 638286 - DNA, 22 bp, Artificial Sequence
  chemically synthesized
tccctcttaaacaaaactaaac

SEQ ID NO: 638287 - DNA, 22 bp, Artificial Sequence
  chemically synthesized
ttccctcttaaacaaaactaaa

SEQ ID NO: 638288 - DNA, 22 bp, Artificial Sequence
  chemically synthesized
atttttccctcttaaacaaaac

SEQ ID NO: 638289 - DNA, 22 bp, Artificial Sequence
  chemically synthesized
tctgaggtttagttttgtttaa

SEQ ID NO: 638290 - DNA, 22 bp, Artificial Sequence
  chemically synthesized
tgaggtttagttttgtttaaga

SEQ ID NO: 638291 - DNA, 22 bp, Artificial Sequence
  chemically synthesized
aggtttagttttgtttaagagg

SEQ ID NO: 638292 - DNA, 22 bp, Artificial Sequence
  chemically synthesized
caaacattcatttttccctctt

SEQ ID NO: 638293 - DNA, 22 bp, Artificial Sequence
  chemically synthesized
acaaacattcatttttccctct

SEQ ID NO: 638294 - DNA, 22 bp, Artificial Sequence
  chemically synthesized
agttttgtttaagagggaaaaa

SEQ ID NO: 638295 - DNA, 22 bp, Artificial Sequence
  chemically synthesized
tacaaacattcatttttccctc

SEQ ID NO: 638296 - DNA, 22 bp, Artificial Sequence
  chemically synthesized
gttttgtttaagagggaaaaat

SEQ ID NO: 638297 - DNA, 22 bp, Artificial Sequence
  chemically synthesized
ttacaaacattcatttttccct

SEQ ID NO: 638298 - DNA, 22 bp, Artificial Sequence
  chemically synthesized
tgtttaagagggaaaaatgaat

SEQ ID NO: 638299 - DNA, 22 bp, Artificial Sequence
  chemically synthesized
gtttaagagggaaaaatgaatg

SEQ ID NO: 638300 - DNA, 22 bp, Artificial Sequence
  chemically synthesized
tttaagagggaaaaatgaatgt

SEQ ID NO: 638301 - DNA, 22 bp, Artificial Sequence
  chemically synthesized
aagagggaaaaatgaatgtttg

SEQ ID NO: 638302 - DNA, 22 bp, Artificial Sequence
  chemically synthesized
agagggaaaaatgaatgtttgt

SEQ ID NO: 638303 - DNA, 22 bp, Artificial Sequence
  chemically synthesized
gagcaagtgaggagagagatgg

SEQ ID NO: 638304 - DNA, 22 bp, Artificial Sequence
  chemically synthesized
gtaaaaatcccatctctctcct

SEQ ID NO: 638305 - DNA, 22 bp, Artificial Sequence
  chemically synthesized
ctggagcaagtgaggagagaga

SEQ ID NO: 638306 - DNA, 22 bp, Artificial Sequence
  chemically synthesized
taaaaatcccatctctctcctc

SEQ ID NO: 638307 - DNA, 22 bp, Artificial Sequence
  chemically synthesized
aggcagctgctggagcaagtga

SEQ ID NO: 638308 - DNA, 22 bp, Artificial Sequence
  chemically synthesized
tctcctcacttgctccagcagc

SEQ ID NO: 638309 - DNA, 22 bp, Artificial Sequence
  chemically synthesized
tcctcacttgctccagcagctg

SEQ ID NO: 638310 - DNA, 22 bp, Artificial Sequence
  chemically synthesized
cacaggctaaggcagctgctgg

SEQ ID NO: 638311 - DNA, 22 bp, Artificial Sequence
  chemically synthesized
ctcacttgctccagcagctgcc

SEQ ID NO: 638312 - DNA, 22 bp, Artificial Sequence
  chemically synthesized
acttgctccagcagctgcctta

SEQ ID NO: 638313 - DNA, 22 bp, Artificial Sequence
  chemically synthesized
gctccagcagctgccttagcct

SEQ ID NO: 638314 - DNA, 22 bp, Artificial Sequence
  chemically synthesized
ctccagcagctgccttagcctg

SEQ ID NO: 638315 - DNA, 22 bp, Artificial Sequence
  chemically synthesized
gagtcacagttacacaggctaa

SEQ ID NO: 638316 - DNA, 22 bp, Artificial Sequence
  chemically synthesized
cagcagctgccttagcctgtgt

SEQ ID NO: 638317 - DNA, 22 bp, Artificial Sequence
  chemically synthesized
ccttagcctgtgtaactgtgac

SEQ ID NO: 638318 - DNA, 22 bp, Artificial Sequence
  chemically synthesized
agcctgtgtaactgtgactcca

SEQ ID NO: 638319 - DNA, 22 bp, Artificial Sequence
  chemically synthesized
gcctgtgtaactgtgactccag

SEQ ID NO: 638320 - DNA, 22 bp, Artificial Sequence
  chemically synthesized
tgtaactgtgactccagctgtt

SEQ ID NO: 638321 - DNA, 22 bp, Artificial Sequence
  chemically synthesized
gaagaccacaataaacagctgg

SEQ ID NO: 638322 - DNA, 22 bp, Artificial Sequence
  chemically synthesized
tgactccagctgtttattgtgg

SEQ ID NO: 638323 - DNA, 22 bp, Artificial Sequence
  chemically synthesized
cagctgtttattgtggtcttcc

SEQ ID NO: 638324 - DNA, 22 bp, Artificial Sequence
  chemically synthesized
tttattgtggtcttccaggatt

SEQ ID NO: 638325 - DNA, 22 bp, Artificial Sequence
  chemically synthesized
gaagccaggatgcaaatcctgg

SEQ ID NO: 638326 - DNA, 22 bp, Artificial Sequence
  chemically synthesized
attgtggtcttccaggatttgc

SEQ ID NO: 638327 - DNA, 22 bp, Artificial Sequence
  chemically synthesized
ttgtggtcttccaggatttgca

SEQ ID NO: 638328 - DNA, 22 bp, Artificial Sequence
  chemically synthesized
tggtcttccaggatttgcatcc

SEQ ID NO: 638329 - DNA, 22 bp, Artificial Sequence
  chemically synthesized
ccaggatttgcatcctggcttc

SEQ ID NO: 638330 - DNA, 22 bp, Artificial Sequence
  chemically synthesized
caggatttgcatcctggcttcc

SEQ ID NO: 638331 - DNA, 22 bp, Artificial Sequence
  chemically synthesized
gcatcctggcttccaggcggcc

SEQ ID NO: 638332 - DNA, 22 bp, Artificial Sequence
  chemically synthesized
cgtcaacacaaaggccgcctgg

SEQ ID NO: 638333 - DNA, 22 bp, Artificial Sequence
  chemically synthesized
catcctggcttccaggcggcct

SEQ ID NO: 638334 - DNA, 22 bp, Artificial Sequence
  chemically synthesized
ctgcgtcaacacaaaggccgcc

SEQ ID NO: 638335 - DNA, 22 bp, Artificial Sequence
  chemically synthesized
gcttccaggcggcctttgtgtt

SEQ ID NO: 638336 - DNA, 22 bp, Artificial Sequence
  chemically synthesized
ccaggcggcctttgtgttgacg

SEQ ID NO: 638337 - DNA, 22 bp, Artificial Sequence
  chemically synthesized
caggcggcctttgtgttgacgc

SEQ ID NO: 638338 - DNA, 22 bp, Artificial Sequence
  chemically synthesized
aggccaagctactgcgtcaaca

SEQ ID NO: 638339 - DNA, 22 bp, Artificial Sequence
  chemically synthesized
ctgaggccaagctactgcgtca

SEQ ID NO: 638340 - DNA, 22 bp, Artificial Sequence
  chemically synthesized
attgctgaggccaagctactgc

SEQ ID NO: 638341 - DNA, 22 bp, Artificial Sequence
  chemically synthesized
tgtgttgacgcagtagcttggc

SEQ ID NO: 638342 - DNA, 22 bp, Artificial Sequence
  chemically synthesized
gtgttgacgcagtagcttggcc

SEQ ID NO: 638343 - DNA, 22 bp, Artificial Sequence
  chemically synthesized
tgttgacgcagtagcttggcct

SEQ ID NO: 638344 - DNA, 22 bp, Artificial Sequence
  chemically synthesized
agctcattgctgaggccaagct

SEQ ID NO: 638345 - DNA, 22 bp, Artificial Sequence
  chemically synthesized
acgcagtagcttggcctcagca

SEQ ID NO: 638346 - DNA, 22 bp, Artificial Sequence
  chemically synthesized
ggcctcagcaatgagctcagca

SEQ ID NO: 638347 - DNA, 22 bp, Artificial Sequence
  chemically synthesized
gcctcagcaatgagctcagcat

SEQ ID NO: 638348 - DNA, 22 bp, Artificial Sequence
  chemically synthesized
cccagagtccccgggatgctga

SEQ ID NO: 638349 - DNA, 22 bp, Artificial Sequence
  chemically synthesized
agcaatgagctcagcatcccgg

SEQ ID NO: 638350 - DNA, 22 bp, Artificial Sequence
  chemically synthesized
tccccagagtccccgggatgct

SEQ ID NO: 638351 - DNA, 22 bp, Artificial Sequence
  chemically synthesized
agcatcccggggactctgggga

SEQ ID NO: 638352 - DNA, 22 bp, Artificial Sequence
  chemically synthesized
aaatgatgcccacctctcccca

SEQ ID NO: 638353 - DNA, 22 bp, Artificial Sequence
  chemically synthesized
ctgaaatgatgcccacctctcc

SEQ ID NO: 638354 - DNA, 22 bp, Artificial Sequence
  chemically synthesized
tggggagaggtgggcatcattt

SEQ ID NO: 638355 - DNA, 22 bp, Artificial Sequence
  chemically synthesized
ccgtcccctcctgaaatgatgc

SEQ ID NO: 638356 - DNA, 22 bp, Artificial Sequence
  chemically synthesized
gggagaggtgggcatcatttca

SEQ ID NO: 638357 - DNA, 22 bp, Artificial Sequence
  chemically synthesized
tccccactgccgtcccctcctg

SEQ ID NO: 638358 - DNA, 22 bp, Artificial Sequence
  chemically synthesized
caggaggggacggcagtgggga

SEQ ID NO: 638359 - DNA, 22 bp, Artificial Sequence
  chemically synthesized
aggaggggacggcagtggggac

SEQ ID NO: 638360 - DNA, 22 bp, Artificial Sequence
  chemically synthesized
aagcagcagcacgaacataaag

SEQ ID NO: 638361 - DNA, 22 bp, Artificial Sequence
  chemically synthesized
tatgttcgtgctgctgctttag

SEQ ID NO: 638362 - DNA, 22 bp, Artificial Sequence
  chemically synthesized
atgttcgtgctgctgctttaga

SEQ ID NO: 638363 - DNA, 22 bp, Artificial Sequence
  chemically synthesized
tgttcgtgctgctgctttagac

SEQ ID NO: 638364 - DNA, 22 bp, Artificial Sequence
  chemically synthesized
caagcagaatatgaccgtctaa

SEQ ID NO: 638365 - DNA, 22 bp, Artificial Sequence
  chemically synthesized
gtgctgctgctttagacggtca

SEQ ID NO: 638366 - DNA, 22 bp, Artificial Sequence
  chemically synthesized
ctgctttagacggtcatattct

SEQ ID NO: 638367 - DNA, 22 bp, Artificial Sequence
  chemically synthesized
ctttagacggtcatattctgct

SEQ ID NO: 638368 - DNA, 22 bp, Artificial Sequence
  chemically synthesized
tagacggtcatattctgcttgc

SEQ ID NO: 638369 - DNA, 22 bp, Artificial Sequence
  chemically synthesized
agacggtcatattctgcttgca

SEQ ID NO: 638370 - DNA, 22 bp, Artificial Sequence
  chemically synthesized
gacggtcatattctgcttgcag

SEQ ID NO: 638371 - DNA, 22 bp, Artificial Sequence
  chemically synthesized
atgccaataggaatctgcaagc

SEQ ID NO: 638372 - DNA, 22 bp, Artificial Sequence
  chemically synthesized
gatgccaataggaatctgcaag

SEQ ID NO: 638373 - DNA, 22 bp, Artificial Sequence
  chemically synthesized
tgatgccaataggaatctgcaa

SEQ ID NO: 638374 - DNA, 22 bp, Artificial Sequence
  chemically synthesized
ttgatgccaataggaatctgca

SEQ ID NO: 638375 - DNA, 22 bp, Artificial Sequence
  chemically synthesized
tttgatgccaataggaatctgc

SEQ ID NO: 638376 - DNA, 22 bp, Artificial Sequence
  chemically synthesized
ttttgatgccaataggaatctg

SEQ ID NO: 638377 - DNA, 22 bp, Artificial Sequence
  chemically synthesized
cttttttgatgccaataggaat

SEQ ID NO: 638378 - DNA, 22 bp, Artificial Sequence
  chemically synthesized
acttttttgatgccaataggaa

SEQ ID NO: 638379 - DNA, 22 bp, Artificial Sequence
  chemically synthesized
tacttttttgatgccaatagga

SEQ ID NO: 638380 - DNA, 22 bp, Artificial Sequence
  chemically synthesized
tgcttgcagattcctattggca

SEQ ID NO: 638381 - DNA, 22 bp, Artificial Sequence
  chemically synthesized
ttacttttttgatgccaatagg

SEQ ID NO: 638382 - DNA, 22 bp, Artificial Sequence
  chemically synthesized
tttacttttttgatgccaatag

SEQ ID NO: 638383 - DNA, 22 bp, Artificial Sequence
  chemically synthesized
cttgcagattcctattggcatc

SEQ ID NO: 638384 - DNA, 22 bp, Artificial Sequence
  chemically synthesized
ttttacttttttgatgccaata

SEQ ID NO: 638385 - DNA, 22 bp, Artificial Sequence
  chemically synthesized
ttttttacttttttgatgccaa

SEQ ID NO: 638386 - DNA, 22 bp, Artificial Sequence
  chemically synthesized
gcagattcctattggcatcaaa

SEQ ID NO: 638387 - DNA, 22 bp, Artificial Sequence
  chemically synthesized
cttttttacttttttgatgcca

SEQ ID NO: 638388 - DNA, 22 bp, Artificial Sequence
  chemically synthesized
cagattcctattggcatcaaaa

SEQ ID NO: 638389 - DNA, 22 bp, Artificial Sequence
  chemically synthesized
tcttttttacttttttgatgcc

SEQ ID NO: 638390 - DNA, 22 bp, Artificial Sequence
  chemically synthesized
ttcttttttacttttttgatgc

SEQ ID NO: 638391 - DNA, 22 bp, Artificial Sequence
  chemically synthesized
tttcttttttacttttttgatg

SEQ ID NO: 638392 - DNA, 22 bp, Artificial Sequence
  chemically synthesized
ttttcttttttacttttttgat

SEQ ID NO: 638393 - DNA, 22 bp, Artificial Sequence
  chemically synthesized
tttttcttttttacttttttga

SEQ ID NO: 638394 - DNA, 22 bp, Artificial Sequence
  chemically synthesized
ttttttcttttttacttttttg

SEQ ID NO: 638395 - DNA, 22 bp, Artificial Sequence
  chemically synthesized
tttttttcttttttactttttt

SEQ ID NO: 638396 - DNA, 22 bp, Artificial Sequence
  chemically synthesized
ctattggcatcaaaaaagtaaa

SEQ ID NO: 638397 - DNA, 22 bp, Artificial Sequence
  chemically synthesized
tttttttttcttttttactttt

SEQ ID NO: 638398 - DNA, 22 bp, Artificial Sequence
  chemically synthesized
ctttttttttcttttttacttt

SEQ ID NO: 638399 - DNA, 22 bp, Artificial Sequence
  chemically synthesized
ttggcatcaaaaaagtaaaaaa

SEQ ID NO: 638400 - DNA, 22 bp, Artificial Sequence
  chemically synthesized
tctttttttttcttttttactt

SEQ ID NO: 638401 - DNA, 22 bp, Artificial Sequence
  chemically synthesized
tttctttttttttcttttttac

SEQ ID NO: 638402 - DNA, 22 bp, Artificial Sequence
  chemically synthesized
gcatcaaaaaagtaaaaaagaa

SEQ ID NO: 638403 - DNA, 22 bp, Artificial Sequence
  chemically synthesized
ctttctttttttttctttttta

SEQ ID NO: 638404 - DNA, 22 bp, Artificial Sequence
  chemically synthesized
tctttctttttttttctttttt

SEQ ID NO: 638405 - DNA, 22 bp, Artificial Sequence
  chemically synthesized
ttctttctttttttttcttttt

SEQ ID NO: 638406 - DNA, 22 bp, Artificial Sequence
  chemically synthesized
tttctttctttttttttctttt

SEQ ID NO: 638407 - DNA, 22 bp, Artificial Sequence
  chemically synthesized
tttttctttctttttttttctt

SEQ ID NO: 638408 - DNA, 22 bp, Artificial Sequence
  chemically synthesized
ctttttctttctttttttttct

SEQ ID NO: 638409 - DNA, 22 bp, Artificial Sequence
  chemically synthesized
tctttttctttctttttttttc

SEQ ID NO: 638410 - DNA, 22 bp, Artificial Sequence
  chemically synthesized
ttctttttctttcttttttttt

SEQ ID NO: 638411 - DNA, 22 bp, Artificial Sequence
  chemically synthesized
tttctttttctttctttttttt

SEQ ID NO: 638412 - DNA, 22 bp, Artificial Sequence
  chemically synthesized
tttttctttttctttctttttt

SEQ ID NO: 638413 - DNA, 22 bp, Artificial Sequence
  chemically synthesized
ctttttctttttctttcttttt

SEQ ID NO: 638414 - DNA, 22 bp, Artificial Sequence
  chemically synthesized
ttctttttctttttctttcttt

SEQ ID NO: 638415 - DNA, 22 bp, Artificial Sequence
  chemically synthesized
cttctttttctttttctttctt

SEQ ID NO: 638416 - DNA, 22 bp, Artificial Sequence
  chemically synthesized
tcttctttttctttttctttct

SEQ ID NO: 638417 - DNA, 22 bp, Artificial Sequence
  chemically synthesized
ttcttctttttctttttctttc

SEQ ID NO: 638418 - DNA, 22 bp, Artificial Sequence
  chemically synthesized
tttcttctttttctttttcttt

SEQ ID NO: 638419 - DNA, 22 bp, Artificial Sequence
  chemically synthesized
ttttcttctttttctttttctt

SEQ ID NO: 638420 - DNA, 22 bp, Artificial Sequence
  chemically synthesized
tttttcttctttttctttttct

SEQ ID NO: 638421 - DNA, 22 bp, Artificial Sequence
  chemically synthesized
ctttttttcttctttttctttt

SEQ ID NO: 638422 - DNA, 22 bp, Artificial Sequence
  chemically synthesized
aaattactttttttcttctttt

SEQ ID NO: 638423 - DNA, 22 bp, Artificial Sequence
  chemically synthesized
gtgatgatattcaaattacttt

SEQ ID NO: 638424 - DNA, 22 bp, Artificial Sequence
  chemically synthesized
ggtgatgatattcaaattactt

SEQ ID NO: 638425 - DNA, 22 bp, Artificial Sequence
  chemically synthesized
ccatggtatataaaatttggtg

SEQ ID NO: 638426 - DNA, 22 bp, Artificial Sequence
  chemically synthesized
gaatatcatcaccaaattttat

SEQ ID NO: 638427 - DNA, 22 bp, Artificial Sequence
  chemically synthesized
aatatcatcaccaaattttata

SEQ ID NO: 638428 - DNA, 22 bp, Artificial Sequence
  chemically synthesized
tctaccatggtatataaaattt

SEQ ID NO: 638429 - DNA, 22 bp, Artificial Sequence
  chemically synthesized
tatataccatggtagatagatg

SEQ ID NO: 638430 - DNA, 22 bp, Artificial Sequence
  chemically synthesized
atataccatggtagatagatgc

SEQ ID NO: 638431 - DNA, 22 bp, Artificial Sequence
  chemically synthesized
tataccatggtagatagatgca

SEQ ID NO: 638432 - DNA, 22 bp, Artificial Sequence
  chemically synthesized
ggtggcagtcagatgcatctat

SEQ ID NO: 638433 - DNA, 22 bp, Artificial Sequence
  chemically synthesized
cggtggcagtcagatgcatcta

SEQ ID NO: 638434 - DNA, 22 bp, Artificial Sequence
  chemically synthesized
ttcggtggcagtcagatgcatc

SEQ ID NO: 638435 - DNA, 22 bp, Artificial Sequence
  chemically synthesized
ttcttcggtggcagtcagatgc

SEQ ID NO: 638436 - DNA, 22 bp, Artificial Sequence
  chemically synthesized
ctgttcttcggtggcagtcaga

SEQ ID NO: 638437 - DNA, 22 bp, Artificial Sequence
  chemically synthesized
gctgttcttcggtggcagtcag

SEQ ID NO: 638438 - DNA, 22 bp, Artificial Sequence
  chemically synthesized
cttgctgttcttcggtggcagt

SEQ ID NO: 638439 - DNA, 22 bp, Artificial Sequence
  chemically synthesized
gcttgctgttcttcggtggcag

SEQ ID NO: 638440 - DNA, 22 bp, Artificial Sequence
  chemically synthesized
tgcttgctgttcttcggtggca

SEQ ID NO: 638441 - DNA, 22 bp, Artificial Sequence
  chemically synthesized
ttgcttgctgttcttcggtggc

SEQ ID NO: 638442 - DNA, 22 bp, Artificial Sequence
  chemically synthesized
ttttgcttgctgttcttcggtg

SEQ ID NO: 638443 - DNA, 22 bp, Artificial Sequence
  chemically synthesized
actgccaccgaagaacagcaag

SEQ ID NO: 638444 - DNA, 22 bp, Artificial Sequence
  chemically synthesized
gtgcctcttttgcttgctgttc

SEQ ID NO: 638445 - DNA, 22 bp, Artificial Sequence
  chemically synthesized
ccaccgaagaacagcaagcaaa

SEQ ID NO: 638446 - DNA, 22 bp, Artificial Sequence
  chemically synthesized
attagtgcctcttttgcttgct

SEQ ID NO: 638447 - DNA, 22 bp, Artificial Sequence
  chemically synthesized
aaaccattcattagtgcctctt

SEQ ID NO: 638448 - DNA, 22 bp, Artificial Sequence
  chemically synthesized
tcatcattaaaaccattcatta

SEQ ID NO: 638449 - DNA, 22 bp, Artificial Sequence
  chemically synthesized
gtaagattgtcatcattaaaac

SEQ ID NO: 638450 - DNA, 22 bp, Artificial Sequence
  chemically synthesized
atgaatggttttaatgatgaca

SEQ ID NO: 638451 - DNA, 22 bp, Artificial Sequence
  chemically synthesized
gcactggtaagattgtcatcat

SEQ ID NO: 638452 - DNA, 22 bp, Artificial Sequence
  chemically synthesized
agcactggtaagattgtcatca

SEQ ID NO: 638453 - DNA, 22 bp, Artificial Sequence
  chemically synthesized
tagcactggtaagattgtcatc

SEQ ID NO: 638454 - DNA, 22 bp, Artificial Sequence
  chemically synthesized
ttagcactggtaagattgtcat

SEQ ID NO: 638455 - DNA, 22 bp, Artificial Sequence
  chemically synthesized
ttttagcactggtaagattgtc

SEQ ID NO: 638456 - DNA, 22 bp, Artificial Sequence
  chemically synthesized
ttcttttagcactggtaagatt

SEQ ID NO: 638457 - DNA, 22 bp, Artificial Sequence
  chemically synthesized
gttcttttagcactggtaagat

SEQ ID NO: 638458 - DNA, 22 bp, Artificial Sequence
  chemically synthesized
taatgatgacaatcttaccagt

SEQ ID NO: 638459 - DNA, 22 bp, Artificial Sequence
  chemically synthesized
tgttcttttagcactggtaaga

SEQ ID NO: 638460 - DNA, 22 bp, Artificial Sequence
  chemically synthesized
aatgatgacaatcttaccagtg

SEQ ID NO: 638461 - DNA, 22 bp, Artificial Sequence
  chemically synthesized
atgatgacaatcttaccagtgc

SEQ ID NO: 638462 - DNA, 22 bp, Artificial Sequence
  chemically synthesized
ttttgttcttttagcactggta

SEQ ID NO: 638463 - DNA, 22 bp, Artificial Sequence
  chemically synthesized
gttttgttcttttagcactggt

SEQ ID NO: 638464 - DNA, 22 bp, Artificial Sequence
  chemically synthesized
tgttttgttcttttagcactgg

SEQ ID NO: 638465 - DNA, 22 bp, Artificial Sequence
  chemically synthesized
aaattttgttttgttcttttag

SEQ ID NO: 638466 - DNA, 22 bp, Artificial Sequence
  chemically synthesized
caaattttgttttgttctttta

SEQ ID NO: 638467 - DNA, 22 bp, Artificial Sequence
  chemically synthesized
accagtgctaaaagaacaaaac

SEQ ID NO: 638468 - DNA, 22 bp, Artificial Sequence
  chemically synthesized
ccagtgctaaaagaacaaaaca

SEQ ID NO: 638469 - DNA, 22 bp, Artificial Sequence
  chemically synthesized
aaagaacaaaacaaaatttgaa

SEQ ID NO: 638470 - DNA, 22 bp, Artificial Sequence
  chemically synthesized
acacaccaggcaaaagcttcaa

SEQ ID NO: 638471 - DNA, 22 bp, Artificial Sequence
  chemically synthesized
cacacaccaggcaaaagcttca

SEQ ID NO: 638472 - DNA, 22 bp, Artificial Sequence
  chemically synthesized
ccttcacacaccaggcaaaagc

SEQ ID NO: 638473 - DNA, 22 bp, Artificial Sequence
  chemically synthesized
gaagcttttgcctggtgtgtga

SEQ ID NO: 638474 - DNA, 22 bp, Artificial Sequence
  chemically synthesized
aagcttttgcctggtgtgtgaa

SEQ ID NO: 638475 - DNA, 22 bp, Artificial Sequence
  chemically synthesized
aaaagcatggctcccttcacac

SEQ ID NO: 638476 - DNA, 22 bp, Artificial Sequence
  chemically synthesized
ttgcctggtgtgtgaagggagc

SEQ ID NO: 638477 - DNA, 22 bp, Artificial Sequence
  chemically synthesized
tgcctggtgtgtgaagggagcc

SEQ ID NO: 638478 - DNA, 22 bp, Artificial Sequence
  chemically synthesized
gcctggtgtgtgaagggagcca

SEQ ID NO: 638479 - DNA, 22 bp, Artificial Sequence
  chemically synthesized
cctggtgtgtgaagggagccat

SEQ ID NO: 638480 - DNA, 22 bp, Artificial Sequence
  chemically synthesized
gtgtgtgaagggagccatgctt

SEQ ID NO: 638481 - DNA, 22 bp, Artificial Sequence
  chemically synthesized
gtgtaacataaaaaattgaaaa

SEQ ID NO: 638482 - DNA, 22 bp, Artificial Sequence
  chemically synthesized
agtgtaacataaaaaattgaaa

SEQ ID NO: 638483 - DNA, 22 bp, Artificial Sequence
  chemically synthesized
tagtgtaacataaaaaattgaa

SEQ ID NO: 638484 - DNA, 22 bp, Artificial Sequence
  chemically synthesized
ttagtgtaacataaaaaattga

SEQ ID NO: 638485 - DNA, 22 bp, Artificial Sequence
  chemically synthesized
ttcaattttttatgttacacta

SEQ ID NO: 638486 - DNA, 22 bp, Artificial Sequence
  chemically synthesized
tcaattttttatgttacactaa

SEQ ID NO: 638487 - DNA, 22 bp, Artificial Sequence
  chemically synthesized
caattttttatgttacactaaa

SEQ ID NO: 638488 - DNA, 22 bp, Artificial Sequence
  chemically synthesized
aattttttatgttacactaaaa

SEQ ID NO: 638489 - DNA, 22 bp, Artificial Sequence
  chemically synthesized
tttatgttacactaaaagcctc

SEQ ID NO: 638490 - DNA, 22 bp, Artificial Sequence
  chemically synthesized
ttatgttacactaaaagcctcg

SEQ ID NO: 638491 - DNA, 22 bp, Artificial Sequence
  chemically synthesized
tatgttacactaaaagcctcgc

SEQ ID NO: 638492 - DNA, 22 bp, Artificial Sequence
  chemically synthesized
aacataccagtcgcgaggcttt

SEQ ID NO: 638493 - DNA, 22 bp, Artificial Sequence
  chemically synthesized
atgttacactaaaagcctcgcg

SEQ ID NO: 638494 - DNA, 22 bp, Artificial Sequence
  chemically synthesized
tgttacactaaaagcctcgcga

SEQ ID NO: 638495 - DNA, 22 bp, Artificial Sequence
  chemically synthesized
tctgaacataccagtcgcgagg

SEQ ID NO: 638496 - DNA, 22 bp, Artificial Sequence
  chemically synthesized
atctgaacataccagtcgcgag

SEQ ID NO: 638497 - DNA, 22 bp, Artificial Sequence
  chemically synthesized
cactaaaagcctcgcgactggt

SEQ ID NO: 638498 - DNA, 22 bp, Artificial Sequence
  chemically synthesized
cttatctgaacataccagtcgc

SEQ ID NO: 638499 - DNA, 22 bp, Artificial Sequence
  chemically synthesized
acttatctgaacataccagtcg

SEQ ID NO: 638500 - DNA, 22 bp, Artificial Sequence
  chemically synthesized
aaagcctcgcgactggtatgtt

SEQ ID NO: 638501 - DNA, 22 bp, Artificial Sequence
  chemically synthesized
cttacttatctgaacataccag

SEQ ID NO: 638502 - DNA, 22 bp, Artificial Sequence
  chemically synthesized
ctgcttacttatctgaacatac

SEQ ID NO: 638503 - DNA, 22 bp, Artificial Sequence
  chemically synthesized
gctgcttacttatctgaacata

SEQ ID NO: 638504 - DNA, 22 bp, Artificial Sequence
  chemically synthesized
tgctgcttacttatctgaacat

SEQ ID NO: 638505 - DNA, 22 bp, Artificial Sequence
  chemically synthesized
gcgactggtatgttcagataag

SEQ ID NO: 638506 - DNA, 22 bp, Artificial Sequence
  chemically synthesized
aatcctttgctgcttacttatc

SEQ ID NO: 638507 - DNA, 22 bp, Artificial Sequence
  chemically synthesized
gtatgttcagataagtaagcag

SEQ ID NO: 638508 - DNA, 22 bp, Artificial Sequence
  chemically synthesized
agataagtaagcagcaaaggat

SEQ ID NO: 638509 - DNA, 22 bp, Artificial Sequence
  chemically synthesized
caaagtgattaaatcctttgct

SEQ ID NO: 638510 - DNA, 22 bp, Artificial Sequence
  chemically synthesized
acaaagtgattaaatcctttgc

SEQ ID NO: 638511 - DNA, 22 bp, Artificial Sequence
  chemically synthesized
taaagaaatatttacaaagtga

SEQ ID NO: 638512 - DNA, 22 bp, Artificial Sequence
  chemically synthesized
atgacattataaagaaatattt

SEQ ID NO: 638513 - DNA, 22 bp, Artificial Sequence
  chemically synthesized
aatcactttgtaaatatttctt

SEQ ID NO: 638514 - DNA, 22 bp, Artificial Sequence
  chemically synthesized
atcactttgtaaatatttcttt

SEQ ID NO: 638515 - DNA, 22 bp, Artificial Sequence
  chemically synthesized
atctcatgacattataaagaaa

SEQ ID NO: 638516 - DNA, 22 bp, Artificial Sequence
  chemically synthesized
aatctcatgacattataaagaa

SEQ ID NO: 638517 - DNA, 22 bp, Artificial Sequence
  chemically synthesized
taatctcatgacattataaaga

SEQ ID NO: 638518 - DNA, 22 bp, Artificial Sequence
  chemically synthesized
ttaatctcatgacattataaag

SEQ ID NO: 638519 - DNA, 22 bp, Artificial Sequence
  chemically synthesized
tgtaaatatttctttataatgt

SEQ ID NO: 638520 - DNA, 22 bp, Artificial Sequence
  chemically synthesized
gtaaatatttctttataatgtc

SEQ ID NO: 638521 - DNA, 22 bp, Artificial Sequence
  chemically synthesized
taaatatttctttataatgtca

SEQ ID NO: 638522 - DNA, 22 bp, Artificial Sequence
  chemically synthesized
ctttataatgtcatgagattaa

SEQ ID NO: 638523 - DNA, 22 bp, Artificial Sequence
  chemically synthesized
tttataatgtcatgagattaaa

SEQ ID NO: 638524 - DNA, 22 bp, Artificial Sequence
  chemically synthesized
tataatgtcatgagattaaaaa

SEQ ID NO: 638525 - DNA, 22 bp, Artificial Sequence
  chemically synthesized
ataatgtcatgagattaaaaat

SEQ ID NO: 638526 - DNA, 22 bp, Artificial Sequence
  chemically synthesized
taatgtcatgagattaaaaatt

SEQ ID NO: 638527 - DNA, 22 bp, Artificial Sequence
  chemically synthesized
atagaggtataaaatttttaat

SEQ ID NO: 638528 - DNA, 22 bp, Artificial Sequence
  chemically synthesized
aaaattttatacctctatcaac

SEQ ID NO: 638529 - DNA, 22 bp, Artificial Sequence
  chemically synthesized
gagcaaaccaaagtgttgatag

SEQ ID NO: 638530 - DNA, 22 bp, Artificial Sequence
  chemically synthesized
agagcaaaccaaagtgttgata

SEQ ID NO: 638531 - DNA, 22 bp, Artificial Sequence
  chemically synthesized
tatacctctatcaacactttgg

SEQ ID NO: 638532 - DNA, 22 bp, Artificial Sequence
  chemically synthesized
atacctctatcaacactttggt

SEQ ID NO: 638533 - DNA, 22 bp, Artificial Sequence
  chemically synthesized
tacctctatcaacactttggtt

SEQ ID NO: 638534 - DNA, 22 bp, Artificial Sequence
  chemically synthesized
atgtttagagcaaaccaaagtg

SEQ ID NO: 638535 - DNA, 22 bp, Artificial Sequence
  chemically synthesized
ctaatgtttagagcaaaccaaa

SEQ ID NO: 638536 - DNA, 22 bp, Artificial Sequence
  chemically synthesized
gctaatgtttagagcaaaccaa

SEQ ID NO: 638537 - DNA, 22 bp, Artificial Sequence
  chemically synthesized
tatcaacactttggtttgctct

SEQ ID NO: 638538 - DNA, 22 bp, Artificial Sequence
  chemically synthesized
tcaacactttggtttgctctaa

SEQ ID NO: 638539 - DNA, 22 bp, Artificial Sequence
  chemically synthesized
aaaatatttgctaatgtttaga

SEQ ID NO: 638540 - DNA, 22 bp, Artificial Sequence
  chemically synthesized
ttgaaaatatttgctaatgttt

SEQ ID NO: 638541 - DNA, 22 bp, Artificial Sequence
  chemically synthesized
tggtttgctctaaacattagca

SEQ ID NO: 638542 - DNA, 22 bp, Artificial Sequence
  chemically synthesized
ggtttgctctaaacattagcaa

SEQ ID NO: 638543 - DNA, 22 bp, Artificial Sequence
  chemically synthesized
tgttgaaaatatttgctaatgt

SEQ ID NO: 638544 - DNA, 22 bp, Artificial Sequence
  chemically synthesized
gtttgctctaaacattagcaaa

SEQ ID NO: 638545 - DNA, 22 bp, Artificial Sequence
  chemically synthesized
ctgttgaaaatatttgctaatg

SEQ ID NO: 638546 - DNA, 22 bp, Artificial Sequence
  chemically synthesized
gctctaaacattagcaaatatt

SEQ ID NO: 638547 - DNA, 22 bp, Artificial Sequence
  chemically synthesized
ctctaaacattagcaaatattt

SEQ ID NO: 638548 - DNA, 22 bp, Artificial Sequence
  chemically synthesized
tacatttctgttgaaaatattt

SEQ ID NO: 638549 - DNA, 22 bp, Artificial Sequence
  chemically synthesized
taaacattagcaaatattttca

SEQ ID NO: 638550 - DNA, 22 bp, Artificial Sequence
  chemically synthesized
atacatttctgttgaaaatatt

SEQ ID NO: 638551 - DNA, 22 bp, Artificial Sequence
  chemically synthesized
aacattagcaaatattttcaac

SEQ ID NO: 638552 - DNA, 22 bp, Artificial Sequence
  chemically synthesized
ttatacatttctgttgaaaata

SEQ ID NO: 638553 - DNA, 22 bp, Artificial Sequence
  chemically synthesized
cattcttatacatttctgttga

SEQ ID NO: 638554 - DNA, 22 bp, Artificial Sequence
  chemically synthesized
gcaaatattttcaacagaaatg

SEQ ID NO: 638555 - DNA, 22 bp, Artificial Sequence
  chemically synthesized
ctccattcttatacatttctgt

SEQ ID NO: 638556 - DNA, 22 bp, Artificial Sequence
  chemically synthesized
actccattcttatacatttctg

SEQ ID NO: 638557 - DNA, 22 bp, Artificial Sequence
  chemically synthesized
tcaacagaaatgtataagaatg

SEQ ID NO: 638558 - DNA, 22 bp, Artificial Sequence
  chemically synthesized
caacagaaatgtataagaatgg

SEQ ID NO: 638559 - DNA, 22 bp, Artificial Sequence
  chemically synthesized
aacagaaatgtataagaatgga

SEQ ID NO: 638560 - DNA, 22 bp, Artificial Sequence
  chemically synthesized
tcaaggggaggtgataggaaca

SEQ ID NO: 638561 - DNA, 22 bp, Artificial Sequence
  chemically synthesized
atcaaggggaggtgataggaac

SEQ ID NO: 638562 - DNA, 22 bp, Artificial Sequence
  chemically synthesized
ctatcacctccccttgataagt

SEQ ID NO: 638563 - DNA, 22 bp, Artificial Sequence
  chemically synthesized
tcacctccccttgataagttta

SEQ ID NO: 638564 - DNA, 22 bp, Artificial Sequence
  chemically synthesized
cccttgataagtttatcatttg

SEQ ID NO: 638565 - DNA, 22 bp, Artificial Sequence
  chemically synthesized
aagaaaatatggcaaatgataa

SEQ ID NO: 638566 - DNA, 22 bp, Artificial Sequence
  chemically synthesized
gaagaaaatatggcaaatgata

SEQ ID NO: 638567 - DNA, 22 bp, Artificial Sequence
  chemically synthesized
tgaagaaaatatggcaaatgat

SEQ ID NO: 638568 - DNA, 22 bp, Artificial Sequence
  chemically synthesized
ttgaagaaaatatggcaaatga

SEQ ID NO: 638569 - DNA, 22 bp, Artificial Sequence
  chemically synthesized
gataagtttatcatttgccata

SEQ ID NO: 638570 - DNA, 22 bp, Artificial Sequence
  chemically synthesized
ataagtttatcatttgccatat

SEQ ID NO: 638571 - DNA, 22 bp, Artificial Sequence
  chemically synthesized
aaaaaacttttgaagaaaatat

SEQ ID NO: 638572 - DNA, 22 bp, Artificial Sequence
  chemically synthesized
caaaaaacttttgaagaaaata

SEQ ID NO: 638573 - DNA, 22 bp, Artificial Sequence
  chemically synthesized
atcatttgccatattttcttca

SEQ ID NO: 638574 - DNA, 22 bp, Artificial Sequence
  chemically synthesized
tcatttgccatattttcttcaa

SEQ ID NO: 638575 - DNA, 22 bp, Artificial Sequence
  chemically synthesized
ttcaaaaaacttttgaagaaaa

SEQ ID NO: 638576 - DNA, 22 bp, Artificial Sequence
  chemically synthesized
cttcaaaaaacttttgaagaaa

SEQ ID NO: 638577 - DNA, 22 bp, Artificial Sequence
  chemically synthesized
tcttcaaaaaacttttgaagaa

SEQ ID NO: 638578 - DNA, 22 bp, Artificial Sequence
  chemically synthesized
tttcttcaaaaaacttttgaag

SEQ ID NO: 638579 - DNA, 22 bp, Artificial Sequence
  chemically synthesized
ctttcttcaaaaaacttttgaa

SEQ ID NO: 638580 - DNA, 22 bp, Artificial Sequence
  chemically synthesized
gccatattttcttcaaaagttt

SEQ ID NO: 638581 - DNA, 22 bp, Artificial Sequence
  chemically synthesized
tctttcttcaaaaaacttttga

SEQ ID NO: 638582 - DNA, 22 bp, Artificial Sequence
  chemically synthesized
ccatattttcttcaaaagtttt

SEQ ID NO: 638583 - DNA, 22 bp, Artificial Sequence
  chemically synthesized
ttctttcttcaaaaaacttttg

SEQ ID NO: 638584 - DNA, 22 bp, Artificial Sequence
  chemically synthesized
acttttctttcttcaaaaaact

SEQ ID NO: 638585 - DNA, 22 bp, Artificial Sequence
  chemically synthesized
ttaacttttctttcttcaaaaa

SEQ ID NO: 638586 - DNA, 22 bp, Artificial Sequence
  chemically synthesized
tcttcaaaagttttttgaagaa

SEQ ID NO: 638587 - DNA, 22 bp, Artificial Sequence
  chemically synthesized
cttcaaaagttttttgaagaaa

SEQ ID NO: 638588 - DNA, 22 bp, Artificial Sequence
  chemically synthesized
ttcaaaagttttttgaagaaag

SEQ ID NO: 638589 - DNA, 22 bp, Artificial Sequence
  chemically synthesized
gctgttaacttttctttcttca

SEQ ID NO: 638590 - DNA, 22 bp, Artificial Sequence
  chemically synthesized
caaaagttttttgaagaaagaa

SEQ ID NO: 638591 - DNA, 22 bp, Artificial Sequence
  chemically synthesized
ggctgttaacttttctttcttc

SEQ ID NO: 638592 - DNA, 22 bp, Artificial Sequence
  chemically synthesized
aaaagttttttgaagaaagaaa

SEQ ID NO: 638593 - DNA, 22 bp, Artificial Sequence
  chemically synthesized
tggctgttaacttttctttctt

SEQ ID NO: 638594 - DNA, 22 bp, Artificial Sequence
  chemically synthesized
ctttggctgttaacttttcttt

SEQ ID NO: 638595 - DNA, 22 bp, Artificial Sequence
  chemically synthesized
tgctttggctgttaacttttct

SEQ ID NO: 638596 - DNA, 22 bp, Artificial Sequence
  chemically synthesized
ctgctttggctgttaacttttc

SEQ ID NO: 638597 - DNA, 22 bp, Artificial Sequence
  chemically synthesized
tttgaagaaagaaaagttaaca

SEQ ID NO: 638598 - DNA, 22 bp, Artificial Sequence
  chemically synthesized
ttgaagaaagaaaagttaacag

SEQ ID NO: 638599 - DNA, 22 bp, Artificial Sequence
  chemically synthesized
tgaagaaagaaaagttaacagc

SEQ ID NO: 638600 - DNA, 22 bp, Artificial Sequence
  chemically synthesized
gaagaaagaaaagttaacagcc

SEQ ID NO: 638601 - DNA, 22 bp, Artificial Sequence
  chemically synthesized
aagaaagaaaagttaacagcca

SEQ ID NO: 638602 - DNA, 22 bp, Artificial Sequence
  chemically synthesized
acagccaaagcagaagctccct

SEQ ID NO: 638603 - DNA, 22 bp, Artificial Sequence
  chemically synthesized
aggcgggcatgtgagggagctt

SEQ ID NO: 638604 - DNA, 22 bp, Artificial Sequence
  chemically synthesized
cctcacatgcccgcctcaacac

SEQ ID NO: 638605 - DNA, 22 bp, Artificial Sequence
  chemically synthesized
acatgcccgcctcaacaccata

SEQ ID NO: 638606 - DNA, 22 bp, Artificial Sequence
  chemically synthesized
agggcagcggggaggagagaat

SEQ ID NO: 638607 - DNA, 22 bp, Artificial Sequence
  chemically synthesized
aacaccataccattctctcctc

SEQ ID NO: 638608 - DNA, 22 bp, Artificial Sequence
  chemically synthesized
gagggcagcggggaggagagaa

SEQ ID NO: 638609 - DNA, 22 bp, Artificial Sequence
  chemically synthesized
cttgagggcagcggggaggaga

SEQ ID NO: 638610 - DNA, 22 bp, Artificial Sequence
  chemically synthesized
tctccttgagggcagcggggag

SEQ ID NO: 638611 - DNA, 22 bp, Artificial Sequence
  chemically synthesized
tctcctccccgctgccctcaag

SEQ ID NO: 638612 - DNA, 22 bp, Artificial Sequence
  chemically synthesized
tcctccccgctgccctcaagga

SEQ ID NO: 638613 - DNA, 22 bp, Artificial Sequence
  chemically synthesized
ctccccgctgccctcaaggaga

SEQ ID NO: 638614 - DNA, 22 bp, Artificial Sequence
  chemically synthesized
agtgtggcattatctccttgag

SEQ ID NO: 638615 - DNA, 22 bp, Artificial Sequence
  chemically synthesized
cccgctgccctcaaggagataa

SEQ ID NO: 638616 - DNA, 22 bp, Artificial Sequence
  chemically synthesized
ccctcaaggagataatgccaca

SEQ ID NO: 638617 - DNA, 22 bp, Artificial Sequence
  chemically synthesized
ggcatgaaattcagtgtggcat

SEQ ID NO: 638618 - DNA, 22 bp, Artificial Sequence
  chemically synthesized
aaggagataatgccacactgaa

SEQ ID NO: 638619 - DNA, 22 bp, Artificial Sequence
  chemically synthesized
atggtaacactgggcatgaaat

SEQ ID NO: 638620 - DNA, 22 bp, Artificial Sequence
  chemically synthesized
atacattcatggtaacactggg

SEQ ID NO: 638621 - DNA, 22 bp, Artificial Sequence
  chemically synthesized
aatttcatgcccagtgttacca

SEQ ID NO: 638622 - DNA, 22 bp, Artificial Sequence
  chemically synthesized
ttgatacattcatggtaacact

SEQ ID NO: 638623 - DNA, 22 bp, Artificial Sequence
  chemically synthesized
gttgatacattcatggtaacac

SEQ ID NO: 638624 - DNA, 22 bp, Artificial Sequence
  chemically synthesized
catgcccagtgttaccatgaat

SEQ ID NO: 638625 - DNA, 22 bp, Artificial Sequence
  chemically synthesized
atgcccagtgttaccatgaatg

SEQ ID NO: 638626 - DNA, 22 bp, Artificial Sequence
  chemically synthesized
gtatttgttgatacattcatgg

SEQ ID NO: 638627 - DNA, 22 bp, Artificial Sequence
  chemically synthesized
aacctagtatttgttgatacat

SEQ ID NO: 638628 - DNA, 22 bp, Artificial Sequence
  chemically synthesized
agctcaacctagtatttgttga

SEQ ID NO: 638629 - DNA, 22 bp, Artificial Sequence
  chemically synthesized
ccatgaatgtatcaacaaatac

SEQ ID NO: 638630 - DNA, 22 bp, Artificial Sequence
  chemically synthesized
aagctcaacctagtatttgttg

SEQ ID NO: 638631 - DNA, 22 bp, Artificial Sequence
  chemically synthesized
taagctcaacctagtatttgtt

SEQ ID NO: 638632 - DNA, 22 bp, Artificial Sequence
  chemically synthesized
ttaagctcaacctagtatttgt

SEQ ID NO: 638633 - DNA, 22 bp, Artificial Sequence
  chemically synthesized
tttaagctcaacctagtatttg

SEQ ID NO: 638634 - DNA, 22 bp, Artificial Sequence
  chemically synthesized
ttttaagctcaacctagtattt

SEQ ID NO: 638635 - DNA, 22 bp, Artificial Sequence
  chemically synthesized
ggttgagcttaaaaaagatgct

SEQ ID NO: 638636 - DNA, 22 bp, Artificial Sequence
  chemically synthesized
agcttaaaaaagatgctgatgt

SEQ ID NO: 638637 - DNA, 22 bp, Artificial Sequence
  chemically synthesized
aaaaaagatgctgatgtttgcc

SEQ ID NO: 638638 - DNA, 22 bp, Artificial Sequence
  chemically synthesized
aaaaagatgctgatgtttgcct

SEQ ID NO: 638639 - DNA, 22 bp, Artificial Sequence
  chemically synthesized
taggtgaaagaaaaatacaggc

SEQ ID NO: 638640 - DNA, 22 bp, Artificial Sequence
  chemically synthesized
gtaggtgaaagaaaaatacagg

SEQ ID NO: 638641 - DNA, 22 bp, Artificial Sequence
  chemically synthesized
tgtaggtgaaagaaaaatacag

SEQ ID NO: 638642 - DNA, 22 bp, Artificial Sequence
  chemically synthesized
ttgtaggtgaaagaaaaataca

SEQ ID NO: 638643 - DNA, 22 bp, Artificial Sequence
  chemically synthesized
atgtttgcctgtatttttcttt

SEQ ID NO: 638644 - DNA, 22 bp, Artificial Sequence
  chemically synthesized
gcctgtatttttctttcaccta

SEQ ID NO: 638645 - DNA, 22 bp, Artificial Sequence
  chemically synthesized
cctgtatttttctttcacctac

SEQ ID NO: 638646 - DNA, 22 bp, Artificial Sequence
  chemically synthesized
tatttttctttcacctacaaaa

SEQ ID NO: 638647 - DNA, 22 bp, Artificial Sequence
  chemically synthesized
ttctttcacctacaaaaacacc

SEQ ID NO: 638648 - DNA, 22 bp, Artificial Sequence
  chemically synthesized
tctttcacctacaaaaacaccc

SEQ ID NO: 638649 - DNA, 22 bp, Artificial Sequence
  chemically synthesized
ctttcacctacaaaaacaccca

SEQ ID NO: 638650 - DNA, 22 bp, Artificial Sequence
  chemically synthesized
aatcacataaaatgggtgtttt

SEQ ID NO: 638651 - DNA, 22 bp, Artificial Sequence
  chemically synthesized
tttcacctacaaaaacacccat

SEQ ID NO: 638652 - DNA, 22 bp, Artificial Sequence
  chemically synthesized
tcacctacaaaaacacccattt

SEQ ID NO: 638653 - DNA, 22 bp, Artificial Sequence
  chemically synthesized
cacctacaaaaacacccatttt

SEQ ID NO: 638654 - DNA, 22 bp, Artificial Sequence
  chemically synthesized
acctacaaaaacacccatttta

SEQ ID NO: 638655 - DNA, 22 bp, Artificial Sequence
  chemically synthesized
gattgaatcacataaaatgggt

SEQ ID NO: 638656 - DNA, 22 bp, Artificial Sequence
  chemically synthesized
ttagattgaatcacataaaatg

SEQ ID NO: 638657 - DNA, 22 bp, Artificial Sequence
  chemically synthesized
caaaaacacccattttatgtga

SEQ ID NO: 638658 - DNA, 22 bp, Artificial Sequence
  chemically synthesized
tatgtgattcaatctaataaca

SEQ ID NO: 638659 - DNA, 22 bp, Artificial Sequence
  chemically synthesized
atgtgattcaatctaataacat

SEQ ID NO: 638660 - DNA, 22 bp, Artificial Sequence
  chemically synthesized
tgtgattcaatctaataacatt

SEQ ID NO: 638661 - DNA, 22 bp, Artificial Sequence
  chemically synthesized
aaaacatgcaaaataatgttat

SEQ ID NO: 638662 - DNA, 22 bp, Artificial Sequence
  chemically synthesized
aaaaacatgcaaaataatgtta

SEQ ID NO: 638663 - DNA, 22 bp, Artificial Sequence
  chemically synthesized
aatctaataacattattttgca

SEQ ID NO: 638664 - DNA, 22 bp, Artificial Sequence
  chemically synthesized
aagtttaaaaacatgcaaaata

SEQ ID NO: 638665 - DNA, 22 bp, Artificial Sequence
  chemically synthesized
aaagtttaaaaacatgcaaaat

SEQ ID NO: 638666 - DNA, 22 bp, Artificial Sequence
  chemically synthesized
ataacattattttgcatgtttt

SEQ ID NO: 638667 - DNA, 22 bp, Artificial Sequence
  chemically synthesized
aatttaaagtttaaaaacatgc

SEQ ID NO: 638668 - DNA, 22 bp, Artificial Sequence
  chemically synthesized
aaatttaaagtttaaaaacatg

SEQ ID NO: 638669 - DNA, 22 bp, Artificial Sequence
  chemically synthesized
ttaaatttaaagtttaaaaaca

SEQ ID NO: 638670 - DNA, 22 bp, Artificial Sequence
  chemically synthesized
ttttgcatgtttttaaacttta

SEQ ID NO: 638671 - DNA, 22 bp, Artificial Sequence
  chemically synthesized
tgcatgtttttaaactttaaat

SEQ ID NO: 638672 - DNA, 22 bp, Artificial Sequence
  chemically synthesized
gcatgtttttaaactttaaatt

SEQ ID NO: 638673 - DNA, 22 bp, Artificial Sequence
  chemically synthesized
catgtttttaaactttaaattt

SEQ ID NO: 638674 - DNA, 22 bp, Artificial Sequence
  chemically synthesized
aatgtgaagttcttaaatttaa

SEQ ID NO: 638675 - DNA, 22 bp, Artificial Sequence
  chemically synthesized
aaatgtgaagttcttaaattta

SEQ ID NO: 638676 - DNA, 22 bp, Artificial Sequence
  chemically synthesized
ttaaatgtgaagttcttaaatt

SEQ ID NO: 638677 - DNA, 22 bp, Artificial Sequence
  chemically synthesized
ttaaactttaaatttaagaact

SEQ ID NO: 638678 - DNA, 22 bp, Artificial Sequence
  chemically synthesized
taaactttaaatttaagaactt

SEQ ID NO: 638679 - DNA, 22 bp, Artificial Sequence
  chemically synthesized
aaactttaaatttaagaacttc

SEQ ID NO: 638680 - DNA, 22 bp, Artificial Sequence
  chemically synthesized
aactttaaatttaagaacttca

SEQ ID NO: 638681 - DNA, 22 bp, Artificial Sequence
  chemically synthesized
taaatttaagaacttcacattt

SEQ ID NO: 638682 - DNA, 22 bp, Artificial Sequence
  chemically synthesized
aaatttaagaacttcacattta

SEQ ID NO: 638683 - DNA, 22 bp, Artificial Sequence
  chemically synthesized
aatttaagaacttcacatttaa

SEQ ID NO: 638684 - DNA, 22 bp, Artificial Sequence
  chemically synthesized
aagaacttcacatttaagaata

SEQ ID NO: 638685 - DNA, 22 bp, Artificial Sequence
  chemically synthesized
gaatggtatgtatattcttaaa

SEQ ID NO: 638686 - DNA, 22 bp, Artificial Sequence
  chemically synthesized
agaacttcacatttaagaatat

SEQ ID NO: 638687 - DNA, 22 bp, Artificial Sequence
  chemically synthesized
agaatggtatgtatattcttaa

SEQ ID NO: 638688 - DNA, 22 bp, Artificial Sequence
  chemically synthesized
ttagaatggtatgtatattctt

SEQ ID NO: 638689 - DNA, 22 bp, Artificial Sequence
  chemically synthesized
cacatttaagaatatacatacc

SEQ ID NO: 638690 - DNA, 22 bp, Artificial Sequence
  chemically synthesized
acatttaagaatatacatacca

SEQ ID NO: 638691 - DNA, 22 bp, Artificial Sequence
  chemically synthesized
aagaatatacataccattctaa

SEQ ID NO: 638692 - DNA, 22 bp, Artificial Sequence
  chemically synthesized
agaatatacataccattctaag

SEQ ID NO: 638693 - DNA, 22 bp, Artificial Sequence
  chemically synthesized
aaggcaaaaagcaactcttaga

SEQ ID NO: 638694 - DNA, 22 bp, Artificial Sequence
  chemically synthesized
caaaatggtgttgaaggcaaaa

SEQ ID NO: 638695 - DNA, 22 bp, Artificial Sequence
  chemically synthesized
taagagttgctttttgccttca

SEQ ID NO: 638696 - DNA, 22 bp, Artificial Sequence
  chemically synthesized
agagttgctttttgccttcaac

SEQ ID NO: 638697 - DNA, 22 bp, Artificial Sequence
  chemically synthesized
ctttttgccttcaacaccattt

SEQ ID NO: 638698 - DNA, 22 bp, Artificial Sequence
  chemically synthesized
gagaaatctccaaaatggtgtt

SEQ ID NO: 638699 - DNA, 22 bp, Artificial Sequence
  chemically synthesized
tttgccttcaacaccattttgg

SEQ ID NO: 638700 - DNA, 22 bp, Artificial Sequence
  chemically synthesized
ttgccttcaacaccattttgga

SEQ ID NO: 638701 - DNA, 22 bp, Artificial Sequence
  chemically synthesized
tgccttcaacaccattttggag

SEQ ID NO: 638702 - DNA, 22 bp, Artificial Sequence
  chemically synthesized
gccttcaacaccattttggaga

SEQ ID NO: 638703 - DNA, 22 bp, Artificial Sequence
  chemically synthesized
ccttcaacaccattttggagat

SEQ ID NO: 638704 - DNA, 22 bp, Artificial Sequence
  chemically synthesized
caacaccattttggagatttct

SEQ ID NO: 638705 - DNA, 22 bp, Artificial Sequence
  chemically synthesized
aacaccattttggagatttctc

SEQ ID NO: 638706 - DNA, 22 bp, Artificial Sequence
  chemically synthesized
tgtatcgacctggagaaatctc

SEQ ID NO: 638707 - DNA, 22 bp, Artificial Sequence
  chemically synthesized
ttatgtatcgacctggagaaat

SEQ ID NO: 638708 - DNA, 22 bp, Artificial Sequence
  chemically synthesized
tggagatttctccaggtcgata

SEQ ID NO: 638709 - DNA, 22 bp, Artificial Sequence
  chemically synthesized
ggagatttctccaggtcgatac

SEQ ID NO: 638710 - DNA, 22 bp, Artificial Sequence
  chemically synthesized
gagatttctccaggtcgataca

SEQ ID NO: 638711 - DNA, 22 bp, Artificial Sequence
  chemically synthesized
aaatagcaaactattatgtatc

SEQ ID NO: 638712 - DNA, 22 bp, Artificial Sequence
  chemically synthesized
ctccaggtcgatacataatagt

SEQ ID NO: 638713 - DNA, 22 bp, Artificial Sequence
  chemically synthesized
tccaggtcgatacataatagtt

SEQ ID NO: 638714 - DNA, 22 bp, Artificial Sequence
  chemically synthesized
caggtcgatacataatagtttg

SEQ ID NO: 638715 - DNA, 22 bp, Artificial Sequence
  chemically synthesized
tggcagttaaaatagcaaacta

SEQ ID NO: 638716 - DNA, 22 bp, Artificial Sequence
  chemically synthesized
atggcagttaaaatagcaaact

SEQ ID NO: 638717 - DNA, 22 bp, Artificial Sequence
  chemically synthesized
gctattttaactgccataaggt

SEQ ID NO: 638718 - DNA, 22 bp, Artificial Sequence
  chemically synthesized
ctattttaactgccataaggta

SEQ ID NO: 638719 - DNA, 22 bp, Artificial Sequence
  chemically synthesized
ttttaactgccataaggtatta

SEQ ID NO: 638720 - DNA, 22 bp, Artificial Sequence
  chemically synthesized
aagcaacagaataataatacct

SEQ ID NO: 638721 - DNA, 22 bp, Artificial Sequence
  chemically synthesized
taactgccataaggtattatta

SEQ ID NO: 638722 - DNA, 22 bp, Artificial Sequence
  chemically synthesized
aactgccataaggtattattat

SEQ ID NO: 638723 - DNA, 22 bp, Artificial Sequence
  chemically synthesized
actgccataaggtattattatt

SEQ ID NO: 638724 - DNA, 22 bp, Artificial Sequence
  chemically synthesized
ccataaggtattattattctgt

SEQ ID NO: 638725 - DNA, 22 bp, Artificial Sequence
  chemically synthesized
gcatattcaagcaacagaataa

SEQ ID NO: 638726 - DNA, 22 bp, Artificial Sequence
  chemically synthesized
ttattctgttgcttgaatatgc

SEQ ID NO: 638727 - DNA, 22 bp, Artificial Sequence
  chemically synthesized
ttctgttgcttgaatatgccaa

SEQ ID NO: 638728 - DNA, 22 bp, Artificial Sequence
  chemically synthesized
tgttgcttgaatatgccaacat

SEQ ID NO: 638729 - DNA, 22 bp, Artificial Sequence
  chemically synthesized
ttgcttgaatatgccaacattt

SEQ ID NO: 638730 - DNA, 22 bp, Artificial Sequence
  chemically synthesized
cttgaatatgccaacattttcc

SEQ ID NO: 638731 - DNA, 22 bp, Artificial Sequence
  chemically synthesized
aatgtccatggacaggaaaatg

SEQ ID NO: 638732 - DNA, 22 bp, Artificial Sequence
  chemically synthesized
gaatatgccaacattttcctgt

SEQ ID NO: 638733 - DNA, 22 bp, Artificial Sequence
  chemically synthesized
aatatgccaacattttcctgtc

SEQ ID NO: 638734 - DNA, 22 bp, Artificial Sequence
  chemically synthesized
gaaacaacctaaatgtccatgg

SEQ ID NO: 638735 - DNA, 22 bp, Artificial Sequence
  chemically synthesized
tcctgtccatggacatttaggt

SEQ ID NO: 638736 - DNA, 22 bp, Artificial Sequence
  chemically synthesized
cctgtccatggacatttaggtt

SEQ ID NO: 638737 - DNA, 22 bp, Artificial Sequence
  chemically synthesized
ctgtccatggacatttaggttg

SEQ ID NO: 638738 - DNA, 22 bp, Artificial Sequence
  chemically synthesized
tccatggacatttaggttgttt

SEQ ID NO: 638739 - DNA, 22 bp, Artificial Sequence
  chemically synthesized
taatagtgaaaagttggaaaca

SEQ ID NO: 638740 - DNA, 22 bp, Artificial Sequence
  chemically synthesized
ataatagtgaaaagttggaaac

SEQ ID NO: 638741 - DNA, 22 bp, Artificial Sequence
  chemically synthesized
tttataatagtgaaaagttgga

SEQ ID NO: 638742 - DNA, 22 bp, Artificial Sequence
  chemically synthesized
aggttgtttccaacttttcact

SEQ ID NO: 638743 - DNA, 22 bp, Artificial Sequence
  chemically synthesized
ggttgtttccaacttttcacta

SEQ ID NO: 638744 - DNA, 22 bp, Artificial Sequence
  chemically synthesized
tatcattgtttataatagtgaa

SEQ ID NO: 638745 - DNA, 22 bp, Artificial Sequence
  chemically synthesized
tttccaacttttcactattata

SEQ ID NO: 638746 - DNA, 22 bp, Artificial Sequence
  chemically synthesized
attgtatcattgtttataatag

SEQ ID NO: 638747 - DNA, 22 bp, Artificial Sequence
  chemically synthesized
ccaacttttcactattataaac

SEQ ID NO: 638748 - DNA, 22 bp, Artificial Sequence
  chemically synthesized
cattgtatcattgtttataata

SEQ ID NO: 638749 - DNA, 22 bp, Artificial Sequence
  chemically synthesized
caacttttcactattataaaca

SEQ ID NO: 638750 - DNA, 22 bp, Artificial Sequence
  chemically synthesized
ttcactattataaacaatgata

SEQ ID NO: 638751 - DNA, 22 bp, Artificial Sequence
  chemically synthesized
tcactattataaacaatgatac

SEQ ID NO: 638752 - DNA, 22 bp, Artificial Sequence
  chemically synthesized
cactattataaacaatgataca

SEQ ID NO: 638753 - DNA, 22 bp, Artificial Sequence
  chemically synthesized
actattataaacaatgatacaa

SEQ ID NO: 638754 - DNA, 22 bp, Artificial Sequence
  chemically synthesized
ttataaacaatgatacaatgaa

SEQ ID NO: 638755 - DNA, 22 bp, Artificial Sequence
  chemically synthesized
taaacaatgatacaatgaaatt

SEQ ID NO: 638756 - DNA, 22 bp, Artificial Sequence
  chemically synthesized
aacaggtatccaaggagatagg

SEQ ID NO: 638757 - DNA, 22 bp, Artificial Sequence
  chemically synthesized
caacaggtatccaaggagatag

SEQ ID NO: 638758 - DNA, 22 bp, Artificial Sequence
  chemically synthesized
ttttttatacctatctccttgg

SEQ ID NO: 638759 - DNA, 22 bp, Artificial Sequence
  chemically synthesized
ttcaacaggtatccaaggagat

SEQ ID NO: 638760 - DNA, 22 bp, Artificial Sequence
  chemically synthesized
ttttatacctatctccttggat

SEQ ID NO: 638761 - DNA, 22 bp, Artificial Sequence
  chemically synthesized
tttatacctatctccttggata

SEQ ID NO: 638762 - DNA, 22 bp, Artificial Sequence
  chemically synthesized
ttatacctatctccttggatac

SEQ ID NO: 638763 - DNA, 22 bp, Artificial Sequence
  chemically synthesized
tatacctatctccttggatacc

SEQ ID NO: 638764 - DNA, 22 bp, Artificial Sequence
  chemically synthesized
atacctatctccttggatacct

SEQ ID NO: 638765 - DNA, 22 bp, Artificial Sequence
  chemically synthesized
tacctatctccttggatacctg

SEQ ID NO: 638766 - DNA, 22 bp, Artificial Sequence
  chemically synthesized
taaagaatctcttcaacaggta

SEQ ID NO: 638767 - DNA, 22 bp, Artificial Sequence
  chemically synthesized
tctccttggatacctgttgaag

SEQ ID NO: 638768 - DNA, 22 bp, Artificial Sequence
  chemically synthesized
tgtaaagaatctcttcaacagg

SEQ ID NO: 638769 - DNA, 22 bp, Artificial Sequence
  chemically synthesized
cttggatacctgttgaagagat

SEQ ID NO: 638770 - DNA, 22 bp, Artificial Sequence
  chemically synthesized
tattctgtaaagaatctcttca

SEQ ID NO: 638771 - DNA, 22 bp, Artificial Sequence
  chemically synthesized
ggatacctgttgaagagattct

SEQ ID NO: 638772 - DNA, 22 bp, Artificial Sequence
  chemically synthesized
gatacctgttgaagagattctt

SEQ ID NO: 638773 - DNA, 22 bp, Artificial Sequence
  chemically synthesized
ttgaagagattctttacagaat

SEQ ID NO: 638774 - DNA, 22 bp, Artificial Sequence
  chemically synthesized
cacatcaaactatattctgtaa

SEQ ID NO: 638775 - DNA, 22 bp, Artificial Sequence
  chemically synthesized
aagagattctttacagaatata

SEQ ID NO: 638776 - DNA, 22 bp, Artificial Sequence
  chemically synthesized
tttacagaatatagtttgatgt

SEQ ID NO: 638777 - DNA, 22 bp, Artificial Sequence
  chemically synthesized
tacagaatatagtttgatgtgg

SEQ ID NO: 638778 - DNA, 22 bp, Artificial Sequence
  chemically synthesized
acagaatatagtttgatgtgga

SEQ ID NO: 638779 - DNA, 22 bp, Artificial Sequence
  chemically synthesized
agatccaacaattccacatcaa

SEQ ID NO: 638780 - DNA, 22 bp, Artificial Sequence
  chemically synthesized
cagaatatagtttgatgtggaa

SEQ ID NO: 638781 - DNA, 22 bp, Artificial Sequence
  chemically synthesized
ctaagatccaacaattccacat

SEQ ID NO: 638782 - DNA, 22 bp, Artificial Sequence
  chemically synthesized
aagatgttgctaagatccaaca

SEQ ID NO: 638783 - DNA, 22 bp, Artificial Sequence
  chemically synthesized
gatgtggaattgttggatctta

SEQ ID NO: 638784 - DNA, 22 bp, Artificial Sequence
  chemically synthesized
atgtggaattgttggatcttag

SEQ ID NO: 638785 - DNA, 22 bp, Artificial Sequence
  chemically synthesized
ttggatcttagcaacatcttca

SEQ ID NO: 638786 - DNA, 22 bp, Artificial Sequence
  chemically synthesized
gatcttagcaacatcttcaaca

SEQ ID NO: 638787 - DNA, 22 bp, Artificial Sequence
  chemically synthesized
ggtgacatgtagcaatgttgaa

SEQ ID NO: 638788 - DNA, 22 bp, Artificial Sequence
  chemically synthesized
agcaacatcttcaacattgcta

SEQ ID NO: 638789 - DNA, 22 bp, Artificial Sequence
  chemically synthesized
gcaacatcttcaacattgctac

SEQ ID NO: 638790 - DNA, 22 bp, Artificial Sequence
  chemically synthesized
caacattgctacatgtcaccga

SEQ ID NO: 638791 - DNA, 22 bp, Artificial Sequence
  chemically synthesized
aacattgctacatgtcaccgaa

SEQ ID NO: 638792 - DNA, 22 bp, Artificial Sequence
  chemically synthesized
tcacccagagcgattcggtgac

SEQ ID NO: 638793 - DNA, 22 bp, Artificial Sequence
  chemically synthesized
gtcacccagagcgattcggtga

SEQ ID NO: 638794 - DNA, 22 bp, Artificial Sequence
  chemically synthesized
ctacatgtcaccgaatcgctct

SEQ ID NO: 638795 - DNA, 22 bp, Artificial Sequence
  chemically synthesized
catgtcaccgaatcgctctggg

SEQ ID NO: 638796 - DNA, 22 bp, Artificial Sequence
  chemically synthesized
gtaaaagcaccgatttgtcacc

SEQ ID NO: 638797 - DNA, 22 bp, Artificial Sequence
  chemically synthesized
tgggtgacaaatcggtgctttt

SEQ ID NO: 638798 - DNA, 22 bp, Artificial Sequence
  chemically synthesized
ggtgacaaatcggtgcttttac

SEQ ID NO: 638799 - DNA, 22 bp, Artificial Sequence
  chemically synthesized
aagcgagagtaaattggtaaaa

SEQ ID NO: 638800 - DNA, 22 bp, Artificial Sequence
  chemically synthesized
ctgaagcgagagtaaattggta

SEQ ID NO: 638801 - DNA, 22 bp, Artificial Sequence
  chemically synthesized
actactgaagcgagagtaaatt

SEQ ID NO: 638802 - DNA, 22 bp, Artificial Sequence
  chemically synthesized
attcactactgaagcgagagta

SEQ ID NO: 638803 - DNA, 22 bp, Artificial Sequence
  chemically synthesized
ttaccaatttactctcgcttca

SEQ ID NO: 638804 - DNA, 22 bp, Artificial Sequence
  chemically synthesized
taccaatttactctcgcttcag

SEQ ID NO: 638805 - DNA, 22 bp, Artificial Sequence
  chemically synthesized
accaatttactctcgcttcagt

SEQ ID NO: 638806 - DNA, 22 bp, Artificial Sequence
  chemically synthesized
ccaatttactctcgcttcagta

SEQ ID NO: 638807 - DNA, 22 bp, Artificial Sequence
  chemically synthesized
actctcgcttcagtagtgaatg

SEQ ID NO: 638808 - DNA, 22 bp, Artificial Sequence
  chemically synthesized
ctctcgcttcagtagtgaatga

SEQ ID NO: 638809 - DNA, 22 bp, Artificial Sequence
  chemically synthesized
tcgcttcagtagtgaatgaggt

SEQ ID NO: 638810 - DNA, 22 bp, Artificial Sequence
  chemically synthesized
gcttcagtagtgaatgaggttt

SEQ ID NO: 638811 - DNA, 22 bp, Artificial Sequence
  chemically synthesized
cagtagtgaatgaggttttcca

SEQ ID NO: 638812 - DNA, 22 bp, Artificial Sequence
  chemically synthesized
agtagtgaatgaggttttccat

SEQ ID NO: 638813 - DNA, 22 bp, Artificial Sequence
  chemically synthesized
gtgaggaggtgggccaaatgga

SEQ ID NO: 638814 - DNA, 22 bp, Artificial Sequence
  chemically synthesized
ggtgaggaggtgggccaaatgg

SEQ ID NO: 638815 - DNA, 22 bp, Artificial Sequence
  chemically synthesized
tccatttggcccacctcctcac

SEQ ID NO: 638816 - DNA, 22 bp, Artificial Sequence
  chemically synthesized
ccatttggcccacctcctcacc

SEQ ID NO: 638817 - DNA, 22 bp, Artificial Sequence
  chemically synthesized
catttggcccacctcctcacca

SEQ ID NO: 638818 - DNA, 22 bp, Artificial Sequence
  chemically synthesized
ataacaccaagtatttggtgag

SEQ ID NO: 638819 - DNA, 22 bp, Artificial Sequence
  chemically synthesized
ggcccacctcctcaccaaatac

SEQ ID NO: 638820 - DNA, 22 bp, Artificial Sequence
  chemically synthesized
gcccacctcctcaccaaatact

SEQ ID NO: 638821 - DNA, 22 bp, Artificial Sequence
  chemically synthesized
aatgtctgataacaccaagtat

SEQ ID NO: 638822 - DNA, 22 bp, Artificial Sequence
  chemically synthesized
gaatgtctgataacaccaagta

SEQ ID NO: 638823 - DNA, 22 bp, Artificial Sequence
  chemically synthesized
ctcaccaaatacttggtgttat

SEQ ID NO: 638824 - DNA, 22 bp, Artificial Sequence
  chemically synthesized
accaaatacttggtgttatcag

SEQ ID NO: 638825 - DNA, 22 bp, Artificial Sequence
  chemically synthesized
aaacttgaatgtctgataacac

SEQ ID NO: 638826 - DNA, 22 bp, Artificial Sequence
  chemically synthesized
actaaaacttgaatgtctgata

SEQ ID NO: 638827 - DNA, 22 bp, Artificial Sequence
  chemically synthesized
ggtgttatcagacattcaagtt

SEQ ID NO: 638828 - DNA, 22 bp, Artificial Sequence
  chemically synthesized
gtgttatcagacattcaagttt

SEQ ID NO: 638829 - DNA, 22 bp, Artificial Sequence
  chemically synthesized
tcagacattcaagttttagtta

SEQ ID NO: 638830 - DNA, 22 bp, Artificial Sequence
  chemically synthesized
aaatgcacccatcaggttaact

SEQ ID NO: 638831 - DNA, 22 bp, Artificial Sequence
  chemically synthesized
aagttttagttaacctgatggg

SEQ ID NO: 638832 - DNA, 22 bp, Artificial Sequence
  chemically synthesized
tagttaacctgatgggtgcatt

SEQ ID NO: 638833 - DNA, 22 bp, Artificial Sequence
  chemically synthesized
agttaacctgatgggtgcattt

SEQ ID NO: 638834 - DNA, 22 bp, Artificial Sequence
  chemically synthesized
gttaacctgatgggtgcatttt

SEQ ID NO: 638835 - DNA, 22 bp, Artificial Sequence
  chemically synthesized
acctgatgggtgcattttaatt

SEQ ID NO: 638836 - DNA, 22 bp, Artificial Sequence
  chemically synthesized
atgggtgcattttaatttgcac

SEQ ID NO: 638837 - DNA, 22 bp, Artificial Sequence
  chemically synthesized
ccagtaatccgggatgtatgtg

SEQ ID NO: 638838 - DNA, 22 bp, Artificial Sequence
  chemically synthesized
gccagtaatccgggatgtatgt

SEQ ID NO: 638839 - DNA, 22 bp, Artificial Sequence
  chemically synthesized
taatttgcacatacatcccgga

SEQ ID NO: 638840 - DNA, 22 bp, Artificial Sequence
  chemically synthesized
aatttgcacatacatcccggat

SEQ ID NO: 638841 - DNA, 22 bp, Artificial Sequence
  chemically synthesized
accttgccagtaatccgggatg

SEQ ID NO: 638842 - DNA, 22 bp, Artificial Sequence
  chemically synthesized
atttgcacatacatcccggatt

SEQ ID NO: 638843 - DNA, 22 bp, Artificial Sequence
  chemically synthesized
gcacatacatcccggattactg

SEQ ID NO: 638844 - DNA, 22 bp, Artificial Sequence
  chemically synthesized
cacatacatcccggattactgg

SEQ ID NO: 638845 - DNA, 22 bp, Artificial Sequence
  chemically synthesized
acatggaagaagtctaaccttg

SEQ ID NO: 638846 - DNA, 22 bp, Artificial Sequence
  chemically synthesized
ctggcaaggttagacttcttcc

SEQ ID NO: 638847 - DNA, 22 bp, Artificial Sequence
  chemically synthesized
gcaaggttagacttcttccatg

SEQ ID NO: 638848 - DNA, 22 bp, Artificial Sequence
  chemically synthesized
gacttcttccatgttaactggc

SEQ ID NO: 638849 - DNA, 22 bp, Artificial Sequence
  chemically synthesized
cttccatgttaactggcttttc

SEQ ID NO: 638850 - DNA, 22 bp, Artificial Sequence
  chemically synthesized
ttccatgttaactggcttttca

SEQ ID NO: 638851 - DNA, 22 bp, Artificial Sequence
  chemically synthesized
ccatgttaactggcttttcatg

SEQ ID NO: 638852 - DNA, 22 bp, Artificial Sequence
  chemically synthesized
catgttaactggcttttcatgc

SEQ ID NO: 638853 - DNA, 22 bp, Artificial Sequence
  chemically synthesized
actggcttttcatgcttccttt

SEQ ID NO: 638854 - DNA, 22 bp, Artificial Sequence
  chemically synthesized
gcttttcatgcttcctttaccc

SEQ ID NO: 638855 - DNA, 22 bp, Artificial Sequence
  chemically synthesized
ttcatgcttcctttacccattt

SEQ ID NO: 638856 - DNA, 22 bp, Artificial Sequence
  chemically synthesized
tcatgcttcctttacccatttt

SEQ ID NO: 638857 - DNA, 22 bp, Artificial Sequence
  chemically synthesized
catgcttcctttacccattttc

SEQ ID NO: 638858 - DNA, 22 bp, Artificial Sequence
  chemically synthesized
atgcttcctttacccattttcc

SEQ ID NO: 638859 - DNA, 22 bp, Artificial Sequence
  chemically synthesized
cctttacccattttcctgctgg

SEQ ID NO: 638860 - DNA, 22 bp, Artificial Sequence
  chemically synthesized
ctttacccattttcctgctgga

SEQ ID NO: 638861 - DNA, 22 bp, Artificial Sequence
  chemically synthesized
tacccattttcctgctggattg

SEQ ID NO: 638862 - DNA, 22 bp, Artificial Sequence
  chemically synthesized
aaaagaaaaagacaatccagca

SEQ ID NO: 638863 - DNA, 22 bp, Artificial Sequence
  chemically synthesized
acccattttcctgctggattgt

SEQ ID NO: 638864 - DNA, 22 bp, Artificial Sequence
  chemically synthesized
aaaaagaaaaagacaatccagc

SEQ ID NO: 638865 - DNA, 22 bp, Artificial Sequence
  chemically synthesized
cccattttcctgctggattgtc

SEQ ID NO: 638866 - DNA, 22 bp, Artificial Sequence
  chemically synthesized
tcctgctggattgtctttttct

SEQ ID NO: 638867 - DNA, 22 bp, Artificial Sequence
  chemically synthesized
cctgctggattgtctttttctt

SEQ ID NO: 638868 - DNA, 22 bp, Artificial Sequence
  chemically synthesized
ctgctggattgtctttttcttt

SEQ ID NO: 638869 - DNA, 22 bp, Artificial Sequence
  chemically synthesized
ctggattgtctttttcttttta

SEQ ID NO: 638870 - DNA, 22 bp, Artificial Sequence
  chemically synthesized
gattgtctttttctttttaaac

SEQ ID NO: 638871 - DNA, 22 bp, Artificial Sequence
  chemically synthesized
gaacatatccaaaggtttaaaa

SEQ ID NO: 638872 - DNA, 22 bp, Artificial Sequence
  chemically synthesized
tctttttctttttaaacctttg

SEQ ID NO: 638873 - DNA, 22 bp, Artificial Sequence
  chemically synthesized
tttctttttaaacctttggata

SEQ ID NO: 638874 - DNA, 22 bp, Artificial Sequence
  chemically synthesized
gcatctagaacatatccaaagg

SEQ ID NO: 638875 - DNA, 22 bp, Artificial Sequence
  chemically synthesized
ttctttttaaacctttggatat

SEQ ID NO: 638876 - DNA, 22 bp, Artificial Sequence
  chemically synthesized
tctttttaaacctttggatatg

SEQ ID NO: 638877 - DNA, 22 bp, Artificial Sequence
  chemically synthesized
ctttttaaacctttggatatgt

SEQ ID NO: 638878 - DNA, 22 bp, Artificial Sequence
  chemically synthesized
tttttaaacctttggatatgtt

SEQ ID NO: 638879 - DNA, 22 bp, Artificial Sequence
  chemically synthesized
tttaaacctttggatatgttct

SEQ ID NO: 638880 - DNA, 22 bp, Artificial Sequence
  chemically synthesized
ttaaacctttggatatgttcta

SEQ ID NO: 638881 - DNA, 22 bp, Artificial Sequence
  chemically synthesized
taaacctttggatatgttctag

SEQ ID NO: 638882 - DNA, 22 bp, Artificial Sequence
  chemically synthesized
aaacctttggatatgttctaga

SEQ ID NO: 638883 - DNA, 22 bp, Artificial Sequence
  chemically synthesized
aacctttggatatgttctagat

SEQ ID NO: 638884 - DNA, 22 bp, Artificial Sequence
  chemically synthesized
acaatggattagcatctagaac

SEQ ID NO: 638885 - DNA, 22 bp, Artificial Sequence
  chemically synthesized
tggatatgttctagatgctaat

SEQ ID NO: 638886 - DNA, 22 bp, Artificial Sequence
  chemically synthesized
ggatatgttctagatgctaatc

SEQ ID NO: 638887 - DNA, 22 bp, Artificial Sequence
  chemically synthesized
gatatgttctagatgctaatcc

SEQ ID NO: 638888 - DNA, 22 bp, Artificial Sequence
  chemically synthesized
ccatgcacataactaacaatgg

SEQ ID NO: 638889 - DNA, 22 bp, Artificial Sequence
  chemically synthesized
tagatgctaatccattgttagt

SEQ ID NO: 638890 - DNA, 22 bp, Artificial Sequence
  chemically synthesized
gccatgcacataactaacaatg

SEQ ID NO: 638891 - DNA, 22 bp, Artificial Sequence
  chemically synthesized
gatgctaatccattgttagtta

SEQ ID NO: 638892 - DNA, 22 bp, Artificial Sequence
  chemically synthesized
atccattgttagttatgtgcat

SEQ ID NO: 638893 - DNA, 22 bp, Artificial Sequence
  chemically synthesized
ttagttatgtgcatggcaaata

SEQ ID NO: 638894 - DNA, 22 bp, Artificial Sequence
  chemically synthesized
gttatgtgcatggcaaatatga

SEQ ID NO: 638895 - DNA, 22 bp, Artificial Sequence
  chemically synthesized
tgtgcatggcaaatatgatctt

SEQ ID NO: 638896 - DNA, 22 bp, Artificial Sequence
  chemically synthesized
agataagggtagaagatcatat

SEQ ID NO: 638897 - DNA, 22 bp, Artificial Sequence
  chemically synthesized
cactaagataagggtagaagat

SEQ ID NO: 638898 - DNA, 22 bp, Artificial Sequence
  chemically synthesized
aagataagctacactaagataa

SEQ ID NO: 638899 - DNA, 22 bp, Artificial Sequence
  chemically synthesized
ctacccttatcttagtgtagct

SEQ ID NO: 638900 - DNA, 22 bp, Artificial Sequence
  chemically synthesized
tacccttatcttagtgtagctt

SEQ ID NO: 638901 - DNA, 22 bp, Artificial Sequence
  chemically synthesized
cccttatcttagtgtagcttat

SEQ ID NO: 638902 - DNA, 22 bp, Artificial Sequence
  chemically synthesized
atcttagtgtagcttatcttta

SEQ ID NO: 638903 - DNA, 22 bp, Artificial Sequence
  chemically synthesized
tcttagtgtagcttatctttaa

SEQ ID NO: 638904 - DNA, 22 bp, Artificial Sequence
  chemically synthesized
agtgtagcttatctttaacttt

SEQ ID NO: 638905 - DNA, 22 bp, Artificial Sequence
  chemically synthesized
gtgtagcttatctttaactttg

SEQ ID NO: 638906 - DNA, 22 bp, Artificial Sequence
  chemically synthesized
taccataggatgccataagcaa

SEQ ID NO: 638907 - DNA, 22 bp, Artificial Sequence
  chemically synthesized
ataccataggatgccataagca

SEQ ID NO: 638908 - DNA, 22 bp, Artificial Sequence
  chemically synthesized
atctttaactttgcttatggca

SEQ ID NO: 638909 - DNA, 22 bp, Artificial Sequence
  chemically synthesized
tataccataggatgccataagc

SEQ ID NO: 638910 - DNA, 22 bp, Artificial Sequence
  chemically synthesized
tctttaactttgcttatggcat

SEQ ID NO: 638911 - DNA, 22 bp, Artificial Sequence
  chemically synthesized
ttataccataggatgccataag

SEQ ID NO: 638912 - DNA, 22 bp, Artificial Sequence
  chemically synthesized
taactttgcttatggcatccta

SEQ ID NO: 638913 - DNA, 22 bp, Artificial Sequence
  chemically synthesized
aactttgcttatggcatcctat

SEQ ID NO: 638914 - DNA, 22 bp, Artificial Sequence
  chemically synthesized
actttgcttatggcatcctatg

SEQ ID NO: 638915 - DNA, 22 bp, Artificial Sequence
  chemically synthesized
catcttttataccataggatgc

SEQ ID NO: 638916 - DNA, 22 bp, Artificial Sequence
  chemically synthesized
acatcttttataccataggatg

SEQ ID NO: 638917 - DNA, 22 bp, Artificial Sequence
  chemically synthesized
tgcttatggcatcctatggtat

SEQ ID NO: 638918 - DNA, 22 bp, Artificial Sequence
  chemically synthesized
gcttatggcatcctatggtata

SEQ ID NO: 638919 - DNA, 22 bp, Artificial Sequence
  chemically synthesized
cttatggcatcctatggtataa

SEQ ID NO: 638920 - DNA, 22 bp, Artificial Sequence
  chemically synthesized
aaatttacatcttttataccat

SEQ ID NO: 638921 - DNA, 22 bp, Artificial Sequence
  chemically synthesized
atggcatcctatggtataaaag

SEQ ID NO: 638922 - DNA, 22 bp, Artificial Sequence
  chemically synthesized
tggcatcctatggtataaaaga

SEQ ID NO: 638923 - DNA, 22 bp, Artificial Sequence
  chemically synthesized
tggtataaaagatgtaaatttt

SEQ ID NO: 638924 - DNA, 22 bp, Artificial Sequence
  chemically synthesized
taacatatccctgtatgttctc

SEQ ID NO: 638925 - DNA, 22 bp, Artificial Sequence
  chemically synthesized
aacatatccctgtatgttctct

SEQ ID NO: 638926 - DNA, 22 bp, Artificial Sequence
  chemically synthesized
acatatccctgtatgttctctg

SEQ ID NO: 638927 - DNA, 22 bp, Artificial Sequence
  chemically synthesized
gtgaacaaaacataaaaagcag

SEQ ID NO: 638928 - DNA, 22 bp, Artificial Sequence
  chemically synthesized
cgtgaacaaaacataaaaagca

SEQ ID NO: 638929 - DNA, 22 bp, Artificial Sequence
  chemically synthesized
tcgtgaacaaaacataaaaagc

SEQ ID NO: 638930 - DNA, 22 bp, Artificial Sequence
  chemically synthesized
tatgttctctgctttttatgtt

SEQ ID NO: 638931 - DNA, 22 bp, Artificial Sequence
  chemically synthesized
tctgctttttatgttttgttca

SEQ ID NO: 638932 - DNA, 22 bp, Artificial Sequence
  chemically synthesized
tgctttttatgttttgttcacg

SEQ ID NO: 638933 - DNA, 22 bp, Artificial Sequence
  chemically synthesized
ctttttatgttttgttcacgaa

SEQ ID NO: 638934 - DNA, 22 bp, Artificial Sequence
  chemically synthesized
tttatgttttgttcacgaaaat

SEQ ID NO: 638935 - DNA, 22 bp, Artificial Sequence
  chemically synthesized
ttatgttttgttcacgaaaatc

SEQ ID NO: 638936 - DNA, 22 bp, Artificial Sequence
  chemically synthesized
tatgttttgttcacgaaaatct

SEQ ID NO: 638937 - DNA, 22 bp, Artificial Sequence
  chemically synthesized
atgttttgttcacgaaaatctt

SEQ ID NO: 638938 - DNA, 22 bp, Artificial Sequence
  chemically synthesized
tgttttgttcacgaaaatcttt

SEQ ID NO: 638939 - DNA, 22 bp, Artificial Sequence
  chemically synthesized
aaatgtaggtgtaagaaaagat

SEQ ID NO: 638940 - DNA, 22 bp, Artificial Sequence
  chemically synthesized
tgttcacgaaaatcttttctta

SEQ ID NO: 638941 - DNA, 22 bp, Artificial Sequence
  chemically synthesized
aaaatgtaggtgtaagaaaaga

SEQ ID NO: 638942 - DNA, 22 bp, Artificial Sequence
  chemically synthesized
gttcacgaaaatcttttcttac

SEQ ID NO: 638943 - DNA, 22 bp, Artificial Sequence
  chemically synthesized
taaaatgtaggtgtaagaaaag

SEQ ID NO: 638944 - DNA, 22 bp, Artificial Sequence
  chemically synthesized
ttcacgaaaatcttttcttaca

SEQ ID NO: 638945 - DNA, 22 bp, Artificial Sequence
  chemically synthesized
acgaaaatcttttcttacacct

SEQ ID NO: 638946 - DNA, 22 bp, Artificial Sequence
  chemically synthesized
aactttaaaatgtaggtgtaag

SEQ ID NO: 638947 - DNA, 22 bp, Artificial Sequence
  chemically synthesized
aaactttaaaatgtaggtgtaa

SEQ ID NO: 638948 - DNA, 22 bp, Artificial Sequence
  chemically synthesized
taaactttaaaatgtaggtgta

SEQ ID NO: 638949 - DNA, 22 bp, Artificial Sequence
  chemically synthesized
ttcttacacctacattttaaag

SEQ ID NO: 638950 - DNA, 22 bp, Artificial Sequence
  chemically synthesized
tcttacacctacattttaaagt

SEQ ID NO: 638951 - DNA, 22 bp, Artificial Sequence
  chemically synthesized
cttacacctacattttaaagtt

SEQ ID NO: 638952 - DNA, 22 bp, Artificial Sequence
  chemically synthesized
ttacacctacattttaaagttt

SEQ ID NO: 638953 - DNA, 22 bp, Artificial Sequence
  chemically synthesized
acacctacattttaaagtttaa

SEQ ID NO: 638954 - DNA, 22 bp, Artificial Sequence
  chemically synthesized
cacctacattttaaagtttaaa

SEQ ID NO: 638955 - DNA, 22 bp, Artificial Sequence
  chemically synthesized
aatgtgaaaaaccaaattttaa

SEQ ID NO: 638956 - DNA, 22 bp, Artificial Sequence
  chemically synthesized
cattttaaagtttaaaatttgg

SEQ ID NO: 638957 - DNA, 22 bp, Artificial Sequence
  chemically synthesized
taaagtttaaaatttggttttt

SEQ ID NO: 638958 - DNA, 22 bp, Artificial Sequence
  chemically synthesized
aaagtttaaaatttggtttttc

SEQ ID NO: 638959 - DNA, 22 bp, Artificial Sequence
  chemically synthesized
aagtttaaaatttggtttttca

SEQ ID NO: 638960 - DNA, 22 bp, Artificial Sequence
  chemically synthesized
aagtcctaaatgtgaaaaacca

SEQ ID NO: 638961 - DNA, 22 bp, Artificial Sequence
  chemically synthesized
aaaatttggtttttcacattta

SEQ ID NO: 638962 - DNA, 22 bp, Artificial Sequence
  chemically synthesized
aaatttggtttttcacatttag

SEQ ID NO: 638963 - DNA, 22 bp, Artificial Sequence
  chemically synthesized
ggtaaattcaagtcctaaatgt

SEQ ID NO: 638964 - DNA, 22 bp, Artificial Sequence
  chemically synthesized
tgggtaaattcaagtcctaaat

SEQ ID NO: 638965 - DNA, 22 bp, Artificial Sequence
  chemically synthesized
ggtttttcacatttaggacttg

SEQ ID NO: 638966 - DNA, 22 bp, Artificial Sequence
  chemically synthesized
gtttttcacatttaggacttga

SEQ ID NO: 638967 - DNA, 22 bp, Artificial Sequence
  chemically synthesized
ttcacatttaggacttgaattt

SEQ ID NO: 638968 - DNA, 22 bp, Artificial Sequence
  chemically synthesized
tcacatttaggacttgaattta

SEQ ID NO: 638969 - DNA, 22 bp, Artificial Sequence
  chemically synthesized
cacatttaggacttgaatttac

SEQ ID NO: 638970 - DNA, 22 bp, Artificial Sequence
  chemically synthesized
acatttaggacttgaatttacc

SEQ ID NO: 638971 - DNA, 22 bp, Artificial Sequence
  chemically synthesized
aggacttgaatttacccagaat

SEQ ID NO: 638972 - DNA, 22 bp, Artificial Sequence
  chemically synthesized
ggacttgaatttacccagaatc

SEQ ID NO: 638973 - DNA, 22 bp, Artificial Sequence
  chemically synthesized
gaatttacccagaatctatttt

SEQ ID NO: 638974 - DNA, 22 bp, Artificial Sequence
  chemically synthesized
acggcaagcacaaaaatagatt

SEQ ID NO: 638975 - DNA, 22 bp, Artificial Sequence
  chemically synthesized
aatttacccagaatctattttt

SEQ ID NO: 638976 - DNA, 22 bp, Artificial Sequence
  chemically synthesized
acccagaatctatttttgtgct

SEQ ID NO: 638977 - DNA, 22 bp, Artificial Sequence
  chemically synthesized
cccagaatctatttttgtgctt

SEQ ID NO: 638978 - DNA, 22 bp, Artificial Sequence
  chemically synthesized
gatcgcatgttcacggcaagca

SEQ ID NO: 638979 - DNA, 22 bp, Artificial Sequence
  chemically synthesized
tttttgtgcttgccgtgaacat

SEQ ID NO: 638980 - DNA, 22 bp, Artificial Sequence
  chemically synthesized
ttgtgcttgccgtgaacatgcg

SEQ ID NO: 638981 - DNA, 22 bp, Artificial Sequence
  chemically synthesized
tgtgcttgccgtgaacatgcga

SEQ ID NO: 638982 - DNA, 22 bp, Artificial Sequence
  chemically synthesized
gtgcttgccgtgaacatgcgat

SEQ ID NO: 638983 - DNA, 22 bp, Artificial Sequence
  chemically synthesized
tgcttgccgtgaacatgcgatc

SEQ ID NO: 638984 - DNA, 22 bp, Artificial Sequence
  chemically synthesized
gccgtgaacatgcgatctaatt

SEQ ID NO: 638985 - DNA, 22 bp, Artificial Sequence
  chemically synthesized
ccgtgaacatgcgatctaattt

SEQ ID NO: 638986 - DNA, 22 bp, Artificial Sequence
  chemically synthesized
tccatgggggaaaagtaaaatt

SEQ ID NO: 638987 - DNA, 22 bp, Artificial Sequence
  chemically synthesized
atccatgggggaaaagtaaaat

SEQ ID NO: 638988 - DNA, 22 bp, Artificial Sequence
  chemically synthesized
atagtttatccatgggggaaaa

SEQ ID NO: 638989 - DNA, 22 bp, Artificial Sequence
  chemically synthesized
catagtttatccatgggggaaa

SEQ ID NO: 638990 - DNA, 22 bp, Artificial Sequence
  chemically synthesized
attttacttttcccccatggat

SEQ ID NO: 638991 - DNA, 22 bp, Artificial Sequence
  chemically synthesized
gcttcatagtttatccatgggg

SEQ ID NO: 638992 - DNA, 22 bp, Artificial Sequence
  chemically synthesized
tacttttcccccatggataaac

SEQ ID NO: 638993 - DNA, 22 bp, Artificial Sequence
  chemically synthesized
acttttcccccatggataaact

SEQ ID NO: 638994 - DNA, 22 bp, Artificial Sequence
  chemically synthesized
cttttcccccatggataaacta

SEQ ID NO: 638995 - DNA, 22 bp, Artificial Sequence
  chemically synthesized
ttcccccatggataaactatga

SEQ ID NO: 638996 - DNA, 22 bp, Artificial Sequence
  chemically synthesized
tcccccatggataaactatgaa

SEQ ID NO: 638997 - DNA, 22 bp, Artificial Sequence
  chemically synthesized
cccccatggataaactatgaag

SEQ ID NO: 638998 - DNA, 22 bp, Artificial Sequence
  chemically synthesized
ccccatggataaactatgaagc

SEQ ID NO: 638999 - DNA, 22 bp, Artificial Sequence
  chemically synthesized
tgaagccagcctcattcattgt

SEQ ID NO: 639000 - DNA, 22 bp, Artificial Sequence
  chemically synthesized
attcattgtatggtccatctat

SEQ ID NO: 639001 - DNA, 22 bp, Artificial Sequence
  chemically synthesized
gagatcagtgggaaatagatgg

SEQ ID NO: 639002 - DNA, 22 bp, Artificial Sequence
  chemically synthesized
attgtatggtccatctatttcc

SEQ ID NO: 639003 - DNA, 22 bp, Artificial Sequence
  chemically synthesized
tatggtccatctatttcccact

SEQ ID NO: 639004 - DNA, 22 bp, Artificial Sequence
  chemically synthesized
cggaagcatcgttagagatcag

SEQ ID NO: 639005 - DNA, 22 bp, Artificial Sequence
  chemically synthesized
gcggaagcatcgttagagatca

SEQ ID NO: 639006 - DNA, 22 bp, Artificial Sequence
  chemically synthesized
tgcggaagcatcgttagagatc

SEQ ID NO: 639007 - DNA, 22 bp, Artificial Sequence
  chemically synthesized
tttcccactgatctctaacgat

SEQ ID NO: 639008 - DNA, 22 bp, Artificial Sequence
  chemically synthesized
cccactgatctctaacgatgct

SEQ ID NO: 639009 - DNA, 22 bp, Artificial Sequence
  chemically synthesized
atgttttgcggaagcatcgtta

SEQ ID NO: 639010 - DNA, 22 bp, Artificial Sequence
  chemically synthesized
ccactgatctctaacgatgctt

SEQ ID NO: 639011 - DNA, 22 bp, Artificial Sequence
  chemically synthesized
gatgttttgcggaagcatcgtt

SEQ ID NO: 639012 - DNA, 22 bp, Artificial Sequence
  chemically synthesized
atctctaacgatgcttccgcaa

SEQ ID NO: 639013 - DNA, 22 bp, Artificial Sequence
  chemically synthesized
tggacacttgatgttttgcgga

SEQ ID NO: 639014 - DNA, 22 bp, Artificial Sequence
  chemically synthesized
atggacacttgatgttttgcgg

SEQ ID NO: 639015 - DNA, 22 bp, Artificial Sequence
  chemically synthesized
taacgatgcttccgcaaaacat

SEQ ID NO: 639016 - DNA, 22 bp, Artificial Sequence
  chemically synthesized
acgatgcttccgcaaaacatca

SEQ ID NO: 639017 - DNA, 22 bp, Artificial Sequence
  chemically synthesized
tatatttatggacacttgatgt

SEQ ID NO: 639018 - DNA, 22 bp, Artificial Sequence
  chemically synthesized
ccgcaaaacatcaagtgtccat

SEQ ID NO: 639019 - DNA, 22 bp, Artificial Sequence
  chemically synthesized
cgcaaaacatcaagtgtccata

SEQ ID NO: 639020 - DNA, 22 bp, Artificial Sequence
  chemically synthesized
agaagcacacctgtatatttat

SEQ ID NO: 639021 - DNA, 22 bp, Artificial Sequence
  chemically synthesized
gaatacagagctcagaagcaca

SEQ ID NO: 639022 - DNA, 22 bp, Artificial Sequence
  chemically synthesized
ctgagctctgtattctagtctg

SEQ ID NO: 639023 - DNA, 22 bp, Artificial Sequence
  chemically synthesized
tgagctctgtattctagtctgt

SEQ ID NO: 639024 - DNA, 22 bp, Artificial Sequence
  chemically synthesized
agctctgtattctagtctgtgg

SEQ ID NO: 639025 - DNA, 22 bp, Artificial Sequence
  chemically synthesized
tgtattctagtctgtggttcta

SEQ ID NO: 639026 - DNA, 22 bp, Artificial Sequence
  chemically synthesized
tattctagtctgtggttctatc

SEQ ID NO: 639027 - DNA, 22 bp, Artificial Sequence
  chemically synthesized
ccagggatatgcagatagaacc

SEQ ID NO: 639028 - DNA, 22 bp, Artificial Sequence
  chemically synthesized
tagtctgtggttctatctgcat

SEQ ID NO: 639029 - DNA, 22 bp, Artificial Sequence
  chemically synthesized
gtctgtggttctatctgcatat

SEQ ID NO: 639030 - DNA, 22 bp, Artificial Sequence
  chemically synthesized
tggttctatctgcatatccctg

SEQ ID NO: 639031 - DNA, 22 bp, Artificial Sequence
  chemically synthesized
gagtgtgggatctaccagggat

SEQ ID NO: 639032 - DNA, 22 bp, Artificial Sequence
  chemically synthesized
tatctgcatatccctggtagat

SEQ ID NO: 639033 - DNA, 22 bp, Artificial Sequence
  chemically synthesized
tctgcatatccctggtagatcc

SEQ ID NO: 639034 - DNA, 22 bp, Artificial Sequence
  chemically synthesized
aagctggagtgtgggatctacc

SEQ ID NO: 639035 - DNA, 22 bp, Artificial Sequence
  chemically synthesized
aaagctggagtgtgggatctac

SEQ ID NO: 639036 - DNA, 22 bp, Artificial Sequence
  chemically synthesized
catatccctggtagatcccaca

SEQ ID NO: 639037 - DNA, 22 bp, Artificial Sequence
  chemically synthesized
atttaaagctggagtgtgggat

SEQ ID NO: 639038 - DNA, 22 bp, Artificial Sequence
  chemically synthesized
gtagatcccacactccagcttt

SEQ ID NO: 639039 - DNA, 22 bp, Artificial Sequence
  chemically synthesized
tcagacatcaattgatttaaag

SEQ ID NO: 639040 - DNA, 22 bp, Artificial Sequence
  chemically synthesized
cagctttaaatcaattgatgtc

SEQ ID NO: 639041 - DNA, 22 bp, Artificial Sequence
  chemically synthesized
agaaggcctatcagacatcaat

SEQ ID NO: 639042 - DNA, 22 bp, Artificial Sequence
  chemically synthesized
taaatcaattgatgtctgatag

SEQ ID NO: 639043 - DNA, 22 bp, Artificial Sequence
  chemically synthesized
aaatcaattgatgtctgatagg

SEQ ID NO: 639044 - DNA, 22 bp, Artificial Sequence
  chemically synthesized
aatcaattgatgtctgataggc

SEQ ID NO: 639045 - DNA, 22 bp, Artificial Sequence
  chemically synthesized
atgtctgataggccttctcagc

SEQ ID NO: 639046 - DNA, 22 bp, Artificial Sequence
  chemically synthesized
aggaaaaacaaagtgggctgag

SEQ ID NO: 639047 - DNA, 22 bp, Artificial Sequence
  chemically synthesized
gaggaaaaacaaagtgggctga

SEQ ID NO: 639048 - DNA, 22 bp, Artificial Sequence
  chemically synthesized
tgaggaaaaacaaagtgggctg

SEQ ID NO: 639049 - DNA, 22 bp, Artificial Sequence
  chemically synthesized
ataggccttctcagcccacttt

SEQ ID NO: 639050 - DNA, 22 bp, Artificial Sequence
  chemically synthesized
ctcagcccactttgtttttcct

SEQ ID NO: 639051 - DNA, 22 bp, Artificial Sequence
  chemically synthesized
tcagcccactttgtttttcctc

SEQ ID NO: 639052 - DNA, 22 bp, Artificial Sequence
  chemically synthesized
agcccactttgtttttcctcaa

SEQ ID NO: 639053 - DNA, 22 bp, Artificial Sequence
  chemically synthesized
tgtttttcctcaaaattgtctt

SEQ ID NO: 639054 - DNA, 22 bp, Artificial Sequence
  chemically synthesized
gtttttcctcaaaattgtcttg

SEQ ID NO: 639055 - DNA, 22 bp, Artificial Sequence
  chemically synthesized
tttttcctcaaaattgtcttga

SEQ ID NO: 639056 - DNA, 22 bp, Artificial Sequence
  chemically synthesized
ttcctcaaaattgtcttgacta

SEQ ID NO: 639057 - DNA, 22 bp, Artificial Sequence
  chemically synthesized
tcctcaaaattgtcttgactat

SEQ ID NO: 639058 - DNA, 22 bp, Artificial Sequence
  chemically synthesized
cctcaaaattgtcttgactatt

SEQ ID NO: 639059 - DNA, 22 bp, Artificial Sequence
  chemically synthesized
ctcaaaattgtcttgactattc

SEQ ID NO: 639060 - DNA, 22 bp, Artificial Sequence
  chemically synthesized
aaaattgtcttgactattctga

SEQ ID NO: 639061 - DNA, 22 bp, Artificial Sequence
  chemically synthesized
tcttgactattctgaccccttt

SEQ ID NO: 639062 - DNA, 22 bp, Artificial Sequence
  chemically synthesized
gactattctgacccctttgatc

SEQ ID NO: 639063 - DNA, 22 bp, Artificial Sequence
  chemically synthesized
actattctgacccctttgatct

SEQ ID NO: 639064 - DNA, 22 bp, Artificial Sequence
  chemically synthesized
aaatcatggagaagatcaaagg

SEQ ID NO: 639065 - DNA, 22 bp, Artificial Sequence
  chemically synthesized
ttctgacccctttgatcttctc

SEQ ID NO: 639066 - DNA, 22 bp, Artificial Sequence
  chemically synthesized
tgacccctttgatcttctccat

SEQ ID NO: 639067 - DNA, 22 bp, Artificial Sequence
  chemically synthesized
acccctttgatcttctccatga

SEQ ID NO: 639068 - DNA, 22 bp, Artificial Sequence
  chemically synthesized
tgatcttctccatgattttagt

SEQ ID NO: 639069 - DNA, 22 bp, Artificial Sequence
  chemically synthesized
gatcttctccatgattttagtg

SEQ ID NO: 639070 - DNA, 22 bp, Artificial Sequence
  chemically synthesized
atcttctccatgattttagtgt

SEQ ID NO: 639071 - DNA, 22 bp, Artificial Sequence
  chemically synthesized
ctccatgattttagtgtttggt

SEQ ID NO: 639072 - DNA, 22 bp, Artificial Sequence
  chemically synthesized
tccatgattttagtgtttggtt

SEQ ID NO: 639073 - DNA, 22 bp, Artificial Sequence
  chemically synthesized
ataaaatcagaaaaccaaacac

SEQ ID NO: 639074 - DNA, 22 bp, Artificial Sequence
  chemically synthesized
cataaaatcagaaaaccaaaca

SEQ ID NO: 639075 - DNA, 22 bp, Artificial Sequence
  chemically synthesized
catgattttagtgtttggtttt

SEQ ID NO: 639076 - DNA, 22 bp, Artificial Sequence
  chemically synthesized
tcataaaatcagaaaaccaaac

SEQ ID NO: 639077 - DNA, 22 bp, Artificial Sequence
  chemically synthesized
tagtgtttggttttctgatttt

SEQ ID NO: 639078 - DNA, 22 bp, Artificial Sequence
  chemically synthesized
agtgtttggttttctgatttta

SEQ ID NO: 639079 - DNA, 22 bp, Artificial Sequence
  chemically synthesized
gtgtttggttttctgattttat

SEQ ID NO: 639080 - DNA, 22 bp, Artificial Sequence
  chemically synthesized
aacaagcattttcataaaatca

SEQ ID NO: 639081 - DNA, 22 bp, Artificial Sequence
  chemically synthesized
caacaagcattttcataaaatc

SEQ ID NO: 639082 - DNA, 22 bp, Artificial Sequence
  chemically synthesized
ggttttctgattttatgaaaat

SEQ ID NO: 639083 - DNA, 22 bp, Artificial Sequence
  chemically synthesized
gttttctgattttatgaaaatg

SEQ ID NO: 639084 - DNA, 22 bp, Artificial Sequence
  chemically synthesized
aaaatttcaacaagcattttca

SEQ ID NO: 639085 - DNA, 22 bp, Artificial Sequence
  chemically synthesized
tctgattttatgaaaatgcttg

SEQ ID NO: 639086 - DNA, 22 bp, Artificial Sequence
  chemically synthesized
ctgattttatgaaaatgcttgt

SEQ ID NO: 639087 - DNA, 22 bp, Artificial Sequence
  chemically synthesized
tgattttatgaaaatgcttgtt

SEQ ID NO: 639088 - DNA, 22 bp, Artificial Sequence
  chemically synthesized
attttatgaaaatgcttgttga

SEQ ID NO: 639089 - DNA, 22 bp, Artificial Sequence
  chemically synthesized
aaactcaaaatttcaacaagca

SEQ ID NO: 639090 - DNA, 22 bp, Artificial Sequence
  chemically synthesized
tatgaaaatgcttgttgaaatt

SEQ ID NO: 639091 - DNA, 22 bp, Artificial Sequence
  chemically synthesized
atgaaaatgcttgttgaaattt

SEQ ID NO: 639092 - DNA, 22 bp, Artificial Sequence
  chemically synthesized
tgaaaatgcttgttgaaatttt

SEQ ID NO: 639093 - DNA, 22 bp, Artificial Sequence
  chemically synthesized
aatgtaattcaaactcaaaatt

SEQ ID NO: 639094 - DNA, 22 bp, Artificial Sequence
  chemically synthesized
gttgaaattttgagtttgaatt

SEQ ID NO: 639095 - DNA, 22 bp, Artificial Sequence
  chemically synthesized
tgaattcaatgtaattcaaact

SEQ ID NO: 639096 - DNA, 22 bp, Artificial Sequence
  chemically synthesized
ttgaaattttgagtttgaatta

SEQ ID NO: 639097 - DNA, 22 bp, Artificial Sequence
  chemically synthesized
aaattttgagtttgaattacat

SEQ ID NO: 639098 - DNA, 22 bp, Artificial Sequence
  chemically synthesized
acctatgaattcaatgtaattc

SEQ ID NO: 639099 - DNA, 22 bp, Artificial Sequence
  chemically synthesized
aacctatgaattcaatgtaatt

SEQ ID NO: 639100 - DNA, 22 bp, Artificial Sequence
  chemically synthesized
tgagtttgaattacattgaatt

SEQ ID NO: 639101 - DNA, 22 bp, Artificial Sequence
  chemically synthesized
gagtttgaattacattgaattc

SEQ ID NO: 639102 - DNA, 22 bp, Artificial Sequence
  chemically synthesized
agtttgaattacattgaattca

SEQ ID NO: 639103 - DNA, 22 bp, Artificial Sequence
  chemically synthesized
ccagtttaacctatgaattcaa

SEQ ID NO: 639104 - DNA, 22 bp, Artificial Sequence
  chemically synthesized
cccagtttaacctatgaattca

SEQ ID NO: 639105 - DNA, 22 bp, Artificial Sequence
  chemically synthesized
ttcccagtttaacctatgaatt

SEQ ID NO: 639106 - DNA, 22 bp, Artificial Sequence
  chemically synthesized
gaattacattgaattcataggt

SEQ ID NO: 639107 - DNA, 22 bp, Artificial Sequence
  chemically synthesized
aattacattgaattcataggtt

SEQ ID NO: 639108 - DNA, 22 bp, Artificial Sequence
  chemically synthesized
gttcttcccagtttaacctatg

SEQ ID NO: 639109 - DNA, 22 bp, Artificial Sequence
  chemically synthesized
agttcttcccagtttaacctat

SEQ ID NO: 639110 - DNA, 22 bp, Artificial Sequence
  chemically synthesized
cattgaattcataggttaaact

SEQ ID NO: 639111 - DNA, 22 bp, Artificial Sequence
  chemically synthesized
aattcataggttaaactgggaa

SEQ ID NO: 639112 - DNA, 22 bp, Artificial Sequence
  chemically synthesized
tgaacttagttcttcccagttt

SEQ ID NO: 639113 - DNA, 22 bp, Artificial Sequence
  chemically synthesized
ttatgaacttagttcttcccag

SEQ ID NO: 639114 - DNA, 22 bp, Artificial Sequence
  chemically synthesized
ataggttaaactgggaagaact

SEQ ID NO: 639115 - DNA, 22 bp, Artificial Sequence
  chemically synthesized
aattattatgaacttagttctt

SEQ ID NO: 639116 - DNA, 22 bp, Artificial Sequence
  chemically synthesized
aactgggaagaactaagttcat

SEQ ID NO: 639117 - DNA, 22 bp, Artificial Sequence
  chemically synthesized
ggaagaactaagttcataataa

SEQ ID NO: 639118 - DNA, 22 bp, Artificial Sequence
  chemically synthesized
gatgtgaagactcaattattat

SEQ ID NO: 639119 - DNA, 22 bp, Artificial Sequence
  chemically synthesized
ggatgtgaagactcaattatta

SEQ ID NO: 639120 - DNA, 22 bp, Artificial Sequence
  chemically synthesized
ttggatgtgaagactcaattat

SEQ ID NO: 639121 - DNA, 22 bp, Artificial Sequence
  chemically synthesized
agttcataataattgagtcttc

SEQ ID NO: 639122 - DNA, 22 bp, Artificial Sequence
  chemically synthesized
cattcttggatgtgaagactca

SEQ ID NO: 639123 - DNA, 22 bp, Artificial Sequence
  chemically synthesized
ataataattgagtcttcacatc

SEQ ID NO: 639124 - DNA, 22 bp, Artificial Sequence
  chemically synthesized
actgcattcttggatgtgaaga

SEQ ID NO: 639125 - DNA, 22 bp, Artificial Sequence
  chemically synthesized
cactgcattcttggatgtgaag

SEQ ID NO: 639126 - DNA, 22 bp, Artificial Sequence
  chemically synthesized
agtcttcacatccaagaatgca

SEQ ID NO: 639127 - DNA, 22 bp, Artificial Sequence
  chemically synthesized
cacatccaagaatgcagtgaag

SEQ ID NO: 639128 - DNA, 22 bp, Artificial Sequence
  chemically synthesized
acatccaagaatgcagtgaagc

SEQ ID NO: 639129 - DNA, 22 bp, Artificial Sequence
  chemically synthesized
atggacataaaatgagaccata

SEQ ID NO: 639130 - DNA, 22 bp, Artificial Sequence
  chemically synthesized
cttacttactatggtctcattt

SEQ ID NO: 639131 - DNA, 22 bp, Artificial Sequence
  chemically synthesized
ttaatggacataaaatgagacc

SEQ ID NO: 639132 - DNA, 22 bp, Artificial Sequence
  chemically synthesized
acttactatggtctcattttat

SEQ ID NO: 639133 - DNA, 22 bp, Artificial Sequence
  chemically synthesized
cttactatggtctcattttatg

SEQ ID NO: 639134 - DNA, 22 bp, Artificial Sequence
  chemically synthesized
actatggtctcattttatgtcc

SEQ ID NO: 639135 - DNA, 22 bp, Artificial Sequence
  chemically synthesized
ctatggtctcattttatgtcca

SEQ ID NO: 639136 - DNA, 22 bp, Artificial Sequence
  chemically synthesized
tggtctcattttatgtccatta

SEQ ID NO: 639137 - DNA, 22 bp, Artificial Sequence
  chemically synthesized
attttatgtccattaataatgt

SEQ ID NO: 639138 - DNA, 22 bp, Artificial Sequence
  chemically synthesized
tatgtccattaataatgtttta

SEQ ID NO: 639139 - DNA, 22 bp, Artificial Sequence
  chemically synthesized
atgtccattaataatgttttac

SEQ ID NO: 639140 - DNA, 22 bp, Artificial Sequence
  chemically synthesized
tgtccattaataatgttttact

SEQ ID NO: 639141 - DNA, 22 bp, Artificial Sequence
  chemically synthesized
ataatgttttacttgttactct

SEQ ID NO: 639142 - DNA, 22 bp, Artificial Sequence
  chemically synthesized
taaagcaagaggaaaaaaaaga

SEQ ID NO: 639143 - DNA, 22 bp, Artificial Sequence
  chemically synthesized
tacttgttactcttttttttcc

SEQ ID NO: 639144 - DNA, 22 bp, Artificial Sequence
  chemically synthesized
acttgttactcttttttttcct

SEQ ID NO: 639145 - DNA, 22 bp, Artificial Sequence
  chemically synthesized
cttgttactcttttttttcctc

SEQ ID NO: 639146 - DNA, 22 bp, Artificial Sequence
  chemically synthesized
aacctgtaaagcaagaggaaaa

SEQ ID NO: 639147 - DNA, 22 bp, Artificial Sequence
  chemically synthesized
gttactcttttttttcctcttg

SEQ ID NO: 639148 - DNA, 22 bp, Artificial Sequence
  chemically synthesized
ttactcttttttttcctcttgc

SEQ ID NO: 639149 - DNA, 22 bp, Artificial Sequence
  chemically synthesized
ttcaacctgtaaagcaagagga

SEQ ID NO: 639150 - DNA, 22 bp, Artificial Sequence
  chemically synthesized
attcaacctgtaaagcaagagg

SEQ ID NO: 639151 - DNA, 22 bp, Artificial Sequence
  chemically synthesized
ctcttttttttcctcttgcttt

SEQ ID NO: 639152 - DNA, 22 bp, Artificial Sequence
  chemically synthesized
ttttttttcctcttgctttaca

SEQ ID NO: 639153 - DNA, 22 bp, Artificial Sequence
  chemically synthesized
ttttttcctcttgctttacagg

SEQ ID NO: 639154 - DNA, 22 bp, Artificial Sequence
  chemically synthesized
tttttcctcttgctttacaggt

SEQ ID NO: 639155 - DNA, 22 bp, Artificial Sequence
  chemically synthesized
ttttcctcttgctttacaggtt

SEQ ID NO: 639156 - DNA, 22 bp, Artificial Sequence
  chemically synthesized
tttcctcttgctttacaggttg

SEQ ID NO: 639157 - DNA, 22 bp, Artificial Sequence
  chemically synthesized
ttcctcttgctttacaggttga

SEQ ID NO: 639158 - DNA, 22 bp, Artificial Sequence
  chemically synthesized
tcctcttgctttacaggttgaa

SEQ ID NO: 639159 - DNA, 22 bp, Artificial Sequence
  chemically synthesized
cctcttgctttacaggttgaat

SEQ ID NO: 639160 - DNA, 22 bp, Artificial Sequence
  chemically synthesized
ctcttgctttacaggttgaata

SEQ ID NO: 639161 - DNA, 22 bp, Artificial Sequence
  chemically synthesized
ttgctttacaggttgaataagt

SEQ ID NO: 639162 - DNA, 22 bp, Artificial Sequence
  chemically synthesized
gctttacaggttgaataagtca

SEQ ID NO: 639163 - DNA, 22 bp, Artificial Sequence
  chemically synthesized
ctttacaggttgaataagtcat

SEQ ID NO: 639164 - DNA, 22 bp, Artificial Sequence
  chemically synthesized
aaaataaaaaatcaatgactta

SEQ ID NO: 639165 - DNA, 22 bp, Artificial Sequence
  chemically synthesized
tacaggttgaataagtcattga

SEQ ID NO: 639166 - DNA, 22 bp, Artificial Sequence
  chemically synthesized
acaggttgaataagtcattgat

SEQ ID NO: 639167 - DNA, 22 bp, Artificial Sequence
  chemically synthesized
caggttgaataagtcattgatt

SEQ ID NO: 639168 - DNA, 22 bp, Artificial Sequence
  chemically synthesized
attaaaaataaaaaatcaatga

SEQ ID NO: 639169 - DNA, 22 bp, Artificial Sequence
  chemically synthesized
aataagtcattgattttttatt

SEQ ID NO: 639170 - DNA, 22 bp, Artificial Sequence
  chemically synthesized
aatgtgttcattaaaaataaaa

SEQ ID NO: 639171 - DNA, 22 bp, Artificial Sequence
  chemically synthesized
attttttatttttaatgaacac

SEQ ID NO: 639172 - DNA, 22 bp, Artificial Sequence
  chemically synthesized
tttatttttaatgaacacattt

SEQ ID NO: 639173 - DNA, 22 bp, Artificial Sequence
  chemically synthesized
ttatttttaatgaacacattta

SEQ ID NO: 639174 - DNA, 22 bp, Artificial Sequence
  chemically synthesized
tatttttaatgaacacatttag

SEQ ID NO: 639175 - DNA, 22 bp, Artificial Sequence
  chemically synthesized
atttttaatgaacacatttagg

SEQ ID NO: 639176 - DNA, 22 bp, Artificial Sequence
  chemically synthesized
tttttaatgaacacatttaggg

SEQ ID NO: 639177 - DNA, 22 bp, Artificial Sequence
  chemically synthesized
ttaatgaacacatttagggtta

SEQ ID NO: 639178 - DNA, 22 bp, Artificial Sequence
  chemically synthesized
taatgaacacatttagggttat

SEQ ID NO: 639179 - DNA, 22 bp, Artificial Sequence
  chemically synthesized
aatgaacacatttagggttata

SEQ ID NO: 639180 - DNA, 22 bp, Artificial Sequence
  chemically synthesized
atgaacacatttagggttatac

SEQ ID NO: 639181 - DNA, 22 bp, Artificial Sequence
  chemically synthesized
aagtggtaccaaggaggaaatg

SEQ ID NO: 639182 - DNA, 22 bp, Artificial Sequence
  chemically synthesized
agggttatacatttcctccttg

SEQ ID NO: 639183 - DNA, 22 bp, Artificial Sequence
  chemically synthesized
gggttatacatttcctccttgg

SEQ ID NO: 639184 - DNA, 22 bp, Artificial Sequence
  chemically synthesized
tacatttcctccttggtaccac

SEQ ID NO: 639185 - DNA, 22 bp, Artificial Sequence
  chemically synthesized
gtatataattaaagtggtacca

SEQ ID NO: 639186 - DNA, 22 bp, Artificial Sequence
  chemically synthesized
ggtatataattaaagtggtacc

SEQ ID NO: 639187 - DNA, 22 bp, Artificial Sequence
  chemically synthesized
tggtatataattaaagtggtac

SEQ ID NO: 639188 - DNA, 22 bp, Artificial Sequence
  chemically synthesized
ttggtatataattaaagtggta

SEQ ID NO: 639189 - DNA, 22 bp, Artificial Sequence
  chemically synthesized
cctccttggtaccactttaatt

SEQ ID NO: 639190 - DNA, 22 bp, Artificial Sequence
  chemically synthesized
ctccttggtaccactttaatta

SEQ ID NO: 639191 - DNA, 22 bp, Artificial Sequence
  chemically synthesized
cttggtaccactttaattatat

SEQ ID NO: 639192 - DNA, 22 bp, Artificial Sequence
  chemically synthesized
ggtaccactttaattatatacc

SEQ ID NO: 639193 - DNA, 22 bp, Artificial Sequence
  chemically synthesized
gtaccactttaattatatacca

SEQ ID NO: 639194 - DNA, 22 bp, Artificial Sequence
  chemically synthesized
taattatataccaaaagttttt

SEQ ID NO: 639195 - DNA, 22 bp, Artificial Sequence
  chemically synthesized
aattatataccaaaagttttta

SEQ ID NO: 639196 - DNA, 22 bp, Artificial Sequence
  chemically synthesized
attatataccaaaagtttttat

SEQ ID NO: 639197 - DNA, 22 bp, Artificial Sequence
  chemically synthesized
aatcaggtgatgtatataaaaa

SEQ ID NO: 639198 - DNA, 22 bp, Artificial Sequence
  chemically synthesized
tataccaaaagtttttatatac

SEQ ID NO: 639199 - DNA, 22 bp, Artificial Sequence
  chemically synthesized
aattgaatcaggtgatgtatat

SEQ ID NO: 639200 - DNA, 22 bp, Artificial Sequence
  chemically synthesized
ttatatacatcacctgattcaa

SEQ ID NO: 639201 - DNA, 22 bp, Artificial Sequence
  chemically synthesized
tatatacatcacctgattcaat

SEQ ID NO: 639202 - DNA, 22 bp, Artificial Sequence
  chemically synthesized
atatacatcacctgattcaatt

SEQ ID NO: 639203 - DNA, 22 bp, Artificial Sequence
  chemically synthesized
tatacatcacctgattcaattc

SEQ ID NO: 639204 - DNA, 22 bp, Artificial Sequence
  chemically synthesized
caaaacataaggcactgaattg

SEQ ID NO: 639205 - DNA, 22 bp, Artificial Sequence
  chemically synthesized
attcaattcagtgccttatgtt

SEQ ID NO: 639206 - DNA, 22 bp, Artificial Sequence
  chemically synthesized
aattcagtgccttatgttttgt

SEQ ID NO: 639207 - DNA, 22 bp, Artificial Sequence
  chemically synthesized
agtgccttatgttttgtaattc

SEQ ID NO: 639208 - DNA, 22 bp, Artificial Sequence
  chemically synthesized
aaagaaatcacagtaagaatta

SEQ ID NO: 639209 - DNA, 22 bp, Artificial Sequence
  chemically synthesized
atgttttgtaattcttactgtg

SEQ ID NO: 639210 - DNA, 22 bp, Artificial Sequence
  chemically synthesized
tgttttgtaattcttactgtga

SEQ ID NO: 639211 - DNA, 22 bp, Artificial Sequence
  chemically synthesized
agttaaaagaaatcacagtaag

SEQ ID NO: 639212 - DNA, 22 bp, Artificial Sequence
  chemically synthesized
tgtaattcttactgtgatttct

SEQ ID NO: 639213 - DNA, 22 bp, Artificial Sequence
  chemically synthesized
gtaattcttactgtgatttctt

SEQ ID NO: 639214 - DNA, 22 bp, Artificial Sequence
  chemically synthesized
taattcttactgtgatttcttt

SEQ ID NO: 639215 - DNA, 22 bp, Artificial Sequence
  chemically synthesized
tgggttaagttaaaagaaatca

SEQ ID NO: 639216 - DNA, 22 bp, Artificial Sequence
  chemically synthesized
ttactgtgatttcttttaactt

SEQ ID NO: 639217 - DNA, 22 bp, Artificial Sequence
  chemically synthesized
actgtgatttcttttaacttaa

SEQ ID NO: 639218 - DNA, 22 bp, Artificial Sequence
  chemically synthesized
aatgactatgggttaagttaaa

SEQ ID NO: 639219 - DNA, 22 bp, Artificial Sequence
  chemically synthesized
ctgtgatttcttttaacttaac

SEQ ID NO: 639220 - DNA, 22 bp, Artificial Sequence
  chemically synthesized
ctaaatgactatgggttaagtt

SEQ ID NO: 639221 - DNA, 22 bp, Artificial Sequence
  chemically synthesized
tgatttcttttaacttaaccca

SEQ ID NO: 639222 - DNA, 22 bp, Artificial Sequence
  chemically synthesized
tgctcctaaatgactatgggtt

SEQ ID NO: 639223 - DNA, 22 bp, Artificial Sequence
  chemically synthesized
cttttaacttaacccatagtca

SEQ ID NO: 639224 - DNA, 22 bp, Artificial Sequence
  chemically synthesized
ttttaacttaacccatagtcat

SEQ ID NO: 639225 - DNA, 22 bp, Artificial Sequence
  chemically synthesized
ttaacttaacccatagtcattt

SEQ ID NO: 639226 - DNA, 22 bp, Artificial Sequence
  chemically synthesized
taacttaacccatagtcattta

SEQ ID NO: 639227 - DNA, 22 bp, Artificial Sequence
  chemically synthesized
aacttaacccatagtcatttag

SEQ ID NO: 639228 - DNA, 22 bp, Artificial Sequence
  chemically synthesized
acttaacccatagtcatttagg

SEQ ID NO: 639229 - DNA, 22 bp, Artificial Sequence
  chemically synthesized
aacccatagtcatttaggagca

SEQ ID NO: 639230 - DNA, 22 bp, Artificial Sequence
  chemically synthesized
acccatagtcatttaggagcac

SEQ ID NO: 639231 - DNA, 22 bp, Artificial Sequence
  chemically synthesized
aggagcacagtggttatatttc

SEQ ID NO: 639232 - DNA, 22 bp, Artificial Sequence
  chemically synthesized
ggagcacagtggttatatttcc

SEQ ID NO: 639233 - DNA, 22 bp, Artificial Sequence
  chemically synthesized
agaagtgaaaatggaaatataa

SEQ ID NO: 639234 - DNA, 22 bp, Artificial Sequence
  chemically synthesized
gaaatgcactaagaagtgaaaa

SEQ ID NO: 639235 - DNA, 22 bp, Artificial Sequence
  chemically synthesized
tatttccattttcacttcttag

SEQ ID NO: 639236 - DNA, 22 bp, Artificial Sequence
  chemically synthesized
aattagaaatgcactaagaagt

SEQ ID NO: 639237 - DNA, 22 bp, Artificial Sequence
  chemically synthesized
ccattttcacttcttagtgcat

SEQ ID NO: 639238 - DNA, 22 bp, Artificial Sequence
  chemically synthesized
cattttcacttcttagtgcatt

SEQ ID NO: 639239 - DNA, 22 bp, Artificial Sequence
  chemically synthesized
tcacttcttagtgcatttctaa

SEQ ID NO: 639240 - DNA, 22 bp, Artificial Sequence
  chemically synthesized
cacttcttagtgcatttctaat

SEQ ID NO: 639241 - DNA, 22 bp, Artificial Sequence
  chemically synthesized
aaacgcaattaaattagaaatg

SEQ ID NO: 639242 - DNA, 22 bp, Artificial Sequence
  chemically synthesized
acttcttagtgcatttctaatt

SEQ ID NO: 639243 - DNA, 22 bp, Artificial Sequence
  chemically synthesized
attgaaacgcaattaaattaga

SEQ ID NO: 639244 - DNA, 22 bp, Artificial Sequence
  chemically synthesized
cttagtgcatttctaatttaat

SEQ ID NO: 639245 - DNA, 22 bp, Artificial Sequence
  chemically synthesized
ttagtgcatttctaatttaatt

SEQ ID NO: 639246 - DNA, 22 bp, Artificial Sequence
  chemically synthesized
tgattgaaacgcaattaaatta

SEQ ID NO: 639247 - DNA, 22 bp, Artificial Sequence
  chemically synthesized
agtgcatttctaatttaattgc

SEQ ID NO: 639248 - DNA, 22 bp, Artificial Sequence
  chemically synthesized
tctgattgaaacgcaattaaat

SEQ ID NO: 639249 - DNA, 22 bp, Artificial Sequence
  chemically synthesized
gtgcatttctaatttaattgcg

SEQ ID NO: 639250 - DNA, 22 bp, Artificial Sequence
  chemically synthesized
ctaatttaattgcgtttcaatc

SEQ ID NO: 639251 - DNA, 22 bp, Artificial Sequence
  chemically synthesized
taatttaattgcgtttcaatca

SEQ ID NO: 639252 - DNA, 22 bp, Artificial Sequence
  chemically synthesized
atttaattgcgtttcaatcaga

SEQ ID NO: 639253 - DNA, 22 bp, Artificial Sequence
  chemically synthesized
aattgcgtttcaatcagagaac

SEQ ID NO: 639254 - DNA, 22 bp, Artificial Sequence
  chemically synthesized
attgcgtttcaatcagagaacc

SEQ ID NO: 639255 - DNA, 22 bp, Artificial Sequence
  chemically synthesized
cgtttcaatcagagaacccctg

SEQ ID NO: 639256 - DNA, 22 bp, Artificial Sequence
  chemically synthesized
caatcagagaacccctgtatga

SEQ ID NO: 639257 - DNA, 22 bp, Artificial Sequence
  chemically synthesized
aaaggatcagtatcatacaggg

SEQ ID NO: 639258 - DNA, 22 bp, Artificial Sequence
  chemically synthesized
aatcagagaacccctgtatgat

SEQ ID NO: 639259 - DNA, 22 bp, Artificial Sequence
  chemically synthesized
caaaggatcagtatcatacagg

SEQ ID NO: 639260 - DNA, 22 bp, Artificial Sequence
  chemically synthesized
aatttcaaaggatcagtatcat

SEQ ID NO: 639261 - DNA, 22 bp, Artificial Sequence
  chemically synthesized
ctaaatttcaaaggatcagtat

SEQ ID NO: 639262 - DNA, 22 bp, Artificial Sequence
  chemically synthesized
tatgatactgatcctttgaaat

SEQ ID NO: 639263 - DNA, 22 bp, Artificial Sequence
  chemically synthesized
atcctttgaaatttagcaatac

SEQ ID NO: 639264 - DNA, 22 bp, Artificial Sequence
  chemically synthesized
ggtcacaaaaagaagtattgct

SEQ ID NO: 639265 - DNA, 22 bp, Artificial Sequence
  chemically synthesized
tgaaatttagcaatacttcttt

SEQ ID NO: 639266 - DNA, 22 bp, Artificial Sequence
  chemically synthesized
gaaatttagcaatacttctttt

SEQ ID NO: 639267 - DNA, 22 bp, Artificial Sequence
  chemically synthesized
aaatttagcaatacttcttttt

SEQ ID NO: 639268 - DNA, 22 bp, Artificial Sequence
  chemically synthesized
tgaactaggtcacaaaaagaag

SEQ ID NO: 639269 - DNA, 22 bp, Artificial Sequence
  chemically synthesized
agcaatacttctttttgtgacc

SEQ ID NO: 639270 - DNA, 22 bp, Artificial Sequence
  chemically synthesized
gcaatacttctttttgtgacct

SEQ ID NO: 639271 - DNA, 22 bp, Artificial Sequence
  chemically synthesized
gaaagtgactgtgaactaggtc

SEQ ID NO: 639272 - DNA, 22 bp, Artificial Sequence
  chemically synthesized
agaaagtgactgtgaactaggt

SEQ ID NO: 639273 - DNA, 22 bp, Artificial Sequence
  chemically synthesized
tagaaagtgactgtgaactagg

SEQ ID NO: 639274 - DNA, 22 bp, Artificial Sequence
  chemically synthesized
ttagaaagtgactgtgaactag

SEQ ID NO: 639275 - DNA, 22 bp, Artificial Sequence
  chemically synthesized
ctttttgtgacctagttcacag

SEQ ID NO: 639276 - DNA, 22 bp, Artificial Sequence
  chemically synthesized
tttttgtgacctagttcacagt

SEQ ID NO: 639277 - DNA, 22 bp, Artificial Sequence
  chemically synthesized
tttgtgacctagttcacagtca

SEQ ID NO: 639278 - DNA, 22 bp, Artificial Sequence
  chemically synthesized
ttgtgacctagttcacagtcac

SEQ ID NO: 639279 - DNA, 22 bp, Artificial Sequence
  chemically synthesized
tgtgacctagttcacagtcact

SEQ ID NO: 639280 - DNA, 22 bp, Artificial Sequence
  chemically synthesized
gtgacctagttcacagtcactt

SEQ ID NO: 639281 - DNA, 22 bp, Artificial Sequence
  chemically synthesized
tgacctagttcacagtcacttt

SEQ ID NO: 639282 - DNA, 22 bp, Artificial Sequence
  chemically synthesized
aatgaacatttttagaaagtga

SEQ ID NO: 639283 - DNA, 22 bp, Artificial Sequence
  chemically synthesized
gttcacagtcactttctaaaaa

SEQ ID NO: 639284 - DNA, 22 bp, Artificial Sequence
  chemically synthesized
acagtcactttctaaaaatgtt

SEQ ID NO: 639285 - DNA, 22 bp, Artificial Sequence
  chemically synthesized
aagtactcaatgaacattttta

SEQ ID NO: 639286 - DNA, 22 bp, Artificial Sequence
  chemically synthesized
caagtactcaatgaacattttt

SEQ ID NO: 639287 - DNA, 22 bp, Artificial Sequence
  chemically synthesized
tttcaagtactcaatgaacatt

SEQ ID NO: 639288 - DNA, 22 bp, Artificial Sequence
  chemically synthesized
tctaaaaatgttcattgagtac

SEQ ID NO: 639289 - DNA, 22 bp, Artificial Sequence
  chemically synthesized
ctaaaaatgttcattgagtact

SEQ ID NO: 639290 - DNA, 22 bp, Artificial Sequence
  chemically synthesized
taaaaatgttcattgagtactt

SEQ ID NO: 639291 - DNA, 22 bp, Artificial Sequence
  chemically synthesized
aaaatgttcattgagtacttga

SEQ ID NO: 639292 - DNA, 22 bp, Artificial Sequence
  chemically synthesized
attgagtacttgaaataatgtg

SEQ ID NO: 639293 - DNA, 22 bp, Artificial Sequence
  chemically synthesized
caatggaaaaatacacattatt

SEQ ID NO: 639294 - DNA, 22 bp, Artificial Sequence
  chemically synthesized
ccaatggaaaaatacacattat

SEQ ID NO: 639295 - DNA, 22 bp, Artificial Sequence
  chemically synthesized
tccaatggaaaaatacacatta

SEQ ID NO: 639296 - DNA, 22 bp, Artificial Sequence
  chemically synthesized
agtacttgaaataatgtgtatt

SEQ ID NO: 639297 - DNA, 22 bp, Artificial Sequence
  chemically synthesized
catctttccaatggaaaaatac

SEQ ID NO: 639298 - DNA, 22 bp, Artificial Sequence
  chemically synthesized
gaaataatgtgtatttttccat

SEQ ID NO: 639299 - DNA, 22 bp, Artificial Sequence
  chemically synthesized
aaataatgtgtatttttccatt

SEQ ID NO: 639300 - DNA, 22 bp, Artificial Sequence
  chemically synthesized
gagactccatctttccaatgga

SEQ ID NO: 639301 - DNA, 22 bp, Artificial Sequence
  chemically synthesized
agagactccatctttccaatgg

SEQ ID NO: 639302 - DNA, 22 bp, Artificial Sequence
  chemically synthesized
tgtatttagagactccatcttt

SEQ ID NO: 639303 - DNA, 22 bp, Artificial Sequence
  chemically synthesized
ttccattggaaagatggagtct

SEQ ID NO: 639304 - DNA, 22 bp, Artificial Sequence
  chemically synthesized
tccattggaaagatggagtctc

SEQ ID NO: 639305 - DNA, 22 bp, Artificial Sequence
  chemically synthesized
ccattggaaagatggagtctct

SEQ ID NO: 639306 - DNA, 22 bp, Artificial Sequence
  chemically synthesized
cattggaaagatggagtctcta

SEQ ID NO: 639307 - DNA, 22 bp, Artificial Sequence
  chemically synthesized
gaaagatggagtctctaaatac

SEQ ID NO: 639308 - DNA, 22 bp, Artificial Sequence
  chemically synthesized
acaacaaaatcagcacactatg

SEQ ID NO: 639309 - DNA, 22 bp, Artificial Sequence
  chemically synthesized
aacaacaaaatcagcacactat

SEQ ID NO: 639310 - DNA, 22 bp, Artificial Sequence
  chemically synthesized
taacaacaaaatcagcacacta

SEQ ID NO: 639311 - DNA, 22 bp, Artificial Sequence
  chemically synthesized
taaatacatagtgtgctgattt

SEQ ID NO: 639312 - DNA, 22 bp, Artificial Sequence
  chemically synthesized
aatacatagtgtgctgattttg

SEQ ID NO: 639313 - DNA, 22 bp, Artificial Sequence
  chemically synthesized
ataaagatatggacaattttaa

SEQ ID NO: 639314 - DNA, 22 bp, Artificial Sequence
  chemically synthesized
attttgttgttaaaattgtcca

SEQ ID NO: 639315 - DNA, 22 bp, Artificial Sequence
  chemically synthesized
tgttgttaaaattgtccatatc

SEQ ID NO: 639316 - DNA, 22 bp, Artificial Sequence
  chemically synthesized
gttgttaaaattgtccatatct

SEQ ID NO: 639317 - DNA, 22 bp, Artificial Sequence
  chemically synthesized
ttgttaaaattgtccatatctt

SEQ ID NO: 639318 - DNA, 22 bp, Artificial Sequence
  chemically synthesized
ttaaaattgtccatatctttat

SEQ ID NO: 639319 - DNA, 22 bp, Artificial Sequence
  chemically synthesized
aaattgtccatatctttattaa

SEQ ID NO: 639320 - DNA, 22 bp, Artificial Sequence
  chemically synthesized
caaataatcaaaaattaataaa

SEQ ID NO: 639321 - DNA, 22 bp, Artificial Sequence
  chemically synthesized
tccatatctttattaatttttg

SEQ ID NO: 639322 - DNA, 22 bp, Artificial Sequence
  chemically synthesized
atagctacaaataatcaaaaat

SEQ ID NO: 639323 - DNA, 22 bp, Artificial Sequence
  chemically synthesized
tattaatttttgattatttgta

SEQ ID NO: 639324 - DNA, 22 bp, Artificial Sequence
  chemically synthesized
attaatttttgattatttgtag

SEQ ID NO: 639325 - DNA, 22 bp, Artificial Sequence
  chemically synthesized
ttaatttttgattatttgtagc

SEQ ID NO: 639326 - DNA, 22 bp, Artificial Sequence
  chemically synthesized
acaaaaattgatagctacaaat

SEQ ID NO: 639327 - DNA, 22 bp, Artificial Sequence
  chemically synthesized
atttttgattatttgtagctat

SEQ ID NO: 639328 - DNA, 22 bp, Artificial Sequence
  chemically synthesized
atctaacaaaaattgatagcta

SEQ ID NO: 639329 - DNA, 22 bp, Artificial Sequence
  chemically synthesized
ttgattatttgtagctatcaat

SEQ ID NO: 639330 - DNA, 22 bp, Artificial Sequence
  chemically synthesized
tgattatttgtagctatcaatt

SEQ ID NO: 639331 - DNA, 22 bp, Artificial Sequence
  chemically synthesized
gattatttgtagctatcaattt

SEQ ID NO: 639332 - DNA, 22 bp, Artificial Sequence
  chemically synthesized
attatttgtagctatcaatttt

SEQ ID NO: 639333 - DNA, 22 bp, Artificial Sequence
  chemically synthesized
aacactcatctaacaaaaattg

SEQ ID NO: 639334 - DNA, 22 bp, Artificial Sequence
  chemically synthesized
tttgtagctatcaatttttgtt

SEQ ID NO: 639335 - DNA, 22 bp, Artificial Sequence
  chemically synthesized
gtagctatcaatttttgttaga

SEQ ID NO: 639336 - DNA, 22 bp, Artificial Sequence
  chemically synthesized
tagctatcaatttttgttagat

SEQ ID NO: 639337 - DNA, 22 bp, Artificial Sequence
  chemically synthesized
tatctcaacactcatctaacaa

SEQ ID NO: 639338 - DNA, 22 bp, Artificial Sequence
  chemically synthesized
tcaatttttgttagatgagtgt

SEQ ID NO: 639339 - DNA, 22 bp, Artificial Sequence
  chemically synthesized
ttgttagatgagtgttgagata

SEQ ID NO: 639340 - DNA, 22 bp, Artificial Sequence
  chemically synthesized
tgttagatgagtgttgagatat

SEQ ID NO: 639341 - DNA, 22 bp, Artificial Sequence
  chemically synthesized
gttagatgagtgttgagatata

SEQ ID NO: 639342 - DNA, 22 bp, Artificial Sequence
  chemically synthesized
ttagatgagtgttgagatataa

SEQ ID NO: 639343 - DNA, 22 bp, Artificial Sequence
  chemically synthesized
acaaatccataattatatctca

SEQ ID NO: 639344 - DNA, 22 bp, Artificial Sequence
  chemically synthesized
gatgagtgttgagatataatta

SEQ ID NO: 639345 - DNA, 22 bp, Artificial Sequence
  chemically synthesized
aaaggagaaactaacaaatcca

SEQ ID NO: 639346 - DNA, 22 bp, Artificial Sequence
  chemically synthesized
agatataattatggatttgtta

SEQ ID NO: 639347 - DNA, 22 bp, Artificial Sequence
  chemically synthesized
tgatagaattaaaaggagaaac

SEQ ID NO: 639348 - DNA, 22 bp, Artificial Sequence
  chemically synthesized
tggatttgttagtttctccttt

SEQ ID NO: 639349 - DNA, 22 bp, Artificial Sequence
  chemically synthesized
gttagtttctccttttaattct

SEQ ID NO: 639350 - DNA, 22 bp, Artificial Sequence
  chemically synthesized
ttagtttctccttttaattcta

SEQ ID NO: 639351 - DNA, 22 bp, Artificial Sequence
  chemically synthesized
gtttctccttttaattctatca

SEQ ID NO: 639352 - DNA, 22 bp, Artificial Sequence
  chemically synthesized
ctccttttaattctatcataat

SEQ ID NO: 639353 - DNA, 22 bp, Artificial Sequence
  chemically synthesized
tccttttaattctatcataatt

SEQ ID NO: 639354 - DNA, 22 bp, Artificial Sequence
  chemically synthesized
cttttaattctatcataattca

SEQ ID NO: 639355 - DNA, 22 bp, Artificial Sequence
  chemically synthesized
gaaatatataaagtgaattatg

SEQ ID NO: 639356 - DNA, 22 bp, Artificial Sequence
  chemically synthesized
ttaattctatcataattcactt

SEQ ID NO: 639357 - DNA, 22 bp, Artificial Sequence
  chemically synthesized
taattctatcataattcacttt

SEQ ID NO: 639358 - DNA, 22 bp, Artificial Sequence
  chemically synthesized
aattctatcataattcacttta

SEQ ID NO: 639359 - DNA, 22 bp, Artificial Sequence
  chemically synthesized
attctatcataattcactttat

SEQ ID NO: 639360 - DNA, 22 bp, Artificial Sequence
  chemically synthesized
tatcataattcactttatatat

SEQ ID NO: 639361 - DNA, 22 bp, Artificial Sequence
  chemically synthesized
tataggtctagaaatatataaa

SEQ ID NO: 639362 - DNA, 22 bp, Artificial Sequence
  chemically synthesized
tcataattcactttatatattt

SEQ ID NO: 639363 - DNA, 22 bp, Artificial Sequence
  chemically synthesized
actatataggtctagaaatata

SEQ ID NO: 639364 - DNA, 22 bp, Artificial Sequence
  chemically synthesized
actttatatatttctagaccta

SEQ ID NO: 639365 - DNA, 22 bp, Artificial Sequence
  chemically synthesized
tgcatctaactatataggtcta

SEQ ID NO: 639366 - DNA, 22 bp, Artificial Sequence
  chemically synthesized
tatatatttctagacctatata

SEQ ID NO: 639367 - DNA, 22 bp, Artificial Sequence
  chemically synthesized
tgtgcatctaactatataggtc

SEQ ID NO: 639368 - DNA, 22 bp, Artificial Sequence
  chemically synthesized
atatatttctagacctatatag

SEQ ID NO: 639369 - DNA, 22 bp, Artificial Sequence
  chemically synthesized
ctgtgcatctaactatataggt

SEQ ID NO: 639370 - DNA, 22 bp, Artificial Sequence
  chemically synthesized
tatatttctagacctatatagt

SEQ ID NO: 639371 - DNA, 22 bp, Artificial Sequence
  chemically synthesized
ctagacctatatagttagatgc

SEQ ID NO: 639372 - DNA, 22 bp, Artificial Sequence
  chemically synthesized
tagacctatatagttagatgca

SEQ ID NO: 639373 - DNA, 22 bp, Artificial Sequence
  chemically synthesized
gacctatatagttagatgcaca

SEQ ID NO: 639374 - DNA, 22 bp, Artificial Sequence
  chemically synthesized
tatagttagatgcacagaagat

SEQ ID NO: 639375 - DNA, 22 bp, Artificial Sequence
  chemically synthesized
gatgcacagaagatcctcgttg

SEQ ID NO: 639376 - DNA, 22 bp, Artificial Sequence
  chemically synthesized
gaaacagtgcaagaacaacgag

SEQ ID NO: 639377 - DNA, 22 bp, Artificial Sequence
  chemically synthesized
cctagaaacagtgcaagaacaa

SEQ ID NO: 639378 - DNA, 22 bp, Artificial Sequence
  chemically synthesized
gttgttcttgcactgtttctag

SEQ ID NO: 639379 - DNA, 22 bp, Artificial Sequence
  chemically synthesized
ttcttgcactgtttctaggtag

SEQ ID NO: 639380 - DNA, 22 bp, Artificial Sequence
  chemically synthesized
ttgcactgtttctaggtagtat

SEQ ID NO: 639381 - DNA, 22 bp, Artificial Sequence
  chemically synthesized
ggaagaaaaagtatactaccta

SEQ ID NO: 639382 - DNA, 22 bp, Artificial Sequence
  chemically synthesized
gcactgtttctaggtagtatac

SEQ ID NO: 639383 - DNA, 22 bp, Artificial Sequence
  chemically synthesized
cactgtttctaggtagtatact

SEQ ID NO: 639384 - DNA, 22 bp, Artificial Sequence
  chemically synthesized
ttaggaagaaaaagtatactac

SEQ ID NO: 639385 - DNA, 22 bp, Artificial Sequence
  chemically synthesized
tttctaggtagtatactttttc

SEQ ID NO: 639386 - DNA, 22 bp, Artificial Sequence
  chemically synthesized
ctaggtagtatactttttcttc

SEQ ID NO: 639387 - DNA, 22 bp, Artificial Sequence
  chemically synthesized
taggtagtatactttttcttcc

SEQ ID NO: 639388 - DNA, 22 bp, Artificial Sequence
  chemically synthesized
ggtagtatactttttcttccta

SEQ ID NO: 639389 - DNA, 22 bp, Artificial Sequence
  chemically synthesized
tggcaatcaacattattaggaa

SEQ ID NO: 639390 - DNA, 22 bp, Artificial Sequence
  chemically synthesized
atggcaatcaacattattagga

SEQ ID NO: 639391 - DNA, 22 bp, Artificial Sequence
  chemically synthesized
tttcttcctaataatgttgatt

SEQ ID NO: 639392 - DNA, 22 bp, Artificial Sequence
  chemically synthesized
ttcttcctaataatgttgattg

SEQ ID NO: 639393 - DNA, 22 bp, Artificial Sequence
  chemically synthesized
tcttcctaataatgttgattgc

SEQ ID NO: 639394 - DNA, 22 bp, Artificial Sequence
  chemically synthesized
cttcctaataatgttgattgcc

SEQ ID NO: 639395 - DNA, 22 bp, Artificial Sequence
  chemically synthesized
ttcctaataatgttgattgcca

SEQ ID NO: 639396 - DNA, 22 bp, Artificial Sequence
  chemically synthesized
cctaataatgttgattgccata

SEQ ID NO: 639397 - DNA, 22 bp, Artificial Sequence
  chemically synthesized
ctaataatgttgattgccataa

SEQ ID NO: 639398 - DNA, 22 bp, Artificial Sequence
  chemically synthesized
aatggaataaaatttatggcaa

SEQ ID NO: 639399 - DNA, 22 bp, Artificial Sequence
  chemically synthesized
aaatggaataaaatttatggca

SEQ ID NO: 639400 - DNA, 22 bp, Artificial Sequence
  chemically synthesized
ataatgttgattgccataaatt

SEQ ID NO: 639401 - DNA, 22 bp, Artificial Sequence
  chemically synthesized
taaatggaataaaatttatggc

SEQ ID NO: 639402 - DNA, 22 bp, Artificial Sequence
  chemically synthesized
attgccataaattttattccat

SEQ ID NO: 639403 - DNA, 22 bp, Artificial Sequence
  chemically synthesized
ccataaattttattccatttaa

SEQ ID NO: 639404 - DNA, 22 bp, Artificial Sequence
  chemically synthesized
tattccatttaaaggtttctat

SEQ ID NO: 639405 - DNA, 22 bp, Artificial Sequence
  chemically synthesized
attccatttaaaggtttctatg

SEQ ID NO: 639406 - DNA, 22 bp, Artificial Sequence
  chemically synthesized
ttccatttaaaggtttctatgg

SEQ ID NO: 639407 - DNA, 22 bp, Artificial Sequence
  chemically synthesized
catttaaaggtttctatggtta

SEQ ID NO: 639408 - DNA, 22 bp, Artificial Sequence
  chemically synthesized
aaaggtttctatggttattcca

SEQ ID NO: 639409 - DNA, 22 bp, Artificial Sequence
  chemically synthesized
aaggtttctatggttattccac

SEQ ID NO: 639410 - DNA, 22 bp, Artificial Sequence
  chemically synthesized
ctatggttattccactgtcttt

SEQ ID NO: 639411 - DNA, 22 bp, Artificial Sequence
  chemically synthesized
tatggttattccactgtctttt

SEQ ID NO: 639412 - DNA, 22 bp, Artificial Sequence
  chemically synthesized
accaaatataaccaaaagacag

SEQ ID NO: 639413 - DNA, 22 bp, Artificial Sequence
  chemically synthesized
tggttattccactgtcttttgg

SEQ ID NO: 639414 - DNA, 22 bp, Artificial Sequence
  chemically synthesized
ttccactgtcttttggttatat

SEQ ID NO: 639415 - DNA, 22 bp, Artificial Sequence
  chemically synthesized
gaaattaaccaaatataaccaa

SEQ ID NO: 639416 - DNA, 22 bp, Artificial Sequence
  chemically synthesized
ggaaattaaccaaatataacca

SEQ ID NO: 639417 - DNA, 22 bp, Artificial Sequence
  chemically synthesized
cactgtcttttggttatatttg

SEQ ID NO: 639418 - DNA, 22 bp, Artificial Sequence
  chemically synthesized
tttggaaattaaccaaatataa

SEQ ID NO: 639419 - DNA, 22 bp, Artificial Sequence
  chemically synthesized
atttggaaattaaccaaatata

SEQ ID NO: 639420 - DNA, 22 bp, Artificial Sequence
  chemically synthesized
tcttttggttatatttggttaa

SEQ ID NO: 639421 - DNA, 22 bp, Artificial Sequence
  chemically synthesized
tatttatttggaaattaaccaa

SEQ ID NO: 639422 - DNA, 22 bp, Artificial Sequence
  chemically synthesized
atatttatttggaaattaacca

SEQ ID NO: 639423 - DNA, 22 bp, Artificial Sequence
  chemically synthesized
ttggttatatttggttaatttc

SEQ ID NO: 639424 - DNA, 22 bp, Artificial Sequence
  chemically synthesized
tggttatatttggttaatttcc

SEQ ID NO: 639425 - DNA, 22 bp, Artificial Sequence
  chemically synthesized
ggttatatttggttaatttcca

SEQ ID NO: 639426 - DNA, 22 bp, Artificial Sequence
  chemically synthesized
tttatatttatttggaaattaa

SEQ ID NO: 639427 - DNA, 22 bp, Artificial Sequence
  chemically synthesized
gttatatttggttaatttccaa

SEQ ID NO: 639428 - DNA, 22 bp, Artificial Sequence
  chemically synthesized
tatttggttaatttccaaataa

SEQ ID NO: 639429 - DNA, 22 bp, Artificial Sequence
  chemically synthesized
atactgtttatatttatttgga

SEQ ID NO: 639430 - DNA, 22 bp, Artificial Sequence
  chemically synthesized
ggttaatttccaaataaatata

SEQ ID NO: 639431 - DNA, 22 bp, Artificial Sequence
  chemically synthesized
gttaatttccaaataaatataa

SEQ ID NO: 639432 - DNA, 22 bp, Artificial Sequence
  chemically synthesized
atttccaaataaatataaacag

SEQ ID NO: 639433 - DNA, 22 bp, Artificial Sequence
  chemically synthesized
acatgtgctaatactgtttata

SEQ ID NO: 639434 - DNA, 22 bp, Artificial Sequence
  chemically synthesized
cacatgtgctaatactgtttat

SEQ ID NO: 639435 - DNA, 22 bp, Artificial Sequence
  chemically synthesized
ccaaataaatataaacagtatt

SEQ ID NO: 639436 - DNA, 22 bp, Artificial Sequence
  chemically synthesized
caaataaatataaacagtatta

SEQ ID NO: 639437 - DNA, 22 bp, Artificial Sequence
  chemically synthesized
ggaccttcacatgtgctaatac

SEQ ID NO: 639438 - DNA, 22 bp, Artificial Sequence
  chemically synthesized
gggaccttcacatgtgctaata

SEQ ID NO: 639439 - DNA, 22 bp, Artificial Sequence
  chemically synthesized
aagcatttgggaccttcacatg

SEQ ID NO: 639440 - DNA, 22 bp, Artificial Sequence
  chemically synthesized
gcacatgtgaaggtcccaaatg

SEQ ID NO: 639441 - DNA, 22 bp, Artificial Sequence
  chemically synthesized
agtaaatcctaaagcatttggg

SEQ ID NO: 639442 - DNA, 22 bp, Artificial Sequence
  chemically synthesized
tcagtaaatcctaaagcatttg

SEQ ID NO: 639443 - DNA, 22 bp, Artificial Sequence
  chemically synthesized
tattctcagtaaatcctaaagc

SEQ ID NO: 639444 - DNA, 22 bp, Artificial Sequence
  chemically synthesized
gaattgtattctcagtaaatcc

SEQ ID NO: 639445 - DNA, 22 bp, Artificial Sequence
  chemically synthesized
aattggaattgtattctcagta

SEQ ID NO: 639446 - DNA, 22 bp, Artificial Sequence
  chemically synthesized
taggatttactgagaatacaat

SEQ ID NO: 639447 - DNA, 22 bp, Artificial Sequence
  chemically synthesized
aggatttactgagaatacaatt

SEQ ID NO: 639448 - DNA, 22 bp, Artificial Sequence
  chemically synthesized
ggatttactgagaatacaattc

SEQ ID NO: 639449 - DNA, 22 bp, Artificial Sequence
  chemically synthesized
actgagaatacaattccaattg

SEQ ID NO: 639450 - DNA, 22 bp, Artificial Sequence
  chemically synthesized
ctgagaatacaattccaattga

SEQ ID NO: 639451 - DNA, 22 bp, Artificial Sequence
  chemically synthesized
agaatacaattccaattgagga

SEQ ID NO: 639452 - DNA, 22 bp, Artificial Sequence
  chemically synthesized
gatatcaaatatcagaaatgtc

SEQ ID NO: 639453 - DNA, 22 bp, Artificial Sequence
  chemically synthesized
caattgaggacatttctgatat

SEQ ID NO: 639454 - DNA, 22 bp, Artificial Sequence
  chemically synthesized
aggacatttctgatatttgata

SEQ ID NO: 639455 - DNA, 22 bp, Artificial Sequence
  chemically synthesized
atcagtcactggatatcaaata

SEQ ID NO: 639456 - DNA, 22 bp, Artificial Sequence
  chemically synthesized
taatcagtcactggatatcaaa

SEQ ID NO: 639457 - DNA, 22 bp, Artificial Sequence
  chemically synthesized
ctgatatttgatatccagtgac

SEQ ID NO: 639458 - DNA, 22 bp, Artificial Sequence
  chemically synthesized
tgatatttgatatccagtgact

SEQ ID NO: 639459 - DNA, 22 bp, Artificial Sequence
  chemically synthesized
atatttgatatccagtgactga

SEQ ID NO: 639460 - DNA, 22 bp, Artificial Sequence
  chemically synthesized
gatatccagtgactgattagaa

SEQ ID NO: 639461 - DNA, 22 bp, Artificial Sequence
  chemically synthesized
atatccagtgactgattagaac

SEQ ID NO: 639462 - DNA, 22 bp, Artificial Sequence
  chemically synthesized
attagaactcttgacatctttc

SEQ ID NO: 639463 - DNA, 22 bp, Artificial Sequence
  chemically synthesized
tcacaagtagaagaaagatgtc

SEQ ID NO: 639464 - DNA, 22 bp, Artificial Sequence
  chemically synthesized
atcacaagtagaagaaagatgt

SEQ ID NO: 639465 - DNA, 22 bp, Artificial Sequence
  chemically synthesized
gaactcttgacatctttcttct

SEQ ID NO: 639466 - DNA, 22 bp, Artificial Sequence
  chemically synthesized
gtatttatcacaagtagaagaa

SEQ ID NO: 639467 - DNA, 22 bp, Artificial Sequence
  chemically synthesized
ggtatttatcacaagtagaaga

SEQ ID NO: 639468 - DNA, 22 bp, Artificial Sequence
  chemically synthesized
tggtatttatcacaagtagaag

SEQ ID NO: 639469 - DNA, 22 bp, Artificial Sequence
  chemically synthesized
ttgacatctttcttctacttgt

SEQ ID NO: 639470 - DNA, 22 bp, Artificial Sequence
  chemically synthesized
gacatctttcttctacttgtga

SEQ ID NO: 639471 - DNA, 22 bp, Artificial Sequence
  chemically synthesized
ttttggtatttatcacaagtag

SEQ ID NO: 639472 - DNA, 22 bp, Artificial Sequence
  chemically synthesized
acatctttcttctacttgtgat

SEQ ID NO: 639473 - DNA, 22 bp, Artificial Sequence
  chemically synthesized
attttggtatttatcacaagta

SEQ ID NO: 639474 - DNA, 22 bp, Artificial Sequence
  chemically synthesized
tcttctacttgtgataaatacc

SEQ ID NO: 639475 - DNA, 22 bp, Artificial Sequence
  chemically synthesized
tcatcttattttggtatttatc

SEQ ID NO: 639476 - DNA, 22 bp, Artificial Sequence
  chemically synthesized
cttctacttgtgataaatacca

SEQ ID NO: 639477 - DNA, 22 bp, Artificial Sequence
  chemically synthesized
ttctacttgtgataaataccaa

SEQ ID NO: 639478 - DNA, 22 bp, Artificial Sequence
  chemically synthesized
ctacttgtgataaataccaaaa

SEQ ID NO: 639479 - DNA, 22 bp, Artificial Sequence
  chemically synthesized
tacttgtgataaataccaaaat

SEQ ID NO: 639480 - DNA, 22 bp, Artificial Sequence
  chemically synthesized
cttgtgataaataccaaaataa

SEQ ID NO: 639481 - DNA, 22 bp, Artificial Sequence
  chemically synthesized
gtgataaataccaaaataagat

SEQ ID NO: 639482 - DNA, 22 bp, Artificial Sequence
  chemically synthesized
tgataaataccaaaataagatg

SEQ ID NO: 639483 - DNA, 22 bp, Artificial Sequence
  chemically synthesized
tgaacaacagaaatctgtcatc

SEQ ID NO: 639484 - DNA, 22 bp, Artificial Sequence
  chemically synthesized
atgaaatatcatctgtgaacaa

SEQ ID NO: 639485 - DNA, 22 bp, Artificial Sequence
  chemically synthesized
acctgatgaaatatcatctgtg

SEQ ID NO: 639486 - DNA, 22 bp, Artificial Sequence
  chemically synthesized
tcacctgatgaaatatcatctg

SEQ ID NO: 639487 - DNA, 22 bp, Artificial Sequence
  chemically synthesized
ctgttgttcacagatgatattt

SEQ ID NO: 639488 - DNA, 22 bp, Artificial Sequence
  chemically synthesized
tctcacctgatgaaatatcatc

SEQ ID NO: 639489 - DNA, 22 bp, Artificial Sequence
  chemically synthesized
tgttgttcacagatgatatttc

SEQ ID NO: 639490 - DNA, 22 bp, Artificial Sequence
  chemically synthesized
ctctcacctgatgaaatatcat

SEQ ID NO: 639491 - DNA, 22 bp, Artificial Sequence
  chemically synthesized
ttgttcacagatgatatttcat

SEQ ID NO: 639492 - DNA, 22 bp, Artificial Sequence
  chemically synthesized
ttcacagatgatatttcatcag

SEQ ID NO: 639493 - DNA, 22 bp, Artificial Sequence
  chemically synthesized
acagatgatatttcatcaggtg

SEQ ID NO: 639494 - DNA, 22 bp, Artificial Sequence
  chemically synthesized
tggataggaatttctctcacct

SEQ ID NO: 639495 - DNA, 22 bp, Artificial Sequence
  chemically synthesized
gtggataggaatttctctcacc

SEQ ID NO: 639496 - DNA, 22 bp, Artificial Sequence
  chemically synthesized
catcaggtgagagaaattccta

SEQ ID NO: 639497 - DNA, 22 bp, Artificial Sequence
  chemically synthesized
atcaggtgagagaaattcctat

SEQ ID NO: 639498 - DNA, 22 bp, Artificial Sequence
  chemically synthesized
ccacatttgtggataggaattt

SEQ ID NO: 639499 - DNA, 22 bp, Artificial Sequence
  chemically synthesized
atatagatctcccacatttgtg

SEQ ID NO: 639500 - DNA, 22 bp, Artificial Sequence
  chemically synthesized
attgatatagatctcccacatt

SEQ ID NO: 639501 - DNA, 22 bp, Artificial Sequence
  chemically synthesized
tcattgatatagatctcccaca

SEQ ID NO: 639502 - DNA, 22 bp, Artificial Sequence
  chemically synthesized
ctatccacaaatgtgggagatc

SEQ ID NO: 639503 - DNA, 22 bp, Artificial Sequence
  chemically synthesized
ctcattgatatagatctcccac

SEQ ID NO: 639504 - DNA, 22 bp, Artificial Sequence
  chemically synthesized
tctcattgatatagatctccca

SEQ ID NO: 639505 - DNA, 22 bp, Artificial Sequence
  chemically synthesized
ttctcattgatatagatctccc

SEQ ID NO: 639506 - DNA, 22 bp, Artificial Sequence
  chemically synthesized
tccacaaatgtgggagatctat

SEQ ID NO: 639507 - DNA, 22 bp, Artificial Sequence
  chemically synthesized
ttttctcattgatatagatctc

SEQ ID NO: 639508 - DNA, 22 bp, Artificial Sequence
  chemically synthesized
atctcttttctcattgatatag

SEQ ID NO: 639509 - DNA, 22 bp, Artificial Sequence
  chemically synthesized
catctcttttctcattgatata

SEQ ID NO: 639510 - DNA, 22 bp, Artificial Sequence
  chemically synthesized
catttcatctcttttctcattg

SEQ ID NO: 639511 - DNA, 22 bp, Artificial Sequence
  chemically synthesized
acatttcatctcttttctcatt

SEQ ID NO: 639512 - DNA, 22 bp, Artificial Sequence
  chemically synthesized
cttacatttcatctcttttctc

SEQ ID NO: 639513 - DNA, 22 bp, Artificial Sequence
  chemically synthesized
actacttacatttcatctcttt

SEQ ID NO: 639514 - DNA, 22 bp, Artificial Sequence
  chemically synthesized
tatcaatgagaaaagagatgaa

SEQ ID NO: 639515 - DNA, 22 bp, Artificial Sequence
  chemically synthesized
ctcactacttacatttcatctc

SEQ ID NO: 639516 - DNA, 22 bp, Artificial Sequence
  chemically synthesized
gctactcactacttacatttca

SEQ ID NO: 639517 - DNA, 22 bp, Artificial Sequence
  chemically synthesized
ggctactcactacttacatttc

SEQ ID NO: 639518 - DNA, 22 bp, Artificial Sequence
  chemically synthesized
ttggctactcactacttacatt

SEQ ID NO: 639519 - DNA, 22 bp, Artificial Sequence
  chemically synthesized
cttggctactcactacttacat

SEQ ID NO: 639520 - DNA, 22 bp, Artificial Sequence
  chemically synthesized
ttcttggctactcactacttac

SEQ ID NO: 639521 - DNA, 22 bp, Artificial Sequence
  chemically synthesized
gacaatgggaaaactcttcttg

SEQ ID NO: 639522 - DNA, 22 bp, Artificial Sequence
  chemically synthesized
aaactggacaatgggaaaactc

SEQ ID NO: 639523 - DNA, 22 bp, Artificial Sequence
  chemically synthesized
tcaaactggacaatgggaaaac

SEQ ID NO: 639524 - DNA, 22 bp, Artificial Sequence
  chemically synthesized
ctcaaactggacaatgggaaaa

SEQ ID NO: 639525 - DNA, 22 bp, Artificial Sequence
  chemically synthesized
tctcaaactggacaatgggaaa

SEQ ID NO: 639526 - DNA, 22 bp, Artificial Sequence
  chemically synthesized
ctttctcaaactggacaatggg

SEQ ID NO: 639527 - DNA, 22 bp, Artificial Sequence
  chemically synthesized
gctttctcaaactggacaatgg

SEQ ID NO: 639528 - DNA, 22 bp, Artificial Sequence
  chemically synthesized
tcccattgtccagtttgagaaa

SEQ ID NO: 639529 - DNA, 22 bp, Artificial Sequence
  chemically synthesized
cccattgtccagtttgagaaag

SEQ ID NO: 639530 - DNA, 22 bp, Artificial Sequence
  chemically synthesized
ccattgtccagtttgagaaagc

SEQ ID NO: 639531 - DNA, 22 bp, Artificial Sequence
  chemically synthesized
gtgatgagatgatcttgctttc

SEQ ID NO: 639532 - DNA, 22 bp, Artificial Sequence
  chemically synthesized
tccagtttgagaaagcaagatc

SEQ ID NO: 639533 - DNA, 22 bp, Artificial Sequence
  chemically synthesized
gcagacctggtgatgagatgat

SEQ ID NO: 639534 - DNA, 22 bp, Artificial Sequence
  chemically synthesized
gagaaagcaagatcatctcatc

SEQ ID NO: 639535 - DNA, 22 bp, Artificial Sequence
  chemically synthesized
agcagacctggtgatgagatga

SEQ ID NO: 639536 - DNA, 22 bp, Artificial Sequence
  chemically synthesized
agaaagcaagatcatctcatca

SEQ ID NO: 639537 - DNA, 22 bp, Artificial Sequence
  chemically synthesized
atcaccaggtctgctaaatatt

SEQ ID NO: 639538 - DNA, 22 bp, Artificial Sequence
  chemically synthesized
cgagtatgggacaacagaaaat

SEQ ID NO: 639539 - DNA, 22 bp, Artificial Sequence
  chemically synthesized
attccgagtatgggacaacaga

SEQ ID NO: 639540 - DNA, 22 bp, Artificial Sequence
  chemically synthesized
ctaaatattttctgttgtccca

SEQ ID NO: 639541 - DNA, 22 bp, Artificial Sequence
  chemically synthesized
aatattttctgttgtcccatac

SEQ ID NO: 639542 - DNA, 22 bp, Artificial Sequence
  chemically synthesized
tggaatgttcattccgagtatg

SEQ ID NO: 639543 - DNA, 22 bp, Artificial Sequence
  chemically synthesized
tctgttgtcccatactcggaat

SEQ ID NO: 639544 - DNA, 22 bp, Artificial Sequence
  chemically synthesized
ctgttgtcccatactcggaatg

SEQ ID NO: 639545 - DNA, 22 bp, Artificial Sequence
  chemically synthesized
tgttgtcccatactcggaatga

SEQ ID NO: 639546 - DNA, 22 bp, Artificial Sequence
  chemically synthesized
ttgtcccatactcggaatgaac

SEQ ID NO: 639547 - DNA, 22 bp, Artificial Sequence
  chemically synthesized
tcccatactcggaatgaacatt

SEQ ID NO: 639548 - DNA, 22 bp, Artificial Sequence
  chemically synthesized
ggaatgaacattccacagggga

SEQ ID NO: 639549 - DNA, 22 bp, Artificial Sequence
  chemically synthesized
gaagacatgccgtcccctgtgg

SEQ ID NO: 639550 - DNA, 22 bp, Artificial Sequence
  chemically synthesized
ggaagacatgccgtcccctgtg

SEQ ID NO: 639551 - DNA, 22 bp, Artificial Sequence
  chemically synthesized
tggaagacatgccgtcccctgt

SEQ ID NO: 639552 - DNA, 22 bp, Artificial Sequence
  chemically synthesized
agcattttggaagacatgccgt

SEQ ID NO: 639553 - DNA, 22 bp, Artificial Sequence
  chemically synthesized
cacaggggacggcatgtcttcc

SEQ ID NO: 639554 - DNA, 22 bp, Artificial Sequence
  chemically synthesized
aaactgagcattttggaagaca

SEQ ID NO: 639555 - DNA, 22 bp, Artificial Sequence
  chemically synthesized
gaaactgagcattttggaagac

SEQ ID NO: 639556 - DNA, 22 bp, Artificial Sequence
  chemically synthesized
tgaaactgagcattttggaaga

SEQ ID NO: 639557 - DNA, 22 bp, Artificial Sequence
  chemically synthesized
ttgaaactgagcattttggaag

SEQ ID NO: 639558 - DNA, 22 bp, Artificial Sequence
  chemically synthesized
gccttttgaaactgagcatttt

SEQ ID NO: 639559 - DNA, 22 bp, Artificial Sequence
  chemically synthesized
ccaaaatgctcagtttcaaaag

SEQ ID NO: 639560 - DNA, 22 bp, Artificial Sequence
  chemically synthesized
caaaatgctcagtttcaaaagg

SEQ ID NO: 639561 - DNA, 22 bp, Artificial Sequence
  chemically synthesized
catgtggagatctagccttttg

SEQ ID NO: 639562 - DNA, 22 bp, Artificial Sequence
  chemically synthesized
ccatgtggagatctagcctttt

SEQ ID NO: 639563 - DNA, 22 bp, Artificial Sequence
  chemically synthesized
cttccatgtggagatctagcct

SEQ ID NO: 639564 - DNA, 22 bp, Artificial Sequence
  chemically synthesized
tgcttccatgtggagatctagc

SEQ ID NO: 639565 - DNA, 22 bp, Artificial Sequence
  chemically synthesized
agtttcaaaaggctagatctcc

SEQ ID NO: 639566 - DNA, 22 bp, Artificial Sequence
  chemically synthesized
ctgcttccatgtggagatctag

SEQ ID NO: 639567 - DNA, 22 bp, Artificial Sequence
  chemically synthesized
tctgcttccatgtggagatcta

SEQ ID NO: 639568 - DNA, 22 bp, Artificial Sequence
  chemically synthesized
tttctgcttccatgtggagatc

SEQ ID NO: 639569 - DNA, 22 bp, Artificial Sequence
  chemically synthesized
ctttctgcttccatgtggagat

SEQ ID NO: 639570 - DNA, 22 bp, Artificial Sequence
  chemically synthesized
caaaaggctagatctccacatg

SEQ ID NO: 639571 - DNA, 22 bp, Artificial Sequence
  chemically synthesized
tctttctgcttccatgtggaga

SEQ ID NO: 639572 - DNA, 22 bp, Artificial Sequence
  chemically synthesized
aaaaggctagatctccacatgg

SEQ ID NO: 639573 - DNA, 22 bp, Artificial Sequence
  chemically synthesized
ggttttctttctgcttccatgt

SEQ ID NO: 639574 - DNA, 22 bp, Artificial Sequence
  chemically synthesized
gatctccacatggaagcagaaa

SEQ ID NO: 639575 - DNA, 22 bp, Artificial Sequence
  chemically synthesized
cacatggaagcagaaagaaaac

SEQ ID NO: 639576 - DNA, 22 bp, Artificial Sequence
  chemically synthesized
ctctggtttttttctttgtttt

SEQ ID NO: 639577 - DNA, 22 bp, Artificial Sequence
  chemically synthesized
tggtttttttctttgttttgtt

SEQ ID NO: 639578 - DNA, 22 bp, Artificial Sequence
  chemically synthesized
gtttttttctttgttttgtttt

SEQ ID NO: 639579 - DNA, 22 bp, Artificial Sequence
  chemically synthesized
ttttctttgttttgttttgctt

SEQ ID NO: 639580 - DNA, 22 bp, Artificial Sequence
  chemically synthesized
tttctttgttttgttttgcttc

SEQ ID NO: 639581 - DNA, 22 bp, Artificial Sequence
  chemically synthesized
ttctttgttttgttttgcttca

SEQ ID NO: 639582 - DNA, 22 bp, Artificial Sequence
  chemically synthesized
tctttgttttgttttgcttcat

SEQ ID NO: 639583 - DNA, 22 bp, Artificial Sequence
  chemically synthesized
ctttgttttgttttgcttcatt

SEQ ID NO: 639584 - DNA, 22 bp, Artificial Sequence
  chemically synthesized
tttgttttgttttgcttcattt

SEQ ID NO: 639585 - DNA, 22 bp, Artificial Sequence
  chemically synthesized
ggtagaatgaaaaaaatgaagc

SEQ ID NO: 639586 - DNA, 22 bp, Artificial Sequence
  chemically synthesized
tgttttgttttgcttcattttt

SEQ ID NO: 639587 - DNA, 22 bp, Artificial Sequence
  chemically synthesized
gttttgttttgcttcatttttt

SEQ ID NO: 639588 - DNA, 22 bp, Artificial Sequence
  chemically synthesized
ttttgttttgcttcattttttt

SEQ ID NO: 639589 - DNA, 22 bp, Artificial Sequence
  chemically synthesized
tgttttgcttcatttttttcat

SEQ ID NO: 639590 - DNA, 22 bp, Artificial Sequence
  chemically synthesized
gttttgcttcatttttttcatt

SEQ ID NO: 639591 - DNA, 22 bp, Artificial Sequence
  chemically synthesized
ggtactaggtagaatgaaaaaa

SEQ ID NO: 639592 - DNA, 22 bp, Artificial Sequence
  chemically synthesized
ttttgcttcatttttttcattc

SEQ ID NO: 639593 - DNA, 22 bp, Artificial Sequence
  chemically synthesized
tgcttcatttttttcattctac

SEQ ID NO: 639594 - DNA, 22 bp, Artificial Sequence
  chemically synthesized
gcttcatttttttcattctacc

SEQ ID NO: 639595 - DNA, 22 bp, Artificial Sequence
  chemically synthesized
cttcatttttttcattctacct

SEQ ID NO: 639596 - DNA, 22 bp, Artificial Sequence
  chemically synthesized
taatgttaggtactaggtagaa

SEQ ID NO: 639597 - DNA, 22 bp, Artificial Sequence
  chemically synthesized
catttttttcattctacctagt

SEQ ID NO: 639598 - DNA, 22 bp, Artificial Sequence
  chemically synthesized
gtaatgttaggtactaggtaga

SEQ ID NO: 639599 - DNA, 22 bp, Artificial Sequence
  chemically synthesized
atttttttcattctacctagta

SEQ ID NO: 639600 - DNA, 22 bp, Artificial Sequence
  chemically synthesized
ttttcattctacctagtaccta

SEQ ID NO: 639601 - DNA, 22 bp, Artificial Sequence
  chemically synthesized
tttcattctacctagtacctaa

SEQ ID NO: 639602 - DNA, 22 bp, Artificial Sequence
  chemically synthesized
ttcattctacctagtacctaac

SEQ ID NO: 639603 - DNA, 22 bp, Artificial Sequence
  chemically synthesized
tcattctacctagtacctaaca

SEQ ID NO: 639604 - DNA, 22 bp, Artificial Sequence
  chemically synthesized
gaaaccttgtaatgttaggtac

SEQ ID NO: 639605 - DNA, 22 bp, Artificial Sequence
  chemically synthesized
cattctacctagtacctaacat

SEQ ID NO: 639606 - DNA, 22 bp, Artificial Sequence
  chemically synthesized
attctacctagtacctaacatt

SEQ ID NO: 639607 - DNA, 22 bp, Artificial Sequence
  chemically synthesized
ctggaaaccttgtaatgttagg

SEQ ID NO: 639608 - DNA, 22 bp, Artificial Sequence
  chemically synthesized
tacctagtacctaacattacaa

SEQ ID NO: 639609 - DNA, 22 bp, Artificial Sequence
  chemically synthesized
cctagtacctaacattacaagg

SEQ ID NO: 639610 - DNA, 22 bp, Artificial Sequence
  chemically synthesized
gtacctaacattacaaggtttc

SEQ ID NO: 639611 - DNA, 22 bp, Artificial Sequence
  chemically synthesized
aataaattcctggaaaccttgt

SEQ ID NO: 639612 - DNA, 22 bp, Artificial Sequence
  chemically synthesized
aaataaattcctggaaaccttg

SEQ ID NO: 639613 - DNA, 22 bp, Artificial Sequence
  chemically synthesized
taaataaattcctggaaacctt

SEQ ID NO: 639614 - DNA, 22 bp, Artificial Sequence
  chemically synthesized
acattacaaggtttccaggaat

SEQ ID NO: 639615 - DNA, 22 bp, Artificial Sequence
  chemically synthesized
tgtgactttaaataaattcctg

SEQ ID NO: 639616 - DNA, 22 bp, Artificial Sequence
  chemically synthesized
tgtgtgactttaaataaattcc

SEQ ID NO: 639617 - DNA, 22 bp, Artificial Sequence
  chemically synthesized
caaggtttccaggaatttattt

SEQ ID NO: 639618 - DNA, 22 bp, Artificial Sequence
  chemically synthesized
ctgtgtgactttaaataaattc

SEQ ID NO: 639619 - DNA, 22 bp, Artificial Sequence
  chemically synthesized
tctgtgtgactttaaataaatt

SEQ ID NO: 639620 - DNA, 22 bp, Artificial Sequence
  chemically synthesized
attttctgtgtgactttaaata

SEQ ID NO: 639621 - DNA, 22 bp, Artificial Sequence
  chemically synthesized
ccaggaatttatttaaagtcac

SEQ ID NO: 639622 - DNA, 22 bp, Artificial Sequence
  chemically synthesized
caggaatttatttaaagtcaca

SEQ ID NO: 639623 - DNA, 22 bp, Artificial Sequence
  chemically synthesized
atttaaagtcacacagaaaatc

SEQ ID NO: 639624 - DNA, 22 bp, Artificial Sequence
  chemically synthesized
tttaaagtcacacagaaaatca

SEQ ID NO: 639625 - DNA, 22 bp, Artificial Sequence
  chemically synthesized
aaagtcacacagaaaatcaatg

SEQ ID NO: 639626 - DNA, 22 bp, Artificial Sequence
  chemically synthesized
aagtcacacagaaaatcaatgt

SEQ ID NO: 639627 - DNA, 22 bp, Artificial Sequence
  chemically synthesized
tagatgaaaaagatcatacatt

SEQ ID NO: 639628 - DNA, 22 bp, Artificial Sequence
  chemically synthesized
tgtagatgaaaaagatcataca

SEQ ID NO: 639629 - DNA, 22 bp, Artificial Sequence
  chemically synthesized
ctgtagatgaaaaagatcatac

SEQ ID NO: 639630 - DNA, 22 bp, Artificial Sequence
  chemically synthesized
tttctgtagatgaaaaagatca

SEQ ID NO: 639631 - DNA, 22 bp, Artificial Sequence
  chemically synthesized
tatttctgtagatgaaaaagat

SEQ ID NO: 639632 - DNA, 22 bp, Artificial Sequence
  chemically synthesized
tttcatctacagaaatagaatc

SEQ ID NO: 639633 - DNA, 22 bp, Artificial Sequence
  chemically synthesized
ttcatctacagaaatagaatct

SEQ ID NO: 639634 - DNA, 22 bp, Artificial Sequence
  chemically synthesized
tcatctacagaaatagaatctc

SEQ ID NO: 639635 - DNA, 22 bp, Artificial Sequence
  chemically synthesized
catctacagaaatagaatctcc

SEQ ID NO: 639636 - DNA, 22 bp, Artificial Sequence
  chemically synthesized
atctacagaaatagaatctcct

SEQ ID NO: 639637 - DNA, 22 bp, Artificial Sequence
  chemically synthesized
aatcagtacagataggagattc

SEQ ID NO: 639638 - DNA, 22 bp, Artificial Sequence
  chemically synthesized
caatcagtacagataggagatt

SEQ ID NO: 639639 - DNA, 22 bp, Artificial Sequence
  chemically synthesized
cagaaatagaatctcctatctg

SEQ ID NO: 639640 - DNA, 22 bp, Artificial Sequence
  chemically synthesized
atagcaataggatttcaatcag

SEQ ID NO: 639641 - DNA, 22 bp, Artificial Sequence
  chemically synthesized
ctatctgtactgattgaaatcc

SEQ ID NO: 639642 - DNA, 22 bp, Artificial Sequence
  chemically synthesized
tctgtactgattgaaatcctat

SEQ ID NO: 639643 - DNA, 22 bp, Artificial Sequence
  chemically synthesized
aaggctgatagcaataggattt

SEQ ID NO: 639644 - DNA, 22 bp, Artificial Sequence
  chemically synthesized
gaaggctgatagcaataggatt

SEQ ID NO: 639645 - DNA, 22 bp, Artificial Sequence
  chemically synthesized
tactgattgaaatcctattgct

SEQ ID NO: 639646 - DNA, 22 bp, Artificial Sequence
  chemically synthesized
cccttgaaggctgatagcaata

SEQ ID NO: 639647 - DNA, 22 bp, Artificial Sequence
  chemically synthesized
attgaaatcctattgctatcag

SEQ ID NO: 639648 - DNA, 22 bp, Artificial Sequence
  chemically synthesized
aaatcctattgctatcagcctt

SEQ ID NO: 639649 - DNA, 22 bp, Artificial Sequence
  chemically synthesized
tacaaacaactacccttgaagg

SEQ ID NO: 639650 - DNA, 22 bp, Artificial Sequence
  chemically synthesized
ttgctatcagccttcaagggta

SEQ ID NO: 639651 - DNA, 22 bp, Artificial Sequence
  chemically synthesized
ctatcagccttcaagggtagtt

SEQ ID NO: 639652 - DNA, 22 bp, Artificial Sequence
  chemically synthesized
tcagccttcaagggtagttgtt

SEQ ID NO: 639653 - DNA, 22 bp, Artificial Sequence
  chemically synthesized
tgaaataaactatacaaacaac

SEQ ID NO: 639654 - DNA, 22 bp, Artificial Sequence
  chemically synthesized
ctatgaaataaactatacaaac

SEQ ID NO: 639655 - DNA, 22 bp, Artificial Sequence
  chemically synthesized
caagggtagttgtttgtatagt

SEQ ID NO: 639656 - DNA, 22 bp, Artificial Sequence
  chemically synthesized
aagggtagttgtttgtatagtt

SEQ ID NO: 639657 - DNA, 22 bp, Artificial Sequence
  chemically synthesized
tttgtatagtttatttcatagc

SEQ ID NO: 639658 - DNA, 22 bp, Artificial Sequence
  chemically synthesized
tcaaagcagattgctatgaaat

SEQ ID NO: 639659 - DNA, 22 bp, Artificial Sequence
  chemically synthesized
gtcaaagcagattgctatgaaa

SEQ ID NO: 639660 - DNA, 22 bp, Artificial Sequence
  chemically synthesized
tgtcaaagcagattgctatgaa

SEQ ID NO: 639661 - DNA, 22 bp, Artificial Sequence
  chemically synthesized
gtatagtttatttcatagcaat

SEQ ID NO: 639662 - DNA, 22 bp, Artificial Sequence
  chemically synthesized
tatagtttatttcatagcaatc

SEQ ID NO: 639663 - DNA, 22 bp, Artificial Sequence
  chemically synthesized
ctttgtcaaagcagattgctat

SEQ ID NO: 639664 - DNA, 22 bp, Artificial Sequence
  chemically synthesized
atttcatagcaatctgctttga

SEQ ID NO: 639665 - DNA, 22 bp, Artificial Sequence
  chemically synthesized
atcactgctttgtcaaagcaga

SEQ ID NO: 639666 - DNA, 22 bp, Artificial Sequence
  chemically synthesized
tttcatagcaatctgctttgac

SEQ ID NO: 639667 - DNA, 22 bp, Artificial Sequence
  chemically synthesized
tcatcactgctttgtcaaagca

SEQ ID NO: 639668 - DNA, 22 bp, Artificial Sequence
  chemically synthesized
ctcatcactgctttgtcaaagc

SEQ ID NO: 639669 - DNA, 22 bp, Artificial Sequence
  chemically synthesized
catagcaatctgctttgacaaa

SEQ ID NO: 639670 - DNA, 22 bp, Artificial Sequence
  chemically synthesized
atagcaatctgctttgacaaag

SEQ ID NO: 639671 - DNA, 22 bp, Artificial Sequence
  chemically synthesized
ttctcatcactgctttgtcaaa

SEQ ID NO: 639672 - DNA, 22 bp, Artificial Sequence
  chemically synthesized
gatgaatctcttctcatcactg

SEQ ID NO: 639673 - DNA, 22 bp, Artificial Sequence
  chemically synthesized
ctttgacaaagcagtgatgaga

SEQ ID NO: 639674 - DNA, 22 bp, Artificial Sequence
  chemically synthesized
cgatgaatctcttctcatcact

SEQ ID NO: 639675 - DNA, 22 bp, Artificial Sequence
  chemically synthesized
tgacaaagcagtgatgagaaga

SEQ ID NO: 639676 - DNA, 22 bp, Artificial Sequence
  chemically synthesized
cttcgatgaatctcttctcatc

SEQ ID NO: 639677 - DNA, 22 bp, Artificial Sequence
  chemically synthesized
gacaaagcagtgatgagaagag

SEQ ID NO: 639678 - DNA, 22 bp, Artificial Sequence
  chemically synthesized
acttcgatgaatctcttctcat

SEQ ID NO: 639679 - DNA, 22 bp, Artificial Sequence
  chemically synthesized
acaaagcagtgatgagaagaga

SEQ ID NO: 639680 - DNA, 22 bp, Artificial Sequence
  chemically synthesized
aaggtgtacttacttcgatgaa

SEQ ID NO: 639681 - DNA, 22 bp, Artificial Sequence
  chemically synthesized
actgaaggtgtacttacttcga

SEQ ID NO: 639682 - DNA, 22 bp, Artificial Sequence
  chemically synthesized
atcgaagtaagtacaccttcag

SEQ ID NO: 639683 - DNA, 22 bp, Artificial Sequence
  chemically synthesized
cagtcagattctgcacacgggt

SEQ ID NO: 639684 - DNA, 22 bp, Artificial Sequence
  chemically synthesized
agtcagattctgcacacgggtc

SEQ ID NO: 639685 - DNA, 22 bp, Artificial Sequence
  chemically synthesized
tgcacacgggtcttctgggtgt

SEQ ID NO: 639686 - DNA, 22 bp, Artificial Sequence
  chemically synthesized
catacatcggtgcacacccaga

SEQ ID NO: 639687 - DNA, 22 bp, Artificial Sequence
  chemically synthesized
cacacgggtcttctgggtgtgc

SEQ ID NO: 639688 - DNA, 22 bp, Artificial Sequence
  chemically synthesized
ctgggtgtgcaccgatgtatgt

SEQ ID NO: 639689 - DNA, 22 bp, Artificial Sequence
  chemically synthesized
atgtggacagttacatacatcg

SEQ ID NO: 639690 - DNA, 22 bp, Artificial Sequence
  chemically synthesized
tgggtgtgcaccgatgtatgta

SEQ ID NO: 639691 - DNA, 22 bp, Artificial Sequence
  chemically synthesized
ggtgtgcaccgatgtatgtaac

SEQ ID NO: 639692 - DNA, 22 bp, Artificial Sequence
  chemically synthesized
attaatgtggacagttacatac

SEQ ID NO: 639693 - DNA, 22 bp, Artificial Sequence
  chemically synthesized
aattaatgtggacagttacata

SEQ ID NO: 639694 - DNA, 22 bp, Artificial Sequence
  chemically synthesized
gatttaattaatgtggacagtt

SEQ ID NO: 639695 - DNA, 22 bp, Artificial Sequence
  chemically synthesized
agaaattagatttaattaatgt

SEQ ID NO: 639696 - DNA, 22 bp, Artificial Sequence
  chemically synthesized
tcagaaattagatttaattaat

SEQ ID NO: 639697 - DNA, 22 bp, Artificial Sequence
  chemically synthesized
agttctcagaaattagatttaa

SEQ ID NO: 639698 - DNA, 22 bp, Artificial Sequence
  chemically synthesized
tccacattaattaaatctaatt

SEQ ID NO: 639699 - DNA, 22 bp, Artificial Sequence
  chemically synthesized
ccagttaagttctcagaaatta

SEQ ID NO: 639700 - DNA, 22 bp, Artificial Sequence
  chemically synthesized
attaaatctaatttctgagaac

SEQ ID NO: 639701 - DNA, 22 bp, Artificial Sequence
  chemically synthesized
attgccagttaagttctcagaa

SEQ ID NO: 639702 - DNA, 22 bp, Artificial Sequence
  chemically synthesized
aatctaatttctgagaacttaa

SEQ ID NO: 639703 - DNA, 22 bp, Artificial Sequence
  chemically synthesized
aactgattgccagttaagttct

SEQ ID NO: 639704 - DNA, 22 bp, Artificial Sequence
  chemically synthesized
atttctgagaacttaactggca

SEQ ID NO: 639705 - DNA, 22 bp, Artificial Sequence
  chemically synthesized
ctgagaacttaactggcaatca

SEQ ID NO: 639706 - DNA, 22 bp, Artificial Sequence
  chemically synthesized
tgagaacttaactggcaatcag

SEQ ID NO: 639707 - DNA, 22 bp, Artificial Sequence
  chemically synthesized
agaacttaactggcaatcagtt

SEQ ID NO: 639708 - DNA, 22 bp, Artificial Sequence
  chemically synthesized
acagaaacattgaactgattgc

SEQ ID NO: 639709 - DNA, 22 bp, Artificial Sequence
  chemically synthesized
aagttcacagaaacattgaact

SEQ ID NO: 639710 - DNA, 22 bp, Artificial Sequence
  chemically synthesized
aactggcaatcagttcaatgtt

SEQ ID NO: 639711 - DNA, 22 bp, Artificial Sequence
  chemically synthesized
caagttcacagaaacattgaac

SEQ ID NO: 639712 - DNA, 22 bp, Artificial Sequence
  chemically synthesized
actggcaatcagttcaatgttt

SEQ ID NO: 639713 - DNA, 22 bp, Artificial Sequence
  chemically synthesized
cttcaagttcacagaaacattg

SEQ ID NO: 639714 - DNA, 22 bp, Artificial Sequence
  chemically synthesized
gcaatcagttcaatgtttctgt

SEQ ID NO: 639715 - DNA, 22 bp, Artificial Sequence
  chemically synthesized
gatactgcttcaagttcacaga

SEQ ID NO: 639716 - DNA, 22 bp, Artificial Sequence
  chemically synthesized
aatgtttctgtgaacttgaagc

SEQ ID NO: 639717 - DNA, 22 bp, Artificial Sequence
  chemically synthesized
tgaacattggatactgcttcaa

SEQ ID NO: 639718 - DNA, 22 bp, Artificial Sequence
  chemically synthesized
gtgaacattggatactgcttca

SEQ ID NO: 639719 - DNA, 22 bp, Artificial Sequence
  chemically synthesized
ctgtgaacttgaagcagtatcc

SEQ ID NO: 639720 - DNA, 22 bp, Artificial Sequence
  chemically synthesized
tgtgaacttgaagcagtatcca

SEQ ID NO: 639721 - DNA, 22 bp, Artificial Sequence
  chemically synthesized
tgaacttgaagcagtatccaat

SEQ ID NO: 639722 - DNA, 22 bp, Artificial Sequence
  chemically synthesized
gaagcagtatccaatgttcaca

SEQ ID NO: 639723 - DNA, 22 bp, Artificial Sequence
  chemically synthesized
aagcagtatccaatgttcacaa

SEQ ID NO: 639724 - DNA, 22 bp, Artificial Sequence
  chemically synthesized
tggaatgagaccttgtgaacat

SEQ ID NO: 639725 - DNA, 22 bp, Artificial Sequence
  chemically synthesized
ctatggaatgagaccttgtgaa

SEQ ID NO: 639726 - DNA, 22 bp, Artificial Sequence
  chemically synthesized
acaaggtctcattccataggaa

SEQ ID NO: 639727 - DNA, 22 bp, Artificial Sequence
  chemically synthesized
attccataggaattactttcta

SEQ ID NO: 639728 - DNA, 22 bp, Artificial Sequence
  chemically synthesized
atgaagagggaaaaatagaaag

SEQ ID NO: 639729 - DNA, 22 bp, Artificial Sequence
  chemically synthesized
cataggaattactttctatttt

SEQ ID NO: 639730 - DNA, 22 bp, Artificial Sequence
  chemically synthesized
aatgaagagggaaaaatagaaa

SEQ ID NO: 639731 - DNA, 22 bp, Artificial Sequence
  chemically synthesized
taatgaagagggaaaaatagaa

SEQ ID NO: 639732 - DNA, 22 bp, Artificial Sequence
  chemically synthesized
ttaatgaagagggaaaaataga

SEQ ID NO: 639733 - DNA, 22 bp, Artificial Sequence
  chemically synthesized
ttttaatgaagagggaaaaata

SEQ ID NO: 639734 - DNA, 22 bp, Artificial Sequence
  chemically synthesized
cttttaatgaagagggaaaaat

SEQ ID NO: 639735 - DNA, 22 bp, Artificial Sequence
  chemically synthesized
tcttttaatgaagagggaaaaa

SEQ ID NO: 639736 - DNA, 22 bp, Artificial Sequence
  chemically synthesized
ctttctatttttccctcttcat

SEQ ID NO: 639737 - DNA, 22 bp, Artificial Sequence
  chemically synthesized
aagttttcttttaatgaagagg

SEQ ID NO: 639738 - DNA, 22 bp, Artificial Sequence
  chemically synthesized
tctatttttccctcttcattaa

SEQ ID NO: 639739 - DNA, 22 bp, Artificial Sequence
  chemically synthesized
ctatttttccctcttcattaaa

SEQ ID NO: 639740 - DNA, 22 bp, Artificial Sequence
  chemically synthesized
ttgaagttttcttttaatgaag

SEQ ID NO: 639741 - DNA, 22 bp, Artificial Sequence
  chemically synthesized
tatttttccctcttcattaaaa

SEQ ID NO: 639742 - DNA, 22 bp, Artificial Sequence
  chemically synthesized
gttgaagttttcttttaatgaa

SEQ ID NO: 639743 - DNA, 22 bp, Artificial Sequence
  chemically synthesized
tgttgaagttttcttttaatga

SEQ ID NO: 639744 - DNA, 22 bp, Artificial Sequence
  chemically synthesized
tttttccctcttcattaaaaga

SEQ ID NO: 639745 - DNA, 22 bp, Artificial Sequence
  chemically synthesized
ttccctcttcattaaaagaaaa

SEQ ID NO: 639746 - DNA, 22 bp, Artificial Sequence
  chemically synthesized
tccctcttcattaaaagaaaac

SEQ ID NO: 639747 - DNA, 22 bp, Artificial Sequence
  chemically synthesized
ccctcttcattaaaagaaaact

SEQ ID NO: 639748 - DNA, 22 bp, Artificial Sequence
  chemically synthesized
cctcttcattaaaagaaaactt

SEQ ID NO: 639749 - DNA, 22 bp, Artificial Sequence
  chemically synthesized
gaacattttgttgaagttttct

SEQ ID NO: 639750 - DNA, 22 bp, Artificial Sequence
  chemically synthesized
ttcattaaaagaaaacttcaac

SEQ ID NO: 639751 - DNA, 22 bp, Artificial Sequence
  chemically synthesized
cattaaaagaaaacttcaacaa

SEQ ID NO: 639752 - DNA, 22 bp, Artificial Sequence
  chemically synthesized
attaaaagaaaacttcaacaaa

SEQ ID NO: 639753 - DNA, 22 bp, Artificial Sequence
  chemically synthesized
ccagttagaacattttgttgaa

SEQ ID NO: 639754 - DNA, 22 bp, Artificial Sequence
  chemically synthesized
aaagaaaacttcaacaaaatgt

SEQ ID NO: 639755 - DNA, 22 bp, Artificial Sequence
  chemically synthesized
caacaaaatgttctaactggca

SEQ ID NO: 639756 - DNA, 22 bp, Artificial Sequence
  chemically synthesized
cataaaaagtgttgccagttag

SEQ ID NO: 639757 - DNA, 22 bp, Artificial Sequence
  chemically synthesized
aacaaaatgttctaactggcaa

SEQ ID NO: 639758 - DNA, 22 bp, Artificial Sequence
  chemically synthesized
tacataaaaagtgttgccagtt

SEQ ID NO: 639759 - DNA, 22 bp, Artificial Sequence
  chemically synthesized
aataggattctacataaaaagt

SEQ ID NO: 639760 - DNA, 22 bp, Artificial Sequence
  chemically synthesized
taactggcaacactttttatgt

SEQ ID NO: 639761 - DNA, 22 bp, Artificial Sequence
  chemically synthesized
gaataggattctacataaaaag

SEQ ID NO: 639762 - DNA, 22 bp, Artificial Sequence
  chemically synthesized
actggcaacactttttatgtag

SEQ ID NO: 639763 - DNA, 22 bp, Artificial Sequence
  chemically synthesized
gcaacactttttatgtagaatc

SEQ ID NO: 639764 - DNA, 22 bp, Artificial Sequence
  chemically synthesized
tttatgtagaatcctattcaaa

SEQ ID NO: 639765 - DNA, 22 bp, Artificial Sequence
  chemically synthesized
ttatgtagaatcctattcaaat

SEQ ID NO: 639766 - DNA, 22 bp, Artificial Sequence
  chemically synthesized
gtagaaagaaaaatttgaatag

SEQ ID NO: 639767 - DNA, 22 bp, Artificial Sequence
  chemically synthesized
tatgtagaatcctattcaaatt

SEQ ID NO: 639768 - DNA, 22 bp, Artificial Sequence
  chemically synthesized
atgtagaatcctattcaaattt

SEQ ID NO: 639769 - DNA, 22 bp, Artificial Sequence
  chemically synthesized
tgtagaatcctattcaaatttt

SEQ ID NO: 639770 - DNA, 22 bp, Artificial Sequence
  chemically synthesized
ccccaatctggtagaaagaaaa

SEQ ID NO: 639771 - DNA, 22 bp, Artificial Sequence
  chemically synthesized
ttcaaatttttctttctaccag

SEQ ID NO: 639772 - DNA, 22 bp, Artificial Sequence
  chemically synthesized
aaatttttctttctaccagatt

SEQ ID NO: 639773 - DNA, 22 bp, Artificial Sequence
  chemically synthesized
ttctttctaccagattggggca

SEQ ID NO: 639774 - DNA, 22 bp, Artificial Sequence
  chemically synthesized
tctttctaccagattggggcag

SEQ ID NO: 639775 - DNA, 22 bp, Artificial Sequence
  chemically synthesized
ctttctaccagattggggcagc

SEQ ID NO: 639776 - DNA, 22 bp, Artificial Sequence
  chemically synthesized
tttctaccagattggggcagcc

SEQ ID NO: 639777 - DNA, 22 bp, Artificial Sequence
  chemically synthesized
tctaccagattggggcagccat

SEQ ID NO: 639778 - DNA, 22 bp, Artificial Sequence
  chemically synthesized
aaaaggaacaccatggctgccc

SEQ ID NO: 639779 - DNA, 22 bp, Artificial Sequence
  chemically synthesized
ctaccagattggggcagccatg

SEQ ID NO: 639780 - DNA, 22 bp, Artificial Sequence
  chemically synthesized
caaaaggaacaccatggctgcc

SEQ ID NO: 639781 - DNA, 22 bp, Artificial Sequence
  chemically synthesized
taccagattggggcagccatgg

SEQ ID NO: 639782 - DNA, 22 bp, Artificial Sequence
  chemically synthesized
tcaaaaggaacaccatggctgc

SEQ ID NO: 639783 - DNA, 22 bp, Artificial Sequence
  chemically synthesized
ccagattggggcagccatggtg

SEQ ID NO: 639784 - DNA, 22 bp, Artificial Sequence
  chemically synthesized
ttttcaaaaggaacaccatggc

SEQ ID NO: 639785 - DNA, 22 bp, Artificial Sequence
  chemically synthesized
gggcagccatggtgttcctttt

SEQ ID NO: 639786 - DNA, 22 bp, Artificial Sequence
  chemically synthesized
aaaactgttttcaaaaggaaca

SEQ ID NO: 639787 - DNA, 22 bp, Artificial Sequence
  chemically synthesized
aggtccatgtctaaaaactgtt

SEQ ID NO: 639788 - DNA, 22 bp, Artificial Sequence
  chemically synthesized
gaggtccatgtctaaaaactgt

SEQ ID NO: 639789 - DNA, 22 bp, Artificial Sequence
  chemically synthesized
cttttgaaaacagtttttagac

SEQ ID NO: 639790 - DNA, 22 bp, Artificial Sequence
  chemically synthesized
ttgaaaacagtttttagacatg

SEQ ID NO: 639791 - DNA, 22 bp, Artificial Sequence
  chemically synthesized
tgaaaacagtttttagacatgg

SEQ ID NO: 639792 - DNA, 22 bp, Artificial Sequence
  chemically synthesized
gaaaacagtttttagacatgga

SEQ ID NO: 639793 - DNA, 22 bp, Artificial Sequence
  chemically synthesized
aaaacagtttttagacatggac

SEQ ID NO: 639794 - DNA, 22 bp, Artificial Sequence
  chemically synthesized
taccatcttgaggtccatgtct

SEQ ID NO: 639795 - DNA, 22 bp, Artificial Sequence
  chemically synthesized
ttgtaccatcttgaggtccatg

SEQ ID NO: 639796 - DNA, 22 bp, Artificial Sequence
  chemically synthesized
gttgtaccatcttgaggtccat

SEQ ID NO: 639797 - DNA, 22 bp, Artificial Sequence
  chemically synthesized
ttagacatggacctcaagatgg

SEQ ID NO: 639798 - DNA, 22 bp, Artificial Sequence
  chemically synthesized
tagacatggacctcaagatggt

SEQ ID NO: 639799 - DNA, 22 bp, Artificial Sequence
  chemically synthesized
agacatggacctcaagatggta

SEQ ID NO: 639800 - DNA, 22 bp, Artificial Sequence
  chemically synthesized
gacatggacctcaagatggtac

SEQ ID NO: 639801 - DNA, 22 bp, Artificial Sequence
  chemically synthesized
aagatggtacaacaagccatta

SEQ ID NO: 639802 - DNA, 22 bp, Artificial Sequence
  chemically synthesized
tgaaaaataggtgggaagacag

SEQ ID NO: 639803 - DNA, 22 bp, Artificial Sequence
  chemically synthesized
gtgaaaaataggtgggaagaca

SEQ ID NO: 639804 - DNA, 22 bp, Artificial Sequence
  chemically synthesized
tgtgaaaaataggtgggaagac

SEQ ID NO: 639805 - DNA, 22 bp, Artificial Sequence
  chemically synthesized
ctgtcttcccacctatttttca

SEQ ID NO: 639806 - DNA, 22 bp, Artificial Sequence
  chemically synthesized
tcagcacctttgtgaaaaatag

SEQ ID NO: 639807 - DNA, 22 bp, Artificial Sequence
  chemically synthesized
tcttcccacctatttttcacaa

SEQ ID NO: 639808 - DNA, 22 bp, Artificial Sequence
  chemically synthesized
ctgtcagcacctttgtgaaaaa

SEQ ID NO: 639809 - DNA, 22 bp, Artificial Sequence
  chemically synthesized
cccacctatttttcacaaaggt

SEQ ID NO: 639810 - DNA, 22 bp, Artificial Sequence
  chemically synthesized
ccacctatttttcacaaaggtg

SEQ ID NO: 639811 - DNA, 22 bp, Artificial Sequence
  chemically synthesized
tttttcacaaaggtgctgacag

SEQ ID NO: 639812 - DNA, 22 bp, Artificial Sequence
  chemically synthesized
gaaaaggcagtctcctgtcagc

SEQ ID NO: 639813 - DNA, 22 bp, Artificial Sequence
  chemically synthesized
ttcacaaaggtgctgacaggag

SEQ ID NO: 639814 - DNA, 22 bp, Artificial Sequence
  chemically synthesized
tcacaaaggtgctgacaggaga

SEQ ID NO: 639815 - DNA, 22 bp, Artificial Sequence
  chemically synthesized
tagaaaaggcagtctcctgtca

SEQ ID NO: 639816 - DNA, 22 bp, Artificial Sequence
  chemically synthesized
cacaaaggtgctgacaggagac

SEQ ID NO: 639817 - DNA, 22 bp, Artificial Sequence
  chemically synthesized
acaaaggtgctgacaggagact

SEQ ID NO: 639818 - DNA, 22 bp, Artificial Sequence
  chemically synthesized
tctagaaaaggcagtctcctgt

SEQ ID NO: 639819 - DNA, 22 bp, Artificial Sequence
  chemically synthesized
acaggagactgccttttctaga

SEQ ID NO: 639820 - DNA, 22 bp, Artificial Sequence
  chemically synthesized
ccttttctagagagatcttcct

SEQ ID NO: 639821 - DNA, 22 bp, Artificial Sequence
  chemically synthesized
ttctagagagatcttccttggt

SEQ ID NO: 639822 - DNA, 22 bp, Artificial Sequence
  chemically synthesized
tctagagagatcttccttggta

SEQ ID NO: 639823 - DNA, 22 bp, Artificial Sequence
  chemically synthesized
ctagagagatcttccttggtat

SEQ ID NO: 639824 - DNA, 22 bp, Artificial Sequence
  chemically synthesized
tagagagatcttccttggtatc

SEQ ID NO: 639825 - DNA, 22 bp, Artificial Sequence
  chemically synthesized
gagagatcttccttggtatctt

SEQ ID NO: 639826 - DNA, 22 bp, Artificial Sequence
  chemically synthesized
aacccacaggatcaagatacca

SEQ ID NO: 639827 - DNA, 22 bp, Artificial Sequence
  chemically synthesized
ccttggtatcttgatcctgtgg

SEQ ID NO: 639828 - DNA, 22 bp, Artificial Sequence
  chemically synthesized
cttggtatcttgatcctgtggg

SEQ ID NO: 639829 - DNA, 22 bp, Artificial Sequence
  chemically synthesized
tggacaactaaacccacaggat

SEQ ID NO: 639830 - DNA, 22 bp, Artificial Sequence
  chemically synthesized
ggtatcttgatcctgtgggttt

SEQ ID NO: 639831 - DNA, 22 bp, Artificial Sequence
  chemically synthesized
gtatcttgatcctgtgggttta

SEQ ID NO: 639832 - DNA, 22 bp, Artificial Sequence
  chemically synthesized
gatcctgtgggtttagttgtcc

SEQ ID NO: 639833 - DNA, 22 bp, Artificial Sequence
  chemically synthesized
atcctgtgggtttagttgtcca

SEQ ID NO: 639834 - DNA, 22 bp, Artificial Sequence
  chemically synthesized
tgggtttagttgtccacagggc

SEQ ID NO: 639835 - DNA, 22 bp, Artificial Sequence
  chemically synthesized
agttgtccacagggctcttctt

SEQ ID NO: 639836 - DNA, 22 bp, Artificial Sequence
  chemically synthesized
gttgtccacagggctcttcttt

SEQ ID NO: 639837 - DNA, 22 bp, Artificial Sequence
  chemically synthesized
taaataaatcataaaagaagag

SEQ ID NO: 639838 - DNA, 22 bp, Artificial Sequence
  chemically synthesized
ataaataaatcataaaagaaga

SEQ ID NO: 639839 - DNA, 22 bp, Artificial Sequence
  chemically synthesized
tccacagggctcttcttttatg

SEQ ID NO: 639840 - DNA, 22 bp, Artificial Sequence
  chemically synthesized
aacaagggtccttataaataaa

SEQ ID NO: 639841 - DNA, 22 bp, Artificial Sequence
  chemically synthesized
ttcttttatgatttatttataa

SEQ ID NO: 639842 - DNA, 22 bp, Artificial Sequence
  chemically synthesized
gaacaagggtccttataaataa

SEQ ID NO: 639843 - DNA, 22 bp, Artificial Sequence
  chemically synthesized
cttttatgatttatttataagg

SEQ ID NO: 639844 - DNA, 22 bp, Artificial Sequence
  chemically synthesized
ttgaacaagggtccttataaat

SEQ ID NO: 639845 - DNA, 22 bp, Artificial Sequence
  chemically synthesized
ttttatgatttatttataagga

SEQ ID NO: 639846 - DNA, 22 bp, Artificial Sequence
  chemically synthesized
ttatgatttatttataaggacc

SEQ ID NO: 639847 - DNA, 22 bp, Artificial Sequence
  chemically synthesized
tatgatttatttataaggaccc

SEQ ID NO: 639848 - DNA, 22 bp, Artificial Sequence
  chemically synthesized
atgatttatttataaggaccct

SEQ ID NO: 639849 - DNA, 22 bp, Artificial Sequence
  chemically synthesized
tgatttatttataaggaccctt

SEQ ID NO: 639850 - DNA, 22 bp, Artificial Sequence
  chemically synthesized
atttataaggacccttgttcaa

SEQ ID NO: 639851 - DNA, 22 bp, Artificial Sequence
  chemically synthesized
tttataaggacccttgttcaag

SEQ ID NO: 639852 - DNA, 22 bp, Artificial Sequence
  chemically synthesized
ataaggacccttgttcaagagg

SEQ ID NO: 639853 - DNA, 22 bp, Artificial Sequence
  chemically synthesized
taaggacccttgttcaagaggc

SEQ ID NO: 639854 - DNA, 22 bp, Artificial Sequence
  chemically synthesized
tatataccaaaccatgcctctt

SEQ ID NO: 639855 - DNA, 22 bp, Artificial Sequence
  chemically synthesized
gttcaagaggcatggtttggta

SEQ ID NO: 639856 - DNA, 22 bp, Artificial Sequence
  chemically synthesized
ttcaagaggcatggtttggtat

SEQ ID NO: 639857 - DNA, 22 bp, Artificial Sequence
  chemically synthesized
aagaggcatggtttggtatata

SEQ ID NO: 639858 - DNA, 22 bp, Artificial Sequence
  chemically synthesized
ggtatatacaacacattacatt

SEQ ID NO: 639859 - DNA, 22 bp, Artificial Sequence
  chemically synthesized
gtatatacaacacattacattt

SEQ ID NO: 639860 - DNA, 22 bp, Artificial Sequence
  chemically synthesized
gaaaccaccaaaacagaaatgt

SEQ ID NO: 639861 - DNA, 22 bp, Artificial Sequence
  chemically synthesized
actggaaaccaccaaaacagaa

SEQ ID NO: 639862 - DNA, 22 bp, Artificial Sequence
  chemically synthesized
cactggaaaccaccaaaacaga

SEQ ID NO: 639863 - DNA, 22 bp, Artificial Sequence
  chemically synthesized
tcactggaaaccaccaaaacag

SEQ ID NO: 639864 - DNA, 22 bp, Artificial Sequence
  chemically synthesized
ttttcactggaaaccaccaaaa

SEQ ID NO: 639865 - DNA, 22 bp, Artificial Sequence
  chemically synthesized
tgttttcactggaaaccaccaa

SEQ ID NO: 639866 - DNA, 22 bp, Artificial Sequence
  chemically synthesized
ctgttttcactggaaaccacca

SEQ ID NO: 639867 - DNA, 22 bp, Artificial Sequence
  chemically synthesized
catttctgttttggtggtttcc

SEQ ID NO: 639868 - DNA, 22 bp, Artificial Sequence
  chemically synthesized
tctgttttcactggaaaccacc

SEQ ID NO: 639869 - DNA, 22 bp, Artificial Sequence
  chemically synthesized
ttctgttttcactggaaaccac

SEQ ID NO: 639870 - DNA, 22 bp, Artificial Sequence
  chemically synthesized
ctgttttggtggtttccagtga

SEQ ID NO: 639871 - DNA, 22 bp, Artificial Sequence
  chemically synthesized
tgttttggtggtttccagtgaa

SEQ ID NO: 639872 - DNA, 22 bp, Artificial Sequence
  chemically synthesized
ttttggtggtttccagtgaaaa

SEQ ID NO: 639873 - DNA, 22 bp, Artificial Sequence
  chemically synthesized
tggtggtttccagtgaaaacag

SEQ ID NO: 639874 - DNA, 22 bp, Artificial Sequence
  chemically synthesized
ggtggtttccagtgaaaacaga

SEQ ID NO: 639875 - DNA, 22 bp, Artificial Sequence
  chemically synthesized
aaatgagccttttctgttttca

SEQ ID NO: 639876 - DNA, 22 bp, Artificial Sequence
  chemically synthesized
gtggtttccagtgaaaacagaa

SEQ ID NO: 639877 - DNA, 22 bp, Artificial Sequence
  chemically synthesized
attaaaatgagccttttctgtt

SEQ ID NO: 639878 - DNA, 22 bp, Artificial Sequence
  chemically synthesized
ccagtgaaaacagaaaaggctc

SEQ ID NO: 639879 - DNA, 22 bp, Artificial Sequence
  chemically synthesized
gctgattaaaatgagccttttc

SEQ ID NO: 639880 - DNA, 22 bp, Artificial Sequence
  chemically synthesized
cagtgaaaacagaaaaggctca

SEQ ID NO: 639881 - DNA, 22 bp, Artificial Sequence
  chemically synthesized
ggctgattaaaatgagcctttt

SEQ ID NO: 639882 - DNA, 22 bp, Artificial Sequence
  chemically synthesized
tggctgattaaaatgagccttt

SEQ ID NO: 639883 - DNA, 22 bp, Artificial Sequence
  chemically synthesized
agctttggctgattaaaatgag

SEQ ID NO: 639884 - DNA, 22 bp, Artificial Sequence
  chemically synthesized
cagctcagctttggctgattaa

SEQ ID NO: 639885 - DNA, 22 bp, Artificial Sequence
  chemically synthesized
acagctcagctttggctgatta

SEQ ID NO: 639886 - DNA, 22 bp, Artificial Sequence
  chemically synthesized
tacagctcagctttggctgatt

SEQ ID NO: 639887 - DNA, 22 bp, Artificial Sequence
  chemically synthesized
tttacagctcagctttggctga

SEQ ID NO: 639888 - DNA, 22 bp, Artificial Sequence
  chemically synthesized
attttaatcagccaaagctgag

SEQ ID NO: 639889 - DNA, 22 bp, Artificial Sequence
  chemically synthesized
atattctttacagctcagcttt

SEQ ID NO: 639890 - DNA, 22 bp, Artificial Sequence
  chemically synthesized
taatcagccaaagctgagctgt

SEQ ID NO: 639891 - DNA, 22 bp, Artificial Sequence
  chemically synthesized
aatcagccaaagctgagctgta

SEQ ID NO: 639892 - DNA, 22 bp, Artificial Sequence
  chemically synthesized
atcagccaaagctgagctgtaa

SEQ ID NO: 639893 - DNA, 22 bp, Artificial Sequence
  chemically synthesized
agcaattgatattctttacagc

SEQ ID NO: 639894 - DNA, 22 bp, Artificial Sequence
  chemically synthesized
cattgagcaattgatattcttt

SEQ ID NO: 639895 - DNA, 22 bp, Artificial Sequence
  chemically synthesized
agctgtaaagaatatcaattgc

SEQ ID NO: 639896 - DNA, 22 bp, Artificial Sequence
  chemically synthesized
taaagaatatcaattgctcaat

SEQ ID NO: 639897 - DNA, 22 bp, Artificial Sequence
  chemically synthesized
ggaaggaaagaaaggcctgcat

SEQ ID NO: 639898 - DNA, 22 bp, Artificial Sequence
  chemically synthesized
ctcaatgcaggcctttctttcc

SEQ ID NO: 639899 - DNA, 22 bp, Artificial Sequence
  chemically synthesized
aaacatctgggaaggaaagaaa

SEQ ID NO: 639900 - DNA, 22 bp, Artificial Sequence
  chemically synthesized
caaacatctgggaaggaaagaa

SEQ ID NO: 639901 - DNA, 22 bp, Artificial Sequence
  chemically synthesized
aatgcaggcctttctttccttc

SEQ ID NO: 639902 - DNA, 22 bp, Artificial Sequence
  chemically synthesized
tctttccttcccagatgtttga

SEQ ID NO: 639903 - DNA, 22 bp, Artificial Sequence
  chemically synthesized
ccaagagaaatttcaaacatct

SEQ ID NO: 639904 - DNA, 22 bp, Artificial Sequence
  chemically synthesized
ctttccttcccagatgtttgaa

SEQ ID NO: 639905 - DNA, 22 bp, Artificial Sequence
  chemically synthesized
tttccttcccagatgtttgaaa

SEQ ID NO: 639906 - DNA, 22 bp, Artificial Sequence
  chemically synthesized
tccttcccagatgtttgaaatt

SEQ ID NO: 639907 - DNA, 22 bp, Artificial Sequence
  chemically synthesized
ccttcccagatgtttgaaattt

SEQ ID NO: 639908 - DNA, 22 bp, Artificial Sequence
  chemically synthesized
cttcccagatgtttgaaatttc

SEQ ID NO: 639909 - DNA, 22 bp, Artificial Sequence
  chemically synthesized
cccagatgtttgaaatttctct

SEQ ID NO: 639910 - DNA, 22 bp, Artificial Sequence
  chemically synthesized
ccagatgtttgaaatttctctt

SEQ ID NO: 639911 - DNA, 22 bp, Artificial Sequence
  chemically synthesized
aaggaaatgtgctcccaagaga

SEQ ID NO: 639912 - DNA, 22 bp, Artificial Sequence
  chemically synthesized
gaaggaaatgtgctcccaagag

SEQ ID NO: 639913 - DNA, 22 bp, Artificial Sequence
  chemically synthesized
gaaatttctcttgggagcacat

SEQ ID NO: 639914 - DNA, 22 bp, Artificial Sequence
  chemically synthesized
aaatttctcttgggagcacatt

SEQ ID NO: 639915 - DNA, 22 bp, Artificial Sequence
  chemically synthesized
ctcttgggagcacatttccttc

SEQ ID NO: 639916 - DNA, 22 bp, Artificial Sequence
  chemically synthesized
tcttgggagcacatttccttca

SEQ ID NO: 639917 - DNA, 22 bp, Artificial Sequence
  chemically synthesized
ttgggagcacatttccttcaag

SEQ ID NO: 639918 - DNA, 22 bp, Artificial Sequence
  chemically synthesized
gggagcacatttccttcaagac

SEQ ID NO: 639919 - DNA, 22 bp, Artificial Sequence
  chemically synthesized
ggagcacatttccttcaagact

SEQ ID NO: 639920 - DNA, 22 bp, Artificial Sequence
  chemically synthesized
aagaaggatgtgagtcttgaag

SEQ ID NO: 639921 - DNA, 22 bp, Artificial Sequence
  chemically synthesized
cagaattgaagaaggatgtgag

SEQ ID NO: 639922 - DNA, 22 bp, Artificial Sequence
  chemically synthesized
ccagaattgaagaaggatgtga

SEQ ID NO: 639923 - DNA, 22 bp, Artificial Sequence
  chemically synthesized
ccttcaagactcacatccttct

SEQ ID NO: 639924 - DNA, 22 bp, Artificial Sequence
  chemically synthesized
cttcaagactcacatccttctt

SEQ ID NO: 639925 - DNA, 22 bp, Artificial Sequence
  chemically synthesized
caagactcacatccttcttcaa

SEQ ID NO: 639926 - DNA, 22 bp, Artificial Sequence
  chemically synthesized
aagactcacatccttcttcaat

SEQ ID NO: 639927 - DNA, 22 bp, Artificial Sequence
  chemically synthesized
agaatcttccagaattgaagaa

SEQ ID NO: 639928 - DNA, 22 bp, Artificial Sequence
  chemically synthesized
acatccttcttcaattctggaa

SEQ ID NO: 639929 - DNA, 22 bp, Artificial Sequence
  chemically synthesized
tcatagctgagaatcttccaga

SEQ ID NO: 639930 - DNA, 22 bp, Artificial Sequence
  chemically synthesized
cttcaattctggaagattctca

SEQ ID NO: 639931 - DNA, 22 bp, Artificial Sequence
  chemically synthesized
ttcaattctggaagattctcag

SEQ ID NO: 639932 - DNA, 22 bp, Artificial Sequence
  chemically synthesized
aagctgtcatagctgagaatct

SEQ ID NO: 639933 - DNA, 22 bp, Artificial Sequence
  chemically synthesized
gaagctgtcatagctgagaatc

SEQ ID NO: 639934 - DNA, 22 bp, Artificial Sequence
  chemically synthesized
caattctggaagattctcagct

SEQ ID NO: 639935 - DNA, 22 bp, Artificial Sequence
  chemically synthesized
aattctggaagattctcagcta

SEQ ID NO: 639936 - DNA, 22 bp, Artificial Sequence
  chemically synthesized
tggaagattctcagctatgaca

SEQ ID NO: 639937 - DNA, 22 bp, Artificial Sequence
  chemically synthesized
gaagattctcagctatgacagc

SEQ ID NO: 639938 - DNA, 22 bp, Artificial Sequence
  chemically synthesized
tcagctatgacagcttcaaata

SEQ ID NO: 639939 - DNA, 22 bp, Artificial Sequence
  chemically synthesized
agctatgacagcttcaaatatt

SEQ ID NO: 639940 - DNA, 22 bp, Artificial Sequence
  chemically synthesized
tgacagcttcaaatattacttc

SEQ ID NO: 639941 - DNA, 22 bp, Artificial Sequence
  chemically synthesized
caaatattacttctctaccatt

SEQ ID NO: 639942 - DNA, 22 bp, Artificial Sequence
  chemically synthesized
aaatattacttctctaccattt

SEQ ID NO: 639943 - DNA, 22 bp, Artificial Sequence
  chemically synthesized
agaagaaaatggaggaaatggt

SEQ ID NO: 639944 - DNA, 22 bp, Artificial Sequence
  chemically synthesized
cagaagaaaatggaggaaatgg

SEQ ID NO: 639945 - DNA, 22 bp, Artificial Sequence
  chemically synthesized
cttctctaccatttcctccatt

SEQ ID NO: 639946 - DNA, 22 bp, Artificial Sequence
  chemically synthesized
ctctaccatttcctccattttc

SEQ ID NO: 639947 - DNA, 22 bp, Artificial Sequence
  chemically synthesized
tctaccatttcctccattttct

SEQ ID NO: 639948 - DNA, 22 bp, Artificial Sequence
  chemically synthesized
agaggtttcagaagaaaatgga

SEQ ID NO: 639949 - DNA, 22 bp, Artificial Sequence
  chemically synthesized
gagaggtttcagaagaaaatgg

SEQ ID NO: 639950 - DNA, 22 bp, Artificial Sequence
  chemically synthesized
taccatttcctccattttcttc

SEQ ID NO: 639951 - DNA, 22 bp, Artificial Sequence
  chemically synthesized
ccatttcctccattttcttctg

SEQ ID NO: 639952 - DNA, 22 bp, Artificial Sequence
  chemically synthesized
cctccattttcttctgaaacct

SEQ ID NO: 639953 - DNA, 22 bp, Artificial Sequence
  chemically synthesized
ctccattttcttctgaaacctc

SEQ ID NO: 639954 - DNA, 22 bp, Artificial Sequence
  chemically synthesized
ggagtgtatttgagaggtttca

SEQ ID NO: 639955 - DNA, 22 bp, Artificial Sequence
  chemically synthesized
aggagtgtatttgagaggtttc

SEQ ID NO: 639956 - DNA, 22 bp, Artificial Sequence
  chemically synthesized
cattttcttctgaaacctctca

SEQ ID NO: 639957 - DNA, 22 bp, Artificial Sequence
  chemically synthesized
tttaggagtgtatttgagaggt

SEQ ID NO: 639958 - DNA, 22 bp, Artificial Sequence
  chemically synthesized
gtttaggagtgtatttgagagg

SEQ ID NO: 639959 - DNA, 22 bp, Artificial Sequence
  chemically synthesized
tcttctgaaacctctcaaatac

SEQ ID NO: 639960 - DNA, 22 bp, Artificial Sequence
  chemically synthesized
cttctgaaacctctcaaataca

SEQ ID NO: 639961 - DNA, 22 bp, Artificial Sequence
  chemically synthesized
ttctgaaacctctcaaatacac

SEQ ID NO: 639962 - DNA, 22 bp, Artificial Sequence
  chemically synthesized
ctgaaacctctcaaatacactc

SEQ ID NO: 639963 - DNA, 22 bp, Artificial Sequence
  chemically synthesized
tgaaacctctcaaatacactcc

SEQ ID NO: 639964 - DNA, 22 bp, Artificial Sequence
  chemically synthesized
gaggtttgtttaggagtgtatt

SEQ ID NO: 639965 - DNA, 22 bp, Artificial Sequence
  chemically synthesized
agaggtttgtttaggagtgtat

SEQ ID NO: 639966 - DNA, 22 bp, Artificial Sequence
  chemically synthesized
aaacctctcaaatacactccta

SEQ ID NO: 639967 - DNA, 22 bp, Artificial Sequence
  chemically synthesized
gaatttagaggtttgtttagga

SEQ ID NO: 639968 - DNA, 22 bp, Artificial Sequence
  chemically synthesized
tcaaatacactcctaaacaaac

SEQ ID NO: 639969 - DNA, 22 bp, Artificial Sequence
  chemically synthesized
ctagaatttagaggtttgttta

SEQ ID NO: 639970 - DNA, 22 bp, Artificial Sequence
  chemically synthesized
aaatacactcctaaacaaacct

SEQ ID NO: 639971 - DNA, 22 bp, Artificial Sequence
  chemically synthesized
actagaatttagaggtttgttt

SEQ ID NO: 639972 - DNA, 22 bp, Artificial Sequence
  chemically synthesized
ctaaacaaacctctaaattcta

SEQ ID NO: 639973 - DNA, 22 bp, Artificial Sequence
  chemically synthesized
caatataccttactagaattta

SEQ ID NO: 639974 - DNA, 22 bp, Artificial Sequence
  chemically synthesized
aacaaacctctaaattctagta

SEQ ID NO: 639975 - DNA, 22 bp, Artificial Sequence
  chemically synthesized
tacaatataccttactagaatt

SEQ ID NO: 639976 - DNA, 22 bp, Artificial Sequence
  chemically synthesized
taaattctagtaaggtatattg

SEQ ID NO: 639977 - DNA, 22 bp, Artificial Sequence
  chemically synthesized
accacaggctctacaatatacc

SEQ ID NO: 639978 - DNA, 22 bp, Artificial Sequence
  chemically synthesized
aattctagtaaggtatattgta

SEQ ID NO: 639979 - DNA, 22 bp, Artificial Sequence
  chemically synthesized
tagtaaggtatattgtagagcc

SEQ ID NO: 639980 - DNA, 22 bp, Artificial Sequence
  chemically synthesized
gtaaggtatattgtagagcctg

SEQ ID NO: 639981 - DNA, 22 bp, Artificial Sequence
  chemically synthesized
ggagaaatggagaattgaccac

SEQ ID NO: 639982 - DNA, 22 bp, Artificial Sequence
  chemically synthesized
tagagcctgtggtcaattctcc

SEQ ID NO: 639983 - DNA, 22 bp, Artificial Sequence
  chemically synthesized
tggtcaattctccatttctcct

SEQ ID NO: 639984 - DNA, 22 bp, Artificial Sequence
  chemically synthesized
tccatttctcctaattgctcat

SEQ ID NO: 639985 - DNA, 22 bp, Artificial Sequence
  chemically synthesized
catttctcctaattgctcattt

SEQ ID NO: 639986 - DNA, 22 bp, Artificial Sequence
  chemically synthesized
ctcctaattgctcatttatatt

SEQ ID NO: 639987 - DNA, 22 bp, Artificial Sequence
  chemically synthesized
tcctaattgctcatttatattt

SEQ ID NO: 639988 - DNA, 22 bp, Artificial Sequence
  chemically synthesized
ctaattgctcatttatatttct

SEQ ID NO: 639989 - DNA, 22 bp, Artificial Sequence
  chemically synthesized
acagaaaaagataagaaatata

SEQ ID NO: 639990 - DNA, 22 bp, Artificial Sequence
  chemically synthesized
attgctcatttatatttcttat

SEQ ID NO: 639991 - DNA, 22 bp, Artificial Sequence
  chemically synthesized
ctcatttatatttcttatcttt

SEQ ID NO: 639992 - DNA, 22 bp, Artificial Sequence
  chemically synthesized
atttatatttcttatctttttc

SEQ ID NO: 639993 - DNA, 22 bp, Artificial Sequence
  chemically synthesized
tgtacaacactcacagaaaaag

SEQ ID NO: 639994 - DNA, 22 bp, Artificial Sequence
  chemically synthesized
atatttcttatctttttctgtg

SEQ ID NO: 639995 - DNA, 22 bp, Artificial Sequence
  chemically synthesized
tatttcttatctttttctgtga

SEQ ID NO: 639996 - DNA, 22 bp, Artificial Sequence
  chemically synthesized
ctgtgtacaacactcacagaaa

SEQ ID NO: 639997 - DNA, 22 bp, Artificial Sequence
  chemically synthesized
cttatctttttctgtgagtgtt

SEQ ID NO: 639998 - DNA, 22 bp, Artificial Sequence
  chemically synthesized
ttatctttttctgtgagtgttg

SEQ ID NO: 639999 - DNA, 22 bp, Artificial Sequence
  chemically synthesized
atctttttctgtgagtgttgta

SEQ ID NO: 640000 - DNA, 22 bp, Artificial Sequence
  chemically synthesized
tctttttctgtgagtgttgtac

SEQ ID NO: 640001 - DNA, 22 bp, Artificial Sequence
  chemically synthesized
agaatgttactgtgtacaacac

SEQ ID NO: 640002 - DNA, 22 bp, Artificial Sequence
  chemically synthesized
tttctgtgagtgttgtacacag

SEQ ID NO: 640003 - DNA, 22 bp, Artificial Sequence
  chemically synthesized
ttctgtgagtgttgtacacagt

SEQ ID NO: 640004 - DNA, 22 bp, Artificial Sequence
  chemically synthesized
tctgtgagtgttgtacacagta

SEQ ID NO: 640005 - DNA, 22 bp, Artificial Sequence
  chemically synthesized
ctgtgagtgttgtacacagtaa

SEQ ID NO: 640006 - DNA, 22 bp, Artificial Sequence
  chemically synthesized
tgtgagtgttgtacacagtaac

SEQ ID NO: 640007 - DNA, 22 bp, Artificial Sequence
  chemically synthesized
tgagtgttgtacacagtaacat

SEQ ID NO: 640008 - DNA, 22 bp, Artificial Sequence
  chemically synthesized
gaagatgatgctgagaatgtta

SEQ ID NO: 640009 - DNA, 22 bp, Artificial Sequence
  chemically synthesized
tacacagtaacattctcagcat

SEQ ID NO: 640010 - DNA, 22 bp, Artificial Sequence
  chemically synthesized
tcagcatcatcttctaattccc

SEQ ID NO: 640011 - DNA, 22 bp, Artificial Sequence
  chemically synthesized
tcagagaaggcaagggaattag

SEQ ID NO: 640012 - DNA, 22 bp, Artificial Sequence
  chemically synthesized
agcatcatcttctaattccctt

SEQ ID NO: 640013 - DNA, 22 bp, Artificial Sequence
  chemically synthesized
tcctgtcagagaaggcaaggga

SEQ ID NO: 640014 - DNA, 22 bp, Artificial Sequence
  chemically synthesized
gtcctgtcagagaaggcaaggg

SEQ ID NO: 640015 - DNA, 22 bp, Artificial Sequence
  chemically synthesized
tgtcctgtcagagaaggcaagg

SEQ ID NO: 640016 - DNA, 22 bp, Artificial Sequence
  chemically synthesized
ctaattcccttgccttctctga

SEQ ID NO: 640017 - DNA, 22 bp, Artificial Sequence
  chemically synthesized
gactttgtcctgtcagagaagg

SEQ ID NO: 640018 - DNA, 22 bp, Artificial Sequence
  chemically synthesized
taattcccttgccttctctgac

SEQ ID NO: 640019 - DNA, 22 bp, Artificial Sequence
  chemically synthesized
tagactttgtcctgtcagagaa

SEQ ID NO: 640020 - DNA, 22 bp, Artificial Sequence
  chemically synthesized
attcccttgccttctctgacag

SEQ ID NO: 640021 - DNA, 22 bp, Artificial Sequence
  chemically synthesized
ccttgccttctctgacaggaca

SEQ ID NO: 640022 - DNA, 22 bp, Artificial Sequence
  chemically synthesized
gccttctctgacaggacaaagt

SEQ ID NO: 640023 - DNA, 22 bp, Artificial Sequence
  chemically synthesized
ccttctctgacaggacaaagtc

SEQ ID NO: 640024 - DNA, 22 bp, Artificial Sequence
  chemically synthesized
ctctgacaggacaaagtctaga

SEQ ID NO: 640025 - DNA, 22 bp, Artificial Sequence
  chemically synthesized
tctgacaggacaaagtctagaa

SEQ ID NO: 640026 - DNA, 22 bp, Artificial Sequence
  chemically synthesized
tgacaggacaaagtctagaatt

SEQ ID NO: 640027 - DNA, 22 bp, Artificial Sequence
  chemically synthesized
aatatacaggataaattctaga

SEQ ID NO: 640028 - DNA, 22 bp, Artificial Sequence
  chemically synthesized
acaggacaaagtctagaattta

SEQ ID NO: 640029 - DNA, 22 bp, Artificial Sequence
  chemically synthesized
aactcaatatacaggataaatt

SEQ ID NO: 640030 - DNA, 22 bp, Artificial Sequence
  chemically synthesized
ctaaactcaatatacaggataa

SEQ ID NO: 640031 - DNA, 22 bp, Artificial Sequence
  chemically synthesized
aagttactaaactcaatataca

SEQ ID NO: 640032 - DNA, 22 bp, Artificial Sequence
  chemically synthesized
gaatttatcctgtatattgagt

SEQ ID NO: 640033 - DNA, 22 bp, Artificial Sequence
  chemically synthesized
gtcattgaagttactaaactca

SEQ ID NO: 640034 - DNA, 22 bp, Artificial Sequence
  chemically synthesized
atcctgtatattgagtttagta

SEQ ID NO: 640035 - DNA, 22 bp, Artificial Sequence
  chemically synthesized
tcctgtatattgagtttagtaa

SEQ ID NO: 640036 - DNA, 22 bp, Artificial Sequence
  chemically synthesized
tatattgagtttagtaacttca

SEQ ID NO: 640037 - DNA, 22 bp, Artificial Sequence
  chemically synthesized
ccaaaaaaactagtcattgaag

SEQ ID NO: 640038 - DNA, 22 bp, Artificial Sequence
  chemically synthesized
gccaaaaaaactagtcattgaa

SEQ ID NO: 640039 - DNA, 22 bp, Artificial Sequence
  chemically synthesized
agtttagtaacttcaatgacta

SEQ ID NO: 640040 - DNA, 22 bp, Artificial Sequence
  chemically synthesized
tgccaaaaaaactagtcattga

SEQ ID NO: 640041 - DNA, 22 bp, Artificial Sequence
  chemically synthesized
agtaacttcaatgactagtttt

SEQ ID NO: 640042 - DNA, 22 bp, Artificial Sequence
  chemically synthesized
gtaacttcaatgactagttttt

SEQ ID NO: 640043 - DNA, 22 bp, Artificial Sequence
  chemically synthesized
caatgactagtttttttggcaa

SEQ ID NO: 640044 - DNA, 22 bp, Artificial Sequence
  chemically synthesized
aatgactagtttttttggcaaa

SEQ ID NO: 640045 - DNA, 22 bp, Artificial Sequence
  chemically synthesized
aaaacaaagatatctttgccaa

SEQ ID NO: 640046 - DNA, 22 bp, Artificial Sequence
  chemically synthesized
gtttttttggcaaagatatctt

SEQ ID NO: 640047 - DNA, 22 bp, Artificial Sequence
  chemically synthesized
ggtctgaaaacaaagatatctt

SEQ ID NO: 640048 - DNA, 22 bp, Artificial Sequence
  chemically synthesized
ttttggcaaagatatctttgtt

SEQ ID NO: 640049 - DNA, 22 bp, Artificial Sequence
  chemically synthesized
tttggcaaagatatctttgttt

SEQ ID NO: 640050 - DNA, 22 bp, Artificial Sequence
  chemically synthesized
ttggcaaagatatctttgtttt

SEQ ID NO: 640051 - DNA, 22 bp, Artificial Sequence
  chemically synthesized
tggcaaagatatctttgttttc

SEQ ID NO: 640052 - DNA, 22 bp, Artificial Sequence
  chemically synthesized
ggcaaagatatctttgttttca

SEQ ID NO: 640053 - DNA, 22 bp, Artificial Sequence
  chemically synthesized
gcaaagatatctttgttttcag

SEQ ID NO: 640054 - DNA, 22 bp, Artificial Sequence
  chemically synthesized
tgttttcagacctagttacatt

SEQ ID NO: 640055 - DNA, 22 bp, Artificial Sequence
  chemically synthesized
gttttcagacctagttacattt

SEQ ID NO: 640056 - DNA, 22 bp, Artificial Sequence
  chemically synthesized
ttttcagacctagttacatttc

SEQ ID NO: 640057 - DNA, 22 bp, Artificial Sequence
  chemically synthesized
tcagacctagttacatttcatc

SEQ ID NO: 640058 - DNA, 22 bp, Artificial Sequence
  chemically synthesized
cagacctagttacatttcatcc

SEQ ID NO: 640059 - DNA, 22 bp, Artificial Sequence
  chemically synthesized
agaaacagagatggatgaaatg

SEQ ID NO: 640060 - DNA, 22 bp, Artificial Sequence
  chemically synthesized
agacctagttacatttcatcca

SEQ ID NO: 640061 - DNA, 22 bp, Artificial Sequence
  chemically synthesized
gttacatttcatccatctctgt

SEQ ID NO: 640062 - DNA, 22 bp, Artificial Sequence
  chemically synthesized
catttcatccatctctgtttct

SEQ ID NO: 640063 - DNA, 22 bp, Artificial Sequence
  chemically synthesized
aaataacaagaaactaagaaac

SEQ ID NO: 640064 - DNA, 22 bp, Artificial Sequence
  chemically synthesized
catccatctctgtttcttagtt

SEQ ID NO: 640065 - DNA, 22 bp, Artificial Sequence
  chemically synthesized
atccatctctgtttcttagttt

SEQ ID NO: 640066 - DNA, 22 bp, Artificial Sequence
  chemically synthesized
gctaaaataacaagaaactaag

SEQ ID NO: 640067 - DNA, 22 bp, Artificial Sequence
  chemically synthesized
tgtttcttagtttcttgttatt

SEQ ID NO: 640068 - DNA, 22 bp, Artificial Sequence
  chemically synthesized
tttcttagtttcttgttatttt

SEQ ID NO: 640069 - DNA, 22 bp, Artificial Sequence
  chemically synthesized
cttagtttcttgttattttagc

SEQ ID NO: 640070 - DNA, 22 bp, Artificial Sequence
  chemically synthesized
ttagtttcttgttattttagcg

SEQ ID NO: 640071 - DNA, 22 bp, Artificial Sequence
  chemically synthesized
agtttcttgttattttagcgag

SEQ ID NO: 640072 - DNA, 22 bp, Artificial Sequence
  chemically synthesized
gtttcttgttattttagcgagt

SEQ ID NO: 640073 - DNA, 22 bp, Artificial Sequence
  chemically synthesized
cttgttattttagcgagtggta

SEQ ID NO: 640074 - DNA, 22 bp, Artificial Sequence
  chemically synthesized
ttgttattttagcgagtggtac

SEQ ID NO: 640075 - DNA, 22 bp, Artificial Sequence
  chemically synthesized
gttattttagcgagtggtaccc

SEQ ID NO: 640076 - DNA, 22 bp, Artificial Sequence
  chemically synthesized
ttattttagcgagtggtacccc

SEQ ID NO: 640077 - DNA, 22 bp, Artificial Sequence
  chemically synthesized
aaggcataaataaggggtacca

SEQ ID NO: 640078 - DNA, 22 bp, Artificial Sequence
  chemically synthesized
aaaggcataaataaggggtacc

SEQ ID NO: 640079 - DNA, 22 bp, Artificial Sequence
  chemically synthesized
ttttagcgagtggtacccctta

SEQ ID NO: 640080 - DNA, 22 bp, Artificial Sequence
  chemically synthesized
tagcgagtggtaccccttattt

SEQ ID NO: 640081 - DNA, 22 bp, Artificial Sequence
  chemically synthesized
agcgagtggtaccccttattta

SEQ ID NO: 640082 - DNA, 22 bp, Artificial Sequence
  chemically synthesized
gcgagtggtaccccttatttat

SEQ ID NO: 640083 - DNA, 22 bp, Artificial Sequence
  chemically synthesized
atttatgcctttaagcatcttt

SEQ ID NO: 640084 - DNA, 22 bp, Artificial Sequence
  chemically synthesized
aaaaaaaaaaaaaaagatgctt

SEQ ID NO: 640085 - DNA, 22 bp, Artificial Sequence
  chemically synthesized
tttatgcctttaagcatctttt

SEQ ID NO: 640086 - DNA, 22 bp, Artificial Sequence
  chemically synthesized
atgcctttaagcatcttttttt

SEQ ID NO: 640087 - DNA, 22 bp, Artificial Sequence
  chemically synthesized
tgcctttaagcatctttttttt

SEQ ID NO: 640088 - DNA, 22 bp, Artificial Sequence
  chemically synthesized
catctcaaaaaaaaaaaaaaag

SEQ ID NO: 640089 - DNA, 22 bp, Artificial Sequence
  chemically synthesized
taagcatctttttttttttttt

SEQ ID NO: 640090 - DNA, 22 bp, Artificial Sequence
  chemically synthesized
aagcatcttttttttttttttt

SEQ ID NO: 640091 - DNA, 22 bp, Artificial Sequence
  chemically synthesized
agcatctttttttttttttttg

SEQ ID NO: 640092 - DNA, 22 bp, Artificial Sequence
  chemically synthesized
caccccagcctccatctcaaaa

SEQ ID NO: 640093 - DNA, 22 bp, Artificial Sequence
  chemically synthesized
tttttttttttttgagatggag

SEQ ID NO: 640094 - DNA, 22 bp, Artificial Sequence
  chemically synthesized
ttttttttttttgagatggagg

SEQ ID NO: 640095 - DNA, 22 bp, Artificial Sequence
  chemically synthesized
tttttttttttgagatggaggc

SEQ ID NO: 640096 - DNA, 22 bp, Artificial Sequence
  chemically synthesized
ttttttttttgagatggaggct

SEQ ID NO: 640097 - DNA, 22 bp, Artificial Sequence
  chemically synthesized
tttttttttgagatggaggctg

SEQ ID NO: 640098 - DNA, 22 bp, Artificial Sequence
  chemically synthesized
ttttttttgagatggaggctgg

SEQ ID NO: 640099 - DNA, 22 bp, Artificial Sequence
  chemically synthesized
tttttttgagatggaggctggg

SEQ ID NO: 640100 - DNA, 22 bp, Artificial Sequence
  chemically synthesized
ttttttgagatggaggctgggg

SEQ ID NO: 640101 - DNA, 22 bp, Artificial Sequence
  chemically synthesized
tttttgagatggaggctggggt

SEQ ID NO: 640102 - DNA, 22 bp, Artificial Sequence
  chemically synthesized
ttttgagatggaggctggggtg

SEQ ID NO: 640103 - DNA, 22 bp, Artificial Sequence
  chemically synthesized
tttgagatggaggctggggtgc

SEQ ID NO: 640104 - DNA, 22 bp, Artificial Sequence
  chemically synthesized
ttgagatggaggctggggtgca

SEQ ID NO: 640105 - DNA, 22 bp, Artificial Sequence
  chemically synthesized
tgagatggaggctggggtgcag

SEQ ID NO: 640106 - DNA, 22 bp, Artificial Sequence
  chemically synthesized
gagatggaggctggggtgcagt

SEQ ID NO: 640107 - DNA, 22 bp, Artificial Sequence
  chemically synthesized
agatggaggctggggtgcagtg

SEQ ID NO: 640108 - DNA, 22 bp, Artificial Sequence
  chemically synthesized
cagtgagcggagatcgtgccac

SEQ ID NO: 640109 - DNA, 22 bp, Artificial Sequence
  chemically synthesized
gggtgcagtggcacgatctccg

SEQ ID NO: 640110 - DNA, 22 bp, Artificial Sequence
  chemically synthesized
aacccaggaggtggtggttgca

SEQ ID NO: 640111 - DNA, 22 bp, Artificial Sequence
  chemically synthesized
gaacccaggaggtggtggttgc

SEQ ID NO: 640112 - DNA, 22 bp, Artificial Sequence
  chemically synthesized
cgctcactgcaaccaccacctc

SEQ ID NO: 640113 - DNA, 22 bp, Artificial Sequence
  chemically synthesized
actgcaaccaccacctcctggg

SEQ ID NO: 640114 - DNA, 22 bp, Artificial Sequence
  chemically synthesized
caaccaccacctcctgggttca

SEQ ID NO: 640115 - DNA, 22 bp, Artificial Sequence
  chemically synthesized
aggcaggagagtcgcttgaacc

SEQ ID NO: 640116 - DNA, 22 bp, Artificial Sequence
  chemically synthesized
ctgggttcaagcgactctcctg

SEQ ID NO: 640117 - DNA, 22 bp, Artificial Sequence
  chemically synthesized
aggaggctgaggcaggagagtc

SEQ ID NO: 640118 - DNA, 22 bp, Artificial Sequence
  chemically synthesized
ggttcaagcgactctcctgcct

SEQ ID NO: 640119 - DNA, 22 bp, Artificial Sequence
  chemically synthesized
ctcaggaggctgaggcaggaga

SEQ ID NO: 640120 - DNA, 22 bp, Artificial Sequence
  chemically synthesized
aagcgactctcctgcctcagcc

SEQ ID NO: 640121 - DNA, 22 bp, Artificial Sequence
  chemically synthesized
taatcccagctactcaggaggc

SEQ ID NO: 640122 - DNA, 22 bp, Artificial Sequence
  chemically synthesized
tcctgcctcagcctcctgagta

SEQ ID NO: 640123 - DNA, 22 bp, Artificial Sequence
  chemically synthesized
ctgcctcagcctcctgagtagc

SEQ ID NO: 640124 - DNA, 22 bp, Artificial Sequence
  chemically synthesized
cctcagcctcctgagtagctgg

SEQ ID NO: 640125 - DNA, 22 bp, Artificial Sequence
  chemically synthesized
agcctcctgagtagctgggatt

SEQ ID NO: 640126 - DNA, 22 bp, Artificial Sequence
  chemically synthesized
ctgagtagctgggattacaggt

SEQ ID NO: 640127 - DNA, 22 bp, Artificial Sequence
  chemically synthesized
agtagctgggattacaggtgcc

SEQ ID NO: 640128 - DNA, 22 bp, Artificial Sequence
  chemically synthesized
ggcatggtggcaggcacctgta

SEQ ID NO: 640129 - DNA, 22 bp, Artificial Sequence
  chemically synthesized
gctgggcatggtggcaggcacc

SEQ ID NO: 640130 - DNA, 22 bp, Artificial Sequence
  chemically synthesized
ggattacaggtgcctgccacca

SEQ ID NO: 640131 - DNA, 22 bp, Artificial Sequence
  chemically synthesized
caggtgcctgccaccatgccca

SEQ ID NO: 640132 - DNA, 22 bp, Artificial Sequence
  chemically synthesized
aaaatacaaaaattagctgggc

SEQ ID NO: 640133 - DNA, 22 bp, Artificial Sequence
  chemically synthesized
ctaaaaatacaaaaattagctg

SEQ ID NO: 640134 - DNA, 22 bp, Artificial Sequence
  chemically synthesized
ccaccatgcccagctaattttt

SEQ ID NO: 640135 - DNA, 22 bp, Artificial Sequence
  chemically synthesized
tactaaaaatacaaaaattagc

SEQ ID NO: 640136 - DNA, 22 bp, Artificial Sequence
  chemically synthesized
cctctactaaaaatacaaaaat

SEQ ID NO: 640137 - DNA, 22 bp, Artificial Sequence
  chemically synthesized
atttttgtatttttagtagagg

SEQ ID NO: 640138 - DNA, 22 bp, Artificial Sequence
  chemically synthesized
ttgtatttttagtagaggcagg

SEQ ID NO: 640139 - DNA, 22 bp, Artificial Sequence
  chemically synthesized
tgtatttttagtagaggcaggg

SEQ ID NO: 640140 - DNA, 22 bp, Artificial Sequence
  chemically synthesized
gtatttttagtagaggcagggt

SEQ ID NO: 640141 - DNA, 22 bp, Artificial Sequence
  chemically synthesized
tatttttagtagaggcagggtt

SEQ ID NO: 640142 - DNA, 22 bp, Artificial Sequence
  chemically synthesized
cccaacatggtgaaaccctgcc

SEQ ID NO: 640143 - DNA, 22 bp, Artificial Sequence
  chemically synthesized
ttagtagaggcagggtttcacc

SEQ ID NO: 640144 - DNA, 22 bp, Artificial Sequence
  chemically synthesized
tagtagaggcagggtttcacca

SEQ ID NO: 640145 - DNA, 22 bp, Artificial Sequence
  chemically synthesized
agtagaggcagggtttcaccat

SEQ ID NO: 640146 - DNA, 22 bp, Artificial Sequence
  chemically synthesized
gtagaggcagggtttcaccatg

SEQ ID NO: 640147 - DNA, 22 bp, Artificial Sequence
  chemically synthesized
aagaacagcctgcccaacatgg

SEQ ID NO: 640148 - DNA, 22 bp, Artificial Sequence
  chemically synthesized
caccatgttgggcaggctgttc

SEQ ID NO: 640149 - DNA, 22 bp, Artificial Sequence
  chemically synthesized
accatgttgggcaggctgttct

SEQ ID NO: 640150 - DNA, 22 bp, Artificial Sequence
  chemically synthesized
aggtcaggagttcaagaacagc

SEQ ID NO: 640151 - DNA, 22 bp, Artificial Sequence
  chemically synthesized
ggcaggctgttcttgaactcct

SEQ ID NO: 640152 - DNA, 22 bp, Artificial Sequence
  chemically synthesized
ttcttgaactcctgacctcagg

SEQ ID NO: 640153 - DNA, 22 bp, Artificial Sequence
  chemically synthesized
agatgggtggatcacctgaggt

SEQ ID NO: 640154 - DNA, 22 bp, Artificial Sequence
  chemically synthesized
ttgaactcctgacctcaggtga

SEQ ID NO: 640155 - DNA, 22 bp, Artificial Sequence
  chemically synthesized
gaactcctgacctcaggtgatc

SEQ ID NO: 640156 - DNA, 22 bp, Artificial Sequence
  chemically synthesized
aactcctgacctcaggtgatcc

SEQ ID NO: 640157 - DNA, 22 bp, Artificial Sequence
  chemically synthesized
ggaggctgagatgggtggatca

SEQ ID NO: 640158 - DNA, 22 bp, Artificial Sequence
  chemically synthesized
ctgacctcaggtgatccaccca

SEQ ID NO: 640159 - DNA, 22 bp, Artificial Sequence
  chemically synthesized
tgggaggctgagatgggtggat

SEQ ID NO: 640160 - DNA, 22 bp, Artificial Sequence
  chemically synthesized
acctcaggtgatccacccatct

SEQ ID NO: 640161 - DNA, 22 bp, Artificial Sequence
  chemically synthesized
aggtgatccacccatctcagcc

SEQ ID NO: 640162 - DNA, 22 bp, Artificial Sequence
  chemically synthesized
taatcccagcactctgggaggc

SEQ ID NO: 640163 - DNA, 22 bp, Artificial Sequence
  chemically synthesized
acgcctgtaatcccagcactct

SEQ ID NO: 640164 - DNA, 22 bp, Artificial Sequence
  chemically synthesized
agcctcccagagtgctgggatt

SEQ ID NO: 640165 - DNA, 22 bp, Artificial Sequence
  chemically synthesized
ccagagtgctgggattacaggc

SEQ ID NO: 640166 - DNA, 22 bp, Artificial Sequence
  chemically synthesized
agaccaggtgcagtggctcacg

SEQ ID NO: 640167 - DNA, 22 bp, Artificial Sequence
  chemically synthesized
ggattacaggcgtgagccactg

SEQ ID NO: 640168 - DNA, 22 bp, Artificial Sequence
  chemically synthesized
caggcgtgagccactgcacctg

SEQ ID NO: 640169 - DNA, 22 bp, Artificial Sequence
  chemically synthesized
agatgctcagaccaggtgcagt

SEQ ID NO: 640170 - DNA, 22 bp, Artificial Sequence
  chemically synthesized
aagatgctcagaccaggtgcag

SEQ ID NO: 640171 - DNA, 22 bp, Artificial Sequence
  chemically synthesized
catttaagatgctcagaccagg

SEQ ID NO: 640172 - DNA, 22 bp, Artificial Sequence
  chemically synthesized
acatttaagatgctcagaccag

SEQ ID NO: 640173 - DNA, 22 bp, Artificial Sequence
  chemically synthesized
cttacatttaagatgctcagac

SEQ ID NO: 640174 - DNA, 22 bp, Artificial Sequence
  chemically synthesized
acttacatttaagatgctcaga

SEQ ID NO: 640175 - DNA, 22 bp, Artificial Sequence
  chemically synthesized
tacttacatttaagatgctcag

SEQ ID NO: 640176 - DNA, 22 bp, Artificial Sequence
  chemically synthesized
ttacttacatttaagatgctca

SEQ ID NO: 640177 - DNA, 22 bp, Artificial Sequence
  chemically synthesized
cacctggtctgagcatcttaaa

SEQ ID NO: 640178 - DNA, 22 bp, Artificial Sequence
  chemically synthesized
gtctgagcatcttaaatgtaag

SEQ ID NO: 640179 - DNA, 22 bp, Artificial Sequence
  chemically synthesized
agcatcttaaatgtaagtaaaa

SEQ ID NO: 640180 - DNA, 22 bp, Artificial Sequence
  chemically synthesized
gtacaacaaagatttttactta

SEQ ID NO: 640181 - DNA, 22 bp, Artificial Sequence
  chemically synthesized
aaatgtaagtaaaaatctttgt

SEQ ID NO: 640182 - DNA, 22 bp, Artificial Sequence
  chemically synthesized
aatgtaagtaaaaatctttgtt

SEQ ID NO: 640183 - DNA, 22 bp, Artificial Sequence
  chemically synthesized
gaagaaagcaaaataatacact

SEQ ID NO: 640184 - DNA, 22 bp, Artificial Sequence
  chemically synthesized
tagaagaaagcaaaataataca

SEQ ID NO: 640185 - DNA, 22 bp, Artificial Sequence
  chemically synthesized
tgttgtactagtgtattatttt

SEQ ID NO: 640186 - DNA, 22 bp, Artificial Sequence
  chemically synthesized
gttgtactagtgtattattttg

SEQ ID NO: 640187 - DNA, 22 bp, Artificial Sequence
  chemically synthesized
ttgtactagtgtattattttgc

SEQ ID NO: 640188 - DNA, 22 bp, Artificial Sequence
  chemically synthesized
attctagaagaaagcaaaataa

SEQ ID NO: 640189 - DNA, 22 bp, Artificial Sequence
  chemically synthesized
tactagtgtattattttgcttt

SEQ ID NO: 640190 - DNA, 22 bp, Artificial Sequence
  chemically synthesized
gtgtattattttgctttcttct

SEQ ID NO: 640191 - DNA, 22 bp, Artificial Sequence
  chemically synthesized
ttttgctttcttctagaattaa

SEQ ID NO: 640192 - DNA, 22 bp, Artificial Sequence
  chemically synthesized
tgctttcttctagaattaattc

SEQ ID NO: 640193 - DNA, 22 bp, Artificial Sequence
  chemically synthesized
gctttcttctagaattaattca

SEQ ID NO: 640194 - DNA, 22 bp, Artificial Sequence
  chemically synthesized
ctttcttctagaattaattcat

SEQ ID NO: 640195 - DNA, 22 bp, Artificial Sequence
  chemically synthesized
aaaaaaaaaaaaagatgaatta

SEQ ID NO: 640196 - DNA, 22 bp, Artificial Sequence
  chemically synthesized
tcttctagaattaattcatctt

SEQ ID NO: 640197 - DNA, 22 bp, Artificial Sequence
  chemically synthesized
cttctagaattaattcatcttt

SEQ ID NO: 640198 - DNA, 22 bp, Artificial Sequence
  chemically synthesized
ttctagaattaattcatctttt

SEQ ID NO: 640199 - DNA, 22 bp, Artificial Sequence
  chemically synthesized
tctcaaaaaaaaaaaaagatga

SEQ ID NO: 640200 - DNA, 22 bp, Artificial Sequence
  chemically synthesized
ctagaattaattcatctttttt

SEQ ID NO: 640201 - DNA, 22 bp, Artificial Sequence
  chemically synthesized
tagaattaattcatcttttttt

SEQ ID NO: 640202 - DNA, 22 bp, Artificial Sequence
  chemically synthesized
gaattaattcatcttttttttt

SEQ ID NO: 640203 - DNA, 22 bp, Artificial Sequence
  chemically synthesized
attcatctttttttttttttga

SEQ ID NO: 640204 - DNA, 22 bp, Artificial Sequence
  chemically synthesized
atctttttttttttttgagata

SEQ ID NO: 640205 - DNA, 22 bp, Artificial Sequence
  chemically synthesized
tttttttttttgagatagggtc

SEQ ID NO: 640206 - DNA, 22 bp, Artificial Sequence
  chemically synthesized
ttttttttttgagatagggtct

SEQ ID NO: 640207 - DNA, 22 bp, Artificial Sequence
  chemically synthesized
ggcaacagagtgagaccctatc

SEQ ID NO: 640208 - DNA, 22 bp, Artificial Sequence
  chemically synthesized
tttttttttgagatagggtctc

SEQ ID NO: 640209 - DNA, 22 bp, Artificial Sequence
  chemically synthesized
ttttttttgagatagggtctca

SEQ ID NO: 640210 - DNA, 22 bp, Artificial Sequence
  chemically synthesized
tttttttgagatagggtctcac

SEQ ID NO: 640211 - DNA, 22 bp, Artificial Sequence
  chemically synthesized
ttttttgagatagggtctcact

SEQ ID NO: 640212 - DNA, 22 bp, Artificial Sequence
  chemically synthesized
tttttgagatagggtctcactc

SEQ ID NO: 640213 - DNA, 22 bp, Artificial Sequence
  chemically synthesized
ttttgagatagggtctcactct

SEQ ID NO: 640214 - DNA, 22 bp, Artificial Sequence
  chemically synthesized
tttgagatagggtctcactctg

SEQ ID NO: 640215 - DNA, 22 bp, Artificial Sequence
  chemically synthesized
catcctgggcaacagagtgaga

SEQ ID NO: 640216 - DNA, 22 bp, Artificial Sequence
  chemically synthesized
ttgagatagggtctcactctgt

SEQ ID NO: 640217 - DNA, 22 bp, Artificial Sequence
  chemically synthesized
tgagatagggtctcactctgtt

SEQ ID NO: 640218 - DNA, 22 bp, Artificial Sequence
  chemically synthesized
gagatagggtctcactctgttg

SEQ ID NO: 640219 - DNA, 22 bp, Artificial Sequence
  chemically synthesized
agatagggtctcactctgttgc

SEQ ID NO: 640220 - DNA, 22 bp, Artificial Sequence
  chemically synthesized
cactccatcctgggcaacagag

SEQ ID NO: 640221 - DNA, 22 bp, Artificial Sequence
  chemically synthesized
tgccactgcactccatcctggg

SEQ ID NO: 640222 - DNA, 22 bp, Artificial Sequence
  chemically synthesized
actctgttgcccaggatggagt

SEQ ID NO: 640223 - DNA, 22 bp, Artificial Sequence
  chemically synthesized
tgttgcccaggatggagtgcag

SEQ ID NO: 640224 - DNA, 22 bp, Artificial Sequence
  chemically synthesized
ttgcccaggatggagtgcagtg

SEQ ID NO: 640225 - DNA, 22 bp, Artificial Sequence
  chemically synthesized
agccataattgtgccactgcac

SEQ ID NO: 640226 - DNA, 22 bp, Artificial Sequence
  chemically synthesized
cccaggatggagtgcagtggca

SEQ ID NO: 640227 - DNA, 22 bp, Artificial Sequence
  chemically synthesized
cattgagccataattgtgccac

SEQ ID NO: 640228 - DNA, 22 bp, Artificial Sequence
  chemically synthesized
agcccaggaggatgaggctgca

SEQ ID NO: 640229 - DNA, 22 bp, Artificial Sequence
  chemically synthesized
gagcccaggaggatgaggctgc

SEQ ID NO: 640230 - DNA, 22 bp, Artificial Sequence
  chemically synthesized
tggctcaatgcagcctcatcct

SEQ ID NO: 640231 - DNA, 22 bp, Artificial Sequence
  chemically synthesized
aatgcagcctcatcctcctggg

SEQ ID NO: 640232 - DNA, 22 bp, Artificial Sequence
  chemically synthesized
agataggaggatcgcttgagcc

SEQ ID NO: 640233 - DNA, 22 bp, Artificial Sequence
  chemically synthesized
atcctcctgggctcaagcgatc

SEQ ID NO: 640234 - DNA, 22 bp, Artificial Sequence
  chemically synthesized
ctgggctcaagcgatcctccta

SEQ ID NO: 640235 - DNA, 22 bp, Artificial Sequence
  chemically synthesized
aggaggctgagataggaggatc

SEQ ID NO: 640236 - DNA, 22 bp, Artificial Sequence
  chemically synthesized
ggctcaagcgatcctcctatct

SEQ ID NO: 640237 - DNA, 22 bp, Artificial Sequence
  chemically synthesized
ctcaggaggctgagataggagg

SEQ ID NO: 640238 - DNA, 22 bp, Artificial Sequence
  chemically synthesized
aagcgatcctcctatctcagcc

SEQ ID NO: 640239 - DNA, 22 bp, Artificial Sequence
  chemically synthesized
tagtcccaactactcaggaggc

SEQ ID NO: 640240 - DNA, 22 bp, Artificial Sequence
  chemically synthesized
ctatctcagcctcctgagtagt

SEQ ID NO: 640241 - DNA, 22 bp, Artificial Sequence
  chemically synthesized
tctcagcctcctgagtagttgg

SEQ ID NO: 640242 - DNA, 22 bp, Artificial Sequence
  chemically synthesized
agcctcctgagtagttgggact

SEQ ID NO: 640243 - DNA, 22 bp, Artificial Sequence
  chemically synthesized
ctgagtagttgggactacaggc

SEQ ID NO: 640244 - DNA, 22 bp, Artificial Sequence
  chemically synthesized
agtagttgggactacaggcatg

SEQ ID NO: 640245 - DNA, 22 bp, Artificial Sequence
  chemically synthesized
gccaggagtggtggtacatgcc

SEQ ID NO: 640246 - DNA, 22 bp, Artificial Sequence
  chemically synthesized
ggactacaggcatgtaccacca

SEQ ID NO: 640247 - DNA, 22 bp, Artificial Sequence
  chemically synthesized
caggcatgtaccaccactcctg

SEQ ID NO: 640248 - DNA, 22 bp, Artificial Sequence
  chemically synthesized
aaatatattagccaggagtggt

SEQ ID NO: 640249 - DNA, 22 bp, Artificial Sequence
  chemically synthesized
aaaatatattagccaggagtgg

SEQ ID NO: 640250 - DNA, 22 bp, Artificial Sequence
  chemically synthesized
caaaaaataatttaaaatatat

SEQ ID NO: 640251 - DNA, 22 bp, Artificial Sequence
  chemically synthesized
acaaaaaataatttaaaatata

SEQ ID NO: 640252 - DNA, 22 bp, Artificial Sequence
  chemically synthesized
tacaaaaaataatttaaaatat

SEQ ID NO: 640253 - DNA, 22 bp, Artificial Sequence
  chemically synthesized
ctggctaatatattttaaatta

SEQ ID NO: 640254 - DNA, 22 bp, Artificial Sequence
  chemically synthesized
gctaatatattttaaattattt

SEQ ID NO: 640255 - DNA, 22 bp, Artificial Sequence
  chemically synthesized
atatattttaaattattttttg

SEQ ID NO: 640256 - DNA, 22 bp, Artificial Sequence
  chemically synthesized
taaattattttttgtaaagatg

SEQ ID NO: 640257 - DNA, 22 bp, Artificial Sequence
  chemically synthesized
aaattattttttgtaaagatgg

SEQ ID NO: 640258 - DNA, 22 bp, Artificial Sequence
  chemically synthesized
aattattttttgtaaagatggc

SEQ ID NO: 640259 - DNA, 22 bp, Artificial Sequence
  chemically synthesized
ttttttgtaaagatggcacctc

SEQ ID NO: 640260 - DNA, 22 bp, Artificial Sequence
  chemically synthesized
tttgtaaagatggcacctcact

SEQ ID NO: 640261 - DNA, 22 bp, Artificial Sequence
  chemically synthesized
ttgtaaagatggcacctcacta

SEQ ID NO: 640262 - DNA, 22 bp, Artificial Sequence
  chemically synthesized
gccagggcaatgtagtgaggtg

SEQ ID NO: 640263 - DNA, 22 bp, Artificial Sequence
  chemically synthesized
tgtaaagatggcacctcactac

SEQ ID NO: 640264 - DNA, 22 bp, Artificial Sequence
  chemically synthesized
gtaaagatggcacctcactaca

SEQ ID NO: 640265 - DNA, 22 bp, Artificial Sequence
  chemically synthesized
taaagatggcacctcactacat

SEQ ID NO: 640266 - DNA, 22 bp, Artificial Sequence
  chemically synthesized
agactagccagggcaatgtagt

SEQ ID NO: 640267 - DNA, 22 bp, Artificial Sequence
  chemically synthesized
gagactagccagggcaatgtag

SEQ ID NO: 640268 - DNA, 22 bp, Artificial Sequence
  chemically synthesized
actacattgccctggctagtct

SEQ ID NO: 640269 - DNA, 22 bp, Artificial Sequence
  chemically synthesized
tgcccaggtgtttgagactagc

SEQ ID NO: 640270 - DNA, 22 bp, Artificial Sequence
  chemically synthesized
gtgcccaggtgtttgagactag

SEQ ID NO: 640271 - DNA, 22 bp, Artificial Sequence
  chemically synthesized
cattgccctggctagtctcaaa

SEQ ID NO: 640272 - DNA, 22 bp, Artificial Sequence
  chemically synthesized
cttgtgcccaggtgtttgagac

SEQ ID NO: 640273 - DNA, 22 bp, Artificial Sequence
  chemically synthesized
ccctggctagtctcaaacacct

SEQ ID NO: 640274 - DNA, 22 bp, Artificial Sequence
  chemically synthesized
gctagtctcaaacacctgggca

SEQ ID NO: 640275 - DNA, 22 bp, Artificial Sequence
  chemically synthesized
gtctcaaacacctgggcacaag

SEQ ID NO: 640276 - DNA, 22 bp, Artificial Sequence
  chemically synthesized
aaacacctgggcacaagcagtc

SEQ ID NO: 640277 - DNA, 22 bp, Artificial Sequence
  chemically synthesized
ggaggccaaggtgggaggactg

SEQ ID NO: 640278 - DNA, 22 bp, Artificial Sequence
  chemically synthesized
gggaggccaaggtgggaggact

SEQ ID NO: 640279 - DNA, 22 bp, Artificial Sequence
  chemically synthesized
tgggaggccaaggtgggaggac

SEQ ID NO: 640280 - DNA, 22 bp, Artificial Sequence
  chemically synthesized
ggcacaagcagtcctcccacct

SEQ ID NO: 640281 - DNA, 22 bp, Artificial Sequence
  chemically synthesized
tcactttgggaggccaaggtgg

SEQ ID NO: 640282 - DNA, 22 bp, Artificial Sequence
  chemically synthesized
taatcctatcactttgggaggc

SEQ ID NO: 640283 - DNA, 22 bp, Artificial Sequence
  chemically synthesized
ccaccttggcctcccaaagtga

SEQ ID NO: 640284 - DNA, 22 bp, Artificial Sequence
  chemically synthesized
acacctgtaatcctatcacttt

SEQ ID NO: 640285 - DNA, 22 bp, Artificial Sequence
  chemically synthesized
ggcctcccaaagtgataggatt

SEQ ID NO: 640286 - DNA, 22 bp, Artificial Sequence
  chemically synthesized
gcctcccaaagtgataggatta

SEQ ID NO: 640287 - DNA, 22 bp, Artificial Sequence
  chemically synthesized
ccaaagtgataggattacaggt

SEQ ID NO: 640288 - DNA, 22 bp, Artificial Sequence
  chemically synthesized
ggaacagtggctcacacctgta

SEQ ID NO: 640289 - DNA, 22 bp, Artificial Sequence
  chemically synthesized
ggctgggaacagtggctcacac

SEQ ID NO: 640290 - DNA, 22 bp, Artificial Sequence
  chemically synthesized
caggtgtgagccactgttccca

SEQ ID NO: 640291 - DNA, 22 bp, Artificial Sequence
  chemically synthesized
aacatcaaaaagtgaattaggc

SEQ ID NO: 640292 - DNA, 22 bp, Artificial Sequence
  chemically synthesized
ttcccagcctaattcacttttt

SEQ ID NO: 640293 - DNA, 22 bp, Artificial Sequence
  chemically synthesized
ccagcctaattcactttttgat

SEQ ID NO: 640294 - DNA, 22 bp, Artificial Sequence
  chemically synthesized
attcactttttgatgtttaact

SEQ ID NO: 640295 - DNA, 22 bp, Artificial Sequence
  chemically synthesized
actttttgatgtttaacttggg

SEQ ID NO: 640296 - DNA, 22 bp, Artificial Sequence
  chemically synthesized
tttgatgtttaacttgggtggg

SEQ ID NO: 640297 - DNA, 22 bp, Artificial Sequence
  chemically synthesized
ttgatgtttaacttgggtgggg

SEQ ID NO: 640298 - DNA, 22 bp, Artificial Sequence
  chemically synthesized
tgatgtttaacttgggtggggg

SEQ ID NO: 640299 - DNA, 22 bp, Artificial Sequence
  chemically synthesized
gatgtttaacttgggtgggggg

SEQ ID NO: 640300 - DNA, 22 bp, Artificial Sequence
  chemically synthesized
atgtttaacttgggtggggggt

SEQ ID NO: 640301 - DNA, 22 bp, Artificial Sequence
  chemically synthesized
aacttgggtggggggtgctatc

SEQ ID NO: 640302 - DNA, 22 bp, Artificial Sequence
  chemically synthesized
acttgggtggggggtgctatcc

SEQ ID NO: 640303 - DNA, 22 bp, Artificial Sequence
  chemically synthesized
gggtggggggtgctatcccatt

SEQ ID NO: 640304 - DNA, 22 bp, Artificial Sequence
  chemically synthesized
ggtggggggtgctatcccattt

SEQ ID NO: 640305 - DNA, 22 bp, Artificial Sequence
  chemically synthesized
tcccatttcttcatgtattttg

SEQ ID NO: 640306 - DNA, 22 bp, Artificial Sequence
  chemically synthesized
caaatcacgatccaaaatacat

SEQ ID NO: 640307 - DNA, 22 bp, Artificial Sequence
  chemically synthesized
tctccaaatcacgatccaaaat

SEQ ID NO: 640308 - DNA, 22 bp, Artificial Sequence
  chemically synthesized
gtctccaaatcacgatccaaaa

SEQ ID NO: 640309 - DNA, 22 bp, Artificial Sequence
  chemically synthesized
cttcatgtattttggatcgtga

SEQ ID NO: 640310 - DNA, 22 bp, Artificial Sequence
  chemically synthesized
ttcatgtattttggatcgtgat

SEQ ID NO: 640311 - DNA, 22 bp, Artificial Sequence
  chemically synthesized
catgtattttggatcgtgattt

SEQ ID NO: 640312 - DNA, 22 bp, Artificial Sequence
  chemically synthesized
atgtattttggatcgtgatttg

SEQ ID NO: 640313 - DNA, 22 bp, Artificial Sequence
  chemically synthesized
caaaatttgtctccaaatcacg

SEQ ID NO: 640314 - DNA, 22 bp, Artificial Sequence
  chemically synthesized
gcaaaatttgtctccaaatcac

SEQ ID NO: 640315 - DNA, 22 bp, Artificial Sequence
  chemically synthesized
tggatcgtgatttggagacaaa

SEQ ID NO: 640316 - DNA, 22 bp, Artificial Sequence
  chemically synthesized
ggatcgtgatttggagacaaat

SEQ ID NO: 640317 - DNA, 22 bp, Artificial Sequence
  chemically synthesized
gatcgtgatttggagacaaatt

SEQ ID NO: 640318 - DNA, 22 bp, Artificial Sequence
  chemically synthesized
ggagacaaattttgcaagggat

SEQ ID NO: 640319 - DNA, 22 bp, Artificial Sequence
  chemically synthesized
gagacaaattttgcaagggatg

SEQ ID NO: 640320 - DNA, 22 bp, Artificial Sequence
  chemically synthesized
tgcaagggatgttttgcatgtg

SEQ ID NO: 640321 - DNA, 22 bp, Artificial Sequence
  chemically synthesized
gcaagggatgttttgcatgtgc

SEQ ID NO: 640322 - DNA, 22 bp, Artificial Sequence
  chemically synthesized
caagggatgttttgcatgtgca

SEQ ID NO: 640323 - DNA, 22 bp, Artificial Sequence
  chemically synthesized
tgcatgtgcatacatatgcatg

SEQ ID NO: 640324 - DNA, 22 bp, Artificial Sequence
  chemically synthesized
gcatgtgcatacatatgcatgt

SEQ ID NO: 640325 - DNA, 22 bp, Artificial Sequence
  chemically synthesized
catgtgcatacatatgcatgtg

SEQ ID NO: 640326 - DNA, 22 bp, Artificial Sequence
  chemically synthesized
aagtacacacacatgagaataa

SEQ ID NO: 640327 - DNA, 22 bp, Artificial Sequence
  chemically synthesized
tctattattctcatgtgtgtgt

SEQ ID NO: 640328 - DNA, 22 bp, Artificial Sequence
  chemically synthesized
ctattattctcatgtgtgtgta

SEQ ID NO: 640329 - DNA, 22 bp, Artificial Sequence
  chemically synthesized
tattattctcatgtgtgtgtac

SEQ ID NO: 640330 - DNA, 22 bp, Artificial Sequence
  chemically synthesized
ttattctcatgtgtgtgtactt

SEQ ID NO: 640331 - DNA, 22 bp, Artificial Sequence
  chemically synthesized
ttctcatgtgtgtgtactttaa

SEQ ID NO: 640332 - DNA, 22 bp, Artificial Sequence
  chemically synthesized
tcatgtgtgtgtactttaatat

SEQ ID NO: 640333 - DNA, 22 bp, Artificial Sequence
  chemically synthesized
aaaagagaggaaaatattaaag

SEQ ID NO: 640334 - DNA, 22 bp, Artificial Sequence
  chemically synthesized
atgtgtgtgtactttaatattt

SEQ ID NO: 640335 - DNA, 22 bp, Artificial Sequence
  chemically synthesized
aaaaagagaggaaaatattaaa

SEQ ID NO: 640336 - DNA, 22 bp, Artificial Sequence
  chemically synthesized
taatattttcctctctttttaa

SEQ ID NO: 640337 - DNA, 22 bp, Artificial Sequence
  chemically synthesized
aatattttcctctctttttaaa

SEQ ID NO: 640338 - DNA, 22 bp, Artificial Sequence
  chemically synthesized
atattttcctctctttttaaac

SEQ ID NO: 640339 - DNA, 22 bp, Artificial Sequence
  chemically synthesized
agagagagataatgagtttaaa

SEQ ID NO: 640340 - DNA, 22 bp, Artificial Sequence
  chemically synthesized
tcctctctttttaaactcatta

SEQ ID NO: 640341 - DNA, 22 bp, Artificial Sequence
  chemically synthesized
cctctctttttaaactcattat

SEQ ID NO: 640342 - DNA, 22 bp, Artificial Sequence
  chemically synthesized
ctctctttttaaactcattatc

SEQ ID NO: 640343 - DNA, 22 bp, Artificial Sequence
  chemically synthesized
tctttttaaactcattatctct

SEQ ID NO: 640344 - DNA, 22 bp, Artificial Sequence
  chemically synthesized
tttttaaactcattatctctct

SEQ ID NO: 640345 - DNA, 22 bp, Artificial Sequence
  chemically synthesized
tttaaactcattatctctctct

SEQ ID NO: 640346 - DNA, 22 bp, Artificial Sequence
  chemically synthesized
ttaaactcattatctctctctc

SEQ ID NO: 640347 - DNA, 22 bp, Artificial Sequence
  chemically synthesized
taaactcattatctctctctca

SEQ ID NO: 640348 - DNA, 22 bp, Artificial Sequence
  chemically synthesized
aaactcattatctctctctcag

SEQ ID NO: 640349 - DNA, 22 bp, Artificial Sequence
  chemically synthesized
aactcattatctctctctcagg

SEQ ID NO: 640350 - DNA, 22 bp, Artificial Sequence
  chemically synthesized
attatctctctctcaggtggtt

SEQ ID NO: 640351 - DNA, 22 bp, Artificial Sequence
  chemically synthesized
ggagaagccataaaaccacctg

SEQ ID NO: 640352 - DNA, 22 bp, Artificial Sequence
  chemically synthesized
tctctctctcaggtggttttat

SEQ ID NO: 640353 - DNA, 22 bp, Artificial Sequence
  chemically synthesized
tctctcaggtggttttatggct

SEQ ID NO: 640354 - DNA, 22 bp, Artificial Sequence
  chemically synthesized
tctcaggtggttttatggcttc

SEQ ID NO: 640355 - DNA, 22 bp, Artificial Sequence
  chemically synthesized
ggtatggctgggagaagccata

SEQ ID NO: 640356 - DNA, 22 bp, Artificial Sequence
  chemically synthesized
tcaggtggttttatggcttctc

SEQ ID NO: 640357 - DNA, 22 bp, Artificial Sequence
  chemically synthesized
aggtggttttatggcttctccc

SEQ ID NO: 640358 - DNA, 22 bp, Artificial Sequence
  chemically synthesized
agcccctgggtatggctgggag

SEQ ID NO: 640359 - DNA, 22 bp, Artificial Sequence
  chemically synthesized
taagcccctgggtatggctggg

SEQ ID NO: 640360 - DNA, 22 bp, Artificial Sequence
  chemically synthesized
tatggcttctcccagccatacc

SEQ ID NO: 640361 - DNA, 22 bp, Artificial Sequence
  chemically synthesized
atggcttctcccagccataccc

SEQ ID NO: 640362 - DNA, 22 bp, Artificial Sequence
  chemically synthesized
tggcttctcccagccataccca

SEQ ID NO: 640363 - DNA, 22 bp, Artificial Sequence
  chemically synthesized
aactctaagcccctgggtatgg

SEQ ID NO: 640364 - DNA, 22 bp, Artificial Sequence
  chemically synthesized
taaactctaagcccctgggtat

SEQ ID NO: 640365 - DNA, 22 bp, Artificial Sequence
  chemically synthesized
ctcccagccatacccaggggct

SEQ ID NO: 640366 - DNA, 22 bp, Artificial Sequence
  chemically synthesized
tcccagccatacccaggggctt

SEQ ID NO: 640367 - DNA, 22 bp, Artificial Sequence
  chemically synthesized
ccagccatacccaggggcttag

SEQ ID NO: 640368 - DNA, 22 bp, Artificial Sequence
  chemically synthesized
ccaacagatgtggctctaaact

SEQ ID NO: 640369 - DNA, 22 bp, Artificial Sequence
  chemically synthesized
caaactaccaacagatgtggct

SEQ ID NO: 640370 - DNA, 22 bp, Artificial Sequence
  chemically synthesized
agagtttagagccacatctgtt

SEQ ID NO: 640371 - DNA, 22 bp, Artificial Sequence
  chemically synthesized
gagtttagagccacatctgttg

SEQ ID NO: 640372 - DNA, 22 bp, Artificial Sequence
  chemically synthesized
agagccacatctgttggtagtt

SEQ ID NO: 640373 - DNA, 22 bp, Artificial Sequence
  chemically synthesized
gagccacatctgttggtagttt

SEQ ID NO: 640374 - DNA, 22 bp, Artificial Sequence
  chemically synthesized
agtgtaggagctgcaaactacc

SEQ ID NO: 640375 - DNA, 22 bp, Artificial Sequence
  chemically synthesized
tatcactcagtgtaggagctgc

SEQ ID NO: 640376 - DNA, 22 bp, Artificial Sequence
  chemically synthesized
ttggtagtttgcagctcctaca

SEQ ID NO: 640377 - DNA, 22 bp, Artificial Sequence
  chemically synthesized
tgtatcactcagtgtaggagct

SEQ ID NO: 640378 - DNA, 22 bp, Artificial Sequence
  chemically synthesized
gtagtttgcagctcctacactg

SEQ ID NO: 640379 - DNA, 22 bp, Artificial Sequence
  chemically synthesized
gcagctcctacactgagtgata

SEQ ID NO: 640380 - DNA, 22 bp, Artificial Sequence
  chemically synthesized
cagctcctacactgagtgatac

SEQ ID NO: 640381 - DNA, 22 bp, Artificial Sequence
  chemically synthesized
ctacactgagtgatacagagat

SEQ ID NO: 640382 - DNA, 22 bp, Artificial Sequence
  chemically synthesized
cactgagtgatacagagatatc

SEQ ID NO: 640383 - DNA, 22 bp, Artificial Sequence
  chemically synthesized
gcaatgaaatgagtgatatctc

SEQ ID NO: 640384 - DNA, 22 bp, Artificial Sequence
  chemically synthesized
agtgatacagagatatcactca

SEQ ID NO: 640385 - DNA, 22 bp, Artificial Sequence
  chemically synthesized
cctggcaatgaaatgagtgata

SEQ ID NO: 640386 - DNA, 22 bp, Artificial Sequence
  chemically synthesized
ctgcctggcaatgaaatgagtg

SEQ ID NO: 640387 - DNA, 22 bp, Artificial Sequence
  chemically synthesized
cctactgcctggcaatgaaatg

SEQ ID NO: 640388 - DNA, 22 bp, Artificial Sequence
  chemically synthesized
aaccaatctacctactgcctgg

SEQ ID NO: 640389 - DNA, 22 bp, Artificial Sequence
  chemically synthesized
atttcattgccaggcagtaggt

SEQ ID NO: 640390 - DNA, 22 bp, Artificial Sequence
  chemically synthesized
cattgccaggcagtaggtagat

SEQ ID NO: 640391 - DNA, 22 bp, Artificial Sequence
  chemically synthesized
attgccaggcagtaggtagatt

SEQ ID NO: 640392 - DNA, 22 bp, Artificial Sequence
  chemically synthesized
ccaggcagtaggtagattggtt

SEQ ID NO: 640393 - DNA, 22 bp, Artificial Sequence
  chemically synthesized
aaaccaggacctgaaccaatct

SEQ ID NO: 640394 - DNA, 22 bp, Artificial Sequence
  chemically synthesized
gaaaccaggacctgaaccaatc

SEQ ID NO: 640395 - DNA, 22 bp, Artificial Sequence
  chemically synthesized
gttcaggtcctggtttcaaggc

SEQ ID NO: 640396 - DNA, 22 bp, Artificial Sequence
  chemically synthesized
aggtcctggtttcaaggctgtg

SEQ ID NO: 640397 - DNA, 22 bp, Artificial Sequence
  chemically synthesized
ggaaagagagcatcacagcctt

SEQ ID NO: 640398 - DNA, 22 bp, Artificial Sequence
  chemically synthesized
gtttcaaggctgtgatgctctc

SEQ ID NO: 640399 - DNA, 22 bp, Artificial Sequence
  chemically synthesized
gcagttgggaaagagagcatca

SEQ ID NO: 640400 - DNA, 22 bp, Artificial Sequence
  chemically synthesized
caaggctgtgatgctctctttc

SEQ ID NO: 640401 - DNA, 22 bp, Artificial Sequence
  chemically synthesized
aaggctgtgatgctctctttcc

SEQ ID NO: 640402 - DNA, 22 bp, Artificial Sequence
  chemically synthesized
tgatgctctctttcccaactgc

SEQ ID NO: 640403 - DNA, 22 bp, Artificial Sequence
  chemically synthesized
tctttcccaactgcgaatcttt

SEQ ID NO: 640404 - DNA, 22 bp, Artificial Sequence
  chemically synthesized
tttcccaactgcgaatctttgc

SEQ ID NO: 640405 - DNA, 22 bp, Artificial Sequence
  chemically synthesized
tcccaactgcgaatctttgcct

SEQ ID NO: 640406 - DNA, 22 bp, Artificial Sequence
  chemically synthesized
cccaactgcgaatctttgcctc

SEQ ID NO: 640407 - DNA, 22 bp, Artificial Sequence
  chemically synthesized
ccaactgcgaatctttgcctct

SEQ ID NO: 640408 - DNA, 22 bp, Artificial Sequence
  chemically synthesized
atgcatagagccgagggaagag

SEQ ID NO: 640409 - DNA, 22 bp, Artificial Sequence
  chemically synthesized
cgaatctttgcctcttccctcg

SEQ ID NO: 640410 - DNA, 22 bp, Artificial Sequence
  chemically synthesized
tggccctaatgcatagagccga

SEQ ID NO: 640411 - DNA, 22 bp, Artificial Sequence
  chemically synthesized
tgcctcttccctcggctctatg

SEQ ID NO: 640412 - DNA, 22 bp, Artificial Sequence
  chemically synthesized
gcctcttccctcggctctatgc

SEQ ID NO: 640413 - DNA, 22 bp, Artificial Sequence
  chemically synthesized
cctcttccctcggctctatgca

SEQ ID NO: 640414 - DNA, 22 bp, Artificial Sequence
  chemically synthesized
ttccctcggctctatgcattag

SEQ ID NO: 640415 - DNA, 22 bp, Artificial Sequence
  chemically synthesized
ccctcggctctatgcattaggg

SEQ ID NO: 640416 - DNA, 22 bp, Artificial Sequence
  chemically synthesized
cctcggctctatgcattagggc

SEQ ID NO: 640417 - DNA, 22 bp, Artificial Sequence
  chemically synthesized
tatgcagctatggccctaatgc

SEQ ID NO: 640418 - DNA, 22 bp, Artificial Sequence
  chemically synthesized
atatgcagctatggccctaatg

SEQ ID NO: 640419 - DNA, 22 bp, Artificial Sequence
  chemically synthesized
ggctctatgcattagggccata

SEQ ID NO: 640420 - DNA, 22 bp, Artificial Sequence
  chemically synthesized
cagcttatatgcagctatggcc

SEQ ID NO: 640421 - DNA, 22 bp, Artificial Sequence
  chemically synthesized
tatgcattagggccatagctgc

SEQ ID NO: 640422 - DNA, 22 bp, Artificial Sequence
  chemically synthesized
tgcattagggccatagctgcat

SEQ ID NO: 640423 - DNA, 22 bp, Artificial Sequence
  chemically synthesized
caagggtctacagcttatatgc

SEQ ID NO: 640424 - DNA, 22 bp, Artificial Sequence
  chemically synthesized
gggccatagctgcatataagct

SEQ ID NO: 640425 - DNA, 22 bp, Artificial Sequence
  chemically synthesized
ctgcaagggtctacagcttata

SEQ ID NO: 640426 - DNA, 22 bp, Artificial Sequence
  chemically synthesized
gctgcaagggtctacagcttat

SEQ ID NO: 640427 - DNA, 22 bp, Artificial Sequence
  chemically synthesized
catataagctgtagacccttgc

SEQ ID NO: 640428 - DNA, 22 bp, Artificial Sequence
  chemically synthesized
tagacccttgcagcaaactgtt

SEQ ID NO: 640429 - DNA, 22 bp, Artificial Sequence
  chemically synthesized
aaagcaacatgaaaagaaacag

SEQ ID NO: 640430 - DNA, 22 bp, Artificial Sequence
  chemically synthesized
aaaagcaacatgaaaagaaaca

SEQ ID NO: 640431 - DNA, 22 bp, Artificial Sequence
  chemically synthesized
gcagcaaactgtttcttttcat

SEQ ID NO: 640432 - DNA, 22 bp, Artificial Sequence
  chemically synthesized
cagcaaactgtttcttttcatg

SEQ ID NO: 640433 - DNA, 22 bp, Artificial Sequence
  chemically synthesized
cacttaaaagcaacatgaaaag

SEQ ID NO: 640434 - DNA, 22 bp, Artificial Sequence
  chemically synthesized
acacttaaaagcaacatgaaaa

SEQ ID NO: 640435 - DNA, 22 bp, Artificial Sequence
  chemically synthesized
tttcttttcatgttgcttttaa

SEQ ID NO: 640436 - DNA, 22 bp, Artificial Sequence
  chemically synthesized
cttttcatgttgcttttaagtg

SEQ ID NO: 640437 - DNA, 22 bp, Artificial Sequence
  chemically synthesized
ttttcatgttgcttttaagtgt

SEQ ID NO: 640438 - DNA, 22 bp, Artificial Sequence
  chemically synthesized
ttcatgttgcttttaagtgtaa

SEQ ID NO: 640439 - DNA, 22 bp, Artificial Sequence
  chemically synthesized
tcatgttgcttttaagtgtaag

SEQ ID NO: 640440 - DNA, 22 bp, Artificial Sequence
  chemically synthesized
catgttgcttttaagtgtaagt

SEQ ID NO: 640441 - DNA, 22 bp, Artificial Sequence
  chemically synthesized
atgttgcttttaagtgtaagtg

SEQ ID NO: 640442 - DNA, 22 bp, Artificial Sequence
  chemically synthesized
gagagagacacatacacactta

SEQ ID NO: 640443 - DNA, 22 bp, Artificial Sequence
  chemically synthesized
cttttaagtgtaagtgtgtatg

SEQ ID NO: 640444 - DNA, 22 bp, Artificial Sequence
  chemically synthesized
ttaagtgtaagtgtgtatgtgt

SEQ ID NO: 640445 - DNA, 22 bp, Artificial Sequence
  chemically synthesized
taagtgtaagtgtgtatgtgtc

SEQ ID NO: 640446 - DNA, 22 bp, Artificial Sequence
  chemically synthesized
aagtgtaagtgtgtatgtgtct

SEQ ID NO: 640447 - DNA, 22 bp, Artificial Sequence
  chemically synthesized
agtgtaagtgtgtatgtgtctc

SEQ ID NO: 640448 - DNA, 22 bp, Artificial Sequence
  chemically synthesized
aaatcagagccccacaaaaaca

SEQ ID NO: 640449 - DNA, 22 bp, Artificial Sequence
  chemically synthesized
gaaatcagagccccacaaaaac

SEQ ID NO: 640450 - DNA, 22 bp, Artificial Sequence
  chemically synthesized
tctctaggtgtgtttttgtggg

SEQ ID NO: 640451 - DNA, 22 bp, Artificial Sequence
  chemically synthesized
tctaggtgtgtttttgtggggc

SEQ ID NO: 640452 - DNA, 22 bp, Artificial Sequence
  chemically synthesized
tttgaaatcagagccccacaaa

SEQ ID NO: 640453 - DNA, 22 bp, Artificial Sequence
  chemically synthesized
taggtgtgtttttgtggggctc

SEQ ID NO: 640454 - DNA, 22 bp, Artificial Sequence
  chemically synthesized
ctatttgaaatcagagccccac

SEQ ID NO: 640455 - DNA, 22 bp, Artificial Sequence
  chemically synthesized
ggtgtgtttttgtggggctctg

SEQ ID NO: 640456 - DNA, 22 bp, Artificial Sequence
  chemically synthesized
ttgtggggctctgatttcaaat

SEQ ID NO: 640457 - DNA, 22 bp, Artificial Sequence
  chemically synthesized
tgtggggctctgatttcaaata

SEQ ID NO: 640458 - DNA, 22 bp, Artificial Sequence
  chemically synthesized
gtggggctctgatttcaaatag

SEQ ID NO: 640459 - DNA, 22 bp, Artificial Sequence
  chemically synthesized
tggggctctgatttcaaatagt

SEQ ID NO: 640460 - DNA, 22 bp, Artificial Sequence
  chemically synthesized
tgatttcaaatagtaatcctgg

SEQ ID NO: 640461 - DNA, 22 bp, Artificial Sequence
  chemically synthesized
atttcaaatagtaatcctggct

SEQ ID NO: 640462 - DNA, 22 bp, Artificial Sequence
  chemically synthesized
caaatagtaatcctggctttgg

SEQ ID NO: 640463 - DNA, 22 bp, Artificial Sequence
  chemically synthesized
caaggtagtggcccaaagccag

SEQ ID NO: 640464 - DNA, 22 bp, Artificial Sequence
  chemically synthesized
aaatagtaatcctggctttggg

SEQ ID NO: 640465 - DNA, 22 bp, Artificial Sequence
  chemically synthesized
acaaggtagtggcccaaagcca

SEQ ID NO: 640466 - DNA, 22 bp, Artificial Sequence
  chemically synthesized
cttacaaggtagtggcccaaag

SEQ ID NO: 640467 - DNA, 22 bp, Artificial Sequence
  chemically synthesized
tccttacaaggtagtggcccaa

SEQ ID NO: 640468 - DNA, 22 bp, Artificial Sequence
  chemically synthesized
aaattctccttacaaggtagtg

SEQ ID NO: 640469 - DNA, 22 bp, Artificial Sequence
  chemically synthesized
gctttgggccactaccttgtaa

SEQ ID NO: 640470 - DNA, 22 bp, Artificial Sequence
  chemically synthesized
tgggccactaccttgtaaggag

SEQ ID NO: 640471 - DNA, 22 bp, Artificial Sequence
  chemically synthesized
gggccactaccttgtaaggaga

SEQ ID NO: 640472 - DNA, 22 bp, Artificial Sequence
  chemically synthesized
ggccactaccttgtaaggagaa

SEQ ID NO: 640473 - DNA, 22 bp, Artificial Sequence
  chemically synthesized
tagtaacagggattaaaattct

SEQ ID NO: 640474 - DNA, 22 bp, Artificial Sequence
  chemically synthesized
ccttgtaaggagaattttaatc

SEQ ID NO: 640475 - DNA, 22 bp, Artificial Sequence
  chemically synthesized
gtaaggagaattttaatccctg

SEQ ID NO: 640476 - DNA, 22 bp, Artificial Sequence
  chemically synthesized
gtgctgtagtaacagggattaa

SEQ ID NO: 640477 - DNA, 22 bp, Artificial Sequence
  chemically synthesized
taaggagaattttaatccctgt

SEQ ID NO: 640478 - DNA, 22 bp, Artificial Sequence
  chemically synthesized
agctcgtgctgtagtaacaggg

SEQ ID NO: 640479 - DNA, 22 bp, Artificial Sequence
  chemically synthesized
cagctcgtgctgtagtaacagg

SEQ ID NO: 640480 - DNA, 22 bp, Artificial Sequence
  chemically synthesized
tcagctcgtgctgtagtaacag

SEQ ID NO: 640481 - DNA, 22 bp, Artificial Sequence
  chemically synthesized
taatccctgttactacagcacg

SEQ ID NO: 640482 - DNA, 22 bp, Artificial Sequence
  chemically synthesized
aatccctgttactacagcacga

SEQ ID NO: 640483 - DNA, 22 bp, Artificial Sequence
  chemically synthesized
atccctgttactacagcacgag

SEQ ID NO: 640484 - DNA, 22 bp, Artificial Sequence
  chemically synthesized
gtgggctttcagctcgtgctgt

SEQ ID NO: 640485 - DNA, 22 bp, Artificial Sequence
  chemically synthesized
aattagtgggctttcagctcgt

SEQ ID NO: 640486 - DNA, 22 bp, Artificial Sequence
  chemically synthesized
ttactacagcacgagctgaaag

SEQ ID NO: 640487 - DNA, 22 bp, Artificial Sequence
  chemically synthesized
ctacagcacgagctgaaagccc

SEQ ID NO: 640488 - DNA, 22 bp, Artificial Sequence
  chemically synthesized
cagcacgagctgaaagcccact

SEQ ID NO: 640489 - DNA, 22 bp, Artificial Sequence
  chemically synthesized
aaagcccactaatttagcccca

SEQ ID NO: 640490 - DNA, 22 bp, Artificial Sequence
  chemically synthesized
atttagccccacttactttttt

SEQ ID NO: 640491 - DNA, 22 bp, Artificial Sequence
  chemically synthesized
agccccacttactttttttttt

SEQ ID NO: 640492 - DNA, 22 bp, Artificial Sequence
  chemically synthesized
gccccacttacttttttttttt

SEQ ID NO: 640493 - DNA, 22 bp, Artificial Sequence
  chemically synthesized
tgaaccagaaatgtgaaagaaa

SEQ ID NO: 640494 - DNA, 22 bp, Artificial Sequence
  chemically synthesized
acttttttttttttctttcaca

SEQ ID NO: 640495 - DNA, 22 bp, Artificial Sequence
  chemically synthesized
cttttttttttttctttcacat

SEQ ID NO: 640496 - DNA, 22 bp, Artificial Sequence
  chemically synthesized
tgtgaaccagaaatgtgaaaga

SEQ ID NO: 640497 - DNA, 22 bp, Artificial Sequence
  chemically synthesized
ttttttttttctttcacatttc

SEQ ID NO: 640498 - DNA, 22 bp, Artificial Sequence
  chemically synthesized
tttttttttctttcacatttct

SEQ ID NO: 640499 - DNA, 22 bp, Artificial Sequence
  chemically synthesized
ttttttttctttcacatttctg

SEQ ID NO: 640500 - DNA, 22 bp, Artificial Sequence
  chemically synthesized
tttttttctttcacatttctgg

SEQ ID NO: 640501 - DNA, 22 bp, Artificial Sequence
  chemically synthesized
ttttttctttcacatttctggt

SEQ ID NO: 640502 - DNA, 22 bp, Artificial Sequence
  chemically synthesized
tttttctttcacatttctggtt

SEQ ID NO: 640503 - DNA, 22 bp, Artificial Sequence
  chemically synthesized
ttttctttcacatttctggttc

SEQ ID NO: 640504 - DNA, 22 bp, Artificial Sequence
  chemically synthesized
tttctttcacatttctggttca

SEQ ID NO: 640505 - DNA, 22 bp, Artificial Sequence
  chemically synthesized
ttctttcacatttctggttcac

SEQ ID NO: 640506 - DNA, 22 bp, Artificial Sequence
  chemically synthesized
tctttcacatttctggttcaca

SEQ ID NO: 640507 - DNA, 22 bp, Artificial Sequence
  chemically synthesized
ctttcacatttctggttcacag

SEQ ID NO: 640508 - DNA, 22 bp, Artificial Sequence
  chemically synthesized
tttcacatttctggttcacaga

SEQ ID NO: 640509 - DNA, 22 bp, Artificial Sequence
  chemically synthesized
tcacatttctggttcacagaga

SEQ ID NO: 640510 - DNA, 22 bp, Artificial Sequence
  chemically synthesized
cacatttctggttcacagagat

SEQ ID NO: 640511 - DNA, 22 bp, Artificial Sequence
  chemically synthesized
acatttctggttcacagagatg

SEQ ID NO: 640512 - DNA, 22 bp, Artificial Sequence
  chemically synthesized
aagcaagatgaacatctctgtg

SEQ ID NO: 640513 - DNA, 22 bp, Artificial Sequence
  chemically synthesized
aaagcaagatgaacatctctgt

SEQ ID NO: 640514 - DNA, 22 bp, Artificial Sequence
  chemically synthesized
taaagcaagatgaacatctctg

SEQ ID NO: 640515 - DNA, 22 bp, Artificial Sequence
  chemically synthesized
ctggttcacagagatgttcatc

SEQ ID NO: 640516 - DNA, 22 bp, Artificial Sequence
  chemically synthesized
tggttcacagagatgttcatct

SEQ ID NO: 640517 - DNA, 22 bp, Artificial Sequence
  chemically synthesized
ggctttaaagcaagatgaacat

SEQ ID NO: 640518 - DNA, 22 bp, Artificial Sequence
  chemically synthesized
gttcacagagatgttcatcttg

SEQ ID NO: 640519 - DNA, 22 bp, Artificial Sequence
  chemically synthesized
acagagatgttcatcttgcttt

SEQ ID NO: 640520 - DNA, 22 bp, Artificial Sequence
  chemically synthesized
atcttgctttaaagcccagcta

SEQ ID NO: 640521 - DNA, 22 bp, Artificial Sequence
  chemically synthesized
gctttaaagcccagctatgtct

SEQ ID NO: 640522 - DNA, 22 bp, Artificial Sequence
  chemically synthesized
ctttaaagcccagctatgtctt

SEQ ID NO: 640523 - DNA, 22 bp, Artificial Sequence
  chemically synthesized
taaagcccagctatgtcttttt

SEQ ID NO: 640524 - DNA, 22 bp, Artificial Sequence
  chemically synthesized
aaagcccagctatgtctttttc

SEQ ID NO: 640525 - DNA, 22 bp, Artificial Sequence
  chemically synthesized
aagcccagctatgtctttttca

SEQ ID NO: 640526 - DNA, 22 bp, Artificial Sequence
  chemically synthesized
tgtctttttcatttttcactcc

SEQ ID NO: 640527 - DNA, 22 bp, Artificial Sequence
  chemically synthesized
tttcatttttcactccatatat

SEQ ID NO: 640528 - DNA, 22 bp, Artificial Sequence
  chemically synthesized
ttcatttttcactccatatatt

SEQ ID NO: 640529 - DNA, 22 bp, Artificial Sequence
  chemically synthesized
tcatttttcactccatatatta

SEQ ID NO: 640530 - DNA, 22 bp, Artificial Sequence
  chemically synthesized
tccagtggtagataatatatgg

SEQ ID NO: 640531 - DNA, 22 bp, Artificial Sequence
  chemically synthesized
catttttcactccatatattat

SEQ ID NO: 640532 - DNA, 22 bp, Artificial Sequence
  chemically synthesized
atccagtggtagataatatatg

SEQ ID NO: 640533 - DNA, 22 bp, Artificial Sequence
  chemically synthesized
atttttcactccatatattatc

SEQ ID NO: 640534 - DNA, 22 bp, Artificial Sequence
  chemically synthesized
ttcactccatatattatctacc

SEQ ID NO: 640535 - DNA, 22 bp, Artificial Sequence
  chemically synthesized
tcactccatatattatctacca

SEQ ID NO: 640536 - DNA, 22 bp, Artificial Sequence
  chemically synthesized
ccatttatccagtggtagataa

SEQ ID NO: 640537 - DNA, 22 bp, Artificial Sequence
  chemically synthesized
cactccatatattatctaccac

SEQ ID NO: 640538 - DNA, 22 bp, Artificial Sequence
  chemically synthesized
actccatatattatctaccact

SEQ ID NO: 640539 - DNA, 22 bp, Artificial Sequence
  chemically synthesized
ctaccatttatccagtggtaga

SEQ ID NO: 640540 - DNA, 22 bp, Artificial Sequence
  chemically synthesized
catatattatctaccactggat

SEQ ID NO: 640541 - DNA, 22 bp, Artificial Sequence
  chemically synthesized
ctcctaccatttatccagtggt

SEQ ID NO: 640542 - DNA, 22 bp, Artificial Sequence
  chemically synthesized
tgctcctaccatttatccagtg

SEQ ID NO: 640543 - DNA, 22 bp, Artificial Sequence
  chemically synthesized
tctgctcctaccatttatccag

SEQ ID NO: 640544 - DNA, 22 bp, Artificial Sequence
  chemically synthesized
ctctgctcctaccatttatcca

SEQ ID NO: 640545 - DNA, 22 bp, Artificial Sequence
  chemically synthesized
tctctgctcctaccatttatcc

SEQ ID NO: 640546 - DNA, 22 bp, Artificial Sequence
  chemically synthesized
tctaccactggataaatggtag

SEQ ID NO: 640547 - DNA, 22 bp, Artificial Sequence
  chemically synthesized
ccactggataaatggtaggagc

SEQ ID NO: 640548 - DNA, 22 bp, Artificial Sequence
  chemically synthesized
aaggcatctttctctgctccta

SEQ ID NO: 640549 - DNA, 22 bp, Artificial Sequence
  chemically synthesized
gaaggcatctttctctgctcct

SEQ ID NO: 640550 - DNA, 22 bp, Artificial Sequence
  chemically synthesized
gataaatggtaggagcagagaa

SEQ ID NO: 640551 - DNA, 22 bp, Artificial Sequence
  chemically synthesized
cttgaaggcatctttctctgct

SEQ ID NO: 640552 - DNA, 22 bp, Artificial Sequence
  chemically synthesized
gcttgaaggcatctttctctgc

SEQ ID NO: 640553 - DNA, 22 bp, Artificial Sequence
  chemically synthesized
ttgcttgaaggcatctttctct

SEQ ID NO: 640554 - DNA, 22 bp, Artificial Sequence
  chemically synthesized
gctcttgcttgaaggcatcttt

SEQ ID NO: 640555 - DNA, 22 bp, Artificial Sequence
  chemically synthesized
agataacattagctcttgcttg

SEQ ID NO: 640556 - DNA, 22 bp, Artificial Sequence
  chemically synthesized
attaagataacattagctcttg

SEQ ID NO: 640557 - DNA, 22 bp, Artificial Sequence
  chemically synthesized
tgattaagataacattagctct

SEQ ID NO: 640558 - DNA, 22 bp, Artificial Sequence
  chemically synthesized
ctgattaagataacattagctc

SEQ ID NO: 640559 - DNA, 22 bp, Artificial Sequence
  chemically synthesized
caagcaagagctaatgttatct

SEQ ID NO: 640560 - DNA, 22 bp, Artificial Sequence
  chemically synthesized
aagcaagagctaatgttatctt

SEQ ID NO: 640561 - DNA, 22 bp, Artificial Sequence
  chemically synthesized
gtaggcttctgattaagataac

SEQ ID NO: 640562 - DNA, 22 bp, Artificial Sequence
  chemically synthesized
atgttatcttaatcagaagcct

SEQ ID NO: 640563 - DNA, 22 bp, Artificial Sequence
  chemically synthesized
tcttaatcagaagcctaccagg

SEQ ID NO: 640564 - DNA, 22 bp, Artificial Sequence
  chemically synthesized
caaaatcaatgtgtcctggtag

SEQ ID NO: 640565 - DNA, 22 bp, Artificial Sequence
  chemically synthesized
aatcagaagcctaccaggacac

SEQ ID NO: 640566 - DNA, 22 bp, Artificial Sequence
  chemically synthesized
atcagaagcctaccaggacaca

SEQ ID NO: 640567 - DNA, 22 bp, Artificial Sequence
  chemically synthesized
tacatctacaaaatcaatgtgt

SEQ ID NO: 640568 - DNA, 22 bp, Artificial Sequence
  chemically synthesized
actatacatctacaaaatcaat

SEQ ID NO: 640569 - DNA, 22 bp, Artificial Sequence
  chemically synthesized
gactatacatctacaaaatcaa

SEQ ID NO: 640570 - DNA, 22 bp, Artificial Sequence
  chemically synthesized
ccaggacacattgattttgtag

SEQ ID NO: 640571 - DNA, 22 bp, Artificial Sequence
  chemically synthesized
agggaaccttgactatacatct

SEQ ID NO: 640572 - DNA, 22 bp, Artificial Sequence
  chemically synthesized
attttgtagatgtatagtcaag

SEQ ID NO: 640573 - DNA, 22 bp, Artificial Sequence
  chemically synthesized
atactgagggaaccttgactat

SEQ ID NO: 640574 - DNA, 22 bp, Artificial Sequence
  chemically synthesized
tgtagatgtatagtcaaggttc

SEQ ID NO: 640575 - DNA, 22 bp, Artificial Sequence
  chemically synthesized
gtagatgtatagtcaaggttcc

SEQ ID NO: 640576 - DNA, 22 bp, Artificial Sequence
  chemically synthesized
tagatgtatagtcaaggttccc

SEQ ID NO: 640577 - DNA, 22 bp, Artificial Sequence
  chemically synthesized
aattaatactgagggaaccttg

SEQ ID NO: 640578 - DNA, 22 bp, Artificial Sequence
  chemically synthesized
gaattaatactgagggaacctt

SEQ ID NO: 640579 - DNA, 22 bp, Artificial Sequence
  chemically synthesized
aggcttgaattaatactgaggg

SEQ ID NO: 640580 - DNA, 22 bp, Artificial Sequence
  chemically synthesized
atgaattaaggcttgaattaat

SEQ ID NO: 640581 - DNA, 22 bp, Artificial Sequence
  chemically synthesized
cctcagtattaattcaagcctt

SEQ ID NO: 640582 - DNA, 22 bp, Artificial Sequence
  chemically synthesized
gcctgatgaattaaggcttgaa

SEQ ID NO: 640583 - DNA, 22 bp, Artificial Sequence
  chemically synthesized
agtattaattcaagccttaatt

SEQ ID NO: 640584 - DNA, 22 bp, Artificial Sequence
  chemically synthesized
atcctggcctgatgaattaagg

SEQ ID NO: 640585 - DNA, 22 bp, Artificial Sequence
  chemically synthesized
aatcctggcctgatgaattaag

SEQ ID NO: 640586 - DNA, 22 bp, Artificial Sequence
  chemically synthesized
attcaagccttaattcatcagg

SEQ ID NO: 640587 - DNA, 22 bp, Artificial Sequence
  chemically synthesized
atttaatcctggcctgatgaat

SEQ ID NO: 640588 - DNA, 22 bp, Artificial Sequence
  chemically synthesized
aagccttaattcatcaggccag

SEQ ID NO: 640589 - DNA, 22 bp, Artificial Sequence
  chemically synthesized
gactcatttaatcctggcctga

SEQ ID NO: 640590 - DNA, 22 bp, Artificial Sequence
  chemically synthesized
ttcgactcatttaatcctggcc

SEQ ID NO: 640591 - DNA, 22 bp, Artificial Sequence
  chemically synthesized
gttcgactcatttaatcctggc

SEQ ID NO: 640592 - DNA, 22 bp, Artificial Sequence
  chemically synthesized
aattcatcaggccaggattaaa

SEQ ID NO: 640593 - DNA, 22 bp, Artificial Sequence
  chemically synthesized
attcatcaggccaggattaaat

SEQ ID NO: 640594 - DNA, 22 bp, Artificial Sequence
  chemically synthesized
atcaggccaggattaaatgagt

SEQ ID NO: 640595 - DNA, 22 bp, Artificial Sequence
  chemically synthesized
gaagaaaagcacttgttcgact

SEQ ID NO: 640596 - DNA, 22 bp, Artificial Sequence
  chemically synthesized
agaagaaaagcacttgttcgac

SEQ ID NO: 640597 - DNA, 22 bp, Artificial Sequence
  chemically synthesized
tttagaagaaaagcacttgttc

SEQ ID NO: 640598 - DNA, 22 bp, Artificial Sequence
  chemically synthesized
gtttagaagaaaagcacttgtt

SEQ ID NO: 640599 - DNA, 22 bp, Artificial Sequence
  chemically synthesized
aatgagtcgaacaagtgctttt

SEQ ID NO: 640600 - DNA, 22 bp, Artificial Sequence
  chemically synthesized
tatgtcatatgtttgtttagaa

SEQ ID NO: 640601 - DNA, 22 bp, Artificial Sequence
  chemically synthesized
tgtatgtcatatgtttgtttag

SEQ ID NO: 640602 - DNA, 22 bp, Artificial Sequence
  chemically synthesized
ctgtatgtcatatgtttgttta

SEQ ID NO: 640603 - DNA, 22 bp, Artificial Sequence
  chemically synthesized
ttcttctaaacaaacatatgac

SEQ ID NO: 640604 - DNA, 22 bp, Artificial Sequence
  chemically synthesized
tcttctaaacaaacatatgaca

SEQ ID NO: 640605 - DNA, 22 bp, Artificial Sequence
  chemically synthesized
cttctaaacaaacatatgacat

SEQ ID NO: 640606 - DNA, 22 bp, Artificial Sequence
  chemically synthesized
ttctaaacaaacatatgacata

SEQ ID NO: 640607 - DNA, 22 bp, Artificial Sequence
  chemically synthesized
ctaaacaaacatatgacataca

SEQ ID NO: 640608 - DNA, 22 bp, Artificial Sequence
  chemically synthesized
ataagaggtttctgtatgtcat

SEQ ID NO: 640609 - DNA, 22 bp, Artificial Sequence
  chemically synthesized
taaacaaacatatgacatacag

SEQ ID NO: 640610 - DNA, 22 bp, Artificial Sequence
  chemically synthesized
aataagaggtttctgtatgtca

SEQ ID NO: 640611 - DNA, 22 bp, Artificial Sequence
  chemically synthesized
aacaaacatatgacatacagaa

SEQ ID NO: 640612 - DNA, 22 bp, Artificial Sequence
  chemically synthesized
agcttaataagaggtttctgta

SEQ ID NO: 640613 - DNA, 22 bp, Artificial Sequence
  chemically synthesized
ttgagcttaataagaggtttct

SEQ ID NO: 640614 - DNA, 22 bp, Artificial Sequence
  chemically synthesized
ctattgagcttaataagaggtt

SEQ ID NO: 640615 - DNA, 22 bp, Artificial Sequence
  chemically synthesized
gctattgagcttaataagaggt

SEQ ID NO: 640616 - DNA, 22 bp, Artificial Sequence
  chemically synthesized
aaaatcaagtttgctattgagc

SEQ ID NO: 640617 - DNA, 22 bp, Artificial Sequence
  chemically synthesized
ttattaagctcaatagcaaact

SEQ ID NO: 640618 - DNA, 22 bp, Artificial Sequence
  chemically synthesized
attaagctcaatagcaaacttg

SEQ ID NO: 640619 - DNA, 22 bp, Artificial Sequence
  chemically synthesized
gtccctcaaaatcaagtttgct

SEQ ID NO: 640620 - DNA, 22 bp, Artificial Sequence
  chemically synthesized
ttaagctcaatagcaaacttga

SEQ ID NO: 640621 - DNA, 22 bp, Artificial Sequence
  chemically synthesized
agctcaatagcaaacttgattt

SEQ ID NO: 640622 - DNA, 22 bp, Artificial Sequence
  chemically synthesized
aatagcaaacttgattttgagg

SEQ ID NO: 640623 - DNA, 22 bp, Artificial Sequence
  chemically synthesized
aggaggaaaaactagtccctca

SEQ ID NO: 640624 - DNA, 22 bp, Artificial Sequence
  chemically synthesized
caggaggaaaaactagtccctc

SEQ ID NO: 640625 - DNA, 22 bp, Artificial Sequence
  chemically synthesized
gattttgagggactagtttttc

SEQ ID NO: 640626 - DNA, 22 bp, Artificial Sequence
  chemically synthesized
attttgagggactagtttttcc

SEQ ID NO: 640627 - DNA, 22 bp, Artificial Sequence
  chemically synthesized
agagcttcaggaggaaaaacta

SEQ ID NO: 640628 - DNA, 22 bp, Artificial Sequence
  chemically synthesized
tgagggactagtttttcctcct

SEQ ID NO: 640629 - DNA, 22 bp, Artificial Sequence
  chemically synthesized
tctcagagcttcaggaggaaaa

SEQ ID NO: 640630 - DNA, 22 bp, Artificial Sequence
  chemically synthesized
gagggactagtttttcctcctg

SEQ ID NO: 640631 - DNA, 22 bp, Artificial Sequence
  chemically synthesized
agggactagtttttcctcctga

SEQ ID NO: 640632 - DNA, 22 bp, Artificial Sequence
  chemically synthesized
tcctatctcagagcttcaggag

SEQ ID NO: 640633 - DNA, 22 bp, Artificial Sequence
  chemically synthesized
gtcctatctcagagcttcagga

SEQ ID NO: 640634 - DNA, 22 bp, Artificial Sequence
  chemically synthesized
gtttttcctcctgaagctctga

SEQ ID NO: 640635 - DNA, 22 bp, Artificial Sequence
  chemically synthesized
ttcctcctgaagctctgagata

SEQ ID NO: 640636 - DNA, 22 bp, Artificial Sequence
  chemically synthesized
tcctcctgaagctctgagatag

SEQ ID NO: 640637 - DNA, 22 bp, Artificial Sequence
  chemically synthesized
cctcctgaagctctgagatagg

SEQ ID NO: 640638 - DNA, 22 bp, Artificial Sequence
  chemically synthesized
ctcctgaagctctgagatagga

SEQ ID NO: 640639 - DNA, 22 bp, Artificial Sequence
  chemically synthesized
tcatgacagcttgtcctatctc

SEQ ID NO: 640640 - DNA, 22 bp, Artificial Sequence
  chemically synthesized
atcatgacagcttgtcctatct

SEQ ID NO: 640641 - DNA, 22 bp, Artificial Sequence
  chemically synthesized
ctgaagctctgagataggacaa

SEQ ID NO: 640642 - DNA, 22 bp, Artificial Sequence
  chemically synthesized
aagctctgagataggacaagct

SEQ ID NO: 640643 - DNA, 22 bp, Artificial Sequence
  chemically synthesized
gaatccttatcatgacagcttg

SEQ ID NO: 640644 - DNA, 22 bp, Artificial Sequence
  chemically synthesized
agaatccttatcatgacagctt

SEQ ID NO: 640645 - DNA, 22 bp, Artificial Sequence
  chemically synthesized
tgagataggacaagctgtcatg

SEQ ID NO: 640646 - DNA, 22 bp, Artificial Sequence
  chemically synthesized
tagaatccttatcatgacagct

SEQ ID NO: 640647 - DNA, 22 bp, Artificial Sequence
  chemically synthesized
ttagaatccttatcatgacagc

SEQ ID NO: 640648 - DNA, 22 bp, Artificial Sequence
  chemically synthesized
agataggacaagctgtcatgat

SEQ ID NO: 640649 - DNA, 22 bp, Artificial Sequence
  chemically synthesized
gcttttagaatccttatcatga

SEQ ID NO: 640650 - DNA, 22 bp, Artificial Sequence
  chemically synthesized
tggcttttagaatccttatcat

SEQ ID NO: 640651 - DNA, 22 bp, Artificial Sequence
  chemically synthesized
ctggcttttagaatccttatca

SEQ ID NO: 640652 - DNA, 22 bp, Artificial Sequence
  chemically synthesized
accatttctggcttttagaatc

SEQ ID NO: 640653 - DNA, 22 bp, Artificial Sequence
  chemically synthesized
aaccatttctggcttttagaat

SEQ ID NO: 640654 - DNA, 22 bp, Artificial Sequence
  chemically synthesized
tcatgataaggattctaaaagc

SEQ ID NO: 640655 - DNA, 22 bp, Artificial Sequence
  chemically synthesized
taaccatttctggcttttagaa

SEQ ID NO: 640656 - DNA, 22 bp, Artificial Sequence
  chemically synthesized
ttaaccatttctggcttttaga

SEQ ID NO: 640657 - DNA, 22 bp, Artificial Sequence
  chemically synthesized
ttttaaccatttctggctttta

SEQ ID NO: 640658 - DNA, 22 bp, Artificial Sequence
  chemically synthesized
taaaagccagaaatggttaaaa

SEQ ID NO: 640659 - DNA, 22 bp, Artificial Sequence
  chemically synthesized
aaagccagaaatggttaaaaga

SEQ ID NO: 640660 - DNA, 22 bp, Artificial Sequence
  chemically synthesized
caggccaagatacctcttttaa

SEQ ID NO: 640661 - DNA, 22 bp, Artificial Sequence
  chemically synthesized
gttgcaggccaagatacctctt

SEQ ID NO: 640662 - DNA, 22 bp, Artificial Sequence
  chemically synthesized
ggttgcaggccaagatacctct

SEQ ID NO: 640663 - DNA, 22 bp, Artificial Sequence
  chemically synthesized
atttggttgcaggccaagatac

SEQ ID NO: 640664 - DNA, 22 bp, Artificial Sequence
  chemically synthesized
catttggttgcaggccaagata

SEQ ID NO: 640665 - DNA, 22 bp, Artificial Sequence
  chemically synthesized
tttcatttggttgcaggccaag

SEQ ID NO: 640666 - DNA, 22 bp, Artificial Sequence
  chemically synthesized
atttcatttggttgcaggccaa

SEQ ID NO: 640667 - DNA, 22 bp, Artificial Sequence
  chemically synthesized
aaagaggtatcttggcctgcaa

SEQ ID NO: 640668 - DNA, 22 bp, Artificial Sequence
  chemically synthesized
ggcctgcaaccaaatgaaataa

SEQ ID NO: 640669 - DNA, 22 bp, Artificial Sequence
  chemically synthesized
gcctgcaaccaaatgaaataag

SEQ ID NO: 640670 - DNA, 22 bp, Artificial Sequence
  chemically synthesized
aaatcaaaaaaccttatttcat

SEQ ID NO: 640671 - DNA, 22 bp, Artificial Sequence
  chemically synthesized
caaccaaatgaaataaggtttt

SEQ ID NO: 640672 - DNA, 22 bp, Artificial Sequence
  chemically synthesized
agactcaaatcaaaaaacctta

SEQ ID NO: 640673 - DNA, 22 bp, Artificial Sequence
  chemically synthesized
aaagagaattcagactcaaatc

SEQ ID NO: 640674 - DNA, 22 bp, Artificial Sequence
  chemically synthesized
aaaagagaattcagactcaaat

SEQ ID NO: 640675 - DNA, 22 bp, Artificial Sequence
  chemically synthesized
tttgatttgagtctgaattctc

SEQ ID NO: 640676 - DNA, 22 bp, Artificial Sequence
  chemically synthesized
ttgatttgagtctgaattctct

SEQ ID NO: 640677 - DNA, 22 bp, Artificial Sequence
  chemically synthesized
tgatttgagtctgaattctctt

SEQ ID NO: 640678 - DNA, 22 bp, Artificial Sequence
  chemically synthesized
gaaataccttaaaagagaattc

SEQ ID NO: 640679 - DNA, 22 bp, Artificial Sequence
  chemically synthesized
gatttgagtctgaattctcttt

SEQ ID NO: 640680 - DNA, 22 bp, Artificial Sequence
  chemically synthesized
agaaataccttaaaagagaatt

SEQ ID NO: 640681 - DNA, 22 bp, Artificial Sequence
  chemically synthesized
atttgagtctgaattctctttt

SEQ ID NO: 640682 - DNA, 22 bp, Artificial Sequence
  chemically synthesized
gagtctgaattctcttttaagg

SEQ ID NO: 640683 - DNA, 22 bp, Artificial Sequence
  chemically synthesized
agtctgaattctcttttaaggt

SEQ ID NO: 640684 - DNA, 22 bp, Artificial Sequence
  chemically synthesized
atgaacatttagaaatacctta

SEQ ID NO: 640685 - DNA, 22 bp, Artificial Sequence
  chemically synthesized
aattctcttttaaggtatttct

SEQ ID NO: 640686 - DNA, 22 bp, Artificial Sequence
  chemically synthesized
tcatgaacatttagaaatacct

SEQ ID NO: 640687 - DNA, 22 bp, Artificial Sequence
  chemically synthesized
tcttttaaggtatttctaaatg

SEQ ID NO: 640688 - DNA, 22 bp, Artificial Sequence
  chemically synthesized
ttttaaggtatttctaaatgtt

SEQ ID NO: 640689 - DNA, 22 bp, Artificial Sequence
  chemically synthesized
ataattctcatgaacatttaga

SEQ ID NO: 640690 - DNA, 22 bp, Artificial Sequence
  chemically synthesized
gataattctcatgaacatttag

SEQ ID NO: 640691 - DNA, 22 bp, Artificial Sequence
  chemically synthesized
ttaaggtatttctaaatgttca

SEQ ID NO: 640692 - DNA, 22 bp, Artificial Sequence
  chemically synthesized
taaggtatttctaaatgttcat

SEQ ID NO: 640693 - DNA, 22 bp, Artificial Sequence
  chemically synthesized
ttgataattctcatgaacattt

SEQ ID NO: 640694 - DNA, 22 bp, Artificial Sequence
  chemically synthesized
aaggtatttctaaatgttcatg

SEQ ID NO: 640695 - DNA, 22 bp, Artificial Sequence
  chemically synthesized
cttgataattctcatgaacatt

SEQ ID NO: 640696 - DNA, 22 bp, Artificial Sequence
  chemically synthesized
aggtatttctaaatgttcatga

SEQ ID NO: 640697 - DNA, 22 bp, Artificial Sequence
  chemically synthesized
ttcttgataattctcatgaaca

SEQ ID NO: 640698 - DNA, 22 bp, Artificial Sequence
  chemically synthesized
ctaaatgttcatgagaattatc

SEQ ID NO: 640699 - DNA, 22 bp, Artificial Sequence
  chemically synthesized
taaatgttcatgagaattatca

SEQ ID NO: 640700 - DNA, 22 bp, Artificial Sequence
  chemically synthesized
aatgttcatgagaattatcaag

SEQ ID NO: 640701 - DNA, 22 bp, Artificial Sequence
  chemically synthesized
cagcatcagttcttcttgataa

SEQ ID NO: 640702 - DNA, 22 bp, Artificial Sequence
  chemically synthesized
atgagaattatcaagaagaact

SEQ ID NO: 640703 - DNA, 22 bp, Artificial Sequence
  chemically synthesized
aaaccctccagcatcagttctt

SEQ ID NO: 640704 - DNA, 22 bp, Artificial Sequence
  chemically synthesized
gttcaaaccctccagcatcagt

SEQ ID NO: 640705 - DNA, 22 bp, Artificial Sequence
  chemically synthesized
tagttcaaaccctccagcatca

SEQ ID NO: 640706 - DNA, 22 bp, Artificial Sequence
  chemically synthesized
tcaagaagaactgatgctggag

SEQ ID NO: 640707 - DNA, 22 bp, Artificial Sequence
  chemically synthesized
atgctggagggtttgaactaga

SEQ ID NO: 640708 - DNA, 22 bp, Artificial Sequence
  chemically synthesized
gtaaaaatcatctctagttcaa

SEQ ID NO: 640709 - DNA, 22 bp, Artificial Sequence
  chemically synthesized
agtaaaaatcatctctagttca

SEQ ID NO: 640710 - DNA, 22 bp, Artificial Sequence
  chemically synthesized
gagggtttgaactagagatgat

SEQ ID NO: 640711 - DNA, 22 bp, Artificial Sequence
  chemically synthesized
gaaaacatttagtaaaaatcat

SEQ ID NO: 640712 - DNA, 22 bp, Artificial Sequence
  chemically synthesized
gaactagagatgatttttacta

SEQ ID NO: 640713 - DNA, 22 bp, Artificial Sequence
  chemically synthesized
ttagaaaacatttagtaaaaat

SEQ ID NO: 640714 - DNA, 22 bp, Artificial Sequence
  chemically synthesized
aactagagatgatttttactaa

SEQ ID NO: 640715 - DNA, 22 bp, Artificial Sequence
  chemically synthesized
attagaaaacatttagtaaaaa

SEQ ID NO: 640716 - DNA, 22 bp, Artificial Sequence
  chemically synthesized
gagatgatttttactaaatgtt

SEQ ID NO: 640717 - DNA, 22 bp, Artificial Sequence
  chemically synthesized
catttattagaaaacatttagt

SEQ ID NO: 640718 - DNA, 22 bp, Artificial Sequence
  chemically synthesized
tgactgcatttattagaaaaca

SEQ ID NO: 640719 - DNA, 22 bp, Artificial Sequence
  chemically synthesized
ttactaaatgttttctaataaa

SEQ ID NO: 640720 - DNA, 22 bp, Artificial Sequence
  chemically synthesized
tactaaatgttttctaataaat

SEQ ID NO: 640721 - DNA, 22 bp, Artificial Sequence
  chemically synthesized
actaaatgttttctaataaatg

SEQ ID NO: 640722 - DNA, 22 bp, Artificial Sequence
  chemically synthesized
tgactatgactgcatttattag

SEQ ID NO: 640723 - DNA, 22 bp, Artificial Sequence
  chemically synthesized
ctaaatgttttctaataaatgc

SEQ ID NO: 640724 - DNA, 22 bp, Artificial Sequence
  chemically synthesized
tgtgactatgactgcatttatt

SEQ ID NO: 640725 - DNA, 22 bp, Artificial Sequence
  chemically synthesized
aatgttttctaataaatgcagt

SEQ ID NO: 640726 - DNA, 22 bp, Artificial Sequence
  chemically synthesized
tctaataaatgcagtcatagtc

SEQ ID NO: 640727 - DNA, 22 bp, Artificial Sequence
  chemically synthesized
acacagctctgtgactatgact

SEQ ID NO: 640728 - DNA, 22 bp, Artificial Sequence
  chemically synthesized
ctaataaatgcagtcatagtca

SEQ ID NO: 640729 - DNA, 22 bp, Artificial Sequence
  chemically synthesized
taataaatgcagtcatagtcac

SEQ ID NO: 640730 - DNA, 22 bp, Artificial Sequence
  chemically synthesized
ataaatgcagtcatagtcacag

SEQ ID NO: 640731 - DNA, 22 bp, Artificial Sequence
  chemically synthesized
acaaaaatatgccctaacacag

SEQ ID NO: 640732 - DNA, 22 bp, Artificial Sequence
  chemically synthesized
ccaacccctaacaaaaatatgc

SEQ ID NO: 640733 - DNA, 22 bp, Artificial Sequence
  chemically synthesized
cccaacccctaacaaaaatatg

SEQ ID NO: 640734 - DNA, 22 bp, Artificial Sequence
  chemically synthesized
tgttagggcatatttttgttag

SEQ ID NO: 640735 - DNA, 22 bp, Artificial Sequence
  chemically synthesized
aatttcccaacccctaacaaaa

SEQ ID NO: 640736 - DNA, 22 bp, Artificial Sequence
  chemically synthesized
gggcatatttttgttaggggtt

SEQ ID NO: 640737 - DNA, 22 bp, Artificial Sequence
  chemically synthesized
aatggctcaatttcccaacccc

SEQ ID NO: 640738 - DNA, 22 bp, Artificial Sequence
  chemically synthesized
ttgttaggggttgggaaattga

SEQ ID NO: 640739 - DNA, 22 bp, Artificial Sequence
  chemically synthesized
tgttaggggttgggaaattgag

SEQ ID NO: 640740 - DNA, 22 bp, Artificial Sequence
  chemically synthesized
gttaggggttgggaaattgagc

SEQ ID NO: 640741 - DNA, 22 bp, Artificial Sequence
  chemically synthesized
ttaggggttgggaaattgagcc

SEQ ID NO: 640742 - DNA, 22 bp, Artificial Sequence
  chemically synthesized
ataagggctaaatggctcaatt

SEQ ID NO: 640743 - DNA, 22 bp, Artificial Sequence
  chemically synthesized
ggggttgggaaattgagccatt

SEQ ID NO: 640744 - DNA, 22 bp, Artificial Sequence
  chemically synthesized
ggaaattgagccatttagccct

SEQ ID NO: 640745 - DNA, 22 bp, Artificial Sequence
  chemically synthesized
aaatgcgtaattgataagggct

SEQ ID NO: 640746 - DNA, 22 bp, Artificial Sequence
  chemically synthesized
agccatttagcccttatcaatt

SEQ ID NO: 640747 - DNA, 22 bp, Artificial Sequence
  chemically synthesized
agcccttatcaattacgcattt

SEQ ID NO: 640748 - DNA, 22 bp, Artificial Sequence
  chemically synthesized
gcccttatcaattacgcatttg

SEQ ID NO: 640749 - DNA, 22 bp, Artificial Sequence
  chemically synthesized
aatataagaaaattcaaatgcg

SEQ ID NO: 640750 - DNA, 22 bp, Artificial Sequence
  chemically synthesized
aaatataagaaaattcaaatgc

SEQ ID NO: 640751 - DNA, 22 bp, Artificial Sequence
  chemically synthesized
taaatataagaaaattcaaatg

SEQ ID NO: 640752 - DNA, 22 bp, Artificial Sequence
  chemically synthesized
ttaaatataagaaaattcaaat

SEQ ID NO: 640753 - DNA, 22 bp, Artificial Sequence
  chemically synthesized
atcaattacgcatttgaatttt

SEQ ID NO: 640754 - DNA, 22 bp, Artificial Sequence
  chemically synthesized
tcaattacgcatttgaattttc

SEQ ID NO: 640755 - DNA, 22 bp, Artificial Sequence
  chemically synthesized
cgcatttgaattttcttatatt

SEQ ID NO: 640756 - DNA, 22 bp, Artificial Sequence
  chemically synthesized
gcatagatgtttttaaatataa

SEQ ID NO: 640757 - DNA, 22 bp, Artificial Sequence
  chemically synthesized
gaattttcttatatttaaaaac

SEQ ID NO: 640758 - DNA, 22 bp, Artificial Sequence
  chemically synthesized
aattttcttatatttaaaaaca

SEQ ID NO: 640759 - DNA, 22 bp, Artificial Sequence
  chemically synthesized
tcttatatttaaaaacatctat

SEQ ID NO: 640760 - DNA, 22 bp, Artificial Sequence
  chemically synthesized
cttatatttaaaaacatctatg

SEQ ID NO: 640761 - DNA, 22 bp, Artificial Sequence
  chemically synthesized
aaaaagtattggcatagatgtt

SEQ ID NO: 640762 - DNA, 22 bp, Artificial Sequence
  chemically synthesized
ttatatttaaaaacatctatgc

SEQ ID NO: 640763 - DNA, 22 bp, Artificial Sequence
  chemically synthesized
atatttaaaaacatctatgcca

SEQ ID NO: 640764 - DNA, 22 bp, Artificial Sequence
  chemically synthesized
tatttaaaaacatctatgccaa

SEQ ID NO: 640765 - DNA, 22 bp, Artificial Sequence
  chemically synthesized
aaaaacatctatgccaatactt

SEQ ID NO: 640766 - DNA, 22 bp, Artificial Sequence
  chemically synthesized
aaaacatctatgccaatacttt

SEQ ID NO: 640767 - DNA, 22 bp, Artificial Sequence
  chemically synthesized
tggtatacctcaaaaagtattg

SEQ ID NO: 640768 - DNA, 22 bp, Artificial Sequence
  chemically synthesized
acattatggtatacctcaaaaa

SEQ ID NO: 640769 - DNA, 22 bp, Artificial Sequence
  chemically synthesized
tgccaatactttttgaggtata

SEQ ID NO: 640770 - DNA, 22 bp, Artificial Sequence
  chemically synthesized
catcaaaactaacattatggta

SEQ ID NO: 640771 - DNA, 22 bp, Artificial Sequence
  chemically synthesized
tttgaggtataccataatgtta

SEQ ID NO: 640772 - DNA, 22 bp, Artificial Sequence
  chemically synthesized
ttgaggtataccataatgttag

SEQ ID NO: 640773 - DNA, 22 bp, Artificial Sequence
  chemically synthesized
tgaggtataccataatgttagt

SEQ ID NO: 640774 - DNA, 22 bp, Artificial Sequence
  chemically synthesized
gaggtataccataatgttagtt

SEQ ID NO: 640775 - DNA, 22 bp, Artificial Sequence
  chemically synthesized
atactgcatcaaaactaacatt

SEQ ID NO: 640776 - DNA, 22 bp, Artificial Sequence
  chemically synthesized
aggtataccataatgttagttt

SEQ ID NO: 640777 - DNA, 22 bp, Artificial Sequence
  chemically synthesized
cgttaatactgcatcaaaacta

SEQ ID NO: 640778 - DNA, 22 bp, Artificial Sequence
  chemically synthesized
ccctacgttaatactgcatcaa

SEQ ID NO: 640779 - DNA, 22 bp, Artificial Sequence
  chemically synthesized
gttttgatgcagtattaacgta

SEQ ID NO: 640780 - DNA, 22 bp, Artificial Sequence
  chemically synthesized
tgatgcagtattaacgtagggg

SEQ ID NO: 640781 - DNA, 22 bp, Artificial Sequence
  chemically synthesized
tgagaatgatctcccctacgtt

SEQ ID NO: 640782 - DNA, 22 bp, Artificial Sequence
  chemically synthesized
gatgcagtattaacgtagggga

SEQ ID NO: 640783 - DNA, 22 bp, Artificial Sequence
  chemically synthesized
atgagaatgatctcccctacgt

SEQ ID NO: 640784 - DNA, 22 bp, Artificial Sequence
  chemically synthesized
atgcagtattaacgtaggggag

SEQ ID NO: 640785 - DNA, 22 bp, Artificial Sequence
  chemically synthesized
atcatttatgagaatgatctcc

SEQ ID NO: 640786 - DNA, 22 bp, Artificial Sequence
  chemically synthesized
gatcatttatgagaatgatctc

SEQ ID NO: 640787 - DNA, 22 bp, Artificial Sequence
  chemically synthesized
acgtaggggagatcattctcat

SEQ ID NO: 640788 - DNA, 22 bp, Artificial Sequence
  chemically synthesized
agggaaccttgatcatttatga

SEQ ID NO: 640789 - DNA, 22 bp, Artificial Sequence
  chemically synthesized
tgagggaaccttgatcatttat

SEQ ID NO: 640790 - DNA, 22 bp, Artificial Sequence
  chemically synthesized
tcataaatgatcaaggttccct

SEQ ID NO: 640791 - DNA, 22 bp, Artificial Sequence
  chemically synthesized
ataaatgatcaaggttccctca

SEQ ID NO: 640792 - DNA, 22 bp, Artificial Sequence
  chemically synthesized
gaacagtaactctgagggaacc

SEQ ID NO: 640793 - DNA, 22 bp, Artificial Sequence
  chemically synthesized
ggaacagtaactctgagggaac

SEQ ID NO: 640794 - DNA, 22 bp, Artificial Sequence
  chemically synthesized
ccttggaacagtaactctgagg

SEQ ID NO: 640795 - DNA, 22 bp, Artificial Sequence
  chemically synthesized
accttggaacagtaactctgag

SEQ ID NO: 640796 - DNA, 22 bp, Artificial Sequence
  chemically synthesized
gaataacttaccttggaacagt

SEQ ID NO: 640797 - DNA, 22 bp, Artificial Sequence
  chemically synthesized
cctcagagttactgttccaagg

SEQ ID NO: 640798 - DNA, 22 bp, Artificial Sequence
  chemically synthesized
agagttactgttccaaggtaag

SEQ ID NO: 640799 - DNA, 22 bp, Artificial Sequence
  chemically synthesized
ctgttccaaggtaagttattct

SEQ ID NO: 640800 - DNA, 22 bp, Artificial Sequence
  chemically synthesized
ttccaaggtaagttattctaat

SEQ ID NO: 640801 - DNA, 22 bp, Artificial Sequence
  chemically synthesized
caaggtaagttattctaatgtt

SEQ ID NO: 640802 - DNA, 22 bp, Artificial Sequence
  chemically synthesized
ttctaatgttttttttttattt

SEQ ID NO: 640803 - DNA, 22 bp, Artificial Sequence
  chemically synthesized
taatgttttttttttatttttt

SEQ ID NO: 640804 - DNA, 22 bp, Artificial Sequence
  chemically synthesized
atgttttttttttattttttta

SEQ ID NO: 640805 - DNA, 22 bp, Artificial Sequence
  chemically synthesized
aaaaaataaaaaataaaaaaat

SEQ ID NO: 640806 - DNA, 22 bp, Artificial Sequence
  chemically synthesized
tttttttatttttttatttttt

SEQ ID NO: 640807 - DNA, 22 bp, Artificial Sequence
  chemically synthesized
ttttttatttttttatttttta

SEQ ID NO: 640808 - DNA, 22 bp, Artificial Sequence
  chemically synthesized
cgtctcaaaaaataaaaaataa

SEQ ID NO: 640809 - DNA, 22 bp, Artificial Sequence
  chemically synthesized
tttttatttttttattttttat

SEQ ID NO: 640810 - DNA, 22 bp, Artificial Sequence
  chemically synthesized
ttttatttttttattttttatt

SEQ ID NO: 640811 - DNA, 22 bp, Artificial Sequence
  chemically synthesized
tttatttttttattttttattt

SEQ ID NO: 640812 - DNA, 22 bp, Artificial Sequence
  chemically synthesized
ttatttttttattttttatttt

SEQ ID NO: 640813 - DNA, 22 bp, Artificial Sequence
  chemically synthesized
tatttttttattttttattttt

SEQ ID NO: 640814 - DNA, 22 bp, Artificial Sequence
  chemically synthesized
atttttttattttttatttttt

SEQ ID NO: 640815 - DNA, 22 bp, Artificial Sequence
  chemically synthesized
tttttttattttttattttttg

SEQ ID NO: 640816 - DNA, 22 bp, Artificial Sequence
  chemically synthesized
ttttattttttattttttgaga

SEQ ID NO: 640817 - DNA, 22 bp, Artificial Sequence
  chemically synthesized
tttattttttattttttgagac

SEQ ID NO: 640818 - DNA, 22 bp, Artificial Sequence
  chemically synthesized
ttattttttattttttgagacg

SEQ ID NO: 640819 - DNA, 22 bp, Artificial Sequence
  chemically synthesized
tattttttattttttgagacgg

SEQ ID NO: 640820 - DNA, 22 bp, Artificial Sequence
  chemically synthesized
attttttattttttgagacgga

SEQ ID NO: 640821 - DNA, 22 bp, Artificial Sequence
  chemically synthesized
ttttttattttttgagacggaa

SEQ ID NO: 640822 - DNA, 22 bp, Artificial Sequence
  chemically synthesized
tttattttttgagacggaatct

SEQ ID NO: 640823 - DNA, 22 bp, Artificial Sequence
  chemically synthesized
ttattttttgagacggaatctc

SEQ ID NO: 640824 - DNA, 22 bp, Artificial Sequence
  chemically synthesized
tattttttgagacggaatctcg

SEQ ID NO: 640825 - DNA, 22 bp, Artificial Sequence
  chemically synthesized
attttttgagacggaatctcgc

SEQ ID NO: 640826 - DNA, 22 bp, Artificial Sequence
  chemically synthesized
ttttttgagacggaatctcgct

SEQ ID NO: 640827 - DNA, 22 bp, Artificial Sequence
  chemically synthesized
tttgagacggaatctcgctctg

SEQ ID NO: 640828 - DNA, 22 bp, Artificial Sequence
  chemically synthesized
cagcatgggcgacagagcgaga

SEQ ID NO: 640829 - DNA, 22 bp, Artificial Sequence
  chemically synthesized
ttgagacggaatctcgctctgt

SEQ ID NO: 640830 - DNA, 22 bp, Artificial Sequence
  chemically synthesized
tgagacggaatctcgctctgtc

SEQ ID NO: 640831 - DNA, 22 bp, Artificial Sequence
  chemically synthesized
gagacggaatctcgctctgtcg

SEQ ID NO: 640832 - DNA, 22 bp, Artificial Sequence
  chemically synthesized
agacggaatctcgctctgtcgc

SEQ ID NO: 640833 - DNA, 22 bp, Artificial Sequence
  chemically synthesized
cactccagcatgggcgacagag

SEQ ID NO: 640834 - DNA, 22 bp, Artificial Sequence
  chemically synthesized
gctctgtcgcccatgctggagt

SEQ ID NO: 640835 - DNA, 22 bp, Artificial Sequence
  chemically synthesized
agatcgcaccactgcactccag

SEQ ID NO: 640836 - DNA, 22 bp, Artificial Sequence
  chemically synthesized
tgtcgcccatgctggagtgcag

SEQ ID NO: 640837 - DNA, 22 bp, Artificial Sequence
  chemically synthesized
tcgcccatgctggagtgcagtg

SEQ ID NO: 640838 - DNA, 22 bp, Artificial Sequence
  chemically synthesized
cagtgagctgagatcgcaccac

SEQ ID NO: 640839 - DNA, 22 bp, Artificial Sequence
  chemically synthesized
gcagtgagctgagatcgcacca

SEQ ID NO: 640840 - DNA, 22 bp, Artificial Sequence
  chemically synthesized
gagtgcagtggtgcgatctcag

SEQ ID NO: 640841 - DNA, 22 bp, Artificial Sequence
  chemically synthesized
agctcactgcaagctctgcctc

SEQ ID NO: 640842 - DNA, 22 bp, Artificial Sequence
  chemically synthesized
actgcaagctctgcctcctggg

SEQ ID NO: 640843 - DNA, 22 bp, Artificial Sequence
  chemically synthesized
caagctctgcctcctgggttca

SEQ ID NO: 640844 - DNA, 22 bp, Artificial Sequence
  chemically synthesized
aggcaggagaatgtgaacccag

SEQ ID NO: 640845 - DNA, 22 bp, Artificial Sequence
  chemically synthesized
tgcctcctgggttcacattctc

SEQ ID NO: 640846 - DNA, 22 bp, Artificial Sequence
  chemically synthesized
gaggctgaggcaggagaatgtg

SEQ ID NO: 640847 - DNA, 22 bp, Artificial Sequence
  chemically synthesized
cctcctgggttcacattctcct

SEQ ID NO: 640848 - DNA, 22 bp, Artificial Sequence
  chemically synthesized
tggaggctgaggcaggagaatg

SEQ ID NO: 640849 - DNA, 22 bp, Artificial Sequence
  chemically synthesized
ctgggttcacattctcctgcct

SEQ ID NO: 640850 - DNA, 22 bp, Artificial Sequence
  chemically synthesized
ggttcacattctcctgcctcag

SEQ ID NO: 640851 - DNA, 22 bp, Artificial Sequence
  chemically synthesized
acattctcctgcctcagcctcc

SEQ ID NO: 640852 - DNA, 22 bp, Artificial Sequence
  chemically synthesized
tagtcccagtgactctggaggc

SEQ ID NO: 640853 - DNA, 22 bp, Artificial Sequence
  chemically synthesized
tcctgcctcagcctccagagtc

SEQ ID NO: 640854 - DNA, 22 bp, Artificial Sequence
  chemically synthesized
ctgcctcagcctccagagtcac

SEQ ID NO: 640855 - DNA, 22 bp, Artificial Sequence
  chemically synthesized
cctcagcctccagagtcactgg

SEQ ID NO: 640856 - DNA, 22 bp, Artificial Sequence
  chemically synthesized
agcctccagagtcactgggact

SEQ ID NO: 640857 - DNA, 22 bp, Artificial Sequence
  chemically synthesized
cagagtcactgggactacaggt

SEQ ID NO: 640858 - DNA, 22 bp, Artificial Sequence
  chemically synthesized
ggactacaggtgcccgccacca

SEQ ID NO: 640859 - DNA, 22 bp, Artificial Sequence
  chemically synthesized
caggtgcccgccaccacgcccg

SEQ ID NO: 640860 - DNA, 22 bp, Artificial Sequence
  chemically synthesized
aaaatacaaaaaaaaaaagccg

SEQ ID NO: 640861 - DNA, 22 bp, Artificial Sequence
  chemically synthesized
ctaaaaatacaaaaaaaaaaag

SEQ ID NO: 640862 - DNA, 22 bp, Artificial Sequence
  chemically synthesized
tactaaaaatacaaaaaaaaaa

SEQ ID NO: 640863 - DNA, 22 bp, Artificial Sequence
  chemically synthesized
tctctactaaaaatacaaaaaa

SEQ ID NO: 640864 - DNA, 22 bp, Artificial Sequence
  chemically synthesized
tttttttttgtatttttagtag

SEQ ID NO: 640865 - DNA, 22 bp, Artificial Sequence
  chemically synthesized
ttttttttgtatttttagtaga

SEQ ID NO: 640866 - DNA, 22 bp, Artificial Sequence
  chemically synthesized
tttttttgtatttttagtagag

SEQ ID NO: 640867 - DNA, 22 bp, Artificial Sequence
  chemically synthesized
ttttttgtatttttagtagaga

SEQ ID NO: 640868 - DNA, 22 bp, Artificial Sequence
  chemically synthesized
tttttgtatttttagtagagac

SEQ ID NO: 640869 - DNA, 22 bp, Artificial Sequence
  chemically synthesized
ttttgtatttttagtagagaca

SEQ ID NO: 640870 - DNA, 22 bp, Artificial Sequence
  chemically synthesized
tttgtatttttagtagagacag

SEQ ID NO: 640871 - DNA, 22 bp, Artificial Sequence
  chemically synthesized
ttgtatttttagtagagacagg

SEQ ID NO: 640872 - DNA, 22 bp, Artificial Sequence
  chemically synthesized
acacggtgaaaccctgtctcta

SEQ ID NO: 640873 - DNA, 22 bp, Artificial Sequence
  chemically synthesized
tgtatttttagtagagacaggg

SEQ ID NO: 640874 - DNA, 22 bp, Artificial Sequence
  chemically synthesized
gtatttttagtagagacagggt

SEQ ID NO: 640875 - DNA, 22 bp, Artificial Sequence
  chemically synthesized
tatttttagtagagacagggtt

SEQ ID NO: 640876 - DNA, 22 bp, Artificial Sequence
  chemically synthesized
gctaacacggtgaaaccctgtc

SEQ ID NO: 640877 - DNA, 22 bp, Artificial Sequence
  chemically synthesized
ttagtagagacagggtttcacc

SEQ ID NO: 640878 - DNA, 22 bp, Artificial Sequence
  chemically synthesized
tagtagagacagggtttcaccg

SEQ ID NO: 640879 - DNA, 22 bp, Artificial Sequence
  chemically synthesized
agtagagacagggtttcaccgt

SEQ ID NO: 640880 - DNA, 22 bp, Artificial Sequence
  chemically synthesized
gtagagacagggtttcaccgtg

SEQ ID NO: 640881 - DNA, 22 bp, Artificial Sequence
  chemically synthesized
caccgtgttagccaggatggtc

SEQ ID NO: 640882 - DNA, 22 bp, Artificial Sequence
  chemically synthesized
accgtgttagccaggatggtct

SEQ ID NO: 640883 - DNA, 22 bp, Artificial Sequence
  chemically synthesized
gccaggatggtctccatctcct

SEQ ID NO: 640884 - DNA, 22 bp, Artificial Sequence
  chemically synthesized
catctcctgacctcgtgatccg

SEQ ID NO: 640885 - DNA, 22 bp, Artificial Sequence
  chemically synthesized
ggaggccgaggcaggcggatca

SEQ ID NO: 640886 - DNA, 22 bp, Artificial Sequence
  chemically synthesized
gggaggccgaggcaggcggatc

SEQ ID NO: 640887 - DNA, 22 bp, Artificial Sequence
  chemically synthesized
tgggaggccgaggcaggcggat

SEQ ID NO: 640888 - DNA, 22 bp, Artificial Sequence
  chemically synthesized
ctgacctcgtgatccgcctgcc

SEQ ID NO: 640889 - DNA, 22 bp, Artificial Sequence
  chemically synthesized
acctcgtgatccgcctgcctcg

SEQ ID NO: 640890 - DNA, 22 bp, Artificial Sequence
  chemically synthesized
gtgatccgcctgcctcggcctc

SEQ ID NO: 640891 - DNA, 22 bp, Artificial Sequence
  chemically synthesized
taatcccagcactttgggaggc

SEQ ID NO: 640892 - DNA, 22 bp, Artificial Sequence
  chemically synthesized
cctcggcctcccaaagtgctgg

SEQ ID NO: 640893 - DNA, 22 bp, Artificial Sequence
  chemically synthesized
acacctgtaatcccagcacttt

SEQ ID NO: 640894 - DNA, 22 bp, Artificial Sequence
  chemically synthesized
ggcctcccaaagtgctgggatt

SEQ ID NO: 640895 - DNA, 22 bp, Artificial Sequence
  chemically synthesized
gctcacacctgtaatcccagca

SEQ ID NO: 640896 - DNA, 22 bp, Artificial Sequence
  chemically synthesized
ccaaagtgctgggattacaggt

SEQ ID NO: 640897 - DNA, 22 bp, Artificial Sequence
  chemically synthesized
ggcatgttggctcacacctgta

SEQ ID NO: 640898 - DNA, 22 bp, Artificial Sequence
  chemically synthesized
gaggctgggcatgttggctcac

SEQ ID NO: 640899 - DNA, 22 bp, Artificial Sequence
  chemically synthesized
ggattacaggtgtgagccaaca

SEQ ID NO: 640900 - DNA, 22 bp, Artificial Sequence
  chemically synthesized
caggtgtgagccaacatgccca

SEQ ID NO: 640901 - DNA, 22 bp, Artificial Sequence
  chemically synthesized
aacattagaggctgggcatgtt

SEQ ID NO: 640902 - DNA, 22 bp, Artificial Sequence
  chemically synthesized
ttaaacattagaggctgggcat

SEQ ID NO: 640903 - DNA, 22 bp, Artificial Sequence
  chemically synthesized
gttaaacattagaggctgggca

SEQ ID NO: 640904 - DNA, 22 bp, Artificial Sequence
  chemically synthesized
tgtacttgttaaacattagagg

SEQ ID NO: 640905 - DNA, 22 bp, Artificial Sequence
  chemically synthesized
aaacgagtgcattgtgtacttg

SEQ ID NO: 640906 - DNA, 22 bp, Artificial Sequence
  chemically synthesized
taatgtttaacaagtacacaat

SEQ ID NO: 640907 - DNA, 22 bp, Artificial Sequence
  chemically synthesized
ttaaaacgagtgcattgtgtac

SEQ ID NO: 640908 - DNA, 22 bp, Artificial Sequence
  chemically synthesized
atgtttaacaagtacacaatgc

SEQ ID NO: 640909 - DNA, 22 bp, Artificial Sequence
  chemically synthesized
aacaagtacacaatgcactcgt

SEQ ID NO: 640910 - DNA, 22 bp, Artificial Sequence
  chemically synthesized
acagctgttaaaacgagtgcat

SEQ ID NO: 640911 - DNA, 22 bp, Artificial Sequence
  chemically synthesized
acaagtacacaatgcactcgtt

SEQ ID NO: 640912 - DNA, 22 bp, Artificial Sequence
  chemically synthesized
gtaataattgacagctgttaaa

SEQ ID NO: 640913 - DNA, 22 bp, Artificial Sequence
  chemically synthesized
gttttaacagctgtcaattatt

SEQ ID NO: 640914 - DNA, 22 bp, Artificial Sequence
  chemically synthesized
taacagctgtcaattattacca

SEQ ID NO: 640915 - DNA, 22 bp, Artificial Sequence
  chemically synthesized
aacagctgtcaattattaccaa

SEQ ID NO: 640916 - DNA, 22 bp, Artificial Sequence
  chemically synthesized
acagctgtcaattattaccaat

SEQ ID NO: 640917 - DNA, 22 bp, Artificial Sequence
  chemically synthesized
aagaaaagcaaaatatgtattg

SEQ ID NO: 640918 - DNA, 22 bp, Artificial Sequence
  chemically synthesized
tcaattattaccaatacatatt

SEQ ID NO: 640919 - DNA, 22 bp, Artificial Sequence
  chemically synthesized
caagaaaagcaaaatatgtatt

SEQ ID NO: 640920 - DNA, 22 bp, Artificial Sequence
  chemically synthesized
ttaccaatacatattttgcttt

SEQ ID NO: 640921 - DNA, 22 bp, Artificial Sequence
  chemically synthesized
ccaatacatattttgcttttct

SEQ ID NO: 640922 - DNA, 22 bp, Artificial Sequence
  chemically synthesized
tgcttttcttgaaggtatacac

SEQ ID NO: 640923 - DNA, 22 bp, Artificial Sequence
  chemically synthesized
gcttttcttgaaggtatacacg

SEQ ID NO: 640924 - DNA, 22 bp, Artificial Sequence
  chemically synthesized
cttttcttgaaggtatacacgt

SEQ ID NO: 640925 - DNA, 22 bp, Artificial Sequence
  chemically synthesized
ggggtgagatgtacgtgtatac

SEQ ID NO: 640926 - DNA, 22 bp, Artificial Sequence
  chemically synthesized
ttcttgaaggtatacacgtaca

SEQ ID NO: 640927 - DNA, 22 bp, Artificial Sequence
  chemically synthesized
tcttgaaggtatacacgtacat

SEQ ID NO: 640928 - DNA, 22 bp, Artificial Sequence
  chemically synthesized
cttgaaggtatacacgtacatc

SEQ ID NO: 640929 - DNA, 22 bp, Artificial Sequence
  chemically synthesized
ttgaaggtatacacgtacatct

SEQ ID NO: 640930 - DNA, 22 bp, Artificial Sequence
  chemically synthesized
gaaggtatacacgtacatctca

SEQ ID NO: 640931 - DNA, 22 bp, Artificial Sequence
  chemically synthesized
aaggtatacacgtacatctcac

SEQ ID NO: 640932 - DNA, 22 bp, Artificial Sequence
  chemically synthesized
gagaatcattaggggtgagatg

SEQ ID NO: 640933 - DNA, 22 bp, Artificial Sequence
  chemically synthesized
acaattagagaatcattagggg

SEQ ID NO: 640934 - DNA, 22 bp, Artificial Sequence
  chemically synthesized
taacaattagagaatcattagg

SEQ ID NO: 640935 - DNA, 22 bp, Artificial Sequence
  chemically synthesized
cattctaacaattagagaatca

SEQ ID NO: 640936 - DNA, 22 bp, Artificial Sequence
  chemically synthesized
acccctaatgattctctaattg

SEQ ID NO: 640937 - DNA, 22 bp, Artificial Sequence
  chemically synthesized
atgactacattctaacaattag

SEQ ID NO: 640938 - DNA, 22 bp, Artificial Sequence
  chemically synthesized
catgactacattctaacaatta

SEQ ID NO: 640939 - DNA, 22 bp, Artificial Sequence
  chemically synthesized
atgattctctaattgttagaat

SEQ ID NO: 640940 - DNA, 22 bp, Artificial Sequence
  chemically synthesized
aaatgacttcatgactacattc

SEQ ID NO: 640941 - DNA, 22 bp, Artificial Sequence
  chemically synthesized
tctaattgttagaatgtagtca

SEQ ID NO: 640942 - DNA, 22 bp, Artificial Sequence
  chemically synthesized
taattgttagaatgtagtcatg

SEQ ID NO: 640943 - DNA, 22 bp, Artificial Sequence
  chemically synthesized
attgttagaatgtagtcatgaa

SEQ ID NO: 640944 - DNA, 22 bp, Artificial Sequence
  chemically synthesized
tattgaaatgacttcatgacta

SEQ ID NO: 640945 - DNA, 22 bp, Artificial Sequence
  chemically synthesized
ttagaatgtagtcatgaagtca

SEQ ID NO: 640946 - DNA, 22 bp, Artificial Sequence
  chemically synthesized
atctgtattgaaatgacttcat

SEQ ID NO: 640947 - DNA, 22 bp, Artificial Sequence
  chemically synthesized
gaatgtagtcatgaagtcattt

SEQ ID NO: 640948 - DNA, 22 bp, Artificial Sequence
  chemically synthesized
acatatattcatctgtattgaa

SEQ ID NO: 640949 - DNA, 22 bp, Artificial Sequence
  chemically synthesized
atcactgacatatattcatctg

SEQ ID NO: 640950 - DNA, 22 bp, Artificial Sequence
  chemically synthesized
tctgatcactgacatatattca

SEQ ID NO: 640951 - DNA, 22 bp, Artificial Sequence
  chemically synthesized
caatacagatgaatatatgtca

SEQ ID NO: 640952 - DNA, 22 bp, Artificial Sequence
  chemically synthesized
aatacagatgaatatatgtcag

SEQ ID NO: 640953 - DNA, 22 bp, Artificial Sequence
  chemically synthesized
tggagtcgttgtctgatcactg

SEQ ID NO: 640954 - DNA, 22 bp, Artificial Sequence
  chemically synthesized
tgtggagtcgttgtctgatcac

SEQ ID NO: 640955 - DNA, 22 bp, Artificial Sequence
  chemically synthesized
tctgtggagtcgttgtctgatc

SEQ ID NO: 640956 - DNA, 22 bp, Artificial Sequence
  chemically synthesized
cacagagaatctatttacgttc

SEQ ID NO: 640957 - DNA, 22 bp, Artificial Sequence
  chemically synthesized
caagataatcaagaacgtaaat

SEQ ID NO: 640958 - DNA, 22 bp, Artificial Sequence
  chemically synthesized
acaagataatcaagaacgtaaa

SEQ ID NO: 640959 - DNA, 22 bp, Artificial Sequence
  chemically synthesized
tttacgttcttgattatcttgt

SEQ ID NO: 640960 - DNA, 22 bp, Artificial Sequence
  chemically synthesized
acgttcttgattatcttgtaaa

SEQ ID NO: 640961 - DNA, 22 bp, Artificial Sequence
  chemically synthesized
cgttcttgattatcttgtaaat

SEQ ID NO: 640962 - DNA, 22 bp, Artificial Sequence
  chemically synthesized
ccagagaaatataatttacaag

SEQ ID NO: 640963 - DNA, 22 bp, Artificial Sequence
  chemically synthesized
ttgattatcttgtaaattatat

SEQ ID NO: 640964 - DNA, 22 bp, Artificial Sequence
  chemically synthesized
gattatcttgtaaattatattt

SEQ ID NO: 640965 - DNA, 22 bp, Artificial Sequence
  chemically synthesized
attatcttgtaaattatatttc

SEQ ID NO: 640966 - DNA, 22 bp, Artificial Sequence
  chemically synthesized
gggagctaccagagaaatataa

SEQ ID NO: 640967 - DNA, 22 bp, Artificial Sequence
  chemically synthesized
agggagctaccagagaaatata

SEQ ID NO: 640968 - DNA, 22 bp, Artificial Sequence
  chemically synthesized
tcttgtaaattatatttctctg

SEQ ID NO: 640969 - DNA, 22 bp, Artificial Sequence
  chemically synthesized
cttagggagctaccagagaaat

SEQ ID NO: 640970 - DNA, 22 bp, Artificial Sequence
  chemically synthesized
gtaaattatatttctctggtag

SEQ ID NO: 640971 - DNA, 22 bp, Artificial Sequence
  chemically synthesized
taaattatatttctctggtagc

SEQ ID NO: 640972 - DNA, 22 bp, Artificial Sequence
  chemically synthesized
atgttccttagggagctaccag

SEQ ID NO: 640973 - DNA, 22 bp, Artificial Sequence
  chemically synthesized
tatttctctggtagctccctaa

SEQ ID NO: 640974 - DNA, 22 bp, Artificial Sequence
  chemically synthesized
aattaatgttccttagggagct

SEQ ID NO: 640975 - DNA, 22 bp, Artificial Sequence
  chemically synthesized
gaattaatgttccttagggagc

SEQ ID NO: 640976 - DNA, 22 bp, Artificial Sequence
  chemically synthesized
ctctggtagctccctaaggaac

SEQ ID NO: 640977 - DNA, 22 bp, Artificial Sequence
  chemically synthesized
tctggtagctccctaaggaaca

SEQ ID NO: 640978 - DNA, 22 bp, Artificial Sequence
  chemically synthesized
aatttgaattaatgttccttag

SEQ ID NO: 640979 - DNA, 22 bp, Artificial Sequence
  chemically synthesized
tggtagctccctaaggaacatt

SEQ ID NO: 640980 - DNA, 22 bp, Artificial Sequence
  chemically synthesized
gtagctccctaaggaacattaa

SEQ ID NO: 640981 - DNA, 22 bp, Artificial Sequence
  chemically synthesized
cctaaggaacattaattcaaat

SEQ ID NO: 640982 - DNA, 22 bp, Artificial Sequence
  chemically synthesized
aggaacattaattcaaattcaa

SEQ ID NO: 640983 - DNA, 22 bp, Artificial Sequence
  chemically synthesized
tagtgacagaagccatgtgtat

SEQ ID NO: 640984 - DNA, 22 bp, Artificial Sequence
  chemically synthesized
attcaaattcaatacacatggc

SEQ ID NO: 640985 - DNA, 22 bp, Artificial Sequence
  chemically synthesized
aaattcaatacacatggcttct

SEQ ID NO: 640986 - DNA, 22 bp, Artificial Sequence
  chemically synthesized
aatacacatggcttctgtcact

SEQ ID NO: 640987 - DNA, 22 bp, Artificial Sequence
  chemically synthesized
caggaagaaattgtagtgacag

SEQ ID NO: 640988 - DNA, 22 bp, Artificial Sequence
  chemically synthesized
gctacaggaagaaattgtagtg

SEQ ID NO: 640989 - DNA, 22 bp, Artificial Sequence
  chemically synthesized
ctgtcactacaatttcttcctg

SEQ ID NO: 640990 - DNA, 22 bp, Artificial Sequence
  chemically synthesized
tgtcactacaatttcttcctgt

SEQ ID NO: 640991 - DNA, 22 bp, Artificial Sequence
  chemically synthesized
ggatgactggctacaggaagaa

SEQ ID NO: 640992 - DNA, 22 bp, Artificial Sequence
  chemically synthesized
aggatgactggctacaggaaga

SEQ ID NO: 640993 - DNA, 22 bp, Artificial Sequence
  chemically synthesized
tcactacaatttcttcctgtag

SEQ ID NO: 640994 - DNA, 22 bp, Artificial Sequence
  chemically synthesized
taggatgactggctacaggaag

SEQ ID NO: 640995 - DNA, 22 bp, Artificial Sequence
  chemically synthesized
ttaggatgactggctacaggaa

SEQ ID NO: 640996 - DNA, 22 bp, Artificial Sequence
  chemically synthesized
tttaggatgactggctacagga

SEQ ID NO: 640997 - DNA, 22 bp, Artificial Sequence
  chemically synthesized
ttttaggatgactggctacagg

SEQ ID NO: 640998 - DNA, 22 bp, Artificial Sequence
  chemically synthesized
tttttaggatgactggctacag

SEQ ID NO: 640999 - DNA, 22 bp, Artificial Sequence
  chemically synthesized
caatttcttcctgtagccagtc

SEQ ID NO: 641000 - DNA, 22 bp, Artificial Sequence
  chemically synthesized
cttcctgtagccagtcatccta

SEQ ID NO: 641001 - DNA, 22 bp, Artificial Sequence
  chemically synthesized
ttcctgtagccagtcatcctaa

SEQ ID NO: 641002 - DNA, 22 bp, Artificial Sequence
  chemically synthesized
cctgtagccagtcatcctaaaa

SEQ ID NO: 641003 - DNA, 22 bp, Artificial Sequence
  chemically synthesized
ctgtagccagtcatcctaaaaa

SEQ ID NO: 641004 - DNA, 22 bp, Artificial Sequence
  chemically synthesized
gatggaagactttttttaggat

SEQ ID NO: 641005 - DNA, 22 bp, Artificial Sequence
  chemically synthesized
tagccagtcatcctaaaaaaag

SEQ ID NO: 641006 - DNA, 22 bp, Artificial Sequence
  chemically synthesized
aaaaaagtcttccatccagtat

SEQ ID NO: 641007 - DNA, 22 bp, Artificial Sequence
  chemically synthesized
tagagaataagaaatactggat

SEQ ID NO: 641008 - DNA, 22 bp, Artificial Sequence
  chemically synthesized
tatagagaataagaaatactgg

SEQ ID NO: 641009 - DNA, 22 bp, Artificial Sequence
  chemically synthesized
gctctatagagaataagaaata

SEQ ID NO: 641010 - DNA, 22 bp, Artificial Sequence
  chemically synthesized
agctctatagagaataagaaat

SEQ ID NO: 641011 - DNA, 22 bp, Artificial Sequence
  chemically synthesized
ttagctctatagagaataagaa

SEQ ID NO: 641012 - DNA, 22 bp, Artificial Sequence
  chemically synthesized
ccatccagtatttcttattctc

SEQ ID NO: 641013 - DNA, 22 bp, Artificial Sequence
  chemically synthesized
catccagtatttcttattctct

SEQ ID NO: 641014 - DNA, 22 bp, Artificial Sequence
  chemically synthesized
cttattctctatagagctaaga

SEQ ID NO: 641015 - DNA, 22 bp, Artificial Sequence
  chemically synthesized
ttattctctatagagctaagaa

SEQ ID NO: 641016 - DNA, 22 bp, Artificial Sequence
  chemically synthesized
tagaatggggggattcttagct

SEQ ID NO: 641017 - DNA, 22 bp, Artificial Sequence
  chemically synthesized
attctctatagagctaagaatc

SEQ ID NO: 641018 - DNA, 22 bp, Artificial Sequence
  chemically synthesized
gtagaatggggggattcttagc

SEQ ID NO: 641019 - DNA, 22 bp, Artificial Sequence
  chemically synthesized
ttctctatagagctaagaatcc

SEQ ID NO: 641020 - DNA, 22 bp, Artificial Sequence
  chemically synthesized
tctatagagctaagaatccccc

SEQ ID NO: 641021 - DNA, 22 bp, Artificial Sequence
  chemically synthesized
tatagagctaagaatcccccca

SEQ ID NO: 641022 - DNA, 22 bp, Artificial Sequence
  chemically synthesized
catatttgtagaatggggggat

SEQ ID NO: 641023 - DNA, 22 bp, Artificial Sequence
  chemically synthesized
tagagctaagaatccccccatt

SEQ ID NO: 641024 - DNA, 22 bp, Artificial Sequence
  chemically synthesized
agaatccccccattctacaaat

SEQ ID NO: 641025 - DNA, 22 bp, Artificial Sequence
  chemically synthesized
atcagatatatctacatatttg

SEQ ID NO: 641026 - DNA, 22 bp, Artificial Sequence
  chemically synthesized
tacaaatatgtagatatatctg

SEQ ID NO: 641027 - DNA, 22 bp, Artificial Sequence
  chemically synthesized
caaatatgtagatatatctgat

SEQ ID NO: 641028 - DNA, 22 bp, Artificial Sequence
  chemically synthesized
tgacataaaattaatcagatat

SEQ ID NO: 641029 - DNA, 22 bp, Artificial Sequence
  chemically synthesized
atgacataaaattaatcagata

SEQ ID NO: 641030 - DNA, 22 bp, Artificial Sequence
  chemically synthesized
tatgacataaaattaatcagat

SEQ ID NO: 641031 - DNA, 22 bp, Artificial Sequence
  chemically synthesized
tttatgacataaaattaatcag

SEQ ID NO: 641032 - DNA, 22 bp, Artificial Sequence
  chemically synthesized
tattctttatgacataaaatta

SEQ ID NO: 641033 - DNA, 22 bp, Artificial Sequence
  chemically synthesized
atattctttatgacataaaatt

SEQ ID NO: 641034 - DNA, 22 bp, Artificial Sequence
  chemically synthesized
attaattttatgtcataaagaa

SEQ ID NO: 641035 - DNA, 22 bp, Artificial Sequence
  chemically synthesized
attttatgtcataaagaatata

SEQ ID NO: 641036 - DNA, 22 bp, Artificial Sequence
  chemically synthesized
tatgtcataaagaatataaact

SEQ ID NO: 641037 - DNA, 22 bp, Artificial Sequence
  chemically synthesized
atgtcataaagaatataaactc

SEQ ID NO: 641038 - DNA, 22 bp, Artificial Sequence
  chemically synthesized
tgtcataaagaatataaactct

SEQ ID NO: 641039 - DNA, 22 bp, Artificial Sequence
  chemically synthesized
tatgtagacaacagagtttata

SEQ ID NO: 641040 - DNA, 22 bp, Artificial Sequence
  chemically synthesized
gtatgtagacaacagagtttat

SEQ ID NO: 641041 - DNA, 22 bp, Artificial Sequence
  chemically synthesized
agtgtaaatttgtatgtagaca

SEQ ID NO: 641042 - DNA, 22 bp, Artificial Sequence
  chemically synthesized
gagtgtaaatttgtatgtagac

SEQ ID NO: 641043 - DNA, 22 bp, Artificial Sequence
  chemically synthesized
tgagtgtaaatttgtatgtaga

SEQ ID NO: 641044 - DNA, 22 bp, Artificial Sequence
  chemically synthesized
ttgagtgtaaatttgtatgtag

SEQ ID NO: 641045 - DNA, 22 bp, Artificial Sequence
  chemically synthesized
tttgagtgtaaatttgtatgta

SEQ ID NO: 641046 - DNA, 22 bp, Artificial Sequence
  chemically synthesized
ttttgagtgtaaatttgtatgt

SEQ ID NO: 641047 - DNA, 22 bp, Artificial Sequence
  chemically synthesized
tgttgtctacatacaaatttac

SEQ ID NO: 641048 - DNA, 22 bp, Artificial Sequence
  chemically synthesized
ttgtctacatacaaatttacac

SEQ ID NO: 641049 - DNA, 22 bp, Artificial Sequence
  chemically synthesized
ggaagtttttttgagtgtaaat

SEQ ID NO: 641050 - DNA, 22 bp, Artificial Sequence
  chemically synthesized
tctacatacaaatttacactca

SEQ ID NO: 641051 - DNA, 22 bp, Artificial Sequence
  chemically synthesized
gttgggaagtttttttgagtgt

SEQ ID NO: 641052 - DNA, 22 bp, Artificial Sequence
  chemically synthesized
catacaaatttacactcaaaaa

SEQ ID NO: 641053 - DNA, 22 bp, Artificial Sequence
  chemically synthesized
gttggttgggaagtttttttga

SEQ ID NO: 641054 - DNA, 22 bp, Artificial Sequence
  chemically synthesized
acactcaaaaaaacttcccaac

SEQ ID NO: 641055 - DNA, 22 bp, Artificial Sequence
  chemically synthesized
cactcaaaaaaacttcccaacc

SEQ ID NO: 641056 - DNA, 22 bp, Artificial Sequence
  chemically synthesized
tgtccattagttggttgggaag

SEQ ID NO: 641057 - DNA, 22 bp, Artificial Sequence
  chemically synthesized
atgtccattagttggttgggaa

SEQ ID NO: 641058 - DNA, 22 bp, Artificial Sequence
  chemically synthesized
ttatgtccattagttggttggg

SEQ ID NO: 641059 - DNA, 22 bp, Artificial Sequence
  chemically synthesized
aaaaaaacttcccaaccaacta

SEQ ID NO: 641060 - DNA, 22 bp, Artificial Sequence
  chemically synthesized
atctcttatgtccattagttgg

SEQ ID NO: 641061 - DNA, 22 bp, Artificial Sequence
  chemically synthesized
attaatctcttatgtccattag

SEQ ID NO: 641062 - DNA, 22 bp, Artificial Sequence
  chemically synthesized
gattaatctcttatgtccatta

SEQ ID NO: 641063 - DNA, 22 bp, Artificial Sequence
  chemically synthesized
cccaaccaactaatggacataa

SEQ ID NO: 641064 - DNA, 22 bp, Artificial Sequence
  chemically synthesized
ccaaccaactaatggacataag

SEQ ID NO: 641065 - DNA, 22 bp, Artificial Sequence
  chemically synthesized
ccaatttgattaatctcttatg

SEQ ID NO: 641066 - DNA, 22 bp, Artificial Sequence
  chemically synthesized
gccaatttgattaatctcttat

SEQ ID NO: 641067 - DNA, 22 bp, Artificial Sequence
  chemically synthesized
atggacataagagattaatcaa

SEQ ID NO: 641068 - DNA, 22 bp, Artificial Sequence
  chemically synthesized
agggaacaagccttgccaattt

SEQ ID NO: 641069 - DNA, 22 bp, Artificial Sequence
  chemically synthesized
agttaagggaacaagccttgcc

SEQ ID NO: 641070 - DNA, 22 bp, Artificial Sequence
  chemically synthesized
atcaaattggcaaggcttgttc

SEQ ID NO: 641071 - DNA, 22 bp, Artificial Sequence
  chemically synthesized
agcaggttgagttaagggaaca

SEQ ID NO: 641072 - DNA, 22 bp, Artificial Sequence
  chemically synthesized
cagcaggttgagttaagggaac

SEQ ID NO: 641073 - DNA, 22 bp, Artificial Sequence
  chemically synthesized
tcagcaggttgagttaagggaa

SEQ ID NO: 641074 - DNA, 22 bp, Artificial Sequence
  chemically synthesized
gcaaggcttgttcccttaactc

SEQ ID NO: 641075 - DNA, 22 bp, Artificial Sequence
  chemically synthesized
atgttttcagcaggttgagtta

SEQ ID NO: 641076 - DNA, 22 bp, Artificial Sequence
  chemically synthesized
catgttttcagcaggttgagtt

SEQ ID NO: 641077 - DNA, 22 bp, Artificial Sequence
  chemically synthesized
tcatgttttcagcaggttgagt

SEQ ID NO: 641078 - DNA, 22 bp, Artificial Sequence
  chemically synthesized
gttcccttaactcaacctgctg

SEQ ID NO: 641079 - DNA, 22 bp, Artificial Sequence
  chemically synthesized
ctttcatgttttcagcaggttg

SEQ ID NO: 641080 - DNA, 22 bp, Artificial Sequence
  chemically synthesized
ttcccttaactcaacctgctga

SEQ ID NO: 641081 - DNA, 22 bp, Artificial Sequence
  chemically synthesized
ccttaactcaacctgctgaaaa

SEQ ID NO: 641082 - DNA, 22 bp, Artificial Sequence
  chemically synthesized
aactcaacctgctgaaaacatg

SEQ ID NO: 641083 - DNA, 22 bp, Artificial Sequence
  chemically synthesized
actcaacctgctgaaaacatga

SEQ ID NO: 641084 - DNA, 22 bp, Artificial Sequence
  chemically synthesized
aacctgctgaaaacatgaaagc

SEQ ID NO: 641085 - DNA, 22 bp, Artificial Sequence
  chemically synthesized
aaagggccagctgctttcatgt

SEQ ID NO: 641086 - DNA, 22 bp, Artificial Sequence
  chemically synthesized
ctaaaagggccagctgctttca

SEQ ID NO: 641087 - DNA, 22 bp, Artificial Sequence
  chemically synthesized
ctgaaaacatgaaagcagctgg

SEQ ID NO: 641088 - DNA, 22 bp, Artificial Sequence
  chemically synthesized
aaaacatgaaagcagctggccc

SEQ ID NO: 641089 - DNA, 22 bp, Artificial Sequence
  chemically synthesized
ataaatcattgctaaaagggcc

SEQ ID NO: 641090 - DNA, 22 bp, Artificial Sequence
  chemically synthesized
gagaggcactcataaatcattg

SEQ ID NO: 641091 - DNA, 22 bp, Artificial Sequence
  chemically synthesized
gcccttttagcaatgatttatg

SEQ ID NO: 641092 - DNA, 22 bp, Artificial Sequence
  chemically synthesized
ctagagaggcactcataaatca

SEQ ID NO: 641093 - DNA, 22 bp, Artificial Sequence
  chemically synthesized
ttagcaatgatttatgagtgcc

SEQ ID NO: 641094 - DNA, 22 bp, Artificial Sequence
  chemically synthesized
tagcaatgatttatgagtgcct

SEQ ID NO: 641095 - DNA, 22 bp, Artificial Sequence
  chemically synthesized
cgattgctagagaggcactcat

SEQ ID NO: 641096 - DNA, 22 bp, Artificial Sequence
  chemically synthesized
agcaatgatttatgagtgcctc

SEQ ID NO: 641097 - DNA, 22 bp, Artificial Sequence
  chemically synthesized
gcaatgatttatgagtgcctct

SEQ ID NO: 641098 - DNA, 22 bp, Artificial Sequence
  chemically synthesized
atgagtgcctctctagcaatcg

SEQ ID NO: 641099 - DNA, 22 bp, Artificial Sequence
  chemically synthesized
tgagtgcctctctagcaatcgt

SEQ ID NO: 641100 - DNA, 22 bp, Artificial Sequence
  chemically synthesized
tcatacataatagttacgattg

SEQ ID NO: 641101 - DNA, 22 bp, Artificial Sequence
  chemically synthesized
atcatacataatagttacgatt

SEQ ID NO: 641102 - DNA, 22 bp, Artificial Sequence
  chemically synthesized
tatcatacataatagttacgat

SEQ ID NO: 641103 - DNA, 22 bp, Artificial Sequence
  chemically synthesized
tttatcatacataatagttacg

SEQ ID NO: 641104 - DNA, 22 bp, Artificial Sequence
  chemically synthesized
tctagcaatcgtaactattatg

SEQ ID NO: 641105 - DNA, 22 bp, Artificial Sequence
  chemically synthesized
tagcaatcgtaactattatgta

SEQ ID NO: 641106 - DNA, 22 bp, Artificial Sequence
  chemically synthesized
gcaatcgtaactattatgtatg

SEQ ID NO: 641107 - DNA, 22 bp, Artificial Sequence
  chemically synthesized
taatgttctttatcatacataa

SEQ ID NO: 641108 - DNA, 22 bp, Artificial Sequence
  chemically synthesized
ttgtaatgttctttatcataca

SEQ ID NO: 641109 - DNA, 22 bp, Artificial Sequence
  chemically synthesized
ttatgtatgataaagaacatta

SEQ ID NO: 641110 - DNA, 22 bp, Artificial Sequence
  chemically synthesized
cacagagattgttgtaatgttc

SEQ ID NO: 641111 - DNA, 22 bp, Artificial Sequence
  chemically synthesized
tgtatgataaagaacattacaa

SEQ ID NO: 641112 - DNA, 22 bp, Artificial Sequence
  chemically synthesized
aattacacagagattgttgtaa

SEQ ID NO: 641113 - DNA, 22 bp, Artificial Sequence
  chemically synthesized
aaattacacagagattgttgta

SEQ ID NO: 641114 - DNA, 22 bp, Artificial Sequence
  chemically synthesized
gtttaaattacacagagattgt

SEQ ID NO: 641115 - DNA, 22 bp, Artificial Sequence
  chemically synthesized
taaattagtttaaattacacag

SEQ ID NO: 641116 - DNA, 22 bp, Artificial Sequence
  chemically synthesized
gtaaattagtttaaattacaca

SEQ ID NO: 641117 - DNA, 22 bp, Artificial Sequence
  chemically synthesized
tgtaaattagtttaaattacac

SEQ ID NO: 641118 - DNA, 22 bp, Artificial Sequence
  chemically synthesized
caacaatctctgtgtaatttaa

SEQ ID NO: 641119 - DNA, 22 bp, Artificial Sequence
  chemically synthesized
acctttgtaaattagtttaaat

SEQ ID NO: 641120 - DNA, 22 bp, Artificial Sequence
  chemically synthesized
gacctttgtaaattagtttaaa

SEQ ID NO: 641121 - DNA, 22 bp, Artificial Sequence
  chemically synthesized
tgtgtaatttaaactaatttac

SEQ ID NO: 641122 - DNA, 22 bp, Artificial Sequence
  chemically synthesized
tgtaatttaaactaatttacaa

SEQ ID NO: 641123 - DNA, 22 bp, Artificial Sequence
  chemically synthesized
aaatcatttgacctttgtaaat

SEQ ID NO: 641124 - DNA, 22 bp, Artificial Sequence
  chemically synthesized
cactgaaatcatttgacctttg

SEQ ID NO: 641125 - DNA, 22 bp, Artificial Sequence
  chemically synthesized
aaactaatttacaaaggtcaaa

SEQ ID NO: 641126 - DNA, 22 bp, Artificial Sequence
  chemically synthesized
acactgaaatcatttgaccttt

SEQ ID NO: 641127 - DNA, 22 bp, Artificial Sequence
  chemically synthesized
aactaatttacaaaggtcaaat

SEQ ID NO: 641128 - DNA, 22 bp, Artificial Sequence
  chemically synthesized
atttacaaaggtcaaatgattt

SEQ ID NO: 641129 - DNA, 22 bp, Artificial Sequence
  chemically synthesized
acaaaggtcaaatgatttcagt

SEQ ID NO: 641130 - DNA, 22 bp, Artificial Sequence
  chemically synthesized
caaaggtcaaatgatttcagtg

SEQ ID NO: 641131 - DNA, 22 bp, Artificial Sequence
  chemically synthesized
aagagtagatgacttacactga

SEQ ID NO: 641132 - DNA, 22 bp, Artificial Sequence
  chemically synthesized
aaagagtagatgacttacactg

SEQ ID NO: 641133 - DNA, 22 bp, Artificial Sequence
  chemically synthesized
catttaaagagtagatgactta

SEQ ID NO: 641134 - DNA, 22 bp, Artificial Sequence
  chemically synthesized
cagtgtaagtcatctactcttt

SEQ ID NO: 641135 - DNA, 22 bp, Artificial Sequence
  chemically synthesized
agtgtaagtcatctactcttta

SEQ ID NO: 641136 - DNA, 22 bp, Artificial Sequence
  chemically synthesized
cacgtagtagggaagctccatt

SEQ ID NO: 641137 - DNA, 22 bp, Artificial Sequence
  chemically synthesized
ctctttaaatggagcttcccta

SEQ ID NO: 641138 - DNA, 22 bp, Artificial Sequence
  chemically synthesized
tttaaatggagcttccctacta

SEQ ID NO: 641139 - DNA, 22 bp, Artificial Sequence
  chemically synthesized
tataactacacgtagtagggaa

SEQ ID NO: 641140 - DNA, 22 bp, Artificial Sequence
  chemically synthesized
taaatggagcttccctactacg

SEQ ID NO: 641141 - DNA, 22 bp, Artificial Sequence
  chemically synthesized
aaatggagcttccctactacgt

SEQ ID NO: 641142 - DNA, 22 bp, Artificial Sequence
  chemically synthesized
aatggagcttccctactacgtg

SEQ ID NO: 641143 - DNA, 22 bp, Artificial Sequence
  chemically synthesized
tacaactatataactacacgta

SEQ ID NO: 641144 - DNA, 22 bp, Artificial Sequence
  chemically synthesized
ccctactacgtgtagttatata

SEQ ID NO: 641145 - DNA, 22 bp, Artificial Sequence
  chemically synthesized
cctactacgtgtagttatatag

SEQ ID NO: 641146 - DNA, 22 bp, Artificial Sequence
  chemically synthesized
ctacgtgtagttatatagttgt

SEQ ID NO: 641147 - DNA, 22 bp, Artificial Sequence
  chemically synthesized
ataaatatcattatacaactat

SEQ ID NO: 641148 - DNA, 22 bp, Artificial Sequence
  chemically synthesized
cgtgtagttatatagttgtata

SEQ ID NO: 641149 - DNA, 22 bp, Artificial Sequence
  chemically synthesized
cataaatatcattatacaacta

SEQ ID NO: 641150 - DNA, 22 bp, Artificial Sequence
  chemically synthesized
tttcataaatatcattatacaa

SEQ ID NO: 641151 - DNA, 22 bp, Artificial Sequence
  chemically synthesized
atttcataaatatcattataca

SEQ ID NO: 641152 - DNA, 22 bp, Artificial Sequence
  chemically synthesized
tatttcataaatatcattatac

SEQ ID NO: 641153 - DNA, 22 bp, Artificial Sequence
  chemically synthesized
tttatttcataaatatcattat

SEQ ID NO: 641154 - DNA, 22 bp, Artificial Sequence
  chemically synthesized
ctttatttcataaatatcatta

SEQ ID NO: 641155 - DNA, 22 bp, Artificial Sequence
  chemically synthesized
tatagttgtataatgatattta

SEQ ID NO: 641156 - DNA, 22 bp, Artificial Sequence
  chemically synthesized
atttctttatttcataaatatc

SEQ ID NO: 641157 - DNA, 22 bp, Artificial Sequence
  chemically synthesized
catttctttatttcataaatat

SEQ ID NO: 641158 - DNA, 22 bp, Artificial Sequence
  chemically synthesized
tataatgatatttatgaaataa

SEQ ID NO: 641159 - DNA, 22 bp, Artificial Sequence
  chemically synthesized
gaaagtgaccttcatttcttta

SEQ ID NO: 641160 - DNA, 22 bp, Artificial Sequence
  chemically synthesized
atgaaataaagaaatgaaggtc

SEQ ID NO: 641161 - DNA, 22 bp, Artificial Sequence
  chemically synthesized
tgaaataaagaaatgaaggtca

SEQ ID NO: 641162 - DNA, 22 bp, Artificial Sequence
  chemically synthesized
atcactggaaagtgaccttcat

SEQ ID NO: 641163 - DNA, 22 bp, Artificial Sequence
  chemically synthesized
agaaaacattgatcactggaaa

SEQ ID NO: 641164 - DNA, 22 bp, Artificial Sequence
  chemically synthesized
ttaagaaaacattgatcactgg

SEQ ID NO: 641165 - DNA, 22 bp, Artificial Sequence
  chemically synthesized
tccagtgatcaatgttttctta

SEQ ID NO: 641166 - DNA, 22 bp, Artificial Sequence
  chemically synthesized
ccagtgatcaatgttttcttaa

SEQ ID NO: 641167 - DNA, 22 bp, Artificial Sequence
  chemically synthesized
cagtgatcaatgttttcttaac

SEQ ID NO: 641168 - DNA, 22 bp, Artificial Sequence
  chemically synthesized
aatgtatgatactgttaagaaa

SEQ ID NO: 641169 - DNA, 22 bp, Artificial Sequence
  chemically synthesized
gtatacagttaaatgtatgata

SEQ ID NO: 641170 - DNA, 22 bp, Artificial Sequence
  chemically synthesized
ggtatacagttaaatgtatgat

SEQ ID NO: 641171 - DNA, 22 bp, Artificial Sequence
  chemically synthesized
tggtatacagttaaatgtatga

SEQ ID NO: 641172 - DNA, 22 bp, Artificial Sequence
  chemically synthesized
tcttaacagtatcatacattta

SEQ ID NO: 641173 - DNA, 22 bp, Artificial Sequence
  chemically synthesized
cttaacagtatcatacatttaa

SEQ ID NO: 641174 - DNA, 22 bp, Artificial Sequence
  chemically synthesized
ttaacagtatcatacatttaac

SEQ ID NO: 641175 - DNA, 22 bp, Artificial Sequence
  chemically synthesized
aacagtatcatacatttaactg

SEQ ID NO: 641176 - DNA, 22 bp, Artificial Sequence
  chemically synthesized
acagtatcatacatttaactgt

SEQ ID NO: 641177 - DNA, 22 bp, Artificial Sequence
  chemically synthesized
atgctttggtatacagttaaat

SEQ ID NO: 641178 - DNA, 22 bp, Artificial Sequence
  chemically synthesized
tgtgtgctcatgctttggtata

SEQ ID NO: 641179 - DNA, 22 bp, Artificial Sequence
  chemically synthesized
aactgtataccaaagcatgagc

SEQ ID NO: 641180 - DNA, 22 bp, Artificial Sequence
  chemically synthesized
actgtataccaaagcatgagca

SEQ ID NO: 641181 - DNA, 22 bp, Artificial Sequence
  chemically synthesized
tataccaaagcatgagcacaca

SEQ ID NO: 641182 - DNA, 22 bp, Artificial Sequence
  chemically synthesized
caaaataatccctgtgtgtgct

SEQ ID NO: 641183 - DNA, 22 bp, Artificial Sequence
  chemically synthesized
acaaaataatccctgtgtgtgc

SEQ ID NO: 641184 - DNA, 22 bp, Artificial Sequence
  chemically synthesized
tacaaaataatccctgtgtgtg

SEQ ID NO: 641185 - DNA, 22 bp, Artificial Sequence
  chemically synthesized
ctttacaaaataatccctgtgt

SEQ ID NO: 641186 - DNA, 22 bp, Artificial Sequence
  chemically synthesized
tactttacaaaataatccctgt

SEQ ID NO: 641187 - DNA, 22 bp, Artificial Sequence
  chemically synthesized
ttctactttacaaaataatccc

SEQ ID NO: 641188 - DNA, 22 bp, Artificial Sequence
  chemically synthesized
tagttgttctactttacaaaat

SEQ ID NO: 641189 - DNA, 22 bp, Artificial Sequence
  chemically synthesized
gtagttgttctactttacaaaa

SEQ ID NO: 641190 - DNA, 22 bp, Artificial Sequence
  chemically synthesized
tgtagttgttctactttacaaa

SEQ ID NO: 641191 - DNA, 22 bp, Artificial Sequence
  chemically synthesized
ttttgtaaagtagaacaactac

SEQ ID NO: 641192 - DNA, 22 bp, Artificial Sequence
  chemically synthesized
gatggcaatctttgtagttgtt

SEQ ID NO: 641193 - DNA, 22 bp, Artificial Sequence
  chemically synthesized
agatggcaatctttgtagttgt

SEQ ID NO: 641194 - DNA, 22 bp, Artificial Sequence
  chemically synthesized
tgtaaagtagaacaactacaaa

SEQ ID NO: 641195 - DNA, 22 bp, Artificial Sequence
  chemically synthesized
tagatggcaatctttgtagttg

SEQ ID NO: 641196 - DNA, 22 bp, Artificial Sequence
  chemically synthesized
gtaaagtagaacaactacaaag

SEQ ID NO: 641197 - DNA, 22 bp, Artificial Sequence
  chemically synthesized
ttagatggcaatctttgtagtt

SEQ ID NO: 641198 - DNA, 22 bp, Artificial Sequence
  chemically synthesized
taaagtagaacaactacaaaga

SEQ ID NO: 641199 - DNA, 22 bp, Artificial Sequence
  chemically synthesized
cttttagatggcaatctttgta

SEQ ID NO: 641200 - DNA, 22 bp, Artificial Sequence
  chemically synthesized
ttccttttagatggcaatcttt

SEQ ID NO: 641201 - DNA, 22 bp, Artificial Sequence
  chemically synthesized
gatctattccttttagatggca

SEQ ID NO: 641202 - DNA, 22 bp, Artificial Sequence
  chemically synthesized
ggatctattccttttagatggc

SEQ ID NO: 641203 - DNA, 22 bp, Artificial Sequence
  chemically synthesized
tggatctattccttttagatgg

SEQ ID NO: 641204 - DNA, 22 bp, Artificial Sequence
  chemically synthesized
tttggatctattccttttagat

SEQ ID NO: 641205 - DNA, 22 bp, Artificial Sequence
  chemically synthesized
caaagattgccatctaaaagga

SEQ ID NO: 641206 - DNA, 22 bp, Artificial Sequence
  chemically synthesized
ctttggatctattccttttaga

SEQ ID NO: 641207 - DNA, 22 bp, Artificial Sequence
  chemically synthesized
ccatctaaaaggaatagatcca

SEQ ID NO: 641208 - DNA, 22 bp, Artificial Sequence
  chemically synthesized
aaaggaatagatccaaagaaat

SEQ ID NO: 641209 - DNA, 22 bp, Artificial Sequence
  chemically synthesized
tatgagggtaaagccagatttc

SEQ ID NO: 641210 - DNA, 22 bp, Artificial Sequence
  chemically synthesized
atattatatgagggtaaagcca

SEQ ID NO: 641211 - DNA, 22 bp, Artificial Sequence
  chemically synthesized
aatattatatgagggtaaagcc

SEQ ID NO: 641212 - DNA, 22 bp, Artificial Sequence
  chemically synthesized
taatattatatgagggtaaagc

SEQ ID NO: 641213 - DNA, 22 bp, Artificial Sequence
  chemically synthesized
ttaatattatatgagggtaaag

SEQ ID NO: 641214 - DNA, 22 bp, Artificial Sequence
  chemically synthesized
cttttaatattatatgagggta

SEQ ID NO: 641215 - DNA, 22 bp, Artificial Sequence
  chemically synthesized
gctgcttttaatattatatgag

SEQ ID NO: 641216 - DNA, 22 bp, Artificial Sequence
  chemically synthesized
agctgcttttaatattatatga

SEQ ID NO: 641217 - DNA, 22 bp, Artificial Sequence
  chemically synthesized
gctttaccctcatataatatta

SEQ ID NO: 641218 - DNA, 22 bp, Artificial Sequence
  chemically synthesized
taccctcatataatattaaaag

SEQ ID NO: 641219 - DNA, 22 bp, Artificial Sequence
  chemically synthesized
accctcatataatattaaaagc

SEQ ID NO: 641220 - DNA, 22 bp, Artificial Sequence
  chemically synthesized
ccctcatataatattaaaagca

SEQ ID NO: 641221 - DNA, 22 bp, Artificial Sequence
  chemically synthesized
gtggatatgatttagctgcttt

SEQ ID NO: 641222 - DNA, 22 bp, Artificial Sequence
  chemically synthesized
atataatattaaaagcagctaa

SEQ ID NO: 641223 - DNA, 22 bp, Artificial Sequence
  chemically synthesized
gattggtggatatgatttagct

SEQ ID NO: 641224 - DNA, 22 bp, Artificial Sequence
  chemically synthesized
agattggtggatatgatttagc

SEQ ID NO: 641225 - DNA, 22 bp, Artificial Sequence
  chemically synthesized
aatttagattggtggatatgat

SEQ ID NO: 641226 - DNA, 22 bp, Artificial Sequence
  chemically synthesized
aaagcagctaaatcatatccac

SEQ ID NO: 641227 - DNA, 22 bp, Artificial Sequence
  chemically synthesized
cctgaatttagattggtggata

SEQ ID NO: 641228 - DNA, 22 bp, Artificial Sequence
  chemically synthesized
gcctgaatttagattggtggat

SEQ ID NO: 641229 - DNA, 22 bp, Artificial Sequence
  chemically synthesized
catttgcctgaatttagattgg

SEQ ID NO: 641230 - DNA, 22 bp, Artificial Sequence
  chemically synthesized
aatcatatccaccaatctaaat

SEQ ID NO: 641231 - DNA, 22 bp, Artificial Sequence
  chemically synthesized
ctacatttgcctgaatttagat

SEQ ID NO: 641232 - DNA, 22 bp, Artificial Sequence
  chemically synthesized
actacatttgcctgaatttaga

SEQ ID NO: 641233 - DNA, 22 bp, Artificial Sequence
  chemically synthesized
tatgatttactacatttgcctg

SEQ ID NO: 641234 - DNA, 22 bp, Artificial Sequence
  chemically synthesized
tgtatgatttactacatttgcc

SEQ ID NO: 641235 - DNA, 22 bp, Artificial Sequence
  chemically synthesized
aattcaggcaaatgtagtaaat

SEQ ID NO: 641236 - DNA, 22 bp, Artificial Sequence
  chemically synthesized
taatagttctgtatgatttact

SEQ ID NO: 641237 - DNA, 22 bp, Artificial Sequence
  chemically synthesized
aggcaaatgtagtaaatcatac

SEQ ID NO: 641238 - DNA, 22 bp, Artificial Sequence
  chemically synthesized
ctgtaatagttctgtatgattt

SEQ ID NO: 641239 - DNA, 22 bp, Artificial Sequence
  chemically synthesized
tagctgctgtaatagttctgta

SEQ ID NO: 641240 - DNA, 22 bp, Artificial Sequence
  chemically synthesized
atagctgctgtaatagttctgt

SEQ ID NO: 641241 - DNA, 22 bp, Artificial Sequence
  chemically synthesized
catttatagctgctgtaatagt

SEQ ID NO: 641242 - DNA, 22 bp, Artificial Sequence
  chemically synthesized
gctacatttatagctgctgtaa

SEQ ID NO: 641243 - DNA, 22 bp, Artificial Sequence
  chemically synthesized
attggctacatttatagctgct

SEQ ID NO: 641244 - DNA, 22 bp, Artificial Sequence
  chemically synthesized
ctgattggctacatttatagct

SEQ ID NO: 641245 - DNA, 22 bp, Artificial Sequence
  chemically synthesized
ttacagcagctataaatgtagc

SEQ ID NO: 641246 - DNA, 22 bp, Artificial Sequence
  chemically synthesized
cagcagctataaatgtagccaa

SEQ ID NO: 641247 - DNA, 22 bp, Artificial Sequence
  chemically synthesized
aaaaaaaactgctgattggcta

SEQ ID NO: 641248 - DNA, 22 bp, Artificial Sequence
  chemically synthesized
aaaaaaaaactgctgattggct

SEQ ID NO: 641249 - DNA, 22 bp, Artificial Sequence
  chemically synthesized
atttaaaaaaaaactgctgatt

SEQ ID NO: 641250 - DNA, 22 bp, Artificial Sequence
  chemically synthesized
taaatgtagccaatcagcagtt

SEQ ID NO: 641251 - DNA, 22 bp, Artificial Sequence
  chemically synthesized
catttaaaaaaaaactgctgat

SEQ ID NO: 641252 - DNA, 22 bp, Artificial Sequence
  chemically synthesized
tcatttaaaaaaaaactgctga

SEQ ID NO: 641253 - DNA, 22 bp, Artificial Sequence
  chemically synthesized
tctttcatttaaaaaaaaactg

SEQ ID NO: 641254 - DNA, 22 bp, Artificial Sequence
  chemically synthesized
gtctttcatttaaaaaaaaact

SEQ ID NO: 641255 - DNA, 22 bp, Artificial Sequence
  chemically synthesized
cagaatttgtctttcatttaaa

SEQ ID NO: 641256 - DNA, 22 bp, Artificial Sequence
  chemically synthesized
gcagaatttgtctttcatttaa

SEQ ID NO: 641257 - DNA, 22 bp, Artificial Sequence
  chemically synthesized
cttgcagaatttgtctttcatt

SEQ ID NO: 641258 - DNA, 22 bp, Artificial Sequence
  chemically synthesized
gcttgcagaatttgtctttcat

SEQ ID NO: 641259 - DNA, 22 bp, Artificial Sequence
  chemically synthesized
ttttttaaatgaaagacaaatt

SEQ ID NO: 641260 - DNA, 22 bp, Artificial Sequence
  chemically synthesized
tttttaaatgaaagacaaattc

SEQ ID NO: 641261 - DNA, 22 bp, Artificial Sequence
  chemically synthesized
atcttgcttgcagaatttgtct

SEQ ID NO: 641262 - DNA, 22 bp, Artificial Sequence
  chemically synthesized
ttttaaatgaaagacaaattct

SEQ ID NO: 641263 - DNA, 22 bp, Artificial Sequence
  chemically synthesized
tttaaatgaaagacaaattctg

SEQ ID NO: 641264 - DNA, 22 bp, Artificial Sequence
  chemically synthesized
ttaaatgaaagacaaattctgc

SEQ ID NO: 641265 - DNA, 22 bp, Artificial Sequence
  chemically synthesized
taaatgaaagacaaattctgca

SEQ ID NO: 641266 - DNA, 22 bp, Artificial Sequence
  chemically synthesized
aaatgaaagacaaattctgcaa

SEQ ID NO: 641267 - DNA, 22 bp, Artificial Sequence
  chemically synthesized
aatgaaagacaaattctgcaag

SEQ ID NO: 641268 - DNA, 22 bp, Artificial Sequence
  chemically synthesized
aagttcatcttgcttgcagaat

SEQ ID NO: 641269 - DNA, 22 bp, Artificial Sequence
  chemically synthesized
aaagttcatcttgcttgcagaa

SEQ ID NO: 641270 - DNA, 22 bp, Artificial Sequence
  chemically synthesized
taaagttcatcttgcttgcaga

SEQ ID NO: 641271 - DNA, 22 bp, Artificial Sequence
  chemically synthesized
ttaaagttcatcttgcttgcag

SEQ ID NO: 641272 - DNA, 22 bp, Artificial Sequence
  chemically synthesized
cagtttttaaagttcatcttgc

SEQ ID NO: 641273 - DNA, 22 bp, Artificial Sequence
  chemically synthesized
ccagtttttaaagttcatcttg

SEQ ID NO: 641274 - DNA, 22 bp, Artificial Sequence
  chemically synthesized
tgcaagcaagatgaactttaaa

SEQ ID NO: 641275 - DNA, 22 bp, Artificial Sequence
  chemically synthesized
caagcaagatgaactttaaaaa

SEQ ID NO: 641276 - DNA, 22 bp, Artificial Sequence
  chemically synthesized
aatgcaatttccagtttttaaa

SEQ ID NO: 641277 - DNA, 22 bp, Artificial Sequence
  chemically synthesized
aagggctcaatgcaatttccag

SEQ ID NO: 641278 - DNA, 22 bp, Artificial Sequence
  chemically synthesized
caagggctcaatgcaatttcca

SEQ ID NO: 641279 - DNA, 22 bp, Artificial Sequence
  chemically synthesized
taaaaactggaaattgcattga

SEQ ID NO: 641280 - DNA, 22 bp, Artificial Sequence
  chemically synthesized
aaaaactggaaattgcattgag

SEQ ID NO: 641281 - DNA, 22 bp, Artificial Sequence
  chemically synthesized
taatttcaagggctcaatgcaa

SEQ ID NO: 641282 - DNA, 22 bp, Artificial Sequence
  chemically synthesized
aaaactggaaattgcattgagc

SEQ ID NO: 641283 - DNA, 22 bp, Artificial Sequence
  chemically synthesized
ttgtaatttcaagggctcaatg

SEQ ID NO: 641284 - DNA, 22 bp, Artificial Sequence
  chemically synthesized
attgtaatttcaagggctcaat

SEQ ID NO: 641285 - DNA, 22 bp, Artificial Sequence
  chemically synthesized
tattgtaatttcaagggctcaa

SEQ ID NO: 641286 - DNA, 22 bp, Artificial Sequence
  chemically synthesized
gaaattgcattgagcccttgaa

SEQ ID NO: 641287 - DNA, 22 bp, Artificial Sequence
  chemically synthesized
agctttattgtaatttcaaggg

SEQ ID NO: 641288 - DNA, 22 bp, Artificial Sequence
  chemically synthesized
cattgagcccttgaaattacaa

SEQ ID NO: 641289 - DNA, 22 bp, Artificial Sequence
  chemically synthesized
cactgagctttattgtaatttc

SEQ ID NO: 641290 - DNA, 22 bp, Artificial Sequence
  chemically synthesized
agcccttgaaattacaataaag

SEQ ID NO: 641291 - DNA, 22 bp, Artificial Sequence
  chemically synthesized
gaaattacaataaagctcagtg

SEQ ID NO: 641292 - DNA, 22 bp, Artificial Sequence
  chemically synthesized
aaattacaataaagctcagtgc

SEQ ID NO: 641293 - DNA, 22 bp, Artificial Sequence
  chemically synthesized
caggtgtgagccattgcactga

SEQ ID NO: 641294 - DNA, 22 bp, Artificial Sequence
  chemically synthesized
caataaagctcagtgcaatggc

SEQ ID NO: 641295 - DNA, 22 bp, Artificial Sequence
  chemically synthesized
ggattacaggtgtgagccattg

SEQ ID NO: 641296 - DNA, 22 bp, Artificial Sequence
  chemically synthesized
agtgcaatggctcacacctgta

SEQ ID NO: 641297 - DNA, 22 bp, Artificial Sequence
  chemically synthesized
ccaaagtgctgggattacaggt

SEQ ID NO: 641298 - DNA, 22 bp, Artificial Sequence
  chemically synthesized
aacctcccaaagtgctgggatt

SEQ ID NO: 641299 - DNA, 22 bp, Artificial Sequence
  chemically synthesized
acacctgtaatcccagcacttt

SEQ ID NO: 641300 - DNA, 22 bp, Artificial Sequence
  chemically synthesized
ccacctcaacctcccaaagtgc

SEQ ID NO: 641301 - DNA, 22 bp, Artificial Sequence
  chemically synthesized
taatcccagcactttgggaggt

SEQ ID NO: 641302 - DNA, 22 bp, Artificial Sequence
  chemically synthesized
aagtgatcctcccacctcaacc

SEQ ID NO: 641303 - DNA, 22 bp, Artificial Sequence
  chemically synthesized
agctcaagtgatcctcccacct

SEQ ID NO: 641304 - DNA, 22 bp, Artificial Sequence
  chemically synthesized
tgggaggttgaggtgggaggat

SEQ ID NO: 641305 - DNA, 22 bp, Artificial Sequence
  chemically synthesized
gggaggttgaggtgggaggatc

SEQ ID NO: 641306 - DNA, 22 bp, Artificial Sequence
  chemically synthesized
ctgagctcaagtgatcctccca

SEQ ID NO: 641307 - DNA, 22 bp, Artificial Sequence
  chemically synthesized
ggaggttgaggtgggaggatca

SEQ ID NO: 641308 - DNA, 22 bp, Artificial Sequence
  chemically synthesized
aactcctgagctcaagtgatcc

SEQ ID NO: 641309 - DNA, 22 bp, Artificial Sequence
  chemically synthesized
gaactcctgagctcaagtgatc

SEQ ID NO: 641310 - DNA, 22 bp, Artificial Sequence
  chemically synthesized
aggtgggaggatcacttgagct

SEQ ID NO: 641311 - DNA, 22 bp, Artificial Sequence
  chemically synthesized
gtcttgaactcctgagctcaag

SEQ ID NO: 641312 - DNA, 22 bp, Artificial Sequence
  chemically synthesized
cccaggctggtcttgaactcct

SEQ ID NO: 641313 - DNA, 22 bp, Artificial Sequence
  chemically synthesized
tgttgcccaggctggtcttgaa

SEQ ID NO: 641314 - DNA, 22 bp, Artificial Sequence
  chemically synthesized
gagctcaggagttcaagaccag

SEQ ID NO: 641315 - DNA, 22 bp, Artificial Sequence
  chemically synthesized
agctcaggagttcaagaccagc

SEQ ID NO: 641316 - DNA, 22 bp, Artificial Sequence
  chemically synthesized
cctatgttgcccaggctggtct

SEQ ID NO: 641317 - DNA, 22 bp, Artificial Sequence
  chemically synthesized
aggagttcaagaccagcctggg

SEQ ID NO: 641318 - DNA, 22 bp, Artificial Sequence
  chemically synthesized
aagaccagcctgggcaacatag

SEQ ID NO: 641319 - DNA, 22 bp, Artificial Sequence
  chemically synthesized
taaagatggtgggggtgtctcc

SEQ ID NO: 641320 - DNA, 22 bp, Artificial Sequence
  chemically synthesized
gtaaagatggtgggggtgtctc

SEQ ID NO: 641321 - DNA, 22 bp, Artificial Sequence
  chemically synthesized
ggcaacatagggagacaccccc

SEQ ID NO: 641322 - DNA, 22 bp, Artificial Sequence
  chemically synthesized
tgtaaagatggtgggggtgtct

SEQ ID NO: 641323 - DNA, 22 bp, Artificial Sequence
  chemically synthesized
ttgtaaagatggtgggggtgtc

SEQ ID NO: 641324 - DNA, 22 bp, Artificial Sequence
  chemically synthesized
tttgtaaagatggtgggggtgt

SEQ ID NO: 641325 - DNA, 22 bp, Artificial Sequence
  chemically synthesized
ttttgtaaagatggtgggggtg

SEQ ID NO: 641326 - DNA, 22 bp, Artificial Sequence
  chemically synthesized
aatttttttgtaaagatggtgg

SEQ ID NO: 641327 - DNA, 22 bp, Artificial Sequence
  chemically synthesized
caatttttttgtaaagatggtg

SEQ ID NO: 641328 - DNA, 22 bp, Artificial Sequence
  chemically synthesized
tcaatttttttgtaaagatggt

SEQ ID NO: 641329 - DNA, 22 bp, Artificial Sequence
  chemically synthesized
ttcaatttttttgtaaagatgg

SEQ ID NO: 641330 - DNA, 22 bp, Artificial Sequence
  chemically synthesized
tttcaatttttttgtaaagatg

SEQ ID NO: 641331 - DNA, 22 bp, Artificial Sequence
  chemically synthesized
ttttcaatttttttgtaaagat

SEQ ID NO: 641332 - DNA, 22 bp, Artificial Sequence
  chemically synthesized
atttttttcaatttttttgtaa

SEQ ID NO: 641333 - DNA, 22 bp, Artificial Sequence
  chemically synthesized
tacaaaaaaattgaaaaaaatt

SEQ ID NO: 641334 - DNA, 22 bp, Artificial Sequence
  chemically synthesized
acaaaaaaattgaaaaaaatta

SEQ ID NO: 641335 - DNA, 22 bp, Artificial Sequence
  chemically synthesized
caaaaaaattgaaaaaaattag

SEQ ID NO: 641336 - DNA, 22 bp, Artificial Sequence
  chemically synthesized
aaaaaaattagccatatgtcgt

SEQ ID NO: 641337 - DNA, 22 bp, Artificial Sequence
  chemically synthesized
caggcatgtgtcacgacatatg

SEQ ID NO: 641338 - DNA, 22 bp, Artificial Sequence
  chemically synthesized
agactacaggcatgtgtcacga

SEQ ID NO: 641339 - DNA, 22 bp, Artificial Sequence
  chemically synthesized
gccatatgtcgtgacacatgcc

SEQ ID NO: 641340 - DNA, 22 bp, Artificial Sequence
  chemically synthesized
agtagctgagactacaggcatg

SEQ ID NO: 641341 - DNA, 22 bp, Artificial Sequence
  chemically synthesized
ctgagtagctgagactacaggc

SEQ ID NO: 641342 - DNA, 22 bp, Artificial Sequence
  chemically synthesized
ctcctgagtagctgagactaca

SEQ ID NO: 641343 - DNA, 22 bp, Artificial Sequence
  chemically synthesized
ctcctcctgagtagctgagact

SEQ ID NO: 641344 - DNA, 22 bp, Artificial Sequence
  chemically synthesized
tagtctcagctactcaggagga

SEQ ID NO: 641345 - DNA, 22 bp, Artificial Sequence
  chemically synthesized
ccaccccagcctcctcctcctg

SEQ ID NO: 641346 - DNA, 22 bp, Artificial Sequence
  chemically synthesized
agctactcaggaggaggaggct

SEQ ID NO: 641347 - DNA, 22 bp, Artificial Sequence
  chemically synthesized
ctcaggaggaggaggctggggt

SEQ ID NO: 641348 - DNA, 22 bp, Artificial Sequence
  chemically synthesized
aagcggtcctcccaccccagcc

SEQ ID NO: 641349 - DNA, 22 bp, Artificial Sequence
  chemically synthesized
aggaggaggaggctggggtggg

SEQ ID NO: 641350 - DNA, 22 bp, Artificial Sequence
  chemically synthesized
ccagactcaagcggtcctccca

SEQ ID NO: 641351 - DNA, 22 bp, Artificial Sequence
  chemically synthesized
aacctcccagactcaagcggtc

SEQ ID NO: 641352 - DNA, 22 bp, Artificial Sequence
  chemically synthesized
gggtgggaggaccgcttgagtc

SEQ ID NO: 641353 - DNA, 22 bp, Artificial Sequence
  chemically synthesized
cagcctcaacctcccagactca

SEQ ID NO: 641354 - DNA, 22 bp, Artificial Sequence
  chemically synthesized
actgcagcctcaacctcccaga

SEQ ID NO: 641355 - DNA, 22 bp, Artificial Sequence
  chemically synthesized
gagtctgggaggttgaggctgc

SEQ ID NO: 641356 - DNA, 22 bp, Artificial Sequence
  chemically synthesized
agtctgggaggttgaggctgca

SEQ ID NO: 641357 - DNA, 22 bp, Artificial Sequence
  chemically synthesized
ggaggttgaggctgcagtgagc

SEQ ID NO: 641358 - DNA, 22 bp, Artificial Sequence
  chemically synthesized
aggctgcagtgagccatgatca

SEQ ID NO: 641359 - DNA, 22 bp, Artificial Sequence
  chemically synthesized
gagtgcagtggcatgatcatgg

SEQ ID NO: 641360 - DNA, 22 bp, Artificial Sequence
  chemically synthesized
ggagtgcagtggcatgatcatg

SEQ ID NO: 641361 - DNA, 22 bp, Artificial Sequence
  chemically synthesized
cagtgagccatgatcatgccac

SEQ ID NO: 641362 - DNA, 22 bp, Artificial Sequence
  chemically synthesized
cccagcttggagtgcagtggca

SEQ ID NO: 641363 - DNA, 22 bp, Artificial Sequence
  chemically synthesized
ttacccagcttggagtgcagtg

SEQ ID NO: 641364 - DNA, 22 bp, Artificial Sequence
  chemically synthesized
tgttacccagcttggagtgcag

SEQ ID NO: 641365 - DNA, 22 bp, Artificial Sequence
  chemically synthesized
cctctgttacccagcttggagt

SEQ ID NO: 641366 - DNA, 22 bp, Artificial Sequence
  chemically synthesized
cactccaagctgggtaacagag

SEQ ID NO: 641367 - DNA, 22 bp, Artificial Sequence
  chemically synthesized
aatggagtctccctctgttacc

SEQ ID NO: 641368 - DNA, 22 bp, Artificial Sequence
  chemically synthesized
aaatggagtctccctctgttac

SEQ ID NO: 641369 - DNA, 22 bp, Artificial Sequence
  chemically synthesized
taaatggagtctccctctgtta

SEQ ID NO: 641370 - DNA, 22 bp, Artificial Sequence
  chemically synthesized
ttaaatggagtctccctctgtt

SEQ ID NO: 641371 - DNA, 22 bp, Artificial Sequence
  chemically synthesized
tttaaatggagtctccctctgt

SEQ ID NO: 641372 - DNA, 22 bp, Artificial Sequence
  chemically synthesized
caagctgggtaacagagggaga

SEQ ID NO: 641373 - DNA, 22 bp, Artificial Sequence
  chemically synthesized
ttttaaatggagtctccctctg

SEQ ID NO: 641374 - DNA, 22 bp, Artificial Sequence
  chemically synthesized
tttttaaatggagtctccctct

SEQ ID NO: 641375 - DNA, 22 bp, Artificial Sequence
  chemically synthesized
ttttttaaatggagtctccctc

SEQ ID NO: 641376 - DNA, 22 bp, Artificial Sequence
  chemically synthesized
tttttttaaatggagtctccct

SEQ ID NO: 641377 - DNA, 22 bp, Artificial Sequence
  chemically synthesized
ttttttttaaatggagtctccc

SEQ ID NO: 641378 - DNA, 22 bp, Artificial Sequence
  chemically synthesized
ggtaacagagggagactccatt

SEQ ID NO: 641379 - DNA, 22 bp, Artificial Sequence
  chemically synthesized
tcacttttttttttaaatggag

SEQ ID NO: 641380 - DNA, 22 bp, Artificial Sequence
  chemically synthesized
ttgtcacttttttttttaaatg

SEQ ID NO: 641381 - DNA, 22 bp, Artificial Sequence
  chemically synthesized
attgtcacttttttttttaaat

SEQ ID NO: 641382 - DNA, 22 bp, Artificial Sequence
  chemically synthesized
tattgtcacttttttttttaaa

SEQ ID NO: 641383 - DNA, 22 bp, Artificial Sequence
  chemically synthesized
taaaattttattgtcacttttt

SEQ ID NO: 641384 - DNA, 22 bp, Artificial Sequence
  chemically synthesized
catttaaaaaaaaaagtgacaa

SEQ ID NO: 641385 - DNA, 22 bp, Artificial Sequence
  chemically synthesized
tactgtaaaattttattgtcac

SEQ ID NO: 641386 - DNA, 22 bp, Artificial Sequence
  chemically synthesized
aaaaaaaaaagtgacaataaaa

SEQ ID NO: 641387 - DNA, 22 bp, Artificial Sequence
  chemically synthesized
aaaaaaaaagtgacaataaaat

SEQ ID NO: 641388 - DNA, 22 bp, Artificial Sequence
  chemically synthesized
aagctgtactgtaaaattttat

SEQ ID NO: 641389 - DNA, 22 bp, Artificial Sequence
  chemically synthesized
ataaagatgtctaaagctgtac

SEQ ID NO: 641390 - DNA, 22 bp, Artificial Sequence
  chemically synthesized
gataaagatgtctaaagctgta

SEQ ID NO: 641391 - DNA, 22 bp, Artificial Sequence
  chemically synthesized
tgtttgataaagatgtctaaag

SEQ ID NO: 641392 - DNA, 22 bp, Artificial Sequence
  chemically synthesized
gtgtttgataaagatgtctaaa

SEQ ID NO: 641393 - DNA, 22 bp, Artificial Sequence
  chemically synthesized
tacagtacagctttagacatct

SEQ ID NO: 641394 - DNA, 22 bp, Artificial Sequence
  chemically synthesized
acagtacagctttagacatctt

SEQ ID NO: 641395 - DNA, 22 bp, Artificial Sequence
  chemically synthesized
cagtacagctttagacatcttt

SEQ ID NO: 641396 - DNA, 22 bp, Artificial Sequence
  chemically synthesized
aatttgtgtttgataaagatgt

SEQ ID NO: 641397 - DNA, 22 bp, Artificial Sequence
  chemically synthesized
gaatttgtgtttgataaagatg

SEQ ID NO: 641398 - DNA, 22 bp, Artificial Sequence
  chemically synthesized
tgaatttgtgtttgataaagat

SEQ ID NO: 641399 - DNA, 22 bp, Artificial Sequence
  chemically synthesized
ttgaatttgtgtttgataaaga

SEQ ID NO: 641400 - DNA, 22 bp, Artificial Sequence
  chemically synthesized
tagacatctttatcaaacacaa

SEQ ID NO: 641401 - DNA, 22 bp, Artificial Sequence
  chemically synthesized
agacatctttatcaaacacaaa

SEQ ID NO: 641402 - DNA, 22 bp, Artificial Sequence
  chemically synthesized
gacatctttatcaaacacaaat

SEQ ID NO: 641403 - DNA, 22 bp, Artificial Sequence
  chemically synthesized
ggggtatttttgaatttgtgtt

SEQ ID NO: 641404 - DNA, 22 bp, Artificial Sequence
  chemically synthesized
aggggtatttttgaatttgtgt

SEQ ID NO: 641405 - DNA, 22 bp, Artificial Sequence
  chemically synthesized
gtttaggggtatttttgaattt

SEQ ID NO: 641406 - DNA, 22 bp, Artificial Sequence
  chemically synthesized
tatcaaacacaaattcaaaaat

SEQ ID NO: 641407 - DNA, 22 bp, Artificial Sequence
  chemically synthesized
atcaaacacaaattcaaaaata

SEQ ID NO: 641408 - DNA, 22 bp, Artificial Sequence
  chemically synthesized
tcaaacacaaattcaaaaatac

SEQ ID NO: 641409 - DNA, 22 bp, Artificial Sequence
  chemically synthesized
cacctagtttaggggtattttt

SEQ ID NO: 641410 - DNA, 22 bp, Artificial Sequence
  chemically synthesized
ccacctagtttaggggtatttt

SEQ ID NO: 641411 - DNA, 22 bp, Artificial Sequence
  chemically synthesized
tccacctagtttaggggtattt

SEQ ID NO: 641412 - DNA, 22 bp, Artificial Sequence
  chemically synthesized
ttccacctagtttaggggtatt

SEQ ID NO: 641413 - DNA, 22 bp, Artificial Sequence
  chemically synthesized
tttccacctagtttaggggtat

SEQ ID NO: 641414 - DNA, 22 bp, Artificial Sequence
  chemically synthesized
atgtctttttccacctagttta

SEQ ID NO: 641415 - DNA, 22 bp, Artificial Sequence
  chemically synthesized
aaaaatacccctaaactaggtg

SEQ ID NO: 641416 - DNA, 22 bp, Artificial Sequence
  chemically synthesized
ttaatgtctttttccacctagt

SEQ ID NO: 641417 - DNA, 22 bp, Artificial Sequence
  chemically synthesized
attaatgtctttttccacctag

SEQ ID NO: 641418 - DNA, 22 bp, Artificial Sequence
  chemically synthesized
tccttattaatgtctttttcca

SEQ ID NO: 641419 - DNA, 22 bp, Artificial Sequence
  chemically synthesized
atccttattaatgtctttttcc

SEQ ID NO: 641420 - DNA, 22 bp, Artificial Sequence
  chemically synthesized
aactaggtggaaaaagacatta

SEQ ID NO: 641421 - DNA, 22 bp, Artificial Sequence
  chemically synthesized
tgagcttatccttattaatgtc

SEQ ID NO: 641422 - DNA, 22 bp, Artificial Sequence
  chemically synthesized
ggtggaaaaagacattaataag

SEQ ID NO: 641423 - DNA, 22 bp, Artificial Sequence
  chemically synthesized
accctgtgagcttatccttatt

SEQ ID NO: 641424 - DNA, 22 bp, Artificial Sequence
  chemically synthesized
tcaccctgtgagcttatcctta

SEQ ID NO: 641425 - DNA, 22 bp, Artificial Sequence
  chemically synthesized
ctcaccctgtgagcttatcctt

SEQ ID NO: 641426 - DNA, 22 bp, Artificial Sequence
  chemically synthesized
cttctcaccctgtgagcttatc

SEQ ID NO: 641427 - DNA, 22 bp, Artificial Sequence
  chemically synthesized
acttctcaccctgtgagcttat

SEQ ID NO: 641428 - DNA, 22 bp, Artificial Sequence
  chemically synthesized
ataaggataagctcacagggtg

SEQ ID NO: 641429 - DNA, 22 bp, Artificial Sequence
  chemically synthesized
aaatatgcatagtcttacttct

SEQ ID NO: 641430 - DNA, 22 bp, Artificial Sequence
  chemically synthesized
acagggtgagaagtaagactat

SEQ ID NO: 641431 - DNA, 22 bp, Artificial Sequence
  chemically synthesized
acctaaaatatgcatagtctta

SEQ ID NO: 641432 - DNA, 22 bp, Artificial Sequence
  chemically synthesized
aggctgacctaaaatatgcata

SEQ ID NO: 641433 - DNA, 22 bp, Artificial Sequence
  chemically synthesized
aaggctgacctaaaatatgcat

SEQ ID NO: 641434 - DNA, 22 bp, Artificial Sequence
  chemically synthesized
cttaaggctgacctaaaatatg

SEQ ID NO: 641435 - DNA, 22 bp, Artificial Sequence
  chemically synthesized
gcttaaggctgacctaaaatat

SEQ ID NO: 641436 - DNA, 22 bp, Artificial Sequence
  chemically synthesized
tgcttaaggctgacctaaaata

SEQ ID NO: 641437 - DNA, 22 bp, Artificial Sequence
  chemically synthesized
ttttgcttaaggctgacctaaa

SEQ ID NO: 641438 - DNA, 22 bp, Artificial Sequence
  chemically synthesized
ctgttttgcttaaggctgacct

SEQ ID NO: 641439 - DNA, 22 bp, Artificial Sequence
  chemically synthesized
actgttttgcttaaggctgacc

SEQ ID NO: 641440 - DNA, 22 bp, Artificial Sequence
  chemically synthesized
tgcatattttaggtcagcctta

SEQ ID NO: 641441 - DNA, 22 bp, Artificial Sequence
  chemically synthesized
tactgttttgcttaaggctgac

SEQ ID NO: 641442 - DNA, 22 bp, Artificial Sequence
  chemically synthesized
ttactgttttgcttaaggctga

SEQ ID NO: 641443 - DNA, 22 bp, Artificial Sequence
  chemically synthesized
ccatttttactgttttgcttaa

SEQ ID NO: 641444 - DNA, 22 bp, Artificial Sequence
  chemically synthesized
taggtcagccttaagcaaaaca

SEQ ID NO: 641445 - DNA, 22 bp, Artificial Sequence
  chemically synthesized
aggtcagccttaagcaaaacag

SEQ ID NO: 641446 - DNA, 22 bp, Artificial Sequence
  chemically synthesized
ggtcagccttaagcaaaacagt

SEQ ID NO: 641447 - DNA, 22 bp, Artificial Sequence
  chemically synthesized
gaggggtcctgccatttttact

SEQ ID NO: 641448 - DNA, 22 bp, Artificial Sequence
  chemically synthesized
aagcaaaacagtaaaaatggca

SEQ ID NO: 641449 - DNA, 22 bp, Artificial Sequence
  chemically synthesized
agcaaaacagtaaaaatggcag

SEQ ID NO: 641450 - DNA, 22 bp, Artificial Sequence
  chemically synthesized
gaaacaagagcctggaggggtc

SEQ ID NO: 641451 - DNA, 22 bp, Artificial Sequence
  chemically synthesized
agaaatgattagaaacaagagc

SEQ ID NO: 641452 - DNA, 22 bp, Artificial Sequence
  chemically synthesized
caggctcttgtttctaatcatt

SEQ ID NO: 641453 - DNA, 22 bp, Artificial Sequence
  chemically synthesized
ttgtttctaatcatttcttagc

SEQ ID NO: 641454 - DNA, 22 bp, Artificial Sequence
  chemically synthesized
aagggggacagtgctaagaaat

SEQ ID NO: 641455 - DNA, 22 bp, Artificial Sequence
  chemically synthesized
aaagggggacagtgctaagaaa

SEQ ID NO: 641456 - DNA, 22 bp, Artificial Sequence
  chemically synthesized
gtttctaatcatttcttagcac

SEQ ID NO: 641457 - DNA, 22 bp, Artificial Sequence
  chemically synthesized
taaagggggacagtgctaagaa

SEQ ID NO: 641458 - DNA, 22 bp, Artificial Sequence
  chemically synthesized
tttctaatcatttcttagcact

SEQ ID NO: 641459 - DNA, 22 bp, Artificial Sequence
  chemically synthesized
ctaatcatttcttagcactgtc

SEQ ID NO: 641460 - DNA, 22 bp, Artificial Sequence
  chemically synthesized
taatcatttcttagcactgtcc

SEQ ID NO: 641461 - DNA, 22 bp, Artificial Sequence
  chemically synthesized
atcatttcttagcactgtcccc

SEQ ID NO: 641462 - DNA, 22 bp, Artificial Sequence
  chemically synthesized
aatgttttaaagggggacagtg

SEQ ID NO: 641463 - DNA, 22 bp, Artificial Sequence
  chemically synthesized
tgaatgttttaaagggggacag

SEQ ID NO: 641464 - DNA, 22 bp, Artificial Sequence
  chemically synthesized
cttagcactgtccccctttaaa

SEQ ID NO: 641465 - DNA, 22 bp, Artificial Sequence
  chemically synthesized
ttagcactgtccccctttaaaa

SEQ ID NO: 641466 - DNA, 22 bp, Artificial Sequence
  chemically synthesized
agcactgtccccctttaaaaca

SEQ ID NO: 641467 - DNA, 22 bp, Artificial Sequence
  chemically synthesized
gcactgtccccctttaaaacat

SEQ ID NO: 641468 - DNA, 22 bp, Artificial Sequence
  chemically synthesized
gaagtaaggctctgaatgtttt

SEQ ID NO: 641469 - DNA, 22 bp, Artificial Sequence
  chemically synthesized
ggaagtaaggctctgaatgttt

SEQ ID NO: 641470 - DNA, 22 bp, Artificial Sequence
  chemically synthesized
tccccctttaaaacattcagag

SEQ ID NO: 641471 - DNA, 22 bp, Artificial Sequence
  chemically synthesized
taaaacattcagagccttactt

SEQ ID NO: 641472 - DNA, 22 bp, Artificial Sequence
  chemically synthesized
aaaacattcagagccttacttc

SEQ ID NO: 641473 - DNA, 22 bp, Artificial Sequence
  chemically synthesized
aaacattcagagccttacttcc

SEQ ID NO: 641474 - DNA, 22 bp, Artificial Sequence
  chemically synthesized
agtaggaaagggcttggaagta

SEQ ID NO: 641475 - DNA, 22 bp, Artificial Sequence
  chemically synthesized
cagtaggaaagggcttggaagt

SEQ ID NO: 641476 - DNA, 22 bp, Artificial Sequence
  chemically synthesized
agagccttacttccaagccctt

SEQ ID NO: 641477 - DNA, 22 bp, Artificial Sequence
  chemically synthesized
agcaaatttcagtaggaaaggg

SEQ ID NO: 641478 - DNA, 22 bp, Artificial Sequence
  chemically synthesized
acttccaagccctttcctactg

SEQ ID NO: 641479 - DNA, 22 bp, Artificial Sequence
  chemically synthesized
cttccaagccctttcctactga

SEQ ID NO: 641480 - DNA, 22 bp, Artificial Sequence
  chemically synthesized
tactgagcaaatttcagtagga

SEQ ID NO: 641481 - DNA, 22 bp, Artificial Sequence
  chemically synthesized
atactgagcaaatttcagtagg

SEQ ID NO: 641482 - DNA, 22 bp, Artificial Sequence
  chemically synthesized
ccaagccctttcctactgaaat

SEQ ID NO: 641483 - DNA, 22 bp, Artificial Sequence
  chemically synthesized
tatactgagcaaatttcagtag

SEQ ID NO: 641484 - DNA, 22 bp, Artificial Sequence
  chemically synthesized
caagccctttcctactgaaatt

SEQ ID NO: 641485 - DNA, 22 bp, Artificial Sequence
  chemically synthesized
tcctactgaaatttgctcagta

SEQ ID NO: 641486 - DNA, 22 bp, Artificial Sequence
  chemically synthesized
cctactgaaatttgctcagtat

SEQ ID NO: 641487 - DNA, 22 bp, Artificial Sequence
  chemically synthesized
tataaaacctttatactgagca

SEQ ID NO: 641488 - DNA, 22 bp, Artificial Sequence
  chemically synthesized
ctactgaaatttgctcagtata

SEQ ID NO: 641489 - DNA, 22 bp, Artificial Sequence
  chemically synthesized
atataaaacctttatactgagc

SEQ ID NO: 641490 - DNA, 22 bp, Artificial Sequence
  chemically synthesized
ctgaaatttgctcagtataaag

SEQ ID NO: 641491 - DNA, 22 bp, Artificial Sequence
  chemically synthesized
aaatttgctcagtataaaggtt

SEQ ID NO: 641492 - DNA, 22 bp, Artificial Sequence
  chemically synthesized
gctcagtataaaggttttatat

SEQ ID NO: 641493 - DNA, 22 bp, Artificial Sequence
  chemically synthesized
ctcagtataaaggttttatata

SEQ ID NO: 641494 - DNA, 22 bp, Artificial Sequence
  chemically synthesized
agtataaaggttttatataaga

SEQ ID NO: 641495 - DNA, 22 bp, Artificial Sequence
  chemically synthesized
taaaatcccagtaaaatgtaaa

SEQ ID NO: 641496 - DNA, 22 bp, Artificial Sequence
  chemically synthesized
tatataagacatttacatttta

SEQ ID NO: 641497 - DNA, 22 bp, Artificial Sequence
  chemically synthesized
atataagacatttacattttac

SEQ ID NO: 641498 - DNA, 22 bp, Artificial Sequence
  chemically synthesized
tataagacatttacattttact

SEQ ID NO: 641499 - DNA, 22 bp, Artificial Sequence
  chemically synthesized
ttataaaatcccagtaaaatgt

SEQ ID NO: 641500 - DNA, 22 bp, Artificial Sequence
  chemically synthesized
attataaaatcccagtaaaatg

SEQ ID NO: 641501 - DNA, 22 bp, Artificial Sequence
  chemically synthesized
tattataaaatcccagtaaaat

SEQ ID NO: 641502 - DNA, 22 bp, Artificial Sequence
  chemically synthesized
acattttactgggattttataa

SEQ ID NO: 641503 - DNA, 22 bp, Artificial Sequence
  chemically synthesized
cattttactgggattttataat

SEQ ID NO: 641504 - DNA, 22 bp, Artificial Sequence
  chemically synthesized
tactgggattttataataaagt

SEQ ID NO: 641505 - DNA, 22 bp, Artificial Sequence
  chemically synthesized
gaagaaatgacaactttattat

SEQ ID NO: 641506 - DNA, 22 bp, Artificial Sequence
  chemically synthesized
actgggattttataataaagtt

SEQ ID NO: 641507 - DNA, 22 bp, Artificial Sequence
  chemically synthesized
ctgggattttataataaagttg

SEQ ID NO: 641508 - DNA, 22 bp, Artificial Sequence
  chemically synthesized
ggattttataataaagttgtca

SEQ ID NO: 641509 - DNA, 22 bp, Artificial Sequence
  chemically synthesized
tataataaagttgtcatttctt

SEQ ID NO: 641510 - DNA, 22 bp, Artificial Sequence
  chemically synthesized
ataataaagttgtcatttcttc

SEQ ID NO: 641511 - DNA, 22 bp, Artificial Sequence
  chemically synthesized
taataaagttgtcatttcttct

SEQ ID NO: 641512 - DNA, 22 bp, Artificial Sequence
  chemically synthesized
aaatgcagatatcactagaaga

SEQ ID NO: 641513 - DNA, 22 bp, Artificial Sequence
  chemically synthesized
aaaatgcagatatcactagaag

SEQ ID NO: 641514 - DNA, 22 bp, Artificial Sequence
  chemically synthesized
taaaatgcagatatcactagaa

SEQ ID NO: 641515 - DNA, 22 bp, Artificial Sequence
  chemically synthesized
ttttaaaatgcagatatcacta

SEQ ID NO: 641516 - DNA, 22 bp, Artificial Sequence
  chemically synthesized
tcatttcttctagtgatatctg

SEQ ID NO: 641517 - DNA, 22 bp, Artificial Sequence
  chemically synthesized
acatctgttttaaaatgcagat

SEQ ID NO: 641518 - DNA, 22 bp, Artificial Sequence
  chemically synthesized
cttctagtgatatctgcatttt

SEQ ID NO: 641519 - DNA, 22 bp, Artificial Sequence
  chemically synthesized
gacatctgttttaaaatgcaga

SEQ ID NO: 641520 - DNA, 22 bp, Artificial Sequence
  chemically synthesized
ttctagtgatatctgcatttta

SEQ ID NO: 641521 - DNA, 22 bp, Artificial Sequence
  chemically synthesized
tgacatctgttttaaaatgcag

SEQ ID NO: 641522 - DNA, 22 bp, Artificial Sequence
  chemically synthesized
ctagtgatatctgcattttaaa

SEQ ID NO: 641523 - DNA, 22 bp, Artificial Sequence
  chemically synthesized
tttgacatctgttttaaaatgc

SEQ ID NO: 641524 - DNA, 22 bp, Artificial Sequence
  chemically synthesized
tagtgatatctgcattttaaaa

SEQ ID NO: 641525 - DNA, 22 bp, Artificial Sequence
  chemically synthesized
gtgatatctgcattttaaaaca

SEQ ID NO: 641526 - DNA, 22 bp, Artificial Sequence
  chemically synthesized
cgttctttgacatctgttttaa

SEQ ID NO: 641527 - DNA, 22 bp, Artificial Sequence
  chemically synthesized
acgttctttgacatctgtttta

SEQ ID NO: 641528 - DNA, 22 bp, Artificial Sequence
  chemically synthesized
tacgttctttgacatctgtttt

SEQ ID NO: 641529 - DNA, 22 bp, Artificial Sequence
  chemically synthesized
ctttacgttctttgacatctgt

SEQ ID NO: 641530 - DNA, 22 bp, Artificial Sequence
  chemically synthesized
cctttacgttctttgacatctg

SEQ ID NO: 641531 - DNA, 22 bp, Artificial Sequence
  chemically synthesized
tcctttacgttctttgacatct

SEQ ID NO: 641532 - DNA, 22 bp, Artificial Sequence
  chemically synthesized
cattttaaaacagatgtcaaag

SEQ ID NO: 641533 - DNA, 22 bp, Artificial Sequence
  chemically synthesized
ttcctttacgttctttgacatc

SEQ ID NO: 641534 - DNA, 22 bp, Artificial Sequence
  chemically synthesized
tttcctttacgttctttgacat

SEQ ID NO: 641535 - DNA, 22 bp, Artificial Sequence
  chemically synthesized
ttttcctttacgttctttgaca

SEQ ID NO: 641536 - DNA, 22 bp, Artificial Sequence
  chemically synthesized
taaaacagatgtcaaagaacgt

SEQ ID NO: 641537 - DNA, 22 bp, Artificial Sequence
  chemically synthesized
tttttttcctttacgttctttg

SEQ ID NO: 641538 - DNA, 22 bp, Artificial Sequence
  chemically synthesized
aaaacagatgtcaaagaacgta

SEQ ID NO: 641539 - DNA, 22 bp, Artificial Sequence
  chemically synthesized
atttttttcctttacgttcttt

SEQ ID NO: 641540 - DNA, 22 bp, Artificial Sequence
  chemically synthesized
aaacagatgtcaaagaacgtaa

SEQ ID NO: 641541 - DNA, 22 bp, Artificial Sequence
  chemically synthesized
tatttttttcctttacgttctt

SEQ ID NO: 641542 - DNA, 22 bp, Artificial Sequence
  chemically synthesized
ttatttttttcctttacgttct

SEQ ID NO: 641543 - DNA, 22 bp, Artificial Sequence
  chemically synthesized
atggggcaaagcttttattttt

SEQ ID NO: 641544 - DNA, 22 bp, Artificial Sequence
  chemically synthesized
ccctgatggggcaaagctttta

SEQ ID NO: 641545 - DNA, 22 bp, Artificial Sequence
  chemically synthesized
cccctgatggggcaaagctttt

SEQ ID NO: 641546 - DNA, 22 bp, Artificial Sequence
  chemically synthesized
tcccctgatggggcaaagcttt

SEQ ID NO: 641547 - DNA, 22 bp, Artificial Sequence
  chemically synthesized
aacctttcccctgatggggcaa

SEQ ID NO: 641548 - DNA, 22 bp, Artificial Sequence
  chemically synthesized
ttcaacctttcccctgatgggg

SEQ ID NO: 641549 - DNA, 22 bp, Artificial Sequence
  chemically synthesized
tgccccatcaggggaaaggttg

SEQ ID NO: 641550 - DNA, 22 bp, Artificial Sequence
  chemically synthesized
gccccatcaggggaaaggttga

SEQ ID NO: 641551 - DNA, 22 bp, Artificial Sequence
  chemically synthesized
ccccatcaggggaaaggttgaa

SEQ ID NO: 641552 - DNA, 22 bp, Artificial Sequence
  chemically synthesized
aacaatgccactttttgacacg

SEQ ID NO: 641553 - DNA, 22 bp, Artificial Sequence
  chemically synthesized
tttgacacgctgcctttgtggt

SEQ ID NO: 641554 - DNA, 22 bp, Artificial Sequence
  chemically synthesized
ttgacacgctgcctttgtggtg

SEQ ID NO: 641555 - DNA, 22 bp, Artificial Sequence
  chemically synthesized
tgacacgctgcctttgtggtgc

SEQ ID NO: 641556 - DNA, 22 bp, Artificial Sequence
  chemically synthesized
gacacgctgcctttgtggtgcc

SEQ ID NO: 641557 - DNA, 22 bp, Artificial Sequence
  chemically synthesized
acacgctgcctttgtggtgcct

SEQ ID NO: 641558 - DNA, 22 bp, Artificial Sequence
  chemically synthesized
agccatggatggtgaaaggcac

SEQ ID NO: 641559 - DNA, 22 bp, Artificial Sequence
  chemically synthesized
ctcagccatggatggtgaaagg

SEQ ID NO: 641560 - DNA, 22 bp, Artificial Sequence
  chemically synthesized
cctttgtggtgcctttcaccat

SEQ ID NO: 641561 - DNA, 22 bp, Artificial Sequence
  chemically synthesized
tcctcagccatggatggtgaaa

SEQ ID NO: 641562 - DNA, 22 bp, Artificial Sequence
  chemically synthesized
tctcctcagccatggatggtga

SEQ ID NO: 641563 - DNA, 22 bp, Artificial Sequence
  chemically synthesized
tgtggtgcctttcaccatccat

SEQ ID NO: 641564 - DNA, 22 bp, Artificial Sequence
  chemically synthesized
gtggtgcctttcaccatccatg

SEQ ID NO: 641565 - DNA, 22 bp, Artificial Sequence
  chemically synthesized
tggtgcctttcaccatccatgg

SEQ ID NO: 641566 - DNA, 22 bp, Artificial Sequence
  chemically synthesized
attctctcctcagccatggatg

SEQ ID NO: 641567 - DNA, 22 bp, Artificial Sequence
  chemically synthesized
taattctctcctcagccatgga

SEQ ID NO: 641568 - DNA, 22 bp, Artificial Sequence
  chemically synthesized
ttctaattctctcctcagccat

SEQ ID NO: 641569 - DNA, 22 bp, Artificial Sequence
  chemically synthesized
gttctaattctctcctcagcca

SEQ ID NO: 641570 - DNA, 22 bp, Artificial Sequence
  chemically synthesized
tcaccatccatggctgaggaga

SEQ ID NO: 641571 - DNA, 22 bp, Artificial Sequence
  chemically synthesized
caccatccatggctgaggagag

SEQ ID NO: 641572 - DNA, 22 bp, Artificial Sequence
  chemically synthesized
accatccatggctgaggagaga

SEQ ID NO: 641573 - DNA, 22 bp, Artificial Sequence
  chemically synthesized
aagccttgttctaattctctcc

SEQ ID NO: 641574 - DNA, 22 bp, Artificial Sequence
  chemically synthesized
tcaagccttgttctaattctct

SEQ ID NO: 641575 - DNA, 22 bp, Artificial Sequence
  chemically synthesized
aggagagaattagaacaaggct

SEQ ID NO: 641576 - DNA, 22 bp, Artificial Sequence
  chemically synthesized
aatccaagaccatctctcaagc

SEQ ID NO: 641577 - DNA, 22 bp, Artificial Sequence
  chemically synthesized
tgaatccaagaccatctctcaa

SEQ ID NO: 641578 - DNA, 22 bp, Artificial Sequence
  chemically synthesized
ctgaatccaagaccatctctca

SEQ ID NO: 641579 - DNA, 22 bp, Artificial Sequence
  chemically synthesized
gaacaaggcttgagagatggtc

SEQ ID NO: 641580 - DNA, 22 bp, Artificial Sequence
  chemically synthesized
gagagatggtcttggattcaga

SEQ ID NO: 641581 - DNA, 22 bp, Artificial Sequence
  chemically synthesized
agagatggtcttggattcagaa

SEQ ID NO: 641582 - DNA, 22 bp, Artificial Sequence
  chemically synthesized
ggattcagaagatcttgattta

SEQ ID NO: 641583 - DNA, 22 bp, Artificial Sequence
  chemically synthesized
gattcagaagatcttgatttat

SEQ ID NO: 641584 - DNA, 22 bp, Artificial Sequence
  chemically synthesized
agaagatcttgatttatgactt

SEQ ID NO: 641585 - DNA, 22 bp, Artificial Sequence
  chemically synthesized
agcaagcagcagaggcaagtaa

SEQ ID NO: 641586 - DNA, 22 bp, Artificial Sequence
  chemically synthesized
gatttatgacttacttgcctct

SEQ ID NO: 641587 - DNA, 22 bp, Artificial Sequence
  chemically synthesized
atttatgacttacttgcctctg

SEQ ID NO: 641588 - DNA, 22 bp, Artificial Sequence
  chemically synthesized
atgacttacttgcctctgctgc

SEQ ID NO: 641589 - DNA, 22 bp, Artificial Sequence
  chemically synthesized
tgacttacttgcctctgctgct

SEQ ID NO: 641590 - DNA, 22 bp, Artificial Sequence
  chemically synthesized
cccagcctcagcaagcagcaga

SEQ ID NO: 641591 - DNA, 22 bp, Artificial Sequence
  chemically synthesized
acttgcctctgctgcttgctga

SEQ ID NO: 641592 - DNA, 22 bp, Artificial Sequence
  chemically synthesized
cttgcctctgctgcttgctgag

SEQ ID NO: 641593 - DNA, 22 bp, Artificial Sequence
  chemically synthesized
gcctctgctgcttgctgaggct

SEQ ID NO: 641594 - DNA, 22 bp, Artificial Sequence
  chemically synthesized
agtcagttgcccagcctcagca

SEQ ID NO: 641595 - DNA, 22 bp, Artificial Sequence
  chemically synthesized
cctctgctgcttgctgaggctg

SEQ ID NO: 641596 - DNA, 22 bp, Artificial Sequence
  chemically synthesized
aagtcagttgcccagcctcagc

SEQ ID NO: 641597 - DNA, 22 bp, Artificial Sequence
  chemically synthesized
tgctgcttgctgaggctgggca

SEQ ID NO: 641598 - DNA, 22 bp, Artificial Sequence
  chemically synthesized
ctgcttgctgaggctgggcaac

SEQ ID NO: 641599 - DNA, 22 bp, Artificial Sequence
  chemically synthesized
gtgcttaagtcagttgcccagc

SEQ ID NO: 641600 - DNA, 22 bp, Artificial Sequence
  chemically synthesized
cttgctgaggctgggcaactga

SEQ ID NO: 641601 - DNA, 22 bp, Artificial Sequence
  chemically synthesized
aattagtgcttaagtcagttgc

SEQ ID NO: 641602 - DNA, 22 bp, Artificial Sequence
  chemically synthesized
gctgaggctgggcaactgactt

SEQ ID NO: 641603 - DNA, 22 bp, Artificial Sequence
  chemically synthesized
ctgaggctgggcaactgactta

SEQ ID NO: 641604 - DNA, 22 bp, Artificial Sequence
  chemically synthesized
aggctgggcaactgacttaagc

SEQ ID NO: 641605 - DNA, 22 bp, Artificial Sequence
  chemically synthesized
ataactgaattagtgcttaagt

SEQ ID NO: 641606 - DNA, 22 bp, Artificial Sequence
  chemically synthesized
ggcaactgacttaagcactaat

SEQ ID NO: 641607 - DNA, 22 bp, Artificial Sequence
  chemically synthesized
ataatcctcataactgaattag

SEQ ID NO: 641608 - DNA, 22 bp, Artificial Sequence
  chemically synthesized
aataatcctcataactgaatta

SEQ ID NO: 641609 - DNA, 22 bp, Artificial Sequence
  chemically synthesized
acttaagcactaattcagttat

SEQ ID NO: 641610 - DNA, 22 bp, Artificial Sequence
  chemically synthesized
gcttaataatcctcataactga

SEQ ID NO: 641611 - DNA, 22 bp, Artificial Sequence
  chemically synthesized
aagcactaattcagttatgagg

SEQ ID NO: 641612 - DNA, 22 bp, Artificial Sequence
  chemically synthesized
agcactaattcagttatgagga

SEQ ID NO: 641613 - DNA, 22 bp, Artificial Sequence
  chemically synthesized
attcagttatgaggattattaa

SEQ ID NO: 641614 - DNA, 22 bp, Artificial Sequence
  chemically synthesized
agttatgaggattattaagcca

SEQ ID NO: 641615 - DNA, 22 bp, Artificial Sequence
  chemically synthesized
tgaggattattaagccagtatg

SEQ ID NO: 641616 - DNA, 22 bp, Artificial Sequence
  chemically synthesized
acatatagaatgtcgaccatac

SEQ ID NO: 641617 - DNA, 22 bp, Artificial Sequence
  chemically synthesized
gacatatagaatgtcgaccata

SEQ ID NO: 641618 - DNA, 22 bp, Artificial Sequence
  chemically synthesized
ttaagccagtatggtcgacatt

SEQ ID NO: 641619 - DNA, 22 bp, Artificial Sequence
  chemically synthesized
agccagtatggtcgacattcta

SEQ ID NO: 641620 - DNA, 22 bp, Artificial Sequence
  chemically synthesized
aaagaaagtttgacatatagaa

SEQ ID NO: 641621 - DNA, 22 bp, Artificial Sequence
  chemically synthesized
ggcatggttcaaagaaagtttg

SEQ ID NO: 641622 - DNA, 22 bp, Artificial Sequence
  chemically synthesized
tatatgtcaaactttctttgaa

SEQ ID NO: 641623 - DNA, 22 bp, Artificial Sequence
  chemically synthesized
tatgtcaaactttctttgaacc

SEQ ID NO: 641624 - DNA, 22 bp, Artificial Sequence
  chemically synthesized
aacacagtatgggctgggcatg

SEQ ID NO: 641625 - DNA, 22 bp, Artificial Sequence
  chemically synthesized
tctttgaaccatgcccagccca

SEQ ID NO: 641626 - DNA, 22 bp, Artificial Sequence
  chemically synthesized
ttgaacacagtatgggctgggc

SEQ ID NO: 641627 - DNA, 22 bp, Artificial Sequence
  chemically synthesized
ctttgaaccatgcccagcccat

SEQ ID NO: 641628 - DNA, 22 bp, Artificial Sequence
  chemically synthesized
attgaacacagtatgggctggg

SEQ ID NO: 641629 - DNA, 22 bp, Artificial Sequence
  chemically synthesized
tttgaaccatgcccagcccata

SEQ ID NO: 641630 - DNA, 22 bp, Artificial Sequence
  chemically synthesized
tgaaccatgcccagcccatact

SEQ ID NO: 641631 - DNA, 22 bp, Artificial Sequence
  chemically synthesized
gaaccatgcccagcccatactg

SEQ ID NO: 641632 - DNA, 22 bp, Artificial Sequence
  chemically synthesized
aaccatgcccagcccatactgt

SEQ ID NO: 641633 - DNA, 22 bp, Artificial Sequence
  chemically synthesized
tgttcaataaatgttggttact

SEQ ID NO: 641634 - DNA, 22 bp, Artificial Sequence
  chemically synthesized
aataaatgttggttactattat

SEQ ID NO: 641635 - DNA, 22 bp, Artificial Sequence
  chemically synthesized
gttactattattattgttatta

SEQ ID NO: 641636 - DNA, 22 bp, Artificial Sequence
  chemically synthesized
ctattattattgttattacttc

SEQ ID NO: 641637 - DNA, 22 bp, Artificial Sequence
  chemically synthesized
ttattattgttattacttcttt

SEQ ID NO: 641638 - DNA, 22 bp, Artificial Sequence
  chemically synthesized
ttattgttattacttctttctc

SEQ ID NO: 641639 - DNA, 22 bp, Artificial Sequence
  chemically synthesized
ttgttattacttctttctctat

SEQ ID NO: 641640 - DNA, 22 bp, Artificial Sequence
  chemically synthesized
ttattacttctttctctatata

SEQ ID NO: 641641 - DNA, 22 bp, Artificial Sequence
  chemically synthesized
ttacttctttctctatatatta

SEQ ID NO: 641642 - DNA, 22 bp, Artificial Sequence
  chemically synthesized
cttctttctctatatattattt

SEQ ID NO: 641643 - DNA, 22 bp, Artificial Sequence
  chemically synthesized
aatccaaaaagtaaataatata

SEQ ID NO: 641644 - DNA, 22 bp, Artificial Sequence
  chemically synthesized
taaatccaaaaagtaaataata

SEQ ID NO: 641645 - DNA, 22 bp, Artificial Sequence
  chemically synthesized
ctttctctatatattatttact

SEQ ID NO: 641646 - DNA, 22 bp, Artificial Sequence
  chemically synthesized
tttctctatatattatttactt

SEQ ID NO: 641647 - DNA, 22 bp, Artificial Sequence
  chemically synthesized
tctctatatattatttactttt

SEQ ID NO: 641648 - DNA, 22 bp, Artificial Sequence
  chemically synthesized
ctctatatattatttacttttt

SEQ ID NO: 641649 - DNA, 22 bp, Artificial Sequence
  chemically synthesized
tctatatattatttactttttg

SEQ ID NO: 641650 - DNA, 22 bp, Artificial Sequence
  chemically synthesized
aggttctaaatccaaaaagtaa

SEQ ID NO: 641651 - DNA, 22 bp, Artificial Sequence
  chemically synthesized
tatatattatttactttttgga

SEQ ID NO: 641652 - DNA, 22 bp, Artificial Sequence
  chemically synthesized
tatattatttactttttggatt

SEQ ID NO: 641653 - DNA, 22 bp, Artificial Sequence
  chemically synthesized
gcacatctgaggttctaaatcc

SEQ ID NO: 641654 - DNA, 22 bp, Artificial Sequence
  chemically synthesized
agcacatctgaggttctaaatc

SEQ ID NO: 641655 - DNA, 22 bp, Artificial Sequence
  chemically synthesized
tttactttttggatttagaacc

SEQ ID NO: 641656 - DNA, 22 bp, Artificial Sequence
  chemically synthesized
tagcacatctgaggttctaaat

SEQ ID NO: 641657 - DNA, 22 bp, Artificial Sequence
  chemically synthesized
ttagcacatctgaggttctaaa

SEQ ID NO: 641658 - DNA, 22 bp, Artificial Sequence
  chemically synthesized
actttttggatttagaacctca

SEQ ID NO: 641659 - DNA, 22 bp, Artificial Sequence
  chemically synthesized
ctttttggatttagaacctcag

SEQ ID NO: 641660 - DNA, 22 bp, Artificial Sequence
  chemically synthesized
tttggatttagaacctcagatg

SEQ ID NO: 641661 - DNA, 22 bp, Artificial Sequence
  chemically synthesized
ttggatttagaacctcagatgt

SEQ ID NO: 641662 - DNA, 22 bp, Artificial Sequence
  chemically synthesized
tggatttagaacctcagatgtg

SEQ ID NO: 641663 - DNA, 22 bp, Artificial Sequence
  chemically synthesized
ggatttagaacctcagatgtgc

SEQ ID NO: 641664 - DNA, 22 bp, Artificial Sequence
  chemically synthesized
gatttagaacctcagatgtgct

SEQ ID NO: 641665 - DNA, 22 bp, Artificial Sequence
  chemically synthesized
taggaagtttttagcacatctg

SEQ ID NO: 641666 - DNA, 22 bp, Artificial Sequence
  chemically synthesized
ataggaagtttttagcacatct

SEQ ID NO: 641667 - DNA, 22 bp, Artificial Sequence
  chemically synthesized
tataggaagtttttagcacatc

SEQ ID NO: 641668 - DNA, 22 bp, Artificial Sequence
  chemically synthesized
ttataggaagtttttagcacat

SEQ ID NO: 641669 - DNA, 22 bp, Artificial Sequence
  chemically synthesized
tttataggaagtttttagcaca

SEQ ID NO: 641670 - DNA, 22 bp, Artificial Sequence
  chemically synthesized
agaacctcagatgtgctaaaaa

SEQ ID NO: 641671 - DNA, 22 bp, Artificial Sequence
  chemically synthesized
gaacctcagatgtgctaaaaac

SEQ ID NO: 641672 - DNA, 22 bp, Artificial Sequence
  chemically synthesized
tttttataggaagtttttagca

SEQ ID NO: 641673 - DNA, 22 bp, Artificial Sequence
  chemically synthesized
ctttttataggaagtttttagc

SEQ ID NO: 641674 - DNA, 22 bp, Artificial Sequence
  chemically synthesized
tctttttataggaagtttttag

SEQ ID NO: 641675 - DNA, 22 bp, Artificial Sequence
  chemically synthesized
agatgtgctaaaaacttcctat

SEQ ID NO: 641676 - DNA, 22 bp, Artificial Sequence
  chemically synthesized
agtgctttctttttataggaag

SEQ ID NO: 641677 - DNA, 22 bp, Artificial Sequence
  chemically synthesized
aaaacttcctataaaaagaaag

SEQ ID NO: 641678 - DNA, 22 bp, Artificial Sequence
  chemically synthesized
agataattaagtgctttctttt

SEQ ID NO: 641679 - DNA, 22 bp, Artificial Sequence
  chemically synthesized
cagataattaagtgctttcttt

SEQ ID NO: 641680 - DNA, 22 bp, Artificial Sequence
  chemically synthesized
cctataaaaagaaagcacttaa

SEQ ID NO: 641681 - DNA, 22 bp, Artificial Sequence
  chemically synthesized
catttcagataattaagtgctt

SEQ ID NO: 641682 - DNA, 22 bp, Artificial Sequence
  chemically synthesized
ctataaaaagaaagcacttaat

SEQ ID NO: 641683 - DNA, 22 bp, Artificial Sequence
  chemically synthesized
ccatttcagataattaagtgct

SEQ ID NO: 641684 - DNA, 22 bp, Artificial Sequence
  chemically synthesized
taaaaagaaagcacttaattat

SEQ ID NO: 641685 - DNA, 22 bp, Artificial Sequence
  chemically synthesized
cttccatttcagataattaagt

SEQ ID NO: 641686 - DNA, 22 bp, Artificial Sequence
  chemically synthesized
agtagattgcttccatttcaga

SEQ ID NO: 641687 - DNA, 22 bp, Artificial Sequence
  chemically synthesized
aattatctgaaatggaagcaat

SEQ ID NO: 641688 - DNA, 22 bp, Artificial Sequence
  chemically synthesized
attatctgaaatggaagcaatc

SEQ ID NO: 641689 - DNA, 22 bp, Artificial Sequence
  chemically synthesized
agtaggtctaagtagattgctt

SEQ ID NO: 641690 - DNA, 22 bp, Artificial Sequence
  chemically synthesized
tctgaaatggaagcaatctact

SEQ ID NO: 641691 - DNA, 22 bp, Artificial Sequence
  chemically synthesized
aaatggaagcaatctacttaga

SEQ ID NO: 641692 - DNA, 22 bp, Artificial Sequence
  chemically synthesized
ccaagctcagtaggtctaagta

SEQ ID NO: 641693 - DNA, 22 bp, Artificial Sequence
  chemically synthesized
tgccaagctcagtaggtctaag

SEQ ID NO: 641694 - DNA, 22 bp, Artificial Sequence
  chemically synthesized
cttagacctactgagcttggca

SEQ ID NO: 641695 - DNA, 22 bp, Artificial Sequence
  chemically synthesized
agacctactgagcttggcagaa

SEQ ID NO: 641696 - DNA, 22 bp, Artificial Sequence
  chemically synthesized
gatatgcatatgttctgccaag

SEQ ID NO: 641697 - DNA, 22 bp, Artificial Sequence
  chemically synthesized
gacctactgagcttggcagaac

SEQ ID NO: 641698 - DNA, 22 bp, Artificial Sequence
  chemically synthesized
ctgagcttggcagaacatatgc

SEQ ID NO: 641699 - DNA, 22 bp, Artificial Sequence
  chemically synthesized
agcgctagatatgcatatgttc

SEQ ID NO: 641700 - DNA, 22 bp, Artificial Sequence
  chemically synthesized
taagcgctagatatgcatatgt

SEQ ID NO: 641701 - DNA, 22 bp, Artificial Sequence
  chemically synthesized
agcttggcagaacatatgcata

SEQ ID NO: 641702 - DNA, 22 bp, Artificial Sequence
  chemically synthesized
ctaagcgctagatatgcatatg

SEQ ID NO: 641703 - DNA, 22 bp, Artificial Sequence
  chemically synthesized
tctaagcgctagatatgcatat

SEQ ID NO: 641704 - DNA, 22 bp, Artificial Sequence
  chemically synthesized
ggcagaacatatgcatatctag

SEQ ID NO: 641705 - DNA, 22 bp, Artificial Sequence
  chemically synthesized
gcagaacatatgcatatctagc

SEQ ID NO: 641706 - DNA, 22 bp, Artificial Sequence
  chemically synthesized
gtcactttctaagcgctagata

SEQ ID NO: 641707 - DNA, 22 bp, Artificial Sequence
  chemically synthesized
agtgattagtcactttctaagc

SEQ ID NO: 641708 - DNA, 22 bp, Artificial Sequence
  chemically synthesized
gcgcttagaaagtgactaatca

SEQ ID NO: 641709 - DNA, 22 bp, Artificial Sequence
  chemically synthesized
caggacaaatactgagtgatta

SEQ ID NO: 641710 - DNA, 22 bp, Artificial Sequence
  chemically synthesized
agaaagtgactaatcactcagt

SEQ ID NO: 641711 - DNA, 22 bp, Artificial Sequence
  chemically synthesized
gaaagtgactaatcactcagta

SEQ ID NO: 641712 - DNA, 22 bp, Artificial Sequence
  chemically synthesized
aggtatctacaggacaaatact

SEQ ID NO: 641713 - DNA, 22 bp, Artificial Sequence
  chemically synthesized
atcactcagtatttgtcctgta

SEQ ID NO: 641714 - DNA, 22 bp, Artificial Sequence
  chemically synthesized
gaactcaggtatctacaggaca

SEQ ID NO: 641715 - DNA, 22 bp, Artificial Sequence
  chemically synthesized
agtatttgtcctgtagatacct

SEQ ID NO: 641716 - DNA, 22 bp, Artificial Sequence
  chemically synthesized
ggggctagaactcaggtatcta

SEQ ID NO: 641717 - DNA, 22 bp, Artificial Sequence
  chemically synthesized
gtcctgtagatacctgagttct

SEQ ID NO: 641718 - DNA, 22 bp, Artificial Sequence
  chemically synthesized
tcctgtagatacctgagttcta

SEQ ID NO: 641719 - DNA, 22 bp, Artificial Sequence
  chemically synthesized
caatgtggctaggggctagaac

SEQ ID NO: 641720 - DNA, 22 bp, Artificial Sequence
  chemically synthesized
tagatacctgagttctagcccc

SEQ ID NO: 641721 - DNA, 22 bp, Artificial Sequence
  chemically synthesized
ggggtggctacaatgtggctag

SEQ ID NO: 641722 - DNA, 22 bp, Artificial Sequence
  chemically synthesized
agttctagcccctagccacatt

SEQ ID NO: 641723 - DNA, 22 bp, Artificial Sequence
  chemically synthesized
gggggtggctacaatgtggcta

SEQ ID NO: 641724 - DNA, 22 bp, Artificial Sequence
  chemically synthesized
tagcccctagccacattgtagc

SEQ ID NO: 641725 - DNA, 22 bp, Artificial Sequence
  chemically synthesized
gcccctagccacattgtagcca

SEQ ID NO: 641726 - DNA, 22 bp, Artificial Sequence
  chemically synthesized
caaaatttgggggtggctacaa

SEQ ID NO: 641727 - DNA, 22 bp, Artificial Sequence
  chemically synthesized
gccacattgtagccacccccaa

SEQ ID NO: 641728 - DNA, 22 bp, Artificial Sequence
  chemically synthesized
tagccacccccaaattttggaa

SEQ ID NO: 641729 - DNA, 22 bp, Artificial Sequence
  chemically synthesized
tggaattattgtgtatcatcca

SEQ ID NO: 641730 - DNA, 22 bp, Artificial Sequence
  chemically synthesized
aggcacagatgatggatgatac

SEQ ID NO: 641731 - DNA, 22 bp, Artificial Sequence
  chemically synthesized
ggaattattgtgtatcatccat

SEQ ID NO: 641732 - DNA, 22 bp, Artificial Sequence
  chemically synthesized
gaattattgtgtatcatccatc

SEQ ID NO: 641733 - DNA, 22 bp, Artificial Sequence
  chemically synthesized
ctaaggcacagatgatggatga

SEQ ID NO: 641734 - DNA, 22 bp, Artificial Sequence
  chemically synthesized
actaaggcacagatgatggatg

SEQ ID NO: 641735 - DNA, 22 bp, Artificial Sequence
  chemically synthesized
tactaaggcacagatgatggat

SEQ ID NO: 641736 - DNA, 22 bp, Artificial Sequence
  chemically synthesized
ttgtgtatcatccatcatctgt

SEQ ID NO: 641737 - DNA, 22 bp, Artificial Sequence
  chemically synthesized
tgtatcatccatcatctgtgcc

SEQ ID NO: 641738 - DNA, 22 bp, Artificial Sequence
  chemically synthesized
tgataaactttactaaggcaca

SEQ ID NO: 641739 - DNA, 22 bp, Artificial Sequence
  chemically synthesized
agctgtgataaactttactaag

SEQ ID NO: 641740 - DNA, 22 bp, Artificial Sequence
  chemically synthesized
tgccttagtaaagtttatcaca

SEQ ID NO: 641741 - DNA, 22 bp, Artificial Sequence
  chemically synthesized
cccagatgttcagctgtgataa

SEQ ID NO: 641742 - DNA, 22 bp, Artificial Sequence
  chemically synthesized
gcccagatgttcagctgtgata

SEQ ID NO: 641743 - DNA, 22 bp, Artificial Sequence
  chemically synthesized
tgcccagatgttcagctgtgat

SEQ ID NO: 641744 - DNA, 22 bp, Artificial Sequence
  chemically synthesized
agtaaagtttatcacagctgaa

SEQ ID NO: 641745 - DNA, 22 bp, Artificial Sequence
  chemically synthesized
gtaaagtttatcacagctgaac

SEQ ID NO: 641746 - DNA, 22 bp, Artificial Sequence
  chemically synthesized
attttgcccagatgttcagctg

SEQ ID NO: 641747 - DNA, 22 bp, Artificial Sequence
  chemically synthesized
cattttgcccagatgttcagct

SEQ ID NO: 641748 - DNA, 22 bp, Artificial Sequence
  chemically synthesized
atcacagctgaacatctgggca

SEQ ID NO: 641749 - DNA, 22 bp, Artificial Sequence
  chemically synthesized
tcacagctgaacatctgggcaa

SEQ ID NO: 641750 - DNA, 22 bp, Artificial Sequence
  chemically synthesized
agtgatttcattttgcccagat

SEQ ID NO: 641751 - DNA, 22 bp, Artificial Sequence
  chemically synthesized
actcagtgatttcattttgccc

SEQ ID NO: 641752 - DNA, 22 bp, Artificial Sequence
  chemically synthesized
aactcagtgatttcattttgcc

SEQ ID NO: 641753 - DNA, 22 bp, Artificial Sequence
  chemically synthesized
aacatctgggcaaaatgaaatc

SEQ ID NO: 641754 - DNA, 22 bp, Artificial Sequence
  chemically synthesized
gtgatcttaactcagtgatttc

SEQ ID NO: 641755 - DNA, 22 bp, Artificial Sequence
  chemically synthesized
ggcaaaatgaaatcactgagtt

SEQ ID NO: 641756 - DNA, 22 bp, Artificial Sequence
  chemically synthesized
atcctagtgatcttaactcagt

SEQ ID NO: 641757 - DNA, 22 bp, Artificial Sequence
  chemically synthesized
agttaagatcactaggatgaga

SEQ ID NO: 641758 - DNA, 22 bp, Artificial Sequence
  chemically synthesized
ggtcaaatcaaggaaatctcat

SEQ ID NO: 641759 - DNA, 22 bp, Artificial Sequence
  chemically synthesized
agatcactaggatgagatttcc

SEQ ID NO: 641760 - DNA, 22 bp, Artificial Sequence
  chemically synthesized
gcgtattgggtcaaatcaagga

SEQ ID NO: 641761 - DNA, 22 bp, Artificial Sequence
  chemically synthesized
ggatgagatttccttgatttga

SEQ ID NO: 641762 - DNA, 22 bp, Artificial Sequence
  chemically synthesized
atcacatacctagcgtattggg

SEQ ID NO: 641763 - DNA, 22 bp, Artificial Sequence
  chemically synthesized
ccttgatttgacccaatacgct

SEQ ID NO: 641764 - DNA, 22 bp, Artificial Sequence
  chemically synthesized
catcacatacctagcgtattgg

SEQ ID NO: 641765 - DNA, 22 bp, Artificial Sequence
  chemically synthesized
cttgatttgacccaatacgcta

SEQ ID NO: 641766 - DNA, 22 bp, Artificial Sequence
  chemically synthesized
gatttgacccaatacgctaggt

SEQ ID NO: 641767 - DNA, 22 bp, Artificial Sequence
  chemically synthesized
atttgacccaatacgctaggta

SEQ ID NO: 641768 - DNA, 22 bp, Artificial Sequence
  chemically synthesized
acagtttcatcacatacctagc

SEQ ID NO: 641769 - DNA, 22 bp, Artificial Sequence
  chemically synthesized
gacagtttcatcacatacctag

SEQ ID NO: 641770 - DNA, 22 bp, Artificial Sequence
  chemically synthesized
gacccaatacgctaggtatgtg

SEQ ID NO: 641771 - DNA, 22 bp, Artificial Sequence
  chemically synthesized
acccaatacgctaggtatgtga

SEQ ID NO: 641772 - DNA, 22 bp, Artificial Sequence
  chemically synthesized
taatttgacagtttcatcacat

SEQ ID NO: 641773 - DNA, 22 bp, Artificial Sequence
  chemically synthesized
ggtatgtgatgaaactgtcaaa

SEQ ID NO: 641774 - DNA, 22 bp, Artificial Sequence
  chemically synthesized
agcaatgatccatggacatatt

SEQ ID NO: 641775 - DNA, 22 bp, Artificial Sequence
  chemically synthesized
cagcaatgatccatggacatat

SEQ ID NO: 641776 - DNA, 22 bp, Artificial Sequence
  chemically synthesized
tcaaattataatatgtccatgg

SEQ ID NO: 641777 - DNA, 22 bp, Artificial Sequence
  chemically synthesized
tttcagcaatgatccatggaca

SEQ ID NO: 641778 - DNA, 22 bp, Artificial Sequence
  chemically synthesized
atttcagcaatgatccatggac

SEQ ID NO: 641779 - DNA, 22 bp, Artificial Sequence
  chemically synthesized
tatttcagcaatgatccatgga

SEQ ID NO: 641780 - DNA, 22 bp, Artificial Sequence
  chemically synthesized
taatatgtccatggatcattgc

SEQ ID NO: 641781 - DNA, 22 bp, Artificial Sequence
  chemically synthesized
gtccacatattttatttcagca

SEQ ID NO: 641782 - DNA, 22 bp, Artificial Sequence
  chemically synthesized
ggtccacatattttatttcagc

SEQ ID NO: 641783 - DNA, 22 bp, Artificial Sequence
  chemically synthesized
tacccttggtccacatatttta

SEQ ID NO: 641784 - DNA, 22 bp, Artificial Sequence
  chemically synthesized
ctgaaataaaatatgtggacca

SEQ ID NO: 641785 - DNA, 22 bp, Artificial Sequence
  chemically synthesized
accctgtacccttggtccacat

SEQ ID NO: 641786 - DNA, 22 bp, Artificial Sequence
  chemically synthesized
aaataaaatatgtggaccaagg

SEQ ID NO: 641787 - DNA, 22 bp, Artificial Sequence
  chemically synthesized
gatacattaaccctgtaccctt

SEQ ID NO: 641788 - DNA, 22 bp, Artificial Sequence
  chemically synthesized
cacctagatacattaaccctgt

SEQ ID NO: 641789 - DNA, 22 bp, Artificial Sequence
  chemically synthesized
atgtatctaggtggagtctatt

SEQ ID NO: 641790 - DNA, 22 bp, Artificial Sequence
  chemically synthesized
ggtggagtctattttctggata

SEQ ID NO: 641791 - DNA, 22 bp, Artificial Sequence
  chemically synthesized
cgtgtcaatgacatatccagaa

SEQ ID NO: 641792 - DNA, 22 bp, Artificial Sequence
  chemically synthesized
ttttctggatatgtcattgaca

SEQ ID NO: 641793 - DNA, 22 bp, Artificial Sequence
  chemically synthesized
tctggatatgtcattgacacgt

SEQ ID NO: 641794 - DNA, 22 bp, Artificial Sequence
  chemically synthesized
ctggatatgtcattgacacgta

SEQ ID NO: 641795 - DNA, 22 bp, Artificial Sequence
  chemically synthesized
tggatatgtcattgacacgtag

SEQ ID NO: 641796 - DNA, 22 bp, Artificial Sequence
  chemically synthesized
gatatgtcattgacacgtagat

SEQ ID NO: 641797 - DNA, 22 bp, Artificial Sequence
  chemically synthesized
agcaagatacagatctacgtgt

SEQ ID NO: 641798 - DNA, 22 bp, Artificial Sequence
  chemically synthesized
gagcaagatacagatctacgtg

SEQ ID NO: 641799 - DNA, 22 bp, Artificial Sequence
  chemically synthesized
gaacttgagcaagatacagatc

SEQ ID NO: 641800 - DNA, 22 bp, Artificial Sequence
  chemically synthesized
ggaacttgagcaagatacagat

SEQ ID NO: 641801 - DNA, 22 bp, Artificial Sequence
  chemically synthesized
ttggaacttgagcaagatacag

SEQ ID NO: 641802 - DNA, 22 bp, Artificial Sequence
  chemically synthesized
acacgtagatctgtatcttgct

SEQ ID NO: 641803 - DNA, 22 bp, Artificial Sequence
  chemically synthesized
tctcttggaacttgagcaagat

SEQ ID NO: 641804 - DNA, 22 bp, Artificial Sequence
  chemically synthesized
tgtctcttggaacttgagcaag

SEQ ID NO: 641805 - DNA, 22 bp, Artificial Sequence
  chemically synthesized
tcatgttctgtctcttggaact

SEQ ID NO: 641806 - DNA, 22 bp, Artificial Sequence
  chemically synthesized
tatcttgctcaagttccaagag

SEQ ID NO: 641807 - DNA, 22 bp, Artificial Sequence
  chemically synthesized
atattgtcatgttctgtctctt

SEQ ID NO: 641808 - DNA, 22 bp, Artificial Sequence
  chemically synthesized
gctcaagttccaagagacagaa

SEQ ID NO: 641809 - DNA, 22 bp, Artificial Sequence
  chemically synthesized
ctcaagttccaagagacagaac

SEQ ID NO: 641810 - DNA, 22 bp, Artificial Sequence
  chemically synthesized
aagttccaagagacagaacatg

SEQ ID NO: 641811 - DNA, 22 bp, Artificial Sequence
  chemically synthesized
aagccaattaatattgtcatgt

SEQ ID NO: 641812 - DNA, 22 bp, Artificial Sequence
  chemically synthesized
caagagacagaacatgacaata

SEQ ID NO: 641813 - DNA, 22 bp, Artificial Sequence
  chemically synthesized
agaaactgaagccaattaatat

SEQ ID NO: 641814 - DNA, 22 bp, Artificial Sequence
  chemically synthesized
aagattaagaaactgaagccaa

SEQ ID NO: 641815 - DNA, 22 bp, Artificial Sequence
  chemically synthesized
agtcattaaagattaagaaact

SEQ ID NO: 641816 - DNA, 22 bp, Artificial Sequence
  chemically synthesized
attggcttcagtttcttaatct

SEQ ID NO: 641817 - DNA, 22 bp, Artificial Sequence
  chemically synthesized
gcttcagtttcttaatctttaa

SEQ ID NO: 641818 - DNA, 22 bp, Artificial Sequence
  chemically synthesized
cagtttcttaatctttaatgac

SEQ ID NO: 641819 - DNA, 22 bp, Artificial Sequence
  chemically synthesized
agtttcttaatctttaatgact

SEQ ID NO: 641820 - DNA, 22 bp, Artificial Sequence
  chemically synthesized
tgaaaaacatctcagtcattaa

SEQ ID NO: 641821 - DNA, 22 bp, Artificial Sequence
  chemically synthesized
gtgaaaaacatctcagtcatta

SEQ ID NO: 641822 - DNA, 22 bp, Artificial Sequence
  chemically synthesized
cttaatctttaatgactgagat

SEQ ID NO: 641823 - DNA, 22 bp, Artificial Sequence
  chemically synthesized
ttaatctttaatgactgagatg

SEQ ID NO: 641824 - DNA, 22 bp, Artificial Sequence
  chemically synthesized
aatctttaatgactgagatgtt

SEQ ID NO: 641825 - DNA, 22 bp, Artificial Sequence
  chemically synthesized
atctttaatgactgagatgttt

SEQ ID NO: 641826 - DNA, 22 bp, Artificial Sequence
  chemically synthesized
atcaggaatttgtgaaaaacat

SEQ ID NO: 641827 - DNA, 22 bp, Artificial Sequence
  chemically synthesized
taatgactgagatgtttttcac

SEQ ID NO: 641828 - DNA, 22 bp, Artificial Sequence
  chemically synthesized
aatgactgagatgtttttcaca

SEQ ID NO: 641829 - DNA, 22 bp, Artificial Sequence
  chemically synthesized
atgactgagatgtttttcacaa

SEQ ID NO: 641830 - DNA, 22 bp, Artificial Sequence
  chemically synthesized
gcatctgatcaggaatttgtga

SEQ ID NO: 641831 - DNA, 22 bp, Artificial Sequence
  chemically synthesized
agatgtttttcacaaattcctg

SEQ ID NO: 641832 - DNA, 22 bp, Artificial Sequence
  chemically synthesized
ttcacaaattcctgatcagatg

SEQ ID NO: 641833 - DNA, 22 bp, Artificial Sequence
  chemically synthesized
tcacaaattcctgatcagatgc

SEQ ID NO: 641834 - DNA, 22 bp, Artificial Sequence
  chemically synthesized
cacaaattcctgatcagatgct

SEQ ID NO: 641835 - DNA, 22 bp, Artificial Sequence
  chemically synthesized
acaaattcctgatcagatgcta

SEQ ID NO: 641836 - DNA, 22 bp, Artificial Sequence
  chemically synthesized
tagacagtaatgaattagcatc

SEQ ID NO: 641837 - DNA, 22 bp, Artificial Sequence
  chemically synthesized
ctgatcagatgctaattcatta

SEQ ID NO: 641838 - DNA, 22 bp, Artificial Sequence
  chemically synthesized
gtctatagacagtaatgaatta

SEQ ID NO: 641839 - DNA, 22 bp, Artificial Sequence
  chemically synthesized
agtctatagacagtaatgaatt

SEQ ID NO: 641840 - DNA, 22 bp, Artificial Sequence
  chemically synthesized
atcagatgctaattcattactg

SEQ ID NO: 641841 - DNA, 22 bp, Artificial Sequence
  chemically synthesized
atacatttagtctatagacagt

SEQ ID NO: 641842 - DNA, 22 bp, Artificial Sequence
  chemically synthesized
attaatacatttagtctataga

SEQ ID NO: 641843 - DNA, 22 bp, Artificial Sequence
  chemically synthesized
attcattactgtctatagacta

SEQ ID NO: 641844 - DNA, 22 bp, Artificial Sequence
  chemically synthesized
gattaatacatttagtctatag

SEQ ID NO: 641845 - DNA, 22 bp, Artificial Sequence
  chemically synthesized
tgattaatacatttagtctata

SEQ ID NO: 641846 - DNA, 22 bp, Artificial Sequence
  chemically synthesized
ttgattaatacatttagtctat

SEQ ID NO: 641847 - DNA, 22 bp, Artificial Sequence
  chemically synthesized
attactgtctatagactaaatg

SEQ ID NO: 641848 - DNA, 22 bp, Artificial Sequence
  chemically synthesized
aacttttgattaatacatttag

SEQ ID NO: 641849 - DNA, 22 bp, Artificial Sequence
  chemically synthesized
ctgtctatagactaaatgtatt

SEQ ID NO: 641850 - DNA, 22 bp, Artificial Sequence
  chemically synthesized
tctatagactaaatgtattaat

SEQ ID NO: 641851 - DNA, 22 bp, Artificial Sequence
  chemically synthesized
tgttgaacttttgattaataca

SEQ ID NO: 641852 - DNA, 22 bp, Artificial Sequence
  chemically synthesized
gtgttgaacttttgattaatac

SEQ ID NO: 641853 - DNA, 22 bp, Artificial Sequence
  chemically synthesized
tagactaaatgtattaatcaaa

SEQ ID NO: 641854 - DNA, 22 bp, Artificial Sequence
  chemically synthesized
ttgtgttgaacttttgattaat

SEQ ID NO: 641855 - DNA, 22 bp, Artificial Sequence
  chemically synthesized
cttgtgttgaacttttgattaa

SEQ ID NO: 641856 - DNA, 22 bp, Artificial Sequence
  chemically synthesized
ttcttgtgttgaacttttgatt

SEQ ID NO: 641857 - DNA, 22 bp, Artificial Sequence
  chemically synthesized
aatgtattaatcaaaagttcaa

SEQ ID NO: 641858 - DNA, 22 bp, Artificial Sequence
  chemically synthesized
tgaattcttcttgtgttgaact

SEQ ID NO: 641859 - DNA, 22 bp, Artificial Sequence
  chemically synthesized
atgaattcttcttgtgttgaac

SEQ ID NO: 641860 - DNA, 22 bp, Artificial Sequence
  chemically synthesized
ttatgaattcttcttgtgttga

SEQ ID NO: 641861 - DNA, 22 bp, Artificial Sequence
  chemically synthesized
cttatgaattcttcttgtgttg

SEQ ID NO: 641862 - DNA, 22 bp, Artificial Sequence
  chemically synthesized
atcaaaagttcaacacaagaag

SEQ ID NO: 641863 - DNA, 22 bp, Artificial Sequence
  chemically synthesized
aaatttcttatgaattcttctt

SEQ ID NO: 641864 - DNA, 22 bp, Artificial Sequence
  chemically synthesized
aacacaagaagaattcataaga

SEQ ID NO: 641865 - DNA, 22 bp, Artificial Sequence
  chemically synthesized
taagtggttaaaatttcttatg

SEQ ID NO: 641866 - DNA, 22 bp, Artificial Sequence
  chemically synthesized
cagttataagtggttaaaattt

SEQ ID NO: 641867 - DNA, 22 bp, Artificial Sequence
  chemically synthesized
ccagttataagtggttaaaatt

SEQ ID NO: 641868 - DNA, 22 bp, Artificial Sequence
  chemically synthesized
tttccagttataagtggttaaa

SEQ ID NO: 641869 - DNA, 22 bp, Artificial Sequence
  chemically synthesized
atttccagttataagtggttaa

SEQ ID NO: 641870 - DNA, 22 bp, Artificial Sequence
  chemically synthesized
ataagaaattttaaccacttat

SEQ ID NO: 641871 - DNA, 22 bp, Artificial Sequence
  chemically synthesized
tcttatttccagttataagtgg

SEQ ID NO: 641872 - DNA, 22 bp, Artificial Sequence
  chemically synthesized
gtctgtcttatttccagttata

SEQ ID NO: 641873 - DNA, 22 bp, Artificial Sequence
  chemically synthesized
ttagtctgtcttatttccagtt

SEQ ID NO: 641874 - DNA, 22 bp, Artificial Sequence
  chemically synthesized
taaccacttataactggaaata

SEQ ID NO: 641875 - DNA, 22 bp, Artificial Sequence
  chemically synthesized
gttagtctgtcttatttccagt

SEQ ID NO: 641876 - DNA, 22 bp, Artificial Sequence
  chemically synthesized
aaccacttataactggaaataa

SEQ ID NO: 641877 - DNA, 22 bp, Artificial Sequence
  chemically synthesized
tgttagtctgtcttatttccag

SEQ ID NO: 641878 - DNA, 22 bp, Artificial Sequence
  chemically synthesized
accacttataactggaaataag

SEQ ID NO: 641879 - DNA, 22 bp, Artificial Sequence
  chemically synthesized
ggttttgttagtctgtcttatt

SEQ ID NO: 641880 - DNA, 22 bp, Artificial Sequence
  chemically synthesized
aggttttgttagtctgtcttat

SEQ ID NO: 641881 - DNA, 22 bp, Artificial Sequence
  chemically synthesized
ataactggaaataagacagact

SEQ ID NO: 641882 - DNA, 22 bp, Artificial Sequence
  chemically synthesized
taactggaaataagacagacta

SEQ ID NO: 641883 - DNA, 22 bp, Artificial Sequence
  chemically synthesized
tcttaggttttgttagtctgtc

SEQ ID NO: 641884 - DNA, 22 bp, Artificial Sequence
  chemically synthesized
gtcttaggttttgttagtctgt

SEQ ID NO: 641885 - DNA, 22 bp, Artificial Sequence
  chemically synthesized
tgtcttaggttttgttagtctg

SEQ ID NO: 641886 - DNA, 22 bp, Artificial Sequence
  chemically synthesized
ttgtcttaggttttgttagtct

SEQ ID NO: 641887 - DNA, 22 bp, Artificial Sequence
  chemically synthesized
gaaataagacagactaacaaaa

SEQ ID NO: 641888 - DNA, 22 bp, Artificial Sequence
  chemically synthesized
ccatttttgtcttaggttttgt

SEQ ID NO: 641889 - DNA, 22 bp, Artificial Sequence
  chemically synthesized
acaaaacctaagacaaaaatgg

SEQ ID NO: 641890 - DNA, 22 bp, Artificial Sequence
  chemically synthesized
atgatgaccagccactgccatt

SEQ ID NO: 641891 - DNA, 22 bp, Artificial Sequence
  chemically synthesized
gctgatgatgaccagccactgc

SEQ ID NO: 641892 - DNA, 22 bp, Artificial Sequence
  chemically synthesized
agacaaaaatggcagtggctgg

SEQ ID NO: 641893 - DNA, 22 bp, Artificial Sequence
  chemically synthesized
ggctgatgatgaccagccactg

SEQ ID NO: 641894 - DNA, 22 bp, Artificial Sequence
  chemically synthesized
tggctgatgatgaccagccact

SEQ ID NO: 641895 - DNA, 22 bp, Artificial Sequence
  chemically synthesized
ttggctgatgatgaccagccac

SEQ ID NO: 641896 - DNA, 22 bp, Artificial Sequence
  chemically synthesized
cttttggctgatgatgaccagc

SEQ ID NO: 641897 - DNA, 22 bp, Artificial Sequence
  chemically synthesized
ccttttggctgatgatgaccag

SEQ ID NO: 641898 - DNA, 22 bp, Artificial Sequence
  chemically synthesized
tccttttggctgatgatgacca

SEQ ID NO: 641899 - DNA, 22 bp, Artificial Sequence
  chemically synthesized
ttccttttggctgatgatgacc

SEQ ID NO: 641900 - DNA, 22 bp, Artificial Sequence
  chemically synthesized
gtttttccttttggctgatgat

SEQ ID NO: 641901 - DNA, 22 bp, Artificial Sequence
  chemically synthesized
caatcctagtttttccttttgg

SEQ ID NO: 641902 - DNA, 22 bp, Artificial Sequence
  chemically synthesized
gtcatcatcagccaaaaggaaa

SEQ ID NO: 641903 - DNA, 22 bp, Artificial Sequence
  chemically synthesized
tccaatcctagtttttcctttt

SEQ ID NO: 641904 - DNA, 22 bp, Artificial Sequence
  chemically synthesized
aaacctctccaatcctagtttt

SEQ ID NO: 641905 - DNA, 22 bp, Artificial Sequence
  chemically synthesized
taaaacctctccaatcctagtt

SEQ ID NO: 641906 - DNA, 22 bp, Artificial Sequence
  chemically synthesized
acctctaaaacctctccaatcc

SEQ ID NO: 641907 - DNA, 22 bp, Artificial Sequence
  chemically synthesized
cacctctaaaacctctccaatc

SEQ ID NO: 641908 - DNA, 22 bp, Artificial Sequence
  chemically synthesized
ttcacctctaaaacctctccaa

SEQ ID NO: 641909 - DNA, 22 bp, Artificial Sequence
  chemically synthesized
gagttcttcacctctaaaacct

SEQ ID NO: 641910 - DNA, 22 bp, Artificial Sequence
  chemically synthesized
ggattggagaggttttagaggt

SEQ ID NO: 641911 - DNA, 22 bp, Artificial Sequence
  chemically synthesized
aggactagagttcttcacctct

SEQ ID NO: 641912 - DNA, 22 bp, Artificial Sequence
  chemically synthesized
gagaggttttagaggtgaagaa

SEQ ID NO: 641913 - DNA, 22 bp, Artificial Sequence
  chemically synthesized
ctgaggactagagttcttcacc

SEQ ID NO: 641914 - DNA, 22 bp, Artificial Sequence
  chemically synthesized
tagaggtgaagaactctagtcc

SEQ ID NO: 641915 - DNA, 22 bp, Artificial Sequence
  chemically synthesized
agaggtgaagaactctagtcct

SEQ ID NO: 641916 - DNA, 22 bp, Artificial Sequence
  chemically synthesized
gaggtgaagaactctagtcctc

SEQ ID NO: 641917 - DNA, 22 bp, Artificial Sequence
  chemically synthesized
ccaatggcagtattcctgagga

SEQ ID NO: 641918 - DNA, 22 bp, Artificial Sequence
  chemically synthesized
cccaatggcagtattcctgagg

SEQ ID NO: 641919 - DNA, 22 bp, Artificial Sequence
  chemically synthesized
tcccaatggcagtattcctgag

SEQ ID NO: 641920 - DNA, 22 bp, Artificial Sequence
  chemically synthesized
ttcccaatggcagtattcctga

SEQ ID NO: 641921 - DNA, 22 bp, Artificial Sequence
  chemically synthesized
tagtcctcaggaatactgccat

SEQ ID NO: 641922 - DNA, 22 bp, Artificial Sequence
  chemically synthesized
gtcctcaggaatactgccattg

SEQ ID NO: 641923 - DNA, 22 bp, Artificial Sequence
  chemically synthesized
aggaatactgccattgggaaaa

SEQ ID NO: 641924 - DNA, 22 bp, Artificial Sequence
  chemically synthesized
aaaatggaaacacacttttccc

SEQ ID NO: 641925 - DNA, 22 bp, Artificial Sequence
  chemically synthesized
tctgaaaatggaaacacacttt

SEQ ID NO: 641926 - DNA, 22 bp, Artificial Sequence
  chemically synthesized
gtctgaaaatggaaacacactt

SEQ ID NO: 641927 - DNA, 22 bp, Artificial Sequence
  chemically synthesized
ccattgggaaaagtgtgtttcc

SEQ ID NO: 641928 - DNA, 22 bp, Artificial Sequence
  chemically synthesized
tatttgtctgaaaatggaaaca

SEQ ID NO: 641929 - DNA, 22 bp, Artificial Sequence
  chemically synthesized
ggaaaagtgtgtttccattttc

SEQ ID NO: 641930 - DNA, 22 bp, Artificial Sequence
  chemically synthesized
ctgtatttgtctgaaaatggaa

SEQ ID NO: 641931 - DNA, 22 bp, Artificial Sequence
  chemically synthesized
gctgtatttgtctgaaaatgga

SEQ ID NO: 641932 - DNA, 22 bp, Artificial Sequence
  chemically synthesized
tgctgtatttgtctgaaaatgg

SEQ ID NO: 641933 - DNA, 22 bp, Artificial Sequence
  chemically synthesized
atattttgctgtatttgtctga

SEQ ID NO: 641934 - DNA, 22 bp, Artificial Sequence
  chemically synthesized
gatattttgctgtatttgtctg

SEQ ID NO: 641935 - DNA, 22 bp, Artificial Sequence
  chemically synthesized
ccattttcagacaaatacagca

SEQ ID NO: 641936 - DNA, 22 bp, Artificial Sequence
  chemically synthesized
cattttcagacaaatacagcaa

SEQ ID NO: 641937 - DNA, 22 bp, Artificial Sequence
  chemically synthesized
tcagacaaatacagcaaaatat

SEQ ID NO: 641938 - DNA, 22 bp, Artificial Sequence
  chemically synthesized
cagacaaatacagcaaaatatc

SEQ ID NO: 641939 - DNA, 22 bp, Artificial Sequence
  chemically synthesized
agacaaatacagcaaaatatca

SEQ ID NO: 641940 - DNA, 22 bp, Artificial Sequence
  chemically synthesized
accacagacaatgaaagtttga

SEQ ID NO: 641941 - DNA, 22 bp, Artificial Sequence
  chemically synthesized
ctgaccacagacaatgaaagtt

SEQ ID NO: 641942 - DNA, 22 bp, Artificial Sequence
  chemically synthesized
gctgaccacagacaatgaaagt

SEQ ID NO: 641943 - DNA, 22 bp, Artificial Sequence
  chemically synthesized
tgctgaccacagacaatgaaag

SEQ ID NO: 641944 - DNA, 22 bp, Artificial Sequence
  chemically synthesized
ttgctgaccacagacaatgaaa

SEQ ID NO: 641945 - DNA, 22 bp, Artificial Sequence
  chemically synthesized
tttgctgaccacagacaatgaa

SEQ ID NO: 641946 - DNA, 22 bp, Artificial Sequence
  chemically synthesized
cggctttttgctgaccacagac

SEQ ID NO: 641947 - DNA, 22 bp, Artificial Sequence
  chemically synthesized
ttacggctttttgctgaccaca

SEQ ID NO: 641948 - DNA, 22 bp, Artificial Sequence
  chemically synthesized
tcattgtctgtggtcagcaaaa

SEQ ID NO: 641949 - DNA, 22 bp, Artificial Sequence
  chemically synthesized
cattgtctgtggtcagcaaaaa

SEQ ID NO: 641950 - DNA, 22 bp, Artificial Sequence
  chemically synthesized
attgtctgtggtcagcaaaaag

SEQ ID NO: 641951 - DNA, 22 bp, Artificial Sequence
  chemically synthesized
gagactgttacggctttttgct

SEQ ID NO: 641952 - DNA, 22 bp, Artificial Sequence
  chemically synthesized
tagagactgttacggctttttg

SEQ ID NO: 641953 - DNA, 22 bp, Artificial Sequence
  chemically synthesized
tctgtggtcagcaaaaagccgt

SEQ ID NO: 641954 - DNA, 22 bp, Artificial Sequence
  chemically synthesized
ctagagactgttacggcttttt

SEQ ID NO: 641955 - DNA, 22 bp, Artificial Sequence
  chemically synthesized
ttctagagactgttacggcttt

SEQ ID NO: 641956 - DNA, 22 bp, Artificial Sequence
  chemically synthesized
tggtcagcaaaaagccgtaaca

SEQ ID NO: 641957 - DNA, 22 bp, Artificial Sequence
  chemically synthesized
tgattcttctagagactgttac

SEQ ID NO: 641958 - DNA, 22 bp, Artificial Sequence
  chemically synthesized
aaattatgattcttctagagac

SEQ ID NO: 641959 - DNA, 22 bp, Artificial Sequence
  chemically synthesized
aaaattatgattcttctagaga

SEQ ID NO: 641960 - DNA, 22 bp, Artificial Sequence
  chemically synthesized
tagaagaatcataattttaagc

SEQ ID NO: 641961 - DNA, 22 bp, Artificial Sequence
  chemically synthesized
gaagaatcataattttaagctt

SEQ ID NO: 641962 - DNA, 22 bp, Artificial Sequence
  chemically synthesized
aagccgggacacacaaagctta

SEQ ID NO: 641963 - DNA, 22 bp, Artificial Sequence
  chemically synthesized
taagctttgtgtgtcccggctt

SEQ ID NO: 641964 - DNA, 22 bp, Artificial Sequence
  chemically synthesized
aagctttgtgtgtcccggcttc

SEQ ID NO: 641965 - DNA, 22 bp, Artificial Sequence
  chemically synthesized
agctttgtgtgtcccggcttca

SEQ ID NO: 641966 - DNA, 22 bp, Artificial Sequence
  chemically synthesized
cgcatgagggattgaagccggg

SEQ ID NO: 641967 - DNA, 22 bp, Artificial Sequence
  chemically synthesized
actacgcatgagggattgaagc

SEQ ID NO: 641968 - DNA, 22 bp, Artificial Sequence
  chemically synthesized
tgtgtgtcccggcttcaatccc

SEQ ID NO: 641969 - DNA, 22 bp, Artificial Sequence
  chemically synthesized
gtgtgtcccggcttcaatccct

SEQ ID NO: 641970 - DNA, 22 bp, Artificial Sequence
  chemically synthesized
tgtgtcccggcttcaatccctc

SEQ ID NO: 641971 - DNA, 22 bp, Artificial Sequence
  chemically synthesized
agtctaactacgcatgagggat

SEQ ID NO: 641972 - DNA, 22 bp, Artificial Sequence
  chemically synthesized
agactaagtctaactacgcatg

SEQ ID NO: 641973 - DNA, 22 bp, Artificial Sequence
  chemically synthesized
aagactaagtctaactacgcat

SEQ ID NO: 641974 - DNA, 22 bp, Artificial Sequence
  chemically synthesized
caatccctcatgcgtagttaga

SEQ ID NO: 641975 - DNA, 22 bp, Artificial Sequence
  chemically synthesized
aatccctcatgcgtagttagac

SEQ ID NO: 641976 - DNA, 22 bp, Artificial Sequence
  chemically synthesized
ggagaacttaagactaagtcta

SEQ ID NO: 641977 - DNA, 22 bp, Artificial Sequence
  chemically synthesized
atgcgtagttagacttagtctt

SEQ ID NO: 641978 - DNA, 22 bp, Artificial Sequence
  chemically synthesized
ctgggagaacttaagactaagt

SEQ ID NO: 641979 - DNA, 22 bp, Artificial Sequence
  chemically synthesized
aagttactgggagaacttaaga

SEQ ID NO: 641980 - DNA, 22 bp, Artificial Sequence
  chemically synthesized
gacttagtcttaagttctccca

SEQ ID NO: 641981 - DNA, 22 bp, Artificial Sequence
  chemically synthesized
agtcttaagttctcccagtaac

SEQ ID NO: 641982 - DNA, 22 bp, Artificial Sequence
  chemically synthesized
gtcttaagttctcccagtaact

SEQ ID NO: 641983 - DNA, 22 bp, Artificial Sequence
  chemically synthesized
aagttctcccagtaacttcaat

SEQ ID NO: 641984 - DNA, 22 bp, Artificial Sequence
  chemically synthesized
agttctcccagtaacttcaatt

SEQ ID NO: 641985 - DNA, 22 bp, Artificial Sequence
  chemically synthesized
tcccagtaacttcaatttgatg

SEQ ID NO: 641986 - DNA, 22 bp, Artificial Sequence
  chemically synthesized
ccagtaacttcaatttgatggc

SEQ ID NO: 641987 - DNA, 22 bp, Artificial Sequence
  chemically synthesized
caatttgatggcctatttttca

SEQ ID NO: 641988 - DNA, 22 bp, Artificial Sequence
  chemically synthesized
aatttgatggcctatttttcac

SEQ ID NO: 641989 - DNA, 22 bp, Artificial Sequence
  chemically synthesized
gatggcctatttttcactccct

SEQ ID NO: 641990 - DNA, 22 bp, Artificial Sequence
  chemically synthesized
atggcctatttttcactccctg

SEQ ID NO: 641991 - DNA, 22 bp, Artificial Sequence
  chemically synthesized
tttttcactccctggcatgcac

SEQ ID NO: 641992 - DNA, 22 bp, Artificial Sequence
  chemically synthesized
ttcactccctggcatgcactgc

SEQ ID NO: 641993 - DNA, 22 bp, Artificial Sequence
  chemically synthesized
tcactccctggcatgcactgct

SEQ ID NO: 641994 - DNA, 22 bp, Artificial Sequence
  chemically synthesized
cactccctggcatgcactgcta

SEQ ID NO: 641995 - DNA, 22 bp, Artificial Sequence
  chemically synthesized
actccctggcatgcactgctat

SEQ ID NO: 641996 - DNA, 22 bp, Artificial Sequence
  chemically synthesized
cctggcatgcactgctatatac

SEQ ID NO: 641997 - DNA, 22 bp, Artificial Sequence
  chemically synthesized
gcatgcactgctatatactctt

SEQ ID NO: 641998 - DNA, 22 bp, Artificial Sequence
  chemically synthesized
ctatatactcttgccatatatg

SEQ ID NO: 641999 - DNA, 22 bp, Artificial Sequence
  chemically synthesized
tatactcttgccatatatgatc

SEQ ID NO: 642000 - DNA, 22 bp, Artificial Sequence
  chemically synthesized
taatagaggaggccataggatc

SEQ ID NO: 642001 - DNA, 22 bp, Artificial Sequence
  chemically synthesized
ttgccatatatgatcctatggc

SEQ ID NO: 642002 - DNA, 22 bp, Artificial Sequence
  chemically synthesized
gccatatatgatcctatggcct

SEQ ID NO: 642003 - DNA, 22 bp, Artificial Sequence
  chemically synthesized
ccatatatgatcctatggcctc

SEQ ID NO: 642004 - DNA, 22 bp, Artificial Sequence
  chemically synthesized
tcattgtaatagaggaggccat

SEQ ID NO: 642005 - DNA, 22 bp, Artificial Sequence
  chemically synthesized
tgtcattgtaatagaggaggcc

SEQ ID NO: 642006 - DNA, 22 bp, Artificial Sequence
  chemically synthesized
ctgtcattgtaatagaggaggc

SEQ ID NO: 642007 - DNA, 22 bp, Artificial Sequence
  chemically synthesized
tagtttctgtcattgtaataga

SEQ ID NO: 642008 - DNA, 22 bp, Artificial Sequence
  chemically synthesized
tatagtttctgtcattgtaata

SEQ ID NO: 642009 - DNA, 22 bp, Artificial Sequence
  chemically synthesized
tggcctcctctattacaatgac

SEQ ID NO: 642010 - DNA, 22 bp, Artificial Sequence
  chemically synthesized
ctctattacaatgacagaaact

SEQ ID NO: 642011 - DNA, 22 bp, Artificial Sequence
  chemically synthesized
tattacaatgacagaaactata

SEQ ID NO: 642012 - DNA, 22 bp, Artificial Sequence
  chemically synthesized
ttacaatgacagaaactataga

SEQ ID NO: 642013 - DNA, 22 bp, Artificial Sequence
  chemically synthesized
caatgacagaaactatagaatc

SEQ ID NO: 642014 - DNA, 22 bp, Artificial Sequence
  chemically synthesized
aaaaaaagaaaaaaaaaaaaaa

SEQ ID NO: 642015 - DNA, 22 bp, Artificial Sequence
  chemically synthesized
tctcaaaaaaagaaaaaaaaaa

SEQ ID NO: 642016 - DNA, 22 bp, Artificial Sequence
  chemically synthesized
tagaatcttttttttttttttc

SEQ ID NO: 642017 - DNA, 22 bp, Artificial Sequence
  chemically synthesized
ttttttttttttctttttttga

SEQ ID NO: 642018 - DNA, 22 bp, Artificial Sequence
  chemically synthesized
tttttttttttctttttttgag

SEQ ID NO: 642019 - DNA, 22 bp, Artificial Sequence
  chemically synthesized
ttttttttttctttttttgaga

SEQ ID NO: 642020 - DNA, 22 bp, Artificial Sequence
  chemically synthesized
tttttttttctttttttgagac

SEQ ID NO: 642021 - DNA, 22 bp, Artificial Sequence
  chemically synthesized
ttttttttctttttttgagaca

SEQ ID NO: 642022 - DNA, 22 bp, Artificial Sequence
  chemically synthesized
tttttttctttttttgagacag

SEQ ID NO: 642023 - DNA, 22 bp, Artificial Sequence
  chemically synthesized
ttttttctttttttgagacagg

SEQ ID NO: 642024 - DNA, 22 bp, Artificial Sequence
  chemically synthesized
tttttctttttttgagacaggg

SEQ ID NO: 642025 - DNA, 22 bp, Artificial Sequence
  chemically synthesized
ttttctttttttgagacagggc

SEQ ID NO: 642026 - DNA, 22 bp, Artificial Sequence
  chemically synthesized
tttctttttttgagacagggcc

SEQ ID NO: 642027 - DNA, 22 bp, Artificial Sequence
  chemically synthesized
ttctttttttgagacagggcct

SEQ ID NO: 642028 - DNA, 22 bp, Artificial Sequence
  chemically synthesized
ggtgacagagcaaggccctgtc

SEQ ID NO: 642029 - DNA, 22 bp, Artificial Sequence
  chemically synthesized
tctttttttgagacagggcctt

SEQ ID NO: 642030 - DNA, 22 bp, Artificial Sequence
  chemically synthesized
ctttttttgagacagggccttg

SEQ ID NO: 642031 - DNA, 22 bp, Artificial Sequence
  chemically synthesized
tttttttgagacagggccttgc

SEQ ID NO: 642032 - DNA, 22 bp, Artificial Sequence
  chemically synthesized
tttttgagacagggccttgctc

SEQ ID NO: 642033 - DNA, 22 bp, Artificial Sequence
  chemically synthesized
ttttgagacagggccttgctct

SEQ ID NO: 642034 - DNA, 22 bp, Artificial Sequence
  chemically synthesized
tttgagacagggccttgctctg

SEQ ID NO: 642035 - DNA, 22 bp, Artificial Sequence
  chemically synthesized
cagcctgggtgacagagcaagg

SEQ ID NO: 642036 - DNA, 22 bp, Artificial Sequence
  chemically synthesized
ttgagacagggccttgctctgt

SEQ ID NO: 642037 - DNA, 22 bp, Artificial Sequence
  chemically synthesized
tgagacagggccttgctctgtc

SEQ ID NO: 642038 - DNA, 22 bp, Artificial Sequence
  chemically synthesized
gagacagggccttgctctgtca

SEQ ID NO: 642039 - DNA, 22 bp, Artificial Sequence
  chemically synthesized
agacagggccttgctctgtcac

SEQ ID NO: 642040 - DNA, 22 bp, Artificial Sequence
  chemically synthesized
cactccagcctgggtgacagag

SEQ ID NO: 642041 - DNA, 22 bp, Artificial Sequence
  chemically synthesized
caccactgcactccagcctggg

SEQ ID NO: 642042 - DNA, 22 bp, Artificial Sequence
  chemically synthesized
gctctgtcacccaggctggagt

SEQ ID NO: 642043 - DNA, 22 bp, Artificial Sequence
  chemically synthesized
ctctgtcacccaggctggagtg

SEQ ID NO: 642044 - DNA, 22 bp, Artificial Sequence
  chemically synthesized
tgattacaccactgcactccag

SEQ ID NO: 642045 - DNA, 22 bp, Artificial Sequence
  chemically synthesized
tgtcacccaggctggagtgcag

SEQ ID NO: 642046 - DNA, 22 bp, Artificial Sequence
  chemically synthesized
tcacccaggctggagtgcagtg

SEQ ID NO: 642047 - DNA, 22 bp, Artificial Sequence
  chemically synthesized
cagtgagctatgattacaccac

SEQ ID NO: 642048 - DNA, 22 bp, Artificial Sequence
  chemically synthesized
gagtgcagtggtgtaatcatag

SEQ ID NO: 642049 - DNA, 22 bp, Artificial Sequence
  chemically synthesized
aaggttacagtgagctatgatt

SEQ ID NO: 642050 - DNA, 22 bp, Artificial Sequence
  chemically synthesized
agcccaggaattcaaggttaca

SEQ ID NO: 642051 - DNA, 22 bp, Artificial Sequence
  chemically synthesized
gagcccaggaattcaaggttac

SEQ ID NO: 642052 - DNA, 22 bp, Artificial Sequence
  chemically synthesized
actgtaaccttgaattcctggg

SEQ ID NO: 642053 - DNA, 22 bp, Artificial Sequence
  chemically synthesized
gaggatcacttgagcccaggaa

SEQ ID NO: 642054 - DNA, 22 bp, Artificial Sequence
  chemically synthesized
taaccttgaattcctgggctca

SEQ ID NO: 642055 - DNA, 22 bp, Artificial Sequence
  chemically synthesized
gggctggaggatcacttgagcc

SEQ ID NO: 642056 - DNA, 22 bp, Artificial Sequence
  chemically synthesized
gaattcctgggctcaagtgatc

SEQ ID NO: 642057 - DNA, 22 bp, Artificial Sequence
  chemically synthesized
aattcctgggctcaagtgatcc

SEQ ID NO: 642058 - DNA, 22 bp, Artificial Sequence
  chemically synthesized
ctgggctcaagtgatcctccag

SEQ ID NO: 642059 - DNA, 22 bp, Artificial Sequence
  chemically synthesized
aagaggctggggctggaggatc

SEQ ID NO: 642060 - DNA, 22 bp, Artificial Sequence
  chemically synthesized
ggctcaagtgatcctccagccc

SEQ ID NO: 642061 - DNA, 22 bp, Artificial Sequence
  chemically synthesized
ctcaagaggctggggctggagg

SEQ ID NO: 642062 - DNA, 22 bp, Artificial Sequence
  chemically synthesized
aagtgatcctccagccccagcc

SEQ ID NO: 642063 - DNA, 22 bp, Artificial Sequence
  chemically synthesized
tagtcccaactactcaagaggc

SEQ ID NO: 642064 - DNA, 22 bp, Artificial Sequence
  chemically synthesized
cagccccagcctcttgagtagt

SEQ ID NO: 642065 - DNA, 22 bp, Artificial Sequence
  chemically synthesized
atgcctgtagtcccaactactc

SEQ ID NO: 642066 - DNA, 22 bp, Artificial Sequence
  chemically synthesized
ttgagtagttgggactacaggc

SEQ ID NO: 642067 - DNA, 22 bp, Artificial Sequence
  chemically synthesized
gagtagttgggactacaggcat

SEQ ID NO: 642068 - DNA, 22 bp, Artificial Sequence
  chemically synthesized
agtagttgggactacaggcatg

SEQ ID NO: 642069 - DNA, 22 bp, Artificial Sequence
  chemically synthesized
gccaggcatggtggctcatgcc

SEQ ID NO: 642070 - DNA, 22 bp, Artificial Sequence
  chemically synthesized
ggactacaggcatgagccacca

SEQ ID NO: 642071 - DNA, 22 bp, Artificial Sequence
  chemically synthesized
attagccaggcatggtggctca

SEQ ID NO: 642072 - DNA, 22 bp, Artificial Sequence
  chemically synthesized
aattagccaggcatggtggctc

SEQ ID NO: 642073 - DNA, 22 bp, Artificial Sequence
  chemically synthesized
taattagccaggcatggtggct

SEQ ID NO: 642074 - DNA, 22 bp, Artificial Sequence
  chemically synthesized
ttaattagccaggcatggtggc

SEQ ID NO: 642075 - DNA, 22 bp, Artificial Sequence
  chemically synthesized
tttaattagccaggcatggtgg

SEQ ID NO: 642076 - DNA, 22 bp, Artificial Sequence
  chemically synthesized
ttttaattagccaggcatggtg

SEQ ID NO: 642077 - DNA, 22 bp, Artificial Sequence
  chemically synthesized
caggcatgagccaccatgcctg

SEQ ID NO: 642078 - DNA, 22 bp, Artificial Sequence
  chemically synthesized
tttttaattagccaggcatggt

SEQ ID NO: 642079 - DNA, 22 bp, Artificial Sequence
  chemically synthesized
ttttttaattagccaggcatgg

SEQ ID NO: 642080 - DNA, 22 bp, Artificial Sequence
  chemically synthesized
tttttttaattagccaggcatg

SEQ ID NO: 642081 - DNA, 22 bp, Artificial Sequence
  chemically synthesized
ttttttttaattagccaggcat

SEQ ID NO: 642082 - DNA, 22 bp, Artificial Sequence
  chemically synthesized
caatttttttttttaattagcc

SEQ ID NO: 642083 - DNA, 22 bp, Artificial Sequence
  chemically synthesized
tacaatttttttttttaattag

SEQ ID NO: 642084 - DNA, 22 bp, Artificial Sequence
  chemically synthesized
gctaattaaaaaaaaaaattgt

SEQ ID NO: 642085 - DNA, 22 bp, Artificial Sequence
  chemically synthesized
attaaaaaaaaaaattgtagag

SEQ ID NO: 642086 - DNA, 22 bp, Artificial Sequence
  chemically synthesized
aaaaaaaaaattgtagagacgg

SEQ ID NO: 642087 - DNA, 22 bp, Artificial Sequence
  chemically synthesized
ggcaacatggggagataccgtc

SEQ ID NO: 642088 - DNA, 22 bp, Artificial Sequence
  chemically synthesized
tagagacggtatctccccatgt

SEQ ID NO: 642089 - DNA, 22 bp, Artificial Sequence
  chemically synthesized
agaccagcctgggcaacatggg

SEQ ID NO: 642090 - DNA, 22 bp, Artificial Sequence
  chemically synthesized
gagaccagcctgggcaacatgg

SEQ ID NO: 642091 - DNA, 22 bp, Artificial Sequence
  chemically synthesized
cccatgttgcccaggctggtct

SEQ ID NO: 642092 - DNA, 22 bp, Artificial Sequence
  chemically synthesized
agaccaagaatttgagaccagc

SEQ ID NO: 642093 - DNA, 22 bp, Artificial Sequence
  chemically synthesized
gagaccaagaatttgagaccag

SEQ ID NO: 642094 - DNA, 22 bp, Artificial Sequence
  chemically synthesized
cccaggctggtctcaaattctt

SEQ ID NO: 642095 - DNA, 22 bp, Artificial Sequence
  chemically synthesized
gtctcaaattcttggtctcaag

SEQ ID NO: 642096 - DNA, 22 bp, Artificial Sequence
  chemically synthesized
aggtgggaggatcacttgagac

SEQ ID NO: 642097 - DNA, 22 bp, Artificial Sequence
  chemically synthesized
aaattcttggtctcaagtgatc

SEQ ID NO: 642098 - DNA, 22 bp, Artificial Sequence
  chemically synthesized
gcaggctgaggtgggaggatca

SEQ ID NO: 642099 - DNA, 22 bp, Artificial Sequence
  chemically synthesized
ttggtctcaagtgatcctccca

SEQ ID NO: 642100 - DNA, 22 bp, Artificial Sequence
  chemically synthesized
ggcaggctgaggtgggaggatc

SEQ ID NO: 642101 - DNA, 22 bp, Artificial Sequence
  chemically synthesized
tggcaggctgaggtgggaggat

SEQ ID NO: 642102 - DNA, 22 bp, Artificial Sequence
  chemically synthesized
ggtctcaagtgatcctcccacc

SEQ ID NO: 642103 - DNA, 22 bp, Artificial Sequence
  chemically synthesized
gtctcaagtgatcctcccacct

SEQ ID NO: 642104 - DNA, 22 bp, Artificial Sequence
  chemically synthesized
aagtgatcctcccacctcagcc

SEQ ID NO: 642105 - DNA, 22 bp, Artificial Sequence
  chemically synthesized
taaacccaacactttggcaggc

SEQ ID NO: 642106 - DNA, 22 bp, Artificial Sequence
  chemically synthesized
ccacctcagcctgccaaagtgt

SEQ ID NO: 642107 - DNA, 22 bp, Artificial Sequence
  chemically synthesized
acacctgtaaacccaacacttt

SEQ ID NO: 642108 - DNA, 22 bp, Artificial Sequence
  chemically synthesized
agcctgccaaagtgttgggttt

SEQ ID NO: 642109 - DNA, 22 bp, Artificial Sequence
  chemically synthesized
ccaaagtgttgggtttacaggt

SEQ ID NO: 642110 - DNA, 22 bp, Artificial Sequence
  chemically synthesized
ggcatggtggctcacacctgta

SEQ ID NO: 642111 - DNA, 22 bp, Artificial Sequence
  chemically synthesized
ggctgggcatggtggctcacac

SEQ ID NO: 642112 - DNA, 22 bp, Artificial Sequence
  chemically synthesized
tgggctgggcatggtggctcac

SEQ ID NO: 642113 - DNA, 22 bp, Artificial Sequence
  chemically synthesized
ggtttacaggtgtgagccacca

SEQ ID NO: 642114 - DNA, 22 bp, Artificial Sequence
  chemically synthesized
ttctgggctgggcatggtggct

SEQ ID NO: 642115 - DNA, 22 bp, Artificial Sequence
  chemically synthesized
acaggtgtgagccaccatgccc

SEQ ID NO: 642116 - DNA, 22 bp, Artificial Sequence
  chemically synthesized
caggtgtgagccaccatgccca

SEQ ID NO: 642117 - DNA, 22 bp, Artificial Sequence
  chemically synthesized
aagaagttattctgggctgggc

SEQ ID NO: 642118 - DNA, 22 bp, Artificial Sequence
  chemically synthesized
aaagaagttattctgggctggg

SEQ ID NO: 642119 - DNA, 22 bp, Artificial Sequence
  chemically synthesized
taaagaagttattctgggctgg

SEQ ID NO: 642120 - DNA, 22 bp, Artificial Sequence
  chemically synthesized
ttttaaagaagttattctgggc

SEQ ID NO: 642121 - DNA, 22 bp, Artificial Sequence
  chemically synthesized
atgtacaagtaccggtaattat

SEQ ID NO: 642122 - DNA, 22 bp, Artificial Sequence
  chemically synthesized
ctttaaaataattaccggtact

SEQ ID NO: 642123 - DNA, 22 bp, Artificial Sequence
  chemically synthesized
tttaaaataattaccggtactt

SEQ ID NO: 642124 - DNA, 22 bp, Artificial Sequence
  chemically synthesized
taaaataattaccggtacttgt

SEQ ID NO: 642125 - DNA, 22 bp, Artificial Sequence
  chemically synthesized
aaaataattaccggtacttgta

SEQ ID NO: 642126 - DNA, 22 bp, Artificial Sequence
  chemically synthesized
tgaacattcatgtacaagtacc

SEQ ID NO: 642127 - DNA, 22 bp, Artificial Sequence
  chemically synthesized
aaataattaccggtacttgtac

SEQ ID NO: 642128 - DNA, 22 bp, Artificial Sequence
  chemically synthesized
ccggtacttgtacatgaatgtt

SEQ ID NO: 642129 - DNA, 22 bp, Artificial Sequence
  chemically synthesized
tggataatgcagctatgaacat

SEQ ID NO: 642130 - DNA, 22 bp, Artificial Sequence
  chemically synthesized
ttatggataatgcagctatgaa

SEQ ID NO: 642131 - DNA, 22 bp, Artificial Sequence
  chemically synthesized
gtacatgaatgttcatagctgc

SEQ ID NO: 642132 - DNA, 22 bp, Artificial Sequence
  chemically synthesized
tacatgaatgttcatagctgca

SEQ ID NO: 642133 - DNA, 22 bp, Artificial Sequence
  chemically synthesized
tctgttatggataatgcagcta

SEQ ID NO: 642134 - DNA, 22 bp, Artificial Sequence
  chemically synthesized
ttgtctgttatggataatgcag

SEQ ID NO: 642135 - DNA, 22 bp, Artificial Sequence
  chemically synthesized
attgtctgttatggataatgca

SEQ ID NO: 642136 - DNA, 22 bp, Artificial Sequence
  chemically synthesized
cttattgtctgttatggataat

SEQ ID NO: 642137 - DNA, 22 bp, Artificial Sequence
  chemically synthesized
tacttattgtctgttatggata

SEQ ID NO: 642138 - DNA, 22 bp, Artificial Sequence
  chemically synthesized
ctacttattgtctgttatggat

SEQ ID NO: 642139 - DNA, 22 bp, Artificial Sequence
  chemically synthesized
atagctgcattatccataacag

SEQ ID NO: 642140 - DNA, 22 bp, Artificial Sequence
  chemically synthesized
tttctacttattgtctgttatg

SEQ ID NO: 642141 - DNA, 22 bp, Artificial Sequence
  chemically synthesized
cattatccataacagacaataa

SEQ ID NO: 642142 - DNA, 22 bp, Artificial Sequence
  chemically synthesized
ggctatttctacttattgtctg

SEQ ID NO: 642143 - DNA, 22 bp, Artificial Sequence
  chemically synthesized
gggctatttctacttattgtct

SEQ ID NO: 642144 - DNA, 22 bp, Artificial Sequence
  chemically synthesized
tccataacagacaataagtaga

SEQ ID NO: 642145 - DNA, 22 bp, Artificial Sequence
  chemically synthesized
atggacatttgggctatttcta

SEQ ID NO: 642146 - DNA, 22 bp, Artificial Sequence
  chemically synthesized
gatggacatttgggctatttct

SEQ ID NO: 642147 - DNA, 22 bp, Artificial Sequence
  chemically synthesized
cttgatggacatttgggctatt

SEQ ID NO: 642148 - DNA, 22 bp, Artificial Sequence
  chemically synthesized
attacttgatggacatttgggc

SEQ ID NO: 642149 - DNA, 22 bp, Artificial Sequence
  chemically synthesized
ttcattacttgatggacatttg

SEQ ID NO: 642150 - DNA, 22 bp, Artificial Sequence
  chemically synthesized
atctattcattacttgatggac

SEQ ID NO: 642151 - DNA, 22 bp, Artificial Sequence
  chemically synthesized
aatctattcattacttgatgga

SEQ ID NO: 642152 - DNA, 22 bp, Artificial Sequence
  chemically synthesized
taatctattcattacttgatgg

SEQ ID NO: 642153 - DNA, 22 bp, Artificial Sequence
  chemically synthesized
ttaatctattcattacttgatg

SEQ ID NO: 642154 - DNA, 22 bp, Artificial Sequence
  chemically synthesized
tttaatctattcattacttgat

SEQ ID NO: 642155 - DNA, 22 bp, Artificial Sequence
  chemically synthesized
tatggatataccacatttttta

SEQ ID NO: 642156 - DNA, 22 bp, Artificial Sequence
  chemically synthesized
attgtatggatataccacattt

SEQ ID NO: 642157 - DNA, 22 bp, Artificial Sequence
  chemically synthesized
cattgtatggatataccacatt

SEQ ID NO: 642158 - DNA, 22 bp, Artificial Sequence
  chemically synthesized
aaaaatgtggtatatccataca

SEQ ID NO: 642159 - DNA, 22 bp, Artificial Sequence
  chemically synthesized
agtaacatttcattgtatggat

SEQ ID NO: 642160 - DNA, 22 bp, Artificial Sequence
  chemically synthesized
atgctgagtaacatttcattgt

SEQ ID NO: 642161 - DNA, 22 bp, Artificial Sequence
  chemically synthesized
aatgctgagtaacatttcattg

SEQ ID NO: 642162 - DNA, 22 bp, Artificial Sequence
  chemically synthesized
taatgctgagtaacatttcatt

SEQ ID NO: 642163 - DNA, 22 bp, Artificial Sequence
  chemically synthesized
tttaatgctgagtaacatttca

SEQ ID NO: 642164 - DNA, 22 bp, Artificial Sequence
  chemically synthesized
ctttaatgctgagtaacatttc

SEQ ID NO: 642165 - DNA, 22 bp, Artificial Sequence
  chemically synthesized
tctttaatgctgagtaacattt

SEQ ID NO: 642166 - DNA, 22 bp, Artificial Sequence
  chemically synthesized
tttctttaatgctgagtaacat

SEQ ID NO: 642167 - DNA, 22 bp, Artificial Sequence
  chemically synthesized
attctttctttaatgctgagta

SEQ ID NO: 642168 - DNA, 22 bp, Artificial Sequence
  chemically synthesized
cattctttctttaatgctgagt

SEQ ID NO: 642169 - DNA, 22 bp, Artificial Sequence
  chemically synthesized
gtatttcattctttctttaatg

SEQ ID NO: 642170 - DNA, 22 bp, Artificial Sequence
  chemically synthesized
ctcagcattaaagaaagaatga

SEQ ID NO: 642171 - DNA, 22 bp, Artificial Sequence
  chemically synthesized
agcattaaagaaagaatgaaat

SEQ ID NO: 642172 - DNA, 22 bp, Artificial Sequence
  chemically synthesized
tagcccgtattagtatttcatt

SEQ ID NO: 642173 - DNA, 22 bp, Artificial Sequence
  chemically synthesized
aagaaagaatgaaatactaata

SEQ ID NO: 642174 - DNA, 22 bp, Artificial Sequence
  chemically synthesized
tattatagcccgtattagtatt

SEQ ID NO: 642175 - DNA, 22 bp, Artificial Sequence
  chemically synthesized
aaatggtatctatattatagcc

SEQ ID NO: 642176 - DNA, 22 bp, Artificial Sequence
  chemically synthesized
aaaatggtatctatattatagc

SEQ ID NO: 642177 - DNA, 22 bp, Artificial Sequence
  chemically synthesized
taaaatggtatctatattatag

SEQ ID NO: 642178 - DNA, 22 bp, Artificial Sequence
  chemically synthesized
ttaaaatggtatctatattata

SEQ ID NO: 642179 - DNA, 22 bp, Artificial Sequence
  chemically synthesized
atacgggctataatatagatac

SEQ ID NO: 642180 - DNA, 22 bp, Artificial Sequence
  chemically synthesized
taatatagataccattttaaaa

SEQ ID NO: 642181 - DNA, 22 bp, Artificial Sequence
  chemically synthesized
acatagcgtaatcttttaaaat

SEQ ID NO: 642182 - DNA, 22 bp, Artificial Sequence
  chemically synthesized
cacatagcgtaatcttttaaaa

SEQ ID NO: 642183 - DNA, 22 bp, Artificial Sequence
  chemically synthesized
tcacatagcgtaatcttttaaa

SEQ ID NO: 642184 - DNA, 22 bp, Artificial Sequence
  chemically synthesized
tttcacatagcgtaatctttta

SEQ ID NO: 642185 - DNA, 22 bp, Artificial Sequence
  chemically synthesized
ctttcacatagcgtaatctttt

SEQ ID NO: 642186 - DNA, 22 bp, Artificial Sequence
  chemically synthesized
gcttctttcacatagcgtaatc

SEQ ID NO: 642187 - DNA, 22 bp, Artificial Sequence
  chemically synthesized
tgactggcttctttcacatagc

SEQ ID NO: 642188 - DNA, 22 bp, Artificial Sequence
  chemically synthesized
taaaagattacgctatgtgaaa

SEQ ID NO: 642189 - DNA, 22 bp, Artificial Sequence
  chemically synthesized
gtgactggcttctttcacatag

SEQ ID NO: 642190 - DNA, 22 bp, Artificial Sequence
  chemically synthesized
aaaagattacgctatgtgaaag

SEQ ID NO: 642191 - DNA, 22 bp, Artificial Sequence
  chemically synthesized
tgtgactggcttctttcacata

SEQ ID NO: 642192 - DNA, 22 bp, Artificial Sequence
  chemically synthesized
aaagattacgctatgtgaaaga

SEQ ID NO: 642193 - DNA, 22 bp, Artificial Sequence
  chemically synthesized
ttgtgactggcttctttcacat

SEQ ID NO: 642194 - DNA, 22 bp, Artificial Sequence
  chemically synthesized
cgctatgtgaaagaagccagtc

SEQ ID NO: 642195 - DNA, 22 bp, Artificial Sequence
  chemically synthesized
tgtgaaagaagccagtcacaaa

SEQ ID NO: 642196 - DNA, 22 bp, Artificial Sequence
  chemically synthesized
atgtaaatgaaataatacaata

SEQ ID NO: 642197 - DNA, 22 bp, Artificial Sequence
  chemically synthesized
ttaatgtaaatgaaataataca

SEQ ID NO: 642198 - DNA, 22 bp, Artificial Sequence
  chemically synthesized
gactgttaatgtaaatgaaata

SEQ ID NO: 642199 - DNA, 22 bp, Artificial Sequence
  chemically synthesized
tatattgtattatttcatttac

SEQ ID NO: 642200 - DNA, 22 bp, Artificial Sequence
  chemically synthesized
tggactgttaatgtaaatgaaa

SEQ ID NO: 642201 - DNA, 22 bp, Artificial Sequence
  chemically synthesized
atattgtattatttcatttaca

SEQ ID NO: 642202 - DNA, 22 bp, Artificial Sequence
  chemically synthesized
tattgtattatttcatttacat

SEQ ID NO: 642203 - DNA, 22 bp, Artificial Sequence
  chemically synthesized
ttctggactgttaatgtaaatg

SEQ ID NO: 642204 - DNA, 22 bp, Artificial Sequence
  chemically synthesized
attctggactgttaatgtaaat

SEQ ID NO: 642205 - DNA, 22 bp, Artificial Sequence
  chemically synthesized
tattatttcatttacattaaca

SEQ ID NO: 642206 - DNA, 22 bp, Artificial Sequence
  chemically synthesized
cttattctggactgttaatgta

SEQ ID NO: 642207 - DNA, 22 bp, Artificial Sequence
  chemically synthesized
gcttattctggactgttaatgt

SEQ ID NO: 642208 - DNA, 22 bp, Artificial Sequence
  chemically synthesized
tttcatttacattaacagtcca

SEQ ID NO: 642209 - DNA, 22 bp, Artificial Sequence
  chemically synthesized
catttacattaacagtccagaa

SEQ ID NO: 642210 - DNA, 22 bp, Artificial Sequence
  chemically synthesized
tggatttgcttattctggactg

SEQ ID NO: 642211 - DNA, 22 bp, Artificial Sequence
  chemically synthesized
atttacattaacagtccagaat

SEQ ID NO: 642212 - DNA, 22 bp, Artificial Sequence
  chemically synthesized
tatggatttgcttattctggac

SEQ ID NO: 642213 - DNA, 22 bp, Artificial Sequence
  chemically synthesized
acattaacagtccagaataagc

SEQ ID NO: 642214 - DNA, 22 bp, Artificial Sequence
  chemically synthesized
cattaacagtccagaataagca

SEQ ID NO: 642215 - DNA, 22 bp, Artificial Sequence
  chemically synthesized
tctctatggatttgcttattct

SEQ ID NO: 642216 - DNA, 22 bp, Artificial Sequence
  chemically synthesized
tgtctctatggatttgcttatt

SEQ ID NO: 642217 - DNA, 22 bp, Artificial Sequence
  chemically synthesized
ctgtctctatggatttgcttat

SEQ ID NO: 642218 - DNA, 22 bp, Artificial Sequence
  chemically synthesized
tctgtctctatggatttgctta

SEQ ID NO: 642219 - DNA, 22 bp, Artificial Sequence
  chemically synthesized
acagtccagaataagcaaatcc

SEQ ID NO: 642220 - DNA, 22 bp, Artificial Sequence
  chemically synthesized
ctttctgtctctatggatttgc

SEQ ID NO: 642221 - DNA, 22 bp, Artificial Sequence
  chemically synthesized
atctactttctgtctctatgga

SEQ ID NO: 642222 - DNA, 22 bp, Artificial Sequence
  chemically synthesized
gcagtagacaatccctgatcta

SEQ ID NO: 642223 - DNA, 22 bp, Artificial Sequence
  chemically synthesized
agccctagcagtagacaatccc

SEQ ID NO: 642224 - DNA, 22 bp, Artificial Sequence
  chemically synthesized
cagccctagcagtagacaatcc

SEQ ID NO: 642225 - DNA, 22 bp, Artificial Sequence
  chemically synthesized
tcagccctagcagtagacaatc

SEQ ID NO: 642226 - DNA, 22 bp, Artificial Sequence
  chemically synthesized
ttcagccctagcagtagacaat

SEQ ID NO: 642227 - DNA, 22 bp, Artificial Sequence
  chemically synthesized
ttttcagccctagcagtagaca

SEQ ID NO: 642228 - DNA, 22 bp, Artificial Sequence
  chemically synthesized
ctcttttcagccctagcagtag

SEQ ID NO: 642229 - DNA, 22 bp, Artificial Sequence
  chemically synthesized
caactactcttttcagccctag

SEQ ID NO: 642230 - DNA, 22 bp, Artificial Sequence
  chemically synthesized
ctgcaactactcttttcagccc

SEQ ID NO: 642231 - DNA, 22 bp, Artificial Sequence
  chemically synthesized
tctactgctagggctgaaaaga

SEQ ID NO: 642232 - DNA, 22 bp, Artificial Sequence
  chemically synthesized
tcctgcaactactcttttcagc

SEQ ID NO: 642233 - DNA, 22 bp, Artificial Sequence
  chemically synthesized
ctcctgcaactactcttttcag

SEQ ID NO: 642234 - DNA, 22 bp, Artificial Sequence
  chemically synthesized
ctgctagggctgaaaagagtag

SEQ ID NO: 642235 - DNA, 22 bp, Artificial Sequence
  chemically synthesized
gtttctcctgcaactactcttt

SEQ ID NO: 642236 - DNA, 22 bp, Artificial Sequence
  chemically synthesized
ctagggctgaaaagagtagttg

SEQ ID NO: 642237 - DNA, 22 bp, Artificial Sequence
  chemically synthesized
ctcgtttctcctgcaactactc

SEQ ID NO: 642238 - DNA, 22 bp, Artificial Sequence
  chemically synthesized
gggctgaaaagagtagttgcag

SEQ ID NO: 642239 - DNA, 22 bp, Artificial Sequence
  chemically synthesized
aaaagagtagttgcaggagaaa

SEQ ID NO: 642240 - DNA, 22 bp, Artificial Sequence
  chemically synthesized
aagtcactcctcgtttctcctg

SEQ ID NO: 642241 - DNA, 22 bp, Artificial Sequence
  chemically synthesized
caagtcactcctcgtttctcct

SEQ ID NO: 642242 - DNA, 22 bp, Artificial Sequence
  chemically synthesized
tcaagtcactcctcgtttctcc

SEQ ID NO: 642243 - DNA, 22 bp, Artificial Sequence
  chemically synthesized
caggagaaacgaggagtgactt

SEQ ID NO: 642244 - DNA, 22 bp, Artificial Sequence
  chemically synthesized
tcaccccccaaaagaaatccca

SEQ ID NO: 642245 - DNA, 22 bp, Artificial Sequence
  chemically synthesized
gaaaatggggatgggatttctt

SEQ ID NO: 642246 - DNA, 22 bp, Artificial Sequence
  chemically synthesized
atcaccccccaaaagaaatccc

SEQ ID NO: 642247 - DNA, 22 bp, Artificial Sequence
  chemically synthesized
aaaatggggatgggatttcttt

SEQ ID NO: 642248 - DNA, 22 bp, Artificial Sequence
  chemically synthesized
tatcaccccccaaaagaaatcc

SEQ ID NO: 642249 - DNA, 22 bp, Artificial Sequence
  chemically synthesized
ttatcaccccccaaaagaaatc

SEQ ID NO: 642250 - DNA, 22 bp, Artificial Sequence
  chemically synthesized
gaacatttttatcaccccccaa

SEQ ID NO: 642251 - DNA, 22 bp, Artificial Sequence
  chemically synthesized
agaacatttttatcacccccca

SEQ ID NO: 642252 - DNA, 22 bp, Artificial Sequence
  chemically synthesized
tagaacatttttatcacccccc

SEQ ID NO: 642253 - DNA, 22 bp, Artificial Sequence
  chemically synthesized
cttttggggggtgataaaaatg

SEQ ID NO: 642254 - DNA, 22 bp, Artificial Sequence
  chemically synthesized
ttttggggggtgataaaaatgt

SEQ ID NO: 642255 - DNA, 22 bp, Artificial Sequence
  chemically synthesized
ttggggggtgataaaaatgttc

SEQ ID NO: 642256 - DNA, 22 bp, Artificial Sequence
  chemically synthesized
tggggggtgataaaaatgttct

SEQ ID NO: 642257 - DNA, 22 bp, Artificial Sequence
  chemically synthesized
ggggggtgataaaaatgttcta

SEQ ID NO: 642258 - DNA, 22 bp, Artificial Sequence
  chemically synthesized
gggggtgataaaaatgttctaa

SEQ ID NO: 642259 - DNA, 22 bp, Artificial Sequence
  chemically synthesized
tgcaaccatcagcgcacaattt

SEQ ID NO: 642260 - DNA, 22 bp, Artificial Sequence
  chemically synthesized
cagagttgtgcaaccatcagcg

SEQ ID NO: 642261 - DNA, 22 bp, Artificial Sequence
  chemically synthesized
taaaattgtgcgctgatggttg

SEQ ID NO: 642262 - DNA, 22 bp, Artificial Sequence
  chemically synthesized
aaattgtgcgctgatggttgca

SEQ ID NO: 642263 - DNA, 22 bp, Artificial Sequence
  chemically synthesized
attacagagttgtgcaaccatc

SEQ ID NO: 642264 - DNA, 22 bp, Artificial Sequence
  chemically synthesized
ttaattacagagttgtgcaacc

SEQ ID NO: 642265 - DNA, 22 bp, Artificial Sequence
  chemically synthesized
tgcgctgatggttgcacaactc

SEQ ID NO: 642266 - DNA, 22 bp, Artificial Sequence
  chemically synthesized
gttattaattacagagttgtgc

SEQ ID NO: 642267 - DNA, 22 bp, Artificial Sequence
  chemically synthesized
atggttgcacaactctgtaatt

SEQ ID NO: 642268 - DNA, 22 bp, Artificial Sequence
  chemically synthesized
gtaatcactggttattaattac

SEQ ID NO: 642269 - DNA, 22 bp, Artificial Sequence
  chemically synthesized
cacaactctgtaattaataacc

SEQ ID NO: 642270 - DNA, 22 bp, Artificial Sequence
  chemically synthesized
accagtattagtaatcactggt

SEQ ID NO: 642271 - DNA, 22 bp, Artificial Sequence
  chemically synthesized
tgtaattaataaccagtgatta

SEQ ID NO: 642272 - DNA, 22 bp, Artificial Sequence
  chemically synthesized
taattaataaccagtgattact

SEQ ID NO: 642273 - DNA, 22 bp, Artificial Sequence
  chemically synthesized
ataggttaaccagtattagtaa

SEQ ID NO: 642274 - DNA, 22 bp, Artificial Sequence
  chemically synthesized
ataaccagtgattactaatact

SEQ ID NO: 642275 - DNA, 22 bp, Artificial Sequence
  chemically synthesized
gttaataggttaaccagtatta

SEQ ID NO: 642276 - DNA, 22 bp, Artificial Sequence
  chemically synthesized
ttagttaataggttaaccagta

SEQ ID NO: 642277 - DNA, 22 bp, Artificial Sequence
  chemically synthesized
attattagttaataggttaacc

SEQ ID NO: 642278 - DNA, 22 bp, Artificial Sequence
  chemically synthesized
ctaatactggttaacctattaa

SEQ ID NO: 642279 - DNA, 22 bp, Artificial Sequence
  chemically synthesized
atactggttaacctattaacta

SEQ ID NO: 642280 - DNA, 22 bp, Artificial Sequence
  chemically synthesized
gtcactgattattagttaatag

SEQ ID NO: 642281 - DNA, 22 bp, Artificial Sequence
  chemically synthesized
gttaacctattaactaataatc

SEQ ID NO: 642282 - DNA, 22 bp, Artificial Sequence
  chemically synthesized
acctattaactaataatcagtg

SEQ ID NO: 642283 - DNA, 22 bp, Artificial Sequence
  chemically synthesized
cagtgtattagtcactgattat

SEQ ID NO: 642284 - DNA, 22 bp, Artificial Sequence
  chemically synthesized
acagtgtattagtcactgatta

SEQ ID NO: 642285 - DNA, 22 bp, Artificial Sequence
  chemically synthesized
ttaactaataatcagtgactaa

SEQ ID NO: 642286 - DNA, 22 bp, Artificial Sequence
  chemically synthesized
actaataatcagtgactaatac

SEQ ID NO: 642287 - DNA, 22 bp, Artificial Sequence
  chemically synthesized
cccatttacagtgtattagtca

SEQ ID NO: 642288 - DNA, 22 bp, Artificial Sequence
  chemically synthesized
ataatcagtgactaatacactg

SEQ ID NO: 642289 - DNA, 22 bp, Artificial Sequence
  chemically synthesized
gtaccataggagttacccattt

SEQ ID NO: 642290 - DNA, 22 bp, Artificial Sequence
  chemically synthesized
tcgtaccataggagttacccat

SEQ ID NO: 642291 - DNA, 22 bp, Artificial Sequence
  chemically synthesized
atacactgtaaatgggtaactc

SEQ ID NO: 642292 - DNA, 22 bp, Artificial Sequence
  chemically synthesized
taaatgggtaactcctatggta

SEQ ID NO: 642293 - DNA, 22 bp, Artificial Sequence
  chemically synthesized
agatataattctcgtaccatag

SEQ ID NO: 642294 - DNA, 22 bp, Artificial Sequence
  chemically synthesized
ttgagatataattctcgtacca

SEQ ID NO: 642295 - DNA, 22 bp, Artificial Sequence
  chemically synthesized
attgagatataattctcgtacc

SEQ ID NO: 642296 - DNA, 22 bp, Artificial Sequence
  chemically synthesized
tattgagatataattctcgtac

SEQ ID NO: 642297 - DNA, 22 bp, Artificial Sequence
  chemically synthesized
ctatggtacgagaattatatct

SEQ ID NO: 642298 - DNA, 22 bp, Artificial Sequence
  chemically synthesized
taagacctttattgagatataa

SEQ ID NO: 642299 - DNA, 22 bp, Artificial Sequence
  chemically synthesized
tggtacgagaattatatctcaa

SEQ ID NO: 642300 - DNA, 22 bp, Artificial Sequence
  chemically synthesized
ataagacctttattgagatata

SEQ ID NO: 642301 - DNA, 22 bp, Artificial Sequence
  chemically synthesized
tataagacctttattgagatat

SEQ ID NO: 642302 - DNA, 22 bp, Artificial Sequence
  chemically synthesized
ttataagacctttattgagata

SEQ ID NO: 642303 - DNA, 22 bp, Artificial Sequence
  chemically synthesized
tttataagacctttattgagat

SEQ ID NO: 642304 - DNA, 22 bp, Artificial Sequence
  chemically synthesized
gttttttataagacctttattg

SEQ ID NO: 642305 - DNA, 22 bp, Artificial Sequence
  chemically synthesized
agttttttataagacctttatt

SEQ ID NO: 642306 - DNA, 22 bp, Artificial Sequence
  chemically synthesized
tatctcaataaaggtcttataa

SEQ ID NO: 642307 - DNA, 22 bp, Artificial Sequence
  chemically synthesized
gaacttagttttttataagacc

SEQ ID NO: 642308 - DNA, 22 bp, Artificial Sequence
  chemically synthesized
aataaaggtcttataaaaaact

SEQ ID NO: 642309 - DNA, 22 bp, Artificial Sequence
  chemically synthesized
aatctagaacttagttttttat

SEQ ID NO: 642310 - DNA, 22 bp, Artificial Sequence
  chemically synthesized
gaatctagaacttagtttttta

SEQ ID NO: 642311 - DNA, 22 bp, Artificial Sequence
  chemically synthesized
tgaatctagaacttagtttttt

SEQ ID NO: 642312 - DNA, 22 bp, Artificial Sequence
  chemically synthesized
ataaaaaactaagttctagatt

SEQ ID NO: 642313 - DNA, 22 bp, Artificial Sequence
  chemically synthesized
taaaaaactaagttctagattc

SEQ ID NO: 642314 - DNA, 22 bp, Artificial Sequence
  chemically synthesized
taagaaataaaattttgaatct

SEQ ID NO: 642315 - DNA, 22 bp, Artificial Sequence
  chemically synthesized
tgctataagaaataaaattttg

SEQ ID NO: 642316 - DNA, 22 bp, Artificial Sequence
  chemically synthesized
agttctagattcaaaattttat

SEQ ID NO: 642317 - DNA, 22 bp, Artificial Sequence
  chemically synthesized
gtgctataagaaataaaatttt

SEQ ID NO: 642318 - DNA, 22 bp, Artificial Sequence
  chemically synthesized
tgtgctataagaaataaaattt

SEQ ID NO: 642319 - DNA, 22 bp, Artificial Sequence
  chemically synthesized
ttgtgctataagaaataaaatt

SEQ ID NO: 642320 - DNA, 22 bp, Artificial Sequence
  chemically synthesized
tagattcaaaattttatttctt

SEQ ID NO: 642321 - DNA, 22 bp, Artificial Sequence
  chemically synthesized
gattcaaaattttatttcttat

SEQ ID NO: 642322 - DNA, 22 bp, Artificial Sequence
  chemically synthesized
aaaattttatttcttatagcac

SEQ ID NO: 642323 - DNA, 22 bp, Artificial Sequence
  chemically synthesized
gggtaatatcttttgtgctata

SEQ ID NO: 642324 - DNA, 22 bp, Artificial Sequence
  chemically synthesized
actggggtaatatcttttgtgc

SEQ ID NO: 642325 - DNA, 22 bp, Artificial Sequence
  chemically synthesized
tatttcttatagcacaaaagat

SEQ ID NO: 642326 - DNA, 22 bp, Artificial Sequence
  chemically synthesized
cactggggtaatatcttttgtg

SEQ ID NO: 642327 - DNA, 22 bp, Artificial Sequence
  chemically synthesized
atttcttatagcacaaaagata

SEQ ID NO: 642328 - DNA, 22 bp, Artificial Sequence
  chemically synthesized
tcactggggtaatatcttttgt

SEQ ID NO: 642329 - DNA, 22 bp, Artificial Sequence
  chemically synthesized
tttcttatagcacaaaagatat

SEQ ID NO: 642330 - DNA, 22 bp, Artificial Sequence
  chemically synthesized
ttttcactggggtaatatcttt

SEQ ID NO: 642331 - DNA, 22 bp, Artificial Sequence
  chemically synthesized
cttatagcacaaaagatattac

SEQ ID NO: 642332 - DNA, 22 bp, Artificial Sequence
  chemically synthesized
ttatagcacaaaagatattacc

SEQ ID NO: 642333 - DNA, 22 bp, Artificial Sequence
  chemically synthesized
ttgttttcactggggtaatatc

SEQ ID NO: 642334 - DNA, 22 bp, Artificial Sequence
  chemically synthesized
atagcacaaaagatattacccc

SEQ ID NO: 642335 - DNA, 22 bp, Artificial Sequence
  chemically synthesized
attgttttcactggggtaatat

SEQ ID NO: 642336 - DNA, 22 bp, Artificial Sequence
  chemically synthesized
tagcacaaaagatattacccca

SEQ ID NO: 642337 - DNA, 22 bp, Artificial Sequence
  chemically synthesized
tattgttttcactggggtaata

SEQ ID NO: 642338 - DNA, 22 bp, Artificial Sequence
  chemically synthesized
taagattttattgttttcactg

SEQ ID NO: 642339 - DNA, 22 bp, Artificial Sequence
  chemically synthesized
ccccagtgaaaacaataaaatc

SEQ ID NO: 642340 - DNA, 22 bp, Artificial Sequence
  chemically synthesized
catagtaggagaaagcattata

SEQ ID NO: 642341 - DNA, 22 bp, Artificial Sequence
  chemically synthesized
ccatagtaggagaaagcattat

SEQ ID NO: 642342 - DNA, 22 bp, Artificial Sequence
  chemically synthesized
tccatagtaggagaaagcatta

SEQ ID NO: 642343 - DNA, 22 bp, Artificial Sequence
  chemically synthesized
ttccatagtaggagaaagcatt

SEQ ID NO: 642344 - DNA, 22 bp, Artificial Sequence
  chemically synthesized
atttttccatagtaggagaaag

SEQ ID NO: 642345 - DNA, 22 bp, Artificial Sequence
  chemically synthesized
gatttttccatagtaggagaaa

SEQ ID NO: 642346 - DNA, 22 bp, Artificial Sequence
  chemically synthesized
ataatgctttctcctactatgg

SEQ ID NO: 642347 - DNA, 22 bp, Artificial Sequence
  chemically synthesized
taatgctttctcctactatgga

SEQ ID NO: 642348 - DNA, 22 bp, Artificial Sequence
  chemically synthesized
aaccttgatttttccatagtag

SEQ ID NO: 642349 - DNA, 22 bp, Artificial Sequence
  chemically synthesized
tctcctactatggaaaaatcaa

SEQ ID NO: 642350 - DNA, 22 bp, Artificial Sequence
  chemically synthesized
ctcctactatggaaaaatcaag

SEQ ID NO: 642351 - DNA, 22 bp, Artificial Sequence
  chemically synthesized
tcctactatggaaaaatcaagg

SEQ ID NO: 642352 - DNA, 22 bp, Artificial Sequence
  chemically synthesized
ctactatggaaaaatcaaggtt

SEQ ID NO: 642353 - DNA, 22 bp, Artificial Sequence
  chemically synthesized
tgtacatgggttaaaccttgat

SEQ ID NO: 642354 - DNA, 22 bp, Artificial Sequence
  chemically synthesized
atgtacatgggttaaaccttga

SEQ ID NO: 642355 - DNA, 22 bp, Artificial Sequence
  chemically synthesized
ctatggaaaaatcaaggtttaa

SEQ ID NO: 642356 - DNA, 22 bp, Artificial Sequence
  chemically synthesized
tatgtacatgggttaaaccttg

SEQ ID NO: 642357 - DNA, 22 bp, Artificial Sequence
  chemically synthesized
ttatgtacatgggttaaacctt

SEQ ID NO: 642358 - DNA, 22 bp, Artificial Sequence
  chemically synthesized
tggaaaaatcaaggtttaaccc

SEQ ID NO: 642359 - DNA, 22 bp, Artificial Sequence
  chemically synthesized
ttttatgtacatgggttaaacc

SEQ ID NO: 642360 - DNA, 22 bp, Artificial Sequence
  chemically synthesized
cttttatgtacatgggttaaac

SEQ ID NO: 642361 - DNA, 22 bp, Artificial Sequence
  chemically synthesized
tcttttatgtacatgggttaaa

SEQ ID NO: 642362 - DNA, 22 bp, Artificial Sequence
  chemically synthesized
ttcttttatgtacatgggttaa

SEQ ID NO: 642363 - DNA, 22 bp, Artificial Sequence
  chemically synthesized
aacccatgtacataaaagaaaa

SEQ ID NO: 642364 - DNA, 22 bp, Artificial Sequence
  chemically synthesized
acccatgtacataaaagaaaaa

SEQ ID NO: 642365 - DNA, 22 bp, Artificial Sequence
  chemically synthesized
aagacatgtgcataccattttt

SEQ ID NO: 642366 - DNA, 22 bp, Artificial Sequence
  chemically synthesized
tgaagacatgtgcataccattt

SEQ ID NO: 642367 - DNA, 22 bp, Artificial Sequence
  chemically synthesized
atgtccacacggataattctga

SEQ ID NO: 642368 - DNA, 22 bp, Artificial Sequence
  chemically synthesized
aatgtccacacggataattctg

SEQ ID NO: 642369 - DNA, 22 bp, Artificial Sequence
  chemically synthesized
aaaatatttaatgtccacacgg

SEQ ID NO: 642370 - DNA, 22 bp, Artificial Sequence
  chemically synthesized
cagaattatccgtgtggacatt

SEQ ID NO: 642371 - DNA, 22 bp, Artificial Sequence
  chemically synthesized
agaattatccgtgtggacatta

SEQ ID NO: 642372 - DNA, 22 bp, Artificial Sequence
  chemically synthesized
atcatctgaaaatatttaatgt

SEQ ID NO: 642373 - DNA, 22 bp, Artificial Sequence
  chemically synthesized
tccgtgtggacattaaatattt

SEQ ID NO: 642374 - DNA, 22 bp, Artificial Sequence
  chemically synthesized
aaactcatcatctgaaaatatt

SEQ ID NO: 642375 - DNA, 22 bp, Artificial Sequence
  chemically synthesized
aaaactcatcatctgaaaatat

SEQ ID NO: 642376 - DNA, 22 bp, Artificial Sequence
  chemically synthesized
taaaactcatcatctgaaaata

SEQ ID NO: 642377 - DNA, 22 bp, Artificial Sequence
  chemically synthesized
ttaaaactcatcatctgaaaat

SEQ ID NO: 642378 - DNA, 22 bp, Artificial Sequence
  chemically synthesized
tttaaaactcatcatctgaaaa

SEQ ID NO: 642379 - DNA, 22 bp, Artificial Sequence
  chemically synthesized
tttttaaaactcatcatctgaa

SEQ ID NO: 642380 - DNA, 22 bp, Artificial Sequence
  chemically synthesized
gactctttttaaaactcatcat

SEQ ID NO: 642381 - DNA, 22 bp, Artificial Sequence
  chemically synthesized
aatattttcagatgatgagttt

SEQ ID NO: 642382 - DNA, 22 bp, Artificial Sequence
  chemically synthesized
ggactctttttaaaactcatca

SEQ ID NO: 642383 - DNA, 22 bp, Artificial Sequence
  chemically synthesized
tggactctttttaaaactcatc

SEQ ID NO: 642384 - DNA, 22 bp, Artificial Sequence
  chemically synthesized
ttggactctttttaaaactcat

SEQ ID NO: 642385 - DNA, 22 bp, Artificial Sequence
  chemically synthesized
tttttggactctttttaaaact

SEQ ID NO: 642386 - DNA, 22 bp, Artificial Sequence
  chemically synthesized
atttttggactctttttaaaac

SEQ ID NO: 642387 - DNA, 22 bp, Artificial Sequence
  chemically synthesized
tcagatgatgagttttaaaaag

SEQ ID NO: 642388 - DNA, 22 bp, Artificial Sequence
  chemically synthesized
cagatgatgagttttaaaaaga

SEQ ID NO: 642389 - DNA, 22 bp, Artificial Sequence
  chemically synthesized
agatgatgagttttaaaaagag

SEQ ID NO: 642390 - DNA, 22 bp, Artificial Sequence
  chemically synthesized
ggcttatttttggactcttttt

SEQ ID NO: 642391 - DNA, 22 bp, Artificial Sequence
  chemically synthesized
tgggcttatttttggactcttt

SEQ ID NO: 642392 - DNA, 22 bp, Artificial Sequence
  chemically synthesized
ctgggcttatttttggactctt

SEQ ID NO: 642393 - DNA, 22 bp, Artificial Sequence
  chemically synthesized
tctgggcttatttttggactct

SEQ ID NO: 642394 - DNA, 22 bp, Artificial Sequence
  chemically synthesized
taaaaagagtccaaaaataagc

SEQ ID NO: 642395 - DNA, 22 bp, Artificial Sequence
  chemically synthesized
agcattttctgggcttattttt

SEQ ID NO: 642396 - DNA, 22 bp, Artificial Sequence
  chemically synthesized
aaaaagagtccaaaaataagcc

SEQ ID NO: 642397 - DNA, 22 bp, Artificial Sequence
  chemically synthesized
aagcattttctgggcttatttt

SEQ ID NO: 642398 - DNA, 22 bp, Artificial Sequence
  chemically synthesized
aaaagagtccaaaaataagccc

SEQ ID NO: 642399 - DNA, 22 bp, Artificial Sequence
  chemically synthesized
acccagacttaagcattttctg

SEQ ID NO: 642400 - DNA, 22 bp, Artificial Sequence
  chemically synthesized
ggctaacccagacttaagcatt

SEQ ID NO: 642401 - DNA, 22 bp, Artificial Sequence
  chemically synthesized
aggctaacccagacttaagcat

SEQ ID NO: 642402 - DNA, 22 bp, Artificial Sequence
  chemically synthesized
tttaggctaacccagacttaag

SEQ ID NO: 642403 - DNA, 22 bp, Artificial Sequence
  chemically synthesized
aagtctgggttagcctaaacaa

SEQ ID NO: 642404 - DNA, 22 bp, Artificial Sequence
  chemically synthesized
aaaccatccaagttgtttaggc

SEQ ID NO: 642405 - DNA, 22 bp, Artificial Sequence
  chemically synthesized
agtctgggttagcctaaacaac

SEQ ID NO: 642406 - DNA, 22 bp, Artificial Sequence
  chemically synthesized
gactgaaaccatccaagttgtt

SEQ ID NO: 642407 - DNA, 22 bp, Artificial Sequence
  chemically synthesized
ggttagcctaaacaacttggat

SEQ ID NO: 642408 - DNA, 22 bp, Artificial Sequence
  chemically synthesized
cattagactgaaaccatccaag

SEQ ID NO: 642409 - DNA, 22 bp, Artificial Sequence
  chemically synthesized
ccattagactgaaaccatccaa

SEQ ID NO: 642410 - DNA, 22 bp, Artificial Sequence
  chemically synthesized
gcctaaacaacttggatggttt

SEQ ID NO: 642411 - DNA, 22 bp, Artificial Sequence
  chemically synthesized
tccattagactgaaaccatcca

SEQ ID NO: 642412 - DNA, 22 bp, Artificial Sequence
  chemically synthesized
aacaacttggatggtttcagtc

SEQ ID NO: 642413 - DNA, 22 bp, Artificial Sequence
  chemically synthesized
tgatgtcattttccattagact

SEQ ID NO: 642414 - DNA, 22 bp, Artificial Sequence
  chemically synthesized
gtgatgtcattttccattagac

SEQ ID NO: 642415 - DNA, 22 bp, Artificial Sequence
  chemically synthesized
ggatggtttcagtctaatggaa

SEQ ID NO: 642416 - DNA, 22 bp, Artificial Sequence
  chemically synthesized
gatggtttcagtctaatggaaa

SEQ ID NO: 642417 - DNA, 22 bp, Artificial Sequence
  chemically synthesized
gtttgtgatgtcattttccatt

SEQ ID NO: 642418 - DNA, 22 bp, Artificial Sequence
  chemically synthesized
agtttgtgatgtcattttccat

SEQ ID NO: 642419 - DNA, 22 bp, Artificial Sequence
  chemically synthesized
tttagtttgtgatgtcattttc

SEQ ID NO: 642420 - DNA, 22 bp, Artificial Sequence
  chemically synthesized
cagtctaatggaaaatgacatc

SEQ ID NO: 642421 - DNA, 22 bp, Artificial Sequence
  chemically synthesized
agtctaatggaaaatgacatca

SEQ ID NO: 642422 - DNA, 22 bp, Artificial Sequence
  chemically synthesized
atggaaaatgacatcacaaact

SEQ ID NO: 642423 - DNA, 22 bp, Artificial Sequence
  chemically synthesized
atatacctgtttagtttgtgat

SEQ ID NO: 642424 - DNA, 22 bp, Artificial Sequence
  chemically synthesized
aatatacctgtttagtttgtga

SEQ ID NO: 642425 - DNA, 22 bp, Artificial Sequence
  chemically synthesized
ccaaaatcccttaatatacctg

SEQ ID NO: 642426 - DNA, 22 bp, Artificial Sequence
  chemically synthesized
cccaaaatcccttaatatacct

SEQ ID NO: 642427 - DNA, 22 bp, Artificial Sequence
  chemically synthesized
tcccaaaatcccttaatatacc

SEQ ID NO: 642428 - DNA, 22 bp, Artificial Sequence
  chemically synthesized
tttcccaaaatcccttaatata

SEQ ID NO: 642429 - DNA, 22 bp, Artificial Sequence
  chemically synthesized
ctttcccaaaatcccttaatat

SEQ ID NO: 642430 - DNA, 22 bp, Artificial Sequence
  chemically synthesized
tctttcccaaaatcccttaata

SEQ ID NO: 642431 - DNA, 22 bp, Artificial Sequence
  chemically synthesized
ttttctttcccaaaatccctta

SEQ ID NO: 642432 - DNA, 22 bp, Artificial Sequence
  chemically synthesized
aacaggtatattaagggatttt

SEQ ID NO: 642433 - DNA, 22 bp, Artificial Sequence
  chemically synthesized
cattattttctttcccaaaatc

SEQ ID NO: 642434 - DNA, 22 bp, Artificial Sequence
  chemically synthesized
acattattttctttcccaaaat

SEQ ID NO: 642435 - DNA, 22 bp, Artificial Sequence
  chemically synthesized
ttacattattttctttcccaaa

SEQ ID NO: 642436 - DNA, 22 bp, Artificial Sequence
  chemically synthesized
cttacattattttctttcccaa

SEQ ID NO: 642437 - DNA, 22 bp, Artificial Sequence
  chemically synthesized
atttcttacattattttctttc

SEQ ID NO: 642438 - DNA, 22 bp, Artificial Sequence
  chemically synthesized
agggattttgggaaagaaaata

SEQ ID NO: 642439 - DNA, 22 bp, Artificial Sequence
  chemically synthesized
tcatttcttacattattttctt

SEQ ID NO: 642440 - DNA, 22 bp, Artificial Sequence
  chemically synthesized
ctcatttcttacattattttct

SEQ ID NO: 642441 - DNA, 22 bp, Artificial Sequence
  chemically synthesized
tctcatttcttacattattttc

SEQ ID NO: 642442 - DNA, 22 bp, Artificial Sequence
  chemically synthesized
ttctcatttcttacattatttt

SEQ ID NO: 642443 - DNA, 22 bp, Artificial Sequence
  chemically synthesized
tttttctcatttcttacattat

SEQ ID NO: 642444 - DNA, 22 bp, Artificial Sequence
  chemically synthesized
tgggaaagaaaataatgtaaga

SEQ ID NO: 642445 - DNA, 22 bp, Artificial Sequence
  chemically synthesized
gtttttctcatttcttacatta

SEQ ID NO: 642446 - DNA, 22 bp, Artificial Sequence
  chemically synthesized
gggaaagaaaataatgtaagaa

SEQ ID NO: 642447 - DNA, 22 bp, Artificial Sequence
  chemically synthesized
ggaaagaaaataatgtaagaaa

SEQ ID NO: 642448 - DNA, 22 bp, Artificial Sequence
  chemically synthesized
ccttgtttttctcatttcttac

SEQ ID NO: 642449 - DNA, 22 bp, Artificial Sequence
  chemically synthesized
aggtatctcccttgtttttctc

SEQ ID NO: 642450 - DNA, 22 bp, Artificial Sequence
  chemically synthesized
caggtatctcccttgtttttct

SEQ ID NO: 642451 - DNA, 22 bp, Artificial Sequence
  chemically synthesized
tcaggtatctcccttgtttttc

SEQ ID NO: 642452 - DNA, 22 bp, Artificial Sequence
  chemically synthesized
attttcaggtatctcccttgtt

SEQ ID NO: 642453 - DNA, 22 bp, Artificial Sequence
  chemically synthesized
gggttgattttcaggtatctcc

SEQ ID NO: 642454 - DNA, 22 bp, Artificial Sequence
  chemically synthesized
ggggttgattttcaggtatctc

SEQ ID NO: 642455 - DNA, 22 bp, Artificial Sequence
  chemically synthesized
tggggttgattttcaggtatct

SEQ ID NO: 642456 - DNA, 22 bp, Artificial Sequence
  chemically synthesized
ttggggttgattttcaggtatc

SEQ ID NO: 642457 - DNA, 22 bp, Artificial Sequence
  chemically synthesized
atgggtttttggggttgatttt

SEQ ID NO: 642458 - DNA, 22 bp, Artificial Sequence
  chemically synthesized
gatgggtttttggggttgattt

SEQ ID NO: 642459 - DNA, 22 bp, Artificial Sequence
  chemically synthesized
cttgatgggtttttggggttga

SEQ ID NO: 642460 - DNA, 22 bp, Artificial Sequence
  chemically synthesized
ttacttgatgggtttttggggt

SEQ ID NO: 642461 - DNA, 22 bp, Artificial Sequence
  chemically synthesized
tgttacttgatgggtttttggg

SEQ ID NO: 642462 - DNA, 22 bp, Artificial Sequence
  chemically synthesized
ctgttacttgatgggtttttgg

SEQ ID NO: 642463 - DNA, 22 bp, Artificial Sequence
  chemically synthesized
tctgttacttgatgggtttttg

SEQ ID NO: 642464 - DNA, 22 bp, Artificial Sequence
  chemically synthesized
aaaatcaaccccaaaaacccat

SEQ ID NO: 642465 - DNA, 22 bp, Artificial Sequence
  chemically synthesized
ttctgttacttgatgggttttt

SEQ ID NO: 642466 - DNA, 22 bp, Artificial Sequence
  chemically synthesized
gagtttttctgttacttgatgg

SEQ ID NO: 642467 - DNA, 22 bp, Artificial Sequence
  chemically synthesized
ggagtttttctgttacttgatg

SEQ ID NO: 642468 - DNA, 22 bp, Artificial Sequence
  chemically synthesized
tggagtttttctgttacttgat

SEQ ID NO: 642469 - DNA, 22 bp, Artificial Sequence
  chemically synthesized
caaaggatatttacccattcat

SEQ ID NO: 642470 - DNA, 22 bp, Artificial Sequence
  chemically synthesized
ggtacataaatgtgtcataaaa

SEQ ID NO: 642471 - DNA, 22 bp, Artificial Sequence
  chemically synthesized
acccattcatttttatgacaca

SEQ ID NO: 642472 - DNA, 22 bp, Artificial Sequence
  chemically synthesized
cccattcatttttatgacacat

SEQ ID NO: 642473 - DNA, 22 bp, Artificial Sequence
  chemically synthesized
atttttatgacacatttatgta

SEQ ID NO: 642474 - DNA, 22 bp, Artificial Sequence
  chemically synthesized
cacagcactgggtacataaatg

SEQ ID NO: 642475 - DNA, 22 bp, Artificial Sequence
  chemically synthesized
ttatgacacatttatgtaccca

SEQ ID NO: 642476 - DNA, 22 bp, Artificial Sequence
  chemically synthesized
tctccacagcactgggtacata

SEQ ID NO: 642477 - DNA, 22 bp, Artificial Sequence
  chemically synthesized
tatgacacatttatgtacccag

SEQ ID NO: 642478 - DNA, 22 bp, Artificial Sequence
  chemically synthesized
atctccacagcactgggtacat

SEQ ID NO: 642479 - DNA, 22 bp, Artificial Sequence
  chemically synthesized
atgacacatttatgtacccagt

SEQ ID NO: 642480 - DNA, 22 bp, Artificial Sequence
  chemically synthesized
tatctccacagcactgggtaca

SEQ ID NO: 642481 - DNA, 22 bp, Artificial Sequence
  chemically synthesized
tgacacatttatgtacccagtg

SEQ ID NO: 642482 - DNA, 22 bp, Artificial Sequence
  chemically synthesized
catatatctttatctccacagc

SEQ ID NO: 642483 - DNA, 22 bp, Artificial Sequence
  chemically synthesized
atgtacccagtgctgtggagat

SEQ ID NO: 642484 - DNA, 22 bp, Artificial Sequence
  chemically synthesized
tgtacccagtgctgtggagata

SEQ ID NO: 642485 - DNA, 22 bp, Artificial Sequence
  chemically synthesized
tggagataaagatatatgtagg

SEQ ID NO: 642486 - DNA, 22 bp, Artificial Sequence
  chemically synthesized
aagggtaagggacagtgtccta

SEQ ID NO: 642487 - DNA, 22 bp, Artificial Sequence
  chemically synthesized
caagggtaagggacagtgtcct

SEQ ID NO: 642488 - DNA, 22 bp, Artificial Sequence
  chemically synthesized
ttcaagggtaagggacagtgtc

SEQ ID NO: 642489 - DNA, 22 bp, Artificial Sequence
  chemically synthesized
gaatgtgagctcttcaagggta

SEQ ID NO: 642490 - DNA, 22 bp, Artificial Sequence
  chemically synthesized
tagaatgtgagctcttcaaggg

SEQ ID NO: 642491 - DNA, 22 bp, Artificial Sequence
  chemically synthesized
tcccttacccttgaagagctca

SEQ ID NO: 642492 - DNA, 22 bp, Artificial Sequence
  chemically synthesized
acccttgaagagctcacattct

SEQ ID NO: 642493 - DNA, 22 bp, Artificial Sequence
  chemically synthesized
cccttgaagagctcacattcta

SEQ ID NO: 642494 - DNA, 22 bp, Artificial Sequence
  chemically synthesized
gaagagctcacattctagagtg

SEQ ID NO: 642495 - DNA, 22 bp, Artificial Sequence
  chemically synthesized
aagagctcacattctagagtgt

SEQ ID NO: 642496 - DNA, 22 bp, Artificial Sequence
  chemically synthesized
acattctagagtgtgggatatt

SEQ ID NO: 642497 - DNA, 22 bp, Artificial Sequence
  chemically synthesized
catggtggaagtaaacaatatc

SEQ ID NO: 642498 - DNA, 22 bp, Artificial Sequence
  chemically synthesized
ccatggtggaagtaaacaatat

SEQ ID NO: 642499 - DNA, 22 bp, Artificial Sequence
  chemically synthesized
tagagtgtgggatattgtttac

SEQ ID NO: 642500 - DNA, 22 bp, Artificial Sequence
  chemically synthesized
gagtgtgggatattgtttactt

SEQ ID NO: 642501 - DNA, 22 bp, Artificial Sequence
  chemically synthesized
tttccatggtggaagtaaacaa

SEQ ID NO: 642502 - DNA, 22 bp, Artificial Sequence
  chemically synthesized
gtttccatggtggaagtaaaca

SEQ ID NO: 642503 - DNA, 22 bp, Artificial Sequence
  chemically synthesized
gagtaaggtttgtttccatggt

SEQ ID NO: 642504 - DNA, 22 bp, Artificial Sequence
  chemically synthesized
cgagtaaggtttgtttccatgg

SEQ ID NO: 642505 - DNA, 22 bp, Artificial Sequence
  chemically synthesized
tttacttccaccatggaaacaa

SEQ ID NO: 642506 - DNA, 22 bp, Artificial Sequence
  chemically synthesized
ccttcgagtaaggtttgtttcc

SEQ ID NO: 642507 - DNA, 22 bp, Artificial Sequence
  chemically synthesized
acttccaccatggaaacaaacc

SEQ ID NO: 642508 - DNA, 22 bp, Artificial Sequence
  chemically synthesized
gccttcgagtaaggtttgtttc

SEQ ID NO: 642509 - DNA, 22 bp, Artificial Sequence
  chemically synthesized
cttccaccatggaaacaaacct

SEQ ID NO: 642510 - DNA, 22 bp, Artificial Sequence
  chemically synthesized
tgccttcgagtaaggtttgttt

SEQ ID NO: 642511 - DNA, 22 bp, Artificial Sequence
  chemically synthesized
ttgccttcgagtaaggtttgtt

SEQ ID NO: 642512 - DNA, 22 bp, Artificial Sequence
  chemically synthesized
tttgccttcgagtaaggtttgt

SEQ ID NO: 642513 - DNA, 22 bp, Artificial Sequence
  chemically synthesized
ccaccatggaaacaaaccttac

SEQ ID NO: 642514 - DNA, 22 bp, Artificial Sequence
  chemically synthesized
caccatggaaacaaaccttact

SEQ ID NO: 642515 - DNA, 22 bp, Artificial Sequence
  chemically synthesized
ccagtctttttgccttcgagta

SEQ ID NO: 642516 - DNA, 22 bp, Artificial Sequence
  chemically synthesized
actcgaaggcaaaaagactggg

SEQ ID NO: 642517 - DNA, 22 bp, Artificial Sequence
  chemically synthesized
ctcgaaggcaaaaagactggga

SEQ ID NO: 642518 - DNA, 22 bp, Artificial Sequence
  chemically synthesized
gcagtgagcatgattcccagtc

SEQ ID NO: 642519 - DNA, 22 bp, Artificial Sequence
  chemically synthesized
gaaggcaaaaagactgggaatc

SEQ ID NO: 642520 - DNA, 22 bp, Artificial Sequence
  chemically synthesized
agcagtgagcatgattcccagt

SEQ ID NO: 642521 - DNA, 22 bp, Artificial Sequence
  chemically synthesized
tagcagtgagcatgattcccag

SEQ ID NO: 642522 - DNA, 22 bp, Artificial Sequence
  chemically synthesized
gctttagcagtgagcatgattc

SEQ ID NO: 642523 - DNA, 22 bp, Artificial Sequence
  chemically synthesized
agctttagcagtgagcatgatt

SEQ ID NO: 642524 - DNA, 22 bp, Artificial Sequence
  chemically synthesized
tagctttagcagtgagcatgat

SEQ ID NO: 642525 - DNA, 22 bp, Artificial Sequence
  chemically synthesized
ttagctttagcagtgagcatga

SEQ ID NO: 642526 - DNA, 22 bp, Artificial Sequence
  chemically synthesized
tatttttagctttagcagtgag

SEQ ID NO: 642527 - DNA, 22 bp, Artificial Sequence
  chemically synthesized
ggaatcatgctcactgctaaag

SEQ ID NO: 642528 - DNA, 22 bp, Artificial Sequence
  chemically synthesized
actgctaaagctaaaaatacag

SEQ ID NO: 642529 - DNA, 22 bp, Artificial Sequence
  chemically synthesized
aaagataaaaatctgtattttt

SEQ ID NO: 642530 - DNA, 22 bp, Artificial Sequence
  chemically synthesized
caaagataaaaatctgtatttt

SEQ ID NO: 642531 - DNA, 22 bp, Artificial Sequence
  chemically synthesized
ctaaagctaaaaatacagattt

SEQ ID NO: 642532 - DNA, 22 bp, Artificial Sequence
  chemically synthesized
aagctaaaaatacagattttta

SEQ ID NO: 642533 - DNA, 22 bp, Artificial Sequence
  chemically synthesized
aaaatacagatttttatctttg

SEQ ID NO: 642534 - DNA, 22 bp, Artificial Sequence
  chemically synthesized
gtaaatcaaggcgataatttca

SEQ ID NO: 642535 - DNA, 22 bp, Artificial Sequence
  chemically synthesized
ctggtaaatcaaggcgataatt

SEQ ID NO: 642536 - DNA, 22 bp, Artificial Sequence
  chemically synthesized
cctggtaaatcaaggcgataat

SEQ ID NO: 642537 - DNA, 22 bp, Artificial Sequence
  chemically synthesized
ttatctttgaaattatcgcctt

SEQ ID NO: 642538 - DNA, 22 bp, Artificial Sequence
  chemically synthesized
tatctttgaaattatcgccttg

SEQ ID NO: 642539 - DNA, 22 bp, Artificial Sequence
  chemically synthesized
atctttgaaattatcgccttga

SEQ ID NO: 642540 - DNA, 22 bp, Artificial Sequence
  chemically synthesized
tctttgaaattatcgccttgat

SEQ ID NO: 642541 - DNA, 22 bp, Artificial Sequence
  chemically synthesized
taatttcctggtaaatcaaggc

SEQ ID NO: 642542 - DNA, 22 bp, Artificial Sequence
  chemically synthesized
tgaaattatcgccttgatttac

SEQ ID NO: 642543 - DNA, 22 bp, Artificial Sequence
  chemically synthesized
gaaattatcgccttgatttacc

SEQ ID NO: 642544 - DNA, 22 bp, Artificial Sequence
  chemically synthesized
ctgtaatttcctggtaaatcaa

SEQ ID NO: 642545 - DNA, 22 bp, Artificial Sequence
  chemically synthesized
aaattatcgccttgatttacca

SEQ ID NO: 642546 - DNA, 22 bp, Artificial Sequence
  chemically synthesized
cctgtaatttcctggtaaatca

SEQ ID NO: 642547 - DNA, 22 bp, Artificial Sequence
  chemically synthesized
tcctgtaatttcctggtaaatc

SEQ ID NO: 642548 - DNA, 22 bp, Artificial Sequence
  chemically synthesized
ttcctgtaatttcctggtaaat

SEQ ID NO: 642549 - DNA, 22 bp, Artificial Sequence
  chemically synthesized
ttttcctgtaatttcctggtaa

SEQ ID NO: 642550 - DNA, 22 bp, Artificial Sequence
  chemically synthesized
tcgccttgatttaccaggaaat

SEQ ID NO: 642551 - DNA, 22 bp, Artificial Sequence
  chemically synthesized
gatttaccaggaaattacagga

SEQ ID NO: 642552 - DNA, 22 bp, Artificial Sequence
  chemically synthesized
atttaccaggaaattacaggaa

SEQ ID NO: 642553 - DNA, 22 bp, Artificial Sequence
  chemically synthesized
accaggaaattacaggaaaaga

SEQ ID NO: 642554 - DNA, 22 bp, Artificial Sequence
  chemically synthesized
ccaggaaattacaggaaaagaa

SEQ ID NO: 642555 - DNA, 22 bp, Artificial Sequence
  chemically synthesized
caggaaaagaatcatatggatt

SEQ ID NO: 642556 - DNA, 22 bp, Artificial Sequence
  chemically synthesized
caagtcataagtaaatccatat

SEQ ID NO: 642557 - DNA, 22 bp, Artificial Sequence
  chemically synthesized
taactacaagtcataagtaaat

SEQ ID NO: 642558 - DNA, 22 bp, Artificial Sequence
  chemically synthesized
ttgtaactacaagtcataagta

SEQ ID NO: 642559 - DNA, 22 bp, Artificial Sequence
  chemically synthesized
tctgttgtaactacaagtcata

SEQ ID NO: 642560 - DNA, 22 bp, Artificial Sequence
  chemically synthesized
gtctgtctgttgtaactacaag

SEQ ID NO: 642561 - DNA, 22 bp, Artificial Sequence
  chemically synthesized
acttatgacttgtagttacaac

SEQ ID NO: 642562 - DNA, 22 bp, Artificial Sequence
  chemically synthesized
cttatgacttgtagttacaaca

SEQ ID NO: 642563 - DNA, 22 bp, Artificial Sequence
  chemically synthesized
atgacttgtagttacaacagac

SEQ ID NO: 642564 - DNA, 22 bp, Artificial Sequence
  chemically synthesized
tggtgctagtctgtctgttgta

SEQ ID NO: 642565 - DNA, 22 bp, Artificial Sequence
  chemically synthesized
tgacttgtagttacaacagaca

SEQ ID NO: 642566 - DNA, 22 bp, Artificial Sequence
  chemically synthesized
atggtgctagtctgtctgttgt

SEQ ID NO: 642567 - DNA, 22 bp, Artificial Sequence
  chemically synthesized
ccttatggtgctagtctgtctg

SEQ ID NO: 642568 - DNA, 22 bp, Artificial Sequence
  chemically synthesized
gtagttacaacagacagactag

SEQ ID NO: 642569 - DNA, 22 bp, Artificial Sequence
  chemically synthesized
tagttacaacagacagactagc

SEQ ID NO: 642570 - DNA, 22 bp, Artificial Sequence
  chemically synthesized
agttaccttatggtgctagtct

SEQ ID NO: 642571 - DNA, 22 bp, Artificial Sequence
  chemically synthesized
tgagttaccttatggtgctagt

SEQ ID NO: 642572 - DNA, 22 bp, Artificial Sequence
  chemically synthesized
caacagacagactagcaccata

SEQ ID NO: 642573 - DNA, 22 bp, Artificial Sequence
  chemically synthesized
caaattctgagttaccttatgg

SEQ ID NO: 642574 - DNA, 22 bp, Artificial Sequence
  chemically synthesized
tgtctccaaattctgagttacc

SEQ ID NO: 642575 - DNA, 22 bp, Artificial Sequence
  chemically synthesized
gtgtctccaaattctgagttac

SEQ ID NO: 642576 - DNA, 22 bp, Artificial Sequence
  chemically synthesized
gcaccataaggtaactcagaat

SEQ ID NO: 642577 - DNA, 22 bp, Artificial Sequence
  chemically synthesized
ttgtgtctccaaattctgagtt

SEQ ID NO: 642578 - DNA, 22 bp, Artificial Sequence
  chemically synthesized
cttgtgtctccaaattctgagt

SEQ ID NO: 642579 - DNA, 22 bp, Artificial Sequence
  chemically synthesized
tcttgtgtctccaaattctgag

SEQ ID NO: 642580 - DNA, 22 bp, Artificial Sequence
  chemically synthesized
ttcttgtgtctccaaattctga

SEQ ID NO: 642581 - DNA, 22 bp, Artificial Sequence
  chemically synthesized
aaatatgaccttttcttgtgtc

SEQ ID NO: 642582 - DNA, 22 bp, Artificial Sequence
  chemically synthesized
agaatttggagacacaagaaaa

SEQ ID NO: 642583 - DNA, 22 bp, Artificial Sequence
  chemically synthesized
atagttaaaatatgaccttttc

SEQ ID NO: 642584 - DNA, 22 bp, Artificial Sequence
  chemically synthesized
aatagttaaaatatgacctttt

SEQ ID NO: 642585 - DNA, 22 bp, Artificial Sequence
  chemically synthesized
ggagacacaagaaaaggtcata

SEQ ID NO: 642586 - DNA, 22 bp, Artificial Sequence
  chemically synthesized
gagacacaagaaaaggtcatat

SEQ ID NO: 642587 - DNA, 22 bp, Artificial Sequence
  chemically synthesized
tcttaatagttaaaatatgacc

SEQ ID NO: 642588 - DNA, 22 bp, Artificial Sequence
  chemically synthesized
ctatcttaatagttaaaatatg

SEQ ID NO: 642589 - DNA, 22 bp, Artificial Sequence
  chemically synthesized
actatcttaatagttaaaatat

SEQ ID NO: 642590 - DNA, 22 bp, Artificial Sequence
  chemically synthesized
tactatcttaatagttaaaata

SEQ ID NO: 642591 - DNA, 22 bp, Artificial Sequence
  chemically synthesized
ttactatcttaatagttaaaat

SEQ ID NO: 642592 - DNA, 22 bp, Artificial Sequence
  chemically synthesized
tttactatcttaatagttaaaa

SEQ ID NO: 642593 - DNA, 22 bp, Artificial Sequence
  chemically synthesized
ttttactatcttaatagttaaa

SEQ ID NO: 642594 - DNA, 22 bp, Artificial Sequence
  chemically synthesized
tttttttactatcttaatagtt

SEQ ID NO: 642595 - DNA, 22 bp, Artificial Sequence
  chemically synthesized
atttttttactatcttaatagt

SEQ ID NO: 642596 - DNA, 22 bp, Artificial Sequence
  chemically synthesized
tatttttttactatcttaatag

SEQ ID NO: 642597 - DNA, 22 bp, Artificial Sequence
  chemically synthesized
acccattttatttttttactat

SEQ ID NO: 642598 - DNA, 22 bp, Artificial Sequence
  chemically synthesized
taactattaagatagtaaaaaa

SEQ ID NO: 642599 - DNA, 22 bp, Artificial Sequence
  chemically synthesized
aactattaagatagtaaaaaaa

SEQ ID NO: 642600 - DNA, 22 bp, Artificial Sequence
  chemically synthesized
actattaagatagtaaaaaaat

SEQ ID NO: 642601 - DNA, 22 bp, Artificial Sequence
  chemically synthesized
aactcacccattttattttttt

SEQ ID NO: 642602 - DNA, 22 bp, Artificial Sequence
  chemically synthesized
ttaagatagtaaaaaaataaaa

SEQ ID NO: 642603 - DNA, 22 bp, Artificial Sequence
  chemically synthesized
agatagtaaaaaaataaaatgg

SEQ ID NO: 642604 - DNA, 22 bp, Artificial Sequence
  chemically synthesized
cagatggctaaactcacccatt

SEQ ID NO: 642605 - DNA, 22 bp, Artificial Sequence
  chemically synthesized
tgcagatggctaaactcaccca

SEQ ID NO: 642606 - DNA, 22 bp, Artificial Sequence
  chemically synthesized
ctgcagatggctaaactcaccc

SEQ ID NO: 642607 - DNA, 22 bp, Artificial Sequence
  chemically synthesized
catatgtacatggatggcttct

SEQ ID NO: 642608 - DNA, 22 bp, Artificial Sequence
  chemically synthesized
agccatctgcagaagccatcca

SEQ ID NO: 642609 - DNA, 22 bp, Artificial Sequence
  chemically synthesized
gccatctgcagaagccatccat

SEQ ID NO: 642610 - DNA, 22 bp, Artificial Sequence
  chemically synthesized
gtattacatatgtacatggatg

SEQ ID NO: 642611 - DNA, 22 bp, Artificial Sequence
  chemically synthesized
ttggtattacatatgtacatgg

SEQ ID NO: 642612 - DNA, 22 bp, Artificial Sequence
  chemically synthesized
cagaagccatccatgtacatat

SEQ ID NO: 642613 - DNA, 22 bp, Artificial Sequence
  chemically synthesized
ctgttggtattacatatgtaca

SEQ ID NO: 642614 - DNA, 22 bp, Artificial Sequence
  chemically synthesized
cctgttggtattacatatgtac

SEQ ID NO: 642615 - DNA, 22 bp, Artificial Sequence
  chemically synthesized
gaaatggtttcctgttggtatt

SEQ ID NO: 642616 - DNA, 22 bp, Artificial Sequence
  chemically synthesized
ggcatgagcagcccagttagaa

SEQ ID NO: 642617 - DNA, 22 bp, Artificial Sequence
  chemically synthesized
taattgggcatgagcagcccag

SEQ ID NO: 642618 - DNA, 22 bp, Artificial Sequence
  chemically synthesized
attgtaattgggcatgagcagc

SEQ ID NO: 642619 - DNA, 22 bp, Artificial Sequence
  chemically synthesized
gattgtaattgggcatgagcag

SEQ ID NO: 642620 - DNA, 22 bp, Artificial Sequence
  chemically synthesized
ctaactgggctgctcatgccca

SEQ ID NO: 642621 - DNA, 22 bp, Artificial Sequence
  chemically synthesized
taactgggctgctcatgcccaa

SEQ ID NO: 642622 - DNA, 22 bp, Artificial Sequence
  chemically synthesized
actgggctgctcatgcccaatt

SEQ ID NO: 642623 - DNA, 22 bp, Artificial Sequence
  chemically synthesized
atgtacttgattgtaattgggc

SEQ ID NO: 642624 - DNA, 22 bp, Artificial Sequence
  chemically synthesized
ggctgctcatgcccaattacaa

SEQ ID NO: 642625 - DNA, 22 bp, Artificial Sequence
  chemically synthesized
ctgatgtacttgattgtaattg

SEQ ID NO: 642626 - DNA, 22 bp, Artificial Sequence
  chemically synthesized
ctcatgcccaattacaatcaag

SEQ ID NO: 642627 - DNA, 22 bp, Artificial Sequence
  chemically synthesized
atgcccaattacaatcaagtac

SEQ ID NO: 642628 - DNA, 22 bp, Artificial Sequence
  chemically synthesized
caatcaagtacatcaggaggtc

SEQ ID NO: 642629 - DNA, 22 bp, Artificial Sequence
  chemically synthesized
tgtaagaagaagaccaaggacc

SEQ ID NO: 642630 - DNA, 22 bp, Artificial Sequence
  chemically synthesized
gtgtaagaagaagaccaaggac

SEQ ID NO: 642631 - DNA, 22 bp, Artificial Sequence
  chemically synthesized
ggaagagagtttgtgtaagaag

SEQ ID NO: 642632 - DNA, 22 bp, Artificial Sequence
  chemically synthesized
ctaggaagagagtttgtgtaag

SEQ ID NO: 642633 - DNA, 22 bp, Artificial Sequence
  chemically synthesized
ggtcttcttcttacacaaactc

SEQ ID NO: 642634 - DNA, 22 bp, Artificial Sequence
  chemically synthesized
gtcttcttcttacacaaactct

SEQ ID NO: 642635 - DNA, 22 bp, Artificial Sequence
  chemically synthesized
cttcttacacaaactctcttcc

SEQ ID NO: 642636 - DNA, 22 bp, Artificial Sequence
  chemically synthesized
ttcttacacaaactctcttcct

SEQ ID NO: 642637 - DNA, 22 bp, Artificial Sequence
  chemically synthesized
cttacacaaactctcttcctag

SEQ ID NO: 642638 - DNA, 22 bp, Artificial Sequence
  chemically synthesized
ttacacaaactctcttcctagg

SEQ ID NO: 642639 - DNA, 22 bp, Artificial Sequence
  chemically synthesized
acacaaactctcttcctaggag

SEQ ID NO: 642640 - DNA, 22 bp, Artificial Sequence
  chemically synthesized
cacaaactctcttcctaggagg

SEQ ID NO: 642641 - DNA, 22 bp, Artificial Sequence
  chemically synthesized
gggagaggacagagacctccta

SEQ ID NO: 642642 - DNA, 22 bp, Artificial Sequence
  chemically synthesized
tcttcctaggaggtctctgtcc

SEQ ID NO: 642643 - DNA, 22 bp, Artificial Sequence
  chemically synthesized
ttcctaggaggtctctgtcctc

SEQ ID NO: 642644 - DNA, 22 bp, Artificial Sequence
  chemically synthesized
cctaggaggtctctgtcctctc

SEQ ID NO: 642645 - DNA, 22 bp, Artificial Sequence
  chemically synthesized
ctaggaggtctctgtcctctcc

SEQ ID NO: 642646 - DNA, 22 bp, Artificial Sequence
  chemically synthesized
ggaggtctctgtcctctcccca

SEQ ID NO: 642647 - DNA, 22 bp, Artificial Sequence
  chemically synthesized
tggcggagatggaagcctgggg

SEQ ID NO: 642648 - DNA, 22 bp, Artificial Sequence
  chemically synthesized
tgtcctctccccaggcttccat

SEQ ID NO: 642649 - DNA, 22 bp, Artificial Sequence
  chemically synthesized
tcctctccccaggcttccatct

SEQ ID NO: 642650 - DNA, 22 bp, Artificial Sequence
  chemically synthesized
tccccaggcttccatctccgcc

SEQ ID NO: 642651 - DNA, 22 bp, Artificial Sequence
  chemically synthesized
cccaggcttccatctccgccac

SEQ ID NO: 642652 - DNA, 22 bp, Artificial Sequence
  chemically synthesized
cgggaaggggtcatggttgtgg

SEQ ID NO: 642653 - DNA, 22 bp, Artificial Sequence
  chemically synthesized
ccatctccgccacaaccatgac

SEQ ID NO: 642654 - DNA, 22 bp, Artificial Sequence
  chemically synthesized
catctccgccacaaccatgacc

SEQ ID NO: 642655 - DNA, 22 bp, Artificial Sequence
  chemically synthesized
cgccacaaccatgaccccttcc

SEQ ID NO: 642656 - DNA, 22 bp, Artificial Sequence
  chemically synthesized
aggagtaatgagttgcgggaag

SEQ ID NO: 642657 - DNA, 22 bp, Artificial Sequence
  chemically synthesized
attaaggagtaatgagttgcgg

SEQ ID NO: 642658 - DNA, 22 bp, Artificial Sequence
  chemically synthesized
gattaaggagtaatgagttgcg

SEQ ID NO: 642659 - DNA, 22 bp, Artificial Sequence
  chemically synthesized
cccgcaactcattactccttaa

SEQ ID NO: 642660 - DNA, 22 bp, Artificial Sequence
  chemically synthesized
ccgcaactcattactccttaat

SEQ ID NO: 642661 - DNA, 22 bp, Artificial Sequence
  chemically synthesized
gaagagaagtcttgattaagga

SEQ ID NO: 642662 - DNA, 22 bp, Artificial Sequence
  chemically synthesized
agaagagaagtcttgattaagg

SEQ ID NO: 642663 - DNA, 22 bp, Artificial Sequence
  chemically synthesized
attactccttaatcaagacttc

SEQ ID NO: 642664 - DNA, 22 bp, Artificial Sequence
  chemically synthesized
aagccttagaagagaagtcttg

SEQ ID NO: 642665 - DNA, 22 bp, Artificial Sequence
  chemically synthesized
ctccttaatcaagacttctctt

SEQ ID NO: 642666 - DNA, 22 bp, Artificial Sequence
  chemically synthesized
cttaatcaagacttctcttcta

SEQ ID NO: 642667 - DNA, 22 bp, Artificial Sequence
  chemically synthesized
aatcaagacttctcttctaagg

SEQ ID NO: 642668 - DNA, 22 bp, Artificial Sequence
  chemically synthesized
atcaagacttctcttctaaggc

SEQ ID NO: 642669 - DNA, 22 bp, Artificial Sequence
  chemically synthesized
gagagataggtctgaagcctta

SEQ ID NO: 642670 - DNA, 22 bp, Artificial Sequence
  chemically synthesized
ctcttctaaggcttcagaccta

SEQ ID NO: 642671 - DNA, 22 bp, Artificial Sequence
  chemically synthesized
tcttctaaggcttcagacctat

SEQ ID NO: 642672 - DNA, 22 bp, Artificial Sequence
  chemically synthesized
ttctaaggcttcagacctatct

SEQ ID NO: 642673 - DNA, 22 bp, Artificial Sequence
  chemically synthesized
ctaaggcttcagacctatctct

SEQ ID NO: 642674 - DNA, 22 bp, Artificial Sequence
  chemically synthesized
taaggcttcagacctatctctc

SEQ ID NO: 642675 - DNA, 22 bp, Artificial Sequence
  chemically synthesized
aggcttcagacctatctctcca

SEQ ID NO: 642676 - DNA, 22 bp, Artificial Sequence
  chemically synthesized
cagacctatctctccaacattc

SEQ ID NO: 642677 - DNA, 22 bp, Artificial Sequence
  chemically synthesized
agacctatctctccaacattct

SEQ ID NO: 642678 - DNA, 22 bp, Artificial Sequence
  chemically synthesized
atggagccatccaggagaatgt

SEQ ID NO: 642679 - DNA, 22 bp, Artificial Sequence
  chemically synthesized
tctctccaacattctcctggat

SEQ ID NO: 642680 - DNA, 22 bp, Artificial Sequence
  chemically synthesized
tccaacattctcctggatggct

SEQ ID NO: 642681 - DNA, 22 bp, Artificial Sequence
  chemically synthesized
caacattctcctggatggctcc

SEQ ID NO: 642682 - DNA, 22 bp, Artificial Sequence
  chemically synthesized
gagcccatggctaatggagcca

SEQ ID NO: 642683 - DNA, 22 bp, Artificial Sequence
  chemically synthesized
tagagcccatggctaatggagc

SEQ ID NO: 642684 - DNA, 22 bp, Artificial Sequence
  chemically synthesized
ctagagcccatggctaatggag

SEQ ID NO: 642685 - DNA, 22 bp, Artificial Sequence
  chemically synthesized
tcctggatggctccattagcca

SEQ ID NO: 642686 - DNA, 22 bp, Artificial Sequence
  chemically synthesized
ctggatggctccattagccatg

SEQ ID NO: 642687 - DNA, 22 bp, Artificial Sequence
  chemically synthesized
agcttctagagcccatggctaa

SEQ ID NO: 642688 - DNA, 22 bp, Artificial Sequence
  chemically synthesized
cagcttctagagcccatggcta

SEQ ID NO: 642689 - DNA, 22 bp, Artificial Sequence
  chemically synthesized
gatggctccattagccatgggc

SEQ ID NO: 642690 - DNA, 22 bp, Artificial Sequence
  chemically synthesized
gcaagtttcagcttctagagcc

SEQ ID NO: 642691 - DNA, 22 bp, Artificial Sequence
  chemically synthesized
cattagccatgggctctagaag

SEQ ID NO: 642692 - DNA, 22 bp, Artificial Sequence
  chemically synthesized
agcaagtttcagcttctagagc

SEQ ID NO: 642693 - DNA, 22 bp, Artificial Sequence
  chemically synthesized
gccatgggctctagaagctgaa

SEQ ID NO: 642694 - DNA, 22 bp, Artificial Sequence
  chemically synthesized
gtgcttagcaagtttcagcttc

SEQ ID NO: 642695 - DNA, 22 bp, Artificial Sequence
  chemically synthesized
ggtgcttagcaagtttcagctt

SEQ ID NO: 642696 - DNA, 22 bp, Artificial Sequence
  chemically synthesized
tagaagctgaaacttgctaagc

SEQ ID NO: 642697 - DNA, 22 bp, Artificial Sequence
  chemically synthesized
gtgtggcttggtgcttagcaag

SEQ ID NO: 642698 - DNA, 22 bp, Artificial Sequence
  chemically synthesized
gaagctgaaacttgctaagcac

SEQ ID NO: 642699 - DNA, 22 bp, Artificial Sequence
  chemically synthesized
aaacttgctaagcaccaagcca

SEQ ID NO: 642700 - DNA, 22 bp, Artificial Sequence
  chemically synthesized
gctaagcaccaagccacacgag

SEQ ID NO: 642701 - DNA, 22 bp, Artificial Sequence
  chemically synthesized
ctaagcaccaagccacacgagg

SEQ ID NO: 642702 - DNA, 22 bp, Artificial Sequence
  chemically synthesized
agcaccaagccacacgaggttg

SEQ ID NO: 642703 - DNA, 22 bp, Artificial Sequence
  chemically synthesized
cataatcagtatatcaacctcg

SEQ ID NO: 642704 - DNA, 22 bp, Artificial Sequence
  chemically synthesized
gcataatcagtatatcaacctc

SEQ ID NO: 642705 - DNA, 22 bp, Artificial Sequence
  chemically synthesized
gagcttgcataatcagtatatc

SEQ ID NO: 642706 - DNA, 22 bp, Artificial Sequence
  chemically synthesized
agagcttgcataatcagtatat

SEQ ID NO: 642707 - DNA, 22 bp, Artificial Sequence
  chemically synthesized
tagagcttgcataatcagtata

SEQ ID NO: 642708 - DNA, 22 bp, Artificial Sequence
  chemically synthesized
aaattttagagcttgcataatc

SEQ ID NO: 642709 - DNA, 22 bp, Artificial Sequence
  chemically synthesized
atatactgattatgcaagctct

SEQ ID NO: 642710 - DNA, 22 bp, Artificial Sequence
  chemically synthesized
gcactgaaattttagagcttgc

SEQ ID NO: 642711 - DNA, 22 bp, Artificial Sequence
  chemically synthesized
ctggcactgaaattttagagct

SEQ ID NO: 642712 - DNA, 22 bp, Artificial Sequence
  chemically synthesized
cctggcactgaaattttagagc

SEQ ID NO: 642713 - DNA, 22 bp, Artificial Sequence
  chemically synthesized
tcctggcactgaaattttagag

SEQ ID NO: 642714 - DNA, 22 bp, Artificial Sequence
  chemically synthesized
attatgcaagctctaaaatttc

SEQ ID NO: 642715 - DNA, 22 bp, Artificial Sequence
  chemically synthesized
ctttcctggcactgaaatttta

SEQ ID NO: 642716 - DNA, 22 bp, Artificial Sequence
  chemically synthesized
tgcaagctctaaaatttcagtg

SEQ ID NO: 642717 - DNA, 22 bp, Artificial Sequence
  chemically synthesized
ttcctttcctggcactgaaatt

SEQ ID NO: 642718 - DNA, 22 bp, Artificial Sequence
  chemically synthesized
taaaatttcagtgccaggaaag

SEQ ID NO: 642719 - DNA, 22 bp, Artificial Sequence
  chemically synthesized
aggaaggctgttcctttcctgg

SEQ ID NO: 642720 - DNA, 22 bp, Artificial Sequence
  chemically synthesized
aaatttcagtgccaggaaagga

SEQ ID NO: 642721 - DNA, 22 bp, Artificial Sequence
  chemically synthesized
gaggaaggctgttcctttcctg

SEQ ID NO: 642722 - DNA, 22 bp, Artificial Sequence
  chemically synthesized
cttgaggaaggctgttcctttc

SEQ ID NO: 642723 - DNA, 22 bp, Artificial Sequence
  chemically synthesized
cagtgccaggaaaggaacagcc

SEQ ID NO: 642724 - DNA, 22 bp, Artificial Sequence
  chemically synthesized
agtgccaggaaaggaacagcct

SEQ ID NO: 642725 - DNA, 22 bp, Artificial Sequence
  chemically synthesized
tgtaatgctacttgaggaaggc

SEQ ID NO: 642726 - DNA, 22 bp, Artificial Sequence
  chemically synthesized
tatggtcctgtgtaatgctact

SEQ ID NO: 642727 - DNA, 22 bp, Artificial Sequence
  chemically synthesized
ctatatggtcctgtgtaatgct

SEQ ID NO: 642728 - DNA, 22 bp, Artificial Sequence
  chemically synthesized
cctcaagtagcattacacagga

SEQ ID NO: 642729 - DNA, 22 bp, Artificial Sequence
  chemically synthesized
ctcaagtagcattacacaggac

SEQ ID NO: 642730 - DNA, 22 bp, Artificial Sequence
  chemically synthesized
aagtagcattacacaggaccat

SEQ ID NO: 642731 - DNA, 22 bp, Artificial Sequence
  chemically synthesized
caaagatgtgtagctactatat

SEQ ID NO: 642732 - DNA, 22 bp, Artificial Sequence
  chemically synthesized
cacaggaccatatagtagctac

SEQ ID NO: 642733 - DNA, 22 bp, Artificial Sequence
  chemically synthesized
aggtataagttacaaagatgtg

SEQ ID NO: 642734 - DNA, 22 bp, Artificial Sequence
  chemically synthesized
cacatctttgtaacttatacct

SEQ ID NO: 642735 - DNA, 22 bp, Artificial Sequence
  chemically synthesized
aaagtaagattaaggtataagt

SEQ ID NO: 642736 - DNA, 22 bp, Artificial Sequence
  chemically synthesized
atctcaaagtaagattaaggta

SEQ ID NO: 642737 - DNA, 22 bp, Artificial Sequence
  chemically synthesized
catctcaaagtaagattaaggt

SEQ ID NO: 642738 - DNA, 22 bp, Artificial Sequence
  chemically synthesized
tcatctcaaagtaagattaagg

SEQ ID NO: 642739 - DNA, 22 bp, Artificial Sequence
  chemically synthesized
tgtaacttataccttaatctta

SEQ ID NO: 642740 - DNA, 22 bp, Artificial Sequence
  chemically synthesized
gtaacttataccttaatcttac

SEQ ID NO: 642741 - DNA, 22 bp, Artificial Sequence
  chemically synthesized
taacttataccttaatcttact

SEQ ID NO: 642742 - DNA, 22 bp, Artificial Sequence
  chemically synthesized
ataccttaatcttactttgaga

SEQ ID NO: 642743 - DNA, 22 bp, Artificial Sequence
  chemically synthesized
taccttaatcttactttgagat

SEQ ID NO: 642744 - DNA, 22 bp, Artificial Sequence
  chemically synthesized
aatcttactttgagatgaaagc

SEQ ID NO: 642745 - DNA, 22 bp, Artificial Sequence
  chemically synthesized
atcttactttgagatgaaagct

SEQ ID NO: 642746 - DNA, 22 bp, Artificial Sequence
  chemically synthesized
actttgagatgaaagctatacc

SEQ ID NO: 642747 - DNA, 22 bp, Artificial Sequence
  chemically synthesized
ctttgagatgaaagctatacct

SEQ ID NO: 642748 - DNA, 22 bp, Artificial Sequence
  chemically synthesized
tgacagaaatgcaggtatagct

SEQ ID NO: 642749 - DNA, 22 bp, Artificial Sequence
  chemically synthesized
atgacagaaatgcaggtatagc

SEQ ID NO: 642750 - DNA, 22 bp, Artificial Sequence
  chemically synthesized
tgagatgaaagctatacctgca

SEQ ID NO: 642751 - DNA, 22 bp, Artificial Sequence
  chemically synthesized
gagatgaaagctatacctgcat

SEQ ID NO: 642752 - DNA, 22 bp, Artificial Sequence
  chemically synthesized
agatgaaagctatacctgcatt

SEQ ID NO: 642753 - DNA, 22 bp, Artificial Sequence
  chemically synthesized
tcttatgacagaaatgcaggta

SEQ ID NO: 642754 - DNA, 22 bp, Artificial Sequence
  chemically synthesized
atcttatgacagaaatgcaggt

SEQ ID NO: 642755 - DNA, 22 bp, Artificial Sequence
  chemically synthesized
tatcttatgacagaaatgcagg

SEQ ID NO: 642756 - DNA, 22 bp, Artificial Sequence
  chemically synthesized
tttatcttatgacagaaatgca

SEQ ID NO: 642757 - DNA, 22 bp, Artificial Sequence
  chemically synthesized
cctctttatcttatgacagaaa

SEQ ID NO: 642758 - DNA, 22 bp, Artificial Sequence
  chemically synthesized
tccctctttatcttatgacaga

SEQ ID NO: 642759 - DNA, 22 bp, Artificial Sequence
  chemically synthesized
ctccctctttatcttatgacag

SEQ ID NO: 642760 - DNA, 22 bp, Artificial Sequence
  chemically synthesized
tacctgcatttctgtcataaga

SEQ ID NO: 642761 - DNA, 22 bp, Artificial Sequence
  chemically synthesized
catttctgtcataagataaaga

SEQ ID NO: 642762 - DNA, 22 bp, Artificial Sequence
  chemically synthesized
ctgtcataagataaagagggag

SEQ ID NO: 642763 - DNA, 22 bp, Artificial Sequence
  chemically synthesized
tgtcataagataaagagggaga

SEQ ID NO: 642764 - DNA, 22 bp, Artificial Sequence
  chemically synthesized
tcataagataaagagggagaaa

SEQ ID NO: 642765 - DNA, 22 bp, Artificial Sequence
  chemically synthesized
aagtgtatcatcaacacatggg

SEQ ID NO: 642766 - DNA, 22 bp, Artificial Sequence
  chemically synthesized
aaagtgtatcatcaacacatgg

SEQ ID NO: 642767 - DNA, 22 bp, Artificial Sequence
  chemically synthesized
taaagtgtatcatcaacacatg

SEQ ID NO: 642768 - DNA, 22 bp, Artificial Sequence
  chemically synthesized
tgattttaaagtgtatcatcaa

SEQ ID NO: 642769 - DNA, 22 bp, Artificial Sequence
  chemically synthesized
cccatgtgttgatgatacactt

SEQ ID NO: 642770 - DNA, 22 bp, Artificial Sequence
  chemically synthesized
ccatgtgttgatgatacacttt

SEQ ID NO: 642771 - DNA, 22 bp, Artificial Sequence
  chemically synthesized
gattgtgattttaaagtgtatc

SEQ ID NO: 642772 - DNA, 22 bp, Artificial Sequence
  chemically synthesized
ctggattgtgattttaaagtgt

SEQ ID NO: 642773 - DNA, 22 bp, Artificial Sequence
  chemically synthesized
tcctggattgtgattttaaagt

SEQ ID NO: 642774 - DNA, 22 bp, Artificial Sequence
  chemically synthesized
atgatacactttaaaatcacaa

SEQ ID NO: 642775 - DNA, 22 bp, Artificial Sequence
  chemically synthesized
aggcctctcctggattgtgatt

SEQ ID NO: 642776 - DNA, 22 bp, Artificial Sequence
  chemically synthesized
gaggcctctcctggattgtgat

SEQ ID NO: 642777 - DNA, 22 bp, Artificial Sequence
  chemically synthesized
cttgaggcctctcctggattgt

SEQ ID NO: 642778 - DNA, 22 bp, Artificial Sequence
  chemically synthesized
ttgcttgaggcctctcctggat

SEQ ID NO: 642779 - DNA, 22 bp, Artificial Sequence
  chemically synthesized
taaaatcacaatccaggagagg

SEQ ID NO: 642780 - DNA, 22 bp, Artificial Sequence
  chemically synthesized
aaaatcacaatccaggagaggc

SEQ ID NO: 642781 - DNA, 22 bp, Artificial Sequence
  chemically synthesized
aaatcacaatccaggagaggcc

SEQ ID NO: 642782 - DNA, 22 bp, Artificial Sequence
  chemically synthesized
gatgcaaaggccagttgttgct

SEQ ID NO: 642783 - DNA, 22 bp, Artificial Sequence
  chemically synthesized
taagtagttagatgcaaaggcc

SEQ ID NO: 642784 - DNA, 22 bp, Artificial Sequence
  chemically synthesized
aagcaacaactggcctttgcat

SEQ ID NO: 642785 - DNA, 22 bp, Artificial Sequence
  chemically synthesized
gtaagtagttagatgcaaaggc

SEQ ID NO: 642786 - DNA, 22 bp, Artificial Sequence
  chemically synthesized
tgtaagtagttagatgcaaagg

SEQ ID NO: 642787 - DNA, 22 bp, Artificial Sequence
  chemically synthesized
tttgtaagtagttagatgcaaa

SEQ ID NO: 642788 - DNA, 22 bp, Artificial Sequence
  chemically synthesized
ctttgtaagtagttagatgcaa

SEQ ID NO: 642789 - DNA, 22 bp, Artificial Sequence
  chemically synthesized
tctttgtaagtagttagatgca

SEQ ID NO: 642790 - DNA, 22 bp, Artificial Sequence
  chemically synthesized
gcctttgcatctaactacttac

SEQ ID NO: 642791 - DNA, 22 bp, Artificial Sequence
  chemically synthesized
tggaatctttctttgtaagtag

SEQ ID NO: 642792 - DNA, 22 bp, Artificial Sequence
  chemically synthesized
tgcatctaactacttacaaaga

SEQ ID NO: 642793 - DNA, 22 bp, Artificial Sequence
  chemically synthesized
ctgtggaatctttctttgtaag

SEQ ID NO: 642794 - DNA, 22 bp, Artificial Sequence
  chemically synthesized
gcatctaactacttacaaagaa

SEQ ID NO: 642795 - DNA, 22 bp, Artificial Sequence
  chemically synthesized
catctaactacttacaaagaaa

SEQ ID NO: 642796 - DNA, 22 bp, Artificial Sequence
  chemically synthesized
actacttacaaagaaagattcc

SEQ ID NO: 642797 - DNA, 22 bp, Artificial Sequence
  chemically synthesized
atcacaattactgtggaatctt

SEQ ID NO: 642798 - DNA, 22 bp, Artificial Sequence
  chemically synthesized
catcacaattactgtggaatct

SEQ ID NO: 642799 - DNA, 22 bp, Artificial Sequence
  chemically synthesized
cttacaaagaaagattccacag

SEQ ID NO: 642800 - DNA, 22 bp, Artificial Sequence
  chemically synthesized
acaaagaaagattccacagtaa

SEQ ID NO: 642801 - DNA, 22 bp, Artificial Sequence
  chemically synthesized
gcttcatcacaattactgtgga

SEQ ID NO: 642802 - DNA, 22 bp, Artificial Sequence
  chemically synthesized
caaagaaagattccacagtaat

SEQ ID NO: 642803 - DNA, 22 bp, Artificial Sequence
  chemically synthesized
agcttcatcacaattactgtgg

SEQ ID NO: 642804 - DNA, 22 bp, Artificial Sequence
  chemically synthesized
tagcttcatcacaattactgtg

SEQ ID NO: 642805 - DNA, 22 bp, Artificial Sequence
  chemically synthesized
cacagtaattgtgatgaagcta

SEQ ID NO: 642806 - DNA, 22 bp, Artificial Sequence
  chemically synthesized
ccaaagacagcacctttagctt

SEQ ID NO: 642807 - DNA, 22 bp, Artificial Sequence
  chemically synthesized
accaaagacagcacctttagct

SEQ ID NO: 642808 - DNA, 22 bp, Artificial Sequence
  chemically synthesized
tgatgaagctaaaggtgctgtc

SEQ ID NO: 642809 - DNA, 22 bp, Artificial Sequence
  chemically synthesized
aaagatgtttaccaaagacagc

SEQ ID NO: 642810 - DNA, 22 bp, Artificial Sequence
  chemically synthesized
gaaagatgtttaccaaagacag

SEQ ID NO: 642811 - DNA, 22 bp, Artificial Sequence
  chemically synthesized
tgaaagatgtttaccaaagaca

SEQ ID NO: 642812 - DNA, 22 bp, Artificial Sequence
  chemically synthesized
aaggtgctgtctttggtaaaca

SEQ ID NO: 642813 - DNA, 22 bp, Artificial Sequence
  chemically synthesized
aactttgaaagatgtttaccaa

SEQ ID NO: 642814 - DNA, 22 bp, Artificial Sequence
  chemically synthesized
tctttggtaaacatctttcaaa

SEQ ID NO: 642815 - DNA, 22 bp, Artificial Sequence
  chemically synthesized
tgaaatgattgaactttgaaag

SEQ ID NO: 642816 - DNA, 22 bp, Artificial Sequence
  chemically synthesized
gtgaaatgattgaactttgaaa

SEQ ID NO: 642817 - DNA, 22 bp, Artificial Sequence
  chemically synthesized
tggtaaacatctttcaaagttc

SEQ ID NO: 642818 - DNA, 22 bp, Artificial Sequence
  chemically synthesized
ggtaaacatctttcaaagttca

SEQ ID NO: 642819 - DNA, 22 bp, Artificial Sequence
  chemically synthesized
ttgtgaaatgattgaactttga

SEQ ID NO: 642820 - DNA, 22 bp, Artificial Sequence
  chemically synthesized
gtaaacatctttcaaagttcaa

SEQ ID NO: 642821 - DNA, 22 bp, Artificial Sequence
  chemically synthesized
cttgtgaaatgattgaactttg

SEQ ID NO: 642822 - DNA, 22 bp, Artificial Sequence
  chemically synthesized
tcttgtgaaatgattgaacttt

SEQ ID NO: 642823 - DNA, 22 bp, Artificial Sequence
  chemically synthesized
tttcttgtgaaatgattgaact

SEQ ID NO: 642824 - DNA, 22 bp, Artificial Sequence
  chemically synthesized
tcaaagttcaatcatttcacaa

SEQ ID NO: 642825 - DNA, 22 bp, Artificial Sequence
  chemically synthesized
caaagttcaatcatttcacaag

SEQ ID NO: 642826 - DNA, 22 bp, Artificial Sequence
  chemically synthesized
aaagttcaatcatttcacaaga

SEQ ID NO: 642827 - DNA, 22 bp, Artificial Sequence
  chemically synthesized
tcgggagttctttcttgtgaaa

SEQ ID NO: 642828 - DNA, 22 bp, Artificial Sequence
  chemically synthesized
ctatcgggagttctttcttgtg

SEQ ID NO: 642829 - DNA, 22 bp, Artificial Sequence
  chemically synthesized
gctatcgggagttctttcttgt

SEQ ID NO: 642830 - DNA, 22 bp, Artificial Sequence
  chemically synthesized
aatcatttcacaagaaagaact

SEQ ID NO: 642831 - DNA, 22 bp, Artificial Sequence
  chemically synthesized
acttgctatcgggagttctttc

SEQ ID NO: 642832 - DNA, 22 bp, Artificial Sequence
  chemically synthesized
cacaagaaagaactcccgatag

SEQ ID NO: 642833 - DNA, 22 bp, Artificial Sequence
  chemically synthesized
acaagaaagaactcccgatagc

SEQ ID NO: 642834 - DNA, 22 bp, Artificial Sequence
  chemically synthesized
atgcaattaacttgctatcggg

SEQ ID NO: 642835 - DNA, 22 bp, Artificial Sequence
  chemically synthesized
gatgcaattaacttgctatcgg

SEQ ID NO: 642836 - DNA, 22 bp, Artificial Sequence
  chemically synthesized
ccgatagcaagttaattgcatc

SEQ ID NO: 642837 - DNA, 22 bp, Artificial Sequence
  chemically synthesized
ccaccagtgacttgatgcaatt

SEQ ID NO: 642838 - DNA, 22 bp, Artificial Sequence
  chemically synthesized
attgcatcaagtcactggtggc

SEQ ID NO: 642839 - DNA, 22 bp, Artificial Sequence
  chemically synthesized
catcaagtcactggtggcaatt

SEQ ID NO: 642840 - DNA, 22 bp, Artificial Sequence
  chemically synthesized
acccaaaccaccaagaaaaatt

SEQ ID NO: 642841 - DNA, 22 bp, Artificial Sequence
  chemically synthesized
cacccaaaccaccaagaaaaat

SEQ ID NO: 642842 - DNA, 22 bp, Artificial Sequence
  chemically synthesized
tcacccaaaccaccaagaaaaa

SEQ ID NO: 642843 - DNA, 22 bp, Artificial Sequence
  chemically synthesized
ttcacccaaaccaccaagaaaa

SEQ ID NO: 642844 - DNA, 22 bp, Artificial Sequence
  chemically synthesized
gtggcaatttttcttggtggtt

SEQ ID NO: 642845 - DNA, 22 bp, Artificial Sequence
  chemically synthesized
gcttttcacccaaaccaccaag

SEQ ID NO: 642846 - DNA, 22 bp, Artificial Sequence
  chemically synthesized
ggcttttcacccaaaccaccaa

SEQ ID NO: 642847 - DNA, 22 bp, Artificial Sequence
  chemically synthesized
ttcttggtggtttgggtgaaaa

SEQ ID NO: 642848 - DNA, 22 bp, Artificial Sequence
  chemically synthesized
tcttggtggtttgggtgaaaag

SEQ ID NO: 642849 - DNA, 22 bp, Artificial Sequence
  chemically synthesized
cttggtggtttgggtgaaaagc

SEQ ID NO: 642850 - DNA, 22 bp, Artificial Sequence
  chemically synthesized
ttggtggtttgggtgaaaagcc

SEQ ID NO: 642851 - DNA, 22 bp, Artificial Sequence
  chemically synthesized
ggtggtttgggtgaaaagccaa

SEQ ID NO: 642852 - DNA, 22 bp, Artificial Sequence
  chemically synthesized
gtggtttgggtgaaaagccaag

SEQ ID NO: 642853 - DNA, 22 bp, Artificial Sequence
  chemically synthesized
gggtgaaaagccaagttattcg

SEQ ID NO: 642854 - DNA, 22 bp, Artificial Sequence
  chemically synthesized
ggtgaaaagccaagttattcgg

SEQ ID NO: 642855 - DNA, 22 bp, Artificial Sequence
  chemically synthesized
tagaatatcccaccgaataact

SEQ ID NO: 642856 - DNA, 22 bp, Artificial Sequence
  chemically synthesized
gtagaatatcccaccgaataac

SEQ ID NO: 642857 - DNA, 22 bp, Artificial Sequence
  chemically synthesized
tgtagaatatcccaccgaataa

SEQ ID NO: 642858 - DNA, 22 bp, Artificial Sequence
  chemically synthesized
ttgtagaatatcccaccgaata

SEQ ID NO: 642859 - DNA, 22 bp, Artificial Sequence
  chemically synthesized
caccatttttgtagaatatccc

SEQ ID NO: 642860 - DNA, 22 bp, Artificial Sequence
  chemically synthesized
gcaccatttttgtagaatatcc

SEQ ID NO: 642861 - DNA, 22 bp, Artificial Sequence
  chemically synthesized
tgcaccatttttgtagaatatc

SEQ ID NO: 642862 - DNA, 22 bp, Artificial Sequence
  chemically synthesized
tttgcaccatttttgtagaata

SEQ ID NO: 642863 - DNA, 22 bp, Artificial Sequence
  chemically synthesized
ttcggtgggatattctacaaaa

SEQ ID NO: 642864 - DNA, 22 bp, Artificial Sequence
  chemically synthesized
ggtgggatattctacaaaaatg

SEQ ID NO: 642865 - DNA, 22 bp, Artificial Sequence
  chemically synthesized
tacaaaaatggtgcaaagaatt

SEQ ID NO: 642866 - DNA, 22 bp, Artificial Sequence
  chemically synthesized
atgatcatagaaaattctttgc

SEQ ID NO: 642867 - DNA, 22 bp, Artificial Sequence
  chemically synthesized
caaaaatggtgcaaagaatttt

SEQ ID NO: 642868 - DNA, 22 bp, Artificial Sequence
  chemically synthesized
tcatgatcatagaaaattcttt

SEQ ID NO: 642869 - DNA, 22 bp, Artificial Sequence
  chemically synthesized
actctcatgatcatagaaaatt

SEQ ID NO: 642870 - DNA, 22 bp, Artificial Sequence
  chemically synthesized
aattaactctcatgatcataga

SEQ ID NO: 642871 - DNA, 22 bp, Artificial Sequence
  chemically synthesized
tctatgatcatgagagttaatt

SEQ ID NO: 642872 - DNA, 22 bp, Artificial Sequence
  chemically synthesized
ctatgatcatgagagttaattt

SEQ ID NO: 642873 - DNA, 22 bp, Artificial Sequence
  chemically synthesized
aagataggtattaaattaactc

SEQ ID NO: 642874 - DNA, 22 bp, Artificial Sequence
  chemically synthesized
tatgatcatgagagttaattta

SEQ ID NO: 642875 - DNA, 22 bp, Artificial Sequence
  chemically synthesized
tgatcatgagagttaatttaat

SEQ ID NO: 642876 - DNA, 22 bp, Artificial Sequence
  chemically synthesized
aaaaatctaaagataggtatta

SEQ ID NO: 642877 - DNA, 22 bp, Artificial Sequence
  chemically synthesized
gtctgaaaaatctaaagatagg

SEQ ID NO: 642878 - DNA, 22 bp, Artificial Sequence
  chemically synthesized
agtctgaaaaatctaaagatag

SEQ ID NO: 642879 - DNA, 22 bp, Artificial Sequence
  chemically synthesized
atttaatacctatctttagatt

SEQ ID NO: 642880 - DNA, 22 bp, Artificial Sequence
  chemically synthesized
aatacctatctttagatttttc

SEQ ID NO: 642881 - DNA, 22 bp, Artificial Sequence
  chemically synthesized
atacctatctttagatttttca

SEQ ID NO: 642882 - DNA, 22 bp, Artificial Sequence
  chemically synthesized
tctttagatttttcagactaaa

SEQ ID NO: 642883 - DNA, 22 bp, Artificial Sequence
  chemically synthesized
tagatttttcagactaaatcat

SEQ ID NO: 642884 - DNA, 22 bp, Artificial Sequence
  chemically synthesized
agatttttcagactaaatcatt

SEQ ID NO: 642885 - DNA, 22 bp, Artificial Sequence
  chemically synthesized
gatttttcagactaaatcattc

SEQ ID NO: 642886 - DNA, 22 bp, Artificial Sequence
  chemically synthesized
tagacccagaagccagaatgat

SEQ ID NO: 642887 - DNA, 22 bp, Artificial Sequence
  chemically synthesized
ttcagactaaatcattctggct

SEQ ID NO: 642888 - DNA, 22 bp, Artificial Sequence
  chemically synthesized
tcagactaaatcattctggctt

SEQ ID NO: 642889 - DNA, 22 bp, Artificial Sequence
  chemically synthesized
cagactaaatcattctggcttc

SEQ ID NO: 642890 - DNA, 22 bp, Artificial Sequence
  chemically synthesized
agactaaatcattctggcttct

SEQ ID NO: 642891 - DNA, 22 bp, Artificial Sequence
  chemically synthesized
ccctgtagacccagaagccaga

SEQ ID NO: 642892 - DNA, 22 bp, Artificial Sequence
  chemically synthesized
aatcattctggcttctgggtct

SEQ ID NO: 642893 - DNA, 22 bp, Artificial Sequence
  chemically synthesized
tggcttctgggtctacagggta

SEQ ID NO: 642894 - DNA, 22 bp, Artificial Sequence
  chemically synthesized
gtggtgaagcagttaccctgta

SEQ ID NO: 642895 - DNA, 22 bp, Artificial Sequence
  chemically synthesized
gcttctgggtctacagggtaac

SEQ ID NO: 642896 - DNA, 22 bp, Artificial Sequence
  chemically synthesized
tagtggtgaagcagttaccctg

SEQ ID NO: 642897 - DNA, 22 bp, Artificial Sequence
  chemically synthesized
ctgggtctacagggtaactgct

SEQ ID NO: 642898 - DNA, 22 bp, Artificial Sequence
  chemically synthesized
tgggtctacagggtaactgctt

SEQ ID NO: 642899 - DNA, 22 bp, Artificial Sequence
  chemically synthesized
ggtctacagggtaactgcttca

SEQ ID NO: 642900 - DNA, 22 bp, Artificial Sequence
  chemically synthesized
atatgctctagtggtgaagcag

SEQ ID NO: 642901 - DNA, 22 bp, Artificial Sequence
  chemically synthesized
catatgctctagtggtgaagca

SEQ ID NO: 642902 - DNA, 22 bp, Artificial Sequence
  chemically synthesized
tcatatgctctagtggtgaagc

SEQ ID NO: 642903 - DNA, 22 bp, Artificial Sequence
  chemically synthesized
ttcatatgctctagtggtgaag

SEQ ID NO: 642904 - DNA, 22 bp, Artificial Sequence
  chemically synthesized
cagggtaactgcttcaccacta

SEQ ID NO: 642905 - DNA, 22 bp, Artificial Sequence
  chemically synthesized
cttcaccactagagcatatgaa

SEQ ID NO: 642906 - DNA, 22 bp, Artificial Sequence
  chemically synthesized
caccactagagcatatgaaaag

SEQ ID NO: 642907 - DNA, 22 bp, Artificial Sequence
  chemically synthesized
gcacaaaagtaacttttcatat

SEQ ID NO: 642908 - DNA, 22 bp, Artificial Sequence
  chemically synthesized
accactagagcatatgaaaagt

SEQ ID NO: 642909 - DNA, 22 bp, Artificial Sequence
  chemically synthesized
cgcacaaaagtaacttttcata

SEQ ID NO: 642910 - DNA, 22 bp, Artificial Sequence
  chemically synthesized
tcgcacaaaagtaacttttcat

SEQ ID NO: 642911 - DNA, 22 bp, Artificial Sequence
  chemically synthesized
ttcgcacaaaagtaacttttca

SEQ ID NO: 642912 - DNA, 22 bp, Artificial Sequence
  chemically synthesized
gagcatatgaaaagttactttt

SEQ ID NO: 642913 - DNA, 22 bp, Artificial Sequence
  chemically synthesized
gatttttcgcacaaaagtaact

SEQ ID NO: 642914 - DNA, 22 bp, Artificial Sequence
  chemically synthesized
cttttgtgcgaaaaatccaggc

SEQ ID NO: 642915 - DNA, 22 bp, Artificial Sequence
  chemically synthesized
ttgtgcgaaaaatccaggcttc

SEQ ID NO: 642916 - DNA, 22 bp, Artificial Sequence
  chemically synthesized
tgtgcgaaaaatccaggcttcc

SEQ ID NO: 642917 - DNA, 22 bp, Artificial Sequence
  chemically synthesized
gtgcgaaaaatccaggcttcct

SEQ ID NO: 642918 - DNA, 22 bp, Artificial Sequence
  chemically synthesized
tgcgaaaaatccaggcttccta

SEQ ID NO: 642919 - DNA, 22 bp, Artificial Sequence
  chemically synthesized
taacaggtgcccacgtaggaag

SEQ ID NO: 642920 - DNA, 22 bp, Artificial Sequence
  chemically synthesized
cctacgtgggcacctgttatag

SEQ ID NO: 642921 - DNA, 22 bp, Artificial Sequence
  chemically synthesized
ctacgtgggcacctgttatagc

SEQ ID NO: 642922 - DNA, 22 bp, Artificial Sequence
  chemically synthesized
cgtgggcacctgttatagcttt

SEQ ID NO: 642923 - DNA, 22 bp, Artificial Sequence
  chemically synthesized
ggaacatcagaagataaagcta

SEQ ID NO: 642924 - DNA, 22 bp, Artificial Sequence
  chemically synthesized
tgggaacatcagaagataaagc

SEQ ID NO: 642925 - DNA, 22 bp, Artificial Sequence
  chemically synthesized
tgtctctgggaacatcagaaga

SEQ ID NO: 642926 - DNA, 22 bp, Artificial Sequence
  chemically synthesized
ttatagctttatcttctgatgt

SEQ ID NO: 642927 - DNA, 22 bp, Artificial Sequence
  chemically synthesized
tagctttatcttctgatgttcc

SEQ ID NO: 642928 - DNA, 22 bp, Artificial Sequence
  chemically synthesized
tccgttgtgtctctgggaacat

SEQ ID NO: 642929 - DNA, 22 bp, Artificial Sequence
  chemically synthesized
tatcttctgatgttcccagaga

SEQ ID NO: 642930 - DNA, 22 bp, Artificial Sequence
  chemically synthesized
atcttctgatgttcccagagac

SEQ ID NO: 642931 - DNA, 22 bp, Artificial Sequence
  chemically synthesized
tcttctgatgttcccagagaca

SEQ ID NO: 642932 - DNA, 22 bp, Artificial Sequence
  chemically synthesized
ctgatgttcccagagacacaac

SEQ ID NO: 642933 - DNA, 22 bp, Artificial Sequence
  chemically synthesized
agaagcctatccgttgtgtctc

SEQ ID NO: 642934 - DNA, 22 bp, Artificial Sequence
  chemically synthesized
tgatgttcccagagacacaacg

SEQ ID NO: 642935 - DNA, 22 bp, Artificial Sequence
  chemically synthesized
atgttcccagagacacaacgga

SEQ ID NO: 642936 - DNA, 22 bp, Artificial Sequence
  chemically synthesized
ttgagaagcctatccgttgtgt

SEQ ID NO: 642937 - DNA, 22 bp, Artificial Sequence
  chemically synthesized
ccagagacacaacggataggct

SEQ ID NO: 642938 - DNA, 22 bp, Artificial Sequence
  chemically synthesized
tagttgttgagaagcctatccg

SEQ ID NO: 642939 - DNA, 22 bp, Artificial Sequence
  chemically synthesized
ctgtagttgttgagaagcctat

SEQ ID NO: 642940 - DNA, 22 bp, Artificial Sequence
  chemically synthesized
tactgtagttgttgagaagcct

SEQ ID NO: 642941 - DNA, 22 bp, Artificial Sequence
  chemically synthesized
tctactgtagttgttgagaagc

SEQ ID NO: 642942 - DNA, 22 bp, Artificial Sequence
  chemically synthesized
actctctactgtagttgttgag

SEQ ID NO: 642943 - DNA, 22 bp, Artificial Sequence
  chemically synthesized
ctcaacaactacagtagagagt

SEQ ID NO: 642944 - DNA, 22 bp, Artificial Sequence
  chemically synthesized
tcaacaactacagtagagagtc

SEQ ID NO: 642945 - DNA, 22 bp, Artificial Sequence
  chemically synthesized
aacaactacagtagagagtcaa

SEQ ID NO: 642946 - DNA, 22 bp, Artificial Sequence
  chemically synthesized
ggagatagcatagttgactctc

SEQ ID NO: 642947 - DNA, 22 bp, Artificial Sequence
  chemically synthesized
cagtagagagtcaactatgcta

SEQ ID NO: 642948 - DNA, 22 bp, Artificial Sequence
  chemically synthesized
aaaaccagtctaggagatagca

SEQ ID NO: 642949 - DNA, 22 bp, Artificial Sequence
  chemically synthesized
gaaaaccagtctaggagatagc

SEQ ID NO: 642950 - DNA, 22 bp, Artificial Sequence
  chemically synthesized
tgaaaaccagtctaggagatag

SEQ ID NO: 642951 - DNA, 22 bp, Artificial Sequence
  chemically synthesized
tgctatctcctagactggtttt

SEQ ID NO: 642952 - DNA, 22 bp, Artificial Sequence
  chemically synthesized
aagtaaactttgaaaaccagtc

SEQ ID NO: 642953 - DNA, 22 bp, Artificial Sequence
  chemically synthesized
tctcctagactggttttcaaag

SEQ ID NO: 642954 - DNA, 22 bp, Artificial Sequence
  chemically synthesized
aagtctgaagtaaactttgaaa

SEQ ID NO: 642955 - DNA, 22 bp, Artificial Sequence
  chemically synthesized
ctagactggttttcaaagttta

SEQ ID NO: 642956 - DNA, 22 bp, Artificial Sequence
  chemically synthesized
gactggttttcaaagtttactt

SEQ ID NO: 642957 - DNA, 22 bp, Artificial Sequence
  chemically synthesized
gttttcaaagtttacttcagac

SEQ ID NO: 642958 - DNA, 22 bp, Artificial Sequence
  chemically synthesized
gtaaagaaattcaagtctgaag

SEQ ID NO: 642959 - DNA, 22 bp, Artificial Sequence
  chemically synthesized
ggtaaagaaattcaagtctgaa

SEQ ID NO: 642960 - DNA, 22 bp, Artificial Sequence
  chemically synthesized
tcaaagtttacttcagacttga

SEQ ID NO: 642961 - DNA, 22 bp, Artificial Sequence
  chemically synthesized
tggtaaagaaattcaagtctga

SEQ ID NO: 642962 - DNA, 22 bp, Artificial Sequence
  chemically synthesized
caaagtttacttcagacttgaa

SEQ ID NO: 642963 - DNA, 22 bp, Artificial Sequence
  chemically synthesized
aaagtttacttcagacttgaat

SEQ ID NO: 642964 - DNA, 22 bp, Artificial Sequence
  chemically synthesized
acttcagacttgaatttcttta

SEQ ID NO: 642965 - DNA, 22 bp, Artificial Sequence
  chemically synthesized
cttcagacttgaatttctttac

SEQ ID NO: 642966 - DNA, 22 bp, Artificial Sequence
  chemically synthesized
cagacttgaatttctttaccaa

SEQ ID NO: 642967 - DNA, 22 bp, Artificial Sequence
  chemically synthesized
agacttgaatttctttaccaaa

SEQ ID NO: 642968 - DNA, 22 bp, Artificial Sequence
  chemically synthesized
tatggaacacactttggtaaag

SEQ ID NO: 642969 - DNA, 22 bp, Artificial Sequence
  chemically synthesized
gaatttctttaccaaagtgtgt

SEQ ID NO: 642970 - DNA, 22 bp, Artificial Sequence
  chemically synthesized
aatttctttaccaaagtgtgtt

SEQ ID NO: 642971 - DNA, 22 bp, Artificial Sequence
  chemically synthesized
caatgttatatggaacacactt

SEQ ID NO: 642972 - DNA, 22 bp, Artificial Sequence
  chemically synthesized
ctttaccaaagtgtgttccata

SEQ ID NO: 642973 - DNA, 22 bp, Artificial Sequence
  chemically synthesized
tttaccaaagtgtgttccatat

SEQ ID NO: 642974 - DNA, 22 bp, Artificial Sequence
  chemically synthesized
taccaaagtgtgttccatataa

SEQ ID NO: 642975 - DNA, 22 bp, Artificial Sequence
  chemically synthesized
accaaagtgtgttccatataac

SEQ ID NO: 642976 - DNA, 22 bp, Artificial Sequence
  chemically synthesized
ccaaagtgtgttccatataaca

SEQ ID NO: 642977 - DNA, 22 bp, Artificial Sequence
  chemically synthesized
gagcccaactgcaatgttatat

SEQ ID NO: 642978 - DNA, 22 bp, Artificial Sequence
  chemically synthesized
acctcgagcccaactgcaatgt

SEQ ID NO: 642979 - DNA, 22 bp, Artificial Sequence
  chemically synthesized
gacctcgagcccaactgcaatg

SEQ ID NO: 642980 - DNA, 22 bp, Artificial Sequence
  chemically synthesized
cttgacctcgagcccaactgca

SEQ ID NO: 642981 - DNA, 22 bp, Artificial Sequence
  chemically synthesized
acttgacctcgagcccaactgc

SEQ ID NO: 642982 - DNA, 22 bp, Artificial Sequence
  chemically synthesized
catataacattgcagttgggct

SEQ ID NO: 642983 - DNA, 22 bp, Artificial Sequence
  chemically synthesized
ccacttacttgacctcgagccc

SEQ ID NO: 642984 - DNA, 22 bp, Artificial Sequence
  chemically synthesized
ctcccacttacttgacctcgag

SEQ ID NO: 642985 - DNA, 22 bp, Artificial Sequence
  chemically synthesized
cagttgggctcgaggtcaagta

SEQ ID NO: 642986 - DNA, 22 bp, Artificial Sequence
  chemically synthesized
atgttgctcccacttacttgac

SEQ ID NO: 642987 - DNA, 22 bp, Artificial Sequence
  chemically synthesized
ggctcgaggtcaagtaagtggg

SEQ ID NO: 642988 - DNA, 22 bp, Artificial Sequence
  chemically synthesized
acctcatgttgctcccacttac

SEQ ID NO: 642989 - DNA, 22 bp, Artificial Sequence
  chemically synthesized
gaggtcaagtaagtgggagcaa

SEQ ID NO: 642990 - DNA, 22 bp, Artificial Sequence
  chemically synthesized
tctaacctcatgttgctcccac

SEQ ID NO: 642991 - DNA, 22 bp, Artificial Sequence
  chemically synthesized
gtctaacctcatgttgctccca

SEQ ID NO: 642992 - DNA, 22 bp, Artificial Sequence
  chemically synthesized
tgtctaacctcatgttgctccc

SEQ ID NO: 642993 - DNA, 22 bp, Artificial Sequence
  chemically synthesized
gctttgtctaacctcatgttgc

SEQ ID NO: 642994 - DNA, 22 bp, Artificial Sequence
  chemically synthesized
attagctttgtctaacctcatg

SEQ ID NO: 642995 - DNA, 22 bp, Artificial Sequence
  chemically synthesized
gaagtgaagaaacctgattagc

SEQ ID NO: 642996 - DNA, 22 bp, Artificial Sequence
  chemically synthesized
ggaagtgaagaaacctgattag

SEQ ID NO: 642997 - DNA, 22 bp, Artificial Sequence
  chemically synthesized
gacaaagctaatcaggtttctt

SEQ ID NO: 642998 - DNA, 22 bp, Artificial Sequence
  chemically synthesized
aggagtttggaagtgaagaaac

SEQ ID NO: 642999 - DNA, 22 bp, Artificial Sequence
  chemically synthesized
cactgaggagtttggaagtgaa

SEQ ID NO: 643000 - DNA, 22 bp, Artificial Sequence
  chemically synthesized
gcactgaggagtttggaagtga

SEQ ID NO: 643001 - DNA, 22 bp, Artificial Sequence
  chemically synthesized
atcaggtttcttcacttccaaa

SEQ ID NO: 643002 - DNA, 22 bp, Artificial Sequence
  chemically synthesized
gcatttgcactgaggagtttgg

SEQ ID NO: 643003 - DNA, 22 bp, Artificial Sequence
  chemically synthesized
cttcacttccaaactcctcagt

SEQ ID NO: 643004 - DNA, 22 bp, Artificial Sequence
  chemically synthesized
ttcacttccaaactcctcagtg

SEQ ID NO: 643005 - DNA, 22 bp, Artificial Sequence
  chemically synthesized
cgttagcatttgcactgaggag

SEQ ID NO: 643006 - DNA, 22 bp, Artificial Sequence
  chemically synthesized
cacttccaaactcctcagtgca

SEQ ID NO: 643007 - DNA, 22 bp, Artificial Sequence
  chemically synthesized
acttccaaactcctcagtgcaa

SEQ ID NO: 643008 - DNA, 22 bp, Artificial Sequence
  chemically synthesized
ccaaactcctcagtgcaaatgc

SEQ ID NO: 643009 - DNA, 22 bp, Artificial Sequence
  chemically synthesized
caaactcctcagtgcaaatgct

SEQ ID NO: 643010 - DNA, 22 bp, Artificial Sequence
  chemically synthesized
gaaagtcatcattacgttagca

SEQ ID NO: 643011 - DNA, 22 bp, Artificial Sequence
  chemically synthesized
ctcagtgcaaatgctaacgtaa

SEQ ID NO: 643012 - DNA, 22 bp, Artificial Sequence
  chemically synthesized
agtgcaaatgctaacgtaatga

SEQ ID NO: 643013 - DNA, 22 bp, Artificial Sequence
  chemically synthesized
atactggaaagtcatcattacg

SEQ ID NO: 643014 - DNA, 22 bp, Artificial Sequence
  chemically synthesized
aaagcactcatactggaaagtc

SEQ ID NO: 643015 - DNA, 22 bp, Artificial Sequence
  chemically synthesized
gaaagcactcatactggaaagt

SEQ ID NO: 643016 - DNA, 22 bp, Artificial Sequence
  chemically synthesized
acgtaatgatgactttccagta

SEQ ID NO: 643017 - DNA, 22 bp, Artificial Sequence
  chemically synthesized
tgaaagcactcatactggaaag

SEQ ID NO: 643018 - DNA, 22 bp, Artificial Sequence
  chemically synthesized
tccagtatgagtgctttcaaag

SEQ ID NO: 643019 - DNA, 22 bp, Artificial Sequence
  chemically synthesized
ccagtatgagtgctttcaaagt

SEQ ID NO: 643020 - DNA, 22 bp, Artificial Sequence
  chemically synthesized
cagtatgagtgctttcaaagtt

SEQ ID NO: 643021 - DNA, 22 bp, Artificial Sequence
  chemically synthesized
caaggacagtaaaactttgaaa

SEQ ID NO: 643022 - DNA, 22 bp, Artificial Sequence
  chemically synthesized
tcaaagttttactgtccttgga

SEQ ID NO: 643023 - DNA, 22 bp, Artificial Sequence
  chemically synthesized
caaagttttactgtccttggaa

SEQ ID NO: 643024 - DNA, 22 bp, Artificial Sequence
  chemically synthesized
agaaaaaaaggattccaaggac

SEQ ID NO: 643025 - DNA, 22 bp, Artificial Sequence
  chemically synthesized
aaagttttactgtccttggaat

SEQ ID NO: 643026 - DNA, 22 bp, Artificial Sequence
  chemically synthesized
tgagaaaaaaaggattccaagg

SEQ ID NO: 643027 - DNA, 22 bp, Artificial Sequence
  chemically synthesized
tactgtccttggaatccttttt

SEQ ID NO: 643028 - DNA, 22 bp, Artificial Sequence
  chemically synthesized
actgtccttggaatcctttttt

SEQ ID NO: 643029 - DNA, 22 bp, Artificial Sequence
  chemically synthesized
ctgtccttggaatccttttttt

SEQ ID NO: 643030 - DNA, 22 bp, Artificial Sequence
  chemically synthesized
agatactctgagaaaaaaagga

SEQ ID NO: 643031 - DNA, 22 bp, Artificial Sequence
  chemically synthesized
tccttggaatcctttttttctc

SEQ ID NO: 643032 - DNA, 22 bp, Artificial Sequence
  chemically synthesized
ggaatcctttttttctcagagt

SEQ ID NO: 643033 - DNA, 22 bp, Artificial Sequence
  chemically synthesized
gaatcctttttttctcagagta

SEQ ID NO: 643034 - DNA, 22 bp, Artificial Sequence
  chemically synthesized
cagaataccactgagatactct

SEQ ID NO: 643035 - DNA, 22 bp, Artificial Sequence
  chemically synthesized
tgcagaataccactgagatact

SEQ ID NO: 643036 - DNA, 22 bp, Artificial Sequence
  chemically synthesized
tttttctcagagtatctcagtg

SEQ ID NO: 643037 - DNA, 22 bp, Artificial Sequence
  chemically synthesized
ttttctcagagtatctcagtgg

SEQ ID NO: 643038 - DNA, 22 bp, Artificial Sequence
  chemically synthesized
tttctcagagtatctcagtggt

SEQ ID NO: 643039 - DNA, 22 bp, Artificial Sequence
  chemically synthesized
ttctcagagtatctcagtggta

SEQ ID NO: 643040 - DNA, 22 bp, Artificial Sequence
  chemically synthesized
tctcagagtatctcagtggtat

SEQ ID NO: 643041 - DNA, 22 bp, Artificial Sequence
  chemically synthesized
ctcagagtatctcagtggtatt

SEQ ID NO: 643042 - DNA, 22 bp, Artificial Sequence
  chemically synthesized
tcagagtatctcagtggtattc

SEQ ID NO: 643043 - DNA, 22 bp, Artificial Sequence
  chemically synthesized
agagtatctcagtggtattctg

SEQ ID NO: 643044 - DNA, 22 bp, Artificial Sequence
  chemically synthesized
aaatgtattctgcagaatacca

SEQ ID NO: 643045 - DNA, 22 bp, Artificial Sequence
  chemically synthesized
cctaaaatgtattctgcagaat

SEQ ID NO: 643046 - DNA, 22 bp, Artificial Sequence
  chemically synthesized
ttgcctaaaatgtattctgcag

SEQ ID NO: 643047 - DNA, 22 bp, Artificial Sequence
  chemically synthesized
agtggtattctgcagaatacat

SEQ ID NO: 643048 - DNA, 22 bp, Artificial Sequence
  chemically synthesized
tgcagaatacattttaggcaac

SEQ ID NO: 643049 - DNA, 22 bp, Artificial Sequence
  chemically synthesized
cagaatacattttaggcaacag

SEQ ID NO: 643050 - DNA, 22 bp, Artificial Sequence
  chemically synthesized
caaggataaaggtcactgttgc

SEQ ID NO: 643051 - DNA, 22 bp, Artificial Sequence
  chemically synthesized
tccaaggataaaggtcactgtt

SEQ ID NO: 643052 - DNA, 22 bp, Artificial Sequence
  chemically synthesized
taggcaacagtgacctttatcc

SEQ ID NO: 643053 - DNA, 22 bp, Artificial Sequence
  chemically synthesized
aggcaacagtgacctttatcct

SEQ ID NO: 643054 - DNA, 22 bp, Artificial Sequence
  chemically synthesized
ggcaacagtgacctttatcctt

SEQ ID NO: 643055 - DNA, 22 bp, Artificial Sequence
  chemically synthesized
tatccttggagaactgtcaccc

SEQ ID NO: 643056 - DNA, 22 bp, Artificial Sequence
  chemically synthesized
atccttggagaactgtcaccct

SEQ ID NO: 643057 - DNA, 22 bp, Artificial Sequence
  chemically synthesized
tccttggagaactgtcacccta

SEQ ID NO: 643058 - DNA, 22 bp, Artificial Sequence
  chemically synthesized
aaacaccaaagatagggtgaca

SEQ ID NO: 643059 - DNA, 22 bp, Artificial Sequence
  chemically synthesized
ggagaactgtcaccctatcttt

SEQ ID NO: 643060 - DNA, 22 bp, Artificial Sequence
  chemically synthesized
gagaactgtcaccctatctttg

SEQ ID NO: 643061 - DNA, 22 bp, Artificial Sequence
  chemically synthesized
acattaaaacaccaaagatagg

SEQ ID NO: 643062 - DNA, 22 bp, Artificial Sequence
  chemically synthesized
aacattaaaacaccaaagatag

SEQ ID NO: 643063 - DNA, 22 bp, Artificial Sequence
  chemically synthesized
tcaccctatctttggtgtttta

SEQ ID NO: 643064 - DNA, 22 bp, Artificial Sequence
  chemically synthesized
tggaaagcttaacattaaaaca

SEQ ID NO: 643065 - DNA, 22 bp, Artificial Sequence
  chemically synthesized
tctttggtgttttaatgttaag

SEQ ID NO: 643066 - DNA, 22 bp, Artificial Sequence
  chemically synthesized
ataattgtggaaagcttaacat

SEQ ID NO: 643067 - DNA, 22 bp, Artificial Sequence
  chemically synthesized
gataattgtggaaagcttaaca

SEQ ID NO: 643068 - DNA, 22 bp, Artificial Sequence
  chemically synthesized
tggtgttttaatgttaagcttt

SEQ ID NO: 643069 - DNA, 22 bp, Artificial Sequence
  chemically synthesized
tgataattgtggaaagcttaac

SEQ ID NO: 643070 - DNA, 22 bp, Artificial Sequence
  chemically synthesized
ggtgttttaatgttaagctttc

SEQ ID NO: 643071 - DNA, 22 bp, Artificial Sequence
  chemically synthesized
gtgttttaatgttaagctttcc

SEQ ID NO: 643072 - DNA, 22 bp, Artificial Sequence
  chemically synthesized
taatgttaagctttccacaatt

SEQ ID NO: 643073 - DNA, 22 bp, Artificial Sequence
  chemically synthesized
atggcctttgataattgtggaa

SEQ ID NO: 643074 - DNA, 22 bp, Artificial Sequence
  chemically synthesized
aatgttaagctttccacaatta

SEQ ID NO: 643075 - DNA, 22 bp, Artificial Sequence
  chemically synthesized
atgttaagctttccacaattat

SEQ ID NO: 643076 - DNA, 22 bp, Artificial Sequence
  chemically synthesized
tcatggcctttgataattgtgg

SEQ ID NO: 643077 - DNA, 22 bp, Artificial Sequence
  chemically synthesized
ctcatggcctttgataattgtg

SEQ ID NO: 643078 - DNA, 22 bp, Artificial Sequence
  chemically synthesized
tttctcatggcctttgataatt

SEQ ID NO: 643079 - DNA, 22 bp, Artificial Sequence
  chemically synthesized
agctttccacaattatcaaagg

SEQ ID NO: 643080 - DNA, 22 bp, Artificial Sequence
  chemically synthesized
tccacaattatcaaaggccatg

SEQ ID NO: 643081 - DNA, 22 bp, Artificial Sequence
  chemically synthesized
ccacaattatcaaaggccatga

SEQ ID NO: 643082 - DNA, 22 bp, Artificial Sequence
  chemically synthesized
cacaattatcaaaggccatgag

SEQ ID NO: 643083 - DNA, 22 bp, Artificial Sequence
  chemically synthesized
tatgtggctgtttctcatggcc

SEQ ID NO: 643084 - DNA, 22 bp, Artificial Sequence
  chemically synthesized
tcaaaggccatgagaaacagcc

SEQ ID NO: 643085 - DNA, 22 bp, Artificial Sequence
  chemically synthesized
taacaaatcccaagggaaatta

SEQ ID NO: 643086 - DNA, 22 bp, Artificial Sequence
  chemically synthesized
ataacaaatcccaagggaaatt

SEQ ID NO: 643087 - DNA, 22 bp, Artificial Sequence
  chemically synthesized
tataacaaatcccaagggaaat

SEQ ID NO: 643088 - DNA, 22 bp, Artificial Sequence
  chemically synthesized
ttataacaaatcccaagggaaa

SEQ ID NO: 643089 - DNA, 22 bp, Artificial Sequence
  chemically synthesized
tcaacatttttataacaaatcc

SEQ ID NO: 643090 - DNA, 22 bp, Artificial Sequence
  chemically synthesized
atcaacatttttataacaaatc

SEQ ID NO: 643091 - DNA, 22 bp, Artificial Sequence
  chemically synthesized
cccttgggatttgttataaaaa

SEQ ID NO: 643092 - DNA, 22 bp, Artificial Sequence
  chemically synthesized
ccttgggatttgttataaaaat

SEQ ID NO: 643093 - DNA, 22 bp, Artificial Sequence
  chemically synthesized
gtgtccttatcaacatttttat

SEQ ID NO: 643094 - DNA, 22 bp, Artificial Sequence
  chemically synthesized
gggatttgttataaaaatgttg

SEQ ID NO: 643095 - DNA, 22 bp, Artificial Sequence
  chemically synthesized
ggatttgttataaaaatgttga

SEQ ID NO: 643096 - DNA, 22 bp, Artificial Sequence
  chemically synthesized
gctagtgtccttatcaacattt

SEQ ID NO: 643097 - DNA, 22 bp, Artificial Sequence
  chemically synthesized
ttggctagtgtccttatcaaca

SEQ ID NO: 643098 - DNA, 22 bp, Artificial Sequence
  chemically synthesized
gttataaaaatgttgataagga

SEQ ID NO: 643099 - DNA, 22 bp, Artificial Sequence
  chemically synthesized
ttataaaaatgttgataaggac

SEQ ID NO: 643100 - DNA, 22 bp, Artificial Sequence
  chemically synthesized
taaaaatgttgataaggacact

SEQ ID NO: 643101 - DNA, 22 bp, Artificial Sequence
  chemically synthesized
aagtgattattggctagtgtcc

SEQ ID NO: 643102 - DNA, 22 bp, Artificial Sequence
  chemically synthesized
gaagtgattattggctagtgtc

SEQ ID NO: 643103 - DNA, 22 bp, Artificial Sequence
  chemically synthesized
cacttgaagtgattattggcta

SEQ ID NO: 643104 - DNA, 22 bp, Artificial Sequence
  chemically synthesized
ataaggacactagccaataatc

SEQ ID NO: 643105 - DNA, 22 bp, Artificial Sequence
  chemically synthesized
agcagcgttacacttgaagtga

SEQ ID NO: 643106 - DNA, 22 bp, Artificial Sequence
  chemically synthesized
aagcagcgttacacttgaagtg

SEQ ID NO: 643107 - DNA, 22 bp, Artificial Sequence
  chemically synthesized
ttaagcagcgttacacttgaag

SEQ ID NO: 643108 - DNA, 22 bp, Artificial Sequence
  chemically synthesized
gccaataatcacttcaagtgta

SEQ ID NO: 643109 - DNA, 22 bp, Artificial Sequence
  chemically synthesized
aactcttaagcagcgttacact

SEQ ID NO: 643110 - DNA, 22 bp, Artificial Sequence
  chemically synthesized
caagtgtaacgctgcttaagag

SEQ ID NO: 643111 - DNA, 22 bp, Artificial Sequence
  chemically synthesized
aagtgtaacgctgcttaagagt

SEQ ID NO: 643112 - DNA, 22 bp, Artificial Sequence
  chemically synthesized
ggtggtggtcctgaactcttaa

SEQ ID NO: 643113 - DNA, 22 bp, Artificial Sequence
  chemically synthesized
gggtggtggtcctgaactctta

SEQ ID NO: 643114 - DNA, 22 bp, Artificial Sequence
  chemically synthesized
aaacttgggtggtggtcctgaa

SEQ ID NO: 643115 - DNA, 22 bp, Artificial Sequence
  chemically synthesized
cttaagagttcaggaccaccac

SEQ ID NO: 643116 - DNA, 22 bp, Artificial Sequence
  chemically synthesized
tattcaaacttgggtggtggtc

SEQ ID NO: 643117 - DNA, 22 bp, Artificial Sequence
  chemically synthesized
aagagttcaggaccaccaccca

SEQ ID NO: 643118 - DNA, 22 bp, Artificial Sequence
  chemically synthesized
agagttcaggaccaccacccaa

SEQ ID NO: 643119 - DNA, 22 bp, Artificial Sequence
  chemically synthesized
aggaccaccacccaagtttgaa

SEQ ID NO: 643120 - DNA, 22 bp, Artificial Sequence
  chemically synthesized
atatggccagcaagtaatagga

SEQ ID NO: 643121 - DNA, 22 bp, Artificial Sequence
  chemically synthesized
catatggccagcaagtaatagg

SEQ ID NO: 643122 - DNA, 22 bp, Artificial Sequence
  chemically synthesized
gaatacaggtcctattacttgc

SEQ ID NO: 643123 - DNA, 22 bp, Artificial Sequence
  chemically synthesized
aatacaggtcctattacttgct

SEQ ID NO: 643124 - DNA, 22 bp, Artificial Sequence
  chemically synthesized
aggacacttcatatggccagca

SEQ ID NO: 643125 - DNA, 22 bp, Artificial Sequence
  chemically synthesized
ttacttgctggccatatgaagt

SEQ ID NO: 643126 - DNA, 22 bp, Artificial Sequence
  chemically synthesized
cttgctggccatatgaagtgtc

SEQ ID NO: 643127 - DNA, 22 bp, Artificial Sequence
  chemically synthesized
gctggccatatgaagtgtcctt

SEQ ID NO: 643128 - DNA, 22 bp, Artificial Sequence
  chemically synthesized
ctggccatatgaagtgtcctta

SEQ ID NO: 643129 - DNA, 22 bp, Artificial Sequence
  chemically synthesized
gccatatgaagtgtccttaata

SEQ ID NO: 643130 - DNA, 22 bp, Artificial Sequence
  chemically synthesized
cgtggcacagagtattaaggac

SEQ ID NO: 643131 - DNA, 22 bp, Artificial Sequence
  chemically synthesized
cagaggattacgtggcacagag

SEQ ID NO: 643132 - DNA, 22 bp, Artificial Sequence
  chemically synthesized
ccagaggattacgtggcacaga

SEQ ID NO: 643133 - DNA, 22 bp, Artificial Sequence
  chemically synthesized
tttccagaggattacgtggcac

SEQ ID NO: 643134 - DNA, 22 bp, Artificial Sequence
  chemically synthesized
aatactctgtgccacgtaatcc

SEQ ID NO: 643135 - DNA, 22 bp, Artificial Sequence
  chemically synthesized
atactctgtgccacgtaatcct

SEQ ID NO: 643136 - DNA, 22 bp, Artificial Sequence
  chemically synthesized
tgtgccacgtaatcctctggaa

SEQ ID NO: 643137 - DNA, 22 bp, Artificial Sequence
  chemically synthesized
tgccacgtaatcctctggaaac

SEQ ID NO: 643138 - DNA, 22 bp, Artificial Sequence
  chemically synthesized
tgaaagagaggctgtttccaga

SEQ ID NO: 643139 - DNA, 22 bp, Artificial Sequence
  chemically synthesized
aaacaaccctatgaaagagagg

SEQ ID NO: 643140 - DNA, 22 bp, Artificial Sequence
  chemically synthesized
aaaacaaccctatgaaagagag

SEQ ID NO: 643141 - DNA, 22 bp, Artificial Sequence
  chemically synthesized
tggaaacagcctctctttcata

SEQ ID NO: 643142 - DNA, 22 bp, Artificial Sequence
  chemically synthesized
gaaacagcctctctttcatagg

SEQ ID NO: 643143 - DNA, 22 bp, Artificial Sequence
  chemically synthesized
atccttaaaacaaccctatgaa

SEQ ID NO: 643144 - DNA, 22 bp, Artificial Sequence
  chemically synthesized
aatccttaaaacaaccctatga

SEQ ID NO: 643145 - DNA, 22 bp, Artificial Sequence
  chemically synthesized
tttaatccttaaaacaacccta

SEQ ID NO: 643146 - DNA, 22 bp, Artificial Sequence
  chemically synthesized
ctatttaatccttaaaacaacc

SEQ ID NO: 643147 - DNA, 22 bp, Artificial Sequence
  chemically synthesized
tctttcatagggttgttttaag

SEQ ID NO: 643148 - DNA, 22 bp, Artificial Sequence
  chemically synthesized
tttcatagggttgttttaagga

SEQ ID NO: 643149 - DNA, 22 bp, Artificial Sequence
  chemically synthesized
tcatagggttgttttaaggatt

SEQ ID NO: 643150 - DNA, 22 bp, Artificial Sequence
  chemically synthesized
catagggttgttttaaggatta

SEQ ID NO: 643151 - DNA, 22 bp, Artificial Sequence
  chemically synthesized
atagggttgttttaaggattaa

SEQ ID NO: 643152 - DNA, 22 bp, Artificial Sequence
  chemically synthesized
agtacatatgaactcctattta

SEQ ID NO: 643153 - DNA, 22 bp, Artificial Sequence
  chemically synthesized
ttttaaggattaaataggagtt

SEQ ID NO: 643154 - DNA, 22 bp, Artificial Sequence
  chemically synthesized
tgagtacatatgaactcctatt

SEQ ID NO: 643155 - DNA, 22 bp, Artificial Sequence
  chemically synthesized
taaggattaaataggagttcat

SEQ ID NO: 643156 - DNA, 22 bp, Artificial Sequence
  chemically synthesized
ttctgagtacatatgaactcct

SEQ ID NO: 643157 - DNA, 22 bp, Artificial Sequence
  chemically synthesized
aaggattaaataggagttcata

SEQ ID NO: 643158 - DNA, 22 bp, Artificial Sequence
  chemically synthesized
aggattaaataggagttcatat

SEQ ID NO: 643159 - DNA, 22 bp, Artificial Sequence
  chemically synthesized
aataggagttcatatgtactca

SEQ ID NO: 643160 - DNA, 22 bp, Artificial Sequence
  chemically synthesized
tggacaggaactgttctgagta

SEQ ID NO: 643161 - DNA, 22 bp, Artificial Sequence
  chemically synthesized
ctatggacaggaactgttctga

SEQ ID NO: 643162 - DNA, 22 bp, Artificial Sequence
  chemically synthesized
atatgtactcagaacagttcct

SEQ ID NO: 643163 - DNA, 22 bp, Artificial Sequence
  chemically synthesized
agtgattgctatggacaggaac

SEQ ID NO: 643164 - DNA, 22 bp, Artificial Sequence
  chemically synthesized
gagtgattgctatggacaggaa

SEQ ID NO: 643165 - DNA, 22 bp, Artificial Sequence
  chemically synthesized
tgagtgattgctatggacagga

SEQ ID NO: 643166 - DNA, 22 bp, Artificial Sequence
  chemically synthesized
agaacagttcctgtccatagca

SEQ ID NO: 643167 - DNA, 22 bp, Artificial Sequence
  chemically synthesized
tcctttgagtgattgctatgga

SEQ ID NO: 643168 - DNA, 22 bp, Artificial Sequence
  chemically synthesized
ctgtccatagcaatcactcaaa

SEQ ID NO: 643169 - DNA, 22 bp, Artificial Sequence
  chemically synthesized
tccatagcaatcactcaaagga

SEQ ID NO: 643170 - DNA, 22 bp, Artificial Sequence
  chemically synthesized
aaaggacagctatttttgttat

SEQ ID NO: 643171 - DNA, 22 bp, Artificial Sequence
  chemically synthesized
cgtaataataataataacaaaa

SEQ ID NO: 643172 - DNA, 22 bp, Artificial Sequence
  chemically synthesized
tacgtaataataataataacaa

SEQ ID NO: 643173 - DNA, 22 bp, Artificial Sequence
  chemically synthesized
gctctacgtaataataataata

SEQ ID NO: 643174 - DNA, 22 bp, Artificial Sequence
  chemically synthesized
ctggctctacgtaataataata

SEQ ID NO: 643175 - DNA, 22 bp, Artificial Sequence
  chemically synthesized
cctggctctacgtaataataat

SEQ ID NO: 643176 - DNA, 22 bp, Artificial Sequence
  chemically synthesized
tttttgttattattattattac

SEQ ID NO: 643177 - DNA, 22 bp, Artificial Sequence
  chemically synthesized
tcctggctctacgtaataataa

SEQ ID NO: 643178 - DNA, 22 bp, Artificial Sequence
  chemically synthesized
ttgttattattattattacgta

SEQ ID NO: 643179 - DNA, 22 bp, Artificial Sequence
  chemically synthesized
ttttcctggctctacgtaataa

SEQ ID NO: 643180 - DNA, 22 bp, Artificial Sequence
  chemically synthesized
tgttattattattattacgtag

SEQ ID NO: 643181 - DNA, 22 bp, Artificial Sequence
  chemically synthesized
gttattattattattacgtaga

SEQ ID NO: 643182 - DNA, 22 bp, Artificial Sequence
  chemically synthesized
ttattattattattacgtagag

SEQ ID NO: 643183 - DNA, 22 bp, Artificial Sequence
  chemically synthesized
ttattattattacgtagagcca

SEQ ID NO: 643184 - DNA, 22 bp, Artificial Sequence
  chemically synthesized
ttattattacgtagagccagga

SEQ ID NO: 643185 - DNA, 22 bp, Artificial Sequence
  chemically synthesized
ttattacgtagagccaggaaaa

SEQ ID NO: 643186 - DNA, 22 bp, Artificial Sequence
  chemically synthesized
aagaaacatcattgttttcctg

SEQ ID NO: 643187 - DNA, 22 bp, Artificial Sequence
  chemically synthesized
ttacgtagagccaggaaaacaa

SEQ ID NO: 643188 - DNA, 22 bp, Artificial Sequence
  chemically synthesized
cgtagagccaggaaaacaatga

SEQ ID NO: 643189 - DNA, 22 bp, Artificial Sequence
  chemically synthesized
aagaagcacgcagcatcctaaa

SEQ ID NO: 643190 - DNA, 22 bp, Artificial Sequence
  chemically synthesized
aattaaagaagcacgcagcatc

SEQ ID NO: 643191 - DNA, 22 bp, Artificial Sequence
  chemically synthesized
ctttaggatgctgcgtgcttct

SEQ ID NO: 643192 - DNA, 22 bp, Artificial Sequence
  chemically synthesized
atattgaattaaagaagcacgc

SEQ ID NO: 643193 - DNA, 22 bp, Artificial Sequence
  chemically synthesized
tttaggatgctgcgtgcttctt

SEQ ID NO: 643194 - DNA, 22 bp, Artificial Sequence
  chemically synthesized
aatattgaattaaagaagcacg

SEQ ID NO: 643195 - DNA, 22 bp, Artificial Sequence
  chemically synthesized
taggatgctgcgtgcttcttta

SEQ ID NO: 643196 - DNA, 22 bp, Artificial Sequence
  chemically synthesized
ttaatattgaattaaagaagca

SEQ ID NO: 643197 - DNA, 22 bp, Artificial Sequence
  chemically synthesized
aggatgctgcgtgcttctttaa

SEQ ID NO: 643198 - DNA, 22 bp, Artificial Sequence
  chemically synthesized
ggatgctgcgtgcttctttaat

SEQ ID NO: 643199 - DNA, 22 bp, Artificial Sequence
  chemically synthesized
tctcttaatattgaattaaaga

SEQ ID NO: 643200 - DNA, 22 bp, Artificial Sequence
  chemically synthesized
tctgtctcttaatattgaatta

SEQ ID NO: 643201 - DNA, 22 bp, Artificial Sequence
  chemically synthesized
gtctgtctcttaatattgaatt

SEQ ID NO: 643202 - DNA, 22 bp, Artificial Sequence
  chemically synthesized
cgtgcttctttaattcaatatt

SEQ ID NO: 643203 - DNA, 22 bp, Artificial Sequence
  chemically synthesized
ctttaattcaatattaagagac

SEQ ID NO: 643204 - DNA, 22 bp, Artificial Sequence
  chemically synthesized
tttaattcaatattaagagaca

SEQ ID NO: 643205 - DNA, 22 bp, Artificial Sequence
  chemically synthesized
taattcaatattaagagacaga

SEQ ID NO: 643206 - DNA, 22 bp, Artificial Sequence
  chemically synthesized
aattcaatattaagagacagac

SEQ ID NO: 643207 - DNA, 22 bp, Artificial Sequence
  chemically synthesized
attcaatattaagagacagaca

SEQ ID NO: 643208 - DNA, 22 bp, Artificial Sequence
  chemically synthesized
aatattaagagacagacaaatc

SEQ ID NO: 643209 - DNA, 22 bp, Artificial Sequence
  chemically synthesized
agagacagacaaatctttgttt

SEQ ID NO: 643210 - DNA, 22 bp, Artificial Sequence
  chemically synthesized
tagccagggagataataggaaa

SEQ ID NO: 643211 - DNA, 22 bp, Artificial Sequence
  chemically synthesized
cctgtagccagggagataatag

SEQ ID NO: 643212 - DNA, 22 bp, Artificial Sequence
  chemically synthesized
ccctgtagccagggagataata

SEQ ID NO: 643213 - DNA, 22 bp, Artificial Sequence
  chemically synthesized
tgtttcctattatctccctggc

SEQ ID NO: 643214 - DNA, 22 bp, Artificial Sequence
  chemically synthesized
agcttccctgtagccagggaga

SEQ ID NO: 643215 - DNA, 22 bp, Artificial Sequence
  chemically synthesized
gtttcctattatctccctggct

SEQ ID NO: 643216 - DNA, 22 bp, Artificial Sequence
  chemically synthesized
gagcttccctgtagccagggag

SEQ ID NO: 643217 - DNA, 22 bp, Artificial Sequence
  chemically synthesized
tttcctattatctccctggcta

SEQ ID NO: 643218 - DNA, 22 bp, Artificial Sequence
  chemically synthesized
cctattatctccctggctacag

SEQ ID NO: 643219 - DNA, 22 bp, Artificial Sequence
  chemically synthesized
ctattatctccctggctacagg

SEQ ID NO: 643220 - DNA, 22 bp, Artificial Sequence
  chemically synthesized
agtttgagcttccctgtagcca

SEQ ID NO: 643221 - DNA, 22 bp, Artificial Sequence
  chemically synthesized
ttatctccctggctacagggaa

SEQ ID NO: 643222 - DNA, 22 bp, Artificial Sequence
  chemically synthesized
tctccctggctacagggaagct

SEQ ID NO: 643223 - DNA, 22 bp, Artificial Sequence
  chemically synthesized
agattcagtttgagcttccctg

SEQ ID NO: 643224 - DNA, 22 bp, Artificial Sequence
  chemically synthesized
cagattcagtttgagcttccct

SEQ ID NO: 643225 - DNA, 22 bp, Artificial Sequence
  chemically synthesized
cctggctacagggaagctcaaa

SEQ ID NO: 643226 - DNA, 22 bp, Artificial Sequence
  chemically synthesized
agcttcagattcagtttgagct

SEQ ID NO: 643227 - DNA, 22 bp, Artificial Sequence
  chemically synthesized
gctacagggaagctcaaactga

SEQ ID NO: 643228 - DNA, 22 bp, Artificial Sequence
  chemically synthesized
actaagcttcagattcagtttg

SEQ ID NO: 643229 - DNA, 22 bp, Artificial Sequence
  chemically synthesized
gactaagcttcagattcagttt

SEQ ID NO: 643230 - DNA, 22 bp, Artificial Sequence
  chemically synthesized
cagggaagctcaaactgaatct

SEQ ID NO: 643231 - DNA, 22 bp, Artificial Sequence
  chemically synthesized
atttgactaagcttcagattca

SEQ ID NO: 643232 - DNA, 22 bp, Artificial Sequence
  chemically synthesized
aaactgaatctgaagcttagtc

SEQ ID NO: 643233 - DNA, 22 bp, Artificial Sequence
  chemically synthesized
gcatagttgatttgactaagct

SEQ ID NO: 643234 - DNA, 22 bp, Artificial Sequence
  chemically synthesized
aatctgaagcttagtcaaatca

SEQ ID NO: 643235 - DNA, 22 bp, Artificial Sequence
  chemically synthesized
aagcttagtcaaatcaactatg

SEQ ID NO: 643236 - DNA, 22 bp, Artificial Sequence
  chemically synthesized
agtcaaatcaactatgctaatc

SEQ ID NO: 643237 - DNA, 22 bp, Artificial Sequence
  chemically synthesized
gtcaaatcaactatgctaatcc

SEQ ID NO: 643238 - DNA, 22 bp, Artificial Sequence
  chemically synthesized
tgctaatccctatgatgttcat

SEQ ID NO: 643239 - DNA, 22 bp, Artificial Sequence
  chemically synthesized
atccctatgatgttcattgatc

SEQ ID NO: 643240 - DNA, 22 bp, Artificial Sequence
  chemically synthesized
caatataaataatagatcaatg

SEQ ID NO: 643241 - DNA, 22 bp, Artificial Sequence
  chemically synthesized
ctgcaatataaataatagatca

SEQ ID NO: 643242 - DNA, 22 bp, Artificial Sequence
  chemically synthesized
tgatgttcattgatctattatt

SEQ ID NO: 643243 - DNA, 22 bp, Artificial Sequence
  chemically synthesized
attgatctattatttatattgc

SEQ ID NO: 643244 - DNA, 22 bp, Artificial Sequence
  chemically synthesized
atctattatttatattgcagga

SEQ ID NO: 643245 - DNA, 22 bp, Artificial Sequence
  chemically synthesized
ttatttatattgcaggaattgt

SEQ ID NO: 643246 - DNA, 22 bp, Artificial Sequence
  chemically synthesized
tttatattgcaggaattgtatt

SEQ ID NO: 643247 - DNA, 22 bp, Artificial Sequence
  chemically synthesized
aaaagtcatagcaatacaattc

SEQ ID NO: 643248 - DNA, 22 bp, Artificial Sequence
  chemically synthesized
aaaaagtcatagcaatacaatt

SEQ ID NO: 643249 - DNA, 22 bp, Artificial Sequence
  chemically synthesized
taaaaagtcatagcaatacaat

SEQ ID NO: 643250 - DNA, 22 bp, Artificial Sequence
  chemically synthesized
atattgcaggaattgtattgct

SEQ ID NO: 643251 - DNA, 22 bp, Artificial Sequence
  chemically synthesized
tattgcaggaattgtattgcta

SEQ ID NO: 643252 - DNA, 22 bp, Artificial Sequence
  chemically synthesized
tttaaaaagtcatagcaataca

SEQ ID NO: 643253 - DNA, 22 bp, Artificial Sequence
  chemically synthesized
caggaattgtattgctatgact

SEQ ID NO: 643254 - DNA, 22 bp, Artificial Sequence
  chemically synthesized
agaaaggattctttaaaaagtc

SEQ ID NO: 643255 - DNA, 22 bp, Artificial Sequence
  chemically synthesized
cagaaaggattctttaaaaagt

SEQ ID NO: 643256 - DNA, 22 bp, Artificial Sequence
  chemically synthesized
tcagaaaggattctttaaaaag

SEQ ID NO: 643257 - DNA, 22 bp, Artificial Sequence
  chemically synthesized
tattgctatgactttttaaaga

SEQ ID NO: 643258 - DNA, 22 bp, Artificial Sequence
  chemically synthesized
agttttcagaaaggattcttta

SEQ ID NO: 643259 - DNA, 22 bp, Artificial Sequence
  chemically synthesized
ctatgactttttaaagaatcct

SEQ ID NO: 643260 - DNA, 22 bp, Artificial Sequence
  chemically synthesized
tgactttttaaagaatcctttc

SEQ ID NO: 643261 - DNA, 22 bp, Artificial Sequence
  chemically synthesized
cgtattcagttttcagaaagga

SEQ ID NO: 643262 - DNA, 22 bp, Artificial Sequence
  chemically synthesized
acgtattcagttttcagaaagg

SEQ ID NO: 643263 - DNA, 22 bp, Artificial Sequence
  chemically synthesized
tacgtattcagttttcagaaag

SEQ ID NO: 643264 - DNA, 22 bp, Artificial Sequence
  chemically synthesized
tttaaagaatcctttctgaaaa

SEQ ID NO: 643265 - DNA, 22 bp, Artificial Sequence
  chemically synthesized
ttaaagaatcctttctgaaaac

SEQ ID NO: 643266 - DNA, 22 bp, Artificial Sequence
  chemically synthesized
taaagaatcctttctgaaaact

SEQ ID NO: 643267 - DNA, 22 bp, Artificial Sequence
  chemically synthesized
aaagaatcctttctgaaaactg

SEQ ID NO: 643268 - DNA, 22 bp, Artificial Sequence
  chemically synthesized
attttacgtattcagttttcag

SEQ ID NO: 643269 - DNA, 22 bp, Artificial Sequence
  chemically synthesized
aagaatcctttctgaaaactga

SEQ ID NO: 643270 - DNA, 22 bp, Artificial Sequence
  chemically synthesized
tgttgattttacgtattcagtt

SEQ ID NO: 643271 - DNA, 22 bp, Artificial Sequence
  chemically synthesized
ctatgttgattttacgtattca

SEQ ID NO: 643272 - DNA, 22 bp, Artificial Sequence
  chemically synthesized
cctatgttgattttacgtattc

SEQ ID NO: 643273 - DNA, 22 bp, Artificial Sequence
  chemically synthesized
tctgaaaactgaatacgtaaaa

SEQ ID NO: 643274 - DNA, 22 bp, Artificial Sequence
  chemically synthesized
ctgaaaactgaatacgtaaaat

SEQ ID NO: 643275 - DNA, 22 bp, Artificial Sequence
  chemically synthesized
tgaaaactgaatacgtaaaatc

SEQ ID NO: 643276 - DNA, 22 bp, Artificial Sequence
  chemically synthesized
aaaactgaatacgtaaaatcaa

SEQ ID NO: 643277 - DNA, 22 bp, Artificial Sequence
  chemically synthesized
aagtggaaatttcctatgttga

SEQ ID NO: 643278 - DNA, 22 bp, Artificial Sequence
  chemically synthesized
aatacgtaaaatcaacatagga

SEQ ID NO: 643279 - DNA, 22 bp, Artificial Sequence
  chemically synthesized
caagtggaaatttcctatgttg

SEQ ID NO: 643280 - DNA, 22 bp, Artificial Sequence
  chemically synthesized
cccaaggacatttcaagtggaa

SEQ ID NO: 643281 - DNA, 22 bp, Artificial Sequence
  chemically synthesized
gcccaaggacatttcaagtgga

SEQ ID NO: 643282 - DNA, 22 bp, Artificial Sequence
  chemically synthesized
tttgcccaaggacatttcaagt

SEQ ID NO: 643283 - DNA, 22 bp, Artificial Sequence
  chemically synthesized
tatttgcccaaggacatttcaa

SEQ ID NO: 643284 - DNA, 22 bp, Artificial Sequence
  chemically synthesized
aattctatttgcccaaggacat

SEQ ID NO: 643285 - DNA, 22 bp, Artificial Sequence
  chemically synthesized
ccacttgaaatgtccttgggca

SEQ ID NO: 643286 - DNA, 22 bp, Artificial Sequence
  chemically synthesized
cacttgaaatgtccttgggcaa

SEQ ID NO: 643287 - DNA, 22 bp, Artificial Sequence
  chemically synthesized
gaaatgtccttgggcaaataga

SEQ ID NO: 643288 - DNA, 22 bp, Artificial Sequence
  chemically synthesized
aaatgtccttgggcaaatagaa

SEQ ID NO: 643289 - DNA, 22 bp, Artificial Sequence
  chemically synthesized
cgtatcagacatactgaattct

SEQ ID NO: 643290 - DNA, 22 bp, Artificial Sequence
  chemically synthesized
gggcaaatagaattcagtatgt

SEQ ID NO: 643291 - DNA, 22 bp, Artificial Sequence
  chemically synthesized
ggcaaatagaattcagtatgtc

SEQ ID NO: 643292 - DNA, 22 bp, Artificial Sequence
  chemically synthesized
agtatgtctgatacgtagctct

SEQ ID NO: 643293 - DNA, 22 bp, Artificial Sequence
  chemically synthesized
gtgcatggagagaaagagctac

SEQ ID NO: 643294 - DNA, 22 bp, Artificial Sequence
  chemically synthesized
atacgtagctctttctctccat

SEQ ID NO: 643295 - DNA, 22 bp, Artificial Sequence
  chemically synthesized
caaagggttagtgcatggagag

SEQ ID NO: 643296 - DNA, 22 bp, Artificial Sequence
  chemically synthesized
gcaaagggttagtgcatggaga

SEQ ID NO: 643297 - DNA, 22 bp, Artificial Sequence
  chemically synthesized
atttgcaaagggttagtgcatg

SEQ ID NO: 643298 - DNA, 22 bp, Artificial Sequence
  chemically synthesized
ctgatttgcaaagggttagtgc

SEQ ID NO: 643299 - DNA, 22 bp, Artificial Sequence
  chemically synthesized
tttctctccatgcactaaccct

SEQ ID NO: 643300 - DNA, 22 bp, Artificial Sequence
  chemically synthesized
tctctccatgcactaacccttt

SEQ ID NO: 643301 - DNA, 22 bp, Artificial Sequence
  chemically synthesized
ctctccatgcactaaccctttg

SEQ ID NO: 643302 - DNA, 22 bp, Artificial Sequence
  chemically synthesized
tctccatgcactaaccctttgc

SEQ ID NO: 643303 - DNA, 22 bp, Artificial Sequence
  chemically synthesized
tccatgcactaaccctttgcaa

SEQ ID NO: 643304 - DNA, 22 bp, Artificial Sequence
  chemically synthesized
catgcactaaccctttgcaaat

SEQ ID NO: 643305 - DNA, 22 bp, Artificial Sequence
  chemically synthesized
accctttgcaaatcaggagttt

SEQ ID NO: 643306 - DNA, 22 bp, Artificial Sequence
  chemically synthesized
gtgcacccaggaaaaactcctg

SEQ ID NO: 643307 - DNA, 22 bp, Artificial Sequence
  chemically synthesized
tgcaaatcaggagtttttcctg

SEQ ID NO: 643308 - DNA, 22 bp, Artificial Sequence
  chemically synthesized
gcaaatcaggagtttttcctgg

SEQ ID NO: 643309 - DNA, 22 bp, Artificial Sequence
  chemically synthesized
caaatcaggagtttttcctggg

SEQ ID NO: 643310 - DNA, 22 bp, Artificial Sequence
  chemically synthesized
ttcctgggtgcactaggttgct

SEQ ID NO: 643311 - DNA, 22 bp, Artificial Sequence
  chemically synthesized
tcctgggtgcactaggttgctt

SEQ ID NO: 643312 - DNA, 22 bp, Artificial Sequence
  chemically synthesized
aaaaacaaacaaaagcaaccta

SEQ ID NO: 643313 - DNA, 22 bp, Artificial Sequence
  chemically synthesized
cctgggtgcactaggttgcttt

SEQ ID NO: 643314 - DNA, 22 bp, Artificial Sequence
  chemically synthesized
ctgggtgcactaggttgctttt

SEQ ID NO: 643315 - DNA, 22 bp, Artificial Sequence
  chemically synthesized
ggtgcactaggttgcttttgtt

SEQ ID NO: 643316 - DNA, 22 bp, Artificial Sequence
  chemically synthesized
ggttgcttttgtttgtttttca

SEQ ID NO: 643317 - DNA, 22 bp, Artificial Sequence
  chemically synthesized
ggaaatgatcattgaaaaacaa

SEQ ID NO: 643318 - DNA, 22 bp, Artificial Sequence
  chemically synthesized
cttttgtttgtttttcaatgat

SEQ ID NO: 643319 - DNA, 22 bp, Artificial Sequence
  chemically synthesized
ggaactgggaaatgatcattga

SEQ ID NO: 643320 - DNA, 22 bp, Artificial Sequence
  chemically synthesized
ttgtttgtttttcaatgatcat

SEQ ID NO: 643321 - DNA, 22 bp, Artificial Sequence
  chemically synthesized
gggaactgggaaatgatcattg

SEQ ID NO: 643322 - DNA, 22 bp, Artificial Sequence
  chemically synthesized
tgtttgtttttcaatgatcatt

SEQ ID NO: 643323 - DNA, 22 bp, Artificial Sequence
  chemically synthesized
gtttgtttttcaatgatcattt

SEQ ID NO: 643324 - DNA, 22 bp, Artificial Sequence
  chemically synthesized
tttgtttttcaatgatcatttc

SEQ ID NO: 643325 - DNA, 22 bp, Artificial Sequence
  chemically synthesized
atttgggaactgggaaatgatc

SEQ ID NO: 643326 - DNA, 22 bp, Artificial Sequence
  chemically synthesized
aatttgggaactgggaaatgat

SEQ ID NO: 643327 - DNA, 22 bp, Artificial Sequence
  chemically synthesized
gtttttcaatgatcatttccca

SEQ ID NO: 643328 - DNA, 22 bp, Artificial Sequence
  chemically synthesized
taatttgggaactgggaaatga

SEQ ID NO: 643329 - DNA, 22 bp, Artificial Sequence
  chemically synthesized
tttttcaatgatcatttcccag

SEQ ID NO: 643330 - DNA, 22 bp, Artificial Sequence
  chemically synthesized
ttcaatgatcatttcccagttc

SEQ ID NO: 643331 - DNA, 22 bp, Artificial Sequence
  chemically synthesized
tcaatgatcatttcccagttcc

SEQ ID NO: 643332 - DNA, 22 bp, Artificial Sequence
  chemically synthesized
caatgatcatttcccagttccc

SEQ ID NO: 643333 - DNA, 22 bp, Artificial Sequence
  chemically synthesized
aatgatcatttcccagttccca

SEQ ID NO: 643334 - DNA, 22 bp, Artificial Sequence
  chemically synthesized
cggaaagttttaatttgggaac

SEQ ID NO: 643335 - DNA, 22 bp, Artificial Sequence
  chemically synthesized
gtgttacggaaagttttaattt

SEQ ID NO: 643336 - DNA, 22 bp, Artificial Sequence
  chemically synthesized
cccagttcccaaattaaaactt

SEQ ID NO: 643337 - DNA, 22 bp, Artificial Sequence
  chemically synthesized
ccagttcccaaattaaaacttt

SEQ ID NO: 643338 - DNA, 22 bp, Artificial Sequence
  chemically synthesized
ccaaattaaaactttccgtaac

SEQ ID NO: 643339 - DNA, 22 bp, Artificial Sequence
  chemically synthesized
aaactttccgtaacaccagatg

SEQ ID NO: 643340 - DNA, 22 bp, Artificial Sequence
  chemically synthesized
tccgtaacaccagatgcctccc

SEQ ID NO: 643341 - DNA, 22 bp, Artificial Sequence
  chemically synthesized
ccgtaacaccagatgcctcccc

SEQ ID NO: 643342 - DNA, 22 bp, Artificial Sequence
  chemically synthesized
cgtaacaccagatgcctccccc

SEQ ID NO: 643343 - DNA, 22 bp, Artificial Sequence
  chemically synthesized
aatgaatgagaccaagggaaaa

SEQ ID NO: 643344 - DNA, 22 bp, Artificial Sequence
  chemically synthesized
cccctctccattttcccttggt

SEQ ID NO: 643345 - DNA, 22 bp, Artificial Sequence
  chemically synthesized
tccattttcccttggtctcatt

SEQ ID NO: 643346 - DNA, 22 bp, Artificial Sequence
  chemically synthesized
cattttcccttggtctcattca

SEQ ID NO: 643347 - DNA, 22 bp, Artificial Sequence
  chemically synthesized
gaaggtcactgaatgaatgaga

SEQ ID NO: 643348 - DNA, 22 bp, Artificial Sequence
  chemically synthesized
tcccttggtctcattcattcag

SEQ ID NO: 643349 - DNA, 22 bp, Artificial Sequence
  chemically synthesized
cccttggtctcattcattcagt

SEQ ID NO: 643350 - DNA, 22 bp, Artificial Sequence
  chemically synthesized
ccttggtctcattcattcagtg

SEQ ID NO: 643351 - DNA, 22 bp, Artificial Sequence
  chemically synthesized
ggtctcattcattcagtgacct

SEQ ID NO: 643352 - DNA, 22 bp, Artificial Sequence
  chemically synthesized
gtctcattcattcagtgacctt

SEQ ID NO: 643353 - DNA, 22 bp, Artificial Sequence
  chemically synthesized
attcattcagtgaccttctaat

SEQ ID NO: 643354 - DNA, 22 bp, Artificial Sequence
  chemically synthesized
attcagtgaccttctaatttct

SEQ ID NO: 643355 - DNA, 22 bp, Artificial Sequence
  chemically synthesized
agtgaccttctaatttctccat

SEQ ID NO: 643356 - DNA, 22 bp, Artificial Sequence
  chemically synthesized
ggcaagtgaagaaggggatgga

SEQ ID NO: 643357 - DNA, 22 bp, Artificial Sequence
  chemically synthesized
aggcaagtgaagaaggggatgg

SEQ ID NO: 643358 - DNA, 22 bp, Artificial Sequence
  chemically synthesized
ctaatttctccatccccttctt

SEQ ID NO: 643359 - DNA, 22 bp, Artificial Sequence
  chemically synthesized
taatttctccatccccttcttc

SEQ ID NO: 643360 - DNA, 22 bp, Artificial Sequence
  chemically synthesized
atttctccatccccttcttcac

SEQ ID NO: 643361 - DNA, 22 bp, Artificial Sequence
  chemically synthesized
ctccatccccttcttcacttgc

SEQ ID NO: 643362 - DNA, 22 bp, Artificial Sequence
  chemically synthesized
aggatgtcttaggcaagtgaag

SEQ ID NO: 643363 - DNA, 22 bp, Artificial Sequence
  chemically synthesized
tccatccccttcttcacttgcc

SEQ ID NO: 643364 - DNA, 22 bp, Artificial Sequence
  chemically synthesized
catccccttcttcacttgccta

SEQ ID NO: 643365 - DNA, 22 bp, Artificial Sequence
  chemically synthesized
actaaggatgtcttaggcaagt

SEQ ID NO: 643366 - DNA, 22 bp, Artificial Sequence
  chemically synthesized
aactaaggatgtcttaggcaag

SEQ ID NO: 643367 - DNA, 22 bp, Artificial Sequence
  chemically synthesized
ttaactaaggatgtcttaggca

SEQ ID NO: 643368 - DNA, 22 bp, Artificial Sequence
  chemically synthesized
cttcacttgcctaagacatcct

SEQ ID NO: 643369 - DNA, 22 bp, Artificial Sequence
  chemically synthesized
ttcacttgcctaagacatcctt

SEQ ID NO: 643370 - DNA, 22 bp, Artificial Sequence
  chemically synthesized
cacttgcctaagacatccttag

SEQ ID NO: 643371 - DNA, 22 bp, Artificial Sequence
  chemically synthesized
acttgcctaagacatccttagt

SEQ ID NO: 643372 - DNA, 22 bp, Artificial Sequence
  chemically synthesized
gcctaagacatccttagttaag

SEQ ID NO: 643373 - DNA, 22 bp, Artificial Sequence
  chemically synthesized
cctaagacatccttagttaaga

SEQ ID NO: 643374 - DNA, 22 bp, Artificial Sequence
  chemically synthesized
aaagatgccaggttcttaacta

SEQ ID NO: 643375 - DNA, 22 bp, Artificial Sequence
  chemically synthesized
agacatccttagttaagaacct

SEQ ID NO: 643376 - DNA, 22 bp, Artificial Sequence
  chemically synthesized
agttaagaacctggcatctttt

SEQ ID NO: 643377 - DNA, 22 bp, Artificial Sequence
  chemically synthesized
gttaagaacctggcatctttta

SEQ ID NO: 643378 - DNA, 22 bp, Artificial Sequence
  chemically synthesized
agaacctggcatcttttaatgg

SEQ ID NO: 643379 - DNA, 22 bp, Artificial Sequence
  chemically synthesized
gcatcttttaatggactattcc

SEQ ID NO: 643380 - DNA, 22 bp, Artificial Sequence
  chemically synthesized
gtagaagcacagtggaatagtc

SEQ ID NO: 643381 - DNA, 22 bp, Artificial Sequence
  chemically synthesized
ttaatggactattccactgtgc

SEQ ID NO: 643382 - DNA, 22 bp, Artificial Sequence
  chemically synthesized
taatggactattccactgtgct

SEQ ID NO: 643383 - DNA, 22 bp, Artificial Sequence
  chemically synthesized
aatggactattccactgtgctt

SEQ ID NO: 643384 - DNA, 22 bp, Artificial Sequence
  chemically synthesized
atggactattccactgtgcttc

SEQ ID NO: 643385 - DNA, 22 bp, Artificial Sequence
  chemically synthesized
aagccatgaagattggtagaag

SEQ ID NO: 643386 - DNA, 22 bp, Artificial Sequence
  chemically synthesized
ttccactgtgcttctaccaatc

SEQ ID NO: 643387 - DNA, 22 bp, Artificial Sequence
  chemically synthesized
cactgtgcttctaccaatcttc

SEQ ID NO: 643388 - DNA, 22 bp, Artificial Sequence
  chemically synthesized
tgcttctaccaatcttcatggc

SEQ ID NO: 643389 - DNA, 22 bp, Artificial Sequence
  chemically synthesized
gcagaaagctaaagccatgaag

SEQ ID NO: 643390 - DNA, 22 bp, Artificial Sequence
  chemically synthesized
ctaccaatcttcatggctttag

SEQ ID NO: 643391 - DNA, 22 bp, Artificial Sequence
  chemically synthesized
taccaatcttcatggctttagc

SEQ ID NO: 643392 - DNA, 22 bp, Artificial Sequence
  chemically synthesized
acctggcagaaagctaaagcca

SEQ ID NO: 643393 - DNA, 22 bp, Artificial Sequence
  chemically synthesized
ccaatcttcatggctttagctt

SEQ ID NO: 643394 - DNA, 22 bp, Artificial Sequence
  chemically synthesized
catggctttagctttctgccag

SEQ ID NO: 643395 - DNA, 22 bp, Artificial Sequence
  chemically synthesized
atggctttagctttctgccagg

SEQ ID NO: 643396 - DNA, 22 bp, Artificial Sequence
  chemically synthesized
agaaaaataactgacctggcag

SEQ ID NO: 643397 - DNA, 22 bp, Artificial Sequence
  chemically synthesized
tagctttctgccaggtcagtta

SEQ ID NO: 643398 - DNA, 22 bp, Artificial Sequence
  chemically synthesized
agctttctgccaggtcagttat

SEQ ID NO: 643399 - DNA, 22 bp, Artificial Sequence
  chemically synthesized
gctttctgccaggtcagttatt

SEQ ID NO: 643400 - DNA, 22 bp, Artificial Sequence
  chemically synthesized
tctgccaggtcagttatttttc

SEQ ID NO: 643401 - DNA, 22 bp, Artificial Sequence
  chemically synthesized
ctgccaggtcagttatttttct

SEQ ID NO: 643402 - DNA, 22 bp, Artificial Sequence
  chemically synthesized
tgccaggtcagttatttttctc

SEQ ID NO: 643403 - DNA, 22 bp, Artificial Sequence
  chemically synthesized
ccaggtcagttatttttctcaa

SEQ ID NO: 643404 - DNA, 22 bp, Artificial Sequence
  chemically synthesized
acgggggggaggattgagaaaa

SEQ ID NO: 643405 - DNA, 22 bp, Artificial Sequence
  chemically synthesized
gacgggggggaggattgagaaa

SEQ ID NO: 643406 - DNA, 22 bp, Artificial Sequence
  chemically synthesized
tgacgggggggaggattgagaa

SEQ ID NO: 643407 - DNA, 22 bp, Artificial Sequence
  chemically synthesized
ttgacgggggggaggattgaga

SEQ ID NO: 643408 - DNA, 22 bp, Artificial Sequence
  chemically synthesized
tttgacgggggggaggattgag

SEQ ID NO: 643409 - DNA, 22 bp, Artificial Sequence
  chemically synthesized
tttttctcaatcctcccccccg

SEQ ID NO: 643410 - DNA, 22 bp, Artificial Sequence
  chemically synthesized
ttctcaatcctcccccccgtca

SEQ ID NO: 643411 - DNA, 22 bp, Artificial Sequence
  chemically synthesized
tctcaatcctcccccccgtcaa

SEQ ID NO: 643412 - DNA, 22 bp, Artificial Sequence
  chemically synthesized
ctcaatcctcccccccgtcaaa

SEQ ID NO: 643413 - DNA, 22 bp, Artificial Sequence
  chemically synthesized
tcaatcctcccccccgtcaaaa

SEQ ID NO: 643414 - DNA, 22 bp, Artificial Sequence
  chemically synthesized
aatcctcccccccgtcaaaaag

SEQ ID NO: 643415 - DNA, 22 bp, Artificial Sequence
  chemically synthesized
ccccccgtcaaaaagccatcac

SEQ ID NO: 643416 - DNA, 22 bp, Artificial Sequence
  chemically synthesized
taagcaggtgaacagtgatggc

SEQ ID NO: 643417 - DNA, 22 bp, Artificial Sequence
  chemically synthesized
tcctataagcaggtgaacagtg

SEQ ID NO: 643418 - DNA, 22 bp, Artificial Sequence
  chemically synthesized
atcctataagcaggtgaacagt

SEQ ID NO: 643419 - DNA, 22 bp, Artificial Sequence
  chemically synthesized
tatcctataagcaggtgaacag

SEQ ID NO: 643420 - DNA, 22 bp, Artificial Sequence
  chemically synthesized
ggttttatcctataagcaggtg

SEQ ID NO: 643421 - DNA, 22 bp, Artificial Sequence
  chemically synthesized
gggttttatcctataagcaggt

SEQ ID NO: 643422 - DNA, 22 bp, Artificial Sequence
  chemically synthesized
aggagtttgggttttatcctat

SEQ ID NO: 643423 - DNA, 22 bp, Artificial Sequence
  chemically synthesized
ttcacctgcttataggataaaa

SEQ ID NO: 643424 - DNA, 22 bp, Artificial Sequence
  chemically synthesized
acctgcttataggataaaaccc

SEQ ID NO: 643425 - DNA, 22 bp, Artificial Sequence
  chemically synthesized
cttataggataaaacccaaact

SEQ ID NO: 643426 - DNA, 22 bp, Artificial Sequence
  chemically synthesized
ataggataaaacccaaactcct

SEQ ID NO: 643427 - DNA, 22 bp, Artificial Sequence
  chemically synthesized
tgcatcatactaaggagtttgg

SEQ ID NO: 643428 - DNA, 22 bp, Artificial Sequence
  chemically synthesized
taggataaaacccaaactcctt

SEQ ID NO: 643429 - DNA, 22 bp, Artificial Sequence
  chemically synthesized
gtgcatcatactaaggagtttg

SEQ ID NO: 643430 - DNA, 22 bp, Artificial Sequence
  chemically synthesized
tgtgcatcatactaaggagttt

SEQ ID NO: 643431 - DNA, 22 bp, Artificial Sequence
  chemically synthesized
aaggactttgtgcatcatacta

SEQ ID NO: 643432 - DNA, 22 bp, Artificial Sequence
  chemically synthesized
aaaggactttgtgcatcatact

SEQ ID NO: 643433 - DNA, 22 bp, Artificial Sequence
  chemically synthesized
tttaaaggactttgtgcatcat

SEQ ID NO: 643434 - DNA, 22 bp, Artificial Sequence
  chemically synthesized
ctgtttaaaggactttgtgcat

SEQ ID NO: 643435 - DNA, 22 bp, Artificial Sequence
  chemically synthesized
cttagtatgatgcacaaagtcc

SEQ ID NO: 643436 - DNA, 22 bp, Artificial Sequence
  chemically synthesized
agtatgatgcacaaagtccttt

SEQ ID NO: 643437 - DNA, 22 bp, Artificial Sequence
  chemically synthesized
gtatgatgcacaaagtccttta

SEQ ID NO: 643438 - DNA, 22 bp, Artificial Sequence
  chemically synthesized
taaacagtagtccccacctacc

SEQ ID NO: 643439 - DNA, 22 bp, Artificial Sequence
  chemically synthesized
aaacagtagtccccacctacca

SEQ ID NO: 643440 - DNA, 22 bp, Artificial Sequence
  chemically synthesized
aacagtagtccccacctaccat

SEQ ID NO: 643441 - DNA, 22 bp, Artificial Sequence
  chemically synthesized
gaatgaggagaataagagggca

SEQ ID NO: 643442 - DNA, 22 bp, Artificial Sequence
  chemically synthesized
ggaatgaggagaataagagggc

SEQ ID NO: 643443 - DNA, 22 bp, Artificial Sequence
  chemically synthesized
ccatcccactgccctcttattc

SEQ ID NO: 643444 - DNA, 22 bp, Artificial Sequence
  chemically synthesized
ccctcttattctcctcattcca

SEQ ID NO: 643445 - DNA, 22 bp, Artificial Sequence
  chemically synthesized
ttattctcctcattccaagcca

SEQ ID NO: 643446 - DNA, 22 bp, Artificial Sequence
  chemically synthesized
attctcctcattccaagccaca

SEQ ID NO: 643447 - DNA, 22 bp, Artificial Sequence
  chemically synthesized
ttctcctcattccaagccacac

SEQ ID NO: 643448 - DNA, 22 bp, Artificial Sequence
  chemically synthesized
tcctcattccaagccacacatt

SEQ ID NO: 643449 - DNA, 22 bp, Artificial Sequence
  chemically synthesized
ctcattccaagccacacattac

SEQ ID NO: 643450 - DNA, 22 bp, Artificial Sequence
  chemically synthesized
gtggaccagtgagtaatgtgtg

SEQ ID NO: 643451 - DNA, 22 bp, Artificial Sequence
  chemically synthesized
attccaagccacacattactca

SEQ ID NO: 643452 - DNA, 22 bp, Artificial Sequence
  chemically synthesized
caagccacacattactcactgg

SEQ ID NO: 643453 - DNA, 22 bp, Artificial Sequence
  chemically synthesized
cagactggtggaccagtgagta

SEQ ID NO: 643454 - DNA, 22 bp, Artificial Sequence
  chemically synthesized
ccagactggtggaccagtgagt

SEQ ID NO: 643455 - DNA, 22 bp, Artificial Sequence
  chemically synthesized
tccagactggtggaccagtgag

SEQ ID NO: 643456 - DNA, 22 bp, Artificial Sequence
  chemically synthesized
ctcactggtccaccagtctgga

SEQ ID NO: 643457 - DNA, 22 bp, Artificial Sequence
  chemically synthesized
actggtccaccagtctggaaaa

SEQ ID NO: 643458 - DNA, 22 bp, Artificial Sequence
  chemically synthesized
gtccaccagtctggaaaactca

SEQ ID NO: 643459 - DNA, 22 bp, Artificial Sequence
  chemically synthesized
agagatgggggaaggatgagtt

SEQ ID NO: 643460 - DNA, 22 bp, Artificial Sequence
  chemically synthesized
cagtctgagagatgggggaagg

SEQ ID NO: 643461 - DNA, 22 bp, Artificial Sequence
  chemically synthesized
ccagtctgagagatgggggaag

SEQ ID NO: 643462 - DNA, 22 bp, Artificial Sequence
  chemically synthesized
gaaaactcatccttcccccatc

SEQ ID NO: 643463 - DNA, 22 bp, Artificial Sequence
  chemically synthesized
tccagtctgagagatgggggaa

SEQ ID NO: 643464 - DNA, 22 bp, Artificial Sequence
  chemically synthesized
atccttcccccatctctcagac

SEQ ID NO: 643465 - DNA, 22 bp, Artificial Sequence
  chemically synthesized
aatgggagttttccagtctgag

SEQ ID NO: 643466 - DNA, 22 bp, Artificial Sequence
  chemically synthesized
cccccatctctcagactggaaa

SEQ ID NO: 643467 - DNA, 22 bp, Artificial Sequence
  chemically synthesized
ccccatctctcagactggaaaa

SEQ ID NO: 643468 - DNA, 22 bp, Artificial Sequence
  chemically synthesized
aagactgaatgggagttttcca

SEQ ID NO: 643469 - DNA, 22 bp, Artificial Sequence
  chemically synthesized
tcagactggaaaactcccattc

SEQ ID NO: 643470 - DNA, 22 bp, Artificial Sequence
  chemically synthesized
agagttgaagactgaatgggag

SEQ ID NO: 643471 - DNA, 22 bp, Artificial Sequence
  chemically synthesized
agactggaaaactcccattcag

SEQ ID NO: 643472 - DNA, 22 bp, Artificial Sequence
  chemically synthesized
aagagttgaagactgaatggga

SEQ ID NO: 643473 - DNA, 22 bp, Artificial Sequence
  chemically synthesized
gaaaactcccattcagtcttca

SEQ ID NO: 643474 - DNA, 22 bp, Artificial Sequence
  chemically synthesized
caaagagagtttaagagttgaa

SEQ ID NO: 643475 - DNA, 22 bp, Artificial Sequence
  chemically synthesized
acaaagagagtttaagagttga

SEQ ID NO: 643476 - DNA, 22 bp, Artificial Sequence
  chemically synthesized
ccattcagtcttcaactcttaa

SEQ ID NO: 643477 - DNA, 22 bp, Artificial Sequence
  chemically synthesized
tacaaagagagtttaagagttg

SEQ ID NO: 643478 - DNA, 22 bp, Artificial Sequence
  chemically synthesized
agtcttcaactcttaaactctc

SEQ ID NO: 643479 - DNA, 22 bp, Artificial Sequence
  chemically synthesized
caactcttaaactctctttgta

SEQ ID NO: 643480 - DNA, 22 bp, Artificial Sequence
  chemically synthesized
aactcttaaactctctttgtaa

SEQ ID NO: 643481 - DNA, 22 bp, Artificial Sequence
  chemically synthesized
ttaaactctctttgtaaaggcc

SEQ ID NO: 643482 - DNA, 22 bp, Artificial Sequence
  chemically synthesized
aaactctctttgtaaaggcctc

SEQ ID NO: 643483 - DNA, 22 bp, Artificial Sequence
  chemically synthesized
aactctctttgtaaaggcctct

SEQ ID NO: 643484 - DNA, 22 bp, Artificial Sequence
  chemically synthesized
tcagagggagtagagaggcctt

SEQ ID NO: 643485 - DNA, 22 bp, Artificial Sequence
  chemically synthesized
tatcagagggagtagagaggcc

SEQ ID NO: 643486 - DNA, 22 bp, Artificial Sequence
  chemically synthesized
tctttgtaaaggcctctctact

SEQ ID NO: 643487 - DNA, 22 bp, Artificial Sequence
  chemically synthesized
ttctatcagagggagtagagag

SEQ ID NO: 643488 - DNA, 22 bp, Artificial Sequence
  chemically synthesized
tttgtaaaggcctctctactcc

SEQ ID NO: 643489 - DNA, 22 bp, Artificial Sequence
  chemically synthesized
attctatcagagggagtagaga

SEQ ID NO: 643490 - DNA, 22 bp, Artificial Sequence
  chemically synthesized
tgtaaaggcctctctactccct

SEQ ID NO: 643491 - DNA, 22 bp, Artificial Sequence
  chemically synthesized
gtaaaggcctctctactccctc

SEQ ID NO: 643492 - DNA, 22 bp, Artificial Sequence
  chemically synthesized
taaaggcctctctactccctct

SEQ ID NO: 643493 - DNA, 22 bp, Artificial Sequence
  chemically synthesized
tctactccctctgatagaataa

SEQ ID NO: 643494 - DNA, 22 bp, Artificial Sequence
  chemically synthesized
tactccctctgatagaataaat

SEQ ID NO: 643495 - DNA, 22 bp, Artificial Sequence
  chemically synthesized
ctccctctgatagaataaatca

SEQ ID NO: 643496 - DNA, 22 bp, Artificial Sequence
  chemically synthesized
cctctgatagaataaatcattc

SEQ ID NO: 643497 - DNA, 22 bp, Artificial Sequence
  chemically synthesized
ggggcacagaggtgaatgattt

SEQ ID NO: 643498 - DNA, 22 bp, Artificial Sequence
  chemically synthesized
tgggggcacagaggtgaatgat

SEQ ID NO: 643499 - DNA, 22 bp, Artificial Sequence
  chemically synthesized
tgatagaataaatcattcacct

SEQ ID NO: 643500 - DNA, 22 bp, Artificial Sequence
  chemically synthesized
atagaataaatcattcacctct

SEQ ID NO: 643501 - DNA, 22 bp, Artificial Sequence
  chemically synthesized
caagtgctctgggggcacagag

SEQ ID NO: 643502 - DNA, 22 bp, Artificial Sequence
  chemically synthesized
ttacaagtgctctgggggcaca

SEQ ID NO: 643503 - DNA, 22 bp, Artificial Sequence
  chemically synthesized
ctgttacaagtgctctgggggc

SEQ ID NO: 643504 - DNA, 22 bp, Artificial Sequence
  chemically synthesized
acctctgtgcccccagagcact

SEQ ID NO: 643505 - DNA, 22 bp, Artificial Sequence
  chemically synthesized
tatcctactgttacaagtgctc

SEQ ID NO: 643506 - DNA, 22 bp, Artificial Sequence
  chemically synthesized
atatcctactgttacaagtgct

SEQ ID NO: 643507 - DNA, 22 bp, Artificial Sequence
  chemically synthesized
tgtgcccccagagcacttgtaa

SEQ ID NO: 643508 - DNA, 22 bp, Artificial Sequence
  chemically synthesized
tgcccccagagcacttgtaaca

SEQ ID NO: 643509 - DNA, 22 bp, Artificial Sequence
  chemically synthesized
cttatatcctactgttacaagt

SEQ ID NO: 643510 - DNA, 22 bp, Artificial Sequence
  chemically synthesized
aaatagaaacaactacttatat

SEQ ID NO: 643511 - DNA, 22 bp, Artificial Sequence
  chemically synthesized
gtaacagtaggatataagtagt

SEQ ID NO: 643512 - DNA, 22 bp, Artificial Sequence
  chemically synthesized
taacagtaggatataagtagtt

SEQ ID NO: 643513 - DNA, 22 bp, Artificial Sequence
  chemically synthesized
aaaaagttaaaatagaaacaac

SEQ ID NO: 643514 - DNA, 22 bp, Artificial Sequence
  chemically synthesized
aaaaaagttaaaatagaaacaa

SEQ ID NO: 643515 - DNA, 22 bp, Artificial Sequence
  chemically synthesized
taaaaaagttaaaatagaaaca

SEQ ID NO: 643516 - DNA, 22 bp, Artificial Sequence
  chemically synthesized
ttttaaaaaagttaaaatagaa

SEQ ID NO: 643517 - DNA, 22 bp, Artificial Sequence
  chemically synthesized
attttaaaaaagttaaaataga

SEQ ID NO: 643518 - DNA, 22 bp, Artificial Sequence
  chemically synthesized
aaaatttattttaaaaaagtta

SEQ ID NO: 643519 - DNA, 22 bp, Artificial Sequence
  chemically synthesized
tttctattttaacttttttaaa

SEQ ID NO: 643520 - DNA, 22 bp, Artificial Sequence
  chemically synthesized
ctattttaacttttttaaaata

SEQ ID NO: 643521 - DNA, 22 bp, Artificial Sequence
  chemically synthesized
tattttaacttttttaaaataa

SEQ ID NO: 643522 - DNA, 22 bp, Artificial Sequence
  chemically synthesized
ttttaacttttttaaaataaat

SEQ ID NO: 643523 - DNA, 22 bp, Artificial Sequence
  chemically synthesized
atggagctcaaaatttatttta

SEQ ID NO: 643524 - DNA, 22 bp, Artificial Sequence
  chemically synthesized
taacttttttaaaataaatttt

SEQ ID NO: 643525 - DNA, 22 bp, Artificial Sequence
  chemically synthesized
aacttttttaaaataaattttg

SEQ ID NO: 643526 - DNA, 22 bp, Artificial Sequence
  chemically synthesized
acttttttaaaataaattttga

SEQ ID NO: 643527 - DNA, 22 bp, Artificial Sequence
  chemically synthesized
ccctcatggagctcaaaattta

SEQ ID NO: 643528 - DNA, 22 bp, Artificial Sequence
  chemically synthesized
accctcatggagctcaaaattt

SEQ ID NO: 643529 - DNA, 22 bp, Artificial Sequence
  chemically synthesized
ttaccctcatggagctcaaaat

SEQ ID NO: 643530 - DNA, 22 bp, Artificial Sequence
  chemically synthesized
ttttaaaataaattttgagctc

SEQ ID NO: 643531 - DNA, 22 bp, Artificial Sequence
  chemically synthesized
tttaaaataaattttgagctcc

SEQ ID NO: 643532 - DNA, 22 bp, Artificial Sequence
  chemically synthesized
ttaaaataaattttgagctcca

SEQ ID NO: 643533 - DNA, 22 bp, Artificial Sequence
  chemically synthesized
taaaataaattttgagctccat

SEQ ID NO: 643534 - DNA, 22 bp, Artificial Sequence
  chemically synthesized
gttcttaccctcatggagctca

SEQ ID NO: 643535 - DNA, 22 bp, Artificial Sequence
  chemically synthesized
aaaataaattttgagctccatg

SEQ ID NO: 643536 - DNA, 22 bp, Artificial Sequence
  chemically synthesized
ggttcttaccctcatggagctc

SEQ ID NO: 643537 - DNA, 22 bp, Artificial Sequence
  chemically synthesized
aaataaattttgagctccatga

SEQ ID NO: 643538 - DNA, 22 bp, Artificial Sequence
  chemically synthesized
tgagctccatgagggtaagaac

SEQ ID NO: 643539 - DNA, 22 bp, Artificial Sequence
  chemically synthesized
gagctccatgagggtaagaacc

SEQ ID NO: 643540 - DNA, 22 bp, Artificial Sequence
  chemically synthesized
agctccatgagggtaagaacca

SEQ ID NO: 643541 - DNA, 22 bp, Artificial Sequence
  chemically synthesized
catgagggtaagaaccaaggct

SEQ ID NO: 643542 - DNA, 22 bp, Artificial Sequence
  chemically synthesized
caaagatgaataagccttggtt

SEQ ID NO: 643543 - DNA, 22 bp, Artificial Sequence
  chemically synthesized
tgagactacaaagatgaataag

SEQ ID NO: 643544 - DNA, 22 bp, Artificial Sequence
  chemically synthesized
aaattatgagactacaaagatg

SEQ ID NO: 643545 - DNA, 22 bp, Artificial Sequence
  chemically synthesized
aaaattatgagactacaaagat

SEQ ID NO: 643546 - DNA, 22 bp, Artificial Sequence
  chemically synthesized
taaaattatgagactacaaaga

SEQ ID NO: 643547 - DNA, 22 bp, Artificial Sequence
  chemically synthesized
attcatctttgtagtctcataa

SEQ ID NO: 643548 - DNA, 22 bp, Artificial Sequence
  chemically synthesized
ttcatctttgtagtctcataat

SEQ ID NO: 643549 - DNA, 22 bp, Artificial Sequence
  chemically synthesized
atgtaattttaaaattatgaga

SEQ ID NO: 643550 - DNA, 22 bp, Artificial Sequence
  chemically synthesized
aatgtaattttaaaattatgag

SEQ ID NO: 643551 - DNA, 22 bp, Artificial Sequence
  chemically synthesized
atctttgtagtctcataatttt

SEQ ID NO: 643552 - DNA, 22 bp, Artificial Sequence
  chemically synthesized
tgtagtctcataattttaaaat

SEQ ID NO: 643553 - DNA, 22 bp, Artificial Sequence
  chemically synthesized
gtagtctcataattttaaaatt

SEQ ID NO: 643554 - DNA, 22 bp, Artificial Sequence
  chemically synthesized
agtgcttaatgtaattttaaaa

SEQ ID NO: 643555 - DNA, 22 bp, Artificial Sequence
  chemically synthesized
tagtctcataattttaaaatta

SEQ ID NO: 643556 - DNA, 22 bp, Artificial Sequence
  chemically synthesized
ctgagtgcttaatgtaatttta

SEQ ID NO: 643557 - DNA, 22 bp, Artificial Sequence
  chemically synthesized
ataattttaaaattacattaag

SEQ ID NO: 643558 - DNA, 22 bp, Artificial Sequence
  chemically synthesized
cagatagttactgagtgcttaa

SEQ ID NO: 643559 - DNA, 22 bp, Artificial Sequence
  chemically synthesized
taaaattacattaagcactcag

SEQ ID NO: 643560 - DNA, 22 bp, Artificial Sequence
  chemically synthesized
tgcagatagttactgagtgctt

SEQ ID NO: 643561 - DNA, 22 bp, Artificial Sequence
  chemically synthesized
aaaattacattaagcactcagt

SEQ ID NO: 643562 - DNA, 22 bp, Artificial Sequence
  chemically synthesized
aaattacattaagcactcagta

SEQ ID NO: 643563 - DNA, 22 bp, Artificial Sequence
  chemically synthesized
aattctgcagatagttactgag

SEQ ID NO: 643564 - DNA, 22 bp, Artificial Sequence
  chemically synthesized
cattaagcactcagtaactatc

SEQ ID NO: 643565 - DNA, 22 bp, Artificial Sequence
  chemically synthesized
ttcaattctgcagatagttact

SEQ ID NO: 643566 - DNA, 22 bp, Artificial Sequence
  chemically synthesized
tgttcaattctgcagatagtta

SEQ ID NO: 643567 - DNA, 22 bp, Artificial Sequence
  chemically synthesized
agcactcagtaactatctgcag

SEQ ID NO: 643568 - DNA, 22 bp, Artificial Sequence
  chemically synthesized
agtaactatctgcagaattgaa

SEQ ID NO: 643569 - DNA, 22 bp, Artificial Sequence
  chemically synthesized
aggatgtaattctgttcaattc

SEQ ID NO: 643570 - DNA, 22 bp, Artificial Sequence
  chemically synthesized
tctgcagaattgaacagaatta

SEQ ID NO: 643571 - DNA, 22 bp, Artificial Sequence
  chemically synthesized
caggcctgaggatgtaattctg

SEQ ID NO: 643572 - DNA, 22 bp, Artificial Sequence
  chemically synthesized
ccaggcctgaggatgtaattct

SEQ ID NO: 643573 - DNA, 22 bp, Artificial Sequence
  chemically synthesized
cagaattgaacagaattacatc

SEQ ID NO: 643574 - DNA, 22 bp, Artificial Sequence
  chemically synthesized
tccaggcctgaggatgtaattc

SEQ ID NO: 643575 - DNA, 22 bp, Artificial Sequence
  chemically synthesized
ctttccaggcctgaggatgtaa

SEQ ID NO: 643576 - DNA, 22 bp, Artificial Sequence
  chemically synthesized
gctactttccaggcctgaggat

SEQ ID NO: 643577 - DNA, 22 bp, Artificial Sequence
  chemically synthesized
aacagaattacatcctcaggcc

SEQ ID NO: 643578 - DNA, 22 bp, Artificial Sequence
  chemically synthesized
agctactttccaggcctgagga

SEQ ID NO: 643579 - DNA, 22 bp, Artificial Sequence
  chemically synthesized
tagctactttccaggcctgagg

SEQ ID NO: 643580 - DNA, 22 bp, Artificial Sequence
  chemically synthesized
tttagctactttccaggcctga

SEQ ID NO: 643581 - DNA, 22 bp, Artificial Sequence
  chemically synthesized
ctttagctactttccaggcctg

SEQ ID NO: 643582 - DNA, 22 bp, Artificial Sequence
  chemically synthesized
catcctcaggcctggaaagtag

SEQ ID NO: 643583 - DNA, 22 bp, Artificial Sequence
  chemically synthesized
aggcctggaaagtagctaaaga

SEQ ID NO: 643584 - DNA, 22 bp, Artificial Sequence
  chemically synthesized
tggtcatgagtttctttagcta

SEQ ID NO: 643585 - DNA, 22 bp, Artificial Sequence
  chemically synthesized
attatggtcatgagtttcttta

SEQ ID NO: 643586 - DNA, 22 bp, Artificial Sequence
  chemically synthesized
gaaagtagctaaagaaactcat

SEQ ID NO: 643587 - DNA, 22 bp, Artificial Sequence
  chemically synthesized
cagtagaattgattatggtcat

SEQ ID NO: 643588 - DNA, 22 bp, Artificial Sequence
  chemically synthesized
tacagtagaattgattatggtc

SEQ ID NO: 643589 - DNA, 22 bp, Artificial Sequence
  chemically synthesized
aagaaactcatgaccataatca

SEQ ID NO: 643590 - DNA, 22 bp, Artificial Sequence
  chemically synthesized
tccctctacagtagaattgatt

SEQ ID NO: 643591 - DNA, 22 bp, Artificial Sequence
  chemically synthesized
atgaccataatcaattctactg

SEQ ID NO: 643592 - DNA, 22 bp, Artificial Sequence
  chemically synthesized
ccaattgtccctctacagtaga

SEQ ID NO: 643593 - DNA, 22 bp, Artificial Sequence
  chemically synthesized
gccaattgtccctctacagtag

SEQ ID NO: 643594 - DNA, 22 bp, Artificial Sequence
  chemically synthesized
atttgccaattgtccctctaca

SEQ ID NO: 643595 - DNA, 22 bp, Artificial Sequence
  chemically synthesized
catttgccaattgtccctctac

SEQ ID NO: 643596 - DNA, 22 bp, Artificial Sequence
  chemically synthesized
gccttcatttgccaattgtccc

SEQ ID NO: 643597 - DNA, 22 bp, Artificial Sequence
  chemically synthesized
tactgtagagggacaattggca

SEQ ID NO: 643598 - DNA, 22 bp, Artificial Sequence
  chemically synthesized
ttggccttcatttgccaattgt

SEQ ID NO: 643599 - DNA, 22 bp, Artificial Sequence
  chemically synthesized
ctgtagagggacaattggcaaa

SEQ ID NO: 643600 - DNA, 22 bp, Artificial Sequence
  chemically synthesized
ctgttggccttcatttgccaat

SEQ ID NO: 643601 - DNA, 22 bp, Artificial Sequence
  chemically synthesized
tagagggacaattggcaaatga

SEQ ID NO: 643602 - DNA, 22 bp, Artificial Sequence
  chemically synthesized
atcctcctgttggccttcattt

SEQ ID NO: 643603 - DNA, 22 bp, Artificial Sequence
  chemically synthesized
gcaaatgaaggccaacaggagg

SEQ ID NO: 643604 - DNA, 22 bp, Artificial Sequence
  chemically synthesized
atgaagaccctcatcctcctgt

SEQ ID NO: 643605 - DNA, 22 bp, Artificial Sequence
  chemically synthesized
catgaagaccctcatcctcctg

SEQ ID NO: 643606 - DNA, 22 bp, Artificial Sequence
  chemically synthesized
tcatgaagaccctcatcctcct

SEQ ID NO: 643607 - DNA, 22 bp, Artificial Sequence
  chemically synthesized
ttcatgaagaccctcatcctcc

SEQ ID NO: 643608 - DNA, 22 bp, Artificial Sequence
  chemically synthesized
gatttttcatgaagaccctcat

SEQ ID NO: 643609 - DNA, 22 bp, Artificial Sequence
  chemically synthesized
agatttttcatgaagaccctca

SEQ ID NO: 643610 - DNA, 22 bp, Artificial Sequence
  chemically synthesized
tagatttttcatgaagaccctc

SEQ ID NO: 643611 - DNA, 22 bp, Artificial Sequence
  chemically synthesized
ttagatttttcatgaagaccct

SEQ ID NO: 643612 - DNA, 22 bp, Artificial Sequence
  chemically synthesized
tttagatttttcatgaagaccc

SEQ ID NO: 643613 - DNA, 22 bp, Artificial Sequence
  chemically synthesized
ttttagatttttcatgaagacc

SEQ ID NO: 643614 - DNA, 22 bp, Artificial Sequence
  chemically synthesized
tttttagatttttcatgaagac

SEQ ID NO: 643615 - DNA, 22 bp, Artificial Sequence
  chemically synthesized
ttttttagatttttcatgaaga

SEQ ID NO: 643616 - DNA, 22 bp, Artificial Sequence
  chemically synthesized
tttttttagatttttcatgaag

SEQ ID NO: 643617 - DNA, 22 bp, Artificial Sequence
  chemically synthesized
ttttttttagatttttcatgaa

SEQ ID NO: 643618 - DNA, 22 bp, Artificial Sequence
  chemically synthesized
tttttttttagatttttcatga

SEQ ID NO: 643619 - DNA, 22 bp, Artificial Sequence
  chemically synthesized
ttttttttttagatttttcatg

SEQ ID NO: 643620 - DNA, 22 bp, Artificial Sequence
  chemically synthesized
tttttttttttagatttttcat

SEQ ID NO: 643621 - DNA, 22 bp, Artificial Sequence
  chemically synthesized
ttttttttttttagatttttca

SEQ ID NO: 643622 - DNA, 22 bp, Artificial Sequence
  chemically synthesized
tttttttttttttagatttttc

SEQ ID NO: 643623 - DNA, 22 bp, Artificial Sequence
  chemically synthesized
ttttttttttttttagattttt

SEQ ID NO: 643624 - DNA, 22 bp, Artificial Sequence
  chemically synthesized
tttttttttttttttagatttt

SEQ ID NO: 643625 - DNA, 22 bp, Artificial Sequence
  chemically synthesized
ttttttttttttttttagattt

SEQ ID NO: 643626 - DNA, 22 bp, Artificial Sequence
  chemically synthesized
tttttttttttttttttagatt

SEQ ID NO: 643627 - DNA, 22 bp, Artificial Sequence
  chemically synthesized
ttttttttttttttttttagat

SEQ ID NO: 643628 - DNA, 22 bp, Artificial Sequence
  chemically synthesized
tttttttttttttttttttaga

SEQ ID NO: 643629 - DNA, 22 bp, Artificial Sequence
  chemically synthesized
ttttttttttttttttttttag

SEQ ID NO: 643630 - DNA, 22 bp, Artificial Sequence
  chemically synthesized
catgaaaaatctaaaaaaaaaa

SEQ ID NO: 643631 - DNA, 22 bp, Artificial Sequence
  chemically synthesized
atgaaaaatctaaaaaaaaaaa

SEQ ID NO: 643632 - DNA, 22 bp, Artificial Sequence
  chemically synthesized
cctttttttttttttttttttt

SEQ ID NO: 643633 - DNA, 22 bp, Artificial Sequence
  chemically synthesized
cccttttttttttttttttttt

SEQ ID NO: 643634 - DNA, 22 bp, Artificial Sequence
  chemically synthesized
aaaaaaaaaaaaaaaaaaaaag

SEQ ID NO: 643635 - DNA, 22 bp, Artificial Sequence
  chemically synthesized
caatccaatttccctttttttt

SEQ ID NO: 643636 - DNA, 22 bp, Artificial Sequence
  chemically synthesized
acaatccaatttcccttttttt

SEQ ID NO: 643637 - DNA, 22 bp, Artificial Sequence
  chemically synthesized
ttacaatccaatttcccttttt

SEQ ID NO: 643638 - DNA, 22 bp, Artificial Sequence
  chemically synthesized
tgttcttacaatccaatttccc

SEQ ID NO: 643639 - DNA, 22 bp, Artificial Sequence
  chemically synthesized
atgttcttacaatccaatttcc

SEQ ID NO: 643640 - DNA, 22 bp, Artificial Sequence
  chemically synthesized
gataagagtttatgttcttaca

SEQ ID NO: 643641 - DNA, 22 bp, Artificial Sequence
  chemically synthesized
gattgtaagaacataaactctt

SEQ ID NO: 643642 - DNA, 22 bp, Artificial Sequence
  chemically synthesized
gaacatgctggataagagttta

SEQ ID NO: 643643 - DNA, 22 bp, Artificial Sequence
  chemically synthesized
taagaacataaactcttatcca

SEQ ID NO: 643644 - DNA, 22 bp, Artificial Sequence
  chemically synthesized
cctagaacatgctggataagag

SEQ ID NO: 643645 - DNA, 22 bp, Artificial Sequence
  chemically synthesized
ccatctccctagaacatgctgg

SEQ ID NO: 643646 - DNA, 22 bp, Artificial Sequence
  chemically synthesized
ttatccagcatgttctagggag

SEQ ID NO: 643647 - DNA, 22 bp, Artificial Sequence
  chemically synthesized
atccagcatgttctagggagat

SEQ ID NO: 643648 - DNA, 22 bp, Artificial Sequence
  chemically synthesized
tccagcatgttctagggagatg

SEQ ID NO: 643649 - DNA, 22 bp, Artificial Sequence
  chemically synthesized
caagtacagctgccatctccct

SEQ ID NO: 643650 - DNA, 22 bp, Artificial Sequence
  chemically synthesized
acaagtacagctgccatctccc

SEQ ID NO: 643651 - DNA, 22 bp, Artificial Sequence
  chemically synthesized
acatcttacaagtacagctgcc

SEQ ID NO: 643652 - DNA, 22 bp, Artificial Sequence
  chemically synthesized
tagggagatggcagctgtactt

SEQ ID NO: 643653 - DNA, 22 bp, Artificial Sequence
  chemically synthesized
gggagatggcagctgtacttgt

SEQ ID NO: 643654 - DNA, 22 bp, Artificial Sequence
  chemically synthesized
gaatattcacatcttacaagta

SEQ ID NO: 643655 - DNA, 22 bp, Artificial Sequence
  chemically synthesized
gcgattagaatattcacatctt

SEQ ID NO: 643656 - DNA, 22 bp, Artificial Sequence
  chemically synthesized
tggcgattagaatattcacatc

SEQ ID NO: 643657 - DNA, 22 bp, Artificial Sequence
  chemically synthesized
tacttgtaagatgtgaatattc

SEQ ID NO: 643658 - DNA, 22 bp, Artificial Sequence
  chemically synthesized
gtaagatgtgaatattctaatc

SEQ ID NO: 643659 - DNA, 22 bp, Artificial Sequence
  chemically synthesized
taagatgtgaatattctaatcg

SEQ ID NO: 643660 - DNA, 22 bp, Artificial Sequence
  chemically synthesized
aagcacccctctggcgattaga

SEQ ID NO: 643661 - DNA, 22 bp, Artificial Sequence
  chemically synthesized
caaaaaaattgaagcacccctc

SEQ ID NO: 643662 - DNA, 22 bp, Artificial Sequence
  chemically synthesized
taatcgccagaggggtgcttca

SEQ ID NO: 643663 - DNA, 22 bp, Artificial Sequence
  chemically synthesized
atcgccagaggggtgcttcaat

SEQ ID NO: 643664 - DNA, 22 bp, Artificial Sequence
  chemically synthesized
atactacaaaaaaattgaagca

SEQ ID NO: 643665 - DNA, 22 bp, Artificial Sequence
  chemically synthesized
catactacaaaaaaattgaagc

SEQ ID NO: 643666 - DNA, 22 bp, Artificial Sequence
  chemically synthesized
cttcatactacaaaaaaattga

SEQ ID NO: 643667 - DNA, 22 bp, Artificial Sequence
  chemically synthesized
tgaggactgcttcatactacaa

SEQ ID NO: 643668 - DNA, 22 bp, Artificial Sequence
  chemically synthesized
gtgaggactgcttcatactaca

SEQ ID NO: 643669 - DNA, 22 bp, Artificial Sequence
  chemically synthesized
caatttttttgtagtatgaagc

SEQ ID NO: 643670 - DNA, 22 bp, Artificial Sequence
  chemically synthesized
aatttttttgtagtatgaagca

SEQ ID NO: 643671 - DNA, 22 bp, Artificial Sequence
  chemically synthesized
gatgtttgtgaggactgcttca

SEQ ID NO: 643672 - DNA, 22 bp, Artificial Sequence
  chemically synthesized
ttttgtagtatgaagcagtcct

SEQ ID NO: 643673 - DNA, 22 bp, Artificial Sequence
  chemically synthesized
tttgtagtatgaagcagtcctc

SEQ ID NO: 643674 - DNA, 22 bp, Artificial Sequence
  chemically synthesized
ttgtagtatgaagcagtcctca

SEQ ID NO: 643675 - DNA, 22 bp, Artificial Sequence
  chemically synthesized
tgtagtatgaagcagtcctcac

SEQ ID NO: 643676 - DNA, 22 bp, Artificial Sequence
  chemically synthesized
gtagtatgaagcagtcctcaca

SEQ ID NO: 643677 - DNA, 22 bp, Artificial Sequence
  chemically synthesized
aaattggatgtttgtgaggact

SEQ ID NO: 643678 - DNA, 22 bp, Artificial Sequence
  chemically synthesized
tagtatgaagcagtcctcacaa

SEQ ID NO: 643679 - DNA, 22 bp, Artificial Sequence
  chemically synthesized
gcatctaaaattggatgtttgt

SEQ ID NO: 643680 - DNA, 22 bp, Artificial Sequence
  chemically synthesized
ggcatctaaaattggatgtttg

SEQ ID NO: 643681 - DNA, 22 bp, Artificial Sequence
  chemically synthesized
gaatcttggcatctaaaattgg

SEQ ID NO: 643682 - DNA, 22 bp, Artificial Sequence
  chemically synthesized
acaaacatccaattttagatgc

SEQ ID NO: 643683 - DNA, 22 bp, Artificial Sequence
  chemically synthesized
gtgagcctagaatcttggcatc

SEQ ID NO: 643684 - DNA, 22 bp, Artificial Sequence
  chemically synthesized
tggtgagcctagaatcttggca

SEQ ID NO: 643685 - DNA, 22 bp, Artificial Sequence
  chemically synthesized
tgttctggtgagcctagaatct

SEQ ID NO: 643686 - DNA, 22 bp, Artificial Sequence
  chemically synthesized
tagatgccaagattctaggctc

SEQ ID NO: 643687 - DNA, 22 bp, Artificial Sequence
  chemically synthesized
agatgccaagattctaggctca

SEQ ID NO: 643688 - DNA, 22 bp, Artificial Sequence
  chemically synthesized
gatgccaagattctaggctcac

SEQ ID NO: 643689 - DNA, 22 bp, Artificial Sequence
  chemically synthesized
taggctcaccagaacacaattt

SEQ ID NO: 643690 - DNA, 22 bp, Artificial Sequence
  chemically synthesized
ggctcaccagaacacaatttga

SEQ ID NO: 643691 - DNA, 22 bp, Artificial Sequence
  chemically synthesized
ggaatcacaataaaaatcaaat

SEQ ID NO: 643692 - DNA, 22 bp, Artificial Sequence
  chemically synthesized
accagaacacaatttgattttt

SEQ ID NO: 643693 - DNA, 22 bp, Artificial Sequence
  chemically synthesized
aggaatcacaataaaaatcaaa

SEQ ID NO: 643694 - DNA, 22 bp, Artificial Sequence
  chemically synthesized
gaatccagtgtcttaggaatca

SEQ ID NO: 643695 - DNA, 22 bp, Artificial Sequence
  chemically synthesized
gatttttattgtgattcctaag

SEQ ID NO: 643696 - DNA, 22 bp, Artificial Sequence
  chemically synthesized
agaatccagtgtcttaggaatc

SEQ ID NO: 643697 - DNA, 22 bp, Artificial Sequence
  chemically synthesized
atttttattgtgattcctaaga

SEQ ID NO: 643698 - DNA, 22 bp, Artificial Sequence
  chemically synthesized
ttattgtgattcctaagacact

SEQ ID NO: 643699 - DNA, 22 bp, Artificial Sequence
  chemically synthesized
tattgtgattcctaagacactg

SEQ ID NO: 643700 - DNA, 22 bp, Artificial Sequence
  chemically synthesized
tgtcttagaatccagtgtctta

SEQ ID NO: 643701 - DNA, 22 bp, Artificial Sequence
  chemically synthesized
attgtgattcctaagacactgg

SEQ ID NO: 643702 - DNA, 22 bp, Artificial Sequence
  chemically synthesized
ttgtgattcctaagacactgga

SEQ ID NO: 643703 - DNA, 22 bp, Artificial Sequence
  chemically synthesized
tgattcctaagacactggattc

SEQ ID NO: 643704 - DNA, 22 bp, Artificial Sequence
  chemically synthesized
ctaagacactggattctaagac

SEQ ID NO: 643705 - DNA, 22 bp, Artificial Sequence
  chemically synthesized
agacactggattctaagacaca

SEQ ID NO: 643706 - DNA, 22 bp, Artificial Sequence
  chemically synthesized
ggcacacagcatcctgtgtctt

SEQ ID NO: 643707 - DNA, 22 bp, Artificial Sequence
  chemically synthesized
cggcacacagcatcctgtgtct

SEQ ID NO: 643708 - DNA, 22 bp, Artificial Sequence
  chemically synthesized
tcggcacacagcatcctgtgtc

SEQ ID NO: 643709 - DNA, 22 bp, Artificial Sequence
  chemically synthesized
ttcggcacacagcatcctgtgt

SEQ ID NO: 643710 - DNA, 22 bp, Artificial Sequence
  chemically synthesized
tttcggcacacagcatcctgtg

SEQ ID NO: 643711 - DNA, 22 bp, Artificial Sequence
  chemically synthesized
gattctaagacacaggatgctg

SEQ ID NO: 643712 - DNA, 22 bp, Artificial Sequence
  chemically synthesized
attttttcggcacacagcatcc

SEQ ID NO: 643713 - DNA, 22 bp, Artificial Sequence
  chemically synthesized
taagacacaggatgctgtgtgc

SEQ ID NO: 643714 - DNA, 22 bp, Artificial Sequence
  chemically synthesized
agacacaggatgctgtgtgccg

SEQ ID NO: 643715 - DNA, 22 bp, Artificial Sequence
  chemically synthesized
aaatgaggaatatattcatttt

SEQ ID NO: 643716 - DNA, 22 bp, Artificial Sequence
  chemically synthesized
tgtgccgaaaaaatgaatatat

SEQ ID NO: 643717 - DNA, 22 bp, Artificial Sequence
  chemically synthesized
ttaaaatgaggaatatattcat

SEQ ID NO: 643718 - DNA, 22 bp, Artificial Sequence
  chemically synthesized
gatctattaaaatgaggaatat

SEQ ID NO: 643719 - DNA, 22 bp, Artificial Sequence
  chemically synthesized
agtgcaaatactagatctatta

SEQ ID NO: 643720 - DNA, 22 bp, Artificial Sequence
  chemically synthesized
aagtgcaaatactagatctatt

SEQ ID NO: 643721 - DNA, 22 bp, Artificial Sequence
  chemically synthesized
ctcattttaatagatctagtat

SEQ ID NO: 643722 - DNA, 22 bp, Artificial Sequence
  chemically synthesized
gtttaagtgcaaatactagatc

SEQ ID NO: 643723 - DNA, 22 bp, Artificial Sequence
  chemically synthesized
attttaatagatctagtatttg

SEQ ID NO: 643724 - DNA, 22 bp, Artificial Sequence
  chemically synthesized
taatagatctagtatttgcact

SEQ ID NO: 643725 - DNA, 22 bp, Artificial Sequence
  chemically synthesized
aatagatctagtatttgcactt

SEQ ID NO: 643726 - DNA, 22 bp, Artificial Sequence
  chemically synthesized
atagatctagtatttgcactta

SEQ ID NO: 643727 - DNA, 22 bp, Artificial Sequence
  chemically synthesized
ggaggagacagcatctggttta

SEQ ID NO: 643728 - DNA, 22 bp, Artificial Sequence
  chemically synthesized
gtatttgcacttaaaccagatg

SEQ ID NO: 643729 - DNA, 22 bp, Artificial Sequence
  chemically synthesized
aggaggagacagcatctggttt

SEQ ID NO: 643730 - DNA, 22 bp, Artificial Sequence
  chemically synthesized
taggaggagacagcatctggtt

SEQ ID NO: 643731 - DNA, 22 bp, Artificial Sequence
  chemically synthesized
ttaggaggagacagcatctggt

SEQ ID NO: 643732 - DNA, 22 bp, Artificial Sequence
  chemically synthesized
tttaggaggagacagcatctgg

SEQ ID NO: 643733 - DNA, 22 bp, Artificial Sequence
  chemically synthesized
ttttaggaggagacagcatctg

SEQ ID NO: 643734 - DNA, 22 bp, Artificial Sequence
  chemically synthesized
gcacttaaaccagatgctgtct

SEQ ID NO: 643735 - DNA, 22 bp, Artificial Sequence
  chemically synthesized
cacttaaaccagatgctgtctc

SEQ ID NO: 643736 - DNA, 22 bp, Artificial Sequence
  chemically synthesized
aagcttttttaggaggagacag

SEQ ID NO: 643737 - DNA, 22 bp, Artificial Sequence
  chemically synthesized
aaagcttttttaggaggagaca

SEQ ID NO: 643738 - DNA, 22 bp, Artificial Sequence
  chemically synthesized
aaaccagatgctgtctcctcct

SEQ ID NO: 643739 - DNA, 22 bp, Artificial Sequence
  chemically synthesized
aaccagatgctgtctcctccta

SEQ ID NO: 643740 - DNA, 22 bp, Artificial Sequence
  chemically synthesized
ccttaaagcttttttaggagga

SEQ ID NO: 643741 - DNA, 22 bp, Artificial Sequence
  chemically synthesized
tcaaggttgccttaaagctttt

SEQ ID NO: 643742 - DNA, 22 bp, Artificial Sequence
  chemically synthesized
tctcctcctaaaaaagctttaa

SEQ ID NO: 643743 - DNA, 22 bp, Artificial Sequence
  chemically synthesized
ctcctaaaaaagctttaaggca

SEQ ID NO: 643744 - DNA, 22 bp, Artificial Sequence
  chemically synthesized
ctaaaaaagctttaaggcaacc

SEQ ID NO: 643745 - DNA, 22 bp, Artificial Sequence
  chemically synthesized
aaatgttatcaaggttgcctta

SEQ ID NO: 643746 - DNA, 22 bp, Artificial Sequence
  chemically synthesized
aaaaagctttaaggcaaccttg

SEQ ID NO: 643747 - DNA, 22 bp, Artificial Sequence
  chemically synthesized
tattaaaatgttatcaaggttg

SEQ ID NO: 643748 - DNA, 22 bp, Artificial Sequence
  chemically synthesized
gtattaaaatgttatcaaggtt

SEQ ID NO: 643749 - DNA, 22 bp, Artificial Sequence
  chemically synthesized
ccttgtattaaaatgttatcaa

SEQ ID NO: 643750 - DNA, 22 bp, Artificial Sequence
  chemically synthesized
taaggcaaccttgataacattt

SEQ ID NO: 643751 - DNA, 22 bp, Artificial Sequence
  chemically synthesized
aaggcaaccttgataacatttt

SEQ ID NO: 643752 - DNA, 22 bp, Artificial Sequence
  chemically synthesized
aggcaaccttgataacatttta

SEQ ID NO: 643753 - DNA, 22 bp, Artificial Sequence
  chemically synthesized
actgccttgtattaaaatgtta

SEQ ID NO: 643754 - DNA, 22 bp, Artificial Sequence
  chemically synthesized
aactgccttgtattaaaatgtt

SEQ ID NO: 643755 - DNA, 22 bp, Artificial Sequence
  chemically synthesized
taactgccttgtattaaaatgt

SEQ ID NO: 643756 - DNA, 22 bp, Artificial Sequence
  chemically synthesized
ttaactgccttgtattaaaatg

SEQ ID NO: 643757 - DNA, 22 bp, Artificial Sequence
  chemically synthesized
tttaactgccttgtattaaaat

SEQ ID NO: 643758 - DNA, 22 bp, Artificial Sequence
  chemically synthesized
tttttaactgccttgtattaaa

SEQ ID NO: 643759 - DNA, 22 bp, Artificial Sequence
  chemically synthesized
tctttttaactgccttgtatta

SEQ ID NO: 643760 - DNA, 22 bp, Artificial Sequence
  chemically synthesized
gataacattttaatacaaggca

SEQ ID NO: 643761 - DNA, 22 bp, Artificial Sequence
  chemically synthesized
ataacattttaatacaaggcag

SEQ ID NO: 643762 - DNA, 22 bp, Artificial Sequence
  chemically synthesized
tctctctttttaactgccttgt

SEQ ID NO: 643763 - DNA, 22 bp, Artificial Sequence
  chemically synthesized
attatctctctttttaactgcc

SEQ ID NO: 643764 - DNA, 22 bp, Artificial Sequence
  chemically synthesized
taatacaaggcagttaaaaaga

SEQ ID NO: 643765 - DNA, 22 bp, Artificial Sequence
  chemically synthesized
aatacaaggcagttaaaaagag

SEQ ID NO: 643766 - DNA, 22 bp, Artificial Sequence
  chemically synthesized
tcctaattatctctctttttaa

SEQ ID NO: 643767 - DNA, 22 bp, Artificial Sequence
  chemically synthesized
atacaaggcagttaaaaagaga

SEQ ID NO: 643768 - DNA, 22 bp, Artificial Sequence
  chemically synthesized
atcctaattatctctcttttta

SEQ ID NO: 643769 - DNA, 22 bp, Artificial Sequence
  chemically synthesized
tatcctaattatctctcttttt

SEQ ID NO: 643770 - DNA, 22 bp, Artificial Sequence
  chemically synthesized
cctttatcctaattatctctct

SEQ ID NO: 643771 - DNA, 22 bp, Artificial Sequence
  chemically synthesized
tccctttatcctaattatctct

SEQ ID NO: 643772 - DNA, 22 bp, Artificial Sequence
  chemically synthesized
ctccctttatcctaattatctc

SEQ ID NO: 643773 - DNA, 22 bp, Artificial Sequence
  chemically synthesized
tttctccctttatcctaattat

SEQ ID NO: 643774 - DNA, 22 bp, Artificial Sequence
  chemically synthesized
atttctccctttatcctaatta

SEQ ID NO: 643775 - DNA, 22 bp, Artificial Sequence
  chemically synthesized
aaaagagagataattaggataa

SEQ ID NO: 643776 - DNA, 22 bp, Artificial Sequence
  chemically synthesized
ggataaagggagaaataaactt

SEQ ID NO: 643777 - DNA, 22 bp, Artificial Sequence
  chemically synthesized
atggcagtgaatggataaccca

SEQ ID NO: 643778 - DNA, 22 bp, Artificial Sequence
  chemically synthesized
tcattctgggttatccattcac

SEQ ID NO: 643779 - DNA, 22 bp, Artificial Sequence
  chemically synthesized
cattctgggttatccattcact

SEQ ID NO: 643780 - DNA, 22 bp, Artificial Sequence
  chemically synthesized
attctgggttatccattcactg

SEQ ID NO: 643781 - DNA, 22 bp, Artificial Sequence
  chemically synthesized
tgggttatccattcactgccat

SEQ ID NO: 643782 - DNA, 22 bp, Artificial Sequence
  chemically synthesized
ggttatccattcactgccatga

SEQ ID NO: 643783 - DNA, 22 bp, Artificial Sequence
  chemically synthesized
atagtatgcagttcatggcagt

SEQ ID NO: 643784 - DNA, 22 bp, Artificial Sequence
  chemically synthesized
attcatagtatgcagttcatgg

SEQ ID NO: 643785 - DNA, 22 bp, Artificial Sequence
  chemically synthesized
tccattcactgccatgaactgc

SEQ ID NO: 643786 - DNA, 22 bp, Artificial Sequence
  chemically synthesized
actgccatgaactgcatactat

SEQ ID NO: 643787 - DNA, 22 bp, Artificial Sequence
  chemically synthesized
aggggactgattcatagtatgc

SEQ ID NO: 643788 - DNA, 22 bp, Artificial Sequence
  chemically synthesized
ccatgaactgcatactatgaat

SEQ ID NO: 643789 - DNA, 22 bp, Artificial Sequence
  chemically synthesized
aagtctgaggggactgattcat

SEQ ID NO: 643790 - DNA, 22 bp, Artificial Sequence
  chemically synthesized
attgaagtctgaggggactgat

SEQ ID NO: 643791 - DNA, 22 bp, Artificial Sequence
  chemically synthesized
catactatgaatcagtcccctc

SEQ ID NO: 643792 - DNA, 22 bp, Artificial Sequence
  chemically synthesized
tgaatcagtcccctcagacttc

SEQ ID NO: 643793 - DNA, 22 bp, Artificial Sequence
  chemically synthesized
tccaaagttaattgaagtctga

SEQ ID NO: 643794 - DNA, 22 bp, Artificial Sequence
  chemically synthesized
atccaaagttaattgaagtctg

SEQ ID NO: 643795 - DNA, 22 bp, Artificial Sequence
  chemically synthesized
agtttatccaaagttaattgaa

SEQ ID NO: 643796 - DNA, 22 bp, Artificial Sequence
  chemically synthesized
cagtttatccaaagttaattga

SEQ ID NO: 643797 - DNA, 22 bp, Artificial Sequence
  chemically synthesized
cttcagtttatccaaagttaat

SEQ ID NO: 643798 - DNA, 22 bp, Artificial Sequence
  chemically synthesized
ccttcagtttatccaaagttaa

SEQ ID NO: 643799 - DNA, 22 bp, Artificial Sequence
  chemically synthesized
agacttcaattaactttggata

SEQ ID NO: 643800 - DNA, 22 bp, Artificial Sequence
  chemically synthesized
aatttccttcagtttatccaaa

SEQ ID NO: 643801 - DNA, 22 bp, Artificial Sequence
  chemically synthesized
caattaactttggataaactga

SEQ ID NO: 643802 - DNA, 22 bp, Artificial Sequence
  chemically synthesized
aattaactttggataaactgaa

SEQ ID NO: 643803 - DNA, 22 bp, Artificial Sequence
  chemically synthesized
actttggataaactgaaggaaa

SEQ ID NO: 643804 - DNA, 22 bp, Artificial Sequence
  chemically synthesized
tggataaactgaaggaaattta

SEQ ID NO: 643805 - DNA, 22 bp, Artificial Sequence
  chemically synthesized
ggataaactgaaggaaatttag

SEQ ID NO: 643806 - DNA, 22 bp, Artificial Sequence
  chemically synthesized
gataaactgaaggaaatttagt

SEQ ID NO: 643807 - DNA, 22 bp, Artificial Sequence
  chemically synthesized
gcagggccagtgtaactaaatt

SEQ ID NO: 643808 - DNA, 22 bp, Artificial Sequence
  chemically synthesized
actagcagggccagtgtaacta

SEQ ID NO: 643809 - DNA, 22 bp, Artificial Sequence
  chemically synthesized
taactagcagggccagtgtaac

SEQ ID NO: 643810 - DNA, 22 bp, Artificial Sequence
  chemically synthesized
aaggaaatttagttacactggc

SEQ ID NO: 643811 - DNA, 22 bp, Artificial Sequence
  chemically synthesized
ctaactagcagggccagtgtaa

SEQ ID NO: 643812 - DNA, 22 bp, Artificial Sequence
  chemically synthesized
agtttctaactagcagggccag

SEQ ID NO: 643813 - DNA, 22 bp, Artificial Sequence
  chemically synthesized
agttacactggccctgctagtt

SEQ ID NO: 643814 - DNA, 22 bp, Artificial Sequence
  chemically synthesized
gttacactggccctgctagtta

SEQ ID NO: 643815 - DNA, 22 bp, Artificial Sequence
  chemically synthesized
acagactcagtttctaactagc

SEQ ID NO: 643816 - DNA, 22 bp, Artificial Sequence
  chemically synthesized
cactggccctgctagttagaaa

SEQ ID NO: 643817 - DNA, 22 bp, Artificial Sequence
  chemically synthesized
ttcacagactcagtttctaact

SEQ ID NO: 643818 - DNA, 22 bp, Artificial Sequence
  chemically synthesized
gccctgctagttagaaactgag

SEQ ID NO: 643819 - DNA, 22 bp, Artificial Sequence
  chemically synthesized
ctagttagaaactgagtctgtg

SEQ ID NO: 643820 - DNA, 22 bp, Artificial Sequence
  chemically synthesized
gttagaaactgagtctgtgaat

SEQ ID NO: 643821 - DNA, 22 bp, Artificial Sequence
  chemically synthesized
gaaactgagtctgtgaataatg

SEQ ID NO: 643822 - DNA, 22 bp, Artificial Sequence
  chemically synthesized
agtctgtgaataatggtgattc

SEQ ID NO: 643823 - DNA, 22 bp, Artificial Sequence
  chemically synthesized
tgaataatggtgattccacttc

SEQ ID NO: 643824 - DNA, 22 bp, Artificial Sequence
  chemically synthesized
aggcagggaggacaggaacatg

SEQ ID NO: 643825 - DNA, 22 bp, Artificial Sequence
  chemically synthesized
cacttctaccatgttcctgtcc

SEQ ID NO: 643826 - DNA, 22 bp, Artificial Sequence
  chemically synthesized
ctcaggcagggaggacaggaac

SEQ ID NO: 643827 - DNA, 22 bp, Artificial Sequence
  chemically synthesized
tactcaggcagggaggacagga

SEQ ID NO: 643828 - DNA, 22 bp, Artificial Sequence
  chemically synthesized
ctaccatgttcctgtcctccct

SEQ ID NO: 643829 - DNA, 22 bp, Artificial Sequence
  chemically synthesized
taccatgttcctgtcctccctg

SEQ ID NO: 643830 - DNA, 22 bp, Artificial Sequence
  chemically synthesized
agctctactcaggcagggagga

SEQ ID NO: 643831 - DNA, 22 bp, Artificial Sequence
  chemically synthesized
ccatgttcctgtcctccctgcc

SEQ ID NO: 643832 - DNA, 22 bp, Artificial Sequence
  chemically synthesized
ctgtcctccctgcctgagtaga

SEQ ID NO: 643833 - DNA, 22 bp, Artificial Sequence
  chemically synthesized
tcctccctgcctgagtagagct

SEQ ID NO: 643834 - DNA, 22 bp, Artificial Sequence
  chemically synthesized
cctgcctgagtagagctgagat

SEQ ID NO: 643835 - DNA, 22 bp, Artificial Sequence
  chemically synthesized
cctgagtagagctgagatggtt

SEQ ID NO: 643836 - DNA, 22 bp, Artificial Sequence
  chemically synthesized
tgtaagaatggggtcaaccatc

SEQ ID NO: 643837 - DNA, 22 bp, Artificial Sequence
  chemically synthesized
agtagagctgagatggttgacc

SEQ ID NO: 643838 - DNA, 22 bp, Artificial Sequence
  chemically synthesized
agaagctgtgtaagaatggggt

SEQ ID NO: 643839 - DNA, 22 bp, Artificial Sequence
  chemically synthesized
aagaagctgtgtaagaatgggg

SEQ ID NO: 643840 - DNA, 22 bp, Artificial Sequence
  chemically synthesized
agatggttgaccccattcttac

SEQ ID NO: 643841 - DNA, 22 bp, Artificial Sequence
  chemically synthesized
accccattcttacacagcttct

SEQ ID NO: 643842 - DNA, 22 bp, Artificial Sequence
  chemically synthesized
ttacacagcttcttaaatgtgg

SEQ ID NO: 643843 - DNA, 22 bp, Artificial Sequence
  chemically synthesized
aagggcatacatgccacattta

SEQ ID NO: 643844 - DNA, 22 bp, Artificial Sequence
  chemically synthesized
acacagcttcttaaatgtggca

SEQ ID NO: 643845 - DNA, 22 bp, Artificial Sequence
  chemically synthesized
cacagcttcttaaatgtggcat

SEQ ID NO: 643846 - DNA, 22 bp, Artificial Sequence
  chemically synthesized
cttaaatgtggcatgtatgccc

SEQ ID NO: 643847 - DNA, 22 bp, Artificial Sequence
  chemically synthesized
ttaaatgtggcatgtatgccct

SEQ ID NO: 643848 - DNA, 22 bp, Artificial Sequence
  chemically synthesized
aaatgtggcatgtatgcccttc

SEQ ID NO: 643849 - DNA, 22 bp, Artificial Sequence
  chemically synthesized
aatgtggcatgtatgcccttca

SEQ ID NO: 643850 - DNA, 22 bp, Artificial Sequence
  chemically synthesized
tggcaaggatgaataagagctg

SEQ ID NO: 643851 - DNA, 22 bp, Artificial Sequence
  chemically synthesized
atggcaaggatgaataagagct

SEQ ID NO: 643852 - DNA, 22 bp, Artificial Sequence
  chemically synthesized
tatggcaaggatgaataagagc

SEQ ID NO: 643853 - DNA, 22 bp, Artificial Sequence
  chemically synthesized
ttatggcaaggatgaataagag

SEQ ID NO: 643854 - DNA, 22 bp, Artificial Sequence
  chemically synthesized
cagctcttattcatccttgcca

SEQ ID NO: 643855 - DNA, 22 bp, Artificial Sequence
  chemically synthesized
agctcttattcatccttgccat

SEQ ID NO: 643856 - DNA, 22 bp, Artificial Sequence
  chemically synthesized
ttattcatccttgccataaaag

SEQ ID NO: 643857 - DNA, 22 bp, Artificial Sequence
  chemically synthesized
attcatccttgccataaaaggt

SEQ ID NO: 643858 - DNA, 22 bp, Artificial Sequence
  chemically synthesized
ttcatccttgccataaaaggtc

SEQ ID NO: 643859 - DNA, 22 bp, Artificial Sequence
  chemically synthesized
atccttgccataaaaggtcttg

SEQ ID NO: 643860 - DNA, 22 bp, Artificial Sequence
  chemically synthesized
gccataaaaggtcttggctttc

SEQ ID NO: 643861 - DNA, 22 bp, Artificial Sequence
  chemically synthesized
ccataaaaggtcttggctttct

SEQ ID NO: 643862 - DNA, 22 bp, Artificial Sequence
  chemically synthesized
atcacagaaatcagaaagccaa

SEQ ID NO: 643863 - DNA, 22 bp, Artificial Sequence
  chemically synthesized
gatcacagaaatcagaaagcca

SEQ ID NO: 643864 - DNA, 22 bp, Artificial Sequence
  chemically synthesized
gtttgatcacagaaatcagaaa

SEQ ID NO: 643865 - DNA, 22 bp, Artificial Sequence
  chemically synthesized
ggctttctgatttctgtgatca

SEQ ID NO: 643866 - DNA, 22 bp, Artificial Sequence
  chemically synthesized
gctttctgatttctgtgatcaa

SEQ ID NO: 643867 - DNA, 22 bp, Artificial Sequence
  chemically synthesized
tctgatttctgtgatcaaacta

SEQ ID NO: 643868 - DNA, 22 bp, Artificial Sequence
  chemically synthesized
ctgatttctgtgatcaaactag

SEQ ID NO: 643869 - DNA, 22 bp, Artificial Sequence
  chemically synthesized
agacaaagggagctagtttgat

SEQ ID NO: 643870 - DNA, 22 bp, Artificial Sequence
  chemically synthesized
tgatttctgtgatcaaactagc

SEQ ID NO: 643871 - DNA, 22 bp, Artificial Sequence
  chemically synthesized
gagacaaagggagctagtttga

SEQ ID NO: 643872 - DNA, 22 bp, Artificial Sequence
  chemically synthesized
atttctgtgatcaaactagctc

SEQ ID NO: 643873 - DNA, 22 bp, Artificial Sequence
  chemically synthesized
ttgagacaaagggagctagttt

SEQ ID NO: 643874 - DNA, 22 bp, Artificial Sequence
  chemically synthesized
cttgagacaaagggagctagtt

SEQ ID NO: 643875 - DNA, 22 bp, Artificial Sequence
  chemically synthesized
ctgtgatcaaactagctccctt

SEQ ID NO: 643876 - DNA, 22 bp, Artificial Sequence
  chemically synthesized
tgtgatcaaactagctcccttt

SEQ ID NO: 643877 - DNA, 22 bp, Artificial Sequence
  chemically synthesized
tgatcaaactagctccctttgt

SEQ ID NO: 643878 - DNA, 22 bp, Artificial Sequence
  chemically synthesized
cagagcccttcttgagacaaag

SEQ ID NO: 643879 - DNA, 22 bp, Artificial Sequence
  chemically synthesized
gctccctttgtctcaagaaggg

SEQ ID NO: 643880 - DNA, 22 bp, Artificial Sequence
  chemically synthesized
cctttgtctcaagaagggctct

SEQ ID NO: 643881 - DNA, 22 bp, Artificial Sequence
  chemically synthesized
tgtctcaagaagggctctgtag

SEQ ID NO: 643882 - DNA, 22 bp, Artificial Sequence
  chemically synthesized
gtctcaagaagggctctgtagc

SEQ ID NO: 643883 - DNA, 22 bp, Artificial Sequence
  chemically synthesized
tctcaagaagggctctgtagcc

SEQ ID NO: 643884 - DNA, 22 bp, Artificial Sequence
  chemically synthesized
aagaagggctctgtagcccttt

SEQ ID NO: 643885 - DNA, 22 bp, Artificial Sequence
  chemically synthesized
gtgacatgggccccaaaacaaa

SEQ ID NO: 643886 - DNA, 22 bp, Artificial Sequence
  chemically synthesized
ggtgacatgggccccaaaacaa

SEQ ID NO: 643887 - DNA, 22 bp, Artificial Sequence
  chemically synthesized
tgtagccctttgttttggggcc

SEQ ID NO: 643888 - DNA, 22 bp, Artificial Sequence
  chemically synthesized
tagccctttgttttggggccca

SEQ ID NO: 643889 - DNA, 22 bp, Artificial Sequence
  chemically synthesized
tatcatttggtgacatgggccc

SEQ ID NO: 643890 - DNA, 22 bp, Artificial Sequence
  chemically synthesized
tgttttggggcccatgtcacca

SEQ ID NO: 643891 - DNA, 22 bp, Artificial Sequence
  chemically synthesized
gttttggggcccatgtcaccaa

SEQ ID NO: 643892 - DNA, 22 bp, Artificial Sequence
  chemically synthesized
ttttggggcccatgtcaccaaa

SEQ ID NO: 643893 - DNA, 22 bp, Artificial Sequence
  chemically synthesized
tggggcccatgtcaccaaatga

SEQ ID NO: 643894 - DNA, 22 bp, Artificial Sequence
  chemically synthesized
ggggcccatgtcaccaaatgat

SEQ ID NO: 643895 - DNA, 22 bp, Artificial Sequence
  chemically synthesized
gggcccatgtcaccaaatgata

SEQ ID NO: 643896 - DNA, 22 bp, Artificial Sequence
  chemically synthesized
ggtggagatccagccaaactat

SEQ ID NO: 643897 - DNA, 22 bp, Artificial Sequence
  chemically synthesized
gggtggagatccagccaaacta

SEQ ID NO: 643898 - DNA, 22 bp, Artificial Sequence
  chemically synthesized
aagatcagatttgggtggagat

SEQ ID NO: 643899 - DNA, 22 bp, Artificial Sequence
  chemically synthesized
ggctggatctccacccaaatct

SEQ ID NO: 643900 - DNA, 22 bp, Artificial Sequence
  chemically synthesized
taattcaagatcagatttgggt

SEQ ID NO: 643901 - DNA, 22 bp, Artificial Sequence
  chemically synthesized
gctggatctccacccaaatctg

SEQ ID NO: 643902 - DNA, 22 bp, Artificial Sequence
  chemically synthesized
gatctccacccaaatctgatct

SEQ ID NO: 643903 - DNA, 22 bp, Artificial Sequence
  chemically synthesized
tgagagctataattcaagatca

SEQ ID NO: 643904 - DNA, 22 bp, Artificial Sequence
  chemically synthesized
cacccaaatctgatcttgaatt

SEQ ID NO: 643905 - DNA, 22 bp, Artificial Sequence
  chemically synthesized
atcttgaattatagctctcata

SEQ ID NO: 643906 - DNA, 22 bp, Artificial Sequence
  chemically synthesized
gaattatagctctcataatccg

SEQ ID NO: 643907 - DNA, 22 bp, Artificial Sequence
  chemically synthesized
ccatgatatgtgcggattatga

SEQ ID NO: 643908 - DNA, 22 bp, Artificial Sequence
  chemically synthesized
aattatagctctcataatccgc

SEQ ID NO: 643909 - DNA, 22 bp, Artificial Sequence
  chemically synthesized
ctcccatgatatgtgcggatta

SEQ ID NO: 643910 - DNA, 22 bp, Artificial Sequence
  chemically synthesized
tagctctcataatccgcacata

SEQ ID NO: 643911 - DNA, 22 bp, Artificial Sequence
  chemically synthesized
ggttcctcccatgatatgtgcg

SEQ ID NO: 643912 - DNA, 22 bp, Artificial Sequence
  chemically synthesized
tcataatccgcacatatcatgg

SEQ ID NO: 643913 - DNA, 22 bp, Artificial Sequence
  chemically synthesized
ataatccgcacatatcatggga

SEQ ID NO: 643914 - DNA, 22 bp, Artificial Sequence
  chemically synthesized
ccactgggttcctcccatgata

SEQ ID NO: 643915 - DNA, 22 bp, Artificial Sequence
  chemically synthesized
cctcccactgggttcctcccat

SEQ ID NO: 643916 - DNA, 22 bp, Artificial Sequence
  chemically synthesized
agttacctcccactgggttcct

SEQ ID NO: 643917 - DNA, 22 bp, Artificial Sequence
  chemically synthesized
aatcatgggggtggggttttcc

SEQ ID NO: 643918 - DNA, 22 bp, Artificial Sequence
  chemically synthesized
tcacaaaaacagcatgggaaaa

SEQ ID NO: 643919 - DNA, 22 bp, Artificial Sequence
  chemically synthesized
ctatcacaaaaacagcatggga

SEQ ID NO: 643920 - DNA, 22 bp, Artificial Sequence
  chemically synthesized
atgagagttactatcacaaaaa

SEQ ID NO: 643921 - DNA, 22 bp, Artificial Sequence
  chemically synthesized
tcccatgctgtttttgtgatag

SEQ ID NO: 643922 - DNA, 22 bp, Artificial Sequence
  chemically synthesized
cccatgctgtttttgtgatagt

SEQ ID NO: 643923 - DNA, 22 bp, Artificial Sequence
  chemically synthesized
ccatgctgtttttgtgatagta

SEQ ID NO: 643924 - DNA, 22 bp, Artificial Sequence
  chemically synthesized
tttttgtgatagtaactctcat

SEQ ID NO: 643925 - DNA, 22 bp, Artificial Sequence
  chemically synthesized
ttgtgatagtaactctcatgag

SEQ ID NO: 643926 - DNA, 22 bp, Artificial Sequence
  chemically synthesized
aaaccatcagatctcatgagag

SEQ ID NO: 643927 - DNA, 22 bp, Artificial Sequence
  chemically synthesized
tgtgatagtaactctcatgaga

SEQ ID NO: 643928 - DNA, 22 bp, Artificial Sequence
  chemically synthesized
aaaaccatcagatctcatgaga

SEQ ID NO: 643929 - DNA, 22 bp, Artificial Sequence
  chemically synthesized
gtgatagtaactctcatgagat

SEQ ID NO: 643930 - DNA, 22 bp, Artificial Sequence
  chemically synthesized
taaaaccatcagatctcatgag

SEQ ID NO: 643931 - DNA, 22 bp, Artificial Sequence
  chemically synthesized
tgatagtaactctcatgagatc

SEQ ID NO: 643932 - DNA, 22 bp, Artificial Sequence
  chemically synthesized
ttaaaaccatcagatctcatga

SEQ ID NO: 643933 - DNA, 22 bp, Artificial Sequence
  chemically synthesized
tttaaaaccatcagatctcatg

SEQ ID NO: 643934 - DNA, 22 bp, Artificial Sequence
  chemically synthesized
ccctttttaaaaccatcagatc

SEQ ID NO: 643935 - DNA, 22 bp, Artificial Sequence
  chemically synthesized
tcatgagatctgatggttttaa

SEQ ID NO: 643936 - DNA, 22 bp, Artificial Sequence
  chemically synthesized
atgagatctgatggttttaaaa

SEQ ID NO: 643937 - DNA, 22 bp, Artificial Sequence
  chemically synthesized
atggttttaaaaagggcagttc

SEQ ID NO: 643938 - DNA, 22 bp, Artificial Sequence
  chemically synthesized
taaaaagggcagttctcctgca

SEQ ID NO: 643939 - DNA, 22 bp, Artificial Sequence
  chemically synthesized
aaaaagggcagttctcctgcac

SEQ ID NO: 643940 - DNA, 22 bp, Artificial Sequence
  chemically synthesized
aaaagggcagttctcctgcaca

SEQ ID NO: 643941 - DNA, 22 bp, Artificial Sequence
  chemically synthesized
cacggtggcaggcaagagagca

SEQ ID NO: 643942 - DNA, 22 bp, Artificial Sequence
  chemically synthesized
acacggtggcaggcaagagagc

SEQ ID NO: 643943 - DNA, 22 bp, Artificial Sequence
  chemically synthesized
tcctgcacatgctctcttgcct

SEQ ID NO: 643944 - DNA, 22 bp, Artificial Sequence
  chemically synthesized
ctgcacatgctctcttgcctgc

SEQ ID NO: 643945 - DNA, 22 bp, Artificial Sequence
  chemically synthesized
cacatgctctcttgcctgccac

SEQ ID NO: 643946 - DNA, 22 bp, Artificial Sequence
  chemically synthesized
tcttgcctgccaccgtgtaaga

SEQ ID NO: 643947 - DNA, 22 bp, Artificial Sequence
  chemically synthesized
ttgcctgccaccgtgtaagaca

SEQ ID NO: 643948 - DNA, 22 bp, Artificial Sequence
  chemically synthesized
gcctgccaccgtgtaagacatg

SEQ ID NO: 643949 - DNA, 22 bp, Artificial Sequence
  chemically synthesized
cctgccaccgtgtaagacatgc

SEQ ID NO: 643950 - DNA, 22 bp, Artificial Sequence
  chemically synthesized
ccaccgtgtaagacatgccttt

SEQ ID NO: 643951 - DNA, 22 bp, Artificial Sequence
  chemically synthesized
acaatcatggcagaaggtgaag

SEQ ID NO: 643952 - DNA, 22 bp, Artificial Sequence
  chemically synthesized
tcctcctccttcaccttctgcc

SEQ ID NO: 643953 - DNA, 22 bp, Artificial Sequence
  chemically synthesized
cctcctccttcaccttctgcca

SEQ ID NO: 643954 - DNA, 22 bp, Artificial Sequence
  chemically synthesized
ctcctccttcaccttctgccat

SEQ ID NO: 643955 - DNA, 22 bp, Artificial Sequence
  chemically synthesized
ctccttcaccttctgccatgat

SEQ ID NO: 643956 - DNA, 22 bp, Artificial Sequence
  chemically synthesized
ggaaggcctcacaatcatggca

SEQ ID NO: 643957 - DNA, 22 bp, Artificial Sequence
  chemically synthesized
cttcaccttctgccatgattgt

SEQ ID NO: 643958 - DNA, 22 bp, Artificial Sequence
  chemically synthesized
caccttctgccatgattgtgag

SEQ ID NO: 643959 - DNA, 22 bp, Artificial Sequence
  chemically synthesized
accttctgccatgattgtgagg

SEQ ID NO: 643960 - DNA, 22 bp, Artificial Sequence
  chemically synthesized
cgtgtggctgggaaggcctcac

SEQ ID NO: 643961 - DNA, 22 bp, Artificial Sequence
  chemically synthesized
ctgccatgattgtgaggccttc

SEQ ID NO: 643962 - DNA, 22 bp, Artificial Sequence
  chemically synthesized
tgccatgattgtgaggccttcc

SEQ ID NO: 643963 - DNA, 22 bp, Artificial Sequence
  chemically synthesized
ccatgattgtgaggccttccca

SEQ ID NO: 643964 - DNA, 22 bp, Artificial Sequence
  chemically synthesized
acagttccgtgtggctgggaag

SEQ ID NO: 643965 - DNA, 22 bp, Artificial Sequence
  chemically synthesized
tgaggccttcccagccacacgg

SEQ ID NO: 643966 - DNA, 22 bp, Artificial Sequence
  chemically synthesized
atggactcacagttccgtgtgg

SEQ ID NO: 643967 - DNA, 22 bp, Artificial Sequence
  chemically synthesized
aatggactcacagttccgtgtg

SEQ ID NO: 643968 - DNA, 22 bp, Artificial Sequence
  chemically synthesized
cccagccacacggaactgtgag

SEQ ID NO: 643969 - DNA, 22 bp, Artificial Sequence
  chemically synthesized
ccagccacacggaactgtgagt

SEQ ID NO: 643970 - DNA, 22 bp, Artificial Sequence
  chemically synthesized
caaagaaaaagaggtttaatgg

SEQ ID NO: 643971 - DNA, 22 bp, Artificial Sequence
  chemically synthesized
acaaagaaaaagaggtttaatg

SEQ ID NO: 643972 - DNA, 22 bp, Artificial Sequence
  chemically synthesized
tgagtccattaaacctcttttt

SEQ ID NO: 643973 - DNA, 22 bp, Artificial Sequence
  chemically synthesized
atacggggcaatttacaaagaa

SEQ ID NO: 643974 - DNA, 22 bp, Artificial Sequence
  chemically synthesized
catacggggcaatttacaaaga

SEQ ID NO: 643975 - DNA, 22 bp, Artificial Sequence
  chemically synthesized
tcatacggggcaatttacaaag

SEQ ID NO: 643976 - DNA, 22 bp, Artificial Sequence
  chemically synthesized
aacctctttttctttgtaaatt

SEQ ID NO: 643977 - DNA, 22 bp, Artificial Sequence
  chemically synthesized
tttttctttgtaaattgccccg

SEQ ID NO: 643978 - DNA, 22 bp, Artificial Sequence
  chemically synthesized
gtccattttcatacggggcaat

SEQ ID NO: 643979 - DNA, 22 bp, Artificial Sequence
  chemically synthesized
tttctttgtaaattgccccgta

SEQ ID NO: 643980 - DNA, 22 bp, Artificial Sequence
  chemically synthesized
ttctttgtaaattgccccgtat

SEQ ID NO: 643981 - DNA, 22 bp, Artificial Sequence
  chemically synthesized
tctttgtaaattgccccgtatg

SEQ ID NO: 643982 - DNA, 22 bp, Artificial Sequence
  chemically synthesized
ctttgtaaattgccccgtatga

SEQ ID NO: 643983 - DNA, 22 bp, Artificial Sequence
  chemically synthesized
tttgtaaattgccccgtatgaa

SEQ ID NO: 643984 - DNA, 22 bp, Artificial Sequence
  chemically synthesized
tgtaaattgccccgtatgaaaa

SEQ ID NO: 643985 - DNA, 22 bp, Artificial Sequence
  chemically synthesized
gtaaattgccccgtatgaaaat

SEQ ID NO: 643986 - DNA, 22 bp, Artificial Sequence
  chemically synthesized
gtgtattagtccattttcatac

SEQ ID NO: 643987 - DNA, 22 bp, Artificial Sequence
  chemically synthesized
taaattgccccgtatgaaaatg

SEQ ID NO: 643988 - DNA, 22 bp, Artificial Sequence
  chemically synthesized
ggtgtattagtccattttcata

SEQ ID NO: 643989 - DNA, 22 bp, Artificial Sequence
  chemically synthesized
cttggtgtattagtccattttc

SEQ ID NO: 643990 - DNA, 22 bp, Artificial Sequence
  chemically synthesized
ccccgtatgaaaatggactaat

SEQ ID NO: 643991 - DNA, 22 bp, Artificial Sequence
  chemically synthesized
aagttacttggtgtattagtcc

SEQ ID NO: 643992 - DNA, 22 bp, Artificial Sequence
  chemically synthesized
ggcattcaagttacttggtgta

SEQ ID NO: 643993 - DNA, 22 bp, Artificial Sequence
  chemically synthesized
acgaaactaggcattcaagtta

SEQ ID NO: 643994 - DNA, 22 bp, Artificial Sequence
  chemically synthesized
aacgaaactaggcattcaagtt

SEQ ID NO: 643995 - DNA, 22 bp, Artificial Sequence
  chemically synthesized
atacaccaagtaacttgaatgc

SEQ ID NO: 643996 - DNA, 22 bp, Artificial Sequence
  chemically synthesized
gaatgcctagtttcgttaaatg

SEQ ID NO: 643997 - DNA, 22 bp, Artificial Sequence
  chemically synthesized
aatgcctagtttcgttaaatgt

SEQ ID NO: 643998 - DNA, 22 bp, Artificial Sequence
  chemically synthesized
gtttcgttaaatgtatcatata

SEQ ID NO: 643999 - DNA, 22 bp, Artificial Sequence
  chemically synthesized
cgttaaatgtatcatataccac

SEQ ID NO: 644000 - DNA, 22 bp, Artificial Sequence
  chemically synthesized
gttaaatgtatcatataccacg

SEQ ID NO: 644001 - DNA, 22 bp, Artificial Sequence
  chemically synthesized
gagtggagaggaaagcgtggta

SEQ ID NO: 644002 - DNA, 22 bp, Artificial Sequence
  chemically synthesized
aatgtatcatataccacgcttt

SEQ ID NO: 644003 - DNA, 22 bp, Artificial Sequence
  chemically synthesized
aagttggagtggagaggaaagc

SEQ ID NO: 644004 - DNA, 22 bp, Artificial Sequence
  chemically synthesized
aaagttggagtggagaggaaag

SEQ ID NO: 644005 - DNA, 22 bp, Artificial Sequence
  chemically synthesized
taaagttggagtggagaggaaa

SEQ ID NO: 644006 - DNA, 22 bp, Artificial Sequence
  chemically synthesized
ttaaagttggagtggagaggaa

SEQ ID NO: 644007 - DNA, 22 bp, Artificial Sequence
  chemically synthesized
ccacatgtttttaaagttggag

SEQ ID NO: 644008 - DNA, 22 bp, Artificial Sequence
  chemically synthesized
tcctctccactccaactttaaa

SEQ ID NO: 644009 - DNA, 22 bp, Artificial Sequence
  chemically synthesized
ttcccacatgtttttaaagttg

SEQ ID NO: 644010 - DNA, 22 bp, Artificial Sequence
  chemically synthesized
cctctccactccaactttaaaa

SEQ ID NO: 644011 - DNA, 22 bp, Artificial Sequence
  chemically synthesized
ctctccactccaactttaaaaa

SEQ ID NO: 644012 - DNA, 22 bp, Artificial Sequence
  chemically synthesized
tccactccaactttaaaaacat

SEQ ID NO: 644013 - DNA, 22 bp, Artificial Sequence
  chemically synthesized
cggctgttcccacatgttttta

SEQ ID NO: 644014 - DNA, 22 bp, Artificial Sequence
  chemically synthesized
cactccaactttaaaaacatgt

SEQ ID NO: 644015 - DNA, 22 bp, Artificial Sequence
  chemically synthesized
ctacggctgttcccacatgttt

SEQ ID NO: 644016 - DNA, 22 bp, Artificial Sequence
  chemically synthesized
caactttaaaaacatgtgggaa

SEQ ID NO: 644017 - DNA, 22 bp, Artificial Sequence
  chemically synthesized
attcctacggctgttcccacat

SEQ ID NO: 644018 - DNA, 22 bp, Artificial Sequence
  chemically synthesized
taaaaacatgtgggaacagccg

SEQ ID NO: 644019 - DNA, 22 bp, Artificial Sequence
  chemically synthesized
aaaaacatgtgggaacagccgt

SEQ ID NO: 644020 - DNA, 22 bp, Artificial Sequence
  chemically synthesized
aaaacatgtgggaacagccgta

SEQ ID NO: 644021 - DNA, 22 bp, Artificial Sequence
  chemically synthesized
aagactgattcctacggctgtt

SEQ ID NO: 644022 - DNA, 22 bp, Artificial Sequence
  chemically synthesized
gaaataattcaagactgattcc

SEQ ID NO: 644023 - DNA, 22 bp, Artificial Sequence
  chemically synthesized
aaatgtccagtagacatcactg

SEQ ID NO: 644024 - DNA, 22 bp, Artificial Sequence
  chemically synthesized
gaattatttccagtgatgtcta

SEQ ID NO: 644025 - DNA, 22 bp, Artificial Sequence
  chemically synthesized
aattatttccagtgatgtctac

SEQ ID NO: 644026 - DNA, 22 bp, Artificial Sequence
  chemically synthesized
tttccagtgatgtctactggac

SEQ ID NO: 644027 - DNA, 22 bp, Artificial Sequence
  chemically synthesized
ccagtgatgtctactggacatt

SEQ ID NO: 644028 - DNA, 22 bp, Artificial Sequence
  chemically synthesized
cagtgatgtctactggacattt

SEQ ID NO: 644029 - DNA, 22 bp, Artificial Sequence
  chemically synthesized
ctggacattttaacattcattc

SEQ ID NO: 644030 - DNA, 22 bp, Artificial Sequence
  chemically synthesized
gacattttaacattcattccat

SEQ ID NO: 644031 - DNA, 22 bp, Artificial Sequence
  chemically synthesized
taacattcattccattatgctt

SEQ ID NO: 644032 - DNA, 22 bp, Artificial Sequence
  chemically synthesized
aacattcattccattatgcttc

SEQ ID NO: 644033 - DNA, 22 bp, Artificial Sequence
  chemically synthesized
acattcattccattatgcttct

SEQ ID NO: 644034 - DNA, 22 bp, Artificial Sequence
  chemically synthesized
attccattatgcttctttcctc

SEQ ID NO: 644035 - DNA, 22 bp, Artificial Sequence
  chemically synthesized
gggtaaggaagggaggaaagaa

SEQ ID NO: 644036 - DNA, 22 bp, Artificial Sequence
  chemically synthesized
agggtaaggaagggaggaaaga

SEQ ID NO: 644037 - DNA, 22 bp, Artificial Sequence
  chemically synthesized
cattatgcttctttcctccctt

SEQ ID NO: 644038 - DNA, 22 bp, Artificial Sequence
  chemically synthesized
tgcttctttcctcccttcctta

SEQ ID NO: 644039 - DNA, 22 bp, Artificial Sequence
  chemically synthesized
ctttcctcccttccttacccta

SEQ ID NO: 644040 - DNA, 22 bp, Artificial Sequence
  chemically synthesized
tttcctcccttccttaccctaa

SEQ ID NO: 644041 - DNA, 22 bp, Artificial Sequence
  chemically synthesized
tcctcccttccttaccctaaat

SEQ ID NO: 644042 - DNA, 22 bp, Artificial Sequence
  chemically synthesized
cctcccttccttaccctaaatt

SEQ ID NO: 644043 - DNA, 22 bp, Artificial Sequence
  chemically synthesized
ctcccttccttaccctaaattc

SEQ ID NO: 644044 - DNA, 22 bp, Artificial Sequence
  chemically synthesized
ccttccttaccctaaattcctt

SEQ ID NO: 644045 - DNA, 22 bp, Artificial Sequence
  chemically synthesized
ccttaccctaaattccttacct

SEQ ID NO: 644046 - DNA, 22 bp, Artificial Sequence
  chemically synthesized
cttaccctaaattccttaccta

SEQ ID NO: 644047 - DNA, 22 bp, Artificial Sequence
  chemically synthesized
aagacaaagtggtaggtaagga

SEQ ID NO: 644048 - DNA, 22 bp, Artificial Sequence
  chemically synthesized
tgaagacaaagtggtaggtaag

SEQ ID NO: 644049 - DNA, 22 bp, Artificial Sequence
  chemically synthesized
accctaaattccttacctacca

SEQ ID NO: 644050 - DNA, 22 bp, Artificial Sequence
  chemically synthesized
ccctaaattccttacctaccac

SEQ ID NO: 644051 - DNA, 22 bp, Artificial Sequence
  chemically synthesized
cctctgaagacaaagtggtagg

SEQ ID NO: 644052 - DNA, 22 bp, Artificial Sequence
  chemically synthesized
aattccttacctaccactttgt

SEQ ID NO: 644053 - DNA, 22 bp, Artificial Sequence
  chemically synthesized
cttacctaccactttgtcttca

SEQ ID NO: 644054 - DNA, 22 bp, Artificial Sequence
  chemically synthesized
acctaccactttgtcttcagag

SEQ ID NO: 644055 - DNA, 22 bp, Artificial Sequence
  chemically synthesized
cctaccactttgtcttcagagg

SEQ ID NO: 644056 - DNA, 22 bp, Artificial Sequence
  chemically synthesized
ccactttgtcttcagaggcagt

SEQ ID NO: 644057 - DNA, 22 bp, Artificial Sequence
  chemically synthesized
aatgagaggaaggactgcctct

SEQ ID NO: 644058 - DNA, 22 bp, Artificial Sequence
  chemically synthesized
gaatgagaggaaggactgcctc

SEQ ID NO: 644059 - DNA, 22 bp, Artificial Sequence
  chemically synthesized
tgtcttcagaggcagtccttcc

SEQ ID NO: 644060 - DNA, 22 bp, Artificial Sequence
  chemically synthesized
gtcttcagaggcagtccttcct

SEQ ID NO: 644061 - DNA, 22 bp, Artificial Sequence
  chemically synthesized
tcttcagaggcagtccttcctc

SEQ ID NO: 644062 - DNA, 22 bp, Artificial Sequence
  chemically synthesized
cagaggcagtccttcctctcat

SEQ ID NO: 644063 - DNA, 22 bp, Artificial Sequence
  chemically synthesized
agaggcagtccttcctctcatt

SEQ ID NO: 644064 - DNA, 22 bp, Artificial Sequence
  chemically synthesized
cctctcattcaaggtcacgcct

SEQ ID NO: 644065 - DNA, 22 bp, Artificial Sequence
  chemically synthesized
aagtatgggaggaggcgtgacc

SEQ ID NO: 644066 - DNA, 22 bp, Artificial Sequence
  chemically synthesized
ctctcattcaaggtcacgcctc

SEQ ID NO: 644067 - DNA, 22 bp, Artificial Sequence
  chemically synthesized
tcattcaaggtcacgcctcctc

SEQ ID NO: 644068 - DNA, 22 bp, Artificial Sequence
  chemically synthesized
attcaaggtcacgcctcctccc

SEQ ID NO: 644069 - DNA, 22 bp, Artificial Sequence
  chemically synthesized
gggaactaaagtatgggaggag

SEQ ID NO: 644070 - DNA, 22 bp, Artificial Sequence
  chemically synthesized
aaggtcacgcctcctcccatac

SEQ ID NO: 644071 - DNA, 22 bp, Artificial Sequence
  chemically synthesized
ctcccatactttagttccctaa

SEQ ID NO: 644072 - DNA, 22 bp, Artificial Sequence
  chemically synthesized
ccatactttagttccctaaccc

SEQ ID NO: 644073 - DNA, 22 bp, Artificial Sequence
  chemically synthesized
tagttccctaacccttctctct

SEQ ID NO: 644074 - DNA, 22 bp, Artificial Sequence
  chemically synthesized
agttccctaacccttctctctc

SEQ ID NO: 644075 - DNA, 22 bp, Artificial Sequence
  chemically synthesized
gttccctaacccttctctctcc

SEQ ID NO: 644076 - DNA, 22 bp, Artificial Sequence
  chemically synthesized
ccacaggaggcaggagagagaa

SEQ ID NO: 644077 - DNA, 22 bp, Artificial Sequence
  chemically synthesized
cccacaggaggcaggagagaga

SEQ ID NO: 644078 - DNA, 22 bp, Artificial Sequence
  chemically synthesized
tcccacaggaggcaggagagag

SEQ ID NO: 644079 - DNA, 22 bp, Artificial Sequence
  chemically synthesized
cctaacccttctctctcctgcc

SEQ ID NO: 644080 - DNA, 22 bp, Artificial Sequence
  chemically synthesized
acccttctctctcctgcctcct

SEQ ID NO: 644081 - DNA, 22 bp, Artificial Sequence
  chemically synthesized
ctctctcctgcctcctgtggga

SEQ ID NO: 644082 - DNA, 22 bp, Artificial Sequence
  chemically synthesized
tctctcctgcctcctgtgggaa

SEQ ID NO: 644083 - DNA, 22 bp, Artificial Sequence
  chemically synthesized
tctcctgcctcctgtgggaaaa

SEQ ID NO: 644084 - DNA, 22 bp, Artificial Sequence
  chemically synthesized
tcctgcctcctgtgggaaaatg

SEQ ID NO: 644085 - DNA, 22 bp, Artificial Sequence
  chemically synthesized
ggaatgatgggagcattttccc

SEQ ID NO: 644086 - DNA, 22 bp, Artificial Sequence
  chemically synthesized
ctgcctcctgtgggaaaatgct

SEQ ID NO: 644087 - DNA, 22 bp, Artificial Sequence
  chemically synthesized
gggaatgatgggagcattttcc

SEQ ID NO: 644088 - DNA, 22 bp, Artificial Sequence
  chemically synthesized
cctcctgtgggaaaatgctccc

SEQ ID NO: 644089 - DNA, 22 bp, Artificial Sequence
  chemically synthesized
ctgtgggaaaatgctcccatca

SEQ ID NO: 644090 - DNA, 22 bp, Artificial Sequence
  chemically synthesized
tgggaaaatgctcccatcattc

SEQ ID NO: 644091 - DNA, 22 bp, Artificial Sequence
  chemically synthesized
ccatcattcccaagctctgccc

SEQ ID NO: 644092 - DNA, 22 bp, Artificial Sequence
  chemically synthesized
ccaagctctgccctcctcttct

SEQ ID NO: 644093 - DNA, 22 bp, Artificial Sequence
  chemically synthesized
gagaaatgtgccagaagaagag

SEQ ID NO: 644094 - DNA, 22 bp, Artificial Sequence
  chemically synthesized
tgccctcctcttcttctggcac

SEQ ID NO: 644095 - DNA, 22 bp, Artificial Sequence
  chemically synthesized
ccctcctcttcttctggcacat

SEQ ID NO: 644096 - DNA, 22 bp, Artificial Sequence
  chemically synthesized
acatgctggagaaatgtgccag

SEQ ID NO: 644097 - DNA, 22 bp, Artificial Sequence
  chemically synthesized
cacatgctggagaaatgtgcca

SEQ ID NO: 644098 - DNA, 22 bp, Artificial Sequence
  chemically synthesized
tcacatgctggagaaatgtgcc

SEQ ID NO: 644099 - DNA, 22 bp, Artificial Sequence
  chemically synthesized
ctcttcttctggcacatttctc

SEQ ID NO: 644100 - DNA, 22 bp, Artificial Sequence
  chemically synthesized
attttcacatgctggagaaatg

SEQ ID NO: 644101 - DNA, 22 bp, Artificial Sequence
  chemically synthesized
ttcttctggcacatttctccag

SEQ ID NO: 644102 - DNA, 22 bp, Artificial Sequence
  chemically synthesized
taattttcacatgctggagaaa

SEQ ID NO: 644103 - DNA, 22 bp, Artificial Sequence
  chemically synthesized
cttctggcacatttctccagca

SEQ ID NO: 644104 - DNA, 22 bp, Artificial Sequence
  chemically synthesized
ttctggcacatttctccagcat

SEQ ID NO: 644105 - DNA, 22 bp, Artificial Sequence
  chemically synthesized
ctggcacatttctccagcatgt

SEQ ID NO: 644106 - DNA, 22 bp, Artificial Sequence
  chemically synthesized
tggcacatttctccagcatgtg

SEQ ID NO: 644107 - DNA, 22 bp, Artificial Sequence
  chemically synthesized
gcacatttctccagcatgtgaa

SEQ ID NO: 644108 - DNA, 22 bp, Artificial Sequence
  chemically synthesized
aaaatctctaattttcacatgc

SEQ ID NO: 644109 - DNA, 22 bp, Artificial Sequence
  chemically synthesized
aaaaatctctaattttcacatg

SEQ ID NO: 644110 - DNA, 22 bp, Artificial Sequence
  chemically synthesized
cttaaaaatctctaattttcac

SEQ ID NO: 644111 - DNA, 22 bp, Artificial Sequence
  chemically synthesized
acttaaaaatctctaattttca

SEQ ID NO: 644112 - DNA, 22 bp, Artificial Sequence
  chemically synthesized
tacttaaaaatctctaattttc

SEQ ID NO: 644113 - DNA, 22 bp, Artificial Sequence
  chemically synthesized
ctccagcatgtgaaaattagag

SEQ ID NO: 644114 - DNA, 22 bp, Artificial Sequence
  chemically synthesized
ttacttaaaaatctctaatttt

SEQ ID NO: 644115 - DNA, 22 bp, Artificial Sequence
  chemically synthesized
tccagcatgtgaaaattagaga

SEQ ID NO: 644116 - DNA, 22 bp, Artificial Sequence
  chemically synthesized
tttacttaaaaatctctaattt

SEQ ID NO: 644117 - DNA, 22 bp, Artificial Sequence
  chemically synthesized
cagcatgtgaaaattagagatt

SEQ ID NO: 644118 - DNA, 22 bp, Artificial Sequence
  chemically synthesized
tttttacttaaaaatctctaat

SEQ ID NO: 644119 - DNA, 22 bp, Artificial Sequence
  chemically synthesized
tctttttacttaaaaatctcta

SEQ ID NO: 644120 - DNA, 22 bp, Artificial Sequence
  chemically synthesized
ctctttttacttaaaaatctct

SEQ ID NO: 644121 - DNA, 22 bp, Artificial Sequence
  chemically synthesized
tctctttttacttaaaaatctc

SEQ ID NO: 644122 - DNA, 22 bp, Artificial Sequence
  chemically synthesized
gttttctctttttacttaaaaa

SEQ ID NO: 644123 - DNA, 22 bp, Artificial Sequence
  chemically synthesized
tggttttctctttttacttaaa

SEQ ID NO: 644124 - DNA, 22 bp, Artificial Sequence
  chemically synthesized
actctggttttctctttttact

SEQ ID NO: 644125 - DNA, 22 bp, Artificial Sequence
  chemically synthesized
gagatttttaagtaaaaagaga

SEQ ID NO: 644126 - DNA, 22 bp, Artificial Sequence
  chemically synthesized
ttaagtaaaaagagaaaaccag

SEQ ID NO: 644127 - DNA, 22 bp, Artificial Sequence
  chemically synthesized
taagtaaaaagagaaaaccaga

SEQ ID NO: 644128 - DNA, 22 bp, Artificial Sequence
  chemically synthesized
aagtaaaaagagaaaaccagag

SEQ ID NO: 644129 - DNA, 22 bp, Artificial Sequence
  chemically synthesized
agtaaaaagagaaaaccagagt

SEQ ID NO: 644130 - DNA, 22 bp, Artificial Sequence
  chemically synthesized
acacagtgtcgtgcagtgttca

SEQ ID NO: 644131 - DNA, 22 bp, Artificial Sequence
  chemically synthesized
cacacagtgtcgtgcagtgttc

SEQ ID NO: 644132 - DNA, 22 bp, Artificial Sequence
  chemically synthesized
cttcacacagtgtcgtgcagtg

SEQ ID NO: 644133 - DNA, 22 bp, Artificial Sequence
  chemically synthesized
gggttacttcacacagtgtcgt

SEQ ID NO: 644134 - DNA, 22 bp, Artificial Sequence
  chemically synthesized
ttggggttacttcacacagtgt

SEQ ID NO: 644135 - DNA, 22 bp, Artificial Sequence
  chemically synthesized
tggttgttggggttacttcaca

SEQ ID NO: 644136 - DNA, 22 bp, Artificial Sequence
  chemically synthesized
atggttgttggggttacttcac

SEQ ID NO: 644137 - DNA, 22 bp, Artificial Sequence
  chemically synthesized
cacgacactgtgtgaagtaacc

SEQ ID NO: 644138 - DNA, 22 bp, Artificial Sequence
  chemically synthesized
tgtgaagtaaccccaacaacca

SEQ ID NO: 644139 - DNA, 22 bp, Artificial Sequence
  chemically synthesized
caaacatatttatggttgttgg

SEQ ID NO: 644140 - DNA, 22 bp, Artificial Sequence
  chemically synthesized
gcaaacatatttatggttgttg

SEQ ID NO: 644141 - DNA, 22 bp, Artificial Sequence
  chemically synthesized
catatgcaaatatttgcaaaca

SEQ ID NO: 644142 - DNA, 22 bp, Artificial Sequence
  chemically synthesized
tacatatgcaaatatttgcaaa

SEQ ID NO: 644143 - DNA, 22 bp, Artificial Sequence
  chemically synthesized
tctacatatgcaaatatttgca

SEQ ID NO: 644144 - DNA, 22 bp, Artificial Sequence
  chemically synthesized
caaacatgctctctacatatgc

SEQ ID NO: 644145 - DNA, 22 bp, Artificial Sequence
  chemically synthesized
ccaaacatgctctctacatatg

SEQ ID NO: 644146 - DNA, 22 bp, Artificial Sequence
  chemically synthesized
gcaaatatttgcatatgtagag

SEQ ID NO: 644147 - DNA, 22 bp, Artificial Sequence
  chemically synthesized
caaatatttgcatatgtagaga

SEQ ID NO: 644148 - DNA, 22 bp, Artificial Sequence
  chemically synthesized
cttccaaacatgctctctacat

SEQ ID NO: 644149 - DNA, 22 bp, Artificial Sequence
  chemically synthesized
ccttccaaacatgctctctaca

SEQ ID NO: 644150 - DNA, 22 bp, Artificial Sequence
  chemically synthesized
tgtttccttccaaacatgctct

SEQ ID NO: 644151 - DNA, 22 bp, Artificial Sequence
  chemically synthesized
gtgtttccttccaaacatgctc

SEQ ID NO: 644152 - DNA, 22 bp, Artificial Sequence
  chemically synthesized
gcatatgtagagagcatgtttg

SEQ ID NO: 644153 - DNA, 22 bp, Artificial Sequence
  chemically synthesized
catatgtagagagcatgtttgg

SEQ ID NO: 644154 - DNA, 22 bp, Artificial Sequence
  chemically synthesized
ttgtgtttccttccaaacatgc

SEQ ID NO: 644155 - DNA, 22 bp, Artificial Sequence
  chemically synthesized
cttgtgtttccttccaaacatg

SEQ ID NO: 644156 - DNA, 22 bp, Artificial Sequence
  chemically synthesized
gtttcttgtgtttccttccaaa

SEQ ID NO: 644157 - DNA, 22 bp, Artificial Sequence
  chemically synthesized
ggtttcttgtgtttccttccaa

SEQ ID NO: 644158 - DNA, 22 bp, Artificial Sequence
  chemically synthesized
ttggtttcttgtgtttccttcc

SEQ ID NO: 644159 - DNA, 22 bp, Artificial Sequence
  chemically synthesized
cttggtttcttgtgtttccttc

SEQ ID NO: 644160 - DNA, 22 bp, Artificial Sequence
  chemically synthesized
tcttggtttcttgtgtttcctt

SEQ ID NO: 644161 - DNA, 22 bp, Artificial Sequence
  chemically synthesized
ccatctttcttggtttcttgtg

SEQ ID NO: 644162 - DNA, 22 bp, Artificial Sequence
  chemically synthesized
ggaaggaaacacaagaaaccaa

SEQ ID NO: 644163 - DNA, 22 bp, Artificial Sequence
  chemically synthesized
gaaggaaacacaagaaaccaag

SEQ ID NO: 644164 - DNA, 22 bp, Artificial Sequence
  chemically synthesized
gaggctgccatctttcttggtt

SEQ ID NO: 644165 - DNA, 22 bp, Artificial Sequence
  chemically synthesized
tggaggctgccatctttcttgg

SEQ ID NO: 644166 - DNA, 22 bp, Artificial Sequence
  chemically synthesized
cagctctggaggctgccatctt

SEQ ID NO: 644167 - DNA, 22 bp, Artificial Sequence
  chemically synthesized
ccagctctggaggctgccatct

SEQ ID NO: 644168 - DNA, 22 bp, Artificial Sequence
  chemically synthesized
tggtgtttccagctctggaggc

SEQ ID NO: 644169 - DNA, 22 bp, Artificial Sequence
  chemically synthesized
gctgtggtgtttccagctctgg

SEQ ID NO: 644170 - DNA, 22 bp, Artificial Sequence
  chemically synthesized
ccctggctgtggtgtttccagc

SEQ ID NO: 644171 - DNA, 22 bp, Artificial Sequence
  chemically synthesized
tcccctggctgtggtgtttcca

SEQ ID NO: 644172 - DNA, 22 bp, Artificial Sequence
  chemically synthesized
ctcccctggctgtggtgtttcc

SEQ ID NO: 644173 - DNA, 22 bp, Artificial Sequence
  chemically synthesized
cagagctggaaacaccacagcc

SEQ ID NO: 644174 - DNA, 22 bp, Artificial Sequence
  chemically synthesized
caaccttctcccctggctgtgg

SEQ ID NO: 644175 - DNA, 22 bp, Artificial Sequence
  chemically synthesized
tccaaccttctcccctggctgt

SEQ ID NO: 644176 - DNA, 22 bp, Artificial Sequence
  chemically synthesized
ctccaaccttctcccctggctg

SEQ ID NO: 644177 - DNA, 22 bp, Artificial Sequence
  chemically synthesized
gaaacaccacagccaggggaga

SEQ ID NO: 644178 - DNA, 22 bp, Artificial Sequence
  chemically synthesized
aaaaagacatatagagaaaagt

SEQ ID NO: 644179 - DNA, 22 bp, Artificial Sequence
  chemically synthesized
gagaaggattcacttttctcta

SEQ ID NO: 644180 - DNA, 22 bp, Artificial Sequence
  chemically synthesized
acttttctctatatgtcttttt

SEQ ID NO: 644181 - DNA, 22 bp, Artificial Sequence
  chemically synthesized
ttctctatatgtctttttgaac

SEQ ID NO: 644182 - DNA, 22 bp, Artificial Sequence
  chemically synthesized
tctctatatgtctttttgaacc

SEQ ID NO: 644183 - DNA, 22 bp, Artificial Sequence
  chemically synthesized
ctctatatgtctttttgaaccc

SEQ ID NO: 644184 - DNA, 22 bp, Artificial Sequence
  chemically synthesized
tctatatgtctttttgaaccct

SEQ ID NO: 644185 - DNA, 22 bp, Artificial Sequence
  chemically synthesized
tacaaaatccaaagggttcaaa

SEQ ID NO: 644186 - DNA, 22 bp, Artificial Sequence
  chemically synthesized
tatatgtctttttgaacccttt

SEQ ID NO: 644187 - DNA, 22 bp, Artificial Sequence
  chemically synthesized
ttatacaaaatccaaagggttc

SEQ ID NO: 644188 - DNA, 22 bp, Artificial Sequence
  chemically synthesized
tatgtctttttgaaccctttgg

SEQ ID NO: 644189 - DNA, 22 bp, Artificial Sequence
  chemically synthesized
tttgaaccctttggattttgta

SEQ ID NO: 644190 - DNA, 22 bp, Artificial Sequence
  chemically synthesized
ttgaaccctttggattttgtat

SEQ ID NO: 644191 - DNA, 22 bp, Artificial Sequence
  chemically synthesized
tgaaccctttggattttgtata

SEQ ID NO: 644192 - DNA, 22 bp, Artificial Sequence
  chemically synthesized
gaaccctttggattttgtataa

SEQ ID NO: 644193 - DNA, 22 bp, Artificial Sequence
  chemically synthesized
aaccctttggattttgtataat

SEQ ID NO: 644194 - DNA, 22 bp, Artificial Sequence
  chemically synthesized
tggattttgtataataatatac

SEQ ID NO: 644195 - DNA, 22 bp, Artificial Sequence
  chemically synthesized
ggattttgtataataatataca

SEQ ID NO: 644196 - DNA, 22 bp, Artificial Sequence
  chemically synthesized
gtagagaatacatgtatattat

SEQ ID NO: 644197 - DNA, 22 bp, Artificial Sequence
  chemically synthesized
gattttgtataataatatacat

SEQ ID NO: 644198 - DNA, 22 bp, Artificial Sequence
  chemically synthesized
agtagagaatacatgtatatta

SEQ ID NO: 644199 - DNA, 22 bp, Artificial Sequence
  chemically synthesized
tagtagagaatacatgtatatt

SEQ ID NO: 644200 - DNA, 22 bp, Artificial Sequence
  chemically synthesized
ttagtagagaatacatgtatat

SEQ ID NO: 644201 - DNA, 22 bp, Artificial Sequence
  chemically synthesized
tgtataataatatacatgtatt

SEQ ID NO: 644202 - DNA, 22 bp, Artificial Sequence
  chemically synthesized
tttttagtagagaatacatgta

SEQ ID NO: 644203 - DNA, 22 bp, Artificial Sequence
  chemically synthesized
gtataataatatacatgtattc

SEQ ID NO: 644204 - DNA, 22 bp, Artificial Sequence
  chemically synthesized
atttttagtagagaatacatgt

SEQ ID NO: 644205 - DNA, 22 bp, Artificial Sequence
  chemically synthesized
tataataatatacatgtattct

SEQ ID NO: 644206 - DNA, 22 bp, Artificial Sequence
  chemically synthesized
tatttttagtagagaatacatg

SEQ ID NO: 644207 - DNA, 22 bp, Artificial Sequence
  chemically synthesized
ttatttttagtagagaatacat

SEQ ID NO: 644208 - DNA, 22 bp, Artificial Sequence
  chemically synthesized
cttttatttttagtagagaata

SEQ ID NO: 644209 - DNA, 22 bp, Artificial Sequence
  chemically synthesized
attacttttatttttagtagag

SEQ ID NO: 644210 - DNA, 22 bp, Artificial Sequence
  chemically synthesized
aattacttttatttttagtaga

SEQ ID NO: 644211 - DNA, 22 bp, Artificial Sequence
  chemically synthesized
tctactaaaaataaaagtaatt

SEQ ID NO: 644212 - DNA, 22 bp, Artificial Sequence
  chemically synthesized
aagtgtgtatttaattactttt

SEQ ID NO: 644213 - DNA, 22 bp, Artificial Sequence
  chemically synthesized
tactaaaaataaaagtaattaa

SEQ ID NO: 644214 - DNA, 22 bp, Artificial Sequence
  chemically synthesized
ctaaaaataaaagtaattaaat

SEQ ID NO: 644215 - DNA, 22 bp, Artificial Sequence
  chemically synthesized
aaaataaaagtaattaaataca

SEQ ID NO: 644216 - DNA, 22 bp, Artificial Sequence
  chemically synthesized
cggaagatgtgaacattaaagt

SEQ ID NO: 644217 - DNA, 22 bp, Artificial Sequence
  chemically synthesized
aatacacactttaatgttcaca

SEQ ID NO: 644218 - DNA, 22 bp, Artificial Sequence
  chemically synthesized
gtagaactccggaagatgtgaa

SEQ ID NO: 644219 - DNA, 22 bp, Artificial Sequence
  chemically synthesized
ggtagaactccggaagatgtga

SEQ ID NO: 644220 - DNA, 22 bp, Artificial Sequence
  chemically synthesized
gatttggtagaactccggaaga

SEQ ID NO: 644221 - DNA, 22 bp, Artificial Sequence
  chemically synthesized
taatgttcacatcttccggagt

SEQ ID NO: 644222 - DNA, 22 bp, Artificial Sequence
  chemically synthesized
aatgttcacatcttccggagtt

SEQ ID NO: 644223 - DNA, 22 bp, Artificial Sequence
  chemically synthesized
atgttcacatcttccggagttc

SEQ ID NO: 644224 - DNA, 22 bp, Artificial Sequence
  chemically synthesized
acatcttccggagttctaccaa

SEQ ID NO: 644225 - DNA, 22 bp, Artificial Sequence
  chemically synthesized
ccggagttctaccaaatccagt

SEQ ID NO: 644226 - DNA, 22 bp, Artificial Sequence
  chemically synthesized
cggagttctaccaaatccagtg

SEQ ID NO: 644227 - DNA, 22 bp, Artificial Sequence
  chemically synthesized
taccaaatccagtgttctcctt

SEQ ID NO: 644228 - DNA, 22 bp, Artificial Sequence
  chemically synthesized
ccaaatccagtgttctccttct

SEQ ID NO: 644229 - DNA, 22 bp, Artificial Sequence
  chemically synthesized
tatatcccgggagcatgtagca

SEQ ID NO: 644230 - DNA, 22 bp, Artificial Sequence
  chemically synthesized
atatatcccgggagcatgtagc

SEQ ID NO: 644231 - DNA, 22 bp, Artificial Sequence
  chemically synthesized
tccttctgctacatgctcccgg

SEQ ID NO: 644232 - DNA, 22 bp, Artificial Sequence
  chemically synthesized
cttctgctacatgctcccggga

SEQ ID NO: 644233 - DNA, 22 bp, Artificial Sequence
  chemically synthesized
ctgctacatgctcccgggatat

SEQ ID NO: 644234 - DNA, 22 bp, Artificial Sequence
  chemically synthesized
tgctacatgctcccgggatata

SEQ ID NO: 644235 - DNA, 22 bp, Artificial Sequence
  chemically synthesized
ctacatgctcccgggatatata

SEQ ID NO: 644236 - DNA, 22 bp, Artificial Sequence
  chemically synthesized
catgctcccgggatatataaat

SEQ ID NO: 644237 - DNA, 22 bp, Artificial Sequence
  chemically synthesized
aaaccgtgagaatgaatttata

SEQ ID NO: 644238 - DNA, 22 bp, Artificial Sequence
  chemically synthesized
ccgggatatataaattcattct

SEQ ID NO: 644239 - DNA, 22 bp, Artificial Sequence
  chemically synthesized
acaggtggtagttgaaaccgtg

SEQ ID NO: 644240 - DNA, 22 bp, Artificial Sequence
  chemically synthesized
attctcacggtttcaactacca

SEQ ID NO: 644241 - DNA, 22 bp, Artificial Sequence
  chemically synthesized
tcacggtttcaactaccacctg

SEQ ID NO: 644242 - DNA, 22 bp, Artificial Sequence
  chemically synthesized
acggtttcaactaccacctgtg

SEQ ID NO: 644243 - DNA, 22 bp, Artificial Sequence
  chemically synthesized
tgagtcgccagctcacaggtgg

SEQ ID NO: 644244 - DNA, 22 bp, Artificial Sequence
  chemically synthesized
caactaccacctgtgagctggc

SEQ ID NO: 644245 - DNA, 22 bp, Artificial Sequence
  chemically synthesized
ggactgtgagtcgccagctcac

SEQ ID NO: 644246 - DNA, 22 bp, Artificial Sequence
  chemically synthesized
aactaccacctgtgagctggcg

SEQ ID NO: 644247 - DNA, 22 bp, Artificial Sequence
  chemically synthesized
ccacctgtgagctggcgactca

SEQ ID NO: 644248 - DNA, 22 bp, Artificial Sequence
  chemically synthesized
agatattaggactgtgagtcgc

SEQ ID NO: 644249 - DNA, 22 bp, Artificial Sequence
  chemically synthesized
tgagctggcgactcacagtcct

SEQ ID NO: 644250 - DNA, 22 bp, Artificial Sequence
  chemically synthesized
gcgactcacagtcctaatatct

SEQ ID NO: 644251 - DNA, 22 bp, Artificial Sequence
  chemically synthesized
acagtcctaatatctcaggctt

SEQ ID NO: 644252 - DNA, 22 bp, Artificial Sequence
  chemically synthesized
tagaaaggatataagcctgaga

SEQ ID NO: 644253 - DNA, 22 bp, Artificial Sequence
  chemically synthesized
gtagaaaggatataagcctgag

SEQ ID NO: 644254 - DNA, 22 bp, Artificial Sequence
  chemically synthesized
atgcttgtagaaaggatataag

SEQ ID NO: 644255 - DNA, 22 bp, Artificial Sequence
  chemically synthesized
atatctcaggcttatatccttt

SEQ ID NO: 644256 - DNA, 22 bp, Artificial Sequence
  chemically synthesized
tgatgcttgtagaaaggatata

SEQ ID NO: 644257 - DNA, 22 bp, Artificial Sequence
  chemically synthesized
aggcttatatcctttctacaag

SEQ ID NO: 644258 - DNA, 22 bp, Artificial Sequence
  chemically synthesized
atatcctttctacaagcatcag

SEQ ID NO: 644259 - DNA, 22 bp, Artificial Sequence
  chemically synthesized
agagatagaactctgatgcttg

SEQ ID NO: 644260 - DNA, 22 bp, Artificial Sequence
  chemically synthesized
tatcctttctacaagcatcaga

SEQ ID NO: 644261 - DNA, 22 bp, Artificial Sequence
  chemically synthesized
tctacaagcatcagagttctat

SEQ ID NO: 644262 - DNA, 22 bp, Artificial Sequence
  chemically synthesized
acagtctgagagatagaactct

SEQ ID NO: 644263 - DNA, 22 bp, Artificial Sequence
  chemically synthesized
ctacaagcatcagagttctatc

SEQ ID NO: 644264 - DNA, 22 bp, Artificial Sequence
  chemically synthesized
tacaagcatcagagttctatct

SEQ ID NO: 644265 - DNA, 22 bp, Artificial Sequence
  chemically synthesized
caagcatcagagttctatctct

SEQ ID NO: 644266 - DNA, 22 bp, Artificial Sequence
  chemically synthesized
catgtgtaaatgtctgacagtc

SEQ ID NO: 644267 - DNA, 22 bp, Artificial Sequence
  chemically synthesized
tatctctcagactgtcagacat

SEQ ID NO: 644268 - DNA, 22 bp, Artificial Sequence
  chemically synthesized
tctctcagactgtcagacattt

SEQ ID NO: 644269 - DNA, 22 bp, Artificial Sequence
  chemically synthesized
tcagactgtcagacatttacac

SEQ ID NO: 644270 - DNA, 22 bp, Artificial Sequence
  chemically synthesized
gtgacatctccatgtgtaaatg

SEQ ID NO: 644271 - DNA, 22 bp, Artificial Sequence
  chemically synthesized
agactgtcagacatttacacat

SEQ ID NO: 644272 - DNA, 22 bp, Artificial Sequence
  chemically synthesized
tcagacatttacacatggagat

SEQ ID NO: 644273 - DNA, 22 bp, Artificial Sequence
  chemically synthesized
aggtcctggtgacatctccatg

SEQ ID NO: 644274 - DNA, 22 bp, Artificial Sequence
  chemically synthesized
acacatggagatgtcaccagga

SEQ ID NO: 644275 - DNA, 22 bp, Artificial Sequence
  chemically synthesized
cacatggagatgtcaccaggac

SEQ ID NO: 644276 - DNA, 22 bp, Artificial Sequence
  chemically synthesized
aactcgacctcttccatacctc

SEQ ID NO: 644277 - DNA, 22 bp, Artificial Sequence
  chemically synthesized
gaaggtgataaatgaggtatgg

SEQ ID NO: 644278 - DNA, 22 bp, Artificial Sequence
  chemically synthesized
gacctcttccatacctcattta

SEQ ID NO: 644279 - DNA, 22 bp, Artificial Sequence
  chemically synthesized
agtagctggaaggtgataaatg

SEQ ID NO: 644280 - DNA, 22 bp, Artificial Sequence
  chemically synthesized
ttccatacctcatttatcacct

SEQ ID NO: 644281 - DNA, 22 bp, Artificial Sequence
  chemically synthesized
ccatacctcatttatcaccttc

SEQ ID NO: 644282 - DNA, 22 bp, Artificial Sequence
  chemically synthesized
catacctcatttatcaccttcc

SEQ ID NO: 644283 - DNA, 22 bp, Artificial Sequence
  chemically synthesized
aagggctgagtagctggaaggt

SEQ ID NO: 644284 - DNA, 22 bp, Artificial Sequence
  chemically synthesized
ctgaagggctgagtagctggaa

SEQ ID NO: 644285 - DNA, 22 bp, Artificial Sequence
  chemically synthesized
cctgaagggctgagtagctgga

SEQ ID NO: 644286 - DNA, 22 bp, Artificial Sequence
  chemically synthesized
atttatcaccttccagctactc

SEQ ID NO: 644287 - DNA, 22 bp, Artificial Sequence
  chemically synthesized
atcaccttccagctactcagcc

SEQ ID NO: 644288 - DNA, 22 bp, Artificial Sequence
  chemically synthesized
tcaccttccagctactcagccc

SEQ ID NO: 644289 - DNA, 22 bp, Artificial Sequence
  chemically synthesized
gaggtccttcctgaagggctga

SEQ ID NO: 644290 - DNA, 22 bp, Artificial Sequence
  chemically synthesized
ttagaggtccttcctgaagggc

SEQ ID NO: 644291 - DNA, 22 bp, Artificial Sequence
  chemically synthesized
ccagctactcagcccttcagga

SEQ ID NO: 644292 - DNA, 22 bp, Artificial Sequence
  chemically synthesized
attagaggtccttcctgaaggg

SEQ ID NO: 644293 - DNA, 22 bp, Artificial Sequence
  chemically synthesized
cagctactcagcccttcaggaa

SEQ ID NO: 644294 - DNA, 22 bp, Artificial Sequence
  chemically synthesized
ctcagcccttcaggaaggacct

SEQ ID NO: 644295 - DNA, 22 bp, Artificial Sequence
  chemically synthesized
agcccttcaggaaggacctcta

SEQ ID NO: 644296 - DNA, 22 bp, Artificial Sequence
  chemically synthesized
atgcagcagtgtttattagagg

SEQ ID NO: 644297 - DNA, 22 bp, Artificial Sequence
  chemically synthesized
aatgcagcagtgtttattagag

SEQ ID NO: 644298 - DNA, 22 bp, Artificial Sequence
  chemically synthesized
taatgcagcagtgtttattaga

SEQ ID NO: 644299 - DNA, 22 bp, Artificial Sequence
  chemically synthesized
caggaaggacctctaataaaca

SEQ ID NO: 644300 - DNA, 22 bp, Artificial Sequence
  chemically synthesized
aggaaggacctctaataaacac

SEQ ID NO: 644301 - DNA, 22 bp, Artificial Sequence
  chemically synthesized
taataaacactgctgcattaaa

SEQ ID NO: 644302 - DNA, 22 bp, Artificial Sequence
  chemically synthesized
ataaacactgctgcattaaagg

SEQ ID NO: 644303 - DNA, 22 bp, Artificial Sequence
  chemically synthesized
cagcaggtccatcctttaatgc

SEQ ID NO: 644304 - DNA, 22 bp, Artificial Sequence
  chemically synthesized
ctgcattaaaggatggacctgc

SEQ ID NO: 644305 - DNA, 22 bp, Artificial Sequence
  chemically synthesized
aggaggagttgcagcaggtcca

SEQ ID NO: 644306 - DNA, 22 bp, Artificial Sequence
  chemically synthesized
cattaaaggatggacctgctgc

SEQ ID NO: 644307 - DNA, 22 bp, Artificial Sequence
  chemically synthesized
aaggatggacctgctgcaactc

SEQ ID NO: 644308 - DNA, 22 bp, Artificial Sequence
  chemically synthesized
ataattcaggaggagttgcagc

SEQ ID NO: 644309 - DNA, 22 bp, Artificial Sequence
  chemically synthesized
ggactgataattcaggaggagt

SEQ ID NO: 644310 - DNA, 22 bp, Artificial Sequence
  chemically synthesized
cagctgggactgataattcagg

SEQ ID NO: 644311 - DNA, 22 bp, Artificial Sequence
  chemically synthesized
ctgcaactcctcctgaattatc

SEQ ID NO: 644312 - DNA, 22 bp, Artificial Sequence
  chemically synthesized
gcagctgggactgataattcag

SEQ ID NO: 644313 - DNA, 22 bp, Artificial Sequence
  chemically synthesized
caactcctcctgaattatcagt

SEQ ID NO: 644314 - DNA, 22 bp, Artificial Sequence
  chemically synthesized
tttgcagctgggactgataatt

SEQ ID NO: 644315 - DNA, 22 bp, Artificial Sequence
  chemically synthesized
ctcctgaattatcagtcccagc

SEQ ID NO: 644316 - DNA, 22 bp, Artificial Sequence
  chemically synthesized
ctgaattatcagtcccagctgc

SEQ ID NO: 644317 - DNA, 22 bp, Artificial Sequence
  chemically synthesized
aattatcagtcccagctgcaaa

SEQ ID NO: 644318 - DNA, 22 bp, Artificial Sequence
  chemically synthesized
tcagtcccagctgcaaataact

SEQ ID NO: 644319 - DNA, 22 bp, Artificial Sequence
  chemically synthesized
caaaacaagatgatagtagtta

SEQ ID NO: 644320 - DNA, 22 bp, Artificial Sequence
  chemically synthesized
gtaactacaaaacaagatgata

SEQ ID NO: 644321 - DNA, 22 bp, Artificial Sequence
  chemically synthesized
caaataactactatcatcttgt

SEQ ID NO: 644322 - DNA, 22 bp, Artificial Sequence
  chemically synthesized
ccagggctggtaactacaaaac

SEQ ID NO: 644323 - DNA, 22 bp, Artificial Sequence
  chemically synthesized
ctatcatcttgttttgtagtta

SEQ ID NO: 644324 - DNA, 22 bp, Artificial Sequence
  chemically synthesized
tcatcttgttttgtagttacca

SEQ ID NO: 644325 - DNA, 22 bp, Artificial Sequence
  chemically synthesized
gttttgtagttaccagccctgg

SEQ ID NO: 644326 - DNA, 22 bp, Artificial Sequence
  chemically synthesized
ttttgtagttaccagccctggg

SEQ ID NO: 644327 - DNA, 22 bp, Artificial Sequence
  chemically synthesized
tgtagttaccagccctgggaat

SEQ ID NO: 644328 - DNA, 22 bp, Artificial Sequence
  chemically synthesized
gtagttaccagccctgggaatc

SEQ ID NO: 644329 - DNA, 22 bp, Artificial Sequence
  chemically synthesized
tagttaccagccctgggaatca

SEQ ID NO: 644330 - DNA, 22 bp, Artificial Sequence
  chemically synthesized
gggtatgaaggaatgattccca

SEQ ID NO: 644331 - DNA, 22 bp, Artificial Sequence
  chemically synthesized
ccagccctgggaatcattcctt

SEQ ID NO: 644332 - DNA, 22 bp, Artificial Sequence
  chemically synthesized
tgggactagggtatgaaggaat

SEQ ID NO: 644333 - DNA, 22 bp, Artificial Sequence
  chemically synthesized
tgtgggactagggtatgaagga

SEQ ID NO: 644334 - DNA, 22 bp, Artificial Sequence
  chemically synthesized
ggaatcattccttcatacccta

SEQ ID NO: 644335 - DNA, 22 bp, Artificial Sequence
  chemically synthesized
ggtagttctgtgggactagggt

SEQ ID NO: 644336 - DNA, 22 bp, Artificial Sequence
  chemically synthesized
attcggtagttctgtgggacta

SEQ ID NO: 644337 - DNA, 22 bp, Artificial Sequence
  chemically synthesized
gattcggtagttctgtgggact

SEQ ID NO: 644338 - DNA, 22 bp, Artificial Sequence
  chemically synthesized
cttcataccctagtcccacaga

SEQ ID NO: 644339 - DNA, 22 bp, Artificial Sequence
  chemically synthesized
tttgattcggtagttctgtggg

SEQ ID NO: 644340 - DNA, 22 bp, Artificial Sequence
  chemically synthesized
cataccctagtcccacagaact

SEQ ID NO: 644341 - DNA, 22 bp, Artificial Sequence
  chemically synthesized
ataccctagtcccacagaacta

SEQ ID NO: 644342 - DNA, 22 bp, Artificial Sequence
  chemically synthesized
gtcccacagaactaccgaatca

SEQ ID NO: 644343 - DNA, 22 bp, Artificial Sequence
  chemically synthesized
gggggaggatagagctgtttga

SEQ ID NO: 644344 - DNA, 22 bp, Artificial Sequence
  chemically synthesized
cgggggaggatagagctgtttg

SEQ ID NO: 644345 - DNA, 22 bp, Artificial Sequence
  chemically synthesized
ccgaatcaaacagctctatcct

SEQ ID NO: 644346 - DNA, 22 bp, Artificial Sequence
  chemically synthesized
agtgatatttcgggggaggata

SEQ ID NO: 644347 - DNA, 22 bp, Artificial Sequence
  chemically synthesized
atctgagtgatatttcggggga

SEQ ID NO: 644348 - DNA, 22 bp, Artificial Sequence
  chemically synthesized
tatcctcccccgaaatatcact

SEQ ID NO: 644349 - DNA, 22 bp, Artificial Sequence
  chemically synthesized
tcctcccccgaaatatcactca

SEQ ID NO: 644350 - DNA, 22 bp, Artificial Sequence
  chemically synthesized
ccccgaaatatcactcagatca

SEQ ID NO: 644351 - DNA, 22 bp, Artificial Sequence
  chemically synthesized
agatcagcctgtctacttcatt

SEQ ID NO: 644352 - DNA, 22 bp, Artificial Sequence
  chemically synthesized
agtaaggtgatagaaatgaagt

SEQ ID NO: 644353 - DNA, 22 bp, Artificial Sequence
  chemically synthesized
aagtaaggtgatagaaatgaag

SEQ ID NO: 644354 - DNA, 22 bp, Artificial Sequence
  chemically synthesized
gagccttaagtaaggtgataga

SEQ ID NO: 644355 - DNA, 22 bp, Artificial Sequence
  chemically synthesized
tctacttcatttctatcacctt

SEQ ID NO: 644356 - DNA, 22 bp, Artificial Sequence
  chemically synthesized
cttcatttctatcaccttactt

SEQ ID NO: 644357 - DNA, 22 bp, Artificial Sequence
  chemically synthesized
catttctatcaccttacttaag

SEQ ID NO: 644358 - DNA, 22 bp, Artificial Sequence
  chemically synthesized
atttctatcaccttacttaagg

SEQ ID NO: 644359 - DNA, 22 bp, Artificial Sequence
  chemically synthesized
ctatcaccttacttaaggctct

SEQ ID NO: 644360 - DNA, 22 bp, Artificial Sequence
  chemically synthesized
tatcaccttacttaaggctcta

SEQ ID NO: 644361 - DNA, 22 bp, Artificial Sequence
  chemically synthesized
tcaccttacttaaggctctaat

SEQ ID NO: 644362 - DNA, 22 bp, Artificial Sequence
  chemically synthesized
acttaaggctctaatcatctct

SEQ ID NO: 644363 - DNA, 22 bp, Artificial Sequence
  chemically synthesized
cttaaggctctaatcatctctt

SEQ ID NO: 644364 - DNA, 22 bp, Artificial Sequence
  chemically synthesized
aaggctctaatcatctctttcc

SEQ ID NO: 644365 - DNA, 22 bp, Artificial Sequence
  chemically synthesized
aggctctaatcatctctttcct

SEQ ID NO: 644366 - DNA, 22 bp, Artificial Sequence
  chemically synthesized
taatcatctctttcctgggctc

SEQ ID NO: 644367 - DNA, 22 bp, Artificial Sequence
  chemically synthesized
atcatctctttcctgggctccc

SEQ ID NO: 644368 - DNA, 22 bp, Artificial Sequence
  chemically synthesized
gggggagtcacatgggagccca

SEQ ID NO: 644369 - DNA, 22 bp, Artificial Sequence
  chemically synthesized
tttcctgggctcccatgtgact

SEQ ID NO: 644370 - DNA, 22 bp, Artificial Sequence
  chemically synthesized
tcctgggctcccatgtgactcc

SEQ ID NO: 644371 - DNA, 22 bp, Artificial Sequence
  chemically synthesized
cctgggctcccatgtgactccc

SEQ ID NO: 644372 - DNA, 22 bp, Artificial Sequence
  chemically synthesized
ctgggctcccatgtgactcccc

SEQ ID NO: 644373 - DNA, 22 bp, Artificial Sequence
  chemically synthesized
ggctcccatgtgactcccccca

SEQ ID NO: 644374 - DNA, 22 bp, Artificial Sequence
  chemically synthesized
ccatgtgactccccccagcttg

SEQ ID NO: 644375 - DNA, 22 bp, Artificial Sequence
  chemically synthesized
gaacgaggaaatcaagctgggg

SEQ ID NO: 644376 - DNA, 22 bp, Artificial Sequence
  chemically synthesized
cccccagcttgatttcctcgtt

SEQ ID NO: 644377 - DNA, 22 bp, Artificial Sequence
  chemically synthesized
aaaagagcgatgctggaacgag

SEQ ID NO: 644378 - DNA, 22 bp, Artificial Sequence
  chemically synthesized
gaaaagagcgatgctggaacga

SEQ ID NO: 644379 - DNA, 22 bp, Artificial Sequence
  chemically synthesized
tgaaaagagcgatgctggaacg

SEQ ID NO: 644380 - DNA, 22 bp, Artificial Sequence
  chemically synthesized
gatttcctcgttccagcatcgc

SEQ ID NO: 644381 - DNA, 22 bp, Artificial Sequence
  chemically synthesized
atttcctcgttccagcatcgct

SEQ ID NO: 644382 - DNA, 22 bp, Artificial Sequence
  chemically synthesized
cctcgttccagcatcgctcttt

SEQ ID NO: 644383 - DNA, 22 bp, Artificial Sequence
  chemically synthesized
ctcgttccagcatcgctctttt

SEQ ID NO: 644384 - DNA, 22 bp, Artificial Sequence
  chemically synthesized
gttccagcatcgctcttttcaa

SEQ ID NO: 644385 - DNA, 22 bp, Artificial Sequence
  chemically synthesized
tgcggagggtaactttgaaaag

SEQ ID NO: 644386 - DNA, 22 bp, Artificial Sequence
  chemically synthesized
cagcatcgctcttttcaaagtt

SEQ ID NO: 644387 - DNA, 22 bp, Artificial Sequence
  chemically synthesized
ttttcaaagttaccctccgcac

SEQ ID NO: 644388 - DNA, 22 bp, Artificial Sequence
  chemically synthesized
ttcaaagttaccctccgcacag

SEQ ID NO: 644389 - DNA, 22 bp, Artificial Sequence
  chemically synthesized
tcaaagttaccctccgcacagc

SEQ ID NO: 644390 - DNA, 22 bp, Artificial Sequence
  chemically synthesized
caaagttaccctccgcacagct

SEQ ID NO: 644391 - DNA, 22 bp, Artificial Sequence
  chemically synthesized
aaagttaccctccgcacagctg

SEQ ID NO: 644392 - DNA, 22 bp, Artificial Sequence
  chemically synthesized
ccctccgcacagctgcctgtgt

SEQ ID NO: 644393 - DNA, 22 bp, Artificial Sequence
  chemically synthesized
acatgaatatacgccacacagg

SEQ ID NO: 644394 - DNA, 22 bp, Artificial Sequence
  chemically synthesized
cgcacagctgcctgtgtggcgt

SEQ ID NO: 644395 - DNA, 22 bp, Artificial Sequence
  chemically synthesized
cctgtgtggcgtatattcatgt

SEQ ID NO: 644396 - DNA, 22 bp, Artificial Sequence
  chemically synthesized
tgtggcgtatattcatgtcaat

SEQ ID NO: 644397 - DNA, 22 bp, Artificial Sequence
  chemically synthesized
atgtcaatatcatggcctgact

SEQ ID NO: 644398 - DNA, 22 bp, Artificial Sequence
  chemically synthesized
aagggtgtgatccaggagtcag

SEQ ID NO: 644399 - DNA, 22 bp, Artificial Sequence
  chemically synthesized
gggagcaactcaagggtgtgat

SEQ ID NO: 644400 - DNA, 22 bp, Artificial Sequence
  chemically synthesized
actcctggatcacacccttgag

SEQ ID NO: 644401 - DNA, 22 bp, Artificial Sequence
  chemically synthesized
gtctagggagcaactcaagggt

SEQ ID NO: 644402 - DNA, 22 bp, Artificial Sequence
  chemically synthesized
ctggatcacacccttgagttgc

SEQ ID NO: 644403 - DNA, 22 bp, Artificial Sequence
  chemically synthesized
gatcacacccttgagttgctcc

SEQ ID NO: 644404 - DNA, 22 bp, Artificial Sequence
  chemically synthesized
cgtgcctagtctagggagcaac

SEQ ID NO: 644405 - DNA, 22 bp, Artificial Sequence
  chemically synthesized
cctccgtgcctagtctagggag

SEQ ID NO: 644406 - DNA, 22 bp, Artificial Sequence
  chemically synthesized
ctgcctccgtgcctagtctagg

SEQ ID NO: 644407 - DNA, 22 bp, Artificial Sequence
  chemically synthesized
gagttgctccctagactaggca

SEQ ID NO: 644408 - DNA, 22 bp, Artificial Sequence
  chemically synthesized
agttgctccctagactaggcac

SEQ ID NO: 644409 - DNA, 22 bp, Artificial Sequence
  chemically synthesized
cagagttgctgcctccgtgcct

SEQ ID NO: 644410 - DNA, 22 bp, Artificial Sequence
  chemically synthesized
ctccctagactaggcacggagg

SEQ ID NO: 644411 - DNA, 22 bp, Artificial Sequence
  chemically synthesized
cctagactaggcacggaggcag

SEQ ID NO: 644412 - DNA, 22 bp, Artificial Sequence
  chemically synthesized
gactaggcacggaggcagcaac

SEQ ID NO: 644413 - DNA, 22 bp, Artificial Sequence
  chemically synthesized
ggcacggaggcagcaactctgc

SEQ ID NO: 644414 - DNA, 22 bp, Artificial Sequence
  chemically synthesized
tgcagtgggtaccacacccttc

SEQ ID NO: 644415 - DNA, 22 bp, Artificial Sequence
  chemically synthesized
cagtgggtaccacacccttccc

SEQ ID NO: 644416 - DNA, 22 bp, Artificial Sequence
  chemically synthesized
accaggtcagcaagggcaggtc

SEQ ID NO: 644417 - DNA, 22 bp, Artificial Sequence
  chemically synthesized
cccgacctgcccttgctgacct

SEQ ID NO: 644418 - DNA, 22 bp, Artificial Sequence
  chemically synthesized
ccgacctgcccttgctgacctg

SEQ ID NO: 644419 - DNA, 22 bp, Artificial Sequence
  chemically synthesized
cccttgctgacctggtcagcct

SEQ ID NO: 644420 - DNA, 22 bp, Artificial Sequence
  chemically synthesized
gctgacctggtcagcctcatct

SEQ ID NO: 644421 - DNA, 22 bp, Artificial Sequence
  chemically synthesized
ctgacctggtcagcctcatctc

SEQ ID NO: 644422 - DNA, 22 bp, Artificial Sequence
  chemically synthesized
acctggtcagcctcatctcctc

SEQ ID NO: 644423 - DNA, 22 bp, Artificial Sequence
  chemically synthesized
agaaggcaaagaatgagaggag

SEQ ID NO: 644424 - DNA, 22 bp, Artificial Sequence
  chemically synthesized
gtcagcctcatctcctctcatt

SEQ ID NO: 644425 - DNA, 22 bp, Artificial Sequence
  chemically synthesized
aagaaggcaaagaatgagagga

SEQ ID NO: 644426 - DNA, 22 bp, Artificial Sequence
  chemically synthesized
taagaaggcaaagaatgagagg

SEQ ID NO: 644427 - DNA, 22 bp, Artificial Sequence
  chemically synthesized
ttaagaaggcaaagaatgagag

SEQ ID NO: 644428 - DNA, 22 bp, Artificial Sequence
  chemically synthesized
tttaagaaggcaaagaatgaga

SEQ ID NO: 644429 - DNA, 22 bp, Artificial Sequence
  chemically synthesized
ttttaagaaggcaaagaatgag

SEQ ID NO: 644430 - DNA, 22 bp, Artificial Sequence
  chemically synthesized
ccttttttaagaaggcaaagaa

SEQ ID NO: 644431 - DNA, 22 bp, Artificial Sequence
  chemically synthesized
atctcctctcattctttgcctt

SEQ ID NO: 644432 - DNA, 22 bp, Artificial Sequence
  chemically synthesized
tattaccttttttaagaaggca

SEQ ID NO: 644433 - DNA, 22 bp, Artificial Sequence
  chemically synthesized
ctctcattctttgccttcttaa

SEQ ID NO: 644434 - DNA, 22 bp, Artificial Sequence
  chemically synthesized
tcattctttgccttcttaaaaa

SEQ ID NO: 644435 - DNA, 22 bp, Artificial Sequence
  chemically synthesized
attctttgccttcttaaaaaag

SEQ ID NO: 644436 - DNA, 22 bp, Artificial Sequence
  chemically synthesized
cagttgtattaccttttttaag

SEQ ID NO: 644437 - DNA, 22 bp, Artificial Sequence
  chemically synthesized
tttgccttcttaaaaaaggtaa

SEQ ID NO: 644438 - DNA, 22 bp, Artificial Sequence
  chemically synthesized
tgccttcttaaaaaaggtaata

SEQ ID NO: 644439 - DNA, 22 bp, Artificial Sequence
  chemically synthesized
gccttcttaaaaaaggtaatac

SEQ ID NO: 644440 - DNA, 22 bp, Artificial Sequence
  chemically synthesized
ccttcttaaaaaaggtaataca

SEQ ID NO: 644441 - DNA, 22 bp, Artificial Sequence
  chemically synthesized
agggaaactgcagttgtattac

SEQ ID NO: 644442 - DNA, 22 bp, Artificial Sequence
  chemically synthesized
gagggaaactgcagttgtatta

SEQ ID NO: 644443 - DNA, 22 bp, Artificial Sequence
  chemically synthesized
cttaaaaaaggtaatacaactg

SEQ ID NO: 644444 - DNA, 22 bp, Artificial Sequence
  chemically synthesized
ttaaaaaaggtaatacaactgc

SEQ ID NO: 644445 - DNA, 22 bp, Artificial Sequence
  chemically synthesized
tttgagggaaactgcagttgta

SEQ ID NO: 644446 - DNA, 22 bp, Artificial Sequence
  chemically synthesized
aaaaaaggtaatacaactgcag

SEQ ID NO: 644447 - DNA, 22 bp, Artificial Sequence
  chemically synthesized
gtttgagggaaactgcagttgt

SEQ ID NO: 644448 - DNA, 22 bp, Artificial Sequence
  chemically synthesized
aaaaaggtaatacaactgcagt

SEQ ID NO: 644449 - DNA, 22 bp, Artificial Sequence
  chemically synthesized
cagtttccctcaaacaaactct

SEQ ID NO: 644450 - DNA, 22 bp, Artificial Sequence
  chemically synthesized
ccctcaaacaaactctgccatt

SEQ ID NO: 644451 - DNA, 22 bp, Artificial Sequence
  chemically synthesized
cctcaaacaaactctgccattc

SEQ ID NO: 644452 - DNA, 22 bp, Artificial Sequence
  chemically synthesized
aaacaaactctgccattcctca

SEQ ID NO: 644453 - DNA, 22 bp, Artificial Sequence
  chemically synthesized
tgccattcctcaccctgacacc

SEQ ID NO: 644454 - DNA, 22 bp, Artificial Sequence
  chemically synthesized
ccattcctcaccctgacacctt

SEQ ID NO: 644455 - DNA, 22 bp, Artificial Sequence
  chemically synthesized
tggaatataaacaaaggtgtca

SEQ ID NO: 644456 - DNA, 22 bp, Artificial Sequence
  chemically synthesized
ctatggaatataaacaaaggtg

SEQ ID NO: 644457 - DNA, 22 bp, Artificial Sequence
  chemically synthesized
ctcaccctgacacctttgttta

SEQ ID NO: 644458 - DNA, 22 bp, Artificial Sequence
  chemically synthesized
accctgacacctttgtttatat

SEQ ID NO: 644459 - DNA, 22 bp, Artificial Sequence
  chemically synthesized
acacctttgtttatattccata

SEQ ID NO: 644460 - DNA, 22 bp, Artificial Sequence
  chemically synthesized
ggaatgggcattcctatggaat

SEQ ID NO: 644461 - DNA, 22 bp, Artificial Sequence
  chemically synthesized
tgtttatattccataggaatgc

SEQ ID NO: 644462 - DNA, 22 bp, Artificial Sequence
  chemically synthesized
gtttatattccataggaatgcc

SEQ ID NO: 644463 - DNA, 22 bp, Artificial Sequence
  chemically synthesized
tttatattccataggaatgccc

SEQ ID NO: 644464 - DNA, 22 bp, Artificial Sequence
  chemically synthesized
aagaggttaggaatgggcattc

SEQ ID NO: 644465 - DNA, 22 bp, Artificial Sequence
  chemically synthesized
atattccataggaatgcccatt

SEQ ID NO: 644466 - DNA, 22 bp, Artificial Sequence
  chemically synthesized
tattccataggaatgcccattc

SEQ ID NO: 644467 - DNA, 22 bp, Artificial Sequence
  chemically synthesized
cataggaatgcccattcctaac

SEQ ID NO: 644468 - DNA, 22 bp, Artificial Sequence
  chemically synthesized
ctaacctcttcagattcccttc

SEQ ID NO: 644469 - DNA, 22 bp, Artificial Sequence
  chemically synthesized
acctcttcagattcccttcatt

SEQ ID NO: 644470 - DNA, 22 bp, Artificial Sequence
  chemically synthesized
ttcagattcccttcattttggc

SEQ ID NO: 644471 - DNA, 22 bp, Artificial Sequence
  chemically synthesized
cagattcccttcattttggcca

SEQ ID NO: 644472 - DNA, 22 bp, Artificial Sequence
  chemically synthesized
agattcccttcattttggccat

SEQ ID NO: 644473 - DNA, 22 bp, Artificial Sequence
  chemically synthesized
caatgatggtgaaaagatggcc

SEQ ID NO: 644474 - DNA, 22 bp, Artificial Sequence
  chemically synthesized
ccttcattttggccatcttttc

SEQ ID NO: 644475 - DNA, 22 bp, Artificial Sequence
  chemically synthesized
cattttggccatcttttcacca

SEQ ID NO: 644476 - DNA, 22 bp, Artificial Sequence
  chemically synthesized
attttggccatcttttcaccat

SEQ ID NO: 644477 - DNA, 22 bp, Artificial Sequence
  chemically synthesized
tgcaagtctccaatgatggtga

SEQ ID NO: 644478 - DNA, 22 bp, Artificial Sequence
  chemically synthesized
tggccatcttttcaccatcatt

SEQ ID NO: 644479 - DNA, 22 bp, Artificial Sequence
  chemically synthesized
gtgcaagtctccaatgatggtg

SEQ ID NO: 644480 - DNA, 22 bp, Artificial Sequence
  chemically synthesized
ggccatcttttcaccatcattg

SEQ ID NO: 644481 - DNA, 22 bp, Artificial Sequence
  chemically synthesized
tgtgcaagtctccaatgatggt

SEQ ID NO: 644482 - DNA, 22 bp, Artificial Sequence
  chemically synthesized
gccatcttttcaccatcattgg

SEQ ID NO: 644483 - DNA, 22 bp, Artificial Sequence
  chemically synthesized
ggtctttgtgcaagtctccaat

SEQ ID NO: 644484 - DNA, 22 bp, Artificial Sequence
  chemically synthesized
ttcaccatcattggagacttgc

SEQ ID NO: 644485 - DNA, 22 bp, Artificial Sequence
  chemically synthesized
tcaccatcattggagacttgca

SEQ ID NO: 644486 - DNA, 22 bp, Artificial Sequence
  chemically synthesized
attaggtctttgtgcaagtctc

SEQ ID NO: 644487 - DNA, 22 bp, Artificial Sequence
  chemically synthesized
caccatcattggagacttgcac

SEQ ID NO: 644488 - DNA, 22 bp, Artificial Sequence
  chemically synthesized
cattaggtctttgtgcaagtct

SEQ ID NO: 644489 - DNA, 22 bp, Artificial Sequence
  chemically synthesized
accatcattggagacttgcaca

SEQ ID NO: 644490 - DNA, 22 bp, Artificial Sequence
  chemically synthesized
tcattaggtctttgtgcaagtc

SEQ ID NO: 644491 - DNA, 22 bp, Artificial Sequence
  chemically synthesized
tttcattaggtctttgtgcaag

SEQ ID NO: 644492 - DNA, 22 bp, Artificial Sequence
  chemically synthesized
aatgttctttcattaggtcttt

SEQ ID NO: 644493 - DNA, 22 bp, Artificial Sequence
  chemically synthesized
gagacttgcacaaagacctaat

SEQ ID NO: 644494 - DNA, 22 bp, Artificial Sequence
  chemically synthesized
ttcaatgttctttcattaggtc

SEQ ID NO: 644495 - DNA, 22 bp, Artificial Sequence
  chemically synthesized
attcaatgttctttcattaggt

SEQ ID NO: 644496 - DNA, 22 bp, Artificial Sequence
  chemically synthesized
tattcaatgttctttcattagg

SEQ ID NO: 644497 - DNA, 22 bp, Artificial Sequence
  chemically synthesized
gcacaaagacctaatgaaagaa

SEQ ID NO: 644498 - DNA, 22 bp, Artificial Sequence
  chemically synthesized
cacaaagacctaatgaaagaac

SEQ ID NO: 644499 - DNA, 22 bp, Artificial Sequence
  chemically synthesized
cgggaaatctttattcaatgtt

SEQ ID NO: 644500 - DNA, 22 bp, Artificial Sequence
  chemically synthesized
atgaaagaacattgaataaaga

SEQ ID NO: 644501 - DNA, 22 bp, Artificial Sequence
  chemically synthesized
atagctacgggaaatctttatt

SEQ ID NO: 644502 - DNA, 22 bp, Artificial Sequence
  chemically synthesized
catagctacgggaaatctttat

SEQ ID NO: 644503 - DNA, 22 bp, Artificial Sequence
  chemically synthesized
tcaatcttcatagctacgggaa

SEQ ID NO: 644504 - DNA, 22 bp, Artificial Sequence
  chemically synthesized
aataaagatttcccgtagctat

SEQ ID NO: 644505 - DNA, 22 bp, Artificial Sequence
  chemically synthesized
gtagctatcaatcttcatagct

SEQ ID NO: 644506 - DNA, 22 bp, Artificial Sequence
  chemically synthesized
gtctagtagctatcaatcttca

SEQ ID NO: 644507 - DNA, 22 bp, Artificial Sequence
  chemically synthesized
cccgtagctatgaagattgata

SEQ ID NO: 644508 - DNA, 22 bp, Artificial Sequence
  chemically synthesized
ccgtagctatgaagattgatag

SEQ ID NO: 644509 - DNA, 22 bp, Artificial Sequence
  chemically synthesized
gacctagtctagtagctatcaa

SEQ ID NO: 644510 - DNA, 22 bp, Artificial Sequence
  chemically synthesized
ggacctagtctagtagctatca

SEQ ID NO: 644511 - DNA, 22 bp, Artificial Sequence
  chemically synthesized
tggacctagtctagtagctatc

SEQ ID NO: 644512 - DNA, 22 bp, Artificial Sequence
  chemically synthesized
tgaagattgatagctactagac

SEQ ID NO: 644513 - DNA, 22 bp, Artificial Sequence
  chemically synthesized
atgactttggacctagtctagt

SEQ ID NO: 644514 - DNA, 22 bp, Artificial Sequence
  chemically synthesized
gatgactttggacctagtctag

SEQ ID NO: 644515 - DNA, 22 bp, Artificial Sequence
  chemically synthesized
acttgatgactttggacctagt

SEQ ID NO: 644516 - DNA, 22 bp, Artificial Sequence
  chemically synthesized
atagctactagactaggtccaa

SEQ ID NO: 644517 - DNA, 22 bp, Artificial Sequence
  chemically synthesized
taattgacttgatgactttgga

SEQ ID NO: 644518 - DNA, 22 bp, Artificial Sequence
  chemically synthesized
gtaattgacttgatgactttgg

SEQ ID NO: 644519 - DNA, 22 bp, Artificial Sequence
  chemically synthesized
ctagactaggtccaaagtcatc

SEQ ID NO: 644520 - DNA, 22 bp, Artificial Sequence
  chemically synthesized
tgtaattgacttgatgactttg

SEQ ID NO: 644521 - DNA, 22 bp, Artificial Sequence
  chemically synthesized
gactaggtccaaagtcatcaag

SEQ ID NO: 644522 - DNA, 22 bp, Artificial Sequence
  chemically synthesized
ctttgtaattgacttgatgact

SEQ ID NO: 644523 - DNA, 22 bp, Artificial Sequence
  chemically synthesized
actttgtaattgacttgatgac

SEQ ID NO: 644524 - DNA, 22 bp, Artificial Sequence
  chemically synthesized
tactttgtaattgacttgatga

SEQ ID NO: 644525 - DNA, 22 bp, Artificial Sequence
  chemically synthesized
ggtccaaagtcatcaagtcaat

SEQ ID NO: 644526 - DNA, 22 bp, Artificial Sequence
  chemically synthesized
ctttactttgtaattgacttga

SEQ ID NO: 644527 - DNA, 22 bp, Artificial Sequence
  chemically synthesized
gaaatcatgatcccgttgcttt

SEQ ID NO: 644528 - DNA, 22 bp, Artificial Sequence
  chemically synthesized
caaagtaaagcaacgggatcat

SEQ ID NO: 644529 - DNA, 22 bp, Artificial Sequence
  chemically synthesized
aagtagctggaaatcatgatcc

SEQ ID NO: 644530 - DNA, 22 bp, Artificial Sequence
  chemically synthesized
aattaaagtagctggaaatcat

SEQ ID NO: 644531 - DNA, 22 bp, Artificial Sequence
  chemically synthesized
ataccactgaattaaagtagct

SEQ ID NO: 644532 - DNA, 22 bp, Artificial Sequence
  chemically synthesized
ctgataccactgaattaaagta

SEQ ID NO: 644533 - DNA, 22 bp, Artificial Sequence
  chemically synthesized
ccagctactttaattcagtggt

SEQ ID NO: 644534 - DNA, 22 bp, Artificial Sequence
  chemically synthesized
cagctactttaattcagtggta

SEQ ID NO: 644535 - DNA, 22 bp, Artificial Sequence
  chemically synthesized
gatcagttactgataccactga

SEQ ID NO: 644536 - DNA, 22 bp, Artificial Sequence
  chemically synthesized
tagatcagttactgataccact

SEQ ID NO: 644537 - DNA, 22 bp, Artificial Sequence
  chemically synthesized
ctttaattcagtggtatcagta

SEQ ID NO: 644538 - DNA, 22 bp, Artificial Sequence
  chemically synthesized
taattcagtggtatcagtaact

SEQ ID NO: 644539 - DNA, 22 bp, Artificial Sequence
  chemically synthesized
aattcagtggtatcagtaactg

SEQ ID NO: 644540 - DNA, 22 bp, Artificial Sequence
  chemically synthesized
attcagtggtatcagtaactga

SEQ ID NO: 644541 - DNA, 22 bp, Artificial Sequence
  chemically synthesized
agtggtatcagtaactgatcta

SEQ ID NO: 644542 - DNA, 22 bp, Artificial Sequence
  chemically synthesized
cagtcaaagaagttctagatca

SEQ ID NO: 644543 - DNA, 22 bp, Artificial Sequence
  chemically synthesized
ttacagtcaaagaagttctaga

SEQ ID NO: 644544 - DNA, 22 bp, Artificial Sequence
  chemically synthesized
ttgttacagtcaaagaagttct

SEQ ID NO: 644545 - DNA, 22 bp, Artificial Sequence
  chemically synthesized
ttattgttacagtcaaagaagt

SEQ ID NO: 644546 - DNA, 22 bp, Artificial Sequence
  chemically synthesized
atctagaacttctttgactgta

SEQ ID NO: 644547 - DNA, 22 bp, Artificial Sequence
  chemically synthesized
gaacttctttgactgtaacaat

SEQ ID NO: 644548 - DNA, 22 bp, Artificial Sequence
  chemically synthesized
tgcaagattattattgttacag

SEQ ID NO: 644549 - DNA, 22 bp, Artificial Sequence
  chemically synthesized
ctttgactgtaacaataataat

SEQ ID NO: 644550 - DNA, 22 bp, Artificial Sequence
  chemically synthesized
tttgactgtaacaataataatc

SEQ ID NO: 644551 - DNA, 22 bp, Artificial Sequence
  chemically synthesized
tgactgtaacaataataatctt

SEQ ID NO: 644552 - DNA, 22 bp, Artificial Sequence
  chemically synthesized
cagtgattgtgcaagattatta

SEQ ID NO: 644553 - DNA, 22 bp, Artificial Sequence
  chemically synthesized
gactgtaacaataataatcttg

SEQ ID NO: 644554 - DNA, 22 bp, Artificial Sequence
  chemically synthesized
actgtaacaataataatcttgc

SEQ ID NO: 644555 - DNA, 22 bp, Artificial Sequence
  chemically synthesized
ctccagtgattgtgcaagatta

SEQ ID NO: 644556 - DNA, 22 bp, Artificial Sequence
  chemically synthesized
taacaataataatcttgcacaa

SEQ ID NO: 644557 - DNA, 22 bp, Artificial Sequence
  chemically synthesized
aattcctccagtgattgtgcaa

SEQ ID NO: 644558 - DNA, 22 bp, Artificial Sequence
  chemically synthesized
aaattcctccagtgattgtgca

SEQ ID NO: 644559 - DNA, 22 bp, Artificial Sequence
  chemically synthesized
taaattcctccagtgattgtgc

SEQ ID NO: 644560 - DNA, 22 bp, Artificial Sequence
  chemically synthesized
ctttaaattcctccagtgattg

SEQ ID NO: 644561 - DNA, 22 bp, Artificial Sequence
  chemically synthesized
cctttaaattcctccagtgatt

SEQ ID NO: 644562 - DNA, 22 bp, Artificial Sequence
  chemically synthesized
tcctttaaattcctccagtgat

SEQ ID NO: 644563 - DNA, 22 bp, Artificial Sequence
  chemically synthesized
ttcctttaaattcctccagtga

SEQ ID NO: 644564 - DNA, 22 bp, Artificial Sequence
  chemically synthesized
tttcctttaaattcctccagtg

SEQ ID NO: 644565 - DNA, 22 bp, Artificial Sequence
  chemically synthesized
tttttcctttaaattcctccag

SEQ ID NO: 644566 - DNA, 22 bp, Artificial Sequence
  chemically synthesized
tctttttcctttaaattcctcc

SEQ ID NO: 644567 - DNA, 22 bp, Artificial Sequence
  chemically synthesized
gcacaatcactggaggaattta

SEQ ID NO: 644568 - DNA, 22 bp, Artificial Sequence
  chemically synthesized
ctctttttcctttaaattcctc

SEQ ID NO: 644569 - DNA, 22 bp, Artificial Sequence
  chemically synthesized
cacaatcactggaggaatttaa

SEQ ID NO: 644570 - DNA, 22 bp, Artificial Sequence
  chemically synthesized
tctctttttcctttaaattcct

SEQ ID NO: 644571 - DNA, 22 bp, Artificial Sequence
  chemically synthesized
agttttctctttttcctttaaa

SEQ ID NO: 644572 - DNA, 22 bp, Artificial Sequence
  chemically synthesized
gagttttctctttttcctttaa

SEQ ID NO: 644573 - DNA, 22 bp, Artificial Sequence
  chemically synthesized
gaggaatttaaaggaaaaagag

SEQ ID NO: 644574 - DNA, 22 bp, Artificial Sequence
  chemically synthesized
aaaggaaaaagagaaaactcaa

SEQ ID NO: 644575 - DNA, 22 bp, Artificial Sequence
  chemically synthesized
tgaagccaaaatttgagttttc

SEQ ID NO: 644576 - DNA, 22 bp, Artificial Sequence
  chemically synthesized
aaggaaaaagagaaaactcaaa

SEQ ID NO: 644577 - DNA, 22 bp, Artificial Sequence
  chemically synthesized
atgaagccaaaatttgagtttt

SEQ ID NO: 644578 - DNA, 22 bp, Artificial Sequence
  chemically synthesized
ggcagtaagaccttatgaagcc

SEQ ID NO: 644579 - DNA, 22 bp, Artificial Sequence
  chemically synthesized
ttgggcagtaagaccttatgaa

SEQ ID NO: 644580 - DNA, 22 bp, Artificial Sequence
  chemically synthesized
gttgggcagtaagaccttatga

SEQ ID NO: 644581 - DNA, 22 bp, Artificial Sequence
  chemically synthesized
aaattttggcttcataaggtct

SEQ ID NO: 644582 - DNA, 22 bp, Artificial Sequence
  chemically synthesized
tggcttcataaggtcttactgc

SEQ ID NO: 644583 - DNA, 22 bp, Artificial Sequence
  chemically synthesized
ggcttcataaggtcttactgcc

SEQ ID NO: 644584 - DNA, 22 bp, Artificial Sequence
  chemically synthesized
gcttcataaggtcttactgccc

SEQ ID NO: 644585 - DNA, 22 bp, Artificial Sequence
  chemically synthesized
atatgtcttgttgggcagtaag

SEQ ID NO: 644586 - DNA, 22 bp, Artificial Sequence
  chemically synthesized
catatgtcttgttgggcagtaa

SEQ ID NO: 644587 - DNA, 22 bp, Artificial Sequence
  chemically synthesized
tcatatgtcttgttgggcagta

SEQ ID NO: 644588 - DNA, 22 bp, Artificial Sequence
  chemically synthesized
cataaggtcttactgcccaaca

SEQ ID NO: 644589 - DNA, 22 bp, Artificial Sequence
  chemically synthesized
ataaggtcttactgcccaacaa

SEQ ID NO: 644590 - DNA, 22 bp, Artificial Sequence
  chemically synthesized
aggacctttcatatgtcttgtt

SEQ ID NO: 644591 - DNA, 22 bp, Artificial Sequence
  chemically synthesized
ctcaggacctttcatatgtctt

SEQ ID NO: 644592 - DNA, 22 bp, Artificial Sequence
  chemically synthesized
actgcccaacaagacatatgaa

SEQ ID NO: 644593 - DNA, 22 bp, Artificial Sequence
  chemically synthesized
ctgcccaacaagacatatgaaa

SEQ ID NO: 644594 - DNA, 22 bp, Artificial Sequence
  chemically synthesized
cccaacaagacatatgaaaggt

SEQ ID NO: 644595 - DNA, 22 bp, Artificial Sequence
  chemically synthesized
atacctactcaggacctttcat

SEQ ID NO: 644596 - DNA, 22 bp, Artificial Sequence
  chemically synthesized
aatacctactcaggacctttca

SEQ ID NO: 644597 - DNA, 22 bp, Artificial Sequence
  chemically synthesized
ttaatacctactcaggaccttt

SEQ ID NO: 644598 - DNA, 22 bp, Artificial Sequence
  chemically synthesized
tagattcttaatacctactcag

SEQ ID NO: 644599 - DNA, 22 bp, Artificial Sequence
  chemically synthesized
tgtagattcttaatacctactc

SEQ ID NO: 644600 - DNA, 22 bp, Artificial Sequence
  chemically synthesized
agtaggtattaagaatctacag

SEQ ID NO: 644601 - DNA, 22 bp, Artificial Sequence
  chemically synthesized
tataacacgagggaactctgta

SEQ ID NO: 644602 - DNA, 22 bp, Artificial Sequence
  chemically synthesized
agaatctacagagttccctcgt

SEQ ID NO: 644603 - DNA, 22 bp, Artificial Sequence
  chemically synthesized
gtagatgttatataacacgagg

SEQ ID NO: 644604 - DNA, 22 bp, Artificial Sequence
  chemically synthesized
ttagtagatgttatataacacg

SEQ ID NO: 644605 - DNA, 22 bp, Artificial Sequence
  chemically synthesized
cagagttccctcgtgttatata

SEQ ID NO: 644606 - DNA, 22 bp, Artificial Sequence
  chemically synthesized
aagttgttagtagatgttatat

SEQ ID NO: 644607 - DNA, 22 bp, Artificial Sequence
  chemically synthesized
cctcgtgttatataacatctac

SEQ ID NO: 644608 - DNA, 22 bp, Artificial Sequence
  chemically synthesized
aagttaaagttgttagtagatg

SEQ ID NO: 644609 - DNA, 22 bp, Artificial Sequence
  chemically synthesized
gtgttatataacatctactaac

SEQ ID NO: 644610 - DNA, 22 bp, Artificial Sequence
  chemically synthesized
tataacatctactaacaacttt

SEQ ID NO: 644611 - DNA, 22 bp, Artificial Sequence
  chemically synthesized
accataaagtctaaagttaaag

SEQ ID NO: 644612 - DNA, 22 bp, Artificial Sequence
  chemically synthesized
attcaccataaagtctaaagtt

SEQ ID NO: 644613 - DNA, 22 bp, Artificial Sequence
  chemically synthesized
ctaacaactttaactttagact

SEQ ID NO: 644614 - DNA, 22 bp, Artificial Sequence
  chemically synthesized
acaactttaactttagacttta

SEQ ID NO: 644615 - DNA, 22 bp, Artificial Sequence
  chemically synthesized
acctaattcaccataaagtcta

SEQ ID NO: 644616 - DNA, 22 bp, Artificial Sequence
  chemically synthesized
taactttagactttatggtgaa

SEQ ID NO: 644617 - DNA, 22 bp, Artificial Sequence
  chemically synthesized
aactttagactttatggtgaat

SEQ ID NO: 644618 - DNA, 22 bp, Artificial Sequence
  chemically synthesized
aatattaacctaattcaccata

SEQ ID NO: 644619 - DNA, 22 bp, Artificial Sequence
  chemically synthesized
actttagactttatggtgaatt

SEQ ID NO: 644620 - DNA, 22 bp, Artificial Sequence
  chemically synthesized
tagactttatggtgaattaggt

SEQ ID NO: 644621 - DNA, 22 bp, Artificial Sequence
  chemically synthesized
agactttatggtgaattaggtt

SEQ ID NO: 644622 - DNA, 22 bp, Artificial Sequence
  chemically synthesized
gactttatggtgaattaggtta

SEQ ID NO: 644623 - DNA, 22 bp, Artificial Sequence
  chemically synthesized
tatggtgaattaggttaatatt

SEQ ID NO: 644624 - DNA, 22 bp, Artificial Sequence
  chemically synthesized
atggtgaattaggttaatattt

SEQ ID NO: 644625 - DNA, 22 bp, Artificial Sequence
  chemically synthesized
tggtgaattaggttaatattta

SEQ ID NO: 644626 - DNA, 22 bp, Artificial Sequence
  chemically synthesized
aagtcaacaaggtggctaaata

SEQ ID NO: 644627 - DNA, 22 bp, Artificial Sequence
  chemically synthesized
tcaagtcaacaaggtggctaaa

SEQ ID NO: 644628 - DNA, 22 bp, Artificial Sequence
  chemically synthesized
ttctcaagtcaacaaggtggct

SEQ ID NO: 644629 - DNA, 22 bp, Artificial Sequence
  chemically synthesized
ggttaatatttagccaccttgt

SEQ ID NO: 644630 - DNA, 22 bp, Artificial Sequence
  chemically synthesized
gattgttctcaagtcaacaagg

SEQ ID NO: 644631 - DNA, 22 bp, Artificial Sequence
  chemically synthesized
atatttagccaccttgttgact

SEQ ID NO: 644632 - DNA, 22 bp, Artificial Sequence
  chemically synthesized
attagattgttctcaagtcaac

SEQ ID NO: 644633 - DNA, 22 bp, Artificial Sequence
  chemically synthesized
agccaccttgttgacttgagaa

SEQ ID NO: 644634 - DNA, 22 bp, Artificial Sequence
  chemically synthesized
gccaccttgttgacttgagaac

SEQ ID NO: 644635 - DNA, 22 bp, Artificial Sequence
  chemically synthesized
gttgacttgagaacaatctaat

SEQ ID NO: 644636 - DNA, 22 bp, Artificial Sequence
  chemically synthesized
cagagcaaattgattagattgt

SEQ ID NO: 644637 - DNA, 22 bp, Artificial Sequence
  chemically synthesized
ttgacttgagaacaatctaatc

SEQ ID NO: 644638 - DNA, 22 bp, Artificial Sequence
  chemically synthesized
acttgagaacaatctaatcaat

SEQ ID NO: 644639 - DNA, 22 bp, Artificial Sequence
  chemically synthesized
cctgcagagcaaattgattaga

SEQ ID NO: 644640 - DNA, 22 bp, Artificial Sequence
  chemically synthesized
ctacctgcagagcaaattgatt

SEQ ID NO: 644641 - DNA, 22 bp, Artificial Sequence
  chemically synthesized
gagaacaatctaatcaatttgc

SEQ ID NO: 644642 - DNA, 22 bp, Artificial Sequence
  chemically synthesized
agaacaatctaatcaatttgct

SEQ ID NO: 644643 - DNA, 22 bp, Artificial Sequence
  chemically synthesized
tactacctgcagagcaaattga

SEQ ID NO: 644644 - DNA, 22 bp, Artificial Sequence
  chemically synthesized
tcgttctactacctgcagagca

SEQ ID NO: 644645 - DNA, 22 bp, Artificial Sequence
  chemically synthesized
atcaatttgctctgcaggtagt

SEQ ID NO: 644646 - DNA, 22 bp, Artificial Sequence
  chemically synthesized
gctctgcaggtagtagaacgac

SEQ ID NO: 644647 - DNA, 22 bp, Artificial Sequence
  chemically synthesized
ctctgcaggtagtagaacgaca

SEQ ID NO: 644648 - DNA, 22 bp, Artificial Sequence
  chemically synthesized
agagacaaagacattgtcgttc

SEQ ID NO: 644649 - DNA, 22 bp, Artificial Sequence
  chemically synthesized
tgcaggtagtagaacgacaatg

SEQ ID NO: 644650 - DNA, 22 bp, Artificial Sequence
  chemically synthesized
tgagagacaaagacattgtcgt

SEQ ID NO: 644651 - DNA, 22 bp, Artificial Sequence
  chemically synthesized
caggtagtagaacgacaatgtc

SEQ ID NO: 644652 - DNA, 22 bp, Artificial Sequence
  chemically synthesized
ctgagagacaaagacattgtcg

SEQ ID NO: 644653 - DNA, 22 bp, Artificial Sequence
  chemically synthesized
tctgagagacaaagacattgtc

SEQ ID NO: 644654 - DNA, 22 bp, Artificial Sequence
  chemically synthesized
gcaatgaaaaggtagcctttct

SEQ ID NO: 644655 - DNA, 22 bp, Artificial Sequence
  chemically synthesized
tgtctctcagaaaggctacctt

SEQ ID NO: 644656 - DNA, 22 bp, Artificial Sequence
  chemically synthesized
gtctctcagaaaggctaccttt

SEQ ID NO: 644657 - DNA, 22 bp, Artificial Sequence
  chemically synthesized
tctctcagaaaggctacctttt

SEQ ID NO: 644658 - DNA, 22 bp, Artificial Sequence
  chemically synthesized
tcagaaaggctaccttttcatt

SEQ ID NO: 644659 - DNA, 22 bp, Artificial Sequence
  chemically synthesized
agaaaggctaccttttcattgc

SEQ ID NO: 644660 - DNA, 22 bp, Artificial Sequence
  chemically synthesized
aaggtatgatcctagcaatgaa

SEQ ID NO: 644661 - DNA, 22 bp, Artificial Sequence
  chemically synthesized
aaattcaaggtatgatcctagc

SEQ ID NO: 644662 - DNA, 22 bp, Artificial Sequence
  chemically synthesized
ccttttcattgctaggatcata

SEQ ID NO: 644663 - DNA, 22 bp, Artificial Sequence
  chemically synthesized
tgaaattcaaggtatgatccta

SEQ ID NO: 644664 - DNA, 22 bp, Artificial Sequence
  chemically synthesized
ctctgaaattcaaggtatgatc

SEQ ID NO: 644665 - DNA, 22 bp, Artificial Sequence
  chemically synthesized
ttcattgctaggatcatacctt

SEQ ID NO: 644666 - DNA, 22 bp, Artificial Sequence
  chemically synthesized
gctctgaaattcaaggtatgat

SEQ ID NO: 644667 - DNA, 22 bp, Artificial Sequence
  chemically synthesized
tcattgctaggatcataccttg

SEQ ID NO: 644668 - DNA, 22 bp, Artificial Sequence
  chemically synthesized
cattgctaggatcataccttga

SEQ ID NO: 644669 - DNA, 22 bp, Artificial Sequence
  chemically synthesized
attgctaggatcataccttgaa

SEQ ID NO: 644670 - DNA, 22 bp, Artificial Sequence
  chemically synthesized
ctaggatcataccttgaatttc

SEQ ID NO: 644671 - DNA, 22 bp, Artificial Sequence
  chemically synthesized
ggatcataccttgaatttcaga

SEQ ID NO: 644672 - DNA, 22 bp, Artificial Sequence
  chemically synthesized
aataaaccaagacttgctctga

SEQ ID NO: 644673 - DNA, 22 bp, Artificial Sequence
  chemically synthesized
tctaaataaaccaagacttgct

SEQ ID NO: 644674 - DNA, 22 bp, Artificial Sequence
  chemically synthesized
gaatttcagagcaagtcttggt

SEQ ID NO: 644675 - DNA, 22 bp, Artificial Sequence
  chemically synthesized
aatttcagagcaagtcttggtt

SEQ ID NO: 644676 - DNA, 22 bp, Artificial Sequence
  chemically synthesized
cactgtctaaataaaccaagac

SEQ ID NO: 644677 - DNA, 22 bp, Artificial Sequence
  chemically synthesized
tgcactgtctaaataaaccaag

SEQ ID NO: 644678 - DNA, 22 bp, Artificial Sequence
  chemically synthesized
cagagcaagtcttggtttattt

SEQ ID NO: 644679 - DNA, 22 bp, Artificial Sequence
  chemically synthesized
agagcaagtcttggtttattta

SEQ ID NO: 644680 - DNA, 22 bp, Artificial Sequence
  chemically synthesized
tctctgcactgtctaaataaac

SEQ ID NO: 644681 - DNA, 22 bp, Artificial Sequence
  chemically synthesized
gtctctgcactgtctaaataaa

SEQ ID NO: 644682 - DNA, 22 bp, Artificial Sequence
  chemically synthesized
ggtttatttagacagtgcagag

SEQ ID NO: 644683 - DNA, 22 bp, Artificial Sequence
  chemically synthesized
gtttatttagacagtgcagaga

SEQ ID NO: 644684 - DNA, 22 bp, Artificial Sequence
  chemically synthesized
atttagacagtgcagagacaaa

SEQ ID NO: 644685 - DNA, 22 bp, Artificial Sequence
  chemically synthesized
tttagacagtgcagagacaaat

SEQ ID NO: 644686 - DNA, 22 bp, Artificial Sequence
  chemically synthesized
aaatacagagatgtatttgtct

SEQ ID NO: 644687 - DNA, 22 bp, Artificial Sequence
  chemically synthesized
agacagtgcagagacaaataca

SEQ ID NO: 644688 - DNA, 22 bp, Artificial Sequence
  chemically synthesized
gacagtgcagagacaaatacat

SEQ ID NO: 644689 - DNA, 22 bp, Artificial Sequence
  chemically synthesized
tagtgttcaaatacagagatgt

SEQ ID NO: 644690 - DNA, 22 bp, Artificial Sequence
  chemically synthesized
agcctgtagtgttcaaatacag

SEQ ID NO: 644691 - DNA, 22 bp, Artificial Sequence
  chemically synthesized
aagcctgtagtgttcaaataca

SEQ ID NO: 644692 - DNA, 22 bp, Artificial Sequence
  chemically synthesized
acttaagcctgtagtgttcaaa

SEQ ID NO: 644693 - DNA, 22 bp, Artificial Sequence
  chemically synthesized
ctgacttaagcctgtagtgttc

SEQ ID NO: 644694 - DNA, 22 bp, Artificial Sequence
  chemically synthesized
tgtatttgaacactacaggctt

SEQ ID NO: 644695 - DNA, 22 bp, Artificial Sequence
  chemically synthesized
agtctcctgacttaagcctgta

SEQ ID NO: 644696 - DNA, 22 bp, Artificial Sequence
  chemically synthesized
tatttgaacactacaggcttaa

SEQ ID NO: 644697 - DNA, 22 bp, Artificial Sequence
  chemically synthesized
cagtctcctgacttaagcctgt

SEQ ID NO: 644698 - DNA, 22 bp, Artificial Sequence
  chemically synthesized
gaacactacaggcttaagtcag

SEQ ID NO: 644699 - DNA, 22 bp, Artificial Sequence
  chemically synthesized
aacactacaggcttaagtcagg

SEQ ID NO: 644700 - DNA, 22 bp, Artificial Sequence
  chemically synthesized
aagccttcagtctcctgactta

SEQ ID NO: 644701 - DNA, 22 bp, Artificial Sequence
  chemically synthesized
attaaagccttcagtctcctga

SEQ ID NO: 644702 - DNA, 22 bp, Artificial Sequence
  chemically synthesized
caggcttaagtcaggagactga

SEQ ID NO: 644703 - DNA, 22 bp, Artificial Sequence
  chemically synthesized
cgttgattaaagccttcagtct

SEQ ID NO: 644704 - DNA, 22 bp, Artificial Sequence
  chemically synthesized
gcgttgattaaagccttcagtc

SEQ ID NO: 644705 - DNA, 22 bp, Artificial Sequence
  chemically synthesized
ttgcgttgattaaagccttcag

SEQ ID NO: 644706 - DNA, 22 bp, Artificial Sequence
  chemically synthesized
aagtcaggagactgaaggcttt

SEQ ID NO: 644707 - DNA, 22 bp, Artificial Sequence
  chemically synthesized
cttgcgttgattaaagccttca

SEQ ID NO: 644708 - DNA, 22 bp, Artificial Sequence
  chemically synthesized
agtcaggagactgaaggcttta

SEQ ID NO: 644709 - DNA, 22 bp, Artificial Sequence
  chemically synthesized
tcttgcgttgattaaagccttc

SEQ ID NO: 644710 - DNA, 22 bp, Artificial Sequence
  chemically synthesized
ttcttgcgttgattaaagcctt

SEQ ID NO: 644711 - DNA, 22 bp, Artificial Sequence
  chemically synthesized
tttcttgcgttgattaaagcct

SEQ ID NO: 644712 - DNA, 22 bp, Artificial Sequence
  chemically synthesized
ttttcttgcgttgattaaagcc

SEQ ID NO: 644713 - DNA, 22 bp, Artificial Sequence
  chemically synthesized
tttttcttgcgttgattaaagc

SEQ ID NO: 644714 - DNA, 22 bp, Artificial Sequence
  chemically synthesized
ttttttcttgcgttgattaaag

SEQ ID NO: 644715 - DNA, 22 bp, Artificial Sequence
  chemically synthesized
cttttttttcttgcgttgatta

SEQ ID NO: 644716 - DNA, 22 bp, Artificial Sequence
  chemically synthesized
acttttttttcttgcgttgatt

SEQ ID NO: 644717 - DNA, 22 bp, Artificial Sequence
  chemically synthesized
aaggctttaatcaacgcaagaa

SEQ ID NO: 644718 - DNA, 22 bp, Artificial Sequence
  chemically synthesized
aaggtttacttttttttcttgc

SEQ ID NO: 644719 - DNA, 22 bp, Artificial Sequence
  chemically synthesized
taatcaacgcaagaaaaaaaag

SEQ ID NO: 644720 - DNA, 22 bp, Artificial Sequence
  chemically synthesized
aatcaacgcaagaaaaaaaagt

SEQ ID NO: 644721 - DNA, 22 bp, Artificial Sequence
  chemically synthesized
atcaacgcaagaaaaaaaagta

SEQ ID NO: 644722 - DNA, 22 bp, Artificial Sequence
  chemically synthesized
cagactcaaggtttactttttt

SEQ ID NO: 644723 - DNA, 22 bp, Artificial Sequence
  chemically synthesized
gcattgcagactcaaggtttac

SEQ ID NO: 644724 - DNA, 22 bp, Artificial Sequence
  chemically synthesized
agcattgcagactcaaggttta

SEQ ID NO: 644725 - DNA, 22 bp, Artificial Sequence
  chemically synthesized
tgtgtccttagcattgcagact

SEQ ID NO: 644726 - DNA, 22 bp, Artificial Sequence
  chemically synthesized
ccccattgtgtgtccttagcat

SEQ ID NO: 644727 - DNA, 22 bp, Artificial Sequence
  chemically synthesized
gccccattgtgtgtccttagca

SEQ ID NO: 644728 - DNA, 22 bp, Artificial Sequence
  chemically synthesized
tgccccattgtgtgtccttagc

SEQ ID NO: 644729 - DNA, 22 bp, Artificial Sequence
  chemically synthesized
gagtctgcaatgctaaggacac

SEQ ID NO: 644730 - DNA, 22 bp, Artificial Sequence
  chemically synthesized
ttgccccattgtgtgtccttag

SEQ ID NO: 644731 - DNA, 22 bp, Artificial Sequence
  chemically synthesized
agtctgcaatgctaaggacaca

SEQ ID NO: 644732 - DNA, 22 bp, Artificial Sequence
  chemically synthesized
ggtttttgccccattgtgtgtc

SEQ ID NO: 644733 - DNA, 22 bp, Artificial Sequence
  chemically synthesized
gggtttttgccccattgtgtgt

SEQ ID NO: 644734 - DNA, 22 bp, Artificial Sequence
  chemically synthesized
caatgctaaggacacacaatgg

SEQ ID NO: 644735 - DNA, 22 bp, Artificial Sequence
  chemically synthesized
gatcttgggtttttgccccatt

SEQ ID NO: 644736 - DNA, 22 bp, Artificial Sequence
  chemically synthesized
aggacacacaatggggcaaaaa

SEQ ID NO: 644737 - DNA, 22 bp, Artificial Sequence
  chemically synthesized
gcaaagagccactggatcttgg

SEQ ID NO: 644738 - DNA, 22 bp, Artificial Sequence
  chemically synthesized
ggcaaagagccactggatcttg

SEQ ID NO: 644739 - DNA, 22 bp, Artificial Sequence
  chemically synthesized
tttggcaaagagccactggatc

SEQ ID NO: 644740 - DNA, 22 bp, Artificial Sequence
  chemically synthesized
atttggcaaagagccactggat

SEQ ID NO: 644741 - DNA, 22 bp, Artificial Sequence
  chemically synthesized
tatttggcaaagagccactgga

SEQ ID NO: 644742 - DNA, 22 bp, Artificial Sequence
  chemically synthesized
agatacatctttatttggcaaa

SEQ ID NO: 644743 - DNA, 22 bp, Artificial Sequence
  chemically synthesized
tttgccaaataaagatgtatct

SEQ ID NO: 644744 - DNA, 22 bp, Artificial Sequence
  chemically synthesized
ccacatataattcagatacatc

SEQ ID NO: 644745 - DNA, 22 bp, Artificial Sequence
  chemically synthesized
tgccaaataaagatgtatctga

SEQ ID NO: 644746 - DNA, 22 bp, Artificial Sequence
  chemically synthesized
gccaaataaagatgtatctgaa

SEQ ID NO: 644747 - DNA, 22 bp, Artificial Sequence
  chemically synthesized
ccaaataaagatgtatctgaat

SEQ ID NO: 644748 - DNA, 22 bp, Artificial Sequence
  chemically synthesized
attaccacatataattcagata

SEQ ID NO: 644749 - DNA, 22 bp, Artificial Sequence
  chemically synthesized
cctcattaccacatataattca

SEQ ID NO: 644750 - DNA, 22 bp, Artificial Sequence
  chemically synthesized
tccctcattaccacatataatt

SEQ ID NO: 644751 - DNA, 22 bp, Artificial Sequence
  chemically synthesized
ctccctcattaccacatataat

SEQ ID NO: 644752 - DNA, 22 bp, Artificial Sequence
  chemically synthesized
catcatatttctccctcattac

SEQ ID NO: 644753 - DNA, 22 bp, Artificial Sequence
  chemically synthesized
aattatatgtggtaatgaggga

SEQ ID NO: 644754 - DNA, 22 bp, Artificial Sequence
  chemically synthesized
tgcatcatatttctccctcatt

SEQ ID NO: 644755 - DNA, 22 bp, Artificial Sequence
  chemically synthesized
ctgcatcatatttctccctcat

SEQ ID NO: 644756 - DNA, 22 bp, Artificial Sequence
  chemically synthesized
tatgtggtaatgagggagaaat

SEQ ID NO: 644757 - DNA, 22 bp, Artificial Sequence
  chemically synthesized
gcttctgcatcatatttctccc

SEQ ID NO: 644758 - DNA, 22 bp, Artificial Sequence
  chemically synthesized
cgcttctgcatcatatttctcc

SEQ ID NO: 644759 - DNA, 22 bp, Artificial Sequence
  chemically synthesized
atatttcgcttctgcatcatat

SEQ ID NO: 644760 - DNA, 22 bp, Artificial Sequence
  chemically synthesized
aatatttcgcttctgcatcata

SEQ ID NO: 644761 - DNA, 22 bp, Artificial Sequence
  chemically synthesized
taatatttcgcttctgcatcat

SEQ ID NO: 644762 - DNA, 22 bp, Artificial Sequence
  chemically synthesized
atctttaatatttcgcttctgc

SEQ ID NO: 644763 - DNA, 22 bp, Artificial Sequence
  chemically synthesized
gtgagatatctaatctttaata

SEQ ID NO: 644764 - DNA, 22 bp, Artificial Sequence
  chemically synthesized
atggtgttagtgagatatctaa

SEQ ID NO: 644765 - DNA, 22 bp, Artificial Sequence
  chemically synthesized
aagattagatatctcactaaca

SEQ ID NO: 644766 - DNA, 22 bp, Artificial Sequence
  chemically synthesized
gatgactaatggtgttagtgag

SEQ ID NO: 644767 - DNA, 22 bp, Artificial Sequence
  chemically synthesized
ggatgactaatggtgttagtga

SEQ ID NO: 644768 - DNA, 22 bp, Artificial Sequence
  chemically synthesized
gatatctcactaacaccattag

SEQ ID NO: 644769 - DNA, 22 bp, Artificial Sequence
  chemically synthesized
ccataagtttggatgactaatg

SEQ ID NO: 644770 - DNA, 22 bp, Artificial Sequence
  chemically synthesized
actaacaccattagtcatccaa

SEQ ID NO: 644771 - DNA, 22 bp, Artificial Sequence
  chemically synthesized
acaccattagtcatccaaactt

SEQ ID NO: 644772 - DNA, 22 bp, Artificial Sequence
  chemically synthesized
ccatagtgcctcccataagttt

SEQ ID NO: 644773 - DNA, 22 bp, Artificial Sequence
  chemically synthesized
cccatagtgcctcccataagtt

SEQ ID NO: 644774 - DNA, 22 bp, Artificial Sequence
  chemically synthesized
tcccatagtgcctcccataagt

SEQ ID NO: 644775 - DNA, 22 bp, Artificial Sequence
  chemically synthesized
ttcccatagtgcctcccataag

SEQ ID NO: 644776 - DNA, 22 bp, Artificial Sequence
  chemically synthesized
gtcatccaaacttatgggaggc

SEQ ID NO: 644777 - DNA, 22 bp, Artificial Sequence
  chemically synthesized
agtttttcccatagtgcctccc

SEQ ID NO: 644778 - DNA, 22 bp, Artificial Sequence
  chemically synthesized
actgagtttttcccatagtgcc

SEQ ID NO: 644779 - DNA, 22 bp, Artificial Sequence
  chemically synthesized
atgggaggcactatgggaaaaa

SEQ ID NO: 644780 - DNA, 22 bp, Artificial Sequence
  chemically synthesized
aatctgactgagtttttcccat

SEQ ID NO: 644781 - DNA, 22 bp, Artificial Sequence
  chemically synthesized
tgggaggcactatgggaaaaac

SEQ ID NO: 644782 - DNA, 22 bp, Artificial Sequence
  chemically synthesized
agtaaaagctaaatctgactga

SEQ ID NO: 644783 - DNA, 22 bp, Artificial Sequence
  chemically synthesized
tgggaaaaactcagtcagattt

SEQ ID NO: 644784 - DNA, 22 bp, Artificial Sequence
  chemically synthesized
tgagtaaaagctaaatctgact

SEQ ID NO: 644785 - DNA, 22 bp, Artificial Sequence
  chemically synthesized
aagctctgagtaaaagctaaat

SEQ ID NO: 644786 - DNA, 22 bp, Artificial Sequence
  chemically synthesized
agtcagatttagcttttactca

SEQ ID NO: 644787 - DNA, 22 bp, Artificial Sequence
  chemically synthesized
agcttttactcagagctttagc

SEQ ID NO: 644788 - DNA, 22 bp, Artificial Sequence
  chemically synthesized
gcttttactcagagctttagcc

SEQ ID NO: 644789 - DNA, 22 bp, Artificial Sequence
  chemically synthesized
atgccacagagataaggctaaa

SEQ ID NO: 644790 - DNA, 22 bp, Artificial Sequence
  chemically synthesized
ttactcagagctttagccttat

SEQ ID NO: 644791 - DNA, 22 bp, Artificial Sequence
  chemically synthesized
tactcagagctttagccttatc

SEQ ID NO: 644792 - DNA, 22 bp, Artificial Sequence
  chemically synthesized
actcagagctttagccttatct

SEQ ID NO: 644793 - DNA, 22 bp, Artificial Sequence
  chemically synthesized
ctcagagctttagccttatctc

SEQ ID NO: 644794 - DNA, 22 bp, Artificial Sequence
  chemically synthesized
gttgatgccacagagataaggc

SEQ ID NO: 644795 - DNA, 22 bp, Artificial Sequence
  chemically synthesized
ggttgatgccacagagataagg

SEQ ID NO: 644796 - DNA, 22 bp, Artificial Sequence
  chemically synthesized
agagctttagccttatctctgt

SEQ ID NO: 644797 - DNA, 22 bp, Artificial Sequence
  chemically synthesized
ttggttgatgccacagagataa

SEQ ID NO: 644798 - DNA, 22 bp, Artificial Sequence
  chemically synthesized
attcttggttgatgccacagag

SEQ ID NO: 644799 - DNA, 22 bp, Artificial Sequence
  chemically synthesized
tgattcttggttgatgccacag

SEQ ID NO: 644800 - DNA, 22 bp, Artificial Sequence
  chemically synthesized
tagccttatctctgtggcatca

SEQ ID NO: 644801 - DNA, 22 bp, Artificial Sequence
  chemically synthesized
agccttatctctgtggcatcaa

SEQ ID NO: 644802 - DNA, 22 bp, Artificial Sequence
  chemically synthesized
tctgattcttggttgatgccac

SEQ ID NO: 644803 - DNA, 22 bp, Artificial Sequence
  chemically synthesized
gccttatctctgtggcatcaac

SEQ ID NO: 644804 - DNA, 22 bp, Artificial Sequence
  chemically synthesized
atctctgtggcatcaaccaaga

SEQ ID NO: 644805 - DNA, 22 bp, Artificial Sequence
  chemically synthesized
gtgttctctgattcttggttga

SEQ ID NO: 644806 - DNA, 22 bp, Artificial Sequence
  chemically synthesized
tctctgtggcatcaaccaagaa

SEQ ID NO: 644807 - DNA, 22 bp, Artificial Sequence
  chemically synthesized
tgtggcatcaaccaagaatcag

SEQ ID NO: 644808 - DNA, 22 bp, Artificial Sequence
  chemically synthesized
tggcatcaaccaagaatcagag

SEQ ID NO: 644809 - DNA, 22 bp, Artificial Sequence
  chemically synthesized
tatgtatcccacattggtgttc

SEQ ID NO: 644810 - DNA, 22 bp, Artificial Sequence
  chemically synthesized
caaatcacaggcactgtatgta

SEQ ID NO: 644811 - DNA, 22 bp, Artificial Sequence
  chemically synthesized
ccaaatcacaggcactgtatgt

SEQ ID NO: 644812 - DNA, 22 bp, Artificial Sequence
  chemically synthesized
tccaaatcacaggcactgtatg

SEQ ID NO: 644813 - DNA, 22 bp, Artificial Sequence
  chemically synthesized
agaacccgttttccaaatcaca

SEQ ID NO: 644814 - DNA, 22 bp, Artificial Sequence
  chemically synthesized
gaatgttaagaacccgttttcc

SEQ ID NO: 644815 - DNA, 22 bp, Artificial Sequence
  chemically synthesized
agaatgttaagaacccgttttc

SEQ ID NO: 644816 - DNA, 22 bp, Artificial Sequence
  chemically synthesized
tgatttggaaaacgggttctta

SEQ ID NO: 644817 - DNA, 22 bp, Artificial Sequence
  chemically synthesized
tcataaatttagaatgttaaga

SEQ ID NO: 644818 - DNA, 22 bp, Artificial Sequence
  chemically synthesized
ggaaaacgggttcttaacattc

SEQ ID NO: 644819 - DNA, 22 bp, Artificial Sequence
  chemically synthesized
gtcataaatttagaatgttaag

SEQ ID NO: 644820 - DNA, 22 bp, Artificial Sequence
  chemically synthesized
gaaaacgggttcttaacattct

SEQ ID NO: 644821 - DNA, 22 bp, Artificial Sequence
  chemically synthesized
tgtcataaatttagaatgttaa

SEQ ID NO: 644822 - DNA, 22 bp, Artificial Sequence
  chemically synthesized
ttaacattctaaatttatgaca

SEQ ID NO: 644823 - DNA, 22 bp, Artificial Sequence
  chemically synthesized
aacattctaaatttatgacaaa

SEQ ID NO: 644824 - DNA, 22 bp, Artificial Sequence
  chemically synthesized
acattctaaatttatgacaaag

SEQ ID NO: 644825 - DNA, 22 bp, Artificial Sequence
  chemically synthesized
gcaccaggcatggctttgtcat

SEQ ID NO: 644826 - DNA, 22 bp, Artificial Sequence
  chemically synthesized
attagcaccaggcatggctttg

SEQ ID NO: 644827 - DNA, 22 bp, Artificial Sequence
  chemically synthesized
taaatttatgacaaagccatgc

SEQ ID NO: 644828 - DNA, 22 bp, Artificial Sequence
  chemically synthesized
gattagcaccaggcatggcttt

SEQ ID NO: 644829 - DNA, 22 bp, Artificial Sequence
  chemically synthesized
aatttatgacaaagccatgcct

SEQ ID NO: 644830 - DNA, 22 bp, Artificial Sequence
  chemically synthesized
ccttgattagcaccaggcatgg

SEQ ID NO: 644831 - DNA, 22 bp, Artificial Sequence
  chemically synthesized
atgacaaagccatgcctggtgc

SEQ ID NO: 644832 - DNA, 22 bp, Artificial Sequence
  chemically synthesized
tgacaaagccatgcctggtgct

SEQ ID NO: 644833 - DNA, 22 bp, Artificial Sequence
  chemically synthesized
aaactgccttgattagcaccag

SEQ ID NO: 644834 - DNA, 22 bp, Artificial Sequence
  chemically synthesized
caaactgccttgattagcacca

SEQ ID NO: 644835 - DNA, 22 bp, Artificial Sequence
  chemically synthesized
tcaaactgccttgattagcacc

SEQ ID NO: 644836 - DNA, 22 bp, Artificial Sequence
  chemically synthesized
ttcaaactgccttgattagcac

SEQ ID NO: 644837 - DNA, 22 bp, Artificial Sequence
  chemically synthesized
tttcaaactgccttgattagca

SEQ ID NO: 644838 - DNA, 22 bp, Artificial Sequence
  chemically synthesized
ccctttttcaaactgccttgat

SEQ ID NO: 644839 - DNA, 22 bp, Artificial Sequence
  chemically synthesized
tcccctttttcaaactgccttg

SEQ ID NO: 644840 - DNA, 22 bp, Artificial Sequence
  chemically synthesized
gtgctaatcaaggcagtttgaa

SEQ ID NO: 644841 - DNA, 22 bp, Artificial Sequence
  chemically synthesized
aaaattctcccctttttcaaac

SEQ ID NO: 644842 - DNA, 22 bp, Artificial Sequence
  chemically synthesized
caaaattctcccctttttcaaa

SEQ ID NO: 644843 - DNA, 22 bp, Artificial Sequence
  chemically synthesized
tcaaaattctcccctttttcaa

SEQ ID NO: 644844 - DNA, 22 bp, Artificial Sequence
  chemically synthesized
atcaaggcagtttgaaaaaggg

SEQ ID NO: 644845 - DNA, 22 bp, Artificial Sequence
  chemically synthesized
ttcaaaattctcccctttttca

SEQ ID NO: 644846 - DNA, 22 bp, Artificial Sequence
  chemically synthesized
cttttcaaaattctcccctttt

SEQ ID NO: 644847 - DNA, 22 bp, Artificial Sequence
  chemically synthesized
gcttttcaaaattctccccttt

SEQ ID NO: 644848 - DNA, 22 bp, Artificial Sequence
  chemically synthesized
cttgcttttcaaaattctcccc

SEQ ID NO: 644849 - DNA, 22 bp, Artificial Sequence
  chemically synthesized
tgcttgcttttcaaaattctcc

SEQ ID NO: 644850 - DNA, 22 bp, Artificial Sequence
  chemically synthesized
ctgcttgcttttcaaaattctc

SEQ ID NO: 644851 - DNA, 22 bp, Artificial Sequence
  chemically synthesized
tctgcttgcttttcaaaattct

SEQ ID NO: 644852 - DNA, 22 bp, Artificial Sequence
  chemically synthesized
gaaaaaggggagaattttgaaa

SEQ ID NO: 644853 - DNA, 22 bp, Artificial Sequence
  chemically synthesized
aaaaaggggagaattttgaaaa

SEQ ID NO: 644854 - DNA, 22 bp, Artificial Sequence
  chemically synthesized
ttttctgcttgcttttcaaaat

SEQ ID NO: 644855 - DNA, 22 bp, Artificial Sequence
  chemically synthesized
gttttctgcttgcttttcaaaa

SEQ ID NO: 644856 - DNA, 22 bp, Artificial Sequence
  chemically synthesized
tgttttctgcttgcttttcaaa

SEQ ID NO: 644857 - DNA, 22 bp, Artificial Sequence
  chemically synthesized
aaagactttgttttctgcttgc

SEQ ID NO: 644858 - DNA, 22 bp, Artificial Sequence
  chemically synthesized
caaagactttgttttctgcttg

SEQ ID NO: 644859 - DNA, 22 bp, Artificial Sequence
  chemically synthesized
tcaaagactttgttttctgctt

SEQ ID NO: 644860 - DNA, 22 bp, Artificial Sequence
  chemically synthesized
tgaaaagcaagcagaaaacaaa

SEQ ID NO: 644861 - DNA, 22 bp, Artificial Sequence
  chemically synthesized
gaaaagcaagcagaaaacaaag

SEQ ID NO: 644862 - DNA, 22 bp, Artificial Sequence
  chemically synthesized
aaaagcaagcagaaaacaaagt

SEQ ID NO: 644863 - DNA, 22 bp, Artificial Sequence
  chemically synthesized
gtagagaaaagcctttcaaaga

SEQ ID NO: 644864 - DNA, 22 bp, Artificial Sequence
  chemically synthesized
cgtagagaaaagcctttcaaag

SEQ ID NO: 644865 - DNA, 22 bp, Artificial Sequence
  chemically synthesized
atttcgtagagaaaagcctttc

SEQ ID NO: 644866 - DNA, 22 bp, Artificial Sequence
  chemically synthesized
caaacctaatttcgtagagaaa

SEQ ID NO: 644867 - DNA, 22 bp, Artificial Sequence
  chemically synthesized
acaaacctaatttcgtagagaa

SEQ ID NO: 644868 - DNA, 22 bp, Artificial Sequence
  chemically synthesized
tacaaacctaatttcgtagaga

SEQ ID NO: 644869 - DNA, 22 bp, Artificial Sequence
  chemically synthesized
tgaaaggcttttctctacgaaa

SEQ ID NO: 644870 - DNA, 22 bp, Artificial Sequence
  chemically synthesized
ttacaaacctaatttcgtagag

SEQ ID NO: 644871 - DNA, 22 bp, Artificial Sequence
  chemically synthesized
gaaaggcttttctctacgaaat

SEQ ID NO: 644872 - DNA, 22 bp, Artificial Sequence
  chemically synthesized
aaaggcttttctctacgaaatt

SEQ ID NO: 644873 - DNA, 22 bp, Artificial Sequence
  chemically synthesized
ttttacaaacctaatttcgtag

SEQ ID NO: 644874 - DNA, 22 bp, Artificial Sequence
  chemically synthesized
aagttcttttacaaacctaatt

SEQ ID NO: 644875 - DNA, 22 bp, Artificial Sequence
  chemically synthesized
ttctctacgaaattaggtttgt

SEQ ID NO: 644876 - DNA, 22 bp, Artificial Sequence
  chemically synthesized
tctctacgaaattaggtttgta

SEQ ID NO: 644877 - DNA, 22 bp, Artificial Sequence
  chemically synthesized
ctctacgaaattaggtttgtaa

SEQ ID NO: 644878 - DNA, 22 bp, Artificial Sequence
  chemically synthesized
actaaagttcttttacaaacct

SEQ ID NO: 644879 - DNA, 22 bp, Artificial Sequence
  chemically synthesized
tctacgaaattaggtttgtaaa

SEQ ID NO: 644880 - DNA, 22 bp, Artificial Sequence
  chemically synthesized
gactaaagttcttttacaaacc

SEQ ID NO: 644881 - DNA, 22 bp, Artificial Sequence
  chemically synthesized
tgactaaagttcttttacaaac

SEQ ID NO: 644882 - DNA, 22 bp, Artificial Sequence
  chemically synthesized
tacgaaattaggtttgtaaaag

SEQ ID NO: 644883 - DNA, 22 bp, Artificial Sequence
  chemically synthesized
ttgactaaagttcttttacaaa

SEQ ID NO: 644884 - DNA, 22 bp, Artificial Sequence
  chemically synthesized
cgaaattaggtttgtaaaagaa

SEQ ID NO: 644885 - DNA, 22 bp, Artificial Sequence
  chemically synthesized
ggtttgtaaaagaactttagtc

SEQ ID NO: 644886 - DNA, 22 bp, Artificial Sequence
  chemically synthesized
gtaaaagaactttagtcaaaag

SEQ ID NO: 644887 - DNA, 22 bp, Artificial Sequence
  chemically synthesized
taaaagaactttagtcaaaagt

SEQ ID NO: 644888 - DNA, 22 bp, Artificial Sequence
  chemically synthesized
tagcatacatgcatgcactttt

SEQ ID NO: 644889 - DNA, 22 bp, Artificial Sequence
  chemically synthesized
attgtagcatacatgcatgcac

SEQ ID NO: 644890 - DNA, 22 bp, Artificial Sequence
  chemically synthesized
aattgtagcatacatgcatgca

SEQ ID NO: 644891 - DNA, 22 bp, Artificial Sequence
  chemically synthesized
taattgtagcatacatgcatgc

SEQ ID NO: 644892 - DNA, 22 bp, Artificial Sequence
  chemically synthesized
tagtcaaaagtgcatgcatgta

SEQ ID NO: 644893 - DNA, 22 bp, Artificial Sequence
  chemically synthesized
agtcaaaagtgcatgcatgtat

SEQ ID NO: 644894 - DNA, 22 bp, Artificial Sequence
  chemically synthesized
gtcaaaagtgcatgcatgtatg

SEQ ID NO: 644895 - DNA, 22 bp, Artificial Sequence
  chemically synthesized
ttttaattgtagcatacatgca

SEQ ID NO: 644896 - DNA, 22 bp, Artificial Sequence
  chemically synthesized
attttaattgtagcatacatgc

SEQ ID NO: 644897 - DNA, 22 bp, Artificial Sequence
  chemically synthesized
aatttattttaattgtagcata

SEQ ID NO: 644898 - DNA, 22 bp, Artificial Sequence
  chemically synthesized
aagctgaatttattttaattgt

SEQ ID NO: 644899 - DNA, 22 bp, Artificial Sequence
  chemically synthesized
caattaaaataaattcagcttc

SEQ ID NO: 644900 - DNA, 22 bp, Artificial Sequence
  chemically synthesized
atgaataaatgaattgaagctg

SEQ ID NO: 644901 - DNA, 22 bp, Artificial Sequence
  chemically synthesized
aaataaattcagcttcaattca

SEQ ID NO: 644902 - DNA, 22 bp, Artificial Sequence
  chemically synthesized
aatgcattaatgaataaatgaa

SEQ ID NO: 644903 - DNA, 22 bp, Artificial Sequence
  chemically synthesized
ttgaatgcattaatgaataaat

SEQ ID NO: 644904 - DNA, 22 bp, Artificial Sequence
  chemically synthesized
agcttcaattcatttattcatt

SEQ ID NO: 644905 - DNA, 22 bp, Artificial Sequence
  chemically synthesized
gttgaatgcattaatgaataaa

SEQ ID NO: 644906 - DNA, 22 bp, Artificial Sequence
  chemically synthesized
caattcatttattcattaatgc

SEQ ID NO: 644907 - DNA, 22 bp, Artificial Sequence
  chemically synthesized
aattcatttattcattaatgca

SEQ ID NO: 644908 - DNA, 22 bp, Artificial Sequence
  chemically synthesized
atttattcattaatgcattcaa

SEQ ID NO: 644909 - DNA, 22 bp, Artificial Sequence
  chemically synthesized
aataaatatttgttgaatgcat

SEQ ID NO: 644910 - DNA, 22 bp, Artificial Sequence
  chemically synthesized
attcattaatgcattcaacaaa

SEQ ID NO: 644911 - DNA, 22 bp, Artificial Sequence
  chemically synthesized
ttcattaatgcattcaacaaat

SEQ ID NO: 644912 - DNA, 22 bp, Artificial Sequence
  chemically synthesized
attaatgcattcaacaaatatt

SEQ ID NO: 644913 - DNA, 22 bp, Artificial Sequence
  chemically synthesized
atgcattcaacaaatatttatt

SEQ ID NO: 644914 - DNA, 22 bp, Artificial Sequence
  chemically synthesized
cacatagtattcaataaatatt

SEQ ID NO: 644915 - DNA, 22 bp, Artificial Sequence
  chemically synthesized
ttgcacatagtattcaataaat

SEQ ID NO: 644916 - DNA, 22 bp, Artificial Sequence
  chemically synthesized
gttgttgcacatagtattcaat

SEQ ID NO: 644917 - DNA, 22 bp, Artificial Sequence
  chemically synthesized
aacaaatatttattgaatacta

SEQ ID NO: 644918 - DNA, 22 bp, Artificial Sequence
  chemically synthesized
ctggttgttgcacatagtattc

SEQ ID NO: 644919 - DNA, 22 bp, Artificial Sequence
  chemically synthesized
tcctggttgttgcacatagtat

SEQ ID NO: 644920 - DNA, 22 bp, Artificial Sequence
  chemically synthesized
ctcctggttgttgcacatagta

SEQ ID NO: 644921 - DNA, 22 bp, Artificial Sequence
  chemically synthesized
catttctcctggttgttgcaca

SEQ ID NO: 644922 - DNA, 22 bp, Artificial Sequence
  chemically synthesized
attgaatactatgtgcaacaac

SEQ ID NO: 644923 - DNA, 22 bp, Artificial Sequence
  chemically synthesized
ttgaatactatgtgcaacaacc

SEQ ID NO: 644924 - DNA, 22 bp, Artificial Sequence
  chemically synthesized
aatactatgtgcaacaaccagg

SEQ ID NO: 644925 - DNA, 22 bp, Artificial Sequence
  chemically synthesized
gaattccatttctcctggttgt

SEQ ID NO: 644926 - DNA, 22 bp, Artificial Sequence
  chemically synthesized
agaattccatttctcctggttg

SEQ ID NO: 644927 - DNA, 22 bp, Artificial Sequence
  chemically synthesized
tagaattccatttctcctggtt

SEQ ID NO: 644928 - DNA, 22 bp, Artificial Sequence
  chemically synthesized
tgtgcaacaaccaggagaaatg

SEQ ID NO: 644929 - DNA, 22 bp, Artificial Sequence
  chemically synthesized
cctttagaattccatttctcct

SEQ ID NO: 644930 - DNA, 22 bp, Artificial Sequence
  chemically synthesized
tgcctttagaattccatttctc

SEQ ID NO: 644931 - DNA, 22 bp, Artificial Sequence
  chemically synthesized
tctctgcctttagaattccatt

SEQ ID NO: 644932 - DNA, 22 bp, Artificial Sequence
  chemically synthesized
atctctgcctttagaattccat

SEQ ID NO: 644933 - DNA, 22 bp, Artificial Sequence
  chemically synthesized
agaggtatcttatctctgcctt

SEQ ID NO: 644934 - DNA, 22 bp, Artificial Sequence
  chemically synthesized
taaaggcagagataagatacct

SEQ ID NO: 644935 - DNA, 22 bp, Artificial Sequence
  chemically synthesized
agaagtgtctcagaggtatctt

SEQ ID NO: 644936 - DNA, 22 bp, Artificial Sequence
  chemically synthesized
aaggcagagataagatacctct

SEQ ID NO: 644937 - DNA, 22 bp, Artificial Sequence
  chemically synthesized
gagaagtgtctcagaggtatct

SEQ ID NO: 644938 - DNA, 22 bp, Artificial Sequence
  chemically synthesized
tttgagaagtgtctcagaggta

SEQ ID NO: 644939 - DNA, 22 bp, Artificial Sequence
  chemically synthesized
tgagacacttctcaaacagcca

SEQ ID NO: 644940 - DNA, 22 bp, Artificial Sequence
  chemically synthesized
gaaaaacagaggatggctgttt

SEQ ID NO: 644941 - DNA, 22 bp, Artificial Sequence
  chemically synthesized
agacacttctcaaacagccatc

SEQ ID NO: 644942 - DNA, 22 bp, Artificial Sequence
  chemically synthesized
ctcaaacagccatcctctgttt

SEQ ID NO: 644943 - DNA, 22 bp, Artificial Sequence
  chemically synthesized
tcaaacagccatcctctgtttt

SEQ ID NO: 644944 - DNA, 22 bp, Artificial Sequence
  chemically synthesized
caaccccctagaaaaacagagg

SEQ ID NO: 644945 - DNA, 22 bp, Artificial Sequence
  chemically synthesized
aaacagccatcctctgtttttc

SEQ ID NO: 644946 - DNA, 22 bp, Artificial Sequence
  chemically synthesized
cctacaaccccctagaaaaaca

SEQ ID NO: 644947 - DNA, 22 bp, Artificial Sequence
  chemically synthesized
atgacacctccctacaaccccc

SEQ ID NO: 644948 - DNA, 22 bp, Artificial Sequence
  chemically synthesized
tgtttttctagggggttgtagg

SEQ ID NO: 644949 - DNA, 22 bp, Artificial Sequence
  chemically synthesized
ttcatgacacctccctacaacc

SEQ ID NO: 644950 - DNA, 22 bp, Artificial Sequence
  chemically synthesized
tttttctagggggttgtaggga

SEQ ID NO: 644951 - DNA, 22 bp, Artificial Sequence
  chemically synthesized
attcatgacacctccctacaac

SEQ ID NO: 644952 - DNA, 22 bp, Artificial Sequence
  chemically synthesized
ttattcatgacacctccctaca

SEQ ID NO: 644953 - DNA, 22 bp, Artificial Sequence
  chemically synthesized
ttctagggggttgtagggaggt

SEQ ID NO: 644954 - DNA, 22 bp, Artificial Sequence
  chemically synthesized
tctagggggttgtagggaggtg

SEQ ID NO: 644955 - DNA, 22 bp, Artificial Sequence
  chemically synthesized
ctagggggttgtagggaggtgt

SEQ ID NO: 644956 - DNA, 22 bp, Artificial Sequence
  chemically synthesized
ttcttattcatgacacctccct

SEQ ID NO: 644957 - DNA, 22 bp, Artificial Sequence
  chemically synthesized
tagggggttgtagggaggtgtc

SEQ ID NO: 644958 - DNA, 22 bp, Artificial Sequence
  chemically synthesized
gggggttgtagggaggtgtcat

SEQ ID NO: 644959 - DNA, 22 bp, Artificial Sequence
  chemically synthesized
attgttcttattcatgacacct

SEQ ID NO: 644960 - DNA, 22 bp, Artificial Sequence
  chemically synthesized
cattaattgttcttattcatga

SEQ ID NO: 644961 - DNA, 22 bp, Artificial Sequence
  chemically synthesized
tagggaggtgtcatgaataaga

SEQ ID NO: 644962 - DNA, 22 bp, Artificial Sequence
  chemically synthesized
aattccattaattgttcttatt

SEQ ID NO: 644963 - DNA, 22 bp, Artificial Sequence
  chemically synthesized
ttaaattccattaattgttctt

SEQ ID NO: 644964 - DNA, 22 bp, Artificial Sequence
  chemically synthesized
attaaattccattaattgttct

SEQ ID NO: 644965 - DNA, 22 bp, Artificial Sequence
  chemically synthesized
gatatttattaaattccattaa

SEQ ID NO: 644966 - DNA, 22 bp, Artificial Sequence
  chemically synthesized
actagatatttattaaattcca

SEQ ID NO: 644967 - DNA, 22 bp, Artificial Sequence
  chemically synthesized
ctgactagatatttattaaatt

SEQ ID NO: 644968 - DNA, 22 bp, Artificial Sequence
  chemically synthesized
atggaatttaataaatatctag

SEQ ID NO: 644969 - DNA, 22 bp, Artificial Sequence
  chemically synthesized
gagagccccattcctgactaga

SEQ ID NO: 644970 - DNA, 22 bp, Artificial Sequence
  chemically synthesized
aataaatatctagtcaggaatg

SEQ ID NO: 644971 - DNA, 22 bp, Artificial Sequence
  chemically synthesized
ataaatatctagtcaggaatgg

SEQ ID NO: 644972 - DNA, 22 bp, Artificial Sequence
  chemically synthesized
gtcaggaatggggctctccagg

SEQ ID NO: 644973 - DNA, 22 bp, Artificial Sequence
  chemically synthesized
caaataacagcaaaagagagag

SEQ ID NO: 644974 - DNA, 22 bp, Artificial Sequence
  chemically synthesized
tctccaaataacagcaaaagag

SEQ ID NO: 644975 - DNA, 22 bp, Artificial Sequence
  chemically synthesized
tccaggcctctctcttttgctg

SEQ ID NO: 644976 - DNA, 22 bp, Artificial Sequence
  chemically synthesized
atctccaaataacagcaaaaga

SEQ ID NO: 644977 - DNA, 22 bp, Artificial Sequence
  chemically synthesized
caggcctctctcttttgctgtt

SEQ ID NO: 644978 - DNA, 22 bp, Artificial Sequence
  chemically synthesized
tgatttatctccaaataacagc

SEQ ID NO: 644979 - DNA, 22 bp, Artificial Sequence
  chemically synthesized
tctcttttgctgttatttggag

SEQ ID NO: 644980 - DNA, 22 bp, Artificial Sequence
  chemically synthesized
gctgtgatttatctccaaataa

SEQ ID NO: 644981 - DNA, 22 bp, Artificial Sequence
  chemically synthesized
agctgtgatttatctccaaata

SEQ ID NO: 644982 - DNA, 22 bp, Artificial Sequence
  chemically synthesized
tcttttgctgttatttggagat

SEQ ID NO: 644983 - DNA, 22 bp, Artificial Sequence
  chemically synthesized
tagctgtgatttatctccaaat

SEQ ID NO: 644984 - DNA, 22 bp, Artificial Sequence
  chemically synthesized
ttttgctgttatttggagataa

SEQ ID NO: 644985 - DNA, 22 bp, Artificial Sequence
  chemically synthesized
ctttagctgtgatttatctcca

SEQ ID NO: 644986 - DNA, 22 bp, Artificial Sequence
  chemically synthesized
ttgctgttatttggagataaat

SEQ ID NO: 644987 - DNA, 22 bp, Artificial Sequence
  chemically synthesized
tgctgttatttggagataaatc

SEQ ID NO: 644988 - DNA, 22 bp, Artificial Sequence
  chemically synthesized
gctgttatttggagataaatca

SEQ ID NO: 644989 - DNA, 22 bp, Artificial Sequence
  chemically synthesized
ctgttatttggagataaatcac

SEQ ID NO: 644990 - DNA, 22 bp, Artificial Sequence
  chemically synthesized
tgttcctttagctgtgatttat

SEQ ID NO: 644991 - DNA, 22 bp, Artificial Sequence
  chemically synthesized
atgttcctttagctgtgattta

SEQ ID NO: 644992 - DNA, 22 bp, Artificial Sequence
  chemically synthesized
ttatttggagataaatcacagc

SEQ ID NO: 644993 - DNA, 22 bp, Artificial Sequence
  chemically synthesized
tatgttcctttagctgtgattt

SEQ ID NO: 644994 - DNA, 22 bp, Artificial Sequence
  chemically synthesized
tttggagataaatcacagctaa

SEQ ID NO: 644995 - DNA, 22 bp, Artificial Sequence
  chemically synthesized
ggagataaatcacagctaaagg

SEQ ID NO: 644996 - DNA, 22 bp, Artificial Sequence
  chemically synthesized
gagataaatcacagctaaagga

SEQ ID NO: 644997 - DNA, 22 bp, Artificial Sequence
  chemically synthesized
atatatatattttatgttcctt

SEQ ID NO: 644998 - DNA, 22 bp, Artificial Sequence
  chemically synthesized
ttaatatatatattttatgttc

SEQ ID NO: 644999 - DNA, 22 bp, Artificial Sequence
  chemically synthesized
atctgttaatatatatatttta

SEQ ID NO: 645000 - DNA, 22 bp, Artificial Sequence
  chemically synthesized
ttgatctgttaatatatatatt

SEQ ID NO: 645001 - DNA, 22 bp, Artificial Sequence
  chemically synthesized
aaggaacataaaatatatatat

SEQ ID NO: 645002 - DNA, 22 bp, Artificial Sequence
  chemically synthesized
attgatctgttaatatatatat

SEQ ID NO: 645003 - DNA, 22 bp, Artificial Sequence
  chemically synthesized
gatgtgtacttattgatctgtt

SEQ ID NO: 645004 - DNA, 22 bp, Artificial Sequence
  chemically synthesized
ggatgtgtacttattgatctgt

SEQ ID NO: 645005 - DNA, 22 bp, Artificial Sequence
  chemically synthesized
tggatgtgtacttattgatctg

SEQ ID NO: 645006 - DNA, 22 bp, Artificial Sequence
  chemically synthesized
acagatcaataagtacacatcc

SEQ ID NO: 645007 - DNA, 22 bp, Artificial Sequence
  chemically synthesized
ccccaagtcctttggatgtgta

SEQ ID NO: 645008 - DNA, 22 bp, Artificial Sequence
  chemically synthesized
agattgccccaagtcctttgga

SEQ ID NO: 645009 - DNA, 22 bp, Artificial Sequence
  chemically synthesized
aaattgagattgccccaagtcc

SEQ ID NO: 645010 - DNA, 22 bp, Artificial Sequence
  chemically synthesized
aaaattgagattgccccaagtc

SEQ ID NO: 645011 - DNA, 22 bp, Artificial Sequence
  chemically synthesized
ggggcaatctcaattttaaata

SEQ ID NO: 645012 - DNA, 22 bp, Artificial Sequence
  chemically synthesized
gggcaatctcaattttaaatat

SEQ ID NO: 645013 - DNA, 22 bp, Artificial Sequence
  chemically synthesized
gagaaaataagaaagtatattt

SEQ ID NO: 645014 - DNA, 22 bp, Artificial Sequence
  chemically synthesized
agagaaaataagaaagtatatt

SEQ ID NO: 645015 - DNA, 22 bp, Artificial Sequence
  chemically synthesized
tagagaaaataagaaagtatat

SEQ ID NO: 645016 - DNA, 22 bp, Artificial Sequence
  chemically synthesized
ttagagaaaataagaaagtata

SEQ ID NO: 645017 - DNA, 22 bp, Artificial Sequence
  chemically synthesized
aattttaaatatactttcttat

SEQ ID NO: 645018 - DNA, 22 bp, Artificial Sequence
  chemically synthesized
taaatatactttcttattttct

SEQ ID NO: 645019 - DNA, 22 bp, Artificial Sequence
  chemically synthesized
aaatatactttcttattttctc

SEQ ID NO: 645020 - DNA, 22 bp, Artificial Sequence
  chemically synthesized
aatatactttcttattttctct

SEQ ID NO: 645021 - DNA, 22 bp, Artificial Sequence
  chemically synthesized
acaaatacgagcatacttttag

SEQ ID NO: 645022 - DNA, 22 bp, Artificial Sequence
  chemically synthesized
tcttattttctctaaaagtatg

SEQ ID NO: 645023 - DNA, 22 bp, Artificial Sequence
  chemically synthesized
cttattttctctaaaagtatgc

SEQ ID NO: 645024 - DNA, 22 bp, Artificial Sequence
  chemically synthesized
ttattttctctaaaagtatgct

SEQ ID NO: 645025 - DNA, 22 bp, Artificial Sequence
  chemically synthesized
attttctctaaaagtatgctcg

SEQ ID NO: 645026 - DNA, 22 bp, Artificial Sequence
  chemically synthesized
ttttctctaaaagtatgctcgt

SEQ ID NO: 645027 - DNA, 22 bp, Artificial Sequence
  chemically synthesized
tctctaaaagtatgctcgtatt

SEQ ID NO: 645028 - DNA, 22 bp, Artificial Sequence
  chemically synthesized
cgcaatctgacaaatacgagca

SEQ ID NO: 645029 - DNA, 22 bp, Artificial Sequence
  chemically synthesized
ctctaaaagtatgctcgtattt

SEQ ID NO: 645030 - DNA, 22 bp, Artificial Sequence
  chemically synthesized
tctaaaagtatgctcgtatttg

SEQ ID NO: 645031 - DNA, 22 bp, Artificial Sequence
  chemically synthesized
taaaagtatgctcgtatttgtc

SEQ ID NO: 645032 - DNA, 22 bp, Artificial Sequence
  chemically synthesized
ggctacgcaatctgacaaatac

SEQ ID NO: 645033 - DNA, 22 bp, Artificial Sequence
  chemically synthesized
aaagtatgctcgtatttgtcag

SEQ ID NO: 645034 - DNA, 22 bp, Artificial Sequence
  chemically synthesized
agtcagcattgggctacgcaat

SEQ ID NO: 645035 - DNA, 22 bp, Artificial Sequence
  chemically synthesized
gtatttgtcagattgcgtagcc

SEQ ID NO: 645036 - DNA, 22 bp, Artificial Sequence
  chemically synthesized
gtcagattgcgtagcccaatgc

SEQ ID NO: 645037 - DNA, 22 bp, Artificial Sequence
  chemically synthesized
tgtcctaagtcagcattgggct

SEQ ID NO: 645038 - DNA, 22 bp, Artificial Sequence
  chemically synthesized
tcagattgcgtagcccaatgct

SEQ ID NO: 645039 - DNA, 22 bp, Artificial Sequence
  chemically synthesized
gctatgtcctaagtcagcattg

SEQ ID NO: 645040 - DNA, 22 bp, Artificial Sequence
  chemically synthesized
gctggctatgtcctaagtcagc

SEQ ID NO: 645041 - DNA, 22 bp, Artificial Sequence
  chemically synthesized
cgtagcccaatgctgacttagg

SEQ ID NO: 645042 - DNA, 22 bp, Artificial Sequence
  chemically synthesized
tgcatgtctagctggctatgtc

SEQ ID NO: 645043 - DNA, 22 bp, Artificial Sequence
  chemically synthesized
tgtgcatgtctagctggctatg

SEQ ID NO: 645044 - DNA, 22 bp, Artificial Sequence
  chemically synthesized
tctgtgcatgtctagctggcta

SEQ ID NO: 645045 - DNA, 22 bp, Artificial Sequence
  chemically synthesized
acttaggacatagccagctaga

SEQ ID NO: 645046 - DNA, 22 bp, Artificial Sequence
  chemically synthesized
aggacatagccagctagacatg

SEQ ID NO: 645047 - DNA, 22 bp, Artificial Sequence
  chemically synthesized
ggacatagccagctagacatgc

SEQ ID NO: 645048 - DNA, 22 bp, Artificial Sequence
  chemically synthesized
gatgccctctctgtgcatgtct

SEQ ID NO: 645049 - DNA, 22 bp, Artificial Sequence
  chemically synthesized
agatgccctctctgtgcatgtc

SEQ ID NO: 645050 - DNA, 22 bp, Artificial Sequence
  chemically synthesized
tagatgccctctctgtgcatgt

SEQ ID NO: 645051 - DNA, 22 bp, Artificial Sequence
  chemically synthesized
tttagatgccctctctgtgcat

SEQ ID NO: 645052 - DNA, 22 bp, Artificial Sequence
  chemically synthesized
gacatgcacagagagggcatct

SEQ ID NO: 645053 - DNA, 22 bp, Artificial Sequence
  chemically synthesized
agaaaacccaggaattctttag

SEQ ID NO: 645054 - DNA, 22 bp, Artificial Sequence
  chemically synthesized
ttgagaaaacccaggaattctt

SEQ ID NO: 645055 - DNA, 22 bp, Artificial Sequence
  chemically synthesized
ctgttgagaaaacccaggaatt

SEQ ID NO: 645056 - DNA, 22 bp, Artificial Sequence
  chemically synthesized
cctgttgagaaaacccaggaat

SEQ ID NO: 645057 - DNA, 22 bp, Artificial Sequence
  chemically synthesized
ccatttcctgttgagaaaaccc

SEQ ID NO: 645058 - DNA, 22 bp, Artificial Sequence
  chemically synthesized
gccatttcctgttgagaaaacc

SEQ ID NO: 645059 - DNA, 22 bp, Artificial Sequence
  chemically synthesized
aagaattcctgggttttctcaa

SEQ ID NO: 645060 - DNA, 22 bp, Artificial Sequence
  chemically synthesized
atttgccatttcctgttgagaa

SEQ ID NO: 645061 - DNA, 22 bp, Artificial Sequence
  chemically synthesized
aatttgccatttcctgttgaga

SEQ ID NO: 645062 - DNA, 22 bp, Artificial Sequence
  chemically synthesized
taatttgccatttcctgttgag

SEQ ID NO: 645063 - DNA, 22 bp, Artificial Sequence
  chemically synthesized
ctgggttttctcaacaggaaat

SEQ ID NO: 645064 - DNA, 22 bp, Artificial Sequence
  chemically synthesized
ggttttctcaacaggaaatggc

SEQ ID NO: 645065 - DNA, 22 bp, Artificial Sequence
  chemically synthesized
aggagcctttaatttgccattt

SEQ ID NO: 645066 - DNA, 22 bp, Artificial Sequence
  chemically synthesized
aaggagcctttaatttgccatt

SEQ ID NO: 645067 - DNA, 22 bp, Artificial Sequence
  chemically synthesized
tctcaacaggaaatggcaaatt

SEQ ID NO: 645068 - DNA, 22 bp, Artificial Sequence
  chemically synthesized
ctcaacaggaaatggcaaatta

SEQ ID NO: 645069 - DNA, 22 bp, Artificial Sequence
  chemically synthesized
tcaacaggaaatggcaaattaa

SEQ ID NO: 645070 - DNA, 22 bp, Artificial Sequence
  chemically synthesized
cttaaggagcctttaatttgcc

SEQ ID NO: 645071 - DNA, 22 bp, Artificial Sequence
  chemically synthesized
aacaggaaatggcaaattaaag

SEQ ID NO: 645072 - DNA, 22 bp, Artificial Sequence
  chemically synthesized
agtgttgcttaaggagccttta

SEQ ID NO: 645073 - DNA, 22 bp, Artificial Sequence
  chemically synthesized
aattcagtgttgcttaaggagc

SEQ ID NO: 645074 - DNA, 22 bp, Artificial Sequence
  chemically synthesized
gaattcagtgttgcttaaggag

SEQ ID NO: 645075 - DNA, 22 bp, Artificial Sequence
  chemically synthesized
cccttgaattcagtgttgctta

SEQ ID NO: 645076 - DNA, 22 bp, Artificial Sequence
  chemically synthesized
aaggctccttaagcaacactga

SEQ ID NO: 645077 - DNA, 22 bp, Artificial Sequence
  chemically synthesized
gctacccttgaattcagtgttg

SEQ ID NO: 645078 - DNA, 22 bp, Artificial Sequence
  chemically synthesized
cgctacccttgaattcagtgtt

SEQ ID NO: 645079 - DNA, 22 bp, Artificial Sequence
  chemically synthesized
ccttcgctacccttgaattcag

SEQ ID NO: 645080 - DNA, 22 bp, Artificial Sequence
  chemically synthesized
cttaagcaacactgaattcaag

SEQ ID NO: 645081 - DNA, 22 bp, Artificial Sequence
  chemically synthesized
gccttcgctacccttgaattca

SEQ ID NO: 645082 - DNA, 22 bp, Artificial Sequence
  chemically synthesized
aagcaacactgaattcaagggt

SEQ ID NO: 645083 - DNA, 22 bp, Artificial Sequence
  chemically synthesized
agcaacactgaattcaagggta

SEQ ID NO: 645084 - DNA, 22 bp, Artificial Sequence
  chemically synthesized
gatttgccttcgctacccttga

SEQ ID NO: 645085 - DNA, 22 bp, Artificial Sequence
  chemically synthesized
aattcaagggtagcgaaggcaa

SEQ ID NO: 645086 - DNA, 22 bp, Artificial Sequence
  chemically synthesized
agagccctagatttgccttcgc

SEQ ID NO: 645087 - DNA, 22 bp, Artificial Sequence
  chemically synthesized
cagagccctagatttgccttcg

SEQ ID NO: 645088 - DNA, 22 bp, Artificial Sequence
  chemically synthesized
aagggtagcgaaggcaaatcta

SEQ ID NO: 645089 - DNA, 22 bp, Artificial Sequence
  chemically synthesized
cgcaaggagcttcagagcccta

SEQ ID NO: 645090 - DNA, 22 bp, Artificial Sequence
  chemically synthesized
tgcgcaaggagcttcagagccc

SEQ ID NO: 645091 - DNA, 22 bp, Artificial Sequence
  chemically synthesized
cagttctgcgcaaggagcttca

SEQ ID NO: 645092 - DNA, 22 bp, Artificial Sequence
  chemically synthesized
gcagttctgcgcaaggagcttc

SEQ ID NO: 645093 - DNA, 22 bp, Artificial Sequence
  chemically synthesized
ttgcagttctgcgcaaggagct

SEQ ID NO: 645094 - DNA, 22 bp, Artificial Sequence
  chemically synthesized
cttgcagttctgcgcaaggagc

SEQ ID NO: 645095 - DNA, 22 bp, Artificial Sequence
  chemically synthesized
gggctctgaagctccttgcgca

SEQ ID NO: 645096 - DNA, 22 bp, Artificial Sequence
  chemically synthesized
tcttcttgcagttctgcgcaag

SEQ ID NO: 645097 - DNA, 22 bp, Artificial Sequence
  chemically synthesized
tgaagctccttgcgcagaactg

SEQ ID NO: 645098 - DNA, 22 bp, Artificial Sequence
  chemically synthesized
tcctgtcttcttgcagttctgc

SEQ ID NO: 645099 - DNA, 22 bp, Artificial Sequence
  chemically synthesized
aagctccttgcgcagaactgca

SEQ ID NO: 645100 - DNA, 22 bp, Artificial Sequence
  chemically synthesized
ccctgtcctgtcttcttgcagt

SEQ ID NO: 645101 - DNA, 22 bp, Artificial Sequence
  chemically synthesized
cttgcgcagaactgcaagaaga

SEQ ID NO: 645102 - DNA, 22 bp, Artificial Sequence
  chemically synthesized
gcgcagaactgcaagaagacag

SEQ ID NO: 645103 - DNA, 22 bp, Artificial Sequence
  chemically synthesized
atctgccctgtcctgtcttctt

SEQ ID NO: 645104 - DNA, 22 bp, Artificial Sequence
  chemically synthesized
cgcagaactgcaagaagacagg

SEQ ID NO: 645105 - DNA, 22 bp, Artificial Sequence
  chemically synthesized
gatctgccctgtcctgtcttct

SEQ ID NO: 645106 - DNA, 22 bp, Artificial Sequence
  chemically synthesized
tgatctgccctgtcctgtcttc

SEQ ID NO: 645107 - DNA, 22 bp, Artificial Sequence
  chemically synthesized
tttgatctgccctgtcctgtct

SEQ ID NO: 645108 - DNA, 22 bp, Artificial Sequence
  chemically synthesized
ctttgatctgccctgtcctgtc

SEQ ID NO: 645109 - DNA, 22 bp, Artificial Sequence
  chemically synthesized
tctttgatctgccctgtcctgt

SEQ ID NO: 645110 - DNA, 22 bp, Artificial Sequence
  chemically synthesized
caagaagacaggacagggcaga

SEQ ID NO: 645111 - DNA, 22 bp, Artificial Sequence
  chemically synthesized
aaaacagcccgtgtgttttctt

SEQ ID NO: 645112 - DNA, 22 bp, Artificial Sequence
  chemically synthesized
ctgaaaacagcccgtgtgtttt

SEQ ID NO: 645113 - DNA, 22 bp, Artificial Sequence
  chemically synthesized
cctgaaaacagcccgtgtgttt

SEQ ID NO: 645114 - DNA, 22 bp, Artificial Sequence
  chemically synthesized
ccttcctgaaaacagcccgtgt

SEQ ID NO: 645115 - DNA, 22 bp, Artificial Sequence
  chemically synthesized
cacagagttcccttcctgaaaa

SEQ ID NO: 645116 - DNA, 22 bp, Artificial Sequence
  chemically synthesized
ttttcaggaagggaactctgtg

SEQ ID NO: 645117 - DNA, 22 bp, Artificial Sequence
  chemically synthesized
caaagaaatgtctccacagagt

SEQ ID NO: 645118 - DNA, 22 bp, Artificial Sequence
  chemically synthesized
tcaggaagggaactctgtggag

SEQ ID NO: 645119 - DNA, 22 bp, Artificial Sequence
  chemically synthesized
caggaagggaactctgtggaga

SEQ ID NO: 645120 - DNA, 22 bp, Artificial Sequence
  chemically synthesized
aggaagggaactctgtggagac

SEQ ID NO: 645121 - DNA, 22 bp, Artificial Sequence
  chemically synthesized
ccaaattccaaagaaatgtctc

SEQ ID NO: 645122 - DNA, 22 bp, Artificial Sequence
  chemically synthesized
taccaaattccaaagaaatgtc

SEQ ID NO: 645123 - DNA, 22 bp, Artificial Sequence
  chemically synthesized
ctaccaaattccaaagaaatgt

SEQ ID NO: 645124 - DNA, 22 bp, Artificial Sequence
  chemically synthesized
tgtggagacatttctttggaat

SEQ ID NO: 645125 - DNA, 22 bp, Artificial Sequence
  chemically synthesized
accttctaccaaattccaaaga

SEQ ID NO: 645126 - DNA, 22 bp, Artificial Sequence
  chemically synthesized
gaccttctaccaaattccaaag

SEQ ID NO: 645127 - DNA, 22 bp, Artificial Sequence
  chemically synthesized
tggagacatttctttggaattt

SEQ ID NO: 645128 - DNA, 22 bp, Artificial Sequence
  chemically synthesized
tttgaccttctaccaaattcca

SEQ ID NO: 645129 - DNA, 22 bp, Artificial Sequence
  chemically synthesized
tcctatttgaccttctaccaaa

SEQ ID NO: 645130 - DNA, 22 bp, Artificial Sequence
  chemically synthesized
gtcctatttgaccttctaccaa

SEQ ID NO: 645131 - DNA, 22 bp, Artificial Sequence
  chemically synthesized
tgtcctatttgaccttctacca

SEQ ID NO: 645132 - DNA, 22 bp, Artificial Sequence
  chemically synthesized
ctttggaatttggtagaaggtc

SEQ ID NO: 645133 - DNA, 22 bp, Artificial Sequence
  chemically synthesized
tttggaatttggtagaaggtca

SEQ ID NO: 645134 - DNA, 22 bp, Artificial Sequence
  chemically synthesized
attttgtcctatttgaccttct

SEQ ID NO: 645135 - DNA, 22 bp, Artificial Sequence
  chemically synthesized
tggaatttggtagaaggtcaaa

SEQ ID NO: 645136 - DNA, 22 bp, Artificial Sequence
  chemically synthesized
cattttgtcctatttgaccttc

SEQ ID NO: 645137 - DNA, 22 bp, Artificial Sequence
  chemically synthesized
ggaatttggtagaaggtcaaat

SEQ ID NO: 645138 - DNA, 22 bp, Artificial Sequence
  chemically synthesized
gaatttggtagaaggtcaaata

SEQ ID NO: 645139 - DNA, 22 bp, Artificial Sequence
  chemically synthesized
tcccttcattttgtcctatttg

SEQ ID NO: 645140 - DNA, 22 bp, Artificial Sequence
  chemically synthesized
ggtagaaggtcaaataggacaa

SEQ ID NO: 645141 - DNA, 22 bp, Artificial Sequence
  chemically synthesized
gtagaaggtcaaataggacaaa

SEQ ID NO: 645142 - DNA, 22 bp, Artificial Sequence
  chemically synthesized
attgtcccttcattttgtccta

SEQ ID NO: 645143 - DNA, 22 bp, Artificial Sequence
  chemically synthesized
cattgtcccttcattttgtcct

SEQ ID NO: 645144 - DNA, 22 bp, Artificial Sequence
  chemically synthesized
cttcattgtcccttcattttgt

SEQ ID NO: 645145 - DNA, 22 bp, Artificial Sequence
  chemically synthesized
ccttcattgtcccttcattttg

SEQ ID NO: 645146 - DNA, 22 bp, Artificial Sequence
  chemically synthesized
acgaaatgatcaggatgagctt

SEQ ID NO: 645147 - DNA, 22 bp, Artificial Sequence
  chemically synthesized
cacgaaatgatcaggatgagct

SEQ ID NO: 645148 - DNA, 22 bp, Artificial Sequence
  chemically synthesized
accttcacgaaatgatcaggat

SEQ ID NO: 645149 - DNA, 22 bp, Artificial Sequence
  chemically synthesized
gaccttcacgaaatgatcagga

SEQ ID NO: 645150 - DNA, 22 bp, Artificial Sequence
  chemically synthesized
ccttgaccttcacgaaatgatc

SEQ ID NO: 645151 - DNA, 22 bp, Artificial Sequence
  chemically synthesized
atcctgatcatttcgtgaaggt

SEQ ID NO: 645152 - DNA, 22 bp, Artificial Sequence
  chemically synthesized
tgtaagttaccttgaccttcac

SEQ ID NO: 645153 - DNA, 22 bp, Artificial Sequence
  chemically synthesized
gtgtaagttaccttgaccttca

SEQ ID NO: 645154 - DNA, 22 bp, Artificial Sequence
  chemically synthesized
tgtgtaagttaccttgaccttc

SEQ ID NO: 645155 - DNA, 22 bp, Artificial Sequence
  chemically synthesized
atcatttcgtgaaggtcaaggt

SEQ ID NO: 645156 - DNA, 22 bp, Artificial Sequence
  chemically synthesized
cgtgaaggtcaaggtaacttac

SEQ ID NO: 645157 - DNA, 22 bp, Artificial Sequence
  chemically synthesized
gtgaaggtcaaggtaacttaca

SEQ ID NO: 645158 - DNA, 22 bp, Artificial Sequence
  chemically synthesized
atgcaaatctttgtgtaagtta

SEQ ID NO: 645159 - DNA, 22 bp, Artificial Sequence
  chemically synthesized
gggttgatgcaaatctttgtgt

SEQ ID NO: 645160 - DNA, 22 bp, Artificial Sequence
  chemically synthesized
tggggttgatgcaaatctttgt

SEQ ID NO: 645161 - DNA, 22 bp, Artificial Sequence
  chemically synthesized
acacaaagatttgcatcaaccc

SEQ ID NO: 645162 - DNA, 22 bp, Artificial Sequence
  chemically synthesized
cacaaagatttgcatcaacccc

SEQ ID NO: 645163 - DNA, 22 bp, Artificial Sequence
  chemically synthesized
caaaatgaggactctggggttg

SEQ ID NO: 645164 - DNA, 22 bp, Artificial Sequence
  chemically synthesized
gagctccaaaatgaggactctg

SEQ ID NO: 645165 - DNA, 22 bp, Artificial Sequence
  chemically synthesized
agagctccaaaatgaggactct

SEQ ID NO: 645166 - DNA, 22 bp, Artificial Sequence
  chemically synthesized
gcatcaaccccagagtcctcat

SEQ ID NO: 645167 - DNA, 22 bp, Artificial Sequence
  chemically synthesized
catcaaccccagagtcctcatt

SEQ ID NO: 645168 - DNA, 22 bp, Artificial Sequence
  chemically synthesized
cttagagctccaaaatgaggac

SEQ ID NO: 645169 - DNA, 22 bp, Artificial Sequence
  chemically synthesized
attttggagctctaagtaggcc

SEQ ID NO: 645170 - DNA, 22 bp, Artificial Sequence
  chemically synthesized
tggagctctaagtaggcctggt

SEQ ID NO: 645171 - DNA, 22 bp, Artificial Sequence
  chemically synthesized
ggagctctaagtaggcctggtg

SEQ ID NO: 645172 - DNA, 22 bp, Artificial Sequence
  chemically synthesized
gagctctaagtaggcctggtgt

SEQ ID NO: 645173 - DNA, 22 bp, Artificial Sequence
  chemically synthesized
aaagaacaaaaaacataacacc

SEQ ID NO: 645174 - DNA, 22 bp, Artificial Sequence
  chemically synthesized
taagtaggcctggtgttatgtt

SEQ ID NO: 645175 - DNA, 22 bp, Artificial Sequence
  chemically synthesized
taaaagaacaaaaaacataaca

SEQ ID NO: 645176 - DNA, 22 bp, Artificial Sequence
  chemically synthesized
agtaggcctggtgttatgtttt

SEQ ID NO: 645177 - DNA, 22 bp, Artificial Sequence
  chemically synthesized
tctaaaagaacaaaaaacataa

SEQ ID NO: 645178 - DNA, 22 bp, Artificial Sequence
  chemically synthesized
ttctctaaaagaacaaaaaaca

SEQ ID NO: 645179 - DNA, 22 bp, Artificial Sequence
  chemically synthesized
gttctctaaaagaacaaaaaac

SEQ ID NO: 645180 - DNA, 22 bp, Artificial Sequence
  chemically synthesized
gtgttatgttttttgttctttt

SEQ ID NO: 645181 - DNA, 22 bp, Artificial Sequence
  chemically synthesized
tgttttttgttcttttagagaa

SEQ ID NO: 645182 - DNA, 22 bp, Artificial Sequence
  chemically synthesized
tttgttcttttagagaacaaac

SEQ ID NO: 645183 - DNA, 22 bp, Artificial Sequence
  chemically synthesized
ttgttcttttagagaacaaacc

SEQ ID NO: 645184 - DNA, 22 bp, Artificial Sequence
  chemically synthesized
caagaatgggatggtttgttct

SEQ ID NO: 645185 - DNA, 22 bp, Artificial Sequence
  chemically synthesized
tgttcttttagagaacaaacca

SEQ ID NO: 645186 - DNA, 22 bp, Artificial Sequence
  chemically synthesized
gttcttttagagaacaaaccat

SEQ ID NO: 645187 - DNA, 22 bp, Artificial Sequence
  chemically synthesized
tccaagaatgggatggtttgtt

SEQ ID NO: 645188 - DNA, 22 bp, Artificial Sequence
  chemically synthesized
ttcttttagagaacaaaccatc

SEQ ID NO: 645189 - DNA, 22 bp, Artificial Sequence
  chemically synthesized
ttttagagaacaaaccatccca

SEQ ID NO: 645190 - DNA, 22 bp, Artificial Sequence
  chemically synthesized
ttagagaacaaaccatcccatt

SEQ ID NO: 645191 - DNA, 22 bp, Artificial Sequence
  chemically synthesized
tagagaacaaaccatcccattc

SEQ ID NO: 645192 - DNA, 22 bp, Artificial Sequence
  chemically synthesized
agagaacaaaccatcccattct

SEQ ID NO: 645193 - DNA, 22 bp, Artificial Sequence
  chemically synthesized
gagaacaaaccatcccattctt

SEQ ID NO: 645194 - DNA, 22 bp, Artificial Sequence
  chemically synthesized
gaagatatccaagaccattctc

SEQ ID NO: 645195 - DNA, 22 bp, Artificial Sequence
  chemically synthesized
ccctggaagatatccaagacca

SEQ ID NO: 645196 - DNA, 22 bp, Artificial Sequence
  chemically synthesized
accctggaagatatccaagacc

SEQ ID NO: 645197 - DNA, 22 bp, Artificial Sequence
  chemically synthesized
taccctggaagatatccaagac

SEQ ID NO: 645198 - DNA, 22 bp, Artificial Sequence
  chemically synthesized
ttggagaatggtcttggatatc

SEQ ID NO: 645199 - DNA, 22 bp, Artificial Sequence
  chemically synthesized
ggagaatggtcttggatatctt

SEQ ID NO: 645200 - DNA, 22 bp, Artificial Sequence
  chemically synthesized
gagaatggtcttggatatcttc

SEQ ID NO: 645201 - DNA, 22 bp, Artificial Sequence
  chemically synthesized
ggatatcttccagggtaaagcg

SEQ ID NO: 645202 - DNA, 22 bp, Artificial Sequence
  chemically synthesized
gatatcttccagggtaaagcgg

SEQ ID NO: 645203 - DNA, 22 bp, Artificial Sequence
  chemically synthesized
tggcacagcgataaccgcttta

SEQ ID NO: 645204 - DNA, 22 bp, Artificial Sequence
  chemically synthesized
gtggcacagcgataaccgcttt

SEQ ID NO: 645205 - DNA, 22 bp, Artificial Sequence
  chemically synthesized
cttgtggcacagcgataaccgc

SEQ ID NO: 645206 - DNA, 22 bp, Artificial Sequence
  chemically synthesized
ccagggtaaagcggttatcgct

SEQ ID NO: 645207 - DNA, 22 bp, Artificial Sequence
  chemically synthesized
cagggtaaagcggttatcgctg

SEQ ID NO: 645208 - DNA, 22 bp, Artificial Sequence
  chemically synthesized
atctacttgtggcacagcgata

SEQ ID NO: 645209 - DNA, 22 bp, Artificial Sequence
  chemically synthesized
ttcatctacttgtggcacagcg

SEQ ID NO: 645210 - DNA, 22 bp, Artificial Sequence
  chemically synthesized
tcgctgtgccacaagtagatga

SEQ ID NO: 645211 - DNA, 22 bp, Artificial Sequence
  chemically synthesized
tgccacaagtagatgaacaggt

SEQ ID NO: 645212 - DNA, 22 bp, Artificial Sequence
  chemically synthesized
agtgtcccggaataaacctgtt

SEQ ID NO: 645213 - DNA, 22 bp, Artificial Sequence
  chemically synthesized
tgaggactgagtgtcccggaat

SEQ ID NO: 645214 - DNA, 22 bp, Artificial Sequence
  chemically synthesized
tctatgaggactgagtgtcccg

SEQ ID NO: 645215 - DNA, 22 bp, Artificial Sequence
  chemically synthesized
attccgggacactcagtcctca

SEQ ID NO: 645216 - DNA, 22 bp, Artificial Sequence
  chemically synthesized
agggactatctatgaggactga

SEQ ID NO: 645217 - DNA, 22 bp, Artificial Sequence
  chemically synthesized
ttccgggacactcagtcctcat

SEQ ID NO: 645218 - DNA, 22 bp, Artificial Sequence
  chemically synthesized
gagggactatctatgaggactg

SEQ ID NO: 645219 - DNA, 22 bp, Artificial Sequence
  chemically synthesized
cgggacactcagtcctcataga

SEQ ID NO: 645220 - DNA, 22 bp, Artificial Sequence
  chemically synthesized
acttgagggactatctatgagg

SEQ ID NO: 645221 - DNA, 22 bp, Artificial Sequence
  chemically synthesized
aacttgagggactatctatgag

SEQ ID NO: 645222 - DNA, 22 bp, Artificial Sequence
  chemically synthesized
agtcctcatagatagtccctca

SEQ ID NO: 645223 - DNA, 22 bp, Artificial Sequence
  chemically synthesized
atagatagtccctcaagttaag

SEQ ID NO: 645224 - DNA, 22 bp, Artificial Sequence
  chemically synthesized
cccagaatgtgccttaacttga

SEQ ID NO: 645225 - DNA, 22 bp, Artificial Sequence
  chemically synthesized
cggcatattccccagaatgtgc

SEQ ID NO: 645226 - DNA, 22 bp, Artificial Sequence
  chemically synthesized
aagttaaggcacattctgggga

SEQ ID NO: 645227 - DNA, 22 bp, Artificial Sequence
  chemically synthesized
aggcacattctggggaatatgc

SEQ ID NO: 645228 - DNA, 22 bp, Artificial Sequence
  chemically synthesized
catagaattgcggcatattccc

SEQ ID NO: 645229 - DNA, 22 bp, Artificial Sequence
  chemically synthesized
acatagaattgcggcatattcc

SEQ ID NO: 645230 - DNA, 22 bp, Artificial Sequence
  chemically synthesized
tggggaatatgccgcaattcta

SEQ ID NO: 645231 - DNA, 22 bp, Artificial Sequence
  chemically synthesized
gggaatatgccgcaattctatg

SEQ ID NO: 645232 - DNA, 22 bp, Artificial Sequence
  chemically synthesized
tgaatgtcatttacatagaatt

SEQ ID NO: 645233 - DNA, 22 bp, Artificial Sequence
  chemically synthesized
tgtgaatgtcatttacatagaa

SEQ ID NO: 645234 - DNA, 22 bp, Artificial Sequence
  chemically synthesized
tatgtaaatgacattcacagag

SEQ ID NO: 645235 - DNA, 22 bp, Artificial Sequence
  chemically synthesized
tgtaaatgacattcacagagac

SEQ ID NO: 645236 - DNA, 22 bp, Artificial Sequence
  chemically synthesized
aaccagataataaagaagagta

SEQ ID NO: 645237 - DNA, 22 bp, Artificial Sequence
  chemically synthesized
caaccagataataaagaagagt

SEQ ID NO: 645238 - DNA, 22 bp, Artificial Sequence
  chemically synthesized
acagagacttactcttctttat

SEQ ID NO: 645239 - DNA, 22 bp, Artificial Sequence
  chemically synthesized
ccttcaaccagataataaagaa

SEQ ID NO: 645240 - DNA, 22 bp, Artificial Sequence
  chemically synthesized
tgccttcaaccagataataaag

SEQ ID NO: 645241 - DNA, 22 bp, Artificial Sequence
  chemically synthesized
actcttctttattatctggttg

SEQ ID NO: 645242 - DNA, 22 bp, Artificial Sequence
  chemically synthesized
ctcttctttattatctggttga

SEQ ID NO: 645243 - DNA, 22 bp, Artificial Sequence
  chemically synthesized
ttctttattatctggttgaagg

SEQ ID NO: 645244 - DNA, 22 bp, Artificial Sequence
  chemically synthesized
ctttattatctggttgaaggca

SEQ ID NO: 645245 - DNA, 22 bp, Artificial Sequence
  chemically synthesized
aataggcaactctgccttcaac

SEQ ID NO: 645246 - DNA, 22 bp, Artificial Sequence
  chemically synthesized
tttattatctggttgaaggcag

SEQ ID NO: 645247 - DNA, 22 bp, Artificial Sequence
  chemically synthesized
taaataggcaactctgccttca

SEQ ID NO: 645248 - DNA, 22 bp, Artificial Sequence
  chemically synthesized
tattatctggttgaaggcagag

SEQ ID NO: 645249 - DNA, 22 bp, Artificial Sequence
  chemically synthesized
attatctggttgaaggcagagt

SEQ ID NO: 645250 - DNA, 22 bp, Artificial Sequence
  chemically synthesized
ttatctggttgaaggcagagtt

SEQ ID NO: 645251 - DNA, 22 bp, Artificial Sequence
  chemically synthesized
actctaaataggcaactctgcc

SEQ ID NO: 645252 - DNA, 22 bp, Artificial Sequence
  chemically synthesized
tctggttgaaggcagagttgcc

SEQ ID NO: 645253 - DNA, 22 bp, Artificial Sequence
  chemically synthesized
tgactctaaataggcaactctg

SEQ ID NO: 645254 - DNA, 22 bp, Artificial Sequence
  chemically synthesized
ctgactctaaataggcaactct

SEQ ID NO: 645255 - DNA, 22 bp, Artificial Sequence
  chemically synthesized
tctgactctaaataggcaactc

SEQ ID NO: 645256 - DNA, 22 bp, Artificial Sequence
  chemically synthesized
ttctgactctaaataggcaact

SEQ ID NO: 645257 - DNA, 22 bp, Artificial Sequence
  chemically synthesized
gttgaaggcagagttgcctatt

SEQ ID NO: 645258 - DNA, 22 bp, Artificial Sequence
  chemically synthesized
aaggcagagttgcctatttaga

SEQ ID NO: 645259 - DNA, 22 bp, Artificial Sequence
  chemically synthesized
aaatccagatttttctgactct

SEQ ID NO: 645260 - DNA, 22 bp, Artificial Sequence
  chemically synthesized
cctatttagagtcagaaaaatc

SEQ ID NO: 645261 - DNA, 22 bp, Artificial Sequence
  chemically synthesized
aattgaaatccagatttttctg

SEQ ID NO: 645262 - DNA, 22 bp, Artificial Sequence
  chemically synthesized
tttagagtcagaaaaatctgga

SEQ ID NO: 645263 - DNA, 22 bp, Artificial Sequence
  chemically synthesized
agagtcagaaaaatctggattt

SEQ ID NO: 645264 - DNA, 22 bp, Artificial Sequence
  chemically synthesized
gagtcagaaaaatctggatttc

SEQ ID NO: 645265 - DNA, 22 bp, Artificial Sequence
  chemically synthesized
ccagtcagccagtggtagaact

SEQ ID NO: 645266 - DNA, 22 bp, Artificial Sequence
  chemically synthesized
gatttcaattcagttctaccac

SEQ ID NO: 645267 - DNA, 22 bp, Artificial Sequence
  chemically synthesized
cccagtcagccagtggtagaac

SEQ ID NO: 645268 - DNA, 22 bp, Artificial Sequence
  chemically synthesized
caattcagttctaccactggct

SEQ ID NO: 645269 - DNA, 22 bp, Artificial Sequence
  chemically synthesized
aattcagttctaccactggctg

SEQ ID NO: 645270 - DNA, 22 bp, Artificial Sequence
  chemically synthesized
ccccagatttcccagtcagcca

SEQ ID NO: 645271 - DNA, 22 bp, Artificial Sequence
  chemically synthesized
agttctaccactggctgactgg

SEQ ID NO: 645272 - DNA, 22 bp, Artificial Sequence
  chemically synthesized
gccccagatttcccagtcagcc

SEQ ID NO: 645273 - DNA, 22 bp, Artificial Sequence
  chemically synthesized
taccactggctgactgggaaat

SEQ ID NO: 645274 - DNA, 22 bp, Artificial Sequence
  chemically synthesized
ccactggctgactgggaaatct

SEQ ID NO: 645275 - DNA, 22 bp, Artificial Sequence
  chemically synthesized
acacagcttgccccagatttcc

SEQ ID NO: 645276 - DNA, 22 bp, Artificial Sequence
  chemically synthesized
gctgactgggaaatctggggca

SEQ ID NO: 645277 - DNA, 22 bp, Artificial Sequence
  chemically synthesized
gaggttcacacagcttgcccca

SEQ ID NO: 645278 - DNA, 22 bp, Artificial Sequence
  chemically synthesized
actgggaaatctggggcaagct

SEQ ID NO: 645279 - DNA, 22 bp, Artificial Sequence
  chemically synthesized
agaggttcacacagcttgcccc

SEQ ID NO: 645280 - DNA, 22 bp, Artificial Sequence
  chemically synthesized
ttagaggttcacacagcttgcc

SEQ ID NO: 645281 - DNA, 22 bp, Artificial Sequence
  chemically synthesized
ggaaatctggggcaagctgtgt

SEQ ID NO: 645282 - DNA, 22 bp, Artificial Sequence
  chemically synthesized
gggcaagctgtgtgaacctcta

SEQ ID NO: 645283 - DNA, 22 bp, Artificial Sequence
  chemically synthesized
tgaatgagacacaggttcttag

SEQ ID NO: 645284 - DNA, 22 bp, Artificial Sequence
  chemically synthesized
tgtgaatgagacacaggttctt

SEQ ID NO: 645285 - DNA, 22 bp, Artificial Sequence
  chemically synthesized
tgtgaacctctaagaacctgtg

SEQ ID NO: 645286 - DNA, 22 bp, Artificial Sequence
  chemically synthesized
ctgtgaatgagacacaggttct

SEQ ID NO: 645287 - DNA, 22 bp, Artificial Sequence
  chemically synthesized
tctgtgaatgagacacaggttc

SEQ ID NO: 645288 - DNA, 22 bp, Artificial Sequence
  chemically synthesized
tcgcctttctgtgaatgagaca

SEQ ID NO: 645289 - DNA, 22 bp, Artificial Sequence
  chemically synthesized
taagaacctgtgtctcattcac

SEQ ID NO: 645290 - DNA, 22 bp, Artificial Sequence
  chemically synthesized
agaacctgtgtctcattcacag

SEQ ID NO: 645291 - DNA, 22 bp, Artificial Sequence
  chemically synthesized
tgtctcattcacagaaaggcga

SEQ ID NO: 645292 - DNA, 22 bp, Artificial Sequence
  chemically synthesized
tggagaagagactgtcgccttt

SEQ ID NO: 645293 - DNA, 22 bp, Artificial Sequence
  chemically synthesized
attcacagaaaggcgacagtct

SEQ ID NO: 645294 - DNA, 22 bp, Artificial Sequence
  chemically synthesized
acagaaaggcgacagtctcttc

SEQ ID NO: 645295 - DNA, 22 bp, Artificial Sequence
  chemically synthesized
caaacgctatggagaagagact

SEQ ID NO: 645296 - DNA, 22 bp, Artificial Sequence
  chemically synthesized
acaaacgctatggagaagagac

SEQ ID NO: 645297 - DNA, 22 bp, Artificial Sequence
  chemically synthesized
ttacaaacgctatggagaagag

SEQ ID NO: 645298 - DNA, 22 bp, Artificial Sequence
  chemically synthesized
cttacaaacgctatggagaaga

SEQ ID NO: 645299 - DNA, 22 bp, Artificial Sequence
  chemically synthesized
atcttcttacaaacgctatgga

SEQ ID NO: 645300 - DNA, 22 bp, Artificial Sequence
  chemically synthesized
aatcttcttacaaacgctatgg

SEQ ID NO: 645301 - DNA, 22 bp, Artificial Sequence
  chemically synthesized
ttctccatagcgtttgtaagaa

SEQ ID NO: 645302 - DNA, 22 bp, Artificial Sequence
  chemically synthesized
gatcatttaatcttcttacaaa

SEQ ID NO: 645303 - DNA, 22 bp, Artificial Sequence
  chemically synthesized
agatcatttaatcttcttacaa

SEQ ID NO: 645304 - DNA, 22 bp, Artificial Sequence
  chemically synthesized
ctccatagcgtttgtaagaaga

SEQ ID NO: 645305 - DNA, 22 bp, Artificial Sequence
  chemically synthesized
tagatcatttaatcttcttaca

SEQ ID NO: 645306 - DNA, 22 bp, Artificial Sequence
  chemically synthesized
tccatagcgtttgtaagaagat

SEQ ID NO: 645307 - DNA, 22 bp, Artificial Sequence
  chemically synthesized
catagcgtttgtaagaagatta

SEQ ID NO: 645308 - DNA, 22 bp, Artificial Sequence
  chemically synthesized
catattttagatcatttaatct

SEQ ID NO: 645309 - DNA, 22 bp, Artificial Sequence
  chemically synthesized
acatattttagatcatttaatc

SEQ ID NO: 645310 - DNA, 22 bp, Artificial Sequence
  chemically synthesized
tacatattttagatcatttaat

SEQ ID NO: 645311 - DNA, 22 bp, Artificial Sequence
  chemically synthesized
ttacatattttagatcatttaa

SEQ ID NO: 645312 - DNA, 22 bp, Artificial Sequence
  chemically synthesized
gtaagaagattaaatgatctaa

SEQ ID NO: 645313 - DNA, 22 bp, Artificial Sequence
  chemically synthesized
taagaagattaaatgatctaaa

SEQ ID NO: 645314 - DNA, 22 bp, Artificial Sequence
  chemically synthesized
agtgcacttttacatattttag

SEQ ID NO: 645315 - DNA, 22 bp, Artificial Sequence
  chemically synthesized
gagtgcacttttacatatttta

SEQ ID NO: 645316 - DNA, 22 bp, Artificial Sequence
  chemically synthesized
tgagtgcacttttacatatttt

SEQ ID NO: 645317 - DNA, 22 bp, Artificial Sequence
  chemically synthesized
aatgatctaaaatatgtaaaag

SEQ ID NO: 645318 - DNA, 22 bp, Artificial Sequence
  chemically synthesized
tcattttgagtgcacttttaca

SEQ ID NO: 645319 - DNA, 22 bp, Artificial Sequence
  chemically synthesized
atcattttgagtgcacttttac

SEQ ID NO: 645320 - DNA, 22 bp, Artificial Sequence
  chemically synthesized
tatcattttgagtgcactttta

SEQ ID NO: 645321 - DNA, 22 bp, Artificial Sequence
  chemically synthesized
aaatatgtaaaagtgcactcaa

SEQ ID NO: 645322 - DNA, 22 bp, Artificial Sequence
  chemically synthesized
tcattttatcattttgagtgca

SEQ ID NO: 645323 - DNA, 22 bp, Artificial Sequence
  chemically synthesized
atcattttatcattttgagtgc

SEQ ID NO: 645324 - DNA, 22 bp, Artificial Sequence
  chemically synthesized
tttatcattttatcattttgag

SEQ ID NO: 645325 - DNA, 22 bp, Artificial Sequence
  chemically synthesized
atttatcattttatcattttga

SEQ ID NO: 645326 - DNA, 22 bp, Artificial Sequence
  chemically synthesized
tcatttatttatcattttatca

SEQ ID NO: 645327 - DNA, 22 bp, Artificial Sequence
  chemically synthesized
ataactatcatttatttatcat

SEQ ID NO: 645328 - DNA, 22 bp, Artificial Sequence
  chemically synthesized
aaaatgataaaatgataaataa

SEQ ID NO: 645329 - DNA, 22 bp, Artificial Sequence
  chemically synthesized
taaagagtactgataactatca

SEQ ID NO: 645330 - DNA, 22 bp, Artificial Sequence
  chemically synthesized
gtaaagagtactgataactatc

SEQ ID NO: 645331 - DNA, 22 bp, Artificial Sequence
  chemically synthesized
tcagtactctttacaaacattc

SEQ ID NO: 645332 - DNA, 22 bp, Artificial Sequence
  chemically synthesized
cacccgggtcaaagaatgtttg

SEQ ID NO: 645333 - DNA, 22 bp, Artificial Sequence
  chemically synthesized
tttacaaacattctttgacccg

SEQ ID NO: 645334 - DNA, 22 bp, Artificial Sequence
  chemically synthesized
tacaaacattctttgacccggg

SEQ ID NO: 645335 - DNA, 22 bp, Artificial Sequence
  chemically synthesized
cgtaccattgcacccgggtcaa

SEQ ID NO: 645336 - DNA, 22 bp, Artificial Sequence
  chemically synthesized
acaaacattctttgacccgggt

SEQ ID NO: 645337 - DNA, 22 bp, Artificial Sequence
  chemically synthesized
caaacattctttgacccgggtg

SEQ ID NO: 645338 - DNA, 22 bp, Artificial Sequence
  chemically synthesized
tccgtaccattgcacccgggtc

SEQ ID NO: 645339 - DNA, 22 bp, Artificial Sequence
  chemically synthesized
ctccgtaccattgcacccgggt

SEQ ID NO: 645340 - DNA, 22 bp, Artificial Sequence
  chemically synthesized
tctccgtaccattgcacccggg

SEQ ID NO: 645341 - DNA, 22 bp, Artificial Sequence
  chemically synthesized
tttgacccgggtgcaatggtac

SEQ ID NO: 645342 - DNA, 22 bp, Artificial Sequence
  chemically synthesized
tgacccgggtgcaatggtacgg

SEQ ID NO: 645343 - DNA, 22 bp, Artificial Sequence
  chemically synthesized
gacccgggtgcaatggtacgga

SEQ ID NO: 645344 - DNA, 22 bp, Artificial Sequence
  chemically synthesized
gcatagtctttctccgtaccat

SEQ ID NO: 645345 - DNA, 22 bp, Artificial Sequence
  chemically synthesized
acccgggtgcaatggtacggag

SEQ ID NO: 645346 - DNA, 22 bp, Artificial Sequence
  chemically synthesized
tggttagcatagtctttctccg

SEQ ID NO: 645347 - DNA, 22 bp, Artificial Sequence
  chemically synthesized
gtggttagcatagtctttctcc

SEQ ID NO: 645348 - DNA, 22 bp, Artificial Sequence
  chemically synthesized
gtttgtggttagcatagtcttt

SEQ ID NO: 645349 - DNA, 22 bp, Artificial Sequence
  chemically synthesized
cctcgtttgtggttagcatagt

SEQ ID NO: 645350 - DNA, 22 bp, Artificial Sequence
  chemically synthesized
gtcaagagccctgcctcgtttg

SEQ ID NO: 645351 - DNA, 22 bp, Artificial Sequence
  chemically synthesized
tgctaaccacaaacgaggcagg

SEQ ID NO: 645352 - DNA, 22 bp, Artificial Sequence
  chemically synthesized
attggtcaagagccctgcctcg

SEQ ID NO: 645353 - DNA, 22 bp, Artificial Sequence
  chemically synthesized
accacaaacgaggcagggctct

SEQ ID NO: 645354 - DNA, 22 bp, Artificial Sequence
  chemically synthesized
agctcattggtcaagagccctg

SEQ ID NO: 645355 - DNA, 22 bp, Artificial Sequence
  chemically synthesized
gagctcattggtcaagagccct

SEQ ID NO: 645356 - DNA, 22 bp, Artificial Sequence
  chemically synthesized
tgagctcattggtcaagagccc

SEQ ID NO: 645357 - DNA, 22 bp, Artificial Sequence
  chemically synthesized
ttgagctcattggtcaagagcc

SEQ ID NO: 645358 - DNA, 22 bp, Artificial Sequence
  chemically synthesized
ttgaccaatgagctcaaaagat

SEQ ID NO: 645359 - DNA, 22 bp, Artificial Sequence
  chemically synthesized
gaccaatgagctcaaaagatat

SEQ ID NO: 645360 - DNA, 22 bp, Artificial Sequence
  chemically synthesized
accaatgagctcaaaagatata

SEQ ID NO: 645361 - DNA, 22 bp, Artificial Sequence
  chemically synthesized
aagtatatgatcgtgtaatata

SEQ ID NO: 645362 - DNA, 22 bp, Artificial Sequence
  chemically synthesized
gaagtatatgatcgtgtaatat

SEQ ID NO: 645363 - DNA, 22 bp, Artificial Sequence
  chemically synthesized
tgaagtatatgatcgtgtaata

SEQ ID NO: 645364 - DNA, 22 bp, Artificial Sequence
  chemically synthesized
ttgaagtatatgatcgtgtaat

SEQ ID NO: 645365 - DNA, 22 bp, Artificial Sequence
  chemically synthesized
aaaagatatattacacgatcat

SEQ ID NO: 645366 - DNA, 22 bp, Artificial Sequence
  chemically synthesized
cacgatcatatacttcaaaaat

SEQ ID NO: 645367 - DNA, 22 bp, Artificial Sequence
  chemically synthesized
ccaaggagtaaatatatttttg

SEQ ID NO: 645368 - DNA, 22 bp, Artificial Sequence
  chemically synthesized
atgttaccaaggagtaaatata

SEQ ID NO: 645369 - DNA, 22 bp, Artificial Sequence
  chemically synthesized
gatgttaccaaggagtaaatat

SEQ ID NO: 645370 - DNA, 22 bp, Artificial Sequence
  chemically synthesized
caaaaatatatttactccttgg

SEQ ID NO: 645371 - DNA, 22 bp, Artificial Sequence
  chemically synthesized
aaaaatatatttactccttggt

SEQ ID NO: 645372 - DNA, 22 bp, Artificial Sequence
  chemically synthesized
taaatagaatttgatgttacca

SEQ ID NO: 645373 - DNA, 22 bp, Artificial Sequence
  chemically synthesized
actccttggtaacatcaaattc

SEQ ID NO: 645374 - DNA, 22 bp, Artificial Sequence
  chemically synthesized
acactgtaaatagaatttgatg

SEQ ID NO: 645375 - DNA, 22 bp, Artificial Sequence
  chemically synthesized
ctccttggtaacatcaaattct

SEQ ID NO: 645376 - DNA, 22 bp, Artificial Sequence
  chemically synthesized
cttggtaacatcaaattctatt

SEQ ID NO: 645377 - DNA, 22 bp, Artificial Sequence
  chemically synthesized
gaactgacactgtaaatagaat

SEQ ID NO: 645378 - DNA, 22 bp, Artificial Sequence
  chemically synthesized
ggtaacatcaaattctatttac

SEQ ID NO: 645379 - DNA, 22 bp, Artificial Sequence
  chemically synthesized
gtaacatcaaattctatttaca

SEQ ID NO: 645380 - DNA, 22 bp, Artificial Sequence
  chemically synthesized
tatttacagtgtcagttccaac

SEQ ID NO: 645381 - DNA, 22 bp, Artificial Sequence
  chemically synthesized
tttacagtgtcagttccaactt

SEQ ID NO: 645382 - DNA, 22 bp, Artificial Sequence
  chemically synthesized
acagtgtcagttccaacttttt

SEQ ID NO: 645383 - DNA, 22 bp, Artificial Sequence
  chemically synthesized
cagtgtcagttccaacttttta

SEQ ID NO: 645384 - DNA, 22 bp, Artificial Sequence
  chemically synthesized
taggggtcaaagtcaaatcgga

SEQ ID NO: 645385 - DNA, 22 bp, Artificial Sequence
  chemically synthesized
caactttttattccgatttgac

SEQ ID NO: 645386 - DNA, 22 bp, Artificial Sequence
  chemically synthesized
ttgtaggggtcaaagtcaaatc

SEQ ID NO: 645387 - DNA, 22 bp, Artificial Sequence
  chemically synthesized
tttattccgatttgactttgac

SEQ ID NO: 645388 - DNA, 22 bp, Artificial Sequence
  chemically synthesized
ttattccgatttgactttgacc

SEQ ID NO: 645389 - DNA, 22 bp, Artificial Sequence
  chemically synthesized
tattccgatttgactttgaccc

SEQ ID NO: 645390 - DNA, 22 bp, Artificial Sequence
  chemically synthesized
taattattgtaggggtcaaagt

SEQ ID NO: 645391 - DNA, 22 bp, Artificial Sequence
  chemically synthesized
attccgatttgactttgacccc

SEQ ID NO: 645392 - DNA, 22 bp, Artificial Sequence
  chemically synthesized
ttccgatttgactttgacccct

SEQ ID NO: 645393 - DNA, 22 bp, Artificial Sequence
  chemically synthesized
cgatttgactttgacccctaca

SEQ ID NO: 645394 - DNA, 22 bp, Artificial Sequence
  chemically synthesized
aatctgtaattattgtaggggt

SEQ ID NO: 645395 - DNA, 22 bp, Artificial Sequence
  chemically synthesized
gactttgacccctacaataatt

SEQ ID NO: 645396 - DNA, 22 bp, Artificial Sequence
  chemically synthesized
tgttaaatctgtaattattgta

SEQ ID NO: 645397 - DNA, 22 bp, Artificial Sequence
  chemically synthesized
actttgacccctacaataatta

SEQ ID NO: 645398 - DNA, 22 bp, Artificial Sequence
  chemically synthesized
atgttaaatctgtaattattgt

SEQ ID NO: 645399 - DNA, 22 bp, Artificial Sequence
  chemically synthesized
tgacccctacaataattacaga

SEQ ID NO: 645400 - DNA, 22 bp, Artificial Sequence
  chemically synthesized
gacccctacaataattacagat

SEQ ID NO: 645401 - DNA, 22 bp, Artificial Sequence
  chemically synthesized
acccctacaataattacagatt

SEQ ID NO: 645402 - DNA, 22 bp, Artificial Sequence
  chemically synthesized
caataattacagatttaacata

SEQ ID NO: 645403 - DNA, 22 bp, Artificial Sequence
  chemically synthesized
cagatttaacataaatggatat

SEQ ID NO: 645404 - DNA, 22 bp, Artificial Sequence
  chemically synthesized
agaataatcagtaatatccatt

SEQ ID NO: 645405 - DNA, 22 bp, Artificial Sequence
  chemically synthesized
ttgagaataatcagtaatatcc

SEQ ID NO: 645406 - DNA, 22 bp, Artificial Sequence
  chemically synthesized
attgagaataatcagtaatatc

SEQ ID NO: 645407 - DNA, 22 bp, Artificial Sequence
  chemically synthesized
tattgagaataatcagtaatat

SEQ ID NO: 645408 - DNA, 22 bp, Artificial Sequence
  chemically synthesized
aacataaatggatattactgat

SEQ ID NO: 645409 - DNA, 22 bp, Artificial Sequence
  chemically synthesized
acataaatggatattactgatt

SEQ ID NO: 645410 - DNA, 22 bp, Artificial Sequence
  chemically synthesized
ctttattgagaataatcagtaa

SEQ ID NO: 645411 - DNA, 22 bp, Artificial Sequence
  chemically synthesized
tactttattgagaataatcagt

SEQ ID NO: 645412 - DNA, 22 bp, Artificial Sequence
  chemically synthesized
ctactttattgagaataatcag

SEQ ID NO: 645413 - DNA, 22 bp, Artificial Sequence
  chemically synthesized
ctgattattctcaataaagtag

SEQ ID NO: 645414 - DNA, 22 bp, Artificial Sequence
  chemically synthesized
attattctcaataaagtagaaa

SEQ ID NO: 645415 - DNA, 22 bp, Artificial Sequence
  chemically synthesized
ttctcaataaagtagaaatgtt

SEQ ID NO: 645416 - DNA, 22 bp, Artificial Sequence
  chemically synthesized
tcaataaagtagaaatgttttc

SEQ ID NO: 645417 - DNA, 22 bp, Artificial Sequence
  chemically synthesized
aataaagtagaaatgttttctc

SEQ ID NO: 645418 - DNA, 22 bp, Artificial Sequence
  chemically synthesized
tcagtgaagaccatggtagaga

SEQ ID NO: 645419 - DNA, 22 bp, Artificial Sequence
  chemically synthesized
gtcagtgaagaccatggtagag

SEQ ID NO: 645420 - DNA, 22 bp, Artificial Sequence
  chemically synthesized
agatcatttgtcagtgaagacc

SEQ ID NO: 645421 - DNA, 22 bp, Artificial Sequence
  chemically synthesized
gagatcatttgtcagtgaagac

SEQ ID NO: 645422 - DNA, 22 bp, Artificial Sequence
  chemically synthesized
tctctaccatggtcttcactga

SEQ ID NO: 645423 - DNA, 22 bp, Artificial Sequence
  chemically synthesized
tgagatcatttgtcagtgaaga

SEQ ID NO: 645424 - DNA, 22 bp, Artificial Sequence
  chemically synthesized
ctctaccatggtcttcactgac

SEQ ID NO: 645425 - DNA, 22 bp, Artificial Sequence
  chemically synthesized
ttgagatcatttgtcagtgaag

SEQ ID NO: 645426 - DNA, 22 bp, Artificial Sequence
  chemically synthesized
tctaccatggtcttcactgaca

SEQ ID NO: 645427 - DNA, 22 bp, Artificial Sequence
  chemically synthesized
taccatggtcttcactgacaaa

SEQ ID NO: 645428 - DNA, 22 bp, Artificial Sequence
  chemically synthesized
ccatggtcttcactgacaaatg

SEQ ID NO: 645429 - DNA, 22 bp, Artificial Sequence
  chemically synthesized
gccgtacttttgagatcatttg

SEQ ID NO: 645430 - DNA, 22 bp, Artificial Sequence
  chemically synthesized
ggccgtacttttgagatcattt

SEQ ID NO: 645431 - DNA, 22 bp, Artificial Sequence
  chemically synthesized
tggccgtacttttgagatcatt

SEQ ID NO: 645432 - DNA, 22 bp, Artificial Sequence
  chemically synthesized
ttggccgtacttttgagatcat

SEQ ID NO: 645433 - DNA, 22 bp, Artificial Sequence
  chemically synthesized
cactgacaaatgatctcaaaag

SEQ ID NO: 645434 - DNA, 22 bp, Artificial Sequence
  chemically synthesized
tttttggccgtacttttgagat

SEQ ID NO: 645435 - DNA, 22 bp, Artificial Sequence
  chemically synthesized
actgacaaatgatctcaaaagt

SEQ ID NO: 645436 - DNA, 22 bp, Artificial Sequence
  chemically synthesized
atttttggccgtacttttgaga

SEQ ID NO: 645437 - DNA, 22 bp, Artificial Sequence
  chemically synthesized
tatttttggccgtacttttgag

SEQ ID NO: 645438 - DNA, 22 bp, Artificial Sequence
  chemically synthesized
acaaatgatctcaaaagtacgg

SEQ ID NO: 645439 - DNA, 22 bp, Artificial Sequence
  chemically synthesized
atgatagctttatttttggccg

SEQ ID NO: 645440 - DNA, 22 bp, Artificial Sequence
  chemically synthesized
aatgatagctttatttttggcc

SEQ ID NO: 645441 - DNA, 22 bp, Artificial Sequence
  chemically synthesized
taatgatagctttatttttggc

SEQ ID NO: 645442 - DNA, 22 bp, Artificial Sequence
  chemically synthesized
aaaagtacggccaaaaataaag

SEQ ID NO: 645443 - DNA, 22 bp, Artificial Sequence
  chemically synthesized
ttttaatgatagctttattttt

SEQ ID NO: 645444 - DNA, 22 bp, Artificial Sequence
  chemically synthesized
ttgttttaatgatagctttatt

SEQ ID NO: 645445 - DNA, 22 bp, Artificial Sequence
  chemically synthesized
gttgttttaatgatagctttat

SEQ ID NO: 645446 - DNA, 22 bp, Artificial Sequence
  chemically synthesized
tgttgttttaatgatagcttta

SEQ ID NO: 645447 - DNA, 22 bp, Artificial Sequence
  chemically synthesized
ttgttgttttaatgatagcttt

SEQ ID NO: 645448 - DNA, 22 bp, Artificial Sequence
  chemically synthesized
tttgttgttttaatgatagctt

SEQ ID NO: 645449 - DNA, 22 bp, Artificial Sequence
  chemically synthesized
ttttgttgttttaatgatagct

SEQ ID NO: 645450 - DNA, 22 bp, Artificial Sequence
  chemically synthesized
tttttgttgttttaatgatagc

SEQ ID NO: 645451 - DNA, 22 bp, Artificial Sequence
  chemically synthesized
aactttttttgttgttttaatg

SEQ ID NO: 645452 - DNA, 22 bp, Artificial Sequence
  chemically synthesized
tcattaaaacaacaaaaaaagt

SEQ ID NO: 645453 - DNA, 22 bp, Artificial Sequence
  chemically synthesized
aaacaacaaaaaaagttcaata

SEQ ID NO: 645454 - DNA, 22 bp, Artificial Sequence
  chemically synthesized
aatattatctcgtggatggtac

SEQ ID NO: 645455 - DNA, 22 bp, Artificial Sequence
  chemically synthesized
tctcgtggatggtactcatgtg

SEQ ID NO: 645456 - DNA, 22 bp, Artificial Sequence
  chemically synthesized
gtggatggtactcatgtgatgt

SEQ ID NO: 645457 - DNA, 22 bp, Artificial Sequence
  chemically synthesized
aaaatacagcaagaacatcaca

SEQ ID NO: 645458 - DNA, 22 bp, Artificial Sequence
  chemically synthesized
aaaacctgaaaatacagcaaga

SEQ ID NO: 645459 - DNA, 22 bp, Artificial Sequence
  chemically synthesized
atgtgatgttcttgctgtattt

SEQ ID NO: 645460 - DNA, 22 bp, Artificial Sequence
  chemically synthesized
ctaaaaacctgaaaatacagca

SEQ ID NO: 645461 - DNA, 22 bp, Artificial Sequence
  chemically synthesized
gctaaaaacctgaaaatacagc

SEQ ID NO: 645462 - DNA, 22 bp, Artificial Sequence
  chemically synthesized
ttgctgtattttcaggttttta

SEQ ID NO: 645463 - DNA, 22 bp, Artificial Sequence
  chemically synthesized
aggaaatgtttgctaaaaacct

SEQ ID NO: 645464 - DNA, 22 bp, Artificial Sequence
  chemically synthesized
gctgtattttcaggtttttagc

SEQ ID NO: 645465 - DNA, 22 bp, Artificial Sequence
  chemically synthesized
ctgtattttcaggtttttagca

SEQ ID NO: 645466 - DNA, 22 bp, Artificial Sequence
  chemically synthesized
ctcaggaaatgtttgctaaaaa

SEQ ID NO: 645467 - DNA, 22 bp, Artificial Sequence
  chemically synthesized
tattttcaggtttttagcaaac

SEQ ID NO: 645468 - DNA, 22 bp, Artificial Sequence
  chemically synthesized
tcaggtttttagcaaacatttc

SEQ ID NO: 645469 - DNA, 22 bp, Artificial Sequence
  chemically synthesized
atggctactcaggaaatgtttg

SEQ ID NO: 645470 - DNA, 22 bp, Artificial Sequence
  chemically synthesized
caggtttttagcaaacatttcc

SEQ ID NO: 645471 - DNA, 22 bp, Artificial Sequence
  chemically synthesized
aatggctactcaggaaatgttt

SEQ ID NO: 645472 - DNA, 22 bp, Artificial Sequence
  chemically synthesized
aggtttttagcaaacatttcct

SEQ ID NO: 645473 - DNA, 22 bp, Artificial Sequence
  chemically synthesized
ttagcaaacatttcctgagtag

SEQ ID NO: 645474 - DNA, 22 bp, Artificial Sequence
  chemically synthesized
aatatttaatggctactcagga

SEQ ID NO: 645475 - DNA, 22 bp, Artificial Sequence
  chemically synthesized
tagcaaacatttcctgagtagc

SEQ ID NO: 645476 - DNA, 22 bp, Artificial Sequence
  chemically synthesized
gaatatttaatggctactcagg

SEQ ID NO: 645477 - DNA, 22 bp, Artificial Sequence
  chemically synthesized
agcaaacatttcctgagtagcc

SEQ ID NO: 645478 - DNA, 22 bp, Artificial Sequence
  chemically synthesized
gcaaacatttcctgagtagcca

SEQ ID NO: 645479 - DNA, 22 bp, Artificial Sequence
  chemically synthesized
gcatggtttgaatatttaatgg

SEQ ID NO: 645480 - DNA, 22 bp, Artificial Sequence
  chemically synthesized
agcatggtttgaatatttaatg

SEQ ID NO: 645481 - DNA, 22 bp, Artificial Sequence
  chemically synthesized
cctgagtagccattaaatattc

SEQ ID NO: 645482 - DNA, 22 bp, Artificial Sequence
  chemically synthesized
ctgagtagccattaaatattca

SEQ ID NO: 645483 - DNA, 22 bp, Artificial Sequence
  chemically synthesized
agtagccattaaatattcaaac

SEQ ID NO: 645484 - DNA, 22 bp, Artificial Sequence
  chemically synthesized
cagagtacttagcatggtttga

SEQ ID NO: 645485 - DNA, 22 bp, Artificial Sequence
  chemically synthesized
aatattcaaaccatgctaagta

SEQ ID NO: 645486 - DNA, 22 bp, Artificial Sequence
  chemically synthesized
atatcctccagagtacttagca

SEQ ID NO: 645487 - DNA, 22 bp, Artificial Sequence
  chemically synthesized
catatcctccagagtacttagc

SEQ ID NO: 645488 - DNA, 22 bp, Artificial Sequence
  chemically synthesized
aaaccatgctaagtactctgga

SEQ ID NO: 645489 - DNA, 22 bp, Artificial Sequence
  chemically synthesized
atcatcttcatatcctccagag

SEQ ID NO: 645490 - DNA, 22 bp, Artificial Sequence
  chemically synthesized
aatcatcttcatatcctccaga

SEQ ID NO: 645491 - DNA, 22 bp, Artificial Sequence
  chemically synthesized
tatcttaatcatcttcatatcc

SEQ ID NO: 645492 - DNA, 22 bp, Artificial Sequence
  chemically synthesized
agtactctggaggatatgaaga

SEQ ID NO: 645493 - DNA, 22 bp, Artificial Sequence
  chemically synthesized
tggaggatatgaagatgattaa

SEQ ID NO: 645494 - DNA, 22 bp, Artificial Sequence
  chemically synthesized
gaggatatgaagatgattaaga

SEQ ID NO: 645495 - DNA, 22 bp, Artificial Sequence
  chemically synthesized
gggcatggactgtatcttaatc

SEQ ID NO: 645496 - DNA, 22 bp, Artificial Sequence
  chemically synthesized
ggggcatggactgtatcttaat

SEQ ID NO: 645497 - DNA, 22 bp, Artificial Sequence
  chemically synthesized
tggggcatggactgtatcttaa

SEQ ID NO: 645498 - DNA, 22 bp, Artificial Sequence
  chemically synthesized
gtgtgtgtctttggggcatgga

SEQ ID NO: 645499 - DNA, 22 bp, Artificial Sequence
  chemically synthesized
agatacagtccatgccccaaag

SEQ ID NO: 645500 - DNA, 22 bp, Artificial Sequence
  chemically synthesized
atgagctagtgtgtgtctttgg

SEQ ID NO: 645501 - DNA, 22 bp, Artificial Sequence
  chemically synthesized
aatgagctagtgtgtgtctttg

SEQ ID NO: 645502 - DNA, 22 bp, Artificial Sequence
  chemically synthesized
taatgagctagtgtgtgtcttt

SEQ ID NO: 645503 - DNA, 22 bp, Artificial Sequence
  chemically synthesized
tttaatgagctagtgtgtgtct

SEQ ID NO: 645504 - DNA, 22 bp, Artificial Sequence
  chemically synthesized
tctttaatgagctagtgtgtgt

SEQ ID NO: 645505 - DNA, 22 bp, Artificial Sequence
  chemically synthesized
ccagtgcctctctttaatgagc

SEQ ID NO: 645506 - DNA, 22 bp, Artificial Sequence
  chemically synthesized
ttaccagtgcctctctttaatg

SEQ ID NO: 645507 - DNA, 22 bp, Artificial Sequence
  chemically synthesized
tcagttattaccagtgcctctc

SEQ ID NO: 645508 - DNA, 22 bp, Artificial Sequence
  chemically synthesized
atcagttattaccagtgcctct

SEQ ID NO: 645509 - DNA, 22 bp, Artificial Sequence
  chemically synthesized
gctcattaaagagaggcactgg

SEQ ID NO: 645510 - DNA, 22 bp, Artificial Sequence
  chemically synthesized
tatcagttattaccagtgcctc

SEQ ID NO: 645511 - DNA, 22 bp, Artificial Sequence
  chemically synthesized
ttatcagttattaccagtgcct

SEQ ID NO: 645512 - DNA, 22 bp, Artificial Sequence
  chemically synthesized
tttatcagttattaccagtgcc

SEQ ID NO: 645513 - DNA, 22 bp, Artificial Sequence
  chemically synthesized
attaaagagaggcactggtaat

SEQ ID NO: 645514 - DNA, 22 bp, Artificial Sequence
  chemically synthesized
ctttttatcagttattaccagt

SEQ ID NO: 645515 - DNA, 22 bp, Artificial Sequence
  chemically synthesized
cctttttatcagttattaccag

SEQ ID NO: 645516 - DNA, 22 bp, Artificial Sequence
  chemically synthesized
tcctttttatcagttattacca

SEQ ID NO: 645517 - DNA, 22 bp, Artificial Sequence
  chemically synthesized
aagagaggcactggtaataact

SEQ ID NO: 645518 - DNA, 22 bp, Artificial Sequence
  chemically synthesized
acagttttcctttttatcagtt

SEQ ID NO: 645519 - DNA, 22 bp, Artificial Sequence
  chemically synthesized
gacagttttcctttttatcagt

SEQ ID NO: 645520 - DNA, 22 bp, Artificial Sequence
  chemically synthesized
cttgacagttttcctttttatc

SEQ ID NO: 645521 - DNA, 22 bp, Artificial Sequence
  chemically synthesized
gtaataactgataaaaaggaaa

SEQ ID NO: 645522 - DNA, 22 bp, Artificial Sequence
  chemically synthesized
agaaaattccttgacagttttc

SEQ ID NO: 645523 - DNA, 22 bp, Artificial Sequence
  chemically synthesized
tcagaaaattccttgacagttt

SEQ ID NO: 645524 - DNA, 22 bp, Artificial Sequence
  chemically synthesized
ctcagaaaattccttgacagtt

SEQ ID NO: 645525 - DNA, 22 bp, Artificial Sequence
  chemically synthesized
ataaaaaggaaaactgtcaagg

SEQ ID NO: 645526 - DNA, 22 bp, Artificial Sequence
  chemically synthesized
tctcagaaaattccttgacagt

SEQ ID NO: 645527 - DNA, 22 bp, Artificial Sequence
  chemically synthesized
gacctttctcagaaaattcctt

SEQ ID NO: 645528 - DNA, 22 bp, Artificial Sequence
  chemically synthesized
ggacctttctcagaaaattcct

SEQ ID NO: 645529 - DNA, 22 bp, Artificial Sequence
  chemically synthesized
tggacctttctcagaaaattcc

SEQ ID NO: 645530 - DNA, 22 bp, Artificial Sequence
  chemically synthesized
tcaaggaattttctgagaaagg

SEQ ID NO: 645531 - DNA, 22 bp, Artificial Sequence
  chemically synthesized
ccagagcactttggacctttct

SEQ ID NO: 645532 - DNA, 22 bp, Artificial Sequence
  chemically synthesized
ttcccagagcactttggacctt

SEQ ID NO: 645533 - DNA, 22 bp, Artificial Sequence
  chemically synthesized
tattcccagagcactttggacc

SEQ ID NO: 645534 - DNA, 22 bp, Artificial Sequence
  chemically synthesized
tctgagaaaggtccaaagtgct

SEQ ID NO: 645535 - DNA, 22 bp, Artificial Sequence
  chemically synthesized
ctgagaaaggtccaaagtgctc

SEQ ID NO: 645536 - DNA, 22 bp, Artificial Sequence
  chemically synthesized
cctctattcccagagcactttg

SEQ ID NO: 645537 - DNA, 22 bp, Artificial Sequence
  chemically synthesized
tgagaaaggtccaaagtgctct

SEQ ID NO: 645538 - DNA, 22 bp, Artificial Sequence
  chemically synthesized
gcctctattcccagagcacttt

SEQ ID NO: 645539 - DNA, 22 bp, Artificial Sequence
  chemically synthesized
tgcctctattcccagagcactt

SEQ ID NO: 645540 - DNA, 22 bp, Artificial Sequence
  chemically synthesized
agaaaggtccaaagtgctctgg

SEQ ID NO: 645541 - DNA, 22 bp, Artificial Sequence
  chemically synthesized
ttgcctctattcccagagcact

SEQ ID NO: 645542 - DNA, 22 bp, Artificial Sequence
  chemically synthesized
tcttttgcctctattcccagag

SEQ ID NO: 645543 - DNA, 22 bp, Artificial Sequence
  chemically synthesized
gaagaaatctgtcttttgcctc

SEQ ID NO: 645544 - DNA, 22 bp, Artificial Sequence
  chemically synthesized
tgggaatagaggcaaaagacag

SEQ ID NO: 645545 - DNA, 22 bp, Artificial Sequence
  chemically synthesized
ggaatagaggcaaaagacagat

SEQ ID NO: 645546 - DNA, 22 bp, Artificial Sequence
  chemically synthesized
cagttggaagaaatctgtcttt

SEQ ID NO: 645547 - DNA, 22 bp, Artificial Sequence
  chemically synthesized
gatccctgcagttggaagaaat

SEQ ID NO: 645548 - DNA, 22 bp, Artificial Sequence
  chemically synthesized
ctagatccctgcagttggaaga

SEQ ID NO: 645549 - DNA, 22 bp, Artificial Sequence
  chemically synthesized
cttccaactgcagggatctagc

SEQ ID NO: 645550 - DNA, 22 bp, Artificial Sequence
  chemically synthesized
ttccaactgcagggatctagca

SEQ ID NO: 645551 - DNA, 22 bp, Artificial Sequence
  chemically synthesized
cccatggagccctgctagatcc

SEQ ID NO: 645552 - DNA, 22 bp, Artificial Sequence
  chemically synthesized
ccccatggagccctgctagatc

SEQ ID NO: 645553 - DNA, 22 bp, Artificial Sequence
  chemically synthesized
ccaactgcagggatctagcagg

SEQ ID NO: 645554 - DNA, 22 bp, Artificial Sequence
  chemically synthesized
tccccatggagccctgctagat

SEQ ID NO: 645555 - DNA, 22 bp, Artificial Sequence
  chemically synthesized
caactgcagggatctagcaggg

SEQ ID NO: 645556 - DNA, 22 bp, Artificial Sequence
  chemically synthesized
cagggatctagcagggctccat

SEQ ID NO: 645557 - DNA, 22 bp, Artificial Sequence
  chemically synthesized
aaaataactttccccatggagc

SEQ ID NO: 645558 - DNA, 22 bp, Artificial Sequence
  chemically synthesized
ctcaaaataactttccccatgg

SEQ ID NO: 645559 - DNA, 22 bp, Artificial Sequence
  chemically synthesized
gcagggctccatggggaaagtt

SEQ ID NO: 645560 - DNA, 22 bp, Artificial Sequence
  chemically synthesized
catcacactgctcaaaataact

SEQ ID NO: 645561 - DNA, 22 bp, Artificial Sequence
  chemically synthesized
catggggaaagttattttgagc

SEQ ID NO: 645562 - DNA, 22 bp, Artificial Sequence
  chemically synthesized
tcctccatcacactgctcaaaa

SEQ ID NO: 645563 - DNA, 22 bp, Artificial Sequence
  chemically synthesized
ttttgagcagtgtgatggagga

SEQ ID NO: 645564 - DNA, 22 bp, Artificial Sequence
  chemically synthesized
tgagcagtgtgatggaggatag

SEQ ID NO: 645565 - DNA, 22 bp, Artificial Sequence
  chemically synthesized
gagcagtgtgatggaggatagg

SEQ ID NO: 645566 - DNA, 22 bp, Artificial Sequence
  chemically synthesized
agcagtgtgatggaggataggt

SEQ ID NO: 645567 - DNA, 22 bp, Artificial Sequence
  chemically synthesized
acaaaggaatcccacctatcct

SEQ ID NO: 645568 - DNA, 22 bp, Artificial Sequence
  chemically synthesized
ccgtatctgacaaaggaatccc

SEQ ID NO: 645569 - DNA, 22 bp, Artificial Sequence
  chemically synthesized
acccaccactgccgtatctgac

SEQ ID NO: 645570 - DNA, 22 bp, Artificial Sequence
  chemically synthesized
taacccaccactgccgtatctg

SEQ ID NO: 645571 - DNA, 22 bp, Artificial Sequence
  chemically synthesized
acctctaacccaccactgccgt

SEQ ID NO: 645572 - DNA, 22 bp, Artificial Sequence
  chemically synthesized
ctttgtcagatacggcagtggt

SEQ ID NO: 645573 - DNA, 22 bp, Artificial Sequence
  chemically synthesized
ctaacctctaacccaccactgc

SEQ ID NO: 645574 - DNA, 22 bp, Artificial Sequence
  chemically synthesized
tgtcagatacggcagtggtggg

SEQ ID NO: 645575 - DNA, 22 bp, Artificial Sequence
  chemically synthesized
gtcagatacggcagtggtgggt

SEQ ID NO: 645576 - DNA, 22 bp, Artificial Sequence
  chemically synthesized
tcagatacggcagtggtgggtt

SEQ ID NO: 645577 - DNA, 22 bp, Artificial Sequence
  chemically synthesized
actgctaacctctaacccacca

SEQ ID NO: 645578 - DNA, 22 bp, Artificial Sequence
  chemically synthesized
agcctaactgctaacctctaac

SEQ ID NO: 645579 - DNA, 22 bp, Artificial Sequence
  chemically synthesized
agtctcagcctaactgctaacc

SEQ ID NO: 645580 - DNA, 22 bp, Artificial Sequence
  chemically synthesized
gagtctcagcctaactgctaac

SEQ ID NO: 645581 - DNA, 22 bp, Artificial Sequence
  chemically synthesized
aagcttgagtctcagcctaact

SEQ ID NO: 645582 - DNA, 22 bp, Artificial Sequence
  chemically synthesized
gaggttagcagttaggctgaga

SEQ ID NO: 645583 - DNA, 22 bp, Artificial Sequence
  chemically synthesized
gcagttaggctgagactcaagc

SEQ ID NO: 645584 - DNA, 22 bp, Artificial Sequence
  chemically synthesized
gggtcaagctcaagcttgagtc

SEQ ID NO: 645585 - DNA, 22 bp, Artificial Sequence
  chemically synthesized
ggggtcaagctcaagcttgagt

SEQ ID NO: 645586 - DNA, 22 bp, Artificial Sequence
  chemically synthesized
tggggtcaagctcaagcttgag

SEQ ID NO: 645587 - DNA, 22 bp, Artificial Sequence
  chemically synthesized
ggctgagactcaagcttgagct

SEQ ID NO: 645588 - DNA, 22 bp, Artificial Sequence
  chemically synthesized
cctttggggtcaagctcaagct

SEQ ID NO: 645589 - DNA, 22 bp, Artificial Sequence
  chemically synthesized
agactcaagcttgagcttgacc

SEQ ID NO: 645590 - DNA, 22 bp, Artificial Sequence
  chemically synthesized
atctacctttggggtcaagctc

SEQ ID NO: 645591 - DNA, 22 bp, Artificial Sequence
  chemically synthesized
tcatctacctttggggtcaagc

SEQ ID NO: 645592 - DNA, 22 bp, Artificial Sequence
  chemically synthesized
ctctcatctacctttggggtca

SEQ ID NO: 645593 - DNA, 22 bp, Artificial Sequence
  chemically synthesized
aagcttgagcttgaccccaaag

SEQ ID NO: 645594 - DNA, 22 bp, Artificial Sequence
  chemically synthesized
gagcttgaccccaaaggtagat

SEQ ID NO: 645595 - DNA, 22 bp, Artificial Sequence
  chemically synthesized
agcttgaccccaaaggtagatg

SEQ ID NO: 645596 - DNA, 22 bp, Artificial Sequence
  chemically synthesized
aatacatcctgctctcatctac

SEQ ID NO: 645597 - DNA, 22 bp, Artificial Sequence
  chemically synthesized
gaccccaaaggtagatgagagc

SEQ ID NO: 645598 - DNA, 22 bp, Artificial Sequence
  chemically synthesized
tgaatacatcctgctctcatct

SEQ ID NO: 645599 - DNA, 22 bp, Artificial Sequence
  chemically synthesized
accccaaaggtagatgagagca

SEQ ID NO: 645600 - DNA, 22 bp, Artificial Sequence
  chemically synthesized
ctgaatacatcctgctctcatc

SEQ ID NO: 645601 - DNA, 22 bp, Artificial Sequence
  chemically synthesized
gtatttctgaatacatcctgct

SEQ ID NO: 645602 - DNA, 22 bp, Artificial Sequence
  chemically synthesized
tagctagtatttctgaatacat

SEQ ID NO: 645603 - DNA, 22 bp, Artificial Sequence
  chemically synthesized
ttgtagctagtatttctgaata

SEQ ID NO: 645604 - DNA, 22 bp, Artificial Sequence
  chemically synthesized
tgctgttgtagctagtatttct

SEQ ID NO: 645605 - DNA, 22 bp, Artificial Sequence
  chemically synthesized
gctatgctgttgtagctagtat

SEQ ID NO: 645606 - DNA, 22 bp, Artificial Sequence
  chemically synthesized
tggctatgctgttgtagctagt

SEQ ID NO: 645607 - DNA, 22 bp, Artificial Sequence
  chemically synthesized
tgttctggctatgctgttgtag

SEQ ID NO: 645608 - DNA, 22 bp, Artificial Sequence
  chemically synthesized
agaaatactagctacaacagca

SEQ ID NO: 645609 - DNA, 22 bp, Artificial Sequence
  chemically synthesized
cctgtgttctggctatgctgtt

SEQ ID NO: 645610 - DNA, 22 bp, Artificial Sequence
  chemically synthesized
tccctgtgttctggctatgctg

SEQ ID NO: 645611 - DNA, 22 bp, Artificial Sequence
  chemically synthesized
ttctccctgtgttctggctatg

SEQ ID NO: 645612 - DNA, 22 bp, Artificial Sequence
  chemically synthesized
gttctccctgtgttctggctat

SEQ ID NO: 645613 - DNA, 22 bp, Artificial Sequence
  chemically synthesized
gctacaacagcatagccagaac

SEQ ID NO: 645614 - DNA, 22 bp, Artificial Sequence
  chemically synthesized
tgttctccctgtgttctggcta

SEQ ID NO: 645615 - DNA, 22 bp, Artificial Sequence
  chemically synthesized
ttgttctccctgtgttctggct

SEQ ID NO: 645616 - DNA, 22 bp, Artificial Sequence
  chemically synthesized
ttttgttctccctgtgttctgg

SEQ ID NO: 645617 - DNA, 22 bp, Artificial Sequence
  chemically synthesized
caacagcatagccagaacacag

SEQ ID NO: 645618 - DNA, 22 bp, Artificial Sequence
  chemically synthesized
cttttgttctccctgtgttctg

SEQ ID NO: 645619 - DNA, 22 bp, Artificial Sequence
  chemically synthesized
tgccatcttcttttgttctccc

SEQ ID NO: 645620 - DNA, 22 bp, Artificial Sequence
  chemically synthesized
tatgccatcttcttttgttctc

SEQ ID NO: 645621 - DNA, 22 bp, Artificial Sequence
  chemically synthesized
ctatgccatcttcttttgttct

SEQ ID NO: 645622 - DNA, 22 bp, Artificial Sequence
  chemically synthesized
tctatgccatcttcttttgttc

SEQ ID NO: 645623 - DNA, 22 bp, Artificial Sequence
  chemically synthesized
ttctatgccatcttcttttgtt

SEQ ID NO: 645624 - DNA, 22 bp, Artificial Sequence
  chemically synthesized
tttctatgccatcttcttttgt

SEQ ID NO: 645625 - DNA, 22 bp, Artificial Sequence
  chemically synthesized
ctttttctatgccatcttcttt

SEQ ID NO: 645626 - DNA, 22 bp, Artificial Sequence
  chemically synthesized
gctttttctatgccatcttctt

SEQ ID NO: 645627 - DNA, 22 bp, Artificial Sequence
  chemically synthesized
acttgctttttctatgccatct

SEQ ID NO: 645628 - DNA, 22 bp, Artificial Sequence
  chemically synthesized
gacttgctttttctatgccatc

SEQ ID NO: 645629 - DNA, 22 bp, Artificial Sequence
  chemically synthesized
ttgacttgctttttctatgcca

SEQ ID NO: 645630 - DNA, 22 bp, Artificial Sequence
  chemically synthesized
tcttgacttgctttttctatgc

SEQ ID NO: 645631 - DNA, 22 bp, Artificial Sequence
  chemically synthesized
cacaatattctcttgacttgct

SEQ ID NO: 645632 - DNA, 22 bp, Artificial Sequence
  chemically synthesized
ccacaatattctcttgacttgc

SEQ ID NO: 645633 - DNA, 22 bp, Artificial Sequence
  chemically synthesized
aaacccttccacaatattctct

SEQ ID NO: 645634 - DNA, 22 bp, Artificial Sequence
  chemically synthesized
gtggggcgttcaaacccttcca

SEQ ID NO: 645635 - DNA, 22 bp, Artificial Sequence
  chemically synthesized
agtggggcgttcaaacccttcc

SEQ ID NO: 645636 - DNA, 22 bp, Artificial Sequence
  chemically synthesized
ttagtggggcgttcaaaccctt

SEQ ID NO: 645637 - DNA, 22 bp, Artificial Sequence
  chemically synthesized
cttagtggggcgttcaaaccct

SEQ ID NO: 645638 - DNA, 22 bp, Artificial Sequence
  chemically synthesized
tggaagggtttgaacgccccac

SEQ ID NO: 645639 - DNA, 22 bp, Artificial Sequence
  chemically synthesized
gaacgccccactaagaagcttg

SEQ ID NO: 645640 - DNA, 22 bp, Artificial Sequence
  chemically synthesized
aacgccccactaagaagcttga

SEQ ID NO: 645641 - DNA, 22 bp, Artificial Sequence
  chemically synthesized
catgtagaaaaaaatcaagctt

SEQ ID NO: 645642 - DNA, 22 bp, Artificial Sequence
  chemically synthesized
tgcatgtagaaaaaaatcaagc

SEQ ID NO: 645643 - DNA, 22 bp, Artificial Sequence
  chemically synthesized
ctgcatgtagaaaaaaatcaag

SEQ ID NO: 645644 - DNA, 22 bp, Artificial Sequence
  chemically synthesized
gatttctgcatgtagaaaaaaa

SEQ ID NO: 645645 - DNA, 22 bp, Artificial Sequence
  chemically synthesized
agaagcttgatttttttctaca

SEQ ID NO: 645646 - DNA, 22 bp, Artificial Sequence
  chemically synthesized
actggatttctgcatgtagaaa

SEQ ID NO: 645647 - DNA, 22 bp, Artificial Sequence
  chemically synthesized
cactggatttctgcatgtagaa

SEQ ID NO: 645648 - DNA, 22 bp, Artificial Sequence
  chemically synthesized
tcactggatttctgcatgtaga

SEQ ID NO: 645649 - DNA, 22 bp, Artificial Sequence
  chemically synthesized
gatttttttctacatgcagaaa

SEQ ID NO: 645650 - DNA, 22 bp, Artificial Sequence
  chemically synthesized
atttttttctacatgcagaaat

SEQ ID NO: 645651 - DNA, 22 bp, Artificial Sequence
  chemically synthesized
ccctttcactggatttctgcat

SEQ ID NO: 645652 - DNA, 22 bp, Artificial Sequence
  chemically synthesized
ttttctacatgcagaaatccag

SEQ ID NO: 645653 - DNA, 22 bp, Artificial Sequence
  chemically synthesized
tttctacatgcagaaatccagt

SEQ ID NO: 645654 - DNA, 22 bp, Artificial Sequence
  chemically synthesized
ttctacatgcagaaatccagtg

SEQ ID NO: 645655 - DNA, 22 bp, Artificial Sequence
  chemically synthesized
tctacatgcagaaatccagtga

SEQ ID NO: 645656 - DNA, 22 bp, Artificial Sequence
  chemically synthesized
ctacatgcagaaatccagtgaa

SEQ ID NO: 645657 - DNA, 22 bp, Artificial Sequence
  chemically synthesized
tacatgcagaaatccagtgaaa

SEQ ID NO: 645658 - DNA, 22 bp, Artificial Sequence
  chemically synthesized
catgcagaaatccagtgaaagg

SEQ ID NO: 645659 - DNA, 22 bp, Artificial Sequence
  chemically synthesized
ccagaaccaagacccatcatgg

SEQ ID NO: 645660 - DNA, 22 bp, Artificial Sequence
  chemically synthesized
gccagaaccaagacccatcatg

SEQ ID NO: 645661 - DNA, 22 bp, Artificial Sequence
  chemically synthesized
tacatcttgccagaaccaagac

SEQ ID NO: 645662 - DNA, 22 bp, Artificial Sequence
  chemically synthesized
gtacatcttgccagaaccaaga

SEQ ID NO: 645663 - DNA, 22 bp, Artificial Sequence
  chemically synthesized
cttgtacatcttgccagaacca

SEQ ID NO: 645664 - DNA, 22 bp, Artificial Sequence
  chemically synthesized
tacttgtacatcttgccagaac

SEQ ID NO: 645665 - DNA, 22 bp, Artificial Sequence
  chemically synthesized
actctacttgtacatcttgcca

SEQ ID NO: 645666 - DNA, 22 bp, Artificial Sequence
  chemically synthesized
ggttctggcaagatgtacaagt

SEQ ID NO: 645667 - DNA, 22 bp, Artificial Sequence
  chemically synthesized
catactgactctacttgtacat

SEQ ID NO: 645668 - DNA, 22 bp, Artificial Sequence
  chemically synthesized
gttctggcaagatgtacaagta

SEQ ID NO: 645669 - DNA, 22 bp, Artificial Sequence
  chemically synthesized
tggcaagatgtacaagtagagt

SEQ ID NO: 645670 - DNA, 22 bp, Artificial Sequence
  chemically synthesized
gcaagatgtacaagtagagtca

SEQ ID NO: 645671 - DNA, 22 bp, Artificial Sequence
  chemically synthesized
caataaatcctccatactgact

SEQ ID NO: 645672 - DNA, 22 bp, Artificial Sequence
  chemically synthesized
gcaataaatcctccatactgac

SEQ ID NO: 645673 - DNA, 22 bp, Artificial Sequence
  chemically synthesized
ccacccttgcaataaatcctcc

SEQ ID NO: 645674 - DNA, 22 bp, Artificial Sequence
  chemically synthesized
cccacccttgcaataaatcctc

SEQ ID NO: 645675 - DNA, 22 bp, Artificial Sequence
  chemically synthesized
tcccacccttgcaataaatcct

SEQ ID NO: 645676 - DNA, 22 bp, Artificial Sequence
  chemically synthesized
tttcccacccttgcaataaatc

SEQ ID NO: 645677 - DNA, 22 bp, Artificial Sequence
  chemically synthesized
gtctctttcccacccttgcaat

SEQ ID NO: 645678 - DNA, 22 bp, Artificial Sequence
  chemically synthesized
agtctctttcccacccttgcaa

SEQ ID NO: 645679 - DNA, 22 bp, Artificial Sequence
  chemically synthesized
tagtctctttcccacccttgca

SEQ ID NO: 645680 - DNA, 22 bp, Artificial Sequence
  chemically synthesized
cctttagtctctttcccaccct

SEQ ID NO: 645681 - DNA, 22 bp, Artificial Sequence
  chemically synthesized
ccctttagtctctttcccaccc

SEQ ID NO: 645682 - DNA, 22 bp, Artificial Sequence
  chemically synthesized
gcttccctttagtctctttccc

SEQ ID NO: 645683 - DNA, 22 bp, Artificial Sequence
  chemically synthesized
attgcaagggtgggaaagagac

SEQ ID NO: 645684 - DNA, 22 bp, Artificial Sequence
  chemically synthesized
ttgcaagggtgggaaagagact

SEQ ID NO: 645685 - DNA, 22 bp, Artificial Sequence
  chemically synthesized
gttggcttccctttagtctctt

SEQ ID NO: 645686 - DNA, 22 bp, Artificial Sequence
  chemically synthesized
caagggtgggaaagagactaaa

SEQ ID NO: 645687 - DNA, 22 bp, Artificial Sequence
  chemically synthesized
tctggttggcttccctttagtc

SEQ ID NO: 645688 - DNA, 22 bp, Artificial Sequence
  chemically synthesized
atctggttggcttccctttagt

SEQ ID NO: 645689 - DNA, 22 bp, Artificial Sequence
  chemically synthesized
cttatctggttggcttcccttt

SEQ ID NO: 645690 - DNA, 22 bp, Artificial Sequence
  chemically synthesized
tggccatagctccttatctggt

SEQ ID NO: 645691 - DNA, 22 bp, Artificial Sequence
  chemically synthesized
aagggaagccaaccagataagg

SEQ ID NO: 645692 - DNA, 22 bp, Artificial Sequence
  chemically synthesized
cctatggccatagctccttatc

SEQ ID NO: 645693 - DNA, 22 bp, Artificial Sequence
  chemically synthesized
acctatggccatagctccttat

SEQ ID NO: 645694 - DNA, 22 bp, Artificial Sequence
  chemically synthesized
tacctatggccatagctcctta

SEQ ID NO: 645695 - DNA, 22 bp, Artificial Sequence
  chemically synthesized
ttacctatggccatagctcctt

SEQ ID NO: 645696 - DNA, 22 bp, Artificial Sequence
  chemically synthesized
acaccttttacctatggccata

SEQ ID NO: 645697 - DNA, 22 bp, Artificial Sequence
  chemically synthesized
aacaccttttacctatggccat

SEQ ID NO: 645698 - DNA, 22 bp, Artificial Sequence
  chemically synthesized
ttaacaccttttacctatggcc

SEQ ID NO: 645699 - DNA, 22 bp, Artificial Sequence
  chemically synthesized
gctcttaacaccttttacctat

SEQ ID NO: 645700 - DNA, 22 bp, Artificial Sequence
  chemically synthesized
tagctcttaacaccttttacct

SEQ ID NO: 645701 - DNA, 22 bp, Artificial Sequence
  chemically synthesized
ctagctcttaacaccttttacc

SEQ ID NO: 645702 - DNA, 22 bp, Artificial Sequence
  chemically synthesized
tggccataggtaaaaggtgtta

SEQ ID NO: 645703 - DNA, 22 bp, Artificial Sequence
  chemically synthesized
cgagccttctagctcttaacac

SEQ ID NO: 645704 - DNA, 22 bp, Artificial Sequence
  chemically synthesized
ccactgcgagccttctagctct

SEQ ID NO: 645705 - DNA, 22 bp, Artificial Sequence
  chemically synthesized
ctgccactgcgagccttctagc

SEQ ID NO: 645706 - DNA, 22 bp, Artificial Sequence
  chemically synthesized
ctgctgccactgcgagccttct

SEQ ID NO: 645707 - DNA, 22 bp, Artificial Sequence
  chemically synthesized
cctgctgccactgcgagccttc

SEQ ID NO: 645708 - DNA, 22 bp, Artificial Sequence
  chemically synthesized
cttcctgctgccactgcgagcc

SEQ ID NO: 645709 - DNA, 22 bp, Artificial Sequence
  chemically synthesized
agagctagaaggctcgcagtgg

SEQ ID NO: 645710 - DNA, 22 bp, Artificial Sequence
  chemically synthesized
cattgcttcctgctgccactgc

SEQ ID NO: 645711 - DNA, 22 bp, Artificial Sequence
  chemically synthesized
ccattgcttcctgctgccactg

SEQ ID NO: 645712 - DNA, 22 bp, Artificial Sequence
  chemically synthesized
ttccattgcttcctgctgccac

SEQ ID NO: 645713 - DNA, 22 bp, Artificial Sequence
  chemically synthesized
gaaggctcgcagtggcagcagg

SEQ ID NO: 645714 - DNA, 22 bp, Artificial Sequence
  chemically synthesized
ccactcttccattgcttcctgc

SEQ ID NO: 645715 - DNA, 22 bp, Artificial Sequence
  chemically synthesized
gcagtggcagcaggaagcaatg

SEQ ID NO: 645716 - DNA, 22 bp, Artificial Sequence
  chemically synthesized
aggatgaaaaaacaaactgcca

SEQ ID NO: 645717 - DNA, 22 bp, Artificial Sequence
  chemically synthesized
caggatgaaaaaacaaactgcc

SEQ ID NO: 645718 - DNA, 22 bp, Artificial Sequence
  chemically synthesized
gggagtatgccacttcaggatg

SEQ ID NO: 645719 - DNA, 22 bp, Artificial Sequence
  chemically synthesized
gttttttcatcctgaagtggca

SEQ ID NO: 645720 - DNA, 22 bp, Artificial Sequence
  chemically synthesized
ttttttcatcctgaagtggcat

SEQ ID NO: 645721 - DNA, 22 bp, Artificial Sequence
  chemically synthesized
tttcatcctgaagtggcatact

SEQ ID NO: 645722 - DNA, 22 bp, Artificial Sequence
  chemically synthesized
ttcatcctgaagtggcatactc

SEQ ID NO: 645723 - DNA, 22 bp, Artificial Sequence
  chemically synthesized
tcatcctgaagtggcatactcc

SEQ ID NO: 645724 - DNA, 22 bp, Artificial Sequence
  chemically synthesized
catcctgaagtggcatactccc

SEQ ID NO: 645725 - DNA, 22 bp, Artificial Sequence
  chemically synthesized
atcctgaagtggcatactcccg

SEQ ID NO: 645726 - DNA, 22 bp, Artificial Sequence
  chemically synthesized
agatcagtgccctcgggagtat

SEQ ID NO: 645727 - DNA, 22 bp, Artificial Sequence
  chemically synthesized
aagtggcatactcccgagggca

SEQ ID NO: 645728 - DNA, 22 bp, Artificial Sequence
  chemically synthesized
ccgagggcactgatctcagaca

SEQ ID NO: 645729 - DNA, 22 bp, Artificial Sequence
  chemically synthesized
acgtaggcaacgcagtgtgtct

SEQ ID NO: 645730 - DNA, 22 bp, Artificial Sequence
  chemically synthesized
aacgtaggcaacgcagtgtgtc

SEQ ID NO: 645731 - DNA, 22 bp, Artificial Sequence
  chemically synthesized
ttaacgtaggcaacgcagtgtg

SEQ ID NO: 645732 - DNA, 22 bp, Artificial Sequence
  chemically synthesized
atctcagacacactgcgttgcc

SEQ ID NO: 645733 - DNA, 22 bp, Artificial Sequence
  chemically synthesized
agacacactgcgttgcctacgt

SEQ ID NO: 645734 - DNA, 22 bp, Artificial Sequence
  chemically synthesized
cgttgcctacgttaagagcttt

SEQ ID NO: 645735 - DNA, 22 bp, Artificial Sequence
  chemically synthesized
agcccaaggcaccaaaagctct

SEQ ID NO: 645736 - DNA, 22 bp, Artificial Sequence
  chemically synthesized
cctacgttaagagcttttggtg

SEQ ID NO: 645737 - DNA, 22 bp, Artificial Sequence
  chemically synthesized
gttgagcccaaggcaccaaaag

SEQ ID NO: 645738 - DNA, 22 bp, Artificial Sequence
  chemically synthesized
ggttgagcccaaggcaccaaaa

SEQ ID NO: 645739 - DNA, 22 bp, Artificial Sequence
  chemically synthesized
tggttgagcccaaggcaccaaa

SEQ ID NO: 645740 - DNA, 22 bp, Artificial Sequence
  chemically synthesized
cgttaagagcttttggtgcctt

SEQ ID NO: 645741 - DNA, 22 bp, Artificial Sequence
  chemically synthesized
tttggttgagcccaaggcacca

SEQ ID NO: 645742 - DNA, 22 bp, Artificial Sequence
  chemically synthesized
agagcttttggtgccttgggct

SEQ ID NO: 645743 - DNA, 22 bp, Artificial Sequence
  chemically synthesized
atctctttggttgagcccaagg

SEQ ID NO: 645744 - DNA, 22 bp, Artificial Sequence
  chemically synthesized
catctctttggttgagcccaag

SEQ ID NO: 645745 - DNA, 22 bp, Artificial Sequence
  chemically synthesized
tcatctctttggttgagcccaa

SEQ ID NO: 645746 - DNA, 22 bp, Artificial Sequence
  chemically synthesized
ttggtgccttgggctcaaccaa

SEQ ID NO: 645747 - DNA, 22 bp, Artificial Sequence
  chemically synthesized
tggtgccttgggctcaaccaaa

SEQ ID NO: 645748 - DNA, 22 bp, Artificial Sequence
  chemically synthesized
ggtgccttgggctcaaccaaag

SEQ ID NO: 645749 - DNA, 22 bp, Artificial Sequence
  chemically synthesized
gtgccttgggctcaaccaaaga

SEQ ID NO: 645750 - DNA, 22 bp, Artificial Sequence
  chemically synthesized
agtactttcatctctttggttg

SEQ ID NO: 645751 - DNA, 22 bp, Artificial Sequence
  chemically synthesized
aagtactttcatctctttggtt

SEQ ID NO: 645752 - DNA, 22 bp, Artificial Sequence
  chemically synthesized
gggctcaaccaaagagatgaaa

SEQ ID NO: 645753 - DNA, 22 bp, Artificial Sequence
  chemically synthesized
ggctcaaccaaagagatgaaag

SEQ ID NO: 645754 - DNA, 22 bp, Artificial Sequence
  chemically synthesized
tgggtcttaagtactttcatct

SEQ ID NO: 645755 - DNA, 22 bp, Artificial Sequence
  chemically synthesized
gtgggtcttaagtactttcatc

SEQ ID NO: 645756 - DNA, 22 bp, Artificial Sequence
  chemically synthesized
aaccaaagagatgaaagtactt

SEQ ID NO: 645757 - DNA, 22 bp, Artificial Sequence
  chemically synthesized
agatttgtgggtcttaagtact

SEQ ID NO: 645758 - DNA, 22 bp, Artificial Sequence
  chemically synthesized
ctcagatttgtgggtcttaagt

SEQ ID NO: 645759 - DNA, 22 bp, Artificial Sequence
  chemically synthesized
aagtagatgttgctcagatttg

SEQ ID NO: 645760 - DNA, 22 bp, Artificial Sequence
  chemically synthesized
aaagtagatgttgctcagattt

SEQ ID NO: 645761 - DNA, 22 bp, Artificial Sequence
  chemically synthesized
aagacccacaaatctgagcaac

SEQ ID NO: 645762 - DNA, 22 bp, Artificial Sequence
  chemically synthesized
agacccacaaatctgagcaaca

SEQ ID NO: 645763 - DNA, 22 bp, Artificial Sequence
  chemically synthesized
agcaacatctactttaaatcct

SEQ ID NO: 645764 - DNA, 22 bp, Artificial Sequence
  chemically synthesized
agacagatgccaccaagcaagg

SEQ ID NO: 645765 - DNA, 22 bp, Artificial Sequence
  chemically synthesized
cagacagatgccaccaagcaag

SEQ ID NO: 645766 - DNA, 22 bp, Artificial Sequence
  chemically synthesized
ttcagacagatgccaccaagca

SEQ ID NO: 645767 - DNA, 22 bp, Artificial Sequence
  chemically synthesized
ctttaaatccttgcttggtggc

SEQ ID NO: 645768 - DNA, 22 bp, Artificial Sequence
  chemically synthesized
cttcagacagatgccaccaagc

SEQ ID NO: 645769 - DNA, 22 bp, Artificial Sequence
  chemically synthesized
taaatccttgcttggtggcatc

SEQ ID NO: 645770 - DNA, 22 bp, Artificial Sequence
  chemically synthesized
aaatccttgcttggtggcatct

SEQ ID NO: 645771 - DNA, 22 bp, Artificial Sequence
  chemically synthesized
aatccttgcttggtggcatctg

SEQ ID NO: 645772 - DNA, 22 bp, Artificial Sequence
  chemically synthesized
gcttggtggcatctgtctgaag

SEQ ID NO: 645773 - DNA, 22 bp, Artificial Sequence
  chemically synthesized
acaatgtgccttcttcagacag

SEQ ID NO: 645774 - DNA, 22 bp, Artificial Sequence
  chemically synthesized
cttggtggcatctgtctgaaga

SEQ ID NO: 645775 - DNA, 22 bp, Artificial Sequence
  chemically synthesized
ggtggcatctgtctgaagaagg

SEQ ID NO: 645776 - DNA, 22 bp, Artificial Sequence
  chemically synthesized
actcacaatgtgccttcttcag

SEQ ID NO: 645777 - DNA, 22 bp, Artificial Sequence
  chemically synthesized
gtggcatctgtctgaagaaggc

SEQ ID NO: 645778 - DNA, 22 bp, Artificial Sequence
  chemically synthesized
taactcacaatgtgccttcttc

SEQ ID NO: 645779 - DNA, 22 bp, Artificial Sequence
  chemically synthesized
ctaactcacaatgtgccttctt

SEQ ID NO: 645780 - DNA, 22 bp, Artificial Sequence
  chemically synthesized
tctgaagaaggcacattgtgag

SEQ ID NO: 645781 - DNA, 22 bp, Artificial Sequence
  chemically synthesized
aagaaggcacattgtgagttag

SEQ ID NO: 645782 - DNA, 22 bp, Artificial Sequence
  chemically synthesized
acatgatcacttctaactcaca

SEQ ID NO: 645783 - DNA, 22 bp, Artificial Sequence
  chemically synthesized
tcacatgatcacttctaactca

SEQ ID NO: 645784 - DNA, 22 bp, Artificial Sequence
  chemically synthesized
ctcacatgatcacttctaactc

SEQ ID NO: 645785 - DNA, 22 bp, Artificial Sequence
  chemically synthesized
aaaagtcttctcacatgatcac

SEQ ID NO: 645786 - DNA, 22 bp, Artificial Sequence
  chemically synthesized
aaaaagtcttctcacatgatca

SEQ ID NO: 645787 - DNA, 22 bp, Artificial Sequence
  chemically synthesized
tgagttagaagtgatcatgtga

SEQ ID NO: 645788 - DNA, 22 bp, Artificial Sequence
  chemically synthesized
gtttaaaaagtcttctcacatg

SEQ ID NO: 645789 - DNA, 22 bp, Artificial Sequence
  chemically synthesized
ggtttaaaaagtcttctcacat

SEQ ID NO: 645790 - DNA, 22 bp, Artificial Sequence
  chemically synthesized
gaagtgatcatgtgagaagact

SEQ ID NO: 645791 - DNA, 22 bp, Artificial Sequence
  chemically synthesized
tgtcacaggtcccttggtttaa

SEQ ID NO: 645792 - DNA, 22 bp, Artificial Sequence
  chemically synthesized
ttatgtcacaggtcccttggtt

SEQ ID NO: 645793 - DNA, 22 bp, Artificial Sequence
  chemically synthesized
attatgtcacaggtcccttggt

SEQ ID NO: 645794 - DNA, 22 bp, Artificial Sequence
  chemically synthesized
catttattatgtcacaggtccc

SEQ ID NO: 645795 - DNA, 22 bp, Artificial Sequence
  chemically synthesized
tttaaaccaagggacctgtgac

SEQ ID NO: 645796 - DNA, 22 bp, Artificial Sequence
  chemically synthesized
ttaaaccaagggacctgtgaca

SEQ ID NO: 645797 - DNA, 22 bp, Artificial Sequence
  chemically synthesized
taaaccaagggacctgtgacat

SEQ ID NO: 645798 - DNA, 22 bp, Artificial Sequence
  chemically synthesized
aaaccaagggacctgtgacata

SEQ ID NO: 645799 - DNA, 22 bp, Artificial Sequence
  chemically synthesized
tattacatttattatgtcacag

SEQ ID NO: 645800 - DNA, 22 bp, Artificial Sequence
  chemically synthesized
aaccaagggacctgtgacataa

SEQ ID NO: 645801 - DNA, 22 bp, Artificial Sequence
  chemically synthesized
tgtattacatttattatgtcac

SEQ ID NO: 645802 - DNA, 22 bp, Artificial Sequence
  chemically synthesized
agttctgtattacatttattat

SEQ ID NO: 645803 - DNA, 22 bp, Artificial Sequence
  chemically synthesized
cagttctgtattacatttatta

SEQ ID NO: 645804 - DNA, 22 bp, Artificial Sequence
  chemically synthesized
tcagttctgtattacatttatt

SEQ ID NO: 645805 - DNA, 22 bp, Artificial Sequence
  chemically synthesized
gactttcagttctgtattacat

SEQ ID NO: 645806 - DNA, 22 bp, Artificial Sequence
  chemically synthesized
tgacataataaatgtaatacag

SEQ ID NO: 645807 - DNA, 22 bp, Artificial Sequence
  chemically synthesized
tgtcaggataatgcaaatcatt

SEQ ID NO: 645808 - DNA, 22 bp, Artificial Sequence
  chemically synthesized
aaagtccaatgatttgcattat

SEQ ID NO: 645809 - DNA, 22 bp, Artificial Sequence
  chemically synthesized
tattgtgtcaggataatgcaaa

SEQ ID NO: 645810 - DNA, 22 bp, Artificial Sequence
  chemically synthesized
gggtactgtattgtgtcaggat

SEQ ID NO: 645811 - DNA, 22 bp, Artificial Sequence
  chemically synthesized
gcattatcctgacacaatacag

SEQ ID NO: 645812 - DNA, 22 bp, Artificial Sequence
  chemically synthesized
cattatcctgacacaatacagt

SEQ ID NO: 645813 - DNA, 22 bp, Artificial Sequence
  chemically synthesized
tcctgacacaatacagtacccc

SEQ ID NO: 645814 - DNA, 22 bp, Artificial Sequence
  chemically synthesized
acacaatacagtaccccagatg

SEQ ID NO: 645815 - DNA, 22 bp, Artificial Sequence
  chemically synthesized
cagggaggacaaagatgtaaac

SEQ ID NO: 645816 - DNA, 22 bp, Artificial Sequence
  chemically synthesized
ataatgactgcagggaggacaa

SEQ ID NO: 645817 - DNA, 22 bp, Artificial Sequence
  chemically synthesized
tcataatgactgcagggaggac

SEQ ID NO: 645818 - DNA, 22 bp, Artificial Sequence
  chemically synthesized
acatctttgtcctccctgcagt

SEQ ID NO: 645819 - DNA, 22 bp, Artificial Sequence
  chemically synthesized
catctttgtcctccctgcagtc

SEQ ID NO: 645820 - DNA, 22 bp, Artificial Sequence
  chemically synthesized
aagaactctcataatgactgca

SEQ ID NO: 645821 - DNA, 22 bp, Artificial Sequence
  chemically synthesized
tgtcctccctgcagtcattatg

SEQ ID NO: 645822 - DNA, 22 bp, Artificial Sequence
  chemically synthesized
gtcctccctgcagtcattatga

SEQ ID NO: 645823 - DNA, 22 bp, Artificial Sequence
  chemically synthesized
tcctccctgcagtcattatgag

SEQ ID NO: 645824 - DNA, 22 bp, Artificial Sequence
  chemically synthesized
cctgcagtcattatgagagttc

SEQ ID NO: 645825 - DNA, 22 bp, Artificial Sequence
  chemically synthesized
cagtcattatgagagttcttta

SEQ ID NO: 645826 - DNA, 22 bp, Artificial Sequence
  chemically synthesized
tagaagagaaaaaggctaaaga

SEQ ID NO: 645827 - DNA, 22 bp, Artificial Sequence
  chemically synthesized
tgagagttctttagcctttttc

SEQ ID NO: 645828 - DNA, 22 bp, Artificial Sequence
  chemically synthesized
tttagcctttttctcttctaca

SEQ ID NO: 645829 - DNA, 22 bp, Artificial Sequence
  chemically synthesized
tagcctttttctcttctacaat

SEQ ID NO: 645830 - DNA, 22 bp, Artificial Sequence
  chemically synthesized
agcctttttctcttctacaatt

SEQ ID NO: 645831 - DNA, 22 bp, Artificial Sequence
  chemically synthesized
gcctttttctcttctacaattt

SEQ ID NO: 645832 - DNA, 22 bp, Artificial Sequence
  chemically synthesized
tttctcttctacaatttctgct

SEQ ID NO: 645833 - DNA, 22 bp, Artificial Sequence
  chemically synthesized
ttctcttctacaatttctgcta

SEQ ID NO: 645834 - DNA, 22 bp, Artificial Sequence
  chemically synthesized
tctcttctacaatttctgctat

SEQ ID NO: 645835 - DNA, 22 bp, Artificial Sequence
  chemically synthesized
ctcttctacaatttctgctatt

SEQ ID NO: 645836 - DNA, 22 bp, Artificial Sequence
  chemically synthesized
tcttctacaatttctgctattt

SEQ ID NO: 645837 - DNA, 22 bp, Artificial Sequence
  chemically synthesized
ttctacaatttctgctattttt

SEQ ID NO: 645838 - DNA, 22 bp, Artificial Sequence
  chemically synthesized
ctacaatttctgctatttttac

SEQ ID NO: 645839 - DNA, 22 bp, Artificial Sequence
  chemically synthesized
tacaatttctgctatttttaca

SEQ ID NO: 645840 - DNA, 22 bp, Artificial Sequence
  chemically synthesized
taaaagacagtcatgtaaaaat

SEQ ID NO: 645841 - DNA, 22 bp, Artificial Sequence
  chemically synthesized
caatttctgctatttttacatg

SEQ ID NO: 645842 - DNA, 22 bp, Artificial Sequence
  chemically synthesized
ctgctatttttacatgactgtc

SEQ ID NO: 645843 - DNA, 22 bp, Artificial Sequence
  chemically synthesized
tgctatttttacatgactgtct

SEQ ID NO: 645844 - DNA, 22 bp, Artificial Sequence
  chemically synthesized
ctatttttacatgactgtcttt

SEQ ID NO: 645845 - DNA, 22 bp, Artificial Sequence
  chemically synthesized
tttttacatgactgtcttttac

SEQ ID NO: 645846 - DNA, 22 bp, Artificial Sequence
  chemically synthesized
tcagccatcacctgtaaaagac

SEQ ID NO: 645847 - DNA, 22 bp, Artificial Sequence
  chemically synthesized
ttacatgactgtcttttacagg

SEQ ID NO: 645848 - DNA, 22 bp, Artificial Sequence
  chemically synthesized
tacatgactgtcttttacaggt

SEQ ID NO: 645849 - DNA, 22 bp, Artificial Sequence
  chemically synthesized
acatgactgtcttttacaggtg

SEQ ID NO: 645850 - DNA, 22 bp, Artificial Sequence
  chemically synthesized
catgactgtcttttacaggtga

SEQ ID NO: 645851 - DNA, 22 bp, Artificial Sequence
  chemically synthesized
caattgtcagccatcacctgta

SEQ ID NO: 645852 - DNA, 22 bp, Artificial Sequence
  chemically synthesized
tcttttacaggtgatggctgac

SEQ ID NO: 645853 - DNA, 22 bp, Artificial Sequence
  chemically synthesized
ttacaggtgatggctgacaatt

SEQ ID NO: 645854 - DNA, 22 bp, Artificial Sequence
  chemically synthesized
tacaggtgatggctgacaattg

SEQ ID NO: 645855 - DNA, 22 bp, Artificial Sequence
  chemically synthesized
gtgagacaattccaattgtcag

SEQ ID NO: 645856 - DNA, 22 bp, Artificial Sequence
  chemically synthesized
acaggtgatggctgacaattgg

SEQ ID NO: 645857 - DNA, 22 bp, Artificial Sequence
  chemically synthesized
caggtgatggctgacaattgga

SEQ ID NO: 645858 - DNA, 22 bp, Artificial Sequence
  chemically synthesized
acaattggaattgtctcactaa

SEQ ID NO: 645859 - DNA, 22 bp, Artificial Sequence
  chemically synthesized
accatcatagcaggttagtgag

SEQ ID NO: 645860 - DNA, 22 bp, Artificial Sequence
  chemically synthesized
gaattgtctcactaacctgcta

SEQ ID NO: 645861 - DNA, 22 bp, Artificial Sequence
  chemically synthesized
tgctcaccatcatagcaggtta

SEQ ID NO: 645862 - DNA, 22 bp, Artificial Sequence
  chemically synthesized
atgctcaccatcatagcaggtt

SEQ ID NO: 645863 - DNA, 22 bp, Artificial Sequence
  chemically synthesized
tttatgctcaccatcatagcag

SEQ ID NO: 645864 - DNA, 22 bp, Artificial Sequence
  chemically synthesized
tctcactaacctgctatgatgg

SEQ ID NO: 645865 - DNA, 22 bp, Artificial Sequence
  chemically synthesized
ttatttatgctcaccatcatag

SEQ ID NO: 645866 - DNA, 22 bp, Artificial Sequence
  chemically synthesized
actaacctgctatgatggtgag

SEQ ID NO: 645867 - DNA, 22 bp, Artificial Sequence
  chemically synthesized
acctgctatgatggtgagcata

SEQ ID NO: 645868 - DNA, 22 bp, Artificial Sequence
  chemically synthesized
ctatgatggtgagcataaataa

SEQ ID NO: 645869 - DNA, 22 bp, Artificial Sequence
  chemically synthesized
tgatggtgagcataaataataa

SEQ ID NO: 645870 - DNA, 22 bp, Artificial Sequence
  chemically synthesized
atcatcaaatgcagaaattatt

SEQ ID NO: 645871 - DNA, 22 bp, Artificial Sequence
  chemically synthesized
catcatcaaatgcagaaattat

SEQ ID NO: 645872 - DNA, 22 bp, Artificial Sequence
  chemically synthesized
tcatcatcaaatgcagaaatta

SEQ ID NO: 645873 - DNA, 22 bp, Artificial Sequence
  chemically synthesized
ttcatcatcaaatgcagaaatt

SEQ ID NO: 645874 - DNA, 22 bp, Artificial Sequence
  chemically synthesized
tttttcatcatcaaatgcagaa

SEQ ID NO: 645875 - DNA, 22 bp, Artificial Sequence
  chemically synthesized
atttttcatcatcaaatgcaga

SEQ ID NO: 645876 - DNA, 22 bp, Artificial Sequence
  chemically synthesized
atcttatttttcatcatcaaat

SEQ ID NO: 645877 - DNA, 22 bp, Artificial Sequence
  chemically synthesized
catcttatttttcatcatcaaa

SEQ ID NO: 645878 - DNA, 22 bp, Artificial Sequence
  chemically synthesized
tttcatcttatttttcatcatc

SEQ ID NO: 645879 - DNA, 22 bp, Artificial Sequence
  chemically synthesized
ctgcatttgatgatgaaaaata

SEQ ID NO: 645880 - DNA, 22 bp, Artificial Sequence
  chemically synthesized
tgcatttgatgatgaaaaataa

SEQ ID NO: 645881 - DNA, 22 bp, Artificial Sequence
  chemically synthesized
catttgatgatgaaaaataaga

SEQ ID NO: 645882 - DNA, 22 bp, Artificial Sequence
  chemically synthesized
gatgatgaaaaataagatgaaa

SEQ ID NO: 645883 - DNA, 22 bp, Artificial Sequence
  chemically synthesized
ggaaaccaattgtttcatctta

SEQ ID NO: 645884 - DNA, 22 bp, Artificial Sequence
  chemically synthesized
atgatgaaaaataagatgaaac

SEQ ID NO: 645885 - DNA, 22 bp, Artificial Sequence
  chemically synthesized
gtcatattgggaaaccaattgt

SEQ ID NO: 645886 - DNA, 22 bp, Artificial Sequence
  chemically synthesized
ggtcatattgggaaaccaattg

SEQ ID NO: 645887 - DNA, 22 bp, Artificial Sequence
  chemically synthesized
gcttggtcatattgggaaacca

SEQ ID NO: 645888 - DNA, 22 bp, Artificial Sequence
  chemically synthesized
ttggcttggtcatattgggaaa

SEQ ID NO: 645889 - DNA, 22 bp, Artificial Sequence
  chemically synthesized
gtttcccaatatgaccaagcca

SEQ ID NO: 645890 - DNA, 22 bp, Artificial Sequence
  chemically synthesized
agaaagtagggttattggcttg

SEQ ID NO: 645891 - DNA, 22 bp, Artificial Sequence
  chemically synthesized
cccaatatgaccaagccaataa

SEQ ID NO: 645892 - DNA, 22 bp, Artificial Sequence
  chemically synthesized
aagaaagtagggttattggctt

SEQ ID NO: 645893 - DNA, 22 bp, Artificial Sequence
  chemically synthesized
ccaatatgaccaagccaataac

SEQ ID NO: 645894 - DNA, 22 bp, Artificial Sequence
  chemically synthesized
aaacatttaagaaagtagggtt

SEQ ID NO: 645895 - DNA, 22 bp, Artificial Sequence
  chemically synthesized
cctcaaacatttaagaaagtag

SEQ ID NO: 645896 - DNA, 22 bp, Artificial Sequence
  chemically synthesized
tctacctcaaacatttaagaaa

SEQ ID NO: 645897 - DNA, 22 bp, Artificial Sequence
  chemically synthesized
gccatattatctacctcaaaca

SEQ ID NO: 645898 - DNA, 22 bp, Artificial Sequence
  chemically synthesized
ggccatattatctacctcaaac

SEQ ID NO: 645899 - DNA, 22 bp, Artificial Sequence
  chemically synthesized
ctttcttaaatgtttgaggtag

SEQ ID NO: 645900 - DNA, 22 bp, Artificial Sequence
  chemically synthesized
tcttaaatgtttgaggtagata

SEQ ID NO: 645901 - DNA, 22 bp, Artificial Sequence
  chemically synthesized
cttaaatgtttgaggtagataa

SEQ ID NO: 645902 - DNA, 22 bp, Artificial Sequence
  chemically synthesized
ttaaatgtttgaggtagataat

SEQ ID NO: 645903 - DNA, 22 bp, Artificial Sequence
  chemically synthesized
aaatgtttgaggtagataatat

SEQ ID NO: 645904 - DNA, 22 bp, Artificial Sequence
  chemically synthesized
aatgtttgaggtagataatatg

SEQ ID NO: 645905 - DNA, 22 bp, Artificial Sequence
  chemically synthesized
catgtgtttggccatattatct

SEQ ID NO: 645906 - DNA, 22 bp, Artificial Sequence
  chemically synthesized
acatgtgtttggccatattatc

SEQ ID NO: 645907 - DNA, 22 bp, Artificial Sequence
  chemically synthesized
tacatgtgtttggccatattat

SEQ ID NO: 645908 - DNA, 22 bp, Artificial Sequence
  chemically synthesized
ttacatgtgtttggccatatta

SEQ ID NO: 645909 - DNA, 22 bp, Artificial Sequence
  chemically synthesized
tttacatgtgtttggccatatt

SEQ ID NO: 645910 - DNA, 22 bp, Artificial Sequence
  chemically synthesized
ttttacatgtgtttggccatat

SEQ ID NO: 645911 - DNA, 22 bp, Artificial Sequence
  chemically synthesized
tttttacatgtgtttggccata

SEQ ID NO: 645912 - DNA, 22 bp, Artificial Sequence
  chemically synthesized
gaggtagataatatggccaaac

SEQ ID NO: 645913 - DNA, 22 bp, Artificial Sequence
  chemically synthesized
aggtagataatatggccaaaca

SEQ ID NO: 645914 - DNA, 22 bp, Artificial Sequence
  chemically synthesized
tatgattttttttacatgtgtt

SEQ ID NO: 645915 - DNA, 22 bp, Artificial Sequence
  chemically synthesized
tgattatatgattttttttaca

SEQ ID NO: 645916 - DNA, 22 bp, Artificial Sequence
  chemically synthesized
atgattatatgattttttttac

SEQ ID NO: 645917 - DNA, 22 bp, Artificial Sequence
  chemically synthesized
tatgattatatgatttttttta

SEQ ID NO: 645918 - DNA, 22 bp, Artificial Sequence
  chemically synthesized
attttatgattatatgattttt

SEQ ID NO: 645919 - DNA, 22 bp, Artificial Sequence
  chemically synthesized
aattttatgattatatgatttt

SEQ ID NO: 645920 - DNA, 22 bp, Artificial Sequence
  chemically synthesized
tttaattttatgattatatgat

SEQ ID NO: 645921 - DNA, 22 bp, Artificial Sequence
  chemically synthesized
agaaaaaagtaggttatttaat

SEQ ID NO: 645922 - DNA, 22 bp, Artificial Sequence
  chemically synthesized
aagaaaaaagtaggttatttaa

SEQ ID NO: 645923 - DNA, 22 bp, Artificial Sequence
  chemically synthesized
agaatagaatttaagaaaaaag

SEQ ID NO: 645924 - DNA, 22 bp, Artificial Sequence
  chemically synthesized
cagaatagaatttaagaaaaaa

SEQ ID NO: 645925 - DNA, 22 bp, Artificial Sequence
  chemically synthesized
aataacctacttttttcttaaa

SEQ ID NO: 645926 - DNA, 22 bp, Artificial Sequence
  chemically synthesized
tatttcagaatagaatttaaga

SEQ ID NO: 645927 - DNA, 22 bp, Artificial Sequence
  chemically synthesized
atatttcagaatagaatttaag

SEQ ID NO: 645928 - DNA, 22 bp, Artificial Sequence
  chemically synthesized
tatatttcagaatagaatttaa

SEQ ID NO: 645929 - DNA, 22 bp, Artificial Sequence
  chemically synthesized
cttttttcttaaattctattct

SEQ ID NO: 645930 - DNA, 22 bp, Artificial Sequence
  chemically synthesized
attttatatttcagaatagaat

SEQ ID NO: 645931 - DNA, 22 bp, Artificial Sequence
  chemically synthesized
gattttatatttcagaatagaa

SEQ ID NO: 645932 - DNA, 22 bp, Artificial Sequence
  chemically synthesized
tgattttatatttcagaataga

SEQ ID NO: 645933 - DNA, 22 bp, Artificial Sequence
  chemically synthesized
ttttcttaaattctattctgaa

SEQ ID NO: 645934 - DNA, 22 bp, Artificial Sequence
  chemically synthesized
tttcttaaattctattctgaaa

SEQ ID NO: 645935 - DNA, 22 bp, Artificial Sequence
  chemically synthesized
ttcttaaattctattctgaaat

SEQ ID NO: 645936 - DNA, 22 bp, Artificial Sequence
  chemically synthesized
tcttaaattctattctgaaata

SEQ ID NO: 645937 - DNA, 22 bp, Artificial Sequence
  chemically synthesized
cttaaattctattctgaaatat

SEQ ID NO: 645938 - DNA, 22 bp, Artificial Sequence
  chemically synthesized
ttaaattctattctgaaatata

SEQ ID NO: 645939 - DNA, 22 bp, Artificial Sequence
  chemically synthesized
aaattctattctgaaatataaa

SEQ ID NO: 645940 - DNA, 22 bp, Artificial Sequence
  chemically synthesized
caaggctttgattttatatttc

SEQ ID NO: 645941 - DNA, 22 bp, Artificial Sequence
  chemically synthesized
aattctattctgaaatataaaa

SEQ ID NO: 645942 - DNA, 22 bp, Artificial Sequence
  chemically synthesized
tattctgaaatataaaatcaaa

SEQ ID NO: 645943 - DNA, 22 bp, Artificial Sequence
  chemically synthesized
ttctgaaatataaaatcaaagc

SEQ ID NO: 645944 - DNA, 22 bp, Artificial Sequence
  chemically synthesized
catgtgtctccaaggctttgat

SEQ ID NO: 645945 - DNA, 22 bp, Artificial Sequence
  chemically synthesized
tgaaatataaaatcaaagcctt

SEQ ID NO: 645946 - DNA, 22 bp, Artificial Sequence
  chemically synthesized
aaatataaaatcaaagccttgg

SEQ ID NO: 645947 - DNA, 22 bp, Artificial Sequence
  chemically synthesized
ttgcatgtgtctccaaggcttt

SEQ ID NO: 645948 - DNA, 22 bp, Artificial Sequence
  chemically synthesized
gttgcatgtgtctccaaggctt

SEQ ID NO: 645949 - DNA, 22 bp, Artificial Sequence
  chemically synthesized
acttgttgcatgtgtctccaag

SEQ ID NO: 645950 - DNA, 22 bp, Artificial Sequence
  chemically synthesized
gacttgttgcatgtgtctccaa

SEQ ID NO: 645951 - DNA, 22 bp, Artificial Sequence
  chemically synthesized
atggtggtatttgacttgttgc

SEQ ID NO: 645952 - DNA, 22 bp, Artificial Sequence
  chemically synthesized
ggagacacatgcaacaagtcaa

SEQ ID NO: 645953 - DNA, 22 bp, Artificial Sequence
  chemically synthesized
gagacacatgcaacaagtcaaa

SEQ ID NO: 645954 - DNA, 22 bp, Artificial Sequence
  chemically synthesized
atgctgatggtggtatttgact

SEQ ID NO: 645955 - DNA, 22 bp, Artificial Sequence
  chemically synthesized
ggtgtgaaggagttaatgctga

SEQ ID NO: 645956 - DNA, 22 bp, Artificial Sequence
  chemically synthesized
aggtgtgaaggagttaatgctg

SEQ ID NO: 645957 - DNA, 22 bp, Artificial Sequence
  chemically synthesized
taggtgtgaaggagttaatgct

SEQ ID NO: 645958 - DNA, 22 bp, Artificial Sequence
  chemically synthesized
atattttaggtgtgaaggagtt

SEQ ID NO: 645959 - DNA, 22 bp, Artificial Sequence
  chemically synthesized
actccttcacacctaaaatatg

SEQ ID NO: 645960 - DNA, 22 bp, Artificial Sequence
  chemically synthesized
cttcacacctaaaatatgagtt

SEQ ID NO: 645961 - DNA, 22 bp, Artificial Sequence
  chemically synthesized
cacacctaaaatatgagttctt

SEQ ID NO: 645962 - DNA, 22 bp, Artificial Sequence
  chemically synthesized
acacctaaaatatgagttcttc

SEQ ID NO: 645963 - DNA, 22 bp, Artificial Sequence
  chemically synthesized
aaatatgagttcttcatcatac

SEQ ID NO: 645964 - DNA, 22 bp, Artificial Sequence
  chemically synthesized
aaagaagacaatggatgcaata

SEQ ID NO: 645965 - DNA, 22 bp, Artificial Sequence
  chemically synthesized
ttcatcatactattgcatccat

SEQ ID NO: 645966 - DNA, 22 bp, Artificial Sequence
  chemically synthesized
catcatactattgcatccattg

SEQ ID NO: 645967 - DNA, 22 bp, Artificial Sequence
  chemically synthesized
tctgaaagaagacaatggatgc

SEQ ID NO: 645968 - DNA, 22 bp, Artificial Sequence
  chemically synthesized
atcatactattgcatccattgt

SEQ ID NO: 645969 - DNA, 22 bp, Artificial Sequence
  chemically synthesized
ttatctgaaagaagacaatgga

SEQ ID NO: 645970 - DNA, 22 bp, Artificial Sequence
  chemically synthesized
gttatctgaaagaagacaatgg

SEQ ID NO: 645971 - DNA, 22 bp, Artificial Sequence
  chemically synthesized
tgttatctgaaagaagacaatg

SEQ ID NO: 645972 - DNA, 22 bp, Artificial Sequence
  chemically synthesized
ttgttatctgaaagaagacaat

SEQ ID NO: 645973 - DNA, 22 bp, Artificial Sequence
  chemically synthesized
tttgttatctgaaagaagacaa

SEQ ID NO: 645974 - DNA, 22 bp, Artificial Sequence
  chemically synthesized
ttttgttatctgaaagaagaca

SEQ ID NO: 645975 - DNA, 22 bp, Artificial Sequence
  chemically synthesized
tttttgttatctgaaagaagac

SEQ ID NO: 645976 - DNA, 22 bp, Artificial Sequence
  chemically synthesized
ttgcatccattgtcttctttca

SEQ ID NO: 645977 - DNA, 22 bp, Artificial Sequence
  chemically synthesized
ttttttgttatctgaaagaaga

SEQ ID NO: 645978 - DNA, 22 bp, Artificial Sequence
  chemically synthesized
tttttttgttatctgaaagaag

SEQ ID NO: 645979 - DNA, 22 bp, Artificial Sequence
  chemically synthesized
ttttttttgttatctgaaagaa

SEQ ID NO: 645980 - DNA, 22 bp, Artificial Sequence
  chemically synthesized
catccattgtcttctttcagat

SEQ ID NO: 645981 - DNA, 22 bp, Artificial Sequence
  chemically synthesized
tttttttttgttatctgaaaga

SEQ ID NO: 645982 - DNA, 22 bp, Artificial Sequence
  chemically synthesized
ttttttttttgttatctgaaag

SEQ ID NO: 645983 - DNA, 22 bp, Artificial Sequence
  chemically synthesized
ttttttttttttgttatctgaa

SEQ ID NO: 645984 - DNA, 22 bp, Artificial Sequence
  chemically synthesized
tcttttttttttttgttatctg

SEQ ID NO: 645985 - DNA, 22 bp, Artificial Sequence
  chemically synthesized
tctcttttttttttttgttatc

SEQ ID NO: 645986 - DNA, 22 bp, Artificial Sequence
  chemically synthesized
tcttctttcagataacaaaaaa

SEQ ID NO: 645987 - DNA, 22 bp, Artificial Sequence
  chemically synthesized
tctctcttttttttttttgtta

SEQ ID NO: 645988 - DNA, 22 bp, Artificial Sequence
  chemically synthesized
tctctctcttttttttttttgt

SEQ ID NO: 645989 - DNA, 22 bp, Artificial Sequence
  chemically synthesized
ctttcagataacaaaaaaaaaa

SEQ ID NO: 645990 - DNA, 22 bp, Artificial Sequence
  chemically synthesized
tttcagataacaaaaaaaaaaa

SEQ ID NO: 645991 - DNA, 22 bp, Artificial Sequence
  chemically synthesized
tcagataacaaaaaaaaaaaag

SEQ ID NO: 645992 - DNA, 22 bp, Artificial Sequence
  chemically synthesized
cagataacaaaaaaaaaaaaga

SEQ ID NO: 645993 - DNA, 22 bp, Artificial Sequence
  chemically synthesized
agataacaaaaaaaaaaaagag

SEQ ID NO: 645994 - DNA, 22 bp, Artificial Sequence
  chemically synthesized
cagattctctctctcttttttt

SEQ ID NO: 645995 - DNA, 22 bp, Artificial Sequence
  chemically synthesized
gcagattctctctctctttttt

SEQ ID NO: 645996 - DNA, 22 bp, Artificial Sequence
  chemically synthesized
catttgcagattctctctctct

SEQ ID NO: 645997 - DNA, 22 bp, Artificial Sequence
  chemically synthesized
gctccatttgcagattctctct

SEQ ID NO: 645998 - DNA, 22 bp, Artificial Sequence
  chemically synthesized
agctccatttgcagattctctc

SEQ ID NO: 645999 - DNA, 22 bp, Artificial Sequence
  chemically synthesized
tttagctccatttgcagattct

SEQ ID NO: 646000 - DNA, 22 bp, Artificial Sequence
  chemically synthesized
aaataatctgtttagctccatt

SEQ ID NO: 646001 - DNA, 22 bp, Artificial Sequence
  chemically synthesized
taaaataatctgtttagctcca

SEQ ID NO: 646002 - DNA, 22 bp, Artificial Sequence
  chemically synthesized
ctaaaataatctgtttagctcc

SEQ ID NO: 646003 - DNA, 22 bp, Artificial Sequence
  chemically synthesized
tctaaaataatctgtttagctc

SEQ ID NO: 646004 - DNA, 22 bp, Artificial Sequence
  chemically synthesized
ttttctaaaataatctgtttag

SEQ ID NO: 646005 - DNA, 22 bp, Artificial Sequence
  chemically synthesized
caaatggagctaaacagattat

SEQ ID NO: 646006 - DNA, 22 bp, Artificial Sequence
  chemically synthesized
attgttttctaaaataatctgt

SEQ ID NO: 646007 - DNA, 22 bp, Artificial Sequence
  chemically synthesized
tgtctaattgttttctaaaata

SEQ ID NO: 646008 - DNA, 22 bp, Artificial Sequence
  chemically synthesized
atgtctaattgttttctaaaat

SEQ ID NO: 646009 - DNA, 22 bp, Artificial Sequence
  chemically synthesized
tatgtctaattgttttctaaaa

SEQ ID NO: 646010 - DNA, 22 bp, Artificial Sequence
  chemically synthesized
aacagattattttagaaaacaa

SEQ ID NO: 646011 - DNA, 22 bp, Artificial Sequence
  chemically synthesized
gagtcattttatgtctaattgt

SEQ ID NO: 646012 - DNA, 22 bp, Artificial Sequence
  chemically synthesized
agagtcattttatgtctaattg

SEQ ID NO: 646013 - DNA, 22 bp, Artificial Sequence
  chemically synthesized
ttttagaaaacaattagacata

SEQ ID NO: 646014 - DNA, 22 bp, Artificial Sequence
  chemically synthesized
acttagagtcattttatgtcta

SEQ ID NO: 646015 - DNA, 22 bp, Artificial Sequence
  chemically synthesized
tagaaaacaattagacataaaa

SEQ ID NO: 646016 - DNA, 22 bp, Artificial Sequence
  chemically synthesized
cacttagagtcattttatgtct

SEQ ID NO: 646017 - DNA, 22 bp, Artificial Sequence
  chemically synthesized
agaaaacaattagacataaaat

SEQ ID NO: 646018 - DNA, 22 bp, Artificial Sequence
  chemically synthesized
gaaaacaattagacataaaatg

SEQ ID NO: 646019 - DNA, 22 bp, Artificial Sequence
  chemically synthesized
gacataaaatgactctaagtga

SEQ ID NO: 646020 - DNA, 22 bp, Artificial Sequence
  chemically synthesized
cacacatagaaaagtgccagga

SEQ ID NO: 646021 - DNA, 22 bp, Artificial Sequence
  chemically synthesized
taagtgaagattcctggcactt

SEQ ID NO: 646022 - DNA, 22 bp, Artificial Sequence
  chemically synthesized
gcacacatagaaaagtgccagg

SEQ ID NO: 646023 - DNA, 22 bp, Artificial Sequence
  chemically synthesized
agtgaagattcctggcactttt

SEQ ID NO: 646024 - DNA, 22 bp, Artificial Sequence
  chemically synthesized
ctggcacttttctatgtgtgca

SEQ ID NO: 646025 - DNA, 22 bp, Artificial Sequence
  chemically synthesized
gcacttttctatgtgtgcaagt

SEQ ID NO: 646026 - DNA, 22 bp, Artificial Sequence
  chemically synthesized
gtatgcagagtgcatacacttg

SEQ ID NO: 646027 - DNA, 22 bp, Artificial Sequence
  chemically synthesized
ttctatgtgtgcaagtgtatgc

SEQ ID NO: 646028 - DNA, 22 bp, Artificial Sequence
  chemically synthesized
tctatgtgtgcaagtgtatgca

SEQ ID NO: 646029 - DNA, 22 bp, Artificial Sequence
  chemically synthesized
ctatgtgtgcaagtgtatgcac

SEQ ID NO: 646030 - DNA, 22 bp, Artificial Sequence
  chemically synthesized
tatgtgtgcaagtgtatgcact

SEQ ID NO: 646031 - DNA, 22 bp, Artificial Sequence
  chemically synthesized
tgtgtgcaagtgtatgcactct

SEQ ID NO: 646032 - DNA, 22 bp, Artificial Sequence
  chemically synthesized
tcattggtatgcagagtgcata

SEQ ID NO: 646033 - DNA, 22 bp, Artificial Sequence
  chemically synthesized
gtcattggtatgcagagtgcat

SEQ ID NO: 646034 - DNA, 22 bp, Artificial Sequence
  chemically synthesized
tgtcattggtatgcagagtgca

SEQ ID NO: 646035 - DNA, 22 bp, Artificial Sequence
  chemically synthesized
gctttgtcattggtatgcagag

SEQ ID NO: 646036 - DNA, 22 bp, Artificial Sequence
  chemically synthesized
tagctttgtcattggtatgcag

SEQ ID NO: 646037 - DNA, 22 bp, Artificial Sequence
  chemically synthesized
ctagctttgtcattggtatgca

SEQ ID NO: 646038 - DNA, 22 bp, Artificial Sequence
  chemically synthesized
tctagctttgtcattggtatgc

SEQ ID NO: 646039 - DNA, 22 bp, Artificial Sequence
  chemically synthesized
tttctagctttgtcattggtat

SEQ ID NO: 646040 - DNA, 22 bp, Artificial Sequence
  chemically synthesized
ctttctagctttgtcattggta

SEQ ID NO: 646041 - DNA, 22 bp, Artificial Sequence
  chemically synthesized
tctttctagctttgtcattggt

SEQ ID NO: 646042 - DNA, 22 bp, Artificial Sequence
  chemically synthesized
tgcataccaatgacaaagctag

SEQ ID NO: 646043 - DNA, 22 bp, Artificial Sequence
  chemically synthesized
cataccaatgacaaagctagaa

SEQ ID NO: 646044 - DNA, 22 bp, Artificial Sequence
  chemically synthesized
aggaagaaaacaggtgagtttt

SEQ ID NO: 646045 - DNA, 22 bp, Artificial Sequence
  chemically synthesized
gaggaagaaaacaggtgagttt

SEQ ID NO: 646046 - DNA, 22 bp, Artificial Sequence
  chemically synthesized
gaaagaaaactcacctgttttc

SEQ ID NO: 646047 - DNA, 22 bp, Artificial Sequence
  chemically synthesized
gcagatcttgaggaagaaaaca

SEQ ID NO: 646048 - DNA, 22 bp, Artificial Sequence
  chemically synthesized
acctgttttcttcctcaagatc

SEQ ID NO: 646049 - DNA, 22 bp, Artificial Sequence
  chemically synthesized
gagagaatcctagcagatcttg

SEQ ID NO: 646050 - DNA, 22 bp, Artificial Sequence
  chemically synthesized
ttttcttcctcaagatctgcta

SEQ ID NO: 646051 - DNA, 22 bp, Artificial Sequence
  chemically synthesized
tcttcctcaagatctgctagga

SEQ ID NO: 646052 - DNA, 22 bp, Artificial Sequence
  chemically synthesized
cttcctcaagatctgctaggat

SEQ ID NO: 646053 - DNA, 22 bp, Artificial Sequence
  chemically synthesized
ttcctcaagatctgctaggatt

SEQ ID NO: 646054 - DNA, 22 bp, Artificial Sequence
  chemically synthesized
cctcaagatctgctaggattct

SEQ ID NO: 646055 - DNA, 22 bp, Artificial Sequence
  chemically synthesized
ctcaagatctgctaggattctc

SEQ ID NO: 646056 - DNA, 22 bp, Artificial Sequence
  chemically synthesized
aagatctgctaggattctctct

SEQ ID NO: 646057 - DNA, 22 bp, Artificial Sequence
  chemically synthesized
ctaggattctctctagctcccc

SEQ ID NO: 646058 - DNA, 22 bp, Artificial Sequence
  chemically synthesized
ggattctctctagctcccctct

SEQ ID NO: 646059 - DNA, 22 bp, Artificial Sequence
  chemically synthesized
gagagtgaggaaagaggggagc

SEQ ID NO: 646060 - DNA, 22 bp, Artificial Sequence
  chemically synthesized
agagagtgaggaaagaggggag

SEQ ID NO: 646061 - DNA, 22 bp, Artificial Sequence
  chemically synthesized
cttagagagtgaggaaagaggg

SEQ ID NO: 646062 - DNA, 22 bp, Artificial Sequence
  chemically synthesized
ccttagagagtgaggaaagagg

SEQ ID NO: 646063 - DNA, 22 bp, Artificial Sequence
  chemically synthesized
tctctagctcccctctttcctc

SEQ ID NO: 646064 - DNA, 22 bp, Artificial Sequence
  chemically synthesized
tctagctcccctctttcctcac

SEQ ID NO: 646065 - DNA, 22 bp, Artificial Sequence
  chemically synthesized
atttccttagagagtgaggaaa

SEQ ID NO: 646066 - DNA, 22 bp, Artificial Sequence
  chemically synthesized
tagctcccctctttcctcactc

SEQ ID NO: 646067 - DNA, 22 bp, Artificial Sequence
  chemically synthesized
gatttccttagagagtgaggaa

SEQ ID NO: 646068 - DNA, 22 bp, Artificial Sequence
  chemically synthesized
gctcccctctttcctcactctc

SEQ ID NO: 646069 - DNA, 22 bp, Artificial Sequence
  chemically synthesized
ccctctttcctcactctctaag

SEQ ID NO: 646070 - DNA, 22 bp, Artificial Sequence
  chemically synthesized
cccagatcttgatttccttaga

SEQ ID NO: 646071 - DNA, 22 bp, Artificial Sequence
  chemically synthesized
tttcctcactctctaaggaaat

SEQ ID NO: 646072 - DNA, 22 bp, Artificial Sequence
  chemically synthesized
tcctcactctctaaggaaatca

SEQ ID NO: 646073 - DNA, 22 bp, Artificial Sequence
  chemically synthesized
cctcactctctaaggaaatcaa

SEQ ID NO: 646074 - DNA, 22 bp, Artificial Sequence
  chemically synthesized
ctcactctctaaggaaatcaag

SEQ ID NO: 646075 - DNA, 22 bp, Artificial Sequence
  chemically synthesized
actctctaaggaaatcaagatc

SEQ ID NO: 646076 - DNA, 22 bp, Artificial Sequence
  chemically synthesized
gtagtcctgcccagatcttgat

SEQ ID NO: 646077 - DNA, 22 bp, Artificial Sequence
  chemically synthesized
tctaaggaaatcaagatctggg

SEQ ID NO: 646078 - DNA, 22 bp, Artificial Sequence
  chemically synthesized
taaggaaatcaagatctgggca

SEQ ID NO: 646079 - DNA, 22 bp, Artificial Sequence
  chemically synthesized
aggaaatcaagatctgggcagg

SEQ ID NO: 646080 - DNA, 22 bp, Artificial Sequence
  chemically synthesized
agccagcctcgtagtcctgccc

SEQ ID NO: 646081 - DNA, 22 bp, Artificial Sequence
  chemically synthesized
ccccctgagccagcctcgtagt

SEQ ID NO: 646082 - DNA, 22 bp, Artificial Sequence
  chemically synthesized
ggcaggactacgaggctggctc

SEQ ID NO: 646083 - DNA, 22 bp, Artificial Sequence
  chemically synthesized
aaccaggactcccccctgagcc

SEQ ID NO: 646084 - DNA, 22 bp, Artificial Sequence
  chemically synthesized
gaaccaggactcccccctgagc

SEQ ID NO: 646085 - DNA, 22 bp, Artificial Sequence
  chemically synthesized
cgaggctggctcaggggggagt

SEQ ID NO: 646086 - DNA, 22 bp, Artificial Sequence
  chemically synthesized
ccaaagtttgaaccaggactcc

SEQ ID NO: 646087 - DNA, 22 bp, Artificial Sequence
  chemically synthesized
gctcaggggggagtcctggttc

SEQ ID NO: 646088 - DNA, 22 bp, Artificial Sequence
  chemically synthesized
ctgccaaagtttgaaccaggac

SEQ ID NO: 646089 - DNA, 22 bp, Artificial Sequence
  chemically synthesized
aggggggagtcctggttcaaac

SEQ ID NO: 646090 - DNA, 22 bp, Artificial Sequence
  chemically synthesized
atccagcattactgccaaagtt

SEQ ID NO: 646091 - DNA, 22 bp, Artificial Sequence
  chemically synthesized
ttaatccagcattactgccaaa

SEQ ID NO: 646092 - DNA, 22 bp, Artificial Sequence
  chemically synthesized
gttaatccagcattactgccaa

SEQ ID NO: 646093 - DNA, 22 bp, Artificial Sequence
  chemically synthesized
gttcaaactttggcagtaatgc

SEQ ID NO: 646094 - DNA, 22 bp, Artificial Sequence
  chemically synthesized
aaactttggcagtaatgctgga

SEQ ID NO: 646095 - DNA, 22 bp, Artificial Sequence
  chemically synthesized
tggcagtaatgctggattaaca

SEQ ID NO: 646096 - DNA, 22 bp, Artificial Sequence
  chemically synthesized
ggcagtaatgctggattaacaa

SEQ ID NO: 646097 - DNA, 22 bp, Artificial Sequence
  chemically synthesized
gcagtaatgctggattaacaaa

SEQ ID NO: 646098 - DNA, 22 bp, Artificial Sequence
  chemically synthesized
cagagatgatgaacatttgtta

SEQ ID NO: 646099 - DNA, 22 bp, Artificial Sequence
  chemically synthesized
ccagagatgatgaacatttgtt

SEQ ID NO: 646100 - DNA, 22 bp, Artificial Sequence
  chemically synthesized
tccagagatgatgaacatttgt

SEQ ID NO: 646101 - DNA, 22 bp, Artificial Sequence
  chemically synthesized
ttttccagagatgatgaacatt

SEQ ID NO: 646102 - DNA, 22 bp, Artificial Sequence
  chemically synthesized
attttccagagatgatgaacat

SEQ ID NO: 646103 - DNA, 22 bp, Artificial Sequence
  chemically synthesized
tattttccagagatgatgaaca

SEQ ID NO: 646104 - DNA, 22 bp, Artificial Sequence
  chemically synthesized
gattaacaaatgttcatcatct

SEQ ID NO: 646105 - DNA, 22 bp, Artificial Sequence
  chemically synthesized
attttattttccagagatgatg

SEQ ID NO: 646106 - DNA, 22 bp, Artificial Sequence
  chemically synthesized
gattttattttccagagatgat

SEQ ID NO: 646107 - DNA, 22 bp, Artificial Sequence
  chemically synthesized
tgattttattttccagagatga

SEQ ID NO: 646108 - DNA, 22 bp, Artificial Sequence
  chemically synthesized
acaaatgttcatcatctctgga

SEQ ID NO: 646109 - DNA, 22 bp, Artificial Sequence
  chemically synthesized
atcatctctggaaaataaaatc

SEQ ID NO: 646110 - DNA, 22 bp, Artificial Sequence
  chemically synthesized
tggaaaataaaatcaaaggttt

SEQ ID NO: 646111 - DNA, 22 bp, Artificial Sequence
  chemically synthesized
gaaaataaaatcaaaggttttg

SEQ ID NO: 646112 - DNA, 22 bp, Artificial Sequence
  chemically synthesized
tggttttttcccccccttattt

SEQ ID NO: 646113 - DNA, 22 bp, Artificial Sequence
  chemically synthesized
acccccaaagcaaaataagggg

SEQ ID NO: 646114 - DNA, 22 bp, Artificial Sequence
  chemically synthesized
ggttttttcccccccttatttt

SEQ ID NO: 646115 - DNA, 22 bp, Artificial Sequence
  chemically synthesized
gttttttcccccccttattttg

SEQ ID NO: 646116 - DNA, 22 bp, Artificial Sequence
  chemically synthesized
tttcccccccttattttgcttt

SEQ ID NO: 646117 - DNA, 22 bp, Artificial Sequence
  chemically synthesized
ttcccccccttattttgctttg

SEQ ID NO: 646118 - DNA, 22 bp, Artificial Sequence
  chemically synthesized
tcccccccttattttgctttgg

SEQ ID NO: 646119 - DNA, 22 bp, Artificial Sequence
  chemically synthesized
agtccctaacccccaaagcaaa

SEQ ID NO: 646120 - DNA, 22 bp, Artificial Sequence
  chemically synthesized
cccccccttattttgctttggg

SEQ ID NO: 646121 - DNA, 22 bp, Artificial Sequence
  chemically synthesized
ccccccttattttgctttgggg

SEQ ID NO: 646122 - DNA, 22 bp, Artificial Sequence
  chemically synthesized
ctgagtccctaacccccaaagc

SEQ ID NO: 646123 - DNA, 22 bp, Artificial Sequence
  chemically synthesized
attttgctttgggggttaggga

SEQ ID NO: 646124 - DNA, 22 bp, Artificial Sequence
  chemically synthesized
ttttgctttgggggttagggac

SEQ ID NO: 646125 - DNA, 22 bp, Artificial Sequence
  chemically synthesized
aaatacactcctgagtccctaa

SEQ ID NO: 646126 - DNA, 22 bp, Artificial Sequence
  chemically synthesized
tgctttgggggttagggactca

SEQ ID NO: 646127 - DNA, 22 bp, Artificial Sequence
  chemically synthesized
caaatacactcctgagtcccta

SEQ ID NO: 646128 - DNA, 22 bp, Artificial Sequence
  chemically synthesized
gctttgggggttagggactcag

SEQ ID NO: 646129 - DNA, 22 bp, Artificial Sequence
  chemically synthesized
tcaaatacactcctgagtccct

SEQ ID NO: 646130 - DNA, 22 bp, Artificial Sequence
  chemically synthesized
ctttgggggttagggactcagg

SEQ ID NO: 646131 - DNA, 22 bp, Artificial Sequence
  chemically synthesized
ttttcaaatacactcctgagtc

SEQ ID NO: 646132 - DNA, 22 bp, Artificial Sequence
  chemically synthesized
tgggggttagggactcaggagt

SEQ ID NO: 646133 - DNA, 22 bp, Artificial Sequence
  chemically synthesized
gggggttagggactcaggagtg

SEQ ID NO: 646134 - DNA, 22 bp, Artificial Sequence
  chemically synthesized
tattttcaaatacactcctgag

SEQ ID NO: 646135 - DNA, 22 bp, Artificial Sequence
  chemically synthesized
ggggttagggactcaggagtgt

SEQ ID NO: 646136 - DNA, 22 bp, Artificial Sequence
  chemically synthesized
ctattttcaaatacactcctga

SEQ ID NO: 646137 - DNA, 22 bp, Artificial Sequence
  chemically synthesized
gggactcaggagtgtatttgaa

SEQ ID NO: 646138 - DNA, 22 bp, Artificial Sequence
  chemically synthesized
aggagtgtatttgaaaatagaa

SEQ ID NO: 646139 - DNA, 22 bp, Artificial Sequence
  chemically synthesized
agagcaaataaatgtttctatt

SEQ ID NO: 646140 - DNA, 22 bp, Artificial Sequence
  chemically synthesized
ttaagagcaaataaatgtttct

SEQ ID NO: 646141 - DNA, 22 bp, Artificial Sequence
  chemically synthesized
attgttaagagcaaataaatgt

SEQ ID NO: 646142 - DNA, 22 bp, Artificial Sequence
  chemically synthesized
gaaaatagaaacatttatttgc

SEQ ID NO: 646143 - DNA, 22 bp, Artificial Sequence
  chemically synthesized
aaaatagaaacatttatttgct

SEQ ID NO: 646144 - DNA, 22 bp, Artificial Sequence
  chemically synthesized
attaattgttaagagcaaataa

SEQ ID NO: 646145 - DNA, 22 bp, Artificial Sequence
  chemically synthesized
atttgctcttaacaattaatta

SEQ ID NO: 646146 - DNA, 22 bp, Artificial Sequence
  chemically synthesized
tttgctcttaacaattaattag

SEQ ID NO: 646147 - DNA, 22 bp, Artificial Sequence
  chemically synthesized
gctcttaacaattaattagacc

SEQ ID NO: 646148 - DNA, 22 bp, Artificial Sequence
  chemically synthesized
ctcttaacaattaattagacct

SEQ ID NO: 646149 - DNA, 22 bp, Artificial Sequence
  chemically synthesized
gaagcaggaaaaaaggtctaat

SEQ ID NO: 646150 - DNA, 22 bp, Artificial Sequence
  chemically synthesized
agaagcaggaaaaaaggtctaa

SEQ ID NO: 646151 - DNA, 22 bp, Artificial Sequence
  chemically synthesized
ttaacaattaattagacctttt

SEQ ID NO: 646152 - DNA, 22 bp, Artificial Sequence
  chemically synthesized
tagaagcaggaaaaaaggtcta

SEQ ID NO: 646153 - DNA, 22 bp, Artificial Sequence
  chemically synthesized
aacaattaattagacctttttt

SEQ ID NO: 646154 - DNA, 22 bp, Artificial Sequence
  chemically synthesized
acaattaattagaccttttttc

SEQ ID NO: 646155 - DNA, 22 bp, Artificial Sequence
  chemically synthesized
attagaccttttttcctgcttc

SEQ ID NO: 646156 - DNA, 22 bp, Artificial Sequence
  chemically synthesized
gaccttttttcctgcttctaaa

SEQ ID NO: 646157 - DNA, 22 bp, Artificial Sequence
  chemically synthesized
agcagtatcaaaaggtctttag

SEQ ID NO: 646158 - DNA, 22 bp, Artificial Sequence
  chemically synthesized
ttttcctgcttctaaagacctt

SEQ ID NO: 646159 - DNA, 22 bp, Artificial Sequence
  chemically synthesized
tttcctgcttctaaagaccttt

SEQ ID NO: 646160 - DNA, 22 bp, Artificial Sequence
  chemically synthesized
ttcctgcttctaaagacctttt

SEQ ID NO: 646161 - DNA, 22 bp, Artificial Sequence
  chemically synthesized
tcctgcttctaaagaccttttg

SEQ ID NO: 646162 - DNA, 22 bp, Artificial Sequence
  chemically synthesized
cctgcttctaaagaccttttga

SEQ ID NO: 646163 - DNA, 22 bp, Artificial Sequence
  chemically synthesized
ctgcttctaaagaccttttgat

SEQ ID NO: 646164 - DNA, 22 bp, Artificial Sequence
  chemically synthesized
cttctaaagaccttttgatact

SEQ ID NO: 646165 - DNA, 22 bp, Artificial Sequence
  chemically synthesized
ctaaagaccttttgatactgct

SEQ ID NO: 646166 - DNA, 22 bp, Artificial Sequence
  chemically synthesized
taaagaccttttgatactgctg

SEQ ID NO: 646167 - DNA, 22 bp, Artificial Sequence
  chemically synthesized
aagaccttttgatactgctgag

SEQ ID NO: 646168 - DNA, 22 bp, Artificial Sequence
  chemically synthesized
ttgatactgctgaggttgtgat

SEQ ID NO: 646169 - DNA, 22 bp, Artificial Sequence
  chemically synthesized
tgatactgctgaggttgtgatc

SEQ ID NO: 646170 - DNA, 22 bp, Artificial Sequence
  chemically synthesized
gatactgctgaggttgtgatct

SEQ ID NO: 646171 - DNA, 22 bp, Artificial Sequence
  chemically synthesized
atactgctgaggttgtgatcta

SEQ ID NO: 646172 - DNA, 22 bp, Artificial Sequence
  chemically synthesized
gtaccagtagaatggtagatca

SEQ ID NO: 646173 - DNA, 22 bp, Artificial Sequence
  chemically synthesized
ctgaggttgtgatctaccattc

SEQ ID NO: 646174 - DNA, 22 bp, Artificial Sequence
  chemically synthesized
aattggtaccagtagaatggta

SEQ ID NO: 646175 - DNA, 22 bp, Artificial Sequence
  chemically synthesized
aggttgtgatctaccattctac

SEQ ID NO: 646176 - DNA, 22 bp, Artificial Sequence
  chemically synthesized
gaattggtaccagtagaatggt

SEQ ID NO: 646177 - DNA, 22 bp, Artificial Sequence
  chemically synthesized
tgaattggtaccagtagaatgg

SEQ ID NO: 646178 - DNA, 22 bp, Artificial Sequence
  chemically synthesized
tgatctaccattctactggtac

SEQ ID NO: 646179 - DNA, 22 bp, Artificial Sequence
  chemically synthesized
ccattctactggtaccaattca

SEQ ID NO: 646180 - DNA, 22 bp, Artificial Sequence
  chemically synthesized
agcaagaaaacactttgaattg

SEQ ID NO: 646181 - DNA, 22 bp, Artificial Sequence
  chemically synthesized
tactggtaccaattcaaagtgt

SEQ ID NO: 646182 - DNA, 22 bp, Artificial Sequence
  chemically synthesized
ctggtaccaattcaaagtgttt

SEQ ID NO: 646183 - DNA, 22 bp, Artificial Sequence
  chemically synthesized
gtaccaattcaaagtgttttct

SEQ ID NO: 646184 - DNA, 22 bp, Artificial Sequence
  chemically synthesized
aaaatctgagcaagaaaacact

SEQ ID NO: 646185 - DNA, 22 bp, Artificial Sequence
  chemically synthesized
gaaaatctgagcaagaaaacac

SEQ ID NO: 646186 - DNA, 22 bp, Artificial Sequence
  chemically synthesized
atttgaaaatctgagcaagaaa

SEQ ID NO: 646187 - DNA, 22 bp, Artificial Sequence
  chemically synthesized
catttgaaaatctgagcaagaa

SEQ ID NO: 646188 - DNA, 22 bp, Artificial Sequence
  chemically synthesized
aaagtgttttcttgctcagatt

SEQ ID NO: 646189 - DNA, 22 bp, Artificial Sequence
  chemically synthesized
tcttgctcagattttcaaatga

SEQ ID NO: 646190 - DNA, 22 bp, Artificial Sequence
  chemically synthesized
cttgctcagattttcaaatgaa

SEQ ID NO: 646191 - DNA, 22 bp, Artificial Sequence
  chemically synthesized
ttgctcagattttcaaatgaaa

SEQ ID NO: 646192 - DNA, 22 bp, Artificial Sequence
  chemically synthesized
gctcagattttcaaatgaaatt

SEQ ID NO: 646193 - DNA, 22 bp, Artificial Sequence
  chemically synthesized
ctcagattttcaaatgaaattg

SEQ ID NO: 646194 - DNA, 22 bp, Artificial Sequence
  chemically synthesized
agattttcaaatgaaattgatt

SEQ ID NO: 646195 - DNA, 22 bp, Artificial Sequence
  chemically synthesized
tccgtgtaaataggccaatcaa

SEQ ID NO: 646196 - DNA, 22 bp, Artificial Sequence
  chemically synthesized
atccgtgtaaataggccaatca

SEQ ID NO: 646197 - DNA, 22 bp, Artificial Sequence
  chemically synthesized
tcaaatgaaattgattggccta

SEQ ID NO: 646198 - DNA, 22 bp, Artificial Sequence
  chemically synthesized
caaatgaaattgattggcctat

SEQ ID NO: 646199 - DNA, 22 bp, Artificial Sequence
  chemically synthesized
aaatgaaattgattggcctatt

SEQ ID NO: 646200 - DNA, 22 bp, Artificial Sequence
  chemically synthesized
atttatccgtgtaaataggcca

SEQ ID NO: 646201 - DNA, 22 bp, Artificial Sequence
  chemically synthesized
catttatccgtgtaaataggcc

SEQ ID NO: 646202 - DNA, 22 bp, Artificial Sequence
  chemically synthesized
tcatttatccgtgtaaataggc

SEQ ID NO: 646203 - DNA, 22 bp, Artificial Sequence
  chemically synthesized
cctttcatttatccgtgtaaat

SEQ ID NO: 646204 - DNA, 22 bp, Artificial Sequence
  chemically synthesized
tgcctttcatttatccgtgtaa

SEQ ID NO: 646205 - DNA, 22 bp, Artificial Sequence
  chemically synthesized
attggcctatttacacggataa

SEQ ID NO: 646206 - DNA, 22 bp, Artificial Sequence
  chemically synthesized
gcctatttacacggataaatga

SEQ ID NO: 646207 - DNA, 22 bp, Artificial Sequence
  chemically synthesized
taattctgcctttcatttatcc

SEQ ID NO: 646208 - DNA, 22 bp, Artificial Sequence
  chemically synthesized
tgtaattctgcctttcatttat

SEQ ID NO: 646209 - DNA, 22 bp, Artificial Sequence
  chemically synthesized
ctgtaattctgcctttcattta

SEQ ID NO: 646210 - DNA, 22 bp, Artificial Sequence
  chemically synthesized
tttacacggataaatgaaaggc

SEQ ID NO: 646211 - DNA, 22 bp, Artificial Sequence
  chemically synthesized
acacggataaatgaaaggcaga

SEQ ID NO: 646212 - DNA, 22 bp, Artificial Sequence
  chemically synthesized
cacggataaatgaaaggcagaa

SEQ ID NO: 646213 - DNA, 22 bp, Artificial Sequence
  chemically synthesized
acatcaacgtagagtcccagta

SEQ ID NO: 646214 - DNA, 22 bp, Artificial Sequence
  chemically synthesized
actaacatcaacgtagagtccc

SEQ ID NO: 646215 - DNA, 22 bp, Artificial Sequence
  chemically synthesized
cagaaatactgggactctacgt

SEQ ID NO: 646216 - DNA, 22 bp, Artificial Sequence
  chemically synthesized
ttgactaacatcaacgtagagt

SEQ ID NO: 646217 - DNA, 22 bp, Artificial Sequence
  chemically synthesized
gctattgactaacatcaacgta

SEQ ID NO: 646218 - DNA, 22 bp, Artificial Sequence
  chemically synthesized
agctattgactaacatcaacgt

SEQ ID NO: 646219 - DNA, 22 bp, Artificial Sequence
  chemically synthesized
tagctattgactaacatcaacg

SEQ ID NO: 646220 - DNA, 22 bp, Artificial Sequence
  chemically synthesized
ttagctattgactaacatcaac

SEQ ID NO: 646221 - DNA, 22 bp, Artificial Sequence
  chemically synthesized
tttagctattgactaacatcaa

SEQ ID NO: 646222 - DNA, 22 bp, Artificial Sequence
  chemically synthesized
ggactctacgttgatgttagtc

SEQ ID NO: 646223 - DNA, 22 bp, Artificial Sequence
  chemically synthesized
atattttttagctattgactaa

SEQ ID NO: 646224 - DNA, 22 bp, Artificial Sequence
  chemically synthesized
aatattttttagctattgacta

SEQ ID NO: 646225 - DNA, 22 bp, Artificial Sequence
  chemically synthesized
tacgttgatgttagtcaatagc

SEQ ID NO: 646226 - DNA, 22 bp, Artificial Sequence
  chemically synthesized
taatattttttagctattgact

SEQ ID NO: 646227 - DNA, 22 bp, Artificial Sequence
  chemically synthesized
ttaatattttttagctattgac

SEQ ID NO: 646228 - DNA, 22 bp, Artificial Sequence
  chemically synthesized
cgttgatgttagtcaatagcta

SEQ ID NO: 646229 - DNA, 22 bp, Artificial Sequence
  chemically synthesized
atgttagtcaatagctaaaaaa

SEQ ID NO: 646230 - DNA, 22 bp, Artificial Sequence
  chemically synthesized
tatcttttaatattttttagct

SEQ ID NO: 646231 - DNA, 22 bp, Artificial Sequence
  chemically synthesized
ttatatcttttaatatttttta

SEQ ID NO: 646232 - DNA, 22 bp, Artificial Sequence
  chemically synthesized
gtcaatagctaaaaaatattaa

SEQ ID NO: 646233 - DNA, 22 bp, Artificial Sequence
  chemically synthesized
tacagccattattatatctttt

SEQ ID NO: 646234 - DNA, 22 bp, Artificial Sequence
  chemically synthesized
aaaaatattaaaagatataata

SEQ ID NO: 646235 - DNA, 22 bp, Artificial Sequence
  chemically synthesized
aaagatataataatggctgtat

SEQ ID NO: 646236 - DNA, 22 bp, Artificial Sequence
  chemically synthesized
gtggccaaagcattatacagcc

SEQ ID NO: 646237 - DNA, 22 bp, Artificial Sequence
  chemically synthesized
ggtggccaaagcattatacagc

SEQ ID NO: 646238 - DNA, 22 bp, Artificial Sequence
  chemically synthesized
acaggcttggtggccaaagcat

SEQ ID NO: 646239 - DNA, 22 bp, Artificial Sequence
  chemically synthesized
gacaggcttggtggccaaagca

SEQ ID NO: 646240 - DNA, 22 bp, Artificial Sequence
  chemically synthesized
tcttgacaggcttggtggccaa

SEQ ID NO: 646241 - DNA, 22 bp, Artificial Sequence
  chemically synthesized
tataatgctttggccaccaagc

SEQ ID NO: 646242 - DNA, 22 bp, Artificial Sequence
  chemically synthesized
gtgaacagattatcttgacagg

SEQ ID NO: 646243 - DNA, 22 bp, Artificial Sequence
  chemically synthesized
tggccaccaagcctgtcaagat

SEQ ID NO: 646244 - DNA, 22 bp, Artificial Sequence
  chemically synthesized
ggccaccaagcctgtcaagata

SEQ ID NO: 646245 - DNA, 22 bp, Artificial Sequence
  chemically synthesized
gccaccaagcctgtcaagataa

SEQ ID NO: 646246 - DNA, 22 bp, Artificial Sequence
  chemically synthesized
tcaagataatctgttcactaac

SEQ ID NO: 646247 - DNA, 22 bp, Artificial Sequence
  chemically synthesized
agtacaacaatagcgtgggtta

SEQ ID NO: 646248 - DNA, 22 bp, Artificial Sequence
  chemically synthesized
ctcagtacaacaatagcgtggg

SEQ ID NO: 646249 - DNA, 22 bp, Artificial Sequence
  chemically synthesized
ctactcagtacaacaatagcgt

SEQ ID NO: 646250 - DNA, 22 bp, Artificial Sequence
  chemically synthesized
ttcactaacccacgctattgtt

SEQ ID NO: 646251 - DNA, 22 bp, Artificial Sequence
  chemically synthesized
cctactcagtacaacaatagcg

SEQ ID NO: 646252 - DNA, 22 bp, Artificial Sequence
  chemically synthesized
tcctactcagtacaacaatagc

SEQ ID NO: 646253 - DNA, 22 bp, Artificial Sequence
  chemically synthesized
ttcctactcagtacaacaatag

SEQ ID NO: 646254 - DNA, 22 bp, Artificial Sequence
  chemically synthesized
actaacccacgctattgttgta

SEQ ID NO: 646255 - DNA, 22 bp, Artificial Sequence
  chemically synthesized
tttcctactcagtacaacaata

SEQ ID NO: 646256 - DNA, 22 bp, Artificial Sequence
  chemically synthesized
acccacgctattgttgtactga

SEQ ID NO: 646257 - DNA, 22 bp, Artificial Sequence
  chemically synthesized
caaggtattttttcctactcag

SEQ ID NO: 646258 - DNA, 22 bp, Artificial Sequence
  chemically synthesized
ttgttgtactgagtaggaaaaa

SEQ ID NO: 646259 - DNA, 22 bp, Artificial Sequence
  chemically synthesized
gagctgcaaggtattttttcct

SEQ ID NO: 646260 - DNA, 22 bp, Artificial Sequence
  chemically synthesized
ttgtactgagtaggaaaaaata

SEQ ID NO: 646261 - DNA, 22 bp, Artificial Sequence
  chemically synthesized
agagctgcaaggtattttttcc

SEQ ID NO: 646262 - DNA, 22 bp, Artificial Sequence
  chemically synthesized
tagagctgcaaggtattttttc

SEQ ID NO: 646263 - DNA, 22 bp, Artificial Sequence
  chemically synthesized
ttagagctgcaaggtatttttt

SEQ ID NO: 646264 - DNA, 22 bp, Artificial Sequence
  chemically synthesized
tactgagtaggaaaaaatacct

SEQ ID NO: 646265 - DNA, 22 bp, Artificial Sequence
  chemically synthesized
cttttagagctgcaaggtattt

SEQ ID NO: 646266 - DNA, 22 bp, Artificial Sequence
  chemically synthesized
agtaggaaaaaataccttgcag

SEQ ID NO: 646267 - DNA, 22 bp, Artificial Sequence
  chemically synthesized
ttacttttagagctgcaaggta

SEQ ID NO: 646268 - DNA, 22 bp, Artificial Sequence
  chemically synthesized
tgttacttttagagctgcaagg

SEQ ID NO: 646269 - DNA, 22 bp, Artificial Sequence
  chemically synthesized
ctctgttacttttagagctgca

SEQ ID NO: 646270 - DNA, 22 bp, Artificial Sequence
  chemically synthesized
cctctgttacttttagagctgc

SEQ ID NO: 646271 - DNA, 22 bp, Artificial Sequence
  chemically synthesized
ataaaatatttcctctgttact

SEQ ID NO: 646272 - DNA, 22 bp, Artificial Sequence
  chemically synthesized
gcagctctaaaagtaacagagg

SEQ ID NO: 646273 - DNA, 22 bp, Artificial Sequence
  chemically synthesized
aataaaatatttcctctgttac

SEQ ID NO: 646274 - DNA, 22 bp, Artificial Sequence
  chemically synthesized
cagctctaaaagtaacagagga

SEQ ID NO: 646275 - DNA, 22 bp, Artificial Sequence
  chemically synthesized
cacttaataaaatatttcctct

SEQ ID NO: 646276 - DNA, 22 bp, Artificial Sequence
  chemically synthesized
ccacttaataaaatatttcctc

SEQ ID NO: 646277 - DNA, 22 bp, Artificial Sequence
  chemically synthesized
taaaagtaacagaggaaatatt

SEQ ID NO: 646278 - DNA, 22 bp, Artificial Sequence
  chemically synthesized
aaagtaacagaggaaatatttt

SEQ ID NO: 646279 - DNA, 22 bp, Artificial Sequence
  chemically synthesized
ccttccacttaataaaatattt

SEQ ID NO: 646280 - DNA, 22 bp, Artificial Sequence
  chemically synthesized
cattgccttccacttaataaaa

SEQ ID NO: 646281 - DNA, 22 bp, Artificial Sequence
  chemically synthesized
gttacattgccttccacttaat

SEQ ID NO: 646282 - DNA, 22 bp, Artificial Sequence
  chemically synthesized
ggttacattgccttccacttaa

SEQ ID NO: 646283 - DNA, 22 bp, Artificial Sequence
  chemically synthesized
tggttacattgccttccactta

SEQ ID NO: 646284 - DNA, 22 bp, Artificial Sequence
  chemically synthesized
ttggttacattgccttccactt

SEQ ID NO: 646285 - DNA, 22 bp, Artificial Sequence
  chemically synthesized
tttggttacattgccttccact

SEQ ID NO: 646286 - DNA, 22 bp, Artificial Sequence
  chemically synthesized
tattaagtggaaggcaatgtaa

SEQ ID NO: 646287 - DNA, 22 bp, Artificial Sequence
  chemically synthesized
attaagtggaaggcaatgtaac

SEQ ID NO: 646288 - DNA, 22 bp, Artificial Sequence
  chemically synthesized
ttaagtggaaggcaatgtaacc

SEQ ID NO: 646289 - DNA, 22 bp, Artificial Sequence
  chemically synthesized
aagcaatactttttggttacat

SEQ ID NO: 646290 - DNA, 22 bp, Artificial Sequence
  chemically synthesized
agtggaaggcaatgtaaccaaa

SEQ ID NO: 646291 - DNA, 22 bp, Artificial Sequence
  chemically synthesized
ctgaagcaatactttttggtta

SEQ ID NO: 646292 - DNA, 22 bp, Artificial Sequence
  chemically synthesized
actgaagcaatactttttggtt

SEQ ID NO: 646293 - DNA, 22 bp, Artificial Sequence
  chemically synthesized
acttactgaagcaatacttttt

SEQ ID NO: 646294 - DNA, 22 bp, Artificial Sequence
  chemically synthesized
aaactgacttactgaagcaata

SEQ ID NO: 646295 - DNA, 22 bp, Artificial Sequence
  chemically synthesized
tataagttaaaactgacttact

SEQ ID NO: 646296 - DNA, 22 bp, Artificial Sequence
  chemically synthesized
atataagttaaaactgacttac

SEQ ID NO: 646297 - DNA, 22 bp, Artificial Sequence
  chemically synthesized
cttcagtaagtcagttttaact

SEQ ID NO: 646298 - DNA, 22 bp, Artificial Sequence
  chemically synthesized
aatgacttatataagttaaaac

SEQ ID NO: 646299 - DNA, 22 bp, Artificial Sequence
  chemically synthesized
cagtaagtcagttttaacttat

SEQ ID NO: 646300 - DNA, 22 bp, Artificial Sequence
  chemically synthesized
agtaagtcagttttaacttata

SEQ ID NO: 646301 - DNA, 22 bp, Artificial Sequence
  chemically synthesized
cctcaatgacttatataagtta

SEQ ID NO: 646302 - DNA, 22 bp, Artificial Sequence
  chemically synthesized
tgcctcaatgacttatataagt

SEQ ID NO: 646303 - DNA, 22 bp, Artificial Sequence
  chemically synthesized
tcattctgcctcaatgacttat

SEQ ID NO: 646304 - DNA, 22 bp, Artificial Sequence
  chemically synthesized
ttgtcattctgcctcaatgact

SEQ ID NO: 646305 - DNA, 22 bp, Artificial Sequence
  chemically synthesized
taacttatataagtcattgagg

SEQ ID NO: 646306 - DNA, 22 bp, Artificial Sequence
  chemically synthesized
aacttatataagtcattgaggc

SEQ ID NO: 646307 - DNA, 22 bp, Artificial Sequence
  chemically synthesized
acttatataagtcattgaggca

SEQ ID NO: 646308 - DNA, 22 bp, Artificial Sequence
  chemically synthesized
ttgttgtcattctgcctcaatg

SEQ ID NO: 646309 - DNA, 22 bp, Artificial Sequence
  chemically synthesized
atataagtcattgaggcagaat

SEQ ID NO: 646310 - DNA, 22 bp, Artificial Sequence
  chemically synthesized
attgttgttgtcattctgcctc

SEQ ID NO: 646311 - DNA, 22 bp, Artificial Sequence
  chemically synthesized
tataagtcattgaggcagaatg

SEQ ID NO: 646312 - DNA, 22 bp, Artificial Sequence
  chemically synthesized
aattgttgttgtcattctgcct

SEQ ID NO: 646313 - DNA, 22 bp, Artificial Sequence
  chemically synthesized
cagtttaattgttgttgtcatt

SEQ ID NO: 646314 - DNA, 22 bp, Artificial Sequence
  chemically synthesized
aggcagaatgacaacaacaatt

SEQ ID NO: 646315 - DNA, 22 bp, Artificial Sequence
  chemically synthesized
aatgaaacaatcatgtatctcc

SEQ ID NO: 646316 - DNA, 22 bp, Artificial Sequence
  chemically synthesized
aactggagatacatgattgttt

SEQ ID NO: 646317 - DNA, 22 bp, Artificial Sequence
  chemically synthesized
aacaataactgaatgaaacaat

SEQ ID NO: 646318 - DNA, 22 bp, Artificial Sequence
  chemically synthesized
gagatacatgattgtttcattc

SEQ ID NO: 646319 - DNA, 22 bp, Artificial Sequence
  chemically synthesized
tctaaacaataactgaatgaaa

SEQ ID NO: 646320 - DNA, 22 bp, Artificial Sequence
  chemically synthesized
tgtctaaacaataactgaatga

SEQ ID NO: 646321 - DNA, 22 bp, Artificial Sequence
  chemically synthesized
ctgtctaaacaataactgaatg

SEQ ID NO: 646322 - DNA, 22 bp, Artificial Sequence
  chemically synthesized
ttctgtctaaacaataactgaa

SEQ ID NO: 646323 - DNA, 22 bp, Artificial Sequence
  chemically synthesized
gttcttctgtctaaacaataac

SEQ ID NO: 646324 - DNA, 22 bp, Artificial Sequence
  chemically synthesized
cgttcttctgtctaaacaataa

SEQ ID NO: 646325 - DNA, 22 bp, Artificial Sequence
  chemically synthesized
tcgttcttctgtctaaacaata

SEQ ID NO: 646326 - DNA, 22 bp, Artificial Sequence
  chemically synthesized
tttcattcagttattgtttaga

SEQ ID NO: 646327 - DNA, 22 bp, Artificial Sequence
  chemically synthesized
cattcagttattgtttagacag

SEQ ID NO: 646328 - DNA, 22 bp, Artificial Sequence
  chemically synthesized
attttcgttcttctgtctaaac

SEQ ID NO: 646329 - DNA, 22 bp, Artificial Sequence
  chemically synthesized
attcagttattgtttagacaga

SEQ ID NO: 646330 - DNA, 22 bp, Artificial Sequence
  chemically synthesized
aattttcgttcttctgtctaaa

SEQ ID NO: 646331 - DNA, 22 bp, Artificial Sequence
  chemically synthesized
agttattgtttagacagaagaa

SEQ ID NO: 646332 - DNA, 22 bp, Artificial Sequence
  chemically synthesized
cccttaattttcgttcttctgt

SEQ ID NO: 646333 - DNA, 22 bp, Artificial Sequence
  chemically synthesized
ccccttaattttcgttcttctg

SEQ ID NO: 646334 - DNA, 22 bp, Artificial Sequence
  chemically synthesized
tccccttaattttcgttcttct

SEQ ID NO: 646335 - DNA, 22 bp, Artificial Sequence
  chemically synthesized
ttccccttaattttcgttcttc

SEQ ID NO: 646336 - DNA, 22 bp, Artificial Sequence
  chemically synthesized
ttgtttagacagaagaacgaaa

SEQ ID NO: 646337 - DNA, 22 bp, Artificial Sequence
  chemically synthesized
tttccccttaattttcgttctt

SEQ ID NO: 646338 - DNA, 22 bp, Artificial Sequence
  chemically synthesized
ttttccccttaattttcgttct

SEQ ID NO: 646339 - DNA, 22 bp, Artificial Sequence
  chemically synthesized
tttagacagaagaacgaaaatt

SEQ ID NO: 646340 - DNA, 22 bp, Artificial Sequence
  chemically synthesized
agacagaagaacgaaaattaag

SEQ ID NO: 646341 - DNA, 22 bp, Artificial Sequence
  chemically synthesized
gacagaagaacgaaaattaagg

SEQ ID NO: 646342 - DNA, 22 bp, Artificial Sequence
  chemically synthesized
atgtcttttttccccttaattt

SEQ ID NO: 646343 - DNA, 22 bp, Artificial Sequence
  chemically synthesized
aatgtcttttttccccttaatt

SEQ ID NO: 646344 - DNA, 22 bp, Artificial Sequence
  chemically synthesized
atcagtcaccttaatgtctttt

SEQ ID NO: 646345 - DNA, 22 bp, Artificial Sequence
  chemically synthesized
aatcagtcaccttaatgtcttt

SEQ ID NO: 646346 - DNA, 22 bp, Artificial Sequence
  chemically synthesized
taatcagtcaccttaatgtctt

SEQ ID NO: 646347 - DNA, 22 bp, Artificial Sequence
  chemically synthesized
ttaatcagtcaccttaatgtct

SEQ ID NO: 646348 - DNA, 22 bp, Artificial Sequence
  chemically synthesized
aggggaaaaaagacattaaggt

SEQ ID NO: 646349 - DNA, 22 bp, Artificial Sequence
  chemically synthesized
ttttaatcagtcaccttaatgt

SEQ ID NO: 646350 - DNA, 22 bp, Artificial Sequence
  chemically synthesized
cttttaatcagtcaccttaatg

SEQ ID NO: 646351 - DNA, 22 bp, Artificial Sequence
  chemically synthesized
agtcttcttttaatcagtcacc

SEQ ID NO: 646352 - DNA, 22 bp, Artificial Sequence
  chemically synthesized
aggtgactgattaaaagaagac

SEQ ID NO: 646353 - DNA, 22 bp, Artificial Sequence
  chemically synthesized
attaaaagaagactgaacatct

SEQ ID NO: 646354 - DNA, 22 bp, Artificial Sequence
  chemically synthesized
ccccgaggaatgagatgttcag

SEQ ID NO: 646355 - DNA, 22 bp, Artificial Sequence
  chemically synthesized
tgccccgaggaatgagatgttc

SEQ ID NO: 646356 - DNA, 22 bp, Artificial Sequence
  chemically synthesized
aaagaagactgaacatctcatt

SEQ ID NO: 646357 - DNA, 22 bp, Artificial Sequence
  chemically synthesized
aaaaaactctgccccgaggaat

SEQ ID NO: 646358 - DNA, 22 bp, Artificial Sequence
  chemically synthesized
aaaaaaactctgccccgaggaa

SEQ ID NO: 646359 - DNA, 22 bp, Artificial Sequence
  chemically synthesized
aacatctcattcctcggggcag

SEQ ID NO: 646360 - DNA, 22 bp, Artificial Sequence
  chemically synthesized
tatttaaaaaaactctgccccg

SEQ ID NO: 646361 - DNA, 22 bp, Artificial Sequence
  chemically synthesized
gtatttaaaaaaactctgcccc

SEQ ID NO: 646362 - DNA, 22 bp, Artificial Sequence
  chemically synthesized
attcctcggggcagagtttttt

SEQ ID NO: 646363 - DNA, 22 bp, Artificial Sequence
  chemically synthesized
ctcggggcagagtttttttaaa

SEQ ID NO: 646364 - DNA, 22 bp, Artificial Sequence
  chemically synthesized
ggggcagagtttttttaaatac

SEQ ID NO: 646365 - DNA, 22 bp, Artificial Sequence
  chemically synthesized
aaaataaataaaacttgtattt

SEQ ID NO: 646366 - DNA, 22 bp, Artificial Sequence
  chemically synthesized
aaaaataaataaaacttgtatt

SEQ ID NO: 646367 - DNA, 22 bp, Artificial Sequence
  chemically synthesized
ttttaaatacaagttttattta

SEQ ID NO: 646368 - DNA, 22 bp, Artificial Sequence
  chemically synthesized
tttaaatacaagttttatttat

SEQ ID NO: 646369 - DNA, 22 bp, Artificial Sequence
  chemically synthesized
ttaaatacaagttttatttatt

SEQ ID NO: 646370 - DNA, 22 bp, Artificial Sequence
  chemically synthesized
taaatacaagttttatttattt

SEQ ID NO: 646371 - DNA, 22 bp, Artificial Sequence
  chemically synthesized
aaatacaagttttatttatttt

SEQ ID NO: 646372 - DNA, 22 bp, Artificial Sequence
  chemically synthesized
tgtataaatttaaaaataaata

SEQ ID NO: 646373 - DNA, 22 bp, Artificial Sequence
  chemically synthesized
aatacaagttttatttattttt

SEQ ID NO: 646374 - DNA, 22 bp, Artificial Sequence
  chemically synthesized
aaaccattatgtataaatttaa

SEQ ID NO: 646375 - DNA, 22 bp, Artificial Sequence
  chemically synthesized
aaaaccattatgtataaattta

SEQ ID NO: 646376 - DNA, 22 bp, Artificial Sequence
  chemically synthesized
tatttatttttaaatttataca

SEQ ID NO: 646377 - DNA, 22 bp, Artificial Sequence
  chemically synthesized
atttatttttaaatttatacat

SEQ ID NO: 646378 - DNA, 22 bp, Artificial Sequence
  chemically synthesized
tttatttttaaatttatacata

SEQ ID NO: 646379 - DNA, 22 bp, Artificial Sequence
  chemically synthesized
gtccttaaaaccattatgtata

SEQ ID NO: 646380 - DNA, 22 bp, Artificial Sequence
  chemically synthesized
atttttaaatttatacataatg

SEQ ID NO: 646381 - DNA, 22 bp, Artificial Sequence
  chemically synthesized
tttttaaatttatacataatgg

SEQ ID NO: 646382 - DNA, 22 bp, Artificial Sequence
  chemically synthesized
ttaaatttatacataatggttt

SEQ ID NO: 646383 - DNA, 22 bp, Artificial Sequence
  chemically synthesized
taaatttatacataatggtttt

SEQ ID NO: 646384 - DNA, 22 bp, Artificial Sequence
  chemically synthesized
aaatttatacataatggtttta

SEQ ID NO: 646385 - DNA, 22 bp, Artificial Sequence
  chemically synthesized
aatttatacataatggttttaa

SEQ ID NO: 646386 - DNA, 22 bp, Artificial Sequence
  chemically synthesized
ccgcaagattagtccttaaaac

SEQ ID NO: 646387 - DNA, 22 bp, Artificial Sequence
  chemically synthesized
cccgcaagattagtccttaaaa

SEQ ID NO: 646388 - DNA, 22 bp, Artificial Sequence
  chemically synthesized
atacataatggttttaaggact

SEQ ID NO: 646389 - DNA, 22 bp, Artificial Sequence
  chemically synthesized
tcccgcaagattagtccttaaa

SEQ ID NO: 646390 - DNA, 22 bp, Artificial Sequence
  chemically synthesized
tacataatggttttaaggacta

SEQ ID NO: 646391 - DNA, 22 bp, Artificial Sequence
  chemically synthesized
ttcccgcaagattagtccttaa

SEQ ID NO: 646392 - DNA, 22 bp, Artificial Sequence
  chemically synthesized
cttttcccgcaagattagtcct

SEQ ID NO: 646393 - DNA, 22 bp, Artificial Sequence
  chemically synthesized
cctccttttcccgcaagattag

SEQ ID NO: 646394 - DNA, 22 bp, Artificial Sequence
  chemically synthesized
gcctccttttcccgcaagatta

SEQ ID NO: 646395 - DNA, 22 bp, Artificial Sequence
  chemically synthesized
tgcctccttttcccgcaagatt

SEQ ID NO: 646396 - DNA, 22 bp, Artificial Sequence
  chemically synthesized
ttgcctccttttcccgcaagat

SEQ ID NO: 646397 - DNA, 22 bp, Artificial Sequence
  chemically synthesized
tttgcctccttttcccgcaaga

SEQ ID NO: 646398 - DNA, 22 bp, Artificial Sequence
  chemically synthesized
taaggactaatcttgcgggaaa

SEQ ID NO: 646399 - DNA, 22 bp, Artificial Sequence
  chemically synthesized
aaggactaatcttgcgggaaaa

SEQ ID NO: 646400 - DNA, 22 bp, Artificial Sequence
  chemically synthesized
aggactaatcttgcgggaaaag

SEQ ID NO: 646401 - DNA, 22 bp, Artificial Sequence
  chemically synthesized
atcttgcgggaaaaggaggcaa

SEQ ID NO: 646402 - DNA, 22 bp, Artificial Sequence
  chemically synthesized
gcgggaaaaggaggcaaaaagg

SEQ ID NO: 646403 - DNA, 22 bp, Artificial Sequence
  chemically synthesized
cccaaatagaagcctttttgcc

SEQ ID NO: 646404 - DNA, 22 bp, Artificial Sequence
  chemically synthesized
cgggaaaaggaggcaaaaaggc

SEQ ID NO: 646405 - DNA, 22 bp, Artificial Sequence
  chemically synthesized
cctccccaaatagaagcctttt

SEQ ID NO: 646406 - DNA, 22 bp, Artificial Sequence
  chemically synthesized
tagctgcctccccaaatagaag

SEQ ID NO: 646407 - DNA, 22 bp, Artificial Sequence
  chemically synthesized
caggaaagattgtagctgcctc

SEQ ID NO: 646408 - DNA, 22 bp, Artificial Sequence
  chemically synthesized
ccaggaaagattgtagctgcct

SEQ ID NO: 646409 - DNA, 22 bp, Artificial Sequence
  chemically synthesized
ctatttggggaggcagctacaa

SEQ ID NO: 646410 - DNA, 22 bp, Artificial Sequence
  chemically synthesized
tatttggggaggcagctacaat

SEQ ID NO: 646411 - DNA, 22 bp, Artificial Sequence
  chemically synthesized
gtttccaggaaagattgtagct

SEQ ID NO: 646412 - DNA, 22 bp, Artificial Sequence
  chemically synthesized
tttggggaggcagctacaatct

SEQ ID NO: 646413 - DNA, 22 bp, Artificial Sequence
  chemically synthesized
ctagtttccaggaaagattgta

SEQ ID NO: 646414 - DNA, 22 bp, Artificial Sequence
  chemically synthesized
ggggaggcagctacaatctttc

SEQ ID NO: 646415 - DNA, 22 bp, Artificial Sequence
  chemically synthesized
gggaggcagctacaatctttcc

SEQ ID NO: 646416 - DNA, 22 bp, Artificial Sequence
  chemically synthesized
gagagttcctagtttccaggaa

SEQ ID NO: 646417 - DNA, 22 bp, Artificial Sequence
  chemically synthesized
caatctttcctggaaactagga

SEQ ID NO: 646418 - DNA, 22 bp, Artificial Sequence
  chemically synthesized
tgtattagagagttcctagttt

SEQ ID NO: 646419 - DNA, 22 bp, Artificial Sequence
  chemically synthesized
tcctgtgtattagagagttcct

SEQ ID NO: 646420 - DNA, 22 bp, Artificial Sequence
  chemically synthesized
tcctggaaactaggaactctct

SEQ ID NO: 646421 - DNA, 22 bp, Artificial Sequence
  chemically synthesized
gtcctgtgtattagagagttcc

SEQ ID NO: 646422 - DNA, 22 bp, Artificial Sequence
  chemically synthesized
cctggaaactaggaactctcta

SEQ ID NO: 646423 - DNA, 22 bp, Artificial Sequence
  chemically synthesized
ctggaaactaggaactctctaa

SEQ ID NO: 646424 - DNA, 22 bp, Artificial Sequence
  chemically synthesized
gaaactaggaactctctaatac

SEQ ID NO: 646425 - DNA, 22 bp, Artificial Sequence
  chemically synthesized
ggaactctctaatacacaggac

SEQ ID NO: 646426 - DNA, 22 bp, Artificial Sequence
  chemically synthesized
agaaaaaagtttgtcctgtgta

SEQ ID NO: 646427 - DNA, 22 bp, Artificial Sequence
  chemically synthesized
tctaatacacaggacaaacttt

SEQ ID NO: 646428 - DNA, 22 bp, Artificial Sequence
  chemically synthesized
taatacacaggacaaacttttt

SEQ ID NO: 646429 - DNA, 22 bp, Artificial Sequence
  chemically synthesized
atacacaggacaaacttttttc

SEQ ID NO: 646430 - DNA, 22 bp, Artificial Sequence
  chemically synthesized
gagcaatgcattcagaaaaaag

SEQ ID NO: 646431 - DNA, 22 bp, Artificial Sequence
  chemically synthesized
ggagcaatgcattcagaaaaaa

SEQ ID NO: 646432 - DNA, 22 bp, Artificial Sequence
  chemically synthesized
cggagcttggagcaatgcattc

SEQ ID NO: 646433 - DNA, 22 bp, Artificial Sequence
  chemically synthesized
ccggagcttggagcaatgcatt

SEQ ID NO: 646434 - DNA, 22 bp, Artificial Sequence
  chemically synthesized
tccggagcttggagcaatgcat

SEQ ID NO: 646435 - DNA, 22 bp, Artificial Sequence
  chemically synthesized
ttttctgaatgcattgctccaa

SEQ ID NO: 646436 - DNA, 22 bp, Artificial Sequence
  chemically synthesized
tttctgaatgcattgctccaag

SEQ ID NO: 646437 - DNA, 22 bp, Artificial Sequence
  chemically synthesized
ttctgaatgcattgctccaagc

SEQ ID NO: 646438 - DNA, 22 bp, Artificial Sequence
  chemically synthesized
tctgaatgcattgctccaagct

SEQ ID NO: 646439 - DNA, 22 bp, Artificial Sequence
  chemically synthesized
ctgaatgcattgctccaagctc

SEQ ID NO: 646440 - DNA, 22 bp, Artificial Sequence
  chemically synthesized
tgaatgcattgctccaagctcc

SEQ ID NO: 646441 - DNA, 22 bp, Artificial Sequence
  chemically synthesized
aatgcattgctccaagctccgg

SEQ ID NO: 646442 - DNA, 22 bp, Artificial Sequence
  chemically synthesized
gaggtaaacaggcctttccgga

SEQ ID NO: 646443 - DNA, 22 bp, Artificial Sequence
  chemically synthesized
ggaggtaaacaggcctttccgg

SEQ ID NO: 646444 - DNA, 22 bp, Artificial Sequence
  chemically synthesized
ctccaagctccggaaaggcctg

SEQ ID NO: 646445 - DNA, 22 bp, Artificial Sequence
  chemically synthesized
caagctccggaaaggcctgttt

SEQ ID NO: 646446 - DNA, 22 bp, Artificial Sequence
  chemically synthesized
taacttggaggtaaacaggcct

SEQ ID NO: 646447 - DNA, 22 bp, Artificial Sequence
  chemically synthesized
ataacttggaggtaaacaggcc

SEQ ID NO: 646448 - DNA, 22 bp, Artificial Sequence
  chemically synthesized
ttataacttggaggtaaacagg

SEQ ID NO: 646449 - DNA, 22 bp, Artificial Sequence
  chemically synthesized
cggaaaggcctgtttacctcca

SEQ ID NO: 646450 - DNA, 22 bp, Artificial Sequence
  chemically synthesized
tttacctccaagttataagaat

SEQ ID NO: 646451 - DNA, 22 bp, Artificial Sequence
  chemically synthesized
cggacagaagaaaattcttata

SEQ ID NO: 646452 - DNA, 22 bp, Artificial Sequence
  chemically synthesized
acctccaagttataagaatttt

SEQ ID NO: 646453 - DNA, 22 bp, Artificial Sequence
  chemically synthesized
cctccaagttataagaattttc

SEQ ID NO: 646454 - DNA, 22 bp, Artificial Sequence
  chemically synthesized
tcattacggacagaagaaaatt

SEQ ID NO: 646455 - DNA, 22 bp, Artificial Sequence
  chemically synthesized
caagttataagaattttcttct

SEQ ID NO: 646456 - DNA, 22 bp, Artificial Sequence
  chemically synthesized
gcctgtcattacggacagaaga

SEQ ID NO: 646457 - DNA, 22 bp, Artificial Sequence
  chemically synthesized
agcctgtcattacggacagaag

SEQ ID NO: 646458 - DNA, 22 bp, Artificial Sequence
  chemically synthesized
tagcctgtcattacggacagaa

SEQ ID NO: 646459 - DNA, 22 bp, Artificial Sequence
  chemically synthesized
taagaattttcttctgtccgta

SEQ ID NO: 646460 - DNA, 22 bp, Artificial Sequence
  chemically synthesized
tcttctgtccgtaatgacaggc

SEQ ID NO: 646461 - DNA, 22 bp, Artificial Sequence
  chemically synthesized
cttctgtccgtaatgacaggct

SEQ ID NO: 646462 - DNA, 22 bp, Artificial Sequence
  chemically synthesized
ttctgtccgtaatgacaggcta

SEQ ID NO: 646463 - DNA, 22 bp, Artificial Sequence
  chemically synthesized
ctgtccgtaatgacaggctaaa

SEQ ID NO: 646464 - DNA, 22 bp, Artificial Sequence
  chemically synthesized
tgtccgtaatgacaggctaaag

SEQ ID NO: 646465 - DNA, 22 bp, Artificial Sequence
  chemically synthesized
tccgtaatgacaggctaaagct

SEQ ID NO: 646466 - DNA, 22 bp, Artificial Sequence
  chemically synthesized
accagaaacaatgagctttagc

SEQ ID NO: 646467 - DNA, 22 bp, Artificial Sequence
  chemically synthesized
atgatatctaaccagaaacaat

SEQ ID NO: 646468 - DNA, 22 bp, Artificial Sequence
  chemically synthesized
aatgatatctaaccagaaacaa

SEQ ID NO: 646469 - DNA, 22 bp, Artificial Sequence
  chemically synthesized
aagctcattgtttctggttaga

SEQ ID NO: 646470 - DNA, 22 bp, Artificial Sequence
  chemically synthesized
attgtttctggttagatatcat

SEQ ID NO: 646471 - DNA, 22 bp, Artificial Sequence
  chemically synthesized
gcgtatcatcttaatgatatct

SEQ ID NO: 646472 - DNA, 22 bp, Artificial Sequence
  chemically synthesized
tttctggttagatatcattaag

SEQ ID NO: 646473 - DNA, 22 bp, Artificial Sequence
  chemically synthesized
ctggttagatatcattaagatg

SEQ ID NO: 646474 - DNA, 22 bp, Artificial Sequence
  chemically synthesized
tggttagatatcattaagatga

SEQ ID NO: 646475 - DNA, 22 bp, Artificial Sequence
  chemically synthesized
gttagatatcattaagatgata

SEQ ID NO: 646476 - DNA, 22 bp, Artificial Sequence
  chemically synthesized
gatatcattaagatgatacgct

SEQ ID NO: 646477 - DNA, 22 bp, Artificial Sequence
  chemically synthesized
agatgatacgctaatattctcc

SEQ ID NO: 646478 - DNA, 22 bp, Artificial Sequence
  chemically synthesized
agtgggtatggagaggagaata

SEQ ID NO: 646479 - DNA, 22 bp, Artificial Sequence
  chemically synthesized
aagtgggtatggagaggagaat

SEQ ID NO: 646480 - DNA, 22 bp, Artificial Sequence
  chemically synthesized
aacttaagtgggtatggagagg

SEQ ID NO: 646481 - DNA, 22 bp, Artificial Sequence
  chemically synthesized
caacttaagtgggtatggagag

SEQ ID NO: 646482 - DNA, 22 bp, Artificial Sequence
  chemically synthesized
tcaacttaagtgggtatggaga

SEQ ID NO: 646483 - DNA, 22 bp, Artificial Sequence
  chemically synthesized
ttcaacttaagtgggtatggag

SEQ ID NO: 646484 - DNA, 22 bp, Artificial Sequence
  chemically synthesized
atattctcctctccatacccac

SEQ ID NO: 646485 - DNA, 22 bp, Artificial Sequence
  chemically synthesized
atatttttcaacttaagtgggt

SEQ ID NO: 646486 - DNA, 22 bp, Artificial Sequence
  chemically synthesized
tcctctccatacccacttaagt

SEQ ID NO: 646487 - DNA, 22 bp, Artificial Sequence
  chemically synthesized
tgatatttttcaacttaagtgg

SEQ ID NO: 646488 - DNA, 22 bp, Artificial Sequence
  chemically synthesized
ctgatatttttcaacttaagtg

SEQ ID NO: 646489 - DNA, 22 bp, Artificial Sequence
  chemically synthesized
ctctccatacccacttaagttg

SEQ ID NO: 646490 - DNA, 22 bp, Artificial Sequence
  chemically synthesized
tccatacccacttaagttgaaa

SEQ ID NO: 646491 - DNA, 22 bp, Artificial Sequence
  chemically synthesized
aatttctgatatttttcaactt

SEQ ID NO: 646492 - DNA, 22 bp, Artificial Sequence
  chemically synthesized
catacccacttaagttgaaaaa

SEQ ID NO: 646493 - DNA, 22 bp, Artificial Sequence
  chemically synthesized
ctaaatttctgatatttttcaa

SEQ ID NO: 646494 - DNA, 22 bp, Artificial Sequence
  chemically synthesized
cctaaatttctgatatttttca

SEQ ID NO: 646495 - DNA, 22 bp, Artificial Sequence
  chemically synthesized
tcctaaatttctgatatttttc

SEQ ID NO: 646496 - DNA, 22 bp, Artificial Sequence
  chemically synthesized
ttcctaaatttctgatattttt

SEQ ID NO: 646497 - DNA, 22 bp, Artificial Sequence
  chemically synthesized
tttcctaaatttctgatatttt

SEQ ID NO: 646498 - DNA, 22 bp, Artificial Sequence
  chemically synthesized
aagttgaaaaatatcagaaatt

SEQ ID NO: 646499 - DNA, 22 bp, Artificial Sequence
  chemically synthesized
agttgaaaaatatcagaaattt

SEQ ID NO: 646500 - DNA, 22 bp, Artificial Sequence
  chemically synthesized
aaaaatatcagaaatttaggaa

SEQ ID NO: 646501 - DNA, 22 bp, Artificial Sequence
  chemically synthesized
aaatgagaaggactttttccta

SEQ ID NO: 646502 - DNA, 22 bp, Artificial Sequence
  chemically synthesized
aggaaaaagtccttctcatttg

SEQ ID NO: 646503 - DNA, 22 bp, Artificial Sequence
  chemically synthesized
ggaaaaagtccttctcatttga

SEQ ID NO: 646504 - DNA, 22 bp, Artificial Sequence
  chemically synthesized
ataaacaaaaataattcaaatg

SEQ ID NO: 646505 - DNA, 22 bp, Artificial Sequence
  chemically synthesized
gataaacaaaaataattcaaat

SEQ ID NO: 646506 - DNA, 22 bp, Artificial Sequence
  chemically synthesized
gcttgataaacaaaaataattc

SEQ ID NO: 646507 - DNA, 22 bp, Artificial Sequence
  chemically synthesized
ctcatttgaattatttttgttt

SEQ ID NO: 646508 - DNA, 22 bp, Artificial Sequence
  chemically synthesized
tcatttgaattatttttgttta

SEQ ID NO: 646509 - DNA, 22 bp, Artificial Sequence
  chemically synthesized
atttgaattatttttgtttatc

SEQ ID NO: 646510 - DNA, 22 bp, Artificial Sequence
  chemically synthesized
gaattatttttgtttatcaagc

SEQ ID NO: 646511 - DNA, 22 bp, Artificial Sequence
  chemically synthesized
aattatttttgtttatcaagcc

SEQ ID NO: 646512 - DNA, 22 bp, Artificial Sequence
  chemically synthesized
aaccaggtaactggcttgataa

SEQ ID NO: 646513 - DNA, 22 bp, Artificial Sequence
  chemically synthesized
tttttgtttatcaagccagtta

SEQ ID NO: 646514 - DNA, 22 bp, Artificial Sequence
  chemically synthesized
acatctaaaccaggtaactggc

SEQ ID NO: 646515 - DNA, 22 bp, Artificial Sequence
  chemically synthesized
ttgtttatcaagccagttacct

SEQ ID NO: 646516 - DNA, 22 bp, Artificial Sequence
  chemically synthesized
cacatctaaaccaggtaactgg

SEQ ID NO: 646517 - DNA, 22 bp, Artificial Sequence
  chemically synthesized
tgtttatcaagccagttacctg

SEQ ID NO: 646518 - DNA, 22 bp, Artificial Sequence
  chemically synthesized
tcacatctaaaccaggtaactg

SEQ ID NO: 646519 - DNA, 22 bp, Artificial Sequence
  chemically synthesized
gtttatcaagccagttacctgg

SEQ ID NO: 646520 - DNA, 22 bp, Artificial Sequence
  chemically synthesized
ttcacatctaaaccaggtaact

SEQ ID NO: 646521 - DNA, 22 bp, Artificial Sequence
  chemically synthesized
tttatcaagccagttacctggt

SEQ ID NO: 646522 - DNA, 22 bp, Artificial Sequence
  chemically synthesized
atcaagccagttacctggttta

SEQ ID NO: 646523 - DNA, 22 bp, Artificial Sequence
  chemically synthesized
tcaagccagttacctggtttag

SEQ ID NO: 646524 - DNA, 22 bp, Artificial Sequence
  chemically synthesized
gtcagcttttcacatctaaacc

SEQ ID NO: 646525 - DNA, 22 bp, Artificial Sequence
  chemically synthesized
agtcagcttttcacatctaaac

SEQ ID NO: 646526 - DNA, 22 bp, Artificial Sequence
  chemically synthesized
tagtcagcttttcacatctaaa

SEQ ID NO: 646527 - DNA, 22 bp, Artificial Sequence
  chemically synthesized
ttagtcagcttttcacatctaa

SEQ ID NO: 646528 - DNA, 22 bp, Artificial Sequence
  chemically synthesized
tttttagtcagcttttcacatc

SEQ ID NO: 646529 - DNA, 22 bp, Artificial Sequence
  chemically synthesized
cctggtttagatgtgaaaagct

SEQ ID NO: 646530 - DNA, 22 bp, Artificial Sequence
  chemically synthesized
gtttagatgtgaaaagctgact

SEQ ID NO: 646531 - DNA, 22 bp, Artificial Sequence
  chemically synthesized
agatgtgaaaagctgactaaaa

SEQ ID NO: 646532 - DNA, 22 bp, Artificial Sequence
  chemically synthesized
gatgtgaaaagctgactaaaaa

SEQ ID NO: 646533 - DNA, 22 bp, Artificial Sequence
  chemically synthesized
atacccaataattatttttagt

SEQ ID NO: 646534 - DNA, 22 bp, Artificial Sequence
  chemically synthesized
aatacccaataattatttttag

SEQ ID NO: 646535 - DNA, 22 bp, Artificial Sequence
  chemically synthesized
taatacccaataattattttta

SEQ ID NO: 646536 - DNA, 22 bp, Artificial Sequence
  chemically synthesized
ttaatacccaataattattttt

SEQ ID NO: 646537 - DNA, 22 bp, Artificial Sequence
  chemically synthesized
actaaaaataattattgggtat

SEQ ID NO: 646538 - DNA, 22 bp, Artificial Sequence
  chemically synthesized
aatgtgtgtttttaatacccaa

SEQ ID NO: 646539 - DNA, 22 bp, Artificial Sequence
  chemically synthesized
aaatgtgtgtttttaataccca

SEQ ID NO: 646540 - DNA, 22 bp, Artificial Sequence
  chemically synthesized
aaaataattattgggtattaaa

SEQ ID NO: 646541 - DNA, 22 bp, Artificial Sequence
  chemically synthesized
acttaaatgtgtgtttttaata

SEQ ID NO: 646542 - DNA, 22 bp, Artificial Sequence
  chemically synthesized
cacttaaatgtgtgtttttaat

SEQ ID NO: 646543 - DNA, 22 bp, Artificial Sequence
  chemically synthesized
acttcacttaaatgtgtgtttt

SEQ ID NO: 646544 - DNA, 22 bp, Artificial Sequence
  chemically synthesized
ttgggtattaaaaacacacatt

SEQ ID NO: 646545 - DNA, 22 bp, Artificial Sequence
  chemically synthesized
gttgacttcacttaaatgtgtg

SEQ ID NO: 646546 - DNA, 22 bp, Artificial Sequence
  chemically synthesized
ggtattaaaaacacacatttaa

SEQ ID NO: 646547 - DNA, 22 bp, Artificial Sequence
  chemically synthesized
aaaacacacatttaagtgaagt

SEQ ID NO: 646548 - DNA, 22 bp, Artificial Sequence
  chemically synthesized
gtggattggttgacttcactta

SEQ ID NO: 646549 - DNA, 22 bp, Artificial Sequence
  chemically synthesized
ggtggattggttgacttcactt

SEQ ID NO: 646550 - DNA, 22 bp, Artificial Sequence
  chemically synthesized
aagtgaagtcaaccaatccacc

SEQ ID NO: 646551 - DNA, 22 bp, Artificial Sequence
  chemically synthesized
gggaagtggtttggtggattgg

SEQ ID NO: 646552 - DNA, 22 bp, Artificial Sequence
  chemically synthesized
agtgaagtcaaccaatccacca

SEQ ID NO: 646553 - DNA, 22 bp, Artificial Sequence
  chemically synthesized
ggggaagtggtttggtggattg

SEQ ID NO: 646554 - DNA, 22 bp, Artificial Sequence
  chemically synthesized
ggggcaggtttggggaagtggt

SEQ ID NO: 646555 - DNA, 22 bp, Artificial Sequence
  chemically synthesized
aggggcaggtttggggaagtgg

SEQ ID NO: 646556 - DNA, 22 bp, Artificial Sequence
  chemically synthesized
taggggcaggtttggggaagtg

SEQ ID NO: 646557 - DNA, 22 bp, Artificial Sequence
  chemically synthesized
atggcattttaggggcaggttt

SEQ ID NO: 646558 - DNA, 22 bp, Artificial Sequence
  chemically synthesized
ccccaaacctgcccctaaaatg

SEQ ID NO: 646559 - DNA, 22 bp, Artificial Sequence
  chemically synthesized
cccaaacctgcccctaaaatgc

SEQ ID NO: 646560 - DNA, 22 bp, Artificial Sequence
  chemically synthesized
gatggcaaaaactcatggcatt

SEQ ID NO: 646561 - DNA, 22 bp, Artificial Sequence
  chemically synthesized
cccctaaaatgccatgagtttt

SEQ ID NO: 646562 - DNA, 22 bp, Artificial Sequence
  chemically synthesized
aatgttggatggcaaaaactca

SEQ ID NO: 646563 - DNA, 22 bp, Artificial Sequence
  chemically synthesized
aaatgccatgagtttttgccat

SEQ ID NO: 646564 - DNA, 22 bp, Artificial Sequence
  chemically synthesized
actcaatgttggatggcaaaaa

SEQ ID NO: 646565 - DNA, 22 bp, Artificial Sequence
  chemically synthesized
gactcaatgttggatggcaaaa

SEQ ID NO: 646566 - DNA, 22 bp, Artificial Sequence
  chemically synthesized
tgactcaatgttggatggcaaa

SEQ ID NO: 646567 - DNA, 22 bp, Artificial Sequence
  chemically synthesized
ttgccatccaacattgagtcaa

SEQ ID NO: 646568 - DNA, 22 bp, Artificial Sequence
  chemically synthesized
tgccatccaacattgagtcaaa

SEQ ID NO: 646569 - DNA, 22 bp, Artificial Sequence
  chemically synthesized
gccatccaacattgagtcaaaa

SEQ ID NO: 646570 - DNA, 22 bp, Artificial Sequence
  chemically synthesized
ccatccaacattgagtcaaaat

SEQ ID NO: 646571 - DNA, 22 bp, Artificial Sequence
  chemically synthesized
aggacataaaatccattttgac

SEQ ID NO: 646572 - DNA, 22 bp, Artificial Sequence
  chemically synthesized
tgaggacataaaatccattttg

SEQ ID NO: 646573 - DNA, 22 bp, Artificial Sequence
  chemically synthesized
ttctgaggacataaaatccatt

SEQ ID NO: 646574 - DNA, 22 bp, Artificial Sequence
  chemically synthesized
attctgaggacataaaatccat

SEQ ID NO: 646575 - DNA, 22 bp, Artificial Sequence
  chemically synthesized
gcttattctgaggacataaaat

SEQ ID NO: 646576 - DNA, 22 bp, Artificial Sequence
  chemically synthesized
agtcaaaatggattttatgtcc

SEQ ID NO: 646577 - DNA, 22 bp, Artificial Sequence
  chemically synthesized
agcttattctgaggacataaaa

SEQ ID NO: 646578 - DNA, 22 bp, Artificial Sequence
  chemically synthesized
tagcttattctgaggacataaa

SEQ ID NO: 646579 - DNA, 22 bp, Artificial Sequence
  chemically synthesized
aaataagctttagcttattctg

SEQ ID NO: 646580 - DNA, 22 bp, Artificial Sequence
  chemically synthesized
aaaataagctttagcttattct

SEQ ID NO: 646581 - DNA, 22 bp, Artificial Sequence
  chemically synthesized
taaaataagctttagcttattc

SEQ ID NO: 646582 - DNA, 22 bp, Artificial Sequence
  chemically synthesized
tatgtcctcagaataagctaaa

SEQ ID NO: 646583 - DNA, 22 bp, Artificial Sequence
  chemically synthesized
atgtcctcagaataagctaaag

SEQ ID NO: 646584 - DNA, 22 bp, Artificial Sequence
  chemically synthesized
ttttaaaataagctttagctta

SEQ ID NO: 646585 - DNA, 22 bp, Artificial Sequence
  chemically synthesized
tgtcctcagaataagctaaagc

SEQ ID NO: 646586 - DNA, 22 bp, Artificial Sequence
  chemically synthesized
attttaaaataagctttagctt

SEQ ID NO: 646587 - DNA, 22 bp, Artificial Sequence
  chemically synthesized
tattttaaaataagctttagct

SEQ ID NO: 646588 - DNA, 22 bp, Artificial Sequence
  chemically synthesized
ttttattttaaaataagcttta

SEQ ID NO: 646589 - DNA, 22 bp, Artificial Sequence
  chemically synthesized
gttttattttaaaataagcttt

SEQ ID NO: 646590 - DNA, 22 bp, Artificial Sequence
  chemically synthesized
tgttttattttaaaataagctt

SEQ ID NO: 646591 - DNA, 22 bp, Artificial Sequence
  chemically synthesized
agaataagctaaagcttatttt

SEQ ID NO: 646592 - DNA, 22 bp, Artificial Sequence
  chemically synthesized
ttgttttattttaaaataagct

SEQ ID NO: 646593 - DNA, 22 bp, Artificial Sequence
  chemically synthesized
cttttgttttattttaaaataa

SEQ ID NO: 646594 - DNA, 22 bp, Artificial Sequence
  chemically synthesized
aagcttattttaaaataaaaca

SEQ ID NO: 646595 - DNA, 22 bp, Artificial Sequence
  chemically synthesized
ggtggtaaaactgcttttgttt

SEQ ID NO: 646596 - DNA, 22 bp, Artificial Sequence
  chemically synthesized
attttaaaataaaacaaaagca

SEQ ID NO: 646597 - DNA, 22 bp, Artificial Sequence
  chemically synthesized
ttttaaaataaaacaaaagcag

SEQ ID NO: 646598 - DNA, 22 bp, Artificial Sequence
  chemically synthesized
taaaataaaacaaaagcagttt

SEQ ID NO: 646599 - DNA, 22 bp, Artificial Sequence
  chemically synthesized
aaaataaaacaaaagcagtttt

SEQ ID NO: 646600 - DNA, 22 bp, Artificial Sequence
  chemically synthesized
aaataaaacaaaagcagtttta

SEQ ID NO: 646601 - DNA, 22 bp, Artificial Sequence
  chemically synthesized
gaatgagtgtgataaattaggt

SEQ ID NO: 646602 - DNA, 22 bp, Artificial Sequence
  chemically synthesized
ggaatgagtgtgataaattagg

SEQ ID NO: 646603 - DNA, 22 bp, Artificial Sequence
  chemically synthesized
taccacctaatttatcacactc

SEQ ID NO: 646604 - DNA, 22 bp, Artificial Sequence
  chemically synthesized
agaatttggaatgagtgtgata

SEQ ID NO: 646605 - DNA, 22 bp, Artificial Sequence
  chemically synthesized
accacctaatttatcacactca

SEQ ID NO: 646606 - DNA, 22 bp, Artificial Sequence
  chemically synthesized
cagaatttggaatgagtgtgat

SEQ ID NO: 646607 - DNA, 22 bp, Artificial Sequence
  chemically synthesized
ccacctaatttatcacactcat

SEQ ID NO: 646608 - DNA, 22 bp, Artificial Sequence
  chemically synthesized
atttatcacactcattccaaat

SEQ ID NO: 646609 - DNA, 22 bp, Artificial Sequence
  chemically synthesized
atcacactcattccaaattctg

SEQ ID NO: 646610 - DNA, 22 bp, Artificial Sequence
  chemically synthesized
gcagtacaacttcagaatttgg

SEQ ID NO: 646611 - DNA, 22 bp, Artificial Sequence
  chemically synthesized
tcacactcattccaaattctga

SEQ ID NO: 646612 - DNA, 22 bp, Artificial Sequence
  chemically synthesized
tagcagtacaacttcagaattt

SEQ ID NO: 646613 - DNA, 22 bp, Artificial Sequence
  chemically synthesized
attccaaattctgaagttgtac

SEQ ID NO: 646614 - DNA, 22 bp, Artificial Sequence
  chemically synthesized
caaattctgaagttgtactgct

SEQ ID NO: 646615 - DNA, 22 bp, Artificial Sequence
  chemically synthesized
aacatgggaagttctagcagta

SEQ ID NO: 646616 - DNA, 22 bp, Artificial Sequence
  chemically synthesized
tgaagttgtactgctagaactt

SEQ ID NO: 646617 - DNA, 22 bp, Artificial Sequence
  chemically synthesized
aagttgtactgctagaacttcc

SEQ ID NO: 646618 - DNA, 22 bp, Artificial Sequence
  chemically synthesized
taattaaacatgggaagttcta

SEQ ID NO: 646619 - DNA, 22 bp, Artificial Sequence
  chemically synthesized
ggttataattaaacatgggaag

SEQ ID NO: 646620 - DNA, 22 bp, Artificial Sequence
  chemically synthesized
tactgctagaacttcccatgtt

SEQ ID NO: 646621 - DNA, 22 bp, Artificial Sequence
  chemically synthesized
taggttataattaaacatggga

SEQ ID NO: 646622 - DNA, 22 bp, Artificial Sequence
  chemically synthesized
ctagaacttcccatgtttaatt

SEQ ID NO: 646623 - DNA, 22 bp, Artificial Sequence
  chemically synthesized
caactctaggttataattaaac

SEQ ID NO: 646624 - DNA, 22 bp, Artificial Sequence
  chemically synthesized
gaacttcccatgtttaattata

SEQ ID NO: 646625 - DNA, 22 bp, Artificial Sequence
  chemically synthesized
cccatgtttaattataacctag

SEQ ID NO: 646626 - DNA, 22 bp, Artificial Sequence
  chemically synthesized
ccatgtttaattataacctaga

SEQ ID NO: 646627 - DNA, 22 bp, Artificial Sequence
  chemically synthesized
aattataacctagagttgtaac

SEQ ID NO: 646628 - DNA, 22 bp, Artificial Sequence
  chemically synthesized
attataacctagagttgtaact

SEQ ID NO: 646629 - DNA, 22 bp, Artificial Sequence
  chemically synthesized
taacctagagttgtaactacac

SEQ ID NO: 646630 - DNA, 22 bp, Artificial Sequence
  chemically synthesized
agagaacaggaagaaaagtgta

SEQ ID NO: 646631 - DNA, 22 bp, Artificial Sequence
  chemically synthesized
gagttgtaactacacttttctt

SEQ ID NO: 646632 - DNA, 22 bp, Artificial Sequence
  chemically synthesized
cctaagagaacaggaagaaaag

SEQ ID NO: 646633 - DNA, 22 bp, Artificial Sequence
  chemically synthesized
taactacacttttcttcctgtt

SEQ ID NO: 646634 - DNA, 22 bp, Artificial Sequence
  chemically synthesized
actgcctaagagaacaggaaga

SEQ ID NO: 646635 - DNA, 22 bp, Artificial Sequence
  chemically synthesized
attgactgcctaagagaacagg

SEQ ID NO: 646636 - DNA, 22 bp, Artificial Sequence
  chemically synthesized
cacttttcttcctgttctctta

SEQ ID NO: 646637 - DNA, 22 bp, Artificial Sequence
  chemically synthesized
tcattcattgactgcctaagag

SEQ ID NO: 646638 - DNA, 22 bp, Artificial Sequence
  chemically synthesized
ttcttcctgttctcttaggcag

SEQ ID NO: 646639 - DNA, 22 bp, Artificial Sequence
  chemically synthesized
tcttcctgttctcttaggcagt

SEQ ID NO: 646640 - DNA, 22 bp, Artificial Sequence
  chemically synthesized
cttcctgttctcttaggcagtc

SEQ ID NO: 646641 - DNA, 22 bp, Artificial Sequence
  chemically synthesized
ttcctgttctcttaggcagtca

SEQ ID NO: 646642 - DNA, 22 bp, Artificial Sequence
  chemically synthesized
cctgttctcttaggcagtcaat

SEQ ID NO: 646643 - DNA, 22 bp, Artificial Sequence
  chemically synthesized
ctgttctcttaggcagtcaatg

SEQ ID NO: 646644 - DNA, 22 bp, Artificial Sequence
  chemically synthesized
ttctcttaggcagtcaatgaat

SEQ ID NO: 646645 - DNA, 22 bp, Artificial Sequence
  chemically synthesized
tcttaggcagtcaatgaatgac

SEQ ID NO: 646646 - DNA, 22 bp, Artificial Sequence
  chemically synthesized
cgtaacagtggctgtcattcat

SEQ ID NO: 646647 - DNA, 22 bp, Artificial Sequence
  chemically synthesized
ttaggcagtcaatgaatgacag

SEQ ID NO: 646648 - DNA, 22 bp, Artificial Sequence
  chemically synthesized
aggcagtcaatgaatgacagcc

SEQ ID NO: 646649 - DNA, 22 bp, Artificial Sequence
  chemically synthesized
ggcagtcaatgaatgacagcca

SEQ ID NO: 646650 - DNA, 22 bp, Artificial Sequence
  chemically synthesized
tatctacgtaacagtggctgtc

SEQ ID NO: 646651 - DNA, 22 bp, Artificial Sequence
  chemically synthesized
gagttgtatctacgtaacagtg

SEQ ID NO: 646652 - DNA, 22 bp, Artificial Sequence
  chemically synthesized
attcgagttgtatctacgtaac

SEQ ID NO: 646653 - DNA, 22 bp, Artificial Sequence
  chemically synthesized
agattaattcgagttgtatcta

SEQ ID NO: 646654 - DNA, 22 bp, Artificial Sequence
  chemically synthesized
ttacgtagatacaactcgaatt

SEQ ID NO: 646655 - DNA, 22 bp, Artificial Sequence
  chemically synthesized
gcacattcagattaattcgagt

SEQ ID NO: 646656 - DNA, 22 bp, Artificial Sequence
  chemically synthesized
cgtagatacaactcgaattaat

SEQ ID NO: 646657 - DNA, 22 bp, Artificial Sequence
  chemically synthesized
tagcacattcagattaattcga

SEQ ID NO: 646658 - DNA, 22 bp, Artificial Sequence
  chemically synthesized
gaagctctagcacattcagatt

SEQ ID NO: 646659 - DNA, 22 bp, Artificial Sequence
  chemically synthesized
gtattagaagctctagcacatt

SEQ ID NO: 646660 - DNA, 22 bp, Artificial Sequence
  chemically synthesized
gaattaatctgaatgtgctaga

SEQ ID NO: 646661 - DNA, 22 bp, Artificial Sequence
  chemically synthesized
ggtattagaagctctagcacat

SEQ ID NO: 646662 - DNA, 22 bp, Artificial Sequence
  chemically synthesized
tggtattagaagctctagcaca

SEQ ID NO: 646663 - DNA, 22 bp, Artificial Sequence
  chemically synthesized
attttggtattagaagctctag

SEQ ID NO: 646664 - DNA, 22 bp, Artificial Sequence
  chemically synthesized
atctgaatgtgctagagcttct

SEQ ID NO: 646665 - DNA, 22 bp, Artificial Sequence
  chemically synthesized
actgattttggtattagaagct

SEQ ID NO: 646666 - DNA, 22 bp, Artificial Sequence
  chemically synthesized
aatgtgctagagcttctaatac

SEQ ID NO: 646667 - DNA, 22 bp, Artificial Sequence
  chemically synthesized
gctcactgattttggtattaga

SEQ ID NO: 646668 - DNA, 22 bp, Artificial Sequence
  chemically synthesized
ggctcactgattttggtattag

SEQ ID NO: 646669 - DNA, 22 bp, Artificial Sequence
  chemically synthesized
tggctcactgattttggtatta

SEQ ID NO: 646670 - DNA, 22 bp, Artificial Sequence
  chemically synthesized
tttggctcactgattttggtat

SEQ ID NO: 646671 - DNA, 22 bp, Artificial Sequence
  chemically synthesized
ctttggctcactgattttggta

SEQ ID NO: 646672 - DNA, 22 bp, Artificial Sequence
  chemically synthesized
gagcttctaataccaaaatcag

SEQ ID NO: 646673 - DNA, 22 bp, Artificial Sequence
  chemically synthesized
tgcttctttggctcactgattt

SEQ ID NO: 646674 - DNA, 22 bp, Artificial Sequence
  chemically synthesized
gtgcttctttggctcactgatt

SEQ ID NO: 646675 - DNA, 22 bp, Artificial Sequence
  chemically synthesized
ctaataccaaaatcagtgagcc

SEQ ID NO: 646676 - DNA, 22 bp, Artificial Sequence
  chemically synthesized
taataccaaaatcagtgagcca

SEQ ID NO: 646677 - DNA, 22 bp, Artificial Sequence
  chemically synthesized
ataccaaaatcagtgagccaaa

SEQ ID NO: 646678 - DNA, 22 bp, Artificial Sequence
  chemically synthesized
tttacatttggctgattctttg

SEQ ID NO: 646679 - DNA, 22 bp, Artificial Sequence
  chemically synthesized
acatttggctgattctttggcc

SEQ ID NO: 646680 - DNA, 22 bp, Artificial Sequence
  chemically synthesized
catttggctgattctttggcca

SEQ ID NO: 646681 - DNA, 22 bp, Artificial Sequence
  chemically synthesized
aacagtaaaatgtgtggccaaa

SEQ ID NO: 646682 - DNA, 22 bp, Artificial Sequence
  chemically synthesized
caacagtaaaatgtgtggccaa

SEQ ID NO: 646683 - DNA, 22 bp, Artificial Sequence
  chemically synthesized
ggctgattctttggccacacat

SEQ ID NO: 646684 - DNA, 22 bp, Artificial Sequence
  chemically synthesized
gctgattctttggccacacatt

SEQ ID NO: 646685 - DNA, 22 bp, Artificial Sequence
  chemically synthesized
attctttggccacacattttac

SEQ ID NO: 646686 - DNA, 22 bp, Artificial Sequence
  chemically synthesized
tttggccacacattttactgtt

SEQ ID NO: 646687 - DNA, 22 bp, Artificial Sequence
  chemically synthesized
tggccacacattttactgttga

SEQ ID NO: 646688 - DNA, 22 bp, Artificial Sequence
  chemically synthesized
ggccacacattttactgttgaa

SEQ ID NO: 646689 - DNA, 22 bp, Artificial Sequence
  chemically synthesized
gccacacattttactgttgaag

SEQ ID NO: 646690 - DNA, 22 bp, Artificial Sequence
  chemically synthesized
atatataagatacttcaacagt

SEQ ID NO: 646691 - DNA, 22 bp, Artificial Sequence
  chemically synthesized
atggtactaatatataagatac

SEQ ID NO: 646692 - DNA, 22 bp, Artificial Sequence
  chemically synthesized
tactgttgaagtatcttatata

SEQ ID NO: 646693 - DNA, 22 bp, Artificial Sequence
  chemically synthesized
actgttgaagtatcttatatat

SEQ ID NO: 646694 - DNA, 22 bp, Artificial Sequence
  chemically synthesized
ctgttgaagtatcttatatatt

SEQ ID NO: 646695 - DNA, 22 bp, Artificial Sequence
  chemically synthesized
ttgaagtatcttatatattagt

SEQ ID NO: 646696 - DNA, 22 bp, Artificial Sequence
  chemically synthesized
aagtatcttatatattagtacc

SEQ ID NO: 646697 - DNA, 22 bp, Artificial Sequence
  chemically synthesized
tgggaaaaagtattaatggtac

SEQ ID NO: 646698 - DNA, 22 bp, Artificial Sequence
  chemically synthesized
atatattagtaccattaatact

SEQ ID NO: 646699 - DNA, 22 bp, Artificial Sequence
  chemically synthesized
gctatgggaaaaagtattaatg

SEQ ID NO: 646700 - DNA, 22 bp, Artificial Sequence
  chemically synthesized
tatattagtaccattaatactt

SEQ ID NO: 646701 - DNA, 22 bp, Artificial Sequence
  chemically synthesized
agctatgggaaaaagtattaat

SEQ ID NO: 646702 - DNA, 22 bp, Artificial Sequence
  chemically synthesized
ttagctatgggaaaaagtatta

SEQ ID NO: 646703 - DNA, 22 bp, Artificial Sequence
  chemically synthesized
cttagctatgggaaaaagtatt

SEQ ID NO: 646704 - DNA, 22 bp, Artificial Sequence
  chemically synthesized
tcttagctatgggaaaaagtat

SEQ ID NO: 646705 - DNA, 22 bp, Artificial Sequence
  chemically synthesized
gtaccattaatactttttccca

SEQ ID NO: 646706 - DNA, 22 bp, Artificial Sequence
  chemically synthesized
tctttcttagctatgggaaaaa

SEQ ID NO: 646707 - DNA, 22 bp, Artificial Sequence
  chemically synthesized
atctttcttagctatgggaaaa

SEQ ID NO: 646708 - DNA, 22 bp, Artificial Sequence
  chemically synthesized
atactttttcccatagctaaga

SEQ ID NO: 646709 - DNA, 22 bp, Artificial Sequence
  chemically synthesized
tgatgccttatctttcttagct

SEQ ID NO: 646710 - DNA, 22 bp, Artificial Sequence
  chemically synthesized
tttcccatagctaagaaagata

SEQ ID NO: 646711 - DNA, 22 bp, Artificial Sequence
  chemically synthesized
ttcccatagctaagaaagataa

SEQ ID NO: 646712 - DNA, 22 bp, Artificial Sequence
  chemically synthesized
tcccatagctaagaaagataag

SEQ ID NO: 646713 - DNA, 22 bp, Artificial Sequence
  chemically synthesized
cccatagctaagaaagataagg

SEQ ID NO: 646714 - DNA, 22 bp, Artificial Sequence
  chemically synthesized
ccatagctaagaaagataaggc

SEQ ID NO: 646715 - DNA, 22 bp, Artificial Sequence
  chemically synthesized
cccaaccataactgtgatgcct

SEQ ID NO: 646716 - DNA, 22 bp, Artificial Sequence
  chemically synthesized
ccccaaccataactgtgatgcc

SEQ ID NO: 646717 - DNA, 22 bp, Artificial Sequence
  chemically synthesized
tccccaaccataactgtgatgc

SEQ ID NO: 646718 - DNA, 22 bp, Artificial Sequence
  chemically synthesized
agaaagataaggcatcacagtt

SEQ ID NO: 646719 - DNA, 22 bp, Artificial Sequence
  chemically synthesized
aaacaaacaaacaaaaaagcct

SEQ ID NO: 646720 - DNA, 22 bp, Artificial Sequence
  chemically synthesized
tggttggggaaaggcttttttg

SEQ ID NO: 646721 - DNA, 22 bp, Artificial Sequence
  chemically synthesized
caaacaaacaaacaaaaaagcc

SEQ ID NO: 646722 - DNA, 22 bp, Artificial Sequence
  chemically synthesized
cttcaaacaaacaaacaaaaaa

SEQ ID NO: 646723 - DNA, 22 bp, Artificial Sequence
  chemically synthesized
ccttcaaacaaacaaacaaaaa

SEQ ID NO: 646724 - DNA, 22 bp, Artificial Sequence
  chemically synthesized
gggaaaggcttttttgtttgtt

SEQ ID NO: 646725 - DNA, 22 bp, Artificial Sequence
  chemically synthesized
cttccttcaaacaaacaaacaa

SEQ ID NO: 646726 - DNA, 22 bp, Artificial Sequence
  chemically synthesized
acttccttcaaacaaacaaaca

SEQ ID NO: 646727 - DNA, 22 bp, Artificial Sequence
  chemically synthesized
ttttgtttgtttgtttgaagga

SEQ ID NO: 646728 - DNA, 22 bp, Artificial Sequence
  chemically synthesized
tttgtttgtttgtttgaaggaa

SEQ ID NO: 646729 - DNA, 22 bp, Artificial Sequence
  chemically synthesized
tatatgacttacttccttcaaa

SEQ ID NO: 646730 - DNA, 22 bp, Artificial Sequence
  chemically synthesized
ttgtttgtttgtttgaaggaag

SEQ ID NO: 646731 - DNA, 22 bp, Artificial Sequence
  chemically synthesized
gtatatgacttacttccttcaa

SEQ ID NO: 646732 - DNA, 22 bp, Artificial Sequence
  chemically synthesized
tgtttgtttgtttgaaggaagt

SEQ ID NO: 646733 - DNA, 22 bp, Artificial Sequence
  chemically synthesized
gtttgtttgtttgaaggaagta

SEQ ID NO: 646734 - DNA, 22 bp, Artificial Sequence
  chemically synthesized
tttgtttgtttgaaggaagtaa

SEQ ID NO: 646735 - DNA, 22 bp, Artificial Sequence
  chemically synthesized
gtttgtttgaaggaagtaagtc

SEQ ID NO: 646736 - DNA, 22 bp, Artificial Sequence
  chemically synthesized
tttgtttgaaggaagtaagtca

SEQ ID NO: 646737 - DNA, 22 bp, Artificial Sequence
  chemically synthesized
agtcatttgtatatgacttact

SEQ ID NO: 646738 - DNA, 22 bp, Artificial Sequence
  chemically synthesized
gtttgaaggaagtaagtcatat

SEQ ID NO: 646739 - DNA, 22 bp, Artificial Sequence
  chemically synthesized
tttgaaggaagtaagtcatata

SEQ ID NO: 646740 - DNA, 22 bp, Artificial Sequence
  chemically synthesized
gaaggaagtaagtcatatacaa

SEQ ID NO: 646741 - DNA, 22 bp, Artificial Sequence
  chemically synthesized
aaggaagtaagtcatatacaaa

SEQ ID NO: 646742 - DNA, 22 bp, Artificial Sequence
  chemically synthesized
ataataaagaatcaagtcaacc

SEQ ID NO: 646743 - DNA, 22 bp, Artificial Sequence
  chemically synthesized
agggttgacttgattctttatt

SEQ ID NO: 646744 - DNA, 22 bp, Artificial Sequence
  chemically synthesized
acttgattctttattattagct

SEQ ID NO: 646745 - DNA, 22 bp, Artificial Sequence
  chemically synthesized
gtacataaacgatcaagctaat

SEQ ID NO: 646746 - DNA, 22 bp, Artificial Sequence
  chemically synthesized
gattctttattattagcttgat

SEQ ID NO: 646747 - DNA, 22 bp, Artificial Sequence
  chemically synthesized
attctttattattagcttgatc

SEQ ID NO: 646748 - DNA, 22 bp, Artificial Sequence
  chemically synthesized
atctggtacataaacgatcaag

SEQ ID NO: 646749 - DNA, 22 bp, Artificial Sequence
  chemically synthesized
tttattattagcttgatcgttt

SEQ ID NO: 646750 - DNA, 22 bp, Artificial Sequence
  chemically synthesized
tattattagcttgatcgtttat

SEQ ID NO: 646751 - DNA, 22 bp, Artificial Sequence
  chemically synthesized
attattagcttgatcgtttatg

SEQ ID NO: 646752 - DNA, 22 bp, Artificial Sequence
  chemically synthesized
ttattagcttgatcgtttatgt

SEQ ID NO: 646753 - DNA, 22 bp, Artificial Sequence
  chemically synthesized
ttagcttgatcgtttatgtacc

SEQ ID NO: 646754 - DNA, 22 bp, Artificial Sequence
  chemically synthesized
gcttgatcgtttatgtaccaga

SEQ ID NO: 646755 - DNA, 22 bp, Artificial Sequence
  chemically synthesized
gatcgtttatgtaccagatgag

SEQ ID NO: 646756 - DNA, 22 bp, Artificial Sequence
  chemically synthesized
atcgtttatgtaccagatgaga

SEQ ID NO: 646757 - DNA, 22 bp, Artificial Sequence
  chemically synthesized
atgtaccagatgagattattta

SEQ ID NO: 646758 - DNA, 22 bp, Artificial Sequence
  chemically synthesized
aagacatgagaataaataatct

SEQ ID NO: 646759 - DNA, 22 bp, Artificial Sequence
  chemically synthesized
tgtaccagatgagattatttat

SEQ ID NO: 646760 - DNA, 22 bp, Artificial Sequence
  chemically synthesized
ttgaagacatgagaataaataa

SEQ ID NO: 646761 - DNA, 22 bp, Artificial Sequence
  chemically synthesized
gttattgaagacatgagaataa

SEQ ID NO: 646762 - DNA, 22 bp, Artificial Sequence
  chemically synthesized
tttattctcatgtcttcaataa

SEQ ID NO: 646763 - DNA, 22 bp, Artificial Sequence
  chemically synthesized
attctcatgtcttcaataacta

SEQ ID NO: 646764 - DNA, 22 bp, Artificial Sequence
  chemically synthesized
ttctcatgtcttcaataactag

SEQ ID NO: 646765 - DNA, 22 bp, Artificial Sequence
  chemically synthesized
tcatgtcttcaataactagtta

SEQ ID NO: 646766 - DNA, 22 bp, Artificial Sequence
  chemically synthesized
atgtcttcaataactagttata

SEQ ID NO: 646767 - DNA, 22 bp, Artificial Sequence
  chemically synthesized
caataactagttatatatatgc

SEQ ID NO: 646768 - DNA, 22 bp, Artificial Sequence
  chemically synthesized
aataactagttatatatatgcc

SEQ ID NO: 646769 - DNA, 22 bp, Artificial Sequence
  chemically synthesized
gttatatatatgccactttgat

SEQ ID NO: 646770 - DNA, 22 bp, Artificial Sequence
  chemically synthesized
tatatatgccactttgatacta

SEQ ID NO: 646771 - DNA, 22 bp, Artificial Sequence
  chemically synthesized
ggccaaaagaaatagtatcaaa

SEQ ID NO: 646772 - DNA, 22 bp, Artificial Sequence
  chemically synthesized
ataaggattaggccaaaagaaa

SEQ ID NO: 646773 - DNA, 22 bp, Artificial Sequence
  chemically synthesized
cataaggattaggccaaaagaa

SEQ ID NO: 646774 - DNA, 22 bp, Artificial Sequence
  chemically synthesized
tgatactatttcttttggccta

SEQ ID NO: 646775 - DNA, 22 bp, Artificial Sequence
  chemically synthesized
gatactatttcttttggcctaa

SEQ ID NO: 646776 - DNA, 22 bp, Artificial Sequence
  chemically synthesized
atactatttcttttggcctaat

SEQ ID NO: 646777 - DNA, 22 bp, Artificial Sequence
  chemically synthesized
tttcttttggcctaatccttat

SEQ ID NO: 646778 - DNA, 22 bp, Artificial Sequence
  chemically synthesized
cttttggcctaatccttatgaa

SEQ ID NO: 646779 - DNA, 22 bp, Artificial Sequence
  chemically synthesized
ttttggcctaatccttatgaag

SEQ ID NO: 646780 - DNA, 22 bp, Artificial Sequence
  chemically synthesized
ttggcctaatccttatgaaggt

SEQ ID NO: 646781 - DNA, 22 bp, Artificial Sequence
  chemically synthesized
tggcctaatccttatgaaggtt

SEQ ID NO: 646782 - DNA, 22 bp, Artificial Sequence
  chemically synthesized
agatgagaaaagaaccttcata

SEQ ID NO: 646783 - DNA, 22 bp, Artificial Sequence
  chemically synthesized
ggcctaatccttatgaaggttc

SEQ ID NO: 646784 - DNA, 22 bp, Artificial Sequence
  chemically synthesized
gcctaatccttatgaaggttct

SEQ ID NO: 646785 - DNA, 22 bp, Artificial Sequence
  chemically synthesized
atccttatgaaggttcttttct

SEQ ID NO: 646786 - DNA, 22 bp, Artificial Sequence
  chemically synthesized
atgaaggttcttttctcatctg

SEQ ID NO: 646787 - DNA, 22 bp, Artificial Sequence
  chemically synthesized
tgaaggttcttttctcatctga

SEQ ID NO: 646788 - DNA, 22 bp, Artificial Sequence
  chemically synthesized
ttttctcatctgagcatgactt

SEQ ID NO: 646789 - DNA, 22 bp, Artificial Sequence
  chemically synthesized
gtgtggcaacacaaagtcatgc

SEQ ID NO: 646790 - DNA, 22 bp, Artificial Sequence
  chemically synthesized
ttctcatctgagcatgactttg

SEQ ID NO: 646791 - DNA, 22 bp, Artificial Sequence
  chemically synthesized
tctcatctgagcatgactttgt

SEQ ID NO: 646792 - DNA, 22 bp, Artificial Sequence
  chemically synthesized
ctcatctgagcatgactttgtg

SEQ ID NO: 646793 - DNA, 22 bp, Artificial Sequence
  chemically synthesized
tcatctgagcatgactttgtgt

SEQ ID NO: 646794 - DNA, 22 bp, Artificial Sequence
  chemically synthesized
atctgagcatgactttgtgttg

SEQ ID NO: 646795 - DNA, 22 bp, Artificial Sequence
  chemically synthesized
agcatgactttgtgttgccaca

SEQ ID NO: 646796 - DNA, 22 bp, Artificial Sequence
  chemically synthesized
tcatatgtagttggtgtggcaa

SEQ ID NO: 646797 - DNA, 22 bp, Artificial Sequence
  chemically synthesized
atcatatgtagttggtgtggca

SEQ ID NO: 646798 - DNA, 22 bp, Artificial Sequence
  chemically synthesized
tgtgttgccacaccaactacat

SEQ ID NO: 646799 - DNA, 22 bp, Artificial Sequence
  chemically synthesized
gtgttgccacaccaactacata

SEQ ID NO: 646800 - DNA, 22 bp, Artificial Sequence
  chemically synthesized
tgttgccacaccaactacatat

SEQ ID NO: 646801 - DNA, 22 bp, Artificial Sequence
  chemically synthesized
ccacaccaactacatatgataa

SEQ ID NO: 646802 - DNA, 22 bp, Artificial Sequence
  chemically synthesized
catatgataaatttaccattct

SEQ ID NO: 646803 - DNA, 22 bp, Artificial Sequence
  chemically synthesized
gagaatatagacaaagggaaga

SEQ ID NO: 646804 - DNA, 22 bp, Artificial Sequence
  chemically synthesized
ggagaatatagacaaagggaag

SEQ ID NO: 646805 - DNA, 22 bp, Artificial Sequence
  chemically synthesized
accattcttccctttgtctata

SEQ ID NO: 646806 - DNA, 22 bp, Artificial Sequence
  chemically synthesized
ccattcttccctttgtctatat

SEQ ID NO: 646807 - DNA, 22 bp, Artificial Sequence
  chemically synthesized
acccatcttggagaatatagac

SEQ ID NO: 646808 - DNA, 22 bp, Artificial Sequence
  chemically synthesized
ttccctttgtctatattctcca

SEQ ID NO: 646809 - DNA, 22 bp, Artificial Sequence
  chemically synthesized
ccctttgtctatattctccaag

SEQ ID NO: 646810 - DNA, 22 bp, Artificial Sequence
  chemically synthesized
cctttgtctatattctccaaga

SEQ ID NO: 646811 - DNA, 22 bp, Artificial Sequence
  chemically synthesized
tgtctatattctccaagatggg

SEQ ID NO: 646812 - DNA, 22 bp, Artificial Sequence
  chemically synthesized
gtctatattctccaagatgggt

SEQ ID NO: 646813 - DNA, 22 bp, Artificial Sequence
  chemically synthesized
tctatattctccaagatgggtg

SEQ ID NO: 646814 - DNA, 22 bp, Artificial Sequence
  chemically synthesized
tattctccaagatgggtgagat

SEQ ID NO: 646815 - DNA, 22 bp, Artificial Sequence
  chemically synthesized
ataaagtaaggatatctcaccc

SEQ ID NO: 646816 - DNA, 22 bp, Artificial Sequence
  chemically synthesized
gataaagtaaggatatctcacc

SEQ ID NO: 646817 - DNA, 22 bp, Artificial Sequence
  chemically synthesized
tccaagatgggtgagatatcct

SEQ ID NO: 646818 - DNA, 22 bp, Artificial Sequence
  chemically synthesized
gtttgataaagtaaggatatct

SEQ ID NO: 646819 - DNA, 22 bp, Artificial Sequence
  chemically synthesized
caagatgggtgagatatcctta

SEQ ID NO: 646820 - DNA, 22 bp, Artificial Sequence
  chemically synthesized
agtttgataaagtaaggatatc

SEQ ID NO: 646821 - DNA, 22 bp, Artificial Sequence
  chemically synthesized
tagtttgataaagtaaggatat

SEQ ID NO: 646822 - DNA, 22 bp, Artificial Sequence
  chemically synthesized
ttagtttgataaagtaaggata

SEQ ID NO: 646823 - DNA, 22 bp, Artificial Sequence
  chemically synthesized
tttagtttgataaagtaaggat

SEQ ID NO: 646824 - DNA, 22 bp, Artificial Sequence
  chemically synthesized
cgatgcctttttagtttgataa

SEQ ID NO: 646825 - DNA, 22 bp, Artificial Sequence
  chemically synthesized
actttatcaaactaaaaaggca

SEQ ID NO: 646826 - DNA, 22 bp, Artificial Sequence
  chemically synthesized
ctttatcaaactaaaaaggcat

SEQ ID NO: 646827 - DNA, 22 bp, Artificial Sequence
  chemically synthesized
gtcaaagtattacgatgccttt

SEQ ID NO: 646828 - DNA, 22 bp, Artificial Sequence
  chemically synthesized
tatcaaactaaaaaggcatcgt

SEQ ID NO: 646829 - DNA, 22 bp, Artificial Sequence
  chemically synthesized
atcaaactaaaaaggcatcgta

SEQ ID NO: 646830 - DNA, 22 bp, Artificial Sequence
  chemically synthesized
tcaaactaaaaaggcatcgtaa

SEQ ID NO: 646831 - DNA, 22 bp, Artificial Sequence
  chemically synthesized
aaaaggcatcgtaatactttga

SEQ ID NO: 646832 - DNA, 22 bp, Artificial Sequence
  chemically synthesized
tgactagatttcttctctttat

SEQ ID NO: 646833 - DNA, 22 bp, Artificial Sequence
  chemically synthesized
gactagatttcttctctttatg

SEQ ID NO: 646834 - DNA, 22 bp, Artificial Sequence
  chemically synthesized
actagatttcttctctttatgt

SEQ ID NO: 646835 - DNA, 22 bp, Artificial Sequence
  chemically synthesized
ccaagtgaataaataacataaa

SEQ ID NO: 646836 - DNA, 22 bp, Artificial Sequence
  chemically synthesized
gatttcttctctttatgttatt

SEQ ID NO: 646837 - DNA, 22 bp, Artificial Sequence
  chemically synthesized
gccaagtgaataaataacataa

SEQ ID NO: 646838 - DNA, 22 bp, Artificial Sequence
  chemically synthesized
cttctctttatgttatttattc

SEQ ID NO: 646839 - DNA, 22 bp, Artificial Sequence
  chemically synthesized
ttctctttatgttatttattca

SEQ ID NO: 646840 - DNA, 22 bp, Artificial Sequence
  chemically synthesized
ctctttatgttatttattcact

SEQ ID NO: 646841 - DNA, 22 bp, Artificial Sequence
  chemically synthesized
tctttatgttatttattcactt

SEQ ID NO: 646842 - DNA, 22 bp, Artificial Sequence
  chemically synthesized
tttatgttatttattcacttgg

SEQ ID NO: 646843 - DNA, 22 bp, Artificial Sequence
  chemically synthesized
tatgttatttattcacttggca

SEQ ID NO: 646844 - DNA, 22 bp, Artificial Sequence
  chemically synthesized
atgttatttattcacttggcaa

SEQ ID NO: 646845 - DNA, 22 bp, Artificial Sequence
  chemically synthesized
tgttatttattcacttggcaaa

SEQ ID NO: 646846 - DNA, 22 bp, Artificial Sequence
  chemically synthesized
tttattcacttggcaaatcctt

SEQ ID NO: 646847 - DNA, 22 bp, Artificial Sequence
  chemically synthesized
attcacttggcaaatccttatt

SEQ ID NO: 646848 - DNA, 22 bp, Artificial Sequence
  chemically synthesized
ttcacttggcaaatccttattt

SEQ ID NO: 646849 - DNA, 22 bp, Artificial Sequence
  chemically synthesized
acttggcaaatccttatttttt

SEQ ID NO: 646850 - DNA, 22 bp, Artificial Sequence
  chemically synthesized
aagcaaatatgaaggaaaaaat

SEQ ID NO: 646851 - DNA, 22 bp, Artificial Sequence
  chemically synthesized
ggcaaatccttattttttcctt

SEQ ID NO: 646852 - DNA, 22 bp, Artificial Sequence
  chemically synthesized
gcaaatccttattttttccttc

SEQ ID NO: 646853 - DNA, 22 bp, Artificial Sequence
  chemically synthesized
attttttccttcatatttgctt

SEQ ID NO: 646854 - DNA, 22 bp, Artificial Sequence
  chemically synthesized
ttttttccttcatatttgcttc

SEQ ID NO: 646855 - DNA, 22 bp, Artificial Sequence
  chemically synthesized
tttccttcatatttgcttcaat

SEQ ID NO: 646856 - DNA, 22 bp, Artificial Sequence
  chemically synthesized
ttccttcatatttgcttcaatg

SEQ ID NO: 646857 - DNA, 22 bp, Artificial Sequence
  chemically synthesized
tccttcatatttgcttcaatgt

SEQ ID NO: 646858 - DNA, 22 bp, Artificial Sequence
  chemically synthesized
ccttcatatttgcttcaatgtc

SEQ ID NO: 646859 - DNA, 22 bp, Artificial Sequence
  chemically synthesized
cttcatatttgcttcaatgtct

SEQ ID NO: 646860 - DNA, 22 bp, Artificial Sequence
  chemically synthesized
aggtagagagagcagacattga

SEQ ID NO: 646861 - DNA, 22 bp, Artificial Sequence
  chemically synthesized
gaggtagagagagcagacattg

SEQ ID NO: 646862 - DNA, 22 bp, Artificial Sequence
  chemically synthesized
catatttgcttcaatgtctgct

SEQ ID NO: 646863 - DNA, 22 bp, Artificial Sequence
  chemically synthesized
atatttgcttcaatgtctgctc

SEQ ID NO: 646864 - DNA, 22 bp, Artificial Sequence
  chemically synthesized
gcttcaatgtctgctctctcta

SEQ ID NO: 646865 - DNA, 22 bp, Artificial Sequence
  chemically synthesized
cttcaatgtctgctctctctac

SEQ ID NO: 646866 - DNA, 22 bp, Artificial Sequence
  chemically synthesized
accggggcttgaggtagagaga

SEQ ID NO: 646867 - DNA, 22 bp, Artificial Sequence
  chemically synthesized
caatgtctgctctctctacctc

SEQ ID NO: 646868 - DNA, 22 bp, Artificial Sequence
  chemically synthesized
aatgtctgctctctctacctca

SEQ ID NO: 646869 - DNA, 22 bp, Artificial Sequence
  chemically synthesized
ctctctctacctcaagccccgg

SEQ ID NO: 646870 - DNA, 22 bp, Artificial Sequence
  chemically synthesized
tctctacctcaagccccggtca

SEQ ID NO: 646871 - DNA, 22 bp, Artificial Sequence
  chemically synthesized
tctacctcaagccccggtcagc

SEQ ID NO: 646872 - DNA, 22 bp, Artificial Sequence
  chemically synthesized
tacctcaagccccggtcagcat

SEQ ID NO: 646873 - DNA, 22 bp, Artificial Sequence
  chemically synthesized
cctcaagccccggtcagcattt

SEQ ID NO: 646874 - DNA, 22 bp, Artificial Sequence
  chemically synthesized
ccatgaaccaagtaaatgctga

SEQ ID NO: 646875 - DNA, 22 bp, Artificial Sequence
  chemically synthesized
aagccccggtcagcatttactt

SEQ ID NO: 646876 - DNA, 22 bp, Artificial Sequence
  chemically synthesized
acttggttcatggcaatgttcc

SEQ ID NO: 646877 - DNA, 22 bp, Artificial Sequence
  chemically synthesized
cttggttcatggcaatgttcct

SEQ ID NO: 646878 - DNA, 22 bp, Artificial Sequence
  chemically synthesized
ggttcatggcaatgttcctttg

SEQ ID NO: 646879 - DNA, 22 bp, Artificial Sequence
  chemically synthesized
gttcatggcaatgttcctttgt

SEQ ID NO: 646880 - DNA, 22 bp, Artificial Sequence
  chemically synthesized
acaatacagagcacaaaggaac

SEQ ID NO: 646881 - DNA, 22 bp, Artificial Sequence
  chemically synthesized
atggcaatgttcctttgtgctc

SEQ ID NO: 646882 - DNA, 22 bp, Artificial Sequence
  chemically synthesized
ctttgtgctctgtattgtgaac

SEQ ID NO: 646883 - DNA, 22 bp, Artificial Sequence
  chemically synthesized
tgtgctctgtattgtgaacact

SEQ ID NO: 646884 - DNA, 22 bp, Artificial Sequence
  chemically synthesized
tagagtgagggcagtgttcaca

SEQ ID NO: 646885 - DNA, 22 bp, Artificial Sequence
  chemically synthesized
gtgctctgtattgtgaacactg

SEQ ID NO: 646886 - DNA, 22 bp, Artificial Sequence
  chemically synthesized
tgctctgtattgtgaacactgc

SEQ ID NO: 646887 - DNA, 22 bp, Artificial Sequence
  chemically synthesized
attatagagtgagggcagtgtt

SEQ ID NO: 646888 - DNA, 22 bp, Artificial Sequence
  chemically synthesized
cattatagagtgagggcagtgt

SEQ ID NO: 646889 - DNA, 22 bp, Artificial Sequence
  chemically synthesized
tgtattgtgaacactgccctca

SEQ ID NO: 646890 - DNA, 22 bp, Artificial Sequence
  chemically synthesized
tattgtgaacactgccctcact

SEQ ID NO: 646891 - DNA, 22 bp, Artificial Sequence
  chemically synthesized
tgaacactgccctcactctata

SEQ ID NO: 646892 - DNA, 22 bp, Artificial Sequence
  chemically synthesized
ccctcactctataatgaagcct

SEQ ID NO: 646893 - DNA, 22 bp, Artificial Sequence
  chemically synthesized
tggcagggaaacaggcttcatt

SEQ ID NO: 646894 - DNA, 22 bp, Artificial Sequence
  chemically synthesized
actctataatgaagcctgtttc

SEQ ID NO: 646895 - DNA, 22 bp, Artificial Sequence
  chemically synthesized
tataatgaagcctgtttccctg

SEQ ID NO: 646896 - DNA, 22 bp, Artificial Sequence
  chemically synthesized
taatgaagcctgtttccctgcc

SEQ ID NO: 646897 - DNA, 22 bp, Artificial Sequence
  chemically synthesized
agagcagcagggaacacagcta

SEQ ID NO: 646898 - DNA, 22 bp, Artificial Sequence
  chemically synthesized
tttccctgccatagctgtgttc

SEQ ID NO: 646899 - DNA, 22 bp, Artificial Sequence
  chemically synthesized
ccctgccatagctgtgttccct

SEQ ID NO: 646900 - DNA, 22 bp, Artificial Sequence
  chemically synthesized
cctgccatagctgtgttccctg

SEQ ID NO: 646901 - DNA, 22 bp, Artificial Sequence
  chemically synthesized
ccatagctgtgttccctgctgc

SEQ ID NO: 646902 - DNA, 22 bp, Artificial Sequence
  chemically synthesized
tgttccctgctgctcttagcac

SEQ ID NO: 646903 - DNA, 22 bp, Artificial Sequence
  chemically synthesized
cctgctgctcttagcaccgctc

SEQ ID NO: 646904 - DNA, 22 bp, Artificial Sequence
  chemically synthesized
aggacggagatagagcggtgct

SEQ ID NO: 646905 - DNA, 22 bp, Artificial Sequence
  chemically synthesized
aaggacggagatagagcggtgc

SEQ ID NO: 646906 - DNA, 22 bp, Artificial Sequence
  chemically synthesized
taaggacggagatagagcggtg

SEQ ID NO: 646907 - DNA, 22 bp, Artificial Sequence
  chemically synthesized
ctgctcttagcaccgctctatc

SEQ ID NO: 646908 - DNA, 22 bp, Artificial Sequence
  chemically synthesized
ctcttagcaccgctctatctcc

SEQ ID NO: 646909 - DNA, 22 bp, Artificial Sequence
  chemically synthesized
aactttaaggacggagatagag

SEQ ID NO: 646910 - DNA, 22 bp, Artificial Sequence
  chemically synthesized
ttagcaccgctctatctccgtc

SEQ ID NO: 646911 - DNA, 22 bp, Artificial Sequence
  chemically synthesized
ttaaactttaaggacggagata

SEQ ID NO: 646912 - DNA, 22 bp, Artificial Sequence
  chemically synthesized
agcaccgctctatctccgtcct

SEQ ID NO: 646913 - DNA, 22 bp, Artificial Sequence
  chemically synthesized
gcaccgctctatctccgtcctt

SEQ ID NO: 646914 - DNA, 22 bp, Artificial Sequence
  chemically synthesized
tatctccgtccttaaagtttaa

SEQ ID NO: 646915 - DNA, 22 bp, Artificial Sequence
  chemically synthesized
tctccgtccttaaagtttaaca

SEQ ID NO: 646916 - DNA, 22 bp, Artificial Sequence
  chemically synthesized
cgtccttaaagtttaacagggt

SEQ ID NO: 646917 - DNA, 22 bp, Artificial Sequence
  chemically synthesized
gcaggatgataagccaaccctg

SEQ ID NO: 646918 - DNA, 22 bp, Artificial Sequence
  chemically synthesized
aaagtttaacagggttggctta

SEQ ID NO: 646919 - DNA, 22 bp, Artificial Sequence
  chemically synthesized
ttagcaggatgataagccaacc

SEQ ID NO: 646920 - DNA, 22 bp, Artificial Sequence
  chemically synthesized
aagtttaacagggttggcttat

SEQ ID NO: 646921 - DNA, 22 bp, Artificial Sequence
  chemically synthesized
aacagggttggcttatcatcct

SEQ ID NO: 646922 - DNA, 22 bp, Artificial Sequence
  chemically synthesized
caggttgttagcaggatgataa

SEQ ID NO: 646923 - DNA, 22 bp, Artificial Sequence
  chemically synthesized
acagggttggcttatcatcctg

SEQ ID NO: 646924 - DNA, 22 bp, Artificial Sequence
  chemically synthesized
aggttgcaggttgttagcagga

SEQ ID NO: 646925 - DNA, 22 bp, Artificial Sequence
  chemically synthesized
gcttatcatcctgctaacaacc

SEQ ID NO: 646926 - DNA, 22 bp, Artificial Sequence
  chemically synthesized
atcatcctgctaacaacctgca

SEQ ID NO: 646927 - DNA, 22 bp, Artificial Sequence
  chemically synthesized
tcatcctgctaacaacctgcaa

SEQ ID NO: 646928 - DNA, 22 bp, Artificial Sequence
  chemically synthesized
ctaacaacctgcaacctgaatt

SEQ ID NO: 646929 - DNA, 22 bp, Artificial Sequence
  chemically synthesized
acaacctgcaacctgaattggt

SEQ ID NO: 646930 - DNA, 22 bp, Artificial Sequence
  chemically synthesized
cagaggagaagtaccaattcag

SEQ ID NO: 646931 - DNA, 22 bp, Artificial Sequence
  chemically synthesized
ccagaggagaagtaccaattca

SEQ ID NO: 646932 - DNA, 22 bp, Artificial Sequence
  chemically synthesized
caacctgaattggtacttctcc

SEQ ID NO: 646933 - DNA, 22 bp, Artificial Sequence
  chemically synthesized
tgaagagtttccagaggagaag

SEQ ID NO: 646934 - DNA, 22 bp, Artificial Sequence
  chemically synthesized
atgaagagtttccagaggagaa

SEQ ID NO: 646935 - DNA, 22 bp, Artificial Sequence
  chemically synthesized
aattggtacttctcctctggaa

SEQ ID NO: 646936 - DNA, 22 bp, Artificial Sequence
  chemically synthesized
gtacttctcctctggaaactct

SEQ ID NO: 646937 - DNA, 22 bp, Artificial Sequence
  chemically synthesized
ctcctctggaaactcttcataa

SEQ ID NO: 646938 - DNA, 22 bp, Artificial Sequence
  chemically synthesized
tcctctggaaactcttcataag

SEQ ID NO: 646939 - DNA, 22 bp, Artificial Sequence
  chemically synthesized
ctctggaaactcttcataagat

SEQ ID NO: 646940 - DNA, 22 bp, Artificial Sequence
  chemically synthesized
tggaaactcttcataagattgc

SEQ ID NO: 646941 - DNA, 22 bp, Artificial Sequence
  chemically synthesized
gaaactcttcataagattgcct

SEQ ID NO: 646942 - DNA, 22 bp, Artificial Sequence
  chemically synthesized
acaagataaataaagtgaggca

SEQ ID NO: 646943 - DNA, 22 bp, Artificial Sequence
  chemically synthesized
cacaagataaataaagtgaggc

SEQ ID NO: 646944 - DNA, 22 bp, Artificial Sequence
  chemically synthesized
ttcataagattgcctcacttta

SEQ ID NO: 646945 - DNA, 22 bp, Artificial Sequence
  chemically synthesized
cataagattgcctcactttatt

SEQ ID NO: 646946 - DNA, 22 bp, Artificial Sequence
  chemically synthesized
ataagattgcctcactttattt

SEQ ID NO: 646947 - DNA, 22 bp, Artificial Sequence
  chemically synthesized
gcatcttcacaagataaataaa

SEQ ID NO: 646948 - DNA, 22 bp, Artificial Sequence
  chemically synthesized
agcatcttcacaagataaataa

SEQ ID NO: 646949 - DNA, 22 bp, Artificial Sequence
  chemically synthesized
cctcactttatttatcttgtga

SEQ ID NO: 646950 - DNA, 22 bp, Artificial Sequence
  chemically synthesized
tgatttagcatcttcacaagat

SEQ ID NO: 646951 - DNA, 22 bp, Artificial Sequence
  chemically synthesized
gtgatttagcatcttcacaaga

SEQ ID NO: 646952 - DNA, 22 bp, Artificial Sequence
  chemically synthesized
tgtgatttagcatcttcacaag

SEQ ID NO: 646953 - DNA, 22 bp, Artificial Sequence
  chemically synthesized
actttatttatcttgtgaagat

SEQ ID NO: 646954 - DNA, 22 bp, Artificial Sequence
  chemically synthesized
ttgtgatttagcatcttcacaa

SEQ ID NO: 646955 - DNA, 22 bp, Artificial Sequence
  chemically synthesized
tatttatcttgtgaagatgcta

SEQ ID NO: 646956 - DNA, 22 bp, Artificial Sequence
  chemically synthesized
atttatcttgtgaagatgctaa

SEQ ID NO: 646957 - DNA, 22 bp, Artificial Sequence
  chemically synthesized
tttatcttgtgaagatgctaaa

SEQ ID NO: 646958 - DNA, 22 bp, Artificial Sequence
  chemically synthesized
atcttgtgaagatgctaaatca

SEQ ID NO: 646959 - DNA, 22 bp, Artificial Sequence
  chemically synthesized
tcttgtgaagatgctaaatcac

SEQ ID NO: 646960 - DNA, 22 bp, Artificial Sequence
  chemically synthesized
gtgaagatgctaaatcacaaaa

SEQ ID NO: 646961 - DNA, 22 bp, Artificial Sequence
  chemically synthesized
tgaagatgctaaatcacaaaaa

SEQ ID NO: 646962 - DNA, 22 bp, Artificial Sequence
  chemically synthesized
agaaatccaaagaagtagattt

SEQ ID NO: 646963 - DNA, 22 bp, Artificial Sequence
  chemically synthesized
cagaaatccaaagaagtagatt

SEQ ID NO: 646964 - DNA, 22 bp, Artificial Sequence
  chemically synthesized
aatcacaaaaatctacttcttt

SEQ ID NO: 646965 - DNA, 22 bp, Artificial Sequence
  chemically synthesized
cttcagaaatccaaagaagtag

SEQ ID NO: 646966 - DNA, 22 bp, Artificial Sequence
  chemically synthesized
ccttcagaaatccaaagaagta

SEQ ID NO: 646967 - DNA, 22 bp, Artificial Sequence
  chemically synthesized
tccttcagaaatccaaagaagt

SEQ ID NO: 646968 - DNA, 22 bp, Artificial Sequence
  chemically synthesized
ggcattttccttcagaaatcca

SEQ ID NO: 646969 - DNA, 22 bp, Artificial Sequence
  chemically synthesized
gttgggcattttccttcagaaa

SEQ ID NO: 646970 - DNA, 22 bp, Artificial Sequence
  chemically synthesized
cttctttggatttctgaaggaa

SEQ ID NO: 646971 - DNA, 22 bp, Artificial Sequence
  chemically synthesized
ctttggatttctgaaggaaaat

SEQ ID NO: 646972 - DNA, 22 bp, Artificial Sequence
  chemically synthesized
tttggatttctgaaggaaaatg

SEQ ID NO: 646973 - DNA, 22 bp, Artificial Sequence
  chemically synthesized
tggatttctgaaggaaaatgcc

SEQ ID NO: 646974 - DNA, 22 bp, Artificial Sequence
  chemically synthesized
ggatttctgaaggaaaatgccc

SEQ ID NO: 646975 - DNA, 22 bp, Artificial Sequence
  chemically synthesized
gatttctgaaggaaaatgccca

SEQ ID NO: 646976 - DNA, 22 bp, Artificial Sequence
  chemically synthesized
ctgaaggaaaatgcccaactaa

SEQ ID NO: 646977 - DNA, 22 bp, Artificial Sequence
  chemically synthesized
acatatggtaggttagttgggc

SEQ ID NO: 646978 - DNA, 22 bp, Artificial Sequence
  chemically synthesized
tgaaggaaaatgcccaactaac

SEQ ID NO: 646979 - DNA, 22 bp, Artificial Sequence
  chemically synthesized
aaggaaaatgcccaactaacct

SEQ ID NO: 646980 - DNA, 22 bp, Artificial Sequence
  chemically synthesized
ttcacatatggtaggttagttg

SEQ ID NO: 646981 - DNA, 22 bp, Artificial Sequence
  chemically synthesized
gtatagcatggctattcacata

SEQ ID NO: 646982 - DNA, 22 bp, Artificial Sequence
  chemically synthesized
ggtatagcatggctattcacat

SEQ ID NO: 646983 - DNA, 22 bp, Artificial Sequence
  chemically synthesized
acctaccatatgtgaatagcca

SEQ ID NO: 646984 - DNA, 22 bp, Artificial Sequence
  chemically synthesized
ccatatgtgaatagccatgcta

SEQ ID NO: 646985 - DNA, 22 bp, Artificial Sequence
  chemically synthesized
atggggagtggaaacgtgatct

SEQ ID NO: 646986 - DNA, 22 bp, Artificial Sequence
  chemically synthesized
cactcatggggagtggaaacgt

SEQ ID NO: 646987 - DNA, 22 bp, Artificial Sequence
  chemically synthesized
taccaagatcacgtttccactc

SEQ ID NO: 646988 - DNA, 22 bp, Artificial Sequence
  chemically synthesized
tccactcatggggagtggaaac

SEQ ID NO: 646989 - DNA, 22 bp, Artificial Sequence
  chemically synthesized
ctccactcatggggagtggaaa

SEQ ID NO: 646990 - DNA, 22 bp, Artificial Sequence
  chemically synthesized
tctccactcatggggagtggaa

SEQ ID NO: 646991 - DNA, 22 bp, Artificial Sequence
  chemically synthesized
ttttctccactcatggggagtg

SEQ ID NO: 646992 - DNA, 22 bp, Artificial Sequence
  chemically synthesized
agtactattttctccactcatg

SEQ ID NO: 646993 - DNA, 22 bp, Artificial Sequence
  chemically synthesized
ccactccccatgagtggagaaa

SEQ ID NO: 646994 - DNA, 22 bp, Artificial Sequence
  chemically synthesized
cactccccatgagtggagaaaa

SEQ ID NO: 646995 - DNA, 22 bp, Artificial Sequence
  chemically synthesized
cccatgagtggagaaaatagta

SEQ ID NO: 646996 - DNA, 22 bp, Artificial Sequence
  chemically synthesized
aagtcatggctaagtactattt

SEQ ID NO: 646997 - DNA, 22 bp, Artificial Sequence
  chemically synthesized
aaagtcatggctaagtactatt

SEQ ID NO: 646998 - DNA, 22 bp, Artificial Sequence
  chemically synthesized
taaagtcatggctaagtactat

SEQ ID NO: 646999 - DNA, 22 bp, Artificial Sequence
  chemically synthesized
attttaaagtcatggctaagta

SEQ ID NO: 647000 - DNA, 22 bp, Artificial Sequence
  chemically synthesized
aagggataggatattaatttta

SEQ ID NO: 647001 - DNA, 22 bp, Artificial Sequence
  chemically synthesized
agccatgactttaaaattaata

SEQ ID NO: 647002 - DNA, 22 bp, Artificial Sequence
  chemically synthesized
aaagggataggatattaatttt

SEQ ID NO: 647003 - DNA, 22 bp, Artificial Sequence
  chemically synthesized
gccatgactttaaaattaatat

SEQ ID NO: 647004 - DNA, 22 bp, Artificial Sequence
  chemically synthesized
ccagatatttaaagggatagga

SEQ ID NO: 647005 - DNA, 22 bp, Artificial Sequence
  chemically synthesized
taaaattaatatcctatccctt

SEQ ID NO: 647006 - DNA, 22 bp, Artificial Sequence
  chemically synthesized
aaaattaatatcctatcccttt

SEQ ID NO: 647007 - DNA, 22 bp, Artificial Sequence
  chemically synthesized
aaattaatatcctatcccttta

SEQ ID NO: 647008 - DNA, 22 bp, Artificial Sequence
  chemically synthesized
atatcctatccctttaaatatc

SEQ ID NO: 647009 - DNA, 22 bp, Artificial Sequence
  chemically synthesized
accaaacctgccagatatttaa

SEQ ID NO: 647010 - DNA, 22 bp, Artificial Sequence
  chemically synthesized
gaccaaacctgccagatattta

SEQ ID NO: 647011 - DNA, 22 bp, Artificial Sequence
  chemically synthesized
tgaccaaacctgccagatattt

SEQ ID NO: 647012 - DNA, 22 bp, Artificial Sequence
  chemically synthesized
tccctttaaatatctggcaggt

SEQ ID NO: 647013 - DNA, 22 bp, Artificial Sequence
  chemically synthesized
atctttgaccaaacctgccaga

SEQ ID NO: 647014 - DNA, 22 bp, Artificial Sequence
  chemically synthesized
aatctttgaccaaacctgccag

SEQ ID NO: 647015 - DNA, 22 bp, Artificial Sequence
  chemically synthesized
taaatatctggcaggtttggtc

SEQ ID NO: 647016 - DNA, 22 bp, Artificial Sequence
  chemically synthesized
aaatatctggcaggtttggtca

SEQ ID NO: 647017 - DNA, 22 bp, Artificial Sequence
  chemically synthesized
aatatctggcaggtttggtcaa

SEQ ID NO: 647018 - DNA, 22 bp, Artificial Sequence
  chemically synthesized
tagtaatgcttaatctttgacc

SEQ ID NO: 647019 - DNA, 22 bp, Artificial Sequence
  chemically synthesized
atagtaatgcttaatctttgac

SEQ ID NO: 647020 - DNA, 22 bp, Artificial Sequence
  chemically synthesized
gcaggtttggtcaaagattaag

SEQ ID NO: 647021 - DNA, 22 bp, Artificial Sequence
  chemically synthesized
ggtcaaagattaagcattacta

SEQ ID NO: 647022 - DNA, 22 bp, Artificial Sequence
  chemically synthesized
gtcaaagattaagcattactat

SEQ ID NO: 647023 - DNA, 22 bp, Artificial Sequence
  chemically synthesized
cagagtcccaagtatttatagt

SEQ ID NO: 647024 - DNA, 22 bp, Artificial Sequence
  chemically synthesized
agcattactataaatacttggg

SEQ ID NO: 647025 - DNA, 22 bp, Artificial Sequence
  chemically synthesized
caaattgcagagtcccaagtat

SEQ ID NO: 647026 - DNA, 22 bp, Artificial Sequence
  chemically synthesized
ctataaatacttgggactctgc

SEQ ID NO: 647027 - DNA, 22 bp, Artificial Sequence
  chemically synthesized
taaatacttgggactctgcaat

SEQ ID NO: 647028 - DNA, 22 bp, Artificial Sequence
  chemically synthesized
ataccatatgattacaaattgc

SEQ ID NO: 647029 - DNA, 22 bp, Artificial Sequence
  chemically synthesized
cataccatatgattacaaattg

SEQ ID NO: 647030 - DNA, 22 bp, Artificial Sequence
  chemically synthesized
gggactctgcaatttgtaatca

SEQ ID NO: 647031 - DNA, 22 bp, Artificial Sequence
  chemically synthesized
tttcataccatatgattacaaa

SEQ ID NO: 647032 - DNA, 22 bp, Artificial Sequence
  chemically synthesized
ggactctgcaatttgtaatcat

SEQ ID NO: 647033 - DNA, 22 bp, Artificial Sequence
  chemically synthesized
atttcataccatatgattacaa

SEQ ID NO: 647034 - DNA, 22 bp, Artificial Sequence
  chemically synthesized
aacttatttcataccatatgat

SEQ ID NO: 647035 - DNA, 22 bp, Artificial Sequence
  chemically synthesized
tgcaatttgtaatcatatggta

SEQ ID NO: 647036 - DNA, 22 bp, Artificial Sequence
  chemically synthesized
gaacttatttcataccatatga

SEQ ID NO: 647037 - DNA, 22 bp, Artificial Sequence
  chemically synthesized
caatttgtaatcatatggtatg

SEQ ID NO: 647038 - DNA, 22 bp, Artificial Sequence
  chemically synthesized
tttgaacttatttcataccata

SEQ ID NO: 647039 - DNA, 22 bp, Artificial Sequence
  chemically synthesized
atttgaacttatttcataccat

SEQ ID NO: 647040 - DNA, 22 bp, Artificial Sequence
  chemically synthesized
ttatttgaacttatttcatacc

SEQ ID NO: 647041 - DNA, 22 bp, Artificial Sequence
  chemically synthesized
gtaatcatatggtatgaaataa

SEQ ID NO: 647042 - DNA, 22 bp, Artificial Sequence
  chemically synthesized
taatcatatggtatgaaataag

SEQ ID NO: 647043 - DNA, 22 bp, Artificial Sequence
  chemically synthesized
ctcttatttgaacttatttcat

SEQ ID NO: 647044 - DNA, 22 bp, Artificial Sequence
  chemically synthesized
actcttatttgaacttatttca

SEQ ID NO: 647045 - DNA, 22 bp, Artificial Sequence
  chemically synthesized
ccttactcttatttgaacttat

SEQ ID NO: 647046 - DNA, 22 bp, Artificial Sequence
  chemically synthesized
gccttactcttatttgaactta

SEQ ID NO: 647047 - DNA, 22 bp, Artificial Sequence
  chemically synthesized
aaataagagtaaggcaaactat

SEQ ID NO: 647048 - DNA, 22 bp, Artificial Sequence
  chemically synthesized
agagtagcaaaaatagtttgcc

SEQ ID NO: 647049 - DNA, 22 bp, Artificial Sequence
  chemically synthesized
gtattcagagtagcaaaaatag

SEQ ID NO: 647050 - DNA, 22 bp, Artificial Sequence
  chemically synthesized
ttagtattcagagtagcaaaaa

SEQ ID NO: 647051 - DNA, 22 bp, Artificial Sequence
  chemically synthesized
gcattattagtattcagagtag

SEQ ID NO: 647052 - DNA, 22 bp, Artificial Sequence
  chemically synthesized
tggcattattagtattcagagt

SEQ ID NO: 647053 - DNA, 22 bp, Artificial Sequence
  chemically synthesized
tttttgctactctgaatactaa

SEQ ID NO: 647054 - DNA, 22 bp, Artificial Sequence
  chemically synthesized
ttgctactctgaatactaataa

SEQ ID NO: 647055 - DNA, 22 bp, Artificial Sequence
  chemically synthesized
tgctactctgaatactaataat

SEQ ID NO: 647056 - DNA, 22 bp, Artificial Sequence
  chemically synthesized
gctactctgaatactaataatg

SEQ ID NO: 647057 - DNA, 22 bp, Artificial Sequence
  chemically synthesized
ctactctgaatactaataatgc

SEQ ID NO: 647058 - DNA, 22 bp, Artificial Sequence
  chemically synthesized
atccaaattctggcattattag

SEQ ID NO: 647059 - DNA, 22 bp, Artificial Sequence
  chemically synthesized
ctctgaatactaataatgccag

SEQ ID NO: 647060 - DNA, 22 bp, Artificial Sequence
  chemically synthesized
tgaatactaataatgccagaat

SEQ ID NO: 647061 - DNA, 22 bp, Artificial Sequence
  chemically synthesized
aatactaataatgccagaattt

SEQ ID NO: 647062 - DNA, 22 bp, Artificial Sequence
  chemically synthesized
ataatgccagaatttggatgag

SEQ ID NO: 647063 - DNA, 22 bp, Artificial Sequence
  chemically synthesized
gcatggaatgagctcatccaaa

SEQ ID NO: 647064 - DNA, 22 bp, Artificial Sequence
  chemically synthesized
atgccctggcatggaatgagct

SEQ ID NO: 647065 - DNA, 22 bp, Artificial Sequence
  chemically synthesized
aatgccctggcatggaatgagc

SEQ ID NO: 647066 - DNA, 22 bp, Artificial Sequence
  chemically synthesized
ttaatgccctggcatggaatga

SEQ ID NO: 647067 - DNA, 22 bp, Artificial Sequence
  chemically synthesized
ggatgagctcattccatgccag

SEQ ID NO: 647068 - DNA, 22 bp, Artificial Sequence
  chemically synthesized
attcttaatgccctggcatgga

SEQ ID NO: 647069 - DNA, 22 bp, Artificial Sequence
  chemically synthesized
gatgagctcattccatgccagg

SEQ ID NO: 647070 - DNA, 22 bp, Artificial Sequence
  chemically synthesized
aattcttaatgccctggcatgg

SEQ ID NO: 647071 - DNA, 22 bp, Artificial Sequence
  chemically synthesized
taattcttaatgccctggcatg

SEQ ID NO: 647072 - DNA, 22 bp, Artificial Sequence
  chemically synthesized
ctttaattcttaatgccctggc

SEQ ID NO: 647073 - DNA, 22 bp, Artificial Sequence
  chemically synthesized
cctttaattcttaatgccctgg

SEQ ID NO: 647074 - DNA, 22 bp, Artificial Sequence
  chemically synthesized
tcctttaattcttaatgccctg

SEQ ID NO: 647075 - DNA, 22 bp, Artificial Sequence
  chemically synthesized
ttcctttaattcttaatgccct

SEQ ID NO: 647076 - DNA, 22 bp, Artificial Sequence
  chemically synthesized
tttcctttaattcttaatgccc

SEQ ID NO: 647077 - DNA, 22 bp, Artificial Sequence
  chemically synthesized
attccatgccagggcattaaga

SEQ ID NO: 647078 - DNA, 22 bp, Artificial Sequence
  chemically synthesized
ttttcctttaattcttaatgcc

SEQ ID NO: 647079 - DNA, 22 bp, Artificial Sequence
  chemically synthesized
cttttttcctttaattcttaat

SEQ ID NO: 647080 - DNA, 22 bp, Artificial Sequence
  chemically synthesized
catgccagggcattaagaatta

SEQ ID NO: 647081 - DNA, 22 bp, Artificial Sequence
  chemically synthesized
acttttttcctttaattcttaa

SEQ ID NO: 647082 - DNA, 22 bp, Artificial Sequence
  chemically synthesized
atttacttttttcctttaattc

SEQ ID NO: 647083 - DNA, 22 bp, Artificial Sequence
  chemically synthesized
agaattaaaggaaaaaagtaaa

SEQ ID NO: 647084 - DNA, 22 bp, Artificial Sequence
  chemically synthesized
aggagccattcatttacttttt

SEQ ID NO: 647085 - DNA, 22 bp, Artificial Sequence
  chemically synthesized
aaggagccattcatttactttt

SEQ ID NO: 647086 - DNA, 22 bp, Artificial Sequence
  chemically synthesized
taaggagccattcatttacttt

SEQ ID NO: 647087 - DNA, 22 bp, Artificial Sequence
  chemically synthesized
ttaaggagccattcatttactt

SEQ ID NO: 647088 - DNA, 22 bp, Artificial Sequence
  chemically synthesized
aaggaaaaaagtaaatgaatgg

SEQ ID NO: 647089 - DNA, 22 bp, Artificial Sequence
  chemically synthesized
atcttttaaggagccattcatt

SEQ ID NO: 647090 - DNA, 22 bp, Artificial Sequence
  chemically synthesized
gatcttttaaggagccattcat

SEQ ID NO: 647091 - DNA, 22 bp, Artificial Sequence
  chemically synthesized
atttgatcttttaaggagccat

SEQ ID NO: 647092 - DNA, 22 bp, Artificial Sequence
  chemically synthesized
gcatcatattcatttgatcttt

SEQ ID NO: 647093 - DNA, 22 bp, Artificial Sequence
  chemically synthesized
cttaaaagatcaaatgaatatg

SEQ ID NO: 647094 - DNA, 22 bp, Artificial Sequence
  chemically synthesized
aaaagatcaaatgaatatgatg

SEQ ID NO: 647095 - DNA, 22 bp, Artificial Sequence
  chemically synthesized
aaagatcaaatgaatatgatgc

SEQ ID NO: 647096 - DNA, 22 bp, Artificial Sequence
  chemically synthesized
gaggtaggatagcacaggatat

SEQ ID NO: 647097 - DNA, 22 bp, Artificial Sequence
  chemically synthesized
agaggtaggatagcacaggata

SEQ ID NO: 647098 - DNA, 22 bp, Artificial Sequence
  chemically synthesized
attcctatatcctgtgctatcc

SEQ ID NO: 647099 - DNA, 22 bp, Artificial Sequence
  chemically synthesized
agggatttagaggtaggatagc

SEQ ID NO: 647100 - DNA, 22 bp, Artificial Sequence
  chemically synthesized
ctatatcctgtgctatcctacc

SEQ ID NO: 647101 - DNA, 22 bp, Artificial Sequence
  chemically synthesized
gagggatttagaggtaggatag

SEQ ID NO: 647102 - DNA, 22 bp, Artificial Sequence
  chemically synthesized
tgagggatttagaggtaggata

SEQ ID NO: 647103 - DNA, 22 bp, Artificial Sequence
  chemically synthesized
tatcctgtgctatcctacctct

SEQ ID NO: 647104 - DNA, 22 bp, Artificial Sequence
  chemically synthesized
ctttgagggatttagaggtagg

SEQ ID NO: 647105 - DNA, 22 bp, Artificial Sequence
  chemically synthesized
tgctatcctacctctaaatccc

SEQ ID NO: 647106 - DNA, 22 bp, Artificial Sequence
  chemically synthesized
tcctacctctaaatccctcaaa

SEQ ID NO: 647107 - DNA, 22 bp, Artificial Sequence
  chemically synthesized
acaatgaaattgctttgaggga

SEQ ID NO: 647108 - DNA, 22 bp, Artificial Sequence
  chemically synthesized
ctgacaatgaaattgctttgag

SEQ ID NO: 647109 - DNA, 22 bp, Artificial Sequence
  chemically synthesized
cctctaaatccctcaaagcaat

SEQ ID NO: 647110 - DNA, 22 bp, Artificial Sequence
  chemically synthesized
taaatccctcaaagcaatttca

SEQ ID NO: 647111 - DNA, 22 bp, Artificial Sequence
  chemically synthesized
aatccctcaaagcaatttcatt

SEQ ID NO: 647112 - DNA, 22 bp, Artificial Sequence
  chemically synthesized
caaaatgttcctgacaatgaaa

SEQ ID NO: 647113 - DNA, 22 bp, Artificial Sequence
  chemically synthesized
acaaaatgttcctgacaatgaa

SEQ ID NO: 647114 - DNA, 22 bp, Artificial Sequence
  chemically synthesized
tacaaaatgttcctgacaatga

SEQ ID NO: 647115 - DNA, 22 bp, Artificial Sequence
  chemically synthesized
ttacaaaatgttcctgacaatg

SEQ ID NO: 647116 - DNA, 22 bp, Artificial Sequence
  chemically synthesized
tttacaaaatgttcctgacaat

SEQ ID NO: 647117 - DNA, 22 bp, Artificial Sequence
  chemically synthesized
aaagcaatttcattgtcaggaa

SEQ ID NO: 647118 - DNA, 22 bp, Artificial Sequence
  chemically synthesized
tttttacaaaatgttcctgaca

SEQ ID NO: 647119 - DNA, 22 bp, Artificial Sequence
  chemically synthesized
cattgtcaggaacattttgtaa

SEQ ID NO: 647120 - DNA, 22 bp, Artificial Sequence
  chemically synthesized
attgtcaggaacattttgtaaa

SEQ ID NO: 647121 - DNA, 22 bp, Artificial Sequence
  chemically synthesized
tcaggaacattttgtaaaaaga

SEQ ID NO: 647122 - DNA, 22 bp, Artificial Sequence
  chemically synthesized
tgtaaaaagagatgggatactt

SEQ ID NO: 647123 - DNA, 22 bp, Artificial Sequence
  chemically synthesized
atgagagcatgtaagtatccca

SEQ ID NO: 647124 - DNA, 22 bp, Artificial Sequence
  chemically synthesized
gtaaaaagagatgggatactta

SEQ ID NO: 647125 - DNA, 22 bp, Artificial Sequence
  chemically synthesized
taaaaagagatgggatacttac

SEQ ID NO: 647126 - DNA, 22 bp, Artificial Sequence
  chemically synthesized
ctaatgagagcatgtaagtatc

SEQ ID NO: 647127 - DNA, 22 bp, Artificial Sequence
  chemically synthesized
tcctaatgagagcatgtaagta

SEQ ID NO: 647128 - DNA, 22 bp, Artificial Sequence
  chemically synthesized
aatgatagcatctctcctaatg

SEQ ID NO: 647129 - DNA, 22 bp, Artificial Sequence
  chemically synthesized
acatgctctcattaggagagat

SEQ ID NO: 647130 - DNA, 22 bp, Artificial Sequence
  chemically synthesized
catgctctcattaggagagatg

SEQ ID NO: 647131 - DNA, 22 bp, Artificial Sequence
  chemically synthesized
tctaaatgatagcatctctcct

SEQ ID NO: 647132 - DNA, 22 bp, Artificial Sequence
  chemically synthesized
atctaaatgatagcatctctcc

SEQ ID NO: 647133 - DNA, 22 bp, Artificial Sequence
  chemically synthesized
tcattaggagagatgctatcat

SEQ ID NO: 647134 - DNA, 22 bp, Artificial Sequence
  chemically synthesized
attaggagagatgctatcattt

SEQ ID NO: 647135 - DNA, 22 bp, Artificial Sequence
  chemically synthesized
ggagagatgctatcatttagat

SEQ ID NO: 647136 - DNA, 22 bp, Artificial Sequence
  chemically synthesized
tcatttagataagatccattgc

SEQ ID NO: 647137 - DNA, 22 bp, Artificial Sequence
  chemically synthesized
gcagaaatggaaaacagcaatg

SEQ ID NO: 647138 - DNA, 22 bp, Artificial Sequence
  chemically synthesized
agataagatccattgctgtttt

SEQ ID NO: 647139 - DNA, 22 bp, Artificial Sequence
  chemically synthesized
gataagatccattgctgttttc

SEQ ID NO: 647140 - DNA, 22 bp, Artificial Sequence
  chemically synthesized
tcaggctagcagaaatggaaaa

SEQ ID NO: 647141 - DNA, 22 bp, Artificial Sequence
  chemically synthesized
atcaggctagcagaaatggaaa

SEQ ID NO: 647142 - DNA, 22 bp, Artificial Sequence
  chemically synthesized
tatcaggctagcagaaatggaa

SEQ ID NO: 647143 - DNA, 22 bp, Artificial Sequence
  chemically synthesized
ttatcaggctagcagaaatgga

SEQ ID NO: 647144 - DNA, 22 bp, Artificial Sequence
  chemically synthesized
tttatcaggctagcagaaatgg

SEQ ID NO: 647145 - DNA, 22 bp, Artificial Sequence
  chemically synthesized
ctgttttccatttctgctagcc

SEQ ID NO: 647146 - DNA, 22 bp, Artificial Sequence
  chemically synthesized
cgttttttatcaggctagcaga

SEQ ID NO: 647147 - DNA, 22 bp, Artificial Sequence
  chemically synthesized
acgttttttatcaggctagcag

SEQ ID NO: 647148 - DNA, 22 bp, Artificial Sequence
  chemically synthesized
tacgttttttatcaggctagca

SEQ ID NO: 647149 - DNA, 22 bp, Artificial Sequence
  chemically synthesized
ttttccatttctgctagcctga

SEQ ID NO: 647150 - DNA, 22 bp, Artificial Sequence
  chemically synthesized
ttacgttttttatcaggctagc

SEQ ID NO: 647151 - DNA, 22 bp, Artificial Sequence
  chemically synthesized
tccatttctgctagcctgataa

SEQ ID NO: 647152 - DNA, 22 bp, Artificial Sequence
  chemically synthesized
ccatttctgctagcctgataaa

SEQ ID NO: 647153 - DNA, 22 bp, Artificial Sequence
  chemically synthesized
catttctgctagcctgataaaa

SEQ ID NO: 647154 - DNA, 22 bp, Artificial Sequence
  chemically synthesized
atgagcttttacgttttttatc

SEQ ID NO: 647155 - DNA, 22 bp, Artificial Sequence
  chemically synthesized
aatgagcttttacgttttttat

SEQ ID NO: 647156 - DNA, 22 bp, Artificial Sequence
  chemically synthesized
ctgctagcctgataaaaaacgt

SEQ ID NO: 647157 - DNA, 22 bp, Artificial Sequence
  chemically synthesized
taatgagcttttacgtttttta

SEQ ID NO: 647158 - DNA, 22 bp, Artificial Sequence
  chemically synthesized
tgctagcctgataaaaaacgta

SEQ ID NO: 647159 - DNA, 22 bp, Artificial Sequence
  chemically synthesized
ctagcctgataaaaaacgtaaa

SEQ ID NO: 647160 - DNA, 22 bp, Artificial Sequence
  chemically synthesized
gcctgataaaaaacgtaaaagc

SEQ ID NO: 647161 - DNA, 22 bp, Artificial Sequence
  chemically synthesized
ataaaaaacgtaaaagctcatt

SEQ ID NO: 647162 - DNA, 22 bp, Artificial Sequence
  chemically synthesized
agacgtcacataagttttaatg

SEQ ID NO: 647163 - DNA, 22 bp, Artificial Sequence
  chemically synthesized
taagacgtcacataagttttaa

SEQ ID NO: 647164 - DNA, 22 bp, Artificial Sequence
  chemically synthesized
aatagattctaagacgtcacat

SEQ ID NO: 647165 - DNA, 22 bp, Artificial Sequence
  chemically synthesized
gaatagattctaagacgtcaca

SEQ ID NO: 647166 - DNA, 22 bp, Artificial Sequence
  chemically synthesized
attaaaacttatgtgacgtctt

SEQ ID NO: 647167 - DNA, 22 bp, Artificial Sequence
  chemically synthesized
aaacttatgtgacgtcttagaa

SEQ ID NO: 647168 - DNA, 22 bp, Artificial Sequence
  chemically synthesized
ggtcttgaatagattctaagac

SEQ ID NO: 647169 - DNA, 22 bp, Artificial Sequence
  chemically synthesized
atgtgacgtcttagaatctatt

SEQ ID NO: 647170 - DNA, 22 bp, Artificial Sequence
  chemically synthesized
gattaggtcttgaatagattct

SEQ ID NO: 647171 - DNA, 22 bp, Artificial Sequence
  chemically synthesized
tgtgacgtcttagaatctattc

SEQ ID NO: 647172 - DNA, 22 bp, Artificial Sequence
  chemically synthesized
aggaatgttcgattaggtcttg

SEQ ID NO: 647173 - DNA, 22 bp, Artificial Sequence
  chemically synthesized
caggaatgttcgattaggtctt

SEQ ID NO: 647174 - DNA, 22 bp, Artificial Sequence
  chemically synthesized
agaatctattcaagacctaatc

SEQ ID NO: 647175 - DNA, 22 bp, Artificial Sequence
  chemically synthesized
tcaggaatgttcgattaggtct

SEQ ID NO: 647176 - DNA, 22 bp, Artificial Sequence
  chemically synthesized
gaatctattcaagacctaatcg

SEQ ID NO: 647177 - DNA, 22 bp, Artificial Sequence
  chemically synthesized
gttttcaggaatgttcgattag

SEQ ID NO: 647178 - DNA, 22 bp, Artificial Sequence
  chemically synthesized
agttttcaggaatgttcgatta

SEQ ID NO: 647179 - DNA, 22 bp, Artificial Sequence
  chemically synthesized
tagttttcaggaatgttcgatt

SEQ ID NO: 647180 - DNA, 22 bp, Artificial Sequence
  chemically synthesized
ttcaagacctaatcgaacattc

SEQ ID NO: 647181 - DNA, 22 bp, Artificial Sequence
  chemically synthesized
aagacctaatcgaacattcctg

SEQ ID NO: 647182 - DNA, 22 bp, Artificial Sequence
  chemically synthesized
tcctttagttttcaggaatgtt

SEQ ID NO: 647183 - DNA, 22 bp, Artificial Sequence
  chemically synthesized
atcctttagttttcaggaatgt

SEQ ID NO: 647184 - DNA, 22 bp, Artificial Sequence
  chemically synthesized
atcgaacattcctgaaaactaa

SEQ ID NO: 647185 - DNA, 22 bp, Artificial Sequence
  chemically synthesized
ccatgatttatcctttagtttt

SEQ ID NO: 647186 - DNA, 22 bp, Artificial Sequence
  chemically synthesized
gccatgatttatcctttagttt

SEQ ID NO: 647187 - DNA, 22 bp, Artificial Sequence
  chemically synthesized
ttgccatgatttatcctttagt

SEQ ID NO: 647188 - DNA, 22 bp, Artificial Sequence
  chemically synthesized
cttgccatgatttatcctttag

SEQ ID NO: 647189 - DNA, 22 bp, Artificial Sequence
  chemically synthesized
ttcttgccatgatttatccttt

SEQ ID NO: 647190 - DNA, 22 bp, Artificial Sequence
  chemically synthesized
tcttcttgccatgatttatcct

SEQ ID NO: 647191 - DNA, 22 bp, Artificial Sequence
  chemically synthesized
ctgaaaactaaaggataaatca

SEQ ID NO: 647192 - DNA, 22 bp, Artificial Sequence
  chemically synthesized
ctcttcttgccatgatttatcc

SEQ ID NO: 647193 - DNA, 22 bp, Artificial Sequence
  chemically synthesized
tctcttcttgccatgatttatc

SEQ ID NO: 647194 - DNA, 22 bp, Artificial Sequence
  chemically synthesized
aaaactaaaggataaatcatgg

SEQ ID NO: 647195 - DNA, 22 bp, Artificial Sequence
  chemically synthesized
ctttctcttcttgccatgattt

SEQ ID NO: 647196 - DNA, 22 bp, Artificial Sequence
  chemically synthesized
aaggataaatcatggcaagaag

SEQ ID NO: 647197 - DNA, 22 bp, Artificial Sequence
  chemically synthesized
aaggattcctttctcttcttgc

SEQ ID NO: 647198 - DNA, 22 bp, Artificial Sequence
  chemically synthesized
gaaggattcctttctcttcttg

SEQ ID NO: 647199 - DNA, 22 bp, Artificial Sequence
  chemically synthesized
atttgaaggattcctttctctt

SEQ ID NO: 647200 - DNA, 22 bp, Artificial Sequence
  chemically synthesized
aatttgaaggattcctttctct

SEQ ID NO: 647201 - DNA, 22 bp, Artificial Sequence
  chemically synthesized
taatttgaaggattcctttctc

SEQ ID NO: 647202 - DNA, 22 bp, Artificial Sequence
  chemically synthesized
agccaacacacacatcctttaa

SEQ ID NO: 647203 - DNA, 22 bp, Artificial Sequence
  chemically synthesized
caaattaaaggatgtgtgtgtt

SEQ ID NO: 647204 - DNA, 22 bp, Artificial Sequence
  chemically synthesized
aaattaaaggatgtgtgtgttg

SEQ ID NO: 647205 - DNA, 22 bp, Artificial Sequence
  chemically synthesized
aaatggttaagccaacacacac

SEQ ID NO: 647206 - DNA, 22 bp, Artificial Sequence
  chemically synthesized
cctcaaatggttaagccaacac

SEQ ID NO: 647207 - DNA, 22 bp, Artificial Sequence
  chemically synthesized
aaggatgtgtgtgttggcttaa

SEQ ID NO: 647208 - DNA, 22 bp, Artificial Sequence
  chemically synthesized
ccacacactgcctcaaatggtt

SEQ ID NO: 647209 - DNA, 22 bp, Artificial Sequence
  chemically synthesized
tggtctaccacacactgcctca

SEQ ID NO: 647210 - DNA, 22 bp, Artificial Sequence
  chemically synthesized
gcttaaccatttgaggcagtgt

SEQ ID NO: 647211 - DNA, 22 bp, Artificial Sequence
  chemically synthesized
gctgtggtctaccacacactgc

SEQ ID NO: 647212 - DNA, 22 bp, Artificial Sequence
  chemically synthesized
aaccatttgaggcagtgtgtgg

SEQ ID NO: 647213 - DNA, 22 bp, Artificial Sequence
  chemically synthesized
accatttgaggcagtgtgtggt

SEQ ID NO: 647214 - DNA, 22 bp, Artificial Sequence
  chemically synthesized
actagctgtggtctaccacaca

SEQ ID NO: 647215 - DNA, 22 bp, Artificial Sequence
  chemically synthesized
ctaactagctgtggtctaccac

SEQ ID NO: 647216 - DNA, 22 bp, Artificial Sequence
  chemically synthesized
gaggcagtgtgtggtagaccac

SEQ ID NO: 647217 - DNA, 22 bp, Artificial Sequence
  chemically synthesized
aggcagtgtgtggtagaccaca

SEQ ID NO: 647218 - DNA, 22 bp, Artificial Sequence
  chemically synthesized
tcataaatgtagtgctactaac

SEQ ID NO: 647219 - DNA, 22 bp, Artificial Sequence
  chemically synthesized
tatcataaatgtagtgctacta

SEQ ID NO: 647220 - DNA, 22 bp, Artificial Sequence
  chemically synthesized
ctatcataaatgtagtgctact

SEQ ID NO: 647221 - DNA, 22 bp, Artificial Sequence
  chemically synthesized
gaatttctatcataaatgtagt

SEQ ID NO: 647222 - DNA, 22 bp, Artificial Sequence
  chemically synthesized
agaatttctatcataaatgtag

SEQ ID NO: 647223 - DNA, 22 bp, Artificial Sequence
  chemically synthesized
gttagtagcactacatttatga

SEQ ID NO: 647224 - DNA, 22 bp, Artificial Sequence
  chemically synthesized
cttagaatttctatcataaatg

SEQ ID NO: 647225 - DNA, 22 bp, Artificial Sequence
  chemically synthesized
ccttagaatttctatcataaat

SEQ ID NO: 647226 - DNA, 22 bp, Artificial Sequence
  chemically synthesized
tccttagaatttctatcataaa

SEQ ID NO: 647227 - DNA, 22 bp, Artificial Sequence
  chemically synthesized
gtagcactacatttatgataga

SEQ ID NO: 647228 - DNA, 22 bp, Artificial Sequence
  chemically synthesized
catttatgatagaaattctaag

SEQ ID NO: 647229 - DNA, 22 bp, Artificial Sequence
  chemically synthesized
atgatagaaattctaaggaaag

SEQ ID NO: 647230 - DNA, 22 bp, Artificial Sequence
  chemically synthesized
tgatagaaattctaaggaaagt

SEQ ID NO: 647231 - DNA, 22 bp, Artificial Sequence
  chemically synthesized
tagggggaaaacagtgaaatat

SEQ ID NO: 647232 - DNA, 22 bp, Artificial Sequence
  chemically synthesized
taaggaaagttatatttcactg

SEQ ID NO: 647233 - DNA, 22 bp, Artificial Sequence
  chemically synthesized
aggaaagttatatttcactgtt

SEQ ID NO: 647234 - DNA, 22 bp, Artificial Sequence
  chemically synthesized
atctgtagggggaaaacagtga

SEQ ID NO: 647235 - DNA, 22 bp, Artificial Sequence
  chemically synthesized
tatttcactgttttccccctac

SEQ ID NO: 647236 - DNA, 22 bp, Artificial Sequence
  chemically synthesized
cactgttttccccctacagatc

SEQ ID NO: 647237 - DNA, 22 bp, Artificial Sequence
  chemically synthesized
actgttttccccctacagatca

SEQ ID NO: 647238 - DNA, 22 bp, Artificial Sequence
  chemically synthesized
agtgaaagcaagactgatctgt

SEQ ID NO: 647239 - DNA, 22 bp, Artificial Sequence
  chemically synthesized
ttttccccctacagatcagtct

SEQ ID NO: 647240 - DNA, 22 bp, Artificial Sequence
  chemically synthesized
tcagtgaaagcaagactgatct

SEQ ID NO: 647241 - DNA, 22 bp, Artificial Sequence
  chemically synthesized
tccccctacagatcagtcttgc

SEQ ID NO: 647242 - DNA, 22 bp, Artificial Sequence
  chemically synthesized
ttctcagtgaaagcaagactga

SEQ ID NO: 647243 - DNA, 22 bp, Artificial Sequence
  chemically synthesized
ccccctacagatcagtcttgct

SEQ ID NO: 647244 - DNA, 22 bp, Artificial Sequence
  chemically synthesized
cccctacagatcagtcttgctt

SEQ ID NO: 647245 - DNA, 22 bp, Artificial Sequence
  chemically synthesized
cagatcagtcttgctttcactg

SEQ ID NO: 647246 - DNA, 22 bp, Artificial Sequence
  chemically synthesized
aaaacaaagacctgttctcagt

SEQ ID NO: 647247 - DNA, 22 bp, Artificial Sequence
  chemically synthesized
tgaaaacaaagacctgttctca

SEQ ID NO: 647248 - DNA, 22 bp, Artificial Sequence
  chemically synthesized
ctgaaaacaaagacctgttctc

SEQ ID NO: 647249 - DNA, 22 bp, Artificial Sequence
  chemically synthesized
ttctgaaaacaaagacctgttc

SEQ ID NO: 647250 - DNA, 22 bp, Artificial Sequence
  chemically synthesized
gctttcactgagaacaggtctt

SEQ ID NO: 647251 - DNA, 22 bp, Artificial Sequence
  chemically synthesized
cttctgaaaacaaagacctgtt

SEQ ID NO: 647252 - DNA, 22 bp, Artificial Sequence
  chemically synthesized
ctttcactgagaacaggtcttt

SEQ ID NO: 647253 - DNA, 22 bp, Artificial Sequence
  chemically synthesized
tcttctgaaaacaaagacctgt

SEQ ID NO: 647254 - DNA, 22 bp, Artificial Sequence
  chemically synthesized
ttcttctgaaaacaaagacctg

SEQ ID NO: 647255 - DNA, 22 bp, Artificial Sequence
  chemically synthesized
tcactgagaacaggtctttgtt

SEQ ID NO: 647256 - DNA, 22 bp, Artificial Sequence
  chemically synthesized
cactgagaacaggtctttgttt

SEQ ID NO: 647257 - DNA, 22 bp, Artificial Sequence
  chemically synthesized
actgagaacaggtctttgtttt

SEQ ID NO: 647258 - DNA, 22 bp, Artificial Sequence
  chemically synthesized
agaacaggtctttgttttcaga

SEQ ID NO: 647259 - DNA, 22 bp, Artificial Sequence
  chemically synthesized
gggaagcttttcttctgaaaac

SEQ ID NO: 647260 - DNA, 22 bp, Artificial Sequence
  chemically synthesized
ttagggaagcttttcttctgaa

SEQ ID NO: 647261 - DNA, 22 bp, Artificial Sequence
  chemically synthesized
ttgttagggaagcttttcttct

SEQ ID NO: 647262 - DNA, 22 bp, Artificial Sequence
  chemically synthesized
attgttagggaagcttttcttc

SEQ ID NO: 647263 - DNA, 22 bp, Artificial Sequence
  chemically synthesized
tgttttcagaagaaaagcttcc

SEQ ID NO: 647264 - DNA, 22 bp, Artificial Sequence
  chemically synthesized
gttttcagaagaaaagcttccc

SEQ ID NO: 647265 - DNA, 22 bp, Artificial Sequence
  chemically synthesized
ttttcagaagaaaagcttccct

SEQ ID NO: 647266 - DNA, 22 bp, Artificial Sequence
  chemically synthesized
tcagaagaaaagcttccctaac

SEQ ID NO: 647267 - DNA, 22 bp, Artificial Sequence
  chemically synthesized
cagaagaaaagcttccctaaca

SEQ ID NO: 647268 - DNA, 22 bp, Artificial Sequence
  chemically synthesized
agaagaaaagcttccctaacaa

SEQ ID NO: 647269 - DNA, 22 bp, Artificial Sequence
  chemically synthesized
ccctaacaataagtgcactccc

SEQ ID NO: 647270 - DNA, 22 bp, Artificial Sequence
  chemically synthesized
cctaacaataagtgcactccct

SEQ ID NO: 647271 - DNA, 22 bp, Artificial Sequence
  chemically synthesized
acaataagtgcactccctacct

SEQ ID NO: 647272 - DNA, 22 bp, Artificial Sequence
  chemically synthesized
aaagacaaggggtagtgtaagg

SEQ ID NO: 647273 - DNA, 22 bp, Artificial Sequence
  chemically synthesized
tcctaaaagacaaggggtagtg

SEQ ID NO: 647274 - DNA, 22 bp, Artificial Sequence
  chemically synthesized
cctaccttacactaccccttgt

SEQ ID NO: 647275 - DNA, 22 bp, Artificial Sequence
  chemically synthesized
ccttacactaccccttgtcttt

SEQ ID NO: 647276 - DNA, 22 bp, Artificial Sequence
  chemically synthesized
acactaccccttgtcttttagg

SEQ ID NO: 647277 - DNA, 22 bp, Artificial Sequence
  chemically synthesized
cactaccccttgtcttttagga

SEQ ID NO: 647278 - DNA, 22 bp, Artificial Sequence
  chemically synthesized
ccccttgtcttttaggacaatt

SEQ ID NO: 647279 - DNA, 22 bp, Artificial Sequence
  chemically synthesized
gtcttttaggacaattactact

SEQ ID NO: 647280 - DNA, 22 bp, Artificial Sequence
  chemically synthesized
tcatcagtggaaagtagtaatt

SEQ ID NO: 647281 - DNA, 22 bp, Artificial Sequence
  chemically synthesized
tcttttaggacaattactactt

SEQ ID NO: 647282 - DNA, 22 bp, Artificial Sequence
  chemically synthesized
ttaggacaattactactttcca

SEQ ID NO: 647283 - DNA, 22 bp, Artificial Sequence
  chemically synthesized
taggacaattactactttccac

SEQ ID NO: 647284 - DNA, 22 bp, Artificial Sequence
  chemically synthesized
aggacaattactactttccact

SEQ ID NO: 647285 - DNA, 22 bp, Artificial Sequence
  chemically synthesized
ggacaattactactttccactg

SEQ ID NO: 647286 - DNA, 22 bp, Artificial Sequence
  chemically synthesized
tgtaagtctgtcatcagtggaa

SEQ ID NO: 647287 - DNA, 22 bp, Artificial Sequence
  chemically synthesized
gctgtgtaagtctgtcatcagt

SEQ ID NO: 647288 - DNA, 22 bp, Artificial Sequence
  chemically synthesized
ctactttccactgatgacagac

SEQ ID NO: 647289 - DNA, 22 bp, Artificial Sequence
  chemically synthesized
gctagctgtgtaagtctgtcat

SEQ ID NO: 647290 - DNA, 22 bp, Artificial Sequence
  chemically synthesized
ctttccactgatgacagactta

SEQ ID NO: 647291 - DNA, 22 bp, Artificial Sequence
  chemically synthesized
tccactgatgacagacttacac

SEQ ID NO: 647292 - DNA, 22 bp, Artificial Sequence
  chemically synthesized
ccactgatgacagacttacaca

SEQ ID NO: 647293 - DNA, 22 bp, Artificial Sequence
  chemically synthesized
cactgatgacagacttacacag

SEQ ID NO: 647294 - DNA, 22 bp, Artificial Sequence
  chemically synthesized
atgacagacttacacagctagc

SEQ ID NO: 647295 - DNA, 22 bp, Artificial Sequence
  chemically synthesized
ccaatcgtgaaaagcattagct

SEQ ID NO: 647296 - DNA, 22 bp, Artificial Sequence
  chemically synthesized
accaatcgtgaaaagcattagc

SEQ ID NO: 647297 - DNA, 22 bp, Artificial Sequence
  chemically synthesized
acacagctagctaatgcttttc

SEQ ID NO: 647298 - DNA, 22 bp, Artificial Sequence
  chemically synthesized
cacagctagctaatgcttttca

SEQ ID NO: 647299 - DNA, 22 bp, Artificial Sequence
  chemically synthesized
gacatgtttaccaatcgtgaaa

SEQ ID NO: 647300 - DNA, 22 bp, Artificial Sequence
  chemically synthesized
gctaatgcttttcacgattggt

SEQ ID NO: 647301 - DNA, 22 bp, Artificial Sequence
  chemically synthesized
ctggacatgtttaccaatcgtg

SEQ ID NO: 647302 - DNA, 22 bp, Artificial Sequence
  chemically synthesized
atgcttttcacgattggtaaac

SEQ ID NO: 647303 - DNA, 22 bp, Artificial Sequence
  chemically synthesized
actgctggacatgtttaccaat

SEQ ID NO: 647304 - DNA, 22 bp, Artificial Sequence
  chemically synthesized
taactgctggacatgtttacca

SEQ ID NO: 647305 - DNA, 22 bp, Artificial Sequence
  chemically synthesized
ttcacgattggtaaacatgtcc

SEQ ID NO: 647306 - DNA, 22 bp, Artificial Sequence
  chemically synthesized
tcacgattggtaaacatgtcca

SEQ ID NO: 647307 - DNA, 22 bp, Artificial Sequence
  chemically synthesized
cacgattggtaaacatgtccag

SEQ ID NO: 647308 - DNA, 22 bp, Artificial Sequence
  chemically synthesized
acgattggtaaacatgtccagc

SEQ ID NO: 647309 - DNA, 22 bp, Artificial Sequence
  chemically synthesized
tcaatattctaactgctggaca

SEQ ID NO: 647310 - DNA, 22 bp, Artificial Sequence
  chemically synthesized
gtcaatattctaactgctggac

SEQ ID NO: 647311 - DNA, 22 bp, Artificial Sequence
  chemically synthesized
tgtcaatattctaactgctgga

SEQ ID NO: 647312 - DNA, 22 bp, Artificial Sequence
  chemically synthesized
gtaaacatgtccagcagttaga

SEQ ID NO: 647313 - DNA, 22 bp, Artificial Sequence
  chemically synthesized
tgcatccatcctttgtcaatat

SEQ ID NO: 647314 - DNA, 22 bp, Artificial Sequence
  chemically synthesized
ctgtgcatccatcctttgtcaa

SEQ ID NO: 647315 - DNA, 22 bp, Artificial Sequence
  chemically synthesized
actgtgcatccatcctttgtca

SEQ ID NO: 647316 - DNA, 22 bp, Artificial Sequence
  chemically synthesized
gaatattgacaaaggatggatg

SEQ ID NO: 647317 - DNA, 22 bp, Artificial Sequence
  chemically synthesized
gagagcttactgtgcatccatc

SEQ ID NO: 647318 - DNA, 22 bp, Artificial Sequence
  chemically synthesized
agagagcttactgtgcatccat

SEQ ID NO: 647319 - DNA, 22 bp, Artificial Sequence
  chemically synthesized
acaaaggatggatgcacagtaa

SEQ ID NO: 647320 - DNA, 22 bp, Artificial Sequence
  chemically synthesized
gtggcagaatgtttagagagct

SEQ ID NO: 647321 - DNA, 22 bp, Artificial Sequence
  chemically synthesized
aaggtaaaaattggtggcagaa

SEQ ID NO: 647322 - DNA, 22 bp, Artificial Sequence
  chemically synthesized
aaaggtaaaaattggtggcaga

SEQ ID NO: 647323 - DNA, 22 bp, Artificial Sequence
  chemically synthesized
taaaggtaaaaattggtggcag

SEQ ID NO: 647324 - DNA, 22 bp, Artificial Sequence
  chemically synthesized
tctaaacattctgccaccaatt

SEQ ID NO: 647325 - DNA, 22 bp, Artificial Sequence
  chemically synthesized
taaacattctgccaccaatttt

SEQ ID NO: 647326 - DNA, 22 bp, Artificial Sequence
  chemically synthesized
aacattctgccaccaattttta

SEQ ID NO: 647327 - DNA, 22 bp, Artificial Sequence
  chemically synthesized
tgccaccaatttttacctttaa

SEQ ID NO: 647328 - DNA, 22 bp, Artificial Sequence
  chemically synthesized
ccaccaatttttacctttaaaa

SEQ ID NO: 647329 - DNA, 22 bp, Artificial Sequence
  chemically synthesized
aggtgaagaagattttaaaggt

SEQ ID NO: 647330 - DNA, 22 bp, Artificial Sequence
  chemically synthesized
cctgaggtgaagaagattttaa

SEQ ID NO: 647331 - DNA, 22 bp, Artificial Sequence
  chemically synthesized
ttacctttaaaatcttcttcac

SEQ ID NO: 647332 - DNA, 22 bp, Artificial Sequence
  chemically synthesized
tacctttaaaatcttcttcacc

SEQ ID NO: 647333 - DNA, 22 bp, Artificial Sequence
  chemically synthesized
acctttaaaatcttcttcacct

SEQ ID NO: 647334 - DNA, 22 bp, Artificial Sequence
  chemically synthesized
tataattgcctgaggtgaagaa

SEQ ID NO: 647335 - DNA, 22 bp, Artificial Sequence
  chemically synthesized
cctttaaaatcttcttcacctc

SEQ ID NO: 647336 - DNA, 22 bp, Artificial Sequence
  chemically synthesized
taaaatcttcttcacctcaggc

SEQ ID NO: 647337 - DNA, 22 bp, Artificial Sequence
  chemically synthesized
aaaatcttcttcacctcaggca

SEQ ID NO: 647338 - DNA, 22 bp, Artificial Sequence
  chemically synthesized
aaatcttcttcacctcaggcaa

SEQ ID NO: 647339 - DNA, 22 bp, Artificial Sequence
  chemically synthesized
cttcacctcaggcaattataca

SEQ ID NO: 647340 - DNA, 22 bp, Artificial Sequence
  chemically synthesized
ttcacctcaggcaattatacag

SEQ ID NO: 647341 - DNA, 22 bp, Artificial Sequence
  chemically synthesized
cacctcaggcaattatacaggg

SEQ ID NO: 647342 - DNA, 22 bp, Artificial Sequence
  chemically synthesized
acctcaggcaattatacagggg

SEQ ID NO: 647343 - DNA, 22 bp, Artificial Sequence
  chemically synthesized
aggcaattatacagggggtttt

SEQ ID NO: 647344 - DNA, 22 bp, Artificial Sequence
  chemically synthesized
tacagggggttttttgtttgtt

SEQ ID NO: 647345 - DNA, 22 bp, Artificial Sequence
  chemically synthesized
taaaaaaacaaacaaacaaaca

SEQ ID NO: 647346 - DNA, 22 bp, Artificial Sequence
  chemically synthesized
gttgtaaaaaaacaaacaaaca

SEQ ID NO: 647347 - DNA, 22 bp, Artificial Sequence
  chemically synthesized
agttgtaaaaaaacaaacaaac

SEQ ID NO: 647348 - DNA, 22 bp, Artificial Sequence
  chemically synthesized
tttgtttgtttgtttgtttgtt

SEQ ID NO: 647349 - DNA, 22 bp, Artificial Sequence
  chemically synthesized
tagttgtaaaaaaacaaacaaa

SEQ ID NO: 647350 - DNA, 22 bp, Artificial Sequence
  chemically synthesized
ttgtttgtttgtttgtttgttt

SEQ ID NO: 647351 - DNA, 22 bp, Artificial Sequence
  chemically synthesized
ttagttgtaaaaaaacaaacaa

SEQ ID NO: 647352 - DNA, 22 bp, Artificial Sequence
  chemically synthesized
tgtttgtttgtttgtttgtttt

SEQ ID NO: 647353 - DNA, 22 bp, Artificial Sequence
  chemically synthesized
tttagttgtaaaaaaacaaaca

SEQ ID NO: 647354 - DNA, 22 bp, Artificial Sequence
  chemically synthesized
gtttgtttgtttgtttgttttt

SEQ ID NO: 647355 - DNA, 22 bp, Artificial Sequence
  chemically synthesized
ttttagttgtaaaaaaacaaac

SEQ ID NO: 647356 - DNA, 22 bp, Artificial Sequence
  chemically synthesized
tttgtttgtttgtttgtttttt

SEQ ID NO: 647357 - DNA, 22 bp, Artificial Sequence
  chemically synthesized
gtttgtttgtttgtttttttac

SEQ ID NO: 647358 - DNA, 22 bp, Artificial Sequence
  chemically synthesized
acttttttagttgtaaaaaaac

SEQ ID NO: 647359 - DNA, 22 bp, Artificial Sequence
  chemically synthesized
tttgtttgtttgtttttttaca

SEQ ID NO: 647360 - DNA, 22 bp, Artificial Sequence
  chemically synthesized
gtttgtttgtttttttacaact

SEQ ID NO: 647361 - DNA, 22 bp, Artificial Sequence
  chemically synthesized
gttaacttttttagttgtaaaa

SEQ ID NO: 647362 - DNA, 22 bp, Artificial Sequence
  chemically synthesized
tttgtttgtttttttacaacta

SEQ ID NO: 647363 - DNA, 22 bp, Artificial Sequence
  chemically synthesized
ggttaacttttttagttgtaaa

SEQ ID NO: 647364 - DNA, 22 bp, Artificial Sequence
  chemically synthesized
gtttgtttttttacaactaaaa

SEQ ID NO: 647365 - DNA, 22 bp, Artificial Sequence
  chemically synthesized
tttgtttttttacaactaaaaa

SEQ ID NO: 647366 - DNA, 22 bp, Artificial Sequence
  chemically synthesized
gtttttttacaactaaaaaagt

SEQ ID NO: 647367 - DNA, 22 bp, Artificial Sequence
  chemically synthesized
tttttttacaactaaaaaagtt

SEQ ID NO: 647368 - DNA, 22 bp, Artificial Sequence
  chemically synthesized
ttttacaactaaaaaagttaac

SEQ ID NO: 647369 - DNA, 22 bp, Artificial Sequence
  chemically synthesized
tttacaactaaaaaagttaacc

SEQ ID NO: 647370 - DNA, 22 bp, Artificial Sequence
  chemically synthesized
ttacaactaaaaaagttaacca

SEQ ID NO: 647371 - DNA, 22 bp, Artificial Sequence
  chemically synthesized
tacaactaaaaaagttaaccaa

SEQ ID NO: 647372 - DNA, 22 bp, Artificial Sequence
  chemically synthesized
acaactaaaaaagttaaccaaa

SEQ ID NO: 647373 - DNA, 22 bp, Artificial Sequence
  chemically synthesized
aatccgtaagagtttggttaac

SEQ ID NO: 647374 - DNA, 22 bp, Artificial Sequence
  chemically synthesized
caactaaaaaagttaaccaaac

SEQ ID NO: 647375 - DNA, 22 bp, Artificial Sequence
  chemically synthesized
ttaaatccgtaagagtttggtt

SEQ ID NO: 647376 - DNA, 22 bp, Artificial Sequence
  chemically synthesized
gttaaatccgtaagagtttggt

SEQ ID NO: 647377 - DNA, 22 bp, Artificial Sequence
  chemically synthesized
aaaaagttaaccaaactcttac

SEQ ID NO: 647378 - DNA, 22 bp, Artificial Sequence
  chemically synthesized
tgcttgttaaatccgtaagagt

SEQ ID NO: 647379 - DNA, 22 bp, Artificial Sequence
  chemically synthesized
atgcttgttaaatccgtaagag

SEQ ID NO: 647380 - DNA, 22 bp, Artificial Sequence
  chemically synthesized
tatgcttgttaaatccgtaaga

SEQ ID NO: 647381 - DNA, 22 bp, Artificial Sequence
  chemically synthesized
accaaactcttacggatttaac

SEQ ID NO: 647382 - DNA, 22 bp, Artificial Sequence
  chemically synthesized
aaatattttatgcttgttaaat

SEQ ID NO: 647383 - DNA, 22 bp, Artificial Sequence
  chemically synthesized
aaaatattttatgcttgttaaa

SEQ ID NO: 647384 - DNA, 22 bp, Artificial Sequence
  chemically synthesized
taaaatattttatgcttgttaa

SEQ ID NO: 647385 - DNA, 22 bp, Artificial Sequence
  chemically synthesized
ttacggatttaacaagcataaa

SEQ ID NO: 647386 - DNA, 22 bp, Artificial Sequence
  chemically synthesized
attttaaaatattttatgcttg

SEQ ID NO: 647387 - DNA, 22 bp, Artificial Sequence
  chemically synthesized
acggatttaacaagcataaaat

SEQ ID NO: 647388 - DNA, 22 bp, Artificial Sequence
  chemically synthesized
cggatttaacaagcataaaata

SEQ ID NO: 647389 - DNA, 22 bp, Artificial Sequence
  chemically synthesized
ctaattttaaaatattttatgc

SEQ ID NO: 647390 - DNA, 22 bp, Artificial Sequence
  chemically synthesized
aattactaattttaaaatattt

SEQ ID NO: 647391 - DNA, 22 bp, Artificial Sequence
  chemically synthesized
aacaagcataaaatattttaaa

SEQ ID NO: 647392 - DNA, 22 bp, Artificial Sequence
  chemically synthesized
acaagcataaaatattttaaaa

SEQ ID NO: 647393 - DNA, 22 bp, Artificial Sequence
  chemically synthesized
aaaactgaattactaattttaa

SEQ ID NO: 647394 - DNA, 22 bp, Artificial Sequence
  chemically synthesized
tacctaaaaactgaattactaa

SEQ ID NO: 647395 - DNA, 22 bp, Artificial Sequence
  chemically synthesized
atacctaaaaactgaattacta

SEQ ID NO: 647396 - DNA, 22 bp, Artificial Sequence
  chemically synthesized
tatacctaaaaactgaattact

SEQ ID NO: 647397 - DNA, 22 bp, Artificial Sequence
  chemically synthesized
ttatacctaaaaactgaattac

SEQ ID NO: 647398 - DNA, 22 bp, Artificial Sequence
  chemically synthesized
taaaattagtaattcagttttt

SEQ ID NO: 647399 - DNA, 22 bp, Artificial Sequence
  chemically synthesized
aaaattagtaattcagttttta

SEQ ID NO: 647400 - DNA, 22 bp, Artificial Sequence
  chemically synthesized
aaattagtaattcagtttttag

SEQ ID NO: 647401 - DNA, 22 bp, Artificial Sequence
  chemically synthesized
agatgatttttatacctaaaaa

SEQ ID NO: 647402 - DNA, 22 bp, Artificial Sequence
  chemically synthesized
gagatgatttttatacctaaaa

SEQ ID NO: 647403 - DNA, 22 bp, Artificial Sequence
  chemically synthesized
gtaattcagtttttaggtataa

SEQ ID NO: 647404 - DNA, 22 bp, Artificial Sequence
  chemically synthesized
tgtttgagatgatttttatacc

SEQ ID NO: 647405 - DNA, 22 bp, Artificial Sequence
  chemically synthesized
gtgtttgagatgatttttatac

SEQ ID NO: 647406 - DNA, 22 bp, Artificial Sequence
  chemically synthesized
tgtgtttgagatgatttttata

SEQ ID NO: 647407 - DNA, 22 bp, Artificial Sequence
  chemically synthesized
agtttttaggtataaaaatcat

SEQ ID NO: 647408 - DNA, 22 bp, Artificial Sequence
  chemically synthesized
tttgtgtttgagatgattttta

SEQ ID NO: 647409 - DNA, 22 bp, Artificial Sequence
  chemically synthesized
ctttgtgtttgagatgattttt

SEQ ID NO: 647410 - DNA, 22 bp, Artificial Sequence
  chemically synthesized
ttaggtataaaaatcatctcaa

SEQ ID NO: 647411 - DNA, 22 bp, Artificial Sequence
  chemically synthesized
taggtataaaaatcatctcaaa

SEQ ID NO: 647412 - DNA, 22 bp, Artificial Sequence
  chemically synthesized
accttctttgtgtttgagatga

SEQ ID NO: 647413 - DNA, 22 bp, Artificial Sequence
  chemically synthesized
aggtataaaaatcatctcaaac

SEQ ID NO: 647414 - DNA, 22 bp, Artificial Sequence
  chemically synthesized
ggtataaaaatcatctcaaaca

SEQ ID NO: 647415 - DNA, 22 bp, Artificial Sequence
  chemically synthesized
tctcaccttctttgtgtttgag

SEQ ID NO: 647416 - DNA, 22 bp, Artificial Sequence
  chemically synthesized
tgtctcaccttctttgtgtttg

SEQ ID NO: 647417 - DNA, 22 bp, Artificial Sequence
  chemically synthesized
ctgtctcaccttctttgtgttt

SEQ ID NO: 647418 - DNA, 22 bp, Artificial Sequence
  chemically synthesized
tctgtctcaccttctttgtgtt

SEQ ID NO: 647419 - DNA, 22 bp, Artificial Sequence
  chemically synthesized
ttctgtctcaccttctttgtgt

SEQ ID NO: 647420 - DNA, 22 bp, Artificial Sequence
  chemically synthesized
gacttttctgtctcaccttctt

SEQ ID NO: 647421 - DNA, 22 bp, Artificial Sequence
  chemically synthesized
ggacttttctgtctcaccttct

SEQ ID NO: 647422 - DNA, 22 bp, Artificial Sequence
  chemically synthesized
aaacacaaagaaggtgagacag

SEQ ID NO: 647423 - DNA, 22 bp, Artificial Sequence
  chemically synthesized
atccttggacttttctgtctca

SEQ ID NO: 647424 - DNA, 22 bp, Artificial Sequence
  chemically synthesized
ctaatccttggacttttctgtc

SEQ ID NO: 647425 - DNA, 22 bp, Artificial Sequence
  chemically synthesized
cctaatccttggacttttctgt

SEQ ID NO: 647426 - DNA, 22 bp, Artificial Sequence
  chemically synthesized
tcctaatccttggacttttctg

SEQ ID NO: 647427 - DNA, 22 bp, Artificial Sequence
  chemically synthesized
attttcctaatccttggacttt

SEQ ID NO: 647428 - DNA, 22 bp, Artificial Sequence
  chemically synthesized
taaagaagagaataattaattt

SEQ ID NO: 647429 - DNA, 22 bp, Artificial Sequence
  chemically synthesized
ggaaaattaattattctcttct

SEQ ID NO: 647430 - DNA, 22 bp, Artificial Sequence
  chemically synthesized
catgatatgctgtaaagaagag

SEQ ID NO: 647431 - DNA, 22 bp, Artificial Sequence
  chemically synthesized
acatgatatgctgtaaagaaga

SEQ ID NO: 647432 - DNA, 22 bp, Artificial Sequence
  chemically synthesized
tacatgatatgctgtaaagaag

SEQ ID NO: 647433 - DNA, 22 bp, Artificial Sequence
  chemically synthesized
ttttacatgatatgctgtaaag

SEQ ID NO: 647434 - DNA, 22 bp, Artificial Sequence
  chemically synthesized
attattctcttctttacagcat

SEQ ID NO: 647435 - DNA, 22 bp, Artificial Sequence
  chemically synthesized
attttacatgatatgctgtaaa

SEQ ID NO: 647436 - DNA, 22 bp, Artificial Sequence
  chemically synthesized
ttctcttctttacagcatatca

SEQ ID NO: 647437 - DNA, 22 bp, Artificial Sequence
  chemically synthesized
tcttctttacagcatatcatgt

SEQ ID NO: 647438 - DNA, 22 bp, Artificial Sequence
  chemically synthesized
tgtatttattttacatgatatg

SEQ ID NO: 647439 - DNA, 22 bp, Artificial Sequence
  chemically synthesized
gtgtatttattttacatgatat

SEQ ID NO: 647440 - DNA, 22 bp, Artificial Sequence
  chemically synthesized
ttctttacagcatatcatgtaa

SEQ ID NO: 647441 - DNA, 22 bp, Artificial Sequence
  chemically synthesized
ctttacagcatatcatgtaaaa

SEQ ID NO: 647442 - DNA, 22 bp, Artificial Sequence
  chemically synthesized
tttacagcatatcatgtaaaat

SEQ ID NO: 647443 - DNA, 22 bp, Artificial Sequence
  chemically synthesized
cgtttgtgtatttattttacat

SEQ ID NO: 647444 - DNA, 22 bp, Artificial Sequence
  chemically synthesized
tacagcatatcatgtaaaataa

SEQ ID NO: 647445 - DNA, 22 bp, Artificial Sequence
  chemically synthesized
ccgtttgtgtatttattttaca

SEQ ID NO: 647446 - DNA, 22 bp, Artificial Sequence
  chemically synthesized
acagcatatcatgtaaaataaa

SEQ ID NO: 647447 - DNA, 22 bp, Artificial Sequence
  chemically synthesized
tccgtttgtgtatttattttac

SEQ ID NO: 647448 - DNA, 22 bp, Artificial Sequence
  chemically synthesized
cagcatatcatgtaaaataaat

SEQ ID NO: 647449 - DNA, 22 bp, Artificial Sequence
  chemically synthesized
tatggagaatatgaaagcatca

SEQ ID NO: 647450 - DNA, 22 bp, Artificial Sequence
  chemically synthesized
tattatatggagaatatgaaag

SEQ ID NO: 647451 - DNA, 22 bp, Artificial Sequence
  chemically synthesized
atgctttcatattctccatata

SEQ ID NO: 647452 - DNA, 22 bp, Artificial Sequence
  chemically synthesized
tcatattctccatataatatag

SEQ ID NO: 647453 - DNA, 22 bp, Artificial Sequence
  chemically synthesized
catattctccatataatatagt

SEQ ID NO: 647454 - DNA, 22 bp, Artificial Sequence
  chemically synthesized
atattctccatataatatagta

SEQ ID NO: 647455 - DNA, 22 bp, Artificial Sequence
  chemically synthesized
atatatgaaaaaatgatactat

SEQ ID NO: 647456 - DNA, 22 bp, Artificial Sequence
  chemically synthesized
tccatataatatagtatcattt

SEQ ID NO: 647457 - DNA, 22 bp, Artificial Sequence
  chemically synthesized
catataatatagtatcattttt

SEQ ID NO: 647458 - DNA, 22 bp, Artificial Sequence
  chemically synthesized
gaccagacattcatatatgaaa

SEQ ID NO: 647459 - DNA, 22 bp, Artificial Sequence
  chemically synthesized
ctagaccagacattcatatatg

SEQ ID NO: 647460 - DNA, 22 bp, Artificial Sequence
  chemically synthesized
gaaaactgctagaccagacatt

SEQ ID NO: 647461 - DNA, 22 bp, Artificial Sequence
  chemically synthesized
tttcatatatgaatgtctggtc

SEQ ID NO: 647462 - DNA, 22 bp, Artificial Sequence
  chemically synthesized
agaaaactgctagaccagacat

SEQ ID NO: 647463 - DNA, 22 bp, Artificial Sequence
  chemically synthesized
ttcatatatgaatgtctggtct

SEQ ID NO: 647464 - DNA, 22 bp, Artificial Sequence
  chemically synthesized
tcatatatgaatgtctggtcta

SEQ ID NO: 647465 - DNA, 22 bp, Artificial Sequence
  chemically synthesized
catatatgaatgtctggtctag

SEQ ID NO: 647466 - DNA, 22 bp, Artificial Sequence
  chemically synthesized
cttagaaaactgctagaccaga

SEQ ID NO: 647467 - DNA, 22 bp, Artificial Sequence
  chemically synthesized
atatatgaatgtctggtctagc

SEQ ID NO: 647468 - DNA, 22 bp, Artificial Sequence
  chemically synthesized
acctccttagaaaactgctaga

SEQ ID NO: 647469 - DNA, 22 bp, Artificial Sequence
  chemically synthesized
aacctccttagaaaactgctag

SEQ ID NO: 647470 - DNA, 22 bp, Artificial Sequence
  chemically synthesized
gtctagcagttttctaaggagg

SEQ ID NO: 647471 - DNA, 22 bp, Artificial Sequence
  chemically synthesized
caaatagtttaacctccttaga

SEQ ID NO: 647472 - DNA, 22 bp, Artificial Sequence
  chemically synthesized
acaaatagtttaacctccttag

SEQ ID NO: 647473 - DNA, 22 bp, Artificial Sequence
  chemically synthesized
gcagttttctaaggaggttaaa

SEQ ID NO: 647474 - DNA, 22 bp, Artificial Sequence
  chemically synthesized
gcttacaaatagtttaacctcc

SEQ ID NO: 647475 - DNA, 22 bp, Artificial Sequence
  chemically synthesized
aattggcttacaaatagtttaa

SEQ ID NO: 647476 - DNA, 22 bp, Artificial Sequence
  chemically synthesized
tctaaggaggttaaactatttg

SEQ ID NO: 647477 - DNA, 22 bp, Artificial Sequence
  chemically synthesized
ctaaggaggttaaactatttgt

SEQ ID NO: 647478 - DNA, 22 bp, Artificial Sequence
  chemically synthesized
ctaaattggcttacaaatagtt

SEQ ID NO: 647479 - DNA, 22 bp, Artificial Sequence
  chemically synthesized
taaggaggttaaactatttgta

SEQ ID NO: 647480 - DNA, 22 bp, Artificial Sequence
  chemically synthesized
actaaattggcttacaaatagt

SEQ ID NO: 647481 - DNA, 22 bp, Artificial Sequence
  chemically synthesized
aggaggttaaactatttgtaag

SEQ ID NO: 647482 - DNA, 22 bp, Artificial Sequence
  chemically synthesized
agcacatttactaaattggctt

SEQ ID NO: 647483 - DNA, 22 bp, Artificial Sequence
  chemically synthesized
aactatttgtaagccaatttag

SEQ ID NO: 647484 - DNA, 22 bp, Artificial Sequence
  chemically synthesized
tactgagcacatttactaaatt

SEQ ID NO: 647485 - DNA, 22 bp, Artificial Sequence
  chemically synthesized
atactgagcacatttactaaat

SEQ ID NO: 647486 - DNA, 22 bp, Artificial Sequence
  chemically synthesized
tttgtaagccaatttagtaaat

SEQ ID NO: 647487 - DNA, 22 bp, Artificial Sequence
  chemically synthesized
tatactgagcacatttactaaa

SEQ ID NO: 647488 - DNA, 22 bp, Artificial Sequence
  chemically synthesized
ttatactgagcacatttactaa

SEQ ID NO: 647489 - DNA, 22 bp, Artificial Sequence
  chemically synthesized
tttatactgagcacatttacta

SEQ ID NO: 647490 - DNA, 22 bp, Artificial Sequence
  chemically synthesized
gtaagccaatttagtaaatgtg

SEQ ID NO: 647491 - DNA, 22 bp, Artificial Sequence
  chemically synthesized
ttttatactgagcacatttact

SEQ ID NO: 647492 - DNA, 22 bp, Artificial Sequence
  chemically synthesized
taagccaatttagtaaatgtgc

SEQ ID NO: 647493 - DNA, 22 bp, Artificial Sequence
  chemically synthesized
tgtttttttatactgagcacat

SEQ ID NO: 647494 - DNA, 22 bp, Artificial Sequence
  chemically synthesized
ctatgtttttttatactgagca

SEQ ID NO: 647495 - DNA, 22 bp, Artificial Sequence
  chemically synthesized
gctatgtttttttatactgagc

SEQ ID NO: 647496 - DNA, 22 bp, Artificial Sequence
  chemically synthesized
agtaaatgtgctcagtataaaa

SEQ ID NO: 647497 - DNA, 22 bp, Artificial Sequence
  chemically synthesized
gtaaatgtgctcagtataaaaa

SEQ ID NO: 647498 - DNA, 22 bp, Artificial Sequence
  chemically synthesized
cggtagccttgctatgtttttt

SEQ ID NO: 647499 - DNA, 22 bp, Artificial Sequence
  chemically synthesized
ccggtagccttgctatgttttt

SEQ ID NO: 647500 - DNA, 22 bp, Artificial Sequence
  chemically synthesized
agtataaaaaaacatagcaagg

SEQ ID NO: 647501 - DNA, 22 bp, Artificial Sequence
  chemically synthesized
aacatttccggtagccttgcta

SEQ ID NO: 647502 - DNA, 22 bp, Artificial Sequence
  chemically synthesized
aaacatttccggtagccttgct

SEQ ID NO: 647503 - DNA, 22 bp, Artificial Sequence
  chemically synthesized
taaacatttccggtagccttgc

SEQ ID NO: 647504 - DNA, 22 bp, Artificial Sequence
  chemically synthesized
ttaaacatttccggtagccttg

SEQ ID NO: 647505 - DNA, 22 bp, Artificial Sequence
  chemically synthesized
gcttttaaacatttccggtagc

SEQ ID NO: 647506 - DNA, 22 bp, Artificial Sequence
  chemically synthesized
accctggcttttaaacatttcc

SEQ ID NO: 647507 - DNA, 22 bp, Artificial Sequence
  chemically synthesized
cctaaccctggcttttaaacat

SEQ ID NO: 647508 - DNA, 22 bp, Artificial Sequence
  chemically synthesized
ccctaaccctggcttttaaaca

SEQ ID NO: 647509 - DNA, 22 bp, Artificial Sequence
  chemically synthesized
ccggaaatgtttaaaagccagg

SEQ ID NO: 647510 - DNA, 22 bp, Artificial Sequence
  chemically synthesized
gtccagaataatcttccctaac

SEQ ID NO: 647511 - DNA, 22 bp, Artificial Sequence
  chemically synthesized
aaaagccagggttagggaagat

SEQ ID NO: 647512 - DNA, 22 bp, Artificial Sequence
  chemically synthesized
aaagccagggttagggaagatt

SEQ ID NO: 647513 - DNA, 22 bp, Artificial Sequence
  chemically synthesized
gggaagattattctggactaat

SEQ ID NO: 647514 - DNA, 22 bp, Artificial Sequence
  chemically synthesized
gtcaccaacaagagcattagtc

SEQ ID NO: 647515 - DNA, 22 bp, Artificial Sequence
  chemically synthesized
ggtcaccaacaagagcattagt

SEQ ID NO: 647516 - DNA, 22 bp, Artificial Sequence
  chemically synthesized
tggtcaccaacaagagcattag

SEQ ID NO: 647517 - DNA, 22 bp, Artificial Sequence
  chemically synthesized
ttggtcaccaacaagagcatta

SEQ ID NO: 647518 - DNA, 22 bp, Artificial Sequence
  chemically synthesized
tttttggtcaccaacaagagca

SEQ ID NO: 647519 - DNA, 22 bp, Artificial Sequence
  chemically synthesized
ttctggactaatgctcttgttg

SEQ ID NO: 647520 - DNA, 22 bp, Artificial Sequence
  chemically synthesized
tggactaatgctcttgttggtg

SEQ ID NO: 647521 - DNA, 22 bp, Artificial Sequence
  chemically synthesized
gactaatgctcttgttggtgac

SEQ ID NO: 647522 - DNA, 22 bp, Artificial Sequence
  chemically synthesized
catgttgtttttggtcaccaac

SEQ ID NO: 647523 - DNA, 22 bp, Artificial Sequence
  chemically synthesized
atgctcttgttggtgaccaaaa

SEQ ID NO: 647524 - DNA, 22 bp, Artificial Sequence
  chemically synthesized
cactgcatgttgtttttggtca

SEQ ID NO: 647525 - DNA, 22 bp, Artificial Sequence
  chemically synthesized
ttgttggtgaccaaaaacaaca

SEQ ID NO: 647526 - DNA, 22 bp, Artificial Sequence
  chemically synthesized
gttggtgaccaaaaacaacatg

SEQ ID NO: 647527 - DNA, 22 bp, Artificial Sequence
  chemically synthesized
ttggtgaccaaaaacaacatgc

SEQ ID NO: 647528 - DNA, 22 bp, Artificial Sequence
  chemically synthesized
gtgaccaaaaacaacatgcagt

SEQ ID NO: 647529 - DNA, 22 bp, Artificial Sequence
  chemically synthesized
acgtgcatgccgttccactgca

SEQ ID NO: 647530 - DNA, 22 bp, Artificial Sequence
  chemically synthesized
taacgtgcatgccgttccactg

SEQ ID NO: 647531 - DNA, 22 bp, Artificial Sequence
  chemically synthesized
ccctctaacgtgcatgccgttc

SEQ ID NO: 647532 - DNA, 22 bp, Artificial Sequence
  chemically synthesized
gccctctaacgtgcatgccgtt

SEQ ID NO: 647533 - DNA, 22 bp, Artificial Sequence
  chemically synthesized
atcaacttgccctctaacgtgc

SEQ ID NO: 647534 - DNA, 22 bp, Artificial Sequence
  chemically synthesized
ctaatcaacttgccctctaacg

SEQ ID NO: 647535 - DNA, 22 bp, Artificial Sequence
  chemically synthesized
ctactaatcaacttgccctcta

SEQ ID NO: 647536 - DNA, 22 bp, Artificial Sequence
  chemically synthesized
attcctactaatcaacttgccc

SEQ ID NO: 647537 - DNA, 22 bp, Artificial Sequence
  chemically synthesized
tctgattcctactaatcaactt

SEQ ID NO: 647538 - DNA, 22 bp, Artificial Sequence
  chemically synthesized
gtctgattcctactaatcaact

SEQ ID NO: 647539 - DNA, 22 bp, Artificial Sequence
  chemically synthesized
gagggcaagttgattagtagga

SEQ ID NO: 647540 - DNA, 22 bp, Artificial Sequence
  chemically synthesized
cccaaacttgtctgattcctac

SEQ ID NO: 647541 - DNA, 22 bp, Artificial Sequence
  chemically synthesized
ccccaaacttgtctgattccta

SEQ ID NO: 647542 - DNA, 22 bp, Artificial Sequence
  chemically synthesized
tccccaaacttgtctgattcct

SEQ ID NO: 647543 - DNA, 22 bp, Artificial Sequence
  chemically synthesized
ttccccaaacttgtctgattcc

SEQ ID NO: 647544 - DNA, 22 bp, Artificial Sequence
  chemically synthesized
tttccccaaacttgtctgattc

SEQ ID NO: 647545 - DNA, 22 bp, Artificial Sequence
  chemically synthesized
ttttccccaaacttgtctgatt

SEQ ID NO: 647546 - DNA, 22 bp, Artificial Sequence
  chemically synthesized
tttttccccaaacttgtctgat

SEQ ID NO: 647547 - DNA, 22 bp, Artificial Sequence
  chemically synthesized
attagtaggaatcagacaagtt

SEQ ID NO: 647548 - DNA, 22 bp, Artificial Sequence
  chemically synthesized
tttttttccccaaacttgtctg

SEQ ID NO: 647549 - DNA, 22 bp, Artificial Sequence
  chemically synthesized
ctttttttccccaaacttgtct

SEQ ID NO: 647550 - DNA, 22 bp, Artificial Sequence
  chemically synthesized
tctttttttccccaaacttgtc

SEQ ID NO: 647551 - DNA, 22 bp, Artificial Sequence
  chemically synthesized
ttctttttttccccaaacttgt

SEQ ID NO: 647552 - DNA, 22 bp, Artificial Sequence
  chemically synthesized
gtaggaatcagacaagtttggg

SEQ ID NO: 647553 - DNA, 22 bp, Artificial Sequence
  chemically synthesized
aacaaatcttttctttttttcc

SEQ ID NO: 647554 - DNA, 22 bp, Artificial Sequence
  chemically synthesized
aaacaaatcttttctttttttc

SEQ ID NO: 647555 - DNA, 22 bp, Artificial Sequence
  chemically synthesized
taaacaaatcttttcttttttt

SEQ ID NO: 647556 - DNA, 22 bp, Artificial Sequence
  chemically synthesized
ggggaaaaaaagaaaagatttg

SEQ ID NO: 647557 - DNA, 22 bp, Artificial Sequence
  chemically synthesized
tgatattttaaacaaatctttt

SEQ ID NO: 647558 - DNA, 22 bp, Artificial Sequence
  chemically synthesized
gggaaaaaaagaaaagatttgt

SEQ ID NO: 647559 - DNA, 22 bp, Artificial Sequence
  chemically synthesized
acctatgatattttaaacaaat

SEQ ID NO: 647560 - DNA, 22 bp, Artificial Sequence
  chemically synthesized
accaaggaaagctaacctatga

SEQ ID NO: 647561 - DNA, 22 bp, Artificial Sequence
  chemically synthesized
gtttaaaatatcataggttagc

SEQ ID NO: 647562 - DNA, 22 bp, Artificial Sequence
  chemically synthesized
tttaaaatatcataggttagct

SEQ ID NO: 647563 - DNA, 22 bp, Artificial Sequence
  chemically synthesized
aaaatatcataggttagctttc

SEQ ID NO: 647564 - DNA, 22 bp, Artificial Sequence
  chemically synthesized
aaatatcataggttagctttcc

SEQ ID NO: 647565 - DNA, 22 bp, Artificial Sequence
  chemically synthesized
aaataactaaccaaggaaagct

SEQ ID NO: 647566 - DNA, 22 bp, Artificial Sequence
  chemically synthesized
attgaaataactaaccaaggaa

SEQ ID NO: 647567 - DNA, 22 bp, Artificial Sequence
  chemically synthesized
gctttccttggttagttatttc

SEQ ID NO: 647568 - DNA, 22 bp, Artificial Sequence
  chemically synthesized
tccttggttagttatttcaatc

SEQ ID NO: 647569 - DNA, 22 bp, Artificial Sequence
  chemically synthesized
ccttggttagttatttcaatca

SEQ ID NO: 647570 - DNA, 22 bp, Artificial Sequence
  chemically synthesized
cttggttagttatttcaatcaa

SEQ ID NO: 647571 - DNA, 22 bp, Artificial Sequence
  chemically synthesized
ggttagttatttcaatcaatat

SEQ ID NO: 647572 - DNA, 22 bp, Artificial Sequence
  chemically synthesized
tatgccaggcaaatattgattg

SEQ ID NO: 647573 - DNA, 22 bp, Artificial Sequence
  chemically synthesized
gttagttatttcaatcaatatt

SEQ ID NO: 647574 - DNA, 22 bp, Artificial Sequence
  chemically synthesized
gttgtatgccaggcaaatattg

SEQ ID NO: 647575 - DNA, 22 bp, Artificial Sequence
  chemically synthesized
gttatttcaatcaatatttgcc

SEQ ID NO: 647576 - DNA, 22 bp, Artificial Sequence
  chemically synthesized
tttcaatcaatatttgcctggc

SEQ ID NO: 647577 - DNA, 22 bp, Artificial Sequence
  chemically synthesized
caatcaatatttgcctggcata

SEQ ID NO: 647578 - DNA, 22 bp, Artificial Sequence
  chemically synthesized
aatcaatatttgcctggcatac

SEQ ID NO: 647579 - DNA, 22 bp, Artificial Sequence
  chemically synthesized
gcaggtatgagactagttgtat

SEQ ID NO: 647580 - DNA, 22 bp, Artificial Sequence
  chemically synthesized
gcctggcatacaactagtctca

SEQ ID NO: 647581 - DNA, 22 bp, Artificial Sequence
  chemically synthesized
tgctagcaggtatgagactagt

SEQ ID NO: 647582 - DNA, 22 bp, Artificial Sequence
  chemically synthesized
cctggcatacaactagtctcat

SEQ ID NO: 647583 - DNA, 22 bp, Artificial Sequence
  chemically synthesized
gcatacaactagtctcatacct

SEQ ID NO: 647584 - DNA, 22 bp, Artificial Sequence
  chemically synthesized
aacattatgctagcaggtatga

SEQ ID NO: 647585 - DNA, 22 bp, Artificial Sequence
  chemically synthesized
acgcattgaacattatgctagc

SEQ ID NO: 647586 - DNA, 22 bp, Artificial Sequence
  chemically synthesized
gtctcatacctgctagcataat

SEQ ID NO: 647587 - DNA, 22 bp, Artificial Sequence
  chemically synthesized
attcacgcattgaacattatgc

SEQ ID NO: 647588 - DNA, 22 bp, Artificial Sequence
  chemically synthesized
atacctgctagcataatgttca

SEQ ID NO: 647589 - DNA, 22 bp, Artificial Sequence
  chemically synthesized
ctagcataatgttcaatgcgtg

SEQ ID NO: 647590 - DNA, 22 bp, Artificial Sequence
  chemically synthesized
gcataatgttcaatgcgtgaat

SEQ ID NO: 647591 - DNA, 22 bp, Artificial Sequence
  chemically synthesized
acacgatgatactcattcacgc

SEQ ID NO: 647592 - DNA, 22 bp, Artificial Sequence
  chemically synthesized
cacacgatgatactcattcacg

SEQ ID NO: 647593 - DNA, 22 bp, Artificial Sequence
  chemically synthesized
tcacacgatgatactcattcac

SEQ ID NO: 647594 - DNA, 22 bp, Artificial Sequence
  chemically synthesized
agctttcacacgatgatactca

SEQ ID NO: 647595 - DNA, 22 bp, Artificial Sequence
  chemically synthesized
aatgcgtgaatgagtatcatcg

SEQ ID NO: 647596 - DNA, 22 bp, Artificial Sequence
  chemically synthesized
gtcccctcagctttcacacgat

SEQ ID NO: 647597 - DNA, 22 bp, Artificial Sequence
  chemically synthesized
cctcgtcccctcagctttcaca

SEQ ID NO: 647598 - DNA, 22 bp, Artificial Sequence
  chemically synthesized
taggcctgcctcgtcccctcag

SEQ ID NO: 647599 - DNA, 22 bp, Artificial Sequence
  chemically synthesized
ataggcctgcctcgtcccctca

SEQ ID NO: 647600 - DNA, 22 bp, Artificial Sequence
  chemically synthesized
ccttataggcctgcctcgtccc

SEQ ID NO: 647601 - DNA, 22 bp, Artificial Sequence
  chemically synthesized
tgccttataggcctgcctcgtc

SEQ ID NO: 647602 - DNA, 22 bp, Artificial Sequence
  chemically synthesized
ctgccttataggcctgcctcgt

SEQ ID NO: 647603 - DNA, 22 bp, Artificial Sequence
  chemically synthesized
tctgccttataggcctgcctcg

SEQ ID NO: 647604 - DNA, 22 bp, Artificial Sequence
  chemically synthesized
aggggacgaggcaggcctataa

SEQ ID NO: 647605 - DNA, 22 bp, Artificial Sequence
  chemically synthesized
atcacattttctgccttatagg

SEQ ID NO: 647606 - DNA, 22 bp, Artificial Sequence
  chemically synthesized
tgactaatcacattttctgcct

SEQ ID NO: 647607 - DNA, 22 bp, Artificial Sequence
  chemically synthesized
taaggcagaaaatgtgattagt

SEQ ID NO: 647608 - DNA, 22 bp, Artificial Sequence
  chemically synthesized
atggatggtatctgtgactaat

SEQ ID NO: 647609 - DNA, 22 bp, Artificial Sequence
  chemically synthesized
cattaatggatggtatctgtga

SEQ ID NO: 647610 - DNA, 22 bp, Artificial Sequence
  chemically synthesized
tccattaatggatggtatctgt

SEQ ID NO: 647611 - DNA, 22 bp, Artificial Sequence
  chemically synthesized
ctccattaatggatggtatctg

SEQ ID NO: 647612 - DNA, 22 bp, Artificial Sequence
  chemically synthesized
tctccattaatggatggtatct

SEQ ID NO: 647613 - DNA, 22 bp, Artificial Sequence
  chemically synthesized
ttctccattaatggatggtatc

SEQ ID NO: 647614 - DNA, 22 bp, Artificial Sequence
  chemically synthesized
tttctccattaatggatggtat

SEQ ID NO: 647615 - DNA, 22 bp, Artificial Sequence
  chemically synthesized
gtcacagataccatccattaat

SEQ ID NO: 647616 - DNA, 22 bp, Artificial Sequence
  chemically synthesized
tgtggtgggttttttctccatt

SEQ ID NO: 647617 - DNA, 22 bp, Artificial Sequence
  chemically synthesized
atggagaaaaaacccaccacac

SEQ ID NO: 647618 - DNA, 22 bp, Artificial Sequence
  chemically synthesized
ggccatgtgtataacataactg

SEQ ID NO: 647619 - DNA, 22 bp, Artificial Sequence
  chemically synthesized
taggccatgtgtataacataac

SEQ ID NO: 647620 - DNA, 22 bp, Artificial Sequence
  chemically synthesized
gaataaaagcattctaggccat

SEQ ID NO: 647621 - DNA, 22 bp, Artificial Sequence
  chemically synthesized
tgttatacacatggcctagaat

SEQ ID NO: 647622 - DNA, 22 bp, Artificial Sequence
  chemically synthesized
tacacatggcctagaatgcttt

SEQ ID NO: 647623 - DNA, 22 bp, Artificial Sequence
  chemically synthesized
tccatagaattagaataaaagc

SEQ ID NO: 647624 - DNA, 22 bp, Artificial Sequence
  chemically synthesized
gaatgcttttattctaattcta

SEQ ID NO: 647625 - DNA, 22 bp, Artificial Sequence
  chemically synthesized
aatgtatacattatccatagaa

SEQ ID NO: 647626 - DNA, 22 bp, Artificial Sequence
  chemically synthesized
ttattctaattctatggataat

SEQ ID NO: 647627 - DNA, 22 bp, Artificial Sequence
  chemically synthesized
tattctaattctatggataatg

SEQ ID NO: 647628 - DNA, 22 bp, Artificial Sequence
  chemically synthesized
attctaattctatggataatgt

SEQ ID NO: 647629 - DNA, 22 bp, Artificial Sequence
  chemically synthesized
ttctaattctatggataatgta

SEQ ID NO: 647630 - DNA, 22 bp, Artificial Sequence
  chemically synthesized
taattctatggataatgtatac

SEQ ID NO: 647631 - DNA, 22 bp, Artificial Sequence
  chemically synthesized
attctatggataatgtatacat

SEQ ID NO: 647632 - DNA, 22 bp, Artificial Sequence
  chemically synthesized
tatggataatgtatacatttag

SEQ ID NO: 647633 - DNA, 22 bp, Artificial Sequence
  chemically synthesized
tggataatgtatacatttagtt

SEQ ID NO: 647634 - DNA, 22 bp, Artificial Sequence
  chemically synthesized
agatataggagcaactaaatgt

SEQ ID NO: 647635 - DNA, 22 bp, Artificial Sequence
  chemically synthesized
aagatataggagcaactaaatg

SEQ ID NO: 647636 - DNA, 22 bp, Artificial Sequence
  chemically synthesized
ataatatttaagatataggagc

SEQ ID NO: 647637 - DNA, 22 bp, Artificial Sequence
  chemically synthesized
gataatatttaagatataggag

SEQ ID NO: 647638 - DNA, 22 bp, Artificial Sequence
  chemically synthesized
agttgctcctatatcttaaata

SEQ ID NO: 647639 - DNA, 22 bp, Artificial Sequence
  chemically synthesized
gttgctcctatatcttaaatat

SEQ ID NO: 647640 - DNA, 22 bp, Artificial Sequence
  chemically synthesized
aaatacttgataatatttaaga

SEQ ID NO: 647641 - DNA, 22 bp, Artificial Sequence
  chemically synthesized
aaaatacttgataatatttaag

SEQ ID NO: 647642 - DNA, 22 bp, Artificial Sequence
  chemically synthesized
taaaatacttgataatatttaa

SEQ ID NO: 647643 - DNA, 22 bp, Artificial Sequence
  chemically synthesized
ctcctatatcttaaatattatc

SEQ ID NO: 647644 - DNA, 22 bp, Artificial Sequence
  chemically synthesized
ctatatcttaaatattatcaag

SEQ ID NO: 647645 - DNA, 22 bp, Artificial Sequence
  chemically synthesized
gattttaaaatacttgataata

SEQ ID NO: 647646 - DNA, 22 bp, Artificial Sequence
  chemically synthesized
tatcttaaatattatcaagtat

SEQ ID NO: 647647 - DNA, 22 bp, Artificial Sequence
  chemically synthesized
aatcctggattttaaaatactt

SEQ ID NO: 647648 - DNA, 22 bp, Artificial Sequence
  chemically synthesized
aaatattatcaagtattttaaa

SEQ ID NO: 647649 - DNA, 22 bp, Artificial Sequence
  chemically synthesized
tcaatcctggattttaaaatac

SEQ ID NO: 647650 - DNA, 22 bp, Artificial Sequence
  chemically synthesized
aatattatcaagtattttaaaa

SEQ ID NO: 647651 - DNA, 22 bp, Artificial Sequence
  chemically synthesized
tcaagtattttaaaatccagga

SEQ ID NO: 647652 - DNA, 22 bp, Artificial Sequence
  chemically synthesized
taaaatccaggattgagagatg

SEQ ID NO: 647653 - DNA, 22 bp, Artificial Sequence
  chemically synthesized
aaaatccaggattgagagatga

SEQ ID NO: 647654 - DNA, 22 bp, Artificial Sequence
  chemically synthesized
aaatccaggattgagagatgat

SEQ ID NO: 647655 - DNA, 22 bp, Artificial Sequence
  chemically synthesized
ataaaagcagaagtatgagaaa

SEQ ID NO: 647656 - DNA, 22 bp, Artificial Sequence
  chemically synthesized
aataaaagcagaagtatgagaa

SEQ ID NO: 647657 - DNA, 22 bp, Artificial Sequence
  chemically synthesized
taataaaagcagaagtatgaga

SEQ ID NO: 647658 - DNA, 22 bp, Artificial Sequence
  chemically synthesized
ttaataaaagcagaagtatgag

SEQ ID NO: 647659 - DNA, 22 bp, Artificial Sequence
  chemically synthesized
agagatgatttctcatacttct

SEQ ID NO: 647660 - DNA, 22 bp, Artificial Sequence
  chemically synthesized
atggcttttaataaaagcagaa

SEQ ID NO: 647661 - DNA, 22 bp, Artificial Sequence
  chemically synthesized
catggcttttaataaaagcaga

SEQ ID NO: 647662 - DNA, 22 bp, Artificial Sequence
  chemically synthesized
ttcatggcttttaataaaagca

SEQ ID NO: 647663 - DNA, 22 bp, Artificial Sequence
  chemically synthesized
ctcatacttctgcttttattaa

SEQ ID NO: 647664 - DNA, 22 bp, Artificial Sequence
  chemically synthesized
tcttcatggcttttaataaaag

SEQ ID NO: 647665 - DNA, 22 bp, Artificial Sequence
  chemically synthesized
tcatacttctgcttttattaaa

SEQ ID NO: 647666 - DNA, 22 bp, Artificial Sequence
  chemically synthesized
atacttctgcttttattaaaag

SEQ ID NO: 647667 - DNA, 22 bp, Artificial Sequence
  chemically synthesized
gcctctcttcatggcttttaat

SEQ ID NO: 647668 - DNA, 22 bp, Artificial Sequence
  chemically synthesized
ggcctctcttcatggcttttaa

SEQ ID NO: 647669 - DNA, 22 bp, Artificial Sequence
  chemically synthesized
tggcctctcttcatggctttta

SEQ ID NO: 647670 - DNA, 22 bp, Artificial Sequence
  chemically synthesized
ctgcttttattaaaagccatga

SEQ ID NO: 647671 - DNA, 22 bp, Artificial Sequence
  chemically synthesized
tgcttttattaaaagccatgaa

SEQ ID NO: 647672 - DNA, 22 bp, Artificial Sequence
  chemically synthesized
cttttattaaaagccatgaaga

SEQ ID NO: 647673 - DNA, 22 bp, Artificial Sequence
  chemically synthesized
ttattaaaagccatgaagagag

SEQ ID NO: 647674 - DNA, 22 bp, Artificial Sequence
  chemically synthesized
tattaaaagccatgaagagagg

SEQ ID NO: 647675 - DNA, 22 bp, Artificial Sequence
  chemically synthesized
attaaaagccatgaagagaggc

SEQ ID NO: 647676 - DNA, 22 bp, Artificial Sequence
  chemically synthesized
ttaaaagccatgaagagaggcc

SEQ ID NO: 647677 - DNA, 22 bp, Artificial Sequence
  chemically synthesized
cagagaagattttggcctctct

SEQ ID NO: 647678 - DNA, 22 bp, Artificial Sequence
  chemically synthesized
ccagagaagattttggcctctc

SEQ ID NO: 647679 - DNA, 22 bp, Artificial Sequence
  chemically synthesized
aaagccatgaagagaggccaaa

SEQ ID NO: 647680 - DNA, 22 bp, Artificial Sequence
  chemically synthesized
tccagagaagattttggcctct

SEQ ID NO: 647681 - DNA, 22 bp, Artificial Sequence
  chemically synthesized
cgatgggaattttccagagaag

SEQ ID NO: 647682 - DNA, 22 bp, Artificial Sequence
  chemically synthesized
tacgatgggaattttccagaga

SEQ ID NO: 647683 - DNA, 22 bp, Artificial Sequence
  chemically synthesized
ctacgatgggaattttccagag

SEQ ID NO: 647684 - DNA, 22 bp, Artificial Sequence
  chemically synthesized
tctacgatgggaattttccaga

SEQ ID NO: 647685 - DNA, 22 bp, Artificial Sequence
  chemically synthesized
ttctacgatgggaattttccag

SEQ ID NO: 647686 - DNA, 22 bp, Artificial Sequence
  chemically synthesized
ctctggaaaattcccatcgtag

SEQ ID NO: 647687 - DNA, 22 bp, Artificial Sequence
  chemically synthesized
ccccaaccttttctacgatggg

SEQ ID NO: 647688 - DNA, 22 bp, Artificial Sequence
  chemically synthesized
tctggaaaattcccatcgtaga

SEQ ID NO: 647689 - DNA, 22 bp, Artificial Sequence
  chemically synthesized
tggaaaattcccatcgtagaaa

SEQ ID NO: 647690 - DNA, 22 bp, Artificial Sequence
  chemically synthesized
tctcccccaaccttttctacga

SEQ ID NO: 647691 - DNA, 22 bp, Artificial Sequence
  chemically synthesized
gaaaattcccatcgtagaaaag

SEQ ID NO: 647692 - DNA, 22 bp, Artificial Sequence
  chemically synthesized
gaaactgtctcccccaaccttt

SEQ ID NO: 647693 - DNA, 22 bp, Artificial Sequence
  chemically synthesized
ccatcgtagaaaaggttggggg

SEQ ID NO: 647694 - DNA, 22 bp, Artificial Sequence
  chemically synthesized
ctagaaactgtctcccccaacc

SEQ ID NO: 647695 - DNA, 22 bp, Artificial Sequence
  chemically synthesized
cctagaaactgtctcccccaac

SEQ ID NO: 647696 - DNA, 22 bp, Artificial Sequence
  chemically synthesized
ggggagacagtttctaggaagc

SEQ ID NO: 647697 - DNA, 22 bp, Artificial Sequence
  chemically synthesized
caaagtaggaggacaaaatgct

SEQ ID NO: 647698 - DNA, 22 bp, Artificial Sequence
  chemically synthesized
ctaggaagcattttgtcctcct

SEQ ID NO: 647699 - DNA, 22 bp, Artificial Sequence
  chemically synthesized
taggaagcattttgtcctccta

SEQ ID NO: 647700 - DNA, 22 bp, Artificial Sequence
  chemically synthesized
ggaagcattttgtcctcctact

SEQ ID NO: 647701 - DNA, 22 bp, Artificial Sequence
  chemically synthesized
taggatgtgagaaattacaaag

SEQ ID NO: 647702 - DNA, 22 bp, Artificial Sequence
  chemically synthesized
tgtcctcctactttgtaatttc

SEQ ID NO: 647703 - DNA, 22 bp, Artificial Sequence
  chemically synthesized
gtcctcctactttgtaatttct

SEQ ID NO: 647704 - DNA, 22 bp, Artificial Sequence
  chemically synthesized
tcctcctactttgtaatttctc

SEQ ID NO: 647705 - DNA, 22 bp, Artificial Sequence
  chemically synthesized
ggaattataggatgtgagaaat

SEQ ID NO: 647706 - DNA, 22 bp, Artificial Sequence
  chemically synthesized
cggaattataggatgtgagaaa

SEQ ID NO: 647707 - DNA, 22 bp, Artificial Sequence
  chemically synthesized
ctactttgtaatttctcacatc

SEQ ID NO: 647708 - DNA, 22 bp, Artificial Sequence
  chemically synthesized
ctttgtaatttctcacatccta

SEQ ID NO: 647709 - DNA, 22 bp, Artificial Sequence
  chemically synthesized
tgtaatttctcacatcctataa

SEQ ID NO: 647710 - DNA, 22 bp, Artificial Sequence
  chemically synthesized
gtaatttctcacatcctataat

SEQ ID NO: 647711 - DNA, 22 bp, Artificial Sequence
  chemically synthesized
taatttctcacatcctataatt

SEQ ID NO: 647712 - DNA, 22 bp, Artificial Sequence
  chemically synthesized
acacaatttcggaattatagga

SEQ ID NO: 647713 - DNA, 22 bp, Artificial Sequence
  chemically synthesized
ctcacatcctataattccgaaa

SEQ ID NO: 647714 - DNA, 22 bp, Artificial Sequence
  chemically synthesized
tcacatcctataattccgaaat

SEQ ID NO: 647715 - DNA, 22 bp, Artificial Sequence
  chemically synthesized
acatcctataattccgaaattg

SEQ ID NO: 647716 - DNA, 22 bp, Artificial Sequence
  chemically synthesized
aaccacatagggctaacacaat

SEQ ID NO: 647717 - DNA, 22 bp, Artificial Sequence
  chemically synthesized
aaaccacatagggctaacacaa

SEQ ID NO: 647718 - DNA, 22 bp, Artificial Sequence
  chemically synthesized
taattccgaaattgtgttagcc

SEQ ID NO: 647719 - DNA, 22 bp, Artificial Sequence
  chemically synthesized
taaaccacatagggctaacaca

SEQ ID NO: 647720 - DNA, 22 bp, Artificial Sequence
  chemically synthesized
cgaaattgtgttagccctatgt

SEQ ID NO: 647721 - DNA, 22 bp, Artificial Sequence
  chemically synthesized
aaattttaaaccacatagggct

SEQ ID NO: 647722 - DNA, 22 bp, Artificial Sequence
  chemically synthesized
aaaattttaaaccacatagggc

SEQ ID NO: 647723 - DNA, 22 bp, Artificial Sequence
  chemically synthesized
tttaaaattttaaaccacatag

SEQ ID NO: 647724 - DNA, 22 bp, Artificial Sequence
  chemically synthesized
tgttagccctatgtggtttaaa

SEQ ID NO: 647725 - DNA, 22 bp, Artificial Sequence
  chemically synthesized
gccctatgtggtttaaaatttt

SEQ ID NO: 647726 - DNA, 22 bp, Artificial Sequence
  chemically synthesized
tgtggtttaaaattttaaatag

SEQ ID NO: 647727 - DNA, 22 bp, Artificial Sequence
  chemically synthesized
taaatggcgcaggtgtaaacta

SEQ ID NO: 647728 - DNA, 22 bp, Artificial Sequence
  chemically synthesized
aaaattttaaatagtttacacc

SEQ ID NO: 647729 - DNA, 22 bp, Artificial Sequence
  chemically synthesized
aaattttaaatagtttacacct

SEQ ID NO: 647730 - DNA, 22 bp, Artificial Sequence
  chemically synthesized
taaatagtttacacctgcgcca

SEQ ID NO: 647731 - DNA, 22 bp, Artificial Sequence
  chemically synthesized
aaatagtttacacctgcgccat

SEQ ID NO: 647732 - DNA, 22 bp, Artificial Sequence
  chemically synthesized
aatagtttacacctgcgccatt

SEQ ID NO: 647733 - DNA, 22 bp, Artificial Sequence
  chemically synthesized
acacctgcgccatttataggct

SEQ ID NO: 647734 - DNA, 22 bp, Artificial Sequence
  chemically synthesized
cacctgcgccatttataggcta

SEQ ID NO: 647735 - DNA, 22 bp, Artificial Sequence
  chemically synthesized
atccaataagaagatagcctat

SEQ ID NO: 647736 - DNA, 22 bp, Artificial Sequence
  chemically synthesized
gatccaataagaagatagccta

SEQ ID NO: 647737 - DNA, 22 bp, Artificial Sequence
  chemically synthesized
tgatccaataagaagatagcct

SEQ ID NO: 647738 - DNA, 22 bp, Artificial Sequence
  chemically synthesized
cgccatttataggctatcttct

SEQ ID NO: 647739 - DNA, 22 bp, Artificial Sequence
  chemically synthesized
ataggctatcttcttattggat

SEQ ID NO: 647740 - DNA, 22 bp, Artificial Sequence
  chemically synthesized
taggctatcttcttattggatc

SEQ ID NO: 647741 - DNA, 22 bp, Artificial Sequence
  chemically synthesized
ggcagatatacagctttgatcc

SEQ ID NO: 647742 - DNA, 22 bp, Artificial Sequence
  chemically synthesized
tcttcttattggatcaaagctg

SEQ ID NO: 647743 - DNA, 22 bp, Artificial Sequence
  chemically synthesized
cttattggatcaaagctgtata

SEQ ID NO: 647744 - DNA, 22 bp, Artificial Sequence
  chemically synthesized
ttattggatcaaagctgtatat

SEQ ID NO: 647745 - DNA, 22 bp, Artificial Sequence
  chemically synthesized
attggatcaaagctgtatatct

SEQ ID NO: 647746 - DNA, 22 bp, Artificial Sequence
  chemically synthesized
ttggatcaaagctgtatatctg

SEQ ID NO: 647747 - DNA, 22 bp, Artificial Sequence
  chemically synthesized
taagtatctaggcagatataca

SEQ ID NO: 647748 - DNA, 22 bp, Artificial Sequence
  chemically synthesized
gatcaaagctgtatatctgcct

SEQ ID NO: 647749 - DNA, 22 bp, Artificial Sequence
  chemically synthesized
aaataattgtaagtatctaggc

SEQ ID NO: 647750 - DNA, 22 bp, Artificial Sequence
  chemically synthesized
tatatctgcctagatacttaca

SEQ ID NO: 647751 - DNA, 22 bp, Artificial Sequence
  chemically synthesized
aagctaaaataattgtaagtat

SEQ ID NO: 647752 - DNA, 22 bp, Artificial Sequence
  chemically synthesized
gaagctaaaataattgtaagta

SEQ ID NO: 647753 - DNA, 22 bp, Artificial Sequence
  chemically synthesized
tgaagctaaaataattgtaagt

SEQ ID NO: 647754 - DNA, 22 bp, Artificial Sequence
  chemically synthesized
tttgaagctaaaataattgtaa

SEQ ID NO: 647755 - DNA, 22 bp, Artificial Sequence
  chemically synthesized
cctagatacttacaattatttt

SEQ ID NO: 647756 - DNA, 22 bp, Artificial Sequence
  chemically synthesized
gatacttacaattattttagct

SEQ ID NO: 647757 - DNA, 22 bp, Artificial Sequence
  chemically synthesized
gagtagcctctttgaagctaaa

SEQ ID NO: 647758 - DNA, 22 bp, Artificial Sequence
  chemically synthesized
acaattattttagcttcaaaga

SEQ ID NO: 647759 - DNA, 22 bp, Artificial Sequence
  chemically synthesized
caattattttagcttcaaagag

SEQ ID NO: 647760 - DNA, 22 bp, Artificial Sequence
  chemically synthesized
tactagagtagcctctttgaag

SEQ ID NO: 647761 - DNA, 22 bp, Artificial Sequence
  chemically synthesized
gtactagagtagcctctttgaa

SEQ ID NO: 647762 - DNA, 22 bp, Artificial Sequence
  chemically synthesized
ttttagcttcaaagaggctact

SEQ ID NO: 647763 - DNA, 22 bp, Artificial Sequence
  chemically synthesized
tagcttcaaagaggctactcta

SEQ ID NO: 647764 - DNA, 22 bp, Artificial Sequence
  chemically synthesized
agcttcaaagaggctactctag

SEQ ID NO: 647765 - DNA, 22 bp, Artificial Sequence
  chemically synthesized
agaagtcttgtactagagtagc

SEQ ID NO: 647766 - DNA, 22 bp, Artificial Sequence
  chemically synthesized
gcttcaaagaggctactctagt

SEQ ID NO: 647767 - DNA, 22 bp, Artificial Sequence
  chemically synthesized
aagaagtcttgtactagagtag

SEQ ID NO: 647768 - DNA, 22 bp, Artificial Sequence
  chemically synthesized
taagaagtcttgtactagagta

SEQ ID NO: 647769 - DNA, 22 bp, Artificial Sequence
  chemically synthesized
caaagaggctactctagtacaa

SEQ ID NO: 647770 - DNA, 22 bp, Artificial Sequence
  chemically synthesized
aaagaggctactctagtacaag

SEQ ID NO: 647771 - DNA, 22 bp, Artificial Sequence
  chemically synthesized
atacatggagttttaagaagtc

SEQ ID NO: 647772 - DNA, 22 bp, Artificial Sequence
  chemically synthesized
ctctagtacaagacttcttaaa

SEQ ID NO: 647773 - DNA, 22 bp, Artificial Sequence
  chemically synthesized
gatacatggagttttaagaagt

SEQ ID NO: 647774 - DNA, 22 bp, Artificial Sequence
  chemically synthesized
tagtacaagacttcttaaaact

SEQ ID NO: 647775 - DNA, 22 bp, Artificial Sequence
  chemically synthesized
gtacaagacttcttaaaactcc

SEQ ID NO: 647776 - DNA, 22 bp, Artificial Sequence
  chemically synthesized
cttaaaactccatgtatcaaga

SEQ ID NO: 647777 - DNA, 22 bp, Artificial Sequence
  chemically synthesized
ttaaaactccatgtatcaagat

SEQ ID NO: 647778 - DNA, 22 bp, Artificial Sequence
  chemically synthesized
catagatcaagacatcttgata

SEQ ID NO: 647779 - DNA, 22 bp, Artificial Sequence
  chemically synthesized
aaaactccatgtatcaagatgt

SEQ ID NO: 647780 - DNA, 22 bp, Artificial Sequence
  chemically synthesized
aaactccatgtatcaagatgtc

SEQ ID NO: 647781 - DNA, 22 bp, Artificial Sequence
  chemically synthesized
catgtatcaagatgtcttgatc

SEQ ID NO: 647782 - DNA, 22 bp, Artificial Sequence
  chemically synthesized
caaaattgcatagatcaagaca

SEQ ID NO: 647783 - DNA, 22 bp, Artificial Sequence
  chemically synthesized
acaaaattgcatagatcaagac

SEQ ID NO: 647784 - DNA, 22 bp, Artificial Sequence
  chemically synthesized
tacaaaattgcatagatcaaga

SEQ ID NO: 647785 - DNA, 22 bp, Artificial Sequence
  chemically synthesized
tttacaaaattgcatagatcaa

SEQ ID NO: 647786 - DNA, 22 bp, Artificial Sequence
  chemically synthesized
ctttacaaaattgcatagatca

SEQ ID NO: 647787 - DNA, 22 bp, Artificial Sequence
  chemically synthesized
ttctttacaaaattgcatagat

SEQ ID NO: 647788 - DNA, 22 bp, Artificial Sequence
  chemically synthesized
cttctttacaaaattgcataga

SEQ ID NO: 647789 - DNA, 22 bp, Artificial Sequence
  chemically synthesized
gatctatgcaattttgtaaaga

SEQ ID NO: 647790 - DNA, 22 bp, Artificial Sequence
  chemically synthesized
atctatgcaattttgtaaagaa

SEQ ID NO: 647791 - DNA, 22 bp, Artificial Sequence
  chemically synthesized
gaagatacatttcttctttaca

SEQ ID NO: 647792 - DNA, 22 bp, Artificial Sequence
  chemically synthesized
tgcaattttgtaaagaagaaat

SEQ ID NO: 647793 - DNA, 22 bp, Artificial Sequence
  chemically synthesized
aattggaagatacatttcttct

SEQ ID NO: 647794 - DNA, 22 bp, Artificial Sequence
  chemically synthesized
ctgaattggaagatacatttct

SEQ ID NO: 647795 - DNA, 22 bp, Artificial Sequence
  chemically synthesized
ctgctgaattggaagatacatt

SEQ ID NO: 647796 - DNA, 22 bp, Artificial Sequence
  chemically synthesized
tgtaaagaagaaatgtatcttc

SEQ ID NO: 647797 - DNA, 22 bp, Artificial Sequence
  chemically synthesized
gctgctgaattggaagatacat

SEQ ID NO: 647798 - DNA, 22 bp, Artificial Sequence
  chemically synthesized
gtaaagaagaaatgtatcttcc

SEQ ID NO: 647799 - DNA, 22 bp, Artificial Sequence
  chemically synthesized
taaagaagaaatgtatcttcca

SEQ ID NO: 647800 - DNA, 22 bp, Artificial Sequence
  chemically synthesized
gtggtatagtcttgctgctgaa

SEQ ID NO: 647801 - DNA, 22 bp, Artificial Sequence
  chemically synthesized
gaaattagtggtatagtcttgc

SEQ ID NO: 647802 - DNA, 22 bp, Artificial Sequence
  chemically synthesized
ccaattcagcagcaagactata

SEQ ID NO: 647803 - DNA, 22 bp, Artificial Sequence
  chemically synthesized
caattcagcagcaagactatac

SEQ ID NO: 647804 - DNA, 22 bp, Artificial Sequence
  chemically synthesized
tgctagaaattagtggtatagt

SEQ ID NO: 647805 - DNA, 22 bp, Artificial Sequence
  chemically synthesized
gtgctagaaattagtggtatag

SEQ ID NO: 647806 - DNA, 22 bp, Artificial Sequence
  chemically synthesized
tgtgctagaaattagtggtata

SEQ ID NO: 647807 - DNA, 22 bp, Artificial Sequence
  chemically synthesized
agcagcaagactataccactaa

SEQ ID NO: 647808 - DNA, 22 bp, Artificial Sequence
  chemically synthesized
ttttgtgctagaaattagtggt

SEQ ID NO: 647809 - DNA, 22 bp, Artificial Sequence
  chemically synthesized
tattttgtgctagaaattagtg

SEQ ID NO: 647810 - DNA, 22 bp, Artificial Sequence
  chemically synthesized
taccactaatttctagcacaaa

SEQ ID NO: 647811 - DNA, 22 bp, Artificial Sequence
  chemically synthesized
atttctagcacaaaatagaatg

SEQ ID NO: 647812 - DNA, 22 bp, Artificial Sequence
  chemically synthesized
ctagcacaaaatagaatgaccc

SEQ ID NO: 647813 - DNA, 22 bp, Artificial Sequence
  chemically synthesized
tagcacaaaatagaatgaccct

SEQ ID NO: 647814 - DNA, 22 bp, Artificial Sequence
  chemically synthesized
acaatataatccagggtcattc

SEQ ID NO: 647815 - DNA, 22 bp, Artificial Sequence
  chemically synthesized
gcacaaaatagaatgaccctgg

SEQ ID NO: 647816 - DNA, 22 bp, Artificial Sequence
  chemically synthesized
aaacctcacaatataatccagg

SEQ ID NO: 647817 - DNA, 22 bp, Artificial Sequence
  chemically synthesized
aaaacctcacaatataatccag

SEQ ID NO: 647818 - DNA, 22 bp, Artificial Sequence
  chemically synthesized
taaaacctcacaatataatcca

SEQ ID NO: 647819 - DNA, 22 bp, Artificial Sequence
  chemically synthesized
ttaaaacctcacaatataatcc

SEQ ID NO: 647820 - DNA, 22 bp, Artificial Sequence
  chemically synthesized
tttaaaacctcacaatataatc

SEQ ID NO: 647821 - DNA, 22 bp, Artificial Sequence
  chemically synthesized
ttttaaaacctcacaatataat

SEQ ID NO: 647822 - DNA, 22 bp, Artificial Sequence
  chemically synthesized
ttttttaaaacctcacaatata

SEQ ID NO: 647823 - DNA, 22 bp, Artificial Sequence
  chemically synthesized
gtcattcttttttaaaacctca

SEQ ID NO: 647824 - DNA, 22 bp, Artificial Sequence
  chemically synthesized
agtcattcttttttaaaacctc

SEQ ID NO: 647825 - DNA, 22 bp, Artificial Sequence
  chemically synthesized
gattatattgtgaggttttaaa

SEQ ID NO: 647826 - DNA, 22 bp, Artificial Sequence
  chemically synthesized
tattgtgaggttttaaaaaaga

SEQ ID NO: 647827 - DNA, 22 bp, Artificial Sequence
  chemically synthesized
tgaaatttagtcattctttttt

SEQ ID NO: 647828 - DNA, 22 bp, Artificial Sequence
  chemically synthesized
tatgaaatttagtcattctttt

SEQ ID NO: 647829 - DNA, 22 bp, Artificial Sequence
  chemically synthesized
tgaggttttaaaaaagaatgac

SEQ ID NO: 647830 - DNA, 22 bp, Artificial Sequence
  chemically synthesized
taaaaaagaatgactaaatttc

SEQ ID NO: 647831 - DNA, 22 bp, Artificial Sequence
  chemically synthesized
aaaaaagaatgactaaatttca

SEQ ID NO: 647832 - DNA, 22 bp, Artificial Sequence
  chemically synthesized
aaaaagaatgactaaatttcat

SEQ ID NO: 647833 - DNA, 22 bp, Artificial Sequence
  chemically synthesized
agatatcatgacgttctatgaa

SEQ ID NO: 647834 - DNA, 22 bp, Artificial Sequence
  chemically synthesized
cagatatcatgacgttctatga

SEQ ID NO: 647835 - DNA, 22 bp, Artificial Sequence
  chemically synthesized
aatttcatagaacgtcatgata

SEQ ID NO: 647836 - DNA, 22 bp, Artificial Sequence
  chemically synthesized
agaaatatttcagatatcatga

SEQ ID NO: 647837 - DNA, 22 bp, Artificial Sequence
  chemically synthesized
taagaaatatttcagatatcat

SEQ ID NO: 647838 - DNA, 22 bp, Artificial Sequence
  chemically synthesized
catagaacgtcatgatatctga

SEQ ID NO: 647839 - DNA, 22 bp, Artificial Sequence
  chemically synthesized
atagaacgtcatgatatctgaa

SEQ ID NO: 647840 - DNA, 22 bp, Artificial Sequence
  chemically synthesized
gcacacagtatctctaagaaat

SEQ ID NO: 647841 - DNA, 22 bp, Artificial Sequence
  chemically synthesized
agcacacagtatctctaagaaa

SEQ ID NO: 647842 - DNA, 22 bp, Artificial Sequence
  chemically synthesized
tagcacacagtatctctaagaa

SEQ ID NO: 647843 - DNA, 22 bp, Artificial Sequence
  chemically synthesized
tgttttagcacacagtatctct

SEQ ID NO: 647844 - DNA, 22 bp, Artificial Sequence
  chemically synthesized
aaatatttcttagagatactgt

SEQ ID NO: 647845 - DNA, 22 bp, Artificial Sequence
  chemically synthesized
acctatgttttagcacacagta

SEQ ID NO: 647846 - DNA, 22 bp, Artificial Sequence
  chemically synthesized
tcacctatgttttagcacacag

SEQ ID NO: 647847 - DNA, 22 bp, Artificial Sequence
  chemically synthesized
ctcacctatgttttagcacaca

SEQ ID NO: 647848 - DNA, 22 bp, Artificial Sequence
  chemically synthesized
cttagagatactgtgtgctaaa

SEQ ID NO: 647849 - DNA, 22 bp, Artificial Sequence
  chemically synthesized
tctcacctatgttttagcacac

SEQ ID NO: 647850 - DNA, 22 bp, Artificial Sequence
  chemically synthesized
ttagagatactgtgtgctaaaa

SEQ ID NO: 647851 - DNA, 22 bp, Artificial Sequence
  chemically synthesized
agagatactgtgtgctaaaaca

SEQ ID NO: 647852 - DNA, 22 bp, Artificial Sequence
  chemically synthesized
ttttctcacctatgttttagca

SEQ ID NO: 647853 - DNA, 22 bp, Artificial Sequence
  chemically synthesized
gagatactgtgtgctaaaacat

SEQ ID NO: 647854 - DNA, 22 bp, Artificial Sequence
  chemically synthesized
attttctcacctatgttttagc

SEQ ID NO: 647855 - DNA, 22 bp, Artificial Sequence
  chemically synthesized
ttattttctcacctatgtttta

SEQ ID NO: 647856 - DNA, 22 bp, Artificial Sequence
  chemically synthesized
ctcttattttctcacctatgtt

SEQ ID NO: 647857 - DNA, 22 bp, Artificial Sequence
  chemically synthesized
tgtgctaaaacataggtgagaa

SEQ ID NO: 647858 - DNA, 22 bp, Artificial Sequence
  chemically synthesized
atgatctcctcttattttctca

SEQ ID NO: 647859 - DNA, 22 bp, Artificial Sequence
  chemically synthesized
aaacataggtgagaaaataaga

SEQ ID NO: 647860 - DNA, 22 bp, Artificial Sequence
  chemically synthesized
ctaatgatctcctcttattttc

SEQ ID NO: 647861 - DNA, 22 bp, Artificial Sequence
  chemically synthesized
ctgctaatgatctcctcttatt

SEQ ID NO: 647862 - DNA, 22 bp, Artificial Sequence
  chemically synthesized
ttcctgctaatgatctcctctt

SEQ ID NO: 647863 - DNA, 22 bp, Artificial Sequence
  chemically synthesized
tatacaaaaagcatatagacta

SEQ ID NO: 647864 - DNA, 22 bp, Artificial Sequence
  chemically synthesized
atatacaaaaagcatatagact

SEQ ID NO: 647865 - DNA, 22 bp, Artificial Sequence
  chemically synthesized
gcaggaatagtctatatgcttt

SEQ ID NO: 647866 - DNA, 22 bp, Artificial Sequence
  chemically synthesized
tatgctttttgtatataaacac

SEQ ID NO: 647867 - DNA, 22 bp, Artificial Sequence
  chemically synthesized
tttgtatataaacacctatctt

SEQ ID NO: 647868 - DNA, 22 bp, Artificial Sequence
  chemically synthesized
tggagataagaaaagataggtg

SEQ ID NO: 647869 - DNA, 22 bp, Artificial Sequence
  chemically synthesized
ttgtatataaacacctatcttt

SEQ ID NO: 647870 - DNA, 22 bp, Artificial Sequence
  chemically synthesized
tgtatataaacacctatctttt

SEQ ID NO: 647871 - DNA, 22 bp, Artificial Sequence
  chemically synthesized
gtatataaacacctatcttttc

SEQ ID NO: 647872 - DNA, 22 bp, Artificial Sequence
  chemically synthesized
tatataaacacctatcttttct

SEQ ID NO: 647873 - DNA, 22 bp, Artificial Sequence
  chemically synthesized
gcctatggagataagaaaagat

SEQ ID NO: 647874 - DNA, 22 bp, Artificial Sequence
  chemically synthesized
tagcctatggagataagaaaag

SEQ ID NO: 647875 - DNA, 22 bp, Artificial Sequence
  chemically synthesized
ccagaattctagcctatggaga

SEQ ID NO: 647876 - DNA, 22 bp, Artificial Sequence
  chemically synthesized
tcttttcttatctccataggct

SEQ ID NO: 647877 - DNA, 22 bp, Artificial Sequence
  chemically synthesized
ttcttatctccataggctagaa

SEQ ID NO: 647878 - DNA, 22 bp, Artificial Sequence
  chemically synthesized
accctaccagaattctagccta

SEQ ID NO: 647879 - DNA, 22 bp, Artificial Sequence
  chemically synthesized
tcttatctccataggctagaat

SEQ ID NO: 647880 - DNA, 22 bp, Artificial Sequence
  chemically synthesized
cttatctccataggctagaatt

SEQ ID NO: 647881 - DNA, 22 bp, Artificial Sequence
  chemically synthesized
ttatctccataggctagaattc

SEQ ID NO: 647882 - DNA, 22 bp, Artificial Sequence
  chemically synthesized
atctccataggctagaattctg

SEQ ID NO: 647883 - DNA, 22 bp, Artificial Sequence
  chemically synthesized
tctccataggctagaattctgg

SEQ ID NO: 647884 - DNA, 22 bp, Artificial Sequence
  chemically synthesized
cataggctagaattctggtagg

SEQ ID NO: 647885 - DNA, 22 bp, Artificial Sequence
  chemically synthesized
gaattctggtagggttaacatt

SEQ ID NO: 647886 - DNA, 22 bp, Artificial Sequence
  chemically synthesized
tggtagggttaacattttttca

SEQ ID NO: 647887 - DNA, 22 bp, Artificial Sequence
  chemically synthesized
gtagggttaacattttttcatc

SEQ ID NO: 647888 - DNA, 22 bp, Artificial Sequence
  chemically synthesized
atagatcagatatgaaaggatg

SEQ ID NO: 647889 - DNA, 22 bp, Artificial Sequence
  chemically synthesized
acattttttcatcctttcatat

SEQ ID NO: 647890 - DNA, 22 bp, Artificial Sequence
  chemically synthesized
tttcatcctttcatatctgatc

SEQ ID NO: 647891 - DNA, 22 bp, Artificial Sequence
  chemically synthesized
ttcatcctttcatatctgatct

SEQ ID NO: 647892 - DNA, 22 bp, Artificial Sequence
  chemically synthesized
tcatcctttcatatctgatcta

SEQ ID NO: 647893 - DNA, 22 bp, Artificial Sequence
  chemically synthesized
aaggataattaatagatcagat

SEQ ID NO: 647894 - DNA, 22 bp, Artificial Sequence
  chemically synthesized
catcctttcatatctgatctat

SEQ ID NO: 647895 - DNA, 22 bp, Artificial Sequence
  chemically synthesized
caaggataattaatagatcaga

SEQ ID NO: 647896 - DNA, 22 bp, Artificial Sequence
  chemically synthesized
atcctttcatatctgatctatt

SEQ ID NO: 647897 - DNA, 22 bp, Artificial Sequence
  chemically synthesized
tcatatctgatctattaattat

SEQ ID NO: 647898 - DNA, 22 bp, Artificial Sequence
  chemically synthesized
catatctgatctattaattatc

SEQ ID NO: 647899 - DNA, 22 bp, Artificial Sequence
  chemically synthesized
atatctgatctattaattatcc

SEQ ID NO: 647900 - DNA, 22 bp, Artificial Sequence
  chemically synthesized
taaaaacttcaaggataattaa

SEQ ID NO: 647901 - DNA, 22 bp, Artificial Sequence
  chemically synthesized
atctattaattatccttgaagt

SEQ ID NO: 647902 - DNA, 22 bp, Artificial Sequence
  chemically synthesized
ttaattatccttgaagttttta

SEQ ID NO: 647903 - DNA, 22 bp, Artificial Sequence
  chemically synthesized
attatccttgaagtttttatag

SEQ ID NO: 647904 - DNA, 22 bp, Artificial Sequence
  chemically synthesized
atccaaaagatactataaaaac

SEQ ID NO: 647905 - DNA, 22 bp, Artificial Sequence
  chemically synthesized
tccttgaagtttttatagtatc

SEQ ID NO: 647906 - DNA, 22 bp, Artificial Sequence
  chemically synthesized
aggttaatccaaaagatactat

SEQ ID NO: 647907 - DNA, 22 bp, Artificial Sequence
  chemically synthesized
gaagtttttatagtatcttttg

SEQ ID NO: 647908 - DNA, 22 bp, Artificial Sequence
  chemically synthesized
ctaaggttaatccaaaagatac

SEQ ID NO: 647909 - DNA, 22 bp, Artificial Sequence
  chemically synthesized
aagtttttatagtatcttttgg

SEQ ID NO: 647910 - DNA, 22 bp, Artificial Sequence
  chemically synthesized
cctaaggttaatccaaaagata

SEQ ID NO: 647911 - DNA, 22 bp, Artificial Sequence
  chemically synthesized
tcctaaggttaatccaaaagat

SEQ ID NO: 647912 - DNA, 22 bp, Artificial Sequence
  chemically synthesized
ttcctaaggttaatccaaaaga

SEQ ID NO: 647913 - DNA, 22 bp, Artificial Sequence
  chemically synthesized
tttcctaaggttaatccaaaag

SEQ ID NO: 647914 - DNA, 22 bp, Artificial Sequence
  chemically synthesized
ttttcctaaggttaatccaaaa

SEQ ID NO: 647915 - DNA, 22 bp, Artificial Sequence
  chemically synthesized
tttttcctaaggttaatccaaa

SEQ ID NO: 647916 - DNA, 22 bp, Artificial Sequence
  chemically synthesized
ttatagtatcttttggattaac

SEQ ID NO: 647917 - DNA, 22 bp, Artificial Sequence
  chemically synthesized
tatagtatcttttggattaacc

SEQ ID NO: 647918 - DNA, 22 bp, Artificial Sequence
  chemically synthesized
atagtatcttttggattaacct

SEQ ID NO: 647919 - DNA, 22 bp, Artificial Sequence
  chemically synthesized
tagtatcttttggattaacctt

SEQ ID NO: 647920 - DNA, 22 bp, Artificial Sequence
  chemically synthesized
ttggattaaccttaggaaaaaa

SEQ ID NO: 647921 - DNA, 22 bp, Artificial Sequence
  chemically synthesized
tggattaaccttaggaaaaaaa

SEQ ID NO: 647922 - DNA, 22 bp, Artificial Sequence
  chemically synthesized
agaacagatggttttttttcct

SEQ ID NO: 647923 - DNA, 22 bp, Artificial Sequence
  chemically synthesized
ggattaaccttaggaaaaaaaa

SEQ ID NO: 647924 - DNA, 22 bp, Artificial Sequence
  chemically synthesized
cagaacagatggttttttttcc

SEQ ID NO: 647925 - DNA, 22 bp, Artificial Sequence
  chemically synthesized
gattaaccttaggaaaaaaaac

SEQ ID NO: 647926 - DNA, 22 bp, Artificial Sequence
  chemically synthesized
tcagaacagatggttttttttc

SEQ ID NO: 647927 - DNA, 22 bp, Artificial Sequence
  chemically synthesized
gttttcagaacagatggttttt

SEQ ID NO: 647928 - DNA, 22 bp, Artificial Sequence
  chemically synthesized
accttaggaaaaaaaaccatct

SEQ ID NO: 647929 - DNA, 22 bp, Artificial Sequence
  chemically synthesized
aactggttttcagaacagatgg

SEQ ID NO: 647930 - DNA, 22 bp, Artificial Sequence
  chemically synthesized
aggaaaaaaaaccatctgttct

SEQ ID NO: 647931 - DNA, 22 bp, Artificial Sequence
  chemically synthesized
ggaaaaaaaaccatctgttctg

SEQ ID NO: 647932 - DNA, 22 bp, Artificial Sequence
  chemically synthesized
ttctgaaaaccagtttaggctt

SEQ ID NO: 647933 - DNA, 22 bp, Artificial Sequence
  chemically synthesized
aaagaaaaagtccaagcctaaa

SEQ ID NO: 647934 - DNA, 22 bp, Artificial Sequence
  chemically synthesized
tgaaaaccagtttaggcttgga

SEQ ID NO: 647935 - DNA, 22 bp, Artificial Sequence
  chemically synthesized
aaaaccagtttaggcttggact

SEQ ID NO: 647936 - DNA, 22 bp, Artificial Sequence
  chemically synthesized
caattaaaagaaaaagtccaag

SEQ ID NO: 647937 - DNA, 22 bp, Artificial Sequence
  chemically synthesized
ttccaattaaaagaaaaagtcc

SEQ ID NO: 647938 - DNA, 22 bp, Artificial Sequence
  chemically synthesized
tgctattccaattaaaagaaaa

SEQ ID NO: 647939 - DNA, 22 bp, Artificial Sequence
  chemically synthesized
aggcttggactttttcttttaa

SEQ ID NO: 647940 - DNA, 22 bp, Artificial Sequence
  chemically synthesized
gtgctattccaattaaaagaaa

SEQ ID NO: 647941 - DNA, 22 bp, Artificial Sequence
  chemically synthesized
ggcttggactttttcttttaat

SEQ ID NO: 647942 - DNA, 22 bp, Artificial Sequence
  chemically synthesized
tgtgctattccaattaaaagaa

SEQ ID NO: 647943 - DNA, 22 bp, Artificial Sequence
  chemically synthesized
ttgtgctattccaattaaaaga

SEQ ID NO: 647944 - DNA, 22 bp, Artificial Sequence
  chemically synthesized
ggactttttcttttaattggaa

SEQ ID NO: 647945 - DNA, 22 bp, Artificial Sequence
  chemically synthesized
gactttttcttttaattggaat

SEQ ID NO: 647946 - DNA, 22 bp, Artificial Sequence
  chemically synthesized
tttcttttaattggaatagcac

SEQ ID NO: 647947 - DNA, 22 bp, Artificial Sequence
  chemically synthesized
ttcttttaattggaatagcaca

SEQ ID NO: 647948 - DNA, 22 bp, Artificial Sequence
  chemically synthesized
tcttttaattggaatagcacaa

SEQ ID NO: 647949 - DNA, 22 bp, Artificial Sequence
  chemically synthesized
cttttaattggaatagcacaaa

SEQ ID NO: 647950 - DNA, 22 bp, Artificial Sequence
  chemically synthesized
ttttaattggaatagcacaaaa

SEQ ID NO: 647951 - DNA, 22 bp, Artificial Sequence
  chemically synthesized
ttaattggaatagcacaaaagg

SEQ ID NO: 647952 - DNA, 22 bp, Artificial Sequence
  chemically synthesized
taattggaatagcacaaaaggt

SEQ ID NO: 647953 - DNA, 22 bp, Artificial Sequence
  chemically synthesized
aattggaatagcacaaaaggtc

SEQ ID NO: 647954 - DNA, 22 bp, Artificial Sequence
  chemically synthesized
attggaatagcacaaaaggtct

SEQ ID NO: 647955 - DNA, 22 bp, Artificial Sequence
  chemically synthesized
gaatagcacaaaaggtctcttc

SEQ ID NO: 647956 - DNA, 22 bp, Artificial Sequence
  chemically synthesized
tgtcagcagagaaatggaagag

SEQ ID NO: 647957 - DNA, 22 bp, Artificial Sequence
  chemically synthesized
tgtgtcagcagagaaatggaag

SEQ ID NO: 647958 - DNA, 22 bp, Artificial Sequence
  chemically synthesized
ctgtgtcagcagagaaatggaa

SEQ ID NO: 647959 - DNA, 22 bp, Artificial Sequence
  chemically synthesized
tctgtgtcagcagagaaatgga

SEQ ID NO: 647960 - DNA, 22 bp, Artificial Sequence
  chemically synthesized
agggctttctgtgtcagcagag

SEQ ID NO: 647961 - DNA, 22 bp, Artificial Sequence
  chemically synthesized
ttccatttctctgctgacacag

SEQ ID NO: 647962 - DNA, 22 bp, Artificial Sequence
  chemically synthesized
cctaagggctttctgtgtcagc

SEQ ID NO: 647963 - DNA, 22 bp, Artificial Sequence
  chemically synthesized
acctaagggctttctgtgtcag

SEQ ID NO: 647964 - DNA, 22 bp, Artificial Sequence
  chemically synthesized
ccatttctctgctgacacagaa

SEQ ID NO: 647965 - DNA, 22 bp, Artificial Sequence
  chemically synthesized
tacctaagggctttctgtgtca

SEQ ID NO: 647966 - DNA, 22 bp, Artificial Sequence
  chemically synthesized
catttctctgctgacacagaaa

SEQ ID NO: 647967 - DNA, 22 bp, Artificial Sequence
  chemically synthesized
ctctgctgacacagaaagccct

SEQ ID NO: 647968 - DNA, 22 bp, Artificial Sequence
  chemically synthesized
tgcctttacctaagggctttct

SEQ ID NO: 647969 - DNA, 22 bp, Artificial Sequence
  chemically synthesized
tctgctgacacagaaagccctt

SEQ ID NO: 647970 - DNA, 22 bp, Artificial Sequence
  chemically synthesized
atgcctttacctaagggctttc

SEQ ID NO: 647971 - DNA, 22 bp, Artificial Sequence
  chemically synthesized
tgctgacacagaaagcccttag

SEQ ID NO: 647972 - DNA, 22 bp, Artificial Sequence
  chemically synthesized
ctgacacagaaagcccttaggt

SEQ ID NO: 647973 - DNA, 22 bp, Artificial Sequence
  chemically synthesized
gatttatgcctttacctaaggg

SEQ ID NO: 647974 - DNA, 22 bp, Artificial Sequence
  chemically synthesized
ggatttatgcctttacctaagg

SEQ ID NO: 647975 - DNA, 22 bp, Artificial Sequence
  chemically synthesized
acacagaaagcccttaggtaaa

SEQ ID NO: 647976 - DNA, 22 bp, Artificial Sequence
  chemically synthesized
tggatttatgcctttacctaag

SEQ ID NO: 647977 - DNA, 22 bp, Artificial Sequence
  chemically synthesized
ttggatttatgcctttacctaa

SEQ ID NO: 647978 - DNA, 22 bp, Artificial Sequence
  chemically synthesized
acttttggatttatgcctttac

SEQ ID NO: 647979 - DNA, 22 bp, Artificial Sequence
  chemically synthesized
tcgttgacttttggatttatgc

SEQ ID NO: 647980 - DNA, 22 bp, Artificial Sequence
  chemically synthesized
aggtaaaggcataaatccaaaa

SEQ ID NO: 647981 - DNA, 22 bp, Artificial Sequence
  chemically synthesized
ggtaaaggcataaatccaaaag

SEQ ID NO: 647982 - DNA, 22 bp, Artificial Sequence
  chemically synthesized
cattatcgttgacttttggatt

SEQ ID NO: 647983 - DNA, 22 bp, Artificial Sequence
  chemically synthesized
aattacattatcgttgactttt

SEQ ID NO: 647984 - DNA, 22 bp, Artificial Sequence
  chemically synthesized
tgaattacattatcgttgactt

SEQ ID NO: 647985 - DNA, 22 bp, Artificial Sequence
  chemically synthesized
tctgaattacattatcgttgac

SEQ ID NO: 647986 - DNA, 22 bp, Artificial Sequence
  chemically synthesized
aaccagggtcctctctgaatta

SEQ ID NO: 647987 - DNA, 22 bp, Artificial Sequence
  chemically synthesized
ggctaaaccagggtcctctctg

SEQ ID NO: 647988 - DNA, 22 bp, Artificial Sequence
  chemically synthesized
gacactgggctaaaccagggtc

SEQ ID NO: 647989 - DNA, 22 bp, Artificial Sequence
  chemically synthesized
ggacactgggctaaaccagggt

SEQ ID NO: 647990 - DNA, 22 bp, Artificial Sequence
  chemically synthesized
cttggacactgggctaaaccag

SEQ ID NO: 647991 - DNA, 22 bp, Artificial Sequence
  chemically synthesized
agagaggaccctggtttagccc

SEQ ID NO: 647992 - DNA, 22 bp, Artificial Sequence
  chemically synthesized
aacgctacttggacactgggct

SEQ ID NO: 647993 - DNA, 22 bp, Artificial Sequence
  chemically synthesized
caacgctacttggacactgggc

SEQ ID NO: 647994 - DNA, 22 bp, Artificial Sequence
  chemically synthesized
gtttagcccagtgtccaagtag

SEQ ID NO: 647995 - DNA, 22 bp, Artificial Sequence
  chemically synthesized
agcccagtgtccaagtagcgtt

SEQ ID NO: 647996 - DNA, 22 bp, Artificial Sequence
  chemically synthesized
gcccagtgtccaagtagcgttg

SEQ ID NO: 647997 - DNA, 22 bp, Artificial Sequence
  chemically synthesized
aaccaagtccttcaacgctact

SEQ ID NO: 647998 - DNA, 22 bp, Artificial Sequence
  chemically synthesized
caaccaagtccttcaacgctac

SEQ ID NO: 647999 - DNA, 22 bp, Artificial Sequence
  chemically synthesized
gtgtttcaaccaagtccttcaa

SEQ ID NO: 648000 - DNA, 22 bp, Artificial Sequence
  chemically synthesized
agtgtttcaaccaagtccttca

SEQ ID NO: 648001 - DNA, 22 bp, Artificial Sequence
  chemically synthesized
cttagtgtttcaaccaagtcct

SEQ ID NO: 648002 - DNA, 22 bp, Artificial Sequence
  chemically synthesized
tccttagtgtttcaaccaagtc

SEQ ID NO: 648003 - DNA, 22 bp, Artificial Sequence
  chemically synthesized
aaggacttggttgaaacactaa

SEQ ID NO: 648004 - DNA, 22 bp, Artificial Sequence
  chemically synthesized
ggttgaaacactaaggagaatg

SEQ ID NO: 648005 - DNA, 22 bp, Artificial Sequence
  chemically synthesized
gttgaaacactaaggagaatgt

SEQ ID NO: 648006 - DNA, 22 bp, Artificial Sequence
  chemically synthesized
aaacactaaggagaatgtgttt

SEQ ID NO: 648007 - DNA, 22 bp, Artificial Sequence
  chemically synthesized
atgtaagaagaaacaaacacat

SEQ ID NO: 648008 - DNA, 22 bp, Artificial Sequence
  chemically synthesized
aatgtaagaagaaacaaacaca

SEQ ID NO: 648009 - DNA, 22 bp, Artificial Sequence
  chemically synthesized
taatgtaagaagaaacaaacac

SEQ ID NO: 648010 - DNA, 22 bp, Artificial Sequence
  chemically synthesized
ttaatgtaagaagaaacaaaca

SEQ ID NO: 648011 - DNA, 22 bp, Artificial Sequence
  chemically synthesized
tttaatgtaagaagaaacaaac

SEQ ID NO: 648012 - DNA, 22 bp, Artificial Sequence
  chemically synthesized
ttttaatgtaagaagaaacaaa

SEQ ID NO: 648013 - DNA, 22 bp, Artificial Sequence
  chemically synthesized
aggagaatgtgtttgtttcttc

SEQ ID NO: 648014 - DNA, 22 bp, Artificial Sequence
  chemically synthesized
ttttttaatgtaagaagaaaca

SEQ ID NO: 648015 - DNA, 22 bp, Artificial Sequence
  chemically synthesized
cttttttaatgtaagaagaaac

SEQ ID NO: 648016 - DNA, 22 bp, Artificial Sequence
  chemically synthesized
tcttttttaatgtaagaagaaa

SEQ ID NO: 648017 - DNA, 22 bp, Artificial Sequence
  chemically synthesized
ttcttttttaatgtaagaagaa

SEQ ID NO: 648018 - DNA, 22 bp, Artificial Sequence
  chemically synthesized
tttcttttttaatgtaagaaga

SEQ ID NO: 648019 - DNA, 22 bp, Artificial Sequence
  chemically synthesized
catctttttcttttttaatgta

SEQ ID NO: 648020 - DNA, 22 bp, Artificial Sequence
  chemically synthesized
gtttcttcttacattaaaaaag

SEQ ID NO: 648021 - DNA, 22 bp, Artificial Sequence
  chemically synthesized
tttcttcttacattaaaaaaga

SEQ ID NO: 648022 - DNA, 22 bp, Artificial Sequence
  chemically synthesized
cttcttacattaaaaaagaaaa

SEQ ID NO: 648023 - DNA, 22 bp, Artificial Sequence
  chemically synthesized
gtaactgcatctttttcttttt

SEQ ID NO: 648024 - DNA, 22 bp, Artificial Sequence
  chemically synthesized
ttcttacattaaaaaagaaaaa

SEQ ID NO: 648025 - DNA, 22 bp, Artificial Sequence
  chemically synthesized
cttacattaaaaaagaaaaaga

SEQ ID NO: 648026 - DNA, 22 bp, Artificial Sequence
  chemically synthesized
ctggtaactgcatctttttctt

SEQ ID NO: 648027 - DNA, 22 bp, Artificial Sequence
  chemically synthesized
ttacattaaaaaagaaaaagat

SEQ ID NO: 648028 - DNA, 22 bp, Artificial Sequence
  chemically synthesized
acattaaaaaagaaaaagatgc

SEQ ID NO: 648029 - DNA, 22 bp, Artificial Sequence
  chemically synthesized
cattaaaaaagaaaaagatgca

SEQ ID NO: 648030 - DNA, 22 bp, Artificial Sequence
  chemically synthesized
gctactggtaactgcatctttt

SEQ ID NO: 648031 - DNA, 22 bp, Artificial Sequence
  chemically synthesized
agctactggtaactgcatcttt

SEQ ID NO: 648032 - DNA, 22 bp, Artificial Sequence
  chemically synthesized
aaaaagaaaaagatgcagttac

SEQ ID NO: 648033 - DNA, 22 bp, Artificial Sequence
  chemically synthesized
atgcaagcttagctactggtaa

SEQ ID NO: 648034 - DNA, 22 bp, Artificial Sequence
  chemically synthesized
taatgcaagcttagctactggt

SEQ ID NO: 648035 - DNA, 22 bp, Artificial Sequence
  chemically synthesized
ctaatgcaagcttagctactgg

SEQ ID NO: 648036 - DNA, 22 bp, Artificial Sequence
  chemically synthesized
tctaatgcaagcttagctactg

SEQ ID NO: 648037 - DNA, 22 bp, Artificial Sequence
  chemically synthesized
gcacattttctaatgcaagctt

SEQ ID NO: 648038 - DNA, 22 bp, Artificial Sequence
  chemically synthesized
tggcacattttctaatgcaagc

SEQ ID NO: 648039 - DNA, 22 bp, Artificial Sequence
  chemically synthesized
ccagtagctaagcttgcattag

SEQ ID NO: 648040 - DNA, 22 bp, Artificial Sequence
  chemically synthesized
ctggcacattttctaatgcaag

SEQ ID NO: 648041 - DNA, 22 bp, Artificial Sequence
  chemically synthesized
agcttgcattagaaaatgtgcc

SEQ ID NO: 648042 - DNA, 22 bp, Artificial Sequence
  chemically synthesized
agaaatatgaatttctggcaca

SEQ ID NO: 648043 - DNA, 22 bp, Artificial Sequence
  chemically synthesized
gcattagaaaatgtgccagaaa

SEQ ID NO: 648044 - DNA, 22 bp, Artificial Sequence
  chemically synthesized
cattagaaaatgtgccagaaat

SEQ ID NO: 648045 - DNA, 22 bp, Artificial Sequence
  chemically synthesized
gaaaatgtgccagaaattcata

SEQ ID NO: 648046 - DNA, 22 bp, Artificial Sequence
  chemically synthesized
tagtatattaagaaatatgaat

SEQ ID NO: 648047 - DNA, 22 bp, Artificial Sequence
  chemically synthesized
ctgtagtatattaagaaatatg

SEQ ID NO: 648048 - DNA, 22 bp, Artificial Sequence
  chemically synthesized
actgtagtatattaagaaatat

SEQ ID NO: 648049 - DNA, 22 bp, Artificial Sequence
  chemically synthesized
tcttactgtagtatattaagaa

SEQ ID NO: 648050 - DNA, 22 bp, Artificial Sequence
  chemically synthesized
atatttcttaatatactacagt

SEQ ID NO: 648051 - DNA, 22 bp, Artificial Sequence
  chemically synthesized
cttaatatactacagtaagata

SEQ ID NO: 648052 - DNA, 22 bp, Artificial Sequence
  chemically synthesized
ttaatatactacagtaagataa

SEQ ID NO: 648053 - DNA, 22 bp, Artificial Sequence
  chemically synthesized
tagtgtgtcgtaattatcttac

SEQ ID NO: 648054 - DNA, 22 bp, Artificial Sequence
  chemically synthesized
aatatactacagtaagataatt

SEQ ID NO: 648055 - DNA, 22 bp, Artificial Sequence
  chemically synthesized
atatactacagtaagataatta

SEQ ID NO: 648056 - DNA, 22 bp, Artificial Sequence
  chemically synthesized
ctatagtgtgtcgtaattatct

SEQ ID NO: 648057 - DNA, 22 bp, Artificial Sequence
  chemically synthesized
gctatagtgtgtcgtaattatc

SEQ ID NO: 648058 - DNA, 22 bp, Artificial Sequence
  chemically synthesized
tttgctatagtgtgtcgtaatt

SEQ ID NO: 648059 - DNA, 22 bp, Artificial Sequence
  chemically synthesized
cagtaagataattacgacacac

SEQ ID NO: 648060 - DNA, 22 bp, Artificial Sequence
  chemically synthesized
gttatttgctatagtgtgtcgt

SEQ ID NO: 648061 - DNA, 22 bp, Artificial Sequence
  chemically synthesized
cctagttatttgctatagtgtg

SEQ ID NO: 648062 - DNA, 22 bp, Artificial Sequence
  chemically synthesized
ccctagttatttgctatagtgt

SEQ ID NO: 648063 - DNA, 22 bp, Artificial Sequence
  chemically synthesized
catttccctagttatttgctat

SEQ ID NO: 648064 - DNA, 22 bp, Artificial Sequence
  chemically synthesized
cgacacactatagcaaataact

SEQ ID NO: 648065 - DNA, 22 bp, Artificial Sequence
  chemically synthesized
agggaagaattccatttcccta

SEQ ID NO: 648066 - DNA, 22 bp, Artificial Sequence
  chemically synthesized
tagcaaataactagggaaatgg

SEQ ID NO: 648067 - DNA, 22 bp, Artificial Sequence
  chemically synthesized
tcagggaagaattccatttccc

SEQ ID NO: 648068 - DNA, 22 bp, Artificial Sequence
  chemically synthesized
tctcagggaagaattccatttc

SEQ ID NO: 648069 - DNA, 22 bp, Artificial Sequence
  chemically synthesized
tctctcagggaagaattccatt

SEQ ID NO: 648070 - DNA, 22 bp, Artificial Sequence
  chemically synthesized
ctctctcagggaagaattccat

SEQ ID NO: 648071 - DNA, 22 bp, Artificial Sequence
  chemically synthesized
tctctctcagggaagaattcca

SEQ ID NO: 648072 - DNA, 22 bp, Artificial Sequence
  chemically synthesized
gggaaatggaattcttccctga

SEQ ID NO: 648073 - DNA, 22 bp, Artificial Sequence
  chemically synthesized
ataaataagacctttctctctc

SEQ ID NO: 648074 - DNA, 22 bp, Artificial Sequence
  chemically synthesized
cataaataagacctttctctct

SEQ ID NO: 648075 - DNA, 22 bp, Artificial Sequence
  chemically synthesized
gtttcataaataagacctttct

SEQ ID NO: 648076 - DNA, 22 bp, Artificial Sequence
  chemically synthesized
ttccctgagagagaaaggtctt

SEQ ID NO: 648077 - DNA, 22 bp, Artificial Sequence
  chemically synthesized
ccctgagagagaaaggtcttat

SEQ ID NO: 648078 - DNA, 22 bp, Artificial Sequence
  chemically synthesized
cctgagagagaaaggtcttatt

SEQ ID NO: 648079 - DNA, 22 bp, Artificial Sequence
  chemically synthesized
agagagaaaggtcttatttatg

SEQ ID NO: 648080 - DNA, 22 bp, Artificial Sequence
  chemically synthesized
gatgacattggtttcataaata

SEQ ID NO: 648081 - DNA, 22 bp, Artificial Sequence
  chemically synthesized
acctagatgacattggtttcat

SEQ ID NO: 648082 - DNA, 22 bp, Artificial Sequence
  chemically synthesized
gacctagatgacattggtttca

SEQ ID NO: 648083 - DNA, 22 bp, Artificial Sequence
  chemically synthesized
cacttgacctagatgacattgg

SEQ ID NO: 648084 - DNA, 22 bp, Artificial Sequence
  chemically synthesized
atttatgaaaccaatgtcatct

SEQ ID NO: 648085 - DNA, 22 bp, Artificial Sequence
  chemically synthesized
tttatgaaaccaatgtcatcta

SEQ ID NO: 648086 - DNA, 22 bp, Artificial Sequence
  chemically synthesized
atgaaaccaatgtcatctaggt

SEQ ID NO: 648087 - DNA, 22 bp, Artificial Sequence
  chemically synthesized
tgattacacttgacctagatga

SEQ ID NO: 648088 - DNA, 22 bp, Artificial Sequence
  chemically synthesized
tgaaaccaatgtcatctaggtc

SEQ ID NO: 648089 - DNA, 22 bp, Artificial Sequence
  chemically synthesized
attatgattacacttgacctag

SEQ ID NO: 648090 - DNA, 22 bp, Artificial Sequence
  chemically synthesized
gattatgattacacttgaccta

SEQ ID NO: 648091 - DNA, 22 bp, Artificial Sequence
  chemically synthesized
aatttgattatgattacacttg

SEQ ID NO: 648092 - DNA, 22 bp, Artificial Sequence
  chemically synthesized
caatttgattatgattacactt

SEQ ID NO: 648093 - DNA, 22 bp, Artificial Sequence
  chemically synthesized
atttcaatttgattatgattac

SEQ ID NO: 648094 - DNA, 22 bp, Artificial Sequence
  chemically synthesized
ggtcaagtgtaatcataatcaa

SEQ ID NO: 648095 - DNA, 22 bp, Artificial Sequence
  chemically synthesized
taactcatttcaatttgattat

SEQ ID NO: 648096 - DNA, 22 bp, Artificial Sequence
  chemically synthesized
ataactcatttcaatttgatta

SEQ ID NO: 648097 - DNA, 22 bp, Artificial Sequence
  chemically synthesized
tataactcatttcaatttgatt

SEQ ID NO: 648098 - DNA, 22 bp, Artificial Sequence
  chemically synthesized
aacgtctttataactcatttca

SEQ ID NO: 648099 - DNA, 22 bp, Artificial Sequence
  chemically synthesized
aaacgtctttataactcatttc

SEQ ID NO: 648100 - DNA, 22 bp, Artificial Sequence
  chemically synthesized
acaatttaaacgtctttataac

SEQ ID NO: 648101 - DNA, 22 bp, Artificial Sequence
  chemically synthesized
gacaatttaaacgtctttataa

SEQ ID NO: 648102 - DNA, 22 bp, Artificial Sequence
  chemically synthesized
ttgacaatttaaacgtctttat

SEQ ID NO: 648103 - DNA, 22 bp, Artificial Sequence
  chemically synthesized
aaatgagttataaagacgttta

SEQ ID NO: 648104 - DNA, 22 bp, Artificial Sequence
  chemically synthesized
ctcttgacaatttaaacgtctt

SEQ ID NO: 648105 - DNA, 22 bp, Artificial Sequence
  chemically synthesized
cctcttgacaatttaaacgtct

SEQ ID NO: 648106 - DNA, 22 bp, Artificial Sequence
  chemically synthesized
tttcctcttgacaatttaaacg

SEQ ID NO: 648107 - DNA, 22 bp, Artificial Sequence
  chemically synthesized
gtttcctcttgacaatttaaac

SEQ ID NO: 648108 - DNA, 22 bp, Artificial Sequence
  chemically synthesized
tgtttcctcttgacaatttaaa

SEQ ID NO: 648109 - DNA, 22 bp, Artificial Sequence
  chemically synthesized
taaagacgtttaaattgtcaag

SEQ ID NO: 648110 - DNA, 22 bp, Artificial Sequence
  chemically synthesized
agtagtcatcgttttgtttcct

SEQ ID NO: 648111 - DNA, 22 bp, Artificial Sequence
  chemically synthesized
aaattgtcaagaggaaacaaaa

SEQ ID NO: 648112 - DNA, 22 bp, Artificial Sequence
  chemically synthesized
aattgtcaagaggaaacaaaac

SEQ ID NO: 648113 - DNA, 22 bp, Artificial Sequence
  chemically synthesized
aattgagtagtcatcgttttgt

SEQ ID NO: 648114 - DNA, 22 bp, Artificial Sequence
  chemically synthesized
tcaagaggaaacaaaacgatga

SEQ ID NO: 648115 - DNA, 22 bp, Artificial Sequence
  chemically synthesized
ttaaattgagtagtcatcgttt

SEQ ID NO: 648116 - DNA, 22 bp, Artificial Sequence
  chemically synthesized
attaaattgagtagtcatcgtt

SEQ ID NO: 648117 - DNA, 22 bp, Artificial Sequence
  chemically synthesized
cttattaaattgagtagtcatc

SEQ ID NO: 648118 - DNA, 22 bp, Artificial Sequence
  chemically synthesized
gatctgcttattaaattgagta

SEQ ID NO: 648119 - DNA, 22 bp, Artificial Sequence
  chemically synthesized
ggatctgcttattaaattgagt

SEQ ID NO: 648120 - DNA, 22 bp, Artificial Sequence
  chemically synthesized
tggatctgcttattaaattgag

SEQ ID NO: 648121 - DNA, 22 bp, Artificial Sequence
  chemically synthesized
ctcaatttaataagcagatcca

SEQ ID NO: 648122 - DNA, 22 bp, Artificial Sequence
  chemically synthesized
acatggaaatctttggatctgc

SEQ ID NO: 648123 - DNA, 22 bp, Artificial Sequence
  chemically synthesized
cacatggaaatctttggatctg

SEQ ID NO: 648124 - DNA, 22 bp, Artificial Sequence
  chemically synthesized
aatttaataagcagatccaaag

SEQ ID NO: 648125 - DNA, 22 bp, Artificial Sequence
  chemically synthesized
aataagcagatccaaagatttc

SEQ ID NO: 648126 - DNA, 22 bp, Artificial Sequence
  chemically synthesized
ataagcagatccaaagatttcc

SEQ ID NO: 648127 - DNA, 22 bp, Artificial Sequence
  chemically synthesized
tagtgaagtttcacatggaaat

SEQ ID NO: 648128 - DNA, 22 bp, Artificial Sequence
  chemically synthesized
caaaactatagtgaagtttcac

SEQ ID NO: 648129 - DNA, 22 bp, Artificial Sequence
  chemically synthesized
tccaaaactatagtgaagtttc

SEQ ID NO: 648130 - DNA, 22 bp, Artificial Sequence
  chemically synthesized
actctccaaaactatagtgaag

SEQ ID NO: 648131 - DNA, 22 bp, Artificial Sequence
  chemically synthesized
ccatgtgaaacttcactatagt

SEQ ID NO: 648132 - DNA, 22 bp, Artificial Sequence
  chemically synthesized
catgtgaaacttcactatagtt

SEQ ID NO: 648133 - DNA, 22 bp, Artificial Sequence
  chemically synthesized
acagattaactctccaaaacta

SEQ ID NO: 648134 - DNA, 22 bp, Artificial Sequence
  chemically synthesized
cactatagttttggagagttaa

SEQ ID NO: 648135 - DNA, 22 bp, Artificial Sequence
  chemically synthesized
actatagttttggagagttaat

SEQ ID NO: 648136 - DNA, 22 bp, Artificial Sequence
  chemically synthesized
gaagattaacagattaactctc

SEQ ID NO: 648137 - DNA, 22 bp, Artificial Sequence
  chemically synthesized
tagaagattaacagattaactc

SEQ ID NO: 648138 - DNA, 22 bp, Artificial Sequence
  chemically synthesized
tagttttggagagttaatctgt

SEQ ID NO: 648139 - DNA, 22 bp, Artificial Sequence
  chemically synthesized
tggagagttaatctgttaatct

SEQ ID NO: 648140 - DNA, 22 bp, Artificial Sequence
  chemically synthesized
ggagagttaatctgttaatctt

SEQ ID NO: 648141 - DNA, 22 bp, Artificial Sequence
  chemically synthesized
gagagttaatctgttaatcttc

SEQ ID NO: 648142 - DNA, 22 bp, Artificial Sequence
  chemically synthesized
tgccagggttctagaagattaa

SEQ ID NO: 648143 - DNA, 22 bp, Artificial Sequence
  chemically synthesized
atctgttaatcttctagaaccc

SEQ ID NO: 648144 - DNA, 22 bp, Artificial Sequence
  chemically synthesized
ataatgggctatgccagggttc

SEQ ID NO: 648145 - DNA, 22 bp, Artificial Sequence
  chemically synthesized
ttaatcttctagaaccctggca

SEQ ID NO: 648146 - DNA, 22 bp, Artificial Sequence
  chemically synthesized
taataatgggctatgccagggt

SEQ ID NO: 648147 - DNA, 22 bp, Artificial Sequence
  chemically synthesized
ctaataatgggctatgccaggg

SEQ ID NO: 648148 - DNA, 22 bp, Artificial Sequence
  chemically synthesized
atcttctagaaccctggcatag

SEQ ID NO: 648149 - DNA, 22 bp, Artificial Sequence
  chemically synthesized
tctaataatgggctatgccagg

SEQ ID NO: 648150 - DNA, 22 bp, Artificial Sequence
  chemically synthesized
ttctaataatgggctatgccag

SEQ ID NO: 648151 - DNA, 22 bp, Artificial Sequence
  chemically synthesized
ctagaaccctggcatagcccat

SEQ ID NO: 648152 - DNA, 22 bp, Artificial Sequence
  chemically synthesized
tagaaccctggcatagcccatt

SEQ ID NO: 648153 - DNA, 22 bp, Artificial Sequence
  chemically synthesized
gcatttttctaataatgggcta

SEQ ID NO: 648154 - DNA, 22 bp, Artificial Sequence
  chemically synthesized
gaaccctggcatagcccattat

SEQ ID NO: 648155 - DNA, 22 bp, Artificial Sequence
  chemically synthesized
agcatttttctaataatgggct

SEQ ID NO: 648156 - DNA, 22 bp, Artificial Sequence
  chemically synthesized
gcatagcccattattagaaaaa

SEQ ID NO: 648157 - DNA, 22 bp, Artificial Sequence
  chemically synthesized
aaaacagaccttagcatttttc

SEQ ID NO: 648158 - DNA, 22 bp, Artificial Sequence
  chemically synthesized
caaaacagaccttagcattttt

SEQ ID NO: 648159 - DNA, 22 bp, Artificial Sequence
  chemically synthesized
ttagaaaaatgctaaggtctgt

SEQ ID NO: 648160 - DNA, 22 bp, Artificial Sequence
  chemically synthesized
gaaaaatgctaaggtctgtttt

SEQ ID NO: 648161 - DNA, 22 bp, Artificial Sequence
  chemically synthesized
cagtgaagatttcaaaacagac

SEQ ID NO: 648162 - DNA, 22 bp, Artificial Sequence
  chemically synthesized
atctgcagtgaagatttcaaaa

SEQ ID NO: 648163 - DNA, 22 bp, Artificial Sequence
  chemically synthesized
gatctgcagtgaagatttcaaa

SEQ ID NO: 648164 - DNA, 22 bp, Artificial Sequence
  chemically synthesized
aggtctgttttgaaatcttcac

SEQ ID NO: 648165 - DNA, 22 bp, Artificial Sequence
  chemically synthesized
tcttgatctgcagtgaagattt

SEQ ID NO: 648166 - DNA, 22 bp, Artificial Sequence
  chemically synthesized
atcttgatctgcagtgaagatt

SEQ ID NO: 648167 - DNA, 22 bp, Artificial Sequence
  chemically synthesized
atttatcttgatctgcagtgaa

SEQ ID NO: 648168 - DNA, 22 bp, Artificial Sequence
  chemically synthesized
ttttgaaatcttcactgcagat

SEQ ID NO: 648169 - DNA, 22 bp, Artificial Sequence
  chemically synthesized
tgaaatcttcactgcagatcaa

SEQ ID NO: 648170 - DNA, 22 bp, Artificial Sequence
  chemically synthesized
gaaatcttcactgcagatcaag

SEQ ID NO: 648171 - DNA, 22 bp, Artificial Sequence
  chemically synthesized
aaatcttcactgcagatcaaga

SEQ ID NO: 648172 - DNA, 22 bp, Artificial Sequence
  chemically synthesized
cactgcagatcaagataaatta

SEQ ID NO: 648173 - DNA, 22 bp, Artificial Sequence
  chemically synthesized
actgcagatcaagataaattaa

SEQ ID NO: 648174 - DNA, 22 bp, Artificial Sequence
  chemically synthesized
cagatcaagataaattaatact

SEQ ID NO: 648175 - DNA, 22 bp, Artificial Sequence
  chemically synthesized
taatacaaataatccaagtatt

SEQ ID NO: 648176 - DNA, 22 bp, Artificial Sequence
  chemically synthesized
ataatacaaataatccaagtat

SEQ ID NO: 648177 - DNA, 22 bp, Artificial Sequence
  chemically synthesized
ttataatacaaataatccaagt

SEQ ID NO: 648178 - DNA, 22 bp, Artificial Sequence
  chemically synthesized
atacttggattatttgtattat

SEQ ID NO: 648179 - DNA, 22 bp, Artificial Sequence
  chemically synthesized
caaaagatagttcttataatac

SEQ ID NO: 648180 - DNA, 22 bp, Artificial Sequence
  chemically synthesized
ggattatttgtattataagaac

SEQ ID NO: 648181 - DNA, 22 bp, Artificial Sequence
  chemically synthesized
ttccaaaagatagttcttataa

SEQ ID NO: 648182 - DNA, 22 bp, Artificial Sequence
  chemically synthesized
gattatttgtattataagaact

SEQ ID NO: 648183 - DNA, 22 bp, Artificial Sequence
  chemically synthesized
gtctgttccaaaagatagttct

SEQ ID NO: 648184 - DNA, 22 bp, Artificial Sequence
  chemically synthesized
tttgtattataagaactatctt

SEQ ID NO: 648185 - DNA, 22 bp, Artificial Sequence
  chemically synthesized
gtattataagaactatcttttg

SEQ ID NO: 648186 - DNA, 22 bp, Artificial Sequence
  chemically synthesized
tattataagaactatcttttgg

SEQ ID NO: 648187 - DNA, 22 bp, Artificial Sequence
  chemically synthesized
aaagactggtctgttccaaaag

SEQ ID NO: 648188 - DNA, 22 bp, Artificial Sequence
  chemically synthesized
taagaactatcttttggaacag

SEQ ID NO: 648189 - DNA, 22 bp, Artificial Sequence
  chemically synthesized
tcttttggaacagaccagtctt

SEQ ID NO: 648190 - DNA, 22 bp, Artificial Sequence
  chemically synthesized
ttggaacagaccagtctttcaa

SEQ ID NO: 648191 - DNA, 22 bp, Artificial Sequence
  chemically synthesized
tggaacagaccagtctttcaat

SEQ ID NO: 648192 - DNA, 22 bp, Artificial Sequence
  chemically synthesized
aaaaaatatgtaattgaaagac

SEQ ID NO: 648193 - DNA, 22 bp, Artificial Sequence
  chemically synthesized
ggaacagaccagtctttcaatt

SEQ ID NO: 648194 - DNA, 22 bp, Artificial Sequence
  chemically synthesized
gaacagaccagtctttcaatta

SEQ ID NO: 648195 - DNA, 22 bp, Artificial Sequence
  chemically synthesized
ttaaaaaaatatgtaattgaaa

SEQ ID NO: 648196 - DNA, 22 bp, Artificial Sequence
  chemically synthesized
attaaaaaaatatgtaattgaa

SEQ ID NO: 648197 - DNA, 22 bp, Artificial Sequence
  chemically synthesized
cttattaaaaaaatatgtaatt

SEQ ID NO: 648198 - DNA, 22 bp, Artificial Sequence
  chemically synthesized
gcttattaaaaaaatatgtaat

SEQ ID NO: 648199 - DNA, 22 bp, Artificial Sequence
  chemically synthesized
tgcttattaaaaaaatatgtaa

SEQ ID NO: 648200 - DNA, 22 bp, Artificial Sequence
  chemically synthesized
ttgcttattaaaaaaatatgta

SEQ ID NO: 648201 - DNA, 22 bp, Artificial Sequence
  chemically synthesized
tttgcttattaaaaaaatatgt

SEQ ID NO: 648202 - DNA, 22 bp, Artificial Sequence
  chemically synthesized
tcaattacatatttttttaata

SEQ ID NO: 648203 - DNA, 22 bp, Artificial Sequence
  chemically synthesized
caattacatatttttttaataa

SEQ ID NO: 648204 - DNA, 22 bp, Artificial Sequence
  chemically synthesized
aattacatatttttttaataag

SEQ ID NO: 648205 - DNA, 22 bp, Artificial Sequence
  chemically synthesized
atggtaggctttttgcttatta

SEQ ID NO: 648206 - DNA, 22 bp, Artificial Sequence
  chemically synthesized
catatttttttaataagcaaaa

SEQ ID NO: 648207 - DNA, 22 bp, Artificial Sequence
  chemically synthesized
cctgatggtaggctttttgctt

SEQ ID NO: 648208 - DNA, 22 bp, Artificial Sequence
  chemically synthesized
ccctgatggtaggctttttgct

SEQ ID NO: 648209 - DNA, 22 bp, Artificial Sequence
  chemically synthesized
tccctgatggtaggctttttgc

SEQ ID NO: 648210 - DNA, 22 bp, Artificial Sequence
  chemically synthesized
ttttaataagcaaaaagcctac

SEQ ID NO: 648211 - DNA, 22 bp, Artificial Sequence
  chemically synthesized
tttaataagcaaaaagcctacc

SEQ ID NO: 648212 - DNA, 22 bp, Artificial Sequence
  chemically synthesized
ttaataagcaaaaagcctacca

SEQ ID NO: 648213 - DNA, 22 bp, Artificial Sequence
  chemically synthesized
taataagcaaaaagcctaccat

SEQ ID NO: 648214 - DNA, 22 bp, Artificial Sequence
  chemically synthesized
aataagcaaaaagcctaccatc

SEQ ID NO: 648215 - DNA, 22 bp, Artificial Sequence
  chemically synthesized
ataagcaaaaagcctaccatca

SEQ ID NO: 648216 - DNA, 22 bp, Artificial Sequence
  chemically synthesized
atgtattttccctgatggtagg

SEQ ID NO: 648217 - DNA, 22 bp, Artificial Sequence
  chemically synthesized
ctaatgtattttccctgatggt

SEQ ID NO: 648218 - DNA, 22 bp, Artificial Sequence
  chemically synthesized
ccatcagggaaaatacattagt

SEQ ID NO: 648219 - DNA, 22 bp, Artificial Sequence
  chemically synthesized
caagggaaaacactactaatgt

SEQ ID NO: 648220 - DNA, 22 bp, Artificial Sequence
  chemically synthesized
ttacaagggaaaacactactaa

SEQ ID NO: 648221 - DNA, 22 bp, Artificial Sequence
  chemically synthesized
caggatagcaactattacaagg

SEQ ID NO: 648222 - DNA, 22 bp, Artificial Sequence
  chemically synthesized
gtagtgttttcccttgtaatag

SEQ ID NO: 648223 - DNA, 22 bp, Artificial Sequence
  chemically synthesized
ccaggatagcaactattacaag

SEQ ID NO: 648224 - DNA, 22 bp, Artificial Sequence
  chemically synthesized
tcccttgtaatagttgctatcc

SEQ ID NO: 648225 - DNA, 22 bp, Artificial Sequence
  chemically synthesized
tacacacttccaggatagcaac

SEQ ID NO: 648226 - DNA, 22 bp, Artificial Sequence
  chemically synthesized
cccttgtaatagttgctatcct

SEQ ID NO: 648227 - DNA, 22 bp, Artificial Sequence
  chemically synthesized
gtacacacttccaggatagcaa

SEQ ID NO: 648228 - DNA, 22 bp, Artificial Sequence
  chemically synthesized
ccttgtaatagttgctatcctg

SEQ ID NO: 648229 - DNA, 22 bp, Artificial Sequence
  chemically synthesized
ttgtacacacttccaggatagc

SEQ ID NO: 648230 - DNA, 22 bp, Artificial Sequence
  chemically synthesized
gtaatagttgctatcctggaag

SEQ ID NO: 648231 - DNA, 22 bp, Artificial Sequence
  chemically synthesized
taatagttgctatcctggaagt

SEQ ID NO: 648232 - DNA, 22 bp, Artificial Sequence
  chemically synthesized
attcttgtacacacttccagga

SEQ ID NO: 648233 - DNA, 22 bp, Artificial Sequence
  chemically synthesized
cattcttgtacacacttccagg

SEQ ID NO: 648234 - DNA, 22 bp, Artificial Sequence
  chemically synthesized
tcattcttgtacacacttccag

SEQ ID NO: 648235 - DNA, 22 bp, Artificial Sequence
  chemically synthesized
ggctttcattcttgtacacact

SEQ ID NO: 648236 - DNA, 22 bp, Artificial Sequence
  chemically synthesized
aggctttcattcttgtacacac

SEQ ID NO: 648237 - DNA, 22 bp, Artificial Sequence
  chemically synthesized
ctatcctggaagtgtgtacaag

SEQ ID NO: 648238 - DNA, 22 bp, Artificial Sequence
  chemically synthesized
tcctggaagtgtgtacaagaat

SEQ ID NO: 648239 - DNA, 22 bp, Artificial Sequence
  chemically synthesized
gaagtgtgtacaagaatgaaag

SEQ ID NO: 648240 - DNA, 22 bp, Artificial Sequence
  chemically synthesized
caaggtcttaggctttcattct

SEQ ID NO: 648241 - DNA, 22 bp, Artificial Sequence
  chemically synthesized
tgctccaaggtcttaggctttc

SEQ ID NO: 648242 - DNA, 22 bp, Artificial Sequence
  chemically synthesized
atgctccaaggtcttaggcttt

SEQ ID NO: 648243 - DNA, 22 bp, Artificial Sequence
  chemically synthesized
gtgtacttatgctccaaggtct

SEQ ID NO: 648244 - DNA, 22 bp, Artificial Sequence
  chemically synthesized
ggtgtacttatgctccaaggtc

SEQ ID NO: 648245 - DNA, 22 bp, Artificial Sequence
  chemically synthesized
ttggtgtacttatgctccaagg

SEQ ID NO: 648246 - DNA, 22 bp, Artificial Sequence
  chemically synthesized
cttggtgtacttatgctccaag

SEQ ID NO: 648247 - DNA, 22 bp, Artificial Sequence
  chemically synthesized
tcttggtgtacttatgctccaa

SEQ ID NO: 648248 - DNA, 22 bp, Artificial Sequence
  chemically synthesized
ttcttggtgtacttatgctcca

SEQ ID NO: 648249 - DNA, 22 bp, Artificial Sequence
  chemically synthesized
cttttcttggtgtacttatgct

SEQ ID NO: 648250 - DNA, 22 bp, Artificial Sequence
  chemically synthesized
agaccttggagcataagtacac

SEQ ID NO: 648251 - DNA, 22 bp, Artificial Sequence
  chemically synthesized
tatgcctacttttcttggtgta

SEQ ID NO: 648252 - DNA, 22 bp, Artificial Sequence
  chemically synthesized
atatgcctacttttcttggtgt

SEQ ID NO: 648253 - DNA, 22 bp, Artificial Sequence
  chemically synthesized
ggagcataagtacaccaagaaa

SEQ ID NO: 648254 - DNA, 22 bp, Artificial Sequence
  chemically synthesized
gagcataagtacaccaagaaaa

SEQ ID NO: 648255 - DNA, 22 bp, Artificial Sequence
  chemically synthesized
gatttatatgcctacttttctt

SEQ ID NO: 648256 - DNA, 22 bp, Artificial Sequence
  chemically synthesized
ggatttatatgcctacttttct

SEQ ID NO: 648257 - DNA, 22 bp, Artificial Sequence
  chemically synthesized
tggatttatatgcctacttttc

SEQ ID NO: 648258 - DNA, 22 bp, Artificial Sequence
  chemically synthesized
aagtattttggatttatatgcc

SEQ ID NO: 648259 - DNA, 22 bp, Artificial Sequence
  chemically synthesized
tataaaatggtattaaagtatt

SEQ ID NO: 648260 - DNA, 22 bp, Artificial Sequence
  chemically synthesized
tgtataaaatggtattaaagta

SEQ ID NO: 648261 - DNA, 22 bp, Artificial Sequence
  chemically synthesized
ctgtataaaatggtattaaagt

SEQ ID NO: 648262 - DNA, 22 bp, Artificial Sequence
  chemically synthesized
tctgtataaaatggtattaaag

SEQ ID NO: 648263 - DNA, 22 bp, Artificial Sequence
  chemically synthesized
tataagattttctgtataaaat

SEQ ID NO: 648264 - DNA, 22 bp, Artificial Sequence
  chemically synthesized
tgtataagattttctgtataaa

SEQ ID NO: 648265 - DNA, 22 bp, Artificial Sequence
  chemically synthesized
taataccattttatacagaaaa

SEQ ID NO: 648266 - DNA, 22 bp, Artificial Sequence
  chemically synthesized
aataccattttatacagaaaat

SEQ ID NO: 648267 - DNA, 22 bp, Artificial Sequence
  chemically synthesized
ataccattttatacagaaaatc

SEQ ID NO: 648268 - DNA, 22 bp, Artificial Sequence
  chemically synthesized
aagctctgtataagattttctg

SEQ ID NO: 648269 - DNA, 22 bp, Artificial Sequence
  chemically synthesized
tatacagaaaatcttatacaga

SEQ ID NO: 648270 - DNA, 22 bp, Artificial Sequence
  chemically synthesized
atacagaaaatcttatacagag

SEQ ID NO: 648271 - DNA, 22 bp, Artificial Sequence
  chemically synthesized
tacagaaaatcttatacagagc

SEQ ID NO: 648272 - DNA, 22 bp, Artificial Sequence
  chemically synthesized
aggcaaagaattaaagctctgt

SEQ ID NO: 648273 - DNA, 22 bp, Artificial Sequence
  chemically synthesized
gaggcaaagaattaaagctctg

SEQ ID NO: 648274 - DNA, 22 bp, Artificial Sequence
  chemically synthesized
tccttgaggcaaagaattaaag

SEQ ID NO: 648275 - DNA, 22 bp, Artificial Sequence
  chemically synthesized
atacagagctttaattctttgc

SEQ ID NO: 648276 - DNA, 22 bp, Artificial Sequence
  chemically synthesized
tacagagctttaattctttgcc

SEQ ID NO: 648277 - DNA, 22 bp, Artificial Sequence
  chemically synthesized
taattctttgcctcaaggataa

SEQ ID NO: 648278 - DNA, 22 bp, Artificial Sequence
  chemically synthesized
aattctttgcctcaaggataat

SEQ ID NO: 648279 - DNA, 22 bp, Artificial Sequence
  chemically synthesized
attctttgcctcaaggataatt

SEQ ID NO: 648280 - DNA, 22 bp, Artificial Sequence
  chemically synthesized
tttgcctcaaggataattccat

SEQ ID NO: 648281 - DNA, 22 bp, Artificial Sequence
  chemically synthesized
tgcctcaaggataattccatgt

SEQ ID NO: 648282 - DNA, 22 bp, Artificial Sequence
  chemically synthesized
ataagaaaaataacatggaatt

SEQ ID NO: 648283 - DNA, 22 bp, Artificial Sequence
  chemically synthesized
gcctcaaggataattccatgtt

SEQ ID NO: 648284 - DNA, 22 bp, Artificial Sequence
  chemically synthesized
cctcaaggataattccatgtta

SEQ ID NO: 648285 - DNA, 22 bp, Artificial Sequence
  chemically synthesized
aaggataattccatgttatttt

SEQ ID NO: 648286 - DNA, 22 bp, Artificial Sequence
  chemically synthesized
atattaataagaaaaataacat

SEQ ID NO: 648287 - DNA, 22 bp, Artificial Sequence
  chemically synthesized
catgttatttttcttattaata

SEQ ID NO: 648288 - DNA, 22 bp, Artificial Sequence
  chemically synthesized
tgataggcgccactgatattaa

SEQ ID NO: 648289 - DNA, 22 bp, Artificial Sequence
  chemically synthesized
tttttcttattaatatcagtgg

SEQ ID NO: 648290 - DNA, 22 bp, Artificial Sequence
  chemically synthesized
ttcttattaatatcagtggcgc

SEQ ID NO: 648291 - DNA, 22 bp, Artificial Sequence
  chemically synthesized
tcttattaatatcagtggcgcc

SEQ ID NO: 648292 - DNA, 22 bp, Artificial Sequence
  chemically synthesized
cttattaatatcagtggcgcct

SEQ ID NO: 648293 - DNA, 22 bp, Artificial Sequence
  chemically synthesized
ttattaatatcagtggcgccta

SEQ ID NO: 648294 - DNA, 22 bp, Artificial Sequence
  chemically synthesized
tgcatgctgtgataggcgccac

SEQ ID NO: 648295 - DNA, 22 bp, Artificial Sequence
  chemically synthesized
atgcatgctgtgataggcgcca

SEQ ID NO: 648296 - DNA, 22 bp, Artificial Sequence
  chemically synthesized
attaatatcagtggcgcctatc

SEQ ID NO: 648297 - DNA, 22 bp, Artificial Sequence
  chemically synthesized
ttaatatcagtggcgcctatca

SEQ ID NO: 648298 - DNA, 22 bp, Artificial Sequence
  chemically synthesized
atatcagtggcgcctatcacag

SEQ ID NO: 648299 - DNA, 22 bp, Artificial Sequence
  chemically synthesized
tgcttatgcatgctgtgatagg

SEQ ID NO: 648300 - DNA, 22 bp, Artificial Sequence
  chemically synthesized
gtgcttatgcatgctgtgatag

SEQ ID NO: 648301 - DNA, 22 bp, Artificial Sequence
  chemically synthesized
ttgtgcttatgcatgctgtgat

SEQ ID NO: 648302 - DNA, 22 bp, Artificial Sequence
  chemically synthesized
taagttcttgtgcttatgcatg

SEQ ID NO: 648303 - DNA, 22 bp, Artificial Sequence
  chemically synthesized
ttgtaagttcttgtgcttatgc

SEQ ID NO: 648304 - DNA, 22 bp, Artificial Sequence
  chemically synthesized
tcacagcatgcataagcacaag

SEQ ID NO: 648305 - DNA, 22 bp, Artificial Sequence
  chemically synthesized
gttattgtaagttcttgtgctt

SEQ ID NO: 648306 - DNA, 22 bp, Artificial Sequence
  chemically synthesized
tggttattgtaagttcttgtgc

SEQ ID NO: 648307 - DNA, 22 bp, Artificial Sequence
  chemically synthesized
ctggttattgtaagttcttgtg

SEQ ID NO: 648308 - DNA, 22 bp, Artificial Sequence
  chemically synthesized
agatttctggttattgtaagtt

SEQ ID NO: 648309 - DNA, 22 bp, Artificial Sequence
  chemically synthesized
aagatttctggttattgtaagt

SEQ ID NO: 648310 - DNA, 22 bp, Artificial Sequence
  chemically synthesized
taagatttctggttattgtaag

SEQ ID NO: 648311 - DNA, 22 bp, Artificial Sequence
  chemically synthesized
ttaagatttctggttattgtaa

SEQ ID NO: 648312 - DNA, 22 bp, Artificial Sequence
  chemically synthesized
tttaagatttctggttattgta

SEQ ID NO: 648313 - DNA, 22 bp, Artificial Sequence
  chemically synthesized
gtgtatattttttaagatttct

SEQ ID NO: 648314 - DNA, 22 bp, Artificial Sequence
  chemically synthesized
agtgtatattttttaagatttc

SEQ ID NO: 648315 - DNA, 22 bp, Artificial Sequence
  chemically synthesized
tagtgtatattttttaagattt

SEQ ID NO: 648316 - DNA, 22 bp, Artificial Sequence
  chemically synthesized
acaataaccagaaatcttaaaa

SEQ ID NO: 648317 - DNA, 22 bp, Artificial Sequence
  chemically synthesized
ttagtgtatattttttaagatt

SEQ ID NO: 648318 - DNA, 22 bp, Artificial Sequence
  chemically synthesized
caataaccagaaatcttaaaaa

SEQ ID NO: 648319 - DNA, 22 bp, Artificial Sequence
  chemically synthesized
ttttagtgtatattttttaaga

SEQ ID NO: 648320 - DNA, 22 bp, Artificial Sequence
  chemically synthesized
ataaatgtctcttttagtgtat

SEQ ID NO: 648321 - DNA, 22 bp, Artificial Sequence
  chemically synthesized
aataaatgtctcttttagtgta

SEQ ID NO: 648322 - DNA, 22 bp, Artificial Sequence
  chemically synthesized
aaaaaatatacactaaaagaga

SEQ ID NO: 648323 - DNA, 22 bp, Artificial Sequence
  chemically synthesized
gtttaataaatgtctcttttag

SEQ ID NO: 648324 - DNA, 22 bp, Artificial Sequence
  chemically synthesized
aaaaatatacactaaaagagac

SEQ ID NO: 648325 - DNA, 22 bp, Artificial Sequence
  chemically synthesized
tggtttaataaatgtctctttt

SEQ ID NO: 648326 - DNA, 22 bp, Artificial Sequence
  chemically synthesized
ctggtttaataaatgtctcttt

SEQ ID NO: 648327 - DNA, 22 bp, Artificial Sequence
  chemically synthesized
tctggtttaataaatgtctctt

SEQ ID NO: 648328 - DNA, 22 bp, Artificial Sequence
  chemically synthesized
attttctggtttaataaatgtc

SEQ ID NO: 648329 - DNA, 22 bp, Artificial Sequence
  chemically synthesized
gctcattttctggtttaataaa

SEQ ID NO: 648330 - DNA, 22 bp, Artificial Sequence
  chemically synthesized
ggctcattttctggtttaataa

SEQ ID NO: 648331 - DNA, 22 bp, Artificial Sequence
  chemically synthesized
tggctcattttctggtttaata

SEQ ID NO: 648332 - DNA, 22 bp, Artificial Sequence
  chemically synthesized
aaagagacatttattaaaccag

SEQ ID NO: 648333 - DNA, 22 bp, Artificial Sequence
  chemically synthesized
ttggctcattttctggtttaat

SEQ ID NO: 648334 - DNA, 22 bp, Artificial Sequence
  chemically synthesized
ccttttggctcattttctggtt

SEQ ID NO: 648335 - DNA, 22 bp, Artificial Sequence
  chemically synthesized
attaaaccagaaaatgagccaa

SEQ ID NO: 648336 - DNA, 22 bp, Artificial Sequence
  chemically synthesized
ttaaaccagaaaatgagccaaa

SEQ ID NO: 648337 - DNA, 22 bp, Artificial Sequence
  chemically synthesized
accagtactcccttttggctca

SEQ ID NO: 648338 - DNA, 22 bp, Artificial Sequence
  chemically synthesized
aaccagaaaatgagccaaaagg

SEQ ID NO: 648339 - DNA, 22 bp, Artificial Sequence
  chemically synthesized
tgaccagtactcccttttggct

SEQ ID NO: 648340 - DNA, 22 bp, Artificial Sequence
  chemically synthesized
atctctgaccagtactcccttt

SEQ ID NO: 648341 - DNA, 22 bp, Artificial Sequence
  chemically synthesized
aatgattcatctctgaccagta

SEQ ID NO: 648342 - DNA, 22 bp, Artificial Sequence
  chemically synthesized
aaatgattcatctctgaccagt

SEQ ID NO: 648343 - DNA, 22 bp, Artificial Sequence
  chemically synthesized
taaatgattcatctctgaccag

SEQ ID NO: 648344 - DNA, 22 bp, Artificial Sequence
  chemically synthesized
ttaaatgattcatctctgacca

SEQ ID NO: 648345 - DNA, 22 bp, Artificial Sequence
  chemically synthesized
gtttttaaatgattcatctctg

SEQ ID NO: 648346 - DNA, 22 bp, Artificial Sequence
  chemically synthesized
ggtttttaaatgattcatctct

SEQ ID NO: 648347 - DNA, 22 bp, Artificial Sequence
  chemically synthesized
ttggtttttaaatgattcatct

SEQ ID NO: 648348 - DNA, 22 bp, Artificial Sequence
  chemically synthesized
attcttggtttttaaatgattc

SEQ ID NO: 648349 - DNA, 22 bp, Artificial Sequence
  chemically synthesized
gtcagagatgaatcatttaaaa

SEQ ID NO: 648350 - DNA, 22 bp, Artificial Sequence
  chemically synthesized
actaattcttggtttttaaatg

SEQ ID NO: 648351 - DNA, 22 bp, Artificial Sequence
  chemically synthesized
cactaattcttggtttttaaat

SEQ ID NO: 648352 - DNA, 22 bp, Artificial Sequence
  chemically synthesized
tcactaattcttggtttttaaa

SEQ ID NO: 648353 - DNA, 22 bp, Artificial Sequence
  chemically synthesized
tattttcactaattcttggttt

SEQ ID NO: 648354 - DNA, 22 bp, Artificial Sequence
  chemically synthesized
gtattttcactaattcttggtt

SEQ ID NO: 648355 - DNA, 22 bp, Artificial Sequence
  chemically synthesized
tgtattttcactaattcttggt

SEQ ID NO: 648356 - DNA, 22 bp, Artificial Sequence
  chemically synthesized
aaaaaccaagaattagtgaaaa

SEQ ID NO: 648357 - DNA, 22 bp, Artificial Sequence
  chemically synthesized
agtggctttgtattttcactaa

SEQ ID NO: 648358 - DNA, 22 bp, Artificial Sequence
  chemically synthesized
aaaaccaagaattagtgaaaat

SEQ ID NO: 648359 - DNA, 22 bp, Artificial Sequence
  chemically synthesized
tggactaagtggctttgtattt

SEQ ID NO: 648360 - DNA, 22 bp, Artificial Sequence
  chemically synthesized
gtggactaagtggctttgtatt

SEQ ID NO: 648361 - DNA, 22 bp, Artificial Sequence
  chemically synthesized
tttgtggactaagtggctttgt

SEQ ID NO: 648362 - DNA, 22 bp, Artificial Sequence
  chemically synthesized
gtttgtggactaagtggctttg

SEQ ID NO: 648363 - DNA, 22 bp, Artificial Sequence
  chemically synthesized
tgtttgtggactaagtggcttt

SEQ ID NO: 648364 - DNA, 22 bp, Artificial Sequence
  chemically synthesized
gtgaaaatacaaagccacttag

SEQ ID NO: 648365 - DNA, 22 bp, Artificial Sequence
  chemically synthesized
gttttgtttgtggactaagtgg

SEQ ID NO: 648366 - DNA, 22 bp, Artificial Sequence
  chemically synthesized
agttttgtttgtggactaagtg

SEQ ID NO: 648367 - DNA, 22 bp, Artificial Sequence
  chemically synthesized
cacttagttttgtttgtggact

SEQ ID NO: 648368 - DNA, 22 bp, Artificial Sequence
  chemically synthesized
gcacttagttttgtttgtggac

SEQ ID NO: 648369 - DNA, 22 bp, Artificial Sequence
  chemically synthesized
tgcacttagttttgtttgtgga

SEQ ID NO: 648370 - DNA, 22 bp, Artificial Sequence
  chemically synthesized
gaaggctttgcacttagttttg

SEQ ID NO: 648371 - DNA, 22 bp, Artificial Sequence
  chemically synthesized
agaaggctttgcacttagtttt

SEQ ID NO: 648372 - DNA, 22 bp, Artificial Sequence
  chemically synthesized
agtccacaaacaaaactaagtg

SEQ ID NO: 648373 - DNA, 22 bp, Artificial Sequence
  chemically synthesized
tagaaggctttgcacttagttt

SEQ ID NO: 648374 - DNA, 22 bp, Artificial Sequence
  chemically synthesized
gtccacaaacaaaactaagtgc

SEQ ID NO: 648375 - DNA, 22 bp, Artificial Sequence
  chemically synthesized
gaagtgttttagaaggctttgc

SEQ ID NO: 648376 - DNA, 22 bp, Artificial Sequence
  chemically synthesized
ggaagtgttttagaaggctttg

SEQ ID NO: 648377 - DNA, 22 bp, Artificial Sequence
  chemically synthesized
tggaagtgttttagaaggcttt

SEQ ID NO: 648378 - DNA, 22 bp, Artificial Sequence
  chemically synthesized
ttggaagtgttttagaaggctt

SEQ ID NO: 648379 - DNA, 22 bp, Artificial Sequence
  chemically synthesized
ttttggaagtgttttagaaggc

SEQ ID NO: 648380 - DNA, 22 bp, Artificial Sequence
  chemically synthesized
cttttggaagtgttttagaagg

SEQ ID NO: 648381 - DNA, 22 bp, Artificial Sequence
  chemically synthesized
agtgcaaagccttctaaaacac

SEQ ID NO: 648382 - DNA, 22 bp, Artificial Sequence
  chemically synthesized
ccttcttttggaagtgttttag

SEQ ID NO: 648383 - DNA, 22 bp, Artificial Sequence
  chemically synthesized
ttaccttcttttggaagtgttt

SEQ ID NO: 648384 - DNA, 22 bp, Artificial Sequence
  chemically synthesized
ctaaaacacttccaaaagaagg

SEQ ID NO: 648385 - DNA, 22 bp, Artificial Sequence
  chemically synthesized
taaaacacttccaaaagaaggt

SEQ ID NO: 648386 - DNA, 22 bp, Artificial Sequence
  chemically synthesized
aaacacttccaaaagaaggtaa

SEQ ID NO: 648387 - DNA, 22 bp, Artificial Sequence
  chemically synthesized
ccaaaagaaggtaataatactg

SEQ ID NO: 648388 - DNA, 22 bp, Artificial Sequence
  chemically synthesized
caaaagaaggtaataatactgt

SEQ ID NO: 648389 - DNA, 22 bp, Artificial Sequence
  chemically synthesized
ggaagtgggaagcggggaacag

SEQ ID NO: 648390 - DNA, 22 bp, Artificial Sequence
  chemically synthesized
aggaagtgggaagcggggaaca

SEQ ID NO: 648391 - DNA, 22 bp, Artificial Sequence
  chemically synthesized
tgtttaggaagtgggaagcggg

SEQ ID NO: 648392 - DNA, 22 bp, Artificial Sequence
  chemically synthesized
gtgtttaggaagtgggaagcgg

SEQ ID NO: 648393 - DNA, 22 bp, Artificial Sequence
  chemically synthesized
tgtgtttaggaagtgggaagcg

SEQ ID NO: 648394 - DNA, 22 bp, Artificial Sequence
  chemically synthesized
ttccccgcttcccacttcctaa

SEQ ID NO: 648395 - DNA, 22 bp, Artificial Sequence
  chemically synthesized
cccgcttcccacttcctaaaca

SEQ ID NO: 648396 - DNA, 22 bp, Artificial Sequence
  chemically synthesized
ggtatatggttttgtgtttagg

SEQ ID NO: 648397 - DNA, 22 bp, Artificial Sequence
  chemically synthesized
tgggtatatggttttgtgttta

SEQ ID NO: 648398 - DNA, 22 bp, Artificial Sequence
  chemically synthesized
ctgggtatatggttttgtgttt

SEQ ID NO: 648399 - DNA, 22 bp, Artificial Sequence
  chemically synthesized
cccacttcctaaacacaaaacc

SEQ ID NO: 648400 - DNA, 22 bp, Artificial Sequence
  chemically synthesized
ccacttcctaaacacaaaacca

SEQ ID NO: 648401 - DNA, 22 bp, Artificial Sequence
  chemically synthesized
cctaaacacaaaaccatatacc

SEQ ID NO: 648402 - DNA, 22 bp, Artificial Sequence
  chemically synthesized
ctaaacacaaaaccatataccc

SEQ ID NO: 648403 - DNA, 22 bp, Artificial Sequence
  chemically synthesized
aacacaaaaccatatacccaga

SEQ ID NO: 648404 - DNA, 22 bp, Artificial Sequence
  chemically synthesized
tagtaagtaatccttctgggta

SEQ ID NO: 648405 - DNA, 22 bp, Artificial Sequence
  chemically synthesized
atagtaagtaatccttctgggt

SEQ ID NO: 648406 - DNA, 22 bp, Artificial Sequence
  chemically synthesized
ttatagtaagtaatccttctgg

SEQ ID NO: 648407 - DNA, 22 bp, Artificial Sequence
  chemically synthesized
actcttatagtaagtaatcctt

SEQ ID NO: 648408 - DNA, 22 bp, Artificial Sequence
  chemically synthesized
accaagtaggtcattaactctt

SEQ ID NO: 648409 - DNA, 22 bp, Artificial Sequence
  chemically synthesized
cttactataagagttaatgacc

SEQ ID NO: 648410 - DNA, 22 bp, Artificial Sequence
  chemically synthesized
actataagagttaatgacctac

SEQ ID NO: 648411 - DNA, 22 bp, Artificial Sequence
  chemically synthesized
ctataagagttaatgacctact

SEQ ID NO: 648412 - DNA, 22 bp, Artificial Sequence
  chemically synthesized
taagagttaatgacctacttgg

SEQ ID NO: 648413 - DNA, 22 bp, Artificial Sequence
  chemically synthesized
atgacctacttggtcaattcca

SEQ ID NO: 648414 - DNA, 22 bp, Artificial Sequence
  chemically synthesized
cttggtcaattccatcccaccc

SEQ ID NO: 648415 - DNA, 22 bp, Artificial Sequence
  chemically synthesized
ggtcaattccatcccacccacc

SEQ ID NO: 648416 - DNA, 22 bp, Artificial Sequence
  chemically synthesized
gtcaattccatcccacccacca

SEQ ID NO: 648417 - DNA, 22 bp, Artificial Sequence
  chemically synthesized
ataaaagagaaggtggtggtgg

SEQ ID NO: 648418 - DNA, 22 bp, Artificial Sequence
  chemically synthesized
cataaaagagaaggtggtggtg

SEQ ID NO: 648419 - DNA, 22 bp, Artificial Sequence
  chemically synthesized
tcataaaagagaaggtggtggt

SEQ ID NO: 648420 - DNA, 22 bp, Artificial Sequence
  chemically synthesized
catcccacccaccaccaccttc

SEQ ID NO: 648421 - DNA, 22 bp, Artificial Sequence
  chemically synthesized
atagagttttcataaaagagaa

SEQ ID NO: 648422 - DNA, 22 bp, Artificial Sequence
  chemically synthesized
attaatagagttttcataaaag

SEQ ID NO: 648423 - DNA, 22 bp, Artificial Sequence
  chemically synthesized
aattaatagagttttcataaaa

SEQ ID NO: 648424 - DNA, 22 bp, Artificial Sequence
  chemically synthesized
taattaatagagttttcataaa

SEQ ID NO: 648425 - DNA, 22 bp, Artificial Sequence
  chemically synthesized
ttaattaatagagttttcataa

SEQ ID NO: 648426 - DNA, 22 bp, Artificial Sequence
  chemically synthesized
ctcttttatgaaaactctatta

SEQ ID NO: 648427 - DNA, 22 bp, Artificial Sequence
  chemically synthesized
tcttttatgaaaactctattaa

SEQ ID NO: 648428 - DNA, 22 bp, Artificial Sequence
  chemically synthesized
ttttatgaaaactctattaatt

SEQ ID NO: 648429 - DNA, 22 bp, Artificial Sequence
  chemically synthesized
ttatgaaaactctattaattaa

SEQ ID NO: 648430 - DNA, 22 bp, Artificial Sequence
  chemically synthesized
tatgaaaactctattaattaaa

SEQ ID NO: 648431 - DNA, 22 bp, Artificial Sequence
  chemically synthesized
atgaaaactctattaattaaaa

SEQ ID NO: 648432 - DNA, 22 bp, Artificial Sequence
  chemically synthesized
tgaaaactctattaattaaaag

SEQ ID NO: 648433 - DNA, 22 bp, Artificial Sequence
  chemically synthesized
aatgaatgtcagcttttaatta

SEQ ID NO: 648434 - DNA, 22 bp, Artificial Sequence
  chemically synthesized
aaacctaaatgaatgtcagctt

SEQ ID NO: 648435 - DNA, 22 bp, Artificial Sequence
  chemically synthesized
tattaattaaaagctgacattc

SEQ ID NO: 648436 - DNA, 22 bp, Artificial Sequence
  chemically synthesized
ttaattaaaagctgacattcat

SEQ ID NO: 648437 - DNA, 22 bp, Artificial Sequence
  chemically synthesized
cattgaaacctaaatgaatgtc

SEQ ID NO: 648438 - DNA, 22 bp, Artificial Sequence
  chemically synthesized
attaaaagctgacattcattta

SEQ ID NO: 648439 - DNA, 22 bp, Artificial Sequence
  chemically synthesized
tgcattgaaacctaaatgaatg

SEQ ID NO: 648440 - DNA, 22 bp, Artificial Sequence
  chemically synthesized
aaagctgacattcatttaggtt

SEQ ID NO: 648441 - DNA, 22 bp, Artificial Sequence
  chemically synthesized
agcgattctgcattgaaaccta

SEQ ID NO: 648442 - DNA, 22 bp, Artificial Sequence
  chemically synthesized
gagcgattctgcattgaaacct

SEQ ID NO: 648443 - DNA, 22 bp, Artificial Sequence
  chemically synthesized
tgagcgattctgcattgaaacc

SEQ ID NO: 648444 - DNA, 22 bp, Artificial Sequence
  chemically synthesized
acattcatttaggtttcaatgc

SEQ ID NO: 648445 - DNA, 22 bp, Artificial Sequence
  chemically synthesized
tttgagcgattctgcattgaaa

SEQ ID NO: 648446 - DNA, 22 bp, Artificial Sequence
  chemically synthesized
atttaggtttcaatgcagaatc

SEQ ID NO: 648447 - DNA, 22 bp, Artificial Sequence
  chemically synthesized
aggtttcaatgcagaatcgctc

SEQ ID NO: 648448 - DNA, 22 bp, Artificial Sequence
  chemically synthesized
ggtttcaatgcagaatcgctca

SEQ ID NO: 648449 - DNA, 22 bp, Artificial Sequence
  chemically synthesized
caatgcagaatcgctcaaagaa

SEQ ID NO: 648450 - DNA, 22 bp, Artificial Sequence
  chemically synthesized
aatgcagaatcgctcaaagaat

SEQ ID NO: 648451 - DNA, 22 bp, Artificial Sequence
  chemically synthesized
tccataagtgagccagtcaaac

SEQ ID NO: 648452 - DNA, 22 bp, Artificial Sequence
  chemically synthesized
aaagaatatcgtttgactggct

SEQ ID NO: 648453 - DNA, 22 bp, Artificial Sequence
  chemically synthesized
tctgtccataagtgagccagtc

SEQ ID NO: 648454 - DNA, 22 bp, Artificial Sequence
  chemically synthesized
cgttgtctgtccataagtgagc

SEQ ID NO: 648455 - DNA, 22 bp, Artificial Sequence
  chemically synthesized
acgttgtctgtccataagtgag

SEQ ID NO: 648456 - DNA, 22 bp, Artificial Sequence
  chemically synthesized
tacgttgtctgtccataagtga

SEQ ID NO: 648457 - DNA, 22 bp, Artificial Sequence
  chemically synthesized
gactggctcacttatggacaga

SEQ ID NO: 648458 - DNA, 22 bp, Artificial Sequence
  chemically synthesized
actggctcacttatggacagac

SEQ ID NO: 648459 - DNA, 22 bp, Artificial Sequence
  chemically synthesized
gctcacttatggacagacaacg

SEQ ID NO: 648460 - DNA, 22 bp, Artificial Sequence
  chemically synthesized
acataggcctttacgttgtctg

SEQ ID NO: 648461 - DNA, 22 bp, Artificial Sequence
  chemically synthesized
acttatggacagacaacgtaaa

SEQ ID NO: 648462 - DNA, 22 bp, Artificial Sequence
  chemically synthesized
aagctaacataggcctttacgt

SEQ ID NO: 648463 - DNA, 22 bp, Artificial Sequence
  chemically synthesized
atggacagacaacgtaaaggcc

SEQ ID NO: 648464 - DNA, 22 bp, Artificial Sequence
  chemically synthesized
tggacagacaacgtaaaggcct

SEQ ID NO: 648465 - DNA, 22 bp, Artificial Sequence
  chemically synthesized
aaactaaagctaacataggcct

SEQ ID NO: 648466 - DNA, 22 bp, Artificial Sequence
  chemically synthesized
aaaactaaagctaacataggcc

SEQ ID NO: 648467 - DNA, 22 bp, Artificial Sequence
  chemically synthesized
taaaactaaagctaacataggc

SEQ ID NO: 648468 - DNA, 22 bp, Artificial Sequence
  chemically synthesized
ctttaaaactaaagctaacata

SEQ ID NO: 648469 - DNA, 22 bp, Artificial Sequence
  chemically synthesized
tcatattactttaaaactaaag

SEQ ID NO: 648470 - DNA, 22 bp, Artificial Sequence
  chemically synthesized
gtcatattactttaaaactaaa

SEQ ID NO: 648471 - DNA, 22 bp, Artificial Sequence
  chemically synthesized
tgttagctttagttttaaagta

SEQ ID NO: 648472 - DNA, 22 bp, Artificial Sequence
  chemically synthesized
tgtttgtcatattactttaaaa

SEQ ID NO: 648473 - DNA, 22 bp, Artificial Sequence
  chemically synthesized
gtgtttgtcatattactttaaa

SEQ ID NO: 648474 - DNA, 22 bp, Artificial Sequence
  chemically synthesized
cttgtgtttgtcatattacttt

SEQ ID NO: 648475 - DNA, 22 bp, Artificial Sequence
  chemically synthesized
gctttagttttaaagtaatatg

SEQ ID NO: 648476 - DNA, 22 bp, Artificial Sequence
  chemically synthesized
gcttgtgtttgtcatattactt

SEQ ID NO: 648477 - DNA, 22 bp, Artificial Sequence
  chemically synthesized
tttgcttgtgtttgtcatatta

SEQ ID NO: 648478 - DNA, 22 bp, Artificial Sequence
  chemically synthesized
tagttttaaagtaatatgacaa

SEQ ID NO: 648479 - DNA, 22 bp, Artificial Sequence
  chemically synthesized
atttgcttgtgtttgtcatatt

SEQ ID NO: 648480 - DNA, 22 bp, Artificial Sequence
  chemically synthesized
agttttaaagtaatatgacaaa

SEQ ID NO: 648481 - DNA, 22 bp, Artificial Sequence
  chemically synthesized
gttttaaagtaatatgacaaac

SEQ ID NO: 648482 - DNA, 22 bp, Artificial Sequence
  chemically synthesized
ttatttgcttgtgtttgtcata

SEQ ID NO: 648483 - DNA, 22 bp, Artificial Sequence
  chemically synthesized
taaagtaatatgacaaacacaa

SEQ ID NO: 648484 - DNA, 22 bp, Artificial Sequence
  chemically synthesized
aaagtaatatgacaaacacaag

SEQ ID NO: 648485 - DNA, 22 bp, Artificial Sequence
  chemically synthesized
aactcttatttgcttgtgtttg

SEQ ID NO: 648486 - DNA, 22 bp, Artificial Sequence
  chemically synthesized
aagtaatatgacaaacacaagc

SEQ ID NO: 648487 - DNA, 22 bp, Artificial Sequence
  chemically synthesized
gactaaactcttatttgcttgt

SEQ ID NO: 648488 - DNA, 22 bp, Artificial Sequence
  chemically synthesized
agactaaactcttatttgcttg

SEQ ID NO: 648489 - DNA, 22 bp, Artificial Sequence
  chemically synthesized
cttagactaaactcttatttgc

SEQ ID NO: 648490 - DNA, 22 bp, Artificial Sequence
  chemically synthesized
ccttagactaaactcttatttg

SEQ ID NO: 648491 - DNA, 22 bp, Artificial Sequence
  chemically synthesized
tccttagactaaactcttattt

SEQ ID NO: 648492 - DNA, 22 bp, Artificial Sequence
  chemically synthesized
gttttccttagactaaactctt

SEQ ID NO: 648493 - DNA, 22 bp, Artificial Sequence
  chemically synthesized
ggttttccttagactaaactct

SEQ ID NO: 648494 - DNA, 22 bp, Artificial Sequence
  chemically synthesized
cagagatacagaccgtttggtt

SEQ ID NO: 648495 - DNA, 22 bp, Artificial Sequence
  chemically synthesized
agtctaaggaaaaccaaacggt

SEQ ID NO: 648496 - DNA, 22 bp, Artificial Sequence
  chemically synthesized
ccagagatacagaccgtttggt

SEQ ID NO: 648497 - DNA, 22 bp, Artificial Sequence
  chemically synthesized
gtctaaggaaaaccaaacggtc

SEQ ID NO: 648498 - DNA, 22 bp, Artificial Sequence
  chemically synthesized
aggaaaaccaaacggtctgtat

SEQ ID NO: 648499 - DNA, 22 bp, Artificial Sequence
  chemically synthesized
aaagtttccagagatacagacc

SEQ ID NO: 648500 - DNA, 22 bp, Artificial Sequence
  chemically synthesized
gaaagtttccagagatacagac

SEQ ID NO: 648501 - DNA, 22 bp, Artificial Sequence
  chemically synthesized
tatctctggaaactttcaaatt

SEQ ID NO: 648502 - DNA, 22 bp, Artificial Sequence
  chemically synthesized
atatggatcacagaatttgaaa

SEQ ID NO: 648503 - DNA, 22 bp, Artificial Sequence
  chemically synthesized
gatatggatcacagaatttgaa

SEQ ID NO: 648504 - DNA, 22 bp, Artificial Sequence
  chemically synthesized
tggaaactttcaaattctgtga

SEQ ID NO: 648505 - DNA, 22 bp, Artificial Sequence
  chemically synthesized
gaaactttcaaattctgtgatc

SEQ ID NO: 648506 - DNA, 22 bp, Artificial Sequence
  chemically synthesized
atccatttgatatggatcacag

SEQ ID NO: 648507 - DNA, 22 bp, Artificial Sequence
  chemically synthesized
gatccatttgatatggatcaca

SEQ ID NO: 648508 - DNA, 22 bp, Artificial Sequence
  chemically synthesized
tcaaattctgtgatccatatca

SEQ ID NO: 648509 - DNA, 22 bp, Artificial Sequence
  chemically synthesized
caaattctgtgatccatatcaa

SEQ ID NO: 648510 - DNA, 22 bp, Artificial Sequence
  chemically synthesized
aaattctgtgatccatatcaaa

SEQ ID NO: 648511 - DNA, 22 bp, Artificial Sequence
  chemically synthesized
caatatttgatccatttgatat

SEQ ID NO: 648512 - DNA, 22 bp, Artificial Sequence
  chemically synthesized
tgtgatccatatcaaatggatc

SEQ ID NO: 648513 - DNA, 22 bp, Artificial Sequence
  chemically synthesized
tgatccatatcaaatggatcaa

SEQ ID NO: 648514 - DNA, 22 bp, Artificial Sequence
  chemically synthesized
tgatgattacaatatttgatcc

SEQ ID NO: 648515 - DNA, 22 bp, Artificial Sequence
  chemically synthesized
acaaatcctatgatgattacaa

SEQ ID NO: 648516 - DNA, 22 bp, Artificial Sequence
  chemically synthesized
atgttaacaaatcctatgatga

SEQ ID NO: 648517 - DNA, 22 bp, Artificial Sequence
  chemically synthesized
tatctaatgttaacaaatccta

SEQ ID NO: 648518 - DNA, 22 bp, Artificial Sequence
  chemically synthesized
gtatctaatgttaacaaatcct

SEQ ID NO: 648519 - DNA, 22 bp, Artificial Sequence
  chemically synthesized
taatcatcataggatttgttaa

SEQ ID NO: 648520 - DNA, 22 bp, Artificial Sequence
  chemically synthesized
caagacttgtatctaatgttaa

SEQ ID NO: 648521 - DNA, 22 bp, Artificial Sequence
  chemically synthesized
gcaagacttgtatctaatgtta

SEQ ID NO: 648522 - DNA, 22 bp, Artificial Sequence
  chemically synthesized
tgcaagacttgtatctaatgtt

SEQ ID NO: 648523 - DNA, 22 bp, Artificial Sequence
  chemically synthesized
attttgcaagacttgtatctaa

SEQ ID NO: 648524 - DNA, 22 bp, Artificial Sequence
  chemically synthesized
cattttgcaagacttgtatcta

SEQ ID NO: 648525 - DNA, 22 bp, Artificial Sequence
  chemically synthesized
gttaacattagatacaagtctt

SEQ ID NO: 648526 - DNA, 22 bp, Artificial Sequence
  chemically synthesized
ttaacattagatacaagtcttg

SEQ ID NO: 648527 - DNA, 22 bp, Artificial Sequence
  chemically synthesized
acattagatacaagtcttgcaa

SEQ ID NO: 648528 - DNA, 22 bp, Artificial Sequence
  chemically synthesized
acgtgtttcattttgcaagact

SEQ ID NO: 648529 - DNA, 22 bp, Artificial Sequence
  chemically synthesized
gatacaagtcttgcaaaatgaa

SEQ ID NO: 648530 - DNA, 22 bp, Artificial Sequence
  chemically synthesized
gcaaaatgaaacacgttaggac

SEQ ID NO: 648531 - DNA, 22 bp, Artificial Sequence
  chemically synthesized
caaaatgaaacacgttaggacc

SEQ ID NO: 648532 - DNA, 22 bp, Artificial Sequence
  chemically synthesized
aggcataagagccaggtcctaa

SEQ ID NO: 648533 - DNA, 22 bp, Artificial Sequence
  chemically synthesized
ttcaggcataagagccaggtcc

SEQ ID NO: 648534 - DNA, 22 bp, Artificial Sequence
  chemically synthesized
ggacctggctcttatgcctgaa

SEQ ID NO: 648535 - DNA, 22 bp, Artificial Sequence
  chemically synthesized
caaagccatcctattcaggcat

SEQ ID NO: 648536 - DNA, 22 bp, Artificial Sequence
  chemically synthesized
gctcttatgcctgaataggatg

SEQ ID NO: 648537 - DNA, 22 bp, Artificial Sequence
  chemically synthesized
ttatgcctgaataggatggctt

SEQ ID NO: 648538 - DNA, 22 bp, Artificial Sequence
  chemically synthesized
atgcctgaataggatggctttg

SEQ ID NO: 648539 - DNA, 22 bp, Artificial Sequence
  chemically synthesized
tgcctgaataggatggctttgt

SEQ ID NO: 648540 - DNA, 22 bp, Artificial Sequence
  chemically synthesized
tataaaatatattacaaagcca

SEQ ID NO: 648541 - DNA, 22 bp, Artificial Sequence
  chemically synthesized
aataggatggctttgtaatata

SEQ ID NO: 648542 - DNA, 22 bp, Artificial Sequence
  chemically synthesized
taaatactgtataaaatatatt

SEQ ID NO: 648543 - DNA, 22 bp, Artificial Sequence
  chemically synthesized
tgtaatatattttatacagtat

SEQ ID NO: 648544 - DNA, 22 bp, Artificial Sequence
  chemically synthesized
ataggattataaatactgtata

SEQ ID NO: 648545 - DNA, 22 bp, Artificial Sequence
  chemically synthesized
gtaatatattttatacagtatt

SEQ ID NO: 648546 - DNA, 22 bp, Artificial Sequence
  chemically synthesized
taatatattttatacagtattt

SEQ ID NO: 648547 - DNA, 22 bp, Artificial Sequence
  chemically synthesized
ttcataggattataaatactgt

SEQ ID NO: 648548 - DNA, 22 bp, Artificial Sequence
  chemically synthesized
attcataggattataaatactg

SEQ ID NO: 648549 - DNA, 22 bp, Artificial Sequence
  chemically synthesized
tatacagtatttataatcctat

SEQ ID NO: 648550 - DNA, 22 bp, Artificial Sequence
  chemically synthesized
aagtatttattcataggattat

SEQ ID NO: 648551 - DNA, 22 bp, Artificial Sequence
  chemically synthesized
atacagtatttataatcctatg

SEQ ID NO: 648552 - DNA, 22 bp, Artificial Sequence
  chemically synthesized
aaagtatttattcataggatta

SEQ ID NO: 648553 - DNA, 22 bp, Artificial Sequence
  chemically synthesized
tacagtatttataatcctatga

SEQ ID NO: 648554 - DNA, 22 bp, Artificial Sequence
  chemically synthesized
tatttaaagtatttattcatag

SEQ ID NO: 648555 - DNA, 22 bp, Artificial Sequence
  chemically synthesized
ataatcctatgaataaatactt

SEQ ID NO: 648556 - DNA, 22 bp, Artificial Sequence
  chemically synthesized
taatcctatgaataaatacttt

SEQ ID NO: 648557 - DNA, 22 bp, Artificial Sequence
  chemically synthesized
atagcagtaattgtatttaaag

SEQ ID NO: 648558 - DNA, 22 bp, Artificial Sequence
  chemically synthesized
aatagcagtaattgtatttaaa

SEQ ID NO: 648559 - DNA, 22 bp, Artificial Sequence
  chemically synthesized
tgaataaatactttaaatacaa

SEQ ID NO: 648560 - DNA, 22 bp, Artificial Sequence
  chemically synthesized
taatagcagtaattgtatttaa

SEQ ID NO: 648561 - DNA, 22 bp, Artificial Sequence
  chemically synthesized
tttaatagcagtaattgtattt

SEQ ID NO: 648562 - DNA, 22 bp, Artificial Sequence
  chemically synthesized
ctttaatagcagtaattgtatt

SEQ ID NO: 648563 - DNA, 22 bp, Artificial Sequence
  chemically synthesized
tctttaatagcagtaattgtat

SEQ ID NO: 648564 - DNA, 22 bp, Artificial Sequence
  chemically synthesized
tgttttctttaatagcagtaat

SEQ ID NO: 648565 - DNA, 22 bp, Artificial Sequence
  chemically synthesized
taaatacaattactgctattaa

SEQ ID NO: 648566 - DNA, 22 bp, Artificial Sequence
  chemically synthesized
aaatacaattactgctattaaa

SEQ ID NO: 648567 - DNA, 22 bp, Artificial Sequence
  chemically synthesized
aatacaattactgctattaaag

SEQ ID NO: 648568 - DNA, 22 bp, Artificial Sequence
  chemically synthesized
aagtctgtgttttctttaatag

SEQ ID NO: 648569 - DNA, 22 bp, Artificial Sequence
  chemically synthesized
gcagactgaagtctgtgttttc

SEQ ID NO: 648570 - DNA, 22 bp, Artificial Sequence
  chemically synthesized
ctgctattaaagaaaacacaga

SEQ ID NO: 648571 - DNA, 22 bp, Artificial Sequence
  chemically synthesized
ctattaaagaaaacacagactt

SEQ ID NO: 648572 - DNA, 22 bp, Artificial Sequence
  chemically synthesized
ttaaagaaaacacagacttcag

SEQ ID NO: 648573 - DNA, 22 bp, Artificial Sequence
  chemically synthesized
aagaaaacacagacttcagtct

SEQ ID NO: 648574 - DNA, 22 bp, Artificial Sequence
  chemically synthesized
aggaagaaaacaaatctagcag

SEQ ID NO: 648575 - DNA, 22 bp, Artificial Sequence
  chemically synthesized
gaggaagaaaacaaatctagca

SEQ ID NO: 648576 - DNA, 22 bp, Artificial Sequence
  chemically synthesized
tgaggaagaaaacaaatctagc

SEQ ID NO: 648577 - DNA, 22 bp, Artificial Sequence
  chemically synthesized
attttgaggaagaaaacaaatc

SEQ ID NO: 648578 - DNA, 22 bp, Artificial Sequence
  chemically synthesized
aattttgaggaagaaaacaaat

SEQ ID NO: 648579 - DNA, 22 bp, Artificial Sequence
  chemically synthesized
cagtctgctagatttgttttct

SEQ ID NO: 648580 - DNA, 22 bp, Artificial Sequence
  chemically synthesized
taattttgaggaagaaaacaaa

SEQ ID NO: 648581 - DNA, 22 bp, Artificial Sequence
  chemically synthesized
agtctgctagatttgttttctt

SEQ ID NO: 648582 - DNA, 22 bp, Artificial Sequence
  chemically synthesized
ctagatttgttttcttcctcaa

SEQ ID NO: 648583 - DNA, 22 bp, Artificial Sequence
  chemically synthesized
gatttgttttcttcctcaaaat

SEQ ID NO: 648584 - DNA, 22 bp, Artificial Sequence
  chemically synthesized
gttttcttcctcaaaattaaaa

SEQ ID NO: 648585 - DNA, 22 bp, Artificial Sequence
  chemically synthesized
ttttcttcctcaaaattaaaac

SEQ ID NO: 648586 - DNA, 22 bp, Artificial Sequence
  chemically synthesized
agaaatagtgggaagttttaat

SEQ ID NO: 648587 - DNA, 22 bp, Artificial Sequence
  chemically synthesized
tcttcctcaaaattaaaacttc

SEQ ID NO: 648588 - DNA, 22 bp, Artificial Sequence
  chemically synthesized
cttcctcaaaattaaaacttcc

SEQ ID NO: 648589 - DNA, 22 bp, Artificial Sequence
  chemically synthesized
ttcctcaaaattaaaacttccc

SEQ ID NO: 648590 - DNA, 22 bp, Artificial Sequence
  chemically synthesized
ttcagaaatagtgggaagtttt

SEQ ID NO: 648591 - DNA, 22 bp, Artificial Sequence
  chemically synthesized
cctcaaaattaaaacttcccac

SEQ ID NO: 648592 - DNA, 22 bp, Artificial Sequence
  chemically synthesized
ctcaaaattaaaacttcccact

SEQ ID NO: 648593 - DNA, 22 bp, Artificial Sequence
  chemically synthesized
gattattcagaaatagtgggaa

SEQ ID NO: 648594 - DNA, 22 bp, Artificial Sequence
  chemically synthesized
aaaattaaaacttcccactatt

SEQ ID NO: 648595 - DNA, 22 bp, Artificial Sequence
  chemically synthesized
gttagattattcagaaatagtg

SEQ ID NO: 648596 - DNA, 22 bp, Artificial Sequence
  chemically synthesized
aaacttcccactatttctgaat

SEQ ID NO: 648597 - DNA, 22 bp, Artificial Sequence
  chemically synthesized
cccactatttctgaataatcta

SEQ ID NO: 648598 - DNA, 22 bp, Artificial Sequence
  chemically synthesized
tgaagagttggttagattattc

SEQ ID NO: 648599 - DNA, 22 bp, Artificial Sequence
  chemically synthesized
ccactatttctgaataatctaa

SEQ ID NO: 648600 - DNA, 22 bp, Artificial Sequence
  chemically synthesized
atgaagagttggttagattatt

SEQ ID NO: 648601 - DNA, 22 bp, Artificial Sequence
  chemically synthesized
tatgaagagttggttagattat

SEQ ID NO: 648602 - DNA, 22 bp, Artificial Sequence
  chemically synthesized
ttatgaagagttggttagatta

SEQ ID NO: 648603 - DNA, 22 bp, Artificial Sequence
  chemically synthesized
tttatgaagagttggttagatt

SEQ ID NO: 648604 - DNA, 22 bp, Artificial Sequence
  chemically synthesized
tttctgaataatctaaccaact

SEQ ID NO: 648605 - DNA, 22 bp, Artificial Sequence
  chemically synthesized
cctttttatgaagagttggtta

SEQ ID NO: 648606 - DNA, 22 bp, Artificial Sequence
  chemically synthesized
gcctttttatgaagagttggtt

SEQ ID NO: 648607 - DNA, 22 bp, Artificial Sequence
  chemically synthesized
ctgaataatctaaccaactctt

SEQ ID NO: 648608 - DNA, 22 bp, Artificial Sequence
  chemically synthesized
tgaataatctaaccaactcttc

SEQ ID NO: 648609 - DNA, 22 bp, Artificial Sequence
  chemically synthesized
aataatctaaccaactcttcat

SEQ ID NO: 648610 - DNA, 22 bp, Artificial Sequence
  chemically synthesized
ccaatttgcctttttatgaaga

SEQ ID NO: 648611 - DNA, 22 bp, Artificial Sequence
  chemically synthesized
accaactcttcataaaaaggca

SEQ ID NO: 648612 - DNA, 22 bp, Artificial Sequence
  chemically synthesized
aaacacacctcccaatttgcct

SEQ ID NO: 648613 - DNA, 22 bp, Artificial Sequence
  chemically synthesized
ttcataaaaaggcaaattggga

SEQ ID NO: 648614 - DNA, 22 bp, Artificial Sequence
  chemically synthesized
cataaaaaggcaaattgggagg

SEQ ID NO: 648615 - DNA, 22 bp, Artificial Sequence
  chemically synthesized
ataaaaaggcaaattgggaggt

SEQ ID NO: 648616 - DNA, 22 bp, Artificial Sequence
  chemically synthesized
acaactaaaacacacctcccaa

SEQ ID NO: 648617 - DNA, 22 bp, Artificial Sequence
  chemically synthesized
taacaactaaaacacacctccc

SEQ ID NO: 648618 - DNA, 22 bp, Artificial Sequence
  chemically synthesized
ctaacaactaaaacacacctcc

SEQ ID NO: 648619 - DNA, 22 bp, Artificial Sequence
  chemically synthesized
tctaacaactaaaacacacctc

SEQ ID NO: 648620 - DNA, 22 bp, Artificial Sequence
  chemically synthesized
aaaatattttctaacaactaaa

SEQ ID NO: 648621 - DNA, 22 bp, Artificial Sequence
  chemically synthesized
aaaaatattttctaacaactaa

SEQ ID NO: 648622 - DNA, 22 bp, Artificial Sequence
  chemically synthesized
ggaggtgtgttttagttgttag

SEQ ID NO: 648623 - DNA, 22 bp, Artificial Sequence
  chemically synthesized
tttaaaaatattttctaacaac

SEQ ID NO: 648624 - DNA, 22 bp, Artificial Sequence
  chemically synthesized
atttaaaaatattttctaacaa

SEQ ID NO: 648625 - DNA, 22 bp, Artificial Sequence
  chemically synthesized
tatttaaaaatattttctaaca

SEQ ID NO: 648626 - DNA, 22 bp, Artificial Sequence
  chemically synthesized
ttatttaaaaatattttctaac

SEQ ID NO: 648627 - DNA, 22 bp, Artificial Sequence
  chemically synthesized
tagttgttagaaaatattttta

SEQ ID NO: 648628 - DNA, 22 bp, Artificial Sequence
  chemically synthesized
agttgttagaaaatatttttaa

SEQ ID NO: 648629 - DNA, 22 bp, Artificial Sequence
  chemically synthesized
gttgttagaaaatatttttaaa

SEQ ID NO: 648630 - DNA, 22 bp, Artificial Sequence
  chemically synthesized
ataacatcttttatttaaaaat

SEQ ID NO: 648631 - DNA, 22 bp, Artificial Sequence
  chemically synthesized
ttagaaaatatttttaaataaa

SEQ ID NO: 648632 - DNA, 22 bp, Artificial Sequence
  chemically synthesized
gaaaatatttttaaataaaaga

SEQ ID NO: 648633 - DNA, 22 bp, Artificial Sequence
  chemically synthesized
aaattaataacatcttttattt

SEQ ID NO: 648634 - DNA, 22 bp, Artificial Sequence
  chemically synthesized
aaaattaataacatcttttatt

SEQ ID NO: 648635 - DNA, 22 bp, Artificial Sequence
  chemically synthesized
taaaattaataacatcttttat

SEQ ID NO: 648636 - DNA, 22 bp, Artificial Sequence
  chemically synthesized
ttaaataaaagatgttattaat

SEQ ID NO: 648637 - DNA, 22 bp, Artificial Sequence
  chemically synthesized
aaagactttaaaattaataaca

SEQ ID NO: 648638 - DNA, 22 bp, Artificial Sequence
  chemically synthesized
taaataaaagatgttattaatt

SEQ ID NO: 648639 - DNA, 22 bp, Artificial Sequence
  chemically synthesized
aaataaaagatgttattaattt

SEQ ID NO: 648640 - DNA, 22 bp, Artificial Sequence
  chemically synthesized
aataaaagatgttattaatttt

SEQ ID NO: 648641 - DNA, 22 bp, Artificial Sequence
  chemically synthesized
aacgttgaaagactttaaaatt

SEQ ID NO: 648642 - DNA, 22 bp, Artificial Sequence
  chemically synthesized
aaacgttgaaagactttaaaat

SEQ ID NO: 648643 - DNA, 22 bp, Artificial Sequence
  chemically synthesized
tcttaaacgttgaaagacttta

SEQ ID NO: 648644 - DNA, 22 bp, Artificial Sequence
  chemically synthesized
tctgtcttaaacgttgaaagac

SEQ ID NO: 648645 - DNA, 22 bp, Artificial Sequence
  chemically synthesized
ttaattttaaagtctttcaacg

SEQ ID NO: 648646 - DNA, 22 bp, Artificial Sequence
  chemically synthesized
gtctgtcttaaacgttgaaaga

SEQ ID NO: 648647 - DNA, 22 bp, Artificial Sequence
  chemically synthesized
tgtctgtcttaaacgttgaaag

SEQ ID NO: 648648 - DNA, 22 bp, Artificial Sequence
  chemically synthesized
attttaaagtctttcaacgttt

SEQ ID NO: 648649 - DNA, 22 bp, Artificial Sequence
  chemically synthesized
taaagtctttcaacgtttaaga

SEQ ID NO: 648650 - DNA, 22 bp, Artificial Sequence
  chemically synthesized
aaagtctttcaacgtttaagac

SEQ ID NO: 648651 - DNA, 22 bp, Artificial Sequence
  chemically synthesized
aagtctttcaacgtttaagaca

SEQ ID NO: 648652 - DNA, 22 bp, Artificial Sequence
  chemically synthesized
agtagaagattttgtctgtctt

SEQ ID NO: 648653 - DNA, 22 bp, Artificial Sequence
  chemically synthesized
aagtagaagattttgtctgtct

SEQ ID NO: 648654 - DNA, 22 bp, Artificial Sequence
  chemically synthesized
taagtagaagattttgtctgtc

SEQ ID NO: 648655 - DNA, 22 bp, Artificial Sequence
  chemically synthesized
tcaacgtttaagacagacaaaa

SEQ ID NO: 648656 - DNA, 22 bp, Artificial Sequence
  chemically synthesized
caacgtttaagacagacaaaat

SEQ ID NO: 648657 - DNA, 22 bp, Artificial Sequence
  chemically synthesized
aacgtttaagacagacaaaatc

SEQ ID NO: 648658 - DNA, 22 bp, Artificial Sequence
  chemically synthesized
ttttaagtagaagattttgtct

SEQ ID NO: 648659 - DNA, 22 bp, Artificial Sequence
  chemically synthesized
attttaagtagaagattttgtc

SEQ ID NO: 648660 - DNA, 22 bp, Artificial Sequence
  chemically synthesized
acttattttaagtagaagattt

SEQ ID NO: 648661 - DNA, 22 bp, Artificial Sequence
  chemically synthesized
aagacagacaaaatcttctact

SEQ ID NO: 648662 - DNA, 22 bp, Artificial Sequence
  chemically synthesized
agacagacaaaatcttctactt

SEQ ID NO: 648663 - DNA, 22 bp, Artificial Sequence
  chemically synthesized
tgacaatcagattaacttattt

SEQ ID NO: 648664 - DNA, 22 bp, Artificial Sequence
  chemically synthesized
ctacttaaaataagttaatctg

SEQ ID NO: 648665 - DNA, 22 bp, Artificial Sequence
  chemically synthesized
tacttaaaataagttaatctga

SEQ ID NO: 648666 - DNA, 22 bp, Artificial Sequence
  chemically synthesized
cttaaaataagttaatctgatt

SEQ ID NO: 648667 - DNA, 22 bp, Artificial Sequence
  chemically synthesized
aaaataagttaatctgattgtc

SEQ ID NO: 648668 - DNA, 22 bp, Artificial Sequence
  chemically synthesized
aaataagttaatctgattgtca

SEQ ID NO: 648669 - DNA, 22 bp, Artificial Sequence
  chemically synthesized
atgagaaaaacattatgacaat

SEQ ID NO: 648670 - DNA, 22 bp, Artificial Sequence
  chemically synthesized
atctgattgtcataatgttttt

SEQ ID NO: 648671 - DNA, 22 bp, Artificial Sequence
  chemically synthesized
cacgtaagctaatgagaaaaac

SEQ ID NO: 648672 - DNA, 22 bp, Artificial Sequence
  chemically synthesized
attgtcataatgtttttctcat

SEQ ID NO: 648673 - DNA, 22 bp, Artificial Sequence
  chemically synthesized
tcataatgtttttctcattagc

SEQ ID NO: 648674 - DNA, 22 bp, Artificial Sequence
  chemically synthesized
ttctcattagcttacgtgtagc

SEQ ID NO: 648675 - DNA, 22 bp, Artificial Sequence
  chemically synthesized
tctcattagcttacgtgtagct

SEQ ID NO: 648676 - DNA, 22 bp, Artificial Sequence
  chemically synthesized
ctcattagcttacgtgtagctc

SEQ ID NO: 648677 - DNA, 22 bp, Artificial Sequence
  chemically synthesized
aaaggcaaaaaggagctacacg

SEQ ID NO: 648678 - DNA, 22 bp, Artificial Sequence
  chemically synthesized
tcattagcttacgtgtagctcc

SEQ ID NO: 648679 - DNA, 22 bp, Artificial Sequence
  chemically synthesized
gaaaggcaaaaaggagctacac

SEQ ID NO: 648680 - DNA, 22 bp, Artificial Sequence
  chemically synthesized
attagcttacgtgtagctcctt

SEQ ID NO: 648681 - DNA, 22 bp, Artificial Sequence
  chemically synthesized
gcttacgtgtagctcctttttg

SEQ ID NO: 648682 - DNA, 22 bp, Artificial Sequence
  chemically synthesized
atagtccttgaaaggcaaaaag

SEQ ID NO: 648683 - DNA, 22 bp, Artificial Sequence
  chemically synthesized
acgtgtagctcctttttgcctt

SEQ ID NO: 648684 - DNA, 22 bp, Artificial Sequence
  chemically synthesized
cgtgtagctcctttttgccttt

SEQ ID NO: 648685 - DNA, 22 bp, Artificial Sequence
  chemically synthesized
ctttttgcctttcaaggactat

SEQ ID NO: 648686 - DNA, 22 bp, Artificial Sequence
  chemically synthesized
tttgcctttcaaggactattaa

SEQ ID NO: 648687 - DNA, 22 bp, Artificial Sequence
  chemically synthesized
ttgcctttcaaggactattaat

SEQ ID NO: 648688 - DNA, 22 bp, Artificial Sequence
  chemically synthesized
tgcctttcaaggactattaatt

SEQ ID NO: 648689 - DNA, 22 bp, Artificial Sequence
  chemically synthesized
gcctttcaaggactattaatta

SEQ ID NO: 648690 - DNA, 22 bp, Artificial Sequence
  chemically synthesized
cctttcaaggactattaattac

SEQ ID NO: 648691 - DNA, 22 bp, Artificial Sequence
  chemically synthesized
tcaaggactattaattactctt

SEQ ID NO: 648692 - DNA, 22 bp, Artificial Sequence
  chemically synthesized
caaggactattaattactcttt

SEQ ID NO: 648693 - DNA, 22 bp, Artificial Sequence
  chemically synthesized
aaggactattaattactctttg

SEQ ID NO: 648694 - DNA, 22 bp, Artificial Sequence
  chemically synthesized
ttaattactctttgtttattat

SEQ ID NO: 648695 - DNA, 22 bp, Artificial Sequence
  chemically synthesized
attactctttgtttattatttg

SEQ ID NO: 648696 - DNA, 22 bp, Artificial Sequence
  chemically synthesized
ctctttgtttattatttggtgc

SEQ ID NO: 648697 - DNA, 22 bp, Artificial Sequence
  chemically synthesized
tttgtttattatttggtgctac

SEQ ID NO: 648698 - DNA, 22 bp, Artificial Sequence
  chemically synthesized
tgtttattatttggtgctactt

SEQ ID NO: 648699 - DNA, 22 bp, Artificial Sequence
  chemically synthesized
gtttattatttggtgctacttt

SEQ ID NO: 648700 - DNA, 22 bp, Artificial Sequence
  chemically synthesized
tttattatttggtgctactttt

SEQ ID NO: 648701 - DNA, 22 bp, Artificial Sequence
  chemically synthesized
caaatacatagataaaagtagc

SEQ ID NO: 648702 - DNA, 22 bp, Artificial Sequence
  chemically synthesized
attatttggtgctacttttatc

SEQ ID NO: 648703 - DNA, 22 bp, Artificial Sequence
  chemically synthesized
ttatttggtgctacttttatct

SEQ ID NO: 648704 - DNA, 22 bp, Artificial Sequence
  chemically synthesized
ttacaaatacatagataaaagt

SEQ ID NO: 648705 - DNA, 22 bp, Artificial Sequence
  chemically synthesized
tttggtgctacttttatctatg

SEQ ID NO: 648706 - DNA, 22 bp, Artificial Sequence
  chemically synthesized
ggtgctacttttatctatgtat

SEQ ID NO: 648707 - DNA, 22 bp, Artificial Sequence
  chemically synthesized
gtgctacttttatctatgtatt

SEQ ID NO: 648708 - DNA, 22 bp, Artificial Sequence
  chemically synthesized
aagaacagttgttacaaataca

SEQ ID NO: 648709 - DNA, 22 bp, Artificial Sequence
  chemically synthesized
cttttatctatgtatttgtaac

SEQ ID NO: 648710 - DNA, 22 bp, Artificial Sequence
  chemically synthesized
ttatctatgtatttgtaacaac

SEQ ID NO: 648711 - DNA, 22 bp, Artificial Sequence
  chemically synthesized
tatctatgtatttgtaacaact

SEQ ID NO: 648712 - DNA, 22 bp, Artificial Sequence
  chemically synthesized
atctatgtatttgtaacaactg

SEQ ID NO: 648713 - DNA, 22 bp, Artificial Sequence
  chemically synthesized
tctatgtatttgtaacaactgt

SEQ ID NO: 648714 - DNA, 22 bp, Artificial Sequence
  chemically synthesized
tgtatttgtaacaactgttctt

SEQ ID NO: 648715 - DNA, 22 bp, Artificial Sequence
  chemically synthesized
gtaacaactgttctttagcata

SEQ ID NO: 648716 - DNA, 22 bp, Artificial Sequence
  chemically synthesized
taacaactgttctttagcatat

SEQ ID NO: 648717 - DNA, 22 bp, Artificial Sequence
  chemically synthesized
ttctttagcatatttgtcgttt

SEQ ID NO: 648718 - DNA, 22 bp, Artificial Sequence
  chemically synthesized
tttagcatatttgtcgtttgga

SEQ ID NO: 648719 - DNA, 22 bp, Artificial Sequence
  chemically synthesized
accgagtaagaaatccaaacga

SEQ ID NO: 648720 - DNA, 22 bp, Artificial Sequence
  chemically synthesized
tagcatatttgtcgtttggatt

SEQ ID NO: 648721 - DNA, 22 bp, Artificial Sequence
  chemically synthesized
aaccgagtaagaaatccaaacg

SEQ ID NO: 648722 - DNA, 22 bp, Artificial Sequence
  chemically synthesized
agcatatttgtcgtttggattt

SEQ ID NO: 648723 - DNA, 22 bp, Artificial Sequence
  chemically synthesized
gcatatttgtcgtttggatttc

SEQ ID NO: 648724 - DNA, 22 bp, Artificial Sequence
  chemically synthesized
gtcgtttggatttcttactcgg

SEQ ID NO: 648725 - DNA, 22 bp, Artificial Sequence
  chemically synthesized
tcgtttggatttcttactcggt

SEQ ID NO: 648726 - DNA, 22 bp, Artificial Sequence
  chemically synthesized
tgtggaaataagtttaaccgag

SEQ ID NO: 648727 - DNA, 22 bp, Artificial Sequence
  chemically synthesized
ggatttcttactcggttaaact

SEQ ID NO: 648728 - DNA, 22 bp, Artificial Sequence
  chemically synthesized
tatgtggaaataagtttaaccg

SEQ ID NO: 648729 - DNA, 22 bp, Artificial Sequence
  chemically synthesized
gatttcttactcggttaaactt

SEQ ID NO: 648730 - DNA, 22 bp, Artificial Sequence
  chemically synthesized
ctctatgtggaaataagtttaa

SEQ ID NO: 648731 - DNA, 22 bp, Artificial Sequence
  chemically synthesized
actctatgtggaaataagttta

SEQ ID NO: 648732 - DNA, 22 bp, Artificial Sequence
  chemically synthesized
cttactcggttaaacttatttc

SEQ ID NO: 648733 - DNA, 22 bp, Artificial Sequence
  chemically synthesized
ttactcggttaaacttatttcc

SEQ ID NO: 648734 - DNA, 22 bp, Artificial Sequence
  chemically synthesized
actcggttaaacttatttccac

SEQ ID NO: 648735 - DNA, 22 bp, Artificial Sequence
  chemically synthesized
ctcggttaaacttatttccaca

SEQ ID NO: 648736 - DNA, 22 bp, Artificial Sequence
  chemically synthesized
ggttaaacttatttccacatag

SEQ ID NO: 648737 - DNA, 22 bp, Artificial Sequence
  chemically synthesized
aacttatttccacatagagtaa

SEQ ID NO: 648738 - DNA, 22 bp, Artificial Sequence
  chemically synthesized
ataagggaatggatttactcta

SEQ ID NO: 648739 - DNA, 22 bp, Artificial Sequence
  chemically synthesized
atttccacatagagtaaatcca

SEQ ID NO: 648740 - DNA, 22 bp, Artificial Sequence
  chemically synthesized
tttccacatagagtaaatccat

SEQ ID NO: 648741 - DNA, 22 bp, Artificial Sequence
  chemically synthesized
ccacatagagtaaatccattcc

SEQ ID NO: 648742 - DNA, 22 bp, Artificial Sequence
  chemically synthesized
gatcctgataagggaatggatt

SEQ ID NO: 648743 - DNA, 22 bp, Artificial Sequence
  chemically synthesized
cacatagagtaaatccattccc

SEQ ID NO: 648744 - DNA, 22 bp, Artificial Sequence
  chemically synthesized
attggatcctgataagggaatg

SEQ ID NO: 648745 - DNA, 22 bp, Artificial Sequence
  chemically synthesized
gattggatcctgataagggaat

SEQ ID NO: 648746 - DNA, 22 bp, Artificial Sequence
  chemically synthesized
agcttgattggatcctgataag

SEQ ID NO: 648747 - DNA, 22 bp, Artificial Sequence
  chemically synthesized
cagcttgattggatcctgataa

SEQ ID NO: 648748 - DNA, 22 bp, Artificial Sequence
  chemically synthesized
cagtttcagcttgattggatcc

SEQ ID NO: 648749 - DNA, 22 bp, Artificial Sequence
  chemically synthesized
ccttatcaggatccaatcaagc

SEQ ID NO: 648750 - DNA, 22 bp, Artificial Sequence
  chemically synthesized
atcaggatccaatcaagctgaa

SEQ ID NO: 648751 - DNA, 22 bp, Artificial Sequence
  chemically synthesized
atacactacagtttcagcttga

SEQ ID NO: 648752 - DNA, 22 bp, Artificial Sequence
  chemically synthesized
tcaggatccaatcaagctgaaa

SEQ ID NO: 648753 - DNA, 22 bp, Artificial Sequence
  chemically synthesized
aagagttgatacactacagttt

SEQ ID NO: 648754 - DNA, 22 bp, Artificial Sequence
  chemically synthesized
aaagagttgatacactacagtt

SEQ ID NO: 648755 - DNA, 22 bp, Artificial Sequence
  chemically synthesized
taaagagttgatacactacagt

SEQ ID NO: 648756 - DNA, 22 bp, Artificial Sequence
  chemically synthesized
ttaaagagttgatacactacag

SEQ ID NO: 648757 - DNA, 22 bp, Artificial Sequence
  chemically synthesized
aaactgtagtgtatcaactctt

SEQ ID NO: 648758 - DNA, 22 bp, Artificial Sequence
  chemically synthesized
tagtgtatcaactctttaaaag

SEQ ID NO: 648759 - DNA, 22 bp, Artificial Sequence
  chemically synthesized
ataaataagaaacttttaaaga

SEQ ID NO: 648760 - DNA, 22 bp, Artificial Sequence
  chemically synthesized
caaccgttcataaataagaaac

SEQ ID NO: 648761 - DNA, 22 bp, Artificial Sequence
  chemically synthesized
tttaaaagtttcttatttatga

SEQ ID NO: 648762 - DNA, 22 bp, Artificial Sequence
  chemically synthesized
taaaagtttcttatttatgaac

SEQ ID NO: 648763 - DNA, 22 bp, Artificial Sequence
  chemically synthesized
aaaagtttcttatttatgaacg

SEQ ID NO: 648764 - DNA, 22 bp, Artificial Sequence
  chemically synthesized
aaagtttcttatttatgaacgg

SEQ ID NO: 648765 - DNA, 22 bp, Artificial Sequence
  chemically synthesized
tagaagttacaaccgttcataa

SEQ ID NO: 648766 - DNA, 22 bp, Artificial Sequence
  chemically synthesized
ttatagaagttacaaccgttca

SEQ ID NO: 648767 - DNA, 22 bp, Artificial Sequence
  chemically synthesized
cttatttatgaacggttgtaac

SEQ ID NO: 648768 - DNA, 22 bp, Artificial Sequence
  chemically synthesized
ttatttatgaacggttgtaact

SEQ ID NO: 648769 - DNA, 22 bp, Artificial Sequence
  chemically synthesized
atttatgaacggttgtaacttc

SEQ ID NO: 648770 - DNA, 22 bp, Artificial Sequence
  chemically synthesized
tttatgaacggttgtaacttct

SEQ ID NO: 648771 - DNA, 22 bp, Artificial Sequence
  chemically synthesized
atgaacggttgtaacttctata

SEQ ID NO: 648772 - DNA, 22 bp, Artificial Sequence
  chemically synthesized
tgaacggttgtaacttctataa

SEQ ID NO: 648773 - DNA, 22 bp, Artificial Sequence
  chemically synthesized
acccaggtagtctgttatagaa

SEQ ID NO: 648774 - DNA, 22 bp, Artificial Sequence
  chemically synthesized
ctaacccaggtagtctgttata

SEQ ID NO: 648775 - DNA, 22 bp, Artificial Sequence
  chemically synthesized
cctaacccaggtagtctgttat

SEQ ID NO: 648776 - DNA, 22 bp, Artificial Sequence
  chemically synthesized
taacttctataacagactacct

SEQ ID NO: 648777 - DNA, 22 bp, Artificial Sequence
  chemically synthesized
tgtttcctaacccaggtagtct

SEQ ID NO: 648778 - DNA, 22 bp, Artificial Sequence
  chemically synthesized
ctataacagactacctgggtta

SEQ ID NO: 648779 - DNA, 22 bp, Artificial Sequence
  chemically synthesized
tataacagactacctgggttag

SEQ ID NO: 648780 - DNA, 22 bp, Artificial Sequence
  chemically synthesized
gaaattgtgtttcctaacccag

SEQ ID NO: 648781 - DNA, 22 bp, Artificial Sequence
  chemically synthesized
taacagactacctgggttagga

SEQ ID NO: 648782 - DNA, 22 bp, Artificial Sequence
  chemically synthesized
ggaaattgtgtttcctaaccca

SEQ ID NO: 648783 - DNA, 22 bp, Artificial Sequence
  chemically synthesized
ttggaaattgtgtttcctaacc

SEQ ID NO: 648784 - DNA, 22 bp, Artificial Sequence
  chemically synthesized
cctcttggaaattgtgtttcct

SEQ ID NO: 648785 - DNA, 22 bp, Artificial Sequence
  chemically synthesized
tgcctcttggaaattgtgtttc

SEQ ID NO: 648786 - DNA, 22 bp, Artificial Sequence
  chemically synthesized
cctgggttaggaaacacaattt

SEQ ID NO: 648787 - DNA, 22 bp, Artificial Sequence
  chemically synthesized
ggttaggaaacacaatttccaa

SEQ ID NO: 648788 - DNA, 22 bp, Artificial Sequence
  chemically synthesized
tgtcctctgcctcttggaaatt

SEQ ID NO: 648789 - DNA, 22 bp, Artificial Sequence
  chemically synthesized
ggaaacacaatttccaagaggc

SEQ ID NO: 648790 - DNA, 22 bp, Artificial Sequence
  chemically synthesized
agttatgtcctctgcctcttgg

SEQ ID NO: 648791 - DNA, 22 bp, Artificial Sequence
  chemically synthesized
ggttcagttatgtcctctgcct

SEQ ID NO: 648792 - DNA, 22 bp, Artificial Sequence
  chemically synthesized
aggttcagttatgtcctctgcc

SEQ ID NO: 648793 - DNA, 22 bp, Artificial Sequence
  chemically synthesized
tttaggttcagttatgtcctct

SEQ ID NO: 648794 - DNA, 22 bp, Artificial Sequence
  chemically synthesized
ccaagaggcagaggacataact

SEQ ID NO: 648795 - DNA, 22 bp, Artificial Sequence
  chemically synthesized
caagaggcagaggacataactg

SEQ ID NO: 648796 - DNA, 22 bp, Artificial Sequence
  chemically synthesized
gggagttatttaggttcagtta

SEQ ID NO: 648797 - DNA, 22 bp, Artificial Sequence
  chemically synthesized
agggagttatttaggttcagtt

SEQ ID NO: 648798 - DNA, 22 bp, Artificial Sequence
  chemically synthesized
aagaacttagggagttatttag

SEQ ID NO: 648799 - DNA, 22 bp, Artificial Sequence
  chemically synthesized
aaagaacttagggagttattta

SEQ ID NO: 648800 - DNA, 22 bp, Artificial Sequence
  chemically synthesized
aacctaaataactccctaagtt

SEQ ID NO: 648801 - DNA, 22 bp, Artificial Sequence
  chemically synthesized
atcatcatgcttaaagaactta

SEQ ID NO: 648802 - DNA, 22 bp, Artificial Sequence
  chemically synthesized
aatcatcatgcttaaagaactt

SEQ ID NO: 648803 - DNA, 22 bp, Artificial Sequence
  chemically synthesized
aataactccctaagttctttaa

SEQ ID NO: 648804 - DNA, 22 bp, Artificial Sequence
  chemically synthesized
tttaatcatcatgcttaaagaa

SEQ ID NO: 648805 - DNA, 22 bp, Artificial Sequence
  chemically synthesized
atttaatcatcatgcttaaaga

SEQ ID NO: 648806 - DNA, 22 bp, Artificial Sequence
  chemically synthesized
atttatttaatcatcatgctta

SEQ ID NO: 648807 - DNA, 22 bp, Artificial Sequence
  chemically synthesized
cctaagttctttaagcatgatg

SEQ ID NO: 648808 - DNA, 22 bp, Artificial Sequence
  chemically synthesized
tctgatttatttaatcatcatg

SEQ ID NO: 648809 - DNA, 22 bp, Artificial Sequence
  chemically synthesized
agttctttaagcatgatgatta

SEQ ID NO: 648810 - DNA, 22 bp, Artificial Sequence
  chemically synthesized
tttaagcatgatgattaaataa

SEQ ID NO: 648811 - DNA, 22 bp, Artificial Sequence
  chemically synthesized
taagcatgatgattaaataaat

SEQ ID NO: 648812 - DNA, 22 bp, Artificial Sequence
  chemically synthesized
aagcatgatgattaaataaatc

SEQ ID NO: 648813 - DNA, 22 bp, Artificial Sequence
  chemically synthesized
agcatgatgattaaataaatca

SEQ ID NO: 648814 - DNA, 22 bp, Artificial Sequence
  chemically synthesized
taagtagtatattatctgattt

SEQ ID NO: 648815 - DNA, 22 bp, Artificial Sequence
  chemically synthesized
aataaatcagataatatactac

SEQ ID NO: 648816 - DNA, 22 bp, Artificial Sequence
  chemically synthesized
agatatggtagctataagtagt

SEQ ID NO: 648817 - DNA, 22 bp, Artificial Sequence
  chemically synthesized
gagatatggtagctataagtag

SEQ ID NO: 648818 - DNA, 22 bp, Artificial Sequence
  chemically synthesized
tgagatatggtagctataagta

SEQ ID NO: 648819 - DNA, 22 bp, Artificial Sequence
  chemically synthesized
attttgagatatggtagctata

SEQ ID NO: 648820 - DNA, 22 bp, Artificial Sequence
  chemically synthesized
aattttgagatatggtagctat

SEQ ID NO: 648821 - DNA, 22 bp, Artificial Sequence
  chemically synthesized
cgccccttaattttgagatatg

SEQ ID NO: 648822 - DNA, 22 bp, Artificial Sequence
  chemically synthesized
cttatagctaccatatctcaaa

SEQ ID NO: 648823 - DNA, 22 bp, Artificial Sequence
  chemically synthesized
ttgcgccccttaattttgagat

SEQ ID NO: 648824 - DNA, 22 bp, Artificial Sequence
  chemically synthesized
atagctaccatatctcaaaatt

SEQ ID NO: 648825 - DNA, 22 bp, Artificial Sequence
  chemically synthesized
tagctaccatatctcaaaatta

SEQ ID NO: 648826 - DNA, 22 bp, Artificial Sequence
  chemically synthesized
gttattgcgccccttaattttg

SEQ ID NO: 648827 - DNA, 22 bp, Artificial Sequence
  chemically synthesized
cgttattgcgccccttaatttt

SEQ ID NO: 648828 - DNA, 22 bp, Artificial Sequence
  chemically synthesized
ccatatctcaaaattaaggggc

SEQ ID NO: 648829 - DNA, 22 bp, Artificial Sequence
  chemically synthesized
aaacttcgttattgcgcccctt

SEQ ID NO: 648830 - DNA, 22 bp, Artificial Sequence
  chemically synthesized
aaaacttcgttattgcgcccct

SEQ ID NO: 648831 - DNA, 22 bp, Artificial Sequence
  chemically synthesized
taaaacttcgttattgcgcccc

SEQ ID NO: 648832 - DNA, 22 bp, Artificial Sequence
  chemically synthesized
ttaaaacttcgttattgcgccc

SEQ ID NO: 648833 - DNA, 22 bp, Artificial Sequence
  chemically synthesized
tttaaaacttcgttattgcgcc

SEQ ID NO: 648834 - DNA, 22 bp, Artificial Sequence
  chemically synthesized
aaaattaaggggcgcaataacg

SEQ ID NO: 648835 - DNA, 22 bp, Artificial Sequence
  chemically synthesized
ctttttaaaacttcgttattgc

SEQ ID NO: 648836 - DNA, 22 bp, Artificial Sequence
  chemically synthesized
cctttttaaaacttcgttattg

SEQ ID NO: 648837 - DNA, 22 bp, Artificial Sequence
  chemically synthesized
tcctttttaaaacttcgttatt

SEQ ID NO: 648838 - DNA, 22 bp, Artificial Sequence
  chemically synthesized
aggggcgcaataacgaagtttt

SEQ ID NO: 648839 - DNA, 22 bp, Artificial Sequence
  chemically synthesized
tgctttcctttttaaaacttcg

SEQ ID NO: 648840 - DNA, 22 bp, Artificial Sequence
  chemically synthesized
aaggaagtggaaggctatgctt

SEQ ID NO: 648841 - DNA, 22 bp, Artificial Sequence
  chemically synthesized
taaaaaggaaagcatagccttc

SEQ ID NO: 648842 - DNA, 22 bp, Artificial Sequence
  chemically synthesized
aaaaaggaaagcatagccttcc

SEQ ID NO: 648843 - DNA, 22 bp, Artificial Sequence
  chemically synthesized
aaaaggaaagcatagccttcca

SEQ ID NO: 648844 - DNA, 22 bp, Artificial Sequence
  chemically synthesized
ataggcctaaaggaagtggaag

SEQ ID NO: 648845 - DNA, 22 bp, Artificial Sequence
  chemically synthesized
aataggcctaaaggaagtggaa

SEQ ID NO: 648846 - DNA, 22 bp, Artificial Sequence
  chemically synthesized
taataggcctaaaggaagtgga

SEQ ID NO: 648847 - DNA, 22 bp, Artificial Sequence
  chemically synthesized
agtctttaataggcctaaagga

SEQ ID NO: 648848 - DNA, 22 bp, Artificial Sequence
  chemically synthesized
cagtctttaataggcctaaagg

SEQ ID NO: 648849 - DNA, 22 bp, Artificial Sequence
  chemically synthesized
tcagtctttaataggcctaaag

SEQ ID NO: 648850 - DNA, 22 bp, Artificial Sequence
  chemically synthesized
ttttcagtctttaataggccta

SEQ ID NO: 648851 - DNA, 22 bp, Artificial Sequence
  chemically synthesized
attttcagtctttaataggcct

SEQ ID NO: 648852 - DNA, 22 bp, Artificial Sequence
  chemically synthesized
ccacttcctttaggcctattaa

SEQ ID NO: 648853 - DNA, 22 bp, Artificial Sequence
  chemically synthesized
cacttcctttaggcctattaaa

SEQ ID NO: 648854 - DNA, 22 bp, Artificial Sequence
  chemically synthesized
aggtttattttcagtctttaat

SEQ ID NO: 648855 - DNA, 22 bp, Artificial Sequence
  chemically synthesized
cctttaggcctattaaagactg

SEQ ID NO: 648856 - DNA, 22 bp, Artificial Sequence
  chemically synthesized
ctttaggcctattaaagactga

SEQ ID NO: 648857 - DNA, 22 bp, Artificial Sequence
  chemically synthesized
attgaggtttattttcagtctt

SEQ ID NO: 648858 - DNA, 22 bp, Artificial Sequence
  chemically synthesized
taggcctattaaagactgaaaa

SEQ ID NO: 648859 - DNA, 22 bp, Artificial Sequence
  chemically synthesized
aggcctattaaagactgaaaat

SEQ ID NO: 648860 - DNA, 22 bp, Artificial Sequence
  chemically synthesized
ggcctattaaagactgaaaata

SEQ ID NO: 648861 - DNA, 22 bp, Artificial Sequence
  chemically synthesized
ttaattgaggtttattttcagt

SEQ ID NO: 648862 - DNA, 22 bp, Artificial Sequence
  chemically synthesized
ttaaagactgaaaataaacctc

SEQ ID NO: 648863 - DNA, 22 bp, Artificial Sequence
  chemically synthesized
aagactgaaaataaacctcaat

SEQ ID NO: 648864 - DNA, 22 bp, Artificial Sequence
  chemically synthesized
aaaataaacctcaattaataat

SEQ ID NO: 648865 - DNA, 22 bp, Artificial Sequence
  chemically synthesized
tcgtgataaatgcatattatta

SEQ ID NO: 648866 - DNA, 22 bp, Artificial Sequence
  chemically synthesized
aattaataatatgcatttatca

SEQ ID NO: 648867 - DNA, 22 bp, Artificial Sequence
  chemically synthesized
aaaaccctgtcgtgataaatgc

SEQ ID NO: 648868 - DNA, 22 bp, Artificial Sequence
  chemically synthesized
aaaaaccctgtcgtgataaatg

SEQ ID NO: 648869 - DNA, 22 bp, Artificial Sequence
  chemically synthesized
taaaaaccctgtcgtgataaat

SEQ ID NO: 648870 - DNA, 22 bp, Artificial Sequence
  chemically synthesized
ttaaaaaccctgtcgtgataaa

SEQ ID NO: 648871 - DNA, 22 bp, Artificial Sequence
  chemically synthesized
tttaaaaaccctgtcgtgataa

SEQ ID NO: 648872 - DNA, 22 bp, Artificial Sequence
  chemically synthesized
ataatatgcatttatcacgaca

SEQ ID NO: 648873 - DNA, 22 bp, Artificial Sequence
  chemically synthesized
ttttaaaaaccctgtcgtgata

SEQ ID NO: 648874 - DNA, 22 bp, Artificial Sequence
  chemically synthesized
gatccttttttaaaaaccctgt

SEQ ID NO: 648875 - DNA, 22 bp, Artificial Sequence
  chemically synthesized
aactagatccttttttaaaaac

SEQ ID NO: 648876 - DNA, 22 bp, Artificial Sequence
  chemically synthesized
atcacgacagggtttttaaaaa

SEQ ID NO: 648877 - DNA, 22 bp, Artificial Sequence
  chemically synthesized
tcacgacagggtttttaaaaaa

SEQ ID NO: 648878 - DNA, 22 bp, Artificial Sequence
  chemically synthesized
atctaaactagatcctttttta

SEQ ID NO: 648879 - DNA, 22 bp, Artificial Sequence
  chemically synthesized
aatctaaactagatcctttttt

SEQ ID NO: 648880 - DNA, 22 bp, Artificial Sequence
  chemically synthesized
ttaaaaaaggatctagtttaga

SEQ ID NO: 648881 - DNA, 22 bp, Artificial Sequence
  chemically synthesized
taaaaaaggatctagtttagat

SEQ ID NO: 648882 - DNA, 22 bp, Artificial Sequence
  chemically synthesized
aaaaaaggatctagtttagatt

SEQ ID NO: 648883 - DNA, 22 bp, Artificial Sequence
  chemically synthesized
aaaaaggatctagtttagatta

SEQ ID NO: 648884 - DNA, 22 bp, Artificial Sequence
  chemically synthesized
caccatataatttaatctaaac

SEQ ID NO: 648885 - DNA, 22 bp, Artificial Sequence
  chemically synthesized
ttccaccatataatttaatcta

SEQ ID NO: 648886 - DNA, 22 bp, Artificial Sequence
  chemically synthesized
ttgttccaccatataatttaat

SEQ ID NO: 648887 - DNA, 22 bp, Artificial Sequence
  chemically synthesized
attgttccaccatataatttaa

SEQ ID NO: 648888 - DNA, 22 bp, Artificial Sequence
  chemically synthesized
tattgttccaccatataattta

SEQ ID NO: 648889 - DNA, 22 bp, Artificial Sequence
  chemically synthesized
ttattgttccaccatataattt

SEQ ID NO: 648890 - DNA, 22 bp, Artificial Sequence
  chemically synthesized
tttattgttccaccatataatt

SEQ ID NO: 648891 - DNA, 22 bp, Artificial Sequence
  chemically synthesized
ttttattgttccaccatataat

SEQ ID NO: 648892 - DNA, 22 bp, Artificial Sequence
  chemically synthesized
gtttagattaaattatatggtg

SEQ ID NO: 648893 - DNA, 22 bp, Artificial Sequence
  chemically synthesized
agattaaattatatggtggaac

SEQ ID NO: 648894 - DNA, 22 bp, Artificial Sequence
  chemically synthesized
gattaaattatatggtggaaca

SEQ ID NO: 648895 - DNA, 22 bp, Artificial Sequence
  chemically synthesized
aatcttttttattgttccacca

SEQ ID NO: 648896 - DNA, 22 bp, Artificial Sequence
  chemically synthesized
ttaaatcttttttattgttcca

SEQ ID NO: 648897 - DNA, 22 bp, Artificial Sequence
  chemically synthesized
attaaatcttttttattgttcc

SEQ ID NO: 648898 - DNA, 22 bp, Artificial Sequence
  chemically synthesized
aattatatggtggaacaataaa

SEQ ID NO: 648899 - DNA, 22 bp, Artificial Sequence
  chemically synthesized
tattaaatcttttttattgttc

SEQ ID NO: 648900 - DNA, 22 bp, Artificial Sequence
  chemically synthesized
ttattaaatcttttttattgtt

SEQ ID NO: 648901 - DNA, 22 bp, Artificial Sequence
  chemically synthesized
tttattaaatcttttttattgt

SEQ ID NO: 648902 - DNA, 22 bp, Artificial Sequence
  chemically synthesized
tttttattaaatcttttttatt

SEQ ID NO: 648903 - DNA, 22 bp, Artificial Sequence
  chemically synthesized
tatggtggaacaataaaaaaga

SEQ ID NO: 648904 - DNA, 22 bp, Artificial Sequence
  chemically synthesized
ctttttattaaatcttttttat

SEQ ID NO: 648905 - DNA, 22 bp, Artificial Sequence
  chemically synthesized
aatttctttttattaaatcttt

SEQ ID NO: 648906 - DNA, 22 bp, Artificial Sequence
  chemically synthesized
tgtaagaattcaatttcttttt

SEQ ID NO: 648907 - DNA, 22 bp, Artificial Sequence
  chemically synthesized
gtgtaagaattcaatttctttt

SEQ ID NO: 648908 - DNA, 22 bp, Artificial Sequence
  chemically synthesized
aataaaaagaaattgaattctt

SEQ ID NO: 648909 - DNA, 22 bp, Artificial Sequence
  chemically synthesized
ataaaaagaaattgaattctta

SEQ ID NO: 648910 - DNA, 22 bp, Artificial Sequence
  chemically synthesized
ggaagataagcttgtgtaagaa

SEQ ID NO: 648911 - DNA, 22 bp, Artificial Sequence
  chemically synthesized
aattcttacacaagcttatctt

SEQ ID NO: 648912 - DNA, 22 bp, Artificial Sequence
  chemically synthesized
ttacacaagcttatcttccgaa

SEQ ID NO: 648913 - DNA, 22 bp, Artificial Sequence
  chemically synthesized
acacaagcttatcttccgaatt

SEQ ID NO: 648914 - DNA, 22 bp, Artificial Sequence
  chemically synthesized
cacaagcttatcttccgaattg

SEQ ID NO: 648915 - DNA, 22 bp, Artificial Sequence
  chemically synthesized
tggataaaggggaaatgaccaa

SEQ ID NO: 648916 - DNA, 22 bp, Artificial Sequence
  chemically synthesized
atcttccgaattggtcatttcc

SEQ ID NO: 648917 - DNA, 22 bp, Artificial Sequence
  chemically synthesized
tcttccgaattggtcatttccc

SEQ ID NO: 648918 - DNA, 22 bp, Artificial Sequence
  chemically synthesized
ttatggataaaggggaaatgac

SEQ ID NO: 648919 - DNA, 22 bp, Artificial Sequence
  chemically synthesized
tgttatggataaaggggaaatg

SEQ ID NO: 648920 - DNA, 22 bp, Artificial Sequence
  chemically synthesized
ccgaattggtcatttccccttt

SEQ ID NO: 648921 - DNA, 22 bp, Artificial Sequence
  chemically synthesized
cgaattggtcatttccccttta

SEQ ID NO: 648922 - DNA, 22 bp, Artificial Sequence
  chemically synthesized
gtcatttcccctttatccataa

SEQ ID NO: 648923 - DNA, 22 bp, Artificial Sequence
  chemically synthesized
aaaatcagacagctctgttatg

SEQ ID NO: 648924 - DNA, 22 bp, Artificial Sequence
  chemically synthesized
cccctttatccataacagagct

SEQ ID NO: 648925 - DNA, 22 bp, Artificial Sequence
  chemically synthesized
ccctttatccataacagagctg

SEQ ID NO: 648926 - DNA, 22 bp, Artificial Sequence
  chemically synthesized
ttgaaaatcagacagctctgtt

SEQ ID NO: 648927 - DNA, 22 bp, Artificial Sequence
  chemically synthesized
attgaaaatcagacagctctgt

SEQ ID NO: 648928 - DNA, 22 bp, Artificial Sequence
  chemically synthesized
tatccataacagagctgtctga

SEQ ID NO: 648929 - DNA, 22 bp, Artificial Sequence
  chemically synthesized
atccataacagagctgtctgat

SEQ ID NO: 648930 - DNA, 22 bp, Artificial Sequence
  chemically synthesized
tccataacagagctgtctgatt

SEQ ID NO: 648931 - DNA, 22 bp, Artificial Sequence
  chemically synthesized
aaatatttattgaaaatcagac

SEQ ID NO: 648932 - DNA, 22 bp, Artificial Sequence
  chemically synthesized
ttaaaatatttattgaaaatca

SEQ ID NO: 648933 - DNA, 22 bp, Artificial Sequence
  chemically synthesized
attaaaatatttattgaaaatc

SEQ ID NO: 648934 - DNA, 22 bp, Artificial Sequence
  chemically synthesized
tattaaaatatttattgaaaat

SEQ ID NO: 648935 - DNA, 22 bp, Artificial Sequence
  chemically synthesized
tctgattttcaataaatatttt

SEQ ID NO: 648936 - DNA, 22 bp, Artificial Sequence
  chemically synthesized
aaagtatgctttattaaaatat

SEQ ID NO: 648937 - DNA, 22 bp, Artificial Sequence
  chemically synthesized
attttcaataaatattttaata

SEQ ID NO: 648938 - DNA, 22 bp, Artificial Sequence
  chemically synthesized
caaagtatgctttattaaaata

SEQ ID NO: 648939 - DNA, 22 bp, Artificial Sequence
  chemically synthesized
tcaataaatattttaataaagc

SEQ ID NO: 648940 - DNA, 22 bp, Artificial Sequence
  chemically synthesized
caataaatattttaataaagca

SEQ ID NO: 648941 - DNA, 22 bp, Artificial Sequence
  chemically synthesized
aataaatattttaataaagcat

SEQ ID NO: 648942 - DNA, 22 bp, Artificial Sequence
  chemically synthesized
gtatttcaaagtatgctttatt

SEQ ID NO: 648943 - DNA, 22 bp, Artificial Sequence
  chemically synthesized
ggtatttcaaagtatgctttat

SEQ ID NO: 648944 - DNA, 22 bp, Artificial Sequence
  chemically synthesized
tggtatttcaaagtatgcttta

SEQ ID NO: 648945 - DNA, 22 bp, Artificial Sequence
  chemically synthesized
ttggtatttcaaagtatgcttt

SEQ ID NO: 648946 - DNA, 22 bp, Artificial Sequence
  chemically synthesized
taataaagcatactttgaaata

SEQ ID NO: 648947 - DNA, 22 bp, Artificial Sequence
  chemically synthesized
aataaagcatactttgaaatac

SEQ ID NO: 648948 - DNA, 22 bp, Artificial Sequence
  chemically synthesized
ataaagcatactttgaaatacc

SEQ ID NO: 648949 - DNA, 22 bp, Artificial Sequence
  chemically synthesized
taacaaacttttggtatttcaa

SEQ ID NO: 648950 - DNA, 22 bp, Artificial Sequence
  chemically synthesized
ttataacaaacttttggtattt

SEQ ID NO: 648951 - DNA, 22 bp, Artificial Sequence
  chemically synthesized
tgaaataccaaaagtttgttat

SEQ ID NO: 648952 - DNA, 22 bp, Artificial Sequence
  chemically synthesized
tgtagggttgttataacaaact

SEQ ID NO: 648953 - DNA, 22 bp, Artificial Sequence
  chemically synthesized
gaaataccaaaagtttgttata

SEQ ID NO: 648954 - DNA, 22 bp, Artificial Sequence
  chemically synthesized
aaataccaaaagtttgttataa

SEQ ID NO: 648955 - DNA, 22 bp, Artificial Sequence
  chemically synthesized
cattatgtagggttgttataac

SEQ ID NO: 648956 - DNA, 22 bp, Artificial Sequence
  chemically synthesized
aaactacattatgtagggttgt

SEQ ID NO: 648957 - DNA, 22 bp, Artificial Sequence
  chemically synthesized
aaaactacattatgtagggttg

SEQ ID NO: 648958 - DNA, 22 bp, Artificial Sequence
  chemically synthesized
taaaactacattatgtagggtt

SEQ ID NO: 648959 - DNA, 22 bp, Artificial Sequence
  chemically synthesized
ttttaaaactacattatgtagg

SEQ ID NO: 648960 - DNA, 22 bp, Artificial Sequence
  chemically synthesized
gttataacaaccctacataatg

SEQ ID NO: 648961 - DNA, 22 bp, Artificial Sequence
  chemically synthesized
ttataacaaccctacataatgt

SEQ ID NO: 648962 - DNA, 22 bp, Artificial Sequence
  chemically synthesized
taacaaccctacataatgtagt

SEQ ID NO: 648963 - DNA, 22 bp, Artificial Sequence
  chemically synthesized
cataatgtagttttaaaatagg

SEQ ID NO: 648964 - DNA, 22 bp, Artificial Sequence
  chemically synthesized
gcaaacaaagtgcctattttaa

SEQ ID NO: 648965 - DNA, 22 bp, Artificial Sequence
  chemically synthesized
tattagcaaacaaagtgcctat

SEQ ID NO: 648966 - DNA, 22 bp, Artificial Sequence
  chemically synthesized
tatattagcaaacaaagtgcct

SEQ ID NO: 648967 - DNA, 22 bp, Artificial Sequence
  chemically synthesized
ctatattagcaaacaaagtgcc

SEQ ID NO: 648968 - DNA, 22 bp, Artificial Sequence
  chemically synthesized
taaaataggcactttgtttgct

SEQ ID NO: 648969 - DNA, 22 bp, Artificial Sequence
  chemically synthesized
aaaataggcactttgtttgcta

SEQ ID NO: 648970 - DNA, 22 bp, Artificial Sequence
  chemically synthesized
tgatttctatattagcaaacaa

SEQ ID NO: 648971 - DNA, 22 bp, Artificial Sequence
  chemically synthesized
aaataggcactttgtttgctaa

SEQ ID NO: 648972 - DNA, 22 bp, Artificial Sequence
  chemically synthesized
gggcctgtgatttctatattag

SEQ ID NO: 648973 - DNA, 22 bp, Artificial Sequence
  chemically synthesized
ggggcctgtgatttctatatta

SEQ ID NO: 648974 - DNA, 22 bp, Artificial Sequence
  chemically synthesized
tggggcctgtgatttctatatt

SEQ ID NO: 648975 - DNA, 22 bp, Artificial Sequence
  chemically synthesized
ttggggcctgtgatttctatat

SEQ ID NO: 648976 - DNA, 22 bp, Artificial Sequence
  chemically synthesized
tttggggcctgtgatttctata

SEQ ID NO: 648977 - DNA, 22 bp, Artificial Sequence
  chemically synthesized
ttttggggcctgtgatttctat

SEQ ID NO: 648978 - DNA, 22 bp, Artificial Sequence
  chemically synthesized
tgtttgctaatatagaaatcac

SEQ ID NO: 648979 - DNA, 22 bp, Artificial Sequence
  chemically synthesized
gtttgctaatatagaaatcaca

SEQ ID NO: 648980 - DNA, 22 bp, Artificial Sequence
  chemically synthesized
ttttttggggcctgtgatttct

SEQ ID NO: 648981 - DNA, 22 bp, Artificial Sequence
  chemically synthesized
tttgctaatatagaaatcacag

SEQ ID NO: 648982 - DNA, 22 bp, Artificial Sequence
  chemically synthesized
gctaatatagaaatcacaggcc

SEQ ID NO: 648983 - DNA, 22 bp, Artificial Sequence
  chemically synthesized
ctaatatagaaatcacaggccc

SEQ ID NO: 648984 - DNA, 22 bp, Artificial Sequence
  chemically synthesized
atatagaaatcacaggccccaa

SEQ ID NO: 648985 - DNA, 22 bp, Artificial Sequence
  chemically synthesized
gaaaactcttttttggggcctg

SEQ ID NO: 648986 - DNA, 22 bp, Artificial Sequence
  chemically synthesized
taatgctagaaaactctttttt

SEQ ID NO: 648987 - DNA, 22 bp, Artificial Sequence
  chemically synthesized
ataatgctagaaaactcttttt

SEQ ID NO: 648988 - DNA, 22 bp, Artificial Sequence
  chemically synthesized
agagtttataatgctagaaaac

SEQ ID NO: 648989 - DNA, 22 bp, Artificial Sequence
  chemically synthesized
tctcagagtttataatgctaga

SEQ ID NO: 648990 - DNA, 22 bp, Artificial Sequence
  chemically synthesized
atctcagagtttataatgctag

SEQ ID NO: 648991 - DNA, 22 bp, Artificial Sequence
  chemically synthesized
tctagcattataaactctgaga

SEQ ID NO: 648992 - DNA, 22 bp, Artificial Sequence
  chemically synthesized
ctagcattataaactctgagat

SEQ ID NO: 648993 - DNA, 22 bp, Artificial Sequence
  chemically synthesized
tagcattataaactctgagata

SEQ ID NO: 648994 - DNA, 22 bp, Artificial Sequence
  chemically synthesized
gcattataaactctgagataaa

SEQ ID NO: 648995 - DNA, 22 bp, Artificial Sequence
  chemically synthesized
gataccagcagatgatttatct

SEQ ID NO: 648996 - DNA, 22 bp, Artificial Sequence
  chemically synthesized
agataccagcagatgatttatc

SEQ ID NO: 648997 - DNA, 22 bp, Artificial Sequence
  chemically synthesized
taaactctgagataaatcatct

SEQ ID NO: 648998 - DNA, 22 bp, Artificial Sequence
  chemically synthesized
agcttagataccagcagatgat

SEQ ID NO: 648999 - DNA, 22 bp, Artificial Sequence
  chemically synthesized
tgagataaatcatctgctggta

SEQ ID NO: 649000 - DNA, 22 bp, Artificial Sequence
  chemically synthesized
agataaatcatctgctggtatc

SEQ ID NO: 649001 - DNA, 22 bp, Artificial Sequence
  chemically synthesized
ataatactgagcttagatacca

SEQ ID NO: 649002 - DNA, 22 bp, Artificial Sequence
  chemically synthesized
gtgtgtattaataatactgagc

SEQ ID NO: 649003 - DNA, 22 bp, Artificial Sequence
  chemically synthesized
ctggtatctaagctcagtatta

SEQ ID NO: 649004 - DNA, 22 bp, Artificial Sequence
  chemically synthesized
ttggtgtgtattaataatactg

SEQ ID NO: 649005 - DNA, 22 bp, Artificial Sequence
  chemically synthesized
gtatctaagctcagtattatta

SEQ ID NO: 649006 - DNA, 22 bp, Artificial Sequence
  chemically synthesized
ctattggtgtgtattaataata

SEQ ID NO: 649007 - DNA, 22 bp, Artificial Sequence
  chemically synthesized
ttactattggtgtgtattaata

SEQ ID NO: 649008 - DNA, 22 bp, Artificial Sequence
  chemically synthesized
agctcagtattattaatacaca

SEQ ID NO: 649009 - DNA, 22 bp, Artificial Sequence
  chemically synthesized
ttattactattggtgtgtatta

SEQ ID NO: 649010 - DNA, 22 bp, Artificial Sequence
  chemically synthesized
gttattactattggtgtgtatt

SEQ ID NO: 649011 - DNA, 22 bp, Artificial Sequence
  chemically synthesized
tgttattactattggtgtgtat

SEQ ID NO: 649012 - DNA, 22 bp, Artificial Sequence
  chemically synthesized
agtattattaatacacaccaat

SEQ ID NO: 649013 - DNA, 22 bp, Artificial Sequence
  chemically synthesized
tttgttattactattggtgtgt

SEQ ID NO: 649014 - DNA, 22 bp, Artificial Sequence
  chemically synthesized
ctttgttattactattggtgtg

SEQ ID NO: 649015 - DNA, 22 bp, Artificial Sequence
  chemically synthesized
ttaatacacaccaatagtaata

SEQ ID NO: 649016 - DNA, 22 bp, Artificial Sequence
  chemically synthesized
atacacaccaatagtaataaca

SEQ ID NO: 649017 - DNA, 22 bp, Artificial Sequence
  chemically synthesized
ggaggaaagtatttctttgtta

SEQ ID NO: 649018 - DNA, 22 bp, Artificial Sequence
  chemically synthesized
taggaggaaagtatttctttgt

SEQ ID NO: 649019 - DNA, 22 bp, Artificial Sequence
  chemically synthesized
ctctaggaggaaagtatttctt

SEQ ID NO: 649020 - DNA, 22 bp, Artificial Sequence
  chemically synthesized
gctctaggaggaaagtatttct

SEQ ID NO: 649021 - DNA, 22 bp, Artificial Sequence
  chemically synthesized
tacatttgctctaggaggaaag

SEQ ID NO: 649022 - DNA, 22 bp, Artificial Sequence
  chemically synthesized
ataaacaattatacatttgctc

SEQ ID NO: 649023 - DNA, 22 bp, Artificial Sequence
  chemically synthesized
tcctcctagagcaaatgtataa

SEQ ID NO: 649024 - DNA, 22 bp, Artificial Sequence
  chemically synthesized
cctcctagagcaaatgtataat

SEQ ID NO: 649025 - DNA, 22 bp, Artificial Sequence
  chemically synthesized
agctcataaacaattatacatt

SEQ ID NO: 649026 - DNA, 22 bp, Artificial Sequence
  chemically synthesized
ctcctagagcaaatgtataatt

SEQ ID NO: 649027 - DNA, 22 bp, Artificial Sequence
  chemically synthesized
ctagagcaaatgtataattgtt

SEQ ID NO: 649028 - DNA, 22 bp, Artificial Sequence
  chemically synthesized
gagcaaatgtataattgtttat

SEQ ID NO: 649029 - DNA, 22 bp, Artificial Sequence
  chemically synthesized
aatattcagctcataaacaatt

SEQ ID NO: 649030 - DNA, 22 bp, Artificial Sequence
  chemically synthesized
caagctaaatattcagctcata

SEQ ID NO: 649031 - DNA, 22 bp, Artificial Sequence
  chemically synthesized
tccaagctaaatattcagctca

SEQ ID NO: 649032 - DNA, 22 bp, Artificial Sequence
  chemically synthesized
ctctccaagctaaatattcagc

SEQ ID NO: 649033 - DNA, 22 bp, Artificial Sequence
  chemically synthesized
tcctctccaagctaaatattca

SEQ ID NO: 649034 - DNA, 22 bp, Artificial Sequence
  chemically synthesized
tttatgagctgaatatttagct

SEQ ID NO: 649035 - DNA, 22 bp, Artificial Sequence
  chemically synthesized
ctctcctctccaagctaaatat

SEQ ID NO: 649036 - DNA, 22 bp, Artificial Sequence
  chemically synthesized
gctctcctctccaagctaaata

SEQ ID NO: 649037 - DNA, 22 bp, Artificial Sequence
  chemically synthesized
tgctctcctctccaagctaaat

SEQ ID NO: 649038 - DNA, 22 bp, Artificial Sequence
  chemically synthesized
atgagctgaatatttagcttgg

SEQ ID NO: 649039 - DNA, 22 bp, Artificial Sequence
  chemically synthesized
tgagctgaatatttagcttgga

SEQ ID NO: 649040 - DNA, 22 bp, Artificial Sequence
  chemically synthesized
actttgctctcctctccaagct

SEQ ID NO: 649041 - DNA, 22 bp, Artificial Sequence
  chemically synthesized
aatatttagcttggagaggaga

SEQ ID NO: 649042 - DNA, 22 bp, Artificial Sequence
  chemically synthesized
aactcactttgctctcctctcc

SEQ ID NO: 649043 - DNA, 22 bp, Artificial Sequence
  chemically synthesized
aactaaactcactttgctctcc

SEQ ID NO: 649044 - DNA, 22 bp, Artificial Sequence
  chemically synthesized
gaactaaactcactttgctctc

SEQ ID NO: 649045 - DNA, 22 bp, Artificial Sequence
  chemically synthesized
agcttggagaggagagcaaagt

SEQ ID NO: 649046 - DNA, 22 bp, Artificial Sequence
  chemically synthesized
tgaactaaactcactttgctct

SEQ ID NO: 649047 - DNA, 22 bp, Artificial Sequence
  chemically synthesized
gcttggagaggagagcaaagtg

SEQ ID NO: 649048 - DNA, 22 bp, Artificial Sequence
  chemically synthesized
ggagaggagagcaaagtgagtt

SEQ ID NO: 649049 - DNA, 22 bp, Artificial Sequence
  chemically synthesized
aattttgaactaaactcacttt

SEQ ID NO: 649050 - DNA, 22 bp, Artificial Sequence
  chemically synthesized
gagaggagagcaaagtgagttt

SEQ ID NO: 649051 - DNA, 22 bp, Artificial Sequence
  chemically synthesized
taaattttgaactaaactcact

SEQ ID NO: 649052 - DNA, 22 bp, Artificial Sequence
  chemically synthesized
ctaaattttgaactaaactcac

SEQ ID NO: 649053 - DNA, 22 bp, Artificial Sequence
  chemically synthesized
tatacaagggtttctaaatttt

SEQ ID NO: 649054 - DNA, 22 bp, Artificial Sequence
  chemically synthesized
agttcaaaatttagaaaccctt

SEQ ID NO: 649055 - DNA, 22 bp, Artificial Sequence
  chemically synthesized
atcattatatacaagggtttct

SEQ ID NO: 649056 - DNA, 22 bp, Artificial Sequence
  chemically synthesized
gttcaaaatttagaaacccttg

SEQ ID NO: 649057 - DNA, 22 bp, Artificial Sequence
  chemically synthesized
actaatcattatatacaagggt

SEQ ID NO: 649058 - DNA, 22 bp, Artificial Sequence
  chemically synthesized
aaaatttagaaacccttgtata

SEQ ID NO: 649059 - DNA, 22 bp, Artificial Sequence
  chemically synthesized
gactaatcattatatacaaggg

SEQ ID NO: 649060 - DNA, 22 bp, Artificial Sequence
  chemically synthesized
tttgactaatcattatatacaa

SEQ ID NO: 649061 - DNA, 22 bp, Artificial Sequence
  chemically synthesized
agaaacccttgtatataatgat

SEQ ID NO: 649062 - DNA, 22 bp, Artificial Sequence
  chemically synthesized
gaaacccttgtatataatgatt

SEQ ID NO: 649063 - DNA, 22 bp, Artificial Sequence
  chemically synthesized
tgccatgctatttgactaatca

SEQ ID NO: 649064 - DNA, 22 bp, Artificial Sequence
  chemically synthesized
gtatataatgattagtcaaata

SEQ ID NO: 649065 - DNA, 22 bp, Artificial Sequence
  chemically synthesized
tatataatgattagtcaaatag

SEQ ID NO: 649066 - DNA, 22 bp, Artificial Sequence
  chemically synthesized
tcaggttatgccatgctatttg

SEQ ID NO: 649067 - DNA, 22 bp, Artificial Sequence
  chemically synthesized
atcaggttatgccatgctattt

SEQ ID NO: 649068 - DNA, 22 bp, Artificial Sequence
  chemically synthesized
tttatcaggttatgccatgcta

SEQ ID NO: 649069 - DNA, 22 bp, Artificial Sequence
  chemically synthesized
gtcaaatagcatggcataacct

SEQ ID NO: 649070 - DNA, 22 bp, Artificial Sequence
  chemically synthesized
atgaggtgtgcggactgtttat

SEQ ID NO: 649071 - DNA, 22 bp, Artificial Sequence
  chemically synthesized
aatgaggtgtgcggactgttta

SEQ ID NO: 649072 - DNA, 22 bp, Artificial Sequence
  chemically synthesized
taatgaggtgtgcggactgttt

SEQ ID NO: 649073 - DNA, 22 bp, Artificial Sequence
  chemically synthesized
aataattttaatgaggtgtgcg

SEQ ID NO: 649074 - DNA, 22 bp, Artificial Sequence
  chemically synthesized
ataaacagtccgcacacctcat

SEQ ID NO: 649075 - DNA, 22 bp, Artificial Sequence
  chemically synthesized
gttgaataattttaatgaggtg

SEQ ID NO: 649076 - DNA, 22 bp, Artificial Sequence
  chemically synthesized
ggttgaataattttaatgaggt

SEQ ID NO: 649077 - DNA, 22 bp, Artificial Sequence
  chemically synthesized
agtttggttgaataattttaat

SEQ ID NO: 649078 - DNA, 22 bp, Artificial Sequence
  chemically synthesized
attaaaattattcaaccaaact

SEQ ID NO: 649079 - DNA, 22 bp, Artificial Sequence
  chemically synthesized
aagtatgatgctgagtttggtt

SEQ ID NO: 649080 - DNA, 22 bp, Artificial Sequence
  chemically synthesized
aaagtatgatgctgagtttggt

SEQ ID NO: 649081 - DNA, 22 bp, Artificial Sequence
  chemically synthesized
taaagtatgatgctgagtttgg

SEQ ID NO: 649082 - DNA, 22 bp, Artificial Sequence
  chemically synthesized
aaattattcaaccaaactcagc

SEQ ID NO: 649083 - DNA, 22 bp, Artificial Sequence
  chemically synthesized
gttttaaagtatgatgctgagt

SEQ ID NO: 649084 - DNA, 22 bp, Artificial Sequence
  chemically synthesized
ttcaaccaaactcagcatcata

SEQ ID NO: 649085 - DNA, 22 bp, Artificial Sequence
  chemically synthesized
aaccaaactcagcatcatactt

SEQ ID NO: 649086 - DNA, 22 bp, Artificial Sequence
  chemically synthesized
agcatcatactttaaaacgaat

SEQ ID NO: 649087 - DNA, 22 bp, Artificial Sequence
  chemically synthesized
aaaatcagcagaattcgtttta

SEQ ID NO: 649088 - DNA, 22 bp, Artificial Sequence
  chemically synthesized
ttaaaaatcagcagaattcgtt

SEQ ID NO: 649089 - DNA, 22 bp, Artificial Sequence
  chemically synthesized
taaaacgaattctgctgatttt

SEQ ID NO: 649090 - DNA, 22 bp, Artificial Sequence
  chemically synthesized
aaaacgaattctgctgattttt

SEQ ID NO: 649091 - DNA, 22 bp, Artificial Sequence
  chemically synthesized
aaacgaattctgctgattttta

SEQ ID NO: 649092 - DNA, 22 bp, Artificial Sequence
  chemically synthesized
taagtggactattaaaaatcag

SEQ ID NO: 649093 - DNA, 22 bp, Artificial Sequence
  chemically synthesized
ttataagtggactattaaaaat

SEQ ID NO: 649094 - DNA, 22 bp, Artificial Sequence
  chemically synthesized
tgctgatttttaatagtccact

SEQ ID NO: 649095 - DNA, 22 bp, Artificial Sequence
  chemically synthesized
gggtctgttataagtggactat

SEQ ID NO: 649096 - DNA, 22 bp, Artificial Sequence
  chemically synthesized
agggtctgttataagtggacta

SEQ ID NO: 649097 - DNA, 22 bp, Artificial Sequence
  chemically synthesized
ctgatttttaatagtccactta

SEQ ID NO: 649098 - DNA, 22 bp, Artificial Sequence
  chemically synthesized
tagggtctgttataagtggact

SEQ ID NO: 649099 - DNA, 22 bp, Artificial Sequence
  chemically synthesized
atttttaatagtccacttataa

SEQ ID NO: 649100 - DNA, 22 bp, Artificial Sequence
  chemically synthesized
ttaatagtccacttataacaga

SEQ ID NO: 649101 - DNA, 22 bp, Artificial Sequence
  chemically synthesized
gaatctttagggtctgttataa

SEQ ID NO: 649102 - DNA, 22 bp, Artificial Sequence
  chemically synthesized
taatagtccacttataacagac

SEQ ID NO: 649103 - DNA, 22 bp, Artificial Sequence
  chemically synthesized
agaatctttagggtctgttata

SEQ ID NO: 649104 - DNA, 22 bp, Artificial Sequence
  chemically synthesized
aatagtccacttataacagacc

SEQ ID NO: 649105 - DNA, 22 bp, Artificial Sequence
  chemically synthesized
tagaatctttagggtctgttat

SEQ ID NO: 649106 - DNA, 22 bp, Artificial Sequence
  chemically synthesized
atagtccacttataacagaccc

SEQ ID NO: 649107 - DNA, 22 bp, Artificial Sequence
  chemically synthesized
ttagaatctttagggtctgtta

SEQ ID NO: 649108 - DNA, 22 bp, Artificial Sequence
  chemically synthesized
tttagaatctttagggtctgtt

SEQ ID NO: 649109 - DNA, 22 bp, Artificial Sequence
  chemically synthesized
gatgctttttagaatctttagg

SEQ ID NO: 649110 - DNA, 22 bp, Artificial Sequence
  chemically synthesized
ataacagaccctaaagattcta

SEQ ID NO: 649111 - DNA, 22 bp, Artificial Sequence
  chemically synthesized
taacagaccctaaagattctaa

SEQ ID NO: 649112 - DNA, 22 bp, Artificial Sequence
  chemically synthesized
agattcgatgctttttagaatc

SEQ ID NO: 649113 - DNA, 22 bp, Artificial Sequence
  chemically synthesized
gagattcgatgctttttagaat

SEQ ID NO: 649114 - DNA, 22 bp, Artificial Sequence
  chemically synthesized
ttgagattcgatgctttttaga

SEQ ID NO: 649115 - DNA, 22 bp, Artificial Sequence
  chemically synthesized
cttgagattcgatgctttttag

SEQ ID NO: 649116 - DNA, 22 bp, Artificial Sequence
  chemically synthesized
aagattctaaaaagcatcgaat

SEQ ID NO: 649117 - DNA, 22 bp, Artificial Sequence
  chemically synthesized
gccatatttcttgagattcgat

SEQ ID NO: 649118 - DNA, 22 bp, Artificial Sequence
  chemically synthesized
agccatatttcttgagattcga

SEQ ID NO: 649119 - DNA, 22 bp, Artificial Sequence
  chemically synthesized
tagccatatttcttgagattcg

SEQ ID NO: 649120 - DNA, 22 bp, Artificial Sequence
  chemically synthesized
taaaaagcatcgaatctcaaga

SEQ ID NO: 649121 - DNA, 22 bp, Artificial Sequence
  chemically synthesized
tttagccatatttcttgagatt

SEQ ID NO: 649122 - DNA, 22 bp, Artificial Sequence
  chemically synthesized
aaaagcatcgaatctcaagaaa

SEQ ID NO: 649123 - DNA, 22 bp, Artificial Sequence
  chemically synthesized
cataataacattctttagccat

SEQ ID NO: 649124 - DNA, 22 bp, Artificial Sequence
  chemically synthesized
attacataataacattctttag

SEQ ID NO: 649125 - DNA, 22 bp, Artificial Sequence
  chemically synthesized
aagaaatatggctaaagaatgt

SEQ ID NO: 649126 - DNA, 22 bp, Artificial Sequence
  chemically synthesized
tgattacataataacattcttt

SEQ ID NO: 649127 - DNA, 22 bp, Artificial Sequence
  chemically synthesized
ctgattacataataacattctt

SEQ ID NO: 649128 - DNA, 22 bp, Artificial Sequence
  chemically synthesized
aagaatgttattatgtaatcag

SEQ ID NO: 649129 - DNA, 22 bp, Artificial Sequence
  chemically synthesized
ttatgtaatcagaagcttcttc

SEQ ID NO: 649130 - DNA, 22 bp, Artificial Sequence
  chemically synthesized
atataaaagcaaggaagaagct

SEQ ID NO: 649131 - DNA, 22 bp, Artificial Sequence
  chemically synthesized
catataaaagcaaggaagaagc

SEQ ID NO: 649132 - DNA, 22 bp, Artificial Sequence
  chemically synthesized
tgtaatcagaagcttcttcctt

SEQ ID NO: 649133 - DNA, 22 bp, Artificial Sequence
  chemically synthesized
ttcatataaaagcaaggaagaa

SEQ ID NO: 649134 - DNA, 22 bp, Artificial Sequence
  chemically synthesized
cttcatataaaagcaaggaaga

SEQ ID NO: 649135 - DNA, 22 bp, Artificial Sequence
  chemically synthesized
tatatttcttcatataaaagca

SEQ ID NO: 649136 - DNA, 22 bp, Artificial Sequence
  chemically synthesized
atatatttcttcatataaaagc

SEQ ID NO: 649137 - DNA, 22 bp, Artificial Sequence
  chemically synthesized
cttccttgcttttatatgaaga

SEQ ID NO: 649138 - DNA, 22 bp, Artificial Sequence
  chemically synthesized
ttccttgcttttatatgaagaa

SEQ ID NO: 649139 - DNA, 22 bp, Artificial Sequence
  chemically synthesized
ccttgcttttatatgaagaaat

SEQ ID NO: 649140 - DNA, 22 bp, Artificial Sequence
  chemically synthesized
cttgcttttatatgaagaaata

SEQ ID NO: 649141 - DNA, 22 bp, Artificial Sequence
  chemically synthesized
gcttttatatgaagaaatatat

SEQ ID NO: 649142 - DNA, 22 bp, Artificial Sequence
  chemically synthesized
ggagacatgtttatatatttct

SEQ ID NO: 649143 - DNA, 22 bp, Artificial Sequence
  chemically synthesized
cttttatatgaagaaatatata

SEQ ID NO: 649144 - DNA, 22 bp, Artificial Sequence
  chemically synthesized
ctgggagacatgtttatatatt

SEQ ID NO: 649145 - DNA, 22 bp, Artificial Sequence
  chemically synthesized
ttatatgaagaaatatataaac

SEQ ID NO: 649146 - DNA, 22 bp, Artificial Sequence
  chemically synthesized
tatatgaagaaatatataaaca

SEQ ID NO: 649147 - DNA, 22 bp, Artificial Sequence
  chemically synthesized
atatgaagaaatatataaacat

SEQ ID NO: 649148 - DNA, 22 bp, Artificial Sequence
  chemically synthesized
tatgaagaaatatataaacatg

SEQ ID NO: 649149 - DNA, 22 bp, Artificial Sequence
  chemically synthesized
tattcctgggagacatgtttat

SEQ ID NO: 649150 - DNA, 22 bp, Artificial Sequence
  chemically synthesized
gctgtattcctgggagacatgt

SEQ ID NO: 649151 - DNA, 22 bp, Artificial Sequence
  chemically synthesized
agctgtattcctgggagacatg

SEQ ID NO: 649152 - DNA, 22 bp, Artificial Sequence
  chemically synthesized
tagctgtattcctgggagacat

SEQ ID NO: 649153 - DNA, 22 bp, Artificial Sequence
  chemically synthesized
gagttttagctgtattcctggg

SEQ ID NO: 649154 - DNA, 22 bp, Artificial Sequence
  chemically synthesized
ttggagttttagctgtattcct

SEQ ID NO: 649155 - DNA, 22 bp, Artificial Sequence
  chemically synthesized
ccaggaatacagctaaaactcc

SEQ ID NO: 649156 - DNA, 22 bp, Artificial Sequence
  chemically synthesized
taatcaaagaagttattggagt

SEQ ID NO: 649157 - DNA, 22 bp, Artificial Sequence
  chemically synthesized
aaattataatcaaagaagttat

SEQ ID NO: 649158 - DNA, 22 bp, Artificial Sequence
  chemically synthesized
aaactccaataacttctttgat

SEQ ID NO: 649159 - DNA, 22 bp, Artificial Sequence
  chemically synthesized
aattcaaattataatcaaagaa

SEQ ID NO: 649160 - DNA, 22 bp, Artificial Sequence
  chemically synthesized
gaattcaaattataatcaaaga

SEQ ID NO: 649161 - DNA, 22 bp, Artificial Sequence
  chemically synthesized
caataacttctttgattataat

SEQ ID NO: 649162 - DNA, 22 bp, Artificial Sequence
  chemically synthesized
gcttgaattcaaattataatca

SEQ ID NO: 649163 - DNA, 22 bp, Artificial Sequence
  chemically synthesized
ctttgattataatttgaattca

SEQ ID NO: 649164 - DNA, 22 bp, Artificial Sequence
  chemically synthesized
tttgattataatttgaattcaa

SEQ ID NO: 649165 - DNA, 22 bp, Artificial Sequence
  chemically synthesized
tgattataatttgaattcaagc

SEQ ID NO: 649166 - DNA, 22 bp, Artificial Sequence
  chemically synthesized
gattataatttgaattcaagcc

SEQ ID NO: 649167 - DNA, 22 bp, Artificial Sequence
  chemically synthesized
attataatttgaattcaagcca

SEQ ID NO: 649168 - DNA, 22 bp, Artificial Sequence
  chemically synthesized
taatttgaattcaagccaggat

SEQ ID NO: 649169 - DNA, 22 bp, Artificial Sequence
  chemically synthesized
aaaccagcagaaatcctggctt

SEQ ID NO: 649170 - DNA, 22 bp, Artificial Sequence
  chemically synthesized
gaattcaagccaggatttctgc

SEQ ID NO: 649171 - DNA, 22 bp, Artificial Sequence
  chemically synthesized
aattcaagccaggatttctgct

SEQ ID NO: 649172 - DNA, 22 bp, Artificial Sequence
  chemically synthesized
aagccaggatttctgctggttt

SEQ ID NO: 649173 - DNA, 22 bp, Artificial Sequence
  chemically synthesized
caccaggtgaaattcaaaccag

SEQ ID NO: 649174 - DNA, 22 bp, Artificial Sequence
  chemically synthesized
ctccaccaggtgaaattcaaac

SEQ ID NO: 649175 - DNA, 22 bp, Artificial Sequence
  chemically synthesized
gttcctccaccaggtgaaattc

SEQ ID NO: 649176 - DNA, 22 bp, Artificial Sequence
  chemically synthesized
ggttcctccaccaggtgaaatt

SEQ ID NO: 649177 - DNA, 22 bp, Artificial Sequence
  chemically synthesized
ctgctggtttgaatttcacctg

SEQ ID NO: 649178 - DNA, 22 bp, Artificial Sequence
  chemically synthesized
tggttcctccaccaggtgaaat

SEQ ID NO: 649179 - DNA, 22 bp, Artificial Sequence
  chemically synthesized
tgctggtttgaatttcacctgg

SEQ ID NO: 649180 - DNA, 22 bp, Artificial Sequence
  chemically synthesized
ttggttcctccaccaggtgaaa

SEQ ID NO: 649181 - DNA, 22 bp, Artificial Sequence
  chemically synthesized
tttggttcctccaccaggtgaa

SEQ ID NO: 649182 - DNA, 22 bp, Artificial Sequence
  chemically synthesized
ctggtttgaatttcacctggtg

SEQ ID NO: 649183 - DNA, 22 bp, Artificial Sequence
  chemically synthesized
gtttgaatttcacctggtggag

SEQ ID NO: 649184 - DNA, 22 bp, Artificial Sequence
  chemically synthesized
gaatttcacctggtggaggaac

SEQ ID NO: 649185 - DNA, 22 bp, Artificial Sequence
  chemically synthesized
aatttcacctggtggaggaacc

SEQ ID NO: 649186 - DNA, 22 bp, Artificial Sequence
  chemically synthesized
cacctggtggaggaaccaaaaa

SEQ ID NO: 649187 - DNA, 22 bp, Artificial Sequence
  chemically synthesized
acctggtggaggaaccaaaaaa

SEQ ID NO: 649188 - DNA, 22 bp, Artificial Sequence
  chemically synthesized
gtggaggaaccaaaaaacccac

SEQ ID NO: 649189 - DNA, 22 bp, Artificial Sequence
  chemically synthesized
cacagatcaggagaatcagagt

SEQ ID NO: 649190 - DNA, 22 bp, Artificial Sequence
  chemically synthesized
aaagtaccatctacacagatca

SEQ ID NO: 649191 - DNA, 22 bp, Artificial Sequence
  chemically synthesized
gaaagtaccatctacacagatc

SEQ ID NO: 649192 - DNA, 22 bp, Artificial Sequence
  chemically synthesized
tgaaagtaccatctacacagat

SEQ ID NO: 649193 - DNA, 22 bp, Artificial Sequence
  chemically synthesized
tgattctcctgatctgtgtaga

SEQ ID NO: 649194 - DNA, 22 bp, Artificial Sequence
  chemically synthesized
attctcctgatctgtgtagatg

SEQ ID NO: 649195 - DNA, 22 bp, Artificial Sequence
  chemically synthesized
tcctgatctgtgtagatggtac

SEQ ID NO: 649196 - DNA, 22 bp, Artificial Sequence
  chemically synthesized
ctgatctgtgtagatggtactt

SEQ ID NO: 649197 - DNA, 22 bp, Artificial Sequence
  chemically synthesized
atgagactttgaaagtaccatc

SEQ ID NO: 649198 - DNA, 22 bp, Artificial Sequence
  chemically synthesized
gatgagactttgaaagtaccat

SEQ ID NO: 649199 - DNA, 22 bp, Artificial Sequence
  chemically synthesized
atctgtgtagatggtactttca

SEQ ID NO: 649200 - DNA, 22 bp, Artificial Sequence
  chemically synthesized
ttgatgagactttgaaagtacc

SEQ ID NO: 649201 - DNA, 22 bp, Artificial Sequence
  chemically synthesized
cttgatgagactttgaaagtac

SEQ ID NO: 649202 - DNA, 22 bp, Artificial Sequence
  chemically synthesized
tcttgatgagactttgaaagta

SEQ ID NO: 649203 - DNA, 22 bp, Artificial Sequence
  chemically synthesized
ttcttgatgagactttgaaagt

SEQ ID NO: 649204 - DNA, 22 bp, Artificial Sequence
  chemically synthesized
tgtagatggtactttcaaagtc

SEQ ID NO: 649205 - DNA, 22 bp, Artificial Sequence
  chemically synthesized
ttttcttgatgagactttgaaa

SEQ ID NO: 649206 - DNA, 22 bp, Artificial Sequence
  chemically synthesized
cttttcttgatgagactttgaa

SEQ ID NO: 649207 - DNA, 22 bp, Artificial Sequence
  chemically synthesized
tcttttcttgatgagactttga

SEQ ID NO: 649208 - DNA, 22 bp, Artificial Sequence
  chemically synthesized
ttcttttcttgatgagactttg

SEQ ID NO: 649209 - DNA, 22 bp, Artificial Sequence
  chemically synthesized
tttcttttcttgatgagacttt

SEQ ID NO: 649210 - DNA, 22 bp, Artificial Sequence
  chemically synthesized
ttttcttttcttgatgagactt

SEQ ID NO: 649211 - DNA, 22 bp, Artificial Sequence
  chemically synthesized
tttttcttttcttgatgagact

SEQ ID NO: 649212 - DNA, 22 bp, Artificial Sequence
  chemically synthesized
ttttttcttttcttgatgagac

SEQ ID NO: 649213 - DNA, 22 bp, Artificial Sequence
  chemically synthesized
tttttttcttttcttgatgaga

SEQ ID NO: 649214 - DNA, 22 bp, Artificial Sequence
  chemically synthesized
ttttttttcttttcttgatgag

SEQ ID NO: 649215 - DNA, 22 bp, Artificial Sequence
  chemically synthesized
tcaaagtctcatcaagaaaaga

SEQ ID NO: 649216 - DNA, 22 bp, Artificial Sequence
  chemically synthesized
agtttttttttttcttttcttg

SEQ ID NO: 649217 - DNA, 22 bp, Artificial Sequence
  chemically synthesized
caaagtctcatcaagaaaagaa

SEQ ID NO: 649218 - DNA, 22 bp, Artificial Sequence
  chemically synthesized
cagtttttttttttcttttctt

SEQ ID NO: 649219 - DNA, 22 bp, Artificial Sequence
  chemically synthesized
aaagtctcatcaagaaaagaaa

SEQ ID NO: 649220 - DNA, 22 bp, Artificial Sequence
  chemically synthesized
atttcagtttttttttttcttt

SEQ ID NO: 649221 - DNA, 22 bp, Artificial Sequence
  chemically synthesized
catttcagtttttttttttctt

SEQ ID NO: 649222 - DNA, 22 bp, Artificial Sequence
  chemically synthesized
cttcatttcagttttttttttt

SEQ ID NO: 649223 - DNA, 22 bp, Artificial Sequence
  chemically synthesized
atcaagaaaagaaaaaaaaaaa

SEQ ID NO: 649224 - DNA, 22 bp, Artificial Sequence
  chemically synthesized
ccttcatttcagtttttttttt

SEQ ID NO: 649225 - DNA, 22 bp, Artificial Sequence
  chemically synthesized
cccttccttcatttcagttttt

SEQ ID NO: 649226 - DNA, 22 bp, Artificial Sequence
  chemically synthesized
attccccttccttcatttcagt

SEQ ID NO: 649227 - DNA, 22 bp, Artificial Sequence
  chemically synthesized
tggacatattaattccccttcc

SEQ ID NO: 649228 - DNA, 22 bp, Artificial Sequence
  chemically synthesized
atggacatattaattccccttc

SEQ ID NO: 649229 - DNA, 22 bp, Artificial Sequence
  chemically synthesized
tatggacatattaattcccctt

SEQ ID NO: 649230 - DNA, 22 bp, Artificial Sequence
  chemically synthesized
aaatgaaggaaggggaattaat

SEQ ID NO: 649231 - DNA, 22 bp, Artificial Sequence
  chemically synthesized
ttttatggacatattaattccc

SEQ ID NO: 649232 - DNA, 22 bp, Artificial Sequence
  chemically synthesized
gttttatggacatattaattcc

SEQ ID NO: 649233 - DNA, 22 bp, Artificial Sequence
  chemically synthesized
tgttttatggacatattaattc

SEQ ID NO: 649234 - DNA, 22 bp, Artificial Sequence
  chemically synthesized
ttttgttttatggacatattaa

SEQ ID NO: 649235 - DNA, 22 bp, Artificial Sequence
  chemically synthesized
gttttgttttatggacatatta

SEQ ID NO: 649236 - DNA, 22 bp, Artificial Sequence
  chemically synthesized
tgttttgttttatggacatatt

SEQ ID NO: 649237 - DNA, 22 bp, Artificial Sequence
  chemically synthesized
ttttgttttgttttatggacat

SEQ ID NO: 649238 - DNA, 22 bp, Artificial Sequence
  chemically synthesized
gttttgttttgttttatggaca

SEQ ID NO: 649239 - DNA, 22 bp, Artificial Sequence
  chemically synthesized
tgttttgttttgttttatggac

SEQ ID NO: 649240 - DNA, 22 bp, Artificial Sequence
  chemically synthesized
ttgttttgttttgttttatgga

SEQ ID NO: 649241 - DNA, 22 bp, Artificial Sequence
  chemically synthesized
ttttgttttgttttgttttatg

SEQ ID NO: 649242 - DNA, 22 bp, Artificial Sequence
  chemically synthesized
cttttgttttgttttgttttat

SEQ ID NO: 649243 - DNA, 22 bp, Artificial Sequence
  chemically synthesized
tcttttgttttgttttgtttta

SEQ ID NO: 649244 - DNA, 22 bp, Artificial Sequence
  chemically synthesized
atatgtccataaaacaaaacaa

SEQ ID NO: 649245 - DNA, 22 bp, Artificial Sequence
  chemically synthesized
ttttcttttgttttgttttgtt

SEQ ID NO: 649246 - DNA, 22 bp, Artificial Sequence
  chemically synthesized
gttttcttttgttttgttttgt

SEQ ID NO: 649247 - DNA, 22 bp, Artificial Sequence
  chemically synthesized
tttgttttcttttgttttgttt

SEQ ID NO: 649248 - DNA, 22 bp, Artificial Sequence
  chemically synthesized
gtttgttttcttttgttttgtt

SEQ ID NO: 649249 - DNA, 22 bp, Artificial Sequence
  chemically synthesized
tttgtttgttttcttttgtttt

SEQ ID NO: 649250 - DNA, 22 bp, Artificial Sequence
  chemically synthesized
atttgtttgttttcttttgttt

SEQ ID NO: 649251 - DNA, 22 bp, Artificial Sequence
  chemically synthesized
tttatttgtttgttttcttttg

SEQ ID NO: 649252 - DNA, 22 bp, Artificial Sequence
  chemically synthesized
tgtttatttgtttgttttcttt

SEQ ID NO: 649253 - DNA, 22 bp, Artificial Sequence
  chemically synthesized
ttctgtttatttgtttgttttc

SEQ ID NO: 649254 - DNA, 22 bp, Artificial Sequence
  chemically synthesized
gttctgtttatttgtttgtttt

SEQ ID NO: 649255 - DNA, 22 bp, Artificial Sequence
  chemically synthesized
tgttctgtttatttgtttgttt

SEQ ID NO: 649256 - DNA, 22 bp, Artificial Sequence
  chemically synthesized
ttgttctgtttatttgtttgtt

SEQ ID NO: 649257 - DNA, 22 bp, Artificial Sequence
  chemically synthesized
ttttgttctgtttatttgtttg

SEQ ID NO: 649258 - DNA, 22 bp, Artificial Sequence
  chemically synthesized
tcttttgttctgtttatttgtt

SEQ ID NO: 649259 - DNA, 22 bp, Artificial Sequence
  chemically synthesized
gttctcttttgttctgtttatt

SEQ ID NO: 649260 - DNA, 22 bp, Artificial Sequence
  chemically synthesized
ggttctcttttgttctgtttat

SEQ ID NO: 649261 - DNA, 22 bp, Artificial Sequence
  chemically synthesized
gcttggttctcttttgttctgt

SEQ ID NO: 649262 - DNA, 22 bp, Artificial Sequence
  chemically synthesized
gctcgcttggttctcttttgtt

SEQ ID NO: 649263 - DNA, 22 bp, Artificial Sequence
  chemically synthesized
ccaccaacacattcgctcgctt

SEQ ID NO: 649264 - DNA, 22 bp, Artificial Sequence
  chemically synthesized
ctaccaccaacacattcgctcg

SEQ ID NO: 649265 - DNA, 22 bp, Artificial Sequence
  chemically synthesized
aagggtgctgctaccaccaaca

SEQ ID NO: 649266 - DNA, 22 bp, Artificial Sequence
  chemically synthesized
ctgaagggtgctgctaccacca

SEQ ID NO: 649267 - DNA, 22 bp, Artificial Sequence
  chemically synthesized
gctgaagggtgctgctaccacc

SEQ ID NO: 649268 - DNA, 22 bp, Artificial Sequence
  chemically synthesized
tgctgaagggtgctgctaccac

SEQ ID NO: 649269 - DNA, 22 bp, Artificial Sequence
  chemically synthesized
ttgctgaagggtgctgctacca

SEQ ID NO: 649270 - DNA, 22 bp, Artificial Sequence
  chemically synthesized
tttgctgaagggtgctgctacc

SEQ ID NO: 649271 - DNA, 22 bp, Artificial Sequence
  chemically synthesized
ttttgctgaagggtgctgctac

SEQ ID NO: 649272 - DNA, 22 bp, Artificial Sequence
  chemically synthesized
tttttgctgaagggtgctgcta

SEQ ID NO: 649273 - DNA, 22 bp, Artificial Sequence
  chemically synthesized
gtggtagcagcacccttcagca

SEQ ID NO: 649274 - DNA, 22 bp, Artificial Sequence
  chemically synthesized
cgtgagtactttttttgctgaa

SEQ ID NO: 649275 - DNA, 22 bp, Artificial Sequence
  chemically synthesized
tgcgtgagtactttttttgctg

SEQ ID NO: 649276 - DNA, 22 bp, Artificial Sequence
  chemically synthesized
cagcaaaaaaagtactcacgca

SEQ ID NO: 649277 - DNA, 22 bp, Artificial Sequence
  chemically synthesized
gccagtagattctgcgtgagta

SEQ ID NO: 649278 - DNA, 22 bp, Artificial Sequence
  chemically synthesized
agcaaaaaaagtactcacgcag

SEQ ID NO: 649279 - DNA, 22 bp, Artificial Sequence
  chemically synthesized
tggccagtagattctgcgtgag

SEQ ID NO: 649280 - DNA, 22 bp, Artificial Sequence
  chemically synthesized
ctggccagtagattctgcgtga

SEQ ID NO: 649281 - DNA, 22 bp, Artificial Sequence
  chemically synthesized
atcaacttctggccagtagatt

SEQ ID NO: 649282 - DNA, 22 bp, Artificial Sequence
  chemically synthesized
tgatcaacttctggccagtaga

SEQ ID NO: 649283 - DNA, 22 bp, Artificial Sequence
  chemically synthesized
ctctgatcaacttctggccagt

SEQ ID NO: 649284 - DNA, 22 bp, Artificial Sequence
  chemically synthesized
acgcagaatctactggccagaa

SEQ ID NO: 649285 - DNA, 22 bp, Artificial Sequence
  chemically synthesized
cagtcccgttactctgatcaac

SEQ ID NO: 649286 - DNA, 22 bp, Artificial Sequence
  chemically synthesized
gcagtcccgttactctgatcaa

SEQ ID NO: 649287 - DNA, 22 bp, Artificial Sequence
  chemically synthesized
ctggccagaagttgatcagagt

SEQ ID NO: 649288 - DNA, 22 bp, Artificial Sequence
  chemically synthesized
tgcagtcccgttactctgatca

SEQ ID NO: 649289 - DNA, 22 bp, Artificial Sequence
  chemically synthesized
gccagaagttgatcagagtaac

SEQ ID NO: 649290 - DNA, 22 bp, Artificial Sequence
  chemically synthesized
ttttgcagtcccgttactctga

SEQ ID NO: 649291 - DNA, 22 bp, Artificial Sequence
  chemically synthesized
gttttgcagtcccgttactctg

SEQ ID NO: 649292 - DNA, 22 bp, Artificial Sequence
  chemically synthesized
tgttttgcagtcccgttactct

SEQ ID NO: 649293 - DNA, 22 bp, Artificial Sequence
  chemically synthesized
ttgttttgcagtcccgttactc

SEQ ID NO: 649294 - DNA, 22 bp, Artificial Sequence
  chemically synthesized
tttgttttgcagtcccgttact

SEQ ID NO: 649295 - DNA, 22 bp, Artificial Sequence
  chemically synthesized
attttttgttttgcagtcccgt

SEQ ID NO: 649296 - DNA, 22 bp, Artificial Sequence
  chemically synthesized
atcagagtaacgggactgcaaa

SEQ ID NO: 649297 - DNA, 22 bp, Artificial Sequence
  chemically synthesized
accacctcattttttgttttgc

SEQ ID NO: 649298 - DNA, 22 bp, Artificial Sequence
  chemically synthesized
caccacctcattttttgttttg

SEQ ID NO: 649299 - DNA, 22 bp, Artificial Sequence
  chemically synthesized
cttcaccacctcattttttgtt

SEQ ID NO: 649300 - DNA, 22 bp, Artificial Sequence
  chemically synthesized
caaaacaaaaaatgaggtggtg

SEQ ID NO: 649301 - DNA, 22 bp, Artificial Sequence
  chemically synthesized
cgtgtgtctccttcaccacctc

SEQ ID NO: 649302 - DNA, 22 bp, Artificial Sequence
  chemically synthesized
gcgtgtgtctccttcaccacct

SEQ ID NO: 649303 - DNA, 22 bp, Artificial Sequence
  chemically synthesized
agtttgcgtgtgtctccttcac

SEQ ID NO: 649304 - DNA, 22 bp, Artificial Sequence
  chemically synthesized
cggctgagtttgcgtgtgtctc

SEQ ID NO: 649305 - DNA, 22 bp, Artificial Sequence
  chemically synthesized
gcggctgagtttgcgtgtgtct

SEQ ID NO: 649306 - DNA, 22 bp, Artificial Sequence
  chemically synthesized
tgcggctgagtttgcgtgtgtc

SEQ ID NO: 649307 - DNA, 22 bp, Artificial Sequence
  chemically synthesized
ttgcggctgagtttgcgtgtgt

SEQ ID NO: 649308 - DNA, 22 bp, Artificial Sequence
  chemically synthesized
tttgcggctgagtttgcgtgtg

SEQ ID NO: 649309 - DNA, 22 bp, Artificial Sequence
  chemically synthesized
ttttgcggctgagtttgcgtgt

SEQ ID NO: 649310 - DNA, 22 bp, Artificial Sequence
  chemically synthesized
agtaaatttttttgcggctgag

SEQ ID NO: 649311 - DNA, 22 bp, Artificial Sequence
  chemically synthesized
cagtaaatttttttgcggctga

SEQ ID NO: 649312 - DNA, 22 bp, Artificial Sequence
  chemically synthesized
tcagtaaatttttttgcggctg

SEQ ID NO: 649313 - DNA, 22 bp, Artificial Sequence
  chemically synthesized
acctttcagtaaatttttttgc

SEQ ID NO: 649314 - DNA, 22 bp, Artificial Sequence
  chemically synthesized
gacctttcagtaaatttttttg

SEQ ID NO: 649315 - DNA, 22 bp, Artificial Sequence
  chemically synthesized
tgacctttcagtaaattttttt

SEQ ID NO: 649316 - DNA, 22 bp, Artificial Sequence
  chemically synthesized
ttttgacctttcagtaaatttt

SEQ ID NO: 649317 - DNA, 22 bp, Artificial Sequence
  chemically synthesized
attttgacctttcagtaaattt

SEQ ID NO: 649318 - DNA, 22 bp, Artificial Sequence
  chemically synthesized
agccgcaaaaaaatttactgaa

SEQ ID NO: 649319 - DNA, 22 bp, Artificial Sequence
  chemically synthesized
tttattttgacctttcagtaaa

SEQ ID NO: 649320 - DNA, 22 bp, Artificial Sequence
  chemically synthesized
atttattttgacctttcagtaa

SEQ ID NO: 649321 - DNA, 22 bp, Artificial Sequence
  chemically synthesized
tatttattttgacctttcagta

SEQ ID NO: 649322 - DNA, 22 bp, Artificial Sequence
  chemically synthesized
gattttatttattttgaccttt

SEQ ID NO: 649323 - DNA, 22 bp, Artificial Sequence
  chemically synthesized
gctggattttatttattttgac

SEQ ID NO: 649324 - DNA, 22 bp, Artificial Sequence
  chemically synthesized
actgaaaggtcaaaataaataa

SEQ ID NO: 649325 - DNA, 22 bp, Artificial Sequence
  chemically synthesized
attggctggattttatttattt

SEQ ID NO: 649326 - DNA, 22 bp, Artificial Sequence
  chemically synthesized
ctgaaaggtcaaaataaataaa

SEQ ID NO: 649327 - DNA, 22 bp, Artificial Sequence
  chemically synthesized
aattggctggattttatttatt

SEQ ID NO: 649328 - DNA, 22 bp, Artificial Sequence
  chemically synthesized
aaaggtcaaaataaataaaatc

SEQ ID NO: 649329 - DNA, 22 bp, Artificial Sequence
  chemically synthesized
atacttaattggctggatttta

SEQ ID NO: 649330 - DNA, 22 bp, Artificial Sequence
  chemically synthesized
catggttcatacttaattggct

SEQ ID NO: 649331 - DNA, 22 bp, Artificial Sequence
  chemically synthesized
ccatggttcatacttaattggc

SEQ ID NO: 649332 - DNA, 22 bp, Artificial Sequence
  chemically synthesized
tccatggttcatacttaattgg

SEQ ID NO: 649333 - DNA, 22 bp, Artificial Sequence
  chemically synthesized
ctttccatggttcatacttaat

SEQ ID NO: 649334 - DNA, 22 bp, Artificial Sequence
  chemically synthesized
ttgctttccatggttcatactt

SEQ ID NO: 649335 - DNA, 22 bp, Artificial Sequence
  chemically synthesized
gctattgctttccatggttcat

SEQ ID NO: 649336 - DNA, 22 bp, Artificial Sequence
  chemically synthesized
ggctattgctttccatggttca

SEQ ID NO: 649337 - DNA, 22 bp, Artificial Sequence
  chemically synthesized
gtttggctattgctttccatgg

SEQ ID NO: 649338 - DNA, 22 bp, Artificial Sequence
  chemically synthesized
ggtttggctattgctttccatg

SEQ ID NO: 649339 - DNA, 22 bp, Artificial Sequence
  chemically synthesized
agtatgaaccatggaaagcaat

SEQ ID NO: 649340 - DNA, 22 bp, Artificial Sequence
  chemically synthesized
caccttggtttggctattgctt

SEQ ID NO: 649341 - DNA, 22 bp, Artificial Sequence
  chemically synthesized
acaccttggtttggctattgct

SEQ ID NO: 649342 - DNA, 22 bp, Artificial Sequence
  chemically synthesized
tacaccttggtttggctattgc

SEQ ID NO: 649343 - DNA, 22 bp, Artificial Sequence
  chemically synthesized
actttacaccttggtttggcta

SEQ ID NO: 649344 - DNA, 22 bp, Artificial Sequence
  chemically synthesized
attcactttacaccttggtttg

SEQ ID NO: 649345 - DNA, 22 bp, Artificial Sequence
  chemically synthesized
aattcactttacaccttggttt

SEQ ID NO: 649346 - DNA, 22 bp, Artificial Sequence
  chemically synthesized
taattcactttacaccttggtt

SEQ ID NO: 649347 - DNA, 22 bp, Artificial Sequence
  chemically synthesized
ttaattcactttacaccttggt

SEQ ID NO: 649348 - DNA, 22 bp, Artificial Sequence
  chemically synthesized
ttttaattcactttacaccttg

SEQ ID NO: 649349 - DNA, 22 bp, Artificial Sequence
  chemically synthesized
cttttaattcactttacacctt

SEQ ID NO: 649350 - DNA, 22 bp, Artificial Sequence
  chemically synthesized
tcttttaattcactttacacct

SEQ ID NO: 649351 - DNA, 22 bp, Artificial Sequence
  chemically synthesized
ttcttttaattcactttacacc

SEQ ID NO: 649352 - DNA, 22 bp, Artificial Sequence
  chemically synthesized
tgtgtttttcttttaattcact

SEQ ID NO: 649353 - DNA, 22 bp, Artificial Sequence
  chemically synthesized
atggcagtcacacaactgtgtg

SEQ ID NO: 649354 - DNA, 22 bp, Artificial Sequence
  chemically synthesized
tgatggcagtcacacaactgtg

SEQ ID NO: 649355 - DNA, 22 bp, Artificial Sequence
  chemically synthesized
aaagaaaaacacacagttgtgt

SEQ ID NO: 649356 - DNA, 22 bp, Artificial Sequence
  chemically synthesized
actctgatggcagtcacacaac

SEQ ID NO: 649357 - DNA, 22 bp, Artificial Sequence
  chemically synthesized
aactctgatggcagtcacacaa

SEQ ID NO: 649358 - DNA, 22 bp, Artificial Sequence
  chemically synthesized
ccttaactctgatggcagtcac

SEQ ID NO: 649359 - DNA, 22 bp, Artificial Sequence
  chemically synthesized
gccttaactctgatggcagtca

SEQ ID NO: 649360 - DNA, 22 bp, Artificial Sequence
  chemically synthesized
tgccttaactctgatggcagtc

SEQ ID NO: 649361 - DNA, 22 bp, Artificial Sequence
  chemically synthesized
ttgccttaactctgatggcagt

SEQ ID NO: 649362 - DNA, 22 bp, Artificial Sequence
  chemically synthesized
tttgccttaactctgatggcag

SEQ ID NO: 649363 - DNA, 22 bp, Artificial Sequence
  chemically synthesized
ttttgccttaactctgatggca

SEQ ID NO: 649364 - DNA, 22 bp, Artificial Sequence
  chemically synthesized
ttttttgccttaactctgatgg

SEQ ID NO: 649365 - DNA, 22 bp, Artificial Sequence
  chemically synthesized
ctcttttttgccttaactctga

SEQ ID NO: 649366 - DNA, 22 bp, Artificial Sequence
  chemically synthesized
tgtgactgccatcagagttaag

SEQ ID NO: 649367 - DNA, 22 bp, Artificial Sequence
  chemically synthesized
ctcctcttttttgccttaactc

SEQ ID NO: 649368 - DNA, 22 bp, Artificial Sequence
  chemically synthesized
ccatcagagttaaggcaaaaaa

SEQ ID NO: 649369 - DNA, 22 bp, Artificial Sequence
  chemically synthesized
aacctgctcctcttttttgcct

SEQ ID NO: 649370 - DNA, 22 bp, Artificial Sequence
  chemically synthesized
caacctgctcctcttttttgcc

SEQ ID NO: 649371 - DNA, 22 bp, Artificial Sequence
  chemically synthesized
tcaacctgctcctcttttttgc

SEQ ID NO: 649372 - DNA, 22 bp, Artificial Sequence
  chemically synthesized
ttcaacctgctcctcttttttg

SEQ ID NO: 649373 - DNA, 22 bp, Artificial Sequence
  chemically synthesized
ttttcaacctgctcctcttttt

SEQ ID NO: 649374 - DNA, 22 bp, Artificial Sequence
  chemically synthesized
acctcttttcaacctgctcctc

SEQ ID NO: 649375 - DNA, 22 bp, Artificial Sequence
  chemically synthesized
cacctcttttcaacctgctcct

SEQ ID NO: 649376 - DNA, 22 bp, Artificial Sequence
  chemically synthesized
aggcaaaaaagaggagcaggtt

SEQ ID NO: 649377 - DNA, 22 bp, Artificial Sequence
  chemically synthesized
aagatcaaaggggacgtcttca

SEQ ID NO: 649378 - DNA, 22 bp, Artificial Sequence
  chemically synthesized
tcaagatcaaaggggacgtctt

SEQ ID NO: 649379 - DNA, 22 bp, Artificial Sequence
  chemically synthesized
aaaagaggtgaagacgtcccct

SEQ ID NO: 649380 - DNA, 22 bp, Artificial Sequence
  chemically synthesized
acagtaagtagtaatgattctc

SEQ ID NO: 649381 - DNA, 22 bp, Artificial Sequence
  chemically synthesized
cacagtaagtagtaatgattct

SEQ ID NO: 649382 - DNA, 22 bp, Artificial Sequence
  chemically synthesized
cttcacagtaagtagtaatgat

SEQ ID NO: 649383 - DNA, 22 bp, Artificial Sequence
  chemically synthesized
tgatcttgagaatcattactac

SEQ ID NO: 649384 - DNA, 22 bp, Artificial Sequence
  chemically synthesized
gatcttgagaatcattactact

SEQ ID NO: 649385 - DNA, 22 bp, Artificial Sequence
  chemically synthesized
atcttgagaatcattactactt

SEQ ID NO: 649386 - DNA, 22 bp, Artificial Sequence
  chemically synthesized
gagaatcattactacttactgt

SEQ ID NO: 649387 - DNA, 22 bp, Artificial Sequence
  chemically synthesized
agaatcattactacttactgtg

SEQ ID NO: 649388 - DNA, 22 bp, Artificial Sequence
  chemically synthesized
ctacttactgtgaagtagtttc

SEQ ID NO: 649389 - DNA, 22 bp, Artificial Sequence
  chemically synthesized
cttactgtgaagtagtttcctg

SEQ ID NO: 649390 - DNA, 22 bp, Artificial Sequence
  chemically synthesized
actgtgaagtagtttcctgtga

SEQ ID NO: 649391 - DNA, 22 bp, Artificial Sequence
  chemically synthesized
ctgtgaagtagtttcctgtgac

SEQ ID NO: 649392 - DNA, 22 bp, Artificial Sequence
  chemically synthesized
aaaagaaaatatagtcacagga

SEQ ID NO: 649393 - DNA, 22 bp, Artificial Sequence
  chemically synthesized
tgaagtagtttcctgtgactat

SEQ ID NO: 649394 - DNA, 22 bp, Artificial Sequence
  chemically synthesized
ctcaaaagaaaatatagtcaca

SEQ ID NO: 649395 - DNA, 22 bp, Artificial Sequence
  chemically synthesized
tactcaaaagaaaatatagtca

SEQ ID NO: 649396 - DNA, 22 bp, Artificial Sequence
  chemically synthesized
ctactcaaaagaaaatatagtc

SEQ ID NO: 649397 - DNA, 22 bp, Artificial Sequence
  chemically synthesized
tttctactcaaaagaaaatata

SEQ ID NO: 649398 - DNA, 22 bp, Artificial Sequence
  chemically synthesized
gtttctactcaaaagaaaatat

SEQ ID NO: 649399 - DNA, 22 bp, Artificial Sequence
  chemically synthesized
cctgtgactatattttcttttg

SEQ ID NO: 649400 - DNA, 22 bp, Artificial Sequence
  chemically synthesized
ctgtgactatattttcttttga

SEQ ID NO: 649401 - DNA, 22 bp, Artificial Sequence
  chemically synthesized
tgactatattttcttttgagta

SEQ ID NO: 649402 - DNA, 22 bp, Artificial Sequence
  chemically synthesized
gtcacttgtttctactcaaaag

SEQ ID NO: 649403 - DNA, 22 bp, Artificial Sequence
  chemically synthesized
tattttcttttgagtagaaaca

SEQ ID NO: 649404 - DNA, 22 bp, Artificial Sequence
  chemically synthesized
tcttttgagtagaaacaagtga

SEQ ID NO: 649405 - DNA, 22 bp, Artificial Sequence
  chemically synthesized
cttttgagtagaaacaagtgac

SEQ ID NO: 649406 - DNA, 22 bp, Artificial Sequence
  chemically synthesized
ttttgagtagaaacaagtgact

SEQ ID NO: 649407 - DNA, 22 bp, Artificial Sequence
  chemically synthesized
tgtggtcatatctagtcacttg

SEQ ID NO: 649408 - DNA, 22 bp, Artificial Sequence
  chemically synthesized
ttgagtagaaacaagtgactag

SEQ ID NO: 649409 - DNA, 22 bp, Artificial Sequence
  chemically synthesized
tgagtagaaacaagtgactaga

SEQ ID NO: 649410 - DNA, 22 bp, Artificial Sequence
  chemically synthesized
gagtagaaacaagtgactagat

SEQ ID NO: 649411 - DNA, 22 bp, Artificial Sequence
  chemically synthesized
agtagaaacaagtgactagata

SEQ ID NO: 649412 - DNA, 22 bp, Artificial Sequence
  chemically synthesized
attgtgtggtcatatctagtca

SEQ ID NO: 649413 - DNA, 22 bp, Artificial Sequence
  chemically synthesized
tatctcattgtgtggtcatatc

SEQ ID NO: 649414 - DNA, 22 bp, Artificial Sequence
  chemically synthesized
gtatctcattgtgtggtcatat

SEQ ID NO: 649415 - DNA, 22 bp, Artificial Sequence
  chemically synthesized
tgtatctcattgtgtggtcata

SEQ ID NO: 649416 - DNA, 22 bp, Artificial Sequence
  chemically synthesized
ttgtatctcattgtgtggtcat

SEQ ID NO: 649417 - DNA, 22 bp, Artificial Sequence
  chemically synthesized
tttgtatctcattgtgtggtca

SEQ ID NO: 649418 - DNA, 22 bp, Artificial Sequence
  chemically synthesized
gatatgaccacacaatgagata

SEQ ID NO: 649419 - DNA, 22 bp, Artificial Sequence
  chemically synthesized
acaaatcagtaaatgtgtgtct

SEQ ID NO: 649420 - DNA, 22 bp, Artificial Sequence
  chemically synthesized
tcacaaatcagtaaatgtgtgt

SEQ ID NO: 649421 - DNA, 22 bp, Artificial Sequence
  chemically synthesized
tctcacaaatcagtaaatgtgt

SEQ ID NO: 649422 - DNA, 22 bp, Artificial Sequence
  chemically synthesized
ctctctcacaaatcagtaaatg

SEQ ID NO: 649423 - DNA, 22 bp, Artificial Sequence
  chemically synthesized
cctctctcacaaatcagtaaat

SEQ ID NO: 649424 - DNA, 22 bp, Artificial Sequence
  chemically synthesized
tcctctctcacaaatcagtaaa

SEQ ID NO: 649425 - DNA, 22 bp, Artificial Sequence
  chemically synthesized
attttcctctctcacaaatcag

SEQ ID NO: 649426 - DNA, 22 bp, Artificial Sequence
  chemically synthesized
gattttcctctctcacaaatca

SEQ ID NO: 649427 - DNA, 22 bp, Artificial Sequence
  chemically synthesized
tgattttcctctctcacaaatc

SEQ ID NO: 649428 - DNA, 22 bp, Artificial Sequence
  chemically synthesized
attttgattttcctctctcaca

SEQ ID NO: 649429 - DNA, 22 bp, Artificial Sequence
  chemically synthesized
cattttgattttcctctctcac

SEQ ID NO: 649430 - DNA, 22 bp, Artificial Sequence
  chemically synthesized
actgatttgtgagagaggaaaa

SEQ ID NO: 649431 - DNA, 22 bp, Artificial Sequence
  chemically synthesized
ctgatttgtgagagaggaaaat

SEQ ID NO: 649432 - DNA, 22 bp, Artificial Sequence
  chemically synthesized
atttgtgagagaggaaaatcaa

SEQ ID NO: 649433 - DNA, 22 bp, Artificial Sequence
  chemically synthesized
cagtatttcattttgattttcc

SEQ ID NO: 649434 - DNA, 22 bp, Artificial Sequence
  chemically synthesized
gtgagagaggaaaatcaaaatg

SEQ ID NO: 649435 - DNA, 22 bp, Artificial Sequence
  chemically synthesized
tgagagaggaaaatcaaaatga

SEQ ID NO: 649436 - DNA, 22 bp, Artificial Sequence
  chemically synthesized
caaatgagtgattccagtattt

SEQ ID NO: 649437 - DNA, 22 bp, Artificial Sequence
  chemically synthesized
acaaatgagtgattccagtatt

SEQ ID NO: 649438 - DNA, 22 bp, Artificial Sequence
  chemically synthesized
tttacaaatgagtgattccagt

SEQ ID NO: 649439 - DNA, 22 bp, Artificial Sequence
  chemically synthesized
gaatcactcatttgtaaacagt

SEQ ID NO: 649440 - DNA, 22 bp, Artificial Sequence
  chemically synthesized
taagaaatatgggactgtttac

SEQ ID NO: 649441 - DNA, 22 bp, Artificial Sequence
  chemically synthesized
ataagaaatatgggactgttta

SEQ ID NO: 649442 - DNA, 22 bp, Artificial Sequence
  chemically synthesized
atttgtaaacagtcccatattt

SEQ ID NO: 649443 - DNA, 22 bp, Artificial Sequence
  chemically synthesized
caagccttataagaaatatggg

SEQ ID NO: 649444 - DNA, 22 bp, Artificial Sequence
  chemically synthesized
acaagccttataagaaatatgg

SEQ ID NO: 649445 - DNA, 22 bp, Artificial Sequence
  chemically synthesized
gtaaacagtcccatatttctta

SEQ ID NO: 649446 - DNA, 22 bp, Artificial Sequence
  chemically synthesized
taaacagtcccatatttcttat

SEQ ID NO: 649447 - DNA, 22 bp, Artificial Sequence
  chemically synthesized
ccttacaagccttataagaaat

SEQ ID NO: 649448 - DNA, 22 bp, Artificial Sequence
  chemically synthesized
attgccttacaagccttataag

SEQ ID NO: 649449 - DNA, 22 bp, Artificial Sequence
  chemically synthesized
cttataaggcttgtaaggcaat

SEQ ID NO: 649450 - DNA, 22 bp, Artificial Sequence
  chemically synthesized
ttataaggcttgtaaggcaatt

SEQ ID NO: 649451 - DNA, 22 bp, Artificial Sequence
  chemically synthesized
ataaggcttgtaaggcaattag

SEQ ID NO: 649452 - DNA, 22 bp, Artificial Sequence
  chemically synthesized
taaggcttgtaaggcaattagt

SEQ ID NO: 649453 - DNA, 22 bp, Artificial Sequence
  chemically synthesized
gtaaggcaattagtggctgtat

SEQ ID NO: 649454 - DNA, 22 bp, Artificial Sequence
  chemically synthesized
taaggcaattagtggctgtatt

SEQ ID NO: 649455 - DNA, 22 bp, Artificial Sequence
  chemically synthesized
gtggctgtattgtgttgtggtt

SEQ ID NO: 649456 - DNA, 22 bp, Artificial Sequence
  chemically synthesized
tattgtgttgtggttttttttt

SEQ ID NO: 649457 - DNA, 22 bp, Artificial Sequence
  chemically synthesized
acagggggaaaaaaaaaaaaaa

SEQ ID NO: 649458 - DNA, 22 bp, Artificial Sequence
  chemically synthesized
tgttgtggtttttttttttttt

SEQ ID NO: 649459 - DNA, 22 bp, Artificial Sequence
  chemically synthesized
tctcacagggggaaaaaaaaaa

SEQ ID NO: 649460 - DNA, 22 bp, Artificial Sequence
  chemically synthesized
atctcacagggggaaaaaaaaa

SEQ ID NO: 649461 - DNA, 22 bp, Artificial Sequence
  chemically synthesized
tatctcacagggggaaaaaaaa

SEQ ID NO: 649462 - DNA, 22 bp, Artificial Sequence
  chemically synthesized
tggtttttttttttttttcccc

SEQ ID NO: 649463 - DNA, 22 bp, Artificial Sequence
  chemically synthesized
aactttatctcacagggggaaa

SEQ ID NO: 649464 - DNA, 22 bp, Artificial Sequence
  chemically synthesized
ttttttttttttccccctgtga

SEQ ID NO: 649465 - DNA, 22 bp, Artificial Sequence
  chemically synthesized
tttttttttttccccctgtgag

SEQ ID NO: 649466 - DNA, 22 bp, Artificial Sequence
  chemically synthesized
ttttttttttccccctgtgaga

SEQ ID NO: 649467 - DNA, 22 bp, Artificial Sequence
  chemically synthesized
tttttttttccccctgtgagat

SEQ ID NO: 649468 - DNA, 22 bp, Artificial Sequence
  chemically synthesized
ttttttttccccctgtgagata

SEQ ID NO: 649469 - DNA, 22 bp, Artificial Sequence
  chemically synthesized
tttttttccccctgtgagataa

SEQ ID NO: 649470 - DNA, 22 bp, Artificial Sequence
  chemically synthesized
ttttttccccctgtgagataaa

SEQ ID NO: 649471 - DNA, 22 bp, Artificial Sequence
  chemically synthesized
caaaagttaaactttatctcac

SEQ ID NO: 649472 - DNA, 22 bp, Artificial Sequence
  chemically synthesized
tttttccccctgtgagataaag

SEQ ID NO: 649473 - DNA, 22 bp, Artificial Sequence
  chemically synthesized
ccaaaagttaaactttatctca

SEQ ID NO: 649474 - DNA, 22 bp, Artificial Sequence
  chemically synthesized
ttttccccctgtgagataaagt

SEQ ID NO: 649475 - DNA, 22 bp, Artificial Sequence
  chemically synthesized
tccaaaagttaaactttatctc

SEQ ID NO: 649476 - DNA, 22 bp, Artificial Sequence
  chemically synthesized
tttccccctgtgagataaagtt

SEQ ID NO: 649477 - DNA, 22 bp, Artificial Sequence
  chemically synthesized
ttccaaaagttaaactttatct

SEQ ID NO: 649478 - DNA, 22 bp, Artificial Sequence
  chemically synthesized
ttccccctgtgagataaagttt

SEQ ID NO: 649479 - DNA, 22 bp, Artificial Sequence
  chemically synthesized
tttccaaaagttaaactttatc

SEQ ID NO: 649480 - DNA, 22 bp, Artificial Sequence
  chemically synthesized
tccccctgtgagataaagttta

SEQ ID NO: 649481 - DNA, 22 bp, Artificial Sequence
  chemically synthesized
ccccctgtgagataaagtttaa

SEQ ID NO: 649482 - DNA, 22 bp, Artificial Sequence
  chemically synthesized
tttttccaaaagttaaacttta

SEQ ID NO: 649483 - DNA, 22 bp, Artificial Sequence
  chemically synthesized
cccctgtgagataaagtttaac

SEQ ID NO: 649484 - DNA, 22 bp, Artificial Sequence
  chemically synthesized
ctttttccaaaagttaaacttt

SEQ ID NO: 649485 - DNA, 22 bp, Artificial Sequence
  chemically synthesized
tgagataaagtttaacttttgg

SEQ ID NO: 649486 - DNA, 22 bp, Artificial Sequence
  chemically synthesized
acaatttctttttccaaaagtt

SEQ ID NO: 649487 - DNA, 22 bp, Artificial Sequence
  chemically synthesized
gacaatttctttttccaaaagt

SEQ ID NO: 649488 - DNA, 22 bp, Artificial Sequence
  chemically synthesized
aacttttggaaaaagaaattgt

SEQ ID NO: 649489 - DNA, 22 bp, Artificial Sequence
  chemically synthesized
ccacgtcacttgacaatttctt

SEQ ID NO: 649490 - DNA, 22 bp, Artificial Sequence
  chemically synthesized
acttttggaaaaagaaattgtc

SEQ ID NO: 649491 - DNA, 22 bp, Artificial Sequence
  chemically synthesized
cccacgtcacttgacaatttct

SEQ ID NO: 649492 - DNA, 22 bp, Artificial Sequence
  chemically synthesized
tcccacgtcacttgacaatttc

SEQ ID NO: 649493 - DNA, 22 bp, Artificial Sequence
  chemically synthesized
ttggaaaaagaaattgtcaagt

SEQ ID NO: 649494 - DNA, 22 bp, Artificial Sequence
  chemically synthesized
tggaaaaagaaattgtcaagtg

SEQ ID NO: 649495 - DNA, 22 bp, Artificial Sequence
  chemically synthesized
ggaaaaagaaattgtcaagtga

SEQ ID NO: 649496 - DNA, 22 bp, Artificial Sequence
  chemically synthesized
gaaaaagaaattgtcaagtgac

SEQ ID NO: 649497 - DNA, 22 bp, Artificial Sequence
  chemically synthesized
ccactttcccacgtcacttgac

SEQ ID NO: 649498 - DNA, 22 bp, Artificial Sequence
  chemically synthesized
atgtccagttgccactttccca

SEQ ID NO: 649499 - DNA, 22 bp, Artificial Sequence
  chemically synthesized
tcaagtgacgtgggaaagtggc

SEQ ID NO: 649500 - DNA, 22 bp, Artificial Sequence
  chemically synthesized
aaaagagaaaaataagctgatg

SEQ ID NO: 649501 - DNA, 22 bp, Artificial Sequence
  chemically synthesized
gctgaaaagagaaaaataagct

SEQ ID NO: 649502 - DNA, 22 bp, Artificial Sequence
  chemically synthesized
cattagctgaaaagagaaaaat

SEQ ID NO: 649503 - DNA, 22 bp, Artificial Sequence
  chemically synthesized
gacatcagcttatttttctctt

SEQ ID NO: 649504 - DNA, 22 bp, Artificial Sequence
  chemically synthesized
acattagctgaaaagagaaaaa

SEQ ID NO: 649505 - DNA, 22 bp, Artificial Sequence
  chemically synthesized
tttacattagctgaaaagagaa

SEQ ID NO: 649506 - DNA, 22 bp, Artificial Sequence
  chemically synthesized
atttacattagctgaaaagaga

SEQ ID NO: 649507 - DNA, 22 bp, Artificial Sequence
  chemically synthesized
tatttacattagctgaaaagag

SEQ ID NO: 649508 - DNA, 22 bp, Artificial Sequence
  chemically synthesized
ttatttacattagctgaaaaga

SEQ ID NO: 649509 - DNA, 22 bp, Artificial Sequence
  chemically synthesized
tttatttacattagctgaaaag

SEQ ID NO: 649510 - DNA, 22 bp, Artificial Sequence
  chemically synthesized
tttttatttacattagctgaaa

SEQ ID NO: 649511 - DNA, 22 bp, Artificial Sequence
  chemically synthesized
ctttttatttacattagctgaa

SEQ ID NO: 649512 - DNA, 22 bp, Artificial Sequence
  chemically synthesized
atttttctcttttcagctaatg

SEQ ID NO: 649513 - DNA, 22 bp, Artificial Sequence
  chemically synthesized
tctttttatttacattagctga

SEQ ID NO: 649514 - DNA, 22 bp, Artificial Sequence
  chemically synthesized
tttttctcttttcagctaatgt

SEQ ID NO: 649515 - DNA, 22 bp, Artificial Sequence
  chemically synthesized
tttctttttatttacattagct

SEQ ID NO: 649516 - DNA, 22 bp, Artificial Sequence
  chemically synthesized
ctttctttttatttacattagc

SEQ ID NO: 649517 - DNA, 22 bp, Artificial Sequence
  chemically synthesized
ttctcttttcagctaatgtaaa

SEQ ID NO: 649518 - DNA, 22 bp, Artificial Sequence
  chemically synthesized
tctcttttcagctaatgtaaat

SEQ ID NO: 649519 - DNA, 22 bp, Artificial Sequence
  chemically synthesized
ctcttttcagctaatgtaaata

SEQ ID NO: 649520 - DNA, 22 bp, Artificial Sequence
  chemically synthesized
tttctttctttttatttacatt

SEQ ID NO: 649521 - DNA, 22 bp, Artificial Sequence
  chemically synthesized
tcttttcagctaatgtaaataa

SEQ ID NO: 649522 - DNA, 22 bp, Artificial Sequence
  chemically synthesized
tatttctttctttttatttaca

SEQ ID NO: 649523 - DNA, 22 bp, Artificial Sequence
  chemically synthesized
ttttcagctaatgtaaataaaa

SEQ ID NO: 649524 - DNA, 22 bp, Artificial Sequence
  chemically synthesized
ctatttctttctttttatttac

SEQ ID NO: 649525 - DNA, 22 bp, Artificial Sequence
  chemically synthesized
ttcagctaatgtaaataaaaag

SEQ ID NO: 649526 - DNA, 22 bp, Artificial Sequence
  chemically synthesized
ttctatttctttctttttattt

SEQ ID NO: 649527 - DNA, 22 bp, Artificial Sequence
  chemically synthesized
tcagctaatgtaaataaaaaga

SEQ ID NO: 649528 - DNA, 22 bp, Artificial Sequence
  chemically synthesized
cagctaatgtaaataaaaagaa

SEQ ID NO: 649529 - DNA, 22 bp, Artificial Sequence
  chemically synthesized
agctaatgtaaataaaaagaaa

SEQ ID NO: 649530 - DNA, 22 bp, Artificial Sequence
  chemically synthesized
atgtaaataaaaagaaagaaat

SEQ ID NO: 649531 - DNA, 22 bp, Artificial Sequence
  chemically synthesized
ccaaatgcaaacagtctcttct

SEQ ID NO: 649532 - DNA, 22 bp, Artificial Sequence
  chemically synthesized
actcccaaatgcaaacagtctc

SEQ ID NO: 649533 - DNA, 22 bp, Artificial Sequence
  chemically synthesized
cactcccaaatgcaaacagtct

SEQ ID NO: 649534 - DNA, 22 bp, Artificial Sequence
  chemically synthesized
cttcactcccaaatgcaaacag

SEQ ID NO: 649535 - DNA, 22 bp, Artificial Sequence
  chemically synthesized
aacaccctccttcactcccaaa

SEQ ID NO: 649536 - DNA, 22 bp, Artificial Sequence
  chemically synthesized
agctgaacaccctccttcactc

SEQ ID NO: 649537 - DNA, 22 bp, Artificial Sequence
  chemically synthesized
tttgcatttgggagtgaaggag

SEQ ID NO: 649538 - DNA, 22 bp, Artificial Sequence
  chemically synthesized
tcagctgaacaccctccttcac

SEQ ID NO: 649539 - DNA, 22 bp, Artificial Sequence
  chemically synthesized
gcatttgggagtgaaggagggt

SEQ ID NO: 649540 - DNA, 22 bp, Artificial Sequence
  chemically synthesized
catttgggagtgaaggagggtg

SEQ ID NO: 649541 - DNA, 22 bp, Artificial Sequence
  chemically synthesized
ctctcagctgaacaccctcctt

SEQ ID NO: 649542 - DNA, 22 bp, Artificial Sequence
  chemically synthesized
gggagtgaaggagggtgttcag

SEQ ID NO: 649543 - DNA, 22 bp, Artificial Sequence
  chemically synthesized
aactcctctcagctgaacaccc

SEQ ID NO: 649544 - DNA, 22 bp, Artificial Sequence
  chemically synthesized
ggagtgaaggagggtgttcagc

SEQ ID NO: 649545 - DNA, 22 bp, Artificial Sequence
  chemically synthesized
gaactcctctcagctgaacacc

SEQ ID NO: 649546 - DNA, 22 bp, Artificial Sequence
  chemically synthesized
atgtatatttgaactcctctca

SEQ ID NO: 649547 - DNA, 22 bp, Artificial Sequence
  chemically synthesized
gatgtatatttgaactcctctc

SEQ ID NO: 649548 - DNA, 22 bp, Artificial Sequence
  chemically synthesized
tttgatgtatatttgaactcct

SEQ ID NO: 649549 - DNA, 22 bp, Artificial Sequence
  chemically synthesized
gtttgatgtatatttgaactcc

SEQ ID NO: 649550 - DNA, 22 bp, Artificial Sequence
  chemically synthesized
ttgtttgatgtatatttgaact

SEQ ID NO: 649551 - DNA, 22 bp, Artificial Sequence
  chemically synthesized
agctgagaggagttcaaatata

SEQ ID NO: 649552 - DNA, 22 bp, Artificial Sequence
  chemically synthesized
agaggagttcaaatatacatca

SEQ ID NO: 649553 - DNA, 22 bp, Artificial Sequence
  chemically synthesized
aaatatacatcaaacaagagtg

SEQ ID NO: 649554 - DNA, 22 bp, Artificial Sequence
  chemically synthesized
tgcttttgctactactcacgtt

SEQ ID NO: 649555 - DNA, 22 bp, Artificial Sequence
  chemically synthesized
cttttgctactactcacgtttc

SEQ ID NO: 649556 - DNA, 22 bp, Artificial Sequence
  chemically synthesized
ttgctactactcacgtttccat

SEQ ID NO: 649557 - DNA, 22 bp, Artificial Sequence
  chemically synthesized
gagggggacaacatggaaacgt

SEQ ID NO: 649558 - DNA, 22 bp, Artificial Sequence
  chemically synthesized
tgctactactcacgtttccatg

SEQ ID NO: 649559 - DNA, 22 bp, Artificial Sequence
  chemically synthesized
agagggggacaacatggaaacg

SEQ ID NO: 649560 - DNA, 22 bp, Artificial Sequence
  chemically synthesized
gctactactcacgtttccatgt

SEQ ID NO: 649561 - DNA, 22 bp, Artificial Sequence
  chemically synthesized
ctactactcacgtttccatgtt

SEQ ID NO: 649562 - DNA, 22 bp, Artificial Sequence
  chemically synthesized
tcttagagggggacaacatgga

SEQ ID NO: 649563 - DNA, 22 bp, Artificial Sequence
  chemically synthesized
ctactcacgtttccatgttgtc

SEQ ID NO: 649564 - DNA, 22 bp, Artificial Sequence
  chemically synthesized
ctcacgtttccatgttgtcccc

SEQ ID NO: 649565 - DNA, 22 bp, Artificial Sequence
  chemically synthesized
acgtttccatgttgtccccctc

SEQ ID NO: 649566 - DNA, 22 bp, Artificial Sequence
  chemically synthesized
ccatgttgtccccctctaagac

SEQ ID NO: 649567 - DNA, 22 bp, Artificial Sequence
  chemically synthesized
ccagtgcagactgtcttagagg

SEQ ID NO: 649568 - DNA, 22 bp, Artificial Sequence
  chemically synthesized
catgttgtccccctctaagaca

SEQ ID NO: 649569 - DNA, 22 bp, Artificial Sequence
  chemically synthesized
cctgccagtgcagactgtctta

SEQ ID NO: 649570 - DNA, 22 bp, Artificial Sequence
  chemically synthesized
tccccctctaagacagtctgca

SEQ ID NO: 649571 - DNA, 22 bp, Artificial Sequence
  chemically synthesized
taagacagtctgcactggcagg

SEQ ID NO: 649572 - DNA, 22 bp, Artificial Sequence
  chemically synthesized
agacagtctgcactggcaggta

SEQ ID NO: 649573 - DNA, 22 bp, Artificial Sequence
  chemically synthesized
cgaagcatccccgaatgggcta

SEQ ID NO: 649574 - DNA, 22 bp, Artificial Sequence
  chemically synthesized
gcgaagcatccccgaatgggct

SEQ ID NO: 649575 - DNA, 22 bp, Artificial Sequence
  chemically synthesized
cactggcaggtagcccattcgg

SEQ ID NO: 649576 - DNA, 22 bp, Artificial Sequence
  chemically synthesized
tgcgaagcatccccgaatgggc

SEQ ID NO: 649577 - DNA, 22 bp, Artificial Sequence
  chemically synthesized
gcaggtagcccattcggggatg

SEQ ID NO: 649578 - DNA, 22 bp, Artificial Sequence
  chemically synthesized
gaaccaaaaggtattttgcgaa

SEQ ID NO: 649579 - DNA, 22 bp, Artificial Sequence
  chemically synthesized
cgaaccaaaaggtattttgcga

SEQ ID NO: 649580 - DNA, 22 bp, Artificial Sequence
  chemically synthesized
ggggatgcttcgcaaaatacct

SEQ ID NO: 649581 - DNA, 22 bp, Artificial Sequence
  chemically synthesized
aaaaacaaatttcgaaccaaaa

SEQ ID NO: 649582 - DNA, 22 bp, Artificial Sequence
  chemically synthesized
cgcaaaataccttttggttcga

SEQ ID NO: 649583 - DNA, 22 bp, Artificial Sequence
  chemically synthesized
gcaaaataccttttggttcgaa

SEQ ID NO: 649584 - DNA, 22 bp, Artificial Sequence
  chemically synthesized
ccaaggtactaaaaaacaaatt

SEQ ID NO: 649585 - DNA, 22 bp, Artificial Sequence
  chemically synthesized
gccaaggtactaaaaaacaaat

SEQ ID NO: 649586 - DNA, 22 bp, Artificial Sequence
  chemically synthesized
tgccaaggtactaaaaaacaaa

SEQ ID NO: 649587 - DNA, 22 bp, Artificial Sequence
  chemically synthesized
ttggttcgaaatttgtttttta

SEQ ID NO: 649588 - DNA, 22 bp, Artificial Sequence
  chemically synthesized
tggttcgaaatttgttttttag

SEQ ID NO: 649589 - DNA, 22 bp, Artificial Sequence
  chemically synthesized
ggttcgaaatttgttttttagt

SEQ ID NO: 649590 - DNA, 22 bp, Artificial Sequence
  chemically synthesized
gttcgaaatttgttttttagta

SEQ ID NO: 649591 - DNA, 22 bp, Artificial Sequence
  chemically synthesized
gagactttgccaaggtactaaa

SEQ ID NO: 649592 - DNA, 22 bp, Artificial Sequence
  chemically synthesized
gaaatttgttttttagtacctt

SEQ ID NO: 649593 - DNA, 22 bp, Artificial Sequence
  chemically synthesized
gttttttagtaccttggcaaag

SEQ ID NO: 649594 - DNA, 22 bp, Artificial Sequence
  chemically synthesized
ttttttagtaccttggcaaagt

SEQ ID NO: 649595 - DNA, 22 bp, Artificial Sequence
  chemically synthesized
tttagtaccttggcaaagtctc

SEQ ID NO: 649596 - DNA, 22 bp, Artificial Sequence
  chemically synthesized
ttagtaccttggcaaagtctcg

SEQ ID NO: 649597 - DNA, 22 bp, Artificial Sequence
  chemically synthesized
tagtaccttggcaaagtctcga

SEQ ID NO: 649598 - DNA, 22 bp, Artificial Sequence
  chemically synthesized
agtaccttggcaaagtctcgaa

SEQ ID NO: 649599 - DNA, 22 bp, Artificial Sequence
  chemically synthesized
gtaccttggcaaagtctcgaac

SEQ ID NO: 649600 - DNA, 22 bp, Artificial Sequence
  chemically synthesized
catcaggagaagatgttcgaga

SEQ ID NO: 649601 - DNA, 22 bp, Artificial Sequence
  chemically synthesized
ggcaaagtctcgaacatcttct

SEQ ID NO: 649602 - DNA, 22 bp, Artificial Sequence
  chemically synthesized
gactacatcaggagaagatgtt

SEQ ID NO: 649603 - DNA, 22 bp, Artificial Sequence
  chemically synthesized
gcaaagtctcgaacatcttctc

SEQ ID NO: 649604 - DNA, 22 bp, Artificial Sequence
  chemically synthesized
agactacatcaggagaagatgt

SEQ ID NO: 649605 - DNA, 22 bp, Artificial Sequence
  chemically synthesized
tagactacatcaggagaagatg

SEQ ID NO: 649606 - DNA, 22 bp, Artificial Sequence
  chemically synthesized
ttagactacatcaggagaagat

SEQ ID NO: 649607 - DNA, 22 bp, Artificial Sequence
  chemically synthesized
ccttttagactacatcaggaga

SEQ ID NO: 649608 - DNA, 22 bp, Artificial Sequence
  chemically synthesized
gaacatcttctcctgatgtagt

SEQ ID NO: 649609 - DNA, 22 bp, Artificial Sequence
  chemically synthesized
accatgatctcccttttagact

SEQ ID NO: 649610 - DNA, 22 bp, Artificial Sequence
  chemically synthesized
ctcctgatgtagtctaaaaggg

SEQ ID NO: 649611 - DNA, 22 bp, Artificial Sequence
  chemically synthesized
tcctgatgtagtctaaaaggga

SEQ ID NO: 649612 - DNA, 22 bp, Artificial Sequence
  chemically synthesized
ctgatgtagtctaaaagggaga

SEQ ID NO: 649613 - DNA, 22 bp, Artificial Sequence
  chemically synthesized
atctcaccatgatctccctttt

SEQ ID NO: 649614 - DNA, 22 bp, Artificial Sequence
  chemically synthesized
atgtagtctaaaagggagatca

SEQ ID NO: 649615 - DNA, 22 bp, Artificial Sequence
  chemically synthesized
aatctgatctcaccatgatctc

SEQ ID NO: 649616 - DNA, 22 bp, Artificial Sequence
  chemically synthesized
tcctaaatctgatctcaccatg

SEQ ID NO: 649617 - DNA, 22 bp, Artificial Sequence
  chemically synthesized
aaagggagatcatggtgagatc

SEQ ID NO: 649618 - DNA, 22 bp, Artificial Sequence
  chemically synthesized
aaatcatcctgtcctaaatctg

SEQ ID NO: 649619 - DNA, 22 bp, Artificial Sequence
  chemically synthesized
gaaatcatcctgtcctaaatct

SEQ ID NO: 649620 - DNA, 22 bp, Artificial Sequence
  chemically synthesized
tgaaatcatcctgtcctaaatc

SEQ ID NO: 649621 - DNA, 22 bp, Artificial Sequence
  chemically synthesized
gttttgaaatcatcctgtccta

SEQ ID NO: 649622 - DNA, 22 bp, Artificial Sequence
  chemically synthesized
gagtggtcattagttttgaaat

SEQ ID NO: 649623 - DNA, 22 bp, Artificial Sequence
  chemically synthesized
aggacaggatgatttcaaaact

SEQ ID NO: 649624 - DNA, 22 bp, Artificial Sequence
  chemically synthesized
ggacaggatgatttcaaaacta

SEQ ID NO: 649625 - DNA, 22 bp, Artificial Sequence
  chemically synthesized
caaaactaatgaccactccagt

SEQ ID NO: 649626 - DNA, 22 bp, Artificial Sequence
  chemically synthesized
aaaactaatgaccactccagtc

SEQ ID NO: 649627 - DNA, 22 bp, Artificial Sequence
  chemically synthesized
atgaccactccagtcttctgcc

SEQ ID NO: 649628 - DNA, 22 bp, Artificial Sequence
  chemically synthesized
caaaacaagtgtcatggggcag

SEQ ID NO: 649629 - DNA, 22 bp, Artificial Sequence
  chemically synthesized
attacaaaacaagtgtcatggg

SEQ ID NO: 649630 - DNA, 22 bp, Artificial Sequence
  chemically synthesized
cagtcttctgccccatgacact

SEQ ID NO: 649631 - DNA, 22 bp, Artificial Sequence
  chemically synthesized
aattacaaaacaagtgtcatgg

SEQ ID NO: 649632 - DNA, 22 bp, Artificial Sequence
  chemically synthesized
cttaattacaaaacaagtgtca

SEQ ID NO: 649633 - DNA, 22 bp, Artificial Sequence
  chemically synthesized
tccttaattacaaaacaagtgt

SEQ ID NO: 649634 - DNA, 22 bp, Artificial Sequence
  chemically synthesized
ctgccccatgacacttgttttg

SEQ ID NO: 649635 - DNA, 22 bp, Artificial Sequence
  chemically synthesized
tgccccatgacacttgttttgt

SEQ ID NO: 649636 - DNA, 22 bp, Artificial Sequence
  chemically synthesized
ccccatgacacttgttttgtaa

SEQ ID NO: 649637 - DNA, 22 bp, Artificial Sequence
  chemically synthesized
acaaccacaacactctccttaa

SEQ ID NO: 649638 - DNA, 22 bp, Artificial Sequence
  chemically synthesized
gttttgtaattaaggagagtgt

SEQ ID NO: 649639 - DNA, 22 bp, Artificial Sequence
  chemically synthesized
ctcacaaccacaacactctcct

SEQ ID NO: 649640 - DNA, 22 bp, Artificial Sequence
  chemically synthesized
ttttgtaattaaggagagtgtt

SEQ ID NO: 649641 - DNA, 22 bp, Artificial Sequence
  chemically synthesized
gctcacaaccacaacactctcc

SEQ ID NO: 649642 - DNA, 22 bp, Artificial Sequence
  chemically synthesized
tgctcacaaccacaacactctc

SEQ ID NO: 649643 - DNA, 22 bp, Artificial Sequence
  chemically synthesized
tgtaattaaggagagtgttgtg

SEQ ID NO: 649644 - DNA, 22 bp, Artificial Sequence
  chemically synthesized
gtaattaaggagagtgttgtgg

SEQ ID NO: 649645 - DNA, 22 bp, Artificial Sequence
  chemically synthesized
taattaaggagagtgttgtggt

SEQ ID NO: 649646 - DNA, 22 bp, Artificial Sequence
  chemically synthesized
caaagcctttgctcacaaccac

SEQ ID NO: 649647 - DNA, 22 bp, Artificial Sequence
  chemically synthesized
aggagagtgttgtggttgtgag

SEQ ID NO: 649648 - DNA, 22 bp, Artificial Sequence
  chemically synthesized
attccaaagcctttgctcacaa

SEQ ID NO: 649649 - DNA, 22 bp, Artificial Sequence
  chemically synthesized
tctgattccaaagcctttgctc

SEQ ID NO: 649650 - DNA, 22 bp, Artificial Sequence
  chemically synthesized
gtctgattccaaagcctttgct

SEQ ID NO: 649651 - DNA, 22 bp, Artificial Sequence
  chemically synthesized
tggttgtgagcaaaggctttgg

SEQ ID NO: 649652 - DNA, 22 bp, Artificial Sequence
  chemically synthesized
tgagcaaaggctttggaatcag

SEQ ID NO: 649653 - DNA, 22 bp, Artificial Sequence
  chemically synthesized
agagccccatttgtctgattcc

SEQ ID NO: 649654 - DNA, 22 bp, Artificial Sequence
  chemically synthesized
cagagccccatttgtctgattc

SEQ ID NO: 649655 - DNA, 22 bp, Artificial Sequence
  chemically synthesized
gtttcagagccccatttgtctg

SEQ ID NO: 649656 - DNA, 22 bp, Artificial Sequence
  chemically synthesized
tggaatcagacaaatggggctc

SEQ ID NO: 649657 - DNA, 22 bp, Artificial Sequence
  chemically synthesized
ggaatcagacaaatggggctct

SEQ ID NO: 649658 - DNA, 22 bp, Artificial Sequence
  chemically synthesized
gaatcagacaaatggggctctg

SEQ ID NO: 649659 - DNA, 22 bp, Artificial Sequence
  chemically synthesized
gtacatgccaggcctggtttca

SEQ ID NO: 649660 - DNA, 22 bp, Artificial Sequence
  chemically synthesized
agccaaattagtacatgccagg

SEQ ID NO: 649661 - DNA, 22 bp, Artificial Sequence
  chemically synthesized
tgaaaccaggcctggcatgtac

SEQ ID NO: 649662 - DNA, 22 bp, Artificial Sequence
  chemically synthesized
aaaccaggcctggcatgtacta

SEQ ID NO: 649663 - DNA, 22 bp, Artificial Sequence
  chemically synthesized
agaagtaaataactcagccaaa

SEQ ID NO: 649664 - DNA, 22 bp, Artificial Sequence
  chemically synthesized
gcatgtactaatttggctgagt

SEQ ID NO: 649665 - DNA, 22 bp, Artificial Sequence
  chemically synthesized
tgagaagtaaataactcagcca

SEQ ID NO: 649666 - DNA, 22 bp, Artificial Sequence
  chemically synthesized
atttggctgagttatttacttc

SEQ ID NO: 649667 - DNA, 22 bp, Artificial Sequence
  chemically synthesized
ggctgagttatttacttctcag

SEQ ID NO: 649668 - DNA, 22 bp, Artificial Sequence
  chemically synthesized
gctgagttatttacttctcaga

SEQ ID NO: 649669 - DNA, 22 bp, Artificial Sequence
  chemically synthesized
atgatcagagcctctgagaagt

SEQ ID NO: 649670 - DNA, 22 bp, Artificial Sequence
  chemically synthesized
ctgatgatcagagcctctgaga

SEQ ID NO: 649671 - DNA, 22 bp, Artificial Sequence
  chemically synthesized
agttatttacttctcagaggct

SEQ ID NO: 649672 - DNA, 22 bp, Artificial Sequence
  chemically synthesized
actgatgatcagagcctctgag

SEQ ID NO: 649673 - DNA, 22 bp, Artificial Sequence
  chemically synthesized
tactgatgatcagagcctctga

SEQ ID NO: 649674 - DNA, 22 bp, Artificial Sequence
  chemically synthesized
tttacttctcagaggctctgat

SEQ ID NO: 649675 - DNA, 22 bp, Artificial Sequence
  chemically synthesized
ccattttactgatgatcagagc

SEQ ID NO: 649676 - DNA, 22 bp, Artificial Sequence
  chemically synthesized
acttctcagaggctctgatcat

SEQ ID NO: 649677 - DNA, 22 bp, Artificial Sequence
  chemically synthesized
cttctcagaggctctgatcatc

SEQ ID NO: 649678 - DNA, 22 bp, Artificial Sequence
  chemically synthesized
ctcccattttactgatgatcag

SEQ ID NO: 649679 - DNA, 22 bp, Artificial Sequence
  chemically synthesized
ctcagaggctctgatcatcagt

SEQ ID NO: 649680 - DNA, 22 bp, Artificial Sequence
  chemically synthesized
tcagaggctctgatcatcagta

SEQ ID NO: 649681 - DNA, 22 bp, Artificial Sequence
  chemically synthesized
ttgctcccattttactgatgat

SEQ ID NO: 649682 - DNA, 22 bp, Artificial Sequence
  chemically synthesized
agaggctctgatcatcagtaaa

SEQ ID NO: 649683 - DNA, 22 bp, Artificial Sequence
  chemically synthesized
aggtgttgttgctcccatttta

SEQ ID NO: 649684 - DNA, 22 bp, Artificial Sequence
  chemically synthesized
tgatcatcagtaaaatgggagc

SEQ ID NO: 649685 - DNA, 22 bp, Artificial Sequence
  chemically synthesized
atcatcagtaaaatgggagcaa

SEQ ID NO: 649686 - DNA, 22 bp, Artificial Sequence
  chemically synthesized
tcataacaacgtgttgaggtgt

SEQ ID NO: 649687 - DNA, 22 bp, Artificial Sequence
  chemically synthesized
atcataacaacgtgttgaggtg

SEQ ID NO: 649688 - DNA, 22 bp, Artificial Sequence
  chemically synthesized
tttatcataacaacgtgttgag

SEQ ID NO: 649689 - DNA, 22 bp, Artificial Sequence
  chemically synthesized
atttatcataacaacgtgttga

SEQ ID NO: 649690 - DNA, 22 bp, Artificial Sequence
  chemically synthesized
tatttatcataacaacgtgttg

SEQ ID NO: 649691 - DNA, 22 bp, Artificial Sequence
  chemically synthesized
ttatttatcataacaacgtgtt

SEQ ID NO: 649692 - DNA, 22 bp, Artificial Sequence
  chemically synthesized
ttttatttatcataacaacgtg

SEQ ID NO: 649693 - DNA, 22 bp, Artificial Sequence
  chemically synthesized
cttttatttatcataacaacgt

SEQ ID NO: 649694 - DNA, 22 bp, Artificial Sequence
  chemically synthesized
tatgtttcttttatttatcata

SEQ ID NO: 649695 - DNA, 22 bp, Artificial Sequence
  chemically synthesized
gtatgtttcttttatttatcat

SEQ ID NO: 649696 - DNA, 22 bp, Artificial Sequence
  chemically synthesized
aacacgttgttatgataaataa

SEQ ID NO: 649697 - DNA, 22 bp, Artificial Sequence
  chemically synthesized
gtaagcttgtatgtttctttta

SEQ ID NO: 649698 - DNA, 22 bp, Artificial Sequence
  chemically synthesized
ttatgataaataaaagaaacat

SEQ ID NO: 649699 - DNA, 22 bp, Artificial Sequence
  chemically synthesized
tgataaataaaagaaacataca

SEQ ID NO: 649700 - DNA, 22 bp, Artificial Sequence
  chemically synthesized
agtagcctagtaagcttgtatg

SEQ ID NO: 649701 - DNA, 22 bp, Artificial Sequence
  chemically synthesized
ttgagtagcctagtaagcttgt

SEQ ID NO: 649702 - DNA, 22 bp, Artificial Sequence
  chemically synthesized
attgagtagcctagtaagcttg

SEQ ID NO: 649703 - DNA, 22 bp, Artificial Sequence
  chemically synthesized
ccatttattgagtagcctagta

SEQ ID NO: 649704 - DNA, 22 bp, Artificial Sequence
  chemically synthesized
taaactaccatttattgagtag

SEQ ID NO: 649705 - DNA, 22 bp, Artificial Sequence
  chemically synthesized
actaggctactcaataaatggt

SEQ ID NO: 649706 - DNA, 22 bp, Artificial Sequence
  chemically synthesized
ctaggctactcaataaatggta

SEQ ID NO: 649707 - DNA, 22 bp, Artificial Sequence
  chemically synthesized
agacctataaactaccatttat

SEQ ID NO: 649708 - DNA, 22 bp, Artificial Sequence
  chemically synthesized
aagacctataaactaccattta

SEQ ID NO: 649709 - DNA, 22 bp, Artificial Sequence
  chemically synthesized
ggctactcaataaatggtagtt

SEQ ID NO: 649710 - DNA, 22 bp, Artificial Sequence
  chemically synthesized
accttaagacctataaactacc

SEQ ID NO: 649711 - DNA, 22 bp, Artificial Sequence
  chemically synthesized
gaccttaagacctataaactac

SEQ ID NO: 649712 - DNA, 22 bp, Artificial Sequence
  chemically synthesized
ctcaataaatggtagtttatag

SEQ ID NO: 649713 - DNA, 22 bp, Artificial Sequence
  chemically synthesized
tgaccttaagacctataaacta

SEQ ID NO: 649714 - DNA, 22 bp, Artificial Sequence
  chemically synthesized
ttgaccttaagacctataaact

SEQ ID NO: 649715 - DNA, 22 bp, Artificial Sequence
  chemically synthesized
tttgaccttaagacctataaac

SEQ ID NO: 649716 - DNA, 22 bp, Artificial Sequence
  chemically synthesized
aataaatggtagtttataggtc

SEQ ID NO: 649717 - DNA, 22 bp, Artificial Sequence
  chemically synthesized
atgtcacctttttgaccttaag

SEQ ID NO: 649718 - DNA, 22 bp, Artificial Sequence
  chemically synthesized
aatgtcacctttttgaccttaa

SEQ ID NO: 649719 - DNA, 22 bp, Artificial Sequence
  chemically synthesized
ataggtcttaaggtcaaaaagg

SEQ ID NO: 649720 - DNA, 22 bp, Artificial Sequence
  chemically synthesized
taggtcttaaggtcaaaaaggt

SEQ ID NO: 649721 - DNA, 22 bp, Artificial Sequence
  chemically synthesized
aaggtcaaaaaggtgacattaa

SEQ ID NO: 649722 - DNA, 22 bp, Artificial Sequence
  chemically synthesized
aggtcaaaaaggtgacattaaa

SEQ ID NO: 649723 - DNA, 22 bp, Artificial Sequence
  chemically synthesized
aaataccataaagtgtggtaaa

SEQ ID NO: 649724 - DNA, 22 bp, Artificial Sequence
  chemically synthesized
aaaataccataaagtgtggtaa

SEQ ID NO: 649725 - DNA, 22 bp, Artificial Sequence
  chemically synthesized
taaaataccataaagtgtggta

SEQ ID NO: 649726 - DNA, 22 bp, Artificial Sequence
  chemically synthesized
ttaaaataccataaagtgtggt

SEQ ID NO: 649727 - DNA, 22 bp, Artificial Sequence
  chemically synthesized
aattttaccacactttatggta

SEQ ID NO: 649728 - DNA, 22 bp, Artificial Sequence
  chemically synthesized
agtagtttttaaaataccataa

SEQ ID NO: 649729 - DNA, 22 bp, Artificial Sequence
  chemically synthesized
taccacactttatggtatttta

SEQ ID NO: 649730 - DNA, 22 bp, Artificial Sequence
  chemically synthesized
accacactttatggtattttaa

SEQ ID NO: 649731 - DNA, 22 bp, Artificial Sequence
  chemically synthesized
ccacactttatggtattttaaa

SEQ ID NO: 649732 - DNA, 22 bp, Artificial Sequence
  chemically synthesized
tactaagtagtttttaaaatac

SEQ ID NO: 649733 - DNA, 22 bp, Artificial Sequence
  chemically synthesized
gtactaagtagtttttaaaata

SEQ ID NO: 649734 - DNA, 22 bp, Artificial Sequence
  chemically synthesized
tgtactaagtagtttttaaaat

SEQ ID NO: 649735 - DNA, 22 bp, Artificial Sequence
  chemically synthesized
tatggtattttaaaaactactt

SEQ ID NO: 649736 - DNA, 22 bp, Artificial Sequence
  chemically synthesized
tcattttgtactaagtagtttt

SEQ ID NO: 649737 - DNA, 22 bp, Artificial Sequence
  chemically synthesized
atggtattttaaaaactactta

SEQ ID NO: 649738 - DNA, 22 bp, Artificial Sequence
  chemically synthesized
tggtattttaaaaactacttag

SEQ ID NO: 649739 - DNA, 22 bp, Artificial Sequence
  chemically synthesized
taaaaactacttagtacaaaat

SEQ ID NO: 649740 - DNA, 22 bp, Artificial Sequence
  chemically synthesized
aaaaactacttagtacaaaatg

SEQ ID NO: 649741 - DNA, 22 bp, Artificial Sequence
  chemically synthesized
aaaactacttagtacaaaatga

SEQ ID NO: 649742 - DNA, 22 bp, Artificial Sequence
  chemically synthesized
gtgggtgaagcatgctatcatt

SEQ ID NO: 649743 - DNA, 22 bp, Artificial Sequence
  chemically synthesized
agtgggtgaagcatgctatcat

SEQ ID NO: 649744 - DNA, 22 bp, Artificial Sequence
  chemically synthesized
cttagtacaaaatgatagcatg

SEQ ID NO: 649745 - DNA, 22 bp, Artificial Sequence
  chemically synthesized
agtacaaaatgatagcatgctt

SEQ ID NO: 649746 - DNA, 22 bp, Artificial Sequence
  chemically synthesized
gtacaaaatgatagcatgcttc

SEQ ID NO: 649747 - DNA, 22 bp, Artificial Sequence
  chemically synthesized
tgaatagaccgaaatttagtgg

SEQ ID NO: 649748 - DNA, 22 bp, Artificial Sequence
  chemically synthesized
cacccactaaatttcggtctat

SEQ ID NO: 649749 - DNA, 22 bp, Artificial Sequence
  chemically synthesized
acccactaaatttcggtctatt

SEQ ID NO: 649750 - DNA, 22 bp, Artificial Sequence
  chemically synthesized
agaatgtaccatgctatgaata

SEQ ID NO: 649751 - DNA, 22 bp, Artificial Sequence
  chemically synthesized
aatttcggtctattcatagcat

SEQ ID NO: 649752 - DNA, 22 bp, Artificial Sequence
  chemically synthesized
cggtctattcatagcatggtac

SEQ ID NO: 649753 - DNA, 22 bp, Artificial Sequence
  chemically synthesized
ggtctattcatagcatggtaca

SEQ ID NO: 649754 - DNA, 22 bp, Artificial Sequence
  chemically synthesized
ttcatagcatggtacattctca

SEQ ID NO: 649755 - DNA, 22 bp, Artificial Sequence
  chemically synthesized
atagcatggtacattctcaatc

SEQ ID NO: 649756 - DNA, 22 bp, Artificial Sequence
  chemically synthesized
tagagatggtcagtgattgaga

SEQ ID NO: 649757 - DNA, 22 bp, Artificial Sequence
  chemically synthesized
atagagatggtcagtgattgag

SEQ ID NO: 649758 - DNA, 22 bp, Artificial Sequence
  chemically synthesized
ttatagagatggtcagtgattg

SEQ ID NO: 649759 - DNA, 22 bp, Artificial Sequence
  chemically synthesized
ctcttatagagatggtcagtga

SEQ ID NO: 649760 - DNA, 22 bp, Artificial Sequence
  chemically synthesized
ttcctcttatagagatggtcag

SEQ ID NO: 649761 - DNA, 22 bp, Artificial Sequence
  chemically synthesized
attcctcttatagagatggtca

SEQ ID NO: 649762 - DNA, 22 bp, Artificial Sequence
  chemically synthesized
tattcctcttatagagatggtc

SEQ ID NO: 649763 - DNA, 22 bp, Artificial Sequence
  chemically synthesized
ttattcctcttatagagatggt

SEQ ID NO: 649764 - DNA, 22 bp, Artificial Sequence
  chemically synthesized
tcaatcactgaccatctctata

SEQ ID NO: 649765 - DNA, 22 bp, Artificial Sequence
  chemically synthesized
aatcactgaccatctctataag

SEQ ID NO: 649766 - DNA, 22 bp, Artificial Sequence
  chemically synthesized
acttttattcctcttatagaga

SEQ ID NO: 649767 - DNA, 22 bp, Artificial Sequence
  chemically synthesized
tctcacttttattcctcttata

SEQ ID NO: 649768 - DNA, 22 bp, Artificial Sequence
  chemically synthesized
accatctctataagaggaataa

SEQ ID NO: 649769 - DNA, 22 bp, Artificial Sequence
  chemically synthesized
cctgtctcacttttattcctct

SEQ ID NO: 649770 - DNA, 22 bp, Artificial Sequence
  chemically synthesized
gcctgtctcacttttattcctc

SEQ ID NO: 649771 - DNA, 22 bp, Artificial Sequence
  chemically synthesized
tataagaggaataaaagtgaga

SEQ ID NO: 649772 - DNA, 22 bp, Artificial Sequence
  chemically synthesized
taagaggaataaaagtgagaca

SEQ ID NO: 649773 - DNA, 22 bp, Artificial Sequence
  chemically synthesized
ccagatatttgcctgtctcact

SEQ ID NO: 649774 - DNA, 22 bp, Artificial Sequence
  chemically synthesized
catcatcagagtgatcctccca

SEQ ID NO: 649775 - DNA, 22 bp, Artificial Sequence
  chemically synthesized
ccatcatcagagtgatcctccc

SEQ ID NO: 649776 - DNA, 22 bp, Artificial Sequence
  chemically synthesized
ttccatcatcagagtgatcctc

SEQ ID NO: 649777 - DNA, 22 bp, Artificial Sequence
  chemically synthesized
tcttccatcatcagagtgatcc

SEQ ID NO: 649778 - DNA, 22 bp, Artificial Sequence
  chemically synthesized
tctcttccatcatcagagtgat

SEQ ID NO: 649779 - DNA, 22 bp, Artificial Sequence
  chemically synthesized
ggaggatcactctgatgatgga

SEQ ID NO: 649780 - DNA, 22 bp, Artificial Sequence
  chemically synthesized
gagcatctctctcttccatcat

SEQ ID NO: 649781 - DNA, 22 bp, Artificial Sequence
  chemically synthesized
agagcatctctctcttccatca

SEQ ID NO: 649782 - DNA, 22 bp, Artificial Sequence
  chemically synthesized
tagagcatctctctcttccatc

SEQ ID NO: 649783 - DNA, 22 bp, Artificial Sequence
  chemically synthesized
ctttagagcatctctctcttcc

SEQ ID NO: 649784 - DNA, 22 bp, Artificial Sequence
  chemically synthesized
tgctttagagcatctctctctt

SEQ ID NO: 649785 - DNA, 22 bp, Artificial Sequence
  chemically synthesized
tgatgatggaagagagagatgc

SEQ ID NO: 649786 - DNA, 22 bp, Artificial Sequence
  chemically synthesized
atgatggaagagagagatgctc

SEQ ID NO: 649787 - DNA, 22 bp, Artificial Sequence
  chemically synthesized
taaagcagagcttctcatactt

SEQ ID NO: 649788 - DNA, 22 bp, Artificial Sequence
  chemically synthesized
ccatacacaacaaagtatgaga

SEQ ID NO: 649789 - DNA, 22 bp, Artificial Sequence
  chemically synthesized
aagcagagcttctcatactttg

SEQ ID NO: 649790 - DNA, 22 bp, Artificial Sequence
  chemically synthesized
gttcccatacacaacaaagtat

SEQ ID NO: 649791 - DNA, 22 bp, Artificial Sequence
  chemically synthesized
cagctggttcccatacacaaca

SEQ ID NO: 649792 - DNA, 22 bp, Artificial Sequence
  chemically synthesized
ctcatactttgttgtgtatggg

SEQ ID NO: 649793 - DNA, 22 bp, Artificial Sequence
  chemically synthesized
tcatactttgttgtgtatggga

SEQ ID NO: 649794 - DNA, 22 bp, Artificial Sequence
  chemically synthesized
atactttgttgtgtatgggaac

SEQ ID NO: 649795 - DNA, 22 bp, Artificial Sequence
  chemically synthesized
gcgagatctgcagctggttccc

SEQ ID NO: 649796 - DNA, 22 bp, Artificial Sequence
  chemically synthesized
agcgagatctgcagctggttcc

SEQ ID NO: 649797 - DNA, 22 bp, Artificial Sequence
  chemically synthesized
tgttgtgtatgggaaccagctg

SEQ ID NO: 649798 - DNA, 22 bp, Artificial Sequence
  chemically synthesized
tagcgagatctgcagctggttc

SEQ ID NO: 649799 - DNA, 22 bp, Artificial Sequence
  chemically synthesized
gttgtgtatgggaaccagctgc

SEQ ID NO: 649800 - DNA, 22 bp, Artificial Sequence
  chemically synthesized
ttgtgtatgggaaccagctgca

SEQ ID NO: 649801 - DNA, 22 bp, Artificial Sequence
  chemically synthesized
tgtatgggaaccagctgcagat

SEQ ID NO: 649802 - DNA, 22 bp, Artificial Sequence
  chemically synthesized
aatcaaaacccacattttagcg

SEQ ID NO: 649803 - DNA, 22 bp, Artificial Sequence
  chemically synthesized
taaatcaaaacccacattttag

SEQ ID NO: 649804 - DNA, 22 bp, Artificial Sequence
  chemically synthesized
cagatctcgctaaaatgtgggt

SEQ ID NO: 649805 - DNA, 22 bp, Artificial Sequence
  chemically synthesized
atgctctaaatcaaaacccaca

SEQ ID NO: 649806 - DNA, 22 bp, Artificial Sequence
  chemically synthesized
ctgatgctctaaatcaaaaccc

SEQ ID NO: 649807 - DNA, 22 bp, Artificial Sequence
  chemically synthesized
gctaaaatgtgggttttgattt

SEQ ID NO: 649808 - DNA, 22 bp, Artificial Sequence
  chemically synthesized
aaatgtgggttttgatttagag

SEQ ID NO: 649809 - DNA, 22 bp, Artificial Sequence
  chemically synthesized
tgatttagagcatcaggagttg

SEQ ID NO: 649810 - DNA, 22 bp, Artificial Sequence
  chemically synthesized
gatttagagcatcaggagttgg

SEQ ID NO: 649811 - DNA, 22 bp, Artificial Sequence
  chemically synthesized
atttagagcatcaggagttggg

SEQ ID NO: 649812 - DNA, 22 bp, Artificial Sequence
  chemically synthesized
agagcatcaggagttggggcct

SEQ ID NO: 649813 - DNA, 22 bp, Artificial Sequence
  chemically synthesized
gagcatcaggagttggggcctg

SEQ ID NO: 649814 - DNA, 22 bp, Artificial Sequence
  chemically synthesized
gaaatgtgaaaccacaggcccc

SEQ ID NO: 649815 - DNA, 22 bp, Artificial Sequence
  chemically synthesized
ttagaaatgtgaaaccacaggc

SEQ ID NO: 649816 - DNA, 22 bp, Artificial Sequence
  chemically synthesized
attagaaatgtgaaaccacagg

SEQ ID NO: 649817 - DNA, 22 bp, Artificial Sequence
  chemically synthesized
tattagaaatgtgaaaccacag

SEQ ID NO: 649818 - DNA, 22 bp, Artificial Sequence
  chemically synthesized
gtctttattagaaatgtgaaac

SEQ ID NO: 649819 - DNA, 22 bp, Artificial Sequence
  chemically synthesized
ggtctttattagaaatgtgaaa

SEQ ID NO: 649820 - DNA, 22 bp, Artificial Sequence
  chemically synthesized
gggcctgtggtttcacatttct

SEQ ID NO: 649821 - DNA, 22 bp, Artificial Sequence
  chemically synthesized
ccttggtctttattagaaatgt

SEQ ID NO: 649822 - DNA, 22 bp, Artificial Sequence
  chemically synthesized
tggtttcacatttctaataaag

SEQ ID NO: 649823 - DNA, 22 bp, Artificial Sequence
  chemically synthesized
gcattaccttggtctttattag

SEQ ID NO: 649824 - DNA, 22 bp, Artificial Sequence
  chemically synthesized
ttggcattaccttggtctttat

SEQ ID NO: 649825 - DNA, 22 bp, Artificial Sequence
  chemically synthesized
cacatttctaataaagaccaag

SEQ ID NO: 649826 - DNA, 22 bp, Artificial Sequence
  chemically synthesized
acatttctaataaagaccaagg

SEQ ID NO: 649827 - DNA, 22 bp, Artificial Sequence
  chemically synthesized
ctaataaagaccaaggtaatgc

SEQ ID NO: 649828 - DNA, 22 bp, Artificial Sequence
  chemically synthesized
taataaagaccaaggtaatgcc

SEQ ID NO: 649829 - DNA, 22 bp, Artificial Sequence
  chemically synthesized
ataaagaccaaggtaatgccaa

SEQ ID NO: 649830 - DNA, 22 bp, Artificial Sequence
  chemically synthesized
atcatcatatgtctattggcat

SEQ ID NO: 649831 - DNA, 22 bp, Artificial Sequence
  chemically synthesized
actaatcatcatatgtctattg

SEQ ID NO: 649832 - DNA, 22 bp, Artificial Sequence
  chemically synthesized
ttgactaatcatcatatgtcta

SEQ ID NO: 649833 - DNA, 22 bp, Artificial Sequence
  chemically synthesized
aagatacggtctgttgactaat

SEQ ID NO: 649834 - DNA, 22 bp, Artificial Sequence
  chemically synthesized
ttcaagatacggtctgttgact

SEQ ID NO: 649835 - DNA, 22 bp, Artificial Sequence
  chemically synthesized
ctattcaagatacggtctgttg

SEQ ID NO: 649836 - DNA, 22 bp, Artificial Sequence
  chemically synthesized
gctattcaagatacggtctgtt

SEQ ID NO: 649837 - DNA, 22 bp, Artificial Sequence
  chemically synthesized
catgcttgctattcaagatacg

SEQ ID NO: 649838 - DNA, 22 bp, Artificial Sequence
  chemically synthesized
gcatgcttgctattcaagatac

SEQ ID NO: 649839 - DNA, 22 bp, Artificial Sequence
  chemically synthesized
gtcaacagaccgtatcttgaat

SEQ ID NO: 649840 - DNA, 22 bp, Artificial Sequence
  chemically synthesized
tgcatgcttgctattcaagata

SEQ ID NO: 649841 - DNA, 22 bp, Artificial Sequence
  chemically synthesized
aactttgcatgcttgctattca

SEQ ID NO: 649842 - DNA, 22 bp, Artificial Sequence
  chemically synthesized
taaactttgcatgcttgctatt

SEQ ID NO: 649843 - DNA, 22 bp, Artificial Sequence
  chemically synthesized
tctaaactttgcatgcttgcta

SEQ ID NO: 649844 - DNA, 22 bp, Artificial Sequence
  chemically synthesized
ctctaaactttgcatgcttgct

SEQ ID NO: 649845 - DNA, 22 bp, Artificial Sequence
  chemically synthesized
ttctctaaactttgcatgcttg

SEQ ID NO: 649846 - DNA, 22 bp, Artificial Sequence
  chemically synthesized
ctcttctctaaactttgcatgc

SEQ ID NO: 649847 - DNA, 22 bp, Artificial Sequence
  chemically synthesized
gaatagcaagcatgcaaagttt

SEQ ID NO: 649848 - DNA, 22 bp, Artificial Sequence
  chemically synthesized
aatagcaagcatgcaaagttta

SEQ ID NO: 649849 - DNA, 22 bp, Artificial Sequence
  chemically synthesized
cagtctcctcttctctaaactt

SEQ ID NO: 649850 - DNA, 22 bp, Artificial Sequence
  chemically synthesized
acagtctcctcttctctaaact

SEQ ID NO: 649851 - DNA, 22 bp, Artificial Sequence
  chemically synthesized
ttacagtctcctcttctctaaa

SEQ ID NO: 649852 - DNA, 22 bp, Artificial Sequence
  chemically synthesized
attcttacagtctcctcttctc

SEQ ID NO: 649853 - DNA, 22 bp, Artificial Sequence
  chemically synthesized
aattcttacagtctcctcttct

SEQ ID NO: 649854 - DNA, 22 bp, Artificial Sequence
  chemically synthesized
taattcttacagtctcctcttc

SEQ ID NO: 649855 - DNA, 22 bp, Artificial Sequence
  chemically synthesized
tttaattcttacagtctcctct

SEQ ID NO: 649856 - DNA, 22 bp, Artificial Sequence
  chemically synthesized
ctttaattcttacagtctcctc

SEQ ID NO: 649857 - DNA, 22 bp, Artificial Sequence
  chemically synthesized
tctttaattcttacagtctcct

SEQ ID NO: 649858 - DNA, 22 bp, Artificial Sequence
  chemically synthesized
tttctttaattcttacagtctc

SEQ ID NO: 649859 - DNA, 22 bp, Artificial Sequence
  chemically synthesized
tctttctttaattcttacagtc

SEQ ID NO: 649860 - DNA, 22 bp, Artificial Sequence
  chemically synthesized
agagaagaggagactgtaagaa

SEQ ID NO: 649861 - DNA, 22 bp, Artificial Sequence
  chemically synthesized
ctctttctttaattcttacagt

SEQ ID NO: 649862 - DNA, 22 bp, Artificial Sequence
  chemically synthesized
gagaagaggagactgtaagaat

SEQ ID NO: 649863 - DNA, 22 bp, Artificial Sequence
  chemically synthesized
ttctctttctttaattcttaca

SEQ ID NO: 649864 - DNA, 22 bp, Artificial Sequence
  chemically synthesized
tcttctctttctttaattctta

SEQ ID NO: 649865 - DNA, 22 bp, Artificial Sequence
  chemically synthesized
ctcttctctttctttaattctt

SEQ ID NO: 649866 - DNA, 22 bp, Artificial Sequence
  chemically synthesized
gtgtttctcttctctttcttta

SEQ ID NO: 649867 - DNA, 22 bp, Artificial Sequence
  chemically synthesized
cgtgtttctcttctctttcttt

SEQ ID NO: 649868 - DNA, 22 bp, Artificial Sequence
  chemically synthesized
taagaattaaagaaagagaaga

SEQ ID NO: 649869 - DNA, 22 bp, Artificial Sequence
  chemically synthesized
aagaaagagaagagaaacacga

SEQ ID NO: 649870 - DNA, 22 bp, Artificial Sequence
  chemically synthesized
tagagccacccttcgtgtttct

SEQ ID NO: 649871 - DNA, 22 bp, Artificial Sequence
  chemically synthesized
actgtagagccacccttcgtgt

SEQ ID NO: 649872 - DNA, 22 bp, Artificial Sequence
  chemically synthesized
ttgactgtagagccacccttcg

SEQ ID NO: 649873 - DNA, 22 bp, Artificial Sequence
  chemically synthesized
tccctgttgactgtagagccac

SEQ ID NO: 649874 - DNA, 22 bp, Artificial Sequence
  chemically synthesized
aaataaacctgtccctgttgac

SEQ ID NO: 649875 - DNA, 22 bp, Artificial Sequence
  chemically synthesized
taaaataaacctgtccctgttg

SEQ ID NO: 649876 - DNA, 22 bp, Artificial Sequence
  chemically synthesized
ctaaaataaacctgtccctgtt

SEQ ID NO: 649877 - DNA, 22 bp, Artificial Sequence
  chemically synthesized
tctaaaataaacctgtccctgt

SEQ ID NO: 649878 - DNA, 22 bp, Artificial Sequence
  chemically synthesized
ttctaaaataaacctgtccctg

SEQ ID NO: 649879 - DNA, 22 bp, Artificial Sequence
  chemically synthesized
tttctaaaataaacctgtccct

SEQ ID NO: 649880 - DNA, 22 bp, Artificial Sequence
  chemically synthesized
tacagtcaacagggacaggttt

SEQ ID NO: 649881 - DNA, 22 bp, Artificial Sequence
  chemically synthesized
ttttttctaaaataaacctgtc

SEQ ID NO: 649882 - DNA, 22 bp, Artificial Sequence
  chemically synthesized
cagtcaacagggacaggtttat

SEQ ID NO: 649883 - DNA, 22 bp, Artificial Sequence
  chemically synthesized
gttttttctaaaataaacctgt

SEQ ID NO: 649884 - DNA, 22 bp, Artificial Sequence
  chemically synthesized
aggtttgttttttctaaaataa

SEQ ID NO: 649885 - DNA, 22 bp, Artificial Sequence
  chemically synthesized
tcaggtttgttttttctaaaat

SEQ ID NO: 649886 - DNA, 22 bp, Artificial Sequence
  chemically synthesized
ctctcaggtttgttttttctaa

SEQ ID NO: 649887 - DNA, 22 bp, Artificial Sequence
  chemically synthesized
attttagaaaaaacaaacctga

SEQ ID NO: 649888 - DNA, 22 bp, Artificial Sequence
  chemically synthesized
ttttagaaaaaacaaacctgag

SEQ ID NO: 649889 - DNA, 22 bp, Artificial Sequence
  chemically synthesized
aagacaggctcctctcaggttt

SEQ ID NO: 649890 - DNA, 22 bp, Artificial Sequence
  chemically synthesized
tagaaaaaacaaacctgagagg

SEQ ID NO: 649891 - DNA, 22 bp, Artificial Sequence
  chemically synthesized
agaaaaaacaaacctgagagga

SEQ ID NO: 649892 - DNA, 22 bp, Artificial Sequence
  chemically synthesized
gaaaaaacaaacctgagaggag

SEQ ID NO: 649893 - DNA, 22 bp, Artificial Sequence
  chemically synthesized
agaattaaagacaggctcctct

SEQ ID NO: 649894 - DNA, 22 bp, Artificial Sequence
  chemically synthesized
cctaagaattaaagacaggctc

SEQ ID NO: 649895 - DNA, 22 bp, Artificial Sequence
  chemically synthesized
agaggagcctgtctttaattct

SEQ ID NO: 649896 - DNA, 22 bp, Artificial Sequence
  chemically synthesized
agtacaaatctgcctaagaatt

SEQ ID NO: 649897 - DNA, 22 bp, Artificial Sequence
  chemically synthesized
tctttaattcttaggcagattt

SEQ ID NO: 649898 - DNA, 22 bp, Artificial Sequence
  chemically synthesized
taattcttaggcagatttgtac

SEQ ID NO: 649899 - DNA, 22 bp, Artificial Sequence
  chemically synthesized
aattcttaggcagatttgtact

SEQ ID NO: 649900 - DNA, 22 bp, Artificial Sequence
  chemically synthesized
attcttaggcagatttgtactc

SEQ ID NO: 649901 - DNA, 22 bp, Artificial Sequence
  chemically synthesized
ttaggcagatttgtactcaggt

SEQ ID NO: 649902 - DNA, 22 bp, Artificial Sequence
  chemically synthesized
gtggccagacagacctgagtac

SEQ ID NO: 649903 - DNA, 22 bp, Artificial Sequence
  chemically synthesized
ggtggccagacagacctgagta

SEQ ID NO: 649904 - DNA, 22 bp, Artificial Sequence
  chemically synthesized
aggcagatttgtactcaggtct

SEQ ID NO: 649905 - DNA, 22 bp, Artificial Sequence
  chemically synthesized
ggcagatttgtactcaggtctg

SEQ ID NO: 649906 - DNA, 22 bp, Artificial Sequence
  chemically synthesized
gtactcaggtctgtctggccac

SEQ ID NO: 649907 - DNA, 22 bp, Artificial Sequence
  chemically synthesized
tactcaggtctgtctggccacc

SEQ ID NO: 649908 - DNA, 22 bp, Artificial Sequence
  chemically synthesized
aggtctgtctggccaccaagtc

SEQ ID NO: 649909 - DNA, 22 bp, Artificial Sequence
  chemically synthesized
tctggccaccaagtctacatcc

SEQ ID NO: 649910 - DNA, 22 bp, Artificial Sequence
  chemically synthesized
gggaaatggcaaggatgtagac

SEQ ID NO: 649911 - DNA, 22 bp, Artificial Sequence
  chemically synthesized
gccaccaagtctacatccttgc

SEQ ID NO: 649912 - DNA, 22 bp, Artificial Sequence
  chemically synthesized
tgaaaaatcactagggaaatgg

SEQ ID NO: 649913 - DNA, 22 bp, Artificial Sequence
  chemically synthesized
catccttgccatttccctagtg

SEQ ID NO: 649914 - DNA, 22 bp, Artificial Sequence
  chemically synthesized
gccatttccctagtgatttttc

SEQ ID NO: 649915 - DNA, 22 bp, Artificial Sequence
  chemically synthesized
ccatttccctagtgatttttca

SEQ ID NO: 649916 - DNA, 22 bp, Artificial Sequence
  chemically synthesized
agtggccaatagaactgtgaaa

SEQ ID NO: 649917 - DNA, 22 bp, Artificial Sequence
  chemically synthesized
ccctagtgatttttcacagttc

SEQ ID NO: 649918 - DNA, 22 bp, Artificial Sequence
  chemically synthesized
cctagtgatttttcacagttct

SEQ ID NO: 649919 - DNA, 22 bp, Artificial Sequence
  chemically synthesized
gtgatttttcacagttctattg

SEQ ID NO: 649920 - DNA, 22 bp, Artificial Sequence
  chemically synthesized
ggaaaatgttaagtggccaata

SEQ ID NO: 649921 - DNA, 22 bp, Artificial Sequence
  chemically synthesized
aggaaaatgttaagtggccaat

SEQ ID NO: 649922 - DNA, 22 bp, Artificial Sequence
  chemically synthesized
ttcacagttctattggccactt

SEQ ID NO: 649923 - DNA, 22 bp, Artificial Sequence
  chemically synthesized
taggaaaatgttaagtggccaa

SEQ ID NO: 649924 - DNA, 22 bp, Artificial Sequence
  chemically synthesized
tcacagttctattggccactta

SEQ ID NO: 649925 - DNA, 22 bp, Artificial Sequence
  chemically synthesized
cacagttctattggccacttaa

SEQ ID NO: 649926 - DNA, 22 bp, Artificial Sequence
  chemically synthesized
acagttctattggccacttaac

SEQ ID NO: 649927 - DNA, 22 bp, Artificial Sequence
  chemically synthesized
ttttaggaaaatgttaagtggc

SEQ ID NO: 649928 - DNA, 22 bp, Artificial Sequence
  chemically synthesized
tattggccacttaacattttcc

SEQ ID NO: 649929 - DNA, 22 bp, Artificial Sequence
  chemically synthesized
agatgttattttaggaaaatgt

SEQ ID NO: 649930 - DNA, 22 bp, Artificial Sequence
  chemically synthesized
ttggccacttaacattttccta

SEQ ID NO: 649931 - DNA, 22 bp, Artificial Sequence
  chemically synthesized
ctaagatgttattttaggaaaa

SEQ ID NO: 649932 - DNA, 22 bp, Artificial Sequence
  chemically synthesized
gccacttaacattttcctaaaa

SEQ ID NO: 649933 - DNA, 22 bp, Artificial Sequence
  chemically synthesized
aacattttcctaaaataacatc

SEQ ID NO: 649934 - DNA, 22 bp, Artificial Sequence
  chemically synthesized
acattttcctaaaataacatct

SEQ ID NO: 649935 - DNA, 22 bp, Artificial Sequence
  chemically synthesized
aagccatctcctaagatgttat

SEQ ID NO: 649936 - DNA, 22 bp, Artificial Sequence
  chemically synthesized
tcctaaaataacatcttaggag

SEQ ID NO: 649937 - DNA, 22 bp, Artificial Sequence
  chemically synthesized
cctaaaataacatcttaggaga

SEQ ID NO: 649938 - DNA, 22 bp, Artificial Sequence
  chemically synthesized
ctaaaataacatcttaggagat

SEQ ID NO: 649939 - DNA, 22 bp, Artificial Sequence
  chemically synthesized
aaataacatcttaggagatggc

SEQ ID NO: 649940 - DNA, 22 bp, Artificial Sequence
  chemically synthesized
taagtaagagttgaagccatct

SEQ ID NO: 649941 - DNA, 22 bp, Artificial Sequence
  chemically synthesized
tataagtaagagttgaagccat

SEQ ID NO: 649942 - DNA, 22 bp, Artificial Sequence
  chemically synthesized
aggagatggcttcaactcttac

SEQ ID NO: 649943 - DNA, 22 bp, Artificial Sequence
  chemically synthesized
aaggttctataagtaagagttg

SEQ ID NO: 649944 - DNA, 22 bp, Artificial Sequence
  chemically synthesized
ggagatggcttcaactcttact

SEQ ID NO: 649945 - DNA, 22 bp, Artificial Sequence
  chemically synthesized
ctcaaggttctataagtaagag

SEQ ID NO: 649946 - DNA, 22 bp, Artificial Sequence
  chemically synthesized
actcaaggttctataagtaaga

SEQ ID NO: 649947 - DNA, 22 bp, Artificial Sequence
  chemically synthesized
caactcttacttatagaacctt

SEQ ID NO: 649948 - DNA, 22 bp, Artificial Sequence
  chemically synthesized
aataatttactcaaggttctat

SEQ ID NO: 649949 - DNA, 22 bp, Artificial Sequence
  chemically synthesized
aactcttacttatagaaccttg

SEQ ID NO: 649950 - DNA, 22 bp, Artificial Sequence
  chemically synthesized
ttacttatagaaccttgagtaa

SEQ ID NO: 649951 - DNA, 22 bp, Artificial Sequence
  chemically synthesized
aggttaaataatttactcaagg

SEQ ID NO: 649952 - DNA, 22 bp, Artificial Sequence
  chemically synthesized
acttatagaaccttgagtaaat

SEQ ID NO: 649953 - DNA, 22 bp, Artificial Sequence
  chemically synthesized
cttatagaaccttgagtaaatt

SEQ ID NO: 649954 - DNA, 22 bp, Artificial Sequence
  chemically synthesized
atagaaccttgagtaaattatt

SEQ ID NO: 649955 - DNA, 22 bp, Artificial Sequence
  chemically synthesized
tagaaccttgagtaaattattt

SEQ ID NO: 649956 - DNA, 22 bp, Artificial Sequence
  chemically synthesized
aggtcctgaggttaaataattt

SEQ ID NO: 649957 - DNA, 22 bp, Artificial Sequence
  chemically synthesized
gagtaaattatttaacctcagg

SEQ ID NO: 649958 - DNA, 22 bp, Artificial Sequence
  chemically synthesized
agtaaattatttaacctcagga

SEQ ID NO: 649959 - DNA, 22 bp, Artificial Sequence
  chemically synthesized
tacagatgaggaccctgaggtc

SEQ ID NO: 649960 - DNA, 22 bp, Artificial Sequence
  chemically synthesized
tttaacctcaggacctcagggt

SEQ ID NO: 649961 - DNA, 22 bp, Artificial Sequence
  chemically synthesized
tatacagatgaggaccctgagg

SEQ ID NO: 649962 - DNA, 22 bp, Artificial Sequence
  chemically synthesized
aacctcaggacctcagggtcct

SEQ ID NO: 649963 - DNA, 22 bp, Artificial Sequence
  chemically synthesized
acctcaggacctcagggtcctc

SEQ ID NO: 649964 - DNA, 22 bp, Artificial Sequence
  chemically synthesized
tcccctctatacagatgaggac

SEQ ID NO: 649965 - DNA, 22 bp, Artificial Sequence
  chemically synthesized
aggacctcagggtcctcatctg

SEQ ID NO: 649966 - DNA, 22 bp, Artificial Sequence
  chemically synthesized
atcccctctatacagatgagga

SEQ ID NO: 649967 - DNA, 22 bp, Artificial Sequence
  chemically synthesized
tatcccctctatacagatgagg

SEQ ID NO: 649968 - DNA, 22 bp, Artificial Sequence
  chemically synthesized
ttatcccctctatacagatgag

SEQ ID NO: 649969 - DNA, 22 bp, Artificial Sequence
  chemically synthesized
agggtcctcatctgtatagagg

SEQ ID NO: 649970 - DNA, 22 bp, Artificial Sequence
  chemically synthesized
tgatttttatcccctctataca

SEQ ID NO: 649971 - DNA, 22 bp, Artificial Sequence
  chemically synthesized
atctgtatagaggggataaaaa

SEQ ID NO: 649972 - DNA, 22 bp, Artificial Sequence
  chemically synthesized
tatagaggggataaaaatcata

SEQ ID NO: 649973 - DNA, 22 bp, Artificial Sequence
  chemically synthesized
tgtaaaataagtactatgattt

SEQ ID NO: 649974 - DNA, 22 bp, Artificial Sequence
  chemically synthesized
ccctgtgtaaaataagtactat

SEQ ID NO: 649975 - DNA, 22 bp, Artificial Sequence
  chemically synthesized
aactaccctgtgtaaaataagt

SEQ ID NO: 649976 - DNA, 22 bp, Artificial Sequence
  chemically synthesized
aaactaccctgtgtaaaataag

SEQ ID NO: 649977 - DNA, 22 bp, Artificial Sequence
  chemically synthesized
taaactaccctgtgtaaaataa

SEQ ID NO: 649978 - DNA, 22 bp, Artificial Sequence
  chemically synthesized
ttaaactaccctgtgtaaaata

SEQ ID NO: 649979 - DNA, 22 bp, Artificial Sequence
  chemically synthesized
ccttttaaactaccctgtgtaa

SEQ ID NO: 649980 - DNA, 22 bp, Artificial Sequence
  chemically synthesized
accttttaaactaccctgtgta

SEQ ID NO: 649981 - DNA, 22 bp, Artificial Sequence
  chemically synthesized
ggcatttaccttttaaactacc

SEQ ID NO: 649982 - DNA, 22 bp, Artificial Sequence
  chemically synthesized
attttacacagggtagtttaaa

SEQ ID NO: 649983 - DNA, 22 bp, Artificial Sequence
  chemically synthesized
ttttacacagggtagtttaaaa

SEQ ID NO: 649984 - DNA, 22 bp, Artificial Sequence
  chemically synthesized
tacacagggtagtttaaaaggt

SEQ ID NO: 649985 - DNA, 22 bp, Artificial Sequence
  chemically synthesized
acacagggtagtttaaaaggta

SEQ ID NO: 649986 - DNA, 22 bp, Artificial Sequence
  chemically synthesized
cacagggtagtttaaaaggtaa

SEQ ID NO: 649987 - DNA, 22 bp, Artificial Sequence
  chemically synthesized
aatgctaggcatttacctttta

SEQ ID NO: 649988 - DNA, 22 bp, Artificial Sequence
  chemically synthesized
ctaaatgctaggcatttacctt

SEQ ID NO: 649989 - DNA, 22 bp, Artificial Sequence
  chemically synthesized
actaaatgctaggcatttacct

SEQ ID NO: 649990 - DNA, 22 bp, Artificial Sequence
  chemically synthesized
acacttactaaatgctaggcat

SEQ ID NO: 649991 - DNA, 22 bp, Artificial Sequence
  chemically synthesized
aaaaggtaaatgcctagcattt

SEQ ID NO: 649992 - DNA, 22 bp, Artificial Sequence
  chemically synthesized
aaaggtaaatgcctagcattta

SEQ ID NO: 649993 - DNA, 22 bp, Artificial Sequence
  chemically synthesized
tatgctaacacttactaaatgc

SEQ ID NO: 649994 - DNA, 22 bp, Artificial Sequence
  chemically synthesized
atatgctaacacttactaaatg

SEQ ID NO: 649995 - DNA, 22 bp, Artificial Sequence
  chemically synthesized
tatatgctaacacttactaaat

SEQ ID NO: 649996 - DNA, 22 bp, Artificial Sequence
  chemically synthesized
gcatttagtaagtgttagcata

SEQ ID NO: 649997 - DNA, 22 bp, Artificial Sequence
  chemically synthesized
aaaatccattttatatgctaac

SEQ ID NO: 649998 - DNA, 22 bp, Artificial Sequence
  chemically synthesized
aaaaatccattttatatgctaa

SEQ ID NO: 649999 - DNA, 22 bp, Artificial Sequence
  chemically synthesized
taaaaatccattttatatgcta

SEQ ID NO: 650000 - DNA, 22 bp, Artificial Sequence
  chemically synthesized
agtaagtgttagcatataaaat

SEQ ID NO: 650001 - DNA, 22 bp, Artificial Sequence
  chemically synthesized
gtaagtgttagcatataaaatg

SEQ ID NO: 650002 - DNA, 22 bp, Artificial Sequence
  chemically synthesized
gtgacattttaaaaatccattt

SEQ ID NO: 650003 - DNA, 22 bp, Artificial Sequence
  chemically synthesized
gcatataaaatggatttttaaa

SEQ ID NO: 650004 - DNA, 22 bp, Artificial Sequence
  chemically synthesized
tatactagtgacattttaaaaa

SEQ ID NO: 650005 - DNA, 22 bp, Artificial Sequence
  chemically synthesized
tcctgtatactagtgacatttt

SEQ ID NO: 650006 - DNA, 22 bp, Artificial Sequence
  chemically synthesized
tctgtcctgtatactagtgaca

SEQ ID NO: 650007 - DNA, 22 bp, Artificial Sequence
  chemically synthesized
ttatctgtcctgtatactagtg

SEQ ID NO: 650008 - DNA, 22 bp, Artificial Sequence
  chemically synthesized
ttaaaatgtcactagtatacag

SEQ ID NO: 650009 - DNA, 22 bp, Artificial Sequence
  chemically synthesized
taaaatgtcactagtatacagg

SEQ ID NO: 650010 - DNA, 22 bp, Artificial Sequence
  chemically synthesized
aaaatgtcactagtatacagga

SEQ ID NO: 650011 - DNA, 22 bp, Artificial Sequence
  chemically synthesized
acctattatctgtcctgtatac

SEQ ID NO: 650012 - DNA, 22 bp, Artificial Sequence
  chemically synthesized
aaatgtcactagtatacaggac

SEQ ID NO: 650013 - DNA, 22 bp, Artificial Sequence
  chemically synthesized
ctcacctattatctgtcctgta

SEQ ID NO: 650014 - DNA, 22 bp, Artificial Sequence
  chemically synthesized
gtatacaggacagataataggt

SEQ ID NO: 650015 - DNA, 22 bp, Artificial Sequence
  chemically synthesized
atcaatgttgctcacctattat

SEQ ID NO: 650016 - DNA, 22 bp, Artificial Sequence
  chemically synthesized
aatcaatgttgctcacctatta

SEQ ID NO: 650017 - DNA, 22 bp, Artificial Sequence
  chemically synthesized
taatcaatgttgctcacctatt

SEQ ID NO: 650018 - DNA, 22 bp, Artificial Sequence
  chemically synthesized
ttaatcaatgttgctcacctat

SEQ ID NO: 650019 - DNA, 22 bp, Artificial Sequence
  chemically synthesized
ccacttttaatcaatgttgctc

SEQ ID NO: 650020 - DNA, 22 bp, Artificial Sequence
  chemically synthesized
ataaactaccacttttaatcaa

SEQ ID NO: 650021 - DNA, 22 bp, Artificial Sequence
  chemically synthesized
ccccaaattcataaactaccac

SEQ ID NO: 650022 - DNA, 22 bp, Artificial Sequence
  chemically synthesized
attaaaagtggtagtttatgaa

SEQ ID NO: 650023 - DNA, 22 bp, Artificial Sequence
  chemically synthesized
ggttcccccaaattcataaact

SEQ ID NO: 650024 - DNA, 22 bp, Artificial Sequence
  chemically synthesized
taggttcccccaaattcataaa

SEQ ID NO: 650025 - DNA, 22 bp, Artificial Sequence
  chemically synthesized
aaagtggtagtttatgaatttg

SEQ ID NO: 650026 - DNA, 22 bp, Artificial Sequence
  chemically synthesized
atgaatttgggggaacctagaa

SEQ ID NO: 650027 - DNA, 22 bp, Artificial Sequence
  chemically synthesized
tgaatttgggggaacctagaac

SEQ ID NO: 650028 - DNA, 22 bp, Artificial Sequence
  chemically synthesized
agtatgggggatggttctaggt

SEQ ID NO: 650029 - DNA, 22 bp, Artificial Sequence
  chemically synthesized
gggggaacctagaaccatcccc

SEQ ID NO: 650030 - DNA, 22 bp, Artificial Sequence
  chemically synthesized
ggggaacctagaaccatccccc

SEQ ID NO: 650031 - DNA, 22 bp, Artificial Sequence
  chemically synthesized
gaaccatcccccatactcaaca

SEQ ID NO: 650032 - DNA, 22 bp, Artificial Sequence
  chemically synthesized
tggccatgaggcatgttgagta

SEQ ID NO: 650033 - DNA, 22 bp, Artificial Sequence
  chemically synthesized
atggccatgaggcatgttgagt

SEQ ID NO: 650034 - DNA, 22 bp, Artificial Sequence
  chemically synthesized
tgtggggcgatcttatggccat

SEQ ID NO: 650035 - DNA, 22 bp, Artificial Sequence
  chemically synthesized
aacatgcctcatggccataaga

SEQ ID NO: 650036 - DNA, 22 bp, Artificial Sequence
  chemically synthesized
gaggttgtgtggggcgatctta

SEQ ID NO: 650037 - DNA, 22 bp, Artificial Sequence
  chemically synthesized
agaggttgtgtggggcgatctt

SEQ ID NO: 650038 - DNA, 22 bp, Artificial Sequence
  chemically synthesized
atggccataagatcgccccaca

SEQ ID NO: 650039 - DNA, 22 bp, Artificial Sequence
  chemically synthesized
cacagccttagaggttgtgtgg

SEQ ID NO: 650040 - DNA, 22 bp, Artificial Sequence
  chemically synthesized
gcacagccttagaggttgtgtg

SEQ ID NO: 650041 - DNA, 22 bp, Artificial Sequence
  chemically synthesized
tgcacagccttagaggttgtgt

SEQ ID NO: 650042 - DNA, 22 bp, Artificial Sequence
  chemically synthesized
ttttgcacagccttagaggttg

SEQ ID NO: 650043 - DNA, 22 bp, Artificial Sequence
  chemically synthesized
attttgcacagccttagaggtt

SEQ ID NO: 650044 - DNA, 22 bp, Artificial Sequence
  chemically synthesized
acgtttattttgcacagcctta

SEQ ID NO: 650045 - DNA, 22 bp, Artificial Sequence
  chemically synthesized
cacgtttattttgcacagcctt

SEQ ID NO: 650046 - DNA, 22 bp, Artificial Sequence
  chemically synthesized
tcacgtttattttgcacagcct

SEQ ID NO: 650047 - DNA, 22 bp, Artificial Sequence
  chemically synthesized
aagacgttttcacgtttatttt

SEQ ID NO: 650048 - DNA, 22 bp, Artificial Sequence
  chemically synthesized
taaggctgtgcaaaataaacgt

SEQ ID NO: 650049 - DNA, 22 bp, Artificial Sequence
  chemically synthesized
aggctgtgcaaaataaacgtga

SEQ ID NO: 650050 - DNA, 22 bp, Artificial Sequence
  chemically synthesized
tattgaagacgttttcacgttt

SEQ ID NO: 650051 - DNA, 22 bp, Artificial Sequence
  chemically synthesized
tgcaaaataaacgtgaaaacgt

SEQ ID NO: 650052 - DNA, 22 bp, Artificial Sequence
  chemically synthesized
tgtgcatggttgtattgaagac

SEQ ID NO: 650053 - DNA, 22 bp, Artificial Sequence
  chemically synthesized
tgtgtgcatggttgtattgaag

SEQ ID NO: 650054 - DNA, 22 bp, Artificial Sequence
  chemically synthesized
attctgtgtgcatggttgtatt

SEQ ID NO: 650055 - DNA, 22 bp, Artificial Sequence
  chemically synthesized
cattctgtgtgcatggttgtat

SEQ ID NO: 650056 - DNA, 22 bp, Artificial Sequence
  chemically synthesized
tcattctgtgtgcatggttgta

SEQ ID NO: 650057 - DNA, 22 bp, Artificial Sequence
  chemically synthesized
caatacaaccatgcacacagaa

SEQ ID NO: 650058 - DNA, 22 bp, Artificial Sequence
  chemically synthesized
aatacaaccatgcacacagaat

SEQ ID NO: 650059 - DNA, 22 bp, Artificial Sequence
  chemically synthesized
gatgaataaatagggttttcat

SEQ ID NO: 650060 - DNA, 22 bp, Artificial Sequence
  chemically synthesized
ttggatgaataaatagggtttt

SEQ ID NO: 650061 - DNA, 22 bp, Artificial Sequence
  chemically synthesized
aataaatattgttggatgaata

SEQ ID NO: 650062 - DNA, 22 bp, Artificial Sequence
  chemically synthesized
tttattcatccaacaatattta

SEQ ID NO: 650063 - DNA, 22 bp, Artificial Sequence
  chemically synthesized
attcatccaacaatatttattg

SEQ ID NO: 650064 - DNA, 22 bp, Artificial Sequence
  chemically synthesized
ttcatccaacaatatttattga

SEQ ID NO: 650065 - DNA, 22 bp, Artificial Sequence
  chemically synthesized
atccaacaatatttattgaggg

SEQ ID NO: 650066 - DNA, 22 bp, Artificial Sequence
  chemically synthesized
gcacatatggaacatgatagac

SEQ ID NO: 650067 - DNA, 22 bp, Artificial Sequence
  chemically synthesized
attgagggtctatcatgttcca

SEQ ID NO: 650068 - DNA, 22 bp, Artificial Sequence
  chemically synthesized
ttgagggtctatcatgttccat

SEQ ID NO: 650069 - DNA, 22 bp, Artificial Sequence
  chemically synthesized
agggtctatcatgttccatatg

SEQ ID NO: 650070 - DNA, 22 bp, Artificial Sequence
  chemically synthesized
ggggagtgcctggcacatatgg

SEQ ID NO: 650071 - DNA, 22 bp, Artificial Sequence
  chemically synthesized
tcatgttccatatgtgccaggc

SEQ ID NO: 650072 - DNA, 22 bp, Artificial Sequence
  chemically synthesized
gtgcctaggggagtgcctggca

SEQ ID NO: 650073 - DNA, 22 bp, Artificial Sequence
  chemically synthesized
catatgtgccaggcactcccct

SEQ ID NO: 650074 - DNA, 22 bp, Artificial Sequence
  chemically synthesized
tccctggtgcctaggggagtgc

SEQ ID NO: 650075 - DNA, 22 bp, Artificial Sequence
  chemically synthesized
ccctatccctggtgcctagggg

SEQ ID NO: 650076 - DNA, 22 bp, Artificial Sequence
  chemically synthesized
accctatccctggtgcctaggg

SEQ ID NO: 650077 - DNA, 22 bp, Artificial Sequence
  chemically synthesized
aggatttaccctatccctggtg

SEQ ID NO: 650078 - DNA, 22 bp, Artificial Sequence
  chemically synthesized
caggatttaccctatccctggt

SEQ ID NO: 650079 - DNA, 22 bp, Artificial Sequence
  chemically synthesized
ccctaggcaccagggatagggt

SEQ ID NO: 650080 - DNA, 22 bp, Artificial Sequence
  chemically synthesized
taggcttcaggatttaccctat

SEQ ID NO: 650081 - DNA, 22 bp, Artificial Sequence
  chemically synthesized
ggcaccagggatagggtaaatc

SEQ ID NO: 650082 - DNA, 22 bp, Artificial Sequence
  chemically synthesized
aactgtaggcttcaggatttac

SEQ ID NO: 650083 - DNA, 22 bp, Artificial Sequence
  chemically synthesized
tcaactgtaggcttcaggattt

SEQ ID NO: 650084 - DNA, 22 bp, Artificial Sequence
  chemically synthesized
aagtggctctcaactgtaggct

SEQ ID NO: 650085 - DNA, 22 bp, Artificial Sequence
  chemically synthesized
cccagctaaagtggctctcaac

SEQ ID NO: 650086 - DNA, 22 bp, Artificial Sequence
  chemically synthesized
aagcctacagttgagagccact

SEQ ID NO: 650087 - DNA, 22 bp, Artificial Sequence
  chemically synthesized
cagttgagagccactttagctg

SEQ ID NO: 650088 - DNA, 22 bp, Artificial Sequence
  chemically synthesized
cccagatgttccccagctaaag

SEQ ID NO: 650089 - DNA, 22 bp, Artificial Sequence
  chemically synthesized
ccccagatgttccccagctaaa

SEQ ID NO: 650090 - DNA, 22 bp, Artificial Sequence
  chemically synthesized
agagccactttagctggggaac

SEQ ID NO: 650091 - DNA, 22 bp, Artificial Sequence
  chemically synthesized
tcacttccccagatgttcccca

SEQ ID NO: 650092 - DNA, 22 bp, Artificial Sequence
  chemically synthesized
gtcacttccccagatgttcccc

SEQ ID NO: 650093 - DNA, 22 bp, Artificial Sequence
  chemically synthesized
tgatttgtcacttccccagatg

SEQ ID NO: 650094 - DNA, 22 bp, Artificial Sequence
  chemically synthesized
tagctggggaacatctggggaa

SEQ ID NO: 650095 - DNA, 22 bp, Artificial Sequence
  chemically synthesized
agctggggaacatctggggaag

SEQ ID NO: 650096 - DNA, 22 bp, Artificial Sequence
  chemically synthesized
gctggggaacatctggggaagt

SEQ ID NO: 650097 - DNA, 22 bp, Artificial Sequence
  chemically synthesized
gggaacatctggggaagtgaca

SEQ ID NO: 650098 - DNA, 22 bp, Artificial Sequence
  chemically synthesized
gggaagtgacaaatcacagcat

SEQ ID NO: 650099 - DNA, 22 bp, Artificial Sequence
  chemically synthesized
cagatcatgtataatgctgtga

SEQ ID NO: 650100 - DNA, 22 bp, Artificial Sequence
  chemically synthesized
tacaatactgcagatcatgtat

SEQ ID NO: 650101 - DNA, 22 bp, Artificial Sequence
  chemically synthesized
gtacaatactgcagatcatgta

SEQ ID NO: 650102 - DNA, 22 bp, Artificial Sequence
  chemically synthesized
tgtacaatactgcagatcatgt

SEQ ID NO: 650103 - DNA, 22 bp, Artificial Sequence
  chemically synthesized
agttttgtacaatactgcagat

SEQ ID NO: 650104 - DNA, 22 bp, Artificial Sequence
  chemically synthesized
cagttttgtacaatactgcaga

SEQ ID NO: 650105 - DNA, 22 bp, Artificial Sequence
  chemically synthesized
tacatgatctgcagtattgtac

SEQ ID NO: 650106 - DNA, 22 bp, Artificial Sequence
  chemically synthesized
ggataaatttcagttttgtaca

SEQ ID NO: 650107 - DNA, 22 bp, Artificial Sequence
  chemically synthesized
acctgggataaatttcagtttt

SEQ ID NO: 650108 - DNA, 22 bp, Artificial Sequence
  chemically synthesized
cagtattgtacaaaactgaaat

SEQ ID NO: 650109 - DNA, 22 bp, Artificial Sequence
  chemically synthesized
gttcacctgggataaatttcag

SEQ ID NO: 650110 - DNA, 22 bp, Artificial Sequence
  chemically synthesized
tacaaaactgaaatttatccca

SEQ ID NO: 650111 - DNA, 22 bp, Artificial Sequence
  chemically synthesized
acgtgagagttagttcacctgg

SEQ ID NO: 650112 - DNA, 22 bp, Artificial Sequence
  chemically synthesized
aaatttatcccaggtgaactaa

SEQ ID NO: 650113 - DNA, 22 bp, Artificial Sequence
  chemically synthesized
atcccaggtgaactaactctca

SEQ ID NO: 650114 - DNA, 22 bp, Artificial Sequence
  chemically synthesized
tcccaggtgaactaactctcac

SEQ ID NO: 650115 - DNA, 22 bp, Artificial Sequence
  chemically synthesized
acgccagcctgacgtgagagtt

SEQ ID NO: 650116 - DNA, 22 bp, Artificial Sequence
  chemically synthesized
gacgccagcctgacgtgagagt

SEQ ID NO: 650117 - DNA, 22 bp, Artificial Sequence
  chemically synthesized
cggtaagtttgacgccagcctg

SEQ ID NO: 650118 - DNA, 22 bp, Artificial Sequence
  chemically synthesized
actctcacgtcaggctggcgtc

SEQ ID NO: 650119 - DNA, 22 bp, Artificial Sequence
  chemically synthesized
cactccggtaagtttgacgcca

SEQ ID NO: 650120 - DNA, 22 bp, Artificial Sequence
  chemically synthesized
tcacgtcaggctggcgtcaaac

SEQ ID NO: 650121 - DNA, 22 bp, Artificial Sequence
  chemically synthesized
acgtcaggctggcgtcaaactt

SEQ ID NO: 650122 - DNA, 22 bp, Artificial Sequence
  chemically synthesized
gcgtcaaacttaccggagtgca

SEQ ID NO: 650123 - DNA, 22 bp, Artificial Sequence
  chemically synthesized
tcccatggtggaatattgcact

SEQ ID NO: 650124 - DNA, 22 bp, Artificial Sequence
  chemically synthesized
accggagtgcaatattccacca

SEQ ID NO: 650125 - DNA, 22 bp, Artificial Sequence
  chemically synthesized
ccggagtgcaatattccaccat

SEQ ID NO: 650126 - DNA, 22 bp, Artificial Sequence
  chemically synthesized
caaaaggccataaaatgcacta

SEQ ID NO: 650127 - DNA, 22 bp, Artificial Sequence
  chemically synthesized
caccatgggatagtgcatttta

SEQ ID NO: 650128 - DNA, 22 bp, Artificial Sequence
  chemically synthesized
gtcgagttgcaaaaggccataa

SEQ ID NO: 650129 - DNA, 22 bp, Artificial Sequence
  chemically synthesized
tggtcgagttgcaaaaggccat

SEQ ID NO: 650130 - DNA, 22 bp, Artificial Sequence
  chemically synthesized
ctggtcgagttgcaaaaggcca

SEQ ID NO: 650131 - DNA, 22 bp, Artificial Sequence
  chemically synthesized
tctggtcgagttgcaaaaggcc

SEQ ID NO: 650132 - DNA, 22 bp, Artificial Sequence
  chemically synthesized
ttctggtcgagttgcaaaaggc

SEQ ID NO: 650133 - DNA, 22 bp, Artificial Sequence
  chemically synthesized
tttctggtcgagttgcaaaagg

SEQ ID NO: 650134 - DNA, 22 bp, Artificial Sequence
  chemically synthesized
ttttctggtcgagttgcaaaag

SEQ ID NO: 650135 - DNA, 22 bp, Artificial Sequence
  chemically synthesized
tttttctggtcgagttgcaaaa

SEQ ID NO: 650136 - DNA, 22 bp, Artificial Sequence
  chemically synthesized
ctttttttctggtcgagttgca

SEQ ID NO: 650137 - DNA, 22 bp, Artificial Sequence
  chemically synthesized
tatggccttttgcaactcgacc

SEQ ID NO: 650138 - DNA, 22 bp, Artificial Sequence
  chemically synthesized
atggccttttgcaactcgacca

SEQ ID NO: 650139 - DNA, 22 bp, Artificial Sequence
  chemically synthesized
tggccttttgcaactcgaccag

SEQ ID NO: 650140 - DNA, 22 bp, Artificial Sequence
  chemically synthesized
ccaaagctgctttttttctggt

SEQ ID NO: 650141 - DNA, 22 bp, Artificial Sequence
  chemically synthesized
ttgcaactcgaccagaaaaaaa

SEQ ID NO: 650142 - DNA, 22 bp, Artificial Sequence
  chemically synthesized
tgcaactcgaccagaaaaaaag

SEQ ID NO: 650143 - DNA, 22 bp, Artificial Sequence
  chemically synthesized
gcaactcgaccagaaaaaaagc

SEQ ID NO: 650144 - DNA, 22 bp, Artificial Sequence
  chemically synthesized
caactcgaccagaaaaaaagca

SEQ ID NO: 650145 - DNA, 22 bp, Artificial Sequence
  chemically synthesized
tgacatctgccaaagctgcttt

SEQ ID NO: 650146 - DNA, 22 bp, Artificial Sequence
  chemically synthesized
gaccagaaaaaaagcagctttg

SEQ ID NO: 650147 - DNA, 22 bp, Artificial Sequence
  chemically synthesized
attatgacatctgccaaagctg

SEQ ID NO: 650148 - DNA, 22 bp, Artificial Sequence
  chemically synthesized
aattatgacatctgccaaagct

SEQ ID NO: 650149 - DNA, 22 bp, Artificial Sequence
  chemically synthesized
taattatgacatctgccaaagc

SEQ ID NO: 650150 - DNA, 22 bp, Artificial Sequence
  chemically synthesized
aagcactttaattatgacatct

SEQ ID NO: 650151 - DNA, 22 bp, Artificial Sequence
  chemically synthesized
tggcagatgtcataattaaagt

SEQ ID NO: 650152 - DNA, 22 bp, Artificial Sequence
  chemically synthesized
ggcagatgtcataattaaagtg

SEQ ID NO: 650153 - DNA, 22 bp, Artificial Sequence
  chemically synthesized
gcagatgtcataattaaagtgc

SEQ ID NO: 650154 - DNA, 22 bp, Artificial Sequence
  chemically synthesized
tcaggtacaggagtctaaagca

SEQ ID NO: 650155 - DNA, 22 bp, Artificial Sequence
  chemically synthesized
atcaggtacaggagtctaaagc

SEQ ID NO: 650156 - DNA, 22 bp, Artificial Sequence
  chemically synthesized
tatcaggtacaggagtctaaag

SEQ ID NO: 650157 - DNA, 22 bp, Artificial Sequence
  chemically synthesized
tttatcaggtacaggagtctaa

SEQ ID NO: 650158 - DNA, 22 bp, Artificial Sequence
  chemically synthesized
ctctttatcaggtacaggagtc

SEQ ID NO: 650159 - DNA, 22 bp, Artificial Sequence
  chemically synthesized
gctctttatcaggtacaggagt

SEQ ID NO: 650160 - DNA, 22 bp, Artificial Sequence
  chemically synthesized
aagtgctttagactcctgtacc

SEQ ID NO: 650161 - DNA, 22 bp, Artificial Sequence
  chemically synthesized
tgctctttatcaggtacaggag

SEQ ID NO: 650162 - DNA, 22 bp, Artificial Sequence
  chemically synthesized
ttgctctttatcaggtacagga

SEQ ID NO: 650163 - DNA, 22 bp, Artificial Sequence
  chemically synthesized
tttttgctctttatcaggtaca

SEQ ID NO: 650164 - DNA, 22 bp, Artificial Sequence
  chemically synthesized
gtttttgctctttatcaggtac

SEQ ID NO: 650165 - DNA, 22 bp, Artificial Sequence
  chemically synthesized
tagactcctgtacctgataaag

SEQ ID NO: 650166 - DNA, 22 bp, Artificial Sequence
  chemically synthesized
agactcctgtacctgataaaga

SEQ ID NO: 650167 - DNA, 22 bp, Artificial Sequence
  chemically synthesized
gactcctgtacctgataaagag

SEQ ID NO: 650168 - DNA, 22 bp, Artificial Sequence
  chemically synthesized
ctgtacctgataaagagcaaaa

SEQ ID NO: 650169 - DNA, 22 bp, Artificial Sequence
  chemically synthesized
tacctgataaagagcaaaaaca

SEQ ID NO: 650170 - DNA, 22 bp, Artificial Sequence
  chemically synthesized
ataaagagcaaaaacaaacacg

SEQ ID NO: 650171 - DNA, 22 bp, Artificial Sequence
  chemically synthesized
gaagaaatacatacgtgtttgt

SEQ ID NO: 650172 - DNA, 22 bp, Artificial Sequence
  chemically synthesized
attcgaagaaatacatacgtgt

SEQ ID NO: 650173 - DNA, 22 bp, Artificial Sequence
  chemically synthesized
gattcgaagaaatacatacgtg

SEQ ID NO: 650174 - DNA, 22 bp, Artificial Sequence
  chemically synthesized
ggaatttgattcgaagaaatac

SEQ ID NO: 650175 - DNA, 22 bp, Artificial Sequence
  chemically synthesized
gggaatttgattcgaagaaata

SEQ ID NO: 650176 - DNA, 22 bp, Artificial Sequence
  chemically synthesized
tgggaatttgattcgaagaaat

SEQ ID NO: 650177 - DNA, 22 bp, Artificial Sequence
  chemically synthesized
tttgggaatttgattcgaagaa

SEQ ID NO: 650178 - DNA, 22 bp, Artificial Sequence
  chemically synthesized
aagagtgttctttgggaatttg

SEQ ID NO: 650179 - DNA, 22 bp, Artificial Sequence
  chemically synthesized
ttaaagagtgttctttgggaat

SEQ ID NO: 650180 - DNA, 22 bp, Artificial Sequence
  chemically synthesized
cttcgaatcaaattcccaaaga

SEQ ID NO: 650181 - DNA, 22 bp, Artificial Sequence
  chemically synthesized
attaaagagtgttctttgggaa

SEQ ID NO: 650182 - DNA, 22 bp, Artificial Sequence
  chemically synthesized
ttcgaatcaaattcccaaagaa

SEQ ID NO: 650183 - DNA, 22 bp, Artificial Sequence
  chemically synthesized
cgaatcaaattcccaaagaaca

SEQ ID NO: 650184 - DNA, 22 bp, Artificial Sequence
  chemically synthesized
gaatcaaattcccaaagaacac

SEQ ID NO: 650185 - DNA, 22 bp, Artificial Sequence
  chemically synthesized
ccaaagaacactctttaataaa

SEQ ID NO: 650186 - DNA, 22 bp, Artificial Sequence
  chemically synthesized
gaacgtggtagaaggtttatta

SEQ ID NO: 650187 - DNA, 22 bp, Artificial Sequence
  chemically synthesized
aaattagaacgtggtagaaggt

SEQ ID NO: 650188 - DNA, 22 bp, Artificial Sequence
  chemically synthesized
tcaaattagaacgtggtagaag

SEQ ID NO: 650189 - DNA, 22 bp, Artificial Sequence
  chemically synthesized
ctcaaattagaacgtggtagaa

SEQ ID NO: 650190 - DNA, 22 bp, Artificial Sequence
  chemically synthesized
tttaataaaccttctaccacgt

SEQ ID NO: 650191 - DNA, 22 bp, Artificial Sequence
  chemically synthesized
taataaaccttctaccacgttc

SEQ ID NO: 650192 - DNA, 22 bp, Artificial Sequence
  chemically synthesized
tttctcaaattagaacgtggta

SEQ ID NO: 650193 - DNA, 22 bp, Artificial Sequence
  chemically synthesized
aataaaccttctaccacgttct

SEQ ID NO: 650194 - DNA, 22 bp, Artificial Sequence
  chemically synthesized
ataaaccttctaccacgttcta

SEQ ID NO: 650195 - DNA, 22 bp, Artificial Sequence
  chemically synthesized
tgtttctcaaattagaacgtgg

SEQ ID NO: 650196 - DNA, 22 bp, Artificial Sequence
  chemically synthesized
ctgtttctcaaattagaacgtg

SEQ ID NO: 650197 - DNA, 22 bp, Artificial Sequence
  chemically synthesized
tctgtttctcaaattagaacgt

SEQ ID NO: 650198 - DNA, 22 bp, Artificial Sequence
  chemically synthesized
ctttctgtttctcaaattagaa

SEQ ID NO: 650199 - DNA, 22 bp, Artificial Sequence
  chemically synthesized
ctaccacgttctaatttgagaa

SEQ ID NO: 650200 - DNA, 22 bp, Artificial Sequence
  chemically synthesized
taccacgttctaatttgagaaa

SEQ ID NO: 650201 - DNA, 22 bp, Artificial Sequence
  chemically synthesized
ccacgttctaatttgagaaaca

SEQ ID NO: 650202 - DNA, 22 bp, Artificial Sequence
  chemically synthesized
atgaacattgctttctgtttct

SEQ ID NO: 650203 - DNA, 22 bp, Artificial Sequence
  chemically synthesized
taatttgagaaacagaaagcaa

SEQ ID NO: 650204 - DNA, 22 bp, Artificial Sequence
  chemically synthesized
atttgagaaacagaaagcaatg

SEQ ID NO: 650205 - DNA, 22 bp, Artificial Sequence
  chemically synthesized
tgggactaatgaacattgcttt

SEQ ID NO: 650206 - DNA, 22 bp, Artificial Sequence
  chemically synthesized
gtgggactaatgaacattgctt

SEQ ID NO: 650207 - DNA, 22 bp, Artificial Sequence
  chemically synthesized
gagaaacagaaagcaatgttca

SEQ ID NO: 650208 - DNA, 22 bp, Artificial Sequence
  chemically synthesized
agaaacagaaagcaatgttcat

SEQ ID NO: 650209 - DNA, 22 bp, Artificial Sequence
  chemically synthesized
ccttgtgggactaatgaacatt

SEQ ID NO: 650210 - DNA, 22 bp, Artificial Sequence
  chemically synthesized
accttgtgggactaatgaacat

SEQ ID NO: 650211 - DNA, 22 bp, Artificial Sequence
  chemically synthesized
atcacttaccttgtgggactaa

SEQ ID NO: 650212 - DNA, 22 bp, Artificial Sequence
  chemically synthesized
attagtcccacaaggtaagtga

SEQ ID NO: 650213 - DNA, 22 bp, Artificial Sequence
  chemically synthesized
gaggcagaaagttaatcactta

SEQ ID NO: 650214 - DNA, 22 bp, Artificial Sequence
  chemically synthesized
gtcccacaaggtaagtgattaa

SEQ ID NO: 650215 - DNA, 22 bp, Artificial Sequence
  chemically synthesized
actttctgcctccagatttttc

SEQ ID NO: 650216 - DNA, 22 bp, Artificial Sequence
  chemically synthesized
taggagaggcaccggaaaaatc

SEQ ID NO: 650217 - DNA, 22 bp, Artificial Sequence
  chemically synthesized
tctgcctccagatttttccggt

SEQ ID NO: 650218 - DNA, 22 bp, Artificial Sequence
  chemically synthesized
ctgcctccagatttttccggtg

SEQ ID NO: 650219 - DNA, 22 bp, Artificial Sequence
  chemically synthesized
tgcctccagatttttccggtgc

SEQ ID NO: 650220 - DNA, 22 bp, Artificial Sequence
  chemically synthesized
cctccagatttttccggtgcct

SEQ ID NO: 650221 - DNA, 22 bp, Artificial Sequence
  chemically synthesized
gtactgtaggagaggcaccgga

SEQ ID NO: 650222 - DNA, 22 bp, Artificial Sequence
  chemically synthesized
ggtactgtaggagaggcaccgg

SEQ ID NO: 650223 - DNA, 22 bp, Artificial Sequence
  chemically synthesized
tggtactgtaggagaggcaccg

SEQ ID NO: 650224 - DNA, 22 bp, Artificial Sequence
  chemically synthesized
cagatttttccggtgcctctcc

SEQ ID NO: 650225 - DNA, 22 bp, Artificial Sequence
  chemically synthesized
ttccggtgcctctcctacagta

SEQ ID NO: 650226 - DNA, 22 bp, Artificial Sequence
  chemically synthesized
tccggtgcctctcctacagtac

SEQ ID NO: 650227 - DNA, 22 bp, Artificial Sequence
  chemically synthesized
ccggtgcctctcctacagtacc

SEQ ID NO: 650228 - DNA, 22 bp, Artificial Sequence
  chemically synthesized
ccaaaatgttttggtactgtag

SEQ ID NO: 650229 - DNA, 22 bp, Artificial Sequence
  chemically synthesized
cggtgcctctcctacagtacca

SEQ ID NO: 650230 - DNA, 22 bp, Artificial Sequence
  chemically synthesized
tgccaaaatgttttggtactgt

SEQ ID NO: 650231 - DNA, 22 bp, Artificial Sequence
  chemically synthesized
ctgccaaaatgttttggtactg

SEQ ID NO: 650232 - DNA, 22 bp, Artificial Sequence
  chemically synthesized
tctgccaaaatgttttggtact

SEQ ID NO: 650233 - DNA, 22 bp, Artificial Sequence
  chemically synthesized
tcctacagtaccaaaacatttt

SEQ ID NO: 650234 - DNA, 22 bp, Artificial Sequence
  chemically synthesized
ctacagtaccaaaacattttgg

SEQ ID NO: 650235 - DNA, 22 bp, Artificial Sequence
  chemically synthesized
cagtaccaaaacattttggcag

SEQ ID NO: 650236 - DNA, 22 bp, Artificial Sequence
  chemically synthesized
taggataatctttctgccaaaa

SEQ ID NO: 650237 - DNA, 22 bp, Artificial Sequence
  chemically synthesized
ataggataatctttctgccaaa

SEQ ID NO: 650238 - DNA, 22 bp, Artificial Sequence
  chemically synthesized
catatgtttataggataatctt

SEQ ID NO: 650239 - DNA, 22 bp, Artificial Sequence
  chemically synthesized
ccatatgtttataggataatct

SEQ ID NO: 650240 - DNA, 22 bp, Artificial Sequence
  chemically synthesized
cttccatatgtttataggataa

SEQ ID NO: 650241 - DNA, 22 bp, Artificial Sequence
  chemically synthesized
tggcagaaagattatcctataa

SEQ ID NO: 650242 - DNA, 22 bp, Artificial Sequence
  chemically synthesized
ggcagaaagattatcctataaa

SEQ ID NO: 650243 - DNA, 22 bp, Artificial Sequence
  chemically synthesized
gcagaaagattatcctataaac

SEQ ID NO: 650244 - DNA, 22 bp, Artificial Sequence
  chemically synthesized
cctccttccatatgtttatagg

SEQ ID NO: 650245 - DNA, 22 bp, Artificial Sequence
  chemically synthesized
ccctccttccatatgtttatag

SEQ ID NO: 650246 - DNA, 22 bp, Artificial Sequence
  chemically synthesized
ttccctccttccatatgtttat

SEQ ID NO: 650247 - DNA, 22 bp, Artificial Sequence
  chemically synthesized
cttccctccttccatatgttta

SEQ ID NO: 650248 - DNA, 22 bp, Artificial Sequence
  chemically synthesized
tcttccctccttccatatgttt

SEQ ID NO: 650249 - DNA, 22 bp, Artificial Sequence
  chemically synthesized
ttcttccctccttccatatgtt

SEQ ID NO: 650250 - DNA, 22 bp, Artificial Sequence
  chemically synthesized
tcctataaacatatggaaggag

SEQ ID NO: 650251 - DNA, 22 bp, Artificial Sequence
  chemically synthesized
agtttttcttccctccttccat

SEQ ID NO: 650252 - DNA, 22 bp, Artificial Sequence
  chemically synthesized
taaacatatggaaggagggaag

SEQ ID NO: 650253 - DNA, 22 bp, Artificial Sequence
  chemically synthesized
aataaaagctgagtttttcttc

SEQ ID NO: 650254 - DNA, 22 bp, Artificial Sequence
  chemically synthesized
aaataaaagctgagtttttctt

SEQ ID NO: 650255 - DNA, 22 bp, Artificial Sequence
  chemically synthesized
gtggagtttaaataaaagctga

SEQ ID NO: 650256 - DNA, 22 bp, Artificial Sequence
  chemically synthesized
ctagtggagtttaaataaaagc

SEQ ID NO: 650257 - DNA, 22 bp, Artificial Sequence
  chemically synthesized
aaagagttcctagtggagttta

SEQ ID NO: 650258 - DNA, 22 bp, Artificial Sequence
  chemically synthesized
agcttttatttaaactccacta

SEQ ID NO: 650259 - DNA, 22 bp, Artificial Sequence
  chemically synthesized
atctcaaagagttcctagtgga

SEQ ID NO: 650260 - DNA, 22 bp, Artificial Sequence
  chemically synthesized
aatctcaaagagttcctagtgg

SEQ ID NO: 650261 - DNA, 22 bp, Artificial Sequence
  chemically synthesized
ttatttaaactccactaggaac

SEQ ID NO: 650262 - DNA, 22 bp, Artificial Sequence
  chemically synthesized
tatttaaactccactaggaact

SEQ ID NO: 650263 - DNA, 22 bp, Artificial Sequence
  chemically synthesized
atttaaactccactaggaactc

SEQ ID NO: 650264 - DNA, 22 bp, Artificial Sequence
  chemically synthesized
cttaatctcaaagagttcctag

SEQ ID NO: 650265 - DNA, 22 bp, Artificial Sequence
  chemically synthesized
tttaaactccactaggaactct

SEQ ID NO: 650266 - DNA, 22 bp, Artificial Sequence
  chemically synthesized
ctacttaatctcaaagagttcc

SEQ ID NO: 650267 - DNA, 22 bp, Artificial Sequence
  chemically synthesized
aaactccactaggaactctttg

SEQ ID NO: 650268 - DNA, 22 bp, Artificial Sequence
  chemically synthesized
cctacttaatctcaaagagttc

SEQ ID NO: 650269 - DNA, 22 bp, Artificial Sequence
  chemically synthesized
aactccactaggaactctttga

SEQ ID NO: 650270 - DNA, 22 bp, Artificial Sequence
  chemically synthesized
cactaggaactctttgagatta

SEQ ID NO: 650271 - DNA, 22 bp, Artificial Sequence
  chemically synthesized
cagtaccttcctacttaatctc

SEQ ID NO: 650272 - DNA, 22 bp, Artificial Sequence
  chemically synthesized
ccagtaccttcctacttaatct

SEQ ID NO: 650273 - DNA, 22 bp, Artificial Sequence
  chemically synthesized
ggaactctttgagattaagtag

SEQ ID NO: 650274 - DNA, 22 bp, Artificial Sequence
  chemically synthesized
tccagtaccttcctacttaatc

SEQ ID NO: 650275 - DNA, 22 bp, Artificial Sequence
  chemically synthesized
tttgagattaagtaggaaggta

SEQ ID NO: 650276 - DNA, 22 bp, Artificial Sequence
  chemically synthesized
gaaattttccagtaccttccta

SEQ ID NO: 650277 - DNA, 22 bp, Artificial Sequence
  chemically synthesized
tgagattaagtaggaaggtact

SEQ ID NO: 650278 - DNA, 22 bp, Artificial Sequence
  chemically synthesized
gagattaagtaggaaggtactg

SEQ ID NO: 650279 - DNA, 22 bp, Artificial Sequence
  chemically synthesized
agattaagtaggaaggtactgg

SEQ ID NO: 650280 - DNA, 22 bp, Artificial Sequence
  chemically synthesized
aaaagactggaaattttccagt

SEQ ID NO: 650281 - DNA, 22 bp, Artificial Sequence
  chemically synthesized
agtaggaaggtactggaaaatt

SEQ ID NO: 650282 - DNA, 22 bp, Artificial Sequence
  chemically synthesized
caaaagactggaaattttccag

SEQ ID NO: 650283 - DNA, 22 bp, Artificial Sequence
  chemically synthesized
tcaaaagactggaaattttcca

SEQ ID NO: 650284 - DNA, 22 bp, Artificial Sequence
  chemically synthesized
gttttcaaaagactggaaattt

SEQ ID NO: 650285 - DNA, 22 bp, Artificial Sequence
  chemically synthesized
ggttttcaaaagactggaaatt

SEQ ID NO: 650286 - DNA, 22 bp, Artificial Sequence
  chemically synthesized
agtatttggttttcaaaagact

SEQ ID NO: 650287 - DNA, 22 bp, Artificial Sequence
  chemically synthesized
gagtatttggttttcaaaagac

SEQ ID NO: 650288 - DNA, 22 bp, Artificial Sequence
  chemically synthesized
gaaaatttccagtcttttgaaa

SEQ ID NO: 650289 - DNA, 22 bp, Artificial Sequence
  chemically synthesized
aatttgagtatttggttttcaa

SEQ ID NO: 650290 - DNA, 22 bp, Artificial Sequence
  chemically synthesized
aaatttgagtatttggttttca

SEQ ID NO: 650291 - DNA, 22 bp, Artificial Sequence
  chemically synthesized
taaatttgagtatttggttttc

SEQ ID NO: 650292 - DNA, 22 bp, Artificial Sequence
  chemically synthesized
ttaaatttgagtatttggtttt

SEQ ID NO: 650293 - DNA, 22 bp, Artificial Sequence
  chemically synthesized
ccagtcttttgaaaaccaaata

SEQ ID NO: 650294 - DNA, 22 bp, Artificial Sequence
  chemically synthesized
cagtcttttgaaaaccaaatac

SEQ ID NO: 650295 - DNA, 22 bp, Artificial Sequence
  chemically synthesized
ttttaaatttgagtatttggtt

SEQ ID NO: 650296 - DNA, 22 bp, Artificial Sequence
  chemically synthesized
ttgaaaaccaaatactcaaatt

SEQ ID NO: 650297 - DNA, 22 bp, Artificial Sequence
  chemically synthesized
gaagttcttttaaatttgagta

SEQ ID NO: 650298 - DNA, 22 bp, Artificial Sequence
  chemically synthesized
tgaaaaccaaatactcaaattt

SEQ ID NO: 650299 - DNA, 22 bp, Artificial Sequence
  chemically synthesized
gaaaaccaaatactcaaattta

SEQ ID NO: 650300 - DNA, 22 bp, Artificial Sequence
  chemically synthesized
aaaaccaaatactcaaatttaa

SEQ ID NO: 650301 - DNA, 22 bp, Artificial Sequence
  chemically synthesized
ctggaagttcttttaaatttga

SEQ ID NO: 650302 - DNA, 22 bp, Artificial Sequence
  chemically synthesized
tcgctcctggaagttcttttaa

SEQ ID NO: 650303 - DNA, 22 bp, Artificial Sequence
  chemically synthesized
aaatttaaaagaacttccagga

SEQ ID NO: 650304 - DNA, 22 bp, Artificial Sequence
  chemically synthesized
aaaagaacttccaggagcgaca

SEQ ID NO: 650305 - DNA, 22 bp, Artificial Sequence
  chemically synthesized
aaagaacttccaggagcgacag

SEQ ID NO: 650306 - DNA, 22 bp, Artificial Sequence
  chemically synthesized
ccaggagcgacagacttacgct

SEQ ID NO: 650307 - DNA, 22 bp, Artificial Sequence
  chemically synthesized
caggagcgacagacttacgctg

SEQ ID NO: 650308 - DNA, 22 bp, Artificial Sequence
  chemically synthesized
tcccatgatgggtaaggggcat

SEQ ID NO: 650309 - DNA, 22 bp, Artificial Sequence
  chemically synthesized
gtcccatgatgggtaaggggca

SEQ ID NO: 650310 - DNA, 22 bp, Artificial Sequence
  chemically synthesized
tgtcccatgatgggtaaggggc

SEQ ID NO: 650311 - DNA, 22 bp, Artificial Sequence
  chemically synthesized
acgctgtgcatgccccttaccc

SEQ ID NO: 650312 - DNA, 22 bp, Artificial Sequence
  chemically synthesized
ttgtcccatgatgggtaagggg

SEQ ID NO: 650313 - DNA, 22 bp, Artificial Sequence
  chemically synthesized
cgctgtgcatgccccttaccca

SEQ ID NO: 650314 - DNA, 22 bp, Artificial Sequence
  chemically synthesized
tgcatgccccttacccatcatg

SEQ ID NO: 650315 - DNA, 22 bp, Artificial Sequence
  chemically synthesized
agaaaacttttgtcccatgatg

SEQ ID NO: 650316 - DNA, 22 bp, Artificial Sequence
  chemically synthesized
cagaaaacttttgtcccatgat

SEQ ID NO: 650317 - DNA, 22 bp, Artificial Sequence
  chemically synthesized
cttcagaaaacttttgtcccat

SEQ ID NO: 650318 - DNA, 22 bp, Artificial Sequence
  chemically synthesized
acccatcatgggacaaaagttt

SEQ ID NO: 650319 - DNA, 22 bp, Artificial Sequence
  chemically synthesized
cccatcatgggacaaaagtttt

SEQ ID NO: 650320 - DNA, 22 bp, Artificial Sequence
  chemically synthesized
aaaataattgcttcagaaaact

SEQ ID NO: 650321 - DNA, 22 bp, Artificial Sequence
  chemically synthesized
gaaaataattgcttcagaaaac

SEQ ID NO: 650322 - DNA, 22 bp, Artificial Sequence
  chemically synthesized
tgaaaataattgcttcagaaaa

SEQ ID NO: 650323 - DNA, 22 bp, Artificial Sequence
  chemically synthesized
acaatgttttgaaaataattgc

SEQ ID NO: 650324 - DNA, 22 bp, Artificial Sequence
  chemically synthesized
gacaatgttttgaaaataattg

SEQ ID NO: 650325 - DNA, 22 bp, Artificial Sequence
  chemically synthesized
tcttgacaatgttttgaaaata

SEQ ID NO: 650326 - DNA, 22 bp, Artificial Sequence
  chemically synthesized
tctgaagcaattattttcaaaa

SEQ ID NO: 650327 - DNA, 22 bp, Artificial Sequence
  chemically synthesized
atcttgacaatgttttgaaaat

SEQ ID NO: 650328 - DNA, 22 bp, Artificial Sequence
  chemically synthesized
ctgaagcaattattttcaaaac

SEQ ID NO: 650329 - DNA, 22 bp, Artificial Sequence
  chemically synthesized
tatcttgacaatgttttgaaaa

SEQ ID NO: 650330 - DNA, 22 bp, Artificial Sequence
  chemically synthesized
tgaagcaattattttcaaaaca

SEQ ID NO: 650331 - DNA, 22 bp, Artificial Sequence
  chemically synthesized
aagcaattattttcaaaacatt

SEQ ID NO: 650332 - DNA, 22 bp, Artificial Sequence
  chemically synthesized
ctttatcttgacaatgttttga

SEQ ID NO: 650333 - DNA, 22 bp, Artificial Sequence
  chemically synthesized
tgaaattgctttatcttgacaa

SEQ ID NO: 650334 - DNA, 22 bp, Artificial Sequence
  chemically synthesized
ttttcaaaacattgtcaagata

SEQ ID NO: 650335 - DNA, 22 bp, Artificial Sequence
  chemically synthesized
gtgaaattgctttatcttgaca

SEQ ID NO: 650336 - DNA, 22 bp, Artificial Sequence
  chemically synthesized
tcaaaacattgtcaagataaag

SEQ ID NO: 650337 - DNA, 22 bp, Artificial Sequence
  chemically synthesized
caaaacattgtcaagataaagc

SEQ ID NO: 650338 - DNA, 22 bp, Artificial Sequence
  chemically synthesized
tcttgtgaaattgctttatctt

SEQ ID NO: 650339 - DNA, 22 bp, Artificial Sequence
  chemically synthesized
aaaacattgtcaagataaagca

SEQ ID NO: 650340 - DNA, 22 bp, Artificial Sequence
  chemically synthesized
gtcttgtgaaattgctttatct

SEQ ID NO: 650341 - DNA, 22 bp, Artificial Sequence
  chemically synthesized
tgtcttgtgaaattgctttatc

SEQ ID NO: 650342 - DNA, 22 bp, Artificial Sequence
  chemically synthesized
ttgtcttgtgaaattgctttat

SEQ ID NO: 650343 - DNA, 22 bp, Artificial Sequence
  chemically synthesized
ttttgtcttgtgaaattgcttt

SEQ ID NO: 650344 - DNA, 22 bp, Artificial Sequence
  chemically synthesized
cttttgtcttgtgaaattgctt

SEQ ID NO: 650345 - DNA, 22 bp, Artificial Sequence
  chemically synthesized
tcaagataaagcaatttcacaa

SEQ ID NO: 650346 - DNA, 22 bp, Artificial Sequence
  chemically synthesized
acatttcttttgtcttgtgaaa

SEQ ID NO: 650347 - DNA, 22 bp, Artificial Sequence
  chemically synthesized
ttcacatttcttttgtcttgtg

SEQ ID NO: 650348 - DNA, 22 bp, Artificial Sequence
  chemically synthesized
gttcacatttcttttgtcttgt

SEQ ID NO: 650349 - DNA, 22 bp, Artificial Sequence
  chemically synthesized
ttgttcacatttcttttgtctt

SEQ ID NO: 650350 - DNA, 22 bp, Artificial Sequence
  chemically synthesized
aaagttcttgttcacatttctt

SEQ ID NO: 650351 - DNA, 22 bp, Artificial Sequence
  chemically synthesized
cacaagacaaaagaaatgtgaa

SEQ ID NO: 650352 - DNA, 22 bp, Artificial Sequence
  chemically synthesized
acaagacaaaagaaatgtgaac

SEQ ID NO: 650353 - DNA, 22 bp, Artificial Sequence
  chemically synthesized
attgaaagttcttgttcacatt

SEQ ID NO: 650354 - DNA, 22 bp, Artificial Sequence
  chemically synthesized
aattgaaagttcttgttcacat

SEQ ID NO: 650355 - DNA, 22 bp, Artificial Sequence
  chemically synthesized
taattgaaagttcttgttcaca

SEQ ID NO: 650356 - DNA, 22 bp, Artificial Sequence
  chemically synthesized
ttttaattgaaagttcttgttc

SEQ ID NO: 650357 - DNA, 22 bp, Artificial Sequence
  chemically synthesized
gttttaattgaaagttcttgtt

SEQ ID NO: 650358 - DNA, 22 bp, Artificial Sequence
  chemically synthesized
aagcgagacttgttttaattga

SEQ ID NO: 650359 - DNA, 22 bp, Artificial Sequence
  chemically synthesized
ttaaagcgagacttgttttaat

SEQ ID NO: 650360 - DNA, 22 bp, Artificial Sequence
  chemically synthesized
tcaattaaaacaagtctcgctt

SEQ ID NO: 650361 - DNA, 22 bp, Artificial Sequence
  chemically synthesized
caattaaaacaagtctcgcttt

SEQ ID NO: 650362 - DNA, 22 bp, Artificial Sequence
  chemically synthesized
gaaaacattattaaagcgagac

SEQ ID NO: 650363 - DNA, 22 bp, Artificial Sequence
  chemically synthesized
aattaaaacaagtctcgcttta

SEQ ID NO: 650364 - DNA, 22 bp, Artificial Sequence
  chemically synthesized
aaacaagtctcgctttaataat

SEQ ID NO: 650365 - DNA, 22 bp, Artificial Sequence
  chemically synthesized
gctttaataatgttttctaatt

SEQ ID NO: 650366 - DNA, 22 bp, Artificial Sequence
  chemically synthesized
taataatgttttctaattgact

SEQ ID NO: 650367 - DNA, 22 bp, Artificial Sequence
  chemically synthesized
aataatgttttctaattgactg

SEQ ID NO: 650368 - DNA, 22 bp, Artificial Sequence
  chemically synthesized
ataatgttttctaattgactga

SEQ ID NO: 650369 - DNA, 22 bp, Artificial Sequence
  chemically synthesized
aagatgaatcgtatcagtcaat

SEQ ID NO: 650370 - DNA, 22 bp, Artificial Sequence
  chemically synthesized
gaagatgaatcgtatcagtcaa

SEQ ID NO: 650371 - DNA, 22 bp, Artificial Sequence
  chemically synthesized
tttgaagatgaatcgtatcagt

SEQ ID NO: 650372 - DNA, 22 bp, Artificial Sequence
  chemically synthesized
tctaattgactgatacgattca

SEQ ID NO: 650373 - DNA, 22 bp, Artificial Sequence
  chemically synthesized
ctaattgactgatacgattcat

SEQ ID NO: 650374 - DNA, 22 bp, Artificial Sequence
  chemically synthesized
taattgactgatacgattcatc

SEQ ID NO: 650375 - DNA, 22 bp, Artificial Sequence
  chemically synthesized
attgactgatacgattcatctt

SEQ ID NO: 650376 - DNA, 22 bp, Artificial Sequence
  chemically synthesized
gagtaactgtttgaagatgaat

SEQ ID NO: 650377 - DNA, 22 bp, Artificial Sequence
  chemically synthesized
actgatacgattcatcttcaaa

SEQ ID NO: 650378 - DNA, 22 bp, Artificial Sequence
  chemically synthesized
attcgagtaactgtttgaagat

SEQ ID NO: 650379 - DNA, 22 bp, Artificial Sequence
  chemically synthesized
atacgattcatcttcaaacagt

SEQ ID NO: 650380 - DNA, 22 bp, Artificial Sequence
  chemically synthesized
atcttcaaacagttactcgaat

SEQ ID NO: 650381 - DNA, 22 bp, Artificial Sequence
  chemically synthesized
caaacagttactcgaatgaact

SEQ ID NO: 650382 - DNA, 22 bp, Artificial Sequence
  chemically synthesized
aaacagttactcgaatgaactc

SEQ ID NO: 650383 - DNA, 22 bp, Artificial Sequence
  chemically synthesized
aagagatagagataaaagagtt

SEQ ID NO: 650384 - DNA, 22 bp, Artificial Sequence
  chemically synthesized
tgaagagatagagataaaagag

SEQ ID NO: 650385 - DNA, 22 bp, Artificial Sequence
  chemically synthesized
ctgaagagatagagataaaaga

SEQ ID NO: 650386 - DNA, 22 bp, Artificial Sequence
  chemically synthesized
ctcgaatgaactcttttatctc

SEQ ID NO: 650387 - DNA, 22 bp, Artificial Sequence
  chemically synthesized
gaatgaactcttttatctctat

SEQ ID NO: 650388 - DNA, 22 bp, Artificial Sequence
  chemically synthesized
ttttatctctatctcttcagaa

SEQ ID NO: 650389 - DNA, 22 bp, Artificial Sequence
  chemically synthesized
ttatctctatctcttcagaaat

SEQ ID NO: 650390 - DNA, 22 bp, Artificial Sequence
  chemically synthesized
tatctctatctcttcagaaatc

SEQ ID NO: 650391 - DNA, 22 bp, Artificial Sequence
  chemically synthesized
atctctatctcttcagaaatct

SEQ ID NO: 650392 - DNA, 22 bp, Artificial Sequence
  chemically synthesized
tctctatctcttcagaaatctc

SEQ ID NO: 650393 - DNA, 22 bp, Artificial Sequence
  chemically synthesized
taggtaatggggtgagagattt

SEQ ID NO: 650394 - DNA, 22 bp, Artificial Sequence
  chemically synthesized
tatctcttcagaaatctctcac

SEQ ID NO: 650395 - DNA, 22 bp, Artificial Sequence
  chemically synthesized
gtaggtaatggggtgagagatt

SEQ ID NO: 650396 - DNA, 22 bp, Artificial Sequence
  chemically synthesized
tctcttcagaaatctctcaccc

SEQ ID NO: 650397 - DNA, 22 bp, Artificial Sequence
  chemically synthesized
ttcagaaatctctcaccccatt

SEQ ID NO: 650398 - DNA, 22 bp, Artificial Sequence
  chemically synthesized
tcatttgtaggtaatggggtga

SEQ ID NO: 650399 - DNA, 22 bp, Artificial Sequence
  chemically synthesized
cagaaatctctcaccccattac

SEQ ID NO: 650400 - DNA, 22 bp, Artificial Sequence
  chemically synthesized
agaaatctctcaccccattacc

SEQ ID NO: 650401 - DNA, 22 bp, Artificial Sequence
  chemically synthesized
agttatcatttgtaggtaatgg

SEQ ID NO: 650402 - DNA, 22 bp, Artificial Sequence
  chemically synthesized
cagttatcatttgtaggtaatg

SEQ ID NO: 650403 - DNA, 22 bp, Artificial Sequence
  chemically synthesized
tcaccccattacctacaaatga

SEQ ID NO: 650404 - DNA, 22 bp, Artificial Sequence
  chemically synthesized
gggcttcagttatcatttgtag

SEQ ID NO: 650405 - DNA, 22 bp, Artificial Sequence
  chemically synthesized
ggggcttcagttatcatttgta

SEQ ID NO: 650406 - DNA, 22 bp, Artificial Sequence
  chemically synthesized
accccattacctacaaatgata

SEQ ID NO: 650407 - DNA, 22 bp, Artificial Sequence
  chemically synthesized
ttggggcttcagttatcatttg

SEQ ID NO: 650408 - DNA, 22 bp, Artificial Sequence
  chemically synthesized
tcttggggcttcagttatcatt

SEQ ID NO: 650409 - DNA, 22 bp, Artificial Sequence
  chemically synthesized
cctacaaatgataactgaagcc

SEQ ID NO: 650410 - DNA, 22 bp, Artificial Sequence
  chemically synthesized
atgttctcttggggcttcagtt

SEQ ID NO: 650411 - DNA, 22 bp, Artificial Sequence
  chemically synthesized
catgttctcttggggcttcagt

SEQ ID NO: 650412 - DNA, 22 bp, Artificial Sequence
  chemically synthesized
caaatgataactgaagccccaa

SEQ ID NO: 650413 - DNA, 22 bp, Artificial Sequence
  chemically synthesized
atccaaatttcatgttctcttg

SEQ ID NO: 650414 - DNA, 22 bp, Artificial Sequence
  chemically synthesized
aagccccaagagaacatgaaat

SEQ ID NO: 650415 - DNA, 22 bp, Artificial Sequence
  chemically synthesized
catctaatccaaatttcatgtt

SEQ ID NO: 650416 - DNA, 22 bp, Artificial Sequence
  chemically synthesized
ccatctaatccaaatttcatgt

SEQ ID NO: 650417 - DNA, 22 bp, Artificial Sequence
  chemically synthesized
ttccatctaatccaaatttcat

SEQ ID NO: 650418 - DNA, 22 bp, Artificial Sequence
  chemically synthesized
taaattcttccatctaatccaa

SEQ ID NO: 650419 - DNA, 22 bp, Artificial Sequence
  chemically synthesized
cagattataaattcttccatct

SEQ ID NO: 650420 - DNA, 22 bp, Artificial Sequence
  chemically synthesized
acagattataaattcttccatc

SEQ ID NO: 650421 - DNA, 22 bp, Artificial Sequence
  chemically synthesized
ggattagatggaagaatttata

SEQ ID NO: 650422 - DNA, 22 bp, Artificial Sequence
  chemically synthesized
gtatttacagattataaattct

SEQ ID NO: 650423 - DNA, 22 bp, Artificial Sequence
  chemically synthesized
gattagatggaagaatttataa

SEQ ID NO: 650424 - DNA, 22 bp, Artificial Sequence
  chemically synthesized
gatggaagaatttataatctgt

SEQ ID NO: 650425 - DNA, 22 bp, Artificial Sequence
  chemically synthesized
ataatctgtaaatactagttgg

SEQ ID NO: 650426 - DNA, 22 bp, Artificial Sequence
  chemically synthesized
taatctgtaaatactagttggt

SEQ ID NO: 650427 - DNA, 22 bp, Artificial Sequence
  chemically synthesized
ataatggaggaaatgtaccaac

SEQ ID NO: 650428 - DNA, 22 bp, Artificial Sequence
  chemically synthesized
tgataatggaggaaatgtacca

SEQ ID NO: 650429 - DNA, 22 bp, Artificial Sequence
  chemically synthesized
taaatactagttggtacatttc

SEQ ID NO: 650430 - DNA, 22 bp, Artificial Sequence
  chemically synthesized
gttggtacatttcctccattat

SEQ ID NO: 650431 - DNA, 22 bp, Artificial Sequence
  chemically synthesized
gtacatttcctccattatcaga

SEQ ID NO: 650432 - DNA, 22 bp, Artificial Sequence
  chemically synthesized
cctccattatcagaatgcgata

SEQ ID NO: 650433 - DNA, 22 bp, Artificial Sequence
  chemically synthesized
ctccattatcagaatgcgatat

SEQ ID NO: 650434 - DNA, 22 bp, Artificial Sequence
  chemically synthesized
cattatcagaatgcgatattct

SEQ ID NO: 650435 - DNA, 22 bp, Artificial Sequence
  chemically synthesized
tcagaatgcgatattctttgtt

SEQ ID NO: 650436 - DNA, 22 bp, Artificial Sequence
  chemically synthesized
agaaagcaaaaggcaggagagt

SEQ ID NO: 650437 - DNA, 22 bp, Artificial Sequence
  chemically synthesized
tttgtttcatactctcctgcct

SEQ ID NO: 650438 - DNA, 22 bp, Artificial Sequence
  chemically synthesized
tgtttcatactctcctgccttt

SEQ ID NO: 650439 - DNA, 22 bp, Artificial Sequence
  chemically synthesized
tctgagaaagcaaaaggcagga

SEQ ID NO: 650440 - DNA, 22 bp, Artificial Sequence
  chemically synthesized
gtttcatactctcctgcctttt

SEQ ID NO: 650441 - DNA, 22 bp, Artificial Sequence
  chemically synthesized
atctgagaaagcaaaaggcagg

SEQ ID NO: 650442 - DNA, 22 bp, Artificial Sequence
  chemically synthesized
tttcatactctcctgccttttg

SEQ ID NO: 650443 - DNA, 22 bp, Artificial Sequence
  chemically synthesized
ttatctgagaaagcaaaaggca

SEQ ID NO: 650444 - DNA, 22 bp, Artificial Sequence
  chemically synthesized
catactctcctgccttttgctt

SEQ ID NO: 650445 - DNA, 22 bp, Artificial Sequence
  chemically synthesized
atactctcctgccttttgcttt

SEQ ID NO: 650446 - DNA, 22 bp, Artificial Sequence
  chemically synthesized
aggttcttatctgagaaagcaa

SEQ ID NO: 650447 - DNA, 22 bp, Artificial Sequence
  chemically synthesized
tcctgccttttgctttctcaga

SEQ ID NO: 650448 - DNA, 22 bp, Artificial Sequence
  chemically synthesized
gctaaggttcttatctgagaaa

SEQ ID NO: 650449 - DNA, 22 bp, Artificial Sequence
  chemically synthesized
ctgccttttgctttctcagata

SEQ ID NO: 650450 - DNA, 22 bp, Artificial Sequence
  chemically synthesized
ccttttgctttctcagataaga

SEQ ID NO: 650451 - DNA, 22 bp, Artificial Sequence
  chemically synthesized
aattggctaaggttcttatctg

SEQ ID NO: 650452 - DNA, 22 bp, Artificial Sequence
  chemically synthesized
gaattggctaaggttcttatct

SEQ ID NO: 650453 - DNA, 22 bp, Artificial Sequence
  chemically synthesized
ttgctttctcagataagaacct

SEQ ID NO: 650454 - DNA, 22 bp, Artificial Sequence
  chemically synthesized
tgctttctcagataagaacctt

SEQ ID NO: 650455 - DNA, 22 bp, Artificial Sequence
  chemically synthesized
tttgaattggctaaggttctta

SEQ ID NO: 650456 - DNA, 22 bp, Artificial Sequence
  chemically synthesized
gctttctcagataagaacctta

SEQ ID NO: 650457 - DNA, 22 bp, Artificial Sequence
  chemically synthesized
atttgaattggctaaggttctt

SEQ ID NO: 650458 - DNA, 22 bp, Artificial Sequence
  chemically synthesized
ctttctcagataagaaccttag

SEQ ID NO: 650459 - DNA, 22 bp, Artificial Sequence
  chemically synthesized
tctcagataagaaccttagcca

SEQ ID NO: 650460 - DNA, 22 bp, Artificial Sequence
  chemically synthesized
ctcagataagaaccttagccaa

SEQ ID NO: 650461 - DNA, 22 bp, Artificial Sequence
  chemically synthesized
tcagataagaaccttagccaat

SEQ ID NO: 650462 - DNA, 22 bp, Artificial Sequence
  chemically synthesized
agataagaaccttagccaattc

SEQ ID NO: 650463 - DNA, 22 bp, Artificial Sequence
  chemically synthesized
agccaattcaaataaacatatt

SEQ ID NO: 650464 - DNA, 22 bp, Artificial Sequence
  chemically synthesized
gccaattcaaataaacatattt

SEQ ID NO: 650465 - DNA, 22 bp, Artificial Sequence
  chemically synthesized
cccatatgtgacataagaaata

SEQ ID NO: 650466 - DNA, 22 bp, Artificial Sequence
  chemically synthesized
ccccatatgtgacataagaaat

SEQ ID NO: 650467 - DNA, 22 bp, Artificial Sequence
  chemically synthesized
aaataaacatatttcttatgtc

SEQ ID NO: 650468 - DNA, 22 bp, Artificial Sequence
  chemically synthesized
ccacttccccatatgtgacata

SEQ ID NO: 650469 - DNA, 22 bp, Artificial Sequence
  chemically synthesized
cccacttccccatatgtgacat

SEQ ID NO: 650470 - DNA, 22 bp, Artificial Sequence
  chemically synthesized
cttcccacttccccatatgtga

SEQ ID NO: 650471 - DNA, 22 bp, Artificial Sequence
  chemically synthesized
ccttcccacttccccatatgtg

SEQ ID NO: 650472 - DNA, 22 bp, Artificial Sequence
  chemically synthesized
tccttcccacttccccatatgt

SEQ ID NO: 650473 - DNA, 22 bp, Artificial Sequence
  chemically synthesized
cttatgtcacatatggggaagt

SEQ ID NO: 650474 - DNA, 22 bp, Artificial Sequence
  chemically synthesized
ttatgtcacatatggggaagtg

SEQ ID NO: 650475 - DNA, 22 bp, Artificial Sequence
  chemically synthesized
atgtcacatatggggaagtggg

SEQ ID NO: 650476 - DNA, 22 bp, Artificial Sequence
  chemically synthesized
tgtcacatatggggaagtggga

SEQ ID NO: 650477 - DNA, 22 bp, Artificial Sequence
  chemically synthesized
aaaaagatagctttccttccca

SEQ ID NO: 650478 - DNA, 22 bp, Artificial Sequence
  chemically synthesized
gaatctaaaaaagatagctttc

SEQ ID NO: 650479 - DNA, 22 bp, Artificial Sequence
  chemically synthesized
aaagatggctggaatctaaaaa

SEQ ID NO: 650480 - DNA, 22 bp, Artificial Sequence
  chemically synthesized
gaaagatggctggaatctaaaa

SEQ ID NO: 650481 - DNA, 22 bp, Artificial Sequence
  chemically synthesized
ttgaaagatggctggaatctaa

SEQ ID NO: 650482 - DNA, 22 bp, Artificial Sequence
  chemically synthesized
tcttttttagattccagccatc

SEQ ID NO: 650483 - DNA, 22 bp, Artificial Sequence
  chemically synthesized
tccccctcttgaaagatggctg

SEQ ID NO: 650484 - DNA, 22 bp, Artificial Sequence
  chemically synthesized
ttttagattccagccatctttc

SEQ ID NO: 650485 - DNA, 22 bp, Artificial Sequence
  chemically synthesized
tttagattccagccatctttca

SEQ ID NO: 650486 - DNA, 22 bp, Artificial Sequence
  chemically synthesized
ctgtccccctcttgaaagatgg

SEQ ID NO: 650487 - DNA, 22 bp, Artificial Sequence
  chemically synthesized
ttagattccagccatctttcaa

SEQ ID NO: 650488 - DNA, 22 bp, Artificial Sequence
  chemically synthesized
tagattccagccatctttcaag

SEQ ID NO: 650489 - DNA, 22 bp, Artificial Sequence
  chemically synthesized
agattccagccatctttcaaga

SEQ ID NO: 650490 - DNA, 22 bp, Artificial Sequence
  chemically synthesized
ctcctgtccccctcttgaaaga

SEQ ID NO: 650491 - DNA, 22 bp, Artificial Sequence
  chemically synthesized
gattccagccatctttcaagag

SEQ ID NO: 650492 - DNA, 22 bp, Artificial Sequence
  chemically synthesized
attcctcctgtccccctcttga

SEQ ID NO: 650493 - DNA, 22 bp, Artificial Sequence
  chemically synthesized
cagccatctttcaagaggggga

SEQ ID NO: 650494 - DNA, 22 bp, Artificial Sequence
  chemically synthesized
tcattcctcctgtccccctctt

SEQ ID NO: 650495 - DNA, 22 bp, Artificial Sequence
  chemically synthesized
ctcattcctcctgtccccctct

SEQ ID NO: 650496 - DNA, 22 bp, Artificial Sequence
  chemically synthesized
tcaagagggggacaggaggaat

SEQ ID NO: 650497 - DNA, 22 bp, Artificial Sequence
  chemically synthesized
caagagggggacaggaggaatg

SEQ ID NO: 650498 - DNA, 22 bp, Artificial Sequence
  chemically synthesized
aagagggggacaggaggaatga

SEQ ID NO: 650499 - DNA, 22 bp, Artificial Sequence
  chemically synthesized
ggacccagcacttctcattcct

SEQ ID NO: 650500 - DNA, 22 bp, Artificial Sequence
  chemically synthesized
aggacccagcacttctcattcc

SEQ ID NO: 650501 - DNA, 22 bp, Artificial Sequence
  chemically synthesized
taggacccagcacttctcattc

SEQ ID NO: 650502 - DNA, 22 bp, Artificial Sequence
  chemically synthesized
ttttaggacccagcacttctca

SEQ ID NO: 650503 - DNA, 22 bp, Artificial Sequence
  chemically synthesized
tattattttaggacccagcact

SEQ ID NO: 650504 - DNA, 22 bp, Artificial Sequence
  chemically synthesized
tcatattatattattttaggac

SEQ ID NO: 650505 - DNA, 22 bp, Artificial Sequence
  chemically synthesized
atcatattatattattttagga

SEQ ID NO: 650506 - DNA, 22 bp, Artificial Sequence
  chemically synthesized
cccttatcatattatattattt

SEQ ID NO: 650507 - DNA, 22 bp, Artificial Sequence
  chemically synthesized
gcccttatcatattatattatt

SEQ ID NO: 650508 - DNA, 22 bp, Artificial Sequence
  chemically synthesized
tgcccttatcatattatattat

SEQ ID NO: 650509 - DNA, 22 bp, Artificial Sequence
  chemically synthesized
ttgcccttatcatattatatta

SEQ ID NO: 650510 - DNA, 22 bp, Artificial Sequence
  chemically synthesized
ggtcctaaaataatataatatg

SEQ ID NO: 650511 - DNA, 22 bp, Artificial Sequence
  chemically synthesized
ttttgcccttatcatattatat

SEQ ID NO: 650512 - DNA, 22 bp, Artificial Sequence
  chemically synthesized
aattcttttgcccttatcatat

SEQ ID NO: 650513 - DNA, 22 bp, Artificial Sequence
  chemically synthesized
caattcttttgcccttatcata

SEQ ID NO: 650514 - DNA, 22 bp, Artificial Sequence
  chemically synthesized
aaataatataatatgataaggg

SEQ ID NO: 650515 - DNA, 22 bp, Artificial Sequence
  chemically synthesized
accttcaattcttttgccctta

SEQ ID NO: 650516 - DNA, 22 bp, Artificial Sequence
  chemically synthesized
caccttcaattcttttgccctt

SEQ ID NO: 650517 - DNA, 22 bp, Artificial Sequence
  chemically synthesized
tcaccttcaattcttttgccct

SEQ ID NO: 650518 - DNA, 22 bp, Artificial Sequence
  chemically synthesized
aaagagcactttcaccttcaat

SEQ ID NO: 650519 - DNA, 22 bp, Artificial Sequence
  chemically synthesized
gaggatctgaaagagcactttc

SEQ ID NO: 650520 - DNA, 22 bp, Artificial Sequence
  chemically synthesized
ggaggatctgaaagagcacttt

SEQ ID NO: 650521 - DNA, 22 bp, Artificial Sequence
  chemically synthesized
aaggtgaaagtgctctttcaga

SEQ ID NO: 650522 - DNA, 22 bp, Artificial Sequence
  chemically synthesized
tttcagatcctccaaggcattc

SEQ ID NO: 650523 - DNA, 22 bp, Artificial Sequence
  chemically synthesized
tcagatcctccaaggcattctt

SEQ ID NO: 650524 - DNA, 22 bp, Artificial Sequence
  chemically synthesized
cagatcctccaaggcattcttc

SEQ ID NO: 650525 - DNA, 22 bp, Artificial Sequence
  chemically synthesized
taaaataaagaagaagaatgcc

SEQ ID NO: 650526 - DNA, 22 bp, Artificial Sequence
  chemically synthesized
agatcctccaaggcattcttct

SEQ ID NO: 650527 - DNA, 22 bp, Artificial Sequence
  chemically synthesized
ataaaataaagaagaagaatgc

SEQ ID NO: 650528 - DNA, 22 bp, Artificial Sequence
  chemically synthesized
tataaaataaagaagaagaatg

SEQ ID NO: 650529 - DNA, 22 bp, Artificial Sequence
  chemically synthesized
ttataaaataaagaagaagaat

SEQ ID NO: 650530 - DNA, 22 bp, Artificial Sequence
  chemically synthesized
caaggcattcttcttctttatt

SEQ ID NO: 650531 - DNA, 22 bp, Artificial Sequence
  chemically synthesized
ttcttctttattttataaaaat

SEQ ID NO: 650532 - DNA, 22 bp, Artificial Sequence
  chemically synthesized
tatacaagggaaatttttataa

SEQ ID NO: 650533 - DNA, 22 bp, Artificial Sequence
  chemically synthesized
gtatacaagggaaatttttata

SEQ ID NO: 650534 - DNA, 22 bp, Artificial Sequence
  chemically synthesized
cttctttattttataaaaattt

SEQ ID NO: 650535 - DNA, 22 bp, Artificial Sequence
  chemically synthesized
tgtatacaagggaaatttttat

SEQ ID NO: 650536 - DNA, 22 bp, Artificial Sequence
  chemically synthesized
ttctttattttataaaaatttc

SEQ ID NO: 650537 - DNA, 22 bp, Artificial Sequence
  chemically synthesized
ctttattttataaaaatttccc

SEQ ID NO: 650538 - DNA, 22 bp, Artificial Sequence
  chemically synthesized
tttattttataaaaatttccct

SEQ ID NO: 650539 - DNA, 22 bp, Artificial Sequence
  chemically synthesized
tattttataaaaatttcccttg

SEQ ID NO: 650540 - DNA, 22 bp, Artificial Sequence
  chemically synthesized
attttataaaaatttcccttgt

SEQ ID NO: 650541 - DNA, 22 bp, Artificial Sequence
  chemically synthesized
ttttataaaaatttcccttgta

SEQ ID NO: 650542 - DNA, 22 bp, Artificial Sequence
  chemically synthesized
gtgggctttgtatacaagggaa

SEQ ID NO: 650543 - DNA, 22 bp, Artificial Sequence
  chemically synthesized
tataaaaatttcccttgtatac

SEQ ID NO: 650544 - DNA, 22 bp, Artificial Sequence
  chemically synthesized
ataaaaatttcccttgtataca

SEQ ID NO: 650545 - DNA, 22 bp, Artificial Sequence
  chemically synthesized
gctagtgggctttgtatacaag

SEQ ID NO: 650546 - DNA, 22 bp, Artificial Sequence
  chemically synthesized
taaaaatttcccttgtatacaa

SEQ ID NO: 650547 - DNA, 22 bp, Artificial Sequence
  chemically synthesized
agctagtgggctttgtatacaa

SEQ ID NO: 650548 - DNA, 22 bp, Artificial Sequence
  chemically synthesized
cttagctagtgggctttgtata

SEQ ID NO: 650549 - DNA, 22 bp, Artificial Sequence
  chemically synthesized
ccttagctagtgggctttgtat

SEQ ID NO: 650550 - DNA, 22 bp, Artificial Sequence
  chemically synthesized
cttccttagctagtgggctttg

SEQ ID NO: 650551 - DNA, 22 bp, Artificial Sequence
  chemically synthesized
cccttgtatacaaagcccacta

SEQ ID NO: 650552 - DNA, 22 bp, Artificial Sequence
  chemically synthesized
tgcttccttagctagtgggctt

SEQ ID NO: 650553 - DNA, 22 bp, Artificial Sequence
  chemically synthesized
ccttgtatacaaagcccactag

SEQ ID NO: 650554 - DNA, 22 bp, Artificial Sequence
  chemically synthesized
tctgcttccttagctagtgggc

SEQ ID NO: 650555 - DNA, 22 bp, Artificial Sequence
  chemically synthesized
ctctgcttccttagctagtggg

SEQ ID NO: 650556 - DNA, 22 bp, Artificial Sequence
  chemically synthesized
tctctgcttccttagctagtgg

SEQ ID NO: 650557 - DNA, 22 bp, Artificial Sequence
  chemically synthesized
gtatacaaagcccactagctaa

SEQ ID NO: 650558 - DNA, 22 bp, Artificial Sequence
  chemically synthesized
ttctctgcttccttagctagtg

SEQ ID NO: 650559 - DNA, 22 bp, Artificial Sequence
  chemically synthesized
tatacaaagcccactagctaag

SEQ ID NO: 650560 - DNA, 22 bp, Artificial Sequence
  chemically synthesized
ccttttctctgcttccttagct

SEQ ID NO: 650561 - DNA, 22 bp, Artificial Sequence
  chemically synthesized
agctaccttttctctgcttcct

SEQ ID NO: 650562 - DNA, 22 bp, Artificial Sequence
  chemically synthesized
taagctaccttttctctgcttc

SEQ ID NO: 650563 - DNA, 22 bp, Artificial Sequence
  chemically synthesized
ctaagctaccttttctctgctt

SEQ ID NO: 650564 - DNA, 22 bp, Artificial Sequence
  chemically synthesized
gctaaggaagcagagaaaaggt

SEQ ID NO: 650565 - DNA, 22 bp, Artificial Sequence
  chemically synthesized
gatttctaagctaccttttctc

SEQ ID NO: 650566 - DNA, 22 bp, Artificial Sequence
  chemically synthesized
aggaagcagagaaaaggtagct

SEQ ID NO: 650567 - DNA, 22 bp, Artificial Sequence
  chemically synthesized
cattagatttctaagctacctt

SEQ ID NO: 650568 - DNA, 22 bp, Artificial Sequence
  chemically synthesized
agaaatctaatgcagtcactgt

SEQ ID NO: 650569 - DNA, 22 bp, Artificial Sequence
  chemically synthesized
gaaatctaatgcagtcactgtg

SEQ ID NO: 650570 - DNA, 22 bp, Artificial Sequence
  chemically synthesized
atgcagtcactgtggcttccct

SEQ ID NO: 650571 - DNA, 22 bp, Artificial Sequence
  chemically synthesized
tggcttcccttccccactcccc

SEQ ID NO: 650572 - DNA, 22 bp, Artificial Sequence
  chemically synthesized
cccttccccactccccaccccc

SEQ ID NO: 650573 - DNA, 22 bp, Artificial Sequence
  chemically synthesized
ccttccccactccccaccccca

SEQ ID NO: 650574 - DNA, 22 bp, Artificial Sequence
  chemically synthesized
ccccactccccacccccatggt

SEQ ID NO: 650575 - DNA, 22 bp, Artificial Sequence
  chemically synthesized
cccactccccacccccatggta

SEQ ID NO: 650576 - DNA, 22 bp, Artificial Sequence
  chemically synthesized
gcaggtaaaaatgataccatgg

SEQ ID NO: 650577 - DNA, 22 bp, Artificial Sequence
  chemically synthesized
ggcaggtaaaaatgataccatg

SEQ ID NO: 650578 - DNA, 22 bp, Artificial Sequence
  chemically synthesized
ttggcaggtaaaaatgatacca

SEQ ID NO: 650579 - DNA, 22 bp, Artificial Sequence
  chemically synthesized
cttggcaggtaaaaatgatacc

SEQ ID NO: 650580 - DNA, 22 bp, Artificial Sequence
  chemically synthesized
cccacccccatggtatcatttt

SEQ ID NO: 650581 - DNA, 22 bp, Artificial Sequence
  chemically synthesized
ccggtttcttggcaggtaaaaa

SEQ ID NO: 650582 - DNA, 22 bp, Artificial Sequence
  chemically synthesized
cccggtttcttggcaggtaaaa

SEQ ID NO: 650583 - DNA, 22 bp, Artificial Sequence
  chemically synthesized
cttcccggtttcttggcaggta

SEQ ID NO: 650584 - DNA, 22 bp, Artificial Sequence
  chemically synthesized
ccttcccggtttcttggcaggt

SEQ ID NO: 650585 - DNA, 22 bp, Artificial Sequence
  chemically synthesized
tccttcccggtttcttggcagg

SEQ ID NO: 650586 - DNA, 22 bp, Artificial Sequence
  chemically synthesized
tttccttcccggtttcttggca

SEQ ID NO: 650587 - DNA, 22 bp, Artificial Sequence
  chemically synthesized
ctttccttcccggtttcttggc

SEQ ID NO: 650588 - DNA, 22 bp, Artificial Sequence
  chemically synthesized
ttacctgccaagaaaccgggaa

SEQ ID NO: 650589 - DNA, 22 bp, Artificial Sequence
  chemically synthesized
tacctgccaagaaaccgggaag

SEQ ID NO: 650590 - DNA, 22 bp, Artificial Sequence
  chemically synthesized
acctgccaagaaaccgggaagg

SEQ ID NO: 650591 - DNA, 22 bp, Artificial Sequence
  chemically synthesized
cctgccaagaaaccgggaagga

SEQ ID NO: 650592 - DNA, 22 bp, Artificial Sequence
  chemically synthesized
ccaagaaaccgggaaggaaaga

SEQ ID NO: 650593 - DNA, 22 bp, Artificial Sequence
  chemically synthesized
caaaggtcaccttctttccttc

SEQ ID NO: 650594 - DNA, 22 bp, Artificial Sequence
  chemically synthesized
gcaaaggtcaccttctttcctt

SEQ ID NO: 650595 - DNA, 22 bp, Artificial Sequence
  chemically synthesized
cttgcaaaggtcaccttctttc

SEQ ID NO: 650596 - DNA, 22 bp, Artificial Sequence
  chemically synthesized
gatagacaacagtgagtaggta

SEQ ID NO: 650597 - DNA, 22 bp, Artificial Sequence
  chemically synthesized
tgcaagcagtacctactcactg

SEQ ID NO: 650598 - DNA, 22 bp, Artificial Sequence
  chemically synthesized
gcaagcagtacctactcactgt

SEQ ID NO: 650599 - DNA, 22 bp, Artificial Sequence
  chemically synthesized
caagcagtacctactcactgtt

SEQ ID NO: 650600 - DNA, 22 bp, Artificial Sequence
  chemically synthesized
aagcctagatagacaacagtga

SEQ ID NO: 650601 - DNA, 22 bp, Artificial Sequence
  chemically synthesized
tgaagcctagatagacaacagt

SEQ ID NO: 650602 - DNA, 22 bp, Artificial Sequence
  chemically synthesized
ctgaagcctagatagacaacag

SEQ ID NO: 650603 - DNA, 22 bp, Artificial Sequence
  chemically synthesized
gaggtttctgaagcctagatag

SEQ ID NO: 650604 - DNA, 22 bp, Artificial Sequence
  chemically synthesized
ctcactgttgtctatctaggct

SEQ ID NO: 650605 - DNA, 22 bp, Artificial Sequence
  chemically synthesized
agaggtttctgaagcctagata

SEQ ID NO: 650606 - DNA, 22 bp, Artificial Sequence
  chemically synthesized
tagaggtttctgaagcctagat

SEQ ID NO: 650607 - DNA, 22 bp, Artificial Sequence
  chemically synthesized
ttagaggtttctgaagcctaga

SEQ ID NO: 650608 - DNA, 22 bp, Artificial Sequence
  chemically synthesized
actgttgtctatctaggcttca

SEQ ID NO: 650609 - DNA, 22 bp, Artificial Sequence
  chemically synthesized
ttgtctatctaggcttcagaaa

SEQ ID NO: 650610 - DNA, 22 bp, Artificial Sequence
  chemically synthesized
tctatctaggcttcagaaacct

SEQ ID NO: 650611 - DNA, 22 bp, Artificial Sequence
  chemically synthesized
caaaaacttttagaggtttctg

SEQ ID NO: 650612 - DNA, 22 bp, Artificial Sequence
  chemically synthesized
acaaaaacttttagaggtttct

SEQ ID NO: 650613 - DNA, 22 bp, Artificial Sequence
  chemically synthesized
tacaaaaacttttagaggtttc

SEQ ID NO: 650614 - DNA, 22 bp, Artificial Sequence
  chemically synthesized
tctaggcttcagaaacctctaa

SEQ ID NO: 650615 - DNA, 22 bp, Artificial Sequence
  chemically synthesized
ggcttcagaaacctctaaaagt

SEQ ID NO: 650616 - DNA, 22 bp, Artificial Sequence
  chemically synthesized
cagaaacctctaaaagtttttg

SEQ ID NO: 650617 - DNA, 22 bp, Artificial Sequence
  chemically synthesized
agaaacctctaaaagtttttgt

SEQ ID NO: 650618 - DNA, 22 bp, Artificial Sequence
  chemically synthesized
caaagaggttttacaaaaactt

SEQ ID NO: 650619 - DNA, 22 bp, Artificial Sequence
  chemically synthesized
acaaagaggttttacaaaaact

SEQ ID NO: 650620 - DNA, 22 bp, Artificial Sequence
  chemically synthesized
tttacaaagaggttttacaaaa

SEQ ID NO: 650621 - DNA, 22 bp, Artificial Sequence
  chemically synthesized
taaaagtttttgtaaaacctct

SEQ ID NO: 650622 - DNA, 22 bp, Artificial Sequence
  chemically synthesized
aaagtttttgtaaaacctcttt

SEQ ID NO: 650623 - DNA, 22 bp, Artificial Sequence
  chemically synthesized
catagtcatgctgtttacaaag

SEQ ID NO: 650624 - DNA, 22 bp, Artificial Sequence
  chemically synthesized
ttgtaaaacctctttgtaaaca

SEQ ID NO: 650625 - DNA, 22 bp, Artificial Sequence
  chemically synthesized
tgtaaaacctctttgtaaacag

SEQ ID NO: 650626 - DNA, 22 bp, Artificial Sequence
  chemically synthesized
gtaaaacctctttgtaaacagc

SEQ ID NO: 650627 - DNA, 22 bp, Artificial Sequence
  chemically synthesized
ttccatagtcatgctgtttaca

SEQ ID NO: 650628 - DNA, 22 bp, Artificial Sequence
  chemically synthesized
taaaacctctttgtaaacagca

SEQ ID NO: 650629 - DNA, 22 bp, Artificial Sequence
  chemically synthesized
ttgttccatagtcatgctgttt

SEQ ID NO: 650630 - DNA, 22 bp, Artificial Sequence
  chemically synthesized
attgttccatagtcatgctgtt

SEQ ID NO: 650631 - DNA, 22 bp, Artificial Sequence
  chemically synthesized
tttgtaaacagcatgactatgg

SEQ ID NO: 650632 - DNA, 22 bp, Artificial Sequence
  chemically synthesized
gtgtttattgttccatagtcat

SEQ ID NO: 650633 - DNA, 22 bp, Artificial Sequence
  chemically synthesized
ggtgtttattgttccatagtca

SEQ ID NO: 650634 - DNA, 22 bp, Artificial Sequence
  chemically synthesized
tgtaaacagcatgactatggaa

SEQ ID NO: 650635 - DNA, 22 bp, Artificial Sequence
  chemically synthesized
tggtgtttattgttccatagtc

SEQ ID NO: 650636 - DNA, 22 bp, Artificial Sequence
  chemically synthesized
gtaaacagcatgactatggaac

SEQ ID NO: 650637 - DNA, 22 bp, Artificial Sequence
  chemically synthesized
ttggtgtttattgttccatagt

SEQ ID NO: 650638 - DNA, 22 bp, Artificial Sequence
  chemically synthesized
taaacagcatgactatggaaca

SEQ ID NO: 650639 - DNA, 22 bp, Artificial Sequence
  chemically synthesized
cttttggtgtttattgttccat

SEQ ID NO: 650640 - DNA, 22 bp, Artificial Sequence
  chemically synthesized
acttttggtgtttattgttcca

SEQ ID NO: 650641 - DNA, 22 bp, Artificial Sequence
  chemically synthesized
tacttttggtgtttattgttcc

SEQ ID NO: 650642 - DNA, 22 bp, Artificial Sequence
  chemically synthesized
ttacttttggtgtttattgttc

SEQ ID NO: 650643 - DNA, 22 bp, Artificial Sequence
  chemically synthesized
tttacttttggtgtttattgtt

SEQ ID NO: 650644 - DNA, 22 bp, Artificial Sequence
  chemically synthesized
ttttacttttggtgtttattgt

SEQ ID NO: 650645 - DNA, 22 bp, Artificial Sequence
  chemically synthesized
tggaacaataaacaccaaaagt

SEQ ID NO: 650646 - DNA, 22 bp, Artificial Sequence
  chemically synthesized
atagtgcttttttacttttggt

SEQ ID NO: 650647 - DNA, 22 bp, Artificial Sequence
  chemically synthesized
ttcatagtgcttttttactttt

SEQ ID NO: 650648 - DNA, 22 bp, Artificial Sequence
  chemically synthesized
attcatagtgcttttttacttt

SEQ ID NO: 650649 - DNA, 22 bp, Artificial Sequence
  chemically synthesized
tattcatagtgcttttttactt

SEQ ID NO: 650650 - DNA, 22 bp, Artificial Sequence
  chemically synthesized
ttattcatagtgcttttttact

SEQ ID NO: 650651 - DNA, 22 bp, Artificial Sequence
  chemically synthesized
tttattcatagtgcttttttac

SEQ ID NO: 650652 - DNA, 22 bp, Artificial Sequence
  chemically synthesized
cgtgctttttattcatagtgct

SEQ ID NO: 650653 - DNA, 22 bp, Artificial Sequence
  chemically synthesized
ttgcgtgctttttattcatagt

SEQ ID NO: 650654 - DNA, 22 bp, Artificial Sequence
  chemically synthesized
tactgttgcgtgctttttattc

SEQ ID NO: 650655 - DNA, 22 bp, Artificial Sequence
  chemically synthesized
gtactgttgcgtgctttttatt

SEQ ID NO: 650656 - DNA, 22 bp, Artificial Sequence
  chemically synthesized
ccttgtactgttgcgtgctttt

SEQ ID NO: 650657 - DNA, 22 bp, Artificial Sequence
  chemically synthesized
tgaataaaaagcacgcaacagt

SEQ ID NO: 650658 - DNA, 22 bp, Artificial Sequence
  chemically synthesized
ataactaccttgtactgttgcg

SEQ ID NO: 650659 - DNA, 22 bp, Artificial Sequence
  chemically synthesized
taataactaccttgtactgttg

SEQ ID NO: 650660 - DNA, 22 bp, Artificial Sequence
  chemically synthesized
ctaataactaccttgtactgtt

SEQ ID NO: 650661 - DNA, 22 bp, Artificial Sequence
  chemically synthesized
tctaataactaccttgtactgt

SEQ ID NO: 650662 - DNA, 22 bp, Artificial Sequence
  chemically synthesized
ttttctaataactaccttgtac

SEQ ID NO: 650663 - DNA, 22 bp, Artificial Sequence
  chemically synthesized
attttctaataactaccttgta

SEQ ID NO: 650664 - DNA, 22 bp, Artificial Sequence
  chemically synthesized
tattttctaataactaccttgt

SEQ ID NO: 650665 - DNA, 22 bp, Artificial Sequence
  chemically synthesized
ctttattttctaataactacct

SEQ ID NO: 650666 - DNA, 22 bp, Artificial Sequence
  chemically synthesized
ttactttattttctaataacta

SEQ ID NO: 650667 - DNA, 22 bp, Artificial Sequence
  chemically synthesized
gttactttattttctaataact

SEQ ID NO: 650668 - DNA, 22 bp, Artificial Sequence
  chemically synthesized
tgttactttattttctaataac

SEQ ID NO: 650669 - DNA, 22 bp, Artificial Sequence
  chemically synthesized
gttttgttactttattttctaa

SEQ ID NO: 650670 - DNA, 22 bp, Artificial Sequence
  chemically synthesized
cgtgtgaactggttttgttact

SEQ ID NO: 650671 - DNA, 22 bp, Artificial Sequence
  chemically synthesized
ttagaaaataaagtaacaaaac

SEQ ID NO: 650672 - DNA, 22 bp, Artificial Sequence
  chemically synthesized
gaaaataaagtaacaaaaccag

SEQ ID NO: 650673 - DNA, 22 bp, Artificial Sequence
  chemically synthesized
cagttacgtgtgaactggtttt

SEQ ID NO: 650674 - DNA, 22 bp, Artificial Sequence
  chemically synthesized
ccagttacgtgtgaactggttt

SEQ ID NO: 650675 - DNA, 22 bp, Artificial Sequence
  chemically synthesized
tccagttacgtgtgaactggtt

SEQ ID NO: 650676 - DNA, 22 bp, Artificial Sequence
  chemically synthesized
ttccagttacgtgtgaactggt

SEQ ID NO: 650677 - DNA, 22 bp, Artificial Sequence
  chemically synthesized
ttttccagttacgtgtgaactg

SEQ ID NO: 650678 - DNA, 22 bp, Artificial Sequence
  chemically synthesized
acacgtaactggaaaagagtgt

SEQ ID NO: 650679 - DNA, 22 bp, Artificial Sequence
  chemically synthesized
gcagcaaagtaaacactctttt

SEQ ID NO: 650680 - DNA, 22 bp, Artificial Sequence
  chemically synthesized
agcagcaaagtaaacactcttt

SEQ ID NO: 650681 - DNA, 22 bp, Artificial Sequence
  chemically synthesized
gaaaagagtgtttactttgctg

SEQ ID NO: 650682 - DNA, 22 bp, Artificial Sequence
  chemically synthesized
tgcagaatccacttagcagcaa

SEQ ID NO: 650683 - DNA, 22 bp, Artificial Sequence
  chemically synthesized
tgcctgtgcagaatccacttag

SEQ ID NO: 650684 - DNA, 22 bp, Artificial Sequence
  chemically synthesized
actttgctgctaagtggattct

SEQ ID NO: 650685 - DNA, 22 bp, Artificial Sequence
  chemically synthesized
ctttgctgctaagtggattctg

SEQ ID NO: 650686 - DNA, 22 bp, Artificial Sequence
  chemically synthesized
tgctgctaagtggattctgcac

SEQ ID NO: 650687 - DNA, 22 bp, Artificial Sequence
  chemically synthesized
tggtctatgcctgtgcagaatc

SEQ ID NO: 650688 - DNA, 22 bp, Artificial Sequence
  chemically synthesized
gctgctaagtggattctgcaca

SEQ ID NO: 650689 - DNA, 22 bp, Artificial Sequence
  chemically synthesized
ctgctaagtggattctgcacag

SEQ ID NO: 650690 - DNA, 22 bp, Artificial Sequence
  chemically synthesized
tatggtctatgcctgtgcagaa

SEQ ID NO: 650691 - DNA, 22 bp, Artificial Sequence
  chemically synthesized
ctaagtggattctgcacaggca

SEQ ID NO: 650692 - DNA, 22 bp, Artificial Sequence
  chemically synthesized
gctctatggtctatgcctgtgc

SEQ ID NO: 650693 - DNA, 22 bp, Artificial Sequence
  chemically synthesized
agtggattctgcacaggcatag

SEQ ID NO: 650694 - DNA, 22 bp, Artificial Sequence
  chemically synthesized
taaactagctctatggtctatg

SEQ ID NO: 650695 - DNA, 22 bp, Artificial Sequence
  chemically synthesized
tgcacaggcatagaccatagag

SEQ ID NO: 650696 - DNA, 22 bp, Artificial Sequence
  chemically synthesized
cacaggcatagaccatagagct

SEQ ID NO: 650697 - DNA, 22 bp, Artificial Sequence
  chemically synthesized
tagtgatgaataagccacaaag

SEQ ID NO: 650698 - DNA, 22 bp, Artificial Sequence
  chemically synthesized
tatagtgatgaataagccacaa

SEQ ID NO: 650699 - DNA, 22 bp, Artificial Sequence
  chemically synthesized
ctatagtgatgaataagccaca

SEQ ID NO: 650700 - DNA, 22 bp, Artificial Sequence
  chemically synthesized
gtttacaactttgtggcttatt

SEQ ID NO: 650701 - DNA, 22 bp, Artificial Sequence
  chemically synthesized
acaactttgtggcttattcatc

SEQ ID NO: 650702 - DNA, 22 bp, Artificial Sequence
  chemically synthesized
caactttgtggcttattcatca

SEQ ID NO: 650703 - DNA, 22 bp, Artificial Sequence
  chemically synthesized
tgtggcttattcatcactatag

SEQ ID NO: 650704 - DNA, 22 bp, Artificial Sequence
  chemically synthesized
gtggcttattcatcactataga

SEQ ID NO: 650705 - DNA, 22 bp, Artificial Sequence
  chemically synthesized
tggcttattcatcactatagaa

SEQ ID NO: 650706 - DNA, 22 bp, Artificial Sequence
  chemically synthesized
attcatcactatagaaaccttg

SEQ ID NO: 650707 - DNA, 22 bp, Artificial Sequence
  chemically synthesized
ttcatcactatagaaaccttga

SEQ ID NO: 650708 - DNA, 22 bp, Artificial Sequence
  chemically synthesized
atcactatagaaaccttgatgt

SEQ ID NO: 650709 - DNA, 22 bp, Artificial Sequence
  chemically synthesized
aatgtgtgaatcaacatcaagg

SEQ ID NO: 650710 - DNA, 22 bp, Artificial Sequence
  chemically synthesized
aaatgtgtgaatcaacatcaag

SEQ ID NO: 650711 - DNA, 22 bp, Artificial Sequence
  chemically synthesized
tagaaaccttgatgttgattca

SEQ ID NO: 650712 - DNA, 22 bp, Artificial Sequence
  chemically synthesized
cgatgtccttaaatgtgtgaat

SEQ ID NO: 650713 - DNA, 22 bp, Artificial Sequence
  chemically synthesized
gatgttgattcacacatttaag

SEQ ID NO: 650714 - DNA, 22 bp, Artificial Sequence
  chemically synthesized
atgttgattcacacatttaagg

SEQ ID NO: 650715 - DNA, 22 bp, Artificial Sequence
  chemically synthesized
aaactgcgatgtccttaaatgt

SEQ ID NO: 650716 - DNA, 22 bp, Artificial Sequence
  chemically synthesized
tgaaactgcgatgtccttaaat

SEQ ID NO: 650717 - DNA, 22 bp, Artificial Sequence
  chemically synthesized
attcacacatttaaggacatcg

SEQ ID NO: 650718 - DNA, 22 bp, Artificial Sequence
  chemically synthesized
attctgaaactgcgatgtcctt

SEQ ID NO: 650719 - DNA, 22 bp, Artificial Sequence
  chemically synthesized
acacatttaaggacatcgcagt

SEQ ID NO: 650720 - DNA, 22 bp, Artificial Sequence
  chemically synthesized
aatcctaattctgaaactgcga

SEQ ID NO: 650721 - DNA, 22 bp, Artificial Sequence
  chemically synthesized
aaggacatcgcagtttcagaat

SEQ ID NO: 650722 - DNA, 22 bp, Artificial Sequence
  chemically synthesized
aggacatcgcagtttcagaatt

SEQ ID NO: 650723 - DNA, 22 bp, Artificial Sequence
  chemically synthesized
atcctaaatcctaattctgaaa

SEQ ID NO: 650724 - DNA, 22 bp, Artificial Sequence
  chemically synthesized
acattaatcctaaatcctaatt

SEQ ID NO: 650725 - DNA, 22 bp, Artificial Sequence
  chemically synthesized
aacattaatcctaaatcctaat

SEQ ID NO: 650726 - DNA, 22 bp, Artificial Sequence
  chemically synthesized
acttaacattaatcctaaatcc

SEQ ID NO: 650727 - DNA, 22 bp, Artificial Sequence
  chemically synthesized
cagaattaggatttaggattaa

SEQ ID NO: 650728 - DNA, 22 bp, Artificial Sequence
  chemically synthesized
agaattaggatttaggattaat

SEQ ID NO: 650729 - DNA, 22 bp, Artificial Sequence
  chemically synthesized
atctcacttaacattaatccta

SEQ ID NO: 650730 - DNA, 22 bp, Artificial Sequence
  chemically synthesized
ggatttaggattaatgttaagt

SEQ ID NO: 650731 - DNA, 22 bp, Artificial Sequence
  chemically synthesized
aatgaattaatctcacttaaca

SEQ ID NO: 650732 - DNA, 22 bp, Artificial Sequence
  chemically synthesized
aaatgaattaatctcacttaac

SEQ ID NO: 650733 - DNA, 22 bp, Artificial Sequence
  chemically synthesized
taaatgaattaatctcacttaa

SEQ ID NO: 650734 - DNA, 22 bp, Artificial Sequence
  chemically synthesized
ttaaatgaattaatctcactta

SEQ ID NO: 650735 - DNA, 22 bp, Artificial Sequence
  chemically synthesized
aggattaatgttaagtgagatt

SEQ ID NO: 650736 - DNA, 22 bp, Artificial Sequence
  chemically synthesized
tttaaatgaattaatctcactt

SEQ ID NO: 650737 - DNA, 22 bp, Artificial Sequence
  chemically synthesized
ggattaatgttaagtgagatta

SEQ ID NO: 650738 - DNA, 22 bp, Artificial Sequence
  chemically synthesized
ttttaaatgaattaatctcact

SEQ ID NO: 650739 - DNA, 22 bp, Artificial Sequence
  chemically synthesized
tttttaaatgaattaatctcac

SEQ ID NO: 650740 - DNA, 22 bp, Artificial Sequence
  chemically synthesized
ttttttaaatgaattaatctca

SEQ ID NO: 650741 - DNA, 22 bp, Artificial Sequence
  chemically synthesized
atgttaagtgagattaattcat

SEQ ID NO: 650742 - DNA, 22 bp, Artificial Sequence
  chemically synthesized
agtgagattaattcatttaaaa

SEQ ID NO: 650743 - DNA, 22 bp, Artificial Sequence
  chemically synthesized
gggagacaggatttttttttaa

SEQ ID NO: 650744 - DNA, 22 bp, Artificial Sequence
  chemically synthesized
ggggagacaggattttttttta

SEQ ID NO: 650745 - DNA, 22 bp, Artificial Sequence
  chemically synthesized
tttggggagacaggattttttt

SEQ ID NO: 650746 - DNA, 22 bp, Artificial Sequence
  chemically synthesized
attcatttaaaaaaaaatcctg

SEQ ID NO: 650747 - DNA, 22 bp, Artificial Sequence
  chemically synthesized
acctgtttggggagacaggatt

SEQ ID NO: 650748 - DNA, 22 bp, Artificial Sequence
  chemically synthesized
atttaaaaaaaaatcctgtctc

SEQ ID NO: 650749 - DNA, 22 bp, Artificial Sequence
  chemically synthesized
ctgacctgtttggggagacagg

SEQ ID NO: 650750 - DNA, 22 bp, Artificial Sequence
  chemically synthesized
aaaaaaaaatcctgtctcccca

SEQ ID NO: 650751 - DNA, 22 bp, Artificial Sequence
  chemically synthesized
aaaaaaaatcctgtctccccaa

SEQ ID NO: 650752 - DNA, 22 bp, Artificial Sequence
  chemically synthesized
gccctgctgacctgtttgggga

SEQ ID NO: 650753 - DNA, 22 bp, Artificial Sequence
  chemically synthesized
agccctgctgacctgtttgggg

SEQ ID NO: 650754 - DNA, 22 bp, Artificial Sequence
  chemically synthesized
tagccctgctgacctgtttggg

SEQ ID NO: 650755 - DNA, 22 bp, Artificial Sequence
  chemically synthesized
tctccccaaacaggtcagcagg

SEQ ID NO: 650756 - DNA, 22 bp, Artificial Sequence
  chemically synthesized
cccaaacaggtcagcagggcta

SEQ ID NO: 650757 - DNA, 22 bp, Artificial Sequence
  chemically synthesized
aaatatcatggaaaacaaggcc

SEQ ID NO: 650758 - DNA, 22 bp, Artificial Sequence
  chemically synthesized
aagatttatttggccttgtttt

SEQ ID NO: 650759 - DNA, 22 bp, Artificial Sequence
  chemically synthesized
aaaatatcatggaaaacaaggc

SEQ ID NO: 650760 - DNA, 22 bp, Artificial Sequence
  chemically synthesized
atttggccttgttttccatgat

SEQ ID NO: 650761 - DNA, 22 bp, Artificial Sequence
  chemically synthesized
tttggccttgttttccatgata

SEQ ID NO: 650762 - DNA, 22 bp, Artificial Sequence
  chemically synthesized
atagtcttaaaatatcatggaa

SEQ ID NO: 650763 - DNA, 22 bp, Artificial Sequence
  chemically synthesized
tgatagtcttaaaatatcatgg

SEQ ID NO: 650764 - DNA, 22 bp, Artificial Sequence
  chemically synthesized
ggccttgttttccatgatattt

SEQ ID NO: 650765 - DNA, 22 bp, Artificial Sequence
  chemically synthesized
gccttgttttccatgatatttt

SEQ ID NO: 650766 - DNA, 22 bp, Artificial Sequence
  chemically synthesized
ttctgatagtcttaaaatatca

SEQ ID NO: 650767 - DNA, 22 bp, Artificial Sequence
  chemically synthesized
gttttccatgatattttaagac

SEQ ID NO: 650768 - DNA, 22 bp, Artificial Sequence
  chemically synthesized
ttttccatgatattttaagact

SEQ ID NO: 650769 - DNA, 22 bp, Artificial Sequence
  chemically synthesized
tccatgatattttaagactatc

SEQ ID NO: 650770 - DNA, 22 bp, Artificial Sequence
  chemically synthesized
ccatgatattttaagactatca

SEQ ID NO: 650771 - DNA, 22 bp, Artificial Sequence
  chemically synthesized
catgatattttaagactatcag

SEQ ID NO: 650772 - DNA, 22 bp, Artificial Sequence
  chemically synthesized
taagactatcagaataacctgc

SEQ ID NO: 650773 - DNA, 22 bp, Artificial Sequence
  chemically synthesized
aagactatcagaataacctgct

SEQ ID NO: 650774 - DNA, 22 bp, Artificial Sequence
  chemically synthesized
agactatcagaataacctgcta

SEQ ID NO: 650775 - DNA, 22 bp, Artificial Sequence
  chemically synthesized
tcagaataacctgctacgtttc

SEQ ID NO: 650776 - DNA, 22 bp, Artificial Sequence
  chemically synthesized
gaagtgaaagagataggaaacg

SEQ ID NO: 650777 - DNA, 22 bp, Artificial Sequence
  chemically synthesized
agaagtgaaagagataggaaac

SEQ ID NO: 650778 - DNA, 22 bp, Artificial Sequence
  chemically synthesized
tacatttagaagtgaaagagat

SEQ ID NO: 650779 - DNA, 22 bp, Artificial Sequence
  chemically synthesized
ctacgtttcctatctctttcac

SEQ ID NO: 650780 - DNA, 22 bp, Artificial Sequence
  chemically synthesized
atacatttagaagtgaaagaga

SEQ ID NO: 650781 - DNA, 22 bp, Artificial Sequence
  chemically synthesized
cgtttcctatctctttcacttc

SEQ ID NO: 650782 - DNA, 22 bp, Artificial Sequence
  chemically synthesized
cctatctctttcacttctaaat

SEQ ID NO: 650783 - DNA, 22 bp, Artificial Sequence
  chemically synthesized
ctatctctttcacttctaaatg

SEQ ID NO: 650784 - DNA, 22 bp, Artificial Sequence
  chemically synthesized
tctctttcacttctaaatgtat

SEQ ID NO: 650785 - DNA, 22 bp, Artificial Sequence
  chemically synthesized
tttcacttctaaatgtataagg

SEQ ID NO: 650786 - DNA, 22 bp, Artificial Sequence
  chemically synthesized
aaaaacaaccagtccttataca

SEQ ID NO: 650787 - DNA, 22 bp, Artificial Sequence
  chemically synthesized
tcacttctaaatgtataaggac

SEQ ID NO: 650788 - DNA, 22 bp, Artificial Sequence
  chemically synthesized
cacttctaaatgtataaggact

SEQ ID NO: 650789 - DNA, 22 bp, Artificial Sequence
  chemically synthesized
acttctaaatgtataaggactg

SEQ ID NO: 650790 - DNA, 22 bp, Artificial Sequence
  chemically synthesized
ctaaatgtataaggactggttg

SEQ ID NO: 650791 - DNA, 22 bp, Artificial Sequence
  chemically synthesized
taaatgtataaggactggttgt

SEQ ID NO: 650792 - DNA, 22 bp, Artificial Sequence
  chemically synthesized
aatgtataaggactggttgttt

SEQ ID NO: 650793 - DNA, 22 bp, Artificial Sequence
  chemically synthesized
acaaagcagctaaaaaacaacc

SEQ ID NO: 650794 - DNA, 22 bp, Artificial Sequence
  chemically synthesized
gttgttttttagctgctttgtg

SEQ ID NO: 650795 - DNA, 22 bp, Artificial Sequence
  chemically synthesized
ttttttagctgctttgtgaatc

SEQ ID NO: 650796 - DNA, 22 bp, Artificial Sequence
  chemically synthesized
tttagctgctttgtgaatcttc

SEQ ID NO: 650797 - DNA, 22 bp, Artificial Sequence
  chemically synthesized
ttagctgctttgtgaatcttcc

SEQ ID NO: 650798 - DNA, 22 bp, Artificial Sequence
  chemically synthesized
tagctgctttgtgaatcttcca

SEQ ID NO: 650799 - DNA, 22 bp, Artificial Sequence
  chemically synthesized
agctgctttgtgaatcttccat

SEQ ID NO: 650800 - DNA, 22 bp, Artificial Sequence
  chemically synthesized
gctgctttgtgaatcttccatt

SEQ ID NO: 650801 - DNA, 22 bp, Artificial Sequence
  chemically synthesized
ctttgtgaatcttccatttact

SEQ ID NO: 650802 - DNA, 22 bp, Artificial Sequence
  chemically synthesized
tgtgaatcttccatttacttgc

SEQ ID NO: 650803 - DNA, 22 bp, Artificial Sequence
  chemically synthesized
gtgaatcttccatttacttgcc

SEQ ID NO: 650804 - DNA, 22 bp, Artificial Sequence
  chemically synthesized
tgaatcttccatttacttgcct

SEQ ID NO: 650805 - DNA, 22 bp, Artificial Sequence
  chemically synthesized
aaggaataaaaagtaggcaagt

SEQ ID NO: 650806 - DNA, 22 bp, Artificial Sequence
  chemically synthesized
taaaggaataaaaagtaggcaa

SEQ ID NO: 650807 - DNA, 22 bp, Artificial Sequence
  chemically synthesized
ctaaaggaataaaaagtaggca

SEQ ID NO: 650808 - DNA, 22 bp, Artificial Sequence
  chemically synthesized
ccatttacttgcctacttttta

SEQ ID NO: 650809 - DNA, 22 bp, Artificial Sequence
  chemically synthesized
catttacttgcctactttttat

SEQ ID NO: 650810 - DNA, 22 bp, Artificial Sequence
  chemically synthesized
acttgcctactttttattcctt

SEQ ID NO: 650811 - DNA, 22 bp, Artificial Sequence
  chemically synthesized
cttgcctactttttattccttt

SEQ ID NO: 650812 - DNA, 22 bp, Artificial Sequence
  chemically synthesized
gcctactttttattcctttaga

SEQ ID NO: 650813 - DNA, 22 bp, Artificial Sequence
  chemically synthesized
cctactttttattcctttagaa

SEQ ID NO: 650814 - DNA, 22 bp, Artificial Sequence
  chemically synthesized
ctttttattcctttagaagttc

SEQ ID NO: 650815 - DNA, 22 bp, Artificial Sequence
  chemically synthesized
tatagtatcccagtgaacttct

SEQ ID NO: 650816 - DNA, 22 bp, Artificial Sequence
  chemically synthesized
tttattcctttagaagttcact

SEQ ID NO: 650817 - DNA, 22 bp, Artificial Sequence
  chemically synthesized
gtatagtatcccagtgaacttc

SEQ ID NO: 650818 - DNA, 22 bp, Artificial Sequence
  chemically synthesized
ttattcctttagaagttcactg

SEQ ID NO: 650819 - DNA, 22 bp, Artificial Sequence
  chemically synthesized
tgtatagtatcccagtgaactt

SEQ ID NO: 650820 - DNA, 22 bp, Artificial Sequence
  chemically synthesized
tattcctttagaagttcactgg

SEQ ID NO: 650821 - DNA, 22 bp, Artificial Sequence
  chemically synthesized
attcctttagaagttcactggg

SEQ ID NO: 650822 - DNA, 22 bp, Artificial Sequence
  chemically synthesized
tttgtatagtatcccagtgaac

SEQ ID NO: 650823 - DNA, 22 bp, Artificial Sequence
  chemically synthesized
ttcctttagaagttcactggga

SEQ ID NO: 650824 - DNA, 22 bp, Artificial Sequence
  chemically synthesized
ctttagaagttcactgggatac

SEQ ID NO: 650825 - DNA, 22 bp, Artificial Sequence
  chemically synthesized
cattctttgtatagtatcccag

SEQ ID NO: 650826 - DNA, 22 bp, Artificial Sequence
  chemically synthesized
tagaagttcactgggatactat

SEQ ID NO: 650827 - DNA, 22 bp, Artificial Sequence
  chemically synthesized
agaagttcactgggatactata

SEQ ID NO: 650828 - DNA, 22 bp, Artificial Sequence
  chemically synthesized
gaagttcactgggatactatac

SEQ ID NO: 650829 - DNA, 22 bp, Artificial Sequence
  chemically synthesized
attacattctttgtatagtatc

SEQ ID NO: 650830 - DNA, 22 bp, Artificial Sequence
  chemically synthesized
actgggatactatacaaagaat

SEQ ID NO: 650831 - DNA, 22 bp, Artificial Sequence
  chemically synthesized
tgaatctgattacattctttgt

SEQ ID NO: 650832 - DNA, 22 bp, Artificial Sequence
  chemically synthesized
ggatactatacaaagaatgtaa

SEQ ID NO: 650833 - DNA, 22 bp, Artificial Sequence
  chemically synthesized
tctgtgaatctgattacattct

SEQ ID NO: 650834 - DNA, 22 bp, Artificial Sequence
  chemically synthesized
atctgtgaatctgattacattc

SEQ ID NO: 650835 - DNA, 22 bp, Artificial Sequence
  chemically synthesized
tatctgtgaatctgattacatt

SEQ ID NO: 650836 - DNA, 22 bp, Artificial Sequence
  chemically synthesized
tttatctgtgaatctgattaca

SEQ ID NO: 650837 - DNA, 22 bp, Artificial Sequence
  chemically synthesized
ctttatctgtgaatctgattac

SEQ ID NO: 650838 - DNA, 22 bp, Artificial Sequence
  chemically synthesized
tacaaagaatgtaatcagattc

SEQ ID NO: 650839 - DNA, 22 bp, Artificial Sequence
  chemically synthesized
cttctttatctgtgaatctgat

SEQ ID NO: 650840 - DNA, 22 bp, Artificial Sequence
  chemically synthesized
gcttctttatctgtgaatctga

SEQ ID NO: 650841 - DNA, 22 bp, Artificial Sequence
  chemically synthesized
gaacttgcttctttatctgtga

SEQ ID NO: 650842 - DNA, 22 bp, Artificial Sequence
  chemically synthesized
agaacttgcttctttatctgtg

SEQ ID NO: 650843 - DNA, 22 bp, Artificial Sequence
  chemically synthesized
agcatcttagaacttgcttctt

SEQ ID NO: 650844 - DNA, 22 bp, Artificial Sequence
  chemically synthesized
cagcatcttagaacttgcttct

SEQ ID NO: 650845 - DNA, 22 bp, Artificial Sequence
  chemically synthesized
tcagcatcttagaacttgcttc

SEQ ID NO: 650846 - DNA, 22 bp, Artificial Sequence
  chemically synthesized
acagataaagaagcaagttcta

SEQ ID NO: 650847 - DNA, 22 bp, Artificial Sequence
  chemically synthesized
ttttcagcatcttagaacttgc

SEQ ID NO: 650848 - DNA, 22 bp, Artificial Sequence
  chemically synthesized
agtaacaagaattgttttcagc

SEQ ID NO: 650849 - DNA, 22 bp, Artificial Sequence
  chemically synthesized
aagtaacaagaattgttttcag

SEQ ID NO: 650850 - DNA, 22 bp, Artificial Sequence
  chemically synthesized
ccttaagtaacaagaattgttt

SEQ ID NO: 650851 - DNA, 22 bp, Artificial Sequence
  chemically synthesized
taagatgctgaaaacaattctt

SEQ ID NO: 650852 - DNA, 22 bp, Artificial Sequence
  chemically synthesized
tcccttaagtaacaagaattgt

SEQ ID NO: 650853 - DNA, 22 bp, Artificial Sequence
  chemically synthesized
agatgctgaaaacaattcttgt

SEQ ID NO: 650854 - DNA, 22 bp, Artificial Sequence
  chemically synthesized
ctcccttaagtaacaagaattg

SEQ ID NO: 650855 - DNA, 22 bp, Artificial Sequence
  chemically synthesized
tctcccttaagtaacaagaatt

SEQ ID NO: 650856 - DNA, 22 bp, Artificial Sequence
  chemically synthesized
ttctcccttaagtaacaagaat

SEQ ID NO: 650857 - DNA, 22 bp, Artificial Sequence
  chemically synthesized
tttctcccttaagtaacaagaa

SEQ ID NO: 650858 - DNA, 22 bp, Artificial Sequence
  chemically synthesized
ttttctcccttaagtaacaaga

SEQ ID NO: 650859 - DNA, 22 bp, Artificial Sequence
  chemically synthesized
tttttctcccttaagtaacaag

SEQ ID NO: 650860 - DNA, 22 bp, Artificial Sequence
  chemically synthesized
ttttttctcccttaagtaacaa

SEQ ID NO: 650861 - DNA, 22 bp, Artificial Sequence
  chemically synthesized
aaaacaattcttgttacttaag

SEQ ID NO: 650862 - DNA, 22 bp, Artificial Sequence
  chemically synthesized
caccatttttttttctccctta

SEQ ID NO: 650863 - DNA, 22 bp, Artificial Sequence
  chemically synthesized
gcaccatttttttttctccctt

SEQ ID NO: 650864 - DNA, 22 bp, Artificial Sequence
  chemically synthesized
tgcaccatttttttttctccct

SEQ ID NO: 650865 - DNA, 22 bp, Artificial Sequence
  chemically synthesized
ttgttacttaagggagaaaaaa

SEQ ID NO: 650866 - DNA, 22 bp, Artificial Sequence
  chemically synthesized
gttacttaagggagaaaaaaaa

SEQ ID NO: 650867 - DNA, 22 bp, Artificial Sequence
  chemically synthesized
actttgcaccatttttttttct

SEQ ID NO: 650868 - DNA, 22 bp, Artificial Sequence
  chemically synthesized
ttacttaagggagaaaaaaaaa

SEQ ID NO: 650869 - DNA, 22 bp, Artificial Sequence
  chemically synthesized
cttaagggagaaaaaaaaatgg

SEQ ID NO: 650870 - DNA, 22 bp, Artificial Sequence
  chemically synthesized
attcactttgcaccattttttt

SEQ ID NO: 650871 - DNA, 22 bp, Artificial Sequence
  chemically synthesized
tcattcactttgcaccattttt

SEQ ID NO: 650872 - DNA, 22 bp, Artificial Sequence
  chemically synthesized
aagggagaaaaaaaaatggtgc

SEQ ID NO: 650873 - DNA, 22 bp, Artificial Sequence
  chemically synthesized
agggagaaaaaaaaatggtgca

SEQ ID NO: 650874 - DNA, 22 bp, Artificial Sequence
  chemically synthesized
agtctctcattcactttgcacc

SEQ ID NO: 650875 - DNA, 22 bp, Artificial Sequence
  chemically synthesized
ggaggaaccataatagtagctc

SEQ ID NO: 650876 - DNA, 22 bp, Artificial Sequence
  chemically synthesized
tgggaggaaccataatagtagc

SEQ ID NO: 650877 - DNA, 22 bp, Artificial Sequence
  chemically synthesized
ttctgggaggaaccataatagt

SEQ ID NO: 650878 - DNA, 22 bp, Artificial Sequence
  chemically synthesized
tattctgggaggaaccataata

SEQ ID NO: 650879 - DNA, 22 bp, Artificial Sequence
  chemically synthesized
agctactattatggttcctccc

SEQ ID NO: 650880 - DNA, 22 bp, Artificial Sequence
  chemically synthesized
ctattatggttcctcccagaat

SEQ ID NO: 650881 - DNA, 22 bp, Artificial Sequence
  chemically synthesized
agagatgattctattctgggag

SEQ ID NO: 650882 - DNA, 22 bp, Artificial Sequence
  chemically synthesized
ttatggttcctcccagaataga

SEQ ID NO: 650883 - DNA, 22 bp, Artificial Sequence
  chemically synthesized
tggttcctcccagaatagaatc

SEQ ID NO: 650884 - DNA, 22 bp, Artificial Sequence
  chemically synthesized
taaaactgagagatgattctat

SEQ ID NO: 650885 - DNA, 22 bp, Artificial Sequence
  chemically synthesized
ctcccagaatagaatcatctct

SEQ ID NO: 650886 - DNA, 22 bp, Artificial Sequence
  chemically synthesized
ccagaatagaatcatctctcag

SEQ ID NO: 650887 - DNA, 22 bp, Artificial Sequence
  chemically synthesized
ccaagaatcagttataaaactg

SEQ ID NO: 650888 - DNA, 22 bp, Artificial Sequence
  chemically synthesized
cccaagaatcagttataaaact

SEQ ID NO: 650889 - DNA, 22 bp, Artificial Sequence
  chemically synthesized
tagaaacttcccaagaatcagt

SEQ ID NO: 650890 - DNA, 22 bp, Artificial Sequence
  chemically synthesized
tcagttttataactgattcttg

SEQ ID NO: 650891 - DNA, 22 bp, Artificial Sequence
  chemically synthesized
atagaaacttcccaagaatcag

SEQ ID NO: 650892 - DNA, 22 bp, Artificial Sequence
  chemically synthesized
agttttataactgattcttggg

SEQ ID NO: 650893 - DNA, 22 bp, Artificial Sequence
  chemically synthesized
tttatagaaacttcccaagaat

SEQ ID NO: 650894 - DNA, 22 bp, Artificial Sequence
  chemically synthesized
ctgtttatagaaacttcccaag

SEQ ID NO: 650895 - DNA, 22 bp, Artificial Sequence
  chemically synthesized
tataactgattcttgggaagtt

SEQ ID NO: 650896 - DNA, 22 bp, Artificial Sequence
  chemically synthesized
cctgtttatagaaacttcccaa

SEQ ID NO: 650897 - DNA, 22 bp, Artificial Sequence
  chemically synthesized
ataactgattcttgggaagttt

SEQ ID NO: 650898 - DNA, 22 bp, Artificial Sequence
  chemically synthesized
tcctgtttatagaaacttccca

SEQ ID NO: 650899 - DNA, 22 bp, Artificial Sequence
  chemically synthesized
taactgattcttgggaagtttc

SEQ ID NO: 650900 - DNA, 22 bp, Artificial Sequence
  chemically synthesized
attcttgggaagtttctataaa

SEQ ID NO: 650901 - DNA, 22 bp, Artificial Sequence
  chemically synthesized
acggtctttcctgtttatagaa

SEQ ID NO: 650902 - DNA, 22 bp, Artificial Sequence
  chemically synthesized
cacggtctttcctgtttataga

SEQ ID NO: 650903 - DNA, 22 bp, Artificial Sequence
  chemically synthesized
tcacggtctttcctgtttatag

SEQ ID NO: 650904 - DNA, 22 bp, Artificial Sequence
  chemically synthesized
ttgggaagtttctataaacagg

SEQ ID NO: 650905 - DNA, 22 bp, Artificial Sequence
  chemically synthesized
ttcacggtctttcctgtttata

SEQ ID NO: 650906 - DNA, 22 bp, Artificial Sequence
  chemically synthesized
tttcacggtctttcctgtttat

SEQ ID NO: 650907 - DNA, 22 bp, Artificial Sequence
  chemically synthesized
gggaagtttctataaacaggaa

SEQ ID NO: 650908 - DNA, 22 bp, Artificial Sequence
  chemically synthesized
ggaagtttctataaacaggaaa

SEQ ID NO: 650909 - DNA, 22 bp, Artificial Sequence
  chemically synthesized
ctttttcacggtctttcctgtt

SEQ ID NO: 650910 - DNA, 22 bp, Artificial Sequence
  chemically synthesized
cctttttcacggtctttcctgt

SEQ ID NO: 650911 - DNA, 22 bp, Artificial Sequence
  chemically synthesized
tcctttttcacggtctttcctg

SEQ ID NO: 650912 - DNA, 22 bp, Artificial Sequence
  chemically synthesized
ctataaacaggaaagaccgtga

SEQ ID NO: 650913 - DNA, 22 bp, Artificial Sequence
  chemically synthesized
tataaacaggaaagaccgtgaa

SEQ ID NO: 650914 - DNA, 22 bp, Artificial Sequence
  chemically synthesized
ccatctttcctttttcacggtc

SEQ ID NO: 650915 - DNA, 22 bp, Artificial Sequence
  chemically synthesized
taaacaggaaagaccgtgaaaa

SEQ ID NO: 650916 - DNA, 22 bp, Artificial Sequence
  chemically synthesized
accatctttcctttttcacggt

SEQ ID NO: 650917 - DNA, 22 bp, Artificial Sequence
  chemically synthesized
taccatctttcctttttcacgg

SEQ ID NO: 650918 - DNA, 22 bp, Artificial Sequence
  chemically synthesized
ttaccatctttcctttttcacg

SEQ ID NO: 650919 - DNA, 22 bp, Artificial Sequence
  chemically synthesized
gaaccaaaacatttttaccatc

SEQ ID NO: 650920 - DNA, 22 bp, Artificial Sequence
  chemically synthesized
ctggaaccaaaacatttttacc

SEQ ID NO: 650921 - DNA, 22 bp, Artificial Sequence
  chemically synthesized
cctggaaccaaaacatttttac

SEQ ID NO: 650922 - DNA, 22 bp, Artificial Sequence
  chemically synthesized
cttcctggaaccaaaacatttt

SEQ ID NO: 650923 - DNA, 22 bp, Artificial Sequence
  chemically synthesized
ctccttcctggaaccaaaacat

SEQ ID NO: 650924 - DNA, 22 bp, Artificial Sequence
  chemically synthesized
tacctcctccttcctggaacca

SEQ ID NO: 650925 - DNA, 22 bp, Artificial Sequence
  chemically synthesized
cagatgaactgtacctcctcct

SEQ ID NO: 650926 - DNA, 22 bp, Artificial Sequence
  chemically synthesized
tggttccaggaaggaggaggta

SEQ ID NO: 650927 - DNA, 22 bp, Artificial Sequence
  chemically synthesized
ggttccaggaaggaggaggtac

SEQ ID NO: 650928 - DNA, 22 bp, Artificial Sequence
  chemically synthesized
gttccaggaaggaggaggtaca

SEQ ID NO: 650929 - DNA, 22 bp, Artificial Sequence
  chemically synthesized
caggaaggaggaggtacagttc

SEQ ID NO: 650930 - DNA, 22 bp, Artificial Sequence
  chemically synthesized
acggaggtattacagatgaact

SEQ ID NO: 650931 - DNA, 22 bp, Artificial Sequence
  chemically synthesized
cacggaggtattacagatgaac

SEQ ID NO: 650932 - DNA, 22 bp, Artificial Sequence
  chemically synthesized
atctgtaatacctccgtgaaga

SEQ ID NO: 650933 - DNA, 22 bp, Artificial Sequence
  chemically synthesized
taatacctccgtgaagacacgc

SEQ ID NO: 650934 - DNA, 22 bp, Artificial Sequence
  chemically synthesized
agcaggccaaagtgcgtgtctt

SEQ ID NO: 650935 - DNA, 22 bp, Artificial Sequence
  chemically synthesized
gttgagcaggccaaagtgcgtg

SEQ ID NO: 650936 - DNA, 22 bp, Artificial Sequence
  chemically synthesized
ggttgagcaggccaaagtgcgt

SEQ ID NO: 650937 - DNA, 22 bp, Artificial Sequence
  chemically synthesized
tggttgagcaggccaaagtgcg

SEQ ID NO: 650938 - DNA, 22 bp, Artificial Sequence
  chemically synthesized
ttggttgagcaggccaaagtgc

SEQ ID NO: 650939 - DNA, 22 bp, Artificial Sequence
  chemically synthesized
cgtgaagacacgcactttggcc

SEQ ID NO: 650940 - DNA, 22 bp, Artificial Sequence
  chemically synthesized
ggagccacatttttggttgagc

SEQ ID NO: 650941 - DNA, 22 bp, Artificial Sequence
  chemically synthesized
cggagccacatttttggttgag

SEQ ID NO: 650942 - DNA, 22 bp, Artificial Sequence
  chemically synthesized
ttcggagccacatttttggttg

SEQ ID NO: 650943 - DNA, 22 bp, Artificial Sequence
  chemically synthesized
tggcctgctcaaccaaaaatgt

SEQ ID NO: 650944 - DNA, 22 bp, Artificial Sequence
  chemically synthesized
ggcctgctcaaccaaaaatgtg

SEQ ID NO: 650945 - DNA, 22 bp, Artificial Sequence
  chemically synthesized
gcctgctcaaccaaaaatgtgg

SEQ ID NO: 650946 - DNA, 22 bp, Artificial Sequence
  chemically synthesized
agctcttcggagccacattttt

SEQ ID NO: 650947 - DNA, 22 bp, Artificial Sequence
  chemically synthesized
cagctcttcggagccacatttt

SEQ ID NO: 650948 - DNA, 22 bp, Artificial Sequence
  chemically synthesized
ttcagctcttcggagccacatt

SEQ ID NO: 650949 - DNA, 22 bp, Artificial Sequence
  chemically synthesized
ctcaaccaaaaatgtggctccg

SEQ ID NO: 650950 - DNA, 22 bp, Artificial Sequence
  chemically synthesized
actcttcagctcttcggagcca

SEQ ID NO: 650951 - DNA, 22 bp, Artificial Sequence
  chemically synthesized
aaccaaaaatgtggctccgaag

SEQ ID NO: 650952 - DNA, 22 bp, Artificial Sequence
  chemically synthesized
cactcttcagctcttcggagcc

SEQ ID NO: 650953 - DNA, 22 bp, Artificial Sequence
  chemically synthesized
ccaccttcactcttcagctctt

SEQ ID NO: 650954 - DNA, 22 bp, Artificial Sequence
  chemically synthesized
accaccttcactcttcagctct

SEQ ID NO: 650955 - DNA, 22 bp, Artificial Sequence
  chemically synthesized
cgaagagctgaagagtgaaggt

SEQ ID NO: 650956 - DNA, 22 bp, Artificial Sequence
  chemically synthesized
gtgtcccttaccaccttcactc

SEQ ID NO: 650957 - DNA, 22 bp, Artificial Sequence
  chemically synthesized
ggctggtgtcccttaccacctt

SEQ ID NO: 650958 - DNA, 22 bp, Artificial Sequence
  chemically synthesized
ttaggctggtgtcccttaccac

SEQ ID NO: 650959 - DNA, 22 bp, Artificial Sequence
  chemically synthesized
attaggctggtgtcccttacca

SEQ ID NO: 650960 - DNA, 22 bp, Artificial Sequence
  chemically synthesized
aagagtgaaggtggtaagggac

SEQ ID NO: 650961 - DNA, 22 bp, Artificial Sequence
  chemically synthesized
acttattaggctggtgtccctt

SEQ ID NO: 650962 - DNA, 22 bp, Artificial Sequence
  chemically synthesized
gtggatctcacttattaggctg

SEQ ID NO: 650963 - DNA, 22 bp, Artificial Sequence
  chemically synthesized
ggtggatctcacttattaggct

SEQ ID NO: 650964 - DNA, 22 bp, Artificial Sequence
  chemically synthesized
tggtggatctcacttattaggc

SEQ ID NO: 650965 - DNA, 22 bp, Artificial Sequence
  chemically synthesized
ttttggtggatctcacttatta

SEQ ID NO: 650966 - DNA, 22 bp, Artificial Sequence
  chemically synthesized
ggttattttggtggatctcact

SEQ ID NO: 650967 - DNA, 22 bp, Artificial Sequence
  chemically synthesized
atcgctaggttattttggtgga

SEQ ID NO: 650968 - DNA, 22 bp, Artificial Sequence
  chemically synthesized
ataagtgagatccaccaaaata

SEQ ID NO: 650969 - DNA, 22 bp, Artificial Sequence
  chemically synthesized
ctgatcgctaggttattttggt

SEQ ID NO: 650970 - DNA, 22 bp, Artificial Sequence
  chemically synthesized
tcaccctcctgatcgctaggtt

SEQ ID NO: 650971 - DNA, 22 bp, Artificial Sequence
  chemically synthesized
ctgtcaccctcctgatcgctag

SEQ ID NO: 650972 - DNA, 22 bp, Artificial Sequence
  chemically synthesized
gcgatcaggagggtgacaggaa

SEQ ID NO: 650973 - DNA, 22 bp, Artificial Sequence
  chemically synthesized
gaacatcgatcattcctgtcac

SEQ ID NO: 650974 - DNA, 22 bp, Artificial Sequence
  chemically synthesized
ggctggaacatcgatcattcct

SEQ ID NO: 650975 - DNA, 22 bp, Artificial Sequence
  chemically synthesized
caaagtgggagagaaggtgatt

SEQ ID NO: 650976 - DNA, 22 bp, Artificial Sequence
  chemically synthesized
cagcccaatcaccttctctccc

SEQ ID NO: 650977 - DNA, 22 bp, Artificial Sequence
  chemically synthesized
gtaccgtctccaaagtgggaga

SEQ ID NO: 650978 - DNA, 22 bp, Artificial Sequence
  chemically synthesized
gttcgtaccgtctccaaagtgg

SEQ ID NO: 650979 - DNA, 22 bp, Artificial Sequence
  chemically synthesized
ttagttcgtaccgtctccaaag

SEQ ID NO: 650980 - DNA, 22 bp, Artificial Sequence
  chemically synthesized
ctgttagttcgtaccgtctcca

SEQ ID NO: 650981 - DNA, 22 bp, Artificial Sequence
  chemically synthesized
ctctcccactttggagacggta

SEQ ID NO: 650982 - DNA, 22 bp, Artificial Sequence
  chemically synthesized
tctcccactttggagacggtac

SEQ ID NO: 650983 - DNA, 22 bp, Artificial Sequence
  chemically synthesized
tcccactttggagacggtacga

SEQ ID NO: 650984 - DNA, 22 bp, Artificial Sequence
  chemically synthesized
ccactttggagacggtacgaac

SEQ ID NO: 650985 - DNA, 22 bp, Artificial Sequence
  chemically synthesized
tgccagttgctgttagttcgta

SEQ ID NO: 650986 - DNA, 22 bp, Artificial Sequence
  chemically synthesized
tggagacggtacgaactaacag

SEQ ID NO: 650987 - DNA, 22 bp, Artificial Sequence
  chemically synthesized
ctgtgccagttgctgttagttc

SEQ ID NO: 650988 - DNA, 22 bp, Artificial Sequence
  chemically synthesized
ggagacggtacgaactaacagc

SEQ ID NO: 650989 - DNA, 22 bp, Artificial Sequence
  chemically synthesized
gagacggtacgaactaacagca

SEQ ID NO: 650990 - DNA, 22 bp, Artificial Sequence
  chemically synthesized
tctcctgtgccagttgctgtta

SEQ ID NO: 650991 - DNA, 22 bp, Artificial Sequence
  chemically synthesized
atctcctgtgccagttgctgtt

SEQ ID NO: 650992 - DNA, 22 bp, Artificial Sequence
  chemically synthesized
tatctcctgtgccagttgctgt

SEQ ID NO: 650993 - DNA, 22 bp, Artificial Sequence
  chemically synthesized
ttatctcctgtgccagttgctg

SEQ ID NO: 650994 - DNA, 22 bp, Artificial Sequence
  chemically synthesized
atcttttatctcctgtgccagt

SEQ ID NO: 650995 - DNA, 22 bp, Artificial Sequence
  chemically synthesized
gatcttttatctcctgtgccag

SEQ ID NO: 650996 - DNA, 22 bp, Artificial Sequence
  chemically synthesized
acagcaactggcacaggagata

SEQ ID NO: 650997 - DNA, 22 bp, Artificial Sequence
  chemically synthesized
tgacttgatcttttatctcctg

SEQ ID NO: 650998 - DNA, 22 bp, Artificial Sequence
  chemically synthesized
atgacttgatcttttatctcct

SEQ ID NO: 650999 - DNA, 22 bp, Artificial Sequence
  chemically synthesized
tatgacttgatcttttatctcc

SEQ ID NO: 651000 - DNA, 22 bp, Artificial Sequence
  chemically synthesized
ttatgacttgatcttttatctc

SEQ ID NO: 651001 - DNA, 22 bp, Artificial Sequence
  chemically synthesized
tttatgacttgatcttttatct

SEQ ID NO: 651002 - DNA, 22 bp, Artificial Sequence
  chemically synthesized
gcacaggagataaaagatcaag

SEQ ID NO: 651003 - DNA, 22 bp, Artificial Sequence
  chemically synthesized
acctttttatgacttgatcttt

SEQ ID NO: 651004 - DNA, 22 bp, Artificial Sequence
  chemically synthesized
cacctttttatgacttgatctt

SEQ ID NO: 651005 - DNA, 22 bp, Artificial Sequence
  chemically synthesized
tcacctttttatgacttgatct

SEQ ID NO: 651006 - DNA, 22 bp, Artificial Sequence
  chemically synthesized
ttcacctttttatgacttgatc

SEQ ID NO: 651007 - DNA, 22 bp, Artificial Sequence
  chemically synthesized
atcatttttcacctttttatga

SEQ ID NO: 651008 - DNA, 22 bp, Artificial Sequence
  chemically synthesized
tcatcatttttcacctttttat

SEQ ID NO: 651009 - DNA, 22 bp, Artificial Sequence
  chemically synthesized
ctcatcatttttcaccttttta

SEQ ID NO: 651010 - DNA, 22 bp, Artificial Sequence
  chemically synthesized
tctcatcatttttcaccttttt

SEQ ID NO: 651011 - DNA, 22 bp, Artificial Sequence
  chemically synthesized
ttctcatcatttttcacctttt

SEQ ID NO: 651012 - DNA, 22 bp, Artificial Sequence
  chemically synthesized
tttctcatcatttttcaccttt

SEQ ID NO: 651013 - DNA, 22 bp, Artificial Sequence
  chemically synthesized
ttttctcatcatttttcacctt

SEQ ID NO: 651014 - DNA, 22 bp, Artificial Sequence
  chemically synthesized
ggaaccaaaaaaaaaatgtcat

SEQ ID NO: 651015 - DNA, 22 bp, Artificial Sequence
  chemically synthesized
aggtattaggaaccaaaaaaaa

SEQ ID NO: 651016 - DNA, 22 bp, Artificial Sequence
  chemically synthesized
gattcaggtattaggaaccaaa

SEQ ID NO: 651017 - DNA, 22 bp, Artificial Sequence
  chemically synthesized
tttttttggttcctaatacctg

SEQ ID NO: 651018 - DNA, 22 bp, Artificial Sequence
  chemically synthesized
ttttttggttcctaatacctga

SEQ ID NO: 651019 - DNA, 22 bp, Artificial Sequence
  chemically synthesized
tttttggttcctaatacctgaa

SEQ ID NO: 651020 - DNA, 22 bp, Artificial Sequence
  chemically synthesized
ttttggttcctaatacctgaat

SEQ ID NO: 651021 - DNA, 22 bp, Artificial Sequence
  chemically synthesized
tttggttcctaatacctgaatc

SEQ ID NO: 651022 - DNA, 22 bp, Artificial Sequence
  chemically synthesized
ttggttcctaatacctgaatcc

SEQ ID NO: 651023 - DNA, 22 bp, Artificial Sequence
  chemically synthesized
tggttcctaatacctgaatcca

SEQ ID NO: 651024 - DNA, 22 bp, Artificial Sequence
  chemically synthesized
ggttcctaatacctgaatccaa

SEQ ID NO: 651025 - DNA, 22 bp, Artificial Sequence
  chemically synthesized
gttcctaatacctgaatccaat

SEQ ID NO: 651026 - DNA, 22 bp, Artificial Sequence
  chemically synthesized
ctaatacctgaatccaatgatt

SEQ ID NO: 651027 - DNA, 22 bp, Artificial Sequence
  chemically synthesized
caaagagtgtccaatcattgga

SEQ ID NO: 651028 - DNA, 22 bp, Artificial Sequence
  chemically synthesized
atacctgaatccaatgattgga

SEQ ID NO: 651029 - DNA, 22 bp, Artificial Sequence
  chemically synthesized
aatccaatgattggacactctt

SEQ ID NO: 651030 - DNA, 22 bp, Artificial Sequence
  chemically synthesized
gacactctttgcagatgttaca

SEQ ID NO: 651031 - DNA, 22 bp, Artificial Sequence
  chemically synthesized
ccaagcatcaggccaaatgtaa

SEQ ID NO: 651032 - DNA, 22 bp, Artificial Sequence
  chemically synthesized
tttgcagatgttacatttggcc

SEQ ID NO: 651033 - DNA, 22 bp, Artificial Sequence
  chemically synthesized
tgcagatgttacatttggcctg

SEQ ID NO: 651034 - DNA, 22 bp, Artificial Sequence
  chemically synthesized
gcagatgttacatttggcctga

SEQ ID NO: 651035 - DNA, 22 bp, Artificial Sequence
  chemically synthesized
cagatgttacatttggcctgat

SEQ ID NO: 651036 - DNA, 22 bp, Artificial Sequence
  chemically synthesized
cagaaactgccaagcatcaggc

SEQ ID NO: 651037 - DNA, 22 bp, Artificial Sequence
  chemically synthesized
ctgcagaaactgccaagcatca

SEQ ID NO: 651038 - DNA, 22 bp, Artificial Sequence
  chemically synthesized
catttggcctgatgcttggcag

SEQ ID NO: 651039 - DNA, 22 bp, Artificial Sequence
  chemically synthesized
ggcctgatgcttggcagtttct

SEQ ID NO: 651040 - DNA, 22 bp, Artificial Sequence
  chemically synthesized
gcctgatgcttggcagtttctg

SEQ ID NO: 651041 - DNA, 22 bp, Artificial Sequence
  chemically synthesized
cacagagtggctgctgcagaaa

SEQ ID NO: 651042 - DNA, 22 bp, Artificial Sequence
  chemically synthesized
atgcttggcagtttctgcagca

SEQ ID NO: 651043 - DNA, 22 bp, Artificial Sequence
  chemically synthesized
ggcagtttctgcagcagccact

SEQ ID NO: 651044 - DNA, 22 bp, Artificial Sequence
  chemically synthesized
gcagtttctgcagcagccactc

SEQ ID NO: 651045 - DNA, 22 bp, Artificial Sequence
  chemically synthesized
cccgtcctgcacagagtggctg

SEQ ID NO: 651046 - DNA, 22 bp, Artificial Sequence
  chemically synthesized
ctgcagcagccactctgtgcag

SEQ ID NO: 651047 - DNA, 22 bp, Artificial Sequence
  chemically synthesized
tgcagcagccactctgtgcagg

SEQ ID NO: 651048 - DNA, 22 bp, Artificial Sequence
  chemically synthesized
cagcagccactctgtgcaggac

SEQ ID NO: 651049 - DNA, 22 bp, Artificial Sequence
  chemically synthesized
tgtgcaggacgggcagccacac

SEQ ID NO: 651050 - DNA, 22 bp, Artificial Sequence
  chemically synthesized
tgcaggacgggcagccacacca

SEQ ID NO: 651051 - DNA, 22 bp, Artificial Sequence
  chemically synthesized
gaaccccagtccatggtgtggc

SEQ ID NO: 651052 - DNA, 22 bp, Artificial Sequence
  chemically synthesized
gatgagactggaaccccagtcc

SEQ ID NO: 651053 - DNA, 22 bp, Artificial Sequence
  chemically synthesized
gactggatgagactggaacccc

SEQ ID NO: 651054 - DNA, 22 bp, Artificial Sequence
  chemically synthesized
ctagactggatgagactggaac

SEQ ID NO: 651055 - DNA, 22 bp, Artificial Sequence
  chemically synthesized
cctagactggatgagactggaa

SEQ ID NO: 651056 - DNA, 22 bp, Artificial Sequence
  chemically synthesized
ttcctagactggatgagactgg

SEQ ID NO: 651057 - DNA, 22 bp, Artificial Sequence
  chemically synthesized
gggttccagtctcatccagtct

SEQ ID NO: 651058 - DNA, 22 bp, Artificial Sequence
  chemically synthesized
cagtctcatccagtctaggaag

SEQ ID NO: 651059 - DNA, 22 bp, Artificial Sequence
  chemically synthesized
atccagtctaggaagagggccg

SEQ ID NO: 651060 - DNA, 22 bp, Artificial Sequence
  chemically synthesized
ataataagccagagatcgaagc

SEQ ID NO: 651061 - DNA, 22 bp, Artificial Sequence
  chemically synthesized
ggaagagggccgcttcgatctc

SEQ ID NO: 651062 - DNA, 22 bp, Artificial Sequence
  chemically synthesized
caggctaataataagccagaga

SEQ ID NO: 651063 - DNA, 22 bp, Artificial Sequence
  chemically synthesized
gcaggctaataataagccagag

SEQ ID NO: 651064 - DNA, 22 bp, Artificial Sequence
  chemically synthesized
tgcaggctaataataagccaga

SEQ ID NO: 651065 - DNA, 22 bp, Artificial Sequence
  chemically synthesized
tctttgcaggctaataataagc

SEQ ID NO: 651066 - DNA, 22 bp, Artificial Sequence
  chemically synthesized
cgatctctggcttattattagc

SEQ ID NO: 651067 - DNA, 22 bp, Artificial Sequence
  chemically synthesized
ctgtctttgcaggctaataata

SEQ ID NO: 651068 - DNA, 22 bp, Artificial Sequence
  chemically synthesized
gatctctggcttattattagcc

SEQ ID NO: 651069 - DNA, 22 bp, Artificial Sequence
  chemically synthesized
cctcctgtctttgcaggctaat

SEQ ID NO: 651070 - DNA, 22 bp, Artificial Sequence
  chemically synthesized
tccctcctgtctttgcaggcta

SEQ ID NO: 651071 - DNA, 22 bp, Artificial Sequence
  chemically synthesized
tggcttattattagcctgcaaa

SEQ ID NO: 651072 - DNA, 22 bp, Artificial Sequence
  chemically synthesized
tctccctcctgtctttgcaggc

SEQ ID NO: 651073 - DNA, 22 bp, Artificial Sequence
  chemically synthesized
gcttattattagcctgcaaaga

SEQ ID NO: 651074 - DNA, 22 bp, Artificial Sequence
  chemically synthesized
tctctccctcctgtctttgcag

SEQ ID NO: 651075 - DNA, 22 bp, Artificial Sequence
  chemically synthesized
ctctctccctcctgtctttgca

SEQ ID NO: 651076 - DNA, 22 bp, Artificial Sequence
  chemically synthesized
attattagcctgcaaagacagg

SEQ ID NO: 651077 - DNA, 22 bp, Artificial Sequence
  chemically synthesized
ttattagcctgcaaagacagga

SEQ ID NO: 651078 - DNA, 22 bp, Artificial Sequence
  chemically synthesized
cttctctctccctcctgtcttt

SEQ ID NO: 651079 - DNA, 22 bp, Artificial Sequence
  chemically synthesized
ttagcctgcaaagacaggaggg

SEQ ID NO: 651080 - DNA, 22 bp, Artificial Sequence
  chemically synthesized
ccctccttctctctccctcctg

SEQ ID NO: 651081 - DNA, 22 bp, Artificial Sequence
  chemically synthesized
gcctgcaaagacaggagggaga

SEQ ID NO: 651082 - DNA, 22 bp, Artificial Sequence
  chemically synthesized
gccctccttctctctccctcct

SEQ ID NO: 651083 - DNA, 22 bp, Artificial Sequence
  chemically synthesized
tgccctccttctctctccctcc

SEQ ID NO: 651084 - DNA, 22 bp, Artificial Sequence
  chemically synthesized
ttgccctccttctctctccctc

SEQ ID NO: 651085 - DNA, 22 bp, Artificial Sequence
  chemically synthesized
caaagacaggagggagagagaa

SEQ ID NO: 651086 - DNA, 22 bp, Artificial Sequence
  chemically synthesized
atccttttgccctccttctctc

SEQ ID NO: 651087 - DNA, 22 bp, Artificial Sequence
  chemically synthesized
catccttttgccctccttctct

SEQ ID NO: 651088 - DNA, 22 bp, Artificial Sequence
  chemically synthesized
tcatccttttgccctccttctc

SEQ ID NO: 651089 - DNA, 22 bp, Artificial Sequence
  chemically synthesized
ctttcatccttttgccctcctt

SEQ ID NO: 651090 - DNA, 22 bp, Artificial Sequence
  chemically synthesized
cctttcatccttttgccctcct

SEQ ID NO: 651091 - DNA, 22 bp, Artificial Sequence
  chemically synthesized
tcctttcatccttttgccctcc

SEQ ID NO: 651092 - DNA, 22 bp, Artificial Sequence
  chemically synthesized
tttcctttcatccttttgccct

SEQ ID NO: 651093 - DNA, 22 bp, Artificial Sequence
  chemically synthesized
ctttcctttcatccttttgccc

SEQ ID NO: 651094 - DNA, 22 bp, Artificial Sequence
  chemically synthesized
ccttctttcctttcatcctttt

SEQ ID NO: 651095 - DNA, 22 bp, Artificial Sequence
  chemically synthesized
gccttctttcctttcatccttt

SEQ ID NO: 651096 - DNA, 22 bp, Artificial Sequence
  chemically synthesized
ccatcttgccttctttcctttc

SEQ ID NO: 651097 - DNA, 22 bp, Artificial Sequence
  chemically synthesized
gccatcttgccttctttccttt

SEQ ID NO: 651098 - DNA, 22 bp, Artificial Sequence
  chemically synthesized
tgccatcttgccttctttcctt

SEQ ID NO: 651099 - DNA, 22 bp, Artificial Sequence
  chemically synthesized
ctttgccatcttgccttctttc

SEQ ID NO: 651100 - DNA, 22 bp, Artificial Sequence
  chemically synthesized
atatacacctcctttgccatct

SEQ ID NO: 651101 - DNA, 22 bp, Artificial Sequence
  chemically synthesized
atcgaactgatatacacctcct

SEQ ID NO: 651102 - DNA, 22 bp, Artificial Sequence
  chemically synthesized
ttaatcgaactgatatacacct

SEQ ID NO: 651103 - DNA, 22 bp, Artificial Sequence
  chemically synthesized
attaatcgaactgatatacacc

SEQ ID NO: 651104 - DNA, 22 bp, Artificial Sequence
  chemically synthesized
acttattaatcgaactgatata

SEQ ID NO: 651105 - DNA, 22 bp, Artificial Sequence
  chemically synthesized
aacttattaatcgaactgatat

SEQ ID NO: 651106 - DNA, 22 bp, Artificial Sequence
  chemically synthesized
tttaacttattaatcgaactga

SEQ ID NO: 651107 - DNA, 22 bp, Artificial Sequence
  chemically synthesized
tgtttaacttattaatcgaact

SEQ ID NO: 651108 - DNA, 22 bp, Artificial Sequence
  chemically synthesized
ctgtttaacttattaatcgaac

SEQ ID NO: 651109 - DNA, 22 bp, Artificial Sequence
  chemically synthesized
tctgtttaacttattaatcgaa

SEQ ID NO: 651110 - DNA, 22 bp, Artificial Sequence
  chemically synthesized
ttctgtttaacttattaatcga

SEQ ID NO: 651111 - DNA, 22 bp, Artificial Sequence
  chemically synthesized
tcttttctgtttaacttattaa

SEQ ID NO: 651112 - DNA, 22 bp, Artificial Sequence
  chemically synthesized
tatcttttctgtttaacttatt

SEQ ID NO: 651113 - DNA, 22 bp, Artificial Sequence
  chemically synthesized
ctatcttttctgtttaacttat

SEQ ID NO: 651114 - DNA, 22 bp, Artificial Sequence
  chemically synthesized
tctatcttttctgtttaactta

SEQ ID NO: 651115 - DNA, 22 bp, Artificial Sequence
  chemically synthesized
tttctatcttttctgtttaact

SEQ ID NO: 651116 - DNA, 22 bp, Artificial Sequence
  chemically synthesized
ttctttctatcttttctgttta

SEQ ID NO: 651117 - DNA, 22 bp, Artificial Sequence
  chemically synthesized
gattaataagttaaacagaaaa

SEQ ID NO: 651118 - DNA, 22 bp, Artificial Sequence
  chemically synthesized
ataagttaaacagaaaagatag

SEQ ID NO: 651119 - DNA, 22 bp, Artificial Sequence
  chemically synthesized
caaccattgttctttctatctt

SEQ ID NO: 651120 - DNA, 22 bp, Artificial Sequence
  chemically synthesized
gcaaccattgttctttctatct

SEQ ID NO: 651121 - DNA, 22 bp, Artificial Sequence
  chemically synthesized
tgcaaccattgttctttctatc

SEQ ID NO: 651122 - DNA, 22 bp, Artificial Sequence
  chemically synthesized
aacagaaaagatagaaagaaca

SEQ ID NO: 651123 - DNA, 22 bp, Artificial Sequence
  chemically synthesized
gctttgcaaccattgttctttc

SEQ ID NO: 651124 - DNA, 22 bp, Artificial Sequence
  chemically synthesized
tgaaaagccagcctagctttgc

SEQ ID NO: 651125 - DNA, 22 bp, Artificial Sequence
  chemically synthesized
caaagctaggctggcttttcac

SEQ ID NO: 651126 - DNA, 22 bp, Artificial Sequence
  chemically synthesized
cagaaacaagctgtgaaaagcc

SEQ ID NO: 651127 - DNA, 22 bp, Artificial Sequence
  chemically synthesized
gcagaaacaagctgtgaaaagc

SEQ ID NO: 651128 - DNA, 22 bp, Artificial Sequence
  chemically synthesized
ggctggcttttcacagcttgtt

SEQ ID NO: 651129 - DNA, 22 bp, Artificial Sequence
  chemically synthesized
gcttttcacagcttgtttctgc

SEQ ID NO: 651130 - DNA, 22 bp, Artificial Sequence
  chemically synthesized
ttcacagcttgtttctgcaaat

SEQ ID NO: 651131 - DNA, 22 bp, Artificial Sequence
  chemically synthesized
tcacagcttgtttctgcaaatg

SEQ ID NO: 651132 - DNA, 22 bp, Artificial Sequence
  chemically synthesized
gatatcagggagcatttgcaga

SEQ ID NO: 651133 - DNA, 22 bp, Artificial Sequence
  chemically synthesized
cacagcttgtttctgcaaatgc

SEQ ID NO: 651134 - DNA, 22 bp, Artificial Sequence
  chemically synthesized
ggatatcagggagcatttgcag

SEQ ID NO: 651135 - DNA, 22 bp, Artificial Sequence
  chemically synthesized
acagcttgtttctgcaaatgct

SEQ ID NO: 651136 - DNA, 22 bp, Artificial Sequence
  chemically synthesized
tggatatcagggagcatttgca

SEQ ID NO: 651137 - DNA, 22 bp, Artificial Sequence
  chemically synthesized
tttggatatcagggagcatttg

SEQ ID NO: 651138 - DNA, 22 bp, Artificial Sequence
  chemically synthesized
gtttctgcaaatgctccctgat

SEQ ID NO: 651139 - DNA, 22 bp, Artificial Sequence
  chemically synthesized
tttctgcaaatgctccctgata

SEQ ID NO: 651140 - DNA, 22 bp, Artificial Sequence
  chemically synthesized
ctgcaaatgctccctgatatcc

SEQ ID NO: 651141 - DNA, 22 bp, Artificial Sequence
  chemically synthesized
tgcaaatgctccctgatatcca

SEQ ID NO: 651142 - DNA, 22 bp, Artificial Sequence
  chemically synthesized
caaatgctccctgatatccaaa

SEQ ID NO: 651143 - DNA, 22 bp, Artificial Sequence
  chemically synthesized
ggagtgggtagctctttggata

SEQ ID NO: 651144 - DNA, 22 bp, Artificial Sequence
  chemically synthesized
aggagtgggtagctctttggat

SEQ ID NO: 651145 - DNA, 22 bp, Artificial Sequence
  chemically synthesized
cctgatatccaaagagctaccc

SEQ ID NO: 651146 - DNA, 22 bp, Artificial Sequence
  chemically synthesized
atatccaaagagctacccactc

SEQ ID NO: 651147 - DNA, 22 bp, Artificial Sequence
  chemically synthesized
ccaaagccttaggagtgggtag

SEQ ID NO: 651148 - DNA, 22 bp, Artificial Sequence
  chemically synthesized
accaaagccttaggagtgggta

SEQ ID NO: 651149 - DNA, 22 bp, Artificial Sequence
  chemically synthesized
cccactcctaaggctttggtaa

SEQ ID NO: 651150 - DNA, 22 bp, Artificial Sequence
  chemically synthesized
ctaaggctttggtaaactgcca

SEQ ID NO: 651151 - DNA, 22 bp, Artificial Sequence
  chemically synthesized
aggctttggtaaactgccatta

SEQ ID NO: 651152 - DNA, 22 bp, Artificial Sequence
  chemically synthesized
gtagccaaaaagagtaatggca

SEQ ID NO: 651153 - DNA, 22 bp, Artificial Sequence
  chemically synthesized
tggtaaactgccattactcttt

SEQ ID NO: 651154 - DNA, 22 bp, Artificial Sequence
  chemically synthesized
ggtaaactgccattactctttt

SEQ ID NO: 651155 - DNA, 22 bp, Artificial Sequence
  chemically synthesized
gtaaactgccattactcttttt

SEQ ID NO: 651156 - DNA, 22 bp, Artificial Sequence
  chemically synthesized
tcatctagtagccaaaaagagt

SEQ ID NO: 651157 - DNA, 22 bp, Artificial Sequence
  chemically synthesized
gtcatctagtagccaaaaagag

SEQ ID NO: 651158 - DNA, 22 bp, Artificial Sequence
  chemically synthesized
ttgtcatctagtagccaaaaag

SEQ ID NO: 651159 - DNA, 22 bp, Artificial Sequence
  chemically synthesized
cttgtcatctagtagccaaaaa

SEQ ID NO: 651160 - DNA, 22 bp, Artificial Sequence
  chemically synthesized
tcttgtcatctagtagccaaaa

SEQ ID NO: 651161 - DNA, 22 bp, Artificial Sequence
  chemically synthesized
ttcttgtcatctagtagccaaa

SEQ ID NO: 651162 - DNA, 22 bp, Artificial Sequence
  chemically synthesized
ccattactctttttggctacta

SEQ ID NO: 651163 - DNA, 22 bp, Artificial Sequence
  chemically synthesized
ttttcttgtcatctagtagcca

SEQ ID NO: 651164 - DNA, 22 bp, Artificial Sequence
  chemically synthesized
cttttcttgtcatctagtagcc

SEQ ID NO: 651165 - DNA, 22 bp, Artificial Sequence
  chemically synthesized
tcttttcttgtcatctagtagc

SEQ ID NO: 651166 - DNA, 22 bp, Artificial Sequence
  chemically synthesized
ctctttttggctactagatgac

SEQ ID NO: 651167 - DNA, 22 bp, Artificial Sequence
  chemically synthesized
ttttcttttcttgtcatctagt

SEQ ID NO: 651168 - DNA, 22 bp, Artificial Sequence
  chemically synthesized
gttttcttttcttgtcatctag

SEQ ID NO: 651169 - DNA, 22 bp, Artificial Sequence
  chemically synthesized
tgttttcttttcttgtcatcta

SEQ ID NO: 651170 - DNA, 22 bp, Artificial Sequence
  chemically synthesized
tttttggctactagatgacaag

SEQ ID NO: 651171 - DNA, 22 bp, Artificial Sequence
  chemically synthesized
tttggctactagatgacaagaa

SEQ ID NO: 651172 - DNA, 22 bp, Artificial Sequence
  chemically synthesized
ttggctactagatgacaagaaa

SEQ ID NO: 651173 - DNA, 22 bp, Artificial Sequence
  chemically synthesized
gttttgttttcttttcttgtca

SEQ ID NO: 651174 - DNA, 22 bp, Artificial Sequence
  chemically synthesized
tggctactagatgacaagaaaa

SEQ ID NO: 651175 - DNA, 22 bp, Artificial Sequence
  chemically synthesized
ggctactagatgacaagaaaag

SEQ ID NO: 651176 - DNA, 22 bp, Artificial Sequence
  chemically synthesized
gctactagatgacaagaaaaga

SEQ ID NO: 651177 - DNA, 22 bp, Artificial Sequence
  chemically synthesized
ttggttttgttttcttttcttg

SEQ ID NO: 651178 - DNA, 22 bp, Artificial Sequence
  chemically synthesized
gttggttttgttttcttttctt

SEQ ID NO: 651179 - DNA, 22 bp, Artificial Sequence
  chemically synthesized
ctagatgacaagaaaagaaaac

SEQ ID NO: 651180 - DNA, 22 bp, Artificial Sequence
  chemically synthesized
gtttgttggttttgttttcttt

SEQ ID NO: 651181 - DNA, 22 bp, Artificial Sequence
  chemically synthesized
gatgacaagaaaagaaaacaaa

SEQ ID NO: 651182 - DNA, 22 bp, Artificial Sequence
  chemically synthesized
tcgtttgttggttttgttttct

SEQ ID NO: 651183 - DNA, 22 bp, Artificial Sequence
  chemically synthesized
ctcgtttgttggttttgttttc

SEQ ID NO: 651184 - DNA, 22 bp, Artificial Sequence
  chemically synthesized
tctcgtttgttggttttgtttt

SEQ ID NO: 651185 - DNA, 22 bp, Artificial Sequence
  chemically synthesized
cctttctcgtttgttggttttg

SEQ ID NO: 651186 - DNA, 22 bp, Artificial Sequence
  chemically synthesized
acctttctcgtttgttggtttt

SEQ ID NO: 651187 - DNA, 22 bp, Artificial Sequence
  chemically synthesized
cttacctttctcgtttgttggt

SEQ ID NO: 651188 - DNA, 22 bp, Artificial Sequence
  chemically synthesized
gcttacctttctcgtttgttgg

SEQ ID NO: 651189 - DNA, 22 bp, Artificial Sequence
  chemically synthesized
aggtgtgtagtttgcttacctt

SEQ ID NO: 651190 - DNA, 22 bp, Artificial Sequence
  chemically synthesized
gctcaggtgtgtagtttgctta

SEQ ID NO: 651191 - DNA, 22 bp, Artificial Sequence
  chemically synthesized
aataaagtctcgctcaggtgtg

SEQ ID NO: 651192 - DNA, 22 bp, Artificial Sequence
  chemically synthesized
aagctaaataaagtctcgctca

SEQ ID NO: 651193 - DNA, 22 bp, Artificial Sequence
  chemically synthesized
cacacctgagcgagactttatt

SEQ ID NO: 651194 - DNA, 22 bp, Artificial Sequence
  chemically synthesized
aaaaattaaagctaaataaagt

SEQ ID NO: 651195 - DNA, 22 bp, Artificial Sequence
  chemically synthesized
agcgagactttatttagcttta

SEQ ID NO: 651196 - DNA, 22 bp, Artificial Sequence
  chemically synthesized
tgtatcagttcaaaaattaaag

SEQ ID NO: 651197 - DNA, 22 bp, Artificial Sequence
  chemically synthesized
atgtatcagttcaaaaattaaa

SEQ ID NO: 651198 - DNA, 22 bp, Artificial Sequence
  chemically synthesized
tatgtatcagttcaaaaattaa

SEQ ID NO: 651199 - DNA, 22 bp, Artificial Sequence
  chemically synthesized
ttatgtatcagttcaaaaatta

SEQ ID NO: 651200 - DNA, 22 bp, Artificial Sequence
  chemically synthesized
tatttagctttaatttttgaac

SEQ ID NO: 651201 - DNA, 22 bp, Artificial Sequence
  chemically synthesized
atttagctttaatttttgaact

SEQ ID NO: 651202 - DNA, 22 bp, Artificial Sequence
  chemically synthesized
tttagctttaatttttgaactg

SEQ ID NO: 651203 - DNA, 22 bp, Artificial Sequence
  chemically synthesized
acttttatgtatcagttcaaaa

SEQ ID NO: 651204 - DNA, 22 bp, Artificial Sequence
  chemically synthesized
agctttaatttttgaactgata

SEQ ID NO: 651205 - DNA, 22 bp, Artificial Sequence
  chemically synthesized
gctttaatttttgaactgatac

SEQ ID NO: 651206 - DNA, 22 bp, Artificial Sequence
  chemically synthesized
gctaacttttatgtatcagttc

SEQ ID NO: 651207 - DNA, 22 bp, Artificial Sequence
  chemically synthesized
tggctaacttttatgtatcagt

SEQ ID NO: 651208 - DNA, 22 bp, Artificial Sequence
  chemically synthesized
ctggctaacttttatgtatcag

SEQ ID NO: 651209 - DNA, 22 bp, Artificial Sequence
  chemically synthesized
taatttttgaactgatacataa

SEQ ID NO: 651210 - DNA, 22 bp, Artificial Sequence
  chemically synthesized
aatttttgaactgatacataaa

SEQ ID NO: 651211 - DNA, 22 bp, Artificial Sequence
  chemically synthesized
atttttgaactgatacataaaa

SEQ ID NO: 651212 - DNA, 22 bp, Artificial Sequence
  chemically synthesized
acttctggctaacttttatgta

SEQ ID NO: 651213 - DNA, 22 bp, Artificial Sequence
  chemically synthesized
cacttctggctaacttttatgt

SEQ ID NO: 651214 - DNA, 22 bp, Artificial Sequence
  chemically synthesized
ttgaactgatacataaaagtta

SEQ ID NO: 651215 - DNA, 22 bp, Artificial Sequence
  chemically synthesized
tgaactgatacataaaagttag

SEQ ID NO: 651216 - DNA, 22 bp, Artificial Sequence
  chemically synthesized
gaactgatacataaaagttagc

SEQ ID NO: 651217 - DNA, 22 bp, Artificial Sequence
  chemically synthesized
aactgatacataaaagttagcc

SEQ ID NO: 651218 - DNA, 22 bp, Artificial Sequence
  chemically synthesized
catttcacttctggctaacttt

SEQ ID NO: 651219 - DNA, 22 bp, Artificial Sequence
  chemically synthesized
atacataaaagttagccagaag

SEQ ID NO: 651220 - DNA, 22 bp, Artificial Sequence
  chemically synthesized
tcagtaaacacctgcatttcac

SEQ ID NO: 651221 - DNA, 22 bp, Artificial Sequence
  chemically synthesized
atcagtaaacacctgcatttca

SEQ ID NO: 651222 - DNA, 22 bp, Artificial Sequence
  chemically synthesized
tatcagtaaacacctgcatttc

SEQ ID NO: 651223 - DNA, 22 bp, Artificial Sequence
  chemically synthesized
gccagaagtgaaatgcaggtgt

SEQ ID NO: 651224 - DNA, 22 bp, Artificial Sequence
  chemically synthesized
aaattttatcagtaaacacctg

SEQ ID NO: 651225 - DNA, 22 bp, Artificial Sequence
  chemically synthesized
gaaattttatcagtaaacacct

SEQ ID NO: 651226 - DNA, 22 bp, Artificial Sequence
  chemically synthesized
tgaaattttatcagtaaacacc

SEQ ID NO: 651227 - DNA, 22 bp, Artificial Sequence
  chemically synthesized
ctttgaaattttatcagtaaac

SEQ ID NO: 651228 - DNA, 22 bp, Artificial Sequence
  chemically synthesized
tccccctcctttgaaattttat

SEQ ID NO: 651229 - DNA, 22 bp, Artificial Sequence
  chemically synthesized
actgataaaatttcaaaggagg

SEQ ID NO: 651230 - DNA, 22 bp, Artificial Sequence
  chemically synthesized
ctgataaaatttcaaaggaggg

SEQ ID NO: 651231 - DNA, 22 bp, Artificial Sequence
  chemically synthesized
ataaaatttcaaaggaggggga

SEQ ID NO: 651232 - DNA, 22 bp, Artificial Sequence
  chemically synthesized
gaaaaaaaaatcagttgtcccc

SEQ ID NO: 651233 - DNA, 22 bp, Artificial Sequence
  chemically synthesized
tagaaaaaaaaatcagttgtcc

SEQ ID NO: 651234 - DNA, 22 bp, Artificial Sequence
  chemically synthesized
caaaggagggggacaactgatt

SEQ ID NO: 651235 - DNA, 22 bp, Artificial Sequence
  chemically synthesized
tctagaaaaaaaaatcagttgt

SEQ ID NO: 651236 - DNA, 22 bp, Artificial Sequence
  chemically synthesized
aaaggagggggacaactgattt

SEQ ID NO: 651237 - DNA, 22 bp, Artificial Sequence
  chemically synthesized
tgagaaacagattctctagaaa

SEQ ID NO: 651238 - DNA, 22 bp, Artificial Sequence
  chemically synthesized
tatgagaaacagattctctaga

SEQ ID NO: 651239 - DNA, 22 bp, Artificial Sequence
  chemically synthesized
atttttttttctagagaatctg

SEQ ID NO: 651240 - DNA, 22 bp, Artificial Sequence
  chemically synthesized
tgattctatgagaaacagattc

SEQ ID NO: 651241 - DNA, 22 bp, Artificial Sequence
  chemically synthesized
ttttttctagagaatctgtttc

SEQ ID NO: 651242 - DNA, 22 bp, Artificial Sequence
  chemically synthesized
tttttctagagaatctgtttct

SEQ ID NO: 651243 - DNA, 22 bp, Artificial Sequence
  chemically synthesized
ttttctagagaatctgtttctc

SEQ ID NO: 651244 - DNA, 22 bp, Artificial Sequence
  chemically synthesized
tttctagagaatctgtttctca

SEQ ID NO: 651245 - DNA, 22 bp, Artificial Sequence
  chemically synthesized
attatgattctatgagaaacag

SEQ ID NO: 651246 - DNA, 22 bp, Artificial Sequence
  chemically synthesized
ttctagagaatctgtttctcat

SEQ ID NO: 651247 - DNA, 22 bp, Artificial Sequence
  chemically synthesized
tctagagaatctgtttctcata

SEQ ID NO: 651248 - DNA, 22 bp, Artificial Sequence
  chemically synthesized
ctagagaatctgtttctcatag

SEQ ID NO: 651249 - DNA, 22 bp, Artificial Sequence
  chemically synthesized
tagagaatctgtttctcataga

SEQ ID NO: 651250 - DNA, 22 bp, Artificial Sequence
  chemically synthesized
gagaatctgtttctcatagaat

SEQ ID NO: 651251 - DNA, 22 bp, Artificial Sequence
  chemically synthesized
aagcccctcattatgattctat

SEQ ID NO: 651252 - DNA, 22 bp, Artificial Sequence
  chemically synthesized
aaagcccctcattatgattcta

SEQ ID NO: 651253 - DNA, 22 bp, Artificial Sequence
  chemically synthesized
taaagcccctcattatgattct

SEQ ID NO: 651254 - DNA, 22 bp, Artificial Sequence
  chemically synthesized
tttctcatagaatcataatgag

SEQ ID NO: 651255 - DNA, 22 bp, Artificial Sequence
  chemically synthesized
ctcatagaatcataatgagggg

SEQ ID NO: 651256 - DNA, 22 bp, Artificial Sequence
  chemically synthesized
tcatagaatcataatgaggggc

SEQ ID NO: 651257 - DNA, 22 bp, Artificial Sequence
  chemically synthesized
atagaatcataatgaggggctt

SEQ ID NO: 651258 - DNA, 22 bp, Artificial Sequence
  chemically synthesized
gaaccagatgaattttaaagcc

SEQ ID NO: 651259 - DNA, 22 bp, Artificial Sequence
  chemically synthesized
ggaaccagatgaattttaaagc

SEQ ID NO: 651260 - DNA, 22 bp, Artificial Sequence
  chemically synthesized
tggaaccagatgaattttaaag

SEQ ID NO: 651261 - DNA, 22 bp, Artificial Sequence
  chemically synthesized
gatgaggctttggaaccagatg

SEQ ID NO: 651262 - DNA, 22 bp, Artificial Sequence
  chemically synthesized
ttagatgaggctttggaaccag

SEQ ID NO: 651263 - DNA, 22 bp, Artificial Sequence
  chemically synthesized
taaaattcatctggttccaaag

SEQ ID NO: 651264 - DNA, 22 bp, Artificial Sequence
  chemically synthesized
aaaattcatctggttccaaagc

SEQ ID NO: 651265 - DNA, 22 bp, Artificial Sequence
  chemically synthesized
aaattcatctggttccaaagcc

SEQ ID NO: 651266 - DNA, 22 bp, Artificial Sequence
  chemically synthesized
tctgttagatgaggctttggaa

SEQ ID NO: 651267 - DNA, 22 bp, Artificial Sequence
  chemically synthesized
gtctgttagatgaggctttgga

SEQ ID NO: 651268 - DNA, 22 bp, Artificial Sequence
  chemically synthesized
cttgtctgttagatgaggcttt

SEQ ID NO: 651269 - DNA, 22 bp, Artificial Sequence
  chemically synthesized
gcttgtctgttagatgaggctt

SEQ ID NO: 651270 - DNA, 22 bp, Artificial Sequence
  chemically synthesized
atctggttccaaagcctcatct

SEQ ID NO: 651271 - DNA, 22 bp, Artificial Sequence
  chemically synthesized
gttccaaagcctcatctaacag

SEQ ID NO: 651272 - DNA, 22 bp, Artificial Sequence
  chemically synthesized
caaagcctcatctaacagacaa

SEQ ID NO: 651273 - DNA, 22 bp, Artificial Sequence
  chemically synthesized
caaaatcagtttgcttgtctgt

SEQ ID NO: 651274 - DNA, 22 bp, Artificial Sequence
  chemically synthesized
gtctacaaaatcagtttgcttg

SEQ ID NO: 651275 - DNA, 22 bp, Artificial Sequence
  chemically synthesized
atctaacagacaagcaaactga

SEQ ID NO: 651276 - DNA, 22 bp, Artificial Sequence
  chemically synthesized
tggtctacaaaatcagtttgct

SEQ ID NO: 651277 - DNA, 22 bp, Artificial Sequence
  chemically synthesized
ctggtctacaaaatcagtttgc

SEQ ID NO: 651278 - DNA, 22 bp, Artificial Sequence
  chemically synthesized
tctggtctacaaaatcagtttg

SEQ ID NO: 651279 - DNA, 22 bp, Artificial Sequence
  chemically synthesized
ttctggtctacaaaatcagttt

SEQ ID NO: 651280 - DNA, 22 bp, Artificial Sequence
  chemically synthesized
acagacaagcaaactgattttg

SEQ ID NO: 651281 - DNA, 22 bp, Artificial Sequence
  chemically synthesized
cttttctggtctacaaaatcag

SEQ ID NO: 651282 - DNA, 22 bp, Artificial Sequence
  chemically synthesized
aaaagctccttttctggtctac

SEQ ID NO: 651283 - DNA, 22 bp, Artificial Sequence
  chemically synthesized
gaaaagctccttttctggtcta

SEQ ID NO: 651284 - DNA, 22 bp, Artificial Sequence
  chemically synthesized
tgaaaagctccttttctggtct

SEQ ID NO: 651285 - DNA, 22 bp, Artificial Sequence
  chemically synthesized
attttgtagaccagaaaaggag

SEQ ID NO: 651286 - DNA, 22 bp, Artificial Sequence
  chemically synthesized
tgtagaccagaaaaggagcttt

SEQ ID NO: 651287 - DNA, 22 bp, Artificial Sequence
  chemically synthesized
tatggcctttgaaaagctcctt

SEQ ID NO: 651288 - DNA, 22 bp, Artificial Sequence
  chemically synthesized
gtagaccagaaaaggagctttt

SEQ ID NO: 651289 - DNA, 22 bp, Artificial Sequence
  chemically synthesized
tagaccagaaaaggagcttttc

SEQ ID NO: 651290 - DNA, 22 bp, Artificial Sequence
  chemically synthesized
gctgtatggcctttgaaaagct

SEQ ID NO: 651291 - DNA, 22 bp, Artificial Sequence
  chemically synthesized
ctagctgtatggcctttgaaaa

SEQ ID NO: 651292 - DNA, 22 bp, Artificial Sequence
  chemically synthesized
ctgctagctgtatggcctttga

SEQ ID NO: 651293 - DNA, 22 bp, Artificial Sequence
  chemically synthesized
tgctgctagctgtatggccttt

SEQ ID NO: 651294 - DNA, 22 bp, Artificial Sequence
  chemically synthesized
tcagctctgctgctagctgtat

SEQ ID NO: 651295 - DNA, 22 bp, Artificial Sequence
  chemically synthesized
ttcaaaggccatacagctagca

SEQ ID NO: 651296 - DNA, 22 bp, Artificial Sequence
  chemically synthesized
tcaaaggccatacagctagcag

SEQ ID NO: 651297 - DNA, 22 bp, Artificial Sequence
  chemically synthesized
ttatcagctctgctgctagctg

SEQ ID NO: 651298 - DNA, 22 bp, Artificial Sequence
  chemically synthesized
caaaggccatacagctagcagc

SEQ ID NO: 651299 - DNA, 22 bp, Artificial Sequence
  chemically synthesized
aaaggccatacagctagcagca

SEQ ID NO: 651300 - DNA, 22 bp, Artificial Sequence
  chemically synthesized
tattatcagctctgctgctagc

SEQ ID NO: 651301 - DNA, 22 bp, Artificial Sequence
  chemically synthesized
gattctattatcagctctgctg

SEQ ID NO: 651302 - DNA, 22 bp, Artificial Sequence
  chemically synthesized
ggattctattatcagctctgct

SEQ ID NO: 651303 - DNA, 22 bp, Artificial Sequence
  chemically synthesized
gcagcagagctgataatagaat

SEQ ID NO: 651304 - DNA, 22 bp, Artificial Sequence
  chemically synthesized
agccaggaggtttggattctat

SEQ ID NO: 651305 - DNA, 22 bp, Artificial Sequence
  chemically synthesized
ataatagaatccaaacctcctg

SEQ ID NO: 651306 - DNA, 22 bp, Artificial Sequence
  chemically synthesized
ctggcttagcgctgttttcatg

SEQ ID NO: 651307 - DNA, 22 bp, Artificial Sequence
  chemically synthesized
gcttagcgctgttttcatgatg

SEQ ID NO: 651308 - DNA, 22 bp, Artificial Sequence
  chemically synthesized
agcgctgttttcatgatgccct

SEQ ID NO: 651309 - DNA, 22 bp, Artificial Sequence
  chemically synthesized
gcgctgttttcatgatgccctg

SEQ ID NO: 651310 - DNA, 22 bp, Artificial Sequence
  chemically synthesized
ttttcatgatgccctgttgatt

SEQ ID NO: 651311 - DNA, 22 bp, Artificial Sequence
  chemically synthesized
tcatgatgccctgttgattctg

SEQ ID NO: 651312 - DNA, 22 bp, Artificial Sequence
  chemically synthesized
catgatgccctgttgattctgt

SEQ ID NO: 651313 - DNA, 22 bp, Artificial Sequence
  chemically synthesized
atgatgccctgttgattctgtc

SEQ ID NO: 651314 - DNA, 22 bp, Artificial Sequence
  chemically synthesized
ttgattctgtctgcctctctat

SEQ ID NO: 651315 - DNA, 22 bp, Artificial Sequence
  chemically synthesized
aaagagagagaaatagagaggc

SEQ ID NO: 651316 - DNA, 22 bp, Artificial Sequence
  chemically synthesized
gaaagagagagaaatagagagg

SEQ ID NO: 651317 - DNA, 22 bp, Artificial Sequence
  chemically synthesized
tgaaagagagagaaatagagag

SEQ ID NO: 651318 - DNA, 22 bp, Artificial Sequence
  chemically synthesized
attctgtctgcctctctatttc

SEQ ID NO: 651319 - DNA, 22 bp, Artificial Sequence
  chemically synthesized
tgtctgcctctctatttctctc

SEQ ID NO: 651320 - DNA, 22 bp, Artificial Sequence
  chemically synthesized
gactttgaaagagagagaaata

SEQ ID NO: 651321 - DNA, 22 bp, Artificial Sequence
  chemically synthesized
agactttgaaagagagagaaat

SEQ ID NO: 651322 - DNA, 22 bp, Artificial Sequence
  chemically synthesized
tctgcctctctatttctctctc

SEQ ID NO: 651323 - DNA, 22 bp, Artificial Sequence
  chemically synthesized
cctctctatttctctctctttc

SEQ ID NO: 651324 - DNA, 22 bp, Artificial Sequence
  chemically synthesized
catttagactttgaaagagaga

SEQ ID NO: 651325 - DNA, 22 bp, Artificial Sequence
  chemically synthesized
acatttagactttgaaagagag

SEQ ID NO: 651326 - DNA, 22 bp, Artificial Sequence
  chemically synthesized
ttacatttagactttgaaagag

SEQ ID NO: 651327 - DNA, 22 bp, Artificial Sequence
  chemically synthesized
tctatttctctctctttcaaag

SEQ ID NO: 651328 - DNA, 22 bp, Artificial Sequence
  chemically synthesized
cttacatttagactttgaaaga

SEQ ID NO: 651329 - DNA, 22 bp, Artificial Sequence
  chemically synthesized
tatttctctctctttcaaagtc

SEQ ID NO: 651330 - DNA, 22 bp, Artificial Sequence
  chemically synthesized
tttctctctctttcaaagtcta

SEQ ID NO: 651331 - DNA, 22 bp, Artificial Sequence
  chemically synthesized
tatttcttacatttagactttg

SEQ ID NO: 651332 - DNA, 22 bp, Artificial Sequence
  chemically synthesized
ctctctctttcaaagtctaaat

SEQ ID NO: 651333 - DNA, 22 bp, Artificial Sequence
  chemically synthesized
tctctctttcaaagtctaaatg

SEQ ID NO: 651334 - DNA, 22 bp, Artificial Sequence
  chemically synthesized
tctctttcaaagtctaaatgta

SEQ ID NO: 651335 - DNA, 22 bp, Artificial Sequence
  chemically synthesized
tctttcaaagtctaaatgtaag

SEQ ID NO: 651336 - DNA, 22 bp, Artificial Sequence
  chemically synthesized
tttcaaagtctaaatgtaagaa

SEQ ID NO: 651337 - DNA, 22 bp, Artificial Sequence
  chemically synthesized
ggatgaattgtatttcttacat

SEQ ID NO: 651338 - DNA, 22 bp, Artificial Sequence
  chemically synthesized
tcaaagtctaaatgtaagaaat

SEQ ID NO: 651339 - DNA, 22 bp, Artificial Sequence
  chemically synthesized
caaagtctaaatgtaagaaata

SEQ ID NO: 651340 - DNA, 22 bp, Artificial Sequence
  chemically synthesized
aaagtctaaatgtaagaaatac

SEQ ID NO: 651341 - DNA, 22 bp, Artificial Sequence
  chemically synthesized
tctgggatgaattgtatttctt

SEQ ID NO: 651342 - DNA, 22 bp, Artificial Sequence
  chemically synthesized
tcctgtctgggatgaattgtat

SEQ ID NO: 651343 - DNA, 22 bp, Artificial Sequence
  chemically synthesized
aatgtaagaaatacaattcatc

SEQ ID NO: 651344 - DNA, 22 bp, Artificial Sequence
  chemically synthesized
agatcattgtcctgtctgggat

SEQ ID NO: 651345 - DNA, 22 bp, Artificial Sequence
  chemically synthesized
ttgagatcattgtcctgtctgg

SEQ ID NO: 651346 - DNA, 22 bp, Artificial Sequence
  chemically synthesized
agattgttgagatcattgtcct

SEQ ID NO: 651347 - DNA, 22 bp, Artificial Sequence
  chemically synthesized
gagattgttgagatcattgtcc

SEQ ID NO: 651348 - DNA, 22 bp, Artificial Sequence
  chemically synthesized
tgagattgttgagatcattgtc

SEQ ID NO: 651349 - DNA, 22 bp, Artificial Sequence
  chemically synthesized
atcccagacaggacaatgatct

SEQ ID NO: 651350 - DNA, 22 bp, Artificial Sequence
  chemically synthesized
aacaatctcaaaataccaccat

SEQ ID NO: 651351 - DNA, 22 bp, Artificial Sequence
  chemically synthesized
aaaataccaccatttgatttat

SEQ ID NO: 651352 - DNA, 22 bp, Artificial Sequence
  chemically synthesized
atgaatatagtaacatataaat

SEQ ID NO: 651353 - DNA, 22 bp, Artificial Sequence
  chemically synthesized
aaattcatgaatatagtaacat

SEQ ID NO: 651354 - DNA, 22 bp, Artificial Sequence
  chemically synthesized
gatttatatgttactatattca

SEQ ID NO: 651355 - DNA, 22 bp, Artificial Sequence
  chemically synthesized
atttatatgttactatattcat

SEQ ID NO: 651356 - DNA, 22 bp, Artificial Sequence
  chemically synthesized
atatgttactatattcatgaat

SEQ ID NO: 651357 - DNA, 22 bp, Artificial Sequence
  chemically synthesized
tatgttactatattcatgaatt

SEQ ID NO: 651358 - DNA, 22 bp, Artificial Sequence
  chemically synthesized
ctatattcatgaattttaatta

SEQ ID NO: 651359 - DNA, 22 bp, Artificial Sequence
  chemically synthesized
aaaaaaacaaggtataattaaa

SEQ ID NO: 651360 - DNA, 22 bp, Artificial Sequence
  chemically synthesized
tattcatgaattttaattatac

SEQ ID NO: 651361 - DNA, 22 bp, Artificial Sequence
  chemically synthesized
atgaattttaattataccttgt

SEQ ID NO: 651362 - DNA, 22 bp, Artificial Sequence
  chemically synthesized
tagggttgaaaaaaacaaggta

SEQ ID NO: 651363 - DNA, 22 bp, Artificial Sequence
  chemically synthesized
taattataccttgtttttttca

SEQ ID NO: 651364 - DNA, 22 bp, Artificial Sequence
  chemically synthesized
aattataccttgtttttttcaa

SEQ ID NO: 651365 - DNA, 22 bp, Artificial Sequence
  chemically synthesized
attataccttgtttttttcaac

SEQ ID NO: 651366 - DNA, 22 bp, Artificial Sequence
  chemically synthesized
aaacaatcctatagggttgaaa

SEQ ID NO: 651367 - DNA, 22 bp, Artificial Sequence
  chemically synthesized
taccttgtttttttcaacccta

SEQ ID NO: 651368 - DNA, 22 bp, Artificial Sequence
  chemically synthesized
gtttttttcaaccctataggat

SEQ ID NO: 651369 - DNA, 22 bp, Artificial Sequence
  chemically synthesized
tttttttcaaccctataggatt

SEQ ID NO: 651370 - DNA, 22 bp, Artificial Sequence
  chemically synthesized
ttttcaaccctataggattgtt

SEQ ID NO: 651371 - DNA, 22 bp, Artificial Sequence
  chemically synthesized
tttcaaccctataggattgttt

SEQ ID NO: 651372 - DNA, 22 bp, Artificial Sequence
  chemically synthesized
ttcaaccctataggattgtttt

SEQ ID NO: 651373 - DNA, 22 bp, Artificial Sequence
  chemically synthesized
tcaaccctataggattgtttta

SEQ ID NO: 651374 - DNA, 22 bp, Artificial Sequence
  chemically synthesized
caaccctataggattgttttaa

SEQ ID NO: 651375 - DNA, 22 bp, Artificial Sequence
  chemically synthesized
aaccctataggattgttttaat

SEQ ID NO: 651376 - DNA, 22 bp, Artificial Sequence
  chemically synthesized
ataatataaaaaattaaaacaa

SEQ ID NO: 651377 - DNA, 22 bp, Artificial Sequence
  chemically synthesized
tctaataatataaaaaattaaa

SEQ ID NO: 651378 - DNA, 22 bp, Artificial Sequence
  chemically synthesized
taggattgttttaattttttat

SEQ ID NO: 651379 - DNA, 22 bp, Artificial Sequence
  chemically synthesized
ttttaattttttatattattag

SEQ ID NO: 651380 - DNA, 22 bp, Artificial Sequence
  chemically synthesized
taattttttatattattagata

SEQ ID NO: 651381 - DNA, 22 bp, Artificial Sequence
  chemically synthesized
aattttttatattattagatag

SEQ ID NO: 651382 - DNA, 22 bp, Artificial Sequence
  chemically synthesized
attttttatattattagataga

SEQ ID NO: 651383 - DNA, 22 bp, Artificial Sequence
  chemically synthesized
tttatattattagatagattga

SEQ ID NO: 651384 - DNA, 22 bp, Artificial Sequence
  chemically synthesized
ttatattattagatagattgac

SEQ ID NO: 651385 - DNA, 22 bp, Artificial Sequence
  chemically synthesized
tatattattagatagattgacc

SEQ ID NO: 651386 - DNA, 22 bp, Artificial Sequence
  chemically synthesized
atattattagatagattgacct

SEQ ID NO: 651387 - DNA, 22 bp, Artificial Sequence
  chemically synthesized
tattattagatagattgaccta

SEQ ID NO: 651388 - DNA, 22 bp, Artificial Sequence
  chemically synthesized
ttagatagattgacctatatat

SEQ ID NO: 651389 - DNA, 22 bp, Artificial Sequence
  chemically synthesized
gatagattgacctatatattga

SEQ ID NO: 651390 - DNA, 22 bp, Artificial Sequence
  chemically synthesized
acctatatattgactacttttt

SEQ ID NO: 651391 - DNA, 22 bp, Artificial Sequence
  chemically synthesized
tatattgactacttttttgctc

SEQ ID NO: 651392 - DNA, 22 bp, Artificial Sequence
  chemically synthesized
actacttttttgctcttcattg

SEQ ID NO: 651393 - DNA, 22 bp, Artificial Sequence
  chemically synthesized
agatgaaagaaagcaatgaaga

SEQ ID NO: 651394 - DNA, 22 bp, Artificial Sequence
  chemically synthesized
gagatgaaagaaagcaatgaag

SEQ ID NO: 651395 - DNA, 22 bp, Artificial Sequence
  chemically synthesized
cttttttgctcttcattgcttt

SEQ ID NO: 651396 - DNA, 22 bp, Artificial Sequence
  chemically synthesized
ttttgctcttcattgctttctt

SEQ ID NO: 651397 - DNA, 22 bp, Artificial Sequence
  chemically synthesized
tttgctcttcattgctttcttt

SEQ ID NO: 651398 - DNA, 22 bp, Artificial Sequence
  chemically synthesized
ttgctcttcattgctttctttc

SEQ ID NO: 651399 - DNA, 22 bp, Artificial Sequence
  chemically synthesized
tgctcttcattgctttctttca

SEQ ID NO: 651400 - DNA, 22 bp, Artificial Sequence
  chemically synthesized
gctcttcattgctttctttcat

SEQ ID NO: 651401 - DNA, 22 bp, Artificial Sequence
  chemically synthesized
ctcttcattgctttctttcatc

SEQ ID NO: 651402 - DNA, 22 bp, Artificial Sequence
  chemically synthesized
ttcattgctttctttcatctca

SEQ ID NO: 651403 - DNA, 22 bp, Artificial Sequence
  chemically synthesized
cattgctttctttcatctcaaa

SEQ ID NO: 651404 - DNA, 22 bp, Artificial Sequence
  chemically synthesized
attgctttctttcatctcaaat

SEQ ID NO: 651405 - DNA, 22 bp, Artificial Sequence
  chemically synthesized
atcccagatggaagatttgaga

SEQ ID NO: 651406 - DNA, 22 bp, Artificial Sequence
  chemically synthesized
ctttctttcatctcaaatcttc

SEQ ID NO: 651407 - DNA, 22 bp, Artificial Sequence
  chemically synthesized
tctttcatctcaaatcttccat

SEQ ID NO: 651408 - DNA, 22 bp, Artificial Sequence
  chemically synthesized
ctttcatctcaaatcttccatc

SEQ ID NO: 651409 - DNA, 22 bp, Artificial Sequence
  chemically synthesized
tttcatctcaaatcttccatct

SEQ ID NO: 651410 - DNA, 22 bp, Artificial Sequence
  chemically synthesized
tcatctcaaatcttccatctgg

SEQ ID NO: 651411 - DNA, 22 bp, Artificial Sequence
  chemically synthesized
catctcaaatcttccatctggg

SEQ ID NO: 651412 - DNA, 22 bp, Artificial Sequence
  chemically synthesized
atctcaaatcttccatctggga

SEQ ID NO: 651413 - DNA, 22 bp, Artificial Sequence
  chemically synthesized
aggcagaactaatcccagatgg

SEQ ID NO: 651414 - DNA, 22 bp, Artificial Sequence
  chemically synthesized
caggcagaactaatcccagatg

SEQ ID NO: 651415 - DNA, 22 bp, Artificial Sequence
  chemically synthesized
aaatcttccatctgggattagt

SEQ ID NO: 651416 - DNA, 22 bp, Artificial Sequence
  chemically synthesized
ccatctgggattagttctgcct

SEQ ID NO: 651417 - DNA, 22 bp, Artificial Sequence
  chemically synthesized
catctgggattagttctgcctg

SEQ ID NO: 651418 - DNA, 22 bp, Artificial Sequence
  chemically synthesized
agggacatatttcaggcagaac

SEQ ID NO: 651419 - DNA, 22 bp, Artificial Sequence
  chemically synthesized
taagggacatatttcaggcaga

SEQ ID NO: 651420 - DNA, 22 bp, Artificial Sequence
  chemically synthesized
ggattagttctgcctgaaatat

SEQ ID NO: 651421 - DNA, 22 bp, Artificial Sequence
  chemically synthesized
gttctgcctgaaatatgtccct

SEQ ID NO: 651422 - DNA, 22 bp, Artificial Sequence
  chemically synthesized
aaggaaattctaagggacatat

SEQ ID NO: 651423 - DNA, 22 bp, Artificial Sequence
  chemically synthesized
tgcctgaaatatgtcccttaga

SEQ ID NO: 651424 - DNA, 22 bp, Artificial Sequence
  chemically synthesized
cctgaaatatgtcccttagaat

SEQ ID NO: 651425 - DNA, 22 bp, Artificial Sequence
  chemically synthesized
aaatatgtcccttagaatttcc

SEQ ID NO: 651426 - DNA, 22 bp, Artificial Sequence
  chemically synthesized
agaaatgcaccaccaacagcta

SEQ ID NO: 651427 - DNA, 22 bp, Artificial Sequence
  chemically synthesized
agaatttcctttagctgttggt

SEQ ID NO: 651428 - DNA, 22 bp, Artificial Sequence
  chemically synthesized
gagaaatgcaccaccaacagct

SEQ ID NO: 651429 - DNA, 22 bp, Artificial Sequence
  chemically synthesized
gaatttcctttagctgttggtg

SEQ ID NO: 651430 - DNA, 22 bp, Artificial Sequence
  chemically synthesized
cctttagctgttggtggtgcat

SEQ ID NO: 651431 - DNA, 22 bp, Artificial Sequence
  chemically synthesized
ctttagctgttggtggtgcatt

SEQ ID NO: 651432 - DNA, 22 bp, Artificial Sequence
  chemically synthesized
tagctgttggtggtgcatttct

SEQ ID NO: 651433 - DNA, 22 bp, Artificial Sequence
  chemically synthesized
agctgttggtggtgcatttctc

SEQ ID NO: 651434 - DNA, 22 bp, Artificial Sequence
  chemically synthesized
gctgttggtggtgcatttctca

SEQ ID NO: 651435 - DNA, 22 bp, Artificial Sequence
  chemically synthesized
agacaaacagagcttgagaaat

SEQ ID NO: 651436 - DNA, 22 bp, Artificial Sequence
  chemically synthesized
cagacaaacagagcttgagaaa

SEQ ID NO: 651437 - DNA, 22 bp, Artificial Sequence
  chemically synthesized
ttggtggtgcatttctcaagct

SEQ ID NO: 651438 - DNA, 22 bp, Artificial Sequence
  chemically synthesized
tcagacaaacagagcttgagaa

SEQ ID NO: 651439 - DNA, 22 bp, Artificial Sequence
  chemically synthesized
gtggtgcatttctcaagctctg

SEQ ID NO: 651440 - DNA, 22 bp, Artificial Sequence
  chemically synthesized
ctcaagctctgtttgtctgaaa

SEQ ID NO: 651441 - DNA, 22 bp, Artificial Sequence
  chemically synthesized
tcaagctctgtttgtctgaaaa

SEQ ID NO: 651442 - DNA, 22 bp, Artificial Sequence
  chemically synthesized
aaaaaaggaggtattttcagac

SEQ ID NO: 651443 - DNA, 22 bp, Artificial Sequence
  chemically synthesized
aagctctgtttgtctgaaaata

SEQ ID NO: 651444 - DNA, 22 bp, Artificial Sequence
  chemically synthesized
aaaaaaaggaggtattttcaga

SEQ ID NO: 651445 - DNA, 22 bp, Artificial Sequence
  chemically synthesized
taaaaaaaggaggtattttcag

SEQ ID NO: 651446 - DNA, 22 bp, Artificial Sequence
  chemically synthesized
ttaaaaaaaggaggtattttca

SEQ ID NO: 651447 - DNA, 22 bp, Artificial Sequence
  chemically synthesized
tttaaaaaaaggaggtattttc

SEQ ID NO: 651448 - DNA, 22 bp, Artificial Sequence
  chemically synthesized
ttttaaaaaaaggaggtatttt

SEQ ID NO: 651449 - DNA, 22 bp, Artificial Sequence
  chemically synthesized
tttttaaaaaaaggaggtattt

SEQ ID NO: 651450 - DNA, 22 bp, Artificial Sequence
  chemically synthesized
tgtttgtctgaaaatacctcct

SEQ ID NO: 651451 - DNA, 22 bp, Artificial Sequence
  chemically synthesized
ttttttaaaaaaaggaggtatt

SEQ ID NO: 651452 - DNA, 22 bp, Artificial Sequence
  chemically synthesized
tttttttaaaaaaaggaggtat

SEQ ID NO: 651453 - DNA, 22 bp, Artificial Sequence
  chemically synthesized
tttgtctgaaaatacctccttt

SEQ ID NO: 651454 - DNA, 22 bp, Artificial Sequence
  chemically synthesized
gtctgaaaatacctcctttttt

SEQ ID NO: 651455 - DNA, 22 bp, Artificial Sequence
  chemically synthesized
tctgaaaatacctccttttttt

SEQ ID NO: 651456 - DNA, 22 bp, Artificial Sequence
  chemically synthesized
aaaatacctcctttttttaaaa

SEQ ID NO: 651457 - DNA, 22 bp, Artificial Sequence
  chemically synthesized
tcaggaatatggattttttttt

SEQ ID NO: 651458 - DNA, 22 bp, Artificial Sequence
  chemically synthesized
ctttttttaaaaaaaaaatcca

SEQ ID NO: 651459 - DNA, 22 bp, Artificial Sequence
  chemically synthesized
tttttaaaaaaaaaatccatat

SEQ ID NO: 651460 - DNA, 22 bp, Artificial Sequence
  chemically synthesized
ttttaaaaaaaaaatccatatt

SEQ ID NO: 651461 - DNA, 22 bp, Artificial Sequence
  chemically synthesized
tttaaaaaaaaaatccatattc

SEQ ID NO: 651462 - DNA, 22 bp, Artificial Sequence
  chemically synthesized
ttaaaaaaaaaatccatattcc

SEQ ID NO: 651463 - DNA, 22 bp, Artificial Sequence
  chemically synthesized
taaaaaaaaaatccatattcct

SEQ ID NO: 651464 - DNA, 22 bp, Artificial Sequence
  chemically synthesized
aaaaaaaaaatccatattcctg

SEQ ID NO: 651465 - DNA, 22 bp, Artificial Sequence
  chemically synthesized
aaaaaaaaatccatattcctga

SEQ ID NO: 651466 - DNA, 22 bp, Artificial Sequence
  chemically synthesized
atgaagataactatcaggaata

SEQ ID NO: 651467 - DNA, 22 bp, Artificial Sequence
  chemically synthesized
aatgaagataactatcaggaat

SEQ ID NO: 651468 - DNA, 22 bp, Artificial Sequence
  chemically synthesized
tatttaatgaagataactatca

SEQ ID NO: 651469 - DNA, 22 bp, Artificial Sequence
  chemically synthesized
ctgatagttatcttcattaaat

SEQ ID NO: 651470 - DNA, 22 bp, Artificial Sequence
  chemically synthesized
atagttatcttcattaaataca

SEQ ID NO: 651471 - DNA, 22 bp, Artificial Sequence
  chemically synthesized
aaaaaaaaaaaaaattgtattt

SEQ ID NO: 651472 - DNA, 22 bp, Artificial Sequence
  chemically synthesized
tcttcattaaatacaatttttt

SEQ ID NO: 651473 - DNA, 22 bp, Artificial Sequence
  chemically synthesized
cattaaatacaatttttttttt

SEQ ID NO: 651474 - DNA, 22 bp, Artificial Sequence
  chemically synthesized
attaaatacaattttttttttt

SEQ ID NO: 651475 - DNA, 22 bp, Artificial Sequence
  chemically synthesized
aatacaattttttttttttttg

SEQ ID NO: 651476 - DNA, 22 bp, Artificial Sequence
  chemically synthesized
tttttttttttgagactgactc

SEQ ID NO: 651477 - DNA, 22 bp, Artificial Sequence
  chemically synthesized
ttttttttttgagactgactct

SEQ ID NO: 651478 - DNA, 22 bp, Artificial Sequence
  chemically synthesized
ggcaatagagatagagtcagtc

SEQ ID NO: 651479 - DNA, 22 bp, Artificial Sequence
  chemically synthesized
tttttttttgagactgactcta

SEQ ID NO: 651480 - DNA, 22 bp, Artificial Sequence
  chemically synthesized
ttttttttgagactgactctat

SEQ ID NO: 651481 - DNA, 22 bp, Artificial Sequence
  chemically synthesized
tttttttgagactgactctatc

SEQ ID NO: 651482 - DNA, 22 bp, Artificial Sequence
  chemically synthesized
ttttttgagactgactctatct

SEQ ID NO: 651483 - DNA, 22 bp, Artificial Sequence
  chemically synthesized
tttttgagactgactctatctc

SEQ ID NO: 651484 - DNA, 22 bp, Artificial Sequence
  chemically synthesized
ttttgagactgactctatctct

SEQ ID NO: 651485 - DNA, 22 bp, Artificial Sequence
  chemically synthesized
tttgagactgactctatctcta

SEQ ID NO: 651486 - DNA, 22 bp, Artificial Sequence
  chemically synthesized
cagcctgggcaatagagataga

SEQ ID NO: 651487 - DNA, 22 bp, Artificial Sequence
  chemically synthesized
ttgagactgactctatctctat

SEQ ID NO: 651488 - DNA, 22 bp, Artificial Sequence
  chemically synthesized
tgagactgactctatctctatt

SEQ ID NO: 651489 - DNA, 22 bp, Artificial Sequence
  chemically synthesized
gagactgactctatctctattg

SEQ ID NO: 651490 - DNA, 22 bp, Artificial Sequence
  chemically synthesized
agactgactctatctctattgc

SEQ ID NO: 651491 - DNA, 22 bp, Artificial Sequence
  chemically synthesized
cactccagcctgggcaatagag

SEQ ID NO: 651492 - DNA, 22 bp, Artificial Sequence
  chemically synthesized
actctatctctattgcccaggc

SEQ ID NO: 651493 - DNA, 22 bp, Artificial Sequence
  chemically synthesized
tatctctattgcccaggctgga

SEQ ID NO: 651494 - DNA, 22 bp, Artificial Sequence
  chemically synthesized
tctctattgcccaggctggagt

SEQ ID NO: 651495 - DNA, 22 bp, Artificial Sequence
  chemically synthesized
tattgcccaggctggagtgcag

SEQ ID NO: 651496 - DNA, 22 bp, Artificial Sequence
  chemically synthesized
ttgcccaggctggagtgcagtg

SEQ ID NO: 651497 - DNA, 22 bp, Artificial Sequence
  chemically synthesized
cccaggctggagtgcagtggcg

SEQ ID NO: 651498 - DNA, 22 bp, Artificial Sequence
  chemically synthesized
caggagccgagatcacgccact

SEQ ID NO: 651499 - DNA, 22 bp, Artificial Sequence
  chemically synthesized
gagtgcagtggcgtgatctcgg

SEQ ID NO: 651500 - DNA, 22 bp, Artificial Sequence
  chemically synthesized
aacccaggaggcggagattgca

SEQ ID NO: 651501 - DNA, 22 bp, Artificial Sequence
  chemically synthesized
gaacccaggaggcggagattgc

SEQ ID NO: 651502 - DNA, 22 bp, Artificial Sequence
  chemically synthesized
ggctcctgcaatctccgcctcc

SEQ ID NO: 651503 - DNA, 22 bp, Artificial Sequence
  chemically synthesized
ctgcaatctccgcctcctgggt

SEQ ID NO: 651504 - DNA, 22 bp, Artificial Sequence
  chemically synthesized
caatctccgcctcctgggttca

SEQ ID NO: 651505 - DNA, 22 bp, Artificial Sequence
  chemically synthesized
aggcatgagaatcacttgaacc

SEQ ID NO: 651506 - DNA, 22 bp, Artificial Sequence
  chemically synthesized
cgcctcctgggttcaagtgatt

SEQ ID NO: 651507 - DNA, 22 bp, Artificial Sequence
  chemically synthesized
ggaggctgaggcatgagaatca

SEQ ID NO: 651508 - DNA, 22 bp, Artificial Sequence
  chemically synthesized
ctgggttcaagtgattctcatg

SEQ ID NO: 651509 - DNA, 22 bp, Artificial Sequence
  chemically synthesized
gggaggctgaggcatgagaatc

SEQ ID NO: 651510 - DNA, 22 bp, Artificial Sequence
  chemically synthesized
ggttcaagtgattctcatgcct

SEQ ID NO: 651511 - DNA, 22 bp, Artificial Sequence
  chemically synthesized
cttgggaggctgaggcatgaga

SEQ ID NO: 651512 - DNA, 22 bp, Artificial Sequence
  chemically synthesized
aagtgattctcatgcctcagcc

SEQ ID NO: 651513 - DNA, 22 bp, Artificial Sequence
  chemically synthesized
tcatgcctcagcctcccaagta

SEQ ID NO: 651514 - DNA, 22 bp, Artificial Sequence
  chemically synthesized
atgcctcagcctcccaagtagc

SEQ ID NO: 651515 - DNA, 22 bp, Artificial Sequence
  chemically synthesized
agcctcccaagtagctgggacc

SEQ ID NO: 651516 - DNA, 22 bp, Artificial Sequence
  chemically synthesized
ccaagtagctgggaccatgggc

SEQ ID NO: 651517 - DNA, 22 bp, Artificial Sequence
  chemically synthesized
ggaccatgggcacacgccaccc

SEQ ID NO: 651518 - DNA, 22 bp, Artificial Sequence
  chemically synthesized
aaaatacaaaaagtagccgggt

SEQ ID NO: 651519 - DNA, 22 bp, Artificial Sequence
  chemically synthesized
ctaaaaatacaaaaagtagccg

SEQ ID NO: 651520 - DNA, 22 bp, Artificial Sequence
  chemically synthesized
tactaaaaatacaaaaagtagc

SEQ ID NO: 651521 - DNA, 22 bp, Artificial Sequence
  chemically synthesized
ctttttgtatttttagtagaga

SEQ ID NO: 651522 - DNA, 22 bp, Artificial Sequence
  chemically synthesized
tttgtatttttagtagagatgg

SEQ ID NO: 651523 - DNA, 22 bp, Artificial Sequence
  chemically synthesized
ttgtatttttagtagagatggg

SEQ ID NO: 651524 - DNA, 22 bp, Artificial Sequence
  chemically synthesized
tgtatttttagtagagatgggg

SEQ ID NO: 651525 - DNA, 22 bp, Artificial Sequence
  chemically synthesized
gtatttttagtagagatggggt

SEQ ID NO: 651526 - DNA, 22 bp, Artificial Sequence
  chemically synthesized
tatttttagtagagatggggtt

SEQ ID NO: 651527 - DNA, 22 bp, Artificial Sequence
  chemically synthesized
gtcaacatggtgaaaccccatc

SEQ ID NO: 651528 - DNA, 22 bp, Artificial Sequence
  chemically synthesized
ttagtagagatggggtttcacc

SEQ ID NO: 651529 - DNA, 22 bp, Artificial Sequence
  chemically synthesized
cctagtcaacatggtgaaaccc

SEQ ID NO: 651530 - DNA, 22 bp, Artificial Sequence
  chemically synthesized
tagtagagatggggtttcacca

SEQ ID NO: 651531 - DNA, 22 bp, Artificial Sequence
  chemically synthesized
agtagagatggggtttcaccat

SEQ ID NO: 651532 - DNA, 22 bp, Artificial Sequence
  chemically synthesized
gtagagatggggtttcaccatg

SEQ ID NO: 651533 - DNA, 22 bp, Artificial Sequence
  chemically synthesized
gagacctgcctagtcaacatgg

SEQ ID NO: 651534 - DNA, 22 bp, Artificial Sequence
  chemically synthesized
caccatgttgactaggcaggtc

SEQ ID NO: 651535 - DNA, 22 bp, Artificial Sequence
  chemically synthesized
accatgttgactaggcaggtct

SEQ ID NO: 651536 - DNA, 22 bp, Artificial Sequence
  chemically synthesized
agtcaggagttcgagacctgcc

SEQ ID NO: 651537 - DNA, 22 bp, Artificial Sequence
  chemically synthesized
aagtcaggagttcgagacctgc

SEQ ID NO: 651538 - DNA, 22 bp, Artificial Sequence
  chemically synthesized
taagtcaggagttcgagacctg

SEQ ID NO: 651539 - DNA, 22 bp, Artificial Sequence
  chemically synthesized
actaggcaggtctcgaactcct

SEQ ID NO: 651540 - DNA, 22 bp, Artificial Sequence
  chemically synthesized
ggcaggtctcgaactcctgact

SEQ ID NO: 651541 - DNA, 22 bp, Artificial Sequence
  chemically synthesized
gaactcctgacttaaaatgatc

SEQ ID NO: 651542 - DNA, 22 bp, Artificial Sequence
  chemically synthesized
ggaggccgaggcgggtggatca

SEQ ID NO: 651543 - DNA, 22 bp, Artificial Sequence
  chemically synthesized
ctgacttaaaatgatccacccg

SEQ ID NO: 651544 - DNA, 22 bp, Artificial Sequence
  chemically synthesized
gggaggccgaggcgggtggatc

SEQ ID NO: 651545 - DNA, 22 bp, Artificial Sequence
  chemically synthesized
tgggaggccgaggcgggtggat

SEQ ID NO: 651546 - DNA, 22 bp, Artificial Sequence
  chemically synthesized
acttaaaatgatccacccgcct

SEQ ID NO: 651547 - DNA, 22 bp, Artificial Sequence
  chemically synthesized
aaaatgatccacccgcctcggc

SEQ ID NO: 651548 - DNA, 22 bp, Artificial Sequence
  chemically synthesized
aaatgatccacccgcctcggcc

SEQ ID NO: 651549 - DNA, 22 bp, Artificial Sequence
  chemically synthesized
tcccagcactttgggaggccga

SEQ ID NO: 651550 - DNA, 22 bp, Artificial Sequence
  chemically synthesized
ttatcccagcactttgggaggc

SEQ ID NO: 651551 - DNA, 22 bp, Artificial Sequence
  chemically synthesized
acgcctgttatcccagcacttt

SEQ ID NO: 651552 - DNA, 22 bp, Artificial Sequence
  chemically synthesized
ggcctcccaaagtgctgggata

SEQ ID NO: 651553 - DNA, 22 bp, Artificial Sequence
  chemically synthesized
ccaaagtgctgggataacaggc

SEQ ID NO: 651554 - DNA, 22 bp, Artificial Sequence
  chemically synthesized
ggccaggcgcagtggctcacgc

SEQ ID NO: 651555 - DNA, 22 bp, Artificial Sequence
  chemically synthesized
gggccaggcgcagtggctcacg

SEQ ID NO: 651556 - DNA, 22 bp, Artificial Sequence
  chemically synthesized
ggataacaggcgtgagccactg

SEQ ID NO: 651557 - DNA, 22 bp, Artificial Sequence
  chemically synthesized
tacttgggccaggcgcagtggc

SEQ ID NO: 651558 - DNA, 22 bp, Artificial Sequence
  chemically synthesized
atacttgggccaggcgcagtgg

SEQ ID NO: 651559 - DNA, 22 bp, Artificial Sequence
  chemically synthesized
tatacttgggccaggcgcagtg

SEQ ID NO: 651560 - DNA, 22 bp, Artificial Sequence
  chemically synthesized
aatcaaaaattttatacttggg

SEQ ID NO: 651561 - DNA, 22 bp, Artificial Sequence
  chemically synthesized
caatcaaaaattttatacttgg

SEQ ID NO: 651562 - DNA, 22 bp, Artificial Sequence
  chemically synthesized
tcaatcaaaaattttatacttg

SEQ ID NO: 651563 - DNA, 22 bp, Artificial Sequence
  chemically synthesized
cgcctggcccaagtataaaatt

SEQ ID NO: 651564 - DNA, 22 bp, Artificial Sequence
  chemically synthesized
gcccaagtataaaatttttgat

SEQ ID NO: 651565 - DNA, 22 bp, Artificial Sequence
  chemically synthesized
ttgattgaaaggttttggggtc

SEQ ID NO: 651566 - DNA, 22 bp, Artificial Sequence
  chemically synthesized
tgattgaaaggttttggggtct

SEQ ID NO: 651567 - DNA, 22 bp, Artificial Sequence
  chemically synthesized
gattgaaaggttttggggtctt

SEQ ID NO: 651568 - DNA, 22 bp, Artificial Sequence
  chemically synthesized
attgaaaggttttggggtcttg

SEQ ID NO: 651569 - DNA, 22 bp, Artificial Sequence
  chemically synthesized
aaaggttttggggtcttgtttt

SEQ ID NO: 651570 - DNA, 22 bp, Artificial Sequence
  chemically synthesized
aaaaacaaaataaaaacaagac

SEQ ID NO: 651571 - DNA, 22 bp, Artificial Sequence
  chemically synthesized
agtattcaaaaacaaaataaaa

SEQ ID NO: 651572 - DNA, 22 bp, Artificial Sequence
  chemically synthesized
tggggtcttgtttttattttgt

SEQ ID NO: 651573 - DNA, 22 bp, Artificial Sequence
  chemically synthesized
cagtattcaaaaacaaaataaa

SEQ ID NO: 651574 - DNA, 22 bp, Artificial Sequence
  chemically synthesized
ggggtcttgtttttattttgtt

SEQ ID NO: 651575 - DNA, 22 bp, Artificial Sequence
  chemically synthesized
gggtcttgtttttattttgttt

SEQ ID NO: 651576 - DNA, 22 bp, Artificial Sequence
  chemically synthesized
gtttttattttgtttttgaata

SEQ ID NO: 651577 - DNA, 22 bp, Artificial Sequence
  chemically synthesized
tttttattttgtttttgaatac

SEQ ID NO: 651578 - DNA, 22 bp, Artificial Sequence
  chemically synthesized
ttattttgtttttgaatactga

SEQ ID NO: 651579 - DNA, 22 bp, Artificial Sequence
  chemically synthesized
tattttgtttttgaatactgaa

SEQ ID NO: 651580 - DNA, 22 bp, Artificial Sequence
  chemically synthesized
attttgtttttgaatactgaaa

SEQ ID NO: 651581 - DNA, 22 bp, Artificial Sequence
  chemically synthesized
ttttgtttttgaatactgaaat

SEQ ID NO: 651582 - DNA, 22 bp, Artificial Sequence
  chemically synthesized
tgtttttgaatactgaaatatt

SEQ ID NO: 651583 - DNA, 22 bp, Artificial Sequence
  chemically synthesized
gtttttgaatactgaaatatta

SEQ ID NO: 651584 - DNA, 22 bp, Artificial Sequence
  chemically synthesized
tttttgaatactgaaatattac

SEQ ID NO: 651585 - DNA, 22 bp, Artificial Sequence
  chemically synthesized
ttgaatactgaaatattactcc

SEQ ID NO: 651586 - DNA, 22 bp, Artificial Sequence
  chemically synthesized
tgaatactgaaatattactcca

SEQ ID NO: 651587 - DNA, 22 bp, Artificial Sequence
  chemically synthesized
gaatactgaaatattactccac

SEQ ID NO: 651588 - DNA, 22 bp, Artificial Sequence
  chemically synthesized
aatactgaaatattactccact

SEQ ID NO: 651589 - DNA, 22 bp, Artificial Sequence
  chemically synthesized
aaatattactccactttcgtct

SEQ ID NO: 651590 - DNA, 22 bp, Artificial Sequence
  chemically synthesized
agcagcaacagagatagacgaa

SEQ ID NO: 651591 - DNA, 22 bp, Artificial Sequence
  chemically synthesized
tcagcagcaacagagatagacg

SEQ ID NO: 651592 - DNA, 22 bp, Artificial Sequence
  chemically synthesized
ctcagcagcaacagagatagac

SEQ ID NO: 651593 - DNA, 22 bp, Artificial Sequence
  chemically synthesized
ctccactttcgtctatctctgt

SEQ ID NO: 651594 - DNA, 22 bp, Artificial Sequence
  chemically synthesized
acttctcagcagcaacagagat

SEQ ID NO: 651595 - DNA, 22 bp, Artificial Sequence
  chemically synthesized
cactttcgtctatctctgttgc

SEQ ID NO: 651596 - DNA, 22 bp, Artificial Sequence
  chemically synthesized
ttgacttctcagcagcaacaga

SEQ ID NO: 651597 - DNA, 22 bp, Artificial Sequence
  chemically synthesized
tcgtctatctctgttgctgctg

SEQ ID NO: 651598 - DNA, 22 bp, Artificial Sequence
  chemically synthesized
ctattgacttctcagcagcaac

SEQ ID NO: 651599 - DNA, 22 bp, Artificial Sequence
  chemically synthesized
cgtctatctctgttgctgctga

SEQ ID NO: 651600 - DNA, 22 bp, Artificial Sequence
  chemically synthesized
actattgacttctcagcagcaa

SEQ ID NO: 651601 - DNA, 22 bp, Artificial Sequence
  chemically synthesized
gtctatctctgttgctgctgag

SEQ ID NO: 651602 - DNA, 22 bp, Artificial Sequence
  chemically synthesized
tactattgacttctcagcagca

SEQ ID NO: 651603 - DNA, 22 bp, Artificial Sequence
  chemically synthesized
tctctgttgctgctgagaagtc

SEQ ID NO: 651604 - DNA, 22 bp, Artificial Sequence
  chemically synthesized
tgttgctgctgagaagtcaata

SEQ ID NO: 651605 - DNA, 22 bp, Artificial Sequence
  chemically synthesized
ttgctgctgagaagtcaatagt

SEQ ID NO: 651606 - DNA, 22 bp, Artificial Sequence
  chemically synthesized
ctgctgagaagtcaatagtaaa

SEQ ID NO: 651607 - DNA, 22 bp, Artificial Sequence
  chemically synthesized
ctgagaagtcaatagtaaagat

SEQ ID NO: 651608 - DNA, 22 bp, Artificial Sequence
  chemically synthesized
agaagtcaatagtaaagatgac

SEQ ID NO: 651609 - DNA, 22 bp, Artificial Sequence
  chemically synthesized
caaaggagcaacagtcatcttt

SEQ ID NO: 651610 - DNA, 22 bp, Artificial Sequence
  chemically synthesized
gcaaaggagcaacagtcatctt

SEQ ID NO: 651611 - DNA, 22 bp, Artificial Sequence
  chemically synthesized
tgcaaaggagcaacagtcatct

SEQ ID NO: 651612 - DNA, 22 bp, Artificial Sequence
  chemically synthesized
ttgcaaaggagcaacagtcatc

SEQ ID NO: 651613 - DNA, 22 bp, Artificial Sequence
  chemically synthesized
tttgcaaaggagcaacagtcat

SEQ ID NO: 651614 - DNA, 22 bp, Artificial Sequence
  chemically synthesized
atgtgttttttgcaaaggagca

SEQ ID NO: 651615 - DNA, 22 bp, Artificial Sequence
  chemically synthesized
catgtgttttttgcaaaggagc

SEQ ID NO: 651616 - DNA, 22 bp, Artificial Sequence
  chemically synthesized
tcatgtgttttttgcaaaggag

SEQ ID NO: 651617 - DNA, 22 bp, Artificial Sequence
  chemically synthesized
ttcatgtgttttttgcaaagga

SEQ ID NO: 651618 - DNA, 22 bp, Artificial Sequence
  chemically synthesized
tttcatgtgttttttgcaaagg

SEQ ID NO: 651619 - DNA, 22 bp, Artificial Sequence
  chemically synthesized
ttgctcctttgcaaaaaacaca

SEQ ID NO: 651620 - DNA, 22 bp, Artificial Sequence
  chemically synthesized
ctcctttgcaaaaaacacatga

SEQ ID NO: 651621 - DNA, 22 bp, Artificial Sequence
  chemically synthesized
ctttgcaaaaaacacatgaaaa

SEQ ID NO: 651622 - DNA, 22 bp, Artificial Sequence
  chemically synthesized
tgcaaaaaacacatgaaaaaat

SEQ ID NO: 651623 - DNA, 22 bp, Artificial Sequence
  chemically synthesized
gcaaaaaacacatgaaaaaatg

SEQ ID NO: 651624 - DNA, 22 bp, Artificial Sequence
  chemically synthesized
caaaaaacacatgaaaaaatgc

SEQ ID NO: 651625 - DNA, 22 bp, Artificial Sequence
  chemically synthesized
atggccagtgatggtgagcatt

SEQ ID NO: 651626 - DNA, 22 bp, Artificial Sequence
  chemically synthesized
tgatggccagtgatggtgagca

SEQ ID NO: 651627 - DNA, 22 bp, Artificial Sequence
  chemically synthesized
tctgatggccagtgatggtgag

SEQ ID NO: 651628 - DNA, 22 bp, Artificial Sequence
  chemically synthesized
ctctgatggccagtgatggtga

SEQ ID NO: 651629 - DNA, 22 bp, Artificial Sequence
  chemically synthesized
catttctctgatggccagtgat

SEQ ID NO: 651630 - DNA, 22 bp, Artificial Sequence
  chemically synthesized
gcatttctctgatggccagtga

SEQ ID NO: 651631 - DNA, 22 bp, Artificial Sequence
  chemically synthesized
atttgcatttctctgatggcca

SEQ ID NO: 651632 - DNA, 22 bp, Artificial Sequence
  chemically synthesized
gatttgcatttctctgatggcc

SEQ ID NO: 651633 - DNA, 22 bp, Artificial Sequence
  chemically synthesized
tgatttgcatttctctgatggc

SEQ ID NO: 651634 - DNA, 22 bp, Artificial Sequence
  chemically synthesized
accatcactggccatcagagaa

SEQ ID NO: 651635 - DNA, 22 bp, Artificial Sequence
  chemically synthesized
tggttttgatttgcatttctct

SEQ ID NO: 651636 - DNA, 22 bp, Artificial Sequence
  chemically synthesized
attgtggttttgatttgcattt

SEQ ID NO: 651637 - DNA, 22 bp, Artificial Sequence
  chemically synthesized
gccatcagagaaatgcaaatca

SEQ ID NO: 651638 - DNA, 22 bp, Artificial Sequence
  chemically synthesized
gtgtgagatggtatctcattgt

SEQ ID NO: 651639 - DNA, 22 bp, Artificial Sequence
  chemically synthesized
actggtgtgagatggtatctca

SEQ ID NO: 651640 - DNA, 22 bp, Artificial Sequence
  chemically synthesized
taactggtgtgagatggtatct

SEQ ID NO: 651641 - DNA, 22 bp, Artificial Sequence
  chemically synthesized
ccattctaactggtgtgagatg

SEQ ID NO: 651642 - DNA, 22 bp, Artificial Sequence
  chemically synthesized
atgattgccattctaactggtg

SEQ ID NO: 651643 - DNA, 22 bp, Artificial Sequence
  chemically synthesized
aatgattgccattctaactggt

SEQ ID NO: 651644 - DNA, 22 bp, Artificial Sequence
  chemically synthesized
taatgattgccattctaactgg

SEQ ID NO: 651645 - DNA, 22 bp, Artificial Sequence
  chemically synthesized
ttaatgattgccattctaactg

SEQ ID NO: 651646 - DNA, 22 bp, Artificial Sequence
  chemically synthesized
tttaatgattgccattctaact

SEQ ID NO: 651647 - DNA, 22 bp, Artificial Sequence
  chemically synthesized
actttttaatgattgccattct

SEQ ID NO: 651648 - DNA, 22 bp, Artificial Sequence
  chemically synthesized
acaccagttagaatggcaatca

SEQ ID NO: 651649 - DNA, 22 bp, Artificial Sequence
  chemically synthesized
ctgactttttaatgattgccat

SEQ ID NO: 651650 - DNA, 22 bp, Artificial Sequence
  chemically synthesized
cctgactttttaatgattgcca

SEQ ID NO: 651651 - DNA, 22 bp, Artificial Sequence
  chemically synthesized
tttcctgactttttaatgattg

SEQ ID NO: 651652 - DNA, 22 bp, Artificial Sequence
  chemically synthesized
ttgtttcctgactttttaatga

SEQ ID NO: 651653 - DNA, 22 bp, Artificial Sequence
  chemically synthesized
gaatggcaatcattaaaaagtc

SEQ ID NO: 651654 - DNA, 22 bp, Artificial Sequence
  chemically synthesized
cagcacctgttgtttcctgact

SEQ ID NO: 651655 - DNA, 22 bp, Artificial Sequence
  chemically synthesized
tccagcacctgttgtttcctga

SEQ ID NO: 651656 - DNA, 22 bp, Artificial Sequence
  chemically synthesized
aaaagtcaggaaacaacaggtg

SEQ ID NO: 651657 - DNA, 22 bp, Artificial Sequence
  chemically synthesized
cacatcctctccagcacctgtt

SEQ ID NO: 651658 - DNA, 22 bp, Artificial Sequence
  chemically synthesized
tccacatcctctccagcacctg

SEQ ID NO: 651659 - DNA, 22 bp, Artificial Sequence
  chemically synthesized
ctccacatcctctccagcacct

SEQ ID NO: 651660 - DNA, 22 bp, Artificial Sequence
  chemically synthesized
tttctccacatcctctccagca

SEQ ID NO: 651661 - DNA, 22 bp, Artificial Sequence
  chemically synthesized
ctatttctccacatcctctcca

SEQ ID NO: 651662 - DNA, 22 bp, Artificial Sequence
  chemically synthesized
gagaggatgtggagaaatagga

SEQ ID NO: 651663 - DNA, 22 bp, Artificial Sequence
  chemically synthesized
cagtcccaccaacagtgtaaaa

SEQ ID NO: 651664 - DNA, 22 bp, Artificial Sequence
  chemically synthesized
acagtcccaccaacagtgtaaa

SEQ ID NO: 651665 - DNA, 22 bp, Artificial Sequence
  chemically synthesized
gtttacagtcccaccaacagtg

SEQ ID NO: 651666 - DNA, 22 bp, Artificial Sequence
  chemically synthesized
aactagtttacagtcccaccaa

SEQ ID NO: 651667 - DNA, 22 bp, Artificial Sequence
  chemically synthesized
ttacactgttggtgggactgta

SEQ ID NO: 651668 - DNA, 22 bp, Artificial Sequence
  chemically synthesized
tacactgttggtgggactgtaa

SEQ ID NO: 651669 - DNA, 22 bp, Artificial Sequence
  chemically synthesized
acactgttggtgggactgtaaa

SEQ ID NO: 651670 - DNA, 22 bp, Artificial Sequence
  chemically synthesized
cactgttggtgggactgtaaac

SEQ ID NO: 651671 - DNA, 22 bp, Artificial Sequence
  chemically synthesized
cacaatggttgaactagtttac

SEQ ID NO: 651672 - DNA, 22 bp, Artificial Sequence
  chemically synthesized
ttggtgggactgtaaactagtt

SEQ ID NO: 651673 - DNA, 22 bp, Artificial Sequence
  chemically synthesized
ccacaatggttgaactagttta

SEQ ID NO: 651674 - DNA, 22 bp, Artificial Sequence
  chemically synthesized
gtgggactgtaaactagttcaa

SEQ ID NO: 651675 - DNA, 22 bp, Artificial Sequence
  chemically synthesized
acttccacaatggttgaactag

SEQ ID NO: 651676 - DNA, 22 bp, Artificial Sequence
  chemically synthesized
taaactagttcaaccattgtgg

SEQ ID NO: 651677 - DNA, 22 bp, Artificial Sequence
  chemically synthesized
gttcaaccattgtggaagtcag

SEQ ID NO: 651678 - DNA, 22 bp, Artificial Sequence
  chemically synthesized
aggaatcgccacactgacttcc

SEQ ID NO: 651679 - DNA, 22 bp, Artificial Sequence
  chemically synthesized
aaccattgtggaagtcagtgtg

SEQ ID NO: 651680 - DNA, 22 bp, Artificial Sequence
  chemically synthesized
gatccctgaggaatcgccacac

SEQ ID NO: 651681 - DNA, 22 bp, Artificial Sequence
  chemically synthesized
tagatccctgaggaatcgccac

SEQ ID NO: 651682 - DNA, 22 bp, Artificial Sequence
  chemically synthesized
tggaagtcagtgtggcgattcc

SEQ ID NO: 651683 - DNA, 22 bp, Artificial Sequence
  chemically synthesized
gttctagatccctgaggaatcg

SEQ ID NO: 651684 - DNA, 22 bp, Artificial Sequence
  chemically synthesized
tagttctagatccctgaggaat

SEQ ID NO: 651685 - DNA, 22 bp, Artificial Sequence
  chemically synthesized
ctagttctagatccctgaggaa

SEQ ID NO: 651686 - DNA, 22 bp, Artificial Sequence
  chemically synthesized
ctcagggatctagaactagaaa

SEQ ID NO: 651687 - DNA, 22 bp, Artificial Sequence
  chemically synthesized
ggtcaaatggtatttctagttc

SEQ ID NO: 651688 - DNA, 22 bp, Artificial Sequence
  chemically synthesized
agggatctagaactagaaatac

SEQ ID NO: 651689 - DNA, 22 bp, Artificial Sequence
  chemically synthesized
gaactagaaataccatttgacc

SEQ ID NO: 651690 - DNA, 22 bp, Artificial Sequence
  chemically synthesized
gaaataccatttgacccagcca

SEQ ID NO: 651691 - DNA, 22 bp, Artificial Sequence
  chemically synthesized
ggtatatacccagtaatgggat

SEQ ID NO: 651692 - DNA, 22 bp, Artificial Sequence
  chemically synthesized
gggtatatacccagtaatggga

SEQ ID NO: 651693 - DNA, 22 bp, Artificial Sequence
  chemically synthesized
tgggtatatacccagtaatggg

SEQ ID NO: 651694 - DNA, 22 bp, Artificial Sequence
  chemically synthesized
gacccagccatcccattactgg

SEQ ID NO: 651695 - DNA, 22 bp, Artificial Sequence
  chemically synthesized
acccagccatcccattactggg

SEQ ID NO: 651696 - DNA, 22 bp, Artificial Sequence
  chemically synthesized
tagtcctttgggtatataccca

SEQ ID NO: 651697 - DNA, 22 bp, Artificial Sequence
  chemically synthesized
atagtcctttgggtatataccc

SEQ ID NO: 651698 - DNA, 22 bp, Artificial Sequence
  chemically synthesized
ctgggtatatacccaaaggact

SEQ ID NO: 651699 - DNA, 22 bp, Artificial Sequence
  chemically synthesized
ggtatatacccaaaggactata

SEQ ID NO: 651700 - DNA, 22 bp, Artificial Sequence
  chemically synthesized
tagcagcatgatttatagtcct

SEQ ID NO: 651701 - DNA, 22 bp, Artificial Sequence
  chemically synthesized
atagcagcatgatttatagtcc

SEQ ID NO: 651702 - DNA, 22 bp, Artificial Sequence
  chemically synthesized
tatagcagcatgatttatagtc

SEQ ID NO: 651703 - DNA, 22 bp, Artificial Sequence
  chemically synthesized
taaatcatgctgctataaagac

SEQ ID NO: 651704 - DNA, 22 bp, Artificial Sequence
  chemically synthesized
ctataaagacacatgcacacgt

SEQ ID NO: 651705 - DNA, 22 bp, Artificial Sequence
  chemically synthesized
taaagacacatgcacacgtatg

SEQ ID NO: 651706 - DNA, 22 bp, Artificial Sequence
  chemically synthesized
tgaatagtgccgcaataaacat

SEQ ID NO: 651707 - DNA, 22 bp, Artificial Sequence
  chemically synthesized
ttgtgaatagtgccgcaataaa

SEQ ID NO: 651708 - DNA, 22 bp, Artificial Sequence
  chemically synthesized
ctattgtgaatagtgccgcaat

SEQ ID NO: 651709 - DNA, 22 bp, Artificial Sequence
  chemically synthesized
gctattgtgaatagtgccgcaa

SEQ ID NO: 651710 - DNA, 22 bp, Artificial Sequence
  chemically synthesized
tgctattgtgaatagtgccgca

SEQ ID NO: 651711 - DNA, 22 bp, Artificial Sequence
  chemically synthesized
caagtctttgctattgtgaata

SEQ ID NO: 651712 - DNA, 22 bp, Artificial Sequence
  chemically synthesized
attgcggcactattcacaatag

SEQ ID NO: 651713 - DNA, 22 bp, Artificial Sequence
  chemically synthesized
ttgcggcactattcacaatagc

SEQ ID NO: 651714 - DNA, 22 bp, Artificial Sequence
  chemically synthesized
gttccaagtctttgctattgtg

SEQ ID NO: 651715 - DNA, 22 bp, Artificial Sequence
  chemically synthesized
cggcactattcacaatagcaaa

SEQ ID NO: 651716 - DNA, 22 bp, Artificial Sequence
  chemically synthesized
ggttggttccaagtctttgcta

SEQ ID NO: 651717 - DNA, 22 bp, Artificial Sequence
  chemically synthesized
gggttggttccaagtctttgct

SEQ ID NO: 651718 - DNA, 22 bp, Artificial Sequence
  chemically synthesized
ttcacaatagcaaagacttgga

SEQ ID NO: 651719 - DNA, 22 bp, Artificial Sequence
  chemically synthesized
acaatagcaaagacttggaacc

SEQ ID NO: 651720 - DNA, 22 bp, Artificial Sequence
  chemically synthesized
ggcatttgggttggttccaagt

SEQ ID NO: 651721 - DNA, 22 bp, Artificial Sequence
  chemically synthesized
ttgggcatttgggttggttcca

SEQ ID NO: 651722 - DNA, 22 bp, Artificial Sequence
  chemically synthesized
tcattgttgggcatttgggttg

SEQ ID NO: 651723 - DNA, 22 bp, Artificial Sequence
  chemically synthesized
ggaaccaacccaaatgcccaac

SEQ ID NO: 651724 - DNA, 22 bp, Artificial Sequence
  chemically synthesized
gaaccaacccaaatgcccaaca

SEQ ID NO: 651725 - DNA, 22 bp, Artificial Sequence
  chemically synthesized
atccagtctatcattgttgggc

SEQ ID NO: 651726 - DNA, 22 bp, Artificial Sequence
  chemically synthesized
aatccagtctatcattgttggg

SEQ ID NO: 651727 - DNA, 22 bp, Artificial Sequence
  chemically synthesized
ttaatccagtctatcattgttg

SEQ ID NO: 651728 - DNA, 22 bp, Artificial Sequence
  chemically synthesized
cttaatccagtctatcattgtt

SEQ ID NO: 651729 - DNA, 22 bp, Artificial Sequence
  chemically synthesized
tcttaatccagtctatcattgt

SEQ ID NO: 651730 - DNA, 22 bp, Artificial Sequence
  chemically synthesized
catggtgtatatgtgccacatt

SEQ ID NO: 651731 - DNA, 22 bp, Artificial Sequence
  chemically synthesized
gattaagaaaatgtggcacata

SEQ ID NO: 651732 - DNA, 22 bp, Artificial Sequence
  chemically synthesized
agaaaatgtggcacatatacac

SEQ ID NO: 651733 - DNA, 22 bp, Artificial Sequence
  chemically synthesized
catagtattccatggtgtatat

SEQ ID NO: 651734 - DNA, 22 bp, Artificial Sequence
  chemically synthesized
tggctgcatagtattccatggt

SEQ ID NO: 651735 - DNA, 22 bp, Artificial Sequence
  chemically synthesized
atggctgcatagtattccatgg

SEQ ID NO: 651736 - DNA, 22 bp, Artificial Sequence
  chemically synthesized
tatggctgcatagtattccatg

SEQ ID NO: 651737 - DNA, 22 bp, Artificial Sequence
  chemically synthesized
ttatggctgcatagtattccat

SEQ ID NO: 651738 - DNA, 22 bp, Artificial Sequence
  chemically synthesized
tttatggctgcatagtattcca

SEQ ID NO: 651739 - DNA, 22 bp, Artificial Sequence
  chemically synthesized
ttttatggctgcatagtattcc

SEQ ID NO: 651740 - DNA, 22 bp, Artificial Sequence
  chemically synthesized
atccttttttatggctgcatag

SEQ ID NO: 651741 - DNA, 22 bp, Artificial Sequence
  chemically synthesized
tgcagccataaaaaaggatgag

SEQ ID NO: 651742 - DNA, 22 bp, Artificial Sequence
  chemically synthesized
caaaggacatgaactcatcctt

SEQ ID NO: 651743 - DNA, 22 bp, Artificial Sequence
  chemically synthesized
atccatgtccctacaaaggaca

SEQ ID NO: 651744 - DNA, 22 bp, Artificial Sequence
  chemically synthesized
catccatgtccctacaaaggac

SEQ ID NO: 651745 - DNA, 22 bp, Artificial Sequence
  chemically synthesized
caatttcatccatgtccctaca

SEQ ID NO: 651746 - DNA, 22 bp, Artificial Sequence
  chemically synthesized
ccaatttcatccatgtccctac

SEQ ID NO: 651747 - DNA, 22 bp, Artificial Sequence
  chemically synthesized
atgtcctttgtagggacatgga

SEQ ID NO: 651748 - DNA, 22 bp, Artificial Sequence
  chemically synthesized
tgtagggacatggatgaaattg

SEQ ID NO: 651749 - DNA, 22 bp, Artificial Sequence
  chemically synthesized
gtagggacatggatgaaattgg

SEQ ID NO: 651750 - DNA, 22 bp, Artificial Sequence
  chemically synthesized
tagggacatggatgaaattgga

SEQ ID NO: 651751 - DNA, 22 bp, Artificial Sequence
  chemically synthesized
agaatgatgatttccaatttca

SEQ ID NO: 651752 - DNA, 22 bp, Artificial Sequence
  chemically synthesized
ctgagaatgatgatttccaatt

SEQ ID NO: 651753 - DNA, 22 bp, Artificial Sequence
  chemically synthesized
actgagaatgatgatttccaat

SEQ ID NO: 651754 - DNA, 22 bp, Artificial Sequence
  chemically synthesized
cgatagtttactgagaatgatg

SEQ ID NO: 651755 - DNA, 22 bp, Artificial Sequence
  chemically synthesized
gcgatagtttactgagaatgat

SEQ ID NO: 651756 - DNA, 22 bp, Artificial Sequence
  chemically synthesized
tccttgcgatagtttactgaga

SEQ ID NO: 651757 - DNA, 22 bp, Artificial Sequence
  chemically synthesized
gaaatcatcattctcagtaaac

SEQ ID NO: 651758 - DNA, 22 bp, Artificial Sequence
  chemically synthesized
gtccttgcgatagtttactgag

SEQ ID NO: 651759 - DNA, 22 bp, Artificial Sequence
  chemically synthesized
tgtccttgcgatagtttactga

SEQ ID NO: 651760 - DNA, 22 bp, Artificial Sequence
  chemically synthesized
ttgtccttgcgatagtttactg

SEQ ID NO: 651761 - DNA, 22 bp, Artificial Sequence
  chemically synthesized
tttgtccttgcgatagtttact

SEQ ID NO: 651762 - DNA, 22 bp, Artificial Sequence
  chemically synthesized
gttttttgtccttgcgatagtt

SEQ ID NO: 651763 - DNA, 22 bp, Artificial Sequence
  chemically synthesized
ggttttttgtccttgcgatagt

SEQ ID NO: 651764 - DNA, 22 bp, Artificial Sequence
  chemically synthesized
tcagtaaactatcgcaaggaca

SEQ ID NO: 651765 - DNA, 22 bp, Artificial Sequence
  chemically synthesized
agtaaactatcgcaaggacaaa

SEQ ID NO: 651766 - DNA, 22 bp, Artificial Sequence
  chemically synthesized
tcgcaaggacaaaaaaccaaac

SEQ ID NO: 651767 - DNA, 22 bp, Artificial Sequence
  chemically synthesized
tgagtgagaacatgcggtgttt

SEQ ID NO: 651768 - DNA, 22 bp, Artificial Sequence
  chemically synthesized
ccacctatgagtgagaacatgc

SEQ ID NO: 651769 - DNA, 22 bp, Artificial Sequence
  chemically synthesized
cattcccacctatgagtgagaa

SEQ ID NO: 651770 - DNA, 22 bp, Artificial Sequence
  chemically synthesized
ttccattcccacctatgagtga

SEQ ID NO: 651771 - DNA, 22 bp, Artificial Sequence
  chemically synthesized
attgttccattcccacctatga

SEQ ID NO: 651772 - DNA, 22 bp, Artificial Sequence
  chemically synthesized
tcattgttccattcccacctat

SEQ ID NO: 651773 - DNA, 22 bp, Artificial Sequence
  chemically synthesized
tcactcataggtgggaatggaa

SEQ ID NO: 651774 - DNA, 22 bp, Artificial Sequence
  chemically synthesized
actcataggtgggaatggaaca

SEQ ID NO: 651775 - DNA, 22 bp, Artificial Sequence
  chemically synthesized
ataggtgggaatggaacaatga

SEQ ID NO: 651776 - DNA, 22 bp, Artificial Sequence
  chemically synthesized
tgtccatgtgttctcattgttc

SEQ ID NO: 651777 - DNA, 22 bp, Artificial Sequence
  chemically synthesized
ctatgtccatgtgttctcattg

SEQ ID NO: 651778 - DNA, 22 bp, Artificial Sequence
  chemically synthesized
cctatgtccatgtgttctcatt

SEQ ID NO: 651779 - DNA, 22 bp, Artificial Sequence
  chemically synthesized
cccttcctatgtccatgtgttc

SEQ ID NO: 651780 - DNA, 22 bp, Artificial Sequence
  chemically synthesized
cccccaccccacaacagtcccc

SEQ ID NO: 651781 - DNA, 22 bp, Artificial Sequence
  chemically synthesized
ccccctccccccaccccacaac

SEQ ID NO: 651782 - DNA, 22 bp, Artificial Sequence
  chemically synthesized
tggggactgttgtggggtgggg

SEQ ID NO: 651783 - DNA, 22 bp, Artificial Sequence
  chemically synthesized
gggactgttgtggggtgggggg

SEQ ID NO: 651784 - DNA, 22 bp, Artificial Sequence
  chemically synthesized
tccctcccccctccccccaccc

SEQ ID NO: 651785 - DNA, 22 bp, Artificial Sequence
  chemically synthesized
atgctatccctcccccctcccc

SEQ ID NO: 651786 - DNA, 22 bp, Artificial Sequence
  chemically synthesized
ttgtggggtggggggagggggg

SEQ ID NO: 651787 - DNA, 22 bp, Artificial Sequence
  chemically synthesized
ctaatgctatccctcccccctc

SEQ ID NO: 651788 - DNA, 22 bp, Artificial Sequence
  chemically synthesized
tggggtggggggaggggggagg

SEQ ID NO: 651789 - DNA, 22 bp, Artificial Sequence
  chemically synthesized
ggtatatctcctaatgctatcc

SEQ ID NO: 651790 - DNA, 22 bp, Artificial Sequence
  chemically synthesized
gcattaggtatatctcctaatg

SEQ ID NO: 651791 - DNA, 22 bp, Artificial Sequence
  chemically synthesized
gtcatctagcattaggtatatc

SEQ ID NO: 651792 - DNA, 22 bp, Artificial Sequence
  chemically synthesized
actcgtcatctagcattaggta

SEQ ID NO: 651793 - DNA, 22 bp, Artificial Sequence
  chemically synthesized
ggagatatacctaatgctagat

SEQ ID NO: 651794 - DNA, 22 bp, Artificial Sequence
  chemically synthesized
cacccactaactcgtcatctag

SEQ ID NO: 651795 - DNA, 22 bp, Artificial Sequence
  chemically synthesized
gtgtgctgcacccactaactcg

SEQ ID NO: 651796 - DNA, 22 bp, Artificial Sequence
  chemically synthesized
atgctagatgacgagttagtgg

SEQ ID NO: 651797 - DNA, 22 bp, Artificial Sequence
  chemically synthesized
gatgacgagttagtgggtgcag

SEQ ID NO: 651798 - DNA, 22 bp, Artificial Sequence
  chemically synthesized
gtgggtgcagcacaccagcatg

SEQ ID NO: 651799 - DNA, 22 bp, Artificial Sequence
  chemically synthesized
catatgtatacatgtgccatgc

SEQ ID NO: 651800 - DNA, 22 bp, Artificial Sequence
  chemically synthesized
gttacatatgtatacatgtgcc

SEQ ID NO: 651801 - DNA, 22 bp, Artificial Sequence
  chemically synthesized
gggtacatgtgcacaatgtgca

SEQ ID NO: 651802 - DNA, 22 bp, Artificial Sequence
  chemically synthesized
agggtacatgtgcacaatgtgc

SEQ ID NO: 651803 - DNA, 22 bp, Artificial Sequence
  chemically synthesized
tagggtacatgtgcacaatgtg

SEQ ID NO: 651804 - DNA, 22 bp, Artificial Sequence
  chemically synthesized
agttttagggtacatgtgcaca

SEQ ID NO: 651805 - DNA, 22 bp, Artificial Sequence
  chemically synthesized
aagttttagggtacatgtgcac

SEQ ID NO: 651806 - DNA, 22 bp, Artificial Sequence
  chemically synthesized
acctgcacattgtgcacatgta

SEQ ID NO: 651807 - DNA, 22 bp, Artificial Sequence
  chemically synthesized
taagttttagggtacatgtgca

SEQ ID NO: 651808 - DNA, 22 bp, Artificial Sequence
  chemically synthesized
cacattgtgcacatgtacccta

SEQ ID NO: 651809 - DNA, 22 bp, Artificial Sequence
  chemically synthesized
tactttaagttttagggtacat

SEQ ID NO: 651810 - DNA, 22 bp, Artificial Sequence
  chemically synthesized
ttatactttaagttttagggta

SEQ ID NO: 651811 - DNA, 22 bp, Artificial Sequence
  chemically synthesized
attatactttaagttttagggt

SEQ ID NO: 651812 - DNA, 22 bp, Artificial Sequence
  chemically synthesized
tattatactttaagttttaggg

SEQ ID NO: 651813 - DNA, 22 bp, Artificial Sequence
  chemically synthesized
ttattatactttaagttttagg

SEQ ID NO: 651814 - DNA, 22 bp, Artificial Sequence
  chemically synthesized
tgcacatgtaccctaaaactta

SEQ ID NO: 651815 - DNA, 22 bp, Artificial Sequence
  chemically synthesized
tttttattatactttaagtttt

SEQ ID NO: 651816 - DNA, 22 bp, Artificial Sequence
  chemically synthesized
atttttattatactttaagttt

SEQ ID NO: 651817 - DNA, 22 bp, Artificial Sequence
  chemically synthesized
tatttttattatactttaagtt

SEQ ID NO: 651818 - DNA, 22 bp, Artificial Sequence
  chemically synthesized
ttttatttttattatactttaa

SEQ ID NO: 651819 - DNA, 22 bp, Artificial Sequence
  chemically synthesized
attttatttttattatacttta

SEQ ID NO: 651820 - DNA, 22 bp, Artificial Sequence
  chemically synthesized
tattttatttttattatacttt

SEQ ID NO: 651821 - DNA, 22 bp, Artificial Sequence
  chemically synthesized
ttattttatttttattatactt

SEQ ID NO: 651822 - DNA, 22 bp, Artificial Sequence
  chemically synthesized
tttattttatttttattatact

SEQ ID NO: 651823 - DNA, 22 bp, Artificial Sequence
  chemically synthesized
ttttattttatttttattatac

SEQ ID NO: 651824 - DNA, 22 bp, Artificial Sequence
  chemically synthesized
tttttattttatttttattata

SEQ ID NO: 651825 - DNA, 22 bp, Artificial Sequence
  chemically synthesized
aaacttaaagtataataaaaat

SEQ ID NO: 651826 - DNA, 22 bp, Artificial Sequence
  chemically synthesized
ttttttttattttatttttatt

SEQ ID NO: 651827 - DNA, 22 bp, Artificial Sequence
  chemically synthesized
attttttttattttatttttat

SEQ ID NO: 651828 - DNA, 22 bp, Artificial Sequence
  chemically synthesized
tattttttttattttattttta

SEQ ID NO: 651829 - DNA, 22 bp, Artificial Sequence
  chemically synthesized
aaagtataataaaaataaaata

SEQ ID NO: 651830 - DNA, 22 bp, Artificial Sequence
  chemically synthesized
aagtataataaaaataaaataa

SEQ ID NO: 651831 - DNA, 22 bp, Artificial Sequence
  chemically synthesized
tctttattttttttattttatt

SEQ ID NO: 651832 - DNA, 22 bp, Artificial Sequence
  chemically synthesized
gaaacagcacaagatagaaaac

SEQ ID NO: 651833 - DNA, 22 bp, Artificial Sequence
  chemically synthesized
tctgttttctatcttgtgctgt

SEQ ID NO: 651834 - DNA, 22 bp, Artificial Sequence
  chemically synthesized
aatcaaatcctagaaacagcac

SEQ ID NO: 651835 - DNA, 22 bp, Artificial Sequence
  chemically synthesized
ttttctatcttgtgctgtttct

SEQ ID NO: 651836 - DNA, 22 bp, Artificial Sequence
  chemically synthesized
tctatcttgtgctgtttctagg

SEQ ID NO: 651837 - DNA, 22 bp, Artificial Sequence
  chemically synthesized
ctatcttgtgctgtttctagga

SEQ ID NO: 651838 - DNA, 22 bp, Artificial Sequence
  chemically synthesized
tatcttgtgctgtttctaggat

SEQ ID NO: 651839 - DNA, 22 bp, Artificial Sequence
  chemically synthesized
tcttgtgctgtttctaggattt

SEQ ID NO: 651840 - DNA, 22 bp, Artificial Sequence
  chemically synthesized
agcagtctaaatcaaatcctag

SEQ ID NO: 651841 - DNA, 22 bp, Artificial Sequence
  chemically synthesized
gtgctgtttctaggatttgatt

SEQ ID NO: 651842 - DNA, 22 bp, Artificial Sequence
  chemically synthesized
tgctgtttctaggatttgattt

SEQ ID NO: 651843 - DNA, 22 bp, Artificial Sequence
  chemically synthesized
tttctaggatttgatttagact

SEQ ID NO: 651844 - DNA, 22 bp, Artificial Sequence
  chemically synthesized
ctaggatttgatttagactgct

SEQ ID NO: 651845 - DNA, 22 bp, Artificial Sequence
  chemically synthesized
taggatttgatttagactgctt

SEQ ID NO: 651846 - DNA, 22 bp, Artificial Sequence
  chemically synthesized
ggatttgatttagactgcttag

SEQ ID NO: 651847 - DNA, 22 bp, Artificial Sequence
  chemically synthesized
agaagtccagtgaatcctaagc

SEQ ID NO: 651848 - DNA, 22 bp, Artificial Sequence
  chemically synthesized
aagaagtccagtgaatcctaag

SEQ ID NO: 651849 - DNA, 22 bp, Artificial Sequence
  chemically synthesized
gatttagactgcttaggattca

SEQ ID NO: 651850 - DNA, 22 bp, Artificial Sequence
  chemically synthesized
atttagactgcttaggattcac

SEQ ID NO: 651851 - DNA, 22 bp, Artificial Sequence
  chemically synthesized
agactgcttaggattcactgga

SEQ ID NO: 651852 - DNA, 22 bp, Artificial Sequence
  chemically synthesized
gactgcttaggattcactggac

SEQ ID NO: 651853 - DNA, 22 bp, Artificial Sequence
  chemically synthesized
cttaggattcactggacttctt

SEQ ID NO: 651854 - DNA, 22 bp, Artificial Sequence
  chemically synthesized
aatcacaggtttaagaagtcca

SEQ ID NO: 651855 - DNA, 22 bp, Artificial Sequence
  chemically synthesized
taaatcacaggtttaagaagtc

SEQ ID NO: 651856 - DNA, 22 bp, Artificial Sequence
  chemically synthesized
aggattcactggacttcttaaa

SEQ ID NO: 651857 - DNA, 22 bp, Artificial Sequence
  chemically synthesized
ggattcactggacttcttaaac

SEQ ID NO: 651858 - DNA, 22 bp, Artificial Sequence
  chemically synthesized
aagactctaaatcacaggttta

SEQ ID NO: 651859 - DNA, 22 bp, Artificial Sequence
  chemically synthesized
actggacttcttaaacctgtga

SEQ ID NO: 651860 - DNA, 22 bp, Artificial Sequence
  chemically synthesized
attaaagactctaaatcacagg

SEQ ID NO: 651861 - DNA, 22 bp, Artificial Sequence
  chemically synthesized
gacttcttaaacctgtgattta

SEQ ID NO: 651862 - DNA, 22 bp, Artificial Sequence
  chemically synthesized
cttaaacctgtgatttagagtc

SEQ ID NO: 651863 - DNA, 22 bp, Artificial Sequence
  chemically synthesized
ttaaacctgtgatttagagtct

SEQ ID NO: 651864 - DNA, 22 bp, Artificial Sequence
  chemically synthesized
cacagctgattaaagactctaa

SEQ ID NO: 651865 - DNA, 22 bp, Artificial Sequence
  chemically synthesized
aaacctgtgatttagagtcttt

SEQ ID NO: 651866 - DNA, 22 bp, Artificial Sequence
  chemically synthesized
aacctgtgatttagagtcttta

SEQ ID NO: 651867 - DNA, 22 bp, Artificial Sequence
  chemically synthesized
tgatttagagtctttaatcagc

SEQ ID NO: 651868 - DNA, 22 bp, Artificial Sequence
  chemically synthesized
agagtctttaatcagctgtgga

SEQ ID NO: 651869 - DNA, 22 bp, Artificial Sequence
  chemically synthesized
gagtctttaatcagctgtggaa

SEQ ID NO: 651870 - DNA, 22 bp, Artificial Sequence
  chemically synthesized
agagaatgacggagaagattcc

SEQ ID NO: 651871 - DNA, 22 bp, Artificial Sequence
  chemically synthesized
taatcagctgtggaatcttctc

SEQ ID NO: 651872 - DNA, 22 bp, Artificial Sequence
  chemically synthesized
aatcagctgtggaatcttctcc

SEQ ID NO: 651873 - DNA, 22 bp, Artificial Sequence
  chemically synthesized
atcagctgtggaatcttctccg

SEQ ID NO: 651874 - DNA, 22 bp, Artificial Sequence
  chemically synthesized
ttgagagaatgacggagaagat

SEQ ID NO: 651875 - DNA, 22 bp, Artificial Sequence
  chemically synthesized
gttgagagaatgacggagaaga

SEQ ID NO: 651876 - DNA, 22 bp, Artificial Sequence
  chemically synthesized
tttgttgagagaatgacggaga

SEQ ID NO: 651877 - DNA, 22 bp, Artificial Sequence
  chemically synthesized
tggaatcttctccgtcattctc

SEQ ID NO: 651878 - DNA, 22 bp, Artificial Sequence
  chemically synthesized
ctccgtcattctctcaacaaat

SEQ ID NO: 651879 - DNA, 22 bp, Artificial Sequence
  chemically synthesized
tccgtcattctctcaacaaata

SEQ ID NO: 651880 - DNA, 22 bp, Artificial Sequence
  chemically synthesized
cgtcattctctcaacaaatagt

SEQ ID NO: 651881 - DNA, 22 bp, Artificial Sequence
  chemically synthesized
tctcaacaaatagtgcctcttc

SEQ ID NO: 651882 - DNA, 22 bp, Artificial Sequence
  chemically synthesized
tcaacaaatagtgcctcttctc

SEQ ID NO: 651883 - DNA, 22 bp, Artificial Sequence
  chemically synthesized
aacaaatagtgcctcttctcca

SEQ ID NO: 651884 - DNA, 22 bp, Artificial Sequence
  chemically synthesized
aaagtagaatggagagggaatg

SEQ ID NO: 651885 - DNA, 22 bp, Artificial Sequence
  chemically synthesized
tgaaagtagaatggagagggaa

SEQ ID NO: 651886 - DNA, 22 bp, Artificial Sequence
  chemically synthesized
ttctccattccctctccattct

SEQ ID NO: 651887 - DNA, 22 bp, Artificial Sequence
  chemically synthesized
ctccattccctctccattctac

SEQ ID NO: 651888 - DNA, 22 bp, Artificial Sequence
  chemically synthesized
tccattccctctccattctact

SEQ ID NO: 651889 - DNA, 22 bp, Artificial Sequence
  chemically synthesized
cattccctctccattctacttt

SEQ ID NO: 651890 - DNA, 22 bp, Artificial Sequence
  chemically synthesized
tgtaacagagttctgaaagtag

SEQ ID NO: 651891 - DNA, 22 bp, Artificial Sequence
  chemically synthesized
atgtaacagagttctgaaagta

SEQ ID NO: 651892 - DNA, 22 bp, Artificial Sequence
  chemically synthesized
cctctccattctactttcagaa

SEQ ID NO: 651893 - DNA, 22 bp, Artificial Sequence
  chemically synthesized
tccattctactttcagaactct

SEQ ID NO: 651894 - DNA, 22 bp, Artificial Sequence
  chemically synthesized
cattctactttcagaactctgt

SEQ ID NO: 651895 - DNA, 22 bp, Artificial Sequence
  chemically synthesized
tactttcagaactctgttacat

SEQ ID NO: 651896 - DNA, 22 bp, Artificial Sequence
  chemically synthesized
ctttcagaactctgttacataa

SEQ ID NO: 651897 - DNA, 22 bp, Artificial Sequence
  chemically synthesized
aagaagagtaacatttatgtaa

SEQ ID NO: 651898 - DNA, 22 bp, Artificial Sequence
  chemically synthesized
tcagaactctgttacataaatg

SEQ ID NO: 651899 - DNA, 22 bp, Artificial Sequence
  chemically synthesized
cagaactctgttacataaatgt

SEQ ID NO: 651900 - DNA, 22 bp, Artificial Sequence
  chemically synthesized
agaactctgttacataaatgtt

SEQ ID NO: 651901 - DNA, 22 bp, Artificial Sequence
  chemically synthesized
tgttacataaatgttactcttc

SEQ ID NO: 651902 - DNA, 22 bp, Artificial Sequence
  chemically synthesized
ttacataaatgttactcttctt

SEQ ID NO: 651903 - DNA, 22 bp, Artificial Sequence
  chemically synthesized
cataaatgttactcttcttcaa

SEQ ID NO: 651904 - DNA, 22 bp, Artificial Sequence
  chemically synthesized
agagaaatatagattgaagaag

SEQ ID NO: 651905 - DNA, 22 bp, Artificial Sequence
  chemically synthesized
ttcagagaaatatagattgaag

SEQ ID NO: 651906 - DNA, 22 bp, Artificial Sequence
  chemically synthesized
ctcttcttcaatctatatttct

SEQ ID NO: 651907 - DNA, 22 bp, Artificial Sequence
  chemically synthesized
ttcttcaatctatatttctctg

SEQ ID NO: 651908 - DNA, 22 bp, Artificial Sequence
  chemically synthesized
gggaagtcctgttcagagaaat

SEQ ID NO: 651909 - DNA, 22 bp, Artificial Sequence
  chemically synthesized
cttcaatctatatttctctgaa

SEQ ID NO: 651910 - DNA, 22 bp, Artificial Sequence
  chemically synthesized
ttcaatctatatttctctgaac

SEQ ID NO: 651911 - DNA, 22 bp, Artificial Sequence
  chemically synthesized
caatctatatttctctgaacag

SEQ ID NO: 651912 - DNA, 22 bp, Artificial Sequence
  chemically synthesized
aatctatatttctctgaacagg

SEQ ID NO: 651913 - DNA, 22 bp, Artificial Sequence
  chemically synthesized
tatttctctgaacaggacttcc

SEQ ID NO: 651914 - DNA, 22 bp, Artificial Sequence
  chemically synthesized
ctctgaacaggacttccctagt

SEQ ID NO: 651915 - DNA, 22 bp, Artificial Sequence
  chemically synthesized
tctgaacaggacttccctagtt

SEQ ID NO: 651916 - DNA, 22 bp, Artificial Sequence
  chemically synthesized
tgaacaggacttccctagttcc

SEQ ID NO: 651917 - DNA, 22 bp, Artificial Sequence
  chemically synthesized
aacaggacttccctagttcccc

SEQ ID NO: 651918 - DNA, 22 bp, Artificial Sequence
  chemically synthesized
aaaagatgtggggcagagaggg

SEQ ID NO: 651919 - DNA, 22 bp, Artificial Sequence
  chemically synthesized
ccctagttcccccctctctgcc

SEQ ID NO: 651920 - DNA, 22 bp, Artificial Sequence
  chemically synthesized
aaaaagatgtggggcagagagg

SEQ ID NO: 651921 - DNA, 22 bp, Artificial Sequence
  chemically synthesized
cctagttcccccctctctgccc

SEQ ID NO: 651922 - DNA, 22 bp, Artificial Sequence
  chemically synthesized
taaaaagatgtggggcagagag

SEQ ID NO: 651923 - DNA, 22 bp, Artificial Sequence
  chemically synthesized
gttcccccctctctgccccaca

SEQ ID NO: 651924 - DNA, 22 bp, Artificial Sequence
  chemically synthesized
ccccctctctgccccacatctt

SEQ ID NO: 651925 - DNA, 22 bp, Artificial Sequence
  chemically synthesized
tctgccccacatctttttaaaa

SEQ ID NO: 651926 - DNA, 22 bp, Artificial Sequence
  chemically synthesized
tgccccacatctttttaaaaca

SEQ ID NO: 651927 - DNA, 22 bp, Artificial Sequence
  chemically synthesized
ccccacatctttttaaaacatc

SEQ ID NO: 651928 - DNA, 22 bp, Artificial Sequence
  chemically synthesized
ataagaatgaagcacagaagga

SEQ ID NO: 651929 - DNA, 22 bp, Artificial Sequence
  chemically synthesized
tttaaaacatccttctgtgctt

SEQ ID NO: 651930 - DNA, 22 bp, Artificial Sequence
  chemically synthesized
ttaaaacatccttctgtgcttc

SEQ ID NO: 651931 - DNA, 22 bp, Artificial Sequence
  chemically synthesized
taaaacatccttctgtgcttca

SEQ ID NO: 651932 - DNA, 22 bp, Artificial Sequence
  chemically synthesized
aaaacatccttctgtgcttcat

SEQ ID NO: 651933 - DNA, 22 bp, Artificial Sequence
  chemically synthesized
aaacatccttctgtgcttcatt

SEQ ID NO: 651934 - DNA, 22 bp, Artificial Sequence
  chemically synthesized
ctgtgcttcattcttattaatt

SEQ ID NO: 651935 - DNA, 22 bp, Artificial Sequence
  chemically synthesized
tgtgcttcattcttattaattc

SEQ ID NO: 651936 - DNA, 22 bp, Artificial Sequence
  chemically synthesized
tgcttcattcttattaattcct

SEQ ID NO: 651937 - DNA, 22 bp, Artificial Sequence
  chemically synthesized
cattcttattaattccttctgc

SEQ ID NO: 651938 - DNA, 22 bp, Artificial Sequence
  chemically synthesized
attcttattaattccttctgcc

SEQ ID NO: 651939 - DNA, 22 bp, Artificial Sequence
  chemically synthesized
ttattaattccttctgccttac

SEQ ID NO: 651940 - DNA, 22 bp, Artificial Sequence
  chemically synthesized
attaattccttctgccttactg

SEQ ID NO: 651941 - DNA, 22 bp, Artificial Sequence
  chemically synthesized
ttaattccttctgccttactgt

SEQ ID NO: 651942 - DNA, 22 bp, Artificial Sequence
  chemically synthesized
attccttctgccttactgtctg

SEQ ID NO: 651943 - DNA, 22 bp, Artificial Sequence
  chemically synthesized
cttctgccttactgtctgggta

SEQ ID NO: 651944 - DNA, 22 bp, Artificial Sequence
  chemically synthesized
ctgccttactgtctgggtatcc

SEQ ID NO: 651945 - DNA, 22 bp, Artificial Sequence
  chemically synthesized
tgccttactgtctgggtatcca

SEQ ID NO: 651946 - DNA, 22 bp, Artificial Sequence
  chemically synthesized
ccttactgtctgggtatccatt

SEQ ID NO: 651947 - DNA, 22 bp, Artificial Sequence
  chemically synthesized
actgtctgggtatccatttctc

SEQ ID NO: 651948 - DNA, 22 bp, Artificial Sequence
  chemically synthesized
ctgtctgggtatccatttctct

SEQ ID NO: 651949 - DNA, 22 bp, Artificial Sequence
  chemically synthesized
cagcagaccggcaagagaaatg

SEQ ID NO: 651950 - DNA, 22 bp, Artificial Sequence
  chemically synthesized
acagcagaccggcaagagaaat

SEQ ID NO: 651951 - DNA, 22 bp, Artificial Sequence
  chemically synthesized
tctgggtatccatttctcttgc

SEQ ID NO: 651952 - DNA, 22 bp, Artificial Sequence
  chemically synthesized
ggtatccatttctcttgccggt

SEQ ID NO: 651953 - DNA, 22 bp, Artificial Sequence
  chemically synthesized
tatgggtttacagcagaccggc

SEQ ID NO: 651954 - DNA, 22 bp, Artificial Sequence
  chemically synthesized
aaactgtatgggtttacagcag

SEQ ID NO: 651955 - DNA, 22 bp, Artificial Sequence
  chemically synthesized
ctcttgccggtctgctgtaaac

SEQ ID NO: 651956 - DNA, 22 bp, Artificial Sequence
  chemically synthesized
aaaactgtatgggtttacagca

SEQ ID NO: 651957 - DNA, 22 bp, Artificial Sequence
  chemically synthesized
tcttgccggtctgctgtaaacc

SEQ ID NO: 651958 - DNA, 22 bp, Artificial Sequence
  chemically synthesized
ttgccggtctgctgtaaaccca

SEQ ID NO: 651959 - DNA, 22 bp, Artificial Sequence
  chemically synthesized
gccggtctgctgtaaacccata

SEQ ID NO: 651960 - DNA, 22 bp, Artificial Sequence
  chemically synthesized
ccggtctgctgtaaacccatac

SEQ ID NO: 651961 - DNA, 22 bp, Artificial Sequence
  chemically synthesized
ctgtaaacccatacagttttaa

SEQ ID NO: 651962 - DNA, 22 bp, Artificial Sequence
  chemically synthesized
taaacccatacagttttaaatt

SEQ ID NO: 651963 - DNA, 22 bp, Artificial Sequence
  chemically synthesized
gatgtcaaaagtacaataatca

SEQ ID NO: 651964 - DNA, 22 bp, Artificial Sequence
  chemically synthesized
tagatgtcaaaagtacaataat

SEQ ID NO: 651965 - DNA, 22 bp, Artificial Sequence
  chemically synthesized
ctagatgtcaaaagtacaataa

SEQ ID NO: 651966 - DNA, 22 bp, Artificial Sequence
  chemically synthesized
taaattttgattattgtacttt

SEQ ID NO: 651967 - DNA, 22 bp, Artificial Sequence
  chemically synthesized
aaattttgattattgtactttt

SEQ ID NO: 651968 - DNA, 22 bp, Artificial Sequence
  chemically synthesized
aattttgattattgtacttttg

SEQ ID NO: 651969 - DNA, 22 bp, Artificial Sequence
  chemically synthesized
tgattattgtacttttgacatc

SEQ ID NO: 651970 - DNA, 22 bp, Artificial Sequence
  chemically synthesized
gattattgtacttttgacatct

SEQ ID NO: 651971 - DNA, 22 bp, Artificial Sequence
  chemically synthesized
attattgtacttttgacatcta

SEQ ID NO: 651972 - DNA, 22 bp, Artificial Sequence
  chemically synthesized
ttgtacttttgacatctagaaa

SEQ ID NO: 651973 - DNA, 22 bp, Artificial Sequence
  chemically synthesized
tacttttgacatctagaaatac

SEQ ID NO: 651974 - DNA, 22 bp, Artificial Sequence
  chemically synthesized
aaaatgaccaagtagtatttct

SEQ ID NO: 651975 - DNA, 22 bp, Artificial Sequence
  chemically synthesized
aaaaatgaccaagtagtatttc

SEQ ID NO: 651976 - DNA, 22 bp, Artificial Sequence
  chemically synthesized
ttgacatctagaaatactactt

SEQ ID NO: 651977 - DNA, 22 bp, Artificial Sequence
  chemically synthesized
tgacatctagaaatactacttg

SEQ ID NO: 651978 - DNA, 22 bp, Artificial Sequence
  chemically synthesized
gacatctagaaatactacttgg

SEQ ID NO: 651979 - DNA, 22 bp, Artificial Sequence
  chemically synthesized
ccttaaaaatgaccaagtagta

SEQ ID NO: 651980 - DNA, 22 bp, Artificial Sequence
  chemically synthesized
acatctagaaatactacttggt

SEQ ID NO: 651981 - DNA, 22 bp, Artificial Sequence
  chemically synthesized
gaaatactacttggtcattttt

SEQ ID NO: 651982 - DNA, 22 bp, Artificial Sequence
  chemically synthesized
agaagttaccttaaaaatgacc

SEQ ID NO: 651983 - DNA, 22 bp, Artificial Sequence
  chemically synthesized
cttggtcatttttaaggtaact

SEQ ID NO: 651984 - DNA, 22 bp, Artificial Sequence
  chemically synthesized
ggtcatttttaaggtaacttct

SEQ ID NO: 651985 - DNA, 22 bp, Artificial Sequence
  chemically synthesized
gtcatttttaaggtaacttctc

SEQ ID NO: 651986 - DNA, 22 bp, Artificial Sequence
  chemically synthesized
cagggaaccacaaacctgagaa

SEQ ID NO: 651987 - DNA, 22 bp, Artificial Sequence
  chemically synthesized
ttaaggtaacttctcaggtttg

SEQ ID NO: 651988 - DNA, 22 bp, Artificial Sequence
  chemically synthesized
taaggtaacttctcaggtttgt

SEQ ID NO: 651989 - DNA, 22 bp, Artificial Sequence
  chemically synthesized
aaggtaacttctcaggtttgtg

SEQ ID NO: 651990 - DNA, 22 bp, Artificial Sequence
  chemically synthesized
aggtaacttctcaggtttgtgg

SEQ ID NO: 651991 - DNA, 22 bp, Artificial Sequence
  chemically synthesized
aaaaatatctacagggaaccac

SEQ ID NO: 651992 - DNA, 22 bp, Artificial Sequence
  chemically synthesized
ctcaggtttgtggttccctgta

SEQ ID NO: 651993 - DNA, 22 bp, Artificial Sequence
  chemically synthesized
tcaggtttgtggttccctgtag

SEQ ID NO: 651994 - DNA, 22 bp, Artificial Sequence
  chemically synthesized
aggtttgtggttccctgtagat

SEQ ID NO: 651995 - DNA, 22 bp, Artificial Sequence
  chemically synthesized
gtggttccctgtagatattttt

SEQ ID NO: 651996 - DNA, 22 bp, Artificial Sequence
  chemically synthesized
tggttccctgtagatatttttc

SEQ ID NO: 651997 - DNA, 22 bp, Artificial Sequence
  chemically synthesized
cctgtagatatttttcaatgtt

SEQ ID NO: 651998 - DNA, 22 bp, Artificial Sequence
  chemically synthesized
gaaaaataaaaaacaacattga

SEQ ID NO: 651999 - DNA, 22 bp, Artificial Sequence
  chemically synthesized
tagatatttttcaatgttgttt

SEQ ID NO: 652000 - DNA, 22 bp, Artificial Sequence
  chemically synthesized
tgcagttagaaaaataaaaaac

SEQ ID NO: 652001 - DNA, 22 bp, Artificial Sequence
  chemically synthesized
atgcagttagaaaaataaaaaa

SEQ ID NO: 652002 - DNA, 22 bp, Artificial Sequence
  chemically synthesized
ttcaatgttgttttttattttt

SEQ ID NO: 652003 - DNA, 22 bp, Artificial Sequence
  chemically synthesized
tcaatgttgttttttatttttc

SEQ ID NO: 652004 - DNA, 22 bp, Artificial Sequence
  chemically synthesized
caatgttgttttttatttttct

SEQ ID NO: 652005 - DNA, 22 bp, Artificial Sequence
  chemically synthesized
aatgttgttttttatttttcta

SEQ ID NO: 652006 - DNA, 22 bp, Artificial Sequence
  chemically synthesized
tgtttatgcagttagaaaaata

SEQ ID NO: 652007 - DNA, 22 bp, Artificial Sequence
  chemically synthesized
attgtgtttatgcagttagaaa

SEQ ID NO: 652008 - DNA, 22 bp, Artificial Sequence
  chemically synthesized
aattgtgtttatgcagttagaa

SEQ ID NO: 652009 - DNA, 22 bp, Artificial Sequence
  chemically synthesized
ttttttatttttctaactgcat

SEQ ID NO: 652010 - DNA, 22 bp, Artificial Sequence
  chemically synthesized
ttaattgtgtttatgcagttag

SEQ ID NO: 652011 - DNA, 22 bp, Artificial Sequence
  chemically synthesized
cttaattgtgtttatgcagtta

SEQ ID NO: 652012 - DNA, 22 bp, Artificial Sequence
  chemically synthesized
tcttaattgtgtttatgcagtt

SEQ ID NO: 652013 - DNA, 22 bp, Artificial Sequence
  chemically synthesized
tttatttttctaactgcataaa

SEQ ID NO: 652014 - DNA, 22 bp, Artificial Sequence
  chemically synthesized
ttatttttctaactgcataaac

SEQ ID NO: 652015 - DNA, 22 bp, Artificial Sequence
  chemically synthesized
tatttttctaactgcataaaca

SEQ ID NO: 652016 - DNA, 22 bp, Artificial Sequence
  chemically synthesized
ttttcttaattgtgtttatgca

SEQ ID NO: 652017 - DNA, 22 bp, Artificial Sequence
  chemically synthesized
atttttctaactgcataaacac

SEQ ID NO: 652018 - DNA, 22 bp, Artificial Sequence
  chemically synthesized
tttttctaactgcataaacaca

SEQ ID NO: 652019 - DNA, 22 bp, Artificial Sequence
  chemically synthesized
ttctaactgcataaacacaatt

SEQ ID NO: 652020 - DNA, 22 bp, Artificial Sequence
  chemically synthesized
tctaactgcataaacacaatta

SEQ ID NO: 652021 - DNA, 22 bp, Artificial Sequence
  chemically synthesized
ctaactgcataaacacaattaa

SEQ ID NO: 652022 - DNA, 22 bp, Artificial Sequence
  chemically synthesized
taactgcataaacacaattaag

SEQ ID NO: 652023 - DNA, 22 bp, Artificial Sequence
  chemically synthesized
gacagattattttcttaattgt

SEQ ID NO: 652024 - DNA, 22 bp, Artificial Sequence
  chemically synthesized
actgcataaacacaattaagaa

SEQ ID NO: 652025 - DNA, 22 bp, Artificial Sequence
  chemically synthesized
ttagacagattattttcttaat

SEQ ID NO: 652026 - DNA, 22 bp, Artificial Sequence
  chemically synthesized
cataaacacaattaagaaaata

SEQ ID NO: 652027 - DNA, 22 bp, Artificial Sequence
  chemically synthesized
cagaattattagacagattatt

SEQ ID NO: 652028 - DNA, 22 bp, Artificial Sequence
  chemically synthesized
agaaaataatctgtctaataat

SEQ ID NO: 652029 - DNA, 22 bp, Artificial Sequence
  chemically synthesized
cgataacatcatattccagaat

SEQ ID NO: 652030 - DNA, 22 bp, Artificial Sequence
  chemically synthesized
tctaataattctggaatatgat

SEQ ID NO: 652031 - DNA, 22 bp, Artificial Sequence
  chemically synthesized
ataattctggaatatgatgtta

SEQ ID NO: 652032 - DNA, 22 bp, Artificial Sequence
  chemically synthesized
tggaatatgatgttatcgtagg

SEQ ID NO: 652033 - DNA, 22 bp, Artificial Sequence
  chemically synthesized
gaatatgatgttatcgtaggtc

SEQ ID NO: 652034 - DNA, 22 bp, Artificial Sequence
  chemically synthesized
tcgtaggtctgcttctatggtt

SEQ ID NO: 652035 - DNA, 22 bp, Artificial Sequence
  chemically synthesized
cttctatggtttgctatttctt

SEQ ID NO: 652036 - DNA, 22 bp, Artificial Sequence
  chemically synthesized
ctatggtttgctatttcttctg

SEQ ID NO: 652037 - DNA, 22 bp, Artificial Sequence
  chemically synthesized
tatggtttgctatttcttctgg

SEQ ID NO: 652038 - DNA, 22 bp, Artificial Sequence
  chemically synthesized
tggtttgctatttcttctggtt

SEQ ID NO: 652039 - DNA, 22 bp, Artificial Sequence
  chemically synthesized
gctatttcttctggttctcatt

SEQ ID NO: 652040 - DNA, 22 bp, Artificial Sequence
  chemically synthesized
ctatttcttctggttctcattc

SEQ ID NO: 652041 - DNA, 22 bp, Artificial Sequence
  chemically synthesized
tttcttctggttctcattcacc

SEQ ID NO: 652042 - DNA, 22 bp, Artificial Sequence
  chemically synthesized
cttctggttctcattcaccttg

SEQ ID NO: 652043 - DNA, 22 bp, Artificial Sequence
  chemically synthesized
ttctggttctcattcaccttga

SEQ ID NO: 652044 - DNA, 22 bp, Artificial Sequence
  chemically synthesized
ctggttctcattcaccttgatt

SEQ ID NO: 652045 - DNA, 22 bp, Artificial Sequence
  chemically synthesized
tggttctcattcaccttgattt

SEQ ID NO: 652046 - DNA, 22 bp, Artificial Sequence
  chemically synthesized
gttctcattcaccttgatttct

SEQ ID NO: 652047 - DNA, 22 bp, Artificial Sequence
  chemically synthesized
tcattcaccttgatttctttct

SEQ ID NO: 652048 - DNA, 22 bp, Artificial Sequence
  chemically synthesized
attcaccttgatttctttcttt

SEQ ID NO: 652049 - DNA, 22 bp, Artificial Sequence
  chemically synthesized
accttgatttctttctttttcc

SEQ ID NO: 652050 - DNA, 22 bp, Artificial Sequence
  chemically synthesized
gatttctttctttttccacctt

SEQ ID NO: 652051 - DNA, 22 bp, Artificial Sequence
  chemically synthesized
atttctttctttttccaccttg

SEQ ID NO: 652052 - DNA, 22 bp, Artificial Sequence
  chemically synthesized
agcacacaagaaatcaaggtgg

SEQ ID NO: 652053 - DNA, 22 bp, Artificial Sequence
  chemically synthesized
ctttctttttccaccttgattt

SEQ ID NO: 652054 - DNA, 22 bp, Artificial Sequence
  chemically synthesized
tttctttttccaccttgatttc

SEQ ID NO: 652055 - DNA, 22 bp, Artificial Sequence
  chemically synthesized
tctttttccaccttgatttctt

SEQ ID NO: 652056 - DNA, 22 bp, Artificial Sequence
  chemically synthesized
ctttttccaccttgatttcttg

SEQ ID NO: 652057 - DNA, 22 bp, Artificial Sequence
  chemically synthesized
tttttccaccttgatttcttgt

SEQ ID NO: 652058 - DNA, 22 bp, Artificial Sequence
  chemically synthesized
tttccaccttgatttcttgtgt

SEQ ID NO: 652059 - DNA, 22 bp, Artificial Sequence
  chemically synthesized
ttccaccttgatttcttgtgtg

SEQ ID NO: 652060 - DNA, 22 bp, Artificial Sequence
  chemically synthesized
tccaccttgatttcttgtgtgc

SEQ ID NO: 652061 - DNA, 22 bp, Artificial Sequence
  chemically synthesized
ccaccttgatttcttgtgtgct

SEQ ID NO: 652062 - DNA, 22 bp, Artificial Sequence
  chemically synthesized
caccttgatttcttgtgtgctt

SEQ ID NO: 652063 - DNA, 22 bp, Artificial Sequence
  chemically synthesized
gatttcttgtgtgcttaatatg

SEQ ID NO: 652064 - DNA, 22 bp, Artificial Sequence
  chemically synthesized
atttcttgtgtgcttaatatgt

SEQ ID NO: 652065 - DNA, 22 bp, Artificial Sequence
  chemically synthesized
cttgtgtgcttaatatgttttt

SEQ ID NO: 652066 - DNA, 22 bp, Artificial Sequence
  chemically synthesized
ttgtgtgcttaatatgtttttt

SEQ ID NO: 652067 - DNA, 22 bp, Artificial Sequence
  chemically synthesized
gtgtgcttaatatgttttttgt

SEQ ID NO: 652068 - DNA, 22 bp, Artificial Sequence
  chemically synthesized
tgtgcttaatatgttttttgtt

SEQ ID NO: 652069 - DNA, 22 bp, Artificial Sequence
  chemically synthesized
aatatgttttttgttttttttt

SEQ ID NO: 652070 - DNA, 22 bp, Artificial Sequence
  chemically synthesized
gtacgtggtaaaaaaaaaaaac

SEQ ID NO: 652071 - DNA, 22 bp, Artificial Sequence
  chemically synthesized
atatgttttttgtttttttttt

SEQ ID NO: 652072 - DNA, 22 bp, Artificial Sequence
  chemically synthesized
agtacgtggtaaaaaaaaaaaa

SEQ ID NO: 652073 - DNA, 22 bp, Artificial Sequence
  chemically synthesized
tttgttttttttttttaccacg

SEQ ID NO: 652074 - DNA, 22 bp, Artificial Sequence
  chemically synthesized
ttgttttttttttttaccacgt

SEQ ID NO: 652075 - DNA, 22 bp, Artificial Sequence
  chemically synthesized
tgttttttttttttaccacgta

SEQ ID NO: 652076 - DNA, 22 bp, Artificial Sequence
  chemically synthesized
gttttttttttttaccacgtac

SEQ ID NO: 652077 - DNA, 22 bp, Artificial Sequence
  chemically synthesized
ttttttttttttaccacgtact

SEQ ID NO: 652078 - DNA, 22 bp, Artificial Sequence
  chemically synthesized
gtaaggtcagtttagtacgtgg

SEQ ID NO: 652079 - DNA, 22 bp, Artificial Sequence
  chemically synthesized
tttttttttaccacgtactaaa

SEQ ID NO: 652080 - DNA, 22 bp, Artificial Sequence
  chemically synthesized
ttttttttaccacgtactaaac

SEQ ID NO: 652081 - DNA, 22 bp, Artificial Sequence
  chemically synthesized
tttttttaccacgtactaaact

SEQ ID NO: 652082 - DNA, 22 bp, Artificial Sequence
  chemically synthesized
ttttttaccacgtactaaactg

SEQ ID NO: 652083 - DNA, 22 bp, Artificial Sequence
  chemically synthesized
tttttaccacgtactaaactga

SEQ ID NO: 652084 - DNA, 22 bp, Artificial Sequence
  chemically synthesized
ttttaccacgtactaaactgac

SEQ ID NO: 652085 - DNA, 22 bp, Artificial Sequence
  chemically synthesized
tttaccacgtactaaactgacc

SEQ ID NO: 652086 - DNA, 22 bp, Artificial Sequence
  chemically synthesized
ttaccacgtactaaactgacct

SEQ ID NO: 652087 - DNA, 22 bp, Artificial Sequence
  chemically synthesized
taccacgtactaaactgacctt

SEQ ID NO: 652088 - DNA, 22 bp, Artificial Sequence
  chemically synthesized
gaaaatattggtaaggtcagtt

SEQ ID NO: 652089 - DNA, 22 bp, Artificial Sequence
  chemically synthesized
accacgtactaaactgacctta

SEQ ID NO: 652090 - DNA, 22 bp, Artificial Sequence
  chemically synthesized
ccacgtactaaactgaccttac

SEQ ID NO: 652091 - DNA, 22 bp, Artificial Sequence
  chemically synthesized
tagaaaatattggtaaggtcag

SEQ ID NO: 652092 - DNA, 22 bp, Artificial Sequence
  chemically synthesized
tctctagaaaatattggtaagg

SEQ ID NO: 652093 - DNA, 22 bp, Artificial Sequence
  chemically synthesized
atctctagaaaatattggtaag

SEQ ID NO: 652094 - DNA, 22 bp, Artificial Sequence
  chemically synthesized
tttatctctagaaaatattggt

SEQ ID NO: 652095 - DNA, 22 bp, Artificial Sequence
  chemically synthesized
atttatctctagaaaatattgg

SEQ ID NO: 652096 - DNA, 22 bp, Artificial Sequence
  chemically synthesized
aactgaccttaccaatattttc

SEQ ID NO: 652097 - DNA, 22 bp, Artificial Sequence
  chemically synthesized
tatttatctctagaaaatattg

SEQ ID NO: 652098 - DNA, 22 bp, Artificial Sequence
  chemically synthesized
ttatttatctctagaaaatatt

SEQ ID NO: 652099 - DNA, 22 bp, Artificial Sequence
  chemically synthesized
accttaccaatattttctagag

SEQ ID NO: 652100 - DNA, 22 bp, Artificial Sequence
  chemically synthesized
aagcttttatttatctctagaa

SEQ ID NO: 652101 - DNA, 22 bp, Artificial Sequence
  chemically synthesized
accaatattttctagagataaa

SEQ ID NO: 652102 - DNA, 22 bp, Artificial Sequence
  chemically synthesized
ccaatattttctagagataaat

SEQ ID NO: 652103 - DNA, 22 bp, Artificial Sequence
  chemically synthesized
ggctcaagcttttatttatctc

SEQ ID NO: 652104 - DNA, 22 bp, Artificial Sequence
  chemically synthesized
taggctcaagcttttatttatc

SEQ ID NO: 652105 - DNA, 22 bp, Artificial Sequence
  chemically synthesized
ttctaggctcaagcttttattt

SEQ ID NO: 652106 - DNA, 22 bp, Artificial Sequence
  chemically synthesized
attctaggctcaagcttttatt

SEQ ID NO: 652107 - DNA, 22 bp, Artificial Sequence
  chemically synthesized
tattctaggctcaagcttttat

SEQ ID NO: 652108 - DNA, 22 bp, Artificial Sequence
  chemically synthesized
tctagagataaataaaagcttg

SEQ ID NO: 652109 - DNA, 22 bp, Artificial Sequence
  chemically synthesized
ttattctaggctcaagctttta

SEQ ID NO: 652110 - DNA, 22 bp, Artificial Sequence
  chemically synthesized
ctagagataaataaaagcttga

SEQ ID NO: 652111 - DNA, 22 bp, Artificial Sequence
  chemically synthesized
tagagataaataaaagcttgag

SEQ ID NO: 652112 - DNA, 22 bp, Artificial Sequence
  chemically synthesized
gagataaataaaagcttgagcc

SEQ ID NO: 652113 - DNA, 22 bp, Artificial Sequence
  chemically synthesized
gagaaagcacttttattctagg

SEQ ID NO: 652114 - DNA, 22 bp, Artificial Sequence
  chemically synthesized
tggagaaagcacttttattcta

SEQ ID NO: 652115 - DNA, 22 bp, Artificial Sequence
  chemically synthesized
gagcctagaataaaagtgcttt

SEQ ID NO: 652116 - DNA, 22 bp, Artificial Sequence
  chemically synthesized
agcctagaataaaagtgctttc

SEQ ID NO: 652117 - DNA, 22 bp, Artificial Sequence
  chemically synthesized
gaataaaagtgctttctccaga

SEQ ID NO: 652118 - DNA, 22 bp, Artificial Sequence
  chemically synthesized
gcaaaagcaaaggagaatcatc

SEQ ID NO: 652119 - DNA, 22 bp, Artificial Sequence
  chemically synthesized
ggcaaaagcaaaggagaatcat

SEQ ID NO: 652120 - DNA, 22 bp, Artificial Sequence
  chemically synthesized
ttggcaaaagcaaaggagaatc

SEQ ID NO: 652121 - DNA, 22 bp, Artificial Sequence
  chemically synthesized
tctccagagatgattctccttt

SEQ ID NO: 652122 - DNA, 22 bp, Artificial Sequence
  chemically synthesized
ctccagagatgattctcctttg

SEQ ID NO: 652123 - DNA, 22 bp, Artificial Sequence
  chemically synthesized
tccagagatgattctcctttgc

SEQ ID NO: 652124 - DNA, 22 bp, Artificial Sequence
  chemically synthesized
gttcttggcaaaagcaaaggag

SEQ ID NO: 652125 - DNA, 22 bp, Artificial Sequence
  chemically synthesized
cagagatgattctcctttgctt

SEQ ID NO: 652126 - DNA, 22 bp, Artificial Sequence
  chemically synthesized
ggttcttggcaaaagcaaagga

SEQ ID NO: 652127 - DNA, 22 bp, Artificial Sequence
  chemically synthesized
ttggttcttggcaaaagcaaag

SEQ ID NO: 652128 - DNA, 22 bp, Artificial Sequence
  chemically synthesized
cttggttcttggcaaaagcaaa

SEQ ID NO: 652129 - DNA, 22 bp, Artificial Sequence
  chemically synthesized
tcctttgcttttgccaagaacc

SEQ ID NO: 652130 - DNA, 22 bp, Artificial Sequence
  chemically synthesized
ctttgcttttgccaagaaccaa

SEQ ID NO: 652131 - DNA, 22 bp, Artificial Sequence
  chemically synthesized
tgcttttgccaagaaccaagaa

SEQ ID NO: 652132 - DNA, 22 bp, Artificial Sequence
  chemically synthesized
gcttttgccaagaaccaagaag

SEQ ID NO: 652133 - DNA, 22 bp, Artificial Sequence
  chemically synthesized
cttttgccaagaaccaagaagc

SEQ ID NO: 652134 - DNA, 22 bp, Artificial Sequence
  chemically synthesized
tggaataagtaatgcttcttgg

SEQ ID NO: 652135 - DNA, 22 bp, Artificial Sequence
  chemically synthesized
ttgccaagaaccaagaagcatt

SEQ ID NO: 652136 - DNA, 22 bp, Artificial Sequence
  chemically synthesized
tgccaagaaccaagaagcatta

SEQ ID NO: 652137 - DNA, 22 bp, Artificial Sequence
  chemically synthesized
gccaagaaccaagaagcattac

SEQ ID NO: 652138 - DNA, 22 bp, Artificial Sequence
  chemically synthesized
gctgtggaataagtaatgcttc

SEQ ID NO: 652139 - DNA, 22 bp, Artificial Sequence
  chemically synthesized
ccaagaaccaagaagcattact

SEQ ID NO: 652140 - DNA, 22 bp, Artificial Sequence
  chemically synthesized
aaattggctgtggaataagtaa

SEQ ID NO: 652141 - DNA, 22 bp, Artificial Sequence
  chemically synthesized
aactgaaattggctgtggaata

SEQ ID NO: 652142 - DNA, 22 bp, Artificial Sequence
  chemically synthesized
cttattccacagccaatttcag

SEQ ID NO: 652143 - DNA, 22 bp, Artificial Sequence
  chemically synthesized
attccacagccaatttcagttg

SEQ ID NO: 652144 - DNA, 22 bp, Artificial Sequence
  chemically synthesized
ttccacagccaatttcagttga

SEQ ID NO: 652145 - DNA, 22 bp, Artificial Sequence
  chemically synthesized
ccatgtcatatattcaactgaa

SEQ ID NO: 652146 - DNA, 22 bp, Artificial Sequence
  chemically synthesized
cacagccaatttcagttgaata

SEQ ID NO: 652147 - DNA, 22 bp, Artificial Sequence
  chemically synthesized
agtattcccatgtcatatattc

SEQ ID NO: 652148 - DNA, 22 bp, Artificial Sequence
  chemically synthesized
cagttgaatatatgacatggga

SEQ ID NO: 652149 - DNA, 22 bp, Artificial Sequence
  chemically synthesized
agttgaatatatgacatgggaa

SEQ ID NO: 652150 - DNA, 22 bp, Artificial Sequence
  chemically synthesized
tgtgatactaagtattcccatg

SEQ ID NO: 652151 - DNA, 22 bp, Artificial Sequence
  chemically synthesized
gtgtgatactaagtattcccat

SEQ ID NO: 652152 - DNA, 22 bp, Artificial Sequence
  chemically synthesized
aatatatgacatgggaatactt

SEQ ID NO: 652153 - DNA, 22 bp, Artificial Sequence
  chemically synthesized
aaatacccatgacttgtgtgat

SEQ ID NO: 652154 - DNA, 22 bp, Artificial Sequence
  chemically synthesized
cagctcaaatacccatgacttg

SEQ ID NO: 652155 - DNA, 22 bp, Artificial Sequence
  chemically synthesized
gcagctcaaatacccatgactt

SEQ ID NO: 652156 - DNA, 22 bp, Artificial Sequence
  chemically synthesized
tgcagctcaaatacccatgact

SEQ ID NO: 652157 - DNA, 22 bp, Artificial Sequence
  chemically synthesized
agtatcacacaagtcatgggta

SEQ ID NO: 652158 - DNA, 22 bp, Artificial Sequence
  chemically synthesized
gtatcacacaagtcatgggtat

SEQ ID NO: 652159 - DNA, 22 bp, Artificial Sequence
  chemically synthesized
gctttgcagctcaaatacccat

SEQ ID NO: 652160 - DNA, 22 bp, Artificial Sequence
  chemically synthesized
ggctttgcagctcaaataccca

SEQ ID NO: 652161 - DNA, 22 bp, Artificial Sequence
  chemically synthesized
caagagaagcaacttggctttg

SEQ ID NO: 652162 - DNA, 22 bp, Artificial Sequence
  chemically synthesized
gagctgcaaagccaagttgctt

SEQ ID NO: 652163 - DNA, 22 bp, Artificial Sequence
  chemically synthesized
agctgcaaagccaagttgcttc

SEQ ID NO: 652164 - DNA, 22 bp, Artificial Sequence
  chemically synthesized
caaagccaagttgcttctcttg

SEQ ID NO: 652165 - DNA, 22 bp, Artificial Sequence
  chemically synthesized
ggaaaccacattacaagagaag

SEQ ID NO: 652166 - DNA, 22 bp, Artificial Sequence
  chemically synthesized
ttaggaaaccacattacaagag

SEQ ID NO: 652167 - DNA, 22 bp, Artificial Sequence
  chemically synthesized
attaggaaaccacattacaaga

SEQ ID NO: 652168 - DNA, 22 bp, Artificial Sequence
  chemically synthesized
tattaggaaaccacattacaag

SEQ ID NO: 652169 - DNA, 22 bp, Artificial Sequence
  chemically synthesized
cttctcttgtaatgtggtttcc

SEQ ID NO: 652170 - DNA, 22 bp, Artificial Sequence
  chemically synthesized
ctcttgtaatgtggtttcctaa

SEQ ID NO: 652171 - DNA, 22 bp, Artificial Sequence
  chemically synthesized
tcttgtaatgtggtttcctaat

SEQ ID NO: 652172 - DNA, 22 bp, Artificial Sequence
  chemically synthesized
ttgtaatgtggtttcctaataa

SEQ ID NO: 652173 - DNA, 22 bp, Artificial Sequence
  chemically synthesized
gtaatgtggtttcctaataaag

SEQ ID NO: 652174 - DNA, 22 bp, Artificial Sequence
  chemically synthesized
taatgtggtttcctaataaagg

SEQ ID NO: 652175 - DNA, 22 bp, Artificial Sequence
  chemically synthesized
aaatgtggatatgtcctttatt

SEQ ID NO: 652176 - DNA, 22 bp, Artificial Sequence
  chemically synthesized
tctgaaatgtggatatgtcctt

SEQ ID NO: 652177 - DNA, 22 bp, Artificial Sequence
  chemically synthesized
tatctgaaatgtggatatgtcc

SEQ ID NO: 652178 - DNA, 22 bp, Artificial Sequence
  chemically synthesized
ctatctgaaatgtggatatgtc

SEQ ID NO: 652179 - DNA, 22 bp, Artificial Sequence
  chemically synthesized
tctatctgaaatgtggatatgt

SEQ ID NO: 652180 - DNA, 22 bp, Artificial Sequence
  chemically synthesized
cctaataaaggacatatccaca

SEQ ID NO: 652181 - DNA, 22 bp, Artificial Sequence
  chemically synthesized
ctaataaaggacatatccacat

SEQ ID NO: 652182 - DNA, 22 bp, Artificial Sequence
  chemically synthesized
cctttctatctgaaatgtggat

SEQ ID NO: 652183 - DNA, 22 bp, Artificial Sequence
  chemically synthesized
ataaaggacatatccacatttc

SEQ ID NO: 652184 - DNA, 22 bp, Artificial Sequence
  chemically synthesized
ctgcctttctatctgaaatgtg

SEQ ID NO: 652185 - DNA, 22 bp, Artificial Sequence
  chemically synthesized
aaccctcctgcctttctatctg

SEQ ID NO: 652186 - DNA, 22 bp, Artificial Sequence
  chemically synthesized
tcagtctaaaccctcctgcctt

SEQ ID NO: 652187 - DNA, 22 bp, Artificial Sequence
  chemically synthesized
cagatagaaaggcaggagggtt

SEQ ID NO: 652188 - DNA, 22 bp, Artificial Sequence
  chemically synthesized
agatagaaaggcaggagggttt

SEQ ID NO: 652189 - DNA, 22 bp, Artificial Sequence
  chemically synthesized
taagccaaatgacctgtcagtc

SEQ ID NO: 652190 - DNA, 22 bp, Artificial Sequence
  chemically synthesized
agactgacaggtcatttggctt

SEQ ID NO: 652191 - DNA, 22 bp, Artificial Sequence
  chemically synthesized
gactgacaggtcatttggctta

SEQ ID NO: 652192 - DNA, 22 bp, Artificial Sequence
  chemically synthesized
aggtgatcagtgttataagcca

SEQ ID NO: 652193 - DNA, 22 bp, Artificial Sequence
  chemically synthesized
acaggtcatttggcttataaca

SEQ ID NO: 652194 - DNA, 22 bp, Artificial Sequence
  chemically synthesized
ttgaggtgatcagtgttataag

SEQ ID NO: 652195 - DNA, 22 bp, Artificial Sequence
  chemically synthesized
gagtgctgttgaggtgatcagt

SEQ ID NO: 652196 - DNA, 22 bp, Artificial Sequence
  chemically synthesized
ggcttataacactgatcacctc

SEQ ID NO: 652197 - DNA, 22 bp, Artificial Sequence
  chemically synthesized
gcttataacactgatcacctca

SEQ ID NO: 652198 - DNA, 22 bp, Artificial Sequence
  chemically synthesized
ataacactgatcacctcaacag

SEQ ID NO: 652199 - DNA, 22 bp, Artificial Sequence
  chemically synthesized
taacactgatcacctcaacagc

SEQ ID NO: 652200 - DNA, 22 bp, Artificial Sequence
  chemically synthesized
ggggtaatgactggagtgctgt

SEQ ID NO: 652201 - DNA, 22 bp, Artificial Sequence
  chemically synthesized
atcacctcaacagcactccagt

SEQ ID NO: 652202 - DNA, 22 bp, Artificial Sequence
  chemically synthesized
gaattaggggtaatgactggag

SEQ ID NO: 652203 - DNA, 22 bp, Artificial Sequence
  chemically synthesized
agaattaggggtaatgactgga

SEQ ID NO: 652204 - DNA, 22 bp, Artificial Sequence
  chemically synthesized
aacagcactccagtcattaccc

SEQ ID NO: 652205 - DNA, 22 bp, Artificial Sequence
  chemically synthesized
aatttagaattaggggtaatga

SEQ ID NO: 652206 - DNA, 22 bp, Artificial Sequence
  chemically synthesized
ctaaatttagaattaggggtaa

SEQ ID NO: 652207 - DNA, 22 bp, Artificial Sequence
  chemically synthesized
cagtcattacccctaattctaa

SEQ ID NO: 652208 - DNA, 22 bp, Artificial Sequence
  chemically synthesized
tagtgttgctaaatttagaatt

SEQ ID NO: 652209 - DNA, 22 bp, Artificial Sequence
  chemically synthesized
ttatagtgttgctaaatttaga

SEQ ID NO: 652210 - DNA, 22 bp, Artificial Sequence
  chemically synthesized
attatagtgttgctaaatttag

SEQ ID NO: 652211 - DNA, 22 bp, Artificial Sequence
  chemically synthesized
cccctaattctaaatttagcaa

SEQ ID NO: 652212 - DNA, 22 bp, Artificial Sequence
  chemically synthesized
aacagtttattatagtgttgct

SEQ ID NO: 652213 - DNA, 22 bp, Artificial Sequence
  chemically synthesized
attctaaatttagcaacactat

SEQ ID NO: 652214 - DNA, 22 bp, Artificial Sequence
  chemically synthesized
taaatttagcaacactataata

SEQ ID NO: 652215 - DNA, 22 bp, Artificial Sequence
  chemically synthesized
aatttagcaacactataataaa

SEQ ID NO: 652216 - DNA, 22 bp, Artificial Sequence
  chemically synthesized
agcaacactataataaactgtt

SEQ ID NO: 652217 - DNA, 22 bp, Artificial Sequence
  chemically synthesized
gcaacactataataaactgttt

SEQ ID NO: 652218 - DNA, 22 bp, Artificial Sequence
  chemically synthesized
ggaaatccaaagttaaacagtt

SEQ ID NO: 652219 - DNA, 22 bp, Artificial Sequence
  chemically synthesized
cagctaggaaatccaaagttaa

SEQ ID NO: 652220 - DNA, 22 bp, Artificial Sequence
  chemically synthesized
taataaactgtttaactttgga

SEQ ID NO: 652221 - DNA, 22 bp, Artificial Sequence
  chemically synthesized
gcagctaggaaatccaaagtta

SEQ ID NO: 652222 - DNA, 22 bp, Artificial Sequence
  chemically synthesized
tgcagctaggaaatccaaagtt

SEQ ID NO: 652223 - DNA, 22 bp, Artificial Sequence
  chemically synthesized
tttaactttggatttcctagct

SEQ ID NO: 652224 - DNA, 22 bp, Artificial Sequence
  chemically synthesized
ataccattttgcagctaggaaa

SEQ ID NO: 652225 - DNA, 22 bp, Artificial Sequence
  chemically synthesized
aactttggatttcctagctgca

SEQ ID NO: 652226 - DNA, 22 bp, Artificial Sequence
  chemically synthesized
actttggatttcctagctgcaa

SEQ ID NO: 652227 - DNA, 22 bp, Artificial Sequence
  chemically synthesized
aactgataccattttgcagcta

SEQ ID NO: 652228 - DNA, 22 bp, Artificial Sequence
  chemically synthesized
gaactgataccattttgcagct

SEQ ID NO: 652229 - DNA, 22 bp, Artificial Sequence
  chemically synthesized
tggatttcctagctgcaaaatg

SEQ ID NO: 652230 - DNA, 22 bp, Artificial Sequence
  chemically synthesized
ggatttcctagctgcaaaatgg

SEQ ID NO: 652231 - DNA, 22 bp, Artificial Sequence
  chemically synthesized
gatttcctagctgcaaaatggt

SEQ ID NO: 652232 - DNA, 22 bp, Artificial Sequence
  chemically synthesized
cctagctgcaaaatggtatcag

SEQ ID NO: 652233 - DNA, 22 bp, Artificial Sequence
  chemically synthesized
ctagctgcaaaatggtatcagt

SEQ ID NO: 652234 - DNA, 22 bp, Artificial Sequence
  chemically synthesized
atcggaagtttgaactgatacc

SEQ ID NO: 652235 - DNA, 22 bp, Artificial Sequence
  chemically synthesized
gatcggaagtttgaactgatac

SEQ ID NO: 652236 - DNA, 22 bp, Artificial Sequence
  chemically synthesized
gctgcaaaatggtatcagttca

SEQ ID NO: 652237 - DNA, 22 bp, Artificial Sequence
  chemically synthesized
caaaatggtatcagttcaaact

SEQ ID NO: 652238 - DNA, 22 bp, Artificial Sequence
  chemically synthesized
gtaaacagtagcatttgatcgg

SEQ ID NO: 652239 - DNA, 22 bp, Artificial Sequence
  chemically synthesized
ggtaaacagtagcatttgatcg

SEQ ID NO: 652240 - DNA, 22 bp, Artificial Sequence
  chemically synthesized
tggtaaacagtagcatttgatc

SEQ ID NO: 652241 - DNA, 22 bp, Artificial Sequence
  chemically synthesized
aaacttccgatcaaatgctact

SEQ ID NO: 652242 - DNA, 22 bp, Artificial Sequence
  chemically synthesized
ggtctttggtaaacagtagcat

SEQ ID NO: 652243 - DNA, 22 bp, Artificial Sequence
  chemically synthesized
taggtctttggtaaacagtagc

SEQ ID NO: 652244 - DNA, 22 bp, Artificial Sequence
  chemically synthesized
ccgatcaaatgctactgtttac

SEQ ID NO: 652245 - DNA, 22 bp, Artificial Sequence
  chemically synthesized
cgatcaaatgctactgtttacc

SEQ ID NO: 652246 - DNA, 22 bp, Artificial Sequence
  chemically synthesized
attctaggtctttggtaaacag

SEQ ID NO: 652247 - DNA, 22 bp, Artificial Sequence
  chemically synthesized
gattgattctaggtctttggta

SEQ ID NO: 652248 - DNA, 22 bp, Artificial Sequence
  chemically synthesized
agattgattctaggtctttggt

SEQ ID NO: 652249 - DNA, 22 bp, Artificial Sequence
  chemically synthesized
ctgtttaccaaagacctagaat

SEQ ID NO: 652250 - DNA, 22 bp, Artificial Sequence
  chemically synthesized
tttaccaaagacctagaatcaa

SEQ ID NO: 652251 - DNA, 22 bp, Artificial Sequence
  chemically synthesized
gtgggcatttagattgattcta

SEQ ID NO: 652252 - DNA, 22 bp, Artificial Sequence
  chemically synthesized
accaaagacctagaatcaatct

SEQ ID NO: 652253 - DNA, 22 bp, Artificial Sequence
  chemically synthesized
ccaaagacctagaatcaatcta

SEQ ID NO: 652254 - DNA, 22 bp, Artificial Sequence
  chemically synthesized
cattggtgggcatttagattga

SEQ ID NO: 652255 - DNA, 22 bp, Artificial Sequence
  chemically synthesized
ccattggtgggcatttagattg

SEQ ID NO: 652256 - DNA, 22 bp, Artificial Sequence
  chemically synthesized
agtcttccattggtgggcattt

SEQ ID NO: 652257 - DNA, 22 bp, Artificial Sequence
  chemically synthesized
gaatcaatctaaatgcccacca

SEQ ID NO: 652258 - DNA, 22 bp, Artificial Sequence
  chemically synthesized
ttcagtcttccattggtgggca

SEQ ID NO: 652259 - DNA, 22 bp, Artificial Sequence
  chemically synthesized
attcagtcttccattggtgggc

SEQ ID NO: 652260 - DNA, 22 bp, Artificial Sequence
  chemically synthesized
tattcagtcttccattggtggg

SEQ ID NO: 652261 - DNA, 22 bp, Artificial Sequence
  chemically synthesized
tttattcagtcttccattggtg

SEQ ID NO: 652262 - DNA, 22 bp, Artificial Sequence
  chemically synthesized
ctttattcagtcttccattggt

SEQ ID NO: 652263 - DNA, 22 bp, Artificial Sequence
  chemically synthesized
tctttattcagtcttccattgg

SEQ ID NO: 652264 - DNA, 22 bp, Artificial Sequence
  chemically synthesized
aatgcccaccaatggaagactg

SEQ ID NO: 652265 - DNA, 22 bp, Artificial Sequence
  chemically synthesized
cagggtgtatatgtaccacgtt

SEQ ID NO: 652266 - DNA, 22 bp, Artificial Sequence
  chemically synthesized
aataaagaaaacgtggtacata

SEQ ID NO: 652267 - DNA, 22 bp, Artificial Sequence
  chemically synthesized
cggagtattccagggtgtatat

SEQ ID NO: 652268 - DNA, 22 bp, Artificial Sequence
  chemically synthesized
gctccggagtattccagggtgt

SEQ ID NO: 652269 - DNA, 22 bp, Artificial Sequence
  chemically synthesized
tggctccggagtattccagggt

SEQ ID NO: 652270 - DNA, 22 bp, Artificial Sequence
  chemically synthesized
ctggctccggagtattccaggg

SEQ ID NO: 652271 - DNA, 22 bp, Artificial Sequence
  chemically synthesized
tctggctccggagtattccagg

SEQ ID NO: 652272 - DNA, 22 bp, Artificial Sequence
  chemically synthesized
ttctggctccggagtattccag

SEQ ID NO: 652273 - DNA, 22 bp, Artificial Sequence
  chemically synthesized
tttctggctccggagtattcca

SEQ ID NO: 652274 - DNA, 22 bp, Artificial Sequence
  chemically synthesized
ttttctggctccggagtattcc

SEQ ID NO: 652275 - DNA, 22 bp, Artificial Sequence
  chemically synthesized
ttttttctggctccggagtatt

SEQ ID NO: 652276 - DNA, 22 bp, Artificial Sequence
  chemically synthesized
attcttttttctggctccggag

SEQ ID NO: 652277 - DNA, 22 bp, Artificial Sequence
  chemically synthesized
gaatactccggagccagaaaaa

SEQ ID NO: 652278 - DNA, 22 bp, Artificial Sequence
  chemically synthesized
cggagccagaaaaaagaatgag

SEQ ID NO: 652279 - DNA, 22 bp, Artificial Sequence
  chemically synthesized
caaagaacatgatctcattctt

SEQ ID NO: 652280 - DNA, 22 bp, Artificial Sequence
  chemically synthesized
ctgcaaagaacatgatctcatt

SEQ ID NO: 652281 - DNA, 22 bp, Artificial Sequence
  chemically synthesized
catccatgttcctgcaaagaac

SEQ ID NO: 652282 - DNA, 22 bp, Artificial Sequence
  chemically synthesized
cagctccatccatgttcctgca

SEQ ID NO: 652283 - DNA, 22 bp, Artificial Sequence
  chemically synthesized
tttgcaggaacatggatggagc

SEQ ID NO: 652284 - DNA, 22 bp, Artificial Sequence
  chemically synthesized
tgcaggaacatggatggagctg

SEQ ID NO: 652285 - DNA, 22 bp, Artificial Sequence
  chemically synthesized
gcaggaacatggatggagctgg

SEQ ID NO: 652286 - DNA, 22 bp, Artificial Sequence
  chemically synthesized
caggaacatggatggagctgga

SEQ ID NO: 652287 - DNA, 22 bp, Artificial Sequence
  chemically synthesized
aggataatggcctccagctcca

SEQ ID NO: 652288 - DNA, 22 bp, Artificial Sequence
  chemically synthesized
ctaaggataatggcctccagct

SEQ ID NO: 652289 - DNA, 22 bp, Artificial Sequence
  chemically synthesized
gctaaggataatggcctccagc

SEQ ID NO: 652290 - DNA, 22 bp, Artificial Sequence
  chemically synthesized
gtttgctaaggataatggcctc

SEQ ID NO: 652291 - DNA, 22 bp, Artificial Sequence
  chemically synthesized
cattagtttgctaaggataatg

SEQ ID NO: 652292 - DNA, 22 bp, Artificial Sequence
  chemically synthesized
ctgcattagtttgctaaggata

SEQ ID NO: 652293 - DNA, 22 bp, Artificial Sequence
  chemically synthesized
ttcctgcattagtttgctaagg

SEQ ID NO: 652294 - DNA, 22 bp, Artificial Sequence
  chemically synthesized
gaggccattatccttagcaaac

SEQ ID NO: 652295 - DNA, 22 bp, Artificial Sequence
  chemically synthesized
tgttcctgcattagtttgctaa

SEQ ID NO: 652296 - DNA, 22 bp, Artificial Sequence
  chemically synthesized
ctgttcctgcattagtttgcta

SEQ ID NO: 652297 - DNA, 22 bp, Artificial Sequence
  chemically synthesized
tctgttcctgcattagtttgct

SEQ ID NO: 652298 - DNA, 22 bp, Artificial Sequence
  chemically synthesized
gttttctgttcctgcattagtt

SEQ ID NO: 652299 - DNA, 22 bp, Artificial Sequence
  chemically synthesized
ggttttctgttcctgcattagt

SEQ ID NO: 652300 - DNA, 22 bp, Artificial Sequence
  chemically synthesized
tccttagcaaactaatgcagga

SEQ ID NO: 652301 - DNA, 22 bp, Artificial Sequence
  chemically synthesized
agcaaactaatgcaggaacaga

SEQ ID NO: 652302 - DNA, 22 bp, Artificial Sequence
  chemically synthesized
gcaaactaatgcaggaacagaa

SEQ ID NO: 652303 - DNA, 22 bp, Artificial Sequence
  chemically synthesized
atgcaggaacagaaaaccaagt

SEQ ID NO: 652304 - DNA, 22 bp, Artificial Sequence
  chemically synthesized
taagtgaaaacatgcaatactt

SEQ ID NO: 652305 - DNA, 22 bp, Artificial Sequence
  chemically synthesized
ataagtgaaaacatgcaatact

SEQ ID NO: 652306 - DNA, 22 bp, Artificial Sequence
  chemically synthesized
ccacttataagtgaaaacatgc

SEQ ID NO: 652307 - DNA, 22 bp, Artificial Sequence
  chemically synthesized
actcccacttataagtgaaaac

SEQ ID NO: 652308 - DNA, 22 bp, Artificial Sequence
  chemically synthesized
aactcccacttataagtgaaaa

SEQ ID NO: 652309 - DNA, 22 bp, Artificial Sequence
  chemically synthesized
atcatttaactcccacttataa

SEQ ID NO: 652310 - DNA, 22 bp, Artificial Sequence
  chemically synthesized
catgttttcacttataagtggg

SEQ ID NO: 652311 - DNA, 22 bp, Artificial Sequence
  chemically synthesized
tcatcatttaactcccacttat

SEQ ID NO: 652312 - DNA, 22 bp, Artificial Sequence
  chemically synthesized
tcacttataagtgggagttaaa

SEQ ID NO: 652313 - DNA, 22 bp, Artificial Sequence
  chemically synthesized
cacttataagtgggagttaaat

SEQ ID NO: 652314 - DNA, 22 bp, Artificial Sequence
  chemically synthesized
acttataagtgggagttaaatg

SEQ ID NO: 652315 - DNA, 22 bp, Artificial Sequence
  chemically synthesized
cccatgtgttctcatcatttaa

SEQ ID NO: 652316 - DNA, 22 bp, Artificial Sequence
  chemically synthesized
ataagtgggagttaaatgatga

SEQ ID NO: 652317 - DNA, 22 bp, Artificial Sequence
  chemically synthesized
taagtgggagttaaatgatgag

SEQ ID NO: 652318 - DNA, 22 bp, Artificial Sequence
  chemically synthesized
tctgcccatgtgttctcatcat

SEQ ID NO: 652319 - DNA, 22 bp, Artificial Sequence
  chemically synthesized
tatctgcccatgtgttctcatc

SEQ ID NO: 652320 - DNA, 22 bp, Artificial Sequence
  chemically synthesized
ccctctatctgcccatgtgttc

SEQ ID NO: 652321 - DNA, 22 bp, Artificial Sequence
  chemically synthesized
cccctctatctgcccatgtgtt

SEQ ID NO: 652322 - DNA, 22 bp, Artificial Sequence
  chemically synthesized
tcccctctatctgcccatgtgt

SEQ ID NO: 652323 - DNA, 22 bp, Artificial Sequence
  chemically synthesized
ttcccctctatctgcccatgtg

SEQ ID NO: 652324 - DNA, 22 bp, Artificial Sequence
  chemically synthesized
aatgatgagaacacatgggcag

SEQ ID NO: 652325 - DNA, 22 bp, Artificial Sequence
  chemically synthesized
ataagccacagtgtgtgttttt

SEQ ID NO: 652326 - DNA, 22 bp, Artificial Sequence
  chemically synthesized
tgataagccacagtgtgtgttt

SEQ ID NO: 652327 - DNA, 22 bp, Artificial Sequence
  chemically synthesized
catcctctgataagccacagtg

SEQ ID NO: 652328 - DNA, 22 bp, Artificial Sequence
  chemically synthesized
ccaccctccatcctctgataag

SEQ ID NO: 652329 - DNA, 22 bp, Artificial Sequence
  chemically synthesized
ctcccaccctccatcctctgat

SEQ ID NO: 652330 - DNA, 22 bp, Artificial Sequence
  chemically synthesized
cctcctcccaccctccatcctc

SEQ ID NO: 652331 - DNA, 22 bp, Artificial Sequence
  chemically synthesized
tggcttatcagaggatggaggg

SEQ ID NO: 652332 - DNA, 22 bp, Artificial Sequence
  chemically synthesized
tccctcctcccaccctccatcc

SEQ ID NO: 652333 - DNA, 22 bp, Artificial Sequence
  chemically synthesized
ctccctcctcccaccctccatc

SEQ ID NO: 652334 - DNA, 22 bp, Artificial Sequence
  chemically synthesized
atcagaggatggagggtgggag

SEQ ID NO: 652335 - DNA, 22 bp, Artificial Sequence
  chemically synthesized
atcttctccctcctcccaccct

SEQ ID NO: 652336 - DNA, 22 bp, Artificial Sequence
  chemically synthesized
tcagaggatggagggtgggagg

SEQ ID NO: 652337 - DNA, 22 bp, Artificial Sequence
  chemically synthesized
ctgatcttctccctcctcccac

SEQ ID NO: 652338 - DNA, 22 bp, Artificial Sequence
  chemically synthesized
cctgatcttctccctcctccca

SEQ ID NO: 652339 - DNA, 22 bp, Artificial Sequence
  chemically synthesized
tcctgatcttctccctcctccc

SEQ ID NO: 652340 - DNA, 22 bp, Artificial Sequence
  chemically synthesized
ttttcctgatcttctccctcct

SEQ ID NO: 652341 - DNA, 22 bp, Artificial Sequence
  chemically synthesized
gttattttcctgatcttctccc
